United States Patent 7,655,785 (BIOINFORMATICALLY DETECTABLE GROUP OF NOVEL REGULATORY OLIGONUCLEOTIDES AND USES THEREOF) - sequence listing, part 14

SEQ ID NO: 536444 - RNA, 20 nt, Homo sapiens
uauguaauauuuacauaaag

SEQ ID NO: 536445 - RNA, 22 nt, Homo sapiens
uauguaaucucaccucaccugg

SEQ ID NO: 536446 - RNA, 13 nt, Homo sapiens
uauguacuaagca

SEQ ID NO: 536447 - RNA, 12 nt, Homo sapiens
uauguacuucag

SEQ ID NO: 536448 - RNA, 17 nt, Homo sapiens
uauguaugaguaucugu

SEQ ID NO: 536449 - RNA, 18 nt, Homo sapiens
uauguaugggagauggca

SEQ ID NO: 536450 - RNA, 21 nt, Homo sapiens
uaugucaccuggcacauucau

SEQ ID NO: 536451 - RNA, 19 nt, Homo sapiens
uaugucauuuuuaauguau

SEQ ID NO: 536452 - RNA, 21 nt, Homo sapiens
uauguccuaauaauaucccac

SEQ ID NO: 536453 - RNA, 23 nt, Homo sapiens
uaugucgagagcuggccaaagag

SEQ ID NO: 536454 - RNA, 16 nt, Homo sapiens
uaugucgaugcacagu

SEQ ID NO: 536455 - RNA, 15 nt, Homo sapiens
uaugucuucaugcaa

SEQ ID NO: 536456 - RNA, 17 nt, Homo sapiens
uaugucuuuugaugaau

SEQ ID NO: 536457 - RNA, 20 nt, Homo sapiens
uaugugacauuuuacauuaa

SEQ ID NO: 536458 - RNA, 23 nt, Homo sapiens
uaugugagagaaagugugagcaa

SEQ ID NO: 536459 - RNA, 21 nt, Homo sapiens
uaugugagauuuccuuaucac

SEQ ID NO: 536460 - RNA, 21 nt, Homo sapiens
uaugugaucaauuuugacuua

SEQ ID NO: 536461 - RNA, 13 nt, Homo sapiens
uaugugaugccaa

SEQ ID NO: 536462 - RNA, 14 nt, Homo sapiens
uaugugaugccucu

SEQ ID NO: 536463 - RNA, 14 nt, Homo sapiens
uaugugauguggca

SEQ ID NO: 536464 - RNA, 20 nt, Homo sapiens
uaugugcacugucacuuugc

SEQ ID NO: 536465 - RNA, 15 nt, Homo sapiens
uaugugcgugugugc

SEQ ID NO: 536466 - RNA, 22 nt, Homo sapiens
uaugugcuauauaaauauguca

SEQ ID NO: 536467 - RNA, 21 nt, Homo sapiens
uauguguaaggugaaauuuau

SEQ ID NO: 536468 - RNA, 13 nt, Homo sapiens
uauguguaaguau

SEQ ID NO: 536469 - RNA, 22 nt, Homo sapiens
uaugugucccgaauccacaguc

SEQ ID NO: 536470 - RNA, 13 nt, Homo sapiens
uaugugugccuuu

SEQ ID NO: 536471 - RNA, 13 nt, Homo sapiens
uauguguguauau

SEQ ID NO: 536472 - RNA, 22 nt, Homo sapiens
uauguuagagaaugcuugaauu

SEQ ID NO: 536473 - RNA, 17 nt, Homo sapiens
uauguuauacaaggcaa

SEQ ID NO: 536474 - RNA, 17 nt, Homo sapiens
uauguuaugaacaugca

SEQ ID NO: 536475 - RNA, 20 nt, Homo sapiens
uauguucaaugcaaaguaaa

SEQ ID NO: 536476 - RNA, 19 nt, Homo sapiens
uauguucccagcagugggg

SEQ ID NO: 536477 - RNA, 16 nt, Homo sapiens
uauguuccuaagguca

SEQ ID NO: 536478 - RNA, 15 nt, Homo sapiens
uauguugaguguuca

SEQ ID NO: 536479 - RNA, 12 nt, Homo sapiens
uauguugcccaa

SEQ ID NO: 536480 - RNA, 20 nt, Homo sapiens
uauguuuacauaucaccuca

SEQ ID NO: 536481 - RNA, 17 nt, Homo sapiens
uauguuuacuucucacc

SEQ ID NO: 536482 - RNA, 17 nt, Homo sapiens
uauguuuggcugcuaga

SEQ ID NO: 536483 - RNA, 20 nt, Homo sapiens
uauuaaaaauaggugugauu

SEQ ID NO: 536484 - RNA, 21 nt, Homo sapiens
uauuaaaaucacugucaauau

SEQ ID NO: 536485 - RNA, 19 nt, Homo sapiens
uauuaaauauauacugacu

SEQ ID NO: 536486 - RNA, 14 nt, Homo sapiens
uauuaaauguugcu

SEQ ID NO: 536487 - RNA, 13 nt, Homo sapiens
uauuaacaucauc

SEQ ID NO: 536488 - RNA, 17 nt, Homo sapiens
uauuaacgggcauguau

SEQ ID NO: 536489 - RNA, 17 nt, Homo sapiens
uauuaacuaugaucauc

SEQ ID NO: 536490 - RNA, 23 nt, Homo sapiens
uauuaagugacugaccaugcacu

SEQ ID NO: 536491 - RNA, 16 nt, Homo sapiens
uauuaauaaagcauuc

SEQ ID NO: 536492 - RNA, 17 nt, Homo sapiens
uauuaauaaagcauucu

SEQ ID NO: 536493 - RNA, 22 nt, Homo sapiens
uauuaauacugccggucaccca

SEQ ID NO: 536494 - RNA, 23 nt, Homo sapiens
uauuaaucaagagaaacuucaaa

SEQ ID NO: 536495 - RNA, 14 nt, Homo sapiens
uauuaaucucugug

SEQ ID NO: 536496 - RNA, 19 nt, Homo sapiens
uauuaaucuggacauucga

SEQ ID NO: 536497 - RNA, 13 nt, Homo sapiens
uauuacaaacaag

SEQ ID NO: 536498 - RNA, 19 nt, Homo sapiens
uauuacaagaucuuuccaa

SEQ ID NO: 536499 - RNA, 18 nt, Homo sapiens
uauuacaagccuacauga

SEQ ID NO: 536500 - RNA, 21 nt, Homo sapiens
uauuacaauuuuugaacaacu

SEQ ID NO: 536501 - RNA, 16 nt, Homo sapiens
uauuaccauuacuugu

SEQ ID NO: 536502 - RNA, 21 nt, Homo sapiens
uauuaccuuuaaauauuucac

SEQ ID NO: 536503 - RNA, 15 nt, Homo sapiens
uucuucuguccugag

SEQ ID NO: 536504 - RNA, 20 nt, Homo sapiens
uucuucuuuuguguccugcu

SEQ ID NO: 536505 - RNA, 13 nt, Homo sapiens
uucuugaaccaau

SEQ ID NO: 536506 - RNA, 19 nt, Homo sapiens
uucuugaagcaguagccua

SEQ ID NO: 536507 - RNA, 18 nt, Homo sapiens
uucuugccuuguaccuca

SEQ ID NO: 536508 - RNA, 14 nt, Homo sapiens
uucuuggagauuua

SEQ ID NO: 536509 - RNA, 23 nt, Homo sapiens
uucuuggcagcuuaacauugacu

SEQ ID NO: 536510 - RNA, 18 nt, Homo sapiens
uucuugggaguauguugu

SEQ ID NO: 536511 - RNA, 13 nt, Homo sapiens
uucuugguauuau

SEQ ID NO: 536512 - RNA, 16 nt, Homo sapiens
uucuugguuccuggga

SEQ ID NO: 536513 - RNA, 17 nt, Homo sapiens
uucuuguaccacuucau

SEQ ID NO: 536514 - RNA, 17 nt, Homo sapiens
uucuuguagaugcauua

SEQ ID NO: 536515 - RNA, 14 nt, Homo sapiens
uucuuguugcugca

SEQ ID NO: 536516 - RNA, 19 nt, Homo sapiens
uucuuguugcugcaucucc

SEQ ID NO: 536517 - RNA, 15 nt, Homo sapiens
uucuuuaaaggcauc

SEQ ID NO: 536518 - RNA, 14 nt, Homo sapiens
uucuuuaaggcaua

SEQ ID NO: 536519 - RNA, 14 nt, Homo sapiens
uucuuuaccugaga

SEQ ID NO: 536520 - RNA, 23 nt, Homo sapiens
uucuuuacuaaagauaucagagc

SEQ ID NO: 536521 - RNA, 21 nt, Homo sapiens
uucuuuagaauuuuuacccaa

SEQ ID NO: 536522 - RNA, 22 nt, Homo sapiens
uucuuuagaauuuuuacccaau

SEQ ID NO: 536523 - RNA, 20 nt, Homo sapiens
uucuuuagagggaaggaaua

SEQ ID NO: 536524 - RNA, 23 nt, Homo sapiens
uucuuuagaugccaaaccacaag

SEQ ID NO: 536525 - RNA, 20 nt, Homo sapiens
uucuuuauaauccucuguaa

SEQ ID NO: 536526 - RNA, 14 nt, Homo sapiens
uauuauuccucaaa

SEQ ID NO: 536527 - RNA, 15 nt, Homo sapiens
uauuauugagcucua

SEQ ID NO: 536528 - RNA, 13 nt, Homo sapiens
uauuauuguggaa

SEQ ID NO: 536529 - RNA, 15 nt, Homo sapiens
uauuauuuacaucac

SEQ ID NO: 536530 - RNA, 19 nt, Homo sapiens
uauuauuuacaucacuuug

SEQ ID NO: 536531 - RNA, 15 nt, Homo sapiens
uauuauuucaaugug

SEQ ID NO: 536532 - RNA, 20 nt, Homo sapiens
uauucaaaaacauaacugag

SEQ ID NO: 536533 - RNA, 15 nt, Homo sapiens
uauucaaaauuuugu

SEQ ID NO: 536534 - RNA, 17 nt, Homo sapiens
uauucaagugauaggau

SEQ ID NO: 536535 - RNA, 13 nt, Homo sapiens
uauucaauggaaa

SEQ ID NO: 536536 - RNA, 20 nt, Homo sapiens
uauucaauggaaagcugcuu

SEQ ID NO: 536537 - RNA, 23 nt, Homo sapiens
uauucacauauaucaaagugaga

SEQ ID NO: 536538 - RNA, 16 nt, Homo sapiens
uauucacuaaggacuu

SEQ ID NO: 536539 - RNA, 13 nt, Homo sapiens
uauucacugaugc

SEQ ID NO: 536540 - RNA, 18 nt, Homo sapiens
uauucacugguuuuacac

SEQ ID NO: 536541 - RNA, 14 nt, Homo sapiens
uauucagacaagca

SEQ ID NO: 536542 - RNA, 14 nt, Homo sapiens
uauucauccuaaaa

SEQ ID NO: 536543 - RNA, 22 nt, Homo sapiens
uauucaugcugaggugauucag

SEQ ID NO: 536544 - RNA, 16 nt, Homo sapiens
uauucauuauuuguca

SEQ ID NO: 536545 - RNA, 14 nt, Homo sapiens
uauucauuggucua

SEQ ID NO: 536546 - RNA, 21 nt, Homo sapiens
uauucccaaaaauuacuuugg

SEQ ID NO: 536547 - RNA, 21 nt, Homo sapiens
uauucccugucacuacacacu

SEQ ID NO: 536548 - RNA, 20 nt, Homo sapiens
uauuccgauacaaaguguug

SEQ ID NO: 536549 - RNA, 13 nt, Homo sapiens
uauuccucaaaaa

SEQ ID NO: 536550 - RNA, 14 nt, Homo sapiens
uauuccuuuuccca

SEQ ID NO: 536551 - RNA, 17 nt, Homo sapiens
uauucgauguacuuuaa

SEQ ID NO: 536552 - RNA, 13 nt, Homo sapiens
uauucgugaauag

SEQ ID NO: 536553 - RNA, 18 nt, Homo sapiens
uauucuaagccaguuuuc

SEQ ID NO: 536554 - RNA, 17 nt, Homo sapiens
uauucuccauccuccca

SEQ ID NO: 536555 - RNA, 21 nt, Homo sapiens
uauucucucuaugcaaaaugu

SEQ ID NO: 536556 - RNA, 21 nt, Homo sapiens
uauucucuuugugaggacaaa

SEQ ID NO: 536557 - RNA, 14 nt, Homo sapiens
uauucugacaugua

SEQ ID NO: 536558 - RNA, 21 nt, Homo sapiens
uauucugccaaaccuguguag

SEQ ID NO: 536559 - RNA, 16 nt, Homo sapiens
uauucuguuuugcaca

SEQ ID NO: 536560 - RNA, 23 nt, Homo sapiens
uauucuguuuuguuaauauaccc

SEQ ID NO: 536561 - RNA, 21 nt, Homo sapiens
uauucuugagggacaaugcca

SEQ ID NO: 536562 - RNA, 11 nt, Homo sapiens
uauucuugagu

SEQ ID NO: 536563 - RNA, 13 nt, Homo sapiens
uauucuugguucu

SEQ ID NO: 536564 - RNA, 13 nt, Homo sapiens
uauucuuuacuau

SEQ ID NO: 536565 - RNA, 20 nt, Homo sapiens
uauucuuucuaaacuacaac

SEQ ID NO: 536566 - RNA, 20 nt, Homo sapiens
uauucuuugaaaacagauga

SEQ ID NO: 536567 - RNA, 21 nt, Homo sapiens
uauugaacuuuuguacugaau

SEQ ID NO: 536568 - RNA, 23 nt, Homo sapiens
uauugaagguuuuagacccauag

SEQ ID NO: 536569 - RNA, 14 nt, Homo sapiens
uauugaaucuuaau

SEQ ID NO: 536570 - RNA, 20 nt, Homo sapiens
uauugaaugaugugauacaa

SEQ ID NO: 536571 - RNA, 14 nt, Homo sapiens
uauugacaucucuu

SEQ ID NO: 536572 - RNA, 21 nt, Homo sapiens
uauugagauaauuuauuuaau

SEQ ID NO: 536573 - RNA, 17 nt, Homo sapiens
uauugagcagaauucau

SEQ ID NO: 536574 - RNA, 14 nt, Homo sapiens
uauugagcagagcc

SEQ ID NO: 536575 - RNA, 20 nt, Homo sapiens
uauugaggcugcagcaggug

SEQ ID NO: 536576 - RNA, 14 nt, Homo sapiens
uauugagugugauu

SEQ ID NO: 536577 - RNA, 20 nt, Homo sapiens
uauugaucccacauuuccau

SEQ ID NO: 536578 - RNA, 19 nt, Homo sapiens
uauugaugauaacacuuaa

SEQ ID NO: 536579 - RNA, 12 nt, Homo sapiens
uauugcaagaca

SEQ ID NO: 536580 - RNA, 23 nt, Homo sapiens
uauugcacuaggaauucuuugca

SEQ ID NO: 536581 - RNA, 16 nt, Homo sapiens
uauugcauaauuuaua

SEQ ID NO: 536582 - RNA, 18 nt, Homo sapiens
uauugccuggagugugaa

SEQ ID NO: 536583 - RNA, 15 nt, Homo sapiens
uauugcgaaugugca

SEQ ID NO: 536584 - RNA, 18 nt, Homo sapiens
uauugcuagccaucuuga

SEQ ID NO: 536585 - RNA, 17 nt, Homo sapiens
uauugcugaaugacuac

SEQ ID NO: 536586 - RNA, 18 nt, Homo sapiens
uauugcuggcaucugugc

SEQ ID NO: 536587 - RNA, 21 nt, Homo sapiens
uauuggagccccaggggacaa

SEQ ID NO: 536588 - RNA, 20 nt, Homo sapiens
uauuggaugacuaacuauca

SEQ ID NO: 536589 - RNA, 14 nt, Homo sapiens
uauuggucacguca

SEQ ID NO: 536590 - RNA, 22 nt, Homo sapiens
uauugguccagcuugcucuuca

SEQ ID NO: 536591 - RNA, 23 nt, Homo sapiens
uauuguaaguggaaaaugcaaug

SEQ ID NO: 536592 - RNA, 23 nt, Homo sapiens
uauugucauaggauuaagcaguu

SEQ ID NO: 536593 - RNA, 17 nt, Homo sapiens
uauugugaaguacauau

SEQ ID NO: 536594 - RNA, 16 nt, Homo sapiens
uauuguggucauuucc

SEQ ID NO: 536595 - RNA, 23 nt, Homo sapiens
uauuguuccaagacauugucaau

SEQ ID NO: 536596 - RNA, 15 nt, Homo sapiens
uauuguucucacuua

SEQ ID NO: 536597 - RNA, 16 nt, Homo sapiens
uauuguuguugccaaa

SEQ ID NO: 536598 - RNA, 16 nt, Homo sapiens
uauuguuucaauugca

SEQ ID NO: 536599 - RNA, 19 nt, Homo sapiens
uauuuaaaaaaaaagucag

SEQ ID NO: 536600 - RNA, 23 nt, Homo sapiens
uauuuaaaaauuguuucuugaca

SEQ ID NO: 536601 - RNA, 17 nt, Homo sapiens
uauuuaaauaaaaucac

SEQ ID NO: 536602 - RNA, 21 nt, Homo sapiens
uauuuaaauaaaaucauauug

SEQ ID NO: 536603 - RNA, 13 nt, Homo sapiens
uauuuaacaugua

SEQ ID NO: 536604 - RNA, 15 nt, Homo sapiens
uauuuaacuggugca

SEQ ID NO: 536605 - RNA, 14 nt, Homo sapiens
uauuuaagccuuuu

SEQ ID NO: 536606 - RNA, 16 nt, Homo sapiens
uauuuaaguugugauu

SEQ ID NO: 536607 - RNA, 14 nt, Homo sapiens
uauuuaauauguca

SEQ ID NO: 536608 - RNA, 13 nt, Homo sapiens
uauuuaauuccau

SEQ ID NO: 536609 - RNA, 20 nt, Homo sapiens
uauuuaauuuuaacugccaa

SEQ ID NO: 536610 - RNA, 13 nt, Homo sapiens
uauuuaccagacc

SEQ ID NO: 536611 - RNA, 22 nt, Homo sapiens
uauuuagaucuagaaacagauc

SEQ ID NO: 536612 - RNA, 16 nt, Homo sapiens
uauuuagcugccaaau

SEQ ID NO: 536613 - RNA, 20 nt, Homo sapiens
uauuuaggagugugugacau

SEQ ID NO: 536614 - RNA, 18 nt, Homo sapiens
uauuuauaagagugccgu

SEQ ID NO: 536615 - RNA, 21 nt, Homo sapiens
uauuuauagucgaacaauuca

SEQ ID NO: 536616 - RNA, 21 nt, Homo sapiens
uauuuauauauuuauaacuca

SEQ ID NO: 536617 - RNA, 21 nt, Homo sapiens
uauuuaugcaacucaucuuca

SEQ ID NO: 536618 - RNA, 14 nt, Homo sapiens
uauuuaugccucug

SEQ ID NO: 536619 - RNA, 17 nt, Homo sapiens
uauuuaugccucuguau

SEQ ID NO: 536620 - RNA, 18 nt, Homo sapiens
uauuuauuacuugugcac

SEQ ID NO: 536621 - RNA, 17 nt, Homo sapiens
uauuuauucuuuaacug

SEQ ID NO: 536622 - RNA, 16 nt, Homo sapiens
uauuucaaaacacauc

SEQ ID NO: 536623 - RNA, 19 nt, Homo sapiens
uauuucaauucuaaaauac

SEQ ID NO: 536624 - RNA, 13 nt, Homo sapiens
uauuucacaagaa

SEQ ID NO: 536625 - RNA, 17 nt, Homo sapiens
uauuucaggaaggucuu

SEQ ID NO: 536626 - RNA, 14 nt, Homo sapiens
uauuucauaaacaa

SEQ ID NO: 536627 - RNA, 15 nt, Homo sapiens
uugaccaaauaaagu

SEQ ID NO: 536628 - RNA, 22 nt, Homo sapiens
uugaccaaauaaaguaccauua

SEQ ID NO: 536629 - RNA, 16 nt, Homo sapiens
uugacccuagccagag

SEQ ID NO: 536630 - RNA, 18 nt, Homo sapiens
uugaccggcagaauguuc

SEQ ID NO: 536631 - RNA, 15 nt, Homo sapiens
uugaccuccuugacu

SEQ ID NO: 536632 - RNA, 14 nt, Homo sapiens
uugacguuugcuca

SEQ ID NO: 536633 - RNA, 21 nt, Homo sapiens
uugacuaaagcuauguuacau

SEQ ID NO: 536634 - RNA, 16 nt, Homo sapiens
uugacuaacaagaaug

SEQ ID NO: 536635 - RNA, 20 nt, Homo sapiens
uugacuaaguuuuuauacca

SEQ ID NO: 536636 - RNA, 22 nt, Homo sapiens
uugacuagaugauggaugccaa

SEQ ID NO: 536637 - RNA, 15 nt, Homo sapiens
uugacuagugcaauu

SEQ ID NO: 536638 - RNA, 23 nt, Homo sapiens
uugacuauguuuggaguuuaauu

SEQ ID NO: 536639 - RNA, 24 nt, Homo sapiens
uugacucauggcagcuguuucuca

SEQ ID NO: 536640 - RNA, 17 nt, Homo sapiens
uugacucuaaaugcagu

SEQ ID NO: 536641 - RNA, 15 nt, Homo sapiens
uugacucuacugauc

SEQ ID NO: 536642 - RNA, 15 nt, Homo sapiens
uugacugacugagca

SEQ ID NO: 536643 - RNA, 11 nt, Homo sapiens
uugacugcugc

SEQ ID NO: 536644 - RNA, 13 nt, Homo sapiens
uugacugcugcuc

SEQ ID NO: 536645 - RNA, 21 nt, Homo sapiens
uugacuggccuccagauucca

SEQ ID NO: 536646 - RNA, 16 nt, Homo sapiens
uugacuuagauauuaa

SEQ ID NO: 536647 - RNA, 19 nt, Homo sapiens
uugacuuccugccauggau

SEQ ID NO: 536648 - RNA, 14 nt, Homo sapiens
uauuugcauaacaa

SEQ ID NO: 536649 - RNA, 19 nt, Homo sapiens
uauuugccuccagugcagu

SEQ ID NO: 536650 - RNA, 17 nt, Homo sapiens
uauuugcuaaaugcugu

SEQ ID NO: 536651 - RNA, 24 nt, Homo sapiens
uauuugcuuuuugcuaacaaugcu

SEQ ID NO: 536652 - RNA, 20 nt, Homo sapiens
uauuuggcuugucacaggaa

SEQ ID NO: 536653 - RNA, 18 nt, Homo sapiens
uauuuguaaaucugccac

SEQ ID NO: 536654 - RNA, 15 nt, Homo sapiens
uauuuguaacauugu

SEQ ID NO: 536655 - RNA, 20 nt, Homo sapiens
uauuuguaauagugacauau

SEQ ID NO: 536656 - RNA, 21 nt, Homo sapiens
uauuuguaauuaaaagcaaau

SEQ ID NO: 536657 - RNA, 15 nt, Homo sapiens
uauuuguacaaaaaa

SEQ ID NO: 536658 - RNA, 16 nt, Homo sapiens
uauuuguauacacaua

SEQ ID NO: 536659 - RNA, 13 nt, Homo sapiens
uauuugucuuuga

SEQ ID NO: 536660 - RNA, 17 nt, Homo sapiens
uauuugugcuauaguau

SEQ ID NO: 536661 - RNA, 14 nt, Homo sapiens
uauuugugggguac

SEQ ID NO: 536662 - RNA, 14 nt, Homo sapiens
uauuuuaacuacuu

SEQ ID NO: 536663 - RNA, 22 nt, Homo sapiens
uauuuuaacuacuuuacuaaau

SEQ ID NO: 536664 - RNA, 22 nt, Homo sapiens
uauuuuaagaauuucacaagcu

SEQ ID NO: 536665 - RNA, 16 nt, Homo sapiens
uauuuuaaguauugca

SEQ ID NO: 536666 - RNA, 17 nt, Homo sapiens
uauuuuaauuacugcua

SEQ ID NO: 536667 - RNA, 22 nt, Homo sapiens
uauuuuacaaucaacaaaaugg

SEQ ID NO: 536668 - RNA, 23 nt, Homo sapiens
uauuuuacacguaucucuuggua

SEQ ID NO: 536669 - RNA, 15 nt, Homo sapiens
uauuuuacugaucuc

SEQ ID NO: 536670 - RNA, 14 nt, Homo sapiens
uauuuuagccuuua

SEQ ID NO: 536671 - RNA, 16 nt, Homo sapiens
uauuuuaggcacuguu

SEQ ID NO: 536672 - RNA, 15 nt, Homo sapiens
uauuuucaguauacu

SEQ ID NO: 536673 - RNA, 19 nt, Homo sapiens
uauuuuccccuagcuuucc

SEQ ID NO: 536674 - RNA, 22 nt, Homo sapiens
uauuuucccuacccugcaacuu

SEQ ID NO: 536675 - RNA, 22 nt, Homo sapiens
uauuuucuuacccaauuuccca

SEQ ID NO: 536676 - RNA, 13 nt, Homo sapiens
uauuuugcauucc

SEQ ID NO: 536677 - RNA, 15 nt, Homo sapiens
uauuuugcauuccag

SEQ ID NO: 536678 - RNA, 16 nt, Homo sapiens
uauuuugccagacuua

SEQ ID NO: 536679 - RNA, 14 nt, Homo sapiens
uauuuugcuguuac

SEQ ID NO: 536680 - RNA, 21 nt, Homo sapiens
uauuuuguaaugcugcacaga

SEQ ID NO: 536681 - RNA, 23 nt, Homo sapiens
uauuuuguaugaaauauauguga

SEQ ID NO: 536682 - RNA, 19 nt, Homo sapiens
uauuuuuacaagaaguuua

SEQ ID NO: 536683 - RNA, 21 nt, Homo sapiens
uauuuuuauacaaaccuacca

SEQ ID NO: 536684 - RNA, 19 nt, Homo sapiens
uauuuuuauaucaugcaaa

SEQ ID NO: 536685 - RNA, 14 nt, Homo sapiens
uauuuuuaugugca

SEQ ID NO: 536686 - RNA, 15 nt, Homo sapiens
uauuuuuaugugcaa

SEQ ID NO: 536687 - RNA, 13 nt, Homo sapiens
uauuuuugccaaa

SEQ ID NO: 536688 - RNA, 23 nt, Homo sapiens
uauuuuuggcugggggaguguga

SEQ ID NO: 536689 - RNA, 20 nt, Homo sapiens
uauuuuuguacugaaucuca

SEQ ID NO: 536690 - RNA, 17 nt, Homo sapiens
uauuuuuuaauaaacug

SEQ ID NO: 536691 - RNA, 16 nt, Homo sapiens
uauuuuuuauauauac

SEQ ID NO: 536692 - RNA, 18 nt, Homo sapiens
uauuuuuucaauguuucu

SEQ ID NO: 536693 - RNA, 14 nt, Homo sapiens
uauuuuuuuuacug

SEQ ID NO: 536694 - RNA, 13 nt, Homo sapiens
ucaaaaacauucu

SEQ ID NO: 536695 - RNA, 14 nt, Homo sapiens
ucaaaaacauuuca

SEQ ID NO: 536696 - RNA, 13 nt, Homo sapiens
ucaaaaagccacu

SEQ ID NO: 536697 - RNA, 15 nt, Homo sapiens
ucaaaaaucuguccg

SEQ ID NO: 536698 - RNA, 17 nt, Homo sapiens
ucaaaacacccaaaaau

SEQ ID NO: 536699 - RNA, 12 nt, Homo sapiens
ucaaaacacugu

SEQ ID NO: 536700 - RNA, 19 nt, Homo sapiens
ucaaaacagagaugugaua

SEQ ID NO: 536701 - RNA, 19 nt, Homo sapiens
ucaaaacaguaauuuccug

SEQ ID NO: 536702 - RNA, 20 nt, Homo sapiens
ucaaaacauucauaggcagu

SEQ ID NO: 536703 - RNA, 16 nt, Homo sapiens
ucaaaaccugugccag

SEQ ID NO: 536704 - RNA, 18 nt, Homo sapiens
ucaaaacuggagucccaa

SEQ ID NO: 536705 - RNA, 22 nt, Homo sapiens
ucaaaagaaccagacugugucu

SEQ ID NO: 536706 - RNA, 13 nt, Homo sapiens
ucaaaagaucaaa

SEQ ID NO: 536707 - RNA, 16 nt, Homo sapiens
ucaaaaggaaaccaag

SEQ ID NO: 536708 - RNA, 23 nt, Homo sapiens
ucaaaaguugguguugacauaca

SEQ ID NO: 536709 - RNA, 17 nt, Homo sapiens
ucaaaauaaaaaugagg

SEQ ID NO: 536710 - RNA, 17 nt, Homo sapiens
ucaaaauauacauucaa

SEQ ID NO: 536711 - RNA, 21 nt, Homo sapiens
ucaaaauauuacccagcugaa

SEQ ID NO: 536712 - RNA, 15 nt, Homo sapiens
ucaaaaucacaauga

SEQ ID NO: 536713 - RNA, 13 nt, Homo sapiens
ucaaaauccaaaa

SEQ ID NO: 536714 - RNA, 13 nt, Homo sapiens
ucaaaaucuuucc

SEQ ID NO: 536715 - RNA, 14 nt, Homo sapiens
ucaaaaugcuuuuu

SEQ ID NO: 536716 - RNA, 20 nt, Homo sapiens
ucaaaauggacguacugguu

SEQ ID NO: 536717 - RNA, 18 nt, Homo sapiens
ucaaaauuaauagcuuuu

SEQ ID NO: 536718 - RNA, 22 nt, Homo sapiens
ucaaaauuguuuaccauagaaa

SEQ ID NO: 536719 - RNA, 17 nt, Homo sapiens
ucaaaauuuaaagccau

SEQ ID NO: 536720 - RNA, 16 nt, Homo sapiens
ucaaaauuuaacaguu

SEQ ID NO: 536721 - RNA, 17 nt, Homo sapiens
ucaaacaaacucucuga

SEQ ID NO: 536722 - RNA, 22 nt, Homo sapiens
ucaaacaaagaugccacauuca

SEQ ID NO: 536723 - RNA, 19 nt, Homo sapiens
ucaaacagggcaaaguguu

SEQ ID NO: 536724 - RNA, 16 nt, Homo sapiens
ucaaacauaauucucu

SEQ ID NO: 536725 - RNA, 17 nt, Homo sapiens
ucaaacauaauucucuc

SEQ ID NO: 536726 - RNA, 23 nt, Homo sapiens
ucaaacauuuuguaucaaggaaa

SEQ ID NO: 536727 - RNA, 11 nt, Homo sapiens
ucaaaccaaga

SEQ ID NO: 536728 - RNA, 12 nt, Homo sapiens
ucaaaccaagaa

SEQ ID NO: 536729 - RNA, 13 nt, Homo sapiens
ucaaaccaagaag

SEQ ID NO: 536730 - RNA, 15 nt, Homo sapiens
ucaaacccagucuca

SEQ ID NO: 536731 - RNA, 20 nt, Homo sapiens
ucaaaccuuucuggccuguu

SEQ ID NO: 536732 - RNA, 20 nt, Homo sapiens
ucaaacgccgcugacugcca

SEQ ID NO: 536733 - RNA, 14 nt, Homo sapiens
ucaaacuacuggca

SEQ ID NO: 536734 - RNA, 18 nt, Homo sapiens
ucaaacucauuggcuuaa

SEQ ID NO: 536735 - RNA, 12 nt, Homo sapiens
ucaaacucccua

SEQ ID NO: 536736 - RNA, 21 nt, Homo sapiens
ucaaacugcaugauucaugcc

SEQ ID NO: 536737 - RNA, 14 nt, Homo sapiens
ucaaacugccuugg

SEQ ID NO: 536738 - RNA, 22 nt, Homo sapiens
ucaaagaaaguguauugguuua

SEQ ID NO: 536739 - RNA, 15 nt, Homo sapiens
ucaaagaagucaaau

SEQ ID NO: 536740 - RNA, 14 nt, Homo sapiens
ucaaagacauggaa

SEQ ID NO: 536741 - RNA, 14 nt, Homo sapiens
ucaaagaggccuua

SEQ ID NO: 536742 - RNA, 19 nt, Homo sapiens
ucaaagagguauauuugaa

SEQ ID NO: 536743 - RNA, 13 nt, Homo sapiens
ucaaagaguccua

SEQ ID NO: 536744 - RNA, 20 nt, Homo sapiens
ucaaagaugccccauuccuu

SEQ ID NO: 536745 - RNA, 18 nt, Homo sapiens
ucaaagaugcguuugccu

SEQ ID NO: 536746 - RNA, 23 nt, Homo sapiens
ucaaagauguguugcuauccuga

SEQ ID NO: 536747 - RNA, 15 nt, Homo sapiens
ucaaagcaaguuuca

SEQ ID NO: 536748 - RNA, 22 nt, Homo sapiens
ucaaagcaauugaaaugcauug

SEQ ID NO: 536749 - RNA, 20 nt, Homo sapiens
ucaaagcacagaauuuguca

SEQ ID NO: 536750 - RNA, 20 nt, Homo sapiens
ucaaagcuuugacucuauaa

SEQ ID NO: 536751 - RNA, 15 nt, Homo sapiens
uugcagcucaguagu

SEQ ID NO: 536752 - RNA, 19 nt, Homo sapiens
uugcagcugagugaaaaau

SEQ ID NO: 536753 - RNA, 15 nt, Homo sapiens
uugcagcugauguug

SEQ ID NO: 536754 - RNA, 18 nt, Homo sapiens
uugcaggcucugggcuca

SEQ ID NO: 536755 - RNA, 21 nt, Homo sapiens
uugcagugaaccuagauugca

SEQ ID NO: 536756 - RNA, 20 nt, Homo sapiens
uugcagugagccgagaucac

SEQ ID NO: 536757 - RNA, 18 nt, Homo sapiens
uugcagugagcugagauc

SEQ ID NO: 536758 - RNA, 20 nt, Homo sapiens
uugcaguucaccugcacuua

SEQ ID NO: 536759 - RNA, 17 nt, Homo sapiens
uugcaguucccacauua

SEQ ID NO: 536760 - RNA, 20 nt, Homo sapiens
uugcaucccugaaacaucuc

SEQ ID NO: 536761 - RNA, 17 nt, Homo sapiens
uugcaucuuuucuacuu

SEQ ID NO: 536762 - RNA, 12 nt, Homo sapiens
uugcaugaaauu

SEQ ID NO: 536763 - RNA, 18 nt, Homo sapiens
uugcauggcuccagaaau

SEQ ID NO: 536764 - RNA, 12 nt, Homo sapiens
uugcaugggcua

SEQ ID NO: 536765 - RNA, 14 nt, Homo sapiens
uugcauuaaucuaa

SEQ ID NO: 536766 - RNA, 13 nt, Homo sapiens
uugcauuccagaa

SEQ ID NO: 536767 - RNA, 14 nt, Homo sapiens
uugcauuccagaau

SEQ ID NO: 536768 - RNA, 22 nt, Homo sapiens
uugcauuccuuacuugcacugu

SEQ ID NO: 536769 - RNA, 14 nt, Homo sapiens
uugcauugcuggac

SEQ ID NO: 536770 - RNA, 17 nt, Homo sapiens
ucaaaucgaauagggaa

SEQ ID NO: 536771 - RNA, 17 nt, Homo sapiens
ucaaaucuauucagaca

SEQ ID NO: 536772 - RNA, 12 nt, Homo sapiens
ucaaaucuccag

SEQ ID NO: 536773 - RNA, 12 nt, Homo sapiens
ucaaaucugugc

SEQ ID NO: 536774 - RNA, 16 nt, Homo sapiens
ucaaaucuuacaaaau

SEQ ID NO: 536775 - RNA, 12 nt, Homo sapiens
ucaaaugaucuu

SEQ ID NO: 536776 - RNA, 18 nt, Homo sapiens
ucaaaugaugaagaccaa

SEQ ID NO: 536777 - RNA, 20 nt, Homo sapiens
ucaaaugaugaagaccaaag

SEQ ID NO: 536778 - RNA, 21 nt, Homo sapiens
ucaaaugaugaagaccaaaga

SEQ ID NO: 536779 - RNA, 14 nt, Homo sapiens
ucaaaugcauuuug

SEQ ID NO: 536780 - RNA, 20 nt, Homo sapiens
ucaaauguaaauuuacugag

SEQ ID NO: 536781 - RNA, 19 nt, Homo sapiens
ucaaaugucagagcuaugu

SEQ ID NO: 536782 - RNA, 18 nt, Homo sapiens
ucaaaugugacauuauau

SEQ ID NO: 536783 - RNA, 13 nt, Homo sapiens
ucaaaugugcugu

SEQ ID NO: 536784 - RNA, 15 nt, Homo sapiens
ucaaauuaucuucac

SEQ ID NO: 536785 - RNA, 14 nt, Homo sapiens
ucaaauugcugcuu

SEQ ID NO: 536786 - RNA, 19 nt, Homo sapiens
ucaaauuggugaacagugu

SEQ ID NO: 536787 - RNA, 14 nt, Homo sapiens
ucaaauuugccaug

SEQ ID NO: 536788 - RNA, 21 nt, Homo sapiens
ucaaauuugccaugacauuuc

SEQ ID NO: 536789 - RNA, 17 nt, Homo sapiens
ucaaauuuguaaaguua

SEQ ID NO: 536790 - RNA, 19 nt, Homo sapiens
ucaacaaacauuugcugaa

SEQ ID NO: 536791 - RNA, 13 nt, Homo sapiens
ucaacaaccugaa

SEQ ID NO: 536792 - RNA, 20 nt, Homo sapiens
ucaacaaggaucaggcugcu

SEQ ID NO: 536793 - RNA, 14 nt, Homo sapiens
ucaacacauuggaa

SEQ ID NO: 536794 - RNA, 16 nt, Homo sapiens
ucaacaccacuaggaa

SEQ ID NO: 536795 - RNA, 19 nt, Homo sapiens
ucaacaccuuaauaugcug

SEQ ID NO: 536796 - RNA, 13 nt, Homo sapiens
ucaacacuguuac

SEQ ID NO: 536797 - RNA, 19 nt, Homo sapiens
ucaacagaauuaaaauguc

SEQ ID NO: 536798 - RNA, 17 nt, Homo sapiens
ucaacagaucaacaaua

SEQ ID NO: 536799 - RNA, 21 nt, Homo sapiens
ucaacagaugaccguguacaa

SEQ ID NO: 536800 - RNA, 20 nt, Homo sapiens
ucaacagaugauaguccaau

SEQ ID NO: 536801 - RNA, 15 nt, Homo sapiens
ucaacagcagugagu

SEQ ID NO: 536802 - RNA, 19 nt, Homo sapiens
ucaacagugagagacucca

SEQ ID NO: 536803 - RNA, 20 nt, Homo sapiens
ucaacaucuuuuacauucug

SEQ ID NO: 536804 - RNA, 20 nt, Homo sapiens
ucaacauggcaauugcacuc

SEQ ID NO: 536805 - RNA, 17 nt, Homo sapiens
ucaacauggcagaacca

SEQ ID NO: 536806 - RNA, 16 nt, Homo sapiens
ucaacauuaccaaaau

SEQ ID NO: 536807 - RNA, 15 nt, Homo sapiens
ucaaccaaugccaaa

SEQ ID NO: 536808 - RNA, 16 nt, Homo sapiens
ucaaccauaacacuug

SEQ ID NO: 536809 - RNA, 17 nt, Homo sapiens
ucaaccgaugguccuca

SEQ ID NO: 536810 - RNA, 17 nt, Homo sapiens
ucaaccugauacauuua

SEQ ID NO: 536811 - RNA, 22 nt, Homo sapiens
ucaaccugguggcaccagaugc

SEQ ID NO: 536812 - RNA, 16 nt, Homo sapiens
ucaacuagguauuuaa

SEQ ID NO: 536813 - RNA, 14 nt, Homo sapiens
ucaacucacagcuu

SEQ ID NO: 536814 - RNA, 19 nt, Homo sapiens
ucaacucguuuuuauauua

SEQ ID NO: 536815 - RNA, 17 nt, Homo sapiens
ucaacucucuuuguaaa

SEQ ID NO: 536816 - RNA, 17 nt, Homo sapiens
ucaacugaaaagacuca

SEQ ID NO: 536817 - RNA, 22 nt, Homo sapiens
ucaacugaaaagacucaguguu

SEQ ID NO: 536818 - RNA, 22 nt, Homo sapiens
ucaacugcuuugaaacuugccu

SEQ ID NO: 536819 - RNA, 23 nt, Homo sapiens
ucaacuggagacacuauuuaucu

SEQ ID NO: 536820 - RNA, 15 nt, Homo sapiens
ucaacuggagucuau

SEQ ID NO: 536821 - RNA, 23 nt, Homo sapiens
ucaacuggggaauugaagccaau

SEQ ID NO: 536822 - RNA, 16 nt, Homo sapiens
ucaacuucaucagugu

SEQ ID NO: 536823 - RNA, 21 nt, Homo sapiens
ucaacuugcucucuuucccac

SEQ ID NO: 536824 - RNA, 20 nt, Homo sapiens
ucaacuuucagaagugccac

SEQ ID NO: 536825 - RNA, 20 nt, Homo sapiens
ucaacuuuggugaacaguuu

SEQ ID NO: 536826 - RNA, 16 nt, Homo sapiens
ucaacuuuuccuuuca

SEQ ID NO: 536827 - RNA, 18 nt, Homo sapiens
ucaacuuuuccuuucaua

SEQ ID NO: 536828 - RNA, 21 nt, Homo sapiens
ucaacuuuugacaaucaaaga

SEQ ID NO: 536829 - RNA, 20 nt, Homo sapiens
ucaagaaacagccagcaaga

SEQ ID NO: 536830 - RNA, 14 nt, Homo sapiens
ucaagaacauucua

SEQ ID NO: 536831 - RNA, 16 nt, Homo sapiens
ucaagaacucugggcu

SEQ ID NO: 536832 - RNA, 22 nt, Homo sapiens
ucaagaaucuagaagaugugua

SEQ ID NO: 536833 - RNA, 13 nt, Homo sapiens
ucaagacaaugca

SEQ ID NO: 536834 - RNA, 15 nt, Homo sapiens
ucaagacaaugcacc

SEQ ID NO: 536835 - RNA, 20 nt, Homo sapiens
ucaagaccauccuggacuga

SEQ ID NO: 536836 - RNA, 11 nt, Homo sapiens
ucaagacuuua

SEQ ID NO: 536837 - RNA, 19 nt, Homo sapiens
ucaagagaguaaacagaca

SEQ ID NO: 536838 - RNA, 14 nt, Homo sapiens
ucaagagcaaagua

SEQ ID NO: 536839 - RNA, 13 nt, Homo sapiens
ucaagaguucagu

SEQ ID NO: 536840 - RNA, 19 nt, Homo sapiens
ucaagauacaagaucaaua

SEQ ID NO: 536841 - RNA, 18 nt, Homo sapiens
ucaagaucaacauuccag

SEQ ID NO: 536842 - RNA, 16 nt, Homo sapiens
ucaagauuugaccaaa

SEQ ID NO: 536843 - RNA, 19 nt, Homo sapiens
ucaagcaauucuccugccu

SEQ ID NO: 536844 - RNA, 15 nt, Homo sapiens
ucaagcacacuggaa

SEQ ID NO: 536845 - RNA, 16 nt, Homo sapiens
ucaagcagucgugccu

SEQ ID NO: 536846 - RNA, 14 nt, Homo sapiens
ucaagcaguucucc

SEQ ID NO: 536847 - RNA, 21 nt, Homo sapiens
ucaagcaugcaauaaugugca

SEQ ID NO: 536848 - RNA, 22 nt, Homo sapiens
ucaagcauguauuuuugucaau

SEQ ID NO: 536849 - RNA, 12 nt, Homo sapiens
ucaagcauuuag

SEQ ID NO: 536850 - RNA, 21 nt, Homo sapiens
ucaagccuagcccuucucuca

SEQ ID NO: 536851 - RNA, 23 nt, Homo sapiens
ucaagccuccccaguucuacuga

SEQ ID NO: 536852 - RNA, 17 nt, Homo sapiens
ucaagcuagaaggccac

SEQ ID NO: 536853 - RNA, 18 nt, Homo sapiens
ucaagcuagaaggccaca

SEQ ID NO: 536854 - RNA, 15 nt, Homo sapiens
ucaagcuagccagag

SEQ ID NO: 536855 - RNA, 13 nt, Homo sapiens
ucaagcucagggc

SEQ ID NO: 536856 - RNA, 15 nt, Homo sapiens
ucaagcugugagaca

SEQ ID NO: 536857 - RNA, 19 nt, Homo sapiens
ucaagcuguugaagucuca

SEQ ID NO: 536858 - RNA, 17 nt, Homo sapiens
ucaaggacaggagccug

SEQ ID NO: 536859 - RNA, 20 nt, Homo sapiens
ucaaggacgaauuugcacag

SEQ ID NO: 536860 - RNA, 16 nt, Homo sapiens
ucaaggauauacugca

SEQ ID NO: 536861 - RNA, 23 nt, Homo sapiens
ucaaggauuuucauguugaugac

SEQ ID NO: 536862 - RNA, 15 nt, Homo sapiens
ucaaggcccucagca

SEQ ID NO: 536863 - RNA, 16 nt, Homo sapiens
ucaaggcugcagugag

SEQ ID NO: 536864 - RNA, 17 nt, Homo sapiens
ucaagggcuuacuauuu

SEQ ID NO: 536865 - RNA, 14 nt, Homo sapiens
ucaaggggcuggaa

SEQ ID NO: 536866 - RNA, 15 nt, Homo sapiens
ucaaggguauuuuaa

SEQ ID NO: 536867 - RNA, 13 nt, Homo sapiens
ucaaggugggccu

SEQ ID NO: 536868 - RNA, 14 nt, Homo sapiens
ucaagguguucucu

SEQ ID NO: 536869 - RNA, 21 nt, Homo sapiens
ucaagguuuuaaaacagucua

SEQ ID NO: 536870 - RNA, 11 nt, Homo sapiens
ucaaguaauaa

SEQ ID NO: 536871 - RNA, 15 nt, Homo sapiens
ucaaguaauacaaac

SEQ ID NO: 536872 - RNA, 17 nt, Homo sapiens
ucaaguaauacaaacua

SEQ ID NO: 536873 - RNA, 13 nt, Homo sapiens
ucaaguaccaaaa

SEQ ID NO: 536874 - RNA, 13 nt, Homo sapiens
ucaaguacucaaa

SEQ ID NO: 536875 - RNA, 13 nt, Homo sapiens
uuggaauggcaau

SEQ ID NO: 536876 - RNA, 15 nt, Homo sapiens
uuggacagacacugu

SEQ ID NO: 536877 - RNA, 14 nt, Homo sapiens
uuggacagcugcuu

SEQ ID NO: 536878 - RNA, 17 nt, Homo sapiens
uuggacccgcucuggac

SEQ ID NO: 536879 - RNA, 21 nt, Homo sapiens
uuggacccgcucuggaccaac

SEQ ID NO: 536880 - RNA, 16 nt, Homo sapiens
uuggacucuugcucuu

SEQ ID NO: 536881 - RNA, 21 nt, Homo sapiens
uuggacugauaaucucuuuaa

SEQ ID NO: 536882 - RNA, 14 nt, Homo sapiens
uuggacuguaacau

SEQ ID NO: 536883 - RNA, 13 nt, Homo sapiens
uuggacugucuau

SEQ ID NO: 536884 - RNA, 15 nt, Homo sapiens
uuggagaaaaugggu

SEQ ID NO: 536885 - RNA, 22 nt, Homo sapiens
uuggagaaccagggcucuucuc

SEQ ID NO: 536886 - RNA, 21 nt, Homo sapiens
uuggagagucagaucuuucuc

SEQ ID NO: 536887 - RNA, 14 nt, Homo sapiens
uuggagcagugcuu

SEQ ID NO: 536888 - RNA, 15 nt, Homo sapiens
uuggagcuacugcaa

SEQ ID NO: 536889 - RNA, 14 nt, Homo sapiens
uuggaggaaugaca

SEQ ID NO: 536890 - RNA, 18 nt, Homo sapiens
uuggagggucuugagggg

SEQ ID NO: 536891 - RNA, 18 nt, Homo sapiens
uuggagugcgggugggcu

SEQ ID NO: 536892 - RNA, 12 nt, Homo sapiens
uuggaguuuucu

SEQ ID NO: 536893 - RNA, 18 nt, Homo sapiens
uuugcaucucaguaugaa

SEQ ID NO: 536894 - RNA, 19 nt, Homo sapiens
uuugcauuaaauucacaaa

SEQ ID NO: 536895 - RNA, 22 nt, Homo sapiens
ugacaaaccauaacugacaaga

SEQ ID NO: 536896 - RNA, 15 nt, Homo sapiens
ugacaaaggaugaag

SEQ ID NO: 536897 - RNA, 14 nt, Homo sapiens
ugacaaagugccgu

SEQ ID NO: 536898 - RNA, 15 nt, Homo sapiens
ugacaaauauucucu

SEQ ID NO: 536899 - RNA, 12 nt, Homo sapiens
ugacaacauguu

SEQ ID NO: 536900 - RNA, 17 nt, Homo sapiens
ugacaaccuccauucua

SEQ ID NO: 536901 - RNA, 12 nt, Homo sapiens
ugacaaccucuu

SEQ ID NO: 536902 - RNA, 16 nt, Homo sapiens
ugacaacuuagcucag

SEQ ID NO: 536903 - RNA, 13 nt, Homo sapiens
ugacaagcacuau

SEQ ID NO: 536904 - RNA, 23 nt, Homo sapiens
ugacaagcugacuuggcacuuaa

SEQ ID NO: 536905 - RNA, 17 nt, Homo sapiens
ugacaaggccccagaga

SEQ ID NO: 536906 - RNA, 20 nt, Homo sapiens
ugacaagugagacaaaaagc

SEQ ID NO: 536907 - RNA, 16 nt, Homo sapiens
ugacaauaaaaacaau

SEQ ID NO: 536908 - RNA, 18 nt, Homo sapiens
ugacaaucaacucuaaua

SEQ ID NO: 536909 - RNA, 19 nt, Homo sapiens
ugacaauugggagcugcca

SEQ ID NO: 536910 - RNA, 14 nt, Homo sapiens
ugacacaaacucac

SEQ ID NO: 536911 - RNA, 15 nt, Homo sapiens
ugacacaaagcuucu

SEQ ID NO: 536912 - RNA, 12 nt, Homo sapiens
ugacacagcagc

SEQ ID NO: 536913 - RNA, 23 nt, Homo sapiens
ugacaccgucccucagugauacg

SEQ ID NO: 536914 - RNA, 18 nt, Homo sapiens
ugacacgucugccuaccc

SEQ ID NO: 536915 - RNA, 22 nt, Homo sapiens
ugacacuaaaacaagaggacac

SEQ ID NO: 536916 - RNA, 19 nt, Homo sapiens
ugacacucuauaagauucc

SEQ ID NO: 536917 - RNA, 15 nt, Homo sapiens
ugacacugcucuaac

SEQ ID NO: 536918 - RNA, 12 nt, Homo sapiens
ugacagaacaag

SEQ ID NO: 536919 - RNA, 17 nt, Homo sapiens
ugacagaaggugccacu

SEQ ID NO: 536920 - RNA, 16 nt, Homo sapiens
ugacagacuuuggaca

SEQ ID NO: 536921 - RNA, 18 nt, Homo sapiens
ugacagaguucacuauaa

SEQ ID NO: 536922 - RNA, 18 nt, Homo sapiens
guacugaaagccuuaggg

SEQ ID NO: 536923 - RNA, 17 nt, Homo sapiens
guacuggaaaagcccuu

SEQ ID NO: 536924 - RNA, 15 nt, Homo sapiens
guacuggccaguguc

SEQ ID NO: 536925 - RNA, 21 nt, Homo sapiens
guacuggggugggaucuugga

SEQ ID NO: 536926 - RNA, 23 nt, Homo sapiens
guacuguaauggguaauucugac

SEQ ID NO: 536927 - RNA, 16 nt, Homo sapiens
guacuguaugccuuca

SEQ ID NO: 536928 - RNA, 14 nt, Homo sapiens
guacugugcaguuu

SEQ ID NO: 536929 - RNA, 11 nt, Homo sapiens
guacuguguuu

SEQ ID NO: 536930 - RNA, 22 nt, Homo sapiens
guacuuauaaagaagguuggug

SEQ ID NO: 536931 - RNA, 20 nt, Homo sapiens
guacuuauguugcacaauga

SEQ ID NO: 536932 - RNA, 23 nt, Homo sapiens
guacuuauguugcacaaugagaa

SEQ ID NO: 536933 - RNA, 21 nt, Homo sapiens
guacuucaaguuaaagugaau

SEQ ID NO: 536934 - RNA, 21 nt, Homo sapiens
guacuugaauuuuucuuccuc

SEQ ID NO: 536935 - RNA, 15 nt, Homo sapiens
guacuugucaaagaa

SEQ ID NO: 536936 - RNA, 18 nt, Homo sapiens
guacuugugaccauugua

SEQ ID NO: 536937 - RNA, 23 nt, Homo sapiens
guacuuugcugaaugucauuuua

SEQ ID NO: 536938 - RNA, 19 nt, Homo sapiens
guacuuuuaugauguauau

SEQ ID NO: 536939 - RNA, 14 nt, Homo sapiens
guacuuuugagugu

SEQ ID NO: 536940 - RNA, 22 nt, Homo sapiens
guagaaauuaacaaaugugcug

SEQ ID NO: 536941 - RNA, 14 nt, Homo sapiens
guagaacucacaga

SEQ ID NO: 536942 - RNA, 16 nt, Homo sapiens
guagaauauucagaca

SEQ ID NO: 536943 - RNA, 22 nt, Homo sapiens
guagaauuaccauuaauuacau

SEQ ID NO: 536944 - RNA, 20 nt, Homo sapiens
guagacagguguuacuuaca

SEQ ID NO: 536945 - RNA, 14 nt, Homo sapiens
guagaccugcugcc

SEQ ID NO: 536946 - RNA, 17 nt, Homo sapiens
guagacuagugccguag

SEQ ID NO: 536947 - RNA, 20 nt, Homo sapiens
guagacugaauucagcacca

SEQ ID NO: 536948 - RNA, 20 nt, Homo sapiens
guagagacgguguuuugcca

SEQ ID NO: 536949 - RNA, 18 nt, Homo sapiens
guagagauuuuuaugugu

SEQ ID NO: 536950 - RNA, 13 nt, Homo sapiens
guagagccagcuu

SEQ ID NO: 536951 - RNA, 18 nt, Homo sapiens
guagagcucuacugccuc

SEQ ID NO: 536952 - RNA, 12 nt, Homo sapiens
guagaguggugc

SEQ ID NO: 536953 - RNA, 13 nt, Homo sapiens
guagaguggugcu

SEQ ID NO: 536954 - RNA, 23 nt, Homo sapiens
guagauccagauccagacuguaa

SEQ ID NO: 536955 - RNA, 12 nt, Homo sapiens
guagaugcauua

SEQ ID NO: 536956 - RNA, 16 nt, Homo sapiens
guagauguaugcacac

SEQ ID NO: 536957 - RNA, 12 nt, Homo sapiens
guagaugugauu

SEQ ID NO: 536958 - RNA, 13 nt, Homo sapiens
guagcaacuaaaa

SEQ ID NO: 536959 - RNA, 23 nt, Homo sapiens
guagcaauaagcuggacuagugu

SEQ ID NO: 536960 - RNA, 13 nt, Homo sapiens
guagcaauggcca

SEQ ID NO: 536961 - RNA, 16 nt, Homo sapiens
guagcacuuacguaaa

SEQ ID NO: 536962 - RNA, 21 nt, Homo sapiens
guagcagagaaaggauugauu

SEQ ID NO: 536963 - RNA, 21 nt, Homo sapiens
guagcagauccccagccucug

SEQ ID NO: 536964 - RNA, 12 nt, Homo sapiens
guagcagcaguu

SEQ ID NO: 536965 - RNA, 13 nt, Homo sapiens
guagcagcaguug

SEQ ID NO: 536966 - RNA, 18 nt, Homo sapiens
guagcaggucaaaaaccu

SEQ ID NO: 536967 - RNA, 15 nt, Homo sapiens
guagcauacauuuau

SEQ ID NO: 536968 - RNA, 21 nt, Homo sapiens
guagccugggcucacugugcu

SEQ ID NO: 536969 - RNA, 18 nt, Homo sapiens
guagcuaaccaucacccc

SEQ ID NO: 536970 - RNA, 20 nt, Homo sapiens
guagcuaagugaaaagguca

SEQ ID NO: 536971 - RNA, 12 nt, Homo sapiens
guagcuagccug

SEQ ID NO: 536972 - RNA, 19 nt, Homo sapiens
guagcuaugggccauaacc

SEQ ID NO: 536973 - RNA, 16 nt, Homo sapiens
guagcuauuacugucc

SEQ ID NO: 536974 - RNA, 19 nt, Homo sapiens
guagcucucacaugcacag

SEQ ID NO: 536975 - RNA, 19 nt, Homo sapiens
guagcucuggaccugucuc

SEQ ID NO: 536976 - RNA, 16 nt, Homo sapiens
guagcuggcacuacag

SEQ ID NO: 536977 - RNA, 19 nt, Homo sapiens
guagcugggacuacaggug

SEQ ID NO: 536978 - RNA, 20 nt, Homo sapiens
guagcugggacuacaggugu

SEQ ID NO: 536979 - RNA, 12 nt, Homo sapiens
guagcugggauu

SEQ ID NO: 536980 - RNA, 18 nt, Homo sapiens
guagcuggggcuacagga

SEQ ID NO: 536981 - RNA, 19 nt, Homo sapiens
guagcuguucaguugccac

SEQ ID NO: 536982 - RNA, 14 nt, Homo sapiens
guagcuugcucccu

SEQ ID NO: 536983 - RNA, 18 nt, Homo sapiens
guaggaaacucaucuccu

SEQ ID NO: 536984 - RNA, 19 nt, Homo sapiens
guaggaaagaggaagcaaa

SEQ ID NO: 536985 - RNA, 18 nt, Homo sapiens
guaggaaagucacccaaa

SEQ ID NO: 536986 - RNA, 18 nt, Homo sapiens
guaggaaucugccuucca

SEQ ID NO: 536987 - RNA, 14 nt, Homo sapiens
guaggaauugagga

SEQ ID NO: 536988 - RNA, 13 nt, Homo sapiens
guaggacauacca

SEQ ID NO: 536989 - RNA, 15 nt, Homo sapiens
guaggagcugccuug

SEQ ID NO: 536990 - RNA, 18 nt, Homo sapiens
guaggcugucugugccau

SEQ ID NO: 536991 - RNA, 14 nt, Homo sapiens
guagggaguaccug

SEQ ID NO: 536992 - RNA, 13 nt, Homo sapiens
guagggaugccuu

SEQ ID NO: 536993 - RNA, 14 nt, Homo sapiens
guaggggcagggag

SEQ ID NO: 536994 - RNA, 19 nt, Homo sapiens
guagguaggaagcacugaa

SEQ ID NO: 536995 - RNA, 21 nt, Homo sapiens
guagguagugauuaacuguga

SEQ ID NO: 536996 - RNA, 16 nt, Homo sapiens
guaggugugacuugaa

SEQ ID NO: 536997 - RNA, 17 nt, Homo sapiens
guaggugugacuugaac

SEQ ID NO: 536998 - RNA, 16 nt, Homo sapiens
guaguauuuuugccaa

SEQ ID NO: 536999 - RNA, 13 nt, Homo sapiens
guaguccaucacc

SEQ ID NO: 537000 - RNA, 16 nt, Homo sapiens
guagucccagccacuc

SEQ ID NO: 537001 - RNA, 20 nt, Homo sapiens
guagucccagcuacuuggga

SEQ ID NO: 537002 - RNA, 15 nt, Homo sapiens
guagucgcuuugccu

SEQ ID NO: 537003 - RNA, 15 nt, Homo sapiens
guagucucauuacuu

SEQ ID NO: 537004 - RNA, 15 nt, Homo sapiens
guagugacacacaga

SEQ ID NO: 537005 - RNA, 20 nt, Homo sapiens
guagugugugcuuacaguaa

SEQ ID NO: 537006 - RNA, 14 nt, Homo sapiens
guaguuacuguggu

SEQ ID NO: 537007 - RNA, 22 nt, Homo sapiens
guaguuaggaaauaaaaccuuu

SEQ ID NO: 537008 - RNA, 18 nt, Homo sapiens
guaguucucaggaccugu

SEQ ID NO: 537009 - RNA, 17 nt, Homo sapiens
guaguucugaguccuga

SEQ ID NO: 537010 - RNA, 17 nt, Homo sapiens
guaguuguucugaaaug

SEQ ID NO: 537011 - RNA, 13 nt, Homo sapiens
guaguuuguuuua

SEQ ID NO: 537012 - RNA, 16 nt, Homo sapiens
guaguuuucaaaacac

SEQ ID NO: 537013 - RNA, 23 nt, Homo sapiens
guauaaaaugguguuuucaugua

SEQ ID NO: 537014 - RNA, 14 nt, Homo sapiens
guauaaauguacau

SEQ ID NO: 537015 - RNA, 16 nt, Homo sapiens
guauaaauuuuuaccu

SEQ ID NO: 537016 - RNA, 14 nt, Homo sapiens
guauaacaacuuug

SEQ ID NO: 537017 - RNA, 16 nt, Homo sapiens
guauaagucaagcaca

SEQ ID NO: 537018 - RNA, 18 nt, Homo sapiens
ugacuacuacucugccaa

SEQ ID NO: 537019 - RNA, 22 nt, Homo sapiens
ugacuagaacaacuugaagauu

SEQ ID NO: 537020 - RNA, 17 nt, Homo sapiens
ugacuagcgccuggccu

SEQ ID NO: 537021 - RNA, 17 nt, Homo sapiens
ugacuauggcuaccaaa

SEQ ID NO: 537022 - RNA, 19 nt, Homo sapiens
ugacuauggcuaccaaaaa

SEQ ID NO: 537023 - RNA, 12 nt, Homo sapiens
ugacucaccuga

SEQ ID NO: 537024 - RNA, 23 nt, Homo sapiens
ugacucagaacuucugccucuaa

SEQ ID NO: 537025 - RNA, 15 nt, Homo sapiens
ugacucaggacaucc

SEQ ID NO: 537026 - RNA, 15 nt, Homo sapiens
ugacucaguauaggu

SEQ ID NO: 537027 - RNA, 20 nt, Homo sapiens
ugacucauccccacagcugg

SEQ ID NO: 537028 - RNA, 17 nt, Homo sapiens
ugacucuaaaugcaguu

SEQ ID NO: 537029 - RNA, 16 nt, Homo sapiens
ugacucucacacugaa

SEQ ID NO: 537030 - RNA, 13 nt, Homo sapiens
ugacucugagcua

SEQ ID NO: 537031 - RNA, 14 nt, Homo sapiens
ugacucuuccgugc

SEQ ID NO: 537032 - RNA, 19 nt, Homo sapiens
ugacucuuuauugucugua

SEQ ID NO: 537033 - RNA, 20 nt, Homo sapiens
ugacucuuuccuaaagccaa

SEQ ID NO: 537034 - RNA, 21 nt, Homo sapiens
ugacugauagcuuacacugag

SEQ ID NO: 537035 - RNA, 22 nt, Homo sapiens
ugacuggaaguuguggauauca

SEQ ID NO: 537036 - RNA, 15 nt, Homo sapiens
ugacuggcaguauua

SEQ ID NO: 537037 - RNA, 14 nt, Homo sapiens
ugacuguacaguua

SEQ ID NO: 537038 - RNA, 21 nt, Homo sapiens
ugacuguagaacuuauucucu

SEQ ID NO: 537039 - RNA, 15 nt, Homo sapiens
ugacuguaucugugu

SEQ ID NO: 537040 - RNA, 19 nt, Homo sapiens
ugacuguccaagugccaca

SEQ ID NO: 537041 - RNA, 20 nt, Homo sapiens
ugacugucuagccacucccu

SEQ ID NO: 537042 - RNA, 22 nt, Homo sapiens
ugacugugcccaagugggucca

SEQ ID NO: 537043 - RNA, 12 nt, Homo sapiens
ugacugugguag

SEQ ID NO: 537044 - RNA, 12 nt, Homo sapiens
ugacuguuacag

SEQ ID NO: 537045 - RNA, 15 nt, Homo sapiens
ugacuuaaccauaua

SEQ ID NO: 537046 - RNA, 13 nt, Homo sapiens
guauauuuuggga

SEQ ID NO: 537047 - RNA, 17 nt, Homo sapiens
guauauuuuugucugca

SEQ ID NO: 537048 - RNA, 15 nt, Homo sapiens
guaucaaacccacga

SEQ ID NO: 537049 - RNA, 18 nt, Homo sapiens
guaucaaauacauuuaaa

SEQ ID NO: 537050 - RNA, 13 nt, Homo sapiens
guaucaacacugu

SEQ ID NO: 537051 - RNA, 14 nt, Homo sapiens
guaucaaugaguaa

SEQ ID NO: 537052 - RNA, 22 nt, Homo sapiens
guauccguucaauaagcauuuc

SEQ ID NO: 537053 - RNA, 16 nt, Homo sapiens
guauccugcccagugu

SEQ ID NO: 537054 - RNA, 18 nt, Homo sapiens
guauccugugacauguaa

SEQ ID NO: 537055 - RNA, 12 nt, Homo sapiens
guaucucuuaca

SEQ ID NO: 537056 - RNA, 20 nt, Homo sapiens
guaucugacaaugcugaggu

SEQ ID NO: 537057 - RNA, 22 nt, Homo sapiens
guaucugaguugccaagacaaa

SEQ ID NO: 537058 - RNA, 18 nt, Homo sapiens
guaucuguaacccuugaa

SEQ ID NO: 537059 - RNA, 21 nt, Homo sapiens
guaucuucuuuagugguggua

SEQ ID NO: 537060 - RNA, 13 nt, Homo sapiens
guaucuugauguu

SEQ ID NO: 537061 - RNA, 19 nt, Homo sapiens
guaucuugccuaaggugcg

SEQ ID NO: 537062 - RNA, 17 nt, Homo sapiens
guaucuuugacaauucu

SEQ ID NO: 537063 - RNA, 14 nt, Homo sapiens
guaugaaugcagug

SEQ ID NO: 537064 - RNA, 20 nt, Homo sapiens
guaugauggcaggagaauca

SEQ ID NO: 537065 - RNA, 19 nt, Homo sapiens
guaugaugucacacaagcu

SEQ ID NO: 537066 - RNA, 18 nt, Homo sapiens
guaugauuuauccucaca

SEQ ID NO: 537067 - RNA, 21 nt, Homo sapiens
guaugcaaaccucaucuuucu

SEQ ID NO: 537068 - RNA, 22 nt, Homo sapiens
guaugcacaguaaaaauggaaa

SEQ ID NO: 537069 - RNA, 17 nt, Homo sapiens
guaugcacgugugcaca

SEQ ID NO: 537070 - RNA, 22 nt, Homo sapiens
guaugcagggagcacuguucac

SEQ ID NO: 537071 - RNA, 16 nt, Homo sapiens
guauggcagaggugca

SEQ ID NO: 537072 - RNA, 15 nt, Homo sapiens
guauggcccaggcag

SEQ ID NO: 537073 - RNA, 17 nt, Homo sapiens
guaugguauaugcacaa

SEQ ID NO: 537074 - RNA, 19 nt, Homo sapiens
guauguaaaagaaaaucca

SEQ ID NO: 537075 - RNA, 19 nt, Homo sapiens
guauguaaguaauugcauu

SEQ ID NO: 537076 - RNA, 17 nt, Homo sapiens
guauguaauuuaugcaa

SEQ ID NO: 537077 - RNA, 20 nt, Homo sapiens
guauguauacacacauauac

SEQ ID NO: 537078 - RNA, 15 nt, Homo sapiens
guauguauauauaca

SEQ ID NO: 537079 - RNA, 18 nt, Homo sapiens
guauguauccccacuuau

SEQ ID NO: 537080 - RNA, 20 nt, Homo sapiens
guauguauuauuuacauuua

SEQ ID NO: 537081 - RNA, 20 nt, Homo sapiens
guaugucagugucacuggau

SEQ ID NO: 537082 - RNA, 16 nt, Homo sapiens
guaugugacuuuucug

SEQ ID NO: 537083 - RNA, 10 nt, Homo sapiens
guaugugcac

SEQ ID NO: 537084 - RNA, 12 nt, Homo sapiens
guaugugcucuu

SEQ ID NO: 537085 - RNA, 18 nt, Homo sapiens
guauguguguagacugua

SEQ ID NO: 537086 - RNA, 14 nt, Homo sapiens
guauguugccuuua

SEQ ID NO: 537087 - RNA, 20 nt, Homo sapiens
guauguugucauaacauuua

SEQ ID NO: 537088 - RNA, 18 nt, Homo sapiens
guauuaaauuagauaucu

SEQ ID NO: 537089 - RNA, 16 nt, Homo sapiens
guauuaacuauuggua

SEQ ID NO: 537090 - RNA, 15 nt, Homo sapiens
guauuaauaccaaag

SEQ ID NO: 537091 - RNA, 20 nt, Homo sapiens
guauuaauaguucaguguau

SEQ ID NO: 537092 - RNA, 19 nt, Homo sapiens
guauuaauccccaucauua

SEQ ID NO: 537093 - RNA, 13 nt, Homo sapiens
guauuaaugcuau

SEQ ID NO: 537094 - RNA, 22 nt, Homo sapiens
guauuaauguguuaagugcagg

SEQ ID NO: 537095 - RNA, 16 nt, Homo sapiens
guauuagcucacugaa

SEQ ID NO: 537096 - RNA, 17 nt, Homo sapiens
guauuauaauaagcaaa

SEQ ID NO: 537097 - RNA, 14 nt, Homo sapiens
guauuauaccuuuu

SEQ ID NO: 537098 - RNA, 18 nt, Homo sapiens
guauuaugucucuucuga

SEQ ID NO: 537099 - RNA, 21 nt, Homo sapiens
guauuauucuguuuugcacag

SEQ ID NO: 537100 - RNA, 17 nt, Homo sapiens
guauuauuuuacaauca

SEQ ID NO: 537101 - RNA, 23 nt, Homo sapiens
guauuauuuuuuaauaaacugca

SEQ ID NO: 537102 - RNA, 18 nt, Homo sapiens
guauucagagucucugau

SEQ ID NO: 537103 - RNA, 17 nt, Homo sapiens
guauucagcguacuuga

SEQ ID NO: 537104 - RNA, 22 nt, Homo sapiens
guauucaggcacugagaaugau

SEQ ID NO: 537105 - RNA, 20 nt, Homo sapiens
guauucauuuuuucuacccu

SEQ ID NO: 537106 - RNA, 13 nt, Homo sapiens
guauuccacuuag

SEQ ID NO: 537107 - RNA, 22 nt, Homo sapiens
guauucccaaaaauuacuuugg

SEQ ID NO: 537108 - RNA, 16 nt, Homo sapiens
guauucuacagcagau

SEQ ID NO: 537109 - RNA, 21 nt, Homo sapiens
guauucucuaaaagcuuuaaa

SEQ ID NO: 537110 - RNA, 21 nt, Homo sapiens
guauucuguuugcguacuugu

SEQ ID NO: 537111 - RNA, 15 nt, Homo sapiens
guauucuucaaccuc

SEQ ID NO: 537112 - RNA, 16 nt, Homo sapiens
guauucuuguuagaau

SEQ ID NO: 537113 - RNA, 21 nt, Homo sapiens
guauucuuuuccaagcuccuu

SEQ ID NO: 537114 - RNA, 14 nt, Homo sapiens
guauugacaacagu

SEQ ID NO: 537115 - RNA, 17 nt, Homo sapiens
guauugagggccaguga

SEQ ID NO: 537116 - RNA, 19 nt, Homo sapiens
guauugauuuuaaauggau

SEQ ID NO: 537117 - RNA, 21 nt, Homo sapiens
guauugcaccuuugaaaugca

SEQ ID NO: 537118 - RNA, 14 nt, Homo sapiens
guauugcagccaaa

SEQ ID NO: 537119 - RNA, 21 nt, Homo sapiens
guauugucgguuaccucugca

SEQ ID NO: 537120 - RNA, 16 nt, Homo sapiens
guauugugcacuguau

SEQ ID NO: 537121 - RNA, 17 nt, Homo sapiens
guauuuaaggagaacca

SEQ ID NO: 537122 - RNA, 20 nt, Homo sapiens
guauuuaggaugacugcugu

SEQ ID NO: 537123 - RNA, 21 nt, Homo sapiens
guauuuauuuuacagcucauu

SEQ ID NO: 537124 - RNA, 21 nt, Homo sapiens
guauuucacagagcacgccug

SEQ ID NO: 537125 - RNA, 13 nt, Homo sapiens
guauuucucagga

SEQ ID NO: 537126 - RNA, 14 nt, Homo sapiens
guauuucuuuacag

SEQ ID NO: 537127 - RNA, 21 nt, Homo sapiens
guauuuggaaauaaagucaga

SEQ ID NO: 537128 - RNA, 21 nt, Homo sapiens
guauuuguauuaauaaagcau

SEQ ID NO: 537129 - RNA, 19 nt, Homo sapiens
guauuuuaacucauaccuu

SEQ ID NO: 537130 - RNA, 15 nt, Homo sapiens
guauuuucagcucaa

SEQ ID NO: 537131 - RNA, 23 nt, Homo sapiens
guauuuucuuacacugugucauu

SEQ ID NO: 537132 - RNA, 12 nt, Homo sapiens
guauuuugccag

SEQ ID NO: 537133 - RNA, 16 nt, Homo sapiens
guauuuuuaaaggcau

SEQ ID NO: 537134 - RNA, 15 nt, Homo sapiens
guauuuuuauagcca

SEQ ID NO: 537135 - RNA, 17 nt, Homo sapiens
guauuuuuauagccaua

SEQ ID NO: 537136 - RNA, 20 nt, Homo sapiens
guauuuuuucuaaugugcau

SEQ ID NO: 537137 - RNA, 14 nt, Homo sapiens
gucaaaaaguucca

SEQ ID NO: 537138 - RNA, 17 nt, Homo sapiens
gucaaaacaagacuccu

SEQ ID NO: 537139 - RNA, 13 nt, Homo sapiens
gucaaacaguaau

SEQ ID NO: 537140 - RNA, 17 nt, Homo sapiens
ugcuuuugaaaucugua

SEQ ID NO: 537141 - RNA, 14 nt, Homo sapiens
ugcuuuugccacuu

SEQ ID NO: 537142 - RNA, 18 nt, Homo sapiens
ugcuuuuguuccaauguc

SEQ ID NO: 537143 - RNA, 18 nt, Homo sapiens
ugcuuuuuggaaagucag

SEQ ID NO: 537144 - RNA, 14 nt, Homo sapiens
ugcuuuuuuuccaa

SEQ ID NO: 537145 - RNA, 17 nt, Homo sapiens
uggaaaaauacugccua

SEQ ID NO: 537146 - RNA, 15 nt, Homo sapiens
uggaaaacacuuuca

SEQ ID NO: 537147 - RNA, 19 nt, Homo sapiens
uggaaaaggaagacuagag

SEQ ID NO: 537148 - RNA, 22 nt, Homo sapiens
uggaaaaggggugaccuaguag

SEQ ID NO: 537149 - RNA, 21 nt, Homo sapiens
uggaaaauaaauucagaucaa

SEQ ID NO: 537150 - RNA, 15 nt, Homo sapiens
uggaaaauaccagug

SEQ ID NO: 537151 - RNA, 15 nt, Homo sapiens
uggaaaauaccuaau

SEQ ID NO: 537152 - RNA, 18 nt, Homo sapiens
uggaaaaugcaaaagcac

SEQ ID NO: 537153 - RNA, 14 nt, Homo sapiens
uggaaaaugugacc

SEQ ID NO: 537154 - RNA, 15 nt, Homo sapiens
uggaaaaugugcaau

SEQ ID NO: 537155 - RNA, 23 nt, Homo sapiens
uggaaacacccacucacuuugca

SEQ ID NO: 537156 - RNA, 14 nt, Homo sapiens
uggaaacaggacca

SEQ ID NO: 537157 - RNA, 22 nt, Homo sapiens
uggaaaccaaggaaagugaaac

SEQ ID NO: 537158 - RNA, 20 nt, Homo sapiens
uggaaaccucuggaggucau

SEQ ID NO: 537159 - RNA, 12 nt, Homo sapiens
uggaaacuaaga

SEQ ID NO: 537160 - RNA, 23 nt, Homo sapiens
uggaaacuaguggcaauauccaa

SEQ ID NO: 537161 - RNA, 17 nt, Homo sapiens
uggaaagaaaaagcaau

SEQ ID NO: 537162 - RNA, 16 nt, Homo sapiens
uggaaagacugggaca

SEQ ID NO: 537163 - RNA, 21 nt, Homo sapiens
uggaaagcagguggcaucucu

SEQ ID NO: 537164 - RNA, 22 nt, Homo sapiens
uggaaagcaucaccucaggcca

SEQ ID NO: 537165 - RNA, 16 nt, Homo sapiens
uggaaagcgccccuca

SEQ ID NO: 537166 - RNA, 19 nt, Homo sapiens
uggaaagcggcuagguuuu

SEQ ID NO: 537167 - RNA, 15 nt, Homo sapiens
uggaaagugauguca

SEQ ID NO: 537168 - RNA, 18 nt, Homo sapiens
uggaaagugcucagugaa

SEQ ID NO: 537169 - RNA, 22 nt, Homo sapiens
uggaaauagaaagaagccauau

SEQ ID NO: 537170 - RNA, 17 nt, Homo sapiens
uggaaaucaacccucuc

SEQ ID NO: 537171 - RNA, 13 nt, Homo sapiens
uggaaaucugcca

SEQ ID NO: 537172 - RNA, 23 nt, Homo sapiens
uggaaaugaaacugcugugaaug

SEQ ID NO: 537173 - RNA, 17 nt, Homo sapiens
uggaaaugaccaggcca

SEQ ID NO: 537174 - RNA, 19 nt, Homo sapiens
uggaaaugcugacuuuuaa

SEQ ID NO: 537175 - RNA, 17 nt, Homo sapiens
uggaacaagacagccuu

SEQ ID NO: 537176 - RNA, 16 nt, Homo sapiens
uggaacaagcacagau

SEQ ID NO: 537177 - RNA, 21 nt, Homo sapiens
uggaacagcgggagaccugug

SEQ ID NO: 537178 - RNA, 20 nt, Homo sapiens
uggaacauauagaaugcaga

SEQ ID NO: 537179 - RNA, 15 nt, Homo sapiens
uggaacauaugcaca

SEQ ID NO: 537180 - RNA, 16 nt, Homo sapiens
uggaacauaugcacag

SEQ ID NO: 537181 - RNA, 23 nt, Homo sapiens
uggaacaugcccacaacuuguca

SEQ ID NO: 537182 - RNA, 12 nt, Homo sapiens
uggaacauuucu

SEQ ID NO: 537183 - RNA, 23 nt, Homo sapiens
uggaaccaacacuaacauauaau

SEQ ID NO: 537184 - RNA, 16 nt, Homo sapiens
uggaacccccaucucu

SEQ ID NO: 537185 - RNA, 17 nt, Homo sapiens
uggaacuacauuacugu

SEQ ID NO: 537186 - RNA, 15 nt, Homo sapiens
uggaacuguccuucc

SEQ ID NO: 537187 - RNA, 15 nt, Homo sapiens
uggaacuucuaauau

SEQ ID NO: 537188 - RNA, 22 nt, Homo sapiens
uggaagaaaaaaaccacacaaa

SEQ ID NO: 537189 - RNA, 19 nt, Homo sapiens
uggaagaaauggcuaugaa

SEQ ID NO: 537190 - RNA, 12 nt, Homo sapiens
uggaagaaggga

SEQ ID NO: 537191 - RNA, 13 nt, Homo sapiens
uggaagacacuuc

SEQ ID NO: 537192 - RNA, 21 nt, Homo sapiens
gugaagacuugauuguacaaa

SEQ ID NO: 537193 - RNA, 19 nt, Homo sapiens
gugaagaguuucacaaauc

SEQ ID NO: 537194 - RNA, 18 nt, Homo sapiens
gugaagcagucagcccuu

SEQ ID NO: 537195 - RNA, 12 nt, Homo sapiens
gugaagcauuua

SEQ ID NO: 537196 - RNA, 11 nt, Homo sapiens
gugaagccaug

SEQ ID NO: 537197 - RNA, 14 nt, Homo sapiens
gugaagcuaauaca

SEQ ID NO: 537198 - RNA, 11 nt, Homo sapiens
gugaaggaaua

SEQ ID NO: 537199 - RNA, 19 nt, Homo sapiens
gugaagucgagcacucuaa

SEQ ID NO: 537200 - RNA, 16 nt, Homo sapiens
gugaauaaaccaucau

SEQ ID NO: 537201 - RNA, 21 nt, Homo sapiens
gugaauacucuucccacauac

SEQ ID NO: 537202 - RNA, 20 nt, Homo sapiens
gugaauacuugaacucuguu

SEQ ID NO: 537203 - RNA, 14 nt, Homo sapiens
gugaaucagacccu

SEQ ID NO: 537204 - RNA, 16 nt, Homo sapiens
gugaaugaacacucuu

SEQ ID NO: 537205 - RNA, 18 nt, Homo sapiens
gugaaugcacugugugau

SEQ ID NO: 537206 - RNA, 11 nt, Homo sapiens
gugaauuguga

SEQ ID NO: 537207 - RNA, 16 nt, Homo sapiens
gugaauuucacaagcu

SEQ ID NO: 537208 - RNA, 19 nt, Homo sapiens
gugacaaggccccagagac

SEQ ID NO: 537209 - RNA, 13 nt, Homo sapiens
gugacaaucugcc

SEQ ID NO: 537210 - RNA, 13 nt, Homo sapiens
gugacacagcagc

SEQ ID NO: 537211 - RNA, 13 nt, Homo sapiens
gugacacauugua

SEQ ID NO: 537212 - RNA, 12 nt, Homo sapiens
gugacaccucac

SEQ ID NO: 537213 - RNA, 20 nt, Homo sapiens
gugacagaccacaucuuuau

SEQ ID NO: 537214 - RNA, 23 nt, Homo sapiens
gugacagcuuucugggaugucac

SEQ ID NO: 537215 - RNA, 19 nt, Homo sapiens
gugacaguccuccauccac

SEQ ID NO: 537216 - RNA, 14 nt, Homo sapiens
gugacagugccugg

SEQ ID NO: 537217 - RNA, 19 nt, Homo sapiens
gugacauauauauguauau

SEQ ID NO: 537218 - RNA, 17 nt, Homo sapiens
gugacaugugcuggaca

SEQ ID NO: 537219 - RNA, 17 nt, Homo sapiens
gugacauuuccaugcau

SEQ ID NO: 537220 - RNA, 22 nt, Homo sapiens
gugaccaacuguuggauucaga

SEQ ID NO: 537221 - RNA, 23 nt, Homo sapiens
gugaccccugaccucacugugac

SEQ ID NO: 537222 - RNA, 16 nt, Homo sapiens
gugacccgaccuggcc

SEQ ID NO: 537223 - RNA, 14 nt, Homo sapiens
gugaccgacuaccc

SEQ ID NO: 537224 - RNA, 19 nt, Homo sapiens
gugacucagaugucucugg

SEQ ID NO: 537225 - RNA, 19 nt, Homo sapiens
gugacugaauucugccuug

SEQ ID NO: 537226 - RNA, 18 nt, Homo sapiens
gugacuucccuucuaacc

SEQ ID NO: 537227 - RNA, 19 nt, Homo sapiens
gugacuucuccaggucuca

SEQ ID NO: 537228 - RNA, 22 nt, Homo sapiens
gugacuuugagcugagugcuga

SEQ ID NO: 537229 - RNA, 20 nt, Homo sapiens
gugacuuuuuagccagugac

SEQ ID NO: 537230 - RNA, 16 nt, Homo sapiens
gugagaaaaggggcau

SEQ ID NO: 537231 - RNA, 13 nt, Homo sapiens
gugagaacaucau

SEQ ID NO: 537232 - RNA, 16 nt, Homo sapiens
gugagaccauguuuca

SEQ ID NO: 537233 - RNA, 13 nt, Homo sapiens
gugagaugcagcu

SEQ ID NO: 537234 - RNA, 14 nt, Homo sapiens
gugagaugcagcug

SEQ ID NO: 537235 - RNA, 14 nt, Homo sapiens
gugagccacugcgu

SEQ ID NO: 537236 - RNA, 15 nt, Homo sapiens
gugagccugggccag

SEQ ID NO: 537237 - RNA, 16 nt, Homo sapiens
gugagcggagaucgca

SEQ ID NO: 537238 - RNA, 19 nt, Homo sapiens
gugagcucaggccuaggug

SEQ ID NO: 537239 - RNA, 16 nt, Homo sapiens
gugagcucuuccagga

SEQ ID NO: 537240 - RNA, 13 nt, Homo sapiens
gugagcugucacu

SEQ ID NO: 537241 - RNA, 11 nt, Homo sapiens
gugaggacaaa

SEQ ID NO: 537242 - RNA, 17 nt, Homo sapiens
gugaggagguucacuga

SEQ ID NO: 537243 - RNA, 15 nt, Homo sapiens
gugaggcccauucuu

SEQ ID NO: 537244 - RNA, 12 nt, Homo sapiens
gugaggcucucu

SEQ ID NO: 537245 - RNA, 19 nt, Homo sapiens
gugagggcagcacugggaa

SEQ ID NO: 537246 - RNA, 16 nt, Homo sapiens
gugaggggcugugaca

SEQ ID NO: 537247 - RNA, 12 nt, Homo sapiens
gugagggguccc

SEQ ID NO: 537248 - RNA, 15 nt, Homo sapiens
gugagggugcugacu

SEQ ID NO: 537249 - RNA, 21 nt, Homo sapiens
gugagguucuuguaccacuuc

SEQ ID NO: 537250 - RNA, 18 nt, Homo sapiens
gugaguaagagcuggugu

SEQ ID NO: 537251 - RNA, 13 nt, Homo sapiens
gugagucaccugc

SEQ ID NO: 537252 - RNA, 19 nt, Homo sapiens
gugaguccccuacucccuc

SEQ ID NO: 537253 - RNA, 15 nt, Homo sapiens
gugaguccuguugaa

SEQ ID NO: 537254 - RNA, 21 nt, Homo sapiens
gugagucugguggaggagcug

SEQ ID NO: 537255 - RNA, 12 nt, Homo sapiens
gugagugcaagg

SEQ ID NO: 537256 - RNA, 19 nt, Homo sapiens
gugagugcuugucauggaa

SEQ ID NO: 537257 - RNA, 13 nt, Homo sapiens
gugagugugacag

SEQ ID NO: 537258 - RNA, 15 nt, Homo sapiens
gugagugugugcaag

SEQ ID NO: 537259 - RNA, 23 nt, Homo sapiens
gugauaaggggccuugcucugag

SEQ ID NO: 537260 - RNA, 23 nt, Homo sapiens
gugauacaacuucaagugcaugc

SEQ ID NO: 537261 - RNA, 13 nt, Homo sapiens
gugauacaaugcu

SEQ ID NO: 537262 - RNA, 13 nt, Homo sapiens
gugauauaugcau

SEQ ID NO: 537263 - RNA, 20 nt, Homo sapiens
uggauucuucccacacagaa

SEQ ID NO: 537264 - RNA, 12 nt, Homo sapiens
uggauugagggu

SEQ ID NO: 537265 - RNA, 13 nt, Homo sapiens
uggauugccacag

SEQ ID NO: 537266 - RNA, 21 nt, Homo sapiens
uggauuggguaugucuaccug

SEQ ID NO: 537267 - RNA, 18 nt, Homo sapiens
uggauuuauaaaugcuau

SEQ ID NO: 537268 - RNA, 23 nt, Homo sapiens
uggauuugaucacuacaaguauu

SEQ ID NO: 537269 - RNA, 14 nt, Homo sapiens
uggauuugauucau

SEQ ID NO: 537270 - RNA, 24 nt, Homo sapiens
uggauuugcaggugaacagccucc

SEQ ID NO: 537271 - RNA, 14 nt, Homo sapiens
uggauuuucuacug

SEQ ID NO: 537272 - RNA, 10 nt, Homo sapiens
uggcaaaaaa

SEQ ID NO: 537273 - RNA, 14 nt, Homo sapiens
uggcaaaagaguca

SEQ ID NO: 537274 - RNA, 22 nt, Homo sapiens
uggcaaaagccacauuacaagc

SEQ ID NO: 537275 - RNA, 13 nt, Homo sapiens
uggcaaacccucc

SEQ ID NO: 537276 - RNA, 19 nt, Homo sapiens
uggcaaacccucccagaaa

SEQ ID NO: 537277 - RNA, 19 nt, Homo sapiens
uggcaaacuucagacugaa

SEQ ID NO: 537278 - RNA, 23 nt, Homo sapiens
uggcaaagauuuuuggcacuuug

SEQ ID NO: 537279 - RNA, 18 nt, Homo sapiens
uggcaaaucaggggccag

SEQ ID NO: 537280 - RNA, 17 nt, Homo sapiens
uggcaaauggaggcuuu

SEQ ID NO: 537281 - RNA, 17 nt, Homo sapiens
uggcaaaugggcagcuc

SEQ ID NO: 537282 - RNA, 21 nt, Homo sapiens
uggcaacagagcgagauucca

SEQ ID NO: 537283 - RNA, 22 nt, Homo sapiens
uggcaaccugcuuucaagaccc

SEQ ID NO: 537284 - RNA, 14 nt, Homo sapiens
uggcaagaaagcuu

SEQ ID NO: 537285 - RNA, 12 nt, Homo sapiens
uggcaagcugca

SEQ ID NO: 537286 - RNA, 13 nt, Homo sapiens
uggcaagcugcag

SEQ ID NO: 537287 - RNA, 22 nt, Homo sapiens
uggcaagucaccugcagcccau

SEQ ID NO: 537288 - RNA, 19 nt, Homo sapiens
uggcaauaaacuccuacua

SEQ ID NO: 537289 - RNA, 15 nt, Homo sapiens
uggcaauacauuuga

SEQ ID NO: 537290 - RNA, 14 nt, Homo sapiens
uggcaauugcacuc

SEQ ID NO: 537291 - RNA, 21 nt, Homo sapiens
uggcacaaaaacacacguaga

SEQ ID NO: 537292 - RNA, 12 nt, Homo sapiens
uggcaccagcag

SEQ ID NO: 537293 - RNA, 16 nt, Homo sapiens
uggcaccccuuucuag

SEQ ID NO: 537294 - RNA, 16 nt, Homo sapiens
uggcaccuucagacuu

SEQ ID NO: 537295 - RNA, 21 nt, Homo sapiens
uggcacuaaagaauacauuua

SEQ ID NO: 537296 - RNA, 13 nt, Homo sapiens
uggcacugagaaa

SEQ ID NO: 537297 - RNA, 19 nt, Homo sapiens
uggcacugagaaacaugca

SEQ ID NO: 537298 - RNA, 13 nt, Homo sapiens
uggcacugcauac

SEQ ID NO: 537299 - RNA, 16 nt, Homo sapiens
uggcacuggaugcaga

SEQ ID NO: 537300 - RNA, 19 nt, Homo sapiens
uggcacuuaagugcacuuu

SEQ ID NO: 537301 - RNA, 11 nt, Homo sapiens
uggcacuuuga

SEQ ID NO: 537302 - RNA, 14 nt, Homo sapiens
uggcagaaagggaa

SEQ ID NO: 537303 - RNA, 14 nt, Homo sapiens
uggcagauuuuaca

SEQ ID NO: 537304 - RNA, 14 nt, Homo sapiens
uggcagccaguacc

SEQ ID NO: 537305 - RNA, 17 nt, Homo sapiens
uggcagcgcggggagcc

SEQ ID NO: 537306 - RNA, 17 nt, Homo sapiens
uggcagcuagugccuuu

SEQ ID NO: 537307 - RNA, 14 nt, Homo sapiens
uggcagcucuccag

SEQ ID NO: 537308 - RNA, 20 nt, Homo sapiens
uggcagcuguuucucaugaa

SEQ ID NO: 537309 - RNA, 16 nt, Homo sapiens
uggcaggaugaugcug

SEQ ID NO: 537310 - RNA, 11 nt, Homo sapiens
uggcagggaua

SEQ ID NO: 537311 - RNA, 13 nt, Homo sapiens
uggcaggugcaga

SEQ ID NO: 537312 - RNA, 14 nt, Homo sapiens
uggcaggugccuug

SEQ ID NO: 537313 - RNA, 17 nt, Homo sapiens
uggcagucugcccugca

SEQ ID NO: 537314 - RNA, 14 nt, Homo sapiens
uggcaguggacuca

SEQ ID NO: 537315 - RNA, 18 nt, Homo sapiens
uggcaguguggacaugag

SEQ ID NO: 537316 - RNA, 21 nt, Homo sapiens
uggcaguucucgcagauguua

SEQ ID NO: 537317 - RNA, 19 nt, Homo sapiens
uggcauagcccauguuaag

SEQ ID NO: 537318 - RNA, 14 nt, Homo sapiens
guggcagucgcagg

SEQ ID NO: 537319 - RNA, 15 nt, Homo sapiens
guggcaucuugccaa

SEQ ID NO: 537320 - RNA, 14 nt, Homo sapiens
guggcaugugcugu

SEQ ID NO: 537321 - RNA, 23 nt, Homo sapiens
guggccaaggagcugcuauagcc

SEQ ID NO: 537322 - RNA, 14 nt, Homo sapiens
guggccacuaagca

SEQ ID NO: 537323 - RNA, 14 nt, Homo sapiens
guggcccaagacaa

SEQ ID NO: 537324 - RNA, 19 nt, Homo sapiens
guggcccagggaagccaaa

SEQ ID NO: 537325 - RNA, 15 nt, Homo sapiens
guggcccguggcuug

SEQ ID NO: 537326 - RNA, 21 nt, Homo sapiens
guggccucaacccucccucag

SEQ ID NO: 537327 - RNA, 19 nt, Homo sapiens
guggccucagcccucagaa

SEQ ID NO: 537328 - RNA, 23 nt, Homo sapiens
guggccuccuggcccgcccucac

SEQ ID NO: 537329 - RNA, 20 nt, Homo sapiens
guggccucugcaggccuagg

SEQ ID NO: 537330 - RNA, 15 nt, Homo sapiens
guggcgugagcugcc

SEQ ID NO: 537331 - RNA, 22 nt, Homo sapiens
guggcucaugccuguaauccca

SEQ ID NO: 537332 - RNA, 17 nt, Homo sapiens
guggcuccuaucugugu

SEQ ID NO: 537333 - RNA, 20 nt, Homo sapiens
guggcugccccggccuccuc

SEQ ID NO: 537334 - RNA, 21 nt, Homo sapiens
guggcuggcucuaccuuccug

SEQ ID NO: 537335 - RNA, 21 nt, Homo sapiens
guggcuggggaggcccuggca

SEQ ID NO: 537336 - RNA, 17 nt, Homo sapiens
guggcuggugcccauga

SEQ ID NO: 537337 - RNA, 18 nt, Homo sapiens
guggcuucccgcucagcc

SEQ ID NO: 537338 - RNA, 16 nt, Homo sapiens
gugggacugacauuuc

SEQ ID NO: 537339 - RNA, 13 nt, Homo sapiens
gugggagcagcuu

SEQ ID NO: 537340 - RNA, 20 nt, Homo sapiens
gugggaggguaccagcagaa

SEQ ID NO: 537341 - RNA, 15 nt, Homo sapiens
gugggcagguggugg

SEQ ID NO: 537342 - RNA, 12 nt, Homo sapiens
gugggcagucac

SEQ ID NO: 537343 - RNA, 21 nt, Homo sapiens
gugggcccccaaugacaccca

SEQ ID NO: 537344 - RNA, 20 nt, Homo sapiens
gugggccucaaggacuugaa

SEQ ID NO: 537345 - RNA, 14 nt, Homo sapiens
gugggccuggcaca

SEQ ID NO: 537346 - RNA, 15 nt, Homo sapiens
gugggccuggcagga

SEQ ID NO: 537347 - RNA, 21 nt, Homo sapiens
gugggcucugugcagucacug

SEQ ID NO: 537348 - RNA, 23 nt, Homo sapiens
gugggcucugugcagucacugga

SEQ ID NO: 537349 - RNA, 17 nt, Homo sapiens
gugggcugcugcaguga

SEQ ID NO: 537350 - RNA, 21 nt, Homo sapiens
gugggcuguguugacugcugc

SEQ ID NO: 537351 - RNA, 18 nt, Homo sapiens
guggggaaggaggccaag

SEQ ID NO: 537352 - RNA, 14 nt, Homo sapiens
guggggaaggggug

SEQ ID NO: 537353 - RNA, 15 nt, Homo sapiens
guggggcauguccuc

SEQ ID NO: 537354 - RNA, 17 nt, Homo sapiens
guggggcucaaaaccuc

SEQ ID NO: 537355 - RNA, 20 nt, Homo sapiens
guggggggugacagugccuu

SEQ ID NO: 537356 - RNA, 13 nt, Homo sapiens
guggggugcacuc

SEQ ID NO: 537357 - RNA, 13 nt, Homo sapiens
gugggguggcacc

SEQ ID NO: 537358 - RNA, 22 nt, Homo sapiens
guggguauugagugugauuuga

SEQ ID NO: 537359 - RNA, 22 nt, Homo sapiens
gugggucuaccucaucucugaa

SEQ ID NO: 537360 - RNA, 22 nt, Homo sapiens
gugggugcagcugucacagccc

SEQ ID NO: 537361 - RNA, 22 nt, Homo sapiens
gugggugccccccuugccagac

SEQ ID NO: 537362 - RNA, 19 nt, Homo sapiens
gugggugcugccaugacag

SEQ ID NO: 537363 - RNA, 11 nt, Homo sapiens
guggguggugg

SEQ ID NO: 537364 - RNA, 16 nt, Homo sapiens
gugguaaauacuguga

SEQ ID NO: 537365 - RNA, 13 nt, Homo sapiens
gugguacaggaag

SEQ ID NO: 537366 - RNA, 21 nt, Homo sapiens
gugguagagaagcaaguaaaa

SEQ ID NO: 537367 - RNA, 13 nt, Homo sapiens
gugguaugaaaug

SEQ ID NO: 537368 - RNA, 16 nt, Homo sapiens
gugguccccguuccac

SEQ ID NO: 537369 - RNA, 22 nt, Homo sapiens
guggucuaagguucagccugaa

SEQ ID NO: 537370 - RNA, 14 nt, Homo sapiens
guggugacaccucc

SEQ ID NO: 537371 - RNA, 13 nt, Homo sapiens
gugguggcacuga

SEQ ID NO: 537372 - RNA, 23 nt, Homo sapiens
gugguggcauacgccuguagucc

SEQ ID NO: 537373 - RNA, 21 nt, Homo sapiens
guggugggggaggagccucug

SEQ ID NO: 537374 - RNA, 14 nt, Homo sapiens
gugguggucuucaa

SEQ ID NO: 537375 - RNA, 14 nt, Homo sapiens
gugguuccaugcag

SEQ ID NO: 537376 - RNA, 21 nt, Homo sapiens
gugguuccucccucuccugaa

SEQ ID NO: 537377 - RNA, 17 nt, Homo sapiens
gugguuccucugcucac

SEQ ID NO: 537378 - RNA, 17 nt, Homo sapiens
gugguucuaucaggggu

SEQ ID NO: 537379 - RNA, 13 nt, Homo sapiens
gugguugcuguug

SEQ ID NO: 537380 - RNA, 16 nt, Homo sapiens
gugguuucuacuuccc

SEQ ID NO: 537381 - RNA, 22 nt, Homo sapiens
gugguuuuguuuguuucuuuga

SEQ ID NO: 537382 - RNA, 18 nt, Homo sapiens
guguaaaauacguuugaa

SEQ ID NO: 537383 - RNA, 13 nt, Homo sapiens
guguaaaccaaag

SEQ ID NO: 537384 - RNA, 13 nt, Homo sapiens
guguaaauugcac

SEQ ID NO: 537385 - RNA, 14 nt, Homo sapiens
ugugguuccucugc

SEQ ID NO: 537386 - RNA, 13 nt, Homo sapiens
ugugguugcucac

SEQ ID NO: 537387 - RNA, 19 nt, Homo sapiens
ugugguuucagaugugcaa

SEQ ID NO: 537388 - RNA, 20 nt, Homo sapiens
uguguaaauaauuugcacug

SEQ ID NO: 537389 - RNA, 22 nt, Homo sapiens
uguguaauaaauauguuucaca

SEQ ID NO: 537390 - RNA, 16 nt, Homo sapiens
uguguaauuagugcca

SEQ ID NO: 537391 - RNA, 22 nt, Homo sapiens
uguguaauuuuuuuuccuugcc

SEQ ID NO: 537392 - RNA, 23 nt, Homo sapiens
uguguaauuuuuuuuccuugccu

SEQ ID NO: 537393 - RNA, 22 nt, Homo sapiens
uguguacucuuuauuucuagca

SEQ ID NO: 537394 - RNA, 18 nt, Homo sapiens
uguguagacuguaacuuu

SEQ ID NO: 537395 - RNA, 21 nt, Homo sapiens
uguguagccuucuccccaaca

SEQ ID NO: 537396 - RNA, 13 nt, Homo sapiens
uguguagcuccca

SEQ ID NO: 537397 - RNA, 18 nt, Homo sapiens
uguguagucaagucacca

SEQ ID NO: 537398 - RNA, 14 nt, Homo sapiens
uguguauacauaca

SEQ ID NO: 537399 - RNA, 20 nt, Homo sapiens
uguguauauaaauacaugca

SEQ ID NO: 537400 - RNA, 22 nt, Homo sapiens
uguguauauauaguagcauuuc

SEQ ID NO: 537401 - RNA, 23 nt, Homo sapiens
uguguauccaugcaccuaccuua

SEQ ID NO: 537402 - RNA, 13 nt, Homo sapiens
uguguaugcaagu

SEQ ID NO: 537403 - RNA, 9 nt, Homo sapiens
uguguaugu

SEQ ID NO: 537404 - RNA, 17 nt, Homo sapiens
uguguauucuagugaau

SEQ ID NO: 537405 - RNA, 24 nt, Homo sapiens
uguguauuuccagugcaauuguag

SEQ ID NO: 537406 - RNA, 20 nt, Homo sapiens
uguguauuuucuuugggggu

SEQ ID NO: 537407 - RNA, 12 nt, Homo sapiens
ugugucagcaua

SEQ ID NO: 537408 - RNA, 16 nt, Homo sapiens
ugugucagccaugacc

SEQ ID NO: 537409 - RNA, 16 nt, Homo sapiens
ugugucaguggaugcu

SEQ ID NO: 537410 - RNA, 16 nt, Homo sapiens
ugugucauagaauuaa

SEQ ID NO: 537411 - RNA, 17 nt, Homo sapiens
ugugucauuccaaauaa

SEQ ID NO: 537412 - RNA, 19 nt, Homo sapiens
uguguccaagugugugugc

SEQ ID NO: 537413 - RNA, 20 nt, Homo sapiens
uguguccacaguugagaggu

SEQ ID NO: 537414 - RNA, 17 nt, Homo sapiens
uguguccaugugugugc

SEQ ID NO: 537415 - RNA, 22 nt, Homo sapiens
uguguccccucacucugucagc

SEQ ID NO: 537416 - RNA, 21 nt, Homo sapiens
ugugucccgaauccacagucg

SEQ ID NO: 537417 - RNA, 22 nt, Homo sapiens
uguguccgcccccgauggagga

SEQ ID NO: 537418 - RNA, 18 nt, Homo sapiens
uguguccuaugcgcucau

SEQ ID NO: 537419 - RNA, 12 nt, Homo sapiens
uguguccucuaa

SEQ ID NO: 537420 - RNA, 18 nt, Homo sapiens
uguguccugaaacgcucc

SEQ ID NO: 537421 - RNA, 21 nt, Homo sapiens
uguguccuggggacuuccuca

SEQ ID NO: 537422 - RNA, 22 nt, Homo sapiens
ugugucuaucugcuuuugccua

SEQ ID NO: 537423 - RNA, 11 nt, Homo sapiens
ugugucugcug

SEQ ID NO: 537424 - RNA, 14 nt, Homo sapiens
ugugugacuccauu

SEQ ID NO: 537425 - RNA, 22 nt, Homo sapiens
ugugugacuuacagaaacugca

SEQ ID NO: 537426 - RNA, 15 nt, Homo sapiens
ugugugaguguacca

SEQ ID NO: 537427 - RNA, 20 nt, Homo sapiens
ugugugcaagugugugcaca

SEQ ID NO: 537428 - RNA, 23 nt, Homo sapiens
ugugugcaagugugugcaugugu

SEQ ID NO: 537429 - RNA, 15 nt, Homo sapiens
uguguggccugccuu

SEQ ID NO: 537430 - RNA, 17 nt, Homo sapiens
uguguggggugggcaca

SEQ ID NO: 537431 - RNA, 11 nt, Homo sapiens
uguguggugga

SEQ ID NO: 537432 - RNA, 14 nt, Homo sapiens
ugugugguggagcc

SEQ ID NO: 537433 - RNA, 18 nt, Homo sapiens
uguguguauguuugcaca

SEQ ID NO: 537434 - RNA, 16 nt, Homo sapiens
ugugugugcguguguc

SEQ ID NO: 537435 - RNA, 14 nt, Homo sapiens
ugugugugugcuga

SEQ ID NO: 537436 - RNA, 16 nt, Homo sapiens
uguguguguguauaca

SEQ ID NO: 537437 - RNA, 19 nt, Homo sapiens
uguguuauuuaaugaguca

SEQ ID NO: 537438 - RNA, 19 nt, Homo sapiens
uguguucucuauugcugcu

SEQ ID NO: 537439 - RNA, 14 nt, Homo sapiens
uguguucuguagag

SEQ ID NO: 537440 - RNA, 13 nt, Homo sapiens
uguguucugucac

SEQ ID NO: 537441 - RNA, 15 nt, Homo sapiens
uguguuuaacauuca

SEQ ID NO: 537442 - RNA, 16 nt, Homo sapiens
uguguuuaacauucac

SEQ ID NO: 537443 - RNA, 15 nt, Homo sapiens
uguguuucugacaca

SEQ ID NO: 537444 - RNA, 17 nt, Homo sapiens
uguguuuggaagacuau

SEQ ID NO: 537445 - RNA, 19 nt, Homo sapiens
uguguuuuaaaaaaacuga

SEQ ID NO: 537446 - RNA, 14 nt, Homo sapiens
uguguuuuuaauaa

SEQ ID NO: 537447 - RNA, 20 nt, Homo sapiens
uguuaaaacaaccaguuaaa

SEQ ID NO: 537448 - RNA, 14 nt, Homo sapiens
uguuaaagcuauuu

SEQ ID NO: 537449 - RNA, 21 nt, Homo sapiens
uguuaacacucaugaagcaua

SEQ ID NO: 537450 - RNA, 23 nt, Homo sapiens
uguuaaccucugcuuuuaucuca

SEQ ID NO: 537451 - RNA, 16 nt, Homo sapiens
uguuaacuaaauaacu

SEQ ID NO: 537452 - RNA, 18 nt, Homo sapiens
uguuaacuuuguggucua

SEQ ID NO: 537453 - RNA, 21 nt, Homo sapiens
uguuaacuuuuguaccaaaua

SEQ ID NO: 537454 - RNA, 18 nt, Homo sapiens
uguuaagauaugcacagu

SEQ ID NO: 537455 - RNA, 19 nt, Homo sapiens
uguuaaggagcuucaggga

SEQ ID NO: 537456 - RNA, 18 nt, Homo sapiens
uguuaaggcaacauuccu

SEQ ID NO: 537457 - RNA, 21 nt, Homo sapiens
uguuaagugccauuacuacug

SEQ ID NO: 537458 - RNA, 19 nt, Homo sapiens
uaagaguguuuaauggcaa

SEQ ID NO: 537459 - RNA, 16 nt, Homo sapiens
uaagauagaacacaaa

SEQ ID NO: 537460 - RNA, 17 nt, Homo sapiens
uaagauauauacaugga

SEQ ID NO: 537461 - RNA, 22 nt, Homo sapiens
uaagauauauaugugcucuuaa

SEQ ID NO: 537462 - RNA, 19 nt, Homo sapiens
uaagauaugcacagucuau

SEQ ID NO: 537463 - RNA, 19 nt, Homo sapiens
uaagauccacaaaugaagg

SEQ ID NO: 537464 - RNA, 19 nt, Homo sapiens
uaagaucucgguuugccaa

SEQ ID NO: 537465 - RNA, 21 nt, Homo sapiens
uaagaucucuuuguagccauc

SEQ ID NO: 537466 - RNA, 20 nt, Homo sapiens
uaagaugaaaugcacuguau

SEQ ID NO: 537467 - RNA, 13 nt, Homo sapiens
uaagaugaucauc

SEQ ID NO: 537468 - RNA, 17 nt, Homo sapiens
uaagaugaucaucucca

SEQ ID NO: 537469 - RNA, 15 nt, Homo sapiens
uaagauguacauuua

SEQ ID NO: 537470 - RNA, 16 nt, Homo sapiens
uaagauuaauuuucuc

SEQ ID NO: 537471 - RNA, 14 nt, Homo sapiens
uaagauuuuccauu

SEQ ID NO: 537472 - RNA, 11 nt, Homo sapiens
uaagcaaaaac

SEQ ID NO: 537473 - RNA, 14 nt, Homo sapiens
uaagcaaaaugcca

SEQ ID NO: 537474 - RNA, 16 nt, Homo sapiens
uaagcaaaaugccaaa

SEQ ID NO: 537475 - RNA, 17 nt, Homo sapiens
uaagcaacuugcuucua

SEQ ID NO: 537476 - RNA, 15 nt, Homo sapiens
uaagcaagagacaau

SEQ ID NO: 537477 - RNA, 15 nt, Homo sapiens
uaagcaauaccagca

SEQ ID NO: 537478 - RNA, 15 nt, Homo sapiens
uaagcagaagcacau

SEQ ID NO: 537479 - RNA, 23 nt, Homo sapiens
uaagcagacccauaccuuuccag

SEQ ID NO: 537480 - RNA, 12 nt, Homo sapiens
uaagcagucuca

SEQ ID NO: 537481 - RNA, 13 nt, Homo sapiens
uaagcaguggcau

SEQ ID NO: 537482 - RNA, 16 nt, Homo sapiens
uaagcauacaacugga

SEQ ID NO: 537483 - RNA, 22 nt, Homo sapiens
uaagcaucaaauauuugugcaa

SEQ ID NO: 537484 - RNA, 14 nt, Homo sapiens
uaagcaucugccau

SEQ ID NO: 537485 - RNA, 21 nt, Homo sapiens
uaagcaucugccaucugcuuu

SEQ ID NO: 537486 - RNA, 17 nt, Homo sapiens
uaagcauggauuuuccc

SEQ ID NO: 537487 - RNA, 20 nt, Homo sapiens
uaagcauuugaguuugcaaa

SEQ ID NO: 537488 - RNA, 20 nt, Homo sapiens
uaagccacucuuccaaaggc

SEQ ID NO: 537489 - RNA, 19 nt, Homo sapiens
uaagccauaggcccaggau

SEQ ID NO: 537490 - RNA, 22 nt, Homo sapiens
uaagcccggauagacuuauugc

SEQ ID NO: 537491 - RNA, 21 nt, Homo sapiens
uaagccuaguugcugaaauuu

SEQ ID NO: 537492 - RNA, 20 nt, Homo sapiens
uaagccugcauucuuaacaa

SEQ ID NO: 537493 - RNA, 14 nt, Homo sapiens
uaagcgauccuccu

SEQ ID NO: 537494 - RNA, 14 nt, Homo sapiens
uaagcuaagccuua

SEQ ID NO: 537495 - RNA, 16 nt, Homo sapiens
uaagcuaucagcaaua

SEQ ID NO: 537496 - RNA, 21 nt, Homo sapiens
uaagcuaucagcaauacucau

SEQ ID NO: 537497 - RNA, 16 nt, Homo sapiens
uaagcuaucuucaaau

SEQ ID NO: 537498 - RNA, 21 nt, Homo sapiens
uaagcuaucuucaaaugucua

SEQ ID NO: 537499 - RNA, 20 nt, Homo sapiens
uaagcucaauuuaauuuugc

SEQ ID NO: 537500 - RNA, 14 nt, Homo sapiens
uaagcucgagugaa

SEQ ID NO: 537501 - RNA, 17 nt, Homo sapiens
uaagcucgagugaauuu

SEQ ID NO: 537502 - RNA, 20 nt, Homo sapiens
uaagcuguggcuggaauuga

SEQ ID NO: 537503 - RNA, 20 nt, Homo sapiens
uaagcuucaaagcugcuuua

SEQ ID NO: 537504 - RNA, 22 nt, Homo sapiens
uaaggaaacacuucuauuuaau

SEQ ID NO: 537505 - RNA, 15 nt, Homo sapiens
uaaggaacaaaucuc

SEQ ID NO: 537506 - RNA, 17 nt, Homo sapiens
uaauuuauuuuguccau

SEQ ID NO: 537507 - RNA, 12 nt, Homo sapiens
uaauuucagggu

SEQ ID NO: 537508 - RNA, 18 nt, Homo sapiens
uaauuucagggugcagcc

SEQ ID NO: 537509 - RNA, 17 nt, Homo sapiens
uaauuuccauaguguga

SEQ ID NO: 537510 - RNA, 21 nt, Homo sapiens
uaauuuccuuuuugacacuga

SEQ ID NO: 537511 - RNA, 20 nt, Homo sapiens
uaauuucuacucugucuuaa

SEQ ID NO: 537512 - RNA, 18 nt, Homo sapiens
uaauuucugucaaaugca

SEQ ID NO: 537513 - RNA, 13 nt, Homo sapiens
uaauuugccacag

SEQ ID NO: 537514 - RNA, 18 nt, Homo sapiens
uaauuugcugguguuuua

SEQ ID NO: 537515 - RNA, 15 nt, Homo sapiens
uaauuuucagccaug

SEQ ID NO: 537516 - RNA, 18 nt, Homo sapiens
uaauuuugagggcaugaa

SEQ ID NO: 537517 - RNA, 17 nt, Homo sapiens
uaauuuugcuugcugaa

SEQ ID NO: 537518 - RNA, 19 nt, Homo sapiens
uaauuuuguacauacugua

SEQ ID NO: 537519 - RNA, 16 nt, Homo sapiens
uaauuuugugcauucu

SEQ ID NO: 537520 - RNA, 20 nt, Homo sapiens
uaauuuuuaaggauguugcc

SEQ ID NO: 537521 - RNA, 18 nt, Homo sapiens
uaauuuuuguacauccca

SEQ ID NO: 537522 - RNA, 19 nt, Homo sapiens
uaauuuuuuguacuuuuag

SEQ ID NO: 537523 - RNA, 15 nt, Homo sapiens
uacaaaaaacaacaa

SEQ ID NO: 537524 - RNA, 13 nt, Homo sapiens
uacaaaaagucaa

SEQ ID NO: 537525 - RNA, 20 nt, Homo sapiens
uacaaaaauuagcugggcau

SEQ ID NO: 537526 - RNA, 22 nt, Homo sapiens
uacaaaacaaacucauucauua

SEQ ID NO: 537527 - RNA, 18 nt, Homo sapiens
uacaaaagauguauccuu

SEQ ID NO: 537528 - RNA, 15 nt, Homo sapiens
uacaaaagcauguga

SEQ ID NO: 537529 - RNA, 16 nt, Homo sapiens
uacaaaagcuuugaau

SEQ ID NO: 537530 - RNA, 20 nt, Homo sapiens
uacaaaauccagcuaugaau

SEQ ID NO: 537531 - RNA, 16 nt, Homo sapiens
uacaaaccuaccaaaa

SEQ ID NO: 537532 - RNA, 19 nt, Homo sapiens
uacaaaccugcaugguguu

SEQ ID NO: 537533 - RNA, 11 nt, Homo sapiens
uacaaacucau

SEQ ID NO: 537534 - RNA, 20 nt, Homo sapiens
uacaaagggccaucguucau

SEQ ID NO: 537535 - RNA, 19 nt, Homo sapiens
uacaaagguugcagugcug

SEQ ID NO: 537536 - RNA, 20 nt, Homo sapiens
uacaaaguuauauucacagu

SEQ ID NO: 537537 - RNA, 13 nt, Homo sapiens
uacaaaguuucaa

SEQ ID NO: 537538 - RNA, 18 nt, Homo sapiens
uacaaaugugaaacggaa

SEQ ID NO: 537539 - RNA, 15 nt, Homo sapiens
uacaacacacacugu

SEQ ID NO: 537540 - RNA, 11 nt, Homo sapiens
uacaacacuga

SEQ ID NO: 537541 - RNA, 12 nt, Homo sapiens
uacaacauguga

SEQ ID NO: 537542 - RNA, 11 nt, Homo sapiens
uacaaccagcc

SEQ ID NO: 537543 - RNA, 21 nt, Homo sapiens
uacaacgauuguauuugugac

SEQ ID NO: 537544 - RNA, 20 nt, Homo sapiens
uacaacgccgagugcacugc

SEQ ID NO: 537545 - RNA, 22 nt, Homo sapiens
uacaacgccgagugcacugcau

SEQ ID NO: 537546 - RNA, 17 nt, Homo sapiens
uacaacucggggacaaa

SEQ ID NO: 537547 - RNA, 20 nt, Homo sapiens
uacaacugcaccugucauca

SEQ ID NO: 537548 - RNA, 22 nt, Homo sapiens
uacaagaaaaaaugaauuuugu

SEQ ID NO: 537549 - RNA, 12 nt, Homo sapiens
uacaagaacaau

SEQ ID NO: 537550 - RNA, 22 nt, Homo sapiens
uacaagaacaaugacaccacac

SEQ ID NO: 537551 - RNA, 17 nt, Homo sapiens
uacaagacacagugacc

SEQ ID NO: 537552 - RNA, 19 nt, Homo sapiens
uacaagauucucugauacc

SEQ ID NO: 537553 - RNA, 20 nt, Homo sapiens
uacaaggccccaagguuuac

SEQ ID NO: 537554 - RNA, 20 nt, Homo sapiens
uacaaggcuuuaucucaggg

SEQ ID NO: 537555 - RNA, 18 nt, Homo sapiens
uacaaguuugcuaaaaga

SEQ ID NO: 537556 - RNA, 18 nt, Homo sapiens
uacaauaaaaacauugcc

SEQ ID NO: 537557 - RNA, 17 nt, Homo sapiens
uacaauaaaaagaaauu

SEQ ID NO: 537558 - RNA, 20 nt, Homo sapiens
uacaauaaaaccuuugccac

SEQ ID NO: 537559 - RNA, 23 nt, Homo sapiens
uacaauaacauaauuuguacaua

SEQ ID NO: 537560 - RNA, 18 nt, Homo sapiens
uacaauauuaaguccaaa

SEQ ID NO: 537561 - RNA, 20 nt, Homo sapiens
uacaaucagccacauucuag

SEQ ID NO: 537562 - RNA, 23 nt, Homo sapiens
uacaaucaugaacagcucugaga

SEQ ID NO: 537563 - RNA, 15 nt, Homo sapiens
uacaaucauugcuga

SEQ ID NO: 537564 - RNA, 19 nt, Homo sapiens
uacaaugacuuuauugcau

SEQ ID NO: 537565 - RNA, 17 nt, Homo sapiens
uacaauuaauaguuugu

SEQ ID NO: 537566 - RNA, 21 nt, Homo sapiens
uacaauuaugucucuugagca

SEQ ID NO: 537567 - RNA, 22 nt, Homo sapiens
uacaauugcaguuuugccuaau

SEQ ID NO: 537568 - RNA, 11 nt, Homo sapiens
uacaauuguga

SEQ ID NO: 537569 - RNA, 12 nt, Homo sapiens
uacaauugugag

SEQ ID NO: 537570 - RNA, 17 nt, Homo sapiens
uacaauuuacaaagugu

SEQ ID NO: 537571 - RNA, 22 nt, Homo sapiens
uacacaaauuauaagcauacaa

SEQ ID NO: 537572 - RNA, 14 nt, Homo sapiens
uacacaacuuugca

SEQ ID NO: 537573 - RNA, 15 nt, Homo sapiens
uacacaacuuugcaa

SEQ ID NO: 537574 - RNA, 17 nt, Homo sapiens
uacacaagaaucuagaa

SEQ ID NO: 537575 - RNA, 15 nt, Homo sapiens
uacacaaggaaggca

SEQ ID NO: 537576 - RNA, 23 nt, Homo sapiens
uacacaaggaaggcauuuggacc

SEQ ID NO: 537577 - RNA, 23 nt, Homo sapiens
uacacaauuaauucaucccuuaa

SEQ ID NO: 537578 - RNA, 20 nt, Homo sapiens
uacacacacguugacgggcc

SEQ ID NO: 537579 - RNA, 21 nt, Homo sapiens
uacacacagccacgcugauaa

SEQ ID NO: 537580 - RNA, 18 nt, Homo sapiens
uacacacaguggauggac

SEQ ID NO: 537581 - RNA, 17 nt, Homo sapiens
uacacacauauacauau

SEQ ID NO: 537582 - RNA, 16 nt, Homo sapiens
uacacaccagggaaua

SEQ ID NO: 537583 - RNA, 22 nt, Homo sapiens
uacacacccgccugacaccgug

SEQ ID NO: 537584 - RNA, 16 nt, Homo sapiens
uuaaagcccuguguua

SEQ ID NO: 537585 - RNA, 18 nt, Homo sapiens
uuaaagcuguacacccca

SEQ ID NO: 537586 - RNA, 19 nt, Homo sapiens
uuaaaggaaaaucacaucu

SEQ ID NO: 537587 - RNA, 22 nt, Homo sapiens
uuaaaggaaaaucacaucucca

SEQ ID NO: 537588 - RNA, 20 nt, Homo sapiens
uuaaaggaacagagugagag

SEQ ID NO: 537589 - RNA, 19 nt, Homo sapiens
uuaaaggggguaugugaua

SEQ ID NO: 537590 - RNA, 16 nt, Homo sapiens
uuaaagguaugcauuu

SEQ ID NO: 537591 - RNA, 19 nt, Homo sapiens
uuaaaguaaugagcaugau

SEQ ID NO: 537592 - RNA, 18 nt, Homo sapiens
uuaaaguaccuguaguga

SEQ ID NO: 537593 - RNA, 15 nt, Homo sapiens
uuaaaguaugcaaaa

SEQ ID NO: 537594 - RNA, 16 nt, Homo sapiens
uuaaaguauucuucuc

SEQ ID NO: 537595 - RNA, 12 nt, Homo sapiens
uuaaagucagaa

SEQ ID NO: 537596 - RNA, 19 nt, Homo sapiens
uuaaaguggcagcuucacu

SEQ ID NO: 537597 - RNA, 14 nt, Homo sapiens
uuaaaguguaagaa

SEQ ID NO: 537598 - RNA, 15 nt, Homo sapiens
uuaaaguuacuuugu

SEQ ID NO: 537599 - RNA, 19 nt, Homo sapiens
uuaaaguuguuugugccuu

SEQ ID NO: 537600 - RNA, 15 nt, Homo sapiens
uuaaauaaaacuuuc

SEQ ID NO: 537601 - RNA, 19 nt, Homo sapiens
uuaaauaaaguuacuugaa

SEQ ID NO: 537602 - RNA, 20 nt, Homo sapiens
uuaaauaaugugaaacugga

SEQ ID NO: 537603 - RNA, 13 nt, Homo sapiens
uuaaauacuauua

SEQ ID NO: 537604 - RNA, 14 nt, Homo sapiens
uuaaauauauccca

SEQ ID NO: 537605 - RNA, 12 nt, Homo sapiens
uuaaauauuucc

SEQ ID NO: 537606 - RNA, 23 nt, Homo sapiens
uuaaaucaacuuuaucauaugcu

SEQ ID NO: 537607 - RNA, 19 nt, Homo sapiens
uuaaaucugugaugauccu

SEQ ID NO: 537608 - RNA, 20 nt, Homo sapiens
uuaaaugaaaguauuggcau

SEQ ID NO: 537609 - RNA, 19 nt, Homo sapiens
uuaaaugaauuuuucuucc

SEQ ID NO: 537610 - RNA, 15 nt, Homo sapiens
uuaaaugacagugaa

SEQ ID NO: 537611 - RNA, 15 nt, Homo sapiens
uuaaaugaucaugaa

SEQ ID NO: 537612 - RNA, 13 nt, Homo sapiens
uuaaaugcugcau

SEQ ID NO: 537613 - RNA, 14 nt, Homo sapiens
uuaaauggcuuuau

SEQ ID NO: 537614 - RNA, 15 nt, Homo sapiens
uuaaauggcuuuaug

SEQ ID NO: 537615 - RNA, 21 nt, Homo sapiens
uuaaaugguguuuuauuacaa

SEQ ID NO: 537616 - RNA, 15 nt, Homo sapiens
uuaaauguauagcug

SEQ ID NO: 537617 - RNA, 17 nt, Homo sapiens
uuaaaugugaauuucaa

SEQ ID NO: 537618 - RNA, 16 nt, Homo sapiens
uuaaauuaugcaacgu

SEQ ID NO: 537619 - RNA, 15 nt, Homo sapiens
uuaaauuccacagau

SEQ ID NO: 537620 - RNA, 17 nt, Homo sapiens
uuaaauuccacagauua

SEQ ID NO: 537621 - RNA, 20 nt, Homo sapiens
uuaaauuccacagauuauca

SEQ ID NO: 537622 - RNA, 16 nt, Homo sapiens
uuaaauucucuuucac

SEQ ID NO: 537623 - RNA, 17 nt, Homo sapiens
uuaaauugcuugaaugu

SEQ ID NO: 537624 - RNA, 17 nt, Homo sapiens
uuaaauuuuaacuaaau

SEQ ID NO: 537625 - RNA, 18 nt, Homo sapiens
uuaaauuuuauaugggcu

SEQ ID NO: 537626 - RNA, 20 nt, Homo sapiens
uuaacaaaucuaaucucuua

SEQ ID NO: 537627 - RNA, 23 nt, Homo sapiens
uuaacaaauuauguuacaucugu

SEQ ID NO: 537628 - RNA, 13 nt, Homo sapiens
aaaaaaaaacuua

SEQ ID NO: 537629 - RNA, 11 nt, Homo sapiens
aaaaaaaagca

SEQ ID NO: 537630 - RNA, 12 nt, Homo sapiens
aaaaaaauuacu

SEQ ID NO: 537631 - RNA, 14 nt, Homo sapiens
aaaaaacaacggug

SEQ ID NO: 537632 - RNA, 21 nt, Homo sapiens
aaaaaacauacuuacauuuca

SEQ ID NO: 537633 - RNA, 12 nt, Homo sapiens
aaaaaacauaua

SEQ ID NO: 537634 - RNA, 23 nt, Homo sapiens
aaaaaagcaaauuucaugcacug

SEQ ID NO: 537635 - RNA, 12 nt, Homo sapiens
aaaaaaucugac

SEQ ID NO: 537636 - RNA, 13 nt, Homo sapiens
aaaaaauugcaca

SEQ ID NO: 537637 - RNA, 15 nt, Homo sapiens
aaaaacauacuuaca

SEQ ID NO: 537638 - RNA, 16 nt, Homo sapiens
aaaaacaucccaagaa

SEQ ID NO: 537639 - RNA, 13 nt, Homo sapiens
aaaaacauuucau

SEQ ID NO: 537640 - RNA, 12 nt, Homo sapiens
aaaaaccaauga

SEQ ID NO: 537641 - RNA, 19 nt, Homo sapiens
aaaaaccacugcuaugcca

SEQ ID NO: 537642 - RNA, 18 nt, Homo sapiens
aaaaaccauaggcugcuc

SEQ ID NO: 537643 - RNA, 13 nt, Homo sapiens
aaaaacccagcgg

SEQ ID NO: 537644 - RNA, 22 nt, Homo sapiens
aaaaaccucuaugcaaucugag

SEQ ID NO: 537645 - RNA, 12 nt, Homo sapiens
aaaaaccugccc

SEQ ID NO: 537646 - RNA, 11 nt, Homo sapiens
aaaaacuacuu

SEQ ID NO: 537647 - RNA, 12 nt, Homo sapiens
aaaaacuauucu

SEQ ID NO: 537648 - RNA, 13 nt, Homo sapiens
aaaaacucacuua

SEQ ID NO: 537649 - RNA, 12 nt, Homo sapiens
aaaaacucugaa

SEQ ID NO: 537650 - RNA, 12 nt, Homo sapiens
aaaaagaacaac

SEQ ID NO: 537651 - RNA, 21 nt, Homo sapiens
aaaaagaugaccuuugucuca

SEQ ID NO: 537652 - RNA, 21 nt, Homo sapiens
aaaaagauucucaucacucaa

SEQ ID NO: 537653 - RNA, 15 nt, Homo sapiens
aaaaaggccggguga

SEQ ID NO: 537654 - RNA, 22 nt, Homo sapiens
aaaaagggauccguacauucaa

SEQ ID NO: 537655 - RNA, 18 nt, Homo sapiens
aaaaagucagagacagau

SEQ ID NO: 537656 - RNA, 23 nt, Homo sapiens
aaaaaguccuugauuuagcacua

SEQ ID NO: 537657 - RNA, 22 nt, Homo sapiens
aaaaauaaaacuucacauuuau

SEQ ID NO: 537658 - RNA, 21 nt, Homo sapiens
aaaaauaaacaagcauuucaa

SEQ ID NO: 537659 - RNA, 15 nt, Homo sapiens
aaaaauaaaguacca

SEQ ID NO: 537660 - RNA, 19 nt, Homo sapiens
aaaaauaaaugucacugcc

SEQ ID NO: 537661 - RNA, 15 nt, Homo sapiens
aaaaauaaauugcuc

SEQ ID NO: 537662 - RNA, 15 nt, Homo sapiens
aaaaauaaauuugca

SEQ ID NO: 537663 - RNA, 14 nt, Homo sapiens
aaaaauaauuauuu

SEQ ID NO: 537664 - RNA, 15 nt, Homo sapiens
aaaaauacaacacug

SEQ ID NO: 537665 - RNA, 12 nt, Homo sapiens
aaaaauacaugu

SEQ ID NO: 537666 - RNA, 11 nt, Homo sapiens
aaaaauacuuu

SEQ ID NO: 537667 - RNA, 23 nt, Homo sapiens
aaaaauagauaaacuauacacuu

SEQ ID NO: 537668 - RNA, 13 nt, Homo sapiens
aaaaauauuauaa

SEQ ID NO: 537669 - RNA, 13 nt, Homo sapiens
aaaaauauuccaa

SEQ ID NO: 537670 - RNA, 20 nt, Homo sapiens
aaaaauauuugcugagugaa

SEQ ID NO: 537671 - RNA, 17 nt, Homo sapiens
aaaaaucaggagauucc

SEQ ID NO: 537672 - RNA, 22 nt, Homo sapiens
aaaaaucauguguugcagcuuu

SEQ ID NO: 537673 - RNA, 15 nt, Homo sapiens
aaaaaucccuuaccu

SEQ ID NO: 537674 - RNA, 17 nt, Homo sapiens
aaaaaucccuuguucuc

SEQ ID NO: 537675 - RNA, 15 nt, Homo sapiens
aaaaaucuuuaggga

SEQ ID NO: 537676 - RNA, 20 nt, Homo sapiens
aaaaaucuuuucauuaaaga

SEQ ID NO: 537677 - RNA, 24 nt, Homo sapiens
aaaaaugaaaagagaaugaugcuc

SEQ ID NO: 537678 - RNA, 13 nt, Homo sapiens
aaaaaugagcucg

SEQ ID NO: 537679 - RNA, 16 nt, Homo sapiens
aaaaaugcacaccuca

SEQ ID NO: 537680 - RNA, 22 nt, Homo sapiens
aaaaaugcccauuuuugcuaau

SEQ ID NO: 537681 - RNA, 12 nt, Homo sapiens
aaaaaugcugcu

SEQ ID NO: 537682 - RNA, 21 nt, Homo sapiens
aaaaauggaaacuauauugac

SEQ ID NO: 537683 - RNA, 15 nt, Homo sapiens
aaaaauguccugccu

SEQ ID NO: 537684 - RNA, 20 nt, Homo sapiens
aaaaaugugccuaguuuuau

SEQ ID NO: 537685 - RNA, 20 nt, Homo sapiens
aaaaaugugguacauacaca

SEQ ID NO: 537686 - RNA, 12 nt, Homo sapiens
aaaaauguucuu

SEQ ID NO: 537687 - RNA, 15 nt, Homo sapiens
aaaaauguuugagua

SEQ ID NO: 537688 - RNA, 22 nt, Homo sapiens
aaaaauguuugaguauucugca

SEQ ID NO: 537689 - RNA, 17 nt, Homo sapiens
aaaaauuaaacuaaaga

SEQ ID NO: 537690 - RNA, 13 nt, Homo sapiens
aaaaauuagcuua

SEQ ID NO: 537691 - RNA, 19 nt, Homo sapiens
aaaaauuauacuaacuuau

SEQ ID NO: 537692 - RNA, 16 nt, Homo sapiens
aaaaauucccuuccug

SEQ ID NO: 537693 - RNA, 13 nt, Homo sapiens
aaaaauugacuua

SEQ ID NO: 537694 - RNA, 18 nt, Homo sapiens
aaaaauuuaagcauuguu

SEQ ID NO: 537695 - RNA, 15 nt, Homo sapiens
aaaacaaaaaaccac

SEQ ID NO: 537696 - RNA, 19 nt, Homo sapiens
aaaacaaaacaaaccuuaa

SEQ ID NO: 537697 - RNA, 18 nt, Homo sapiens
aaaacaaaauguaauguc

SEQ ID NO: 537698 - RNA, 20 nt, Homo sapiens
aaaacaaagaaauaaugguc

SEQ ID NO: 537699 - RNA, 21 nt, Homo sapiens
aaaacaaaggaauaaaaccau

SEQ ID NO: 537700 - RNA, 13 nt, Homo sapiens
aaaacaaauccau

SEQ ID NO: 537701 - RNA, 15 nt, Homo sapiens
aaaacaagaugagau

SEQ ID NO: 537702 - RNA, 14 nt, Homo sapiens
aaaacaaguacugg

SEQ ID NO: 537703 - RNA, 14 nt, Homo sapiens
aaaacaaugcagua

SEQ ID NO: 537704 - RNA, 18 nt, Homo sapiens
aaaacacaaaguguauaa

SEQ ID NO: 537705 - RNA, 13 nt, Homo sapiens
aaaacacauauca

SEQ ID NO: 537706 - RNA, 16 nt, Homo sapiens
aaaacaccuagcuuua

SEQ ID NO: 537707 - RNA, 15 nt, Homo sapiens
aaaacacugugcaca

SEQ ID NO: 537708 - RNA, 16 nt, Homo sapiens
aaaacagaacacuuau

SEQ ID NO: 537709 - RNA, 15 nt, Homo sapiens
aaaacagacgggucu

SEQ ID NO: 537710 - RNA, 15 nt, Homo sapiens
aaaacagaugaccau

SEQ ID NO: 537711 - RNA, 23 nt, Homo sapiens
aaaacagcauaguacuggcacaa

SEQ ID NO: 537712 - RNA, 13 nt, Homo sapiens
aaaacaggccagg

SEQ ID NO: 537713 - RNA, 20 nt, Homo sapiens
aaaacagggugggcaaacuc

SEQ ID NO: 537714 - RNA, 19 nt, Homo sapiens
aaaacagguauauacuuug

SEQ ID NO: 537715 - RNA, 15 nt, Homo sapiens
aaaacaggucuucau

SEQ ID NO: 537716 - RNA, 15 nt, Homo sapiens
aaaacaucacauucc

SEQ ID NO: 537717 - RNA, 19 nt, Homo sapiens
aaaacaucauuacugccau

SEQ ID NO: 537718 - RNA, 19 nt, Homo sapiens
aaaacaucuuuaaggggag

SEQ ID NO: 537719 - RNA, 13 nt, Homo sapiens
aaaacaugaauuu

SEQ ID NO: 537720 - RNA, 20 nt, Homo sapiens
aaaacauugugccaugucaa

SEQ ID NO: 537721 - RNA, 10 nt, Homo sapiens
aaaaccaaaa

SEQ ID NO: 537722 - RNA, 21 nt, Homo sapiens
aaaaccaacagguuuaucuga

SEQ ID NO: 537723 - RNA, 23 nt, Homo sapiens
aaaaccaccaccaucaccagaca

SEQ ID NO: 537724 - RNA, 22 nt, Homo sapiens
aaaaccacugggaggagucuau

SEQ ID NO: 537725 - RNA, 22 nt, Homo sapiens
aaaaccagaacaguaugaauuu

SEQ ID NO: 537726 - RNA, 14 nt, Homo sapiens
aaaaccccaucucu

SEQ ID NO: 537727 - RNA, 18 nt, Homo sapiens
aaaaccccaucucuacua

SEQ ID NO: 537728 - RNA, 22 nt, Homo sapiens
aaaacccuugauuauacucugu

SEQ ID NO: 537729 - RNA, 23 nt, Homo sapiens
aaaaccuacacacauaccuucau

SEQ ID NO: 537730 - RNA, 22 nt, Homo sapiens
aaaaccugaagacugaggacaa

SEQ ID NO: 537731 - RNA, 14 nt, Homo sapiens
aaaaccugugccag

SEQ ID NO: 537732 - RNA, 18 nt, Homo sapiens
aaaaccuucaagaucuca

SEQ ID NO: 537733 - RNA, 19 nt, Homo sapiens
aaccagguuuagacaguau

SEQ ID NO: 537734 - RNA, 23 nt, Homo sapiens
aaccaguauuuuugcugcuucug

SEQ ID NO: 537735 - RNA, 18 nt, Homo sapiens
aaccagucucucaaguga

SEQ ID NO: 537736 - RNA, 14 nt, Homo sapiens
aaccaguucaugca

SEQ ID NO: 537737 - RNA, 16 nt, Homo sapiens
aaccauaaugucuuua

SEQ ID NO: 537738 - RNA, 18 nt, Homo sapiens
aaccauaugauacuauca

SEQ ID NO: 537739 - RNA, 18 nt, Homo sapiens
aaccaucacccccaggac

SEQ ID NO: 537740 - RNA, 17 nt, Homo sapiens
aaccaugaacucagcua

SEQ ID NO: 537741 - RNA, 19 nt, Homo sapiens
aaaaccuuguaaaaaaagc

SEQ ID NO: 537742 - RNA, 18 nt, Homo sapiens
aaaaccuuucaaauuuca

SEQ ID NO: 537743 - RNA, 19 nt, Homo sapiens
aaaacgaaagcugaaccua

SEQ ID NO: 537744 - RNA, 13 nt, Homo sapiens
aaaacgacacugc

SEQ ID NO: 537745 - RNA, 17 nt, Homo sapiens
aaaacguuuuauugugu

SEQ ID NO: 537746 - RNA, 15 nt, Homo sapiens
aaaacuaaccaucug

SEQ ID NO: 537747 - RNA, 17 nt, Homo sapiens
aaaacuaaccaucugaa

SEQ ID NO: 537748 - RNA, 20 nt, Homo sapiens
aaaacuacagcaucauugca

SEQ ID NO: 537749 - RNA, 19 nt, Homo sapiens
aaaacuacaguuguaauaa

SEQ ID NO: 537750 - RNA, 14 nt, Homo sapiens
aaaacuaccacaug

SEQ ID NO: 537751 - RNA, 16 nt, Homo sapiens
aaaacuacugauacuu

SEQ ID NO: 537752 - RNA, 20 nt, Homo sapiens
aaaacuauauucauuuccac

SEQ ID NO: 537753 - RNA, 20 nt, Homo sapiens
aaaacuauccugauuccaaa

SEQ ID NO: 537754 - RNA, 12 nt, Homo sapiens
aaaacucagaga

SEQ ID NO: 537755 - RNA, 20 nt, Homo sapiens
aaaacucauuacuuuuccau

SEQ ID NO: 537756 - RNA, 20 nt, Homo sapiens
aaaacucauuuccuauguaa

SEQ ID NO: 537757 - RNA, 16 nt, Homo sapiens
aaaacuccaucucaaa

SEQ ID NO: 537758 - RNA, 22 nt, Homo sapiens
aaaacucugggaaauaagagag

SEQ ID NO: 537759 - RNA, 19 nt, Homo sapiens
aaaacugacaguaaaucuc

SEQ ID NO: 537760 - RNA, 16 nt, Homo sapiens
aaaacugauguuacua

SEQ ID NO: 537761 - RNA, 20 nt, Homo sapiens
aaaacugauuuuuagcuuua

SEQ ID NO: 537762 - RNA, 15 nt, Homo sapiens
aaaacugcucuggaa

SEQ ID NO: 537763 - RNA, 15 nt, Homo sapiens
aaaacuggaagcaca

SEQ ID NO: 537764 - RNA, 13 nt, Homo sapiens
aaaacuguauuua

SEQ ID NO: 537765 - RNA, 23 nt, Homo sapiens
aacaggugcugaacugugcauca

SEQ ID NO: 537766 - RNA, 21 nt, Homo sapiens
aacaguaaaagccuuauucua

SEQ ID NO: 537767 - RNA, 16 nt, Homo sapiens
aacaguaacugccauc

SEQ ID NO: 537768 - RNA, 12 nt, Homo sapiens
aacaguauuuca

SEQ ID NO: 537769 - RNA, 14 nt, Homo sapiens
aacaguggacaaag

SEQ ID NO: 537770 - RNA, 11 nt, Homo sapiens
aacaguggcug

SEQ ID NO: 537771 - RNA, 19 nt, Homo sapiens
aacagugguggcaacauuc

SEQ ID NO: 537772 - RNA, 15 nt, Homo sapiens
aacaguguguuggcg

SEQ ID NO: 537773 - RNA, 14 nt, Homo sapiens
aacaguuacuccag

SEQ ID NO: 537774 - RNA, 13 nt, Homo sapiens
agaaggcugucuu

SEQ ID NO: 537775 - RNA, 14 nt, Homo sapiens
agaagggcugagcc

SEQ ID NO: 537776 - RNA, 15 nt, Homo sapiens
agaagggggugacag

SEQ ID NO: 537777 - RNA, 14 nt, Homo sapiens
agaagguaacucuu

SEQ ID NO: 537778 - RNA, 23 nt, Homo sapiens
agaagguaucaguuauaugauau

SEQ ID NO: 537779 - RNA, 19 nt, Homo sapiens
agaaggucauaagggagca

SEQ ID NO: 537780 - RNA, 20 nt, Homo sapiens
agaaggucauaagggagcau

SEQ ID NO: 537781 - RNA, 14 nt, Homo sapiens
agaagguccuuaau

SEQ ID NO: 537782 - RNA, 22 nt, Homo sapiens
agaaggugccacuuuacccacc

SEQ ID NO: 537783 - RNA, 12 nt, Homo sapiens
agaaggugcuga

SEQ ID NO: 537784 - RNA, 20 nt, Homo sapiens
agaagguuaccaagaagccu

SEQ ID NO: 537785 - RNA, 14 nt, Homo sapiens
agaagguugcucua

SEQ ID NO: 537786 - RNA, 21 nt, Homo sapiens
agaagguuggugaauuucaca

SEQ ID NO: 537787 - RNA, 19 nt, Homo sapiens
agaaguacuuuucuguuca

SEQ ID NO: 537788 - RNA, 13 nt, Homo sapiens
agaaguaggcaug

SEQ ID NO: 537789 - RNA, 21 nt, Homo sapiens
agaaguaggggaagacaugca

SEQ ID NO: 537790 - RNA, 15 nt, Homo sapiens
agaagucagcuacuc

SEQ ID NO: 537791 - RNA, 16 nt, Homo sapiens
agaagucuauaaugca

SEQ ID NO: 537792 - RNA, 23 nt, Homo sapiens
agaagucugucuuucuauagaaa

SEQ ID NO: 537793 - RNA, 23 nt, Homo sapiens
agaagugaguuuguaaauauucu

SEQ ID NO: 537794 - RNA, 14 nt, Homo sapiens
agaagugauuuagu

SEQ ID NO: 537795 - RNA, 19 nt, Homo sapiens
agaagugucguuuucauaa

SEQ ID NO: 537796 - RNA, 21 nt, Homo sapiens
agaaguugcugcuugugaucu

SEQ ID NO: 537797 - RNA, 23 nt, Homo sapiens
agaaguuuaaggaauaugggaga

SEQ ID NO: 537798 - RNA, 18 nt, Homo sapiens
agaauaaaaacuuccuuc

SEQ ID NO: 537799 - RNA, 19 nt, Homo sapiens
agaauaaaaacuuccuuca

SEQ ID NO: 537800 - RNA, 15 nt, Homo sapiens
agaauaaaagaugau

SEQ ID NO: 537801 - RNA, 21 nt, Homo sapiens
agaauaaaauuccuaucucau

SEQ ID NO: 537802 - RNA, 15 nt, Homo sapiens
agaauaaagauuuau

SEQ ID NO: 537803 - RNA, 21 nt, Homo sapiens
agaauaaagccacuguaugau

SEQ ID NO: 537804 - RNA, 14 nt, Homo sapiens
agaauaaaguccaa

SEQ ID NO: 537805 - RNA, 17 nt, Homo sapiens
agaauaaauucuaccuc

SEQ ID NO: 537806 - RNA, 22 nt, Homo sapiens
agaauaauauugugucauagaa

SEQ ID NO: 537807 - RNA, 12 nt, Homo sapiens
agaauaaugugu

SEQ ID NO: 537808 - RNA, 16 nt, Homo sapiens
agaauacuuugcuuca

SEQ ID NO: 537809 - RNA, 14 nt, Homo sapiens
agaauagucucacu

SEQ ID NO: 537810 - RNA, 16 nt, Homo sapiens
agaauauaauacugua

SEQ ID NO: 537811 - RNA, 19 nt, Homo sapiens
agaauauacaaauagcaaa

SEQ ID NO: 537812 - RNA, 13 nt, Homo sapiens
agaauaucuggga

SEQ ID NO: 537813 - RNA, 18 nt, Homo sapiens
agaauauucaaaauucca

SEQ ID NO: 537814 - RNA, 23 nt, Homo sapiens
agaauauugucccuuugagcaga

SEQ ID NO: 537815 - RNA, 12 nt, Homo sapiens
agaauauuuacu

SEQ ID NO: 537816 - RNA, 21 nt, Homo sapiens
agaauauuuuaaguauugcau

SEQ ID NO: 537817 - RNA, 12 nt, Homo sapiens
agaaucaaagau

SEQ ID NO: 537818 - RNA, 16 nt, Homo sapiens
agaaucacuggaaccu

SEQ ID NO: 537819 - RNA, 13 nt, Homo sapiens
agaaucacuuaag

SEQ ID NO: 537820 - RNA, 17 nt, Homo sapiens
agaaucagguuuccaau

SEQ ID NO: 537821 - RNA, 15 nt, Homo sapiens
agaaucauggagaaa

SEQ ID NO: 537822 - RNA, 18 nt, Homo sapiens
agaaucaugugaacccgg

SEQ ID NO: 537823 - RNA, 18 nt, Homo sapiens
agaaucauuaauacaaag

SEQ ID NO: 537824 - RNA, 19 nt, Homo sapiens
agaaucauugaaguauuuu

SEQ ID NO: 537825 - RNA, 11 nt, Homo sapiens
agaaucccaag

SEQ ID NO: 537826 - RNA, 15 nt, Homo sapiens
agaaucccugccugu

SEQ ID NO: 537827 - RNA, 18 nt, Homo sapiens
agaaucccuguucauugu

SEQ ID NO: 537828 - RNA, 13 nt, Homo sapiens
agaauccuuggcu

SEQ ID NO: 537829 - RNA, 22 nt, Homo sapiens
agaaucgcuugaaccugggaag

SEQ ID NO: 537830 - RNA, 23 nt, Homo sapiens
agaaucuauaguucacugacaca

SEQ ID NO: 537831 - RNA, 21 nt, Homo sapiens
agaaucucuucaugcuugaca

SEQ ID NO: 537832 - RNA, 18 nt, Homo sapiens
agaaucucuugaaccugg

SEQ ID NO: 537833 - RNA, 14 nt, Homo sapiens
agaaucugcagcua

SEQ ID NO: 537834 - RNA, 16 nt, Homo sapiens
aaagauguuccaguga

SEQ ID NO: 537835 - RNA, 21 nt, Homo sapiens
aaagauuauagaaguagcaaa

SEQ ID NO: 537836 - RNA, 20 nt, Homo sapiens
aaagauuauugugacuucac

SEQ ID NO: 537837 - RNA, 19 nt, Homo sapiens
aaagauugauuuguguguu

SEQ ID NO: 537838 - RNA, 23 nt, Homo sapiens
aaagauuggacaccccugcuaua

SEQ ID NO: 537839 - RNA, 17 nt, Homo sapiens
aaagauuguuggaugaa

SEQ ID NO: 537840 - RNA, 11 nt, Homo sapiens
aaagauuuaca

SEQ ID NO: 537841 - RNA, 20 nt, Homo sapiens
aaagauuucuugaguuuugu

SEQ ID NO: 537842 - RNA, 17 nt, Homo sapiens
aaagauuuguuuuguca

SEQ ID NO: 537843 - RNA, 18 nt, Homo sapiens
aaagauuuucugguucua

SEQ ID NO: 537844 - RNA, 22 nt, Homo sapiens
aaagcaaacacuuacagaauua

SEQ ID NO: 537845 - RNA, 19 nt, Homo sapiens
aaagcaaacuuaagaaaca

SEQ ID NO: 537846 - RNA, 20 nt, Homo sapiens
aaagcaaaucuuucuguaaa

SEQ ID NO: 537847 - RNA, 13 nt, Homo sapiens
aaagcaacaguua

SEQ ID NO: 537848 - RNA, 20 nt, Homo sapiens
aaagcaagcauucagaagaa

SEQ ID NO: 537849 - RNA, 22 nt, Homo sapiens
aaagcaaguguucacugcuccu

SEQ ID NO: 537850 - RNA, 15 nt, Homo sapiens
aaagcaaguugccug

SEQ ID NO: 537851 - RNA, 20 nt, Homo sapiens
aaagcaaguuucaucaguca

SEQ ID NO: 537852 - RNA, 14 nt, Homo sapiens
aaagcaauaaccuc

SEQ ID NO: 537853 - RNA, 16 nt, Homo sapiens
aaagcaaugugguagu

SEQ ID NO: 537854 - RNA, 15 nt, Homo sapiens
aaagcacaguuugaa

SEQ ID NO: 537855 - RNA, 18 nt, Homo sapiens
aaagcacauguauugaca

SEQ ID NO: 537856 - RNA, 13 nt, Homo sapiens
aaagcacuacaau

SEQ ID NO: 537857 - RNA, 24 nt, Homo sapiens
aaagcagaauuuuaaugugaagac

SEQ ID NO: 537858 - RNA, 18 nt, Homo sapiens
aaagcagacccaccuccc

SEQ ID NO: 537859 - RNA, 17 nt, Homo sapiens
aaagcagaugagcugug

SEQ ID NO: 537860 - RNA, 12 nt, Homo sapiens
aaagcagccacg

SEQ ID NO: 537861 - RNA, 16 nt, Homo sapiens
aaagcagcucaagaac

SEQ ID NO: 537862 - RNA, 17 nt, Homo sapiens
aaagcaguaaauuugcu

SEQ ID NO: 537863 - RNA, 20 nt, Homo sapiens
aaagcaguaaauuugcuagc

SEQ ID NO: 537864 - RNA, 21 nt, Homo sapiens
aaagcaguaaauuugcuagca

SEQ ID NO: 537865 - RNA, 16 nt, Homo sapiens
aaagcagucacugugg

SEQ ID NO: 537866 - RNA, 13 nt, Homo sapiens
aaagcaucaccuc

SEQ ID NO: 537867 - RNA, 20 nt, Homo sapiens
aaagcaugaaacauuucaga

SEQ ID NO: 537868 - RNA, 14 nt, Homo sapiens
aaagcaugugagac

SEQ ID NO: 537869 - RNA, 15 nt, Homo sapiens
aaagcauucuuuaac

SEQ ID NO: 537870 - RNA, 15 nt, Homo sapiens
aaagcauuguccaaa

SEQ ID NO: 537871 - RNA, 12 nt, Homo sapiens
aaagcauuucag

SEQ ID NO: 537872 - RNA, 18 nt, Homo sapiens
aaagcauuugcaacagcu

SEQ ID NO: 537873 - RNA, 12 nt, Homo sapiens
aaagccaaaaac

SEQ ID NO: 537874 - RNA, 15 nt, Homo sapiens
aaagccaaauuucca

SEQ ID NO: 537875 - RNA, 22 nt, Homo sapiens
aaagccaacauguggcuccucc

SEQ ID NO: 537876 - RNA, 21 nt, Homo sapiens
aaagccaaccagccuuugggu

SEQ ID NO: 537877 - RNA, 16 nt, Homo sapiens
aaagccaaggcagcuc

SEQ ID NO: 537878 - RNA, 21 nt, Homo sapiens
aaagccaccagacugacaaau

SEQ ID NO: 537879 - RNA, 16 nt, Homo sapiens
aaagccauaacuugaa

SEQ ID NO: 537880 - RNA, 16 nt, Homo sapiens
aaagccaucaugccuu

SEQ ID NO: 537881 - RNA, 14 nt, Homo sapiens
aaagccaucucagg

SEQ ID NO: 537882 - RNA, 19 nt, Homo sapiens
aaagccauuauuaugaugu

SEQ ID NO: 537883 - RNA, 19 nt, Homo sapiens
aaagcccuuuuauaccucc

SEQ ID NO: 537884 - RNA, 16 nt, Homo sapiens
aaagccucgggccaca

SEQ ID NO: 537885 - RNA, 22 nt, Homo sapiens
aaagccucuggaaaacucagga

SEQ ID NO: 537886 - RNA, 17 nt, Homo sapiens
aaagccucuucaaaaag

SEQ ID NO: 537887 - RNA, 17 nt, Homo sapiens
aaagccugccucuucca

SEQ ID NO: 537888 - RNA, 18 nt, Homo sapiens
aaagccugccucuuccag

SEQ ID NO: 537889 - RNA, 16 nt, Homo sapiens
aaagccuuaacuaaga

SEQ ID NO: 537890 - RNA, 23 nt, Homo sapiens
aaagccuuaucaagugucuucca

SEQ ID NO: 537891 - RNA, 20 nt, Homo sapiens
aaagccuuauuuuucaaaag

SEQ ID NO: 537892 - RNA, 22 nt, Homo sapiens
aaagccuugugugaacucacca

SEQ ID NO: 537893 - RNA, 17 nt, Homo sapiens
aaagcggacaucagcug

SEQ ID NO: 537894 - RNA, 16 nt, Homo sapiens
aaagcguaaaaggaga

SEQ ID NO: 537895 - RNA, 17 nt, Homo sapiens
aaagcuaaaguaucugu

SEQ ID NO: 537896 - RNA, 16 nt, Homo sapiens
aaagcuaauuaaucau

SEQ ID NO: 537897 - RNA, 22 nt, Homo sapiens
aaagcuacaacaaauacuacag

SEQ ID NO: 537898 - RNA, 18 nt, Homo sapiens
aaagcuagauacuggaaa

SEQ ID NO: 537899 - RNA, 17 nt, Homo sapiens
aaagcuccaucaaugag

SEQ ID NO: 537900 - RNA, 15 nt, Homo sapiens
aaagcugcccacugu

SEQ ID NO: 537901 - RNA, 13 nt, Homo sapiens
aaagcugccugua

SEQ ID NO: 537902 - RNA, 13 nt, Homo sapiens
aaagcugccuguc

SEQ ID NO: 537903 - RNA, 14 nt, Homo sapiens
aaagcugcucaggg

SEQ ID NO: 537904 - RNA, 11 nt, Homo sapiens
aaagcuuaaug

SEQ ID NO: 537905 - RNA, 20 nt, Homo sapiens
aaagcuuaaugauucugaua

SEQ ID NO: 537906 - RNA, 16 nt, Homo sapiens
aaagcuucacaguacc

SEQ ID NO: 537907 - RNA, 18 nt, Homo sapiens
aaagcuugaagcugugga

SEQ ID NO: 537908 - RNA, 11 nt, Homo sapiens
aaagcuuuacu

SEQ ID NO: 537909 - RNA, 18 nt, Homo sapiens
aaagcuuuauacaguuga

SEQ ID NO: 537910 - RNA, 22 nt, Homo sapiens
aaagcuuuauuaccaguggcgu

SEQ ID NO: 537911 - RNA, 21 nt, Homo sapiens
aaagcuuuuagaaauacugca

SEQ ID NO: 537912 - RNA, 19 nt, Homo sapiens
aaagcuuuuauugucacag

SEQ ID NO: 537913 - RNA, 21 nt, Homo sapiens
aaagcuuuuuacucaaagagu

SEQ ID NO: 537914 - RNA, 19 nt, Homo sapiens
aaaggaaaaucacaucucc

SEQ ID NO: 537915 - RNA, 16 nt, Homo sapiens
aaaggaaagauuugcc

SEQ ID NO: 537916 - RNA, 22 nt, Homo sapiens
aaaggaacuauguucacaagaa

SEQ ID NO: 537917 - RNA, 16 nt, Homo sapiens
aaaggaagacagauuu

SEQ ID NO: 537918 - RNA, 20 nt, Homo sapiens
aaaggaagcuccacugucac

SEQ ID NO: 537919 - RNA, 20 nt, Homo sapiens
aaaggaauaaaaaauacugu

SEQ ID NO: 537920 - RNA, 17 nt, Homo sapiens
aaaggaaucacguuaga

SEQ ID NO: 537921 - RNA, 20 nt, Homo sapiens
aaaggaaucacguuagagga

SEQ ID NO: 537922 - RNA, 14 nt, Homo sapiens
aaaggacaugaaca

SEQ ID NO: 537923 - RNA, 13 nt, Homo sapiens
aaaggacccugug

SEQ ID NO: 537924 - RNA, 15 nt, Homo sapiens
aaaggacccugugag

SEQ ID NO: 537925 - RNA, 17 nt, Homo sapiens
aaaggagacauugcucu

SEQ ID NO: 537926 - RNA, 16 nt, Homo sapiens
aaaggagcagagcucc

SEQ ID NO: 537927 - RNA, 15 nt, Homo sapiens
aaaggagcuuucuca

SEQ ID NO: 537928 - RNA, 15 nt, Homo sapiens
aaaggaggugggggc

SEQ ID NO: 537929 - RNA, 15 nt, Homo sapiens
aaaggagucagagca

SEQ ID NO: 537930 - RNA, 15 nt, Homo sapiens
aaaggaguuuugcaa

SEQ ID NO: 537931 - RNA, 17 nt, Homo sapiens
aaaggaugagaauguga

SEQ ID NO: 537932 - RNA, 18 nt, Homo sapiens
aaaggaugcacagaguug

SEQ ID NO: 537933 - RNA, 17 nt, Homo sapiens
aaaggauuuuacagaaa

SEQ ID NO: 537934 - RNA, 19 nt, Homo sapiens
aaaggcagcugccucugcu

SEQ ID NO: 537935 - RNA, 23 nt, Homo sapiens
aaaggcagcugccucugcucccu

SEQ ID NO: 537936 - RNA, 13 nt, Homo sapiens
aaaggcaguuuuc

SEQ ID NO: 537937 - RNA, 22 nt, Homo sapiens
aaaggcauaagacccuaagccu

SEQ ID NO: 537938 - RNA, 13 nt, Homo sapiens
aaaggccacccua

SEQ ID NO: 537939 - RNA, 10 nt, Homo sapiens
aaaggccagu

SEQ ID NO: 537940 - RNA, 16 nt, Homo sapiens
aaaggccccugcaaug

SEQ ID NO: 537941 - RNA, 16 nt, Homo sapiens
aaaggcuaaaagggaa

SEQ ID NO: 537942 - RNA, 17 nt, Homo sapiens
aaaggcuaaacauaugg

SEQ ID NO: 537943 - RNA, 16 nt, Homo sapiens
aaaggcugcugugaac

SEQ ID NO: 537944 - RNA, 15 nt, Homo sapiens
aaaggcugguggcaa

SEQ ID NO: 537945 - RNA, 11 nt, Homo sapiens
aaagggagaag

SEQ ID NO: 537946 - RNA, 17 nt, Homo sapiens
aaagggagcacuggguu

SEQ ID NO: 537947 - RNA, 14 nt, Homo sapiens
aaagggauacacag

SEQ ID NO: 537948 - RNA, 18 nt, Homo sapiens
aaagggauaguccaaaga

SEQ ID NO: 537949 - RNA, 21 nt, Homo sapiens
aaagggccaaagaaccaaaga

SEQ ID NO: 537950 - RNA, 23 nt, Homo sapiens
aaagggccuugacaucaguuccu

SEQ ID NO: 537951 - RNA, 15 nt, Homo sapiens
aaagguaaucagcuc

SEQ ID NO: 537952 - RNA, 20 nt, Homo sapiens
aaagguaauuguagcacauu

SEQ ID NO: 537953 - RNA, 17 nt, Homo sapiens
aaagguagggacuggag

SEQ ID NO: 537954 - RNA, 16 nt, Homo sapiens
aaagguauauugugaa

SEQ ID NO: 537955 - RNA, 23 nt, Homo sapiens
aaagguauuaaauugauguugcu

SEQ ID NO: 537956 - RNA, 15 nt, Homo sapiens
aaaggucagcccguu

SEQ ID NO: 537957 - RNA, 16 nt, Homo sapiens
aaaggugaccaaugau

SEQ ID NO: 537958 - RNA, 12 nt, Homo sapiens
aaaggugcagga

SEQ ID NO: 537959 - RNA, 19 nt, Homo sapiens
aaaggugccucauagcaua

SEQ ID NO: 537960 - RNA, 19 nt, Homo sapiens
aaagguuaugaaacauauc

SEQ ID NO: 537961 - RNA, 15 nt, Homo sapiens
aaagguucucaggug

SEQ ID NO: 537962 - RNA, 22 nt, Homo sapiens
aaagguugacaauaaaugugcu

SEQ ID NO: 537963 - RNA, 18 nt, Homo sapiens
aaagguugaguuuuccac

SEQ ID NO: 537964 - RNA, 22 nt, Homo sapiens
aaagguuucauguucacuguga

SEQ ID NO: 537965 - RNA, 20 nt, Homo sapiens
aaagguuuggauuucuccaa

SEQ ID NO: 537966 - RNA, 17 nt, Homo sapiens
aaaguaaauacaugcau

SEQ ID NO: 537967 - RNA, 18 nt, Homo sapiens
aaaguaaccugaacuaau

SEQ ID NO: 537968 - RNA, 22 nt, Homo sapiens
aaaguaaccugaacuaaucuga

SEQ ID NO: 537969 - RNA, 13 nt, Homo sapiens
aaaguaacugaau

SEQ ID NO: 537970 - RNA, 16 nt, Homo sapiens
aaaguaagcauuucca

SEQ ID NO: 537971 - RNA, 15 nt, Homo sapiens
aaaguaaucuaccuc

SEQ ID NO: 537972 - RNA, 16 nt, Homo sapiens
aaaugauuauauucac

SEQ ID NO: 537973 - RNA, 18 nt, Homo sapiens
aaaugauuauauucacag

SEQ ID NO: 537974 - RNA, 22 nt, Homo sapiens
aaaugauuccuggacaucacca

SEQ ID NO: 537975 - RNA, 22 nt, Homo sapiens
aaaugcaauguaagcauacuuu

SEQ ID NO: 537976 - RNA, 21 nt, Homo sapiens
aaaugcacuguauugcuccuc

SEQ ID NO: 537977 - RNA, 16 nt, Homo sapiens
aaaugcagaaccacaa

SEQ ID NO: 537978 - RNA, 14 nt, Homo sapiens
aaaugcagaacuua

SEQ ID NO: 537979 - RNA, 21 nt, Homo sapiens
aaaugcagcagggaugcccug

SEQ ID NO: 537980 - RNA, 12 nt, Homo sapiens
aaaugcagucau

SEQ ID NO: 537981 - RNA, 17 nt, Homo sapiens
aaaugcaguccugagga

SEQ ID NO: 537982 - RNA, 17 nt, Homo sapiens
aaaugcauacuguugau

SEQ ID NO: 537983 - RNA, 20 nt, Homo sapiens
aaaugcauauccugagccau

SEQ ID NO: 537984 - RNA, 20 nt, Homo sapiens
aaaugccaagggggugacug

SEQ ID NO: 537985 - RNA, 20 nt, Homo sapiens
aaaugccacacggcucucac

SEQ ID NO: 537986 - RNA, 23 nt, Homo sapiens
aaaugcccagcuuaaaggggcua

SEQ ID NO: 537987 - RNA, 13 nt, Homo sapiens
aaaugcuauaauu

SEQ ID NO: 537988 - RNA, 14 nt, Homo sapiens
aaaugcucaaggaa

SEQ ID NO: 537989 - RNA, 17 nt, Homo sapiens
aaaugcucagaccagcu

SEQ ID NO: 537990 - RNA, 11 nt, Homo sapiens
aaaugcugcuc

SEQ ID NO: 537991 - RNA, 23 nt, Homo sapiens
aaaugcugguuuuucaguuuuca

SEQ ID NO: 537992 - RNA, 13 nt, Homo sapiens
aaaugcuguuuau

SEQ ID NO: 537993 - RNA, 12 nt, Homo sapiens
aaaugcuuccaa

SEQ ID NO: 537994 - RNA, 12 nt, Homo sapiens
aaaugcuuuaac

SEQ ID NO: 537995 - RNA, 19 nt, Homo sapiens
aaaugcuuuaacagcugau

SEQ ID NO: 537996 - RNA, 16 nt, Homo sapiens
aaauggaaauugaugg

SEQ ID NO: 537997 - RNA, 12 nt, Homo sapiens
aaauggacaaac

SEQ ID NO: 537998 - RNA, 13 nt, Homo sapiens
aaauggaccaucc

SEQ ID NO: 537999 - RNA, 18 nt, Homo sapiens
aaauggagauaaaagcaa

SEQ ID NO: 538000 - RNA, 20 nt, Homo sapiens
aaauggaggaucucuaaaga

SEQ ID NO: 538001 - RNA, 13 nt, Homo sapiens
aaauggcaaagaa

SEQ ID NO: 538002 - RNA, 15 nt, Homo sapiens
aaauggcagaaccaa

SEQ ID NO: 538003 - RNA, 16 nt, Homo sapiens
aaauggcagugguggc

SEQ ID NO: 538004 - RNA, 17 nt, Homo sapiens
aaauggccagugcugcu

SEQ ID NO: 538005 - RNA, 14 nt, Homo sapiens
aaauggcuaugaac

SEQ ID NO: 538006 - RNA, 13 nt, Homo sapiens
aaauggcugagau

SEQ ID NO: 538007 - RNA, 19 nt, Homo sapiens
aaaugggagacagccucuu

SEQ ID NO: 538008 - RNA, 20 nt, Homo sapiens
aaaugggggcaggaaagcca

SEQ ID NO: 538009 - RNA, 22 nt, Homo sapiens
aaaugggggcaggaaagccaca

SEQ ID NO: 538010 - RNA, 20 nt, Homo sapiens
aaauggguuucuugccuuaa

SEQ ID NO: 538011 - RNA, 21 nt, Homo sapiens
aaaugguuaaauuuuacauga

SEQ ID NO: 538012 - RNA, 15 nt, Homo sapiens
aaaugguuucacuug

SEQ ID NO: 538013 - RNA, 16 nt, Homo sapiens
aaauguaaauacucau

SEQ ID NO: 538014 - RNA, 19 nt, Homo sapiens
aaauguaaauacucaugaa

SEQ ID NO: 538015 - RNA, 13 nt, Homo sapiens
aaauguaacugug

SEQ ID NO: 538016 - RNA, 18 nt, Homo sapiens
aaauguaacugugccagu

SEQ ID NO: 538017 - RNA, 22 nt, Homo sapiens
aaauguacaacugcaccuguca

SEQ ID NO: 538018 - RNA, 11 nt, Homo sapiens
aaauguacaau

SEQ ID NO: 538019 - RNA, 16 nt, Homo sapiens
aaauguacagacauau

SEQ ID NO: 538020 - RNA, 13 nt, Homo sapiens
aaauguacauguu

SEQ ID NO: 538021 - RNA, 23 nt, Homo sapiens
aaauguaccuucuuucacucugu

SEQ ID NO: 538022 - RNA, 22 nt, Homo sapiens
aaauguacucagcuaucagcuc

SEQ ID NO: 538023 - RNA, 18 nt, Homo sapiens
aaauguagcgacugucaa

SEQ ID NO: 538024 - RNA, 15 nt, Homo sapiens
aaauguauacuauag

SEQ ID NO: 538025 - RNA, 17 nt, Homo sapiens
aaauguauacuauagua

SEQ ID NO: 538026 - RNA, 16 nt, Homo sapiens
aaauguauauuuugau

SEQ ID NO: 538027 - RNA, 17 nt, Homo sapiens
aaauguaugugcucuua

SEQ ID NO: 538028 - RNA, 17 nt, Homo sapiens
aaauguauuuaauucca

SEQ ID NO: 538029 - RNA, 19 nt, Homo sapiens
aaauguauuuugacacugg

SEQ ID NO: 538030 - RNA, 14 nt, Homo sapiens
aaaugucacuauau

SEQ ID NO: 538031 - RNA, 12 nt, Homo sapiens
aaaugucacugc

SEQ ID NO: 538032 - RNA, 21 nt, Homo sapiens
aaaugucagaaaauaacagau

SEQ ID NO: 538033 - RNA, 13 nt, Homo sapiens
aaaugucaucuca

SEQ ID NO: 538034 - RNA, 19 nt, Homo sapiens
aaauguccauuuauaucau

SEQ ID NO: 538035 - RNA, 20 nt, Homo sapiens
aaaugucccuccaacacaga

SEQ ID NO: 538036 - RNA, 16 nt, Homo sapiens
aaauguccguguaaaa

SEQ ID NO: 538037 - RNA, 19 nt, Homo sapiens
aaaugucuaagguaguaac

SEQ ID NO: 538038 - RNA, 22 nt, Homo sapiens
aaaugucuaguuucuaguguca

SEQ ID NO: 538039 - RNA, 10 nt, Homo sapiens
aaaugucucc

SEQ ID NO: 538040 - RNA, 21 nt, Homo sapiens
aaaugucuguuucaaugaccu

SEQ ID NO: 538041 - RNA, 12 nt, Homo sapiens
aaaugugcaaua

SEQ ID NO: 538042 - RNA, 19 nt, Homo sapiens
aaaugugcagcucccauuu

SEQ ID NO: 538043 - RNA, 15 nt, Homo sapiens
aaaugugcuggucac

SEQ ID NO: 538044 - RNA, 14 nt, Homo sapiens
aaaugugcuuaugu

SEQ ID NO: 538045 - RNA, 19 nt, Homo sapiens
aaaugugguuuuccugaaa

SEQ ID NO: 538046 - RNA, 16 nt, Homo sapiens
aaauguguaagaacaa

SEQ ID NO: 538047 - RNA, 22 nt, Homo sapiens
aaaugugucauuggaagccauc

SEQ ID NO: 538048 - RNA, 18 nt, Homo sapiens
aaaugugucuugcuguca

SEQ ID NO: 538049 - RNA, 22 nt, Homo sapiens
aaauguuaacacucaugaagca

SEQ ID NO: 538050 - RNA, 13 nt, Homo sapiens
aaauguuacguga

SEQ ID NO: 538051 - RNA, 16 nt, Homo sapiens
aaauguuauuauguca

SEQ ID NO: 538052 - RNA, 19 nt, Homo sapiens
aaauguucaagucaugccu

SEQ ID NO: 538053 - RNA, 17 nt, Homo sapiens
aaauguucucaugaacu

SEQ ID NO: 538054 - RNA, 13 nt, Homo sapiens
aaauguugacagg

SEQ ID NO: 538055 - RNA, 18 nt, Homo sapiens
aaauguuuauacuguauu

SEQ ID NO: 538056 - RNA, 13 nt, Homo sapiens
aaauguuucuaca

SEQ ID NO: 538057 - RNA, 14 nt, Homo sapiens
aaauguuugagcac

SEQ ID NO: 538058 - RNA, 21 nt, Homo sapiens
aaauguuuuuaaaaaggucau

SEQ ID NO: 538059 - RNA, 15 nt, Homo sapiens
aaauuaaaaccaauu

SEQ ID NO: 538060 - RNA, 18 nt, Homo sapiens
aaauuaaaccaacaacaa

SEQ ID NO: 538061 - RNA, 19 nt, Homo sapiens
aaauuaaaccaagcagcuu

SEQ ID NO: 538062 - RNA, 18 nt, Homo sapiens
aaauuaaacuuauuuaca

SEQ ID NO: 538063 - RNA, 21 nt, Homo sapiens
aaauuaauaucuuucugcaca

SEQ ID NO: 538064 - RNA, 19 nt, Homo sapiens
aaauuacaauaaaaccuuu

SEQ ID NO: 538065 - RNA, 22 nt, Homo sapiens
aaauuacacaguuaaugccaca

SEQ ID NO: 538066 - RNA, 23 nt, Homo sapiens
aaauuacagucaucugucuuuca

SEQ ID NO: 538067 - RNA, 12 nt, Homo sapiens
aaauuacauguu

SEQ ID NO: 538068 - RNA, 14 nt, Homo sapiens
aaauuacuguguaa

SEQ ID NO: 538069 - RNA, 18 nt, Homo sapiens
aaauuagccauuucacuc

SEQ ID NO: 538070 - RNA, 19 nt, Homo sapiens
aaauuagcugggcauggug

SEQ ID NO: 538071 - RNA, 17 nt, Homo sapiens
aaauuagcugugugaaa

SEQ ID NO: 538072 - RNA, 23 nt, Homo sapiens
aaauuagcuugagcaaccuggcu

SEQ ID NO: 538073 - RNA, 21 nt, Homo sapiens
aaauuaugcaaaagcagcuaa

SEQ ID NO: 538074 - RNA, 14 nt, Homo sapiens
aaauuaugugacau

SEQ ID NO: 538075 - RNA, 23 nt, Homo sapiens
aaauuauguuugccacuuugcaa

SEQ ID NO: 538076 - RNA, 22 nt, Homo sapiens
aaauuauugacgcuuaaccuuu

SEQ ID NO: 538077 - RNA, 19 nt, Homo sapiens
aaauuauugcuguauguaa

SEQ ID NO: 538078 - RNA, 22 nt, Homo sapiens
aaauuauuugaaaacauauaaa

SEQ ID NO: 538079 - RNA, 14 nt, Homo sapiens
aaauucaaacugcc

SEQ ID NO: 538080 - RNA, 19 nt, Homo sapiens
aaauucaaagaaguacuuu

SEQ ID NO: 538081 - RNA, 19 nt, Homo sapiens
aaauucaaauaaaaauccu

SEQ ID NO: 538082 - RNA, 15 nt, Homo sapiens
aaauucaaauuauuc

SEQ ID NO: 538083 - RNA, 17 nt, Homo sapiens
aaauucaaauuauucua

SEQ ID NO: 538084 - RNA, 13 nt, Homo sapiens
aaauucaaggccu

SEQ ID NO: 538085 - RNA, 16 nt, Homo sapiens
aaauucacaaacuuuu

SEQ ID NO: 538086 - RNA, 17 nt, Homo sapiens
aaauucacaaguugugu

SEQ ID NO: 538087 - RNA, 14 nt, Homo sapiens
aaauucacuuucau

SEQ ID NO: 538088 - RNA, 15 nt, Homo sapiens
aaauucagcauuuga

SEQ ID NO: 538089 - RNA, 14 nt, Homo sapiens
aaauucaguuauaa

SEQ ID NO: 538090 - RNA, 18 nt, Homo sapiens
aaauucauccucuuacca

SEQ ID NO: 538091 - RNA, 16 nt, Homo sapiens
aaauucauuuuauucu

SEQ ID NO: 538092 - RNA, 19 nt, Homo sapiens
aaauuccaaauucauggca

SEQ ID NO: 538093 - RNA, 14 nt, Homo sapiens
aaauuccuguagca

SEQ ID NO: 538094 - RNA, 16 nt, Homo sapiens
aaaaugagugcuuaaa

SEQ ID NO: 538095 - RNA, 16 nt, Homo sapiens
aaaaugauggaaugac

SEQ ID NO: 538096 - RNA, 23 nt, Homo sapiens
aaaaugccaaaacuuaccuauaa

SEQ ID NO: 538097 - RNA, 13 nt, Homo sapiens
aaaaugccaugaa

SEQ ID NO: 538098 - RNA, 20 nt, Homo sapiens
aaaaugccugucucuagcug

SEQ ID NO: 538099 - RNA, 20 nt, Homo sapiens
aaaaugggaaaccaguucau

SEQ ID NO: 538100 - RNA, 14 nt, Homo sapiens
aaaaugggaacaau

SEQ ID NO: 538101 - RNA, 22 nt, Homo sapiens
aaaauggucauccaaacucaaa

SEQ ID NO: 538102 - RNA, 15 nt, Homo sapiens
aaaauggucaugaau

SEQ ID NO: 538103 - RNA, 22 nt, Homo sapiens
aaaauguaacaucauaauuaca

SEQ ID NO: 538104 - RNA, 14 nt, Homo sapiens
aaaauguacacugg

SEQ ID NO: 538105 - RNA, 13 nt, Homo sapiens
aaaauguacucag

SEQ ID NO: 538106 - RNA, 17 nt, Homo sapiens
aaaaugucagucugguu

SEQ ID NO: 538107 - RNA, 21 nt, Homo sapiens
aaaaugucaguguuugggaaa

SEQ ID NO: 538108 - RNA, 14 nt, Homo sapiens
aaaaugucaucuca

SEQ ID NO: 538109 - RNA, 19 nt, Homo sapiens
aaaauguccaugauggaau

SEQ ID NO: 538110 - RNA, 21 nt, Homo sapiens
aaaaugucuuaaugcaaauuu

SEQ ID NO: 538111 - RNA, 16 nt, Homo sapiens
aaaaugucuucuccca

SEQ ID NO: 538112 - RNA, 23 nt, Homo sapiens
aaaaugugacccuccaaauggag

SEQ ID NO: 538113 - RNA, 15 nt, Homo sapiens
aaaaugugcaauaug

SEQ ID NO: 538114 - RNA, 18 nt, Homo sapiens
aaaauguucuauuuaaca

SEQ ID NO: 538115 - RNA, 11 nt, Homo sapiens
aaaauguuggc

SEQ ID NO: 538116 - RNA, 15 nt, Homo sapiens
aaaauguuugagcac

SEQ ID NO: 538117 - RNA, 22 nt, Homo sapiens
aaaauguuugaguauucugcau

SEQ ID NO: 538118 - RNA, 19 nt, Homo sapiens
aaaauguuuugauggucuu

SEQ ID NO: 538119 - RNA, 15 nt, Homo sapiens
aaaauuaaacaaaua

SEQ ID NO: 538120 - RNA, 17 nt, Homo sapiens
aaaauuaauacauucua

SEQ ID NO: 538121 - RNA, 15 nt, Homo sapiens
aaaauuaauacugaa

SEQ ID NO: 538122 - RNA, 13 nt, Homo sapiens
aaaauuacauguu

SEQ ID NO: 538123 - RNA, 14 nt, Homo sapiens
aaaauuacuaauaa

SEQ ID NO: 538124 - RNA, 13 nt, Homo sapiens
aaaauuagccagg

SEQ ID NO: 538125 - RNA, 17 nt, Homo sapiens
aaaauuaucaauaucua

SEQ ID NO: 538126 - RNA, 21 nt, Homo sapiens
aaaauuauuacuaaugaugcu

SEQ ID NO: 538127 - RNA, 21 nt, Homo sapiens
aaaauucagaguccuugcaaa

SEQ ID NO: 538128 - RNA, 23 nt, Homo sapiens
aaaauucccuaaagacuaacuug

SEQ ID NO: 538129 - RNA, 18 nt, Homo sapiens
aaaauuccucuuacugua

SEQ ID NO: 538130 - RNA, 20 nt, Homo sapiens
aaaauucuauguuaauuaca

SEQ ID NO: 538131 - RNA, 20 nt, Homo sapiens
aaaauucuauuacaguaugu

SEQ ID NO: 538132 - RNA, 21 nt, Homo sapiens
aaaauucuauuacaguauguc

SEQ ID NO: 538133 - RNA, 15 nt, Homo sapiens
aaaauugacaaugau

SEQ ID NO: 538134 - RNA, 13 nt, Homo sapiens
aaaauugauauac

SEQ ID NO: 538135 - RNA, 22 nt, Homo sapiens
aaaauugcuucuuuaccaagga

SEQ ID NO: 538136 - RNA, 20 nt, Homo sapiens
aaaauuggaacucuacucaa

SEQ ID NO: 538137 - RNA, 17 nt, Homo sapiens
aaaauugggcaugccau

SEQ ID NO: 538138 - RNA, 15 nt, Homo sapiens
aaaauuuaaaucaua

SEQ ID NO: 538139 - RNA, 17 nt, Homo sapiens
aaaauuuaacuucuuca

SEQ ID NO: 538140 - RNA, 15 nt, Homo sapiens
aaaauuuagcccuuu

SEQ ID NO: 538141 - RNA, 12 nt, Homo sapiens
aaaauuuauuuc

SEQ ID NO: 538142 - RNA, 17 nt, Homo sapiens
aaaauuucauagcugua

SEQ ID NO: 538143 - RNA, 14 nt, Homo sapiens
aaaauuugcugcca

SEQ ID NO: 538144 - RNA, 15 nt, Homo sapiens
aaaauuugucuuaaa

SEQ ID NO: 538145 - RNA, 23 nt, Homo sapiens
aaaauuuguuugucacugccaaa

SEQ ID NO: 538146 - RNA, 21 nt, Homo sapiens
aaaauuuugugacauuccuuc

SEQ ID NO: 538147 - RNA, 20 nt, Homo sapiens
aaaauuuuucuuaagacaga

SEQ ID NO: 538148 - RNA, 18 nt, Homo sapiens
aaacaaaaaaacuauaaa

SEQ ID NO: 538149 - RNA, 18 nt, Homo sapiens
aaacaaaaaaccacaaaa

SEQ ID NO: 538150 - RNA, 18 nt, Homo sapiens
aaacaaaaaacccaagaa

SEQ ID NO: 538151 - RNA, 16 nt, Homo sapiens
aaacaaaaaagacuug

SEQ ID NO: 538152 - RNA, 21 nt, Homo sapiens
aaacaaaacccucagcacugu

SEQ ID NO: 538153 - RNA, 10 nt, Homo sapiens
aaacaaaaga

SEQ ID NO: 538154 - RNA, 21 nt, Homo sapiens
aaacaaaaggguguauagugu

SEQ ID NO: 538155 - RNA, 17 nt, Homo sapiens
aaacaaaauuugacuaa

SEQ ID NO: 538156 - RNA, 15 nt, Homo sapiens
aaacaaacucauuca

SEQ ID NO: 538157 - RNA, 18 nt, Homo sapiens
aaacaaaggaaguucucc

SEQ ID NO: 538158 - RNA, 16 nt, Homo sapiens
aaacaacagcuuuaaa

SEQ ID NO: 538159 - RNA, 15 nt, Homo sapiens
aaacaaccaugucau

SEQ ID NO: 538160 - RNA, 21 nt, Homo sapiens
aaacaaguacugguugacuuu

SEQ ID NO: 538161 - RNA, 23 nt, Homo sapiens
aaacaaucuuucaugucuuguca

SEQ ID NO: 538162 - RNA, 14 nt, Homo sapiens
aaacaaugcaguac

SEQ ID NO: 538163 - RNA, 19 nt, Homo sapiens
aaacaauuggcaaacuuug

SEQ ID NO: 538164 - RNA, 20 nt, Homo sapiens
aaacaauuguaaauuucuuu

SEQ ID NO: 538165 - RNA, 21 nt, Homo sapiens
aaacaauuuuuuuuuuccucu

SEQ ID NO: 538166 - RNA, 11 nt, Homo sapiens
aaacacaaaac

SEQ ID NO: 538167 - RNA, 15 nt, Homo sapiens
aaacacaaaacauuc

SEQ ID NO: 538168 - RNA, 19 nt, Homo sapiens
aaacacaaaauccauucca

SEQ ID NO: 538169 - RNA, 17 nt, Homo sapiens
aaacacaaauagaacau

SEQ ID NO: 538170 - RNA, 13 nt, Homo sapiens
aaacacacaucca

SEQ ID NO: 538171 - RNA, 13 nt, Homo sapiens
aaacacacaugga

SEQ ID NO: 538172 - RNA, 21 nt, Homo sapiens
aaacacacgagcaaacccaga

SEQ ID NO: 538173 - RNA, 21 nt, Homo sapiens
aaacacagcaacaaugacuua

SEQ ID NO: 538174 - RNA, 23 nt, Homo sapiens
aaacacagcugcuuucuucuuac

SEQ ID NO: 538175 - RNA, 23 nt, Homo sapiens
aaacacaguuacacuugugcacc

SEQ ID NO: 538176 - RNA, 22 nt, Homo sapiens
aaacacauacaggaagguagaa

SEQ ID NO: 538177 - RNA, 22 nt, Homo sapiens
aaacacaucuggccuaauguuc

SEQ ID NO: 538178 - RNA, 13 nt, Homo sapiens
aaacacauuuacc

SEQ ID NO: 538179 - RNA, 16 nt, Homo sapiens
aaacaccagucaccuc

SEQ ID NO: 538180 - RNA, 16 nt, Homo sapiens
aaacacccaugcuauc

SEQ ID NO: 538181 - RNA, 17 nt, Homo sapiens
aaacaccgcuucugccu

SEQ ID NO: 538182 - RNA, 21 nt, Homo sapiens
aaacaccuuaagaagucuaua

SEQ ID NO: 538183 - RNA, 14 nt, Homo sapiens
aaacacgugucuau

SEQ ID NO: 538184 - RNA, 16 nt, Homo sapiens
aaacacuccacagugu

SEQ ID NO: 538185 - RNA, 12 nt, Homo sapiens
aaacacugccau

SEQ ID NO: 538186 - RNA, 13 nt, Homo sapiens
aaacacuggaccu

SEQ ID NO: 538187 - RNA, 12 nt, Homo sapiens
aaacacuguaau

SEQ ID NO: 538188 - RNA, 14 nt, Homo sapiens
aaacacuuacagaa

SEQ ID NO: 538189 - RNA, 20 nt, Homo sapiens
aaacacuuccagucuggaga

SEQ ID NO: 538190 - RNA, 17 nt, Homo sapiens
aaacacuuggcauacaa

SEQ ID NO: 538191 - RNA, 20 nt, Homo sapiens
aaacagaaagcauccuaaau

SEQ ID NO: 538192 - RNA, 14 nt, Homo sapiens
aaacagaagccuga

SEQ ID NO: 538193 - RNA, 15 nt, Homo sapiens
aaacagaccccuguu

SEQ ID NO: 538194 - RNA, 20 nt, Homo sapiens
aaacagacucgcuagcacuc

SEQ ID NO: 538195 - RNA, 15 nt, Homo sapiens
aaacagagaugugau

SEQ ID NO: 538196 - RNA, 21 nt, Homo sapiens
aaacagauaacaccaaaccaa

SEQ ID NO: 538197 - RNA, 16 nt, Homo sapiens
aaacagauuucauacc

SEQ ID NO: 538198 - RNA, 21 nt, Homo sapiens
aaacagcagauuucagaucau

SEQ ID NO: 538199 - RNA, 21 nt, Homo sapiens
aaacagccccucuggacacag

SEQ ID NO: 538200 - RNA, 14 nt, Homo sapiens
aaacagcugagggu

SEQ ID NO: 538201 - RNA, 15 nt, Homo sapiens
aaacagcuguauuua

SEQ ID NO: 538202 - RNA, 16 nt, Homo sapiens
aaacaggaccacaaaa

SEQ ID NO: 538203 - RNA, 22 nt, Homo sapiens
aaacaggcaguuggccagagag

SEQ ID NO: 538204 - RNA, 13 nt, Homo sapiens
aaacagggcaaag

SEQ ID NO: 538205 - RNA, 16 nt, Homo sapiens
aaacaggguaccucaa

SEQ ID NO: 538206 - RNA, 18 nt, Homo sapiens
aaacaggugcuaauuugu

SEQ ID NO: 538207 - RNA, 14 nt, Homo sapiens
aaacaguaagaaau

SEQ ID NO: 538208 - RNA, 18 nt, Homo sapiens
aaacagugagcauaucug

SEQ ID NO: 538209 - RNA, 14 nt, Homo sapiens
aaacagugugcaug

SEQ ID NO: 538210 - RNA, 14 nt, Homo sapiens
aaacaguuuuccaa

SEQ ID NO: 538211 - RNA, 19 nt, Homo sapiens
aaacauaaggcacauugug

SEQ ID NO: 538212 - RNA, 17 nt, Homo sapiens
aaacauaauaaaaggag

SEQ ID NO: 538213 - RNA, 16 nt, Homo sapiens
aaacauacuuacauuu

SEQ ID NO: 538214 - RNA, 22 nt, Homo sapiens
aaacaucacaccugcccuaaac

SEQ ID NO: 538215 - RNA, 16 nt, Homo sapiens
aaacauccagauacac

SEQ ID NO: 538216 - RNA, 16 nt, Homo sapiens
aaacauccuugcaaau

SEQ ID NO: 538217 - RNA, 19 nt, Homo sapiens
aaacaucuccccucucacc

SEQ ID NO: 538218 - RNA, 13 nt, Homo sapiens
aaacaucuggaag

SEQ ID NO: 538219 - RNA, 19 nt, Homo sapiens
aaacaugaccuuccacaau

SEQ ID NO: 538220 - RNA, 17 nt, Homo sapiens
aaacaugauuguuuaca

SEQ ID NO: 538221 - RNA, 19 nt, Homo sapiens
aaacaugcuaaauaguucu

SEQ ID NO: 538222 - RNA, 24 nt, Homo sapiens
aaacaugcuaaauaguucuaucag

SEQ ID NO: 538223 - RNA, 21 nt, Homo sapiens
aaacaugcugaaaacuacaca

SEQ ID NO: 538224 - RNA, 23 nt, Homo sapiens
aaacaugggguuggcugggccca

SEQ ID NO: 538225 - RNA, 16 nt, Homo sapiens
aaacauguaugugcau

SEQ ID NO: 538226 - RNA, 14 nt, Homo sapiens
aaacaugucacaau

SEQ ID NO: 538227 - RNA, 9 nt, Homo sapiens
aaacauguu

SEQ ID NO: 538228 - RNA, 15 nt, Homo sapiens
aaacauguucacuua

SEQ ID NO: 538229 - RNA, 20 nt, Homo sapiens
aaacauguuguacauuucac

SEQ ID NO: 538230 - RNA, 19 nt, Homo sapiens
aaacauuaaucaccaaagu

SEQ ID NO: 538231 - RNA, 12 nt, Homo sapiens
aaacauuacugu

SEQ ID NO: 538232 - RNA, 20 nt, Homo sapiens
aaacauuauaaaaauugaca

SEQ ID NO: 538233 - RNA, 16 nt, Homo sapiens
aaacauucacaccucu

SEQ ID NO: 538234 - RNA, 18 nt, Homo sapiens
aaacauugauugcuaaau

SEQ ID NO: 538235 - RNA, 21 nt, Homo sapiens
aaacauuggauuuuuccuuaa

SEQ ID NO: 538236 - RNA, 14 nt, Homo sapiens
aaacauuugccaag

SEQ ID NO: 538237 - RNA, 22 nt, Homo sapiens
aaacauuuuaauuuuaguuuca

SEQ ID NO: 538238 - RNA, 13 nt, Homo sapiens
aaacauuuugaca

SEQ ID NO: 538239 - RNA, 15 nt, Homo sapiens
aaaccaaaaacugaa

SEQ ID NO: 538240 - RNA, 23 nt, Homo sapiens
aaaccaaaacauaaaaaccaaac

SEQ ID NO: 538241 - RNA, 20 nt, Homo sapiens
aaaccaaauuuuaaaagcca

SEQ ID NO: 538242 - RNA, 18 nt, Homo sapiens
aaaccaaccgcacaugca

SEQ ID NO: 538243 - RNA, 11 nt, Homo sapiens
aaaccaagaag

SEQ ID NO: 538244 - RNA, 15 nt, Homo sapiens
aaaccacagcccugu

SEQ ID NO: 538245 - RNA, 22 nt, Homo sapiens
aaaccacagcugggcaggguga

SEQ ID NO: 538246 - RNA, 16 nt, Homo sapiens
aaaccaccaucuucua

SEQ ID NO: 538247 - RNA, 20 nt, Homo sapiens
aaaccaccccauuaaaaagu

SEQ ID NO: 538248 - RNA, 15 nt, Homo sapiens
aaaccaccucagaaa

SEQ ID NO: 538249 - RNA, 15 nt, Homo sapiens
aaaccacuagaacuc

SEQ ID NO: 538250 - RNA, 14 nt, Homo sapiens
aaaccagagucaaa

SEQ ID NO: 538251 - RNA, 23 nt, Homo sapiens
aaaccagcccuugagucugucac

SEQ ID NO: 538252 - RNA, 16 nt, Homo sapiens
aaaccagccuggccaa

SEQ ID NO: 538253 - RNA, 16 nt, Homo sapiens
aaaccaggauuuccuu

SEQ ID NO: 538254 - RNA, 22 nt, Homo sapiens
aaaccauucuuuccccucagga

SEQ ID NO: 538255 - RNA, 22 nt, Homo sapiens
aaaccauuuuguuauugacuaa

SEQ ID NO: 538256 - RNA, 18 nt, Homo sapiens
aaacccagagcggaagga

SEQ ID NO: 538257 - RNA, 21 nt, Homo sapiens
aaacccauaaguuuaacugua

SEQ ID NO: 538258 - RNA, 22 nt, Homo sapiens
aaacccauguugaucuuucuca

SEQ ID NO: 538259 - RNA, 13 nt, Homo sapiens
aaaccccagggua

SEQ ID NO: 538260 - RNA, 13 nt, Homo sapiens
aaaccccaucucu

SEQ ID NO: 538261 - RNA, 20 nt, Homo sapiens
aaaccccaucuuuacuaaaa

SEQ ID NO: 538262 - RNA, 14 nt, Homo sapiens
aaacccccacucca

SEQ ID NO: 538263 - RNA, 21 nt, Homo sapiens
aaaccccgagauagugcugga

SEQ ID NO: 538264 - RNA, 13 nt, Homo sapiens
aaacccucaaggg

SEQ ID NO: 538265 - RNA, 17 nt, Homo sapiens
aaacccugcugaacaca

SEQ ID NO: 538266 - RNA, 21 nt, Homo sapiens
aaacccugucucuacuaaaaa

SEQ ID NO: 538267 - RNA, 16 nt, Homo sapiens
aaacccuuauacucac

SEQ ID NO: 538268 - RNA, 16 nt, Homo sapiens
aaaccgcacucaccca

SEQ ID NO: 538269 - RNA, 11 nt, Homo sapiens
aaaccuaccaa

SEQ ID NO: 538270 - RNA, 21 nt, Homo sapiens
aaaccucacaaaccuucuuua

SEQ ID NO: 538271 - RNA, 15 nt, Homo sapiens
aaaccucaucucuac

SEQ ID NO: 538272 - RNA, 20 nt, Homo sapiens
aaaccucauuaauucugaaa

SEQ ID NO: 538273 - RNA, 23 nt, Homo sapiens
aaaccuccaaggaccucucucaa

SEQ ID NO: 538274 - RNA, 15 nt, Homo sapiens
aaaccuccagccucc

SEQ ID NO: 538275 - RNA, 17 nt, Homo sapiens
aaaccuccagccucccu

SEQ ID NO: 538276 - RNA, 14 nt, Homo sapiens
aaaccucuaugcaa

SEQ ID NO: 538277 - RNA, 14 nt, Homo sapiens
aaaccucuccugac

SEQ ID NO: 538278 - RNA, 12 nt, Homo sapiens
aaaccucugggu

SEQ ID NO: 538279 - RNA, 15 nt, Homo sapiens
aaaccuggaugucac

SEQ ID NO: 538280 - RNA, 13 nt, Homo sapiens
aaaccuuccccag

SEQ ID NO: 538281 - RNA, 14 nt, Homo sapiens
aaaccuuccucagc

SEQ ID NO: 538282 - RNA, 16 nt, Homo sapiens
aaaccuugugcuacuu

SEQ ID NO: 538283 - RNA, 19 nt, Homo sapiens
aaacgccgcugacugccac

SEQ ID NO: 538284 - RNA, 23 nt, Homo sapiens
aaacgccuuuuauucuauuuaca

SEQ ID NO: 538285 - RNA, 23 nt, Homo sapiens
aaacguacauacacacaaaaacu

SEQ ID NO: 538286 - RNA, 16 nt, Homo sapiens
aaacguccuacuguau

SEQ ID NO: 538287 - RNA, 14 nt, Homo sapiens
aaacgucuaggaaa

SEQ ID NO: 538288 - RNA, 20 nt, Homo sapiens
aaacguggacucauuucacu

SEQ ID NO: 538289 - RNA, 17 nt, Homo sapiens
aaacguuaguuaauccc

SEQ ID NO: 538290 - RNA, 15 nt, Homo sapiens
aaacuaaaaagccau

SEQ ID NO: 538291 - RNA, 21 nt, Homo sapiens
aaacuaaaggugcacugcuuu

SEQ ID NO: 538292 - RNA, 17 nt, Homo sapiens
aaacuaaaucucuaaua

SEQ ID NO: 538293 - RNA, 13 nt, Homo sapiens
aaacuaaccaucu

SEQ ID NO: 538294 - RNA, 13 nt, Homo sapiens
aaacuaagccagg

SEQ ID NO: 538295 - RNA, 12 nt, Homo sapiens
aaacuaaggauu

SEQ ID NO: 538296 - RNA, 21 nt, Homo sapiens
aaacuaauuuuuggugcugau

SEQ ID NO: 538297 - RNA, 22 nt, Homo sapiens
aaacuacaagacaauuguugaa

SEQ ID NO: 538298 - RNA, 17 nt, Homo sapiens
aaacuagcacaguaaaa

SEQ ID NO: 538299 - RNA, 16 nt, Homo sapiens
aaacuauggcuuuaaa

SEQ ID NO: 538300 - RNA, 16 nt, Homo sapiens
aaacuauugagccuug

SEQ ID NO: 538301 - RNA, 19 nt, Homo sapiens
aaacuauuggaaaguacuc

SEQ ID NO: 538302 - RNA, 21 nt, Homo sapiens
aaacuauuugcagaugacaca

SEQ ID NO: 538303 - RNA, 17 nt, Homo sapiens
aaacucaagacaaugca

SEQ ID NO: 538304 - RNA, 20 nt, Homo sapiens
aaacucaaugagcucuucca

SEQ ID NO: 538305 - RNA, 20 nt, Homo sapiens
aaacucacagaacuauguac

SEQ ID NO: 538306 - RNA, 22 nt, Homo sapiens
aaacucacuauauaagucacau

SEQ ID NO: 538307 - RNA, 15 nt, Homo sapiens
aaacucacugcucaa

SEQ ID NO: 538308 - RNA, 18 nt, Homo sapiens
aaacucagaucugaucaa

SEQ ID NO: 538309 - RNA, 11 nt, Homo sapiens
aaacucaggga

SEQ ID NO: 538310 - RNA, 11 nt, Homo sapiens
aaacucagugc

SEQ ID NO: 538311 - RNA, 13 nt, Homo sapiens
aaacucagugcaa

SEQ ID NO: 538312 - RNA, 15 nt, Homo sapiens
aaacucauaacaguc

SEQ ID NO: 538313 - RNA, 12 nt, Homo sapiens
aaacucaucucc

SEQ ID NO: 538314 - RNA, 19 nt, Homo sapiens
aaacucauuacuuuuccau

SEQ ID NO: 538315 - RNA, 15 nt, Homo sapiens
aaacucauuggcuua

SEQ ID NO: 538316 - RNA, 17 nt, Homo sapiens
aaacucauuggcuuaaa

SEQ ID NO: 538317 - RNA, 12 nt, Homo sapiens
aaacuccauuga

SEQ ID NO: 538318 - RNA, 13 nt, Homo sapiens
aaacuccgucuca

SEQ ID NO: 538319 - RNA, 13 nt, Homo sapiens
aaacuccuuguua

SEQ ID NO: 538320 - RNA, 12 nt, Homo sapiens
aaacucucacca

SEQ ID NO: 538321 - RNA, 22 nt, Homo sapiens
aaacucuguccacgauucacuc

SEQ ID NO: 538322 - RNA, 20 nt, Homo sapiens
aaacucuguuacacuuuuug

SEQ ID NO: 538323 - RNA, 18 nt, Homo sapiens
aaacucuucagugcaaau

SEQ ID NO: 538324 - RNA, 12 nt, Homo sapiens
aaacucuucccu

SEQ ID NO: 538325 - RNA, 15 nt, Homo sapiens
aaacugaaagaucug

SEQ ID NO: 538326 - RNA, 14 nt, Homo sapiens
aaacugaaccacaa

SEQ ID NO: 538327 - RNA, 20 nt, Homo sapiens
aaacugagaaauuuacuaca

SEQ ID NO: 538328 - RNA, 17 nt, Homo sapiens
aaacugagacacauugg

SEQ ID NO: 538329 - RNA, 21 nt, Homo sapiens
aaacugaggaauuucaccugu

SEQ ID NO: 538330 - RNA, 21 nt, Homo sapiens
aaacugauuucuucagaauua

SEQ ID NO: 538331 - RNA, 20 nt, Homo sapiens
aaacugauuuuuagcuuuac

SEQ ID NO: 538332 - RNA, 20 nt, Homo sapiens
aaacugcaaauauugucaua

SEQ ID NO: 538333 - RNA, 14 nt, Homo sapiens
aaacugcacauugg

SEQ ID NO: 538334 - RNA, 20 nt, Homo sapiens
aaacugcauuuccuuucuac

SEQ ID NO: 538335 - RNA, 19 nt, Homo sapiens
aaacugcucuguaggucau

SEQ ID NO: 538336 - RNA, 13 nt, Homo sapiens
aaacugcuuuaua

SEQ ID NO: 538337 - RNA, 18 nt, Homo sapiens
aaacugcuuuauuuuccc

SEQ ID NO: 538338 - RNA, 21 nt, Homo sapiens
aauauaugcaucccuggugaa

SEQ ID NO: 538339 - RNA, 15 nt, Homo sapiens
aauauaugucugaua

SEQ ID NO: 538340 - RNA, 16 nt, Homo sapiens
aauaucaaaacaagua

SEQ ID NO: 538341 - RNA, 14 nt, Homo sapiens
aauaucaaagucau

SEQ ID NO: 538342 - RNA, 14 nt, Homo sapiens
aauaucaaaugcag

SEQ ID NO: 538343 - RNA, 19 nt, Homo sapiens
aauaucaacucugaagcua

SEQ ID NO: 538344 - RNA, 18 nt, Homo sapiens
aauaucacuguaaugagu

SEQ ID NO: 538345 - RNA, 17 nt, Homo sapiens
aauaucauaaagcauuu

SEQ ID NO: 538346 - RNA, 16 nt, Homo sapiens
aauaucauacuguuca

SEQ ID NO: 538347 - RNA, 17 nt, Homo sapiens
aauauccaaagacugua

SEQ ID NO: 538348 - RNA, 12 nt, Homo sapiens
aauauccaagac

SEQ ID NO: 538349 - RNA, 14 nt, Homo sapiens
aauauccaagacuu

SEQ ID NO: 538350 - RNA, 20 nt, Homo sapiens
aauauccagcgagagaaaga

SEQ ID NO: 538351 - RNA, 13 nt, Homo sapiens
aauauccauauag

SEQ ID NO: 538352 - RNA, 21 nt, Homo sapiens
aauaucccagagaacaaucac

SEQ ID NO: 538353 - RNA, 16 nt, Homo sapiens
aauaucccuacaugua

SEQ ID NO: 538354 - RNA, 17 nt, Homo sapiens
aauauccuaaacaucau

SEQ ID NO: 538355 - RNA, 22 nt, Homo sapiens
aauauccuguaauaaagcucuu

SEQ ID NO: 538356 - RNA, 23 nt, Homo sapiens
aauaucguuagggugaagcauua

SEQ ID NO: 538357 - RNA, 19 nt, Homo sapiens
aauaucuugaaacauagag

SEQ ID NO: 538358 - RNA, 12 nt, Homo sapiens
aauaucuuggcc

SEQ ID NO: 538359 - RNA, 19 nt, Homo sapiens
aauaugaaaaauguaaaua

SEQ ID NO: 538360 - RNA, 16 nt, Homo sapiens
aauaugaguaauacau

SEQ ID NO: 538361 - RNA, 21 nt, Homo sapiens
aauaugaguaauacaucaaag

SEQ ID NO: 538362 - RNA, 22 nt, Homo sapiens
aauaugaguaauacaucaaaga

SEQ ID NO: 538363 - RNA, 23 nt, Homo sapiens
aauaugaucagguaacuuucgac

SEQ ID NO: 538364 - RNA, 19 nt, Homo sapiens
aauaugcacaauagcaguu

SEQ ID NO: 538365 - RNA, 22 nt, Homo sapiens
aauaugcagaauggcauuugca

SEQ ID NO: 538366 - RNA, 16 nt, Homo sapiens
aauaugcuuuacaauc

SEQ ID NO: 538367 - RNA, 23 nt, Homo sapiens
aauauggcaaccauuauaaccuu

SEQ ID NO: 538368 - RNA, 21 nt, Homo sapiens
aauaugggcacuuuaaaugaa

SEQ ID NO: 538369 - RNA, 14 nt, Homo sapiens
aauauguaauacuu

SEQ ID NO: 538370 - RNA, 12 nt, Homo sapiens
aauauguuacaa

SEQ ID NO: 538371 - RNA, 18 nt, Homo sapiens
aauauguuguuuaccuga

SEQ ID NO: 538372 - RNA, 13 nt, Homo sapiens
aauauguuuugcc

SEQ ID NO: 538373 - RNA, 18 nt, Homo sapiens
aauauuaaaaaacuucau

SEQ ID NO: 538374 - RNA, 21 nt, Homo sapiens
aauauuaacuaaauaaacaga

SEQ ID NO: 538375 - RNA, 13 nt, Homo sapiens
aauauuacaauac

SEQ ID NO: 538376 - RNA, 14 nt, Homo sapiens
aauauuacagugaa

SEQ ID NO: 538377 - RNA, 15 nt, Homo sapiens
aauauuagcaaagaa

SEQ ID NO: 538378 - RNA, 22 nt, Homo sapiens
aauauuagguugucacgaugaa

SEQ ID NO: 538379 - RNA, 14 nt, Homo sapiens
aauauuauuagucu

SEQ ID NO: 538380 - RNA, 22 nt, Homo sapiens
aauauuauuagucugcaugguu

SEQ ID NO: 538381 - RNA, 15 nt, Homo sapiens
aauauucagauauaa

SEQ ID NO: 538382 - RNA, 18 nt, Homo sapiens
aauauucagccagcuuaa

SEQ ID NO: 538383 - RNA, 17 nt, Homo sapiens
aauauucaucuacauaa

SEQ ID NO: 538384 - RNA, 17 nt, Homo sapiens
aauauucauuuuacuca

SEQ ID NO: 538385 - RNA, 17 nt, Homo sapiens
aauauuccaauacccua

SEQ ID NO: 538386 - RNA, 23 nt, Homo sapiens
aauauuccuauauguagcuuuau

SEQ ID NO: 538387 - RNA, 14 nt, Homo sapiens
aauauucuacacau

SEQ ID NO: 538388 - RNA, 19 nt, Homo sapiens
aauauucuauaugaauuua

SEQ ID NO: 538389 - RNA, 16 nt, Homo sapiens
aauauucuguaacuau

SEQ ID NO: 538390 - RNA, 20 nt, Homo sapiens
aauauugaaguuguuuauca

SEQ ID NO: 538391 - RNA, 19 nt, Homo sapiens
aauauugcaaaauacauga

SEQ ID NO: 538392 - RNA, 15 nt, Homo sapiens
aauauugucugccuu

SEQ ID NO: 538393 - RNA, 18 nt, Homo sapiens
aauauugucugccuuaaa

SEQ ID NO: 538394 - RNA, 14 nt, Homo sapiens
aauauugugcaaac

SEQ ID NO: 538395 - RNA, 21 nt, Homo sapiens
aauauugugucauagaauuaa

SEQ ID NO: 538396 - RNA, 13 nt, Homo sapiens
aauauuguugaca

SEQ ID NO: 538397 - RNA, 14 nt, Homo sapiens
aauauuguugacaa

SEQ ID NO: 538398 - RNA, 18 nt, Homo sapiens
aauauuuaaaaaugucuu

SEQ ID NO: 538399 - RNA, 20 nt, Homo sapiens
aauauuuaaaaugaaaugag

SEQ ID NO: 538400 - RNA, 19 nt, Homo sapiens
aauauuuaaacagcagugu

SEQ ID NO: 538401 - RNA, 20 nt, Homo sapiens
aauauuuaauggaaguguau

SEQ ID NO: 538402 - RNA, 13 nt, Homo sapiens
aauauuuaguaaa

SEQ ID NO: 538403 - RNA, 17 nt, Homo sapiens
aauauuuaucugauuaa

SEQ ID NO: 538404 - RNA, 14 nt, Homo sapiens
aauauuuauugucu

SEQ ID NO: 538405 - RNA, 18 nt, Homo sapiens
aauauuucacauccugua

SEQ ID NO: 538406 - RNA, 16 nt, Homo sapiens
aauauuuccauauucu

SEQ ID NO: 538407 - RNA, 20 nt, Homo sapiens
aauauuucccucaccuuucc

SEQ ID NO: 538408 - RNA, 20 nt, Homo sapiens
aauauuuccuuaaacugugu

SEQ ID NO: 538409 - RNA, 17 nt, Homo sapiens
aauauuugcaagacaua

SEQ ID NO: 538410 - RNA, 18 nt, Homo sapiens
aauauuugcaagacauag

SEQ ID NO: 538411 - RNA, 19 nt, Homo sapiens
aauauuuuaagaauuucac

SEQ ID NO: 538412 - RNA, 18 nt, Homo sapiens
aauauuuuagccacucaa

SEQ ID NO: 538413 - RNA, 18 nt, Homo sapiens
aauauuuucucuguacuu

SEQ ID NO: 538414 - RNA, 19 nt, Homo sapiens
aauauuuuguaaugcugca

SEQ ID NO: 538415 - RNA, 19 nt, Homo sapiens
aauauuuuguuuugugcag

SEQ ID NO: 538416 - RNA, 17 nt, Homo sapiens
aauauuuuuauauuucc

SEQ ID NO: 538417 - RNA, 18 nt, Homo sapiens
aauauuuuuuuuuugcca

SEQ ID NO: 538418 - RNA, 19 nt, Homo sapiens
aaucaaaagggccaaagaa

SEQ ID NO: 538419 - RNA, 14 nt, Homo sapiens
aaucaaaccucagg

SEQ ID NO: 538420 - RNA, 12 nt, Homo sapiens
aaucaaagacau

SEQ ID NO: 538421 - RNA, 13 nt, Homo sapiens
aaucaaagcacuu

SEQ ID NO: 538422 - RNA, 22 nt, Homo sapiens
aaucaaaggaaaauaguaaugu

SEQ ID NO: 538423 - RNA, 13 nt, Homo sapiens
aaucaaauagcau

SEQ ID NO: 538424 - RNA, 17 nt, Homo sapiens
aaucaaaucugugcucu

SEQ ID NO: 538425 - RNA, 20 nt, Homo sapiens
aaucaaaucugugcucuuuc

SEQ ID NO: 538426 - RNA, 16 nt, Homo sapiens
aaucaaauuuugccag

SEQ ID NO: 538427 - RNA, 18 nt, Homo sapiens
aaucaacaaaauggucau

SEQ ID NO: 538428 - RNA, 17 nt, Homo sapiens
aaucaacaagauuucca

SEQ ID NO: 538429 - RNA, 17 nt, Homo sapiens
aaucaacagaagcauuu

SEQ ID NO: 538430 - RNA, 15 nt, Homo sapiens
aaucaacaugcuuua

SEQ ID NO: 538431 - RNA, 23 nt, Homo sapiens
aaucaacuggagucuaugcuuaa

SEQ ID NO: 538432 - RNA, 19 nt, Homo sapiens
aaucaagagugaacaugua

SEQ ID NO: 538433 - RNA, 13 nt, Homo sapiens
aaucaaguccuuu

SEQ ID NO: 538434 - RNA, 21 nt, Homo sapiens
aaucaaguucuagcauuuuag

SEQ ID NO: 538435 - RNA, 20 nt, Homo sapiens
aaucaaguuguaacuuauau

SEQ ID NO: 538436 - RNA, 13 nt, Homo sapiens
aaucaauauccca

SEQ ID NO: 538437 - RNA, 14 nt, Homo sapiens
aaucaaugaagcaa

SEQ ID NO: 538438 - RNA, 13 nt, Homo sapiens
aaucacaaaaaca

SEQ ID NO: 538439 - RNA, 18 nt, Homo sapiens
aaucacaaaccaagccau

SEQ ID NO: 538440 - RNA, 18 nt, Homo sapiens
aaucacacagccaagcca

SEQ ID NO: 538441 - RNA, 23 nt, Homo sapiens
aaucacaggacauuaaggaccaa

SEQ ID NO: 538442 - RNA, 13 nt, Homo sapiens
aaucacaucucca

SEQ ID NO: 538443 - RNA, 18 nt, Homo sapiens
aaucacauuuuaagugcu

SEQ ID NO: 538444 - RNA, 14 nt, Homo sapiens
aaucaccucucugu

SEQ ID NO: 538445 - RNA, 19 nt, Homo sapiens
aaucacgagaucuuccuuc

SEQ ID NO: 538446 - RNA, 14 nt, Homo sapiens
aaucacucuguccu

SEQ ID NO: 538447 - RNA, 15 nt, Homo sapiens
aaucacugcauuuca

SEQ ID NO: 538448 - RNA, 22 nt, Homo sapiens
aaucacuugcacuccggaggua

SEQ ID NO: 538449 - RNA, 13 nt, Homo sapiens
aaucagagacaaa

SEQ ID NO: 538450 - RNA, 23 nt, Homo sapiens
aaaagaaauauacaguuugacuu

SEQ ID NO: 538451 - RNA, 15 nt, Homo sapiens
aaaagaaaugaacau

SEQ ID NO: 538452 - RNA, 21 nt, Homo sapiens
aaaagaagacaacauuucuca

SEQ ID NO: 538453 - RNA, 16 nt, Homo sapiens
aaaagaagcaaccuca

SEQ ID NO: 538454 - RNA, 17 nt, Homo sapiens
aaaagaauaguugccaa

SEQ ID NO: 538455 - RNA, 15 nt, Homo sapiens
aaaagaaugacuaua

SEQ ID NO: 538456 - RNA, 20 nt, Homo sapiens
aaaagacugguuuguuugcu

SEQ ID NO: 538457 - RNA, 15 nt, Homo sapiens
aaaagaggugucaug

SEQ ID NO: 538458 - RNA, 12 nt, Homo sapiens
aaaagaguaugu

SEQ ID NO: 538459 - RNA, 15 nt, Homo sapiens
aaaagaguauguagu

SEQ ID NO: 538460 - RNA, 16 nt, Homo sapiens
aaaagauacugaugca

SEQ ID NO: 538461 - RNA, 16 nt, Homo sapiens
aaaagaucuacauaca

SEQ ID NO: 538462 - RNA, 14 nt, Homo sapiens
aaaagaucuugaau

SEQ ID NO: 538463 - RNA, 20 nt, Homo sapiens
aaaagaucuugaauagucuc

SEQ ID NO: 538464 - RNA, 23 nt, Homo sapiens
aaaagaugcuucucacugccaug

SEQ ID NO: 538465 - RNA, 17 nt, Homo sapiens
aaaagcaaauagaucau

SEQ ID NO: 538466 - RNA, 20 nt, Homo sapiens
aaaagcaaauagaucaugca

SEQ ID NO: 538467 - RNA, 16 nt, Homo sapiens
aaaagcaacaggccau

SEQ ID NO: 538468 - RNA, 16 nt, Homo sapiens
aaaagcaauacuguuu

SEQ ID NO: 538469 - RNA, 13 nt, Homo sapiens
aaaagcacacucc

SEQ ID NO: 538470 - RNA, 11 nt, Homo sapiens
aaaagcacuua

SEQ ID NO: 538471 - RNA, 17 nt, Homo sapiens
aaaagcaguaggagaaa

SEQ ID NO: 538472 - RNA, 17 nt, Homo sapiens
aaaagcauaaggccgga

SEQ ID NO: 538473 - RNA, 15 nt, Homo sapiens
aaaagccacaaugaa

SEQ ID NO: 538474 - RNA, 23 nt, Homo sapiens
aaaagcccucaucuucucuuucu

SEQ ID NO: 538475 - RNA, 10 nt, Homo sapiens
aaaagcuuuc

SEQ ID NO: 538476 - RNA, 21 nt, Homo sapiens
aaaagcuuucugccaccccua

SEQ ID NO: 538477 - RNA, 18 nt, Homo sapiens
aaaaggaaaaugaaacua

SEQ ID NO: 538478 - RNA, 12 nt, Homo sapiens
aaaaggaccagc

SEQ ID NO: 538479 - RNA, 20 nt, Homo sapiens
aaaaggacucucaggaccaa

SEQ ID NO: 538480 - RNA, 20 nt, Homo sapiens
aaaaggacucugcuucaguc

SEQ ID NO: 538481 - RNA, 21 nt, Homo sapiens
aaaaggacucugcuucagucc

SEQ ID NO: 538482 - RNA, 17 nt, Homo sapiens
aaaaggagccugugaga

SEQ ID NO: 538483 - RNA, 15 nt, Homo sapiens
aaaaggauaugcagu

SEQ ID NO: 538484 - RNA, 23 nt, Homo sapiens
aaaaggauaugcaguaugcuuaa

SEQ ID NO: 538485 - RNA, 23 nt, Homo sapiens
aaaaggauguuacaaguuugcua

SEQ ID NO: 538486 - RNA, 19 nt, Homo sapiens
aaaaggcccuuuucagggc

SEQ ID NO: 538487 - RNA, 18 nt, Homo sapiens
aaaagggaaguugugccu

SEQ ID NO: 538488 - RNA, 14 nt, Homo sapiens
aaaagggccaaaga

SEQ ID NO: 538489 - RNA, 24 nt, Homo sapiens
aaaagguauuuugaauaccauuaa

SEQ ID NO: 538490 - RNA, 16 nt, Homo sapiens
aaaagguccuugccuc

SEQ ID NO: 538491 - RNA, 16 nt, Homo sapiens
aaaaggucucaccaca

SEQ ID NO: 538492 - RNA, 21 nt, Homo sapiens
aaaaggucugaggacugagcc

SEQ ID NO: 538493 - RNA, 14 nt, Homo sapiens
aaaaggugauucua

SEQ ID NO: 538494 - RNA, 19 nt, Homo sapiens
aaaagguuaaauauuguca

SEQ ID NO: 538495 - RNA, 20 nt, Homo sapiens
aaaagguuaaauauugucau

SEQ ID NO: 538496 - RNA, 14 nt, Homo sapiens
aaaaguaaagacua

SEQ ID NO: 538497 - RNA, 19 nt, Homo sapiens
aaaaguacaaagggcacau

SEQ ID NO: 538498 - RNA, 14 nt, Homo sapiens
aaaaguacauguau

SEQ ID NO: 538499 - RNA, 19 nt, Homo sapiens
aaaaguacauguugauacu

SEQ ID NO: 538500 - RNA, 13 nt, Homo sapiens
aaaaguacauuaa

SEQ ID NO: 538501 - RNA, 19 nt, Homo sapiens
aaaaguagguuuacauuca

SEQ ID NO: 538502 - RNA, 23 nt, Homo sapiens
aaaaguauucuuguuagaaucug

SEQ ID NO: 538503 - RNA, 18 nt, Homo sapiens
aaaagucaacaaacugca

SEQ ID NO: 538504 - RNA, 13 nt, Homo sapiens
aaaagucaaguuu

SEQ ID NO: 538505 - RNA, 16 nt, Homo sapiens
aaaagucagagacaga

SEQ ID NO: 538506 - RNA, 23 nt, Homo sapiens
aaaaguccaauguugugugcaug

SEQ ID NO: 538507 - RNA, 19 nt, Homo sapiens
aaaagucuacaacauagca

SEQ ID NO: 538508 - RNA, 15 nt, Homo sapiens
aaaagucuaccaccg

SEQ ID NO: 538509 - RNA, 23 nt, Homo sapiens
aaaagugaaucuugcuguuuuca

SEQ ID NO: 538510 - RNA, 12 nt, Homo sapiens
aaaagugauuau

SEQ ID NO: 538511 - RNA, 13 nt, Homo sapiens
aaaagugucucaa

SEQ ID NO: 538512 - RNA, 13 nt, Homo sapiens
aaaaguuacuuau

SEQ ID NO: 538513 - RNA, 13 nt, Homo sapiens
aaaaguuagucaa

SEQ ID NO: 538514 - RNA, 16 nt, Homo sapiens
aaaaguuagucaaucc

SEQ ID NO: 538515 - RNA, 21 nt, Homo sapiens
aaaaguuagucaauccuguca

SEQ ID NO: 538516 - RNA, 14 nt, Homo sapiens
aaaaguugugcaug

SEQ ID NO: 538517 - RNA, 12 nt, Homo sapiens
aaaaguuuacaa

SEQ ID NO: 538518 - RNA, 17 nt, Homo sapiens
aaaauaaaaaacauaua

SEQ ID NO: 538519 - RNA, 15 nt, Homo sapiens
aaaauaaaagaucuu

SEQ ID NO: 538520 - RNA, 16 nt, Homo sapiens
aaaauaaaagaucuug

SEQ ID NO: 538521 - RNA, 18 nt, Homo sapiens
aaaauaaaauacuuugag

SEQ ID NO: 538522 - RNA, 17 nt, Homo sapiens
aaaauaaagcaaugugu

SEQ ID NO: 538523 - RNA, 13 nt, Homo sapiens
aaaauaagaucuc

SEQ ID NO: 538524 - RNA, 21 nt, Homo sapiens
aaaauaauagacucgcuaguc

SEQ ID NO: 538525 - RNA, 19 nt, Homo sapiens
aaaauaauuauaaauauca

SEQ ID NO: 538526 - RNA, 17 nt, Homo sapiens
aaaauacauaucgcuga

SEQ ID NO: 538527 - RNA, 18 nt, Homo sapiens
aaaauacaugacauuuau

SEQ ID NO: 538528 - RNA, 12 nt, Homo sapiens
aaaauacaugua

SEQ ID NO: 538529 - RNA, 13 nt, Homo sapiens
aaaauacauugua

SEQ ID NO: 538530 - RNA, 12 nt, Homo sapiens
aaaauaccucuu

SEQ ID NO: 538531 - RNA, 16 nt, Homo sapiens
aaaauacgaaguggag

SEQ ID NO: 538532 - RNA, 16 nt, Homo sapiens
aaaauagacuaacuuc

SEQ ID NO: 538533 - RNA, 18 nt, Homo sapiens
aaaauagagccugaggga

SEQ ID NO: 538534 - RNA, 13 nt, Homo sapiens
aaaauagcaaaag

SEQ ID NO: 538535 - RNA, 15 nt, Homo sapiens
aaaauagcucuuuca

SEQ ID NO: 538536 - RNA, 21 nt, Homo sapiens
aaaauaggauugcuucaauua

SEQ ID NO: 538537 - RNA, 16 nt, Homo sapiens
aaaauaguaaacauua

SEQ ID NO: 538538 - RNA, 14 nt, Homo sapiens
aaaauaguuuagau

SEQ ID NO: 538539 - RNA, 20 nt, Homo sapiens
aaaauauagcuguacaaaua

SEQ ID NO: 538540 - RNA, 15 nt, Homo sapiens
aaaauauauacuaaa

SEQ ID NO: 538541 - RNA, 17 nt, Homo sapiens
aaaauauauguauuuaa

SEQ ID NO: 538542 - RNA, 17 nt, Homo sapiens
aaaauauguaauuucaa

SEQ ID NO: 538543 - RNA, 14 nt, Homo sapiens
aaaauaugucauca

SEQ ID NO: 538544 - RNA, 16 nt, Homo sapiens
aaaauauuucagauau

SEQ ID NO: 538545 - RNA, 15 nt, Homo sapiens
aaaaucacaucucca

SEQ ID NO: 538546 - RNA, 19 nt, Homo sapiens
aaaaucagagaacuuuccc

SEQ ID NO: 538547 - RNA, 19 nt, Homo sapiens
aaaaucaguguuuaaauaa

SEQ ID NO: 538548 - RNA, 16 nt, Homo sapiens
aaaaucauaguacucu

SEQ ID NO: 538549 - RNA, 16 nt, Homo sapiens
aaaaucaugggccaga

SEQ ID NO: 538550 - RNA, 17 nt, Homo sapiens
aacaugauugaaccauu

SEQ ID NO: 538551 - RNA, 14 nt, Homo sapiens
aacaugcaaagauc

SEQ ID NO: 538552 - RNA, 22 nt, Homo sapiens
aacaugcaagaccaguauucua

SEQ ID NO: 538553 - RNA, 18 nt, Homo sapiens
aacaugcaguucauuauu

SEQ ID NO: 538554 - RNA, 16 nt, Homo sapiens
aacaugcauacuuuau

SEQ ID NO: 538555 - RNA, 13 nt, Homo sapiens
aacaugccagaag

SEQ ID NO: 538556 - RNA, 20 nt, Homo sapiens
aacaugcuaaauaguucuau

SEQ ID NO: 538557 - RNA, 22 nt, Homo sapiens
aacaugcuugaauaacugagcu

SEQ ID NO: 538558 - RNA, 13 nt, Homo sapiens
aacaugcuuuaau

SEQ ID NO: 538559 - RNA, 13 nt, Homo sapiens
acgacuucagggc

SEQ ID NO: 538560 - RNA, 17 nt, Homo sapiens
acgagauaccaucucac

SEQ ID NO: 538561 - RNA, 17 nt, Homo sapiens
acgagccuccucagggg

SEQ ID NO: 538562 - RNA, 20 nt, Homo sapiens
acgagucaccugcaagcccc

SEQ ID NO: 538563 - RNA, 21 nt, Homo sapiens
acgauguucuguacaacuuaa

SEQ ID NO: 538564 - RNA, 18 nt, Homo sapiens
acgauucuucacuucuug

SEQ ID NO: 538565 - RNA, 18 nt, Homo sapiens
acgcacacaucuuaccuc

SEQ ID NO: 538566 - RNA, 16 nt, Homo sapiens
acgcacauaccuucau

SEQ ID NO: 538567 - RNA, 19 nt, Homo sapiens
acgcaccagacacucacag

SEQ ID NO: 538568 - RNA, 18 nt, Homo sapiens
acgcaccuguagucccag

SEQ ID NO: 538569 - RNA, 20 nt, Homo sapiens
acgcacgcucgcugccauca

SEQ ID NO: 538570 - RNA, 11 nt, Homo sapiens
acgcacugcuc

SEQ ID NO: 538571 - RNA, 16 nt, Homo sapiens
acgcacugguaugugu

SEQ ID NO: 538572 - RNA, 15 nt, Homo sapiens
acgcagaucacuaaa

SEQ ID NO: 538573 - RNA, 16 nt, Homo sapiens
acgcauccagcaagaa

SEQ ID NO: 538574 - RNA, 12 nt, Homo sapiens
acgcaugugcag

SEQ ID NO: 538575 - RNA, 16 nt, Homo sapiens
acgcaugugugcugca

SEQ ID NO: 538576 - RNA, 17 nt, Homo sapiens
acgcaugugugcugcag

SEQ ID NO: 538577 - RNA, 20 nt, Homo sapiens
acgccaaagugcagcccuuc

SEQ ID NO: 538578 - RNA, 15 nt, Homo sapiens
acgccacucauuuca

SEQ ID NO: 538579 - RNA, 21 nt, Homo sapiens
acgccacucauuucaucucau

SEQ ID NO: 538580 - RNA, 17 nt, Homo sapiens
acgccacucccugggac

SEQ ID NO: 538581 - RNA, 20 nt, Homo sapiens
acgccagcuccucucugaag

SEQ ID NO: 538582 - RNA, 20 nt, Homo sapiens
acgcccuauuucuaugucau

SEQ ID NO: 538583 - RNA, 20 nt, Homo sapiens
acgccuaaaacucaaaacac

SEQ ID NO: 538584 - RNA, 14 nt, Homo sapiens
acgccugagcucac

SEQ ID NO: 538585 - RNA, 19 nt, Homo sapiens
acgccugcccuccccagag

SEQ ID NO: 538586 - RNA, 15 nt, Homo sapiens
acgccuguaauccca

SEQ ID NO: 538587 - RNA, 21 nt, Homo sapiens
acgccuguaaucccagcacuu

SEQ ID NO: 538588 - RNA, 18 nt, Homo sapiens
acgcgcguacagaucucu

SEQ ID NO: 538589 - RNA, 17 nt, Homo sapiens
acgcuaaagagcccuug

SEQ ID NO: 538590 - RNA, 18 nt, Homo sapiens
acgcucgcugccaucacc

SEQ ID NO: 538591 - RNA, 19 nt, Homo sapiens
acgcugauaauaugcaaau

SEQ ID NO: 538592 - RNA, 16 nt, Homo sapiens
acgcuggcaacacaga

SEQ ID NO: 538593 - RNA, 21 nt, Homo sapiens
acgcuggggaauauacgugcu

SEQ ID NO: 538594 - RNA, 22 nt, Homo sapiens
acgcuggguccuaauuaccagu

SEQ ID NO: 538595 - RNA, 16 nt, Homo sapiens
acgcuucauuuccuug

SEQ ID NO: 538596 - RNA, 20 nt, Homo sapiens
acgcuuguagaacucacucu

SEQ ID NO: 538597 - RNA, 17 nt, Homo sapiens
acgcuuguuugccugaa

SEQ ID NO: 538598 - RNA, 16 nt, Homo sapiens
acgcuuuuaauucuca

SEQ ID NO: 538599 - RNA, 20 nt, Homo sapiens
acggaauaaugaguuagaac

SEQ ID NO: 538600 - RNA, 22 nt, Homo sapiens
acggaauauuuaaacaguagcu

SEQ ID NO: 538601 - RNA, 12 nt, Homo sapiens
acggacacucaa

SEQ ID NO: 538602 - RNA, 21 nt, Homo sapiens
acggagccccugaaagccuca

SEQ ID NO: 538603 - RNA, 15 nt, Homo sapiens
acggaggaugaugcc

SEQ ID NO: 538604 - RNA, 19 nt, Homo sapiens
acggagggccgugugacac

SEQ ID NO: 538605 - RNA, 21 nt, Homo sapiens
acggaguuucacucuugucac

SEQ ID NO: 538606 - RNA, 15 nt, Homo sapiens
acggaugaguuauua

SEQ ID NO: 538607 - RNA, 14 nt, Homo sapiens
acggcaagguuuaa

SEQ ID NO: 538608 - RNA, 12 nt, Homo sapiens
acggccaugaga

SEQ ID NO: 538609 - RNA, 21 nt, Homo sapiens
acggcgugccuggacacugua

SEQ ID NO: 538610 - RNA, 20 nt, Homo sapiens
acggcugccugacacugagc

SEQ ID NO: 538611 - RNA, 22 nt, Homo sapiens
acgggcaugggccucucugggg

SEQ ID NO: 538612 - RNA, 15 nt, Homo sapiens
acggggcuuacagga

SEQ ID NO: 538613 - RNA, 18 nt, Homo sapiens
acgggucugagacugaaa

SEQ ID NO: 538614 - RNA, 23 nt, Homo sapiens
acgguaaguguucucaugaagca

SEQ ID NO: 538615 - RNA, 16 nt, Homo sapiens
acggucaguccauguc

SEQ ID NO: 538616 - RNA, 17 nt, Homo sapiens
acgguccgcggccugca

SEQ ID NO: 538617 - RNA, 12 nt, Homo sapiens
acggugccaagg

SEQ ID NO: 538618 - RNA, 20 nt, Homo sapiens
acgguggcucacgccuguaa

SEQ ID NO: 538619 - RNA, 15 nt, Homo sapiens
acgguguccaugccu

SEQ ID NO: 538620 - RNA, 17 nt, Homo sapiens
acgguuuaauucugucu

SEQ ID NO: 538621 - RNA, 21 nt, Homo sapiens
acguaaaaagaaaaaaaccau

SEQ ID NO: 538622 - RNA, 16 nt, Homo sapiens
acguaccccacugggc

SEQ ID NO: 538623 - RNA, 17 nt, Homo sapiens
acgucagugcucagaaa

SEQ ID NO: 538624 - RNA, 18 nt, Homo sapiens
acgucauguguuuugcca

SEQ ID NO: 538625 - RNA, 21 nt, Homo sapiens
acgucccagcggccucagggu

SEQ ID NO: 538626 - RNA, 19 nt, Homo sapiens
acguccuccguccauauca

SEQ ID NO: 538627 - RNA, 18 nt, Homo sapiens
acgucuccuucacugaag

SEQ ID NO: 538628 - RNA, 22 nt, Homo sapiens
acgucugggagaaauugacaga

SEQ ID NO: 538629 - RNA, 20 nt, Homo sapiens
acgugauccucucaccucag

SEQ ID NO: 538630 - RNA, 14 nt, Homo sapiens
acgugcagccacac

SEQ ID NO: 538631 - RNA, 19 nt, Homo sapiens
acgugcauccuuguaauac

SEQ ID NO: 538632 - RNA, 14 nt, Homo sapiens
acgugccuaccucu

SEQ ID NO: 538633 - RNA, 18 nt, Homo sapiens
acgugcgcucugccauuc

SEQ ID NO: 538634 - RNA, 18 nt, Homo sapiens
acgugcgugcgagcacac

SEQ ID NO: 538635 - RNA, 17 nt, Homo sapiens
acguggcucagccagca

SEQ ID NO: 538636 - RNA, 19 nt, Homo sapiens
acgugggcaaacaggcagu

SEQ ID NO: 538637 - RNA, 16 nt, Homo sapiens
acguguaaauugcaca

SEQ ID NO: 538638 - RNA, 18 nt, Homo sapiens
acguguauaguaucugua

SEQ ID NO: 538639 - RNA, 23 nt, Homo sapiens
acguguggaauuuuccacuucug

SEQ ID NO: 538640 - RNA, 15 nt, Homo sapiens
acguuaagugaugaa

SEQ ID NO: 538641 - RNA, 23 nt, Homo sapiens
acguuguuuugguuguacuuugg

SEQ ID NO: 538642 - RNA, 16 nt, Homo sapiens
acguuuaacauacaau

SEQ ID NO: 538643 - RNA, 22 nt, Homo sapiens
acguuucuaaaggcuaccuuug

SEQ ID NO: 538644 - RNA, 14 nt, Homo sapiens
acguuucuguggag

SEQ ID NO: 538645 - RNA, 13 nt, Homo sapiens
acguuucuucccc

SEQ ID NO: 538646 - RNA, 23 nt, Homo sapiens
acguuuguccuuuuucacuuuga

SEQ ID NO: 538647 - RNA, 15 nt, Homo sapiens
acguuuucuuucaca

SEQ ID NO: 538648 - RNA, 17 nt, Homo sapiens
acguuuuggucacauau

SEQ ID NO: 538649 - RNA, 14 nt, Homo sapiens
acuaaaaaugcaaa

SEQ ID NO: 538650 - RNA, 15 nt, Homo sapiens
acuaaaacacugaaa

SEQ ID NO: 538651 - RNA, 21 nt, Homo sapiens
acuaaaacuuuccugacuuac

SEQ ID NO: 538652 - RNA, 16 nt, Homo sapiens
acuaaaaggugaccaa

SEQ ID NO: 538653 - RNA, 22 nt, Homo sapiens
acuaaaaugugucuugcuguca

SEQ ID NO: 538654 - RNA, 22 nt, Homo sapiens
acuaaaauuguaucaaauguga

SEQ ID NO: 538655 - RNA, 22 nt, Homo sapiens
acuaaaauuuuaggcacucuua

SEQ ID NO: 538656 - RNA, 23 nt, Homo sapiens
acuaaacaauaagcaagagacaa

SEQ ID NO: 538657 - RNA, 14 nt, Homo sapiens
acuaaacugcugca

SEQ ID NO: 538658 - RNA, 17 nt, Homo sapiens
acuaaacuucaccuaca

SEQ ID NO: 538659 - RNA, 22 nt, Homo sapiens
acuaaagcaaauuuuagaacuu

SEQ ID NO: 538660 - RNA, 15 nt, Homo sapiens
acuaaauaagcuucc

SEQ ID NO: 538661 - RNA, 14 nt, Homo sapiens
acuaaauaugugac

SEQ ID NO: 538662 - RNA, 13 nt, Homo sapiens
acuaaaugaacau

SEQ ID NO: 538663 - RNA, 20 nt, Homo sapiens
acuaaaugguguuacauuaa

SEQ ID NO: 538664 - RNA, 22 nt, Homo sapiens
acuaacaagaauguaacuccag

SEQ ID NO: 538665 - RNA, 17 nt, Homo sapiens
acuaacacuuuaguuau

SEQ ID NO: 538666 - RNA, 18 nt, Homo sapiens
acuaaccauccccaacuc

SEQ ID NO: 538667 - RNA, 22 nt, Homo sapiens
acuaaccaucugaagaaacuuc

SEQ ID NO: 538668 - RNA, 13 nt, Homo sapiens
acuaacccaaugc

SEQ ID NO: 538669 - RNA, 15 nt, Homo sapiens
acuaacccaaugccu

SEQ ID NO: 538670 - RNA, 19 nt, Homo sapiens
acuaagaaaaaaagcacaa

SEQ ID NO: 538671 - RNA, 15 nt, Homo sapiens
acuaagaaauaugca

SEQ ID NO: 538672 - RNA, 14 nt, Homo sapiens
acuaagcaauuucc

SEQ ID NO: 538673 - RNA, 12 nt, Homo sapiens
acuaagcacaaa

SEQ ID NO: 538674 - RNA, 13 nt, Homo sapiens
acuaagcacaaag

SEQ ID NO: 538675 - RNA, 19 nt, Homo sapiens
acuaaggcugcuucaaaga

SEQ ID NO: 538676 - RNA, 14 nt, Homo sapiens
acuaauacuacugu

SEQ ID NO: 538677 - RNA, 22 nt, Homo sapiens
acuaauagaauaaaggcaguuu

SEQ ID NO: 538678 - RNA, 22 nt, Homo sapiens
acuaaucaagaaaaacaucuuu

SEQ ID NO: 538679 - RNA, 22 nt, Homo sapiens
acuaaugaucacauucuuucca

SEQ ID NO: 538680 - RNA, 16 nt, Homo sapiens
acuaaugauguuuucc

SEQ ID NO: 538681 - RNA, 15 nt, Homo sapiens
accucugcacaagcu

SEQ ID NO: 538682 - RNA, 10 nt, Homo sapiens
accucugcau

SEQ ID NO: 538683 - RNA, 22 nt, Homo sapiens
accucuggcaugaauauuucau

SEQ ID NO: 538684 - RNA, 23 nt, Homo sapiens
accucugugaccaacuguuggau

SEQ ID NO: 538685 - RNA, 18 nt, Homo sapiens
accucuguuguccucccc

SEQ ID NO: 538686 - RNA, 14 nt, Homo sapiens
accucuuauugcaa

SEQ ID NO: 538687 - RNA, 22 nt, Homo sapiens
accucuucaugagcuugaacaa

SEQ ID NO: 538688 - RNA, 18 nt, Homo sapiens
accucuucccaugacugc

SEQ ID NO: 538689 - RNA, 19 nt, Homo sapiens
accucuucucuuccuguaa

SEQ ID NO: 538690 - RNA, 20 nt, Homo sapiens
accucuucugggaacuuccu

SEQ ID NO: 538691 - RNA, 21 nt, Homo sapiens
accucuuuauuuuuugauuga

SEQ ID NO: 538692 - RNA, 20 nt, Homo sapiens
accugaaaacacugugcaca

SEQ ID NO: 538693 - RNA, 15 nt, Homo sapiens
accugaaacacugga

SEQ ID NO: 538694 - RNA, 16 nt, Homo sapiens
accugaaacacuggac

SEQ ID NO: 538695 - RNA, 18 nt, Homo sapiens
accugaaauaaaauucau

SEQ ID NO: 538696 - RNA, 19 nt, Homo sapiens
accugaaauuuauucacau

SEQ ID NO: 538697 - RNA, 17 nt, Homo sapiens
accugaagacugaggac

SEQ ID NO: 538698 - RNA, 18 nt, Homo sapiens
accugacaauggcagcua

SEQ ID NO: 538699 - RNA, 14 nt, Homo sapiens
accugagauggagg

SEQ ID NO: 538700 - RNA, 18 nt, Homo sapiens
accugauauucaggcuac

SEQ ID NO: 538701 - RNA, 17 nt, Homo sapiens
accugauugaucacaca

SEQ ID NO: 538702 - RNA, 12 nt, Homo sapiens
accugcaaaaaa

SEQ ID NO: 538703 - RNA, 11 nt, Homo sapiens
accugcacaac

SEQ ID NO: 538704 - RNA, 23 nt, Homo sapiens
accugcaccuccccccacugcag

SEQ ID NO: 538705 - RNA, 19 nt, Homo sapiens
accugcagggugugugcua

SEQ ID NO: 538706 - RNA, 13 nt, Homo sapiens
accugcaugugcu

SEQ ID NO: 538707 - RNA, 17 nt, Homo sapiens
accugcaugugcuguca

SEQ ID NO: 538708 - RNA, 18 nt, Homo sapiens
accugcaugugcugucac

SEQ ID NO: 538709 - RNA, 22 nt, Homo sapiens
accugcccaaggaugcugucaa

SEQ ID NO: 538710 - RNA, 22 nt, Homo sapiens
accugccccggaccuaccuccc

SEQ ID NO: 538711 - RNA, 23 nt, Homo sapiens
accugcccugggccacacugacc

SEQ ID NO: 538712 - RNA, 17 nt, Homo sapiens
accugccgucuucacuu

SEQ ID NO: 538713 - RNA, 20 nt, Homo sapiens
accugccugcaucugugaaa

SEQ ID NO: 538714 - RNA, 16 nt, Homo sapiens
accugcgaaggaugau

SEQ ID NO: 538715 - RNA, 21 nt, Homo sapiens
accugcgucauuucagcucuu

SEQ ID NO: 538716 - RNA, 18 nt, Homo sapiens
accugcguuuucauuugu

SEQ ID NO: 538717 - RNA, 23 nt, Homo sapiens
accugcucuuguucuacugagaa

SEQ ID NO: 538718 - RNA, 23 nt, Homo sapiens
accugcugagaaaacaugccucu

SEQ ID NO: 538719 - RNA, 14 nt, Homo sapiens
accuggaaccagag

SEQ ID NO: 538720 - RNA, 20 nt, Homo sapiens
accuggaaucuacaagccaa

SEQ ID NO: 538721 - RNA, 23 nt, Homo sapiens
accuggacacaacaccaaaaagg

SEQ ID NO: 538722 - RNA, 21 nt, Homo sapiens
accuggagcggcuauuccagg

SEQ ID NO: 538723 - RNA, 19 nt, Homo sapiens
accuggccgcuaaguugcu

SEQ ID NO: 538724 - RNA, 17 nt, Homo sapiens
accuggcuuuuacuuua

SEQ ID NO: 538725 - RNA, 14 nt, Homo sapiens
accugggacccugc

SEQ ID NO: 538726 - RNA, 16 nt, Homo sapiens
accugggcauuguuga

SEQ ID NO: 538727 - RNA, 20 nt, Homo sapiens
accugggcccacagagccug

SEQ ID NO: 538728 - RNA, 18 nt, Homo sapiens
accuggggugaauacuua

SEQ ID NO: 538729 - RNA, 13 nt, Homo sapiens
accuggguccuuu

SEQ ID NO: 538730 - RNA, 19 nt, Homo sapiens
accugguacccuccuggcu

SEQ ID NO: 538731 - RNA, 17 nt, Homo sapiens
accuggucaauagugau

SEQ ID NO: 538732 - RNA, 16 nt, Homo sapiens
accugguccgugcacu

SEQ ID NO: 538733 - RNA, 20 nt, Homo sapiens
accuguaaucccagcacuuu

SEQ ID NO: 538734 - RNA, 21 nt, Homo sapiens
accuguaccuggccuggccuc

SEQ ID NO: 538735 - RNA, 15 nt, Homo sapiens
accuguacuaaacca

SEQ ID NO: 538736 - RNA, 14 nt, Homo sapiens
accuguagauucag

SEQ ID NO: 538737 - RNA, 15 nt, Homo sapiens
accuguaggucagga

SEQ ID NO: 538738 - RNA, 13 nt, Homo sapiens
accuguaguccca

SEQ ID NO: 538739 - RNA, 16 nt, Homo sapiens
accuguagucccagcu

SEQ ID NO: 538740 - RNA, 22 nt, Homo sapiens
accuguagucccagcuacucag

SEQ ID NO: 538741 - RNA, 11 nt, Homo sapiens
accugucaaug

SEQ ID NO: 538742 - RNA, 21 nt, Homo sapiens
accugucccccacucucucac

SEQ ID NO: 538743 - RNA, 22 nt, Homo sapiens
accugucuuccaaggagaccaa

SEQ ID NO: 538744 - RNA, 22 nt, Homo sapiens
accugugagcccagcuggguca

SEQ ID NO: 538745 - RNA, 14 nt, Homo sapiens
accugugcuuugag

SEQ ID NO: 538746 - RNA, 16 nt, Homo sapiens
accuguuagcagacag

SEQ ID NO: 538747 - RNA, 20 nt, Homo sapiens
accuguucagugucccgggc

SEQ ID NO: 538748 - RNA, 15 nt, Homo sapiens
accuguuuauucucu

SEQ ID NO: 538749 - RNA, 14 nt, Homo sapiens
accuuaaacaagcu

SEQ ID NO: 538750 - RNA, 19 nt, Homo sapiens
accuuaaauuaaacaauuu

SEQ ID NO: 538751 - RNA, 18 nt, Homo sapiens
accuuaccaacuuucugu

SEQ ID NO: 538752 - RNA, 14 nt, Homo sapiens
accuuagaaaucau

SEQ ID NO: 538753 - RNA, 13 nt, Homo sapiens
accuuagugcaac

SEQ ID NO: 538754 - RNA, 18 nt, Homo sapiens
accuuauaguuacugugu

SEQ ID NO: 538755 - RNA, 16 nt, Homo sapiens
accuuaucugugcgug

SEQ ID NO: 538756 - RNA, 20 nt, Homo sapiens
accuuaugagaaacugcaug

SEQ ID NO: 538757 - RNA, 18 nt, Homo sapiens
accuuauuaacaaaauag

SEQ ID NO: 538758 - RNA, 17 nt, Homo sapiens
accuuauuguaccucuc

SEQ ID NO: 538759 - RNA, 18 nt, Homo sapiens
accuucaaaauguucuau

SEQ ID NO: 538760 - RNA, 16 nt, Homo sapiens
accuucaagaucucau

SEQ ID NO: 538761 - RNA, 19 nt, Homo sapiens
accuucagauuuguguuau

SEQ ID NO: 538762 - RNA, 16 nt, Homo sapiens
accuucaugaaaaccu

SEQ ID NO: 538763 - RNA, 19 nt, Homo sapiens
accuuccauucacaccagc

SEQ ID NO: 538764 - RNA, 16 nt, Homo sapiens
accuucccaugcccug

SEQ ID NO: 538765 - RNA, 16 nt, Homo sapiens
accuuccgacauccca

SEQ ID NO: 538766 - RNA, 12 nt, Homo sapiens
accuuccucauc

SEQ ID NO: 538767 - RNA, 23 nt, Homo sapiens
accuuccuucccugggcugugcu

SEQ ID NO: 538768 - RNA, 17 nt, Homo sapiens
accuucuaaaagccauu

SEQ ID NO: 538769 - RNA, 19 nt, Homo sapiens
accuucugguaucuuguua

SEQ ID NO: 538770 - RNA, 12 nt, Homo sapiens
accuucuuggcu

SEQ ID NO: 538771 - RNA, 12 nt, Homo sapiens
accuucuuucac

SEQ ID NO: 538772 - RNA, 17 nt, Homo sapiens
accuugacuucauuuau

SEQ ID NO: 538773 - RNA, 12 nt, Homo sapiens
accuugagcaaa

SEQ ID NO: 538774 - RNA, 15 nt, Homo sapiens
accuugcuccugugu

SEQ ID NO: 538775 - RNA, 14 nt, Homo sapiens
accuugcuguccug

SEQ ID NO: 538776 - RNA, 22 nt, Homo sapiens
accuuggaaaugaccaggccaa

SEQ ID NO: 538777 - RNA, 15 nt, Homo sapiens
accuuggcagugugg

SEQ ID NO: 538778 - RNA, 20 nt, Homo sapiens
accuuggccucccaaagugu

SEQ ID NO: 538779 - RNA, 16 nt, Homo sapiens
accuuggcgcucucag

SEQ ID NO: 538780 - RNA, 19 nt, Homo sapiens
accuugggggaagacuuua

SEQ ID NO: 538781 - RNA, 13 nt, Homo sapiens
accuuggugcuua

SEQ ID NO: 538782 - RNA, 12 nt, Homo sapiens
accuuguucuau

SEQ ID NO: 538783 - RNA, 20 nt, Homo sapiens
accuuuaaaguaaaggccuc

SEQ ID NO: 538784 - RNA, 22 nt, Homo sapiens
accuuuacucacacuaugugca

SEQ ID NO: 538785 - RNA, 18 nt, Homo sapiens
accuuuauuaaaaccauu

SEQ ID NO: 538786 - RNA, 19 nt, Homo sapiens
accuuuggaagucaugagc

SEQ ID NO: 538787 - RNA, 14 nt, Homo sapiens
accuuugguuuuaa

SEQ ID NO: 538788 - RNA, 11 nt, Homo sapiens
accuuuguacg

SEQ ID NO: 538789 - RNA, 10 nt, Homo sapiens
accuuuucau

SEQ ID NO: 538790 - RNA, 17 nt, Homo sapiens
accuuuugcaccugcuc

SEQ ID NO: 538791 - RNA, 17 nt, Homo sapiens
accuuuuugacuuuucc

SEQ ID NO: 538792 - RNA, 19 nt, Homo sapiens
accuuuuugacuuuuccaa

SEQ ID NO: 538793 - RNA, 23 nt, Homo sapiens
accuuuuuuccuucuugacauuu

SEQ ID NO: 538794 - RNA, 19 nt, Homo sapiens
accuuuuuuuuuuuuccaa

SEQ ID NO: 538795 - RNA, 22 nt, Homo sapiens
acgaacgcucuuagcuuucuca

SEQ ID NO: 538796 - RNA, 22 nt, Homo sapiens
acgaagccuuauuucuagaagc

SEQ ID NO: 538797 - RNA, 20 nt, Homo sapiens
acgaaguguugcauggaugu

SEQ ID NO: 538798 - RNA, 17 nt, Homo sapiens
acgaauuccaucuugua

SEQ ID NO: 538799 - RNA, 22 nt, Homo sapiens
acgacaaagccaaacucugcca

SEQ ID NO: 538800 - RNA, 21 nt, Homo sapiens
acgacagugcauuugccuugu

SEQ ID NO: 538801 - RNA, 19 nt, Homo sapiens
acgaccccugccucgaggg

SEQ ID NO: 538802 - RNA, 16 nt, Homo sapiens
acgacgauuucagcua

SEQ ID NO: 538803 - RNA, 18 nt, Homo sapiens
acgacuggccagggccac

SEQ ID NO: 538804 - RNA, 19 nt, Homo sapiens
acugugccuuugcaaauca

SEQ ID NO: 538805 - RNA, 20 nt, Homo sapiens
acugugcuccucacuuccuc

SEQ ID NO: 538806 - RNA, 14 nt, Homo sapiens
acugugcugagaag

SEQ ID NO: 538807 - RNA, 18 nt, Homo sapiens
acugugcuguuguucucg

SEQ ID NO: 538808 - RNA, 19 nt, Homo sapiens
acuguggcccuucugucca

SEQ ID NO: 538809 - RNA, 19 nt, Homo sapiens
acuguggccugugcccagg

SEQ ID NO: 538810 - RNA, 21 nt, Homo sapiens
acuguggccuguuaacuggua

SEQ ID NO: 538811 - RNA, 22 nt, Homo sapiens
acuguggcugcuagcacuugga

SEQ ID NO: 538812 - RNA, 22 nt, Homo sapiens
acugugggauguguucuucuuu

SEQ ID NO: 538813 - RNA, 13 nt, Homo sapiens
acugugguagcca

SEQ ID NO: 538814 - RNA, 18 nt, Homo sapiens
acugugguauggcuaaua

SEQ ID NO: 538815 - RNA, 18 nt, Homo sapiens
acuguguacauaacugaa

SEQ ID NO: 538816 - RNA, 13 nt, Homo sapiens
acuguguacugug

SEQ ID NO: 538817 - RNA, 15 nt, Homo sapiens
acuguguacugugga

SEQ ID NO: 538818 - RNA, 17 nt, Homo sapiens
acugugucuggccagaa

SEQ ID NO: 538819 - RNA, 19 nt, Homo sapiens
acuguguggacugugaugc

SEQ ID NO: 538820 - RNA, 22 nt, Homo sapiens
acuguguucccacgggugccau

SEQ ID NO: 538821 - RNA, 20 nt, Homo sapiens
acuguuauagaauagccuga

SEQ ID NO: 538822 - RNA, 18 nt, Homo sapiens
acuguucaaacucaggcc

SEQ ID NO: 538823 - RNA, 18 nt, Homo sapiens
acuguucccccugugcag

SEQ ID NO: 538824 - RNA, 13 nt, Homo sapiens
acuguucuguccu

SEQ ID NO: 538825 - RNA, 15 nt, Homo sapiens
acuguugauguaucu

SEQ ID NO: 538826 - RNA, 18 nt, Homo sapiens
acuguugcacagccagaa

SEQ ID NO: 538827 - RNA, 17 nt, Homo sapiens
acuguugcauaacuauu

SEQ ID NO: 538828 - RNA, 22 nt, Homo sapiens
acuguugguauuauauaauuca

SEQ ID NO: 538829 - RNA, 17 nt, Homo sapiens
acuguuguucugugguu

SEQ ID NO: 538830 - RNA, 17 nt, Homo sapiens
acuguuuauuacuucca

SEQ ID NO: 538831 - RNA, 14 nt, Homo sapiens
acuguuucaaauca

SEQ ID NO: 538832 - RNA, 13 nt, Homo sapiens
acuguuucauuca

SEQ ID NO: 538833 - RNA, 21 nt, Homo sapiens
acuguuugucacgucuucuga

SEQ ID NO: 538834 - RNA, 21 nt, Homo sapiens
acuguuuuauaaacugcugua

SEQ ID NO: 538835 - RNA, 17 nt, Homo sapiens
acuuaaaaaaagcacau

SEQ ID NO: 538836 - RNA, 17 nt, Homo sapiens
acuuaaaaaaaugacag

SEQ ID NO: 538837 - RNA, 21 nt, Homo sapiens
acuuaaauaauaaacagugga

SEQ ID NO: 538838 - RNA, 16 nt, Homo sapiens
acuuaaauuccucaac

SEQ ID NO: 538839 - RNA, 20 nt, Homo sapiens
acuuaaauuugaaucugagu

SEQ ID NO: 538840 - RNA, 14 nt, Homo sapiens
acuuaaccuuuuaa

SEQ ID NO: 538841 - RNA, 18 nt, Homo sapiens
acuuaacggaccaaagca

SEQ ID NO: 538842 - RNA, 22 nt, Homo sapiens
acuuaagcugggauaaucacau

SEQ ID NO: 538843 - RNA, 23 nt, Homo sapiens
acuuaagggaacugaaucacuua

SEQ ID NO: 538844 - RNA, 22 nt, Homo sapiens
acuuaaugaaaacaaugcagua

SEQ ID NO: 538845 - RNA, 16 nt, Homo sapiens
acuuaaugcacagugc

SEQ ID NO: 538846 - RNA, 18 nt, Homo sapiens
acuuaauugccagcaaau

SEQ ID NO: 538847 - RNA, 16 nt, Homo sapiens
acuuacauguguguau

SEQ ID NO: 538848 - RNA, 18 nt, Homo sapiens
acuuacauuuccauuuau

SEQ ID NO: 538849 - RNA, 22 nt, Homo sapiens
acuuaccacucgugcaucccug

SEQ ID NO: 538850 - RNA, 22 nt, Homo sapiens
acuuagaaauugcauuuccuga

SEQ ID NO: 538851 - RNA, 16 nt, Homo sapiens
acuuagauacuaauaa

SEQ ID NO: 538852 - RNA, 19 nt, Homo sapiens
acuuaggcuuggauacuca

SEQ ID NO: 538853 - RNA, 22 nt, Homo sapiens
acuuagguaaaauaaaagacua

SEQ ID NO: 538854 - RNA, 16 nt, Homo sapiens
acuuagguguggggga

SEQ ID NO: 538855 - RNA, 14 nt, Homo sapiens
acuuaguaagugcu

SEQ ID NO: 538856 - RNA, 18 nt, Homo sapiens
acuuaguaguuuuuacaa

SEQ ID NO: 538857 - RNA, 19 nt, Homo sapiens
acuuaguauugcagccaaa

SEQ ID NO: 538858 - RNA, 18 nt, Homo sapiens
acuuagucuguacuucau

SEQ ID NO: 538859 - RNA, 22 nt, Homo sapiens
acuuauauugaagacaauuuga

SEQ ID NO: 538860 - RNA, 14 nt, Homo sapiens
acuuaucaguuugc

SEQ ID NO: 538861 - RNA, 22 nt, Homo sapiens
acuuaucccaagagaaugaaau

SEQ ID NO: 538862 - RNA, 14 nt, Homo sapiens
acuuaucuugcucu

SEQ ID NO: 538863 - RNA, 15 nt, Homo sapiens
acuuaugaugaugaa

SEQ ID NO: 538864 - RNA, 16 nt, Homo sapiens
acuuauggaacaggga

SEQ ID NO: 538865 - RNA, 17 nt, Homo sapiens
acuuauguuauacaaua

SEQ ID NO: 538866 - RNA, 21 nt, Homo sapiens
acuuauuaugcauaaagccaa

SEQ ID NO: 538867 - RNA, 21 nt, Homo sapiens
acuuauuauuaauaaugaagu

SEQ ID NO: 538868 - RNA, 22 nt, Homo sapiens
acuuauuguaucugaauuccug

SEQ ID NO: 538869 - RNA, 14 nt, Homo sapiens
acuuauuuauauaa

SEQ ID NO: 538870 - RNA, 15 nt, Homo sapiens
acuuauuucauaaac

SEQ ID NO: 538871 - RNA, 23 nt, Homo sapiens
acugguggaucuaagaagggcug

SEQ ID NO: 538872 - RNA, 16 nt, Homo sapiens
acuggugugcucucuu

SEQ ID NO: 538873 - RNA, 19 nt, Homo sapiens
acugguuagugaugcaguu

SEQ ID NO: 538874 - RNA, 13 nt, Homo sapiens
acugguucucaau

SEQ ID NO: 538875 - RNA, 21 nt, Homo sapiens
acugguuuggucaguuacaaa

SEQ ID NO: 538876 - RNA, 15 nt, Homo sapiens
acugguuuucugcca

SEQ ID NO: 538877 - RNA, 13 nt, Homo sapiens
acuguaaagaauu

SEQ ID NO: 538878 - RNA, 13 nt, Homo sapiens
acuguaaagcaaa

SEQ ID NO: 538879 - RNA, 18 nt, Homo sapiens
acuguaacugacugccuu

SEQ ID NO: 538880 - RNA, 14 nt, Homo sapiens
acuguaagcuuuua

SEQ ID NO: 538881 - RNA, 13 nt, Homo sapiens
acuguaagggauu

SEQ ID NO: 538882 - RNA, 14 nt, Homo sapiens
acuguaagggauug

SEQ ID NO: 538883 - RNA, 23 nt, Homo sapiens
acuguacaaugacuuuauugcau

SEQ ID NO: 538884 - RNA, 17 nt, Homo sapiens
acuguacacauaagcca

SEQ ID NO: 538885 - RNA, 16 nt, Homo sapiens
acuguacagugucuuu

SEQ ID NO: 538886 - RNA, 12 nt, Homo sapiens
acuguacauuua

SEQ ID NO: 538887 - RNA, 22 nt, Homo sapiens
acuguacccucgcaugacuguu

SEQ ID NO: 538888 - RNA, 18 nt, Homo sapiens
acuguagcucaaguuuaa

SEQ ID NO: 538889 - RNA, 14 nt, Homo sapiens
acuguagcuuuuag

SEQ ID NO: 538890 - RNA, 16 nt, Homo sapiens
acuguaggaacaagca

SEQ ID NO: 538891 - RNA, 14 nt, Homo sapiens
acuguagggccagg

SEQ ID NO: 538892 - RNA, 14 nt, Homo sapiens
acuguagucucuga

SEQ ID NO: 538893 - RNA, 15 nt, Homo sapiens
acuguauaaacaaaa

SEQ ID NO: 538894 - RNA, 16 nt, Homo sapiens
acuguauacauuacaa

SEQ ID NO: 538895 - RNA, 18 nt, Homo sapiens
acuguauauauaauacug

SEQ ID NO: 538896 - RNA, 19 nt, Homo sapiens
acuguauauauaauacuga

SEQ ID NO: 538897 - RNA, 16 nt, Homo sapiens
acuguaugugccaaag

SEQ ID NO: 538898 - RNA, 16 nt, Homo sapiens
acuguauuacauaaau

SEQ ID NO: 538899 - RNA, 18 nt, Homo sapiens
acuguauuugaaauaaga

SEQ ID NO: 538900 - RNA, 19 nt, Homo sapiens
acuguauuuuugaagacua

SEQ ID NO: 538901 - RNA, 20 nt, Homo sapiens
acugucaaggcugcuuagaa

SEQ ID NO: 538902 - RNA, 17 nt, Homo sapiens
acugucacacuggugcu

SEQ ID NO: 538903 - RNA, 12 nt, Homo sapiens
acugucacuguu

SEQ ID NO: 538904 - RNA, 22 nt, Homo sapiens
acugucagggagggccagggag

SEQ ID NO: 538905 - RNA, 20 nt, Homo sapiens
acugucaguguacacgucug

SEQ ID NO: 538906 - RNA, 22 nt, Homo sapiens
acuguccaagugccacaugccu

SEQ ID NO: 538907 - RNA, 16 nt, Homo sapiens
acugucccuugccuca

SEQ ID NO: 538908 - RNA, 22 nt, Homo sapiens
acugucggccagagucuguuuc

SEQ ID NO: 538909 - RNA, 21 nt, Homo sapiens
acugucuauuuaagugcaauu

SEQ ID NO: 538910 - RNA, 20 nt, Homo sapiens
acugucuauuuucucaguca

SEQ ID NO: 538911 - RNA, 21 nt, Homo sapiens
acugucuccacccaccuugac

SEQ ID NO: 538912 - RNA, 16 nt, Homo sapiens
acugucucgaacuauu

SEQ ID NO: 538913 - RNA, 14 nt, Homo sapiens
acugucuuccucaa

SEQ ID NO: 538914 - RNA, 14 nt, Homo sapiens
acugucuugccaga

SEQ ID NO: 538915 - RNA, 20 nt, Homo sapiens
acugugaacugggcauuuca

SEQ ID NO: 538916 - RNA, 12 nt, Homo sapiens
acugugacugua

SEQ ID NO: 538917 - RNA, 17 nt, Homo sapiens
acugugagaggugacac

SEQ ID NO: 538918 - RNA, 16 nt, Homo sapiens
acugugaggaagugug

SEQ ID NO: 538919 - RNA, 19 nt, Homo sapiens
acugugaggggaaggccuu

SEQ ID NO: 538920 - RNA, 13 nt, Homo sapiens
acugugcaguuuu

SEQ ID NO: 538921 - RNA, 15 nt, Homo sapiens
acugugcaguuuuca

SEQ ID NO: 538922 - RNA, 21 nt, Homo sapiens
acugugcccaaguggguccaa

SEQ ID NO: 538923 - RNA, 23 nt, Homo sapiens
agaaaucuuuauuaauguuuaga

SEQ ID NO: 538924 - RNA, 19 nt, Homo sapiens
agaaaucuuucucccucaa

SEQ ID NO: 538925 - RNA, 20 nt, Homo sapiens
agaaaugacugccggucauu

SEQ ID NO: 538926 - RNA, 23 nt, Homo sapiens
agaaaugacugccggucauuuga

SEQ ID NO: 538927 - RNA, 11 nt, Homo sapiens
agaaaugaugg

SEQ ID NO: 538928 - RNA, 19 nt, Homo sapiens
agaaaugcugcuggccaaa

SEQ ID NO: 538929 - RNA, 21 nt, Homo sapiens
agaaaugcuuuccaaaaccgc

SEQ ID NO: 538930 - RNA, 13 nt, Homo sapiens
agaaaugcuuuga

SEQ ID NO: 538931 - RNA, 16 nt, Homo sapiens
agaaauggauucuauu

SEQ ID NO: 538932 - RNA, 19 nt, Homo sapiens
agaaaugugucaucaggag

SEQ ID NO: 538933 - RNA, 15 nt, Homo sapiens
agaaauuaacaaaug

SEQ ID NO: 538934 - RNA, 16 nt, Homo sapiens
agaaauucagcauuug

SEQ ID NO: 538935 - RNA, 19 nt, Homo sapiens
agaaauuccaacuccugau

SEQ ID NO: 538936 - RNA, 23 nt, Homo sapiens
agaaauuccaggaaaaucugcac

SEQ ID NO: 538937 - RNA, 22 nt, Homo sapiens
agaaauuccauacuucucucag

SEQ ID NO: 538938 - RNA, 19 nt, Homo sapiens
agaaauuccuguagcaucu

SEQ ID NO: 538939 - RNA, 14 nt, Homo sapiens
agaaauucuguggu

SEQ ID NO: 538940 - RNA, 22 nt, Homo sapiens
agaaauugacacaaguggaccu

SEQ ID NO: 538941 - RNA, 17 nt, Homo sapiens
agaaauugacagaucaa

SEQ ID NO: 538942 - RNA, 16 nt, Homo sapiens
agaaauuuaaaagaca

SEQ ID NO: 538943 - RNA, 23 nt, Homo sapiens
agaaauuugccuuguucaauaau

SEQ ID NO: 538944 - RNA, 23 nt, Homo sapiens
agaaauuuucauucagguauuug

SEQ ID NO: 538945 - RNA, 18 nt, Homo sapiens
agaaauuuucugaucuca

SEQ ID NO: 538946 - RNA, 23 nt, Homo sapiens
agaaauuuugccugccauuuuca

SEQ ID NO: 538947 - RNA, 21 nt, Homo sapiens
agaacaaaagaauaacauuuu

SEQ ID NO: 538948 - RNA, 22 nt, Homo sapiens
agaacaaaggacagaguaugaa

SEQ ID NO: 538949 - RNA, 14 nt, Homo sapiens
agaacaaauguguu

SEQ ID NO: 538950 - RNA, 15 nt, Homo sapiens
agaacaacuacugug

SEQ ID NO: 538951 - RNA, 14 nt, Homo sapiens
agaacaacuugaag

SEQ ID NO: 538952 - RNA, 20 nt, Homo sapiens
agaacaagaccccgucucaa

SEQ ID NO: 538953 - RNA, 23 nt, Homo sapiens
agaacaaugcuauaauauauaau

SEQ ID NO: 538954 - RNA, 20 nt, Homo sapiens
agaacacaugugcagucacu

SEQ ID NO: 538955 - RNA, 17 nt, Homo sapiens
agaacagaggcauuuaa

SEQ ID NO: 538956 - RNA, 18 nt, Homo sapiens
agaacagagggaacuuug

SEQ ID NO: 538957 - RNA, 12 nt, Homo sapiens
agaacagccgcu

SEQ ID NO: 538958 - RNA, 11 nt, Homo sapiens
agaacagggaa

SEQ ID NO: 538959 - RNA, 12 nt, Homo sapiens
agaacaggguca

SEQ ID NO: 538960 - RNA, 13 nt, Homo sapiens
agaacaguaggau

SEQ ID NO: 538961 - RNA, 22 nt, Homo sapiens
agaacauaaaaaauaaaguacc

SEQ ID NO: 538962 - RNA, 17 nt, Homo sapiens
agaacauacacugugaa

SEQ ID NO: 538963 - RNA, 18 nt, Homo sapiens
agaacauacacugugaac

SEQ ID NO: 538964 - RNA, 20 nt, Homo sapiens
agaacaucauaacccaugaa

SEQ ID NO: 538965 - RNA, 22 nt, Homo sapiens
agaacaucauuagaacaaagga

SEQ ID NO: 538966 - RNA, 23 nt, Homo sapiens
agaacauuuuaauucaucccaac

SEQ ID NO: 538967 - RNA, 12 nt, Homo sapiens
agaaccaaaaaa

SEQ ID NO: 538968 - RNA, 20 nt, Homo sapiens
agaaccaaaaguuuuccuga

SEQ ID NO: 538969 - RNA, 16 nt, Homo sapiens
agaaccagggcucuuc

SEQ ID NO: 538970 - RNA, 15 nt, Homo sapiens
agaacccagauuucc

SEQ ID NO: 538971 - RNA, 19 nt, Homo sapiens
agaacccagggcucugccc

SEQ ID NO: 538972 - RNA, 16 nt, Homo sapiens
agaacccgggcugugu

SEQ ID NO: 538973 - RNA, 18 nt, Homo sapiens
agaacccuuggagccaau

SEQ ID NO: 538974 - RNA, 12 nt, Homo sapiens
agaaccuacugu

SEQ ID NO: 538975 - RNA, 15 nt, Homo sapiens
agaaccucagaucag

SEQ ID NO: 538976 - RNA, 12 nt, Homo sapiens
agaaccucaggc

SEQ ID NO: 538977 - RNA, 22 nt, Homo sapiens
agaaccuuaaugacaacacuua

SEQ ID NO: 538978 - RNA, 14 nt, Homo sapiens
agaaccuucaaccc

SEQ ID NO: 538979 - RNA, 13 nt, Homo sapiens
agaaccuugccug

SEQ ID NO: 538980 - RNA, 13 nt, Homo sapiens
agaaccuuguccc

SEQ ID NO: 538981 - RNA, 20 nt, Homo sapiens
agaacuaaccaguaccucug

SEQ ID NO: 538982 - RNA, 21 nt, Homo sapiens
agaacuaagaugaucaucucc

SEQ ID NO: 538983 - RNA, 12 nt, Homo sapiens
agaacuauccaa

SEQ ID NO: 538984 - RNA, 20 nt, Homo sapiens
agaacuaucugcauuaucua

SEQ ID NO: 538985 - RNA, 14 nt, Homo sapiens
acuuugcuccucac

SEQ ID NO: 538986 - RNA, 16 nt, Homo sapiens
acuuugcugcauuuua

SEQ ID NO: 538987 - RNA, 23 nt, Homo sapiens
acuuugcugucaaaacuacugac

SEQ ID NO: 538988 - RNA, 12 nt, Homo sapiens
acuuugcuucau

SEQ ID NO: 538989 - RNA, 20 nt, Homo sapiens
acuuugcuugcucauaugca

SEQ ID NO: 538990 - RNA, 15 nt, Homo sapiens
acuuuggaggacaau

SEQ ID NO: 538991 - RNA, 19 nt, Homo sapiens
acuuuggcuucuccuguga

SEQ ID NO: 538992 - RNA, 17 nt, Homo sapiens
acuuugggaggccaagg

SEQ ID NO: 538993 - RNA, 15 nt, Homo sapiens
acuuugggggaggag

SEQ ID NO: 538994 - RNA, 22 nt, Homo sapiens
acuuugucccguggcauuucaa

SEQ ID NO: 538995 - RNA, 22 nt, Homo sapiens
acuuuguuuagcccaaaaccaa

SEQ ID NO: 538996 - RNA, 17 nt, Homo sapiens
acuuuuaaguugcugau

SEQ ID NO: 538997 - RNA, 22 nt, Homo sapiens
acuuuuaaguugcugaugaacu

SEQ ID NO: 538998 - RNA, 16 nt, Homo sapiens
acuuuuaaucagugaa

SEQ ID NO: 538999 - RNA, 15 nt, Homo sapiens
acuuuuaccacuugc

SEQ ID NO: 539000 - RNA, 16 nt, Homo sapiens
acuuuuacucugccua

SEQ ID NO: 539001 - RNA, 20 nt, Homo sapiens
acuuuuaugagaacaaugga

SEQ ID NO: 539002 - RNA, 19 nt, Homo sapiens
acuuuuaugugagauuucc

SEQ ID NO: 539003 - RNA, 17 nt, Homo sapiens
acuuuucaagcugcuga

SEQ ID NO: 539004 - RNA, 21 nt, Homo sapiens
acuuuucaagcugcugaagga

SEQ ID NO: 539005 - RNA, 20 nt, Homo sapiens
acuuuucuaacauaugucua

SEQ ID NO: 539006 - RNA, 16 nt, Homo sapiens
acuuuugcugaugcuu

SEQ ID NO: 539007 - RNA, 20 nt, Homo sapiens
acuuuugcugaugcuuuuga

SEQ ID NO: 539008 - RNA, 14 nt, Homo sapiens
acuuuuggaaucau

SEQ ID NO: 539009 - RNA, 23 nt, Homo sapiens
acuuuugguaucuacuucuacau

SEQ ID NO: 539010 - RNA, 16 nt, Homo sapiens
acuuuuguguaaugaa

SEQ ID NO: 539011 - RNA, 18 nt, Homo sapiens
acuuuuguuauuaugcuc

SEQ ID NO: 539012 - RNA, 21 nt, Homo sapiens
acuuuuguugaaauagcuuua

SEQ ID NO: 539013 - RNA, 21 nt, Homo sapiens
acuuuuuaaaauaauaacaau

SEQ ID NO: 539014 - RNA, 16 nt, Homo sapiens
acuuuuuagccaguga

SEQ ID NO: 539015 - RNA, 17 nt, Homo sapiens
acuuuuuagccagugac

SEQ ID NO: 539016 - RNA, 19 nt, Homo sapiens
acuuuuuaguuguucagca

SEQ ID NO: 539017 - RNA, 21 nt, Homo sapiens
acuuuuuccuggcucaucucu

SEQ ID NO: 539018 - RNA, 18 nt, Homo sapiens
acuuuuuuauccaccucc

SEQ ID NO: 539019 - RNA, 20 nt, Homo sapiens
acuuuuuuucugugacauuu

SEQ ID NO: 539020 - RNA, 16 nt, Homo sapiens
agaaaaaaaaagugaa

SEQ ID NO: 539021 - RNA, 16 nt, Homo sapiens
agaaaaaaagcacaaa

SEQ ID NO: 539022 - RNA, 23 nt, Homo sapiens
agaaaaaaagcacaaaguucuca

SEQ ID NO: 539023 - RNA, 15 nt, Homo sapiens
agaaaaaaguuuaca

SEQ ID NO: 539024 - RNA, 24 nt, Homo sapiens
agaaaaaaguuuacaacauaaucu

SEQ ID NO: 539025 - RNA, 12 nt, Homo sapiens
agaaaaaaucug

SEQ ID NO: 539026 - RNA, 13 nt, Homo sapiens
agaaaaacaaaua

SEQ ID NO: 539027 - RNA, 21 nt, Homo sapiens
agaaaaacaccgcuucugccu

SEQ ID NO: 539028 - RNA, 18 nt, Homo sapiens
agaaaaacaucccaagaa

SEQ ID NO: 539029 - RNA, 17 nt, Homo sapiens
agaaaaaggaugcacag

SEQ ID NO: 539030 - RNA, 19 nt, Homo sapiens
agaaaaagucaauguacuu

SEQ ID NO: 539031 - RNA, 21 nt, Homo sapiens
agaaaaauagcugugaacaga

SEQ ID NO: 539032 - RNA, 18 nt, Homo sapiens
agaaaacaagagauauac

SEQ ID NO: 539033 - RNA, 15 nt, Homo sapiens
agaaaacaauuccuu

SEQ ID NO: 539034 - RNA, 15 nt, Homo sapiens
agaaaaccacaacua

SEQ ID NO: 539035 - RNA, 22 nt, Homo sapiens
agaaaaccacaacuaaaacugg

SEQ ID NO: 539036 - RNA, 21 nt, Homo sapiens
agaaaacucccaauacaaaga

SEQ ID NO: 539037 - RNA, 23 nt, Homo sapiens
agaaaagaaauuggacagaacag

SEQ ID NO: 539038 - RNA, 22 nt, Homo sapiens
agaaaagaugugcagauaucac

SEQ ID NO: 539039 - RNA, 12 nt, Homo sapiens
agaaaagcagac

SEQ ID NO: 539040 - RNA, 15 nt, Homo sapiens
agaaaagccucucca

SEQ ID NO: 539041 - RNA, 14 nt, Homo sapiens
agaaaagcugccau

SEQ ID NO: 539042 - RNA, 20 nt, Homo sapiens
agaaaaggaaauaugaucca

SEQ ID NO: 539043 - RNA, 19 nt, Homo sapiens
agaaaaguagguuuacauu

SEQ ID NO: 539044 - RNA, 15 nt, Homo sapiens
agaaaaguauucuca

SEQ ID NO: 539045 - RNA, 13 nt, Homo sapiens
agaaaaguauugu

SEQ ID NO: 539046 - RNA, 14 nt, Homo sapiens
agaaaagugcauau

SEQ ID NO: 539047 - RNA, 21 nt, Homo sapiens
agaaaaguuauuagugguuua

SEQ ID NO: 539048 - RNA, 22 nt, Homo sapiens
acuucugggucaugcacugagg

SEQ ID NO: 539049 - RNA, 20 nt, Homo sapiens
acuucuuacccaaagcacau

SEQ ID NO: 539050 - RNA, 18 nt, Homo sapiens
acuucuucaccucuucca

SEQ ID NO: 539051 - RNA, 19 nt, Homo sapiens
acuucuugcuucuuucuag

SEQ ID NO: 539052 - RNA, 18 nt, Homo sapiens
acuugaaagcauccaugu

SEQ ID NO: 539053 - RNA, 19 nt, Homo sapiens
acuugaaagcauccaugug

SEQ ID NO: 539054 - RNA, 19 nt, Homo sapiens
acuugaaaguuuuccagua

SEQ ID NO: 539055 - RNA, 22 nt, Homo sapiens
acuugaaauaccagugaaccaa

SEQ ID NO: 539056 - RNA, 17 nt, Homo sapiens
acuugaaauuugccuug

SEQ ID NO: 539057 - RNA, 22 nt, Homo sapiens
acuugaacugauucacaucuca

SEQ ID NO: 539058 - RNA, 14 nt, Homo sapiens
acuugaagcacuua

SEQ ID NO: 539059 - RNA, 16 nt, Homo sapiens
acuugaagcacuuaag

SEQ ID NO: 539060 - RNA, 19 nt, Homo sapiens
acuugaaugcuaguuauac

SEQ ID NO: 539061 - RNA, 19 nt, Homo sapiens
acuugacaacaucccacag

SEQ ID NO: 539062 - RNA, 12 nt, Homo sapiens
acuugacagugg

SEQ ID NO: 539063 - RNA, 14 nt, Homo sapiens
acuugacuggcaca

SEQ ID NO: 539064 - RNA, 22 nt, Homo sapiens
acuugagaccuaaucucuguaa

SEQ ID NO: 539065 - RNA, 20 nt, Homo sapiens
acuugagccggacaccaagc

SEQ ID NO: 539066 - RNA, 23 nt, Homo sapiens
acuugaggccagugagcugugau

SEQ ID NO: 539067 - RNA, 20 nt, Homo sapiens
acuugagguaccaguuguau

SEQ ID NO: 539068 - RNA, 15 nt, Homo sapiens
acuugaugauacaau

SEQ ID NO: 539069 - RNA, 18 nt, Homo sapiens
acuugaugauacaaugaa

SEQ ID NO: 539070 - RNA, 21 nt, Homo sapiens
acuugaugccaaaaugacuuu

SEQ ID NO: 539071 - RNA, 17 nt, Homo sapiens
acuugauguguuaucuc

SEQ ID NO: 539072 - RNA, 13 nt, Homo sapiens
acuugauuccuug

SEQ ID NO: 539073 - RNA, 17 nt, Homo sapiens
acuugauuguacuugga

SEQ ID NO: 539074 - RNA, 18 nt, Homo sapiens
acuugauuugcauggauu

SEQ ID NO: 539075 - RNA, 11 nt, Homo sapiens
acuugcacaaa

SEQ ID NO: 539076 - RNA, 18 nt, Homo sapiens
acuugcacgcccaugugu

SEQ ID NO: 539077 - RNA, 13 nt, Homo sapiens
acuugcacuguua

SEQ ID NO: 539078 - RNA, 16 nt, Homo sapiens
acuugcauacagagac

SEQ ID NO: 539079 - RNA, 17 nt, Homo sapiens
acuugcauacagagaca

SEQ ID NO: 539080 - RNA, 21 nt, Homo sapiens
acuugcauccaacuccaggau

SEQ ID NO: 539081 - RNA, 20 nt, Homo sapiens
acuugcauuucugacuuuau

SEQ ID NO: 539082 - RNA, 19 nt, Homo sapiens
acuugccaggcucccuuuc

SEQ ID NO: 539083 - RNA, 17 nt, Homo sapiens
acuugcccuguucucuu

SEQ ID NO: 539084 - RNA, 17 nt, Homo sapiens
acuugcguggacaguca

SEQ ID NO: 539085 - RNA, 17 nt, Homo sapiens
acuugcuaaagcacuuu

SEQ ID NO: 539086 - RNA, 14 nt, Homo sapiens
acuugcugccugaa

SEQ ID NO: 539087 - RNA, 17 nt, Homo sapiens
acuugcugcugucuugu

SEQ ID NO: 539088 - RNA, 21 nt, Homo sapiens
acuuggaauuuguaaccucag

SEQ ID NO: 539089 - RNA, 21 nt, Homo sapiens
acuuggagggcucagggcagu

SEQ ID NO: 539090 - RNA, 13 nt, Homo sapiens
acuuggcaaaaag

SEQ ID NO: 539091 - RNA, 19 nt, Homo sapiens
acuuggcacuccuggacaa

SEQ ID NO: 539092 - RNA, 14 nt, Homo sapiens
acuugggagcugcu

SEQ ID NO: 539093 - RNA, 20 nt, Homo sapiens
acuugggccacugugaagag

SEQ ID NO: 539094 - RNA, 16 nt, Homo sapiens
acuuggucaccagcuc

SEQ ID NO: 539095 - RNA, 12 nt, Homo sapiens
acuugguccuaa

SEQ ID NO: 539096 - RNA, 20 nt, Homo sapiens
acuugguuuccuauuucccc

SEQ ID NO: 539097 - RNA, 18 nt, Homo sapiens
acuugguuuuuggcucuu

SEQ ID NO: 539098 - RNA, 15 nt, Homo sapiens
acuuguacccacagg

SEQ ID NO: 539099 - RNA, 13 nt, Homo sapiens
acuuguacuaugu

SEQ ID NO: 539100 - RNA, 18 nt, Homo sapiens
acuuguauagcaugaaau

SEQ ID NO: 539101 - RNA, 21 nt, Homo sapiens
acuugucagugggaaacaaac

SEQ ID NO: 539102 - RNA, 21 nt, Homo sapiens
acuugucccacuaucugggug

SEQ ID NO: 539103 - RNA, 13 nt, Homo sapiens
acuuguccugacu

SEQ ID NO: 539104 - RNA, 13 nt, Homo sapiens
acuugugcuauaa

SEQ ID NO: 539105 - RNA, 19 nt, Homo sapiens
acuuguggccucaagcaau

SEQ ID NO: 539106 - RNA, 22 nt, Homo sapiens
acuugugggccccccuugccuc

SEQ ID NO: 539107 - RNA, 23 nt, Homo sapiens
acuuguguuuuuuaaucagcauu

SEQ ID NO: 539108 - RNA, 14 nt, Homo sapiens
acuuguucauuugg

SEQ ID NO: 539109 - RNA, 16 nt, Homo sapiens
acuuguuccagcucuu

SEQ ID NO: 539110 - RNA, 19 nt, Homo sapiens
acuuguuuucacuuuauca

SEQ ID NO: 539111 - RNA, 17 nt, Homo sapiens
acuuguuuuugcacaug

SEQ ID NO: 539112 - RNA, 15 nt, Homo sapiens
acuuuaaaacuguau

SEQ ID NO: 539113 - RNA, 14 nt, Homo sapiens
acuuuaaaaugcca

SEQ ID NO: 539114 - RNA, 14 nt, Homo sapiens
acccaguucaguga

SEQ ID NO: 539115 - RNA, 14 nt, Homo sapiens
acccauauuacaga

SEQ ID NO: 539116 - RNA, 19 nt, Homo sapiens
acccaucaaaagcaccagc

SEQ ID NO: 539117 - RNA, 16 nt, Homo sapiens
acccauccccugaugc

SEQ ID NO: 539118 - RNA, 21 nt, Homo sapiens
acccauccgguuugccauguu

SEQ ID NO: 539119 - RNA, 23 nt, Homo sapiens
acccaucguccaccccagugugc

SEQ ID NO: 539120 - RNA, 16 nt, Homo sapiens
acccaugaaucaaaga

SEQ ID NO: 539121 - RNA, 15 nt, Homo sapiens
acccaugacuuuaua

SEQ ID NO: 539122 - RNA, 21 nt, Homo sapiens
acccauuauccaggacuguuu

SEQ ID NO: 539123 - RNA, 13 nt, Homo sapiens
acccauucuacac

SEQ ID NO: 539124 - RNA, 17 nt, Homo sapiens
acccauucuacacagag

SEQ ID NO: 539125 - RNA, 14 nt, Homo sapiens
acccauucuucccg

SEQ ID NO: 539126 - RNA, 21 nt, Homo sapiens
acccauuuuuguuuauuuucc

SEQ ID NO: 539127 - RNA, 19 nt, Homo sapiens
accccaaacaacucagcuu

SEQ ID NO: 539128 - RNA, 13 nt, Homo sapiens
accccaaacccca

SEQ ID NO: 539129 - RNA, 21 nt, Homo sapiens
accccaacaugccugcaccug

SEQ ID NO: 539130 - RNA, 14 nt, Homo sapiens
accccaacucuccc

SEQ ID NO: 539131 - RNA, 15 nt, Homo sapiens
accccaagcaggaac

SEQ ID NO: 539132 - RNA, 14 nt, Homo sapiens
accccacauuuuuc

SEQ ID NO: 539133 - RNA, 13 nt, Homo sapiens
accccaccuugcc

SEQ ID NO: 539134 - RNA, 15 nt, Homo sapiens
accccacgcugacca

SEQ ID NO: 539135 - RNA, 14 nt, Homo sapiens
accccagaggacac

SEQ ID NO: 539136 - RNA, 13 nt, Homo sapiens
accccagcauucc

SEQ ID NO: 539137 - RNA, 22 nt, Homo sapiens
accccagccccaacuccagggg

SEQ ID NO: 539138 - RNA, 17 nt, Homo sapiens
accccaggaacaauaaa

SEQ ID NO: 539139 - RNA, 23 nt, Homo sapiens
accccaggacgccacucauuuca

SEQ ID NO: 539140 - RNA, 22 nt, Homo sapiens
accccagugcuuguuccucuca

SEQ ID NO: 539141 - RNA, 22 nt, Homo sapiens
accccagugguauccugugaca

SEQ ID NO: 539142 - RNA, 23 nt, Homo sapiens
accccagugguauccugugacau

SEQ ID NO: 539143 - RNA, 19 nt, Homo sapiens
accccaucuuuacuaaaaa

SEQ ID NO: 539144 - RNA, 14 nt, Homo sapiens
accccaugccaaag

SEQ ID NO: 539145 - RNA, 14 nt, Homo sapiens
accccauguccuca

SEQ ID NO: 539146 - RNA, 18 nt, Homo sapiens
accccauguccucagcau

SEQ ID NO: 539147 - RNA, 13 nt, Homo sapiens
acccccaacccaa

SEQ ID NO: 539148 - RNA, 20 nt, Homo sapiens
acccccacccccagcucaau

SEQ ID NO: 539149 - RNA, 13 nt, Homo sapiens
acccccagcucaa

SEQ ID NO: 539150 - RNA, 14 nt, Homo sapiens
acccccagugcagg

SEQ ID NO: 539151 - RNA, 17 nt, Homo sapiens
acccccaucucuacuaa

SEQ ID NO: 539152 - RNA, 15 nt, Homo sapiens
acccccaugaccacu

SEQ ID NO: 539153 - RNA, 12 nt, Homo sapiens
acccccaugcug

SEQ ID NO: 539154 - RNA, 18 nt, Homo sapiens
accccccuccugcuccuc

SEQ ID NO: 539155 - RNA, 16 nt, Homo sapiens
acccccuaaaauccau

SEQ ID NO: 539156 - RNA, 21 nt, Homo sapiens
acccccucccugcccccagac

SEQ ID NO: 539157 - RNA, 21 nt, Homo sapiens
acccccugcuccaccagcagc

SEQ ID NO: 539158 - RNA, 14 nt, Homo sapiens
acccccuucagugc

SEQ ID NO: 539159 - RNA, 22 nt, Homo sapiens
accccgaccaccugcccaaccu

SEQ ID NO: 539160 - RNA, 18 nt, Homo sapiens
accccgagaagugcucuu

SEQ ID NO: 539161 - RNA, 16 nt, Homo sapiens
accccgagacuaccag

SEQ ID NO: 539162 - RNA, 16 nt, Homo sapiens
accccgcggcccagac

SEQ ID NO: 539163 - RNA, 20 nt, Homo sapiens
accccggggacccugugaca

SEQ ID NO: 539164 - RNA, 21 nt, Homo sapiens
accccgucgaggggcucucag

SEQ ID NO: 539165 - RNA, 15 nt, Homo sapiens
accccuacacuguga

SEQ ID NO: 539166 - RNA, 13 nt, Homo sapiens
accccuacaugaa

SEQ ID NO: 539167 - RNA, 21 nt, Homo sapiens
accccucaaacugcacaucua

SEQ ID NO: 539168 - RNA, 15 nt, Homo sapiens
accccucaccuugca

SEQ ID NO: 539169 - RNA, 18 nt, Homo sapiens
accccucagggguuucau

SEQ ID NO: 539170 - RNA, 20 nt, Homo sapiens
accccuccaggaaugaucuc

SEQ ID NO: 539171 - RNA, 17 nt, Homo sapiens
accccucugucuucaag

SEQ ID NO: 539172 - RNA, 18 nt, Homo sapiens
accccugaccucacugug

SEQ ID NO: 539173 - RNA, 23 nt, Homo sapiens
accccugcccccagccccggggu

SEQ ID NO: 539174 - RNA, 20 nt, Homo sapiens
accccugcucuacccaugag

SEQ ID NO: 539175 - RNA, 19 nt, Homo sapiens
accccuggaagagcccagu

SEQ ID NO: 539176 - RNA, 21 nt, Homo sapiens
accccugugcuccccugccac

SEQ ID NO: 539177 - RNA, 11 nt, Homo sapiens
accccuuccaa

SEQ ID NO: 539178 - RNA, 18 nt, Homo sapiens
accccuugguacugaaaa

SEQ ID NO: 539179 - RNA, 20 nt, Homo sapiens
accccuugugggcaaaggca

SEQ ID NO: 539180 - RNA, 21 nt, Homo sapiens
acccgagggacagcagauucc

SEQ ID NO: 539181 - RNA, 18 nt, Homo sapiens
acccgaguaccuccaguc

SEQ ID NO: 539182 - RNA, 13 nt, Homo sapiens
acccgauuccacc

SEQ ID NO: 539183 - RNA, 15 nt, Homo sapiens
acccgcucuggacca

SEQ ID NO: 539184 - RNA, 20 nt, Homo sapiens
acccggcugcagaggccaga

SEQ ID NO: 539185 - RNA, 15 nt, Homo sapiens
acccgggagcagugu

SEQ ID NO: 539186 - RNA, 21 nt, Homo sapiens
acccgggaggcagagguugca

SEQ ID NO: 539187 - RNA, 20 nt, Homo sapiens
acccgggggagcccagugaa

SEQ ID NO: 539188 - RNA, 12 nt, Homo sapiens
acccggugcucc

SEQ ID NO: 539189 - RNA, 13 nt, Homo sapiens
acccguccauuca

SEQ ID NO: 539190 - RNA, 14 nt, Homo sapiens
acccguuugcuaca

SEQ ID NO: 539191 - RNA, 17 nt, Homo sapiens
acccuauaaaucaacac

SEQ ID NO: 539192 - RNA, 21 nt, Homo sapiens
acccuaucaagaaggugaaaa

SEQ ID NO: 539193 - RNA, 20 nt, Homo sapiens
acccuauuuagaaauggauu

SEQ ID NO: 539194 - RNA, 19 nt, Homo sapiens
acccucacaagcaugaagu

SEQ ID NO: 539195 - RNA, 22 nt, Homo sapiens
acccucauuggccugcccuuca

SEQ ID NO: 539196 - RNA, 16 nt, Homo sapiens
acccucccagucucau

SEQ ID NO: 539197 - RNA, 15 nt, Homo sapiens
acccuccguugacag

SEQ ID NO: 539198 - RNA, 15 nt, Homo sapiens
acccuccuccuguca

SEQ ID NO: 539199 - RNA, 14 nt, Homo sapiens
aacaaauaugcaaa

SEQ ID NO: 539200 - RNA, 18 nt, Homo sapiens
aacaaaucuucacugagc

SEQ ID NO: 539201 - RNA, 20 nt, Homo sapiens
aacaaauucauauucugucu

SEQ ID NO: 539202 - RNA, 18 nt, Homo sapiens
aacaacaaaaaccaaaaa

SEQ ID NO: 539203 - RNA, 13 nt, Homo sapiens
aacaacaacgaga

SEQ ID NO: 539204 - RNA, 19 nt, Homo sapiens
aacaacaauaacacugucu

SEQ ID NO: 539205 - RNA, 16 nt, Homo sapiens
aacaacagaucugcag

SEQ ID NO: 539206 - RNA, 19 nt, Homo sapiens
aacaacaggcacacaccac

SEQ ID NO: 539207 - RNA, 14 nt, Homo sapiens
aacaacauaucuca

SEQ ID NO: 539208 - RNA, 21 nt, Homo sapiens
aacaacccacaccgucuuccu

SEQ ID NO: 539209 - RNA, 20 nt, Homo sapiens
aacaacgagauaccaucuca

SEQ ID NO: 539210 - RNA, 14 nt, Homo sapiens
aacaacuccaaaac

SEQ ID NO: 539211 - RNA, 17 nt, Homo sapiens
caguuaucuaaguuaau

SEQ ID NO: 539212 - RNA, 20 nt, Homo sapiens
caguuaugugaaugaucucu

SEQ ID NO: 539213 - RNA, 14 nt, Homo sapiens
caguucagugaggu

SEQ ID NO: 539214 - RNA, 12 nt, Homo sapiens
caguucaucacc

SEQ ID NO: 539215 - RNA, 11 nt, Homo sapiens
caguucaugca

SEQ ID NO: 539216 - RNA, 16 nt, Homo sapiens
caguucauuauuuugu

SEQ ID NO: 539217 - RNA, 18 nt, Homo sapiens
caguucauugcacuuuga

SEQ ID NO: 539218 - RNA, 15 nt, Homo sapiens
caguucuacugaccu

SEQ ID NO: 539219 - RNA, 15 nt, Homo sapiens
caguucugcaaagau

SEQ ID NO: 539220 - RNA, 14 nt, Homo sapiens
caguucugcuccuc

SEQ ID NO: 539221 - RNA, 22 nt, Homo sapiens
caguucuguguggauuugucug

SEQ ID NO: 539222 - RNA, 21 nt, Homo sapiens
caguugaauaaaagugcacac

SEQ ID NO: 539223 - RNA, 22 nt, Homo sapiens
caguugaauauauucuauucca

SEQ ID NO: 539224 - RNA, 23 nt, Homo sapiens
caguugaauauauucuauuccau

SEQ ID NO: 539225 - RNA, 21 nt, Homo sapiens
caguugaaugacaacagaagc

SEQ ID NO: 539226 - RNA, 15 nt, Homo sapiens
caguugacaaaaagc

SEQ ID NO: 539227 - RNA, 14 nt, Homo sapiens
caguugacagcagg

SEQ ID NO: 539228 - RNA, 23 nt, Homo sapiens
caguugagcuucauauaccagca

SEQ ID NO: 539229 - RNA, 16 nt, Homo sapiens
caguugaucagacuga

SEQ ID NO: 539230 - RNA, 17 nt, Homo sapiens
caguugaucagacugaa

SEQ ID NO: 539231 - RNA, 18 nt, Homo sapiens
caguugcagcccuuguga

SEQ ID NO: 539232 - RNA, 14 nt, Homo sapiens
caguugcccuagcc

SEQ ID NO: 539233 - RNA, 22 nt, Homo sapiens
caguugcccuagcccagacucu

SEQ ID NO: 539234 - RNA, 13 nt, Homo sapiens
caguugcucugac

SEQ ID NO: 539235 - RNA, 14 nt, Homo sapiens
caguugcugugaac

SEQ ID NO: 539236 - RNA, 17 nt, Homo sapiens
caguugcuuugcccaag

SEQ ID NO: 539237 - RNA, 14 nt, Homo sapiens
caguugggacucag

SEQ ID NO: 539238 - RNA, 16 nt, Homo sapiens
caguugggagcacugg

SEQ ID NO: 539239 - RNA, 15 nt, Homo sapiens
caguuggugcugcuu

SEQ ID NO: 539240 - RNA, 21 nt, Homo sapiens
caguuguuugcuucuugccau

SEQ ID NO: 539241 - RNA, 13 nt, Homo sapiens
caguuuaaguaau

SEQ ID NO: 539242 - RNA, 16 nt, Homo sapiens
caguuuagaacagagg

SEQ ID NO: 539243 - RNA, 13 nt, Homo sapiens
caguuuagcaaga

SEQ ID NO: 539244 - RNA, 15 nt, Homo sapiens
caguuuagcaagcaa

SEQ ID NO: 539245 - RNA, 16 nt, Homo sapiens
caguuuaggaguacug

SEQ ID NO: 539246 - RNA, 17 nt, Homo sapiens
caguuuaggaguacuga

SEQ ID NO: 539247 - RNA, 17 nt, Homo sapiens
caguuuauauuguggaa

SEQ ID NO: 539248 - RNA, 20 nt, Homo sapiens
caguuucagguguuuaguug

SEQ ID NO: 539249 - RNA, 18 nt, Homo sapiens
caguuucuaggcaccuca

SEQ ID NO: 539250 - RNA, 19 nt, Homo sapiens
caguuucuaggcaccucag

SEQ ID NO: 539251 - RNA, 17 nt, Homo sapiens
caguuugaagucaaaug

SEQ ID NO: 539252 - RNA, 21 nt, Homo sapiens
caguuugccugcuguauuuau

SEQ ID NO: 539253 - RNA, 16 nt, Homo sapiens
caguuugcugccaugg

SEQ ID NO: 539254 - RNA, 19 nt, Homo sapiens
caguuuuauaaaaagugga

SEQ ID NO: 539255 - RNA, 21 nt, Homo sapiens
caguuuuaucuuuaaucuccu

SEQ ID NO: 539256 - RNA, 20 nt, Homo sapiens
caguuuuauuuuugccaagg

SEQ ID NO: 539257 - RNA, 17 nt, Homo sapiens
cauaaaaagcagaauuu

SEQ ID NO: 539258 - RNA, 18 nt, Homo sapiens
cauaaaagcauugucucu

SEQ ID NO: 539259 - RNA, 20 nt, Homo sapiens
cauaaaaugauccugccaau

SEQ ID NO: 539260 - RNA, 23 nt, Homo sapiens
cauaaacacccaugaaucaaaga

SEQ ID NO: 539261 - RNA, 17 nt, Homo sapiens
cauaaagguaacaaagg

SEQ ID NO: 539262 - RNA, 15 nt, Homo sapiens
cauaaaucacaaaua

SEQ ID NO: 539263 - RNA, 21 nt, Homo sapiens
cauaaauccccaaacccugaa

SEQ ID NO: 539264 - RNA, 18 nt, Homo sapiens
cauaaaucuuuuuacuuu

SEQ ID NO: 539265 - RNA, 17 nt, Homo sapiens
cauaaaugaaucaucaa

SEQ ID NO: 539266 - RNA, 16 nt, Homo sapiens
cauaaauugguauaau

SEQ ID NO: 539267 - RNA, 13 nt, Homo sapiens
cauaacaaaaaga

SEQ ID NO: 539268 - RNA, 14 nt, Homo sapiens
cauaaccugucuca

SEQ ID NO: 539269 - RNA, 21 nt, Homo sapiens
cauaacugaaaaugugcuaua

SEQ ID NO: 539270 - RNA, 17 nt, Homo sapiens
cauaacugaacauccaa

SEQ ID NO: 539271 - RNA, 17 nt, Homo sapiens
cauaacugaaggcauau

SEQ ID NO: 539272 - RNA, 12 nt, Homo sapiens
cauaacugacaa

SEQ ID NO: 539273 - RNA, 21 nt, Homo sapiens
cauaacugcuucuuggagcuu

SEQ ID NO: 539274 - RNA, 17 nt, Homo sapiens
cauaacuguucucauuu

SEQ ID NO: 539275 - RNA, 14 nt, Homo sapiens
cauaagaaagcacu

SEQ ID NO: 539276 - RNA, 16 nt, Homo sapiens
cauaagaaagcacuau

SEQ ID NO: 539277 - RNA, 20 nt, Homo sapiens
cauaagagcuuaagaaccau

SEQ ID NO: 539278 - RNA, 17 nt, Homo sapiens
cauaagaggugaucucu

SEQ ID NO: 539279 - RNA, 21 nt, Homo sapiens
cauaagccuaccaauguagac

SEQ ID NO: 539280 - RNA, 14 nt, Homo sapiens
cauaaggugcuauc

SEQ ID NO: 539281 - RNA, 22 nt, Homo sapiens
cauaagguuucguuucuguaua

SEQ ID NO: 539282 - RNA, 19 nt, Homo sapiens
cauaagucuaaauaaauga

SEQ ID NO: 539283 - RNA, 13 nt, Homo sapiens
cauaagugcaaua

SEQ ID NO: 539284 - RNA, 20 nt, Homo sapiens
cauaaguuaugccucugaca

SEQ ID NO: 539285 - RNA, 20 nt, Homo sapiens
cauaaguuuaggauaaaaua

SEQ ID NO: 539286 - RNA, 17 nt, Homo sapiens
cauaauaaaaaggcaau

SEQ ID NO: 539287 - RNA, 12 nt, Homo sapiens
cauaauacauga

SEQ ID NO: 539288 - RNA, 18 nt, Homo sapiens
cauaauguuaagcuuuau

SEQ ID NO: 539289 - RNA, 21 nt, Homo sapiens
cauaauguuucuggauuucau

SEQ ID NO: 539290 - RNA, 24 nt, Homo sapiens
cauaauuaugaaaacucaugauca

SEQ ID NO: 539291 - RNA, 14 nt, Homo sapiens
cauaauucagcacu

SEQ ID NO: 539292 - RNA, 15 nt, Homo sapiens
cauaauucagcacuu

SEQ ID NO: 539293 - RNA, 22 nt, Homo sapiens
cauaauucugaaacaacuugcc

SEQ ID NO: 539294 - RNA, 22 nt, Homo sapiens
cauaauugcuguucugcugaau

SEQ ID NO: 539295 - RNA, 19 nt, Homo sapiens
cauaauuuggggcccugag

SEQ ID NO: 539296 - RNA, 22 nt, Homo sapiens
cauaauuuguacauauguaaaa

SEQ ID NO: 539297 - RNA, 23 nt, Homo sapiens
cauacaaacaaugcaaccaacua

SEQ ID NO: 539298 - RNA, 16 nt, Homo sapiens
cauacaacagaaacca

SEQ ID NO: 539299 - RNA, 14 nt, Homo sapiens
cauacaaguuucau

SEQ ID NO: 539300 - RNA, 19 nt, Homo sapiens
cauacaauguauguacaau

SEQ ID NO: 539301 - RNA, 15 nt, Homo sapiens
cauacacugugaacu

SEQ ID NO: 539302 - RNA, 15 nt, Homo sapiens
cauacauauuaucuc

SEQ ID NO: 539303 - RNA, 16 nt, Homo sapiens
cauacauauuaucuca

SEQ ID NO: 539304 - RNA, 18 nt, Homo sapiens
cauacauuuaugcacauu

SEQ ID NO: 539305 - RNA, 17 nt, Homo sapiens
cauacccacacauucca

SEQ ID NO: 539306 - RNA, 18 nt, Homo sapiens
cauaccccggugugccug

SEQ ID NO: 539307 - RNA, 22 nt, Homo sapiens
cauacgguaugauauugcagcu

SEQ ID NO: 539308 - RNA, 22 nt, Homo sapiens
cauacuaaugaugagcauuuag

SEQ ID NO: 539309 - RNA, 23 nt, Homo sapiens
cauacuacaguaacugugacuga

SEQ ID NO: 539310 - RNA, 23 nt, Homo sapiens
cauacuaguagucauacucccug

SEQ ID NO: 539311 - RNA, 18 nt, Homo sapiens
cauacucccuuucagggc

SEQ ID NO: 539312 - RNA, 10 nt, Homo sapiens
cauacugcug

SEQ ID NO: 539313 - RNA, 18 nt, Homo sapiens
cauacuggccuggacugu

SEQ ID NO: 539314 - RNA, 14 nt, Homo sapiens
cauacuucucucag

SEQ ID NO: 539315 - RNA, 23 nt, Homo sapiens
cauagaaaaauucagcaaaccau

SEQ ID NO: 539316 - RNA, 23 nt, Homo sapiens
cauagaaaaggcgugcaguacua

SEQ ID NO: 539317 - RNA, 18 nt, Homo sapiens
cauagaaaauuaaacaca

SEQ ID NO: 539318 - RNA, 16 nt, Homo sapiens
cauagaaagaugacaa

SEQ ID NO: 539319 - RNA, 16 nt, Homo sapiens
cauagagugugaugua

SEQ ID NO: 539320 - RNA, 15 nt, Homo sapiens
cauagccaauggaca

SEQ ID NO: 539321 - RNA, 18 nt, Homo sapiens
cauagcccagaucagcuc

SEQ ID NO: 539322 - RNA, 11 nt, Homo sapiens
cauagccucau

SEQ ID NO: 539323 - RNA, 15 nt, Homo sapiens
cauagcuuccaugag

SEQ ID NO: 539324 - RNA, 19 nt, Homo sapiens
cauaggaagggaucugaga

SEQ ID NO: 539325 - RNA, 19 nt, Homo sapiens
cauaggaaguauggcauga

SEQ ID NO: 539326 - RNA, 21 nt, Homo sapiens
agucaaacgacuaaccuaucu

SEQ ID NO: 539327 - RNA, 15 nt, Homo sapiens
agucaacacucuucu

SEQ ID NO: 539328 - RNA, 16 nt, Homo sapiens
agucaacucuggccag

SEQ ID NO: 539329 - RNA, 17 nt, Homo sapiens
agucaagaucaacauuc

SEQ ID NO: 539330 - RNA, 20 nt, Homo sapiens
agucaauaaaagagcugucu

SEQ ID NO: 539331 - RNA, 23 nt, Homo sapiens
agucaauccccucauucaggaaa

SEQ ID NO: 539332 - RNA, 14 nt, Homo sapiens
agucaauccuguca

SEQ ID NO: 539333 - RNA, 18 nt, Homo sapiens
agucaauccugucauaua

SEQ ID NO: 539334 - RNA, 18 nt, Homo sapiens
agucaaugggcagagcca

SEQ ID NO: 539335 - RNA, 16 nt, Homo sapiens
agucaauuugcugaaa

SEQ ID NO: 539336 - RNA, 22 nt, Homo sapiens
agucacaacagagugaaaaauc

SEQ ID NO: 539337 - RNA, 22 nt, Homo sapiens
agucacaaugaguuugggcaua

SEQ ID NO: 539338 - RNA, 21 nt, Homo sapiens
agucacauaggaaacuugaaa

SEQ ID NO: 539339 - RNA, 14 nt, Homo sapiens
agucacauugccau

SEQ ID NO: 539340 - RNA, 14 nt, Homo sapiens
agucacccuuccac

SEQ ID NO: 539341 - RNA, 16 nt, Homo sapiens
agucacccuucugggc

SEQ ID NO: 539342 - RNA, 20 nt, Homo sapiens
agucacuaucauagggauaa

SEQ ID NO: 539343 - RNA, 16 nt, Homo sapiens
agucacugaacaaaac

SEQ ID NO: 539344 - RNA, 16 nt, Homo sapiens
agucacugcucuucag

SEQ ID NO: 539345 - RNA, 20 nt, Homo sapiens
agucacugcucuucagccau

SEQ ID NO: 539346 - RNA, 23 nt, Homo sapiens
agucacuggagguugaagccaag

SEQ ID NO: 539347 - RNA, 12 nt, Homo sapiens
agucacuggcau

SEQ ID NO: 539348 - RNA, 14 nt, Homo sapiens
agucagacugacac

SEQ ID NO: 539349 - RNA, 10 nt, Homo sapiens
agucagagac

SEQ ID NO: 539350 - RNA, 21 nt, Homo sapiens
agucagauccuguuacuugcu

SEQ ID NO: 539351 - RNA, 14 nt, Homo sapiens
agucagaugcccag

SEQ ID NO: 539352 - RNA, 16 nt, Homo sapiens
agucagcuuucagagc

SEQ ID NO: 539353 - RNA, 23 nt, Homo sapiens
agucaggccuuaauuuucaguau

SEQ ID NO: 539354 - RNA, 14 nt, Homo sapiens
agucaguauggucu

SEQ ID NO: 539355 - RNA, 13 nt, Homo sapiens
agucagucucuug

SEQ ID NO: 539356 - RNA, 14 nt, Homo sapiens
agucaguugcauuc

SEQ ID NO: 539357 - RNA, 14 nt, Homo sapiens
agucauauaccuau

SEQ ID NO: 539358 - RNA, 23 nt, Homo sapiens
agucaucagauaugcuuacuaaa

SEQ ID NO: 539359 - RNA, 17 nt, Homo sapiens
agucaucaucagggccu

SEQ ID NO: 539360 - RNA, 12 nt, Homo sapiens
agucaucuauag

SEQ ID NO: 539361 - RNA, 15 nt, Homo sapiens
agucaucucauucca

SEQ ID NO: 539362 - RNA, 16 nt, Homo sapiens
agucaucugucuuuca

SEQ ID NO: 539363 - RNA, 20 nt, Homo sapiens
agucaugaagcccaagugaa

SEQ ID NO: 539364 - RNA, 15 nt, Homo sapiens
agucaugcaucucag

SEQ ID NO: 539365 - RNA, 15 nt, Homo sapiens
agucaugggaacgca

SEQ ID NO: 539366 - RNA, 23 nt, Homo sapiens
agucauucagcagcaaauuuuca

SEQ ID NO: 539367 - RNA, 15 nt, Homo sapiens
agucauugaggcccu

SEQ ID NO: 539368 - RNA, 22 nt, Homo sapiens
agucauugucgcucagcaauag

SEQ ID NO: 539369 - RNA, 15 nt, Homo sapiens
aguccaacaauguug

SEQ ID NO: 539370 - RNA, 15 nt, Homo sapiens
aguccaaccugccug

SEQ ID NO: 539371 - RNA, 14 nt, Homo sapiens
aguccaauuccuug

SEQ ID NO: 539372 - RNA, 18 nt, Homo sapiens
aguccaauuuuuacucag

SEQ ID NO: 539373 - RNA, 15 nt, Homo sapiens
aguccaccugaggaa

SEQ ID NO: 539374 - RNA, 21 nt, Homo sapiens
aguccaccugaggaacugucu

SEQ ID NO: 539375 - RNA, 22 nt, Homo sapiens
aguccacuuguucuguacuugu

SEQ ID NO: 539376 - RNA, 22 nt, Homo sapiens
aguccagacacuuaacucaauu

SEQ ID NO: 539377 - RNA, 18 nt, Homo sapiens
aguccagauuuacacugg

SEQ ID NO: 539378 - RNA, 19 nt, Homo sapiens
aguccagauuuacacuggg

SEQ ID NO: 539379 - RNA, 15 nt, Homo sapiens
aguccagcacuggaa

SEQ ID NO: 539380 - RNA, 16 nt, Homo sapiens
aguccagcacuggaag

SEQ ID NO: 539381 - RNA, 17 nt, Homo sapiens
aguccaguaaagccuua

SEQ ID NO: 539382 - RNA, 16 nt, Homo sapiens
aguccaucuucuuuau

SEQ ID NO: 539383 - RNA, 11 nt, Homo sapiens
aguccauuucc

SEQ ID NO: 539384 - RNA, 12 nt, Homo sapiens
aguccauuuuaa

SEQ ID NO: 539385 - RNA, 13 nt, Homo sapiens
agucccacacugu

SEQ ID NO: 539386 - RNA, 16 nt, Homo sapiens
agucccacacugugca

SEQ ID NO: 539387 - RNA, 20 nt, Homo sapiens
agucccacccggacaggugg

SEQ ID NO: 539388 - RNA, 20 nt, Homo sapiens
agucccagaauuguaucuca

SEQ ID NO: 539389 - RNA, 15 nt, Homo sapiens
agucccagcuacuug

SEQ ID NO: 539390 - RNA, 16 nt, Homo sapiens
aguccccuuaagccaa

SEQ ID NO: 539391 - RNA, 21 nt, Homo sapiens
agucccucccaucucuacccc

SEQ ID NO: 539392 - RNA, 23 nt, Homo sapiens
agucccucccccagcccugucau

SEQ ID NO: 539393 - RNA, 13 nt, Homo sapiens
agucccugacucu

SEQ ID NO: 539394 - RNA, 23 nt, Homo sapiens
agucccuggaaaaacagucacug

SEQ ID NO: 539395 - RNA, 12 nt, Homo sapiens
agucccugugaa

SEQ ID NO: 539396 - RNA, 20 nt, Homo sapiens
agucccuugagacuccccaa

SEQ ID NO: 539397 - RNA, 17 nt, Homo sapiens
aguccgcagaagcccug

SEQ ID NO: 539398 - RNA, 22 nt, Homo sapiens
aguccggcuaaguggagcucag

SEQ ID NO: 539399 - RNA, 20 nt, Homo sapiens
aguccuacccugaaccuaug

SEQ ID NO: 539400 - RNA, 11 nt, Homo sapiens
aguccuacuca

SEQ ID NO: 539401 - RNA, 16 nt, Homo sapiens
aguccuauguacagag

SEQ ID NO: 539402 - RNA, 14 nt, Homo sapiens
aguccucuacugcu

SEQ ID NO: 539403 - RNA, 12 nt, Homo sapiens
aguccucugaau

SEQ ID NO: 539404 - RNA, 12 nt, Homo sapiens
aguccucugcau

SEQ ID NO: 539405 - RNA, 20 nt, Homo sapiens
aguccucuuugucauaccuu

SEQ ID NO: 539406 - RNA, 18 nt, Homo sapiens
aguccuggaugauacuaa

SEQ ID NO: 539407 - RNA, 23 nt, Homo sapiens
aguccugguccuggcugcacucu

SEQ ID NO: 539408 - RNA, 16 nt, Homo sapiens
aguccuucagaauuaa

SEQ ID NO: 539409 - RNA, 17 nt, Homo sapiens
agucgagauugcacugc

SEQ ID NO: 539410 - RNA, 19 nt, Homo sapiens
agucgagauugcacugcug

SEQ ID NO: 539411 - RNA, 13 nt, Homo sapiens
agucgaugaacua

SEQ ID NO: 539412 - RNA, 17 nt, Homo sapiens
agucgccagucacugcu

SEQ ID NO: 539413 - RNA, 16 nt, Homo sapiens
agucggccccaucucu

SEQ ID NO: 539414 - RNA, 15 nt, Homo sapiens
agucgggacuuguaa

SEQ ID NO: 539415 - RNA, 23 nt, Homo sapiens
agucgugccuguuugcuuagcau

SEQ ID NO: 539416 - RNA, 15 nt, Homo sapiens
agucguucccagugu

SEQ ID NO: 539417 - RNA, 15 nt, Homo sapiens
agucuaaucaagugu

SEQ ID NO: 539418 - RNA, 15 nt, Homo sapiens
agucuagcaccucua

SEQ ID NO: 539419 - RNA, 21 nt, Homo sapiens
agucuagccuggacaacacag

SEQ ID NO: 539420 - RNA, 21 nt, Homo sapiens
agucuagccuuguagcuguua

SEQ ID NO: 539421 - RNA, 19 nt, Homo sapiens
agucuaucaaccccagaca

SEQ ID NO: 539422 - RNA, 23 nt, Homo sapiens
agucuaucaaccccagacacugg

SEQ ID NO: 539423 - RNA, 14 nt, Homo sapiens
agucuauggguuua

SEQ ID NO: 539424 - RNA, 17 nt, Homo sapiens
agucuauguucaaagac

SEQ ID NO: 539425 - RNA, 23 nt, Homo sapiens
agucuauugucuccuugguuaua

SEQ ID NO: 539426 - RNA, 23 nt, Homo sapiens
agucuauuuccacugaacaaaac

SEQ ID NO: 539427 - RNA, 22 nt, Homo sapiens
agucucacuuuuauugauaaaa

SEQ ID NO: 539428 - RNA, 23 nt, Homo sapiens
agucucagagaccagcacucagc

SEQ ID NO: 539429 - RNA, 14 nt, Homo sapiens
agucucaguucucu

SEQ ID NO: 539430 - RNA, 12 nt, Homo sapiens
agucucaucucc

SEQ ID NO: 539431 - RNA, 22 nt, Homo sapiens
agucuccagggacccuugccug

SEQ ID NO: 539432 - RNA, 23 nt, Homo sapiens
agucuccccuugcagccugguca

SEQ ID NO: 539433 - RNA, 17 nt, Homo sapiens
agucuccgugguugaag

SEQ ID NO: 539434 - RNA, 17 nt, Homo sapiens
agucuccuuugcacuga

SEQ ID NO: 539435 - RNA, 16 nt, Homo sapiens
agucucuagguucuga

SEQ ID NO: 539436 - RNA, 17 nt, Homo sapiens
agucucugccacccacu

SEQ ID NO: 539437 - RNA, 22 nt, Homo sapiens
agucucuggaaaaagacugauu

SEQ ID NO: 539438 - RNA, 13 nt, Homo sapiens
agucucugugaau

SEQ ID NO: 539439 - RNA, 15 nt, Homo sapiens
agucucugugaauug

SEQ ID NO: 539440 - RNA, 11 nt, Homo sapiens
agucucugugc

SEQ ID NO: 539441 - RNA, 16 nt, Homo sapiens
agucugaaagacagaa

SEQ ID NO: 539442 - RNA, 13 nt, Homo sapiens
agucugaacagcu

SEQ ID NO: 539443 - RNA, 20 nt, Homo sapiens
agucugaauagucuucagag

SEQ ID NO: 539444 - RNA, 14 nt, Homo sapiens
agucugacugugcc

SEQ ID NO: 539445 - RNA, 21 nt, Homo sapiens
agucugaggccccuuaacuca

SEQ ID NO: 539446 - RNA, 15 nt, Homo sapiens
agucugaguaaaauc

SEQ ID NO: 539447 - RNA, 14 nt, Homo sapiens
agucugaugacaca

SEQ ID NO: 539448 - RNA, 15 nt, Homo sapiens
agugcgaguccucca

SEQ ID NO: 539449 - RNA, 18 nt, Homo sapiens
agugcgcagaucugugcc

SEQ ID NO: 539450 - RNA, 22 nt, Homo sapiens
agugcggcgugggggcacugac

SEQ ID NO: 539451 - RNA, 20 nt, Homo sapiens
agugcgggauucaaaggugg

SEQ ID NO: 539452 - RNA, 15 nt, Homo sapiens
agugcugaacagugg

SEQ ID NO: 539453 - RNA, 15 nt, Homo sapiens
agugcugaccagaca

SEQ ID NO: 539454 - RNA, 22 nt, Homo sapiens
agugcugccccuugcaagccau

SEQ ID NO: 539455 - RNA, 13 nt, Homo sapiens
agugcugcugaag

SEQ ID NO: 539456 - RNA, 20 nt, Homo sapiens
agugcugcuggaaguagaau

SEQ ID NO: 539457 - RNA, 16 nt, Homo sapiens
agugcuggaacacugc

SEQ ID NO: 539458 - RNA, 19 nt, Homo sapiens
agugcuggcucacaguaca

SEQ ID NO: 539459 - RNA, 17 nt, Homo sapiens
agugcugggauuacaau

SEQ ID NO: 539460 - RNA, 14 nt, Homo sapiens
agugcuggucagag

SEQ ID NO: 539461 - RNA, 22 nt, Homo sapiens
agugcugucgggaccacaucug

SEQ ID NO: 539462 - RNA, 15 nt, Homo sapiens
agugcuucagaguuu

SEQ ID NO: 539463 - RNA, 16 nt, Homo sapiens
agugcuuggguggugg

SEQ ID NO: 539464 - RNA, 22 nt, Homo sapiens
agugcuuuucagugauacucac

SEQ ID NO: 539465 - RNA, 15 nt, Homo sapiens
caugaaaaccugaag

SEQ ID NO: 539466 - RNA, 19 nt, Homo sapiens
caugaaaauagcucuuuca

SEQ ID NO: 539467 - RNA, 13 nt, Homo sapiens
caugaaacauguu

SEQ ID NO: 539468 - RNA, 14 nt, Homo sapiens
caugaaacugucca

SEQ ID NO: 539469 - RNA, 20 nt, Homo sapiens
caugaacagacacuuuucaa

SEQ ID NO: 539470 - RNA, 22 nt, Homo sapiens
caugaacaucuuuagugucuga

SEQ ID NO: 539471 - RNA, 15 nt, Homo sapiens
caugaaccaagugga

SEQ ID NO: 539472 - RNA, 21 nt, Homo sapiens
caugaacucuugaagucacac

SEQ ID NO: 539473 - RNA, 19 nt, Homo sapiens
caugaagaaugcauucaaa

SEQ ID NO: 539474 - RNA, 14 nt, Homo sapiens
caugaagcacauca

SEQ ID NO: 539475 - RNA, 21 nt, Homo sapiens
caugaagcccaagugaaauca

SEQ ID NO: 539476 - RNA, 21 nt, Homo sapiens
caugaaggauaaaagccccaa

SEQ ID NO: 539477 - RNA, 20 nt, Homo sapiens
caugaagggagggucccugu

SEQ ID NO: 539478 - RNA, 22 nt, Homo sapiens
caugaagggagggucccugugu

SEQ ID NO: 539479 - RNA, 15 nt, Homo sapiens
caugaauacuaucca

SEQ ID NO: 539480 - RNA, 15 nt, Homo sapiens
caugaaucaaagaca

SEQ ID NO: 539481 - RNA, 17 nt, Homo sapiens
caugaauccaguccaga

SEQ ID NO: 539482 - RNA, 13 nt, Homo sapiens
caugaaugcacac

SEQ ID NO: 539483 - RNA, 13 nt, Homo sapiens
caugaauguauca

SEQ ID NO: 539484 - RNA, 14 nt, Homo sapiens
caugaauuccuuaa

SEQ ID NO: 539485 - RNA, 14 nt, Homo sapiens
aguggaacagucac

SEQ ID NO: 539486 - RNA, 23 nt, Homo sapiens
aguggaaggucuauuggccaaca

SEQ ID NO: 539487 - RNA, 11 nt, Homo sapiens
aguggacaaau

SEQ ID NO: 539488 - RNA, 18 nt, Homo sapiens
aguggacagucuggccac

SEQ ID NO: 539489 - RNA, 17 nt, Homo sapiens
aguggacuuccuauuaa

SEQ ID NO: 539490 - RNA, 14 nt, Homo sapiens
aguggagacagacu

SEQ ID NO: 539491 - RNA, 14 nt, Homo sapiens
aguggagaugaagc

SEQ ID NO: 539492 - RNA, 14 nt, Homo sapiens
aguggauggaauau

SEQ ID NO: 539493 - RNA, 17 nt, Homo sapiens
aguggauguguacuuca

SEQ ID NO: 539494 - RNA, 13 nt, Homo sapiens
aguggauucccag

SEQ ID NO: 539495 - RNA, 17 nt, Homo sapiens
aguggcaccagaggugc

SEQ ID NO: 539496 - RNA, 19 nt, Homo sapiens
aguggcaggugggcugccu

SEQ ID NO: 539497 - RNA, 23 nt, Homo sapiens
aguggcauggcuccagucugcug

SEQ ID NO: 539498 - RNA, 18 nt, Homo sapiens
aguggccacguucaggga

SEQ ID NO: 539499 - RNA, 16 nt, Homo sapiens
aguggccagccagugc

SEQ ID NO: 539500 - RNA, 19 nt, Homo sapiens
aguggccagccagugccau

SEQ ID NO: 539501 - RNA, 14 nt, Homo sapiens
aguggccaugccac

SEQ ID NO: 539502 - RNA, 20 nt, Homo sapiens
aguggcuaccuacauacaau

SEQ ID NO: 539503 - RNA, 14 nt, Homo sapiens
aguggcugccaugg

SEQ ID NO: 539504 - RNA, 19 nt, Homo sapiens
aguggcuuggccucaagag

SEQ ID NO: 539505 - RNA, 21 nt, Homo sapiens
aguggcuuugcauagcuuuca

SEQ ID NO: 539506 - RNA, 13 nt, Homo sapiens
aguggcuuuuuaa

SEQ ID NO: 539507 - RNA, 15 nt, Homo sapiens
agugggaacugugca

SEQ ID NO: 539508 - RNA, 15 nt, Homo sapiens
agugggaaggggugc

SEQ ID NO: 539509 - RNA, 20 nt, Homo sapiens
agugggagaaggcagugauu

SEQ ID NO: 539510 - RNA, 16 nt, Homo sapiens
agugggagccaaugaa

SEQ ID NO: 539511 - RNA, 15 nt, Homo sapiens
agugggaucccagac

SEQ ID NO: 539512 - RNA, 11 nt, Homo sapiens
agugggccagg

SEQ ID NO: 539513 - RNA, 18 nt, Homo sapiens
agugggccauuaaaaacu

SEQ ID NO: 539514 - RNA, 18 nt, Homo sapiens
agugggccugguagcaca

SEQ ID NO: 539515 - RNA, 21 nt, Homo sapiens
agugggcugcagcagccggaa

SEQ ID NO: 539516 - RNA, 19 nt, Homo sapiens
aguggggagacuucuuggc

SEQ ID NO: 539517 - RNA, 16 nt, Homo sapiens
aguggggugcucuggu

SEQ ID NO: 539518 - RNA, 17 nt, Homo sapiens
aguggguccaaguggcu

SEQ ID NO: 539519 - RNA, 20 nt, Homo sapiens
aguggguggcaggugggggu

SEQ ID NO: 539520 - RNA, 13 nt, Homo sapiens
agugguacaggaa

SEQ ID NO: 539521 - RNA, 13 nt, Homo sapiens
aguggucgaguga

SEQ ID NO: 539522 - RNA, 17 nt, Homo sapiens
aguggucugaauucugg

SEQ ID NO: 539523 - RNA, 12 nt, Homo sapiens
aguggugguaug

SEQ ID NO: 539524 - RNA, 15 nt, Homo sapiens
agugguggucuucaa

SEQ ID NO: 539525 - RNA, 15 nt, Homo sapiens
aguggugugcucugg

SEQ ID NO: 539526 - RNA, 13 nt, Homo sapiens
agugguucaagca

SEQ ID NO: 539527 - RNA, 15 nt, Homo sapiens
agugguugcauucua

SEQ ID NO: 539528 - RNA, 20 nt, Homo sapiens
agugguuguuuugucaugaa

SEQ ID NO: 539529 - RNA, 16 nt, Homo sapiens
agugguuuccagucau

SEQ ID NO: 539530 - RNA, 23 nt, Homo sapiens
aguguaaaaaaugucucauguca

SEQ ID NO: 539531 - RNA, 17 nt, Homo sapiens
aguguacaaaacuguaa

SEQ ID NO: 539532 - RNA, 13 nt, Homo sapiens
aguguacauggaa

SEQ ID NO: 539533 - RNA, 17 nt, Homo sapiens
aguguacccaucuuuaa

SEQ ID NO: 539534 - RNA, 16 nt, Homo sapiens
aguguacugugccugg

SEQ ID NO: 539535 - RNA, 17 nt, Homo sapiens
aguguagaccugagcug

SEQ ID NO: 539536 - RNA, 18 nt, Homo sapiens
aguguagauguagcauug

SEQ ID NO: 539537 - RNA, 16 nt, Homo sapiens
aguguaguuggaucuc

SEQ ID NO: 539538 - RNA, 15 nt, Homo sapiens
aguguauaaauccaa

SEQ ID NO: 539539 - RNA, 15 nt, Homo sapiens
aguguauacaugugu

SEQ ID NO: 539540 - RNA, 18 nt, Homo sapiens
aguguaugacugcacaug

SEQ ID NO: 539541 - RNA, 23 nt, Homo sapiens
aguguauuuuauguguggcccaa

SEQ ID NO: 539542 - RNA, 20 nt, Homo sapiens
agugucauccucacagugaa

SEQ ID NO: 539543 - RNA, 20 nt, Homo sapiens
agugucuaauaaugcugaag

SEQ ID NO: 539544 - RNA, 17 nt, Homo sapiens
agugucuagacauauuu

SEQ ID NO: 539545 - RNA, 21 nt, Homo sapiens
agugucucugccuugagucau

SEQ ID NO: 539546 - RNA, 16 nt, Homo sapiens
agugucugugugcaag

SEQ ID NO: 539547 - RNA, 22 nt, Homo sapiens
agugugaaccgaggggcucagg

SEQ ID NO: 539548 - RNA, 14 nt, Homo sapiens
agugugacagggcc

SEQ ID NO: 539549 - RNA, 17 nt, Homo sapiens
agugugacagggccagu

SEQ ID NO: 539550 - RNA, 22 nt, Homo sapiens
agugugacagggccaguggggc

SEQ ID NO: 539551 - RNA, 15 nt, Homo sapiens
agugugagaacuucc

SEQ ID NO: 539552 - RNA, 14 nt, Homo sapiens
agugugcauuucag

SEQ ID NO: 539553 - RNA, 20 nt, Homo sapiens
agugugcucuuagcucuacc

SEQ ID NO: 539554 - RNA, 14 nt, Homo sapiens
agugugcugcuauu

SEQ ID NO: 539555 - RNA, 12 nt, Homo sapiens
aguguggaacca

SEQ ID NO: 539556 - RNA, 16 nt, Homo sapiens
aguguggaaccacuga

SEQ ID NO: 539557 - RNA, 23 nt, Homo sapiens
aguguggcccagggaagccaaaa

SEQ ID NO: 539558 - RNA, 19 nt, Homo sapiens
aguguggcugcaucuugcu

SEQ ID NO: 539559 - RNA, 17 nt, Homo sapiens
agugugggcuugaccag

SEQ ID NO: 539560 - RNA, 20 nt, Homo sapiens
aguguggggauuuucacuga

SEQ ID NO: 539561 - RNA, 14 nt, Homo sapiens
aguguggugugugg

SEQ ID NO: 539562 - RNA, 19 nt, Homo sapiens
aguguguaaauaauuugca

SEQ ID NO: 539563 - RNA, 20 nt, Homo sapiens
aguguguaucuagcuucuuc

SEQ ID NO: 539564 - RNA, 14 nt, Homo sapiens
aguguguaugugcg

SEQ ID NO: 539565 - RNA, 16 nt, Homo sapiens
aguguguccaagugug

SEQ ID NO: 539566 - RNA, 15 nt, Homo sapiens
agugugugacauucc

SEQ ID NO: 539567 - RNA, 18 nt, Homo sapiens
agugugugacauuccagg

SEQ ID NO: 539568 - RNA, 21 nt, Homo sapiens
agugugugauaaaucagucaa

SEQ ID NO: 539569 - RNA, 20 nt, Homo sapiens
agugugugcaaguaugugag

SEQ ID NO: 539570 - RNA, 14 nt, Homo sapiens
agugugugugcaug

SEQ ID NO: 539571 - RNA, 13 nt, Homo sapiens
agugugugugcgu

SEQ ID NO: 539572 - RNA, 17 nt, Homo sapiens
aguguuaucagucauaa

SEQ ID NO: 539573 - RNA, 19 nt, Homo sapiens
aguguucacaaacugugaa

SEQ ID NO: 539574 - RNA, 18 nt, Homo sapiens
aguguucacaacagugaa

SEQ ID NO: 539575 - RNA, 21 nt, Homo sapiens
aguguucauuuuagugacugu

SEQ ID NO: 539576 - RNA, 19 nt, Homo sapiens
aguguucccagagcacuuu

SEQ ID NO: 539577 - RNA, 16 nt, Homo sapiens
aguguuccccuuccac

SEQ ID NO: 539578 - RNA, 23 nt, Homo sapiens
aguguuccccuuccacugagggc

SEQ ID NO: 539579 - RNA, 19 nt, Homo sapiens
aguguucuaugaacaacuc

SEQ ID NO: 539580 - RNA, 10 nt, Homo sapiens
aguguucucc

SEQ ID NO: 539581 - RNA, 21 nt, Homo sapiens
aguguugaugcuuucgucucc

SEQ ID NO: 539582 - RNA, 20 nt, Homo sapiens
aguguuggaaaaugugcaau

SEQ ID NO: 539583 - RNA, 22 nt, Homo sapiens
aguguugugccccuucacucau

SEQ ID NO: 539584 - RNA, 18 nt, Homo sapiens
aguguuguggacacugca

SEQ ID NO: 539585 - RNA, 14 nt, Homo sapiens
aguguuucuuccac

SEQ ID NO: 539586 - RNA, 18 nt, Homo sapiens
aguguuucuuccacaaca

SEQ ID NO: 539587 - RNA, 16 nt, Homo sapiens
cauggugaaaauguac

SEQ ID NO: 539588 - RNA, 13 nt, Homo sapiens
cauggugacauug

SEQ ID NO: 539589 - RNA, 18 nt, Homo sapiens
cauggugcagggagacau

SEQ ID NO: 539590 - RNA, 12 nt, Homo sapiens
cauggugcagug

SEQ ID NO: 539591 - RNA, 15 nt, Homo sapiens
cauggugguggacac

SEQ ID NO: 539592 - RNA, 19 nt, Homo sapiens
cauggugugaguccaaaga

SEQ ID NO: 539593 - RNA, 17 nt, Homo sapiens
caugguguguggugcua

SEQ ID NO: 539594 - RNA, 15 nt, Homo sapiens
caugguuauugauga

SEQ ID NO: 539595 - RNA, 16 nt, Homo sapiens
cauguaagccaaguca

SEQ ID NO: 539596 - RNA, 21 nt, Homo sapiens
cauguaauguuaauguuauau

SEQ ID NO: 539597 - RNA, 22 nt, Homo sapiens
cauguacacggccucaagggau

SEQ ID NO: 539598 - RNA, 14 nt, Homo sapiens
cauguacagcauua

SEQ ID NO: 539599 - RNA, 18 nt, Homo sapiens
cauguacucuguugagua

SEQ ID NO: 539600 - RNA, 21 nt, Homo sapiens
cauguaggaguguuuaucuuu

SEQ ID NO: 539601 - RNA, 19 nt, Homo sapiens
cauguagguaggaagcacu

SEQ ID NO: 539602 - RNA, 23 nt, Homo sapiens
cauguagguaggaagcacugaaa

SEQ ID NO: 539603 - RNA, 15 nt, Homo sapiens
cauguaucucaguac

SEQ ID NO: 539604 - RNA, 13 nt, Homo sapiens
cauguaugcaagu

SEQ ID NO: 539605 - RNA, 14 nt, Homo sapiens
cauguaugucugca

SEQ ID NO: 539606 - RNA, 12 nt, Homo sapiens
caugucaccuca

SEQ ID NO: 539607 - RNA, 12 nt, Homo sapiens
caugucacugug

SEQ ID NO: 539608 - RNA, 20 nt, Homo sapiens
caugucacuucccugcuuaa

SEQ ID NO: 539609 - RNA, 20 nt, Homo sapiens
cauguccacaaugcacaugu

SEQ ID NO: 539610 - RNA, 21 nt, Homo sapiens
cauguccugcugcuucugcaa

SEQ ID NO: 539611 - RNA, 14 nt, Homo sapiens
caugucgcacaaug

SEQ ID NO: 539612 - RNA, 17 nt, Homo sapiens
caugucucaauaguaaa

SEQ ID NO: 539613 - RNA, 21 nt, Homo sapiens
caugucuccauuuucuucucu

SEQ ID NO: 539614 - RNA, 12 nt, Homo sapiens
caugucuuucag

SEQ ID NO: 539615 - RNA, 14 nt, Homo sapiens
caugugaagagaau

SEQ ID NO: 539616 - RNA, 23 nt, Homo sapiens
caugugacaaagggccagcaguc

SEQ ID NO: 539617 - RNA, 16 nt, Homo sapiens
caugugagcaugucac

SEQ ID NO: 539618 - RNA, 15 nt, Homo sapiens
caugugcaaaugugc

SEQ ID NO: 539619 - RNA, 18 nt, Homo sapiens
caugugcgcgcgugcaug

SEQ ID NO: 539620 - RNA, 20 nt, Homo sapiens
caugugcggcugaacugaga

SEQ ID NO: 539621 - RNA, 13 nt, Homo sapiens
caugugcugcaaa

SEQ ID NO: 539622 - RNA, 17 nt, Homo sapiens
caugugcuggacacugu

SEQ ID NO: 539623 - RNA, 20 nt, Homo sapiens
caugugcuggacacugucca

SEQ ID NO: 539624 - RNA, 20 nt, Homo sapiens
caugugcugucuccaugcug

SEQ ID NO: 539625 - RNA, 21 nt, Homo sapiens
cauguggagaaaggagugaaa

SEQ ID NO: 539626 - RNA, 14 nt, Homo sapiens
caugugggcugugg

SEQ ID NO: 539627 - RNA, 15 nt, Homo sapiens
caugugggucuucca

SEQ ID NO: 539628 - RNA, 18 nt, Homo sapiens
caugugguuacuaguaca

SEQ ID NO: 539629 - RNA, 21 nt, Homo sapiens
cauguguagguauugaaaaag

SEQ ID NO: 539630 - RNA, 13 nt, Homo sapiens
cauguguauuucc

SEQ ID NO: 539631 - RNA, 16 nt, Homo sapiens
caugugucacuugugc

SEQ ID NO: 539632 - RNA, 16 nt, Homo sapiens
caugugucaugaagaa

SEQ ID NO: 539633 - RNA, 19 nt, Homo sapiens
caugugugagugugugcaa

SEQ ID NO: 539634 - RNA, 20 nt, Homo sapiens
caugugugagugugugcaag

SEQ ID NO: 539635 - RNA, 14 nt, Homo sapiens
caugugugcaaaaa

SEQ ID NO: 539636 - RNA, 17 nt, Homo sapiens
caugugugcgagugugu

SEQ ID NO: 539637 - RNA, 22 nt, Homo sapiens
caugugugcgagugugugcaug

SEQ ID NO: 539638 - RNA, 23 nt, Homo sapiens
caugugugcgugugcgugcaugu

SEQ ID NO: 539639 - RNA, 17 nt, Homo sapiens
cauguguguaagugugu

SEQ ID NO: 539640 - RNA, 15 nt, Homo sapiens
caugugugugcaagu

SEQ ID NO: 539641 - RNA, 19 nt, Homo sapiens
caugugugugcaagugugu

SEQ ID NO: 539642 - RNA, 15 nt, Homo sapiens
cauguuaagugccau

SEQ ID NO: 539643 - RNA, 23 nt, Homo sapiens
cauguuaagugccauuacuacug

SEQ ID NO: 539644 - RNA, 14 nt, Homo sapiens
cauguuccucaaaa

SEQ ID NO: 539645 - RNA, 19 nt, Homo sapiens
cauguuccugccccacagg

SEQ ID NO: 539646 - RNA, 23 nt, Homo sapiens
cauguuuauaaaucuuaugcucu

SEQ ID NO: 539647 - RNA, 22 nt, Homo sapiens
cauguuucaagaaaauggauuu

SEQ ID NO: 539648 - RNA, 16 nt, Homo sapiens
cauguuuccaucauuu

SEQ ID NO: 539649 - RNA, 16 nt, Homo sapiens
cauguuuccucucaau

SEQ ID NO: 539650 - RNA, 19 nt, Homo sapiens
cauguuugcaccugugcau

SEQ ID NO: 539651 - RNA, 17 nt, Homo sapiens
cauguuugcacuuggca

SEQ ID NO: 539652 - RNA, 23 nt, Homo sapiens
cauguuuugccacccccugugag

SEQ ID NO: 539653 - RNA, 15 nt, Homo sapiens
cauguuuuugccaaa

SEQ ID NO: 539654 - RNA, 18 nt, Homo sapiens
cauuaaaacucauaauua

SEQ ID NO: 539655 - RNA, 13 nt, Homo sapiens
cauuaaaagcuac

SEQ ID NO: 539656 - RNA, 22 nt, Homo sapiens
cauuaaaauaaaacaagccuua

SEQ ID NO: 539657 - RNA, 19 nt, Homo sapiens
cauuaaaauccaguauuau

SEQ ID NO: 539658 - RNA, 13 nt, Homo sapiens
cauuaaacacugu

SEQ ID NO: 539659 - RNA, 15 nt, Homo sapiens
cauuaaacacuguaa

SEQ ID NO: 539660 - RNA, 15 nt, Homo sapiens
cauuaaacuuaccug

SEQ ID NO: 539661 - RNA, 21 nt, Homo sapiens
cauuaacaguuuuccaugaaa

SEQ ID NO: 539662 - RNA, 15 nt, Homo sapiens
cauuaacuucucugg

SEQ ID NO: 539663 - RNA, 12 nt, Homo sapiens
cauuaagcacac

SEQ ID NO: 539664 - RNA, 16 nt, Homo sapiens
cauuaaggaauuugau

SEQ ID NO: 539665 - RNA, 15 nt, Homo sapiens
cauuaaucagauuag

SEQ ID NO: 539666 - RNA, 14 nt, Homo sapiens
cauuaaucaguuca

SEQ ID NO: 539667 - RNA, 21 nt, Homo sapiens
cauuaaugguuggaaaacacu

SEQ ID NO: 539668 - RNA, 23 nt, Homo sapiens
cauuacagagaggagaaacacau

SEQ ID NO: 539669 - RNA, 15 nt, Homo sapiens
cauuacagauucugc

SEQ ID NO: 539670 - RNA, 12 nt, Homo sapiens
cauuacaguauu

SEQ ID NO: 539671 - RNA, 17 nt, Homo sapiens
cauuaccauggagacaa

SEQ ID NO: 539672 - RNA, 19 nt, Homo sapiens
cauuacuguuccagauucc

SEQ ID NO: 539673 - RNA, 22 nt, Homo sapiens
cauuacuuaugaugaugaaggg

SEQ ID NO: 539674 - RNA, 12 nt, Homo sapiens
cauuacuuugau

SEQ ID NO: 539675 - RNA, 17 nt, Homo sapiens
cauuagaacaaaggaca

SEQ ID NO: 539676 - RNA, 15 nt, Homo sapiens
cauuagcagcaucuu

SEQ ID NO: 539677 - RNA, 14 nt, Homo sapiens
cauuagccaaggau

SEQ ID NO: 539678 - RNA, 20 nt, Homo sapiens
cauuaguaauaaguaaaaug

SEQ ID NO: 539679 - RNA, 16 nt, Homo sapiens
cauuagucaauaacua

SEQ ID NO: 539680 - RNA, 18 nt, Homo sapiens
cauuagugaaaauucugu

SEQ ID NO: 539681 - RNA, 23 nt, Homo sapiens
cauuaguuguuagugauggagcu

SEQ ID NO: 539682 - RNA, 14 nt, Homo sapiens
cauuauacauuuga

SEQ ID NO: 539683 - RNA, 14 nt, Homo sapiens
cauuauaugcacua

SEQ ID NO: 539684 - RNA, 15 nt, Homo sapiens
cauuaucaguugaca

SEQ ID NO: 539685 - RNA, 20 nt, Homo sapiens
cauuaucaguugacagugua

SEQ ID NO: 539686 - RNA, 19 nt, Homo sapiens
cauuaucuaguucauugaa

SEQ ID NO: 539687 - RNA, 15 nt, Homo sapiens
cauuaucucacuuag

SEQ ID NO: 539688 - RNA, 23 nt, Homo sapiens
cauuaucuuugucuguucacuuu

SEQ ID NO: 539689 - RNA, 16 nt, Homo sapiens
cauuaugagaggcaau

SEQ ID NO: 539690 - RNA, 15 nt, Homo sapiens
cauuauguucaucac

SEQ ID NO: 539691 - RNA, 15 nt, Homo sapiens
cauuauuagcacuuc

SEQ ID NO: 539692 - RNA, 16 nt, Homo sapiens
cauuauucuucacuua

SEQ ID NO: 539693 - RNA, 17 nt, Homo sapiens
cauuauuuucugucaga

SEQ ID NO: 539694 - RNA, 19 nt, Homo sapiens
cauuauuuuuuacaauggc

SEQ ID NO: 539695 - RNA, 18 nt, Homo sapiens
cauucaacagagacugaa

SEQ ID NO: 539696 - RNA, 15 nt, Homo sapiens
cauucaacucggaaa

SEQ ID NO: 539697 - RNA, 14 nt, Homo sapiens
cauucaacugaaaa

SEQ ID NO: 539698 - RNA, 14 nt, Homo sapiens
cauucaauauugac

SEQ ID NO: 539699 - RNA, 17 nt, Homo sapiens
cauucaauuagugguca

SEQ ID NO: 539700 - RNA, 12 nt, Homo sapiens
cauucacaccag

SEQ ID NO: 539701 - RNA, 19 nt, Homo sapiens
cauucacauuugauguaca

SEQ ID NO: 539702 - RNA, 17 nt, Homo sapiens
cauucacuacaggugaa

SEQ ID NO: 539703 - RNA, 17 nt, Homo sapiens
cauucacuugcauuucu

SEQ ID NO: 539704 - RNA, 18 nt, Homo sapiens
cauucagaaagcuucaaa

SEQ ID NO: 539705 - RNA, 9 nt, Homo sapiens
cauucaguc

SEQ ID NO: 539706 - RNA, 20 nt, Homo sapiens
cauucagugauuacugucaa

SEQ ID NO: 539707 - RNA, 19 nt, Homo sapiens
cauucaguuaaaaauccag

SEQ ID NO: 539708 - RNA, 17 nt, Homo sapiens
cauucaguuagcaaaga

SEQ ID NO: 539709 - RNA, 17 nt, Homo sapiens
ccagagaccugacccaa

SEQ ID NO: 539710 - RNA, 18 nt, Homo sapiens
ccagagaccugaggcaga

SEQ ID NO: 539711 - RNA, 22 nt, Homo sapiens
ccagagagcagcuucagugaca

SEQ ID NO: 539712 - RNA, 18 nt, Homo sapiens
ccagagagcaggggagcu

SEQ ID NO: 539713 - RNA, 15 nt, Homo sapiens
ccagagaguccugug

SEQ ID NO: 539714 - RNA, 12 nt, Homo sapiens
ccagagcacugg

SEQ ID NO: 539715 - RNA, 15 nt, Homo sapiens
ccagagccaccaaag

SEQ ID NO: 539716 - RNA, 22 nt, Homo sapiens
ccagagccagaaagggugccag

SEQ ID NO: 539717 - RNA, 16 nt, Homo sapiens
ccagagcccagcucuu

SEQ ID NO: 539718 - RNA, 22 nt, Homo sapiens
ccagagcuggaaggcagggcag

SEQ ID NO: 539719 - RNA, 20 nt, Homo sapiens
ccagagcugggaggcauggc

SEQ ID NO: 539720 - RNA, 12 nt, Homo sapiens
ccagagcugugc

SEQ ID NO: 539721 - RNA, 14 nt, Homo sapiens
ccagagcugugcca

SEQ ID NO: 539722 - RNA, 15 nt, Homo sapiens
ccagagcugugccag

SEQ ID NO: 539723 - RNA, 17 nt, Homo sapiens
ccagagcugugccagca

SEQ ID NO: 539724 - RNA, 21 nt, Homo sapiens
ccagaggaaucuauaguuuaa

SEQ ID NO: 539725 - RNA, 14 nt, Homo sapiens
ccagaggacaaaag

SEQ ID NO: 539726 - RNA, 13 nt, Homo sapiens
ccagaggacaaag

SEQ ID NO: 539727 - RNA, 15 nt, Homo sapiens
ccagaggauggugag

SEQ ID NO: 539728 - RNA, 15 nt, Homo sapiens
ccagaggcaguaacc

SEQ ID NO: 539729 - RNA, 12 nt, Homo sapiens
ccagaggcaucu

SEQ ID NO: 539730 - RNA, 23 nt, Homo sapiens
ccagaggcucuaauguacaauaa

SEQ ID NO: 539731 - RNA, 15 nt, Homo sapiens
ccagagggcacucug

SEQ ID NO: 539732 - RNA, 17 nt, Homo sapiens
ccagaggguagggcaca

SEQ ID NO: 539733 - RNA, 22 nt, Homo sapiens
ccagaggugcccgcucuucccu

SEQ ID NO: 539734 - RNA, 11 nt, Homo sapiens
ccagagucaga

SEQ ID NO: 539735 - RNA, 21 nt, Homo sapiens
ccagaguguauuacaacaauc

SEQ ID NO: 539736 - RNA, 23 nt, Homo sapiens
ccagauaaaauguucagugcaau

SEQ ID NO: 539737 - RNA, 19 nt, Homo sapiens
ccagauagcagggcaugaa

SEQ ID NO: 539738 - RNA, 18 nt, Homo sapiens
ccagauauaacugucuug

SEQ ID NO: 539739 - RNA, 15 nt, Homo sapiens
ccagauauuucacau

SEQ ID NO: 539740 - RNA, 22 nt, Homo sapiens
ccagauccuucaaagagucaua

SEQ ID NO: 539741 - RNA, 21 nt, Homo sapiens
ccagauccuuuuccagaaaua

SEQ ID NO: 539742 - RNA, 18 nt, Homo sapiens
ccagaucuaacaucuuga

SEQ ID NO: 539743 - RNA, 12 nt, Homo sapiens
ccagaucugccu

SEQ ID NO: 539744 - RNA, 15 nt, Homo sapiens
ccagaugaacauuuc

SEQ ID NO: 539745 - RNA, 16 nt, Homo sapiens
ccagaugaacauuuca

SEQ ID NO: 539746 - RNA, 21 nt, Homo sapiens
ccagaugaacugacugaagga

SEQ ID NO: 539747 - RNA, 11 nt, Homo sapiens
auaaucucauc

SEQ ID NO: 539748 - RNA, 16 nt, Homo sapiens
auaaucuguacaauga

SEQ ID NO: 539749 - RNA, 21 nt, Homo sapiens
auaaucugucaaaacacugug

SEQ ID NO: 539750 - RNA, 12 nt, Homo sapiens
auaaucuuaucu

SEQ ID NO: 539751 - RNA, 12 nt, Homo sapiens
auaaucuuucaa

SEQ ID NO: 539752 - RNA, 21 nt, Homo sapiens
auaaucuuuggguaacuucaa

SEQ ID NO: 539753 - RNA, 22 nt, Homo sapiens
auaaugaauacauuuccaaaau

SEQ ID NO: 539754 - RNA, 21 nt, Homo sapiens
auaaugcgugcauaccacuuu

SEQ ID NO: 539755 - RNA, 17 nt, Homo sapiens
auaaugcuguugccuca

SEQ ID NO: 539756 - RNA, 18 nt, Homo sapiens
auaaugcuguugccucau

SEQ ID NO: 539757 - RNA, 20 nt, Homo sapiens
auaaugucauuaaacaugac

SEQ ID NO: 539758 - RNA, 22 nt, Homo sapiens
auaaugugaaugcuauguucug

SEQ ID NO: 539759 - RNA, 20 nt, Homo sapiens
auaauguggguuauccuccu

SEQ ID NO: 539760 - RNA, 19 nt, Homo sapiens
auaauguuaacauggacau

SEQ ID NO: 539761 - RNA, 21 nt, Homo sapiens
auaauuaccaauaucuugcca

SEQ ID NO: 539762 - RNA, 14 nt, Homo sapiens
auaauucaagucag

SEQ ID NO: 539763 - RNA, 15 nt, Homo sapiens
auaauuccagucaca

SEQ ID NO: 539764 - RNA, 22 nt, Homo sapiens
auaauucuaaguuauuuacuuu

SEQ ID NO: 539765 - RNA, 15 nt, Homo sapiens
auaauucuucaccua

SEQ ID NO: 539766 - RNA, 13 nt, Homo sapiens
auaauucuuccaa

SEQ ID NO: 539767 - RNA, 22 nt, Homo sapiens
auaauucuuuucuuuuccauuu

SEQ ID NO: 539768 - RNA, 21 nt, Homo sapiens
auaauuggacucugucacaaa

SEQ ID NO: 539769 - RNA, 19 nt, Homo sapiens
auaauuggagaagauuuau

SEQ ID NO: 539770 - RNA, 15 nt, Homo sapiens
auaauuggugcuauu

SEQ ID NO: 539771 - RNA, 15 nt, Homo sapiens
auaauuguugauauu

SEQ ID NO: 539772 - RNA, 21 nt, Homo sapiens
auaauuuaaaauccauuuuag

SEQ ID NO: 539773 - RNA, 17 nt, Homo sapiens
auaauuuacuuuguaga

SEQ ID NO: 539774 - RNA, 15 nt, Homo sapiens
auaauuuauuauuaa

SEQ ID NO: 539775 - RNA, 16 nt, Homo sapiens
auaauuucaaaccaca

SEQ ID NO: 539776 - RNA, 19 nt, Homo sapiens
auaauuucaaaccacacau

SEQ ID NO: 539777 - RNA, 13 nt, Homo sapiens
auaauuucagggu

SEQ ID NO: 539778 - RNA, 13 nt, Homo sapiens
auaauuugaucuu

SEQ ID NO: 539779 - RNA, 19 nt, Homo sapiens
auaauuuugcuugcugaag

SEQ ID NO: 539780 - RNA, 21 nt, Homo sapiens
auaauuuuguaagaggcuuca

SEQ ID NO: 539781 - RNA, 17 nt, Homo sapiens
auacaaaagggucuuga

SEQ ID NO: 539782 - RNA, 15 nt, Homo sapiens
auacaaacaaugcaa

SEQ ID NO: 539783 - RNA, 17 nt, Homo sapiens
auacaaaccacugugaa

SEQ ID NO: 539784 - RNA, 14 nt, Homo sapiens
auacaaaccuacca

SEQ ID NO: 539785 - RNA, 14 nt, Homo sapiens
auacaaaguacaga

SEQ ID NO: 539786 - RNA, 18 nt, Homo sapiens
auacaaauuuggccuuaa

SEQ ID NO: 539787 - RNA, 18 nt, Homo sapiens
auacaacagaaaccagaa

SEQ ID NO: 539788 - RNA, 17 nt, Homo sapiens
auacaaccuucauuuaa

SEQ ID NO: 539789 - RNA, 16 nt, Homo sapiens
auacaauagcauugau

SEQ ID NO: 539790 - RNA, 19 nt, Homo sapiens
auacaaugguuaaaaucac

SEQ ID NO: 539791 - RNA, 13 nt, Homo sapiens
auacaauuccaaa

SEQ ID NO: 539792 - RNA, 18 nt, Homo sapiens
auacaauuuccauauagu

SEQ ID NO: 539793 - RNA, 13 nt, Homo sapiens
auacacacacaca

SEQ ID NO: 539794 - RNA, 14 nt, Homo sapiens
auacacacauauac

SEQ ID NO: 539795 - RNA, 20 nt, Homo sapiens
auacacacauauacauauau

SEQ ID NO: 539796 - RNA, 15 nt, Homo sapiens
auacacacaugcccu

SEQ ID NO: 539797 - RNA, 12 nt, Homo sapiens
auacacacuguu

SEQ ID NO: 539798 - RNA, 13 nt, Homo sapiens
auacacagaggag

SEQ ID NO: 539799 - RNA, 16 nt, Homo sapiens
auacacagaugaaggu

SEQ ID NO: 539800 - RNA, 19 nt, Homo sapiens
auacaccaccucacuccug

SEQ ID NO: 539801 - RNA, 14 nt, Homo sapiens
auacaccagcaauu

SEQ ID NO: 539802 - RNA, 22 nt, Homo sapiens
auacaccagcaauuuagacaaa

SEQ ID NO: 539803 - RNA, 13 nt, Homo sapiens
auacacuagacaa

SEQ ID NO: 539804 - RNA, 11 nt, Homo sapiens
auacacugugu

SEQ ID NO: 539805 - RNA, 21 nt, Homo sapiens
auacacuuaaugauacauguu

SEQ ID NO: 539806 - RNA, 13 nt, Homo sapiens
auacacuuacacu

SEQ ID NO: 539807 - RNA, 15 nt, Homo sapiens
auacacuuacacuuu

SEQ ID NO: 539808 - RNA, 21 nt, Homo sapiens
auacacuucuggcucacagga

SEQ ID NO: 539809 - RNA, 16 nt, Homo sapiens
auacacuuuguugcaa

SEQ ID NO: 539810 - RNA, 17 nt, Homo sapiens
auacagaacucacagua

SEQ ID NO: 539811 - RNA, 15 nt, Homo sapiens
auacagaagcccaug

SEQ ID NO: 539812 - RNA, 21 nt, Homo sapiens
auacagauagaguuccauaua

SEQ ID NO: 539813 - RNA, 23 nt, Homo sapiens
auacagccaaagauaaucucuca

SEQ ID NO: 539814 - RNA, 22 nt, Homo sapiens
auacagcccucccccagcaguu

SEQ ID NO: 539815 - RNA, 13 nt, Homo sapiens
auacagcuaugaa

SEQ ID NO: 539816 - RNA, 14 nt, Homo sapiens
auacagcuaugaag

SEQ ID NO: 539817 - RNA, 20 nt, Homo sapiens
auacagcucuacguggcaaa

SEQ ID NO: 539818 - RNA, 19 nt, Homo sapiens
auacaggaaaaaugaaaau

SEQ ID NO: 539819 - RNA, 15 nt, Homo sapiens
auacaggaaagcaau

SEQ ID NO: 539820 - RNA, 21 nt, Homo sapiens
auacaggugucuagacugcca

SEQ ID NO: 539821 - RNA, 18 nt, Homo sapiens
auacaguaagcugcucua

SEQ ID NO: 539822 - RNA, 20 nt, Homo sapiens
auacaguagaagcucacaaa

SEQ ID NO: 539823 - RNA, 15 nt, Homo sapiens
auacagucuuccaca

SEQ ID NO: 539824 - RNA, 20 nt, Homo sapiens
auacagucuuccacaaagaa

SEQ ID NO: 539825 - RNA, 21 nt, Homo sapiens
auacagucuuccacaaagaaa

SEQ ID NO: 539826 - RNA, 11 nt, Homo sapiens
auacagugaag

SEQ ID NO: 539827 - RNA, 19 nt, Homo sapiens
auacaguguaggcauuuaa

SEQ ID NO: 539828 - RNA, 21 nt, Homo sapiens
auacauaaacaagaccacguu

SEQ ID NO: 539829 - RNA, 14 nt, Homo sapiens
auacauacauacau

SEQ ID NO: 539830 - RNA, 14 nt, Homo sapiens
auacauacauauau

SEQ ID NO: 539831 - RNA, 14 nt, Homo sapiens
ccagcugugcugug

SEQ ID NO: 539832 - RNA, 21 nt, Homo sapiens
ccagcuucaaacuauacuaca

SEQ ID NO: 539833 - RNA, 14 nt, Homo sapiens
ccagcuucaggcag

SEQ ID NO: 539834 - RNA, 19 nt, Homo sapiens
ccagcuugggcccagcugg

SEQ ID NO: 539835 - RNA, 19 nt, Homo sapiens
ccagcuuucccugccucuc

SEQ ID NO: 539836 - RNA, 15 nt, Homo sapiens
ccagcuuugcaguga

SEQ ID NO: 539837 - RNA, 17 nt, Homo sapiens
ccagcuuugcagugaca

SEQ ID NO: 539838 - RNA, 23 nt, Homo sapiens
ccaggaaacaaggggucugagga

SEQ ID NO: 539839 - RNA, 12 nt, Homo sapiens
ccaggaaggcag

SEQ ID NO: 539840 - RNA, 14 nt, Homo sapiens
ccaggaccagcugg

SEQ ID NO: 539841 - RNA, 12 nt, Homo sapiens
ccaggaccaguc

SEQ ID NO: 539842 - RNA, 15 nt, Homo sapiens
ccaggaccucuuaag

SEQ ID NO: 539843 - RNA, 13 nt, Homo sapiens
ccaggacugagau

SEQ ID NO: 539844 - RNA, 22 nt, Homo sapiens
ccaggagacagaccacuugcca

SEQ ID NO: 539845 - RNA, 18 nt, Homo sapiens
ccaggagagagggcaaag

SEQ ID NO: 539846 - RNA, 17 nt, Homo sapiens
ccaggagauggccccaa

SEQ ID NO: 539847 - RNA, 20 nt, Homo sapiens
ccaggagauggguccagggg

SEQ ID NO: 539848 - RNA, 16 nt, Homo sapiens
ccaggagcaacagccu

SEQ ID NO: 539849 - RNA, 22 nt, Homo sapiens
ccaggagcagcagccagcacca

SEQ ID NO: 539850 - RNA, 22 nt, Homo sapiens
ccaggagguggagguugcagug

SEQ ID NO: 539851 - RNA, 23 nt, Homo sapiens
ccaggagguuugcagggagcuca

SEQ ID NO: 539852 - RNA, 13 nt, Homo sapiens
ccaggaguaccug

SEQ ID NO: 539853 - RNA, 18 nt, Homo sapiens
ccaggaguuugagaccag

SEQ ID NO: 539854 - RNA, 14 nt, Homo sapiens
ccaggauacuggca

SEQ ID NO: 539855 - RNA, 22 nt, Homo sapiens
ccaggauccagaagggguuugg

SEQ ID NO: 539856 - RNA, 17 nt, Homo sapiens
ccaggauccugcaggaa

SEQ ID NO: 539857 - RNA, 20 nt, Homo sapiens
ccaggaucuggguuaggugg

SEQ ID NO: 539858 - RNA, 20 nt, Homo sapiens
ccaggauugaagguguaaau

SEQ ID NO: 539859 - RNA, 15 nt, Homo sapiens
ccaggcaaggcugac

SEQ ID NO: 539860 - RNA, 19 nt, Homo sapiens
ccaggcacaggaugcugug

SEQ ID NO: 539861 - RNA, 22 nt, Homo sapiens
ccaggcagaauggcugcacgua

SEQ ID NO: 539862 - RNA, 17 nt, Homo sapiens
ccaggcagccaccagug

SEQ ID NO: 539863 - RNA, 17 nt, Homo sapiens
ccaggccaacagcaccu

SEQ ID NO: 539864 - RNA, 16 nt, Homo sapiens
ccaggccaagacucaa

SEQ ID NO: 539865 - RNA, 15 nt, Homo sapiens
ccaggccaaugucag

SEQ ID NO: 539866 - RNA, 17 nt, Homo sapiens
ccaggccagugggccug

SEQ ID NO: 539867 - RNA, 19 nt, Homo sapiens
ccaggcccaccaucaccac

SEQ ID NO: 539868 - RNA, 17 nt, Homo sapiens
ccaggcccuacuaccca

SEQ ID NO: 539869 - RNA, 16 nt, Homo sapiens
ccaggcccuccagugg

SEQ ID NO: 539870 - RNA, 22 nt, Homo sapiens
ccaggcccuuggcugcaggcaa

SEQ ID NO: 539871 - RNA, 13 nt, Homo sapiens
auacucaaauggu

SEQ ID NO: 539872 - RNA, 19 nt, Homo sapiens
auacucaaauggugucaug

SEQ ID NO: 539873 - RNA, 16 nt, Homo sapiens
auacuccagcaccugu

SEQ ID NO: 539874 - RNA, 22 nt, Homo sapiens
auacuccauacauaacuugaua

SEQ ID NO: 539875 - RNA, 21 nt, Homo sapiens
auacugacuccaaccauucaa

SEQ ID NO: 539876 - RNA, 15 nt, Homo sapiens
auacugcccaaggau

SEQ ID NO: 539877 - RNA, 20 nt, Homo sapiens
auacugcuggaguccagugc

SEQ ID NO: 539878 - RNA, 15 nt, Homo sapiens
auacuggacucagga

SEQ ID NO: 539879 - RNA, 23 nt, Homo sapiens
auacugggauuacaggcuugagc

SEQ ID NO: 539880 - RNA, 15 nt, Homo sapiens
auacuggucucaggc

SEQ ID NO: 539881 - RNA, 21 nt, Homo sapiens
auacuguagaagaagcccaua

SEQ ID NO: 539882 - RNA, 12 nt, Homo sapiens
auacugugcaua

SEQ ID NO: 539883 - RNA, 18 nt, Homo sapiens
auacuguucaaugguucu

SEQ ID NO: 539884 - RNA, 21 nt, Homo sapiens
auacuguugauacaaaccacu

SEQ ID NO: 539885 - RNA, 13 nt, Homo sapiens
auacuguuuccau

SEQ ID NO: 539886 - RNA, 23 nt, Homo sapiens
auacuguuucuugcacugaauau

SEQ ID NO: 539887 - RNA, 16 nt, Homo sapiens
auacuuaagaauacac

SEQ ID NO: 539888 - RNA, 19 nt, Homo sapiens
auacuuaaucucacauuca

SEQ ID NO: 539889 - RNA, 13 nt, Homo sapiens
auacuucauuaaa

SEQ ID NO: 539890 - RNA, 13 nt, Homo sapiens
auacuugccauca

SEQ ID NO: 539891 - RNA, 14 nt, Homo sapiens
auacuuggaccuca

SEQ ID NO: 539892 - RNA, 18 nt, Homo sapiens
auacuuggaccucagcca

SEQ ID NO: 539893 - RNA, 17 nt, Homo sapiens
auacuuuagaaguagaa

SEQ ID NO: 539894 - RNA, 15 nt, Homo sapiens
auacuuuauuguggg

SEQ ID NO: 539895 - RNA, 14 nt, Homo sapiens
auacuuugcauaaa

SEQ ID NO: 539896 - RNA, 17 nt, Homo sapiens
auacuuuguauacaagu

SEQ ID NO: 539897 - RNA, 14 nt, Homo sapiens
auacuuuugcugau

SEQ ID NO: 539898 - RNA, 21 nt, Homo sapiens
auacuuuugcuuucagggaaa

SEQ ID NO: 539899 - RNA, 12 nt, Homo sapiens
auacuuuuggcu

SEQ ID NO: 539900 - RNA, 15 nt, Homo sapiens
auacuuuugugaaca

SEQ ID NO: 539901 - RNA, 17 nt, Homo sapiens
auacuuuuuguuuauuu

SEQ ID NO: 539902 - RNA, 19 nt, Homo sapiens
auacuuuuuucuaguuuca

SEQ ID NO: 539903 - RNA, 13 nt, Homo sapiens
auagaaaccucuc

SEQ ID NO: 539904 - RNA, 17 nt, Homo sapiens
auagaaagaugacaaaa

SEQ ID NO: 539905 - RNA, 23 nt, Homo sapiens
auagaaauuguaaaucagagguu

SEQ ID NO: 539906 - RNA, 13 nt, Homo sapiens
auagaacuacuuu

SEQ ID NO: 539907 - RNA, 14 nt, Homo sapiens
auagaacuuugcca

SEQ ID NO: 539908 - RNA, 16 nt, Homo sapiens
auagaagaacugcaaa

SEQ ID NO: 539909 - RNA, 13 nt, Homo sapiens
auagaagauccua

SEQ ID NO: 539910 - RNA, 18 nt, Homo sapiens
auagaagcaaaugacaaa

SEQ ID NO: 539911 - RNA, 23 nt, Homo sapiens
auagaagccacaucguugagaca

SEQ ID NO: 539912 - RNA, 18 nt, Homo sapiens
auagaauaaaauauaauu

SEQ ID NO: 539913 - RNA, 15 nt, Homo sapiens
auagaauacauguaa

SEQ ID NO: 539914 - RNA, 22 nt, Homo sapiens
auagaauggaggggacuccaaa

SEQ ID NO: 539915 - RNA, 12 nt, Homo sapiens
auagacaaauag

SEQ ID NO: 539916 - RNA, 12 nt, Homo sapiens
auagacauguag

SEQ ID NO: 539917 - RNA, 15 nt, Homo sapiens
auagacauucucaca

SEQ ID NO: 539918 - RNA, 14 nt, Homo sapiens
auagacauugcaaa

SEQ ID NO: 539919 - RNA, 19 nt, Homo sapiens
auagacuuaauacaugcaa

SEQ ID NO: 539920 - RNA, 14 nt, Homo sapiens
auagacuuacugca

SEQ ID NO: 539921 - RNA, 19 nt, Homo sapiens
auagacuuauugccaaaaa

SEQ ID NO: 539922 - RNA, 23 nt, Homo sapiens
auagagacggagauccuaagguc

SEQ ID NO: 539923 - RNA, 13 nt, Homo sapiens
auagagccugagg

SEQ ID NO: 539924 - RNA, 15 nt, Homo sapiens
auagaggaaagggau

SEQ ID NO: 539925 - RNA, 12 nt, Homo sapiens
auagaggcuagc

SEQ ID NO: 539926 - RNA, 15 nt, Homo sapiens
auagaguauaugcac

SEQ ID NO: 539927 - RNA, 14 nt, Homo sapiens
auagaucuucauga

SEQ ID NO: 539928 - RNA, 13 nt, Homo sapiens
auagaugcugcug

SEQ ID NO: 539929 - RNA, 20 nt, Homo sapiens
auagauggcugaacaucagg

SEQ ID NO: 539930 - RNA, 21 nt, Homo sapiens
auagaugucaggaaacauuca

SEQ ID NO: 539931 - RNA, 16 nt, Homo sapiens
auagaugugaucacug

SEQ ID NO: 539932 - RNA, 12 nt, Homo sapiens
auagauuacuga

SEQ ID NO: 539933 - RNA, 19 nt, Homo sapiens
auagauuacugaugugaua

SEQ ID NO: 539934 - RNA, 21 nt, Homo sapiens
auagauuauuauaaacuauaa

SEQ ID NO: 539935 - RNA, 18 nt, Homo sapiens
auagauuguuuugccacu

SEQ ID NO: 539936 - RNA, 21 nt, Homo sapiens
auagauuuucugcuacuuugc

SEQ ID NO: 539937 - RNA, 15 nt, Homo sapiens
auagauuuuuucaga

SEQ ID NO: 539938 - RNA, 20 nt, Homo sapiens
auagcaacagagcacuugag

SEQ ID NO: 539939 - RNA, 13 nt, Homo sapiens
auagcaagacaca

SEQ ID NO: 539940 - RNA, 17 nt, Homo sapiens
auagcaaggugcucaca

SEQ ID NO: 539941 - RNA, 18 nt, Homo sapiens
auagcacccugcccucau

SEQ ID NO: 539942 - RNA, 16 nt, Homo sapiens
auagcacuaaugcuuu

SEQ ID NO: 539943 - RNA, 18 nt, Homo sapiens
auagcagauuguguaaca

SEQ ID NO: 539944 - RNA, 18 nt, Homo sapiens
auagcagcuuugucucug

SEQ ID NO: 539945 - RNA, 18 nt, Homo sapiens
auagcaguugaaacaaga

SEQ ID NO: 539946 - RNA, 14 nt, Homo sapiens
auagcaucucagga

SEQ ID NO: 539947 - RNA, 20 nt, Homo sapiens
auagcauugauaaucuucag

SEQ ID NO: 539948 - RNA, 18 nt, Homo sapiens
auagcauugcuuucgugu

SEQ ID NO: 539949 - RNA, 15 nt, Homo sapiens
auagcauuugccacu

SEQ ID NO: 539950 - RNA, 13 nt, Homo sapiens
auagccaaaaagu

SEQ ID NO: 539951 - RNA, 23 nt, Homo sapiens
auagccagauaguagaaccagug

SEQ ID NO: 539952 - RNA, 13 nt, Homo sapiens
auagcccacagcu

SEQ ID NO: 539953 - RNA, 14 nt, Homo sapiens
auagccgauaucag

SEQ ID NO: 539954 - RNA, 16 nt, Homo sapiens
auauauuuuagcauuu

SEQ ID NO: 539955 - RNA, 20 nt, Homo sapiens
auauauuuucauccuauaag

SEQ ID NO: 539956 - RNA, 17 nt, Homo sapiens
auauauuuuuaccaucu

SEQ ID NO: 539957 - RNA, 13 nt, Homo sapiens
auauauuuuuaga

SEQ ID NO: 539958 - RNA, 20 nt, Homo sapiens
auaucaaaaaaccuuuacag

SEQ ID NO: 539959 - RNA, 14 nt, Homo sapiens
auaucaacucugaa

SEQ ID NO: 539960 - RNA, 20 nt, Homo sapiens
auaucaauauugggccuaaa

SEQ ID NO: 539961 - RNA, 22 nt, Homo sapiens
auaucaauuaauuugaaaacau

SEQ ID NO: 539962 - RNA, 13 nt, Homo sapiens
auaucacaaucuc

SEQ ID NO: 539963 - RNA, 23 nt, Homo sapiens
auaucacaauuuacgaaaccaaa

SEQ ID NO: 539964 - RNA, 13 nt, Homo sapiens
auaucagaacugu

SEQ ID NO: 539965 - RNA, 20 nt, Homo sapiens
auaucagggguacauucuag

SEQ ID NO: 539966 - RNA, 16 nt, Homo sapiens
auaucaguaguguaca

SEQ ID NO: 539967 - RNA, 19 nt, Homo sapiens
auaucagugcucgagacac

SEQ ID NO: 539968 - RNA, 20 nt, Homo sapiens
auaucaguuugcuagcagaa

SEQ ID NO: 539969 - RNA, 17 nt, Homo sapiens
auaucauacuguucaau

SEQ ID NO: 539970 - RNA, 17 nt, Homo sapiens
auaucaugguaaugaca

SEQ ID NO: 539971 - RNA, 22 nt, Homo sapiens
auaucauuuauuuuuuacauua

SEQ ID NO: 539972 - RNA, 15 nt, Homo sapiens
auaucauuucacugu

SEQ ID NO: 539973 - RNA, 12 nt, Homo sapiens
auaucauuuuaa

SEQ ID NO: 539974 - RNA, 16 nt, Homo sapiens
auauccaaagacugua

SEQ ID NO: 539975 - RNA, 17 nt, Homo sapiens
auauccaaagacuguac

SEQ ID NO: 539976 - RNA, 13 nt, Homo sapiens
auauccaagaagc

SEQ ID NO: 539977 - RNA, 16 nt, Homo sapiens
auauccagcugaguga

SEQ ID NO: 539978 - RNA, 18 nt, Homo sapiens
auaucccuuccucucagg

SEQ ID NO: 539979 - RNA, 14 nt, Homo sapiens
auauccugugacug

SEQ ID NO: 539980 - RNA, 16 nt, Homo sapiens
auauccuugcgaugua

SEQ ID NO: 539981 - RNA, 17 nt, Homo sapiens
auauccuuucaagacag

SEQ ID NO: 539982 - RNA, 17 nt, Homo sapiens
auauccuuucacucugc

SEQ ID NO: 539983 - RNA, 19 nt, Homo sapiens
auaucgcuggccagcauua

SEQ ID NO: 539984 - RNA, 14 nt, Homo sapiens
auaucuaacuuucc

SEQ ID NO: 539985 - RNA, 13 nt, Homo sapiens
auaucuaccccag

SEQ ID NO: 539986 - RNA, 22 nt, Homo sapiens
auaucuccuccaauguccugaa

SEQ ID NO: 539987 - RNA, 15 nt, Homo sapiens
auaucugaaccaaga

SEQ ID NO: 539988 - RNA, 21 nt, Homo sapiens
auaucugaauggaagaguguu

SEQ ID NO: 539989 - RNA, 18 nt, Homo sapiens
auaucuggguuaaguguu

SEQ ID NO: 539990 - RNA, 20 nt, Homo sapiens
auaucuuggacaaaucacau

SEQ ID NO: 539991 - RNA, 23 nt, Homo sapiens
auaucuuuuaauuguguauuuaa

SEQ ID NO: 539992 - RNA, 20 nt, Homo sapiens
auaugaaaaucuccaucuca

SEQ ID NO: 539993 - RNA, 20 nt, Homo sapiens
auaugaaauaaaauuacaca

SEQ ID NO: 539994 - RNA, 19 nt, Homo sapiens
auaugaaauuccagcaaua

SEQ ID NO: 539995 - RNA, 13 nt, Homo sapiens
auaugaagacaua

SEQ ID NO: 539996 - RNA, 20 nt, Homo sapiens
ccauagaggcccaggcacca

SEQ ID NO: 539997 - RNA, 13 nt, Homo sapiens
ccauagauggguc

SEQ ID NO: 539998 - RNA, 19 nt, Homo sapiens
ccauagggacccauucuac

SEQ ID NO: 539999 - RNA, 22 nt, Homo sapiens
ccauagucgugccuguuugcuu

SEQ ID NO: 540000 - RNA, 16 nt, Homo sapiens
ccauagugagccauga

SEQ ID NO: 540001 - RNA, 23 nt, Homo sapiens
ccauaguggagagaacugaauaa

SEQ ID NO: 540002 - RNA, 23 nt, Homo sapiens
ccauauaacaauucaguaacaaa

SEQ ID NO: 540003 - RNA, 22 nt, Homo sapiens
ccauaucuugcgaauccaagcu

SEQ ID NO: 540004 - RNA, 14 nt, Homo sapiens
ccauaugucugcuu

SEQ ID NO: 540005 - RNA, 15 nt, Homo sapiens
ccauauuaaaaucug

SEQ ID NO: 540006 - RNA, 12 nt, Homo sapiens
ccauauucacac

SEQ ID NO: 540007 - RNA, 16 nt, Homo sapiens
ccauauuuaacaugua

SEQ ID NO: 540008 - RNA, 18 nt, Homo sapiens
ccauauuuauacagcaga

SEQ ID NO: 540009 - RNA, 22 nt, Homo sapiens
ccauauuuauuuuuauguucuu

SEQ ID NO: 540010 - RNA, 17 nt, Homo sapiens
ccauauuugauaguaua

SEQ ID NO: 540011 - RNA, 14 nt, Homo sapiens
ccaucaagugcagu

SEQ ID NO: 540012 - RNA, 22 nt, Homo sapiens
ccaucaauaccuguacuaugau

SEQ ID NO: 540013 - RNA, 17 nt, Homo sapiens
ccaucagcccaucucaa

SEQ ID NO: 540014 - RNA, 23 nt, Homo sapiens
ccaucagugaaaaagauguacag

SEQ ID NO: 540015 - RNA, 14 nt, Homo sapiens
ccaucagugcuccc

SEQ ID NO: 540016 - RNA, 15 nt, Homo sapiens
ccaucaucacuguaa

SEQ ID NO: 540017 - RNA, 19 nt, Homo sapiens
ccaucauccuuuguucuga

SEQ ID NO: 540018 - RNA, 22 nt, Homo sapiens
ccaucaugcggugggugcugcc

SEQ ID NO: 540019 - RNA, 21 nt, Homo sapiens
ccaucauuacugguaaagccu

SEQ ID NO: 540020 - RNA, 19 nt, Homo sapiens
ccauccaccccguugcuca

SEQ ID NO: 540021 - RNA, 19 nt, Homo sapiens
ccauccaucugcuuacaau

SEQ ID NO: 540022 - RNA, 15 nt, Homo sapiens
ccaucccauuggcaa

SEQ ID NO: 540023 - RNA, 15 nt, Homo sapiens
ccauccccaccagcu

SEQ ID NO: 540024 - RNA, 22 nt, Homo sapiens
ccaucccuuuuuuuacauuuca

SEQ ID NO: 540025 - RNA, 19 nt, Homo sapiens
ccauccuaccaaugcaugc

SEQ ID NO: 540026 - RNA, 16 nt, Homo sapiens
ccauccugaccagcug

SEQ ID NO: 540027 - RNA, 14 nt, Homo sapiens
ccauccugauccca

SEQ ID NO: 540028 - RNA, 22 nt, Homo sapiens
ccauccugcccuucugacccaa

SEQ ID NO: 540029 - RNA, 21 nt, Homo sapiens
ccauccuggccaacauuguaa

SEQ ID NO: 540030 - RNA, 17 nt, Homo sapiens
ccaucggggggugggag

SEQ ID NO: 540031 - RNA, 14 nt, Homo sapiens
ccaucguguuugca

SEQ ID NO: 540032 - RNA, 21 nt, Homo sapiens
ccaucuaaugcuuguuuauga

SEQ ID NO: 540033 - RNA, 14 nt, Homo sapiens
ccaucuaccugcuu

SEQ ID NO: 540034 - RNA, 14 nt, Homo sapiens
ccaucuaugagcug

SEQ ID NO: 540035 - RNA, 20 nt, Homo sapiens
ccaucuccuauaaucuguca

SEQ ID NO: 540036 - RNA, 22 nt, Homo sapiens
ccaucucgggcacaggcccacc

SEQ ID NO: 540037 - RNA, 15 nt, Homo sapiens
ccaucucuauuaaaa

SEQ ID NO: 540038 - RNA, 19 nt, Homo sapiens
ccaucucuuuguguaauag

SEQ ID NO: 540039 - RNA, 14 nt, Homo sapiens
ccaucugacaaaau

SEQ ID NO: 540040 - RNA, 15 nt, Homo sapiens
ccaucugauguuuca

SEQ ID NO: 540041 - RNA, 16 nt, Homo sapiens
ccaucugcaucuuaac

SEQ ID NO: 540042 - RNA, 15 nt, Homo sapiens
ccaucugcugcaguu

SEQ ID NO: 540043 - RNA, 13 nt, Homo sapiens
ccaucugcuuaca

SEQ ID NO: 540044 - RNA, 18 nt, Homo sapiens
ccaucugcuugguuggcu

SEQ ID NO: 540045 - RNA, 17 nt, Homo sapiens
ccaucuggcucagcaua

SEQ ID NO: 540046 - RNA, 16 nt, Homo sapiens
ccaucuguaaauaucc

SEQ ID NO: 540047 - RNA, 16 nt, Homo sapiens
ccaucugugugcagca

SEQ ID NO: 540048 - RNA, 15 nt, Homo sapiens
ccaucuuaacugagg

SEQ ID NO: 540049 - RNA, 19 nt, Homo sapiens
ccaucuuaacugaggcuca

SEQ ID NO: 540050 - RNA, 22 nt, Homo sapiens
ccaucuucacucuucacuugag

SEQ ID NO: 540051 - RNA, 16 nt, Homo sapiens
ccaucuugagugguca

SEQ ID NO: 540052 - RNA, 13 nt, Homo sapiens
ccaucuugaucug

SEQ ID NO: 540053 - RNA, 17 nt, Homo sapiens
ccaugaacaucauggac

SEQ ID NO: 540054 - RNA, 19 nt, Homo sapiens
ccaugaaccaagaccauug

SEQ ID NO: 540055 - RNA, 15 nt, Homo sapiens
ccaugaagacaggau

SEQ ID NO: 540056 - RNA, 21 nt, Homo sapiens
ccaugaagcgaaacacagaga

SEQ ID NO: 540057 - RNA, 14 nt, Homo sapiens
ccaugaaucaaaga

SEQ ID NO: 540058 - RNA, 17 nt, Homo sapiens
ccaugaauuaguucucc

SEQ ID NO: 540059 - RNA, 21 nt, Homo sapiens
ccaugacauuucaucugggug

SEQ ID NO: 540060 - RNA, 18 nt, Homo sapiens
ccaugaccuaguuuucca

SEQ ID NO: 540061 - RNA, 20 nt, Homo sapiens
ccaugacgacauacaugcua

SEQ ID NO: 540062 - RNA, 16 nt, Homo sapiens
ccaugacuuccucaca

SEQ ID NO: 540063 - RNA, 20 nt, Homo sapiens
ccaugaggaaggaacagcaa

SEQ ID NO: 540064 - RNA, 20 nt, Homo sapiens
ccaugaggcaaugucaggaa

SEQ ID NO: 540065 - RNA, 21 nt, Homo sapiens
ccaugaggccucaguggacuu

SEQ ID NO: 540066 - RNA, 19 nt, Homo sapiens
ccaugaguuaucaugaauu

SEQ ID NO: 540067 - RNA, 19 nt, Homo sapiens
ccaugauugaaaucaaaua

SEQ ID NO: 540068 - RNA, 15 nt, Homo sapiens
ccaugcacuguaaau

SEQ ID NO: 540069 - RNA, 20 nt, Homo sapiens
ccaugccacccuguuuucag

SEQ ID NO: 540070 - RNA, 21 nt, Homo sapiens
ccaugccacugccaggcaccu

SEQ ID NO: 540071 - RNA, 17 nt, Homo sapiens
ccaugccagacccacug

SEQ ID NO: 540072 - RNA, 21 nt, Homo sapiens
ccaugccaggaaccuguccua

SEQ ID NO: 540073 - RNA, 17 nt, Homo sapiens
ccaugcccuccaugugu

SEQ ID NO: 540074 - RNA, 15 nt, Homo sapiens
ccaugcuaacaaaga

SEQ ID NO: 540075 - RNA, 13 nt, Homo sapiens
cagauggggaaac

SEQ ID NO: 540076 - RNA, 15 nt, Homo sapiens
cagauggguauuaaa

SEQ ID NO: 540077 - RNA, 15 nt, Homo sapiens
cagaugggucugaua

SEQ ID NO: 540078 - RNA, 16 nt, Homo sapiens
cagaugguagaacuaa

SEQ ID NO: 540079 - RNA, 15 nt, Homo sapiens
cagauggugcugcua

SEQ ID NO: 540080 - RNA, 18 nt, Homo sapiens
cagauguaacagaacaaa

SEQ ID NO: 540081 - RNA, 20 nt, Homo sapiens
cagauguaauuauguuuuca

SEQ ID NO: 540082 - RNA, 17 nt, Homo sapiens
cagauguauugacugua

SEQ ID NO: 540083 - RNA, 11 nt, Homo sapiens
cagaugugcau

SEQ ID NO: 540084 - RNA, 22 nt, Homo sapiens
cagaugugucugggagagccug

SEQ ID NO: 540085 - RNA, 18 nt, Homo sapiens
cagauguugcaucccuga

SEQ ID NO: 540086 - RNA, 21 nt, Homo sapiens
cagauuaccgacacugucacu

SEQ ID NO: 540087 - RNA, 22 nt, Homo sapiens
cagauuagguuugucccaguca

SEQ ID NO: 540088 - RNA, 11 nt, Homo sapiens
cagauuauuca

SEQ ID NO: 540089 - RNA, 14 nt, Homo sapiens
cagauuauuugcuu

SEQ ID NO: 540090 - RNA, 22 nt, Homo sapiens
cagauucagacuuggacuauga

SEQ ID NO: 540091 - RNA, 20 nt, Homo sapiens
cagauucugccucucuggaa

SEQ ID NO: 540092 - RNA, 23 nt, Homo sapiens
cagauuuaaaaaaagaacauaaa

SEQ ID NO: 540093 - RNA, 16 nt, Homo sapiens
cagauuuaaagcacau

SEQ ID NO: 540094 - RNA, 23 nt, Homo sapiens
cagauuuauuuuugaaacaaaca

SEQ ID NO: 540095 - RNA, 11 nt, Homo sapiens
cagauuuccau

SEQ ID NO: 540096 - RNA, 23 nt, Homo sapiens
cagauuuuaagggggaaaacugu

SEQ ID NO: 540097 - RNA, 15 nt, Homo sapiens
cagauuuucagcaaa

SEQ ID NO: 540098 - RNA, 21 nt, Homo sapiens
cagcaaaagaagacaacauuu

SEQ ID NO: 540099 - RNA, 14 nt, Homo sapiens
cagcaaaagagcua

SEQ ID NO: 540100 - RNA, 13 nt, Homo sapiens
cagcaacaaugac

SEQ ID NO: 540101 - RNA, 21 nt, Homo sapiens
cagcaacacagccacuaaaac

SEQ ID NO: 540102 - RNA, 15 nt, Homo sapiens
cagcaacugucuuau

SEQ ID NO: 540103 - RNA, 15 nt, Homo sapiens
cagcaaggaaauguc

SEQ ID NO: 540104 - RNA, 23 nt, Homo sapiens
cagcaaggccagaugcacauccc

SEQ ID NO: 540105 - RNA, 18 nt, Homo sapiens
cagcaaggggacaucuua

SEQ ID NO: 540106 - RNA, 23 nt, Homo sapiens
cagcaauacuaagggaagaaaca

SEQ ID NO: 540107 - RNA, 21 nt, Homo sapiens
cagcaaugaagggaagugcau

SEQ ID NO: 540108 - RNA, 17 nt, Homo sapiens
cagcaaugacaucucag

SEQ ID NO: 540109 - RNA, 18 nt, Homo sapiens
cagcaaugacaucucagg

SEQ ID NO: 540110 - RNA, 21 nt, Homo sapiens
cagcaaugacaucucaggggc

SEQ ID NO: 540111 - RNA, 14 nt, Homo sapiens
cagcaauuccaugc

SEQ ID NO: 540112 - RNA, 17 nt, Homo sapiens
cagcaauucucuuucuu

SEQ ID NO: 540113 - RNA, 13 nt, Homo sapiens
cagcaauugucua

SEQ ID NO: 540114 - RNA, 15 nt, Homo sapiens
cagcaauugucuaca

SEQ ID NO: 540115 - RNA, 20 nt, Homo sapiens
cagcaauuuaaauguuauga

SEQ ID NO: 540116 - RNA, 16 nt, Homo sapiens
cagcaauuugauaaaa

SEQ ID NO: 540117 - RNA, 21 nt, Homo sapiens
cagcacacgaguuccagaccc

SEQ ID NO: 540118 - RNA, 15 nt, Homo sapiens
cagcacagcccaggg

SEQ ID NO: 540119 - RNA, 15 nt, Homo sapiens
cagcacccaugggaa

SEQ ID NO: 540120 - RNA, 11 nt, Homo sapiens
cagcacccucc

SEQ ID NO: 540121 - RNA, 21 nt, Homo sapiens
cagcaccgauggccauguaaa

SEQ ID NO: 540122 - RNA, 17 nt, Homo sapiens
cagcacuccaguagcga

SEQ ID NO: 540123 - RNA, 21 nt, Homo sapiens
cagcacuccccagagcugugc

SEQ ID NO: 540124 - RNA, 17 nt, Homo sapiens
cagcacucugaaacuga

SEQ ID NO: 540125 - RNA, 19 nt, Homo sapiens
cagcacucugaaacugaga

SEQ ID NO: 540126 - RNA, 17 nt, Homo sapiens
cagcacuggaccauucc

SEQ ID NO: 540127 - RNA, 22 nt, Homo sapiens
cagcacuguuacaagaggccau

SEQ ID NO: 540128 - RNA, 12 nt, Homo sapiens
cagcacuuccau

SEQ ID NO: 540129 - RNA, 12 nt, Homo sapiens
cagcacuuguau

SEQ ID NO: 540130 - RNA, 13 nt, Homo sapiens
cagcacuuuggac

SEQ ID NO: 540131 - RNA, 18 nt, Homo sapiens
cagcagaaauuaaaugaa

SEQ ID NO: 540132 - RNA, 16 nt, Homo sapiens
cagcagagaagcugua

SEQ ID NO: 540133 - RNA, 17 nt, Homo sapiens
cagcagagaucugcagg

SEQ ID NO: 540134 - RNA, 22 nt, Homo sapiens
cagcagagguuugcugacaggu

SEQ ID NO: 540135 - RNA, 15 nt, Homo sapiens
cagcagaugcuguug

SEQ ID NO: 540136 - RNA, 22 nt, Homo sapiens
cagcagcaccuuucucugagaa

SEQ ID NO: 540137 - RNA, 15 nt, Homo sapiens
cagcagcacuguucu

SEQ ID NO: 540138 - RNA, 17 nt, Homo sapiens
cagcagcccuggcaugu

SEQ ID NO: 540139 - RNA, 20 nt, Homo sapiens
cagcagccgccuuaagcuga

SEQ ID NO: 540140 - RNA, 16 nt, Homo sapiens
cagcagccucccugaa

SEQ ID NO: 540141 - RNA, 14 nt, Homo sapiens
cagcagccugugag

SEQ ID NO: 540142 - RNA, 17 nt, Homo sapiens
cagcagcucauagaauu

SEQ ID NO: 540143 - RNA, 17 nt, Homo sapiens
cagcagcuucaccagag

SEQ ID NO: 540144 - RNA, 22 nt, Homo sapiens
cagcagcuucucuccacugaaa

SEQ ID NO: 540145 - RNA, 21 nt, Homo sapiens
cagcaggaaggaacaaagaca

SEQ ID NO: 540146 - RNA, 20 nt, Homo sapiens
cagcaggaccugugcuuuga

SEQ ID NO: 540147 - RNA, 19 nt, Homo sapiens
cagcaggagagacugagca

SEQ ID NO: 540148 - RNA, 20 nt, Homo sapiens
cagcaggcuccuggcugugc

SEQ ID NO: 540149 - RNA, 17 nt, Homo sapiens
cagcagggacuguaaac

SEQ ID NO: 540150 - RNA, 13 nt, Homo sapiens
cagcagugccaua

SEQ ID NO: 540151 - RNA, 13 nt, Homo sapiens
cagcagugccuug

SEQ ID NO: 540152 - RNA, 17 nt, Homo sapiens
cagcauacacagaugaa

SEQ ID NO: 540153 - RNA, 19 nt, Homo sapiens
cagcauacccuuacucugc

SEQ ID NO: 540154 - RNA, 20 nt, Homo sapiens
cagcauagggucacuuugcc

SEQ ID NO: 540155 - RNA, 18 nt, Homo sapiens
cagcauaguacuggcaca

SEQ ID NO: 540156 - RNA, 15 nt, Homo sapiens
cagcauaugauuucu

SEQ ID NO: 540157 - RNA, 14 nt, Homo sapiens
cagcaucggaaaga

SEQ ID NO: 540158 - RNA, 15 nt, Homo sapiens
cagcaucugcuaaua

SEQ ID NO: 540159 - RNA, 14 nt, Homo sapiens
cagcaucugggacu

SEQ ID NO: 540160 - RNA, 14 nt, Homo sapiens
cagcaucugugaug

SEQ ID NO: 540161 - RNA, 20 nt, Homo sapiens
cagcaucuucccaaaaccau

SEQ ID NO: 540162 - RNA, 18 nt, Homo sapiens
cagcaucuuuaacacagc

SEQ ID NO: 540163 - RNA, 21 nt, Homo sapiens
cagcaugaccugugaccagca

SEQ ID NO: 540164 - RNA, 23 nt, Homo sapiens
cagcaugaggacagaccacagag

SEQ ID NO: 540165 - RNA, 15 nt, Homo sapiens
cagcauggagcuaua

SEQ ID NO: 540166 - RNA, 11 nt, Homo sapiens
cagcauugcuu

SEQ ID NO: 540167 - RNA, 21 nt, Homo sapiens
cagcauuuucacauuuugccu

SEQ ID NO: 540168 - RNA, 17 nt, Homo sapiens
cagccaaaaaggacuuu

SEQ ID NO: 540169 - RNA, 17 nt, Homo sapiens
cagccaaagauaaucuc

SEQ ID NO: 540170 - RNA, 16 nt, Homo sapiens
cagccaaaggggagcc

SEQ ID NO: 540171 - RNA, 19 nt, Homo sapiens
cagccaaaggggagccaga

SEQ ID NO: 540172 - RNA, 17 nt, Homo sapiens
cagccaaaugcagggag

SEQ ID NO: 540173 - RNA, 15 nt, Homo sapiens
cagccaacuuuugca

SEQ ID NO: 540174 - RNA, 16 nt, Homo sapiens
cagccaaguagccucu

SEQ ID NO: 540175 - RNA, 12 nt, Homo sapiens
cagccacaacca

SEQ ID NO: 540176 - RNA, 16 nt, Homo sapiens
cagccacaaccaaaaa

SEQ ID NO: 540177 - RNA, 21 nt, Homo sapiens
cagccacaguggccaaagagg

SEQ ID NO: 540178 - RNA, 14 nt, Homo sapiens
cagccaccagggag

SEQ ID NO: 540179 - RNA, 13 nt, Homo sapiens
cagccacccugag

SEQ ID NO: 540180 - RNA, 17 nt, Homo sapiens
cagccacgucagcuuuu

SEQ ID NO: 540181 - RNA, 14 nt, Homo sapiens
cagccacuucugca

SEQ ID NO: 540182 - RNA, 19 nt, Homo sapiens
cagccacuugacuggcaca

SEQ ID NO: 540183 - RNA, 19 nt, Homo sapiens
cagccacuugccugugcua

SEQ ID NO: 540184 - RNA, 19 nt, Homo sapiens
cagccagcgccucccucca

SEQ ID NO: 540185 - RNA, 23 nt, Homo sapiens
cagccagcuaccccuugugggca

SEQ ID NO: 540186 - RNA, 21 nt, Homo sapiens
cagccaggcagguccacagag

SEQ ID NO: 540187 - RNA, 17 nt, Homo sapiens
cagccaggcccugagau

SEQ ID NO: 540188 - RNA, 15 nt, Homo sapiens
cagccaggcugcuaa

SEQ ID NO: 540189 - RNA, 15 nt, Homo sapiens
cagccagggugugac

SEQ ID NO: 540190 - RNA, 15 nt, Homo sapiens
cagccagucuugccu

SEQ ID NO: 540191 - RNA, 13 nt, Homo sapiens
cagccagugccau

SEQ ID NO: 540192 - RNA, 14 nt, Homo sapiens
cagccagugccauu

SEQ ID NO: 540193 - RNA, 17 nt, Homo sapiens
cagccagugccauucca

SEQ ID NO: 540194 - RNA, 18 nt, Homo sapiens
cagccagugccauuccac

SEQ ID NO: 540195 - RNA, 14 nt, Homo sapiens
cagccauauggaaa

SEQ ID NO: 540196 - RNA, 21 nt, Homo sapiens
cagccaucaagagacugaguc

SEQ ID NO: 540197 - RNA, 23 nt, Homo sapiens
cacuuccaugagaagaagcagau

SEQ ID NO: 540198 - RNA, 16 nt, Homo sapiens
cacuuccccacaggcu

SEQ ID NO: 540199 - RNA, 14 nt, Homo sapiens
cacuuccuuggaaa

SEQ ID NO: 540200 - RNA, 18 nt, Homo sapiens
cacuuccuuggaaacaga

SEQ ID NO: 540201 - RNA, 19 nt, Homo sapiens
cacuucgagcacuguccag

SEQ ID NO: 540202 - RNA, 16 nt, Homo sapiens
cacuucuaaaugcaua

SEQ ID NO: 540203 - RNA, 19 nt, Homo sapiens
cacuucucaucauauugua

SEQ ID NO: 540204 - RNA, 16 nt, Homo sapiens
cacuucuccaucgcag

SEQ ID NO: 540205 - RNA, 12 nt, Homo sapiens
cacuucucucag

SEQ ID NO: 540206 - RNA, 20 nt, Homo sapiens
cacuucugggucaugcacug

SEQ ID NO: 540207 - RNA, 22 nt, Homo sapiens
cacuucugggucaugcacugag

SEQ ID NO: 540208 - RNA, 16 nt, Homo sapiens
cacuugaggccaguga

SEQ ID NO: 540209 - RNA, 22 nt, Homo sapiens
cacuugccugugcuacaauuca

SEQ ID NO: 540210 - RNA, 20 nt, Homo sapiens
cacuugccuucuucacccag

SEQ ID NO: 540211 - RNA, 17 nt, Homo sapiens
cacuugggauugucuua

SEQ ID NO: 540212 - RNA, 19 nt, Homo sapiens
cacuugggauugucuuacu

SEQ ID NO: 540213 - RNA, 19 nt, Homo sapiens
cacuugggucuucccugua

SEQ ID NO: 540214 - RNA, 22 nt, Homo sapiens
cacuugguuuuuggcucuuuca

SEQ ID NO: 540215 - RNA, 23 nt, Homo sapiens
cacuugucuccuuucugacuguc

SEQ ID NO: 540216 - RNA, 22 nt, Homo sapiens
cacuugugggccccccuugccu

SEQ ID NO: 540217 - RNA, 23 nt, Homo sapiens
cacuuuaaaaccaguuacccaaa

SEQ ID NO: 540218 - RNA, 15 nt, Homo sapiens
cacuuuaaagcccuu

SEQ ID NO: 540219 - RNA, 16 nt, Homo sapiens
cacuuuaacucaggag

SEQ ID NO: 540220 - RNA, 17 nt, Homo sapiens
cacuuuaacugacuuaa

SEQ ID NO: 540221 - RNA, 18 nt, Homo sapiens
cacuuuaccucuguggac

SEQ ID NO: 540222 - RNA, 20 nt, Homo sapiens
cacuuuaccucuguggaccu

SEQ ID NO: 540223 - RNA, 20 nt, Homo sapiens
cacuuuaguuauauucacug

SEQ ID NO: 540224 - RNA, 17 nt, Homo sapiens
cacuuuauaaauaucaa

SEQ ID NO: 540225 - RNA, 23 nt, Homo sapiens
cacuuuaucuauaucucauuuca

SEQ ID NO: 540226 - RNA, 20 nt, Homo sapiens
cacuuugaaggggccucacc

SEQ ID NO: 540227 - RNA, 22 nt, Homo sapiens
cacuuugcacugauauaucaug

SEQ ID NO: 540228 - RNA, 12 nt, Homo sapiens
cacuuugcucuc

SEQ ID NO: 540229 - RNA, 18 nt, Homo sapiens
cacuuuggacauggcuca

SEQ ID NO: 540230 - RNA, 19 nt, Homo sapiens
cacuuugggaggccgaggu

SEQ ID NO: 540231 - RNA, 19 nt, Homo sapiens
cacuuugggaggcugaggu

SEQ ID NO: 540232 - RNA, 15 nt, Homo sapiens
cacuuuguccauuug

SEQ ID NO: 540233 - RNA, 22 nt, Homo sapiens
cacuuuguugcaagaugugaau

SEQ ID NO: 540234 - RNA, 23 nt, Homo sapiens
cacuuuuaaaggaaugugaaauu

SEQ ID NO: 540235 - RNA, 21 nt, Homo sapiens
cacuuuugauagauuacgucu

SEQ ID NO: 540236 - RNA, 14 nt, Homo sapiens
cacuuuuuccaaau

SEQ ID NO: 540237 - RNA, 15 nt, Homo sapiens
cagaaaaacaaucuu

SEQ ID NO: 540238 - RNA, 19 nt, Homo sapiens
cagaaaaacuggcucugau

SEQ ID NO: 540239 - RNA, 18 nt, Homo sapiens
cagaaaaagcuagcacua

SEQ ID NO: 540240 - RNA, 14 nt, Homo sapiens
cagaaaaauacuuu

SEQ ID NO: 540241 - RNA, 16 nt, Homo sapiens
cagaaaacaaaagaga

SEQ ID NO: 540242 - RNA, 16 nt, Homo sapiens
cagaaaacaagaugag

SEQ ID NO: 540243 - RNA, 17 nt, Homo sapiens
cagaaaaccucuccuga

SEQ ID NO: 540244 - RNA, 22 nt, Homo sapiens
cagaaaagcaauacuguuucca

SEQ ID NO: 540245 - RNA, 18 nt, Homo sapiens
cagaaaagcccaaguuca

SEQ ID NO: 540246 - RNA, 15 nt, Homo sapiens
cagaaaagugauuag

SEQ ID NO: 540247 - RNA, 20 nt, Homo sapiens
cagaaaauaaaugguuucau

SEQ ID NO: 540248 - RNA, 23 nt, Homo sapiens
cagaaaauguugagaaucccaaa

SEQ ID NO: 540249 - RNA, 13 nt, Homo sapiens
cagaaaauucugu

SEQ ID NO: 540250 - RNA, 18 nt, Homo sapiens
cagaaacaaaaacacuaa

SEQ ID NO: 540251 - RNA, 22 nt, Homo sapiens
cagaaacagugggagcccugac

SEQ ID NO: 540252 - RNA, 19 nt, Homo sapiens
cagaaacaguucaccuuga

SEQ ID NO: 540253 - RNA, 12 nt, Homo sapiens
cagaaacaucuc

SEQ ID NO: 540254 - RNA, 21 nt, Homo sapiens
cagaaacccaguaacuugcaa

SEQ ID NO: 540255 - RNA, 19 nt, Homo sapiens
cagaaaccuaucucaggga

SEQ ID NO: 540256 - RNA, 22 nt, Homo sapiens
cagaaacuagaaaugugaauga

SEQ ID NO: 540257 - RNA, 20 nt, Homo sapiens
cagaaagagacuccgucuca

SEQ ID NO: 540258 - RNA, 15 nt, Homo sapiens
cagaaagauuuuccu

SEQ ID NO: 540259 - RNA, 16 nt, Homo sapiens
cagaaagcauccuaaa

SEQ ID NO: 540260 - RNA, 17 nt, Homo sapiens
cagaaagcauccuaaau

SEQ ID NO: 540261 - RNA, 20 nt, Homo sapiens
cagaaagccugggugacauu

SEQ ID NO: 540262 - RNA, 19 nt, Homo sapiens
cagaaagcuccuuccagac

SEQ ID NO: 540263 - RNA, 20 nt, Homo sapiens
cagaaagcuccuuccagacc

SEQ ID NO: 540264 - RNA, 17 nt, Homo sapiens
cagaaagggaacagaaa

SEQ ID NO: 540265 - RNA, 17 nt, Homo sapiens
cagaaagguuaguauca

SEQ ID NO: 540266 - RNA, 20 nt, Homo sapiens
cagaaaguaucacaaaugga

SEQ ID NO: 540267 - RNA, 21 nt, Homo sapiens
cagaaaguaucacaaauggaa

SEQ ID NO: 540268 - RNA, 15 nt, Homo sapiens
cagaaauaccugucu

SEQ ID NO: 540269 - RNA, 20 nt, Homo sapiens
cagaaauaccugucuaggaa

SEQ ID NO: 540270 - RNA, 19 nt, Homo sapiens
cagaaaucaaaaagggaau

SEQ ID NO: 540271 - RNA, 22 nt, Homo sapiens
cagaaaugcaaggggcugcaug

SEQ ID NO: 540272 - RNA, 15 nt, Homo sapiens
cagaaauggacugga

SEQ ID NO: 540273 - RNA, 21 nt, Homo sapiens
cagaaaugucuaaaugcugaa

SEQ ID NO: 540274 - RNA, 15 nt, Homo sapiens
cagaaauuaaaugaa

SEQ ID NO: 540275 - RNA, 23 nt, Homo sapiens
cagaaauuagccggucauggugg

SEQ ID NO: 540276 - RNA, 15 nt, Homo sapiens
cagaaauuccaacuc

SEQ ID NO: 540277 - RNA, 22 nt, Homo sapiens
cagaaauuccaguaaauccuca

SEQ ID NO: 540278 - RNA, 23 nt, Homo sapiens
cagaaauuccaguaaauccucau

SEQ ID NO: 540279 - RNA, 15 nt, Homo sapiens
cagaaauucuagcgc

SEQ ID NO: 540280 - RNA, 23 nt, Homo sapiens
cagaacaaaaagaaaucuugucu

SEQ ID NO: 540281 - RNA, 13 nt, Homo sapiens
cagaacacacaga

SEQ ID NO: 540282 - RNA, 23 nt, Homo sapiens
cagaacacauuucucugaucucc

SEQ ID NO: 540283 - RNA, 19 nt, Homo sapiens
cagaacaccaacuuaagaa

SEQ ID NO: 540284 - RNA, 20 nt, Homo sapiens
cagaacacuuauguuauaca

SEQ ID NO: 540285 - RNA, 20 nt, Homo sapiens
cagaacacuuuuuaugacaa

SEQ ID NO: 540286 - RNA, 20 nt, Homo sapiens
cagaacagaugcugagccau

SEQ ID NO: 540287 - RNA, 15 nt, Homo sapiens
cagaaccagagcuca

SEQ ID NO: 540288 - RNA, 23 nt, Homo sapiens
cagaaccauccauaguaguauga

SEQ ID NO: 540289 - RNA, 17 nt, Homo sapiens
cagaacccagauuuccu

SEQ ID NO: 540290 - RNA, 23 nt, Homo sapiens
cagaacccagggcucugccccag

SEQ ID NO: 540291 - RNA, 18 nt, Homo sapiens
cagaaccccuacaugaaa

SEQ ID NO: 540292 - RNA, 20 nt, Homo sapiens
cagaaccucuuccccagaaa

SEQ ID NO: 540293 - RNA, 19 nt, Homo sapiens
cagaaccuucaacccagug

SEQ ID NO: 540294 - RNA, 20 nt, Homo sapiens
cagaacguggugaccuuuca

SEQ ID NO: 540295 - RNA, 20 nt, Homo sapiens
cagaacuuaaggauggagcc

SEQ ID NO: 540296 - RNA, 16 nt, Homo sapiens
cagaacuuaaucugga

SEQ ID NO: 540297 - RNA, 21 nt, Homo sapiens
cagaacuuaaucuggacacac

SEQ ID NO: 540298 - RNA, 16 nt, Homo sapiens
cagaacuugaaggguu

SEQ ID NO: 540299 - RNA, 22 nt, Homo sapiens
cagaagaaaauagaauugacau

SEQ ID NO: 540300 - RNA, 14 nt, Homo sapiens
cagaagacacugca

SEQ ID NO: 540301 - RNA, 19 nt, Homo sapiens
cagaagaccccugacucau

SEQ ID NO: 540302 - RNA, 22 nt, Homo sapiens
cagaagacccgcucuccaucuu

SEQ ID NO: 540303 - RNA, 11 nt, Homo sapiens
cagaagaucug

SEQ ID NO: 540304 - RNA, 15 nt, Homo sapiens
aggacaagacacuga

SEQ ID NO: 540305 - RNA, 18 nt, Homo sapiens
aggacaagacacugagga

SEQ ID NO: 540306 - RNA, 15 nt, Homo sapiens
aggacaagagggaca

SEQ ID NO: 540307 - RNA, 17 nt, Homo sapiens
aggacaagggcucagag

SEQ ID NO: 540308 - RNA, 14 nt, Homo sapiens
aggacacaauggca

SEQ ID NO: 540309 - RNA, 23 nt, Homo sapiens
aggacacagauaggauggggugu

SEQ ID NO: 540310 - RNA, 20 nt, Homo sapiens
aggacacagcacaagggcac

SEQ ID NO: 540311 - RNA, 17 nt, Homo sapiens
aggacacagcaguauug

SEQ ID NO: 540312 - RNA, 13 nt, Homo sapiens
aggacaccacuag

SEQ ID NO: 540313 - RNA, 16 nt, Homo sapiens
aggacagaccacagag

SEQ ID NO: 540314 - RNA, 21 nt, Homo sapiens
aggacagcagcacucccgcug

SEQ ID NO: 540315 - RNA, 14 nt, Homo sapiens
aggacagcccuccu

SEQ ID NO: 540316 - RNA, 15 nt, Homo sapiens
aggacagcucugggg

SEQ ID NO: 540317 - RNA, 14 nt, Homo sapiens
aggaugcagcacug

SEQ ID NO: 540318 - RNA, 18 nt, Homo sapiens
aggaugcuguguugucaa

SEQ ID NO: 540319 - RNA, 17 nt, Homo sapiens
aggauggaugcaucaca

SEQ ID NO: 540320 - RNA, 20 nt, Homo sapiens
aggauggcagcaauggcgcu

SEQ ID NO: 540321 - RNA, 22 nt, Homo sapiens
aggauggggcucccagcuccuu

SEQ ID NO: 540322 - RNA, 18 nt, Homo sapiens
aggaugucacagggccaa

SEQ ID NO: 540323 - RNA, 13 nt, Homo sapiens
aggaugugauaua

SEQ ID NO: 540324 - RNA, 12 nt, Homo sapiens
aggaugugauga

SEQ ID NO: 540325 - RNA, 16 nt, Homo sapiens
aggaugugcauucucc

SEQ ID NO: 540326 - RNA, 23 nt, Homo sapiens
aggauuauuuuaaauacaaaagg

SEQ ID NO: 540327 - RNA, 22 nt, Homo sapiens
aggauucccuucugggcuucau

SEQ ID NO: 540328 - RNA, 21 nt, Homo sapiens
aggauuuggggcagagggaca

SEQ ID NO: 540329 - RNA, 19 nt, Homo sapiens
aggcaaaaauguccagcca

SEQ ID NO: 540330 - RNA, 17 nt, Homo sapiens
aggcaaaggcagaggaa

SEQ ID NO: 540331 - RNA, 14 nt, Homo sapiens
aggcaaaguccagc

SEQ ID NO: 540332 - RNA, 19 nt, Homo sapiens
aggcaaaguuuacagaugu

SEQ ID NO: 540333 - RNA, 17 nt, Homo sapiens
aggcaaauuaacuguau

SEQ ID NO: 540334 - RNA, 23 nt, Homo sapiens
aggcaacugaggcagacagcagc

SEQ ID NO: 540335 - RNA, 13 nt, Homo sapiens
aggcaacugcauu

SEQ ID NO: 540336 - RNA, 13 nt, Homo sapiens
aggcaagcccuuc

SEQ ID NO: 540337 - RNA, 17 nt, Homo sapiens
aggcaagcuaacugcuu

SEQ ID NO: 540338 - RNA, 21 nt, Homo sapiens
aggcaagggauaacucuucua

SEQ ID NO: 540339 - RNA, 21 nt, Homo sapiens
aggcaagguugggcuggugcu

SEQ ID NO: 540340 - RNA, 18 nt, Homo sapiens
aggcaauccuaagcaaaa

SEQ ID NO: 540341 - RNA, 14 nt, Homo sapiens
aggcaauggguuua

SEQ ID NO: 540342 - RNA, 19 nt, Homo sapiens
aggcaaugugggaucucag

SEQ ID NO: 540343 - RNA, 13 nt, Homo sapiens
aggcaauuucacc

SEQ ID NO: 540344 - RNA, 13 nt, Homo sapiens
aggcacaacaguu

SEQ ID NO: 540345 - RNA, 22 nt, Homo sapiens
aggcacaacgcaccagacacuc

SEQ ID NO: 540346 - RNA, 18 nt, Homo sapiens
aggcacacagcuacucuc

SEQ ID NO: 540347 - RNA, 16 nt, Homo sapiens
aggcacauacaccucg

SEQ ID NO: 540348 - RNA, 14 nt, Homo sapiens
aggcaccaucauuu

SEQ ID NO: 540349 - RNA, 15 nt, Homo sapiens
aggcaccugcuggaa

SEQ ID NO: 540350 - RNA, 15 nt, Homo sapiens
aggcacucaaaagcu

SEQ ID NO: 540351 - RNA, 13 nt, Homo sapiens
aggcacucauggg

SEQ ID NO: 540352 - RNA, 15 nt, Homo sapiens
aggcacucccaucca

SEQ ID NO: 540353 - RNA, 22 nt, Homo sapiens
aggcacugcugcccagccucca

SEQ ID NO: 540354 - RNA, 14 nt, Homo sapiens
aggcacuguucaau

SEQ ID NO: 540355 - RNA, 17 nt, Homo sapiens
aggcagaaaaaugucau

SEQ ID NO: 540356 - RNA, 15 nt, Homo sapiens
aggcagaaagcaaaa

SEQ ID NO: 540357 - RNA, 16 nt, Homo sapiens
aggcagagaaucauac

SEQ ID NO: 540358 - RNA, 22 nt, Homo sapiens
aggcagagagucagacccuuca

SEQ ID NO: 540359 - RNA, 18 nt, Homo sapiens
aggcagaggcuggcacca

SEQ ID NO: 540360 - RNA, 19 nt, Homo sapiens
aggcagagguugcagugaa

SEQ ID NO: 540361 - RNA, 18 nt, Homo sapiens
aggcagauuaaaagcaca

SEQ ID NO: 540362 - RNA, 16 nt, Homo sapiens
aggcagcacagugugu

SEQ ID NO: 540363 - RNA, 14 nt, Homo sapiens
aggcagcauuccau

SEQ ID NO: 540364 - RNA, 11 nt, Homo sapiens
aggcagccacc

SEQ ID NO: 540365 - RNA, 21 nt, Homo sapiens
aggcagccaccaguggaccua

SEQ ID NO: 540366 - RNA, 16 nt, Homo sapiens
aggcagcgcagggcug

SEQ ID NO: 540367 - RNA, 14 nt, Homo sapiens
aggcagcgugggcu

SEQ ID NO: 540368 - RNA, 16 nt, Homo sapiens
aggcagcuaagacaua

SEQ ID NO: 540369 - RNA, 19 nt, Homo sapiens
aggcagcucaccccugggc

SEQ ID NO: 540370 - RNA, 19 nt, Homo sapiens
aggcagcugccucugcucc

SEQ ID NO: 540371 - RNA, 16 nt, Homo sapiens
aggcaggagaaucacu

SEQ ID NO: 540372 - RNA, 20 nt, Homo sapiens
aggcaggagaaucacuggaa

SEQ ID NO: 540373 - RNA, 17 nt, Homo sapiens
aggcaggagaauggugu

SEQ ID NO: 540374 - RNA, 20 nt, Homo sapiens
aggcaggaggauugcuugag

SEQ ID NO: 540375 - RNA, 22 nt, Homo sapiens
aggcaggcugggacggaccagc

SEQ ID NO: 540376 - RNA, 19 nt, Homo sapiens
aggcaggcuuuuccuccaa

SEQ ID NO: 540377 - RNA, 18 nt, Homo sapiens
aggcagggccugauuuau

SEQ ID NO: 540378 - RNA, 16 nt, Homo sapiens
aggcagggcugggaag

SEQ ID NO: 540379 - RNA, 14 nt, Homo sapiens
aggcaggggugaga

SEQ ID NO: 540380 - RNA, 23 nt, Homo sapiens
aggcaggggugggagagccagcu

SEQ ID NO: 540381 - RNA, 16 nt, Homo sapiens
aggcagguccacagag

SEQ ID NO: 540382 - RNA, 13 nt, Homo sapiens
aggcagguuucau

SEQ ID NO: 540383 - RNA, 14 nt, Homo sapiens
aggcaguaaccaug

SEQ ID NO: 540384 - RNA, 15 nt, Homo sapiens
aggcaguaaugccuu

SEQ ID NO: 540385 - RNA, 23 nt, Homo sapiens
aggcaguauuuuguguccuccag

SEQ ID NO: 540386 - RNA, 22 nt, Homo sapiens
aggcaguggccacguucaggga

SEQ ID NO: 540387 - RNA, 13 nt, Homo sapiens
aggcagugucccu

SEQ ID NO: 540388 - RNA, 14 nt, Homo sapiens
aggcagugugguua

SEQ ID NO: 540389 - RNA, 11 nt, Homo sapiens
aggcauaugca

SEQ ID NO: 540390 - RNA, 18 nt, Homo sapiens
aggcaucaaaaaaacaag

SEQ ID NO: 540391 - RNA, 15 nt, Homo sapiens
aggcaugacuaaugc

SEQ ID NO: 540392 - RNA, 22 nt, Homo sapiens
aggcaugagccacugcaccuga

SEQ ID NO: 540393 - RNA, 16 nt, Homo sapiens
aggcaugcagcugccu

SEQ ID NO: 540394 - RNA, 16 nt, Homo sapiens
aggcauuaacacaaag

SEQ ID NO: 540395 - RNA, 17 nt, Homo sapiens
aggcauuuagcccucac

SEQ ID NO: 540396 - RNA, 13 nt, Homo sapiens
aggccaacagcac

SEQ ID NO: 540397 - RNA, 13 nt, Homo sapiens
aggccaagcauuu

SEQ ID NO: 540398 - RNA, 20 nt, Homo sapiens
aggccaagcccaauacagcc

SEQ ID NO: 540399 - RNA, 20 nt, Homo sapiens
aggccacaggagacauuacu

SEQ ID NO: 540400 - RNA, 14 nt, Homo sapiens
aggccacaugucac

SEQ ID NO: 540401 - RNA, 13 nt, Homo sapiens
aggccacauugac

SEQ ID NO: 540402 - RNA, 14 nt, Homo sapiens
aggccacauugaca

SEQ ID NO: 540403 - RNA, 14 nt, Homo sapiens
aggccacuggggac

SEQ ID NO: 540404 - RNA, 18 nt, Homo sapiens
aggccagaaggaggggga

SEQ ID NO: 540405 - RNA, 22 nt, Homo sapiens
aggccagacuugguccuaagca

SEQ ID NO: 540406 - RNA, 23 nt, Homo sapiens
aggccagagaauucaaauuguua

SEQ ID NO: 540407 - RNA, 17 nt, Homo sapiens
aggccagagugcugcca

SEQ ID NO: 540408 - RNA, 15 nt, Homo sapiens
aggccagaugcacau

SEQ ID NO: 540409 - RNA, 16 nt, Homo sapiens
aggccagccugucccu

SEQ ID NO: 540410 - RNA, 16 nt, Homo sapiens
aggccaggcagauccc

SEQ ID NO: 540411 - RNA, 20 nt, Homo sapiens
aggccaggcgcgguggcuca

SEQ ID NO: 540412 - RNA, 13 nt, Homo sapiens
aggccaucuguaa

SEQ ID NO: 540413 - RNA, 12 nt, Homo sapiens
aggccaucuuuu

SEQ ID NO: 540414 - RNA, 20 nt, Homo sapiens
aggccaugaaaaaaaugauc

SEQ ID NO: 540415 - RNA, 16 nt, Homo sapiens
aggccauggugcacaa

SEQ ID NO: 540416 - RNA, 21 nt, Homo sapiens
aggccauugugaaccaaugca

SEQ ID NO: 540417 - RNA, 15 nt, Homo sapiens
aggcccaaagcacuu

SEQ ID NO: 540418 - RNA, 19 nt, Homo sapiens
aggcccagggaggugaccc

SEQ ID NO: 540419 - RNA, 12 nt, Homo sapiens
aggcccagugac

SEQ ID NO: 540420 - RNA, 19 nt, Homo sapiens
aggcccagugacaaagacu

SEQ ID NO: 540421 - RNA, 16 nt, Homo sapiens
aggcccccacuugccu

SEQ ID NO: 540422 - RNA, 20 nt, Homo sapiens
aggccccugcaaugugguga

SEQ ID NO: 540423 - RNA, 23 nt, Homo sapiens
aggcccgcccucugccuccucag

SEQ ID NO: 540424 - RNA, 20 nt, Homo sapiens
aggcccgcuagguccagaga

SEQ ID NO: 540425 - RNA, 20 nt, Homo sapiens
aggcccucugccugcacucc

SEQ ID NO: 540426 - RNA, 16 nt, Homo sapiens
aggcccucuguggccu

SEQ ID NO: 540427 - RNA, 21 nt, Homo sapiens
aggcccugagcuuuguccuga

SEQ ID NO: 540428 - RNA, 14 nt, Homo sapiens
aggcccuguccuaa

SEQ ID NO: 540429 - RNA, 23 nt, Homo sapiens
aggcccuuccucuccacugccuu

SEQ ID NO: 540430 - RNA, 18 nt, Homo sapiens
cagagaucuauaaacaga

SEQ ID NO: 540431 - RNA, 17 nt, Homo sapiens
cagagaugaaacuaugg

SEQ ID NO: 540432 - RNA, 18 nt, Homo sapiens
cagagaugaacaucuaac

SEQ ID NO: 540433 - RNA, 15 nt, Homo sapiens
cagagaugacugucc

SEQ ID NO: 540434 - RNA, 20 nt, Homo sapiens
cagagaugcaaugauaguua

SEQ ID NO: 540435 - RNA, 23 nt, Homo sapiens
cagagaugcaccaccaagccaag

SEQ ID NO: 540436 - RNA, 16 nt, Homo sapiens
cagagauguacugcaa

SEQ ID NO: 540437 - RNA, 17 nt, Homo sapiens
cagagauugaacuccaa

SEQ ID NO: 540438 - RNA, 15 nt, Homo sapiens
cagagcaaccucuca

SEQ ID NO: 540439 - RNA, 17 nt, Homo sapiens
aggccucaccauuccaa

SEQ ID NO: 540440 - RNA, 21 nt, Homo sapiens
aggccucccuagccagcacuu

SEQ ID NO: 540441 - RNA, 15 nt, Homo sapiens
aggccucucucagga

SEQ ID NO: 540442 - RNA, 19 nt, Homo sapiens
aggccucucucaggagcag

SEQ ID NO: 540443 - RNA, 15 nt, Homo sapiens
aggccucuguggcac

SEQ ID NO: 540444 - RNA, 18 nt, Homo sapiens
aggccucuuggaccucug

SEQ ID NO: 540445 - RNA, 21 nt, Homo sapiens
aggccucuuguugagugccag

SEQ ID NO: 540446 - RNA, 13 nt, Homo sapiens
aggccugaagcca

SEQ ID NO: 540447 - RNA, 12 nt, Homo sapiens
aggccugaauca

SEQ ID NO: 540448 - RNA, 22 nt, Homo sapiens
aggccugaccucaagcaaccau

SEQ ID NO: 540449 - RNA, 19 nt, Homo sapiens
aggccugagcgagugucca

SEQ ID NO: 540450 - RNA, 22 nt, Homo sapiens
aggccugcaccaaaugucagaa

SEQ ID NO: 540451 - RNA, 20 nt, Homo sapiens
aggccuggacgggcccuccu

SEQ ID NO: 540452 - RNA, 20 nt, Homo sapiens
aggccuggacuuuccugcaa

SEQ ID NO: 540453 - RNA, 21 nt, Homo sapiens
aggccuggagggcacuuccuc

SEQ ID NO: 540454 - RNA, 18 nt, Homo sapiens
aggccugggaauccgcug

SEQ ID NO: 540455 - RNA, 21 nt, Homo sapiens
aggccugggccgcugccacgu

SEQ ID NO: 540456 - RNA, 15 nt, Homo sapiens
aggccuguacagaug

SEQ ID NO: 540457 - RNA, 16 nt, Homo sapiens
aggccugugugacucc

SEQ ID NO: 540458 - RNA, 17 nt, Homo sapiens
aggccuucaggacucua

SEQ ID NO: 540459 - RNA, 23 nt, Homo sapiens
aggccuucaguuuauuuccacua

SEQ ID NO: 540460 - RNA, 16 nt, Homo sapiens
aggcgagcuccuugaa

SEQ ID NO: 540461 - RNA, 15 nt, Homo sapiens
aggcgauccaccugu

SEQ ID NO: 540462 - RNA, 19 nt, Homo sapiens
aggcgauccaccugucuca

SEQ ID NO: 540463 - RNA, 22 nt, Homo sapiens
aggcgauccaccugucucagcc

SEQ ID NO: 540464 - RNA, 17 nt, Homo sapiens
aggcgaugugcaagugu

SEQ ID NO: 540465 - RNA, 19 nt, Homo sapiens
aggcgcaguggcucaugcc

SEQ ID NO: 540466 - RNA, 20 nt, Homo sapiens
aggcgcaguggcucaugccu

SEQ ID NO: 540467 - RNA, 24 nt, Homo sapiens
aggcgccaccugggcggacagcca

SEQ ID NO: 540468 - RNA, 19 nt, Homo sapiens
aggcgcugacccaagagaa

SEQ ID NO: 540469 - RNA, 15 nt, Homo sapiens
aggcggaucaucuaa

SEQ ID NO: 540470 - RNA, 20 nt, Homo sapiens
aggcgggagcaucucuugag

SEQ ID NO: 540471 - RNA, 20 nt, Homo sapiens
aggcgggaugggacacccaa

SEQ ID NO: 540472 - RNA, 16 nt, Homo sapiens
aggcgggaugggcucg

SEQ ID NO: 540473 - RNA, 18 nt, Homo sapiens
aggcgggcggcacgccaa

SEQ ID NO: 540474 - RNA, 23 nt, Homo sapiens
aggcggggaggaggaacgggcag

SEQ ID NO: 540475 - RNA, 20 nt, Homo sapiens
aggcggguggaucacuugag

SEQ ID NO: 540476 - RNA, 15 nt, Homo sapiens
aggcgucaccaucca

SEQ ID NO: 540477 - RNA, 21 nt, Homo sapiens
aggcguuucugaagugcucuu

SEQ ID NO: 540478 - RNA, 21 nt, Homo sapiens
aggcuaagaugagauuugcca

SEQ ID NO: 540479 - RNA, 17 nt, Homo sapiens
aggcuacuggcauuaau

SEQ ID NO: 540480 - RNA, 12 nt, Homo sapiens
aggcuagaugau

SEQ ID NO: 540481 - RNA, 19 nt, Homo sapiens
aggcuaguugggaugggca

SEQ ID NO: 540482 - RNA, 19 nt, Homo sapiens
aggcuaucuggccugagac

SEQ ID NO: 540483 - RNA, 15 nt, Homo sapiens
aggcuauguauggaa

SEQ ID NO: 540484 - RNA, 19 nt, Homo sapiens
aggcucacugcaacuucug

SEQ ID NO: 540485 - RNA, 19 nt, Homo sapiens
aggcucaggucccuggggc

SEQ ID NO: 540486 - RNA, 20 nt, Homo sapiens
aggcuccccagaacuggcug

SEQ ID NO: 540487 - RNA, 15 nt, Homo sapiens
aggcuccugccugag

SEQ ID NO: 540488 - RNA, 14 nt, Homo sapiens
aggcucuaauguac

SEQ ID NO: 540489 - RNA, 18 nt, Homo sapiens
aggcucucgcacaccucu

SEQ ID NO: 540490 - RNA, 21 nt, Homo sapiens
aggcucucgcacaccucugca

SEQ ID NO: 540491 - RNA, 19 nt, Homo sapiens
aggcucuuccuugaaucuu

SEQ ID NO: 540492 - RNA, 12 nt, Homo sapiens
aggcucuucucc

SEQ ID NO: 540493 - RNA, 15 nt, Homo sapiens
aggcugaaagacagg

SEQ ID NO: 540494 - RNA, 17 nt, Homo sapiens
aggcugaccacagcaca

SEQ ID NO: 540495 - RNA, 18 nt, Homo sapiens
aggcugaccacagcacag

SEQ ID NO: 540496 - RNA, 14 nt, Homo sapiens
aggcugagcugcau

SEQ ID NO: 540497 - RNA, 17 nt, Homo sapiens
aggcugaggcaagagaa

SEQ ID NO: 540498 - RNA, 22 nt, Homo sapiens
aggcugaugucuuaacugucac

SEQ ID NO: 540499 - RNA, 23 nt, Homo sapiens
aggcugaugucuuaacugucacc

SEQ ID NO: 540500 - RNA, 16 nt, Homo sapiens
aggcugauuacugaaa

SEQ ID NO: 540501 - RNA, 22 nt, Homo sapiens
aggcugccccaggccggagccc

SEQ ID NO: 540502 - RNA, 15 nt, Homo sapiens
aggcugccccucuca

SEQ ID NO: 540503 - RNA, 16 nt, Homo sapiens
aggcugccccucucac

SEQ ID NO: 540504 - RNA, 22 nt, Homo sapiens
aggcugccucagccaguggcac

SEQ ID NO: 540505 - RNA, 17 nt, Homo sapiens
aggcugcgacugaugaa

SEQ ID NO: 540506 - RNA, 20 nt, Homo sapiens
aggcugcgagagaaagggag

SEQ ID NO: 540507 - RNA, 16 nt, Homo sapiens
aggcuggagugcaaug

SEQ ID NO: 540508 - RNA, 20 nt, Homo sapiens
aggcuggagugcaauggugu

SEQ ID NO: 540509 - RNA, 17 nt, Homo sapiens
aggcuggagugcagugc

SEQ ID NO: 540510 - RNA, 15 nt, Homo sapiens
aggcuggaugggaaa

SEQ ID NO: 540511 - RNA, 16 nt, Homo sapiens
aggcugggccaugucc

SEQ ID NO: 540512 - RNA, 15 nt, Homo sapiens
aggcuggggaggcca

SEQ ID NO: 540513 - RNA, 12 nt, Homo sapiens
aggcuggucuca

SEQ ID NO: 540514 - RNA, 11 nt, Homo sapiens
aggcuguaacu

SEQ ID NO: 540515 - RNA, 11 nt, Homo sapiens
aggcugucacc

SEQ ID NO: 540516 - RNA, 16 nt, Homo sapiens
aggcuguccuguacau

SEQ ID NO: 540517 - RNA, 17 nt, Homo sapiens
aggcugucugugccaug

SEQ ID NO: 540518 - RNA, 14 nt, Homo sapiens
aggcugugagccaa

SEQ ID NO: 540519 - RNA, 19 nt, Homo sapiens
aggcuguggcuggugagcc

SEQ ID NO: 540520 - RNA, 18 nt, Homo sapiens
aggcugugggguggagca

SEQ ID NO: 540521 - RNA, 22 nt, Homo sapiens
aggcuguugaaucaaagugauu

SEQ ID NO: 540522 - RNA, 21 nt, Homo sapiens
aggcuuaauaccugggugauu

SEQ ID NO: 540523 - RNA, 15 nt, Homo sapiens
aggcuucaucaaggu

SEQ ID NO: 540524 - RNA, 21 nt, Homo sapiens
aggcuuccagagaguccucug

SEQ ID NO: 540525 - RNA, 22 nt, Homo sapiens
aggcuucccugacuugcuuuag

SEQ ID NO: 540526 - RNA, 16 nt, Homo sapiens
aggcuugagucaccau

SEQ ID NO: 540527 - RNA, 14 nt, Homo sapiens
aggcuuuacagugu

SEQ ID NO: 540528 - RNA, 13 nt, Homo sapiens
aggcuuugccauu

SEQ ID NO: 540529 - RNA, 21 nt, Homo sapiens
aggcuuuguacagagugcuuu

SEQ ID NO: 540530 - RNA, 21 nt, Homo sapiens
aggcuuuuccguaaacauaua

SEQ ID NO: 540531 - RNA, 18 nt, Homo sapiens
agggaaaauuauuugcau

SEQ ID NO: 540532 - RNA, 14 nt, Homo sapiens
agggaaaguuaaaa

SEQ ID NO: 540533 - RNA, 23 nt, Homo sapiens
agggaaaguuaaaaguguugauu

SEQ ID NO: 540534 - RNA, 18 nt, Homo sapiens
agggaacacucaucccug

SEQ ID NO: 540535 - RNA, 13 nt, Homo sapiens
agggaacagugcc

SEQ ID NO: 540536 - RNA, 15 nt, Homo sapiens
agggaacagugccca

SEQ ID NO: 540537 - RNA, 18 nt, Homo sapiens
agggaacgggguccuuca

SEQ ID NO: 540538 - RNA, 21 nt, Homo sapiens
agggaacucuccccauuggca

SEQ ID NO: 540539 - RNA, 20 nt, Homo sapiens
agggaagaaugaacacuccc

SEQ ID NO: 540540 - RNA, 17 nt, Homo sapiens
agggaagagggagacca

SEQ ID NO: 540541 - RNA, 19 nt, Homo sapiens
agggaagccccacuugaag

SEQ ID NO: 540542 - RNA, 15 nt, Homo sapiens
agggaagcucagggg

SEQ ID NO: 540543 - RNA, 18 nt, Homo sapiens
agggaagcugucccucac

SEQ ID NO: 540544 - RNA, 21 nt, Homo sapiens
agggaagcugucccucacugu

SEQ ID NO: 540545 - RNA, 22 nt, Homo sapiens
agggaaggaacucuggcuucca

SEQ ID NO: 540546 - RNA, 14 nt, Homo sapiens
agggaaggagccca

SEQ ID NO: 540547 - RNA, 15 nt, Homo sapiens
agggaaggcaaaggc

SEQ ID NO: 540548 - RNA, 19 nt, Homo sapiens
agggaaggucucaggagaa

SEQ ID NO: 540549 - RNA, 22 nt, Homo sapiens
agggaagguucuucaugaucca

SEQ ID NO: 540550 - RNA, 15 nt, Homo sapiens
agggaauacuauaca

SEQ ID NO: 540551 - RNA, 16 nt, Homo sapiens
agggaauacugugcau

SEQ ID NO: 540552 - RNA, 22 nt, Homo sapiens
agggaaugagaguuccuucuca

SEQ ID NO: 540553 - RNA, 12 nt, Homo sapiens
acucugacucuc

SEQ ID NO: 540554 - RNA, 23 nt, Homo sapiens
acucugaggcucuuucugggcca

SEQ ID NO: 540555 - RNA, 18 nt, Homo sapiens
acucugagucacaggugu

SEQ ID NO: 540556 - RNA, 15 nt, Homo sapiens
acucugauguggaau

SEQ ID NO: 540557 - RNA, 14 nt, Homo sapiens
acucugcacuccau

SEQ ID NO: 540558 - RNA, 19 nt, Homo sapiens
acucugcagugauuagaag

SEQ ID NO: 540559 - RNA, 20 nt, Homo sapiens
acucugcauccagagauuca

SEQ ID NO: 540560 - RNA, 20 nt, Homo sapiens
acucugccgcuguguaggga

SEQ ID NO: 540561 - RNA, 22 nt, Homo sapiens
acucugcugcuuagacauaaca

SEQ ID NO: 540562 - RNA, 14 nt, Homo sapiens
acucugcugucuaa

SEQ ID NO: 540563 - RNA, 17 nt, Homo sapiens
acucugcuucaguccac

SEQ ID NO: 540564 - RNA, 22 nt, Homo sapiens
acucugcuugauuuuugccucu

SEQ ID NO: 540565 - RNA, 18 nt, Homo sapiens
acucuggaccauauacca

SEQ ID NO: 540566 - RNA, 15 nt, Homo sapiens
acucuggacuuucuc

SEQ ID NO: 540567 - RNA, 22 nt, Homo sapiens
acucuggacuuucucuaauaau

SEQ ID NO: 540568 - RNA, 18 nt, Homo sapiens
acucuggcaaagcuuuua

SEQ ID NO: 540569 - RNA, 14 nt, Homo sapiens
acucugggcuccag

SEQ ID NO: 540570 - RNA, 14 nt, Homo sapiens
acucuggggcuugu

SEQ ID NO: 540571 - RNA, 19 nt, Homo sapiens
acucuguaaaaacacugaa

SEQ ID NO: 540572 - RNA, 13 nt, Homo sapiens
acucuguccugga

SEQ ID NO: 540573 - RNA, 23 nt, Homo sapiens
acucuguccuggaggcacuggga

SEQ ID NO: 540574 - RNA, 16 nt, Homo sapiens
acucugugggugcuac

SEQ ID NO: 540575 - RNA, 18 nt, Homo sapiens
acucuguuuccuggucag

SEQ ID NO: 540576 - RNA, 21 nt, Homo sapiens
acucuuauucccaaacuacag

SEQ ID NO: 540577 - RNA, 12 nt, Homo sapiens
acucuucacuug

SEQ ID NO: 540578 - RNA, 14 nt, Homo sapiens
acucuucauucagu

SEQ ID NO: 540579 - RNA, 10 nt, Homo sapiens
acucuucccu

SEQ ID NO: 540580 - RNA, 12 nt, Homo sapiens
acucuucuugca

SEQ ID NO: 540581 - RNA, 20 nt, Homo sapiens
acucuucuugcagcuguuga

SEQ ID NO: 540582 - RNA, 19 nt, Homo sapiens
acucuugaauagacuucca

SEQ ID NO: 540583 - RNA, 22 nt, Homo sapiens
acucuugagaaaugaauaagcu

SEQ ID NO: 540584 - RNA, 23 nt, Homo sapiens
acucuugagucucuuuaccuaau

SEQ ID NO: 540585 - RNA, 16 nt, Homo sapiens
acucuugucacccagg

SEQ ID NO: 540586 - RNA, 20 nt, Homo sapiens
acucuugugaauuauucuga

SEQ ID NO: 540587 - RNA, 18 nt, Homo sapiens
acucuuuaacacauucuu

SEQ ID NO: 540588 - RNA, 22 nt, Homo sapiens
acucuuucaauaaauguaucau

SEQ ID NO: 540589 - RNA, 18 nt, Homo sapiens
acucuuuccuaaagccaa

SEQ ID NO: 540590 - RNA, 23 nt, Homo sapiens
acucuuucugaggagcuguuacu

SEQ ID NO: 540591 - RNA, 19 nt, Homo sapiens
acucuuucuggccugccuu

SEQ ID NO: 540592 - RNA, 19 nt, Homo sapiens
acucuuuggguccauucag

SEQ ID NO: 540593 - RNA, 21 nt, Homo sapiens
acucuuuuuuaugccuauucu

SEQ ID NO: 540594 - RNA, 15 nt, Homo sapiens
acugaaaaccucucc

SEQ ID NO: 540595 - RNA, 17 nt, Homo sapiens
acugaaaacuacaguug

SEQ ID NO: 540596 - RNA, 13 nt, Homo sapiens
acugaaacauuca

SEQ ID NO: 540597 - RNA, 15 nt, Homo sapiens
acugaaacauucaca

SEQ ID NO: 540598 - RNA, 12 nt, Homo sapiens
acugaaaccaaa

SEQ ID NO: 540599 - RNA, 20 nt, Homo sapiens
acugaaauauuuucuaggaa

SEQ ID NO: 540600 - RNA, 16 nt, Homo sapiens
acugaaauuuaguaca

SEQ ID NO: 540601 - RNA, 19 nt, Homo sapiens
acugaacaaaaccuacaca

SEQ ID NO: 540602 - RNA, 13 nt, Homo sapiens
acugaacauccaa

SEQ ID NO: 540603 - RNA, 17 nt, Homo sapiens
acugaacgauccuucaa

SEQ ID NO: 540604 - RNA, 13 nt, Homo sapiens
acugaagaccucc

SEQ ID NO: 540605 - RNA, 15 nt, Homo sapiens
acugaagacugcaca

SEQ ID NO: 540606 - RNA, 19 nt, Homo sapiens
acugaagccuucuucugcc

SEQ ID NO: 540607 - RNA, 22 nt, Homo sapiens
acugaagcuucaaaaagccacu

SEQ ID NO: 540608 - RNA, 16 nt, Homo sapiens
acugaaggacacagca

SEQ ID NO: 540609 - RNA, 21 nt, Homo sapiens
acugaaggcuaaaaagcaaca

SEQ ID NO: 540610 - RNA, 14 nt, Homo sapiens
acugaaggggcaca

SEQ ID NO: 540611 - RNA, 16 nt, Homo sapiens
acugaaggugauucac

SEQ ID NO: 540612 - RNA, 20 nt, Homo sapiens
acugaauaaacucaaaacuc

SEQ ID NO: 540613 - RNA, 15 nt, Homo sapiens
acugaauaaauaccu

SEQ ID NO: 540614 - RNA, 18 nt, Homo sapiens
acugaauaaauaccucuu

SEQ ID NO: 540615 - RNA, 15 nt, Homo sapiens
aucuguguuuguacu

SEQ ID NO: 540616 - RNA, 15 nt, Homo sapiens
aucuguucacuuuuc

SEQ ID NO: 540617 - RNA, 14 nt, Homo sapiens
aucuguucugggug

SEQ ID NO: 540618 - RNA, 15 nt, Homo sapiens
aucuguucuugcuac

SEQ ID NO: 540619 - RNA, 13 nt, Homo sapiens
aucuguugcuugu

SEQ ID NO: 540620 - RNA, 16 nt, Homo sapiens
aucuguuugaacacuu

SEQ ID NO: 540621 - RNA, 17 nt, Homo sapiens
aucuguuuuauaccuug

SEQ ID NO: 540622 - RNA, 20 nt, Homo sapiens
aucuguuuugaaggcaaaau

SEQ ID NO: 540623 - RNA, 15 nt, Homo sapiens
aucuuaaagcauucc

SEQ ID NO: 540624 - RNA, 14 nt, Homo sapiens
aucuuaaaugacag

SEQ ID NO: 540625 - RNA, 17 nt, Homo sapiens
aucuuaacaaagccuuu

SEQ ID NO: 540626 - RNA, 14 nt, Homo sapiens
aucuuaaguaccaa

SEQ ID NO: 540627 - RNA, 22 nt, Homo sapiens
aucuuaauuuuuuuuaauguac

SEQ ID NO: 540628 - RNA, 12 nt, Homo sapiens
aucuuacauaua

SEQ ID NO: 540629 - RNA, 22 nt, Homo sapiens
aucuuaccagaugcuacuggac

SEQ ID NO: 540630 - RNA, 19 nt, Homo sapiens
aucuuagaagcacuacacc

SEQ ID NO: 540631 - RNA, 18 nt, Homo sapiens
aucuucaaacuuucacuu

SEQ ID NO: 540632 - RNA, 19 nt, Homo sapiens
aucuucacucuucacuuga

SEQ ID NO: 540633 - RNA, 15 nt, Homo sapiens
aucuucacugcaauu

SEQ ID NO: 540634 - RNA, 19 nt, Homo sapiens
aucuucaggugaacacuua

SEQ ID NO: 540635 - RNA, 18 nt, Homo sapiens
aucuuccaaaugcaauuu

SEQ ID NO: 540636 - RNA, 15 nt, Homo sapiens
aucuuccugcugcug

SEQ ID NO: 540637 - RNA, 17 nt, Homo sapiens
aucuuccuuucuugucu

SEQ ID NO: 540638 - RNA, 13 nt, Homo sapiens
aucuucuacugua

SEQ ID NO: 540639 - RNA, 17 nt, Homo sapiens
aucuucuaucauuccaa

SEQ ID NO: 540640 - RNA, 20 nt, Homo sapiens
aucuucucccuuguccugcu

SEQ ID NO: 540641 - RNA, 19 nt, Homo sapiens
aucuugaaaugaaaguaua

SEQ ID NO: 540642 - RNA, 22 nt, Homo sapiens
aucuugaaauuaagaaggcaaa

SEQ ID NO: 540643 - RNA, 16 nt, Homo sapiens
aucuugaauagucuca

SEQ ID NO: 540644 - RNA, 17 nt, Homo sapiens
aucuugaauagucucau

SEQ ID NO: 540645 - RNA, 18 nt, Homo sapiens
aucuugaauagucucauc

SEQ ID NO: 540646 - RNA, 17 nt, Homo sapiens
aucuugauacauucaaa

SEQ ID NO: 540647 - RNA, 23 nt, Homo sapiens
aucuugcaagcaaaucccauuuc

SEQ ID NO: 540648 - RNA, 14 nt, Homo sapiens
aucuugcaccccaa

SEQ ID NO: 540649 - RNA, 20 nt, Homo sapiens
aucuugcuucugcuucucau

SEQ ID NO: 540650 - RNA, 18 nt, Homo sapiens
aucuuggagaaugugaga

SEQ ID NO: 540651 - RNA, 19 nt, Homo sapiens
aucuuggauuaugaaguga

SEQ ID NO: 540652 - RNA, 23 nt, Homo sapiens
aucuuggccaggcuggucuugaa

SEQ ID NO: 540653 - RNA, 15 nt, Homo sapiens
aucuugggaccucca

SEQ ID NO: 540654 - RNA, 18 nt, Homo sapiens
aucuugggauaguuccca

SEQ ID NO: 540655 - RNA, 16 nt, Homo sapiens
aucuuggggacaucuc

SEQ ID NO: 540656 - RNA, 19 nt, Homo sapiens
aucuuguaaaggauauuaa

SEQ ID NO: 540657 - RNA, 17 nt, Homo sapiens
aucuugucuaacauucc

SEQ ID NO: 540658 - RNA, 14 nt, Homo sapiens
aucuugugcuucuu

SEQ ID NO: 540659 - RNA, 23 nt, Homo sapiens
aucuuguguaagguuuugguuau

SEQ ID NO: 540660 - RNA, 14 nt, Homo sapiens
aucuuguuaauguc

SEQ ID NO: 540661 - RNA, 15 nt, Homo sapiens
aucuuguuaauguca

SEQ ID NO: 540662 - RNA, 15 nt, Homo sapiens
aucuuguuuuuccac

SEQ ID NO: 540663 - RNA, 22 nt, Homo sapiens
aucuuguuuuuccacuacugcu

SEQ ID NO: 540664 - RNA, 24 nt, Homo sapiens
aucuuguuuuuccacuacugcuac

SEQ ID NO: 540665 - RNA, 20 nt, Homo sapiens
aucuuuacaaaacuacauga

SEQ ID NO: 540666 - RNA, 16 nt, Homo sapiens
aucuuuaggcuuucaa

SEQ ID NO: 540667 - RNA, 20 nt, Homo sapiens
aucuuuaucaugaagcacau

SEQ ID NO: 540668 - RNA, 23 nt, Homo sapiens
aucuuuaucaugaagcacaucaa

SEQ ID NO: 540669 - RNA, 16 nt, Homo sapiens
aucuuucaaaccagcu

SEQ ID NO: 540670 - RNA, 12 nt, Homo sapiens
aucuuucaggaa

SEQ ID NO: 540671 - RNA, 13 nt, Homo sapiens
aucuuuccaaaua

SEQ ID NO: 540672 - RNA, 18 nt, Homo sapiens
aucuuucuuuaccugaga

SEQ ID NO: 540673 - RNA, 16 nt, Homo sapiens
aucuuuguacauuuaa

SEQ ID NO: 540674 - RNA, 15 nt, Homo sapiens
aucuuuguaccaaaa

SEQ ID NO: 540675 - RNA, 21 nt, Homo sapiens
augacuucuuuacuaacacug

SEQ ID NO: 540676 - RNA, 22 nt, Homo sapiens
augacuucuuuacuaacacugg

SEQ ID NO: 540677 - RNA, 16 nt, Homo sapiens
augacuuugagauuau

SEQ ID NO: 540678 - RNA, 22 nt, Homo sapiens
augagaaacuuugaucucugcu

SEQ ID NO: 540679 - RNA, 17 nt, Homo sapiens
augagaacaaacagauc

SEQ ID NO: 540680 - RNA, 13 nt, Homo sapiens
augagaaugugac

SEQ ID NO: 540681 - RNA, 19 nt, Homo sapiens
augagacaggaaaaaccaa

SEQ ID NO: 540682 - RNA, 16 nt, Homo sapiens
augagaccacuguuau

SEQ ID NO: 540683 - RNA, 13 nt, Homo sapiens
augagaccuggaa

SEQ ID NO: 540684 - RNA, 22 nt, Homo sapiens
augagacuaugcaaaaguacaa

SEQ ID NO: 540685 - RNA, 14 nt, Homo sapiens
augagagugcacug

SEQ ID NO: 540686 - RNA, 17 nt, Homo sapiens
augagaguuccuucuca

SEQ ID NO: 540687 - RNA, 15 nt, Homo sapiens
augagauaacucaag

SEQ ID NO: 540688 - RNA, 15 nt, Homo sapiens
augagaugacagaua

SEQ ID NO: 540689 - RNA, 22 nt, Homo sapiens
augagcaaauggugcugaauac

SEQ ID NO: 540690 - RNA, 14 nt, Homo sapiens
augagcauccccag

SEQ ID NO: 540691 - RNA, 19 nt, Homo sapiens
augagcccaccauuguuca

SEQ ID NO: 540692 - RNA, 23 nt, Homo sapiens
augagcccagaucaccaccugaa

SEQ ID NO: 540693 - RNA, 19 nt, Homo sapiens
augagccgugaacugugca

SEQ ID NO: 540694 - RNA, 17 nt, Homo sapiens
augagccuccucgucac

SEQ ID NO: 540695 - RNA, 20 nt, Homo sapiens
augagccuggcaagaaugug

SEQ ID NO: 540696 - RNA, 13 nt, Homo sapiens
augagcuccagac

SEQ ID NO: 540697 - RNA, 14 nt, Homo sapiens
augagcucuuccaa

SEQ ID NO: 540698 - RNA, 22 nt, Homo sapiens
augagcugaucugcggaucuca

SEQ ID NO: 540699 - RNA, 18 nt, Homo sapiens
augaggauaaugggaaga

SEQ ID NO: 540700 - RNA, 20 nt, Homo sapiens
augaggcaaacagcaagagu

SEQ ID NO: 540701 - RNA, 15 nt, Homo sapiens
augaggcaaugucag

SEQ ID NO: 540702 - RNA, 24 nt, Homo sapiens
augaggccacugcugcuucuccau

SEQ ID NO: 540703 - RNA, 18 nt, Homo sapiens
augagggaaauugcuauu

SEQ ID NO: 540704 - RNA, 17 nt, Homo sapiens
augagggugacugucaa

SEQ ID NO: 540705 - RNA, 20 nt, Homo sapiens
augagguacucuccuggaaa

SEQ ID NO: 540706 - RNA, 15 nt, Homo sapiens
augaggucuguuuaa

SEQ ID NO: 540707 - RNA, 13 nt, Homo sapiens
augaggugcucaa

SEQ ID NO: 540708 - RNA, 13 nt, Homo sapiens
augaggugggggu

SEQ ID NO: 540709 - RNA, 19 nt, Homo sapiens
augaguaaacugagacuua

SEQ ID NO: 540710 - RNA, 16 nt, Homo sapiens
augaguaacauuugcu

SEQ ID NO: 540711 - RNA, 20 nt, Homo sapiens
augaguaauacaucaaagag

SEQ ID NO: 540712 - RNA, 13 nt, Homo sapiens
augagucauuugu

SEQ ID NO: 540713 - RNA, 21 nt, Homo sapiens
augaguuucacuguacugcau

SEQ ID NO: 540714 - RNA, 20 nt, Homo sapiens
augaguuuuugauagcuuua

SEQ ID NO: 540715 - RNA, 23 nt, Homo sapiens
augauaaaauacuaaacuacauu

SEQ ID NO: 540716 - RNA, 13 nt, Homo sapiens
augauaaagacuu

SEQ ID NO: 540717 - RNA, 15 nt, Homo sapiens
augauaagugacaaa

SEQ ID NO: 540718 - RNA, 16 nt, Homo sapiens
augauacacaccuuuc

SEQ ID NO: 540719 - RNA, 15 nt, Homo sapiens
augauacacuaugaa

SEQ ID NO: 540720 - RNA, 13 nt, Homo sapiens
augauacauccaa

SEQ ID NO: 540721 - RNA, 16 nt, Homo sapiens
augauacugaugccau

SEQ ID NO: 540722 - RNA, 12 nt, Homo sapiens
augauacuugag

SEQ ID NO: 540723 - RNA, 19 nt, Homo sapiens
augauacuuggaugcagcu

SEQ ID NO: 540724 - RNA, 20 nt, Homo sapiens
augauagcaaauggccucau

SEQ ID NO: 540725 - RNA, 22 nt, Homo sapiens
augauaguccaauuuuuacuca

SEQ ID NO: 540726 - RNA, 17 nt, Homo sapiens
augauaucuucaagccu

SEQ ID NO: 540727 - RNA, 14 nt, Homo sapiens
augauaugaccaaa

SEQ ID NO: 540728 - RNA, 16 nt, Homo sapiens
augauaugaccaaaau

SEQ ID NO: 540729 - RNA, 17 nt, Homo sapiens
augauauuuuaugcaaa

SEQ ID NO: 540730 - RNA, 16 nt, Homo sapiens
augaucaaaacaugcu

SEQ ID NO: 540731 - RNA, 19 nt, Homo sapiens
augaucaaaaccugugcca

SEQ ID NO: 540732 - RNA, 17 nt, Homo sapiens
augaucaagauauaugu

SEQ ID NO: 540733 - RNA, 14 nt, Homo sapiens
augaucaaggugaa

SEQ ID NO: 540734 - RNA, 19 nt, Homo sapiens
augaucagaagaacaugau

SEQ ID NO: 540735 - RNA, 18 nt, Homo sapiens
augaucagaagacuuuaa

SEQ ID NO: 540736 - RNA, 17 nt, Homo sapiens
augauccagaacagugg

SEQ ID NO: 540737 - RNA, 20 nt, Homo sapiens
augaucccagucacuccucu

SEQ ID NO: 540738 - RNA, 22 nt, Homo sapiens
augauccuaggcauuugcugaa

SEQ ID NO: 540739 - RNA, 16 nt, Homo sapiens
augauccuuguguuca

SEQ ID NO: 540740 - RNA, 17 nt, Homo sapiens
augauccuuuuuuguca

SEQ ID NO: 540741 - RNA, 13 nt, Homo sapiens
augaucucccugc

SEQ ID NO: 540742 - RNA, 12 nt, Homo sapiens
augaucuuggcu

SEQ ID NO: 540743 - RNA, 20 nt, Homo sapiens
augaugagcauuuagcacaa

SEQ ID NO: 540744 - RNA, 18 nt, Homo sapiens
augaugagccuucgugcc

SEQ ID NO: 540745 - RNA, 23 nt, Homo sapiens
augaugagucgguccucuuucca

SEQ ID NO: 540746 - RNA, 13 nt, Homo sapiens
augaugcaguuuc

SEQ ID NO: 540747 - RNA, 13 nt, Homo sapiens
augaugcaguuuu

SEQ ID NO: 540748 - RNA, 21 nt, Homo sapiens
augaugcuagccagcaaagau

SEQ ID NO: 540749 - RNA, 19 nt, Homo sapiens
augauggcaccacugcacu

SEQ ID NO: 540750 - RNA, 19 nt, Homo sapiens
augauggccuuacacugaa

SEQ ID NO: 540751 - RNA, 18 nt, Homo sapiens
augaugggcuuuuguucu

SEQ ID NO: 540752 - RNA, 23 nt, Homo sapiens
augaugggggaaaaaaaguaauc

SEQ ID NO: 540753 - RNA, 20 nt, Homo sapiens
augaugguuuuaaacuuuca

SEQ ID NO: 540754 - RNA, 14 nt, Homo sapiens
augauguaaucucu

SEQ ID NO: 540755 - RNA, 23 nt, Homo sapiens
augauguagagugugguuaugaa

SEQ ID NO: 540756 - RNA, 16 nt, Homo sapiens
augauguggacauaug

SEQ ID NO: 540757 - RNA, 11 nt, Homo sapiens
augauguuucg

SEQ ID NO: 540758 - RNA, 14 nt, Homo sapiens
augauucaagccau

SEQ ID NO: 540759 - RNA, 15 nt, Homo sapiens
augauucaagccauu

SEQ ID NO: 540760 - RNA, 14 nt, Homo sapiens
augauucuaugucu

SEQ ID NO: 540761 - RNA, 21 nt, Homo sapiens
augauucuuuguuacaggcac

SEQ ID NO: 540762 - RNA, 18 nt, Homo sapiens
augauuggaauauuacaa

SEQ ID NO: 540763 - RNA, 21 nt, Homo sapiens
augauuguuuuugcucaaggc

SEQ ID NO: 540764 - RNA, 16 nt, Homo sapiens
augauuucaaaaucag

SEQ ID NO: 540765 - RNA, 23 nt, Homo sapiens
augauuucuagcaggcaggaagu

SEQ ID NO: 540766 - RNA, 21 nt, Homo sapiens
augauuugggggaggcuuugg

SEQ ID NO: 540767 - RNA, 11 nt, Homo sapiens
augauuuuccu

SEQ ID NO: 540768 - RNA, 24 nt, Homo sapiens
augcaaaauuguuuucacuuguau

SEQ ID NO: 540769 - RNA, 19 nt, Homo sapiens
augcaaagcacucucugca

SEQ ID NO: 540770 - RNA, 21 nt, Homo sapiens
augcaaaguucuucauaucau

SEQ ID NO: 540771 - RNA, 15 nt, Homo sapiens
augcaacaucaugga

SEQ ID NO: 540772 - RNA, 14 nt, Homo sapiens
augcaaccauaaga

SEQ ID NO: 540773 - RNA, 20 nt, Homo sapiens
augcaacucaucuucacaga

SEQ ID NO: 540774 - RNA, 14 nt, Homo sapiens
augcaagaugaacc

SEQ ID NO: 540775 - RNA, 12 nt, Homo sapiens
augcaagcagcu

SEQ ID NO: 540776 - RNA, 15 nt, Homo sapiens
augcaagugcaaaag

SEQ ID NO: 540777 - RNA, 16 nt, Homo sapiens
augcaauaaugugcaa

SEQ ID NO: 540778 - RNA, 16 nt, Homo sapiens
augcaaugacucagga

SEQ ID NO: 540779 - RNA, 17 nt, Homo sapiens
augcacaagaauggauc

SEQ ID NO: 540780 - RNA, 18 nt, Homo sapiens
augcacaggggaaggaaa

SEQ ID NO: 540781 - RNA, 13 nt, Homo sapiens
augcaccaagaaa

SEQ ID NO: 540782 - RNA, 11 nt, Homo sapiens
augcaccucag

SEQ ID NO: 540783 - RNA, 23 nt, Homo sapiens
augcacgugugcacacacaccac

SEQ ID NO: 540784 - RNA, 15 nt, Homo sapiens
augcacuauauacau

SEQ ID NO: 540785 - RNA, 22 nt, Homo sapiens
augcacuauauguuuacacaau

SEQ ID NO: 540786 - RNA, 18 nt, Homo sapiens
augcacucucagaccaag

SEQ ID NO: 540787 - RNA, 20 nt, Homo sapiens
augcacugugggauguguuc

SEQ ID NO: 540788 - RNA, 20 nt, Homo sapiens
augcacuuaaagaaguauuu

SEQ ID NO: 540789 - RNA, 17 nt, Homo sapiens
augcagaauggcauuug

SEQ ID NO: 540790 - RNA, 16 nt, Homo sapiens
augcagacaacaccuu

SEQ ID NO: 540791 - RNA, 14 nt, Homo sapiens
augcagagccacag

SEQ ID NO: 540792 - RNA, 18 nt, Homo sapiens
augcagauucagugcaau

SEQ ID NO: 540793 - RNA, 22 nt, Homo sapiens
augcagauuccucagauucaau

SEQ ID NO: 540794 - RNA, 20 nt, Homo sapiens
augcagcaaggggacaucuu

SEQ ID NO: 540795 - RNA, 22 nt, Homo sapiens
augcagcaggaaggaacaaaga

SEQ ID NO: 540796 - RNA, 13 nt, Homo sapiens
augcagcagggau

SEQ ID NO: 540797 - RNA, 22 nt, Homo sapiens
augcagccaaccaagaugcaaa

SEQ ID NO: 540798 - RNA, 21 nt, Homo sapiens
augcagccagcauuaccacag

SEQ ID NO: 540799 - RNA, 20 nt, Homo sapiens
augcagcucuucaacaugac

SEQ ID NO: 540800 - RNA, 16 nt, Homo sapiens
augcagcuuauacgaa

SEQ ID NO: 540801 - RNA, 13 nt, Homo sapiens
augcagggacaaa

SEQ ID NO: 540802 - RNA, 14 nt, Homo sapiens
augcagggacaaau

SEQ ID NO: 540803 - RNA, 15 nt, Homo sapiens
augcaggugguggga

SEQ ID NO: 540804 - RNA, 18 nt, Homo sapiens
augcaguuuuaagaauug

SEQ ID NO: 540805 - RNA, 17 nt, Homo sapiens
augcaguuuucauauau

SEQ ID NO: 540806 - RNA, 16 nt, Homo sapiens
augcaguuuuccuuaa

SEQ ID NO: 540807 - RNA, 20 nt, Homo sapiens
augcauaaaaaaaugaugca

SEQ ID NO: 540808 - RNA, 15 nt, Homo sapiens
augcauaaagccaaa

SEQ ID NO: 540809 - RNA, 14 nt, Homo sapiens
augcauaaaugcga

SEQ ID NO: 540810 - RNA, 22 nt, Homo sapiens
augcauacuguugauacaaacc

SEQ ID NO: 540811 - RNA, 18 nt, Homo sapiens
augcauauccugagccau

SEQ ID NO: 540812 - RNA, 13 nt, Homo sapiens
augcaucuuguuu

SEQ ID NO: 540813 - RNA, 19 nt, Homo sapiens
augcaugcagccacugugc

SEQ ID NO: 540814 - RNA, 16 nt, Homo sapiens
augcauucuuuucaga

SEQ ID NO: 540815 - RNA, 18 nt, Homo sapiens
augcauugaaagaauuag

SEQ ID NO: 540816 - RNA, 16 nt, Homo sapiens
augcauuugcacuauu

SEQ ID NO: 540817 - RNA, 11 nt, Homo sapiens
augcauuuuaa

SEQ ID NO: 540818 - RNA, 17 nt, Homo sapiens
augcauuuucuucacag

SEQ ID NO: 540819 - RNA, 20 nt, Homo sapiens
augcauuuucuucacagugc

SEQ ID NO: 540820 - RNA, 11 nt, Homo sapiens
augccaaaaaa

SEQ ID NO: 540821 - RNA, 16 nt, Homo sapiens
augccaaaaugacuuu

SEQ ID NO: 540822 - RNA, 21 nt, Homo sapiens
augccaauaauaaaugcccuc

SEQ ID NO: 540823 - RNA, 17 nt, Homo sapiens
augccaccacacguguu

SEQ ID NO: 540824 - RNA, 14 nt, Homo sapiens
augccacccuagcc

SEQ ID NO: 540825 - RNA, 16 nt, Homo sapiens
augccacuucaccaag

SEQ ID NO: 540826 - RNA, 13 nt, Homo sapiens
augccacuuccuu

SEQ ID NO: 540827 - RNA, 17 nt, Homo sapiens
augccagacccacugaa

SEQ ID NO: 540828 - RNA, 18 nt, Homo sapiens
augccagcuuaucucagg

SEQ ID NO: 540829 - RNA, 19 nt, Homo sapiens
augccagcuuaucucaggg

SEQ ID NO: 540830 - RNA, 22 nt, Homo sapiens
augccagggcccaggaggaccg

SEQ ID NO: 540831 - RNA, 22 nt, Homo sapiens
augccaguaacgcgucuuccug

SEQ ID NO: 540832 - RNA, 17 nt, Homo sapiens
augccagugaaacuuca

SEQ ID NO: 540833 - RNA, 16 nt, Homo sapiens
augccaguuacuugcu

SEQ ID NO: 540834 - RNA, 15 nt, Homo sapiens
augccauagcauaau

SEQ ID NO: 540835 - RNA, 18 nt, Homo sapiens
augccauauacaaaaauu

SEQ ID NO: 540836 - RNA, 17 nt, Homo sapiens
augcccacaacuuguca

SEQ ID NO: 540837 - RNA, 14 nt, Homo sapiens
augcccacugagga

SEQ ID NO: 540838 - RNA, 11 nt, Homo sapiens
augcccagaag

SEQ ID NO: 540839 - RNA, 22 nt, Homo sapiens
augccccgagcccaggcagcua

SEQ ID NO: 540840 - RNA, 14 nt, Homo sapiens
augcccuccaugug

SEQ ID NO: 540841 - RNA, 17 nt, Homo sapiens
augcccuccauguguaa

SEQ ID NO: 540842 - RNA, 19 nt, Homo sapiens
augcccuguaccugugcac

SEQ ID NO: 540843 - RNA, 13 nt, Homo sapiens
augcccugugugg

SEQ ID NO: 540844 - RNA, 18 nt, Homo sapiens
augccgcagggagggcug

SEQ ID NO: 540845 - RNA, 18 nt, Homo sapiens
augccuacugaguagggg

SEQ ID NO: 540846 - RNA, 12 nt, Homo sapiens
augccuacugcu

SEQ ID NO: 540847 - RNA, 21 nt, Homo sapiens
augccuagacuucccaacagc

SEQ ID NO: 540848 - RNA, 16 nt, Homo sapiens
augccucaauucacau

SEQ ID NO: 540849 - RNA, 19 nt, Homo sapiens
augccucacuuucuucuag

SEQ ID NO: 540850 - RNA, 23 nt, Homo sapiens
augccucagcccugacccugugg

SEQ ID NO: 540851 - RNA, 20 nt, Homo sapiens
augccucccugggccaccuc

SEQ ID NO: 540852 - RNA, 16 nt, Homo sapiens
augccugguauuuuca

SEQ ID NO: 540853 - RNA, 23 nt, Homo sapiens
augccuggucccaagacagugag

SEQ ID NO: 540854 - RNA, 14 nt, Homo sapiens
augccuguaaucuc

SEQ ID NO: 540855 - RNA, 13 nt, Homo sapiens
augccuuuaguca

SEQ ID NO: 540856 - RNA, 21 nt, Homo sapiens
augcgaaauguucucaugaac

SEQ ID NO: 540857 - RNA, 15 nt, Homo sapiens
augcgagacucugau

SEQ ID NO: 540858 - RNA, 14 nt, Homo sapiens
augcgaggggccag

SEQ ID NO: 540859 - RNA, 14 nt, Homo sapiens
augcggccauucaa

SEQ ID NO: 540860 - RNA, 18 nt, Homo sapiens
augcuacauauaugcaau

SEQ ID NO: 540861 - RNA, 21 nt, Homo sapiens
augcuaccacugguacuuccu

SEQ ID NO: 540862 - RNA, 23 nt, Homo sapiens
augcuacuuuuuuuuaguucaau

SEQ ID NO: 540863 - RNA, 17 nt, Homo sapiens
augcuaguuugaccuca

SEQ ID NO: 540864 - RNA, 14 nt, Homo sapiens
acugaauaaauuca

SEQ ID NO: 540865 - RNA, 15 nt, Homo sapiens
acugaaucacuuaaa

SEQ ID NO: 540866 - RNA, 19 nt, Homo sapiens
acugaaucugcuaccaaaa

SEQ ID NO: 540867 - RNA, 16 nt, Homo sapiens
acugaauugacaugac

SEQ ID NO: 540868 - RNA, 20 nt, Homo sapiens
acugaauuuuaaauguucac

SEQ ID NO: 540869 - RNA, 19 nt, Homo sapiens
acugacaaaggagccuuga

SEQ ID NO: 540870 - RNA, 15 nt, Homo sapiens
acugacaaagucauc

SEQ ID NO: 540871 - RNA, 20 nt, Homo sapiens
acugacacaagaauggucuu

SEQ ID NO: 540872 - RNA, 18 nt, Homo sapiens
acugacagcaugugcccu

SEQ ID NO: 540873 - RNA, 20 nt, Homo sapiens
acugacauauaucuauuaca

SEQ ID NO: 540874 - RNA, 23 nt, Homo sapiens
acugacauuuuuuccuaaggaag

SEQ ID NO: 540875 - RNA, 15 nt, Homo sapiens
acugacccugaggag

SEQ ID NO: 540876 - RNA, 20 nt, Homo sapiens
acugacccugauacaggcau

SEQ ID NO: 540877 - RNA, 14 nt, Homo sapiens
acugaccuaccuca

SEQ ID NO: 540878 - RNA, 14 nt, Homo sapiens
acugaccuuugucc

SEQ ID NO: 540879 - RNA, 18 nt, Homo sapiens
acugacggaguccugugu

SEQ ID NO: 540880 - RNA, 16 nt, Homo sapiens
acugacuccuguggag

SEQ ID NO: 540881 - RNA, 21 nt, Homo sapiens
acugacucugacucaucccca

SEQ ID NO: 540882 - RNA, 18 nt, Homo sapiens
acugacugccuugcuaaa

SEQ ID NO: 540883 - RNA, 17 nt, Homo sapiens
acugacuucagugggac

SEQ ID NO: 540884 - RNA, 20 nt, Homo sapiens
acugagaagaggagugcaag

SEQ ID NO: 540885 - RNA, 13 nt, Homo sapiens
acugagaaggcuc

SEQ ID NO: 540886 - RNA, 19 nt, Homo sapiens
acugagaagugcacuuuaa

SEQ ID NO: 540887 - RNA, 21 nt, Homo sapiens
acugagagugagcaaccagcu

SEQ ID NO: 540888 - RNA, 13 nt, Homo sapiens
acugagaugcaaa

SEQ ID NO: 540889 - RNA, 18 nt, Homo sapiens
acugagcagccgccagcu

SEQ ID NO: 540890 - RNA, 22 nt, Homo sapiens
acugagcauguauuuugugcca

SEQ ID NO: 540891 - RNA, 16 nt, Homo sapiens
acugagccagucccag

SEQ ID NO: 540892 - RNA, 15 nt, Homo sapiens
acugagcuacuagag

SEQ ID NO: 540893 - RNA, 20 nt, Homo sapiens
acugagcuccccagaucucc

SEQ ID NO: 540894 - RNA, 18 nt, Homo sapiens
acugagcugggcaggaag

SEQ ID NO: 540895 - RNA, 23 nt, Homo sapiens
acugaggcccagggaggugaccc

SEQ ID NO: 540896 - RNA, 12 nt, Homo sapiens
acugagggccac

SEQ ID NO: 540897 - RNA, 21 nt, Homo sapiens
acugaggugccugcucaggug

SEQ ID NO: 540898 - RNA, 22 nt, Homo sapiens
acugaguagcucuccugacuuu

SEQ ID NO: 540899 - RNA, 17 nt, Homo sapiens
acugagucaucuuguga

SEQ ID NO: 540900 - RNA, 15 nt, Homo sapiens
acugaguccaugaaa

SEQ ID NO: 540901 - RNA, 18 nt, Homo sapiens
acugaguccucguagcca

SEQ ID NO: 540902 - RNA, 23 nt, Homo sapiens
acugaguguucaaacuacuguac

SEQ ID NO: 540903 - RNA, 15 nt, Homo sapiens
acugauacacuugaa

SEQ ID NO: 540904 - RNA, 16 nt, Homo sapiens
acugauacacuugaag

SEQ ID NO: 540905 - RNA, 18 nt, Homo sapiens
acugauacuucacuacuu

SEQ ID NO: 540906 - RNA, 21 nt, Homo sapiens
acugauagaugucuauucuug

SEQ ID NO: 540907 - RNA, 20 nt, Homo sapiens
acugaucacccaaugcauca

SEQ ID NO: 540908 - RNA, 20 nt, Homo sapiens
acugauccaguauaagacua

SEQ ID NO: 540909 - RNA, 16 nt, Homo sapiens
acugaugaaaucugcu

SEQ ID NO: 540910 - RNA, 19 nt, Homo sapiens
acugaugaaggcaugccua

SEQ ID NO: 540911 - RNA, 21 nt, Homo sapiens
acugaugaguuucacuguacu

SEQ ID NO: 540912 - RNA, 12 nt, Homo sapiens
acugaugcauug

SEQ ID NO: 540913 - RNA, 17 nt, Homo sapiens
acugaugccauguuuag

SEQ ID NO: 540914 - RNA, 16 nt, Homo sapiens
acugaugcuucuguca

SEQ ID NO: 540915 - RNA, 16 nt, Homo sapiens
acugauguacaauuaa

SEQ ID NO: 540916 - RNA, 21 nt, Homo sapiens
acugauguuacaucacagugu

SEQ ID NO: 540917 - RNA, 13 nt, Homo sapiens
acugauguuacua

SEQ ID NO: 540918 - RNA, 19 nt, Homo sapiens
acugauucucuacaugcuc

SEQ ID NO: 540919 - RNA, 22 nt, Homo sapiens
auggaagguucucugugcuccu

SEQ ID NO: 540920 - RNA, 17 nt, Homo sapiens
auggaaguggcagugaa

SEQ ID NO: 540921 - RNA, 14 nt, Homo sapiens
auggaaguguucag

SEQ ID NO: 540922 - RNA, 20 nt, Homo sapiens
auggaaguuuuccuacacuu

SEQ ID NO: 540923 - RNA, 18 nt, Homo sapiens
auggaauggcagguguca

SEQ ID NO: 540924 - RNA, 14 nt, Homo sapiens
auggacaacucaau

SEQ ID NO: 540925 - RNA, 17 nt, Homo sapiens
auggacaacucaaugaa

SEQ ID NO: 540926 - RNA, 15 nt, Homo sapiens
auggacauaagacag

SEQ ID NO: 540927 - RNA, 18 nt, Homo sapiens
auggacauaagacagaca

SEQ ID NO: 540928 - RNA, 23 nt, Homo sapiens
auggaccagugguuuccagucau

SEQ ID NO: 540929 - RNA, 20 nt, Homo sapiens
auggaccuagcuugaggcaa

SEQ ID NO: 540930 - RNA, 22 nt, Homo sapiens
auggacguuauccucucagauu

SEQ ID NO: 540931 - RNA, 16 nt, Homo sapiens
auggacugcuucaucu

SEQ ID NO: 540932 - RNA, 15 nt, Homo sapiens
auggacuguguuucc

SEQ ID NO: 540933 - RNA, 17 nt, Homo sapiens
auggacuucuggaugcc

SEQ ID NO: 540934 - RNA, 21 nt, Homo sapiens
auggagacaagggcaucaucu

SEQ ID NO: 540935 - RNA, 17 nt, Homo sapiens
auggagacuccaugaga

SEQ ID NO: 540936 - RNA, 13 nt, Homo sapiens
auggagaggacag

SEQ ID NO: 540937 - RNA, 14 nt, Homo sapiens
auggagauucugau

SEQ ID NO: 540938 - RNA, 14 nt, Homo sapiens
auggagcagucucc

SEQ ID NO: 540939 - RNA, 18 nt, Homo sapiens
auggagccuggaacugca

SEQ ID NO: 540940 - RNA, 16 nt, Homo sapiens
auggagcugaauuuga

SEQ ID NO: 540941 - RNA, 15 nt, Homo sapiens
auggaggaacuuucc

SEQ ID NO: 540942 - RNA, 14 nt, Homo sapiens
auggaggacuccag

SEQ ID NO: 540943 - RNA, 15 nt, Homo sapiens
auggaggcccuccug

SEQ ID NO: 540944 - RNA, 21 nt, Homo sapiens
auggaggggagggaucuccug

SEQ ID NO: 540945 - RNA, 16 nt, Homo sapiens
auggaguauaugucaa

SEQ ID NO: 540946 - RNA, 20 nt, Homo sapiens
auggagucucccacugcaac

SEQ ID NO: 540947 - RNA, 16 nt, Homo sapiens
auggagugcaccaaag

SEQ ID NO: 540948 - RNA, 16 nt, Homo sapiens
auggaguggcugccau

SEQ ID NO: 540949 - RNA, 19 nt, Homo sapiens
auggaguggcugccaugga

SEQ ID NO: 540950 - RNA, 11 nt, Homo sapiens
auggaucacaa

SEQ ID NO: 540951 - RNA, 12 nt, Homo sapiens
auggaucagauc

SEQ ID NO: 540952 - RNA, 17 nt, Homo sapiens
auggaucuuaaagcauu

SEQ ID NO: 540953 - RNA, 9 nt, Homo sapiens
auggaugaa

SEQ ID NO: 540954 - RNA, 12 nt, Homo sapiens
auggaugggaug

SEQ ID NO: 540955 - RNA, 14 nt, Homo sapiens
auggauucuauuua

SEQ ID NO: 540956 - RNA, 19 nt, Homo sapiens
auggauuugaaguuugcca

SEQ ID NO: 540957 - RNA, 17 nt, Homo sapiens
auggcaaagaauucaaa

SEQ ID NO: 540958 - RNA, 20 nt, Homo sapiens
auggcaaaggaagguggaug

SEQ ID NO: 540959 - RNA, 13 nt, Homo sapiens
auggcaaggcagc

SEQ ID NO: 540960 - RNA, 21 nt, Homo sapiens
auggcaauugcacucaugugg

SEQ ID NO: 540961 - RNA, 17 nt, Homo sapiens
auggcaauuucacugau

SEQ ID NO: 540962 - RNA, 17 nt, Homo sapiens
auggcacucaggaaagu

SEQ ID NO: 540963 - RNA, 11 nt, Homo sapiens
auggcacuggc

SEQ ID NO: 540964 - RNA, 21 nt, Homo sapiens
auggcagaagggaauugcuca

SEQ ID NO: 540965 - RNA, 15 nt, Homo sapiens
auggcagcagugaag

SEQ ID NO: 540966 - RNA, 20 nt, Homo sapiens
auggcagcuguuucucauga

SEQ ID NO: 540967 - RNA, 15 nt, Homo sapiens
auggcaggauccaag

SEQ ID NO: 540968 - RNA, 19 nt, Homo sapiens
auggcagggccucaucuca

SEQ ID NO: 540969 - RNA, 18 nt, Homo sapiens
auggcaggugucauauga

SEQ ID NO: 540970 - RNA, 18 nt, Homo sapiens
auggcauaaccugucuca

SEQ ID NO: 540971 - RNA, 21 nt, Homo sapiens
auggcauaggccuuagcagua

SEQ ID NO: 540972 - RNA, 15 nt, Homo sapiens
auggcauccugugaa

SEQ ID NO: 540973 - RNA, 21 nt, Homo sapiens
auggcaugcgccaccaugccc

SEQ ID NO: 540974 - RNA, 23 nt, Homo sapiens
auggcauugaacugguucaugaa

SEQ ID NO: 540975 - RNA, 19 nt, Homo sapiens
auggcauuuggucucaggc

SEQ ID NO: 540976 - RNA, 23 nt, Homo sapiens
auggcauuuggucucaggcagca

SEQ ID NO: 540977 - RNA, 18 nt, Homo sapiens
auggccaacucaacuuuc

SEQ ID NO: 540978 - RNA, 17 nt, Homo sapiens
auggccaauaacuuuuc

SEQ ID NO: 540979 - RNA, 13 nt, Homo sapiens
auggccacuacuu

SEQ ID NO: 540980 - RNA, 19 nt, Homo sapiens
auggccagagccucuggcc

SEQ ID NO: 540981 - RNA, 18 nt, Homo sapiens
auggccagugugauccca

SEQ ID NO: 540982 - RNA, 16 nt, Homo sapiens
auggcccgacauuucu

SEQ ID NO: 540983 - RNA, 17 nt, Homo sapiens
auggccucauguggcug

SEQ ID NO: 540984 - RNA, 22 nt, Homo sapiens
auggccuggggaagcugugaaa

SEQ ID NO: 540985 - RNA, 16 nt, Homo sapiens
auggccuuugcuuaug

SEQ ID NO: 540986 - RNA, 15 nt, Homo sapiens
auggcgaaaccucau

SEQ ID NO: 540987 - RNA, 18 nt, Homo sapiens
auggcgaggccucucuca

SEQ ID NO: 540988 - RNA, 16 nt, Homo sapiens
auggcgauguguuaua

SEQ ID NO: 540989 - RNA, 15 nt, Homo sapiens
auggcuaaauacaau

SEQ ID NO: 540990 - RNA, 16 nt, Homo sapiens
auggcuaacugaugaa

SEQ ID NO: 540991 - RNA, 16 nt, Homo sapiens
auggcuacuaagcaca

SEQ ID NO: 540992 - RNA, 17 nt, Homo sapiens
auggcucuggcacagug

SEQ ID NO: 540993 - RNA, 19 nt, Homo sapiens
auggcugaacaucagggug

SEQ ID NO: 540994 - RNA, 19 nt, Homo sapiens
auggcugcccaggagacag

SEQ ID NO: 540995 - RNA, 19 nt, Homo sapiens
auggcuuaggaaugacuua

SEQ ID NO: 540996 - RNA, 14 nt, Homo sapiens
auggcuuauucaca

SEQ ID NO: 540997 - RNA, 19 nt, Homo sapiens
auggcuuuagcuaccucac

SEQ ID NO: 540998 - RNA, 15 nt, Homo sapiens
auggcuuuaugcuag

SEQ ID NO: 540999 - RNA, 14 nt, Homo sapiens
auggcuuucacuuu

SEQ ID NO: 541000 - RNA, 15 nt, Homo sapiens
auggcuuugugauuc

SEQ ID NO: 541001 - RNA, 15 nt, Homo sapiens
auggcuuuugugcau

SEQ ID NO: 541002 - RNA, 17 nt, Homo sapiens
augggaaaccaguucau

SEQ ID NO: 541003 - RNA, 18 nt, Homo sapiens
augggaaggggaggaccc

SEQ ID NO: 541004 - RNA, 13 nt, Homo sapiens
augggacaucaaa

SEQ ID NO: 541005 - RNA, 14 nt, Homo sapiens
augggaccagggau

SEQ ID NO: 541006 - RNA, 23 nt, Homo sapiens
augggagggggcuugaagccaaa

SEQ ID NO: 541007 - RNA, 19 nt, Homo sapiens
augggagugggcaccucag

SEQ ID NO: 541008 - RNA, 12 nt, Homo sapiens
augggaugaaug

SEQ ID NO: 541009 - RNA, 13 nt, Homo sapiens
augggaugaaugg

SEQ ID NO: 541010 - RNA, 17 nt, Homo sapiens
augggauucagugcuuc

SEQ ID NO: 541011 - RNA, 20 nt, Homo sapiens
augggcaaauuaaggcauaa

SEQ ID NO: 541012 - RNA, 16 nt, Homo sapiens
augggcagaaaaaugg

SEQ ID NO: 541013 - RNA, 19 nt, Homo sapiens
augggcagagcccaaggga

SEQ ID NO: 541014 - RNA, 20 nt, Homo sapiens
augggcgcaggcccagugac

SEQ ID NO: 541015 - RNA, 17 nt, Homo sapiens
augggcuaucaacuuaa

SEQ ID NO: 541016 - RNA, 18 nt, Homo sapiens
augggcucaagucacuuu

SEQ ID NO: 541017 - RNA, 15 nt, Homo sapiens
augggcucuaccucu

SEQ ID NO: 541018 - RNA, 20 nt, Homo sapiens
augggcucuccggggccauu

SEQ ID NO: 541019 - RNA, 14 nt, Homo sapiens
augggcucuuccaa

SEQ ID NO: 541020 - RNA, 22 nt, Homo sapiens
auggggaagguuaucagugcuu

SEQ ID NO: 541021 - RNA, 16 nt, Homo sapiens
auggggacgguguaug

SEQ ID NO: 541022 - RNA, 13 nt, Homo sapiens
auggggaggacaa

SEQ ID NO: 541023 - RNA, 23 nt, Homo sapiens
auggggauaaaggagaaggcaug

SEQ ID NO: 541024 - RNA, 14 nt, Homo sapiens
auggggauggcugg

SEQ ID NO: 541025 - RNA, 18 nt, Homo sapiens
auggggccagucaggccc

SEQ ID NO: 541026 - RNA, 14 nt, Homo sapiens
augggguccagaga

SEQ ID NO: 541027 - RNA, 14 nt, Homo sapiens
auggggugggccca

SEQ ID NO: 541028 - RNA, 18 nt, Homo sapiens
auggggugucuguguuau

SEQ ID NO: 541029 - RNA, 18 nt, Homo sapiens
auggguccacugcaccag

SEQ ID NO: 541030 - RNA, 17 nt, Homo sapiens
augggucuaggacacag

SEQ ID NO: 541031 - RNA, 22 nt, Homo sapiens
augggucuggcugagcugaacc

SEQ ID NO: 541032 - RNA, 15 nt, Homo sapiens
augggugcagacccu

SEQ ID NO: 541033 - RNA, 22 nt, Homo sapiens
augggugggaguaaaagcaaca

SEQ ID NO: 541034 - RNA, 23 nt, Homo sapiens
auggguuucauauuucuuaucac

SEQ ID NO: 541035 - RNA, 17 nt, Homo sapiens
augguaaguugagaugu

SEQ ID NO: 541036 - RNA, 15 nt, Homo sapiens
augguacucuaauca

SEQ ID NO: 541037 - RNA, 13 nt, Homo sapiens
augguagcauuuu

SEQ ID NO: 541038 - RNA, 14 nt, Homo sapiens
augguagucacuaa

SEQ ID NO: 541039 - RNA, 20 nt, Homo sapiens
augguauaaacaggagacag

SEQ ID NO: 541040 - RNA, 14 nt, Homo sapiens
augguaucaaugga

SEQ ID NO: 541041 - RNA, 21 nt, Homo sapiens
auggucacacaccagcacuuu

SEQ ID NO: 541042 - RNA, 17 nt, Homo sapiens
acuuuacuguaauauaa

SEQ ID NO: 541043 - RNA, 16 nt, Homo sapiens
acuuuagguagaugaa

SEQ ID NO: 541044 - RNA, 14 nt, Homo sapiens
acuuuagguucaca

SEQ ID NO: 541045 - RNA, 18 nt, Homo sapiens
acuuuaguagacauuuau

SEQ ID NO: 541046 - RNA, 11 nt, Homo sapiens
acuuuagucuc

SEQ ID NO: 541047 - RNA, 15 nt, Homo sapiens
acuuuauagcucuaa

SEQ ID NO: 541048 - RNA, 14 nt, Homo sapiens
acuuuauaguuguu

SEQ ID NO: 541049 - RNA, 20 nt, Homo sapiens
acuuuauauaaggcauucca

SEQ ID NO: 541050 - RNA, 17 nt, Homo sapiens
acuuuaucuauaucuca

SEQ ID NO: 541051 - RNA, 22 nt, Homo sapiens
acuuuaucuauaucucauuuca

SEQ ID NO: 541052 - RNA, 22 nt, Homo sapiens
acuuuauguaguuuuuauaugu

SEQ ID NO: 541053 - RNA, 20 nt, Homo sapiens
acuuuauuguacagacuguu

SEQ ID NO: 541054 - RNA, 13 nt, Homo sapiens
acuuucaaacaua

SEQ ID NO: 541055 - RNA, 16 nt, Homo sapiens
acuuucaauugucacu

SEQ ID NO: 541056 - RNA, 18 nt, Homo sapiens
acuuucagguacuaaaua

SEQ ID NO: 541057 - RNA, 20 nt, Homo sapiens
acuuucagguacuaaauacc

SEQ ID NO: 541058 - RNA, 12 nt, Homo sapiens
acuuuccacuuc

SEQ ID NO: 541059 - RNA, 14 nt, Homo sapiens
acuuuccauuaaau

SEQ ID NO: 541060 - RNA, 15 nt, Homo sapiens
acuuucccucaucca

SEQ ID NO: 541061 - RNA, 17 nt, Homo sapiens
acuuuccucgccugaca

SEQ ID NO: 541062 - RNA, 21 nt, Homo sapiens
acuuucgaccgacuuucccca

SEQ ID NO: 541063 - RNA, 14 nt, Homo sapiens
acuuucuaaaucaa

SEQ ID NO: 541064 - RNA, 22 nt, Homo sapiens
acuuucuaaguaggaugaauca

SEQ ID NO: 541065 - RNA, 19 nt, Homo sapiens
acuuucucuucauacuuuu

SEQ ID NO: 541066 - RNA, 17 nt, Homo sapiens
acuuucugucuagguua

SEQ ID NO: 541067 - RNA, 20 nt, Homo sapiens
acuuucugucuagguuaaag

SEQ ID NO: 541068 - RNA, 20 nt, Homo sapiens
acuuucugugacgcagacag

SEQ ID NO: 541069 - RNA, 23 nt, Homo sapiens
acuuucuguguugaagcacuguu

SEQ ID NO: 541070 - RNA, 14 nt, Homo sapiens
acuuucuguuacua

SEQ ID NO: 541071 - RNA, 18 nt, Homo sapiens
acuuucuuaucacuuaua

SEQ ID NO: 541072 - RNA, 22 nt, Homo sapiens
acuuucuucaccaagugcaaua

SEQ ID NO: 541073 - RNA, 22 nt, Homo sapiens
acuuucuucuagcugagcuuua

SEQ ID NO: 541074 - RNA, 18 nt, Homo sapiens
acuuucuucucuuuccca

SEQ ID NO: 541075 - RNA, 15 nt, Homo sapiens
acuuucuucugaaua

SEQ ID NO: 541076 - RNA, 20 nt, Homo sapiens
acuuugaaaguuaacucuuc

SEQ ID NO: 541077 - RNA, 23 nt, Homo sapiens
acuuugaaaguuaacucuucaaa

SEQ ID NO: 541078 - RNA, 14 nt, Homo sapiens
acuuugaaccauaa

SEQ ID NO: 541079 - RNA, 15 nt, Homo sapiens
acuuugaaccauaaa

SEQ ID NO: 541080 - RNA, 23 nt, Homo sapiens
acuuugagcugagugcugaaaua

SEQ ID NO: 541081 - RNA, 18 nt, Homo sapiens
acuuugaguuagugccau

SEQ ID NO: 541082 - RNA, 18 nt, Homo sapiens
acuuugauaucugaucaa

SEQ ID NO: 541083 - RNA, 19 nt, Homo sapiens
acuuugauugaaguauuca

SEQ ID NO: 541084 - RNA, 15 nt, Homo sapiens
acuuugcagcuaaaa

SEQ ID NO: 541085 - RNA, 14 nt, Homo sapiens
acuuugcaucucag

SEQ ID NO: 541086 - RNA, 22 nt, Homo sapiens
acuuugcugucaaaacuacuga

SEQ ID NO: 541087 - RNA, 18 nt, Homo sapiens
acuuuggaaaacuacuuu

SEQ ID NO: 541088 - RNA, 23 nt, Homo sapiens
acuuuggaaccagacucuugccu

SEQ ID NO: 541089 - RNA, 22 nt, Homo sapiens
acuuuggaauguacucuguuca

SEQ ID NO: 541090 - RNA, 20 nt, Homo sapiens
acuuuggaggcaaaaugugu

SEQ ID NO: 541091 - RNA, 11 nt, Homo sapiens
acuuugggacg

SEQ ID NO: 541092 - RNA, 19 nt, Homo sapiens
acuuugggcuuaguauuuc

SEQ ID NO: 541093 - RNA, 17 nt, Homo sapiens
acuuugguacauggcca

SEQ ID NO: 541094 - RNA, 16 nt, Homo sapiens
acuuuguaucaaucca

SEQ ID NO: 541095 - RNA, 19 nt, Homo sapiens
acuuuguauuaauguguua

SEQ ID NO: 541096 - RNA, 22 nt, Homo sapiens
acuuugucaugguuuccauuua

SEQ ID NO: 541097 - RNA, 12 nt, Homo sapiens
acuuugugaaaa

SEQ ID NO: 541098 - RNA, 13 nt, Homo sapiens
acuuugugcuuuc

SEQ ID NO: 541099 - RNA, 23 nt, Homo sapiens
acuuuguuuucaagaugguguua

SEQ ID NO: 541100 - RNA, 15 nt, Homo sapiens
acuuuuaaaaugccc

SEQ ID NO: 541101 - RNA, 15 nt, Homo sapiens
acuuuuaaugaacuu

SEQ ID NO: 541102 - RNA, 13 nt, Homo sapiens
acuuuuaauguca

SEQ ID NO: 541103 - RNA, 22 nt, Homo sapiens
acuuuuacacgaccauuugaua

SEQ ID NO: 541104 - RNA, 15 nt, Homo sapiens
acuuuuauaaauuaa

SEQ ID NO: 541105 - RNA, 14 nt, Homo sapiens
acuuuucacacugu

SEQ ID NO: 541106 - RNA, 15 nt, Homo sapiens
acuuuucgacauauu

SEQ ID NO: 541107 - RNA, 18 nt, Homo sapiens
acuuuucggucuuuccca

SEQ ID NO: 541108 - RNA, 17 nt, Homo sapiens
acuuuucugguuccaaa

SEQ ID NO: 541109 - RNA, 16 nt, Homo sapiens
acuuuucuuuuuccca

SEQ ID NO: 541110 - RNA, 18 nt, Homo sapiens
acuuuugaggacgcuggg

SEQ ID NO: 541111 - RNA, 16 nt, Homo sapiens
acuuuuguaccaaaua

SEQ ID NO: 541112 - RNA, 18 nt, Homo sapiens
acuuuuuacagugcuauu

SEQ ID NO: 541113 - RNA, 22 nt, Homo sapiens
acuuuuucagaguugcuuuaaa

SEQ ID NO: 541114 - RNA, 17 nt, Homo sapiens
acuuuuucuuguauuca

SEQ ID NO: 541115 - RNA, 21 nt, Homo sapiens
acuuuuucuuguauucaugaa

SEQ ID NO: 541116 - RNA, 15 nt, Homo sapiens
acuuuuugcauuuaa

SEQ ID NO: 541117 - RNA, 17 nt, Homo sapiens
acuuuuuuacacugaua

SEQ ID NO: 541118 - RNA, 22 nt, Homo sapiens
acuuuuuucuuauuuaacuuaa

SEQ ID NO: 541119 - RNA, 22 nt, Homo sapiens
acuuuuuuucugugacauuuau

SEQ ID NO: 541120 - RNA, 22 nt, Homo sapiens
auugaauuuuuaagcuacuuau

SEQ ID NO: 541121 - RNA, 16 nt, Homo sapiens
auugacaacugcacau

SEQ ID NO: 541122 - RNA, 20 nt, Homo sapiens
auugacaacugcacaugaaa

SEQ ID NO: 541123 - RNA, 22 nt, Homo sapiens
auugacacagaaaauguugaga

SEQ ID NO: 541124 - RNA, 12 nt, Homo sapiens
auugaccaaaua

SEQ ID NO: 541125 - RNA, 18 nt, Homo sapiens
auugaccaauuccugaca

SEQ ID NO: 541126 - RNA, 15 nt, Homo sapiens
auugaccuuuaggua

SEQ ID NO: 541127 - RNA, 20 nt, Homo sapiens
auugacuuaauaaagcuuuu

SEQ ID NO: 541128 - RNA, 21 nt, Homo sapiens
auugacuuuuuuugagcgaca

SEQ ID NO: 541129 - RNA, 12 nt, Homo sapiens
auugagauacua

SEQ ID NO: 541130 - RNA, 18 nt, Homo sapiens
auugagcagaagaucaag

SEQ ID NO: 541131 - RNA, 21 nt, Homo sapiens
auugagcagaagaucaaggag

SEQ ID NO: 541132 - RNA, 16 nt, Homo sapiens
auugagccaguggugc

SEQ ID NO: 541133 - RNA, 22 nt, Homo sapiens
auugagccuugcauguacuuga

SEQ ID NO: 541134 - RNA, 23 nt, Homo sapiens
auugagccuugcauguacuugaa

SEQ ID NO: 541135 - RNA, 19 nt, Homo sapiens
auugaggagcugcacugau

SEQ ID NO: 541136 - RNA, 18 nt, Homo sapiens
auugaggaguugccugac

SEQ ID NO: 541137 - RNA, 15 nt, Homo sapiens
auugaggcccugcug

SEQ ID NO: 541138 - RNA, 12 nt, Homo sapiens
auugagguucuc

SEQ ID NO: 541139 - RNA, 22 nt, Homo sapiens
auugaguaucacuuuaacucag

SEQ ID NO: 541140 - RNA, 17 nt, Homo sapiens
auugauagaacuacuuu

SEQ ID NO: 541141 - RNA, 18 nt, Homo sapiens
auugauagaguguuauca

SEQ ID NO: 541142 - RNA, 23 nt, Homo sapiens
auugauagcagauaucacgacag

SEQ ID NO: 541143 - RNA, 18 nt, Homo sapiens
auugauagucaauaucaa

SEQ ID NO: 541144 - RNA, 15 nt, Homo sapiens
auugauauaauuucc

SEQ ID NO: 541145 - RNA, 18 nt, Homo sapiens
auugauauugaaugaugu

SEQ ID NO: 541146 - RNA, 20 nt, Homo sapiens
auugauauugaaugauguga

SEQ ID NO: 541147 - RNA, 14 nt, Homo sapiens
auugauuaccaagu

SEQ ID NO: 541148 - RNA, 15 nt, Homo sapiens
auugauuacuaucau

SEQ ID NO: 541149 - RNA, 19 nt, Homo sapiens
auugauuauaagcauguau

SEQ ID NO: 541150 - RNA, 22 nt, Homo sapiens
auugauuguauuguugaaaaag

SEQ ID NO: 541151 - RNA, 11 nt, Homo sapiens
auugauuucaa

SEQ ID NO: 541152 - RNA, 16 nt, Homo sapiens
auugauuucugacucu

SEQ ID NO: 541153 - RNA, 15 nt, Homo sapiens
auugauuucuucuca

SEQ ID NO: 541154 - RNA, 17 nt, Homo sapiens
auugauuuuuacuucaa

SEQ ID NO: 541155 - RNA, 18 nt, Homo sapiens
auugcaaagauguuuaca

SEQ ID NO: 541156 - RNA, 18 nt, Homo sapiens
auugcaaauaaaccacuu

SEQ ID NO: 541157 - RNA, 13 nt, Homo sapiens
auugcaauaacug

SEQ ID NO: 541158 - RNA, 16 nt, Homo sapiens
auugcacaccuuggaa

SEQ ID NO: 541159 - RNA, 22 nt, Homo sapiens
auugcacuaggaauucuuugca

SEQ ID NO: 541160 - RNA, 15 nt, Homo sapiens
auugcacugcuguuc

SEQ ID NO: 541161 - RNA, 16 nt, Homo sapiens
auugcagcagguggua

SEQ ID NO: 541162 - RNA, 18 nt, Homo sapiens
auugcagcuugaaaaaga

SEQ ID NO: 541163 - RNA, 23 nt, Homo sapiens
agaaaauuguugcaaacuaugca

SEQ ID NO: 541164 - RNA, 17 nt, Homo sapiens
agaaacaaagauguuau

SEQ ID NO: 541165 - RNA, 16 nt, Homo sapiens
agaaacaagcugugca

SEQ ID NO: 541166 - RNA, 23 nt, Homo sapiens
agaaacaccccucugucuaggac

SEQ ID NO: 541167 - RNA, 20 nt, Homo sapiens
agaaacacuaaagcauucaa

SEQ ID NO: 541168 - RNA, 13 nt, Homo sapiens
agaaacacuuucu

SEQ ID NO: 541169 - RNA, 14 nt, Homo sapiens
agaaacauuucaga

SEQ ID NO: 541170 - RNA, 23 nt, Homo sapiens
agaaaccaaggccccgagcucag

SEQ ID NO: 541171 - RNA, 13 nt, Homo sapiens
agaaaccaugaca

SEQ ID NO: 541172 - RNA, 19 nt, Homo sapiens
agaaacccggcuuccugug

SEQ ID NO: 541173 - RNA, 23 nt, Homo sapiens
agaaacccggcuuccugugcuaa

SEQ ID NO: 541174 - RNA, 23 nt, Homo sapiens
agaaacccuugcugcuuuagucc

SEQ ID NO: 541175 - RNA, 15 nt, Homo sapiens
agaaaccuaaaauaa

SEQ ID NO: 541176 - RNA, 13 nt, Homo sapiens
agaaaccucggga

SEQ ID NO: 541177 - RNA, 20 nt, Homo sapiens
agaaaccuggggugaauacu

SEQ ID NO: 541178 - RNA, 13 nt, Homo sapiens
agaaacucaccau

SEQ ID NO: 541179 - RNA, 21 nt, Homo sapiens
agaaacuuucuggugcugucu

SEQ ID NO: 541180 - RNA, 18 nt, Homo sapiens
agaaagaaacauaggcau

SEQ ID NO: 541181 - RNA, 14 nt, Homo sapiens
agaaagaaugcauu

SEQ ID NO: 541182 - RNA, 22 nt, Homo sapiens
agaaagaaugcauuccagaaca

SEQ ID NO: 541183 - RNA, 16 nt, Homo sapiens
agaaagaccacuggca

SEQ ID NO: 541184 - RNA, 15 nt, Homo sapiens
agaaagacuaucuaa

SEQ ID NO: 541185 - RNA, 16 nt, Homo sapiens
agaaagagaaugaacu

SEQ ID NO: 541186 - RNA, 15 nt, Homo sapiens
agaaagagucaggcc

SEQ ID NO: 541187 - RNA, 18 nt, Homo sapiens
agaaagauguuccaguga

SEQ ID NO: 541188 - RNA, 21 nt, Homo sapiens
agaaagauguuccagugagga

SEQ ID NO: 541189 - RNA, 20 nt, Homo sapiens
agaaagccaacauguggcuc

SEQ ID NO: 541190 - RNA, 14 nt, Homo sapiens
agaaagccauauuc

SEQ ID NO: 541191 - RNA, 19 nt, Homo sapiens
agaaagccucucucucccu

SEQ ID NO: 541192 - RNA, 15 nt, Homo sapiens
agaaagccuucauaa

SEQ ID NO: 541193 - RNA, 19 nt, Homo sapiens
agaaagcuccuuccagacc

SEQ ID NO: 541194 - RNA, 19 nt, Homo sapiens
agaaaggaacugcaauaau

SEQ ID NO: 541195 - RNA, 22 nt, Homo sapiens
agaaaggagaacuauccaaaac

SEQ ID NO: 541196 - RNA, 18 nt, Homo sapiens
agaaaggugugcugguca

SEQ ID NO: 541197 - RNA, 16 nt, Homo sapiens
agaaaguaagcauuuc

SEQ ID NO: 541198 - RNA, 19 nt, Homo sapiens
agaaagugauaagugcagg

SEQ ID NO: 541199 - RNA, 19 nt, Homo sapiens
agaaagugcgaguccucca

SEQ ID NO: 541200 - RNA, 19 nt, Homo sapiens
agaaauaaaaauaccucuu

SEQ ID NO: 541201 - RNA, 23 nt, Homo sapiens
agaaauaaauguaccugauguac

SEQ ID NO: 541202 - RNA, 15 nt, Homo sapiens
agaaauaauaugcau

SEQ ID NO: 541203 - RNA, 23 nt, Homo sapiens
agaaauacaauucuacauuguca

SEQ ID NO: 541204 - RNA, 21 nt, Homo sapiens
agaaauacaauuuuagauauc

SEQ ID NO: 541205 - RNA, 18 nt, Homo sapiens
agaaauaccugucuagga

SEQ ID NO: 541206 - RNA, 13 nt, Homo sapiens
agaaauacuuuca

SEQ ID NO: 541207 - RNA, 17 nt, Homo sapiens
agaaauagacaguauau

SEQ ID NO: 541208 - RNA, 15 nt, Homo sapiens
agaaauaucuuucuc

SEQ ID NO: 541209 - RNA, 18 nt, Homo sapiens
agaaauauggacacuuaa

SEQ ID NO: 541210 - RNA, 17 nt, Homo sapiens
agaaaucauaguuuaaa

SEQ ID NO: 541211 - RNA, 18 nt, Homo sapiens
agaaauccuaguaugcca

SEQ ID NO: 541212 - RNA, 17 nt, Homo sapiens
agaaauccugcaaugaa

SEQ ID NO: 541213 - RNA, 18 nt, Homo sapiens
agaaaucguagacaagca

SEQ ID NO: 541214 - RNA, 18 nt, Homo sapiens
agaaaucuagaagacugu

SEQ ID NO: 541215 - RNA, 19 nt, Homo sapiens
agaaaucuagaagacuguc

SEQ ID NO: 541216 - RNA, 12 nt, Homo sapiens
agaaaucugcca

SEQ ID NO: 541217 - RNA, 16 nt, Homo sapiens
agaaaucuggucuugu

SEQ ID NO: 541218 - RNA, 22 nt, Homo sapiens
agaaaucuuguuggcaaaucag

SEQ ID NO: 541219 - RNA, 14 nt, Homo sapiens
agaaaugacuuuga

SEQ ID NO: 541220 - RNA, 17 nt, Homo sapiens
agaaaugaggagacaca

SEQ ID NO: 541221 - RNA, 18 nt, Homo sapiens
agaaaugaugauguggaa

SEQ ID NO: 541222 - RNA, 19 nt, Homo sapiens
agaaaugauggaaguucau

SEQ ID NO: 541223 - RNA, 22 nt, Homo sapiens
agaaaugcaauaacucugggag

SEQ ID NO: 541224 - RNA, 13 nt, Homo sapiens
agaaaugccccca

SEQ ID NO: 541225 - RNA, 17 nt, Homo sapiens
agaaauggcgaauguca

SEQ ID NO: 541226 - RNA, 16 nt, Homo sapiens
agaaaugggccugccu

SEQ ID NO: 541227 - RNA, 14 nt, Homo sapiens
agaaauguguuauc

SEQ ID NO: 541228 - RNA, 14 nt, Homo sapiens
agaaauuaguuuca

SEQ ID NO: 541229 - RNA, 23 nt, Homo sapiens
agaaauuaguuucaaauuuaccu

SEQ ID NO: 541230 - RNA, 15 nt, Homo sapiens
agaaauuauaaacaa

SEQ ID NO: 541231 - RNA, 22 nt, Homo sapiens
agaaauuccuguagcaucuucu

SEQ ID NO: 541232 - RNA, 22 nt, Homo sapiens
agaaauugcauuuccugacaga

SEQ ID NO: 541233 - RNA, 22 nt, Homo sapiens
agaaauugugggauaaucugua

SEQ ID NO: 541234 - RNA, 21 nt, Homo sapiens
agaaauuugcaacucacugau

SEQ ID NO: 541235 - RNA, 23 nt, Homo sapiens
agaaauuugguuucaaguguaca

SEQ ID NO: 541236 - RNA, 15 nt, Homo sapiens
agaacaaacucugaa

SEQ ID NO: 541237 - RNA, 15 nt, Homo sapiens
agaacaacuaccuga

SEQ ID NO: 541238 - RNA, 16 nt, Homo sapiens
agaacaacuacuguga

SEQ ID NO: 541239 - RNA, 19 nt, Homo sapiens
agaacacacacauauacac

SEQ ID NO: 541240 - RNA, 19 nt, Homo sapiens
agaacaccgagcacugaac

SEQ ID NO: 541241 - RNA, 18 nt, Homo sapiens
agaacaccuccagcuuuu

SEQ ID NO: 541242 - RNA, 17 nt, Homo sapiens
agaacacguuggcucag

SEQ ID NO: 541243 - RNA, 15 nt, Homo sapiens
auugugcaguacuuu

SEQ ID NO: 541244 - RNA, 17 nt, Homo sapiens
auugugcaguacuuugu

SEQ ID NO: 541245 - RNA, 14 nt, Homo sapiens
auugugccaagccu

SEQ ID NO: 541246 - RNA, 23 nt, Homo sapiens
auugugccgagaaaagcauuuua

SEQ ID NO: 541247 - RNA, 23 nt, Homo sapiens
auuguggauuauaaaaaauguaa

SEQ ID NO: 541248 - RNA, 16 nt, Homo sapiens
auuguuaaccacagcu

SEQ ID NO: 541249 - RNA, 16 nt, Homo sapiens
auuguuaucuaucaac

SEQ ID NO: 541250 - RNA, 21 nt, Homo sapiens
auuguucuuuuuuaagacuca

SEQ ID NO: 541251 - RNA, 20 nt, Homo sapiens
auuguugaaagguaauuuga

SEQ ID NO: 541252 - RNA, 18 nt, Homo sapiens
auuguugcaaacuaugca

SEQ ID NO: 541253 - RNA, 16 nt, Homo sapiens
auuguugucaggccau

SEQ ID NO: 541254 - RNA, 12 nt, Homo sapiens
auuguuguguag

SEQ ID NO: 541255 - RNA, 13 nt, Homo sapiens
auuguuguuacuu

SEQ ID NO: 541256 - RNA, 22 nt, Homo sapiens
auuguuuauguguuaugaacau

SEQ ID NO: 541257 - RNA, 19 nt, Homo sapiens
auuguuucauucauccuga

SEQ ID NO: 541258 - RNA, 17 nt, Homo sapiens
auuguuuccugagcaua

SEQ ID NO: 541259 - RNA, 16 nt, Homo sapiens
auuguuugaaacaaag

SEQ ID NO: 541260 - RNA, 17 nt, Homo sapiens
auuguuuucaguguaca

SEQ ID NO: 541261 - RNA, 18 nt, Homo sapiens
auuuaaaaaaaaagucag

SEQ ID NO: 541262 - RNA, 18 nt, Homo sapiens
auuuaaaaaaagaacaua

SEQ ID NO: 541263 - RNA, 16 nt, Homo sapiens
auuuaaaaagugcuau

SEQ ID NO: 541264 - RNA, 13 nt, Homo sapiens
auuuaaaauggaa

SEQ ID NO: 541265 - RNA, 15 nt, Homo sapiens
auuuaaaauucaauu

SEQ ID NO: 541266 - RNA, 16 nt, Homo sapiens
auuuaaacaccuccuc

SEQ ID NO: 541267 - RNA, 17 nt, Homo sapiens
auuuaaagaaagaaugc

SEQ ID NO: 541268 - RNA, 19 nt, Homo sapiens
auuuaaagaaagaaugcau

SEQ ID NO: 541269 - RNA, 19 nt, Homo sapiens
auuuaaagcuuacucuguc

SEQ ID NO: 541270 - RNA, 19 nt, Homo sapiens
auuuaaagggaaaacccuc

SEQ ID NO: 541271 - RNA, 20 nt, Homo sapiens
auuuaaauaaaguuacuuga

SEQ ID NO: 541272 - RNA, 23 nt, Homo sapiens
auuuaaauguguacaauguacac

SEQ ID NO: 541273 - RNA, 15 nt, Homo sapiens
auuuaaauuccacag

SEQ ID NO: 541274 - RNA, 20 nt, Homo sapiens
auuuaaauuuuuuuccuuac

SEQ ID NO: 541275 - RNA, 19 nt, Homo sapiens
auuuaacaccccacaggca

SEQ ID NO: 541276 - RNA, 19 nt, Homo sapiens
auuuaacagggucucuagu

SEQ ID NO: 541277 - RNA, 20 nt, Homo sapiens
auuuaacauuaucuaguuca

SEQ ID NO: 541278 - RNA, 21 nt, Homo sapiens
auuuaaccccuugguacugaa

SEQ ID NO: 541279 - RNA, 21 nt, Homo sapiens
auuuaaccuguaaaaugucaa

SEQ ID NO: 541280 - RNA, 22 nt, Homo sapiens
auuuaacugauuaaaaauaccu

SEQ ID NO: 541281 - RNA, 22 nt, Homo sapiens
auuuaagaaaaguguuuucaca

SEQ ID NO: 541282 - RNA, 13 nt, Homo sapiens
auuuaagauauau

SEQ ID NO: 541283 - RNA, 15 nt, Homo sapiens
auuuaaggcaaaaaa

SEQ ID NO: 541284 - RNA, 21 nt, Homo sapiens
auuuccugacagaaggacuca

SEQ ID NO: 541285 - RNA, 17 nt, Homo sapiens
auuuccuguguuugucc

SEQ ID NO: 541286 - RNA, 23 nt, Homo sapiens
auuuccuuaaacuguguggacug

SEQ ID NO: 541287 - RNA, 21 nt, Homo sapiens
auuuccuuacagaacuacuuc

SEQ ID NO: 541288 - RNA, 13 nt, Homo sapiens
auuuccuugccuu

SEQ ID NO: 541289 - RNA, 16 nt, Homo sapiens
auuucuaaaagucuga

SEQ ID NO: 541290 - RNA, 17 nt, Homo sapiens
auuucuaaaguaaaauu

SEQ ID NO: 541291 - RNA, 18 nt, Homo sapiens
auuucuaagaaguuacuu

SEQ ID NO: 541292 - RNA, 16 nt, Homo sapiens
auuucuaauggcccau

SEQ ID NO: 541293 - RNA, 14 nt, Homo sapiens
auuucuacugucaa

SEQ ID NO: 541294 - RNA, 16 nt, Homo sapiens
auuucuagaagcacau

SEQ ID NO: 541295 - RNA, 16 nt, Homo sapiens
auuucuagacaguauu

SEQ ID NO: 541296 - RNA, 21 nt, Homo sapiens
auuucuagacaguauugccac

SEQ ID NO: 541297 - RNA, 13 nt, Homo sapiens
auuucuagcagag

SEQ ID NO: 541298 - RNA, 15 nt, Homo sapiens
auuucuagguaggaa

SEQ ID NO: 541299 - RNA, 20 nt, Homo sapiens
auuucuaguaggcagcaaaa

SEQ ID NO: 541300 - RNA, 12 nt, Homo sapiens
auuucuauucaa

SEQ ID NO: 541301 - RNA, 15 nt, Homo sapiens
auuucuauuccuuau

SEQ ID NO: 541302 - RNA, 12 nt, Homo sapiens
auuucucaaaaa

SEQ ID NO: 541303 - RNA, 17 nt, Homo sapiens
auuucucaaaugcacau

SEQ ID NO: 541304 - RNA, 22 nt, Homo sapiens
auuucucacacucuaacuguau

SEQ ID NO: 541305 - RNA, 20 nt, Homo sapiens
auuucucacccuacucugga

SEQ ID NO: 541306 - RNA, 22 nt, Homo sapiens
auuucuccaaagaagauaugca

SEQ ID NO: 541307 - RNA, 14 nt, Homo sapiens
auuucuccaaagcc

SEQ ID NO: 541308 - RNA, 14 nt, Homo sapiens
auuucugacucuau

SEQ ID NO: 541309 - RNA, 17 nt, Homo sapiens
auuucugacucuaucau

SEQ ID NO: 541310 - RNA, 20 nt, Homo sapiens
auuucugagagugaaaccau

SEQ ID NO: 541311 - RNA, 23 nt, Homo sapiens
auuucugagagugaaaccaugac

SEQ ID NO: 541312 - RNA, 18 nt, Homo sapiens
auuucugaucuauacaaa

SEQ ID NO: 541313 - RNA, 18 nt, Homo sapiens
auuucugcuaaauaucac

SEQ ID NO: 541314 - RNA, 18 nt, Homo sapiens
auuucuggaaaacugccu

SEQ ID NO: 541315 - RNA, 21 nt, Homo sapiens
auuucugggucuuucugacau

SEQ ID NO: 541316 - RNA, 19 nt, Homo sapiens
auuucuguuccagucacau

SEQ ID NO: 541317 - RNA, 16 nt, Homo sapiens
auuucuuaaacacaaa

SEQ ID NO: 541318 - RNA, 15 nt, Homo sapiens
auuucuuaacuucuu

SEQ ID NO: 541319 - RNA, 19 nt, Homo sapiens
auuucuuaucaccacagua

SEQ ID NO: 541320 - RNA, 19 nt, Homo sapiens
auuucuuauuauuauaugu

SEQ ID NO: 541321 - RNA, 23 nt, Homo sapiens
auuucuucccgcacaaauuccac

SEQ ID NO: 541322 - RNA, 15 nt, Homo sapiens
auuucuucuacugcu

SEQ ID NO: 541323 - RNA, 13 nt, Homo sapiens
auuucuugauuaa

SEQ ID NO: 541324 - RNA, 16 nt, Homo sapiens
auuucuuggcauugga

SEQ ID NO: 541325 - RNA, 22 nt, Homo sapiens
auuucuuuucuggccaaaagca

SEQ ID NO: 541326 - RNA, 24 nt, Homo sapiens
auuugaaccagugauccauguccu

SEQ ID NO: 541327 - RNA, 15 nt, Homo sapiens
auuugaagaagaguu

SEQ ID NO: 541328 - RNA, 17 nt, Homo sapiens
auuugaagaagaguuuc

SEQ ID NO: 541329 - RNA, 19 nt, Homo sapiens
auuugaagaggagaacaaa

SEQ ID NO: 541330 - RNA, 11 nt, Homo sapiens
auuugacuuac

SEQ ID NO: 541331 - RNA, 17 nt, Homo sapiens
auuugagaguucacaga

SEQ ID NO: 541332 - RNA, 15 nt, Homo sapiens
auuugaucacuacaa

SEQ ID NO: 541333 - RNA, 16 nt, Homo sapiens
auuugaucacuacaag

SEQ ID NO: 541334 - RNA, 10 nt, Homo sapiens
auuugaugug

SEQ ID NO: 541335 - RNA, 22 nt, Homo sapiens
auuugauucgcccuccucccug

SEQ ID NO: 541336 - RNA, 15 nt, Homo sapiens
auuugcaacagcuac

SEQ ID NO: 541337 - RNA, 16 nt, Homo sapiens
auuugcaacucacuga

SEQ ID NO: 541338 - RNA, 17 nt, Homo sapiens
auuugcacgguuuguga

SEQ ID NO: 541339 - RNA, 11 nt, Homo sapiens
auuugcacuau

SEQ ID NO: 541340 - RNA, 20 nt, Homo sapiens
auuugcagaguccugcacag

SEQ ID NO: 541341 - RNA, 19 nt, Homo sapiens
auuugcauuauguauuuau

SEQ ID NO: 541342 - RNA, 17 nt, Homo sapiens
auuugcauugggcauua

SEQ ID NO: 541343 - RNA, 13 nt, Homo sapiens
auuugccaccacu

SEQ ID NO: 541344 - RNA, 15 nt, Homo sapiens
auuugccauagccuu

SEQ ID NO: 541345 - RNA, 17 nt, Homo sapiens
auuugccaugacauuuc

SEQ ID NO: 541346 - RNA, 22 nt, Homo sapiens
auuugccuugcagaacugccau

SEQ ID NO: 541347 - RNA, 15 nt, Homo sapiens
auuugcuagcaguaa

SEQ ID NO: 541348 - RNA, 13 nt, Homo sapiens
auuugcuauuuau

SEQ ID NO: 541349 - RNA, 11 nt, Homo sapiens
auuugcucagg

SEQ ID NO: 541350 - RNA, 16 nt, Homo sapiens
auuugcucauugcugu

SEQ ID NO: 541351 - RNA, 20 nt, Homo sapiens
auuugcucccaccacggggu

SEQ ID NO: 541352 - RNA, 18 nt, Homo sapiens
auuugcucuuucaucucu

SEQ ID NO: 541353 - RNA, 21 nt, Homo sapiens
auuugcuguguaagcucacau

SEQ ID NO: 541354 - RNA, 20 nt, Homo sapiens
auuugcuuuggaaguuuuaa

SEQ ID NO: 541355 - RNA, 15 nt, Homo sapiens
auuugcuuuuugcua

SEQ ID NO: 541356 - RNA, 15 nt, Homo sapiens
auuuggaaucuucuc

SEQ ID NO: 541357 - RNA, 19 nt, Homo sapiens
auuuggacuggugugcucu

SEQ ID NO: 541358 - RNA, 22 nt, Homo sapiens
auuuggacuggugugcucucuu

SEQ ID NO: 541359 - RNA, 18 nt, Homo sapiens
auuuggaggcuaccucac

SEQ ID NO: 541360 - RNA, 13 nt, Homo sapiens
auuuggcucacuu

SEQ ID NO: 541361 - RNA, 13 nt, Homo sapiens
auuuggcugcacu

SEQ ID NO: 541362 - RNA, 20 nt, Homo sapiens
auuugggagcugaaccaaag

SEQ ID NO: 541363 - RNA, 20 nt, Homo sapiens
auuugggagggaaaagggaa

SEQ ID NO: 541364 - RNA, 22 nt, Homo sapiens
auuugggauggaagcaggacag

SEQ ID NO: 541365 - RNA, 15 nt, Homo sapiens
auuugggauggagaa

SEQ ID NO: 541366 - RNA, 21 nt, Homo sapiens
auuugggggaacuggacacaa

SEQ ID NO: 541367 - RNA, 19 nt, Homo sapiens
agaauaaaagaugauuucu

SEQ ID NO: 541368 - RNA, 20 nt, Homo sapiens
agaauaaaagaugauuucuc

SEQ ID NO: 541369 - RNA, 17 nt, Homo sapiens
agaauaaaggcaguuuu

SEQ ID NO: 541370 - RNA, 14 nt, Homo sapiens
agaauaaauuccca

SEQ ID NO: 541371 - RNA, 22 nt, Homo sapiens
agaauaaauucccaacuucucu

SEQ ID NO: 541372 - RNA, 20 nt, Homo sapiens
agaauaaggcuuuuucuucc

SEQ ID NO: 541373 - RNA, 21 nt, Homo sapiens
agaauaauauugugucauaga

SEQ ID NO: 541374 - RNA, 19 nt, Homo sapiens
agaauaauggaaacauuac

SEQ ID NO: 541375 - RNA, 13 nt, Homo sapiens
agaauacuugacu

SEQ ID NO: 541376 - RNA, 22 nt, Homo sapiens
agaauacuugcacucuuuaaca

SEQ ID NO: 541377 - RNA, 15 nt, Homo sapiens
agaauagaacuauug

SEQ ID NO: 541378 - RNA, 20 nt, Homo sapiens
agaauagcuuuuacucuggu

SEQ ID NO: 541379 - RNA, 13 nt, Homo sapiens
agaauagucucac

SEQ ID NO: 541380 - RNA, 13 nt, Homo sapiens
agaauagugcauu

SEQ ID NO: 541381 - RNA, 17 nt, Homo sapiens
agaauauaauacuguau

SEQ ID NO: 541382 - RNA, 13 nt, Homo sapiens
agaauauaccuua

SEQ ID NO: 541383 - RNA, 15 nt, Homo sapiens
agaauauaggucucu

SEQ ID NO: 541384 - RNA, 16 nt, Homo sapiens
agaauaugaaguucua

SEQ ID NO: 541385 - RNA, 18 nt, Homo sapiens
agaauauguuaaugcaaa

SEQ ID NO: 541386 - RNA, 14 nt, Homo sapiens
agaauauuauuagu

SEQ ID NO: 541387 - RNA, 13 nt, Homo sapiens
agaaucaaaugca

SEQ ID NO: 541388 - RNA, 19 nt, Homo sapiens
agaaucacuuaagccugga

SEQ ID NO: 541389 - RNA, 17 nt, Homo sapiens
agaaucagaucauuuca

SEQ ID NO: 541390 - RNA, 20 nt, Homo sapiens
agaaucauacuuaacauuuc

SEQ ID NO: 541391 - RNA, 19 nt, Homo sapiens
agaaucauaugauucugcu

SEQ ID NO: 541392 - RNA, 23 nt, Homo sapiens
agaaucccuuugcaccugagacc

SEQ ID NO: 541393 - RNA, 14 nt, Homo sapiens
agaaucgcuuaaac

SEQ ID NO: 541394 - RNA, 15 nt, Homo sapiens
agaaucugcugcaua

SEQ ID NO: 541395 - RNA, 23 nt, Homo sapiens
agaaucugcugcauagcucuauu

SEQ ID NO: 541396 - RNA, 11 nt, Homo sapiens
agaaucugggg

SEQ ID NO: 541397 - RNA, 22 nt, Homo sapiens
agaaucuguauucagacccugg

SEQ ID NO: 541398 - RNA, 22 nt, Homo sapiens
agaaucuguuaccagaggacaa

SEQ ID NO: 541399 - RNA, 19 nt, Homo sapiens
agaaucuuguuuugaaaau

SEQ ID NO: 541400 - RNA, 16 nt, Homo sapiens
agaaugagaagacaug

SEQ ID NO: 541401 - RNA, 14 nt, Homo sapiens
agaaugagacugaa

SEQ ID NO: 541402 - RNA, 16 nt, Homo sapiens
agaaugaugcuaugaa

SEQ ID NO: 541403 - RNA, 24 nt, Homo sapiens
agaaugcacaagaauggaucacaa

SEQ ID NO: 541404 - RNA, 12 nt, Homo sapiens
agaaugcagcug

SEQ ID NO: 541405 - RNA, 13 nt, Homo sapiens
agaaugcauuccc

SEQ ID NO: 541406 - RNA, 15 nt, Homo sapiens
agacauuucugcaca

SEQ ID NO: 541407 - RNA, 13 nt, Homo sapiens
agacauuugcuga

SEQ ID NO: 541408 - RNA, 19 nt, Homo sapiens
agacauuugcugaacucag

SEQ ID NO: 541409 - RNA, 20 nt, Homo sapiens
agaccaaaauuacuaauaaa

SEQ ID NO: 541410 - RNA, 12 nt, Homo sapiens
agaccaaagacc

SEQ ID NO: 541411 - RNA, 19 nt, Homo sapiens
agaccaagacacagaucac

SEQ ID NO: 541412 - RNA, 20 nt, Homo sapiens
agaccaagacuuuugucuga

SEQ ID NO: 541413 - RNA, 20 nt, Homo sapiens
agaccaaguuaucaucucac

SEQ ID NO: 541414 - RNA, 21 nt, Homo sapiens
agaccagaccccaaaccagcc

SEQ ID NO: 541415 - RNA, 18 nt, Homo sapiens
agaccagccugggcaaca

SEQ ID NO: 541416 - RNA, 17 nt, Homo sapiens
agaccagggaccacagg

SEQ ID NO: 541417 - RNA, 23 nt, Homo sapiens
agaccaguccuguuugcagggaa

SEQ ID NO: 541418 - RNA, 13 nt, Homo sapiens
agaccaucuuugc

SEQ ID NO: 541419 - RNA, 22 nt, Homo sapiens
agacccaacagcagugaucuca

SEQ ID NO: 541420 - RNA, 22 nt, Homo sapiens
agacccacgugcuaggggauga

SEQ ID NO: 541421 - RNA, 14 nt, Homo sapiens
agacccagugcacu

SEQ ID NO: 541422 - RNA, 15 nt, Homo sapiens
agaccccagucguga

SEQ ID NO: 541423 - RNA, 15 nt, Homo sapiens
agacccccagcacuu

SEQ ID NO: 541424 - RNA, 14 nt, Homo sapiens
agaccccuguucau

SEQ ID NO: 541425 - RNA, 18 nt, Homo sapiens
agaccccuuguugcacug

SEQ ID NO: 541426 - RNA, 14 nt, Homo sapiens
agacccgcccuccc

SEQ ID NO: 541427 - RNA, 16 nt, Homo sapiens
agacccugucucaaaa

SEQ ID NO: 541428 - RNA, 21 nt, Homo sapiens
agacccuuuuaucugcuguug

SEQ ID NO: 541429 - RNA, 17 nt, Homo sapiens
agacccuuuucucagga

SEQ ID NO: 541430 - RNA, 18 nt, Homo sapiens
agaccgccccagggcuau

SEQ ID NO: 541431 - RNA, 18 nt, Homo sapiens
agaccuacugcacugagu

SEQ ID NO: 541432 - RNA, 12 nt, Homo sapiens
agaccuagagau

SEQ ID NO: 541433 - RNA, 14 nt, Homo sapiens
agaccucaagccau

SEQ ID NO: 541434 - RNA, 15 nt, Homo sapiens
agaccucaagccauc

SEQ ID NO: 541435 - RNA, 15 nt, Homo sapiens
agaccucaucugugg

SEQ ID NO: 541436 - RNA, 16 nt, Homo sapiens
agaccucugugcacuu

SEQ ID NO: 541437 - RNA, 23 nt, Homo sapiens
agaccugaaagaugggcaaaaga

SEQ ID NO: 541438 - RNA, 20 nt, Homo sapiens
agaccugaagugugcacguu

SEQ ID NO: 541439 - RNA, 22 nt, Homo sapiens
agaccugcucuggacacuugcu

SEQ ID NO: 541440 - RNA, 15 nt, Homo sapiens
agaccuggaaccaga

SEQ ID NO: 541441 - RNA, 12 nt, Homo sapiens
agaccugucacc

SEQ ID NO: 541442 - RNA, 20 nt, Homo sapiens
agaccuuccaaggacauauu

SEQ ID NO: 541443 - RNA, 21 nt, Homo sapiens
agaccuugagggugggccagc

SEQ ID NO: 541444 - RNA, 19 nt, Homo sapiens
agaccuugggggaagacuu

SEQ ID NO: 541445 - RNA, 22 nt, Homo sapiens
agaccuuuuuuuuuuuuccaau

SEQ ID NO: 541446 - RNA, 16 nt, Homo sapiens
agacgcauguggcaaa

SEQ ID NO: 541447 - RNA, 13 nt, Homo sapiens
agacgccuuccuc

SEQ ID NO: 541448 - RNA, 15 nt, Homo sapiens
agacgcugcugucac

SEQ ID NO: 541449 - RNA, 20 nt, Homo sapiens
agacgguaccaauucagugu

SEQ ID NO: 541450 - RNA, 16 nt, Homo sapiens
agacguggacuccucu

SEQ ID NO: 541451 - RNA, 18 nt, Homo sapiens
agacguuaggcauuuccu

SEQ ID NO: 541452 - RNA, 24 nt, Homo sapiens
agacuaagcccugucgagacacuu

SEQ ID NO: 541453 - RNA, 11 nt, Homo sapiens
agacuacaggg

SEQ ID NO: 541454 - RNA, 16 nt, Homo sapiens
agacuacauuugugaa

SEQ ID NO: 541455 - RNA, 23 nt, Homo sapiens
agacuagaaaauuagacugugau

SEQ ID NO: 541456 - RNA, 15 nt, Homo sapiens
agacuagauugccuu

SEQ ID NO: 541457 - RNA, 14 nt, Homo sapiens
agacuagugccgua

SEQ ID NO: 541458 - RNA, 20 nt, Homo sapiens
agacuaugauuuaccuauac

SEQ ID NO: 541459 - RNA, 23 nt, Homo sapiens
agacuauuaauaaauaagacugu

SEQ ID NO: 541460 - RNA, 19 nt, Homo sapiens
agacucaagggggugacag

SEQ ID NO: 541461 - RNA, 17 nt, Homo sapiens
agacucacauccugacc

SEQ ID NO: 541462 - RNA, 19 nt, Homo sapiens
agacucaccuguucucacu

SEQ ID NO: 541463 - RNA, 21 nt, Homo sapiens
agacucagggccccagcacua

SEQ ID NO: 541464 - RNA, 13 nt, Homo sapiens
agacuccaaaagg

SEQ ID NO: 541465 - RNA, 15 nt, Homo sapiens
agacuccugugcaac

SEQ ID NO: 541466 - RNA, 15 nt, Homo sapiens
agacucuaguauuua

SEQ ID NO: 541467 - RNA, 10 nt, Homo sapiens
agacucugac

SEQ ID NO: 541468 - RNA, 20 nt, Homo sapiens
agacucugccauuaaaacau

SEQ ID NO: 541469 - RNA, 14 nt, Homo sapiens
agacucugguguuc

SEQ ID NO: 541470 - RNA, 17 nt, Homo sapiens
agacucuguaauugaau

SEQ ID NO: 541471 - RNA, 20 nt, Homo sapiens
agacucuuuggguccauuca

SEQ ID NO: 541472 - RNA, 19 nt, Homo sapiens
agacugaaacgccuugcac

SEQ ID NO: 541473 - RNA, 20 nt, Homo sapiens
agacugacauuuuuuccuaa

SEQ ID NO: 541474 - RNA, 17 nt, Homo sapiens
agacugaccaucuccca

SEQ ID NO: 541475 - RNA, 23 nt, Homo sapiens
agacugacuuguuugucuuccau

SEQ ID NO: 541476 - RNA, 12 nt, Homo sapiens
agacugaucauc

SEQ ID NO: 541477 - RNA, 15 nt, Homo sapiens
agacugaugagcaca

SEQ ID NO: 541478 - RNA, 14 nt, Homo sapiens
agacugccagggag

SEQ ID NO: 541479 - RNA, 16 nt, Homo sapiens
agacugcuaaaugcac

SEQ ID NO: 541480 - RNA, 13 nt, Homo sapiens
agacuggcaauaa

SEQ ID NO: 541481 - RNA, 14 nt, Homo sapiens
agacuggcuuuuau

SEQ ID NO: 541482 - RNA, 21 nt, Homo sapiens
agacugggucucgcuuuguug

SEQ ID NO: 541483 - RNA, 19 nt, Homo sapiens
agacugguuuucugccaau

SEQ ID NO: 541484 - RNA, 14 nt, Homo sapiens
agacuguaaugugu

SEQ ID NO: 541485 - RNA, 19 nt, Homo sapiens
agacugucccugaaaccua

SEQ ID NO: 541486 - RNA, 22 nt, Homo sapiens
agacuguggcugcuagcacuug

SEQ ID NO: 541487 - RNA, 17 nt, Homo sapiens
agacuguugccacuuaa

SEQ ID NO: 541488 - RNA, 14 nt, Homo sapiens
agacuguugcucaa

SEQ ID NO: 541489 - RNA, 19 nt, Homo sapiens
agacuguuucacauugcac

SEQ ID NO: 541490 - RNA, 18 nt, Homo sapiens
agacuuaaaaaauacuug

SEQ ID NO: 541491 - RNA, 21 nt, Homo sapiens
agacuuaaaaaauacuugcau

SEQ ID NO: 541492 - RNA, 14 nt, Homo sapiens
auuuuucaaagcaa

SEQ ID NO: 541493 - RNA, 14 nt, Homo sapiens
auuuuucaagagau

SEQ ID NO: 541494 - RNA, 17 nt, Homo sapiens
auuuuucaagagcuccu

SEQ ID NO: 541495 - RNA, 22 nt, Homo sapiens
auuuuucaauauauugaacuuu

SEQ ID NO: 541496 - RNA, 16 nt, Homo sapiens
auuuuucaccugagaa

SEQ ID NO: 541497 - RNA, 23 nt, Homo sapiens
auuuuucacuuugcucucaauua

SEQ ID NO: 541498 - RNA, 15 nt, Homo sapiens
auuuuucauacuuuu

SEQ ID NO: 541499 - RNA, 16 nt, Homo sapiens
auuuuucaucaaacau

SEQ ID NO: 541500 - RNA, 23 nt, Homo sapiens
auuuuuccccaaaaagaauggga

SEQ ID NO: 541501 - RNA, 18 nt, Homo sapiens
auuuuuccucuguucaca

SEQ ID NO: 541502 - RNA, 13 nt, Homo sapiens
auuuuucuguacu

SEQ ID NO: 541503 - RNA, 18 nt, Homo sapiens
auuuuugaugacuaccuc

SEQ ID NO: 541504 - RNA, 12 nt, Homo sapiens
auuuuugcaaug

SEQ ID NO: 541505 - RNA, 16 nt, Homo sapiens
auuuuugcugagacua

SEQ ID NO: 541506 - RNA, 14 nt, Homo sapiens
auuuuuguauguca

SEQ ID NO: 541507 - RNA, 16 nt, Homo sapiens
auuuuugucugcagcu

SEQ ID NO: 541508 - RNA, 14 nt, Homo sapiens
auuuuugucuuaua

SEQ ID NO: 541509 - RNA, 20 nt, Homo sapiens
auuuuuguuucuuccaaagc

SEQ ID NO: 541510 - RNA, 15 nt, Homo sapiens
auuuuuuaaagcuac

SEQ ID NO: 541511 - RNA, 15 nt, Homo sapiens
auuuuuuaacuuucu

SEQ ID NO: 541512 - RNA, 15 nt, Homo sapiens
auuuuuuaauaaaga

SEQ ID NO: 541513 - RNA, 16 nt, Homo sapiens
auuuuuuauacuguau

SEQ ID NO: 541514 - RNA, 21 nt, Homo sapiens
auuuuuuccuuaagagcuauu

SEQ ID NO: 541515 - RNA, 22 nt, Homo sapiens
auuuuuuccuuaagagcuauuu

SEQ ID NO: 541516 - RNA, 21 nt, Homo sapiens
auuuuuugguuuugugcacau

SEQ ID NO: 541517 - RNA, 16 nt, Homo sapiens
auuuuuuuaaaacaca

SEQ ID NO: 541518 - RNA, 18 nt, Homo sapiens
auuuuuuuaaaucaagga

SEQ ID NO: 541519 - RNA, 18 nt, Homo sapiens
auuuuuuucauuguccau

SEQ ID NO: 541520 - RNA, 20 nt, Homo sapiens
auuuuuuuuuccaaaacaau

SEQ ID NO: 541521 - RNA, 16 nt, Homo sapiens
auuuuuuuuugaagca

SEQ ID NO: 541522 - RNA, 17 nt, Homo sapiens
auuuuuuuuuuuaacua

SEQ ID NO: 541523 - RNA, 21 nt, Homo sapiens
caaaaaaaaaaaaaaaagccu

SEQ ID NO: 541524 - RNA, 21 nt, Homo sapiens
caaaaaaaaaaaaaaucacaa

SEQ ID NO: 541525 - RNA, 14 nt, Homo sapiens
caaaaaaagacagg

SEQ ID NO: 541526 - RNA, 16 nt, Homo sapiens
caaaaaaagagaacac

SEQ ID NO: 541527 - RNA, 21 nt, Homo sapiens
caaaaaaaguugaaggccuua

SEQ ID NO: 541528 - RNA, 14 nt, Homo sapiens
caaacaauuuuaau

SEQ ID NO: 541529 - RNA, 21 nt, Homo sapiens
caaacaccacuuuacuugugu

SEQ ID NO: 541530 - RNA, 17 nt, Homo sapiens
caaacacuagcucugua

SEQ ID NO: 541531 - RNA, 20 nt, Homo sapiens
caaacacuagcucuguauua

SEQ ID NO: 541532 - RNA, 16 nt, Homo sapiens
caaacacuuacagaau

SEQ ID NO: 541533 - RNA, 22 nt, Homo sapiens
caaacagaccccuguucaugcc

SEQ ID NO: 541534 - RNA, 14 nt, Homo sapiens
caaacauaaagaga

SEQ ID NO: 541535 - RNA, 21 nt, Homo sapiens
caaacauaauaccaccauuua

SEQ ID NO: 541536 - RNA, 12 nt, Homo sapiens
caaacauauaac

SEQ ID NO: 541537 - RNA, 23 nt, Homo sapiens
caaacauccuacaagacacagug

SEQ ID NO: 541538 - RNA, 21 nt, Homo sapiens
caaacaugcggugccaugaag

SEQ ID NO: 541539 - RNA, 23 nt, Homo sapiens
caaacauuucuaacucuauuaau

SEQ ID NO: 541540 - RNA, 16 nt, Homo sapiens
caaacauuugccaagu

SEQ ID NO: 541541 - RNA, 21 nt, Homo sapiens
caaaccaaaccccguagcucc

SEQ ID NO: 541542 - RNA, 19 nt, Homo sapiens
caaaccaaccgcacaugca

SEQ ID NO: 541543 - RNA, 24 nt, Homo sapiens
caaaccacgccucuugaccaggcu

SEQ ID NO: 541544 - RNA, 13 nt, Homo sapiens
caaaccagagcag

SEQ ID NO: 541545 - RNA, 19 nt, Homo sapiens
caaaccagcuucauguggc

SEQ ID NO: 541546 - RNA, 12 nt, Homo sapiens
caaaccagcuuu

SEQ ID NO: 541547 - RNA, 19 nt, Homo sapiens
caaacccagacaaccaaaa

SEQ ID NO: 541548 - RNA, 21 nt, Homo sapiens
caaaccccauuagucuagccu

SEQ ID NO: 541549 - RNA, 20 nt, Homo sapiens
caaacccuagccuugcuugu

SEQ ID NO: 541550 - RNA, 20 nt, Homo sapiens
caaaccuacugcccacauuu

SEQ ID NO: 541551 - RNA, 14 nt, Homo sapiens
caaaccucaucuuu

SEQ ID NO: 541552 - RNA, 17 nt, Homo sapiens
caaaccugaccacagaa

SEQ ID NO: 541553 - RNA, 19 nt, Homo sapiens
caaacguuuugaacuaaua

SEQ ID NO: 541554 - RNA, 13 nt, Homo sapiens
caaacuaaaggug

SEQ ID NO: 541555 - RNA, 22 nt, Homo sapiens
caaacuaacaggaacaaaauga

SEQ ID NO: 541556 - RNA, 15 nt, Homo sapiens
caaacuacauguaau

SEQ ID NO: 541557 - RNA, 16 nt, Homo sapiens
caaacuacauguaauc

SEQ ID NO: 541558 - RNA, 12 nt, Homo sapiens
caaacuacuuca

SEQ ID NO: 541559 - RNA, 23 nt, Homo sapiens
caaacucaaugcuuuauuuguaa

SEQ ID NO: 541560 - RNA, 17 nt, Homo sapiens
caaacucacugcucaag

SEQ ID NO: 541561 - RNA, 21 nt, Homo sapiens
caaacucacugcucaagaaga

SEQ ID NO: 541562 - RNA, 15 nt, Homo sapiens
caaacucagauccuu

SEQ ID NO: 541563 - RNA, 17 nt, Homo sapiens
caaacucauuggcuuaa

SEQ ID NO: 541564 - RNA, 23 nt, Homo sapiens
caaacucccuagucuccaccuga

SEQ ID NO: 541565 - RNA, 13 nt, Homo sapiens
caaacuccugacc

SEQ ID NO: 541566 - RNA, 16 nt, Homo sapiens
caaacuccugaccuca

SEQ ID NO: 541567 - RNA, 20 nt, Homo sapiens
caaacucuggggcucaagca

SEQ ID NO: 541568 - RNA, 13 nt, Homo sapiens
caaacucuucagu

SEQ ID NO: 541569 - RNA, 19 nt, Homo sapiens
caaacucuucccucucuca

SEQ ID NO: 541570 - RNA, 17 nt, Homo sapiens
caaacugcagcugugag

SEQ ID NO: 541571 - RNA, 18 nt, Homo sapiens
caaacugugaagcauuua

SEQ ID NO: 541572 - RNA, 19 nt, Homo sapiens
caaacugugaagcauuuac

SEQ ID NO: 541573 - RNA, 14 nt, Homo sapiens
caaacuuacuauuu

SEQ ID NO: 541574 - RNA, 14 nt, Homo sapiens
caaacuugcuuuau

SEQ ID NO: 541575 - RNA, 15 nt, Homo sapiens
caaacuugcuuuaug

SEQ ID NO: 541576 - RNA, 20 nt, Homo sapiens
caaacuuuuuuauaucuuuu

SEQ ID NO: 541577 - RNA, 22 nt, Homo sapiens
caaagaacaaacauccuugcaa

SEQ ID NO: 541578 - RNA, 17 nt, Homo sapiens
caaagaagauaugcaaa

SEQ ID NO: 541579 - RNA, 18 nt, Homo sapiens
caaagaagguuaccaaga

SEQ ID NO: 541580 - RNA, 20 nt, Homo sapiens
caaagaagguuaccaagaag

SEQ ID NO: 541581 - RNA, 15 nt, Homo sapiens
caaagaaguacuuua

SEQ ID NO: 541582 - RNA, 13 nt, Homo sapiens
caaagaauuccaa

SEQ ID NO: 541583 - RNA, 22 nt, Homo sapiens
caaagaauuccugaagccagau

SEQ ID NO: 541584 - RNA, 20 nt, Homo sapiens
caaagaauuuuuuuuaacau

SEQ ID NO: 541585 - RNA, 20 nt, Homo sapiens
caaagacaguauuuugacaa

SEQ ID NO: 541586 - RNA, 12 nt, Homo sapiens
caaagacaucaa

SEQ ID NO: 541587 - RNA, 18 nt, Homo sapiens
caaagacaucagucucca

SEQ ID NO: 541588 - RNA, 12 nt, Homo sapiens
caaagacaugga

SEQ ID NO: 541589 - RNA, 17 nt, Homo sapiens
caaagaccaaguuauca

SEQ ID NO: 541590 - RNA, 19 nt, Homo sapiens
caaagacuaccugagauca

SEQ ID NO: 541591 - RNA, 16 nt, Homo sapiens
caaagacucugagcca

SEQ ID NO: 541592 - RNA, 13 nt, Homo sapiens
caaagacugcagu

SEQ ID NO: 541593 - RNA, 13 nt, Homo sapiens
caaagacugugaa

SEQ ID NO: 541594 - RNA, 14 nt, Homo sapiens
caaagagaaugaga

SEQ ID NO: 541595 - RNA, 20 nt, Homo sapiens
caaagaggcugccccucuca

SEQ ID NO: 541596 - RNA, 14 nt, Homo sapiens
caaagagguauuua

SEQ ID NO: 541597 - RNA, 19 nt, Homo sapiens
caaagaucuuuuccagagu

SEQ ID NO: 541598 - RNA, 23 nt, Homo sapiens
caaagauguuaugguguuuagau

SEQ ID NO: 541599 - RNA, 21 nt, Homo sapiens
caaagauuaaaugugucauug

SEQ ID NO: 541600 - RNA, 15 nt, Homo sapiens
caaagauuacaacuu

SEQ ID NO: 541601 - RNA, 22 nt, Homo sapiens
caaagauuuuggaggagaagga

SEQ ID NO: 541602 - RNA, 15 nt, Homo sapiens
caaagcaaaggcagu

SEQ ID NO: 541603 - RNA, 15 nt, Homo sapiens
caaagcacaugcuua

SEQ ID NO: 541604 - RNA, 18 nt, Homo sapiens
caaagcacgaaauguuau

SEQ ID NO: 541605 - RNA, 21 nt, Homo sapiens
caaagcacuugcuuacauccu

SEQ ID NO: 541606 - RNA, 11 nt, Homo sapiens
caaagcacuuu

SEQ ID NO: 541607 - RNA, 16 nt, Homo sapiens
caaagcaggaguggaa

SEQ ID NO: 541608 - RNA, 16 nt, Homo sapiens
caaagcaggauuauua

SEQ ID NO: 541609 - RNA, 20 nt, Homo sapiens
caaagcaggggaguaugcaa

SEQ ID NO: 541610 - RNA, 23 nt, Homo sapiens
caaagcaggggaguaugcaaaag

SEQ ID NO: 541611 - RNA, 19 nt, Homo sapiens
caaagcaguagucaaggag

SEQ ID NO: 541612 - RNA, 20 nt, Homo sapiens
caaagcaguguugguugcuu

SEQ ID NO: 541613 - RNA, 14 nt, Homo sapiens
caaagcaucccucu

SEQ ID NO: 541614 - RNA, 22 nt, Homo sapiens
caaagcaucccucuuagucuag

SEQ ID NO: 541615 - RNA, 18 nt, Homo sapiens
caaagccacugacugaga

SEQ ID NO: 541616 - RNA, 22 nt, Homo sapiens
agaggacgcacgcucgcugcca

SEQ ID NO: 541617 - RNA, 17 nt, Homo sapiens
agaggagccaccaguuc

SEQ ID NO: 541618 - RNA, 19 nt, Homo sapiens
agaggagccaccaguucuc

SEQ ID NO: 541619 - RNA, 12 nt, Homo sapiens
agaggagcucuc

SEQ ID NO: 541620 - RNA, 15 nt, Homo sapiens
agaggaggggaccaa

SEQ ID NO: 541621 - RNA, 23 nt, Homo sapiens
agaggaggggacccauguaaucc

SEQ ID NO: 541622 - RNA, 15 nt, Homo sapiens
agaggauacauuuaa

SEQ ID NO: 541623 - RNA, 14 nt, Homo sapiens
agaggaugaaugua

SEQ ID NO: 541624 - RNA, 13 nt, Homo sapiens
agaggaugugcaa

SEQ ID NO: 541625 - RNA, 16 nt, Homo sapiens
agaggauuuaacugug

SEQ ID NO: 541626 - RNA, 13 nt, Homo sapiens
agaggcacucagu

SEQ ID NO: 541627 - RNA, 13 nt, Homo sapiens
agaggcagagaaa

SEQ ID NO: 541628 - RNA, 15 nt, Homo sapiens
agaggcaguggccac

SEQ ID NO: 541629 - RNA, 22 nt, Homo sapiens
agaggccgcgcguccagcugcc

SEQ ID NO: 541630 - RNA, 22 nt, Homo sapiens
agaggcuaagaugagauuugcc

SEQ ID NO: 541631 - RNA, 17 nt, Homo sapiens
agaggcuacucuugacu

SEQ ID NO: 541632 - RNA, 15 nt, Homo sapiens
agaggcucagcacuu

SEQ ID NO: 541633 - RNA, 19 nt, Homo sapiens
agaggcucuaauguacaau

SEQ ID NO: 541634 - RNA, 20 nt, Homo sapiens
agaggcucuaauguacaaua

SEQ ID NO: 541635 - RNA, 13 nt, Homo sapiens
agaggcucugaga

SEQ ID NO: 541636 - RNA, 23 nt, Homo sapiens
agaggcugaggugagaggaucag

SEQ ID NO: 541637 - RNA, 18 nt, Homo sapiens
agaggcugccccucucac

SEQ ID NO: 541638 - RNA, 17 nt, Homo sapiens
agaggcuguguggccaa

SEQ ID NO: 541639 - RNA, 17 nt, Homo sapiens
agaggcuuucaaaugua

SEQ ID NO: 541640 - RNA, 15 nt, Homo sapiens
agagggacugaauag

SEQ ID NO: 541641 - RNA, 15 nt, Homo sapiens
agagggaggucacug

SEQ ID NO: 541642 - RNA, 18 nt, Homo sapiens
agagggaggucacuggaa

SEQ ID NO: 541643 - RNA, 17 nt, Homo sapiens
agagggauaaaaacaau

SEQ ID NO: 541644 - RNA, 15 nt, Homo sapiens
agagggcagggucca

SEQ ID NO: 541645 - RNA, 15 nt, Homo sapiens
agagggcccagccca

SEQ ID NO: 541646 - RNA, 17 nt, Homo sapiens
agagggcccagcccaga

SEQ ID NO: 541647 - RNA, 13 nt, Homo sapiens
agaggggaaaaug

SEQ ID NO: 541648 - RNA, 13 nt, Homo sapiens
agaggguacuuua

SEQ ID NO: 541649 - RNA, 19 nt, Homo sapiens
agagggugggguacuggag

SEQ ID NO: 541650 - RNA, 19 nt, Homo sapiens
caacagcuacagucuaaaa

SEQ ID NO: 541651 - RNA, 17 nt, Homo sapiens
caacaggaaacugggaa

SEQ ID NO: 541652 - RNA, 22 nt, Homo sapiens
caacaggauuacaguguagcua

SEQ ID NO: 541653 - RNA, 21 nt, Homo sapiens
caacagggaagaaacuuucug

SEQ ID NO: 541654 - RNA, 20 nt, Homo sapiens
caacagugagagacuccaua

SEQ ID NO: 541655 - RNA, 18 nt, Homo sapiens
caacagugagucugucag

SEQ ID NO: 541656 - RNA, 18 nt, Homo sapiens
caacaguggaauucaccu

SEQ ID NO: 541657 - RNA, 18 nt, Homo sapiens
caacaguuuuuuaugcua

SEQ ID NO: 541658 - RNA, 15 nt, Homo sapiens
caacauaacugaagg

SEQ ID NO: 541659 - RNA, 17 nt, Homo sapiens
caacaucacacaguaua

SEQ ID NO: 541660 - RNA, 16 nt, Homo sapiens
caacauccuuaaguca

SEQ ID NO: 541661 - RNA, 18 nt, Homo sapiens
caacaucgaauguguaca

SEQ ID NO: 541662 - RNA, 22 nt, Homo sapiens
caacaucuuuuuaaccugcaaa

SEQ ID NO: 541663 - RNA, 14 nt, Homo sapiens
caacaugcuuuaau

SEQ ID NO: 541664 - RNA, 19 nt, Homo sapiens
caacauggcaauugcacuc

SEQ ID NO: 541665 - RNA, 23 nt, Homo sapiens
caacauggugaaaccccgucucu

SEQ ID NO: 541666 - RNA, 21 nt, Homo sapiens
caacauggugaaaccucaucu

SEQ ID NO: 541667 - RNA, 23 nt, Homo sapiens
caacauggugaaaccucaucucu

SEQ ID NO: 541668 - RNA, 14 nt, Homo sapiens
caacaugugacuaa

SEQ ID NO: 541669 - RNA, 17 nt, Homo sapiens
caacauuguaagaacaa

SEQ ID NO: 541670 - RNA, 14 nt, Homo sapiens
caacauuguacaag

SEQ ID NO: 541671 - RNA, 16 nt, Homo sapiens
caacauuguagccuca

SEQ ID NO: 541672 - RNA, 19 nt, Homo sapiens
caacauuucucacugaaag

SEQ ID NO: 541673 - RNA, 16 nt, Homo sapiens
caaccaacugccccag

SEQ ID NO: 541674 - RNA, 12 nt, Homo sapiens
caaccaagaaug

SEQ ID NO: 541675 - RNA, 12 nt, Homo sapiens
caaccaauucca

SEQ ID NO: 541676 - RNA, 15 nt, Homo sapiens
caaccaauuuacacu

SEQ ID NO: 541677 - RNA, 15 nt, Homo sapiens
caaccacucauucaa

SEQ ID NO: 541678 - RNA, 18 nt, Homo sapiens
caaccagaggaaucuaua

SEQ ID NO: 541679 - RNA, 16 nt, Homo sapiens
caaccaggaguaccug

SEQ ID NO: 541680 - RNA, 15 nt, Homo sapiens
caaccauaccuuccu

SEQ ID NO: 541681 - RNA, 13 nt, Homo sapiens
caacccaaaccau

SEQ ID NO: 541682 - RNA, 17 nt, Homo sapiens
caacccaauaaaacuga

SEQ ID NO: 541683 - RNA, 18 nt, Homo sapiens
caacccagccaugcaaug

SEQ ID NO: 541684 - RNA, 13 nt, Homo sapiens
caaccccaggcug

SEQ ID NO: 541685 - RNA, 17 nt, Homo sapiens
caaccccccaccugcca

SEQ ID NO: 541686 - RNA, 14 nt, Homo sapiens
caacccgagucauu

SEQ ID NO: 541687 - RNA, 18 nt, Homo sapiens
caacccgcuggagcccac

SEQ ID NO: 541688 - RNA, 13 nt, Homo sapiens
caaccuaugguau

SEQ ID NO: 541689 - RNA, 20 nt, Homo sapiens
caaccucaaugcccugccau

SEQ ID NO: 541690 - RNA, 20 nt, Homo sapiens
caaccucgcuggacucucag

SEQ ID NO: 541691 - RNA, 14 nt, Homo sapiens
caaccucugccucc

SEQ ID NO: 541692 - RNA, 16 nt, Homo sapiens
caaccugaagcacaag

SEQ ID NO: 541693 - RNA, 16 nt, Homo sapiens
caaccugaauguccca

SEQ ID NO: 541694 - RNA, 16 nt, Homo sapiens
caaccugccugugcau

SEQ ID NO: 541695 - RNA, 15 nt, Homo sapiens
caaccuggacccaga

SEQ ID NO: 541696 - RNA, 18 nt, Homo sapiens
caaccugggacuuccuaa

SEQ ID NO: 541697 - RNA, 17 nt, Homo sapiens
caaccuguggggucuga

SEQ ID NO: 541698 - RNA, 18 nt, Homo sapiens
caaccuucacaucuguca

SEQ ID NO: 541699 - RNA, 14 nt, Homo sapiens
caaccuuccauuca

SEQ ID NO: 541700 - RNA, 20 nt, Homo sapiens
caaccuugagaauagcuuua

SEQ ID NO: 541701 - RNA, 22 nt, Homo sapiens
caacgagugaaacuccgucuca

SEQ ID NO: 541702 - RNA, 22 nt, Homo sapiens
caacgauuguauuugugacuuu

SEQ ID NO: 541703 - RNA, 20 nt, Homo sapiens
caacgcaccagacacucaca

SEQ ID NO: 541704 - RNA, 14 nt, Homo sapiens
caacgcucccagac

SEQ ID NO: 541705 - RNA, 20 nt, Homo sapiens
caacuaagaaaaaaagcaca

SEQ ID NO: 541706 - RNA, 16 nt, Homo sapiens
caacuaaggacaaauu

SEQ ID NO: 541707 - RNA, 18 nt, Homo sapiens
caacuaaugccuuacucu

SEQ ID NO: 541708 - RNA, 11 nt, Homo sapiens
caacuaccuga

SEQ ID NO: 541709 - RNA, 12 nt, Homo sapiens
caacuaccugag

SEQ ID NO: 541710 - RNA, 15 nt, Homo sapiens
caacuagcugggacu

SEQ ID NO: 541711 - RNA, 20 nt, Homo sapiens
caacuauauuaucaugcaaa

SEQ ID NO: 541712 - RNA, 20 nt, Homo sapiens
caacucaaugaaaauuuaaa

SEQ ID NO: 541713 - RNA, 13 nt, Homo sapiens
caacucaucuuag

SEQ ID NO: 541714 - RNA, 15 nt, Homo sapiens
caacucauuuuuaca

SEQ ID NO: 541715 - RNA, 21 nt, Homo sapiens
caacucuccccugaccuguga

SEQ ID NO: 541716 - RNA, 15 nt, Homo sapiens
caacucugaagcuaa

SEQ ID NO: 541717 - RNA, 16 nt, Homo sapiens
caacucugcacuccau

SEQ ID NO: 541718 - RNA, 22 nt, Homo sapiens
caacucugccuuuaugaugcua

SEQ ID NO: 541719 - RNA, 21 nt, Homo sapiens
caacucuucgaagccuugccu

SEQ ID NO: 541720 - RNA, 12 nt, Homo sapiens
caacucuugauu

SEQ ID NO: 541721 - RNA, 15 nt, Homo sapiens
caacucuuugagaaa

SEQ ID NO: 541722 - RNA, 12 nt, Homo sapiens
caacugaaggcu

SEQ ID NO: 541723 - RNA, 18 nt, Homo sapiens
caacugaaggcuaaaaag

SEQ ID NO: 541724 - RNA, 16 nt, Homo sapiens
caacugaauaaauuca

SEQ ID NO: 541725 - RNA, 14 nt, Homo sapiens
caacugaauugcaa

SEQ ID NO: 541726 - RNA, 18 nt, Homo sapiens
caacugcugcugugcaca

SEQ ID NO: 541727 - RNA, 23 nt, Homo sapiens
caacugcugcugugcacauuuau

SEQ ID NO: 541728 - RNA, 23 nt, Homo sapiens
caacugggccugggauggggcuu

SEQ ID NO: 541729 - RNA, 19 nt, Homo sapiens
caacugggucugacaugaa

SEQ ID NO: 541730 - RNA, 16 nt, Homo sapiens
caacuguaaagcaaau

SEQ ID NO: 541731 - RNA, 16 nt, Homo sapiens
caacugugugauuaaa

SEQ ID NO: 541732 - RNA, 13 nt, Homo sapiens
caacuguuuucau

SEQ ID NO: 541733 - RNA, 18 nt, Homo sapiens
caacuucaggagcucuuu

SEQ ID NO: 541734 - RNA, 16 nt, Homo sapiens
caacuuccgcugaggg

SEQ ID NO: 541735 - RNA, 15 nt, Homo sapiens
caacuuccuguugau

SEQ ID NO: 541736 - RNA, 19 nt, Homo sapiens
caacuucuguuucuucucu

SEQ ID NO: 541737 - RNA, 20 nt, Homo sapiens
caacuugaauaauacaccag

SEQ ID NO: 541738 - RNA, 23 nt, Homo sapiens
caacuugauuuuuucaaaaaagu

SEQ ID NO: 541739 - RNA, 19 nt, Homo sapiens
caacuuggcauuucuauac

SEQ ID NO: 541740 - RNA, 20 nt, Homo sapiens
caacuuguauuaaagacaga

SEQ ID NO: 541741 - RNA, 13 nt, Homo sapiens
caacuuugcaaau

SEQ ID NO: 541742 - RNA, 16 nt, Homo sapiens
agauuaaaaagcacag

SEQ ID NO: 541743 - RNA, 23 nt, Homo sapiens
agauuaagagauggguuugacaa

SEQ ID NO: 541744 - RNA, 18 nt, Homo sapiens
agauuaccgacacuguca

SEQ ID NO: 541745 - RNA, 16 nt, Homo sapiens
agauuacugaugugau

SEQ ID NO: 541746 - RNA, 17 nt, Homo sapiens
agauuacugaugugaua

SEQ ID NO: 541747 - RNA, 23 nt, Homo sapiens
agauuagccuguauucucuucag

SEQ ID NO: 541748 - RNA, 20 nt, Homo sapiens
agauuagcucuggaccagcc

SEQ ID NO: 541749 - RNA, 16 nt, Homo sapiens
agauuagguagacuuu

SEQ ID NO: 541750 - RNA, 14 nt, Homo sapiens
agauuagucucuuc

SEQ ID NO: 541751 - RNA, 16 nt, Homo sapiens
agauuauaaacugacu

SEQ ID NO: 541752 - RNA, 12 nt, Homo sapiens
agauuaucuggg

SEQ ID NO: 541753 - RNA, 13 nt, Homo sapiens
agauuaugugacu

SEQ ID NO: 541754 - RNA, 22 nt, Homo sapiens
agauuaugugacuugcaauaaa

SEQ ID NO: 541755 - RNA, 23 nt, Homo sapiens
agauuauuaucuauuaucucaau

SEQ ID NO: 541756 - RNA, 19 nt, Homo sapiens
agauucauaaaguaaugau

SEQ ID NO: 541757 - RNA, 22 nt, Homo sapiens
agauucauuuucuagauacaau

SEQ ID NO: 541758 - RNA, 15 nt, Homo sapiens
agauuccaaaaagca

SEQ ID NO: 541759 - RNA, 16 nt, Homo sapiens
agauuccccuguguca

SEQ ID NO: 541760 - RNA, 16 nt, Homo sapiens
agauuccuaugaugga

SEQ ID NO: 541761 - RNA, 22 nt, Homo sapiens
agauuccugguuaaauuugaau

SEQ ID NO: 541762 - RNA, 20 nt, Homo sapiens
agauucucaaaauuccuaca

SEQ ID NO: 541763 - RNA, 22 nt, Homo sapiens
agauucugaccuuaaaugcaac

SEQ ID NO: 541764 - RNA, 12 nt, Homo sapiens
agauucugcuag

SEQ ID NO: 541765 - RNA, 15 nt, Homo sapiens
agauucugugaucuu

SEQ ID NO: 541766 - RNA, 13 nt, Homo sapiens
agauucuguggaa

SEQ ID NO: 541767 - RNA, 14 nt, Homo sapiens
agauucuguuaacu

SEQ ID NO: 541768 - RNA, 18 nt, Homo sapiens
agauucuuuauaucugaa

SEQ ID NO: 541769 - RNA, 23 nt, Homo sapiens
agauugaucaaaguguaaacacc

SEQ ID NO: 541770 - RNA, 22 nt, Homo sapiens
agauugcacagucaaaacgacu

SEQ ID NO: 541771 - RNA, 20 nt, Homo sapiens
agauugcaccauugcgcucu

SEQ ID NO: 541772 - RNA, 15 nt, Homo sapiens
agcggauugcucugg

SEQ ID NO: 541773 - RNA, 14 nt, Homo sapiens
agcggcuguucccc

SEQ ID NO: 541774 - RNA, 19 nt, Homo sapiens
agcgguaucucuggcacca

SEQ ID NO: 541775 - RNA, 16 nt, Homo sapiens
agcgucaagacauuug

SEQ ID NO: 541776 - RNA, 20 nt, Homo sapiens
agcgucacugcccaccaaag

SEQ ID NO: 541777 - RNA, 20 nt, Homo sapiens
agcgucagcgggcgcugcug

SEQ ID NO: 541778 - RNA, 15 nt, Homo sapiens
agcgucccagucucu

SEQ ID NO: 541779 - RNA, 15 nt, Homo sapiens
agcgugaaagcagau

SEQ ID NO: 541780 - RNA, 24 nt, Homo sapiens
agcgugcauaaguuaacuuccaau

SEQ ID NO: 541781 - RNA, 16 nt, Homo sapiens
agcguguggagcagag

SEQ ID NO: 541782 - RNA, 19 nt, Homo sapiens
agcguuccaaguuccccau

SEQ ID NO: 541783 - RNA, 20 nt, Homo sapiens
agcuaaaauaagcucaguga

SEQ ID NO: 541784 - RNA, 13 nt, Homo sapiens
agcuaaacugaau

SEQ ID NO: 541785 - RNA, 14 nt, Homo sapiens
agcuaaagccugaa

SEQ ID NO: 541786 - RNA, 16 nt, Homo sapiens
agcuaacuuauuuucc

SEQ ID NO: 541787 - RNA, 14 nt, Homo sapiens
agcuaagauuaucu

SEQ ID NO: 541788 - RNA, 15 nt, Homo sapiens
agcuaagcagucuuc

SEQ ID NO: 541789 - RNA, 23 nt, Homo sapiens
agcuaaggagucccugguucauu

SEQ ID NO: 541790 - RNA, 13 nt, Homo sapiens
agcuaaguacaca

SEQ ID NO: 541791 - RNA, 17 nt, Homo sapiens
agcuaaguacacaauaa

SEQ ID NO: 541792 - RNA, 20 nt, Homo sapiens
agcuaaguucuaaguucaug

SEQ ID NO: 541793 - RNA, 19 nt, Homo sapiens
agcuaauaacaugugaaaa

SEQ ID NO: 541794 - RNA, 16 nt, Homo sapiens
agcuaauaagugcuuu

SEQ ID NO: 541795 - RNA, 17 nt, Homo sapiens
agcuaauugagaccaca

SEQ ID NO: 541796 - RNA, 19 nt, Homo sapiens
agcuacacaaggaaggcau

SEQ ID NO: 541797 - RNA, 20 nt, Homo sapiens
agcuacauagcagacuuucc

SEQ ID NO: 541798 - RNA, 18 nt, Homo sapiens
agcuacauuccucagcug

SEQ ID NO: 541799 - RNA, 23 nt, Homo sapiens
agcuaccagguguucuacacuca

SEQ ID NO: 541800 - RNA, 15 nt, Homo sapiens
agcuaccucaaccaa

SEQ ID NO: 541801 - RNA, 20 nt, Homo sapiens
agcuaccucacuaugcugcu

SEQ ID NO: 541802 - RNA, 13 nt, Homo sapiens
agcuacuaaugau

SEQ ID NO: 541803 - RNA, 15 nt, Homo sapiens
agcuacuauauguca

SEQ ID NO: 541804 - RNA, 14 nt, Homo sapiens
agcuacugacuaug

SEQ ID NO: 541805 - RNA, 13 nt, Homo sapiens
agcuacugaugaa

SEQ ID NO: 541806 - RNA, 23 nt, Homo sapiens
agcuacugugugugugaaugaac

SEQ ID NO: 541807 - RNA, 19 nt, Homo sapiens
agcuacuucaaauguggua

SEQ ID NO: 541808 - RNA, 13 nt, Homo sapiens
agcuacuugccuu

SEQ ID NO: 541809 - RNA, 17 nt, Homo sapiens
agcuagaacuucucuaa

SEQ ID NO: 541810 - RNA, 14 nt, Homo sapiens
agcuagaaggccac

SEQ ID NO: 541811 - RNA, 19 nt, Homo sapiens
agcuagaggacuucuggca

SEQ ID NO: 541812 - RNA, 23 nt, Homo sapiens
agcuagaggacuucuggcaggga

SEQ ID NO: 541813 - RNA, 15 nt, Homo sapiens
agcuagauacuggaa

SEQ ID NO: 541814 - RNA, 15 nt, Homo sapiens
agcuagcgugugcca

SEQ ID NO: 541815 - RNA, 16 nt, Homo sapiens
agcuaggugacauaua

SEQ ID NO: 541816 - RNA, 13 nt, Homo sapiens
agcuagugccuuu

SEQ ID NO: 541817 - RNA, 14 nt, Homo sapiens
agcuagugccuuua

SEQ ID NO: 541818 - RNA, 16 nt, Homo sapiens
agcuaguguaccuccu

SEQ ID NO: 541819 - RNA, 15 nt, Homo sapiens
agcuaguuaauguca

SEQ ID NO: 541820 - RNA, 15 nt, Homo sapiens
agcuauaacuaagca

SEQ ID NO: 541821 - RNA, 18 nt, Homo sapiens
agcuauaacuaagcaucc

SEQ ID NO: 541822 - RNA, 19 nt, Homo sapiens
agcuaucagcaauacucau

SEQ ID NO: 541823 - RNA, 16 nt, Homo sapiens
agcuaugaucgcgcca

SEQ ID NO: 541824 - RNA, 19 nt, Homo sapiens
agcuaugcccggaccucca

SEQ ID NO: 541825 - RNA, 15 nt, Homo sapiens
agcuauggaaucaau

SEQ ID NO: 541826 - RNA, 23 nt, Homo sapiens
agcuaugugacucggauggucuu

SEQ ID NO: 541827 - RNA, 14 nt, Homo sapiens
agcuauuaagauac

SEQ ID NO: 541828 - RNA, 14 nt, Homo sapiens
agcuauuacuggau

SEQ ID NO: 541829 - RNA, 15 nt, Homo sapiens
agcuauucaccucag

SEQ ID NO: 541830 - RNA, 19 nt, Homo sapiens
agcuauugccaaccaguuu

SEQ ID NO: 541831 - RNA, 17 nt, Homo sapiens
agcuauuuuaagccauc

SEQ ID NO: 541832 - RNA, 21 nt, Homo sapiens
agcuauuuuaagccaucucag

SEQ ID NO: 541833 - RNA, 17 nt, Homo sapiens
agcucaacucacagcuu

SEQ ID NO: 541834 - RNA, 14 nt, Homo sapiens
agcucaaucugcaa

SEQ ID NO: 541835 - RNA, 19 nt, Homo sapiens
agcucaccacugugccuac

SEQ ID NO: 541836 - RNA, 10 nt, Homo sapiens
agcucaccag

SEQ ID NO: 541837 - RNA, 12 nt, Homo sapiens
agcucaccaucu

SEQ ID NO: 541838 - RNA, 11 nt, Homo sapiens
agcucacucau

SEQ ID NO: 541839 - RNA, 18 nt, Homo sapiens
agcucacugaaucuucac

SEQ ID NO: 541840 - RNA, 17 nt, Homo sapiens
agcucacugcagccuca

SEQ ID NO: 541841 - RNA, 16 nt, Homo sapiens
agcucagacccuuucu

SEQ ID NO: 541842 - RNA, 20 nt, Homo sapiens
agcucagcauuuccacacca

SEQ ID NO: 541843 - RNA, 14 nt, Homo sapiens
agcucaggcagcuc

SEQ ID NO: 541844 - RNA, 19 nt, Homo sapiens
agcucaggcagcucgaggc

SEQ ID NO: 541845 - RNA, 20 nt, Homo sapiens
agcucaggccuaggugcgca

SEQ ID NO: 541846 - RNA, 13 nt, Homo sapiens
agcucaggugccu

SEQ ID NO: 541847 - RNA, 21 nt, Homo sapiens
agcucaguaguauaugguguu

SEQ ID NO: 541848 - RNA, 20 nt, Homo sapiens
agcucaguuucaccguccac

SEQ ID NO: 541849 - RNA, 16 nt, Homo sapiens
agcucaucugcaaaag

SEQ ID NO: 541850 - RNA, 11 nt, Homo sapiens
agcucaugccc

SEQ ID NO: 541851 - RNA, 21 nt, Homo sapiens
agcuccacccuggccgagucc

SEQ ID NO: 541852 - RNA, 13 nt, Homo sapiens
agcuccacuguca

SEQ ID NO: 541853 - RNA, 14 nt, Homo sapiens
agcuccacugucac

SEQ ID NO: 541854 - RNA, 22 nt, Homo sapiens
agcuccagauccaguaucuugu

SEQ ID NO: 541855 - RNA, 12 nt, Homo sapiens
agcuccaggaca

SEQ ID NO: 541856 - RNA, 18 nt, Homo sapiens
agcucccgggcacaucca

SEQ ID NO: 541857 - RNA, 22 nt, Homo sapiens
agcucccuguggggcaggagug

SEQ ID NO: 541858 - RNA, 17 nt, Homo sapiens
agcuccuguugucauga

SEQ ID NO: 541859 - RNA, 15 nt, Homo sapiens
agcuccuucccagga

SEQ ID NO: 541860 - RNA, 12 nt, Homo sapiens
agcuccuuggcu

SEQ ID NO: 541861 - RNA, 20 nt, Homo sapiens
agcucgggcccucugugaga

SEQ ID NO: 541862 - RNA, 15 nt, Homo sapiens
agcucuaaguuuuga

SEQ ID NO: 541863 - RNA, 14 nt, Homo sapiens
agcucuacugaggu

SEQ ID NO: 541864 - RNA, 17 nt, Homo sapiens
agcucuccccuccugcu

SEQ ID NO: 541865 - RNA, 16 nt, Homo sapiens
agcucuccugacuuuu

SEQ ID NO: 541866 - RNA, 12 nt, Homo sapiens
agcucucuaggc

SEQ ID NO: 541867 - RNA, 19 nt, Homo sapiens
agcucucugacgcuuguga

SEQ ID NO: 541868 - RNA, 22 nt, Homo sapiens
agcucugagacccuuuucucag

SEQ ID NO: 541869 - RNA, 23 nt, Homo sapiens
agcucugcagcacucuuaucuac

SEQ ID NO: 541870 - RNA, 23 nt, Homo sapiens
agcucugccucccucuccauauc

SEQ ID NO: 541871 - RNA, 14 nt, Homo sapiens
agcucuggaccagc

SEQ ID NO: 541872 - RNA, 15 nt, Homo sapiens
agcucuggaccagcc

SEQ ID NO: 541873 - RNA, 22 nt, Homo sapiens
agcucuggggacagcuuccuca

SEQ ID NO: 541874 - RNA, 15 nt, Homo sapiens
agcucugguauauaa

SEQ ID NO: 541875 - RNA, 19 nt, Homo sapiens
agcucugguauauaaucca

SEQ ID NO: 541876 - RNA, 19 nt, Homo sapiens
agcucugguuauuuuucuc

SEQ ID NO: 541877 - RNA, 19 nt, Homo sapiens
caccuagaacacuaacuca

SEQ ID NO: 541878 - RNA, 15 nt, Homo sapiens
caccuagacuguaaa

SEQ ID NO: 541879 - RNA, 16 nt, Homo sapiens
caccuagacuguaaac

SEQ ID NO: 541880 - RNA, 21 nt, Homo sapiens
caccuagagcuagaugugucu

SEQ ID NO: 541881 - RNA, 16 nt, Homo sapiens
caccuagagcuccagu

SEQ ID NO: 541882 - RNA, 17 nt, Homo sapiens
caccuagcugugcaaga

SEQ ID NO: 541883 - RNA, 21 nt, Homo sapiens
caccuagcugugcaagaccua

SEQ ID NO: 541884 - RNA, 13 nt, Homo sapiens
caccuagucugua

SEQ ID NO: 541885 - RNA, 18 nt, Homo sapiens
caccucaagacccccauu

SEQ ID NO: 541886 - RNA, 18 nt, Homo sapiens
caccucaagguguucucu

SEQ ID NO: 541887 - RNA, 23 nt, Homo sapiens
caccucacacuccuccaaggcac

SEQ ID NO: 541888 - RNA, 17 nt, Homo sapiens
caccucagccuggagag

SEQ ID NO: 541889 - RNA, 20 nt, Homo sapiens
caccucccauuacuuugaua

SEQ ID NO: 541890 - RNA, 15 nt, Homo sapiens
caccuccucuaaggu

SEQ ID NO: 541891 - RNA, 13 nt, Homo sapiens
caccucugcacaa

SEQ ID NO: 541892 - RNA, 19 nt, Homo sapiens
caccucugcacaagcugca

SEQ ID NO: 541893 - RNA, 18 nt, Homo sapiens
caccucugccucaaugug

SEQ ID NO: 541894 - RNA, 15 nt, Homo sapiens
caccugaaacacugg

SEQ ID NO: 541895 - RNA, 15 nt, Homo sapiens
ugauggagaggacag

SEQ ID NO: 541896 - RNA, 15 nt, Homo sapiens
ugauggcaccacugc

SEQ ID NO: 541897 - RNA, 15 nt, Homo sapiens
ugauggcacucuguu

SEQ ID NO: 541898 - RNA, 15 nt, Homo sapiens
ugauggcagagccag

SEQ ID NO: 541899 - RNA, 16 nt, Homo sapiens
ugauggccaggccaga

SEQ ID NO: 541900 - RNA, 16 nt, Homo sapiens
ugauggcgggcacugg

SEQ ID NO: 541901 - RNA, 14 nt, Homo sapiens
ugauggcugaagaa

SEQ ID NO: 541902 - RNA, 16 nt, Homo sapiens
ugauggggccuggguu

SEQ ID NO: 541903 - RNA, 20 nt, Homo sapiens
ugaugguauaaacaggagac

SEQ ID NO: 541904 - RNA, 18 nt, Homo sapiens
ugauggugagcugggaag

SEQ ID NO: 541905 - RNA, 17 nt, Homo sapiens
ugaugguggacuaagca

SEQ ID NO: 541906 - RNA, 23 nt, Homo sapiens
ugauguauaaagcaacuguuaug

SEQ ID NO: 541907 - RNA, 19 nt, Homo sapiens
ugauguauuguugcuuuuu

SEQ ID NO: 541908 - RNA, 14 nt, Homo sapiens
ugaugucuaugaua

SEQ ID NO: 541909 - RNA, 20 nt, Homo sapiens
ugaugugauacaaauugaua

SEQ ID NO: 541910 - RNA, 13 nt, Homo sapiens
ugaugugggagcu

SEQ ID NO: 541911 - RNA, 18 nt, Homo sapiens
ugauguguccucagggag

SEQ ID NO: 541912 - RNA, 11 nt, Homo sapiens
ugauguugcug

SEQ ID NO: 541913 - RNA, 17 nt, Homo sapiens
ugauguuucacauaaaa

SEQ ID NO: 541914 - RNA, 13 nt, Homo sapiens
ugauuaacuugcu

SEQ ID NO: 541915 - RNA, 14 nt, Homo sapiens
ugauuaaucaaagg

SEQ ID NO: 541916 - RNA, 22 nt, Homo sapiens
ugauuaccaaaauauauauuaa

SEQ ID NO: 541917 - RNA, 21 nt, Homo sapiens
ugauuaccagucugauuauac

SEQ ID NO: 541918 - RNA, 23 nt, Homo sapiens
ugauuauccauauugagucaaau

SEQ ID NO: 541919 - RNA, 22 nt, Homo sapiens
ugauuaucucuuugaucuacuu

SEQ ID NO: 541920 - RNA, 14 nt, Homo sapiens
ugauucaaaccaaa

SEQ ID NO: 541921 - RNA, 16 nt, Homo sapiens
ugauucaaauugcugc

SEQ ID NO: 541922 - RNA, 16 nt, Homo sapiens
ugauucaccucuuccu

SEQ ID NO: 541923 - RNA, 13 nt, Homo sapiens
ugauucacugcau

SEQ ID NO: 541924 - RNA, 22 nt, Homo sapiens
ugauucccuccugcuacucugu

SEQ ID NO: 541925 - RNA, 20 nt, Homo sapiens
ugauuccuuuaugaugacug

SEQ ID NO: 541926 - RNA, 14 nt, Homo sapiens
ugauucgaaugaca

SEQ ID NO: 541927 - RNA, 15 nt, Homo sapiens
ugauucuaugucuca

SEQ ID NO: 541928 - RNA, 19 nt, Homo sapiens
ugauucugauaaugcucac

SEQ ID NO: 541929 - RNA, 19 nt, Homo sapiens
guccaugugugugcaagug

SEQ ID NO: 541930 - RNA, 21 nt, Homo sapiens
guccauugauuuuaaccaaug

SEQ ID NO: 541931 - RNA, 22 nt, Homo sapiens
guccauuugcugaguuucccuu

SEQ ID NO: 541932 - RNA, 18 nt, Homo sapiens
gucccaacccagacaaug

SEQ ID NO: 541933 - RNA, 11 nt, Homo sapiens
gucccaagaca

SEQ ID NO: 541934 - RNA, 21 nt, Homo sapiens
gucccaaguuggaaauauuca

SEQ ID NO: 541935 - RNA, 15 nt, Homo sapiens
gucccaaucuuacca

SEQ ID NO: 541936 - RNA, 20 nt, Homo sapiens
gucccacgugucuuccacuu

SEQ ID NO: 541937 - RNA, 18 nt, Homo sapiens
gucccacuacuguagaaa

SEQ ID NO: 541938 - RNA, 14 nt, Homo sapiens
gucccagccaguga

SEQ ID NO: 541939 - RNA, 19 nt, Homo sapiens
gucccagcggccucagggu

SEQ ID NO: 541940 - RNA, 18 nt, Homo sapiens
gucccagcuacucaggag

SEQ ID NO: 541941 - RNA, 19 nt, Homo sapiens
gucccaggccaggcuuugu

SEQ ID NO: 541942 - RNA, 15 nt, Homo sapiens
gucccaggcuuccca

SEQ ID NO: 541943 - RNA, 22 nt, Homo sapiens
gucccagggaagguggggcccu

SEQ ID NO: 541944 - RNA, 23 nt, Homo sapiens
gucccagggcccuggaugguccu

SEQ ID NO: 541945 - RNA, 13 nt, Homo sapiens
gucccaugaccca

SEQ ID NO: 541946 - RNA, 21 nt, Homo sapiens
gucccaugaccuugggguaca

SEQ ID NO: 541947 - RNA, 19 nt, Homo sapiens
gucccauggacacuccagu

SEQ ID NO: 541948 - RNA, 14 nt, Homo sapiens
guccccacagacug

SEQ ID NO: 541949 - RNA, 17 nt, Homo sapiens
guccccagagcuacagg

SEQ ID NO: 541950 - RNA, 14 nt, Homo sapiens
guccccagccugcu

SEQ ID NO: 541951 - RNA, 20 nt, Homo sapiens
guccccagccugcucccuag

SEQ ID NO: 541952 - RNA, 22 nt, Homo sapiens
guccccagccugcucccuagcc

SEQ ID NO: 541953 - RNA, 18 nt, Homo sapiens
guccccauccccaccagc

SEQ ID NO: 541954 - RNA, 23 nt, Homo sapiens
gucccccagauuccaacauuucu

SEQ ID NO: 541955 - RNA, 23 nt, Homo sapiens
guccccccaccgcucagugucag

SEQ ID NO: 541956 - RNA, 15 nt, Homo sapiens
gucccccccaggugc

SEQ ID NO: 541957 - RNA, 18 nt, Homo sapiens
guccccguaccaccaugc

SEQ ID NO: 541958 - RNA, 23 nt, Homo sapiens
guccccucauucuacuaauguga

SEQ ID NO: 541959 - RNA, 15 nt, Homo sapiens
guccccuccacuguc

SEQ ID NO: 541960 - RNA, 21 nt, Homo sapiens
guccccuccccggcccuacca

SEQ ID NO: 541961 - RNA, 16 nt, Homo sapiens
guccccucuugaccca

SEQ ID NO: 541962 - RNA, 17 nt, Homo sapiens
guccccucuugacccau

SEQ ID NO: 541963 - RNA, 15 nt, Homo sapiens
guccccuuuccucua

SEQ ID NO: 541964 - RNA, 14 nt, Homo sapiens
gucccgcacagugg

SEQ ID NO: 541965 - RNA, 15 nt, Homo sapiens
gucccgcacagugga

SEQ ID NO: 541966 - RNA, 20 nt, Homo sapiens
gucccggggcuccacugaac

SEQ ID NO: 541967 - RNA, 15 nt, Homo sapiens
gucccgguaccuucc

SEQ ID NO: 541968 - RNA, 17 nt, Homo sapiens
gucccguggcauuucaa

SEQ ID NO: 541969 - RNA, 11 nt, Homo sapiens
gucccuaccuc

SEQ ID NO: 541970 - RNA, 13 nt, Homo sapiens
gucccucccugcc

SEQ ID NO: 541971 - RNA, 20 nt, Homo sapiens
gucccucuucucuccucagu

SEQ ID NO: 541972 - RNA, 19 nt, Homo sapiens
gucccugcagaagccagaa

SEQ ID NO: 541973 - RNA, 21 nt, Homo sapiens
gucccuuccuauucuccugcc

SEQ ID NO: 541974 - RNA, 19 nt, Homo sapiens
gucccuugagacuccccaa

SEQ ID NO: 541975 - RNA, 19 nt, Homo sapiens
gucccuuucgacuugcauu

SEQ ID NO: 541976 - RNA, 22 nt, Homo sapiens
gucccuuugagcagaaauuuau

SEQ ID NO: 541977 - RNA, 13 nt, Homo sapiens
guccgagcuuuga

SEQ ID NO: 541978 - RNA, 16 nt, Homo sapiens
guccuaaagaugcuga

SEQ ID NO: 541979 - RNA, 14 nt, Homo sapiens
guccuaagcacuuu

SEQ ID NO: 541980 - RNA, 14 nt, Homo sapiens
guccuaccuauuau

SEQ ID NO: 541981 - RNA, 17 nt, Homo sapiens
guccuacuaucacugaa

SEQ ID NO: 541982 - RNA, 13 nt, Homo sapiens
guccuaugcgcuc

SEQ ID NO: 541983 - RNA, 21 nt, Homo sapiens
guccucacccugugggaccgc

SEQ ID NO: 541984 - RNA, 20 nt, Homo sapiens
guccucagcugcucccacac

SEQ ID NO: 541985 - RNA, 20 nt, Homo sapiens
guccucauccuuuccugcca

SEQ ID NO: 541986 - RNA, 15 nt, Homo sapiens
guccucauucuugcc

SEQ ID NO: 541987 - RNA, 23 nt, Homo sapiens
guccuccccuauugcgcucucaa

SEQ ID NO: 541988 - RNA, 15 nt, Homo sapiens
guccucuacugcuaa

SEQ ID NO: 541989 - RNA, 14 nt, Homo sapiens
guccucuagugaau

SEQ ID NO: 541990 - RNA, 15 nt, Homo sapiens
guccucucugugucc

SEQ ID NO: 541991 - RNA, 19 nt, Homo sapiens
guccucuggggccuucggg

SEQ ID NO: 541992 - RNA, 19 nt, Homo sapiens
guccucuuaccaacaucug

SEQ ID NO: 541993 - RNA, 18 nt, Homo sapiens
guccucuuccaccacaga

SEQ ID NO: 541994 - RNA, 21 nt, Homo sapiens
guccucuuugugauaauucuc

SEQ ID NO: 541995 - RNA, 17 nt, Homo sapiens
guccugaaaaaugcuca

SEQ ID NO: 541996 - RNA, 19 nt, Homo sapiens
guccugaaaaaugcucaau

SEQ ID NO: 541997 - RNA, 15 nt, Homo sapiens
guccugaucugugau

SEQ ID NO: 541998 - RNA, 13 nt, Homo sapiens
guccugaugcugu

SEQ ID NO: 541999 - RNA, 20 nt, Homo sapiens
guccugaugcuuuugucuaa

SEQ ID NO: 542000 - RNA, 22 nt, Homo sapiens
guccugcagucccacacugugc

SEQ ID NO: 542001 - RNA, 21 nt, Homo sapiens
guccugccccggcugugccag

SEQ ID NO: 542002 - RNA, 14 nt, Homo sapiens
guccuggaaauucu

SEQ ID NO: 542003 - RNA, 17 nt, Homo sapiens
guccuggucaugcacau

SEQ ID NO: 542004 - RNA, 12 nt, Homo sapiens
guccuuaccucg

SEQ ID NO: 542005 - RNA, 19 nt, Homo sapiens
guccuucaaacaauguaaa

SEQ ID NO: 542006 - RNA, 13 nt, Homo sapiens
guccuuccugugc

SEQ ID NO: 542007 - RNA, 13 nt, Homo sapiens
guccuuguguuga

SEQ ID NO: 542008 - RNA, 19 nt, Homo sapiens
guccuuguuguuucuugcc

SEQ ID NO: 542009 - RNA, 14 nt, Homo sapiens
guccuuucauuugu

SEQ ID NO: 542010 - RNA, 18 nt, Homo sapiens
guccuuucccaccauucc

SEQ ID NO: 542011 - RNA, 22 nt, Homo sapiens
guccuuucccaccauuccugcc

SEQ ID NO: 542012 - RNA, 14 nt, Homo sapiens
guccuuuugacacu

SEQ ID NO: 542013 - RNA, 15 nt, Homo sapiens
guccuuuuucacuuu

SEQ ID NO: 542014 - RNA, 21 nt, Homo sapiens
guccuuuuuuauacaggaaaa

SEQ ID NO: 542015 - RNA, 16 nt, Homo sapiens
gucgacuucaugacaa

SEQ ID NO: 542016 - RNA, 13 nt, Homo sapiens
gucgagacuucac

SEQ ID NO: 542017 - RNA, 21 nt, Homo sapiens
ugcacaccuuggaauucgcuu

SEQ ID NO: 542018 - RNA, 19 nt, Homo sapiens
ugcacacguguguaugagu

SEQ ID NO: 542019 - RNA, 12 nt, Homo sapiens
ugcacacugagg

SEQ ID NO: 542020 - RNA, 15 nt, Homo sapiens
ugcacagaagacagc

SEQ ID NO: 542021 - RNA, 11 nt, Homo sapiens
ugcacagaauu

SEQ ID NO: 542022 - RNA, 21 nt, Homo sapiens
ugcacagaauuuguauguauu

SEQ ID NO: 542023 - RNA, 18 nt, Homo sapiens
ugcacagcucaacggaag

SEQ ID NO: 542024 - RNA, 17 nt, Homo sapiens
ugcacagucacugcucu

SEQ ID NO: 542025 - RNA, 16 nt, Homo sapiens
ugcacagugacuucug

SEQ ID NO: 542026 - RNA, 13 nt, Homo sapiens
ugcacagugauau

SEQ ID NO: 542027 - RNA, 15 nt, Homo sapiens
ugcacaucacaacau

SEQ ID NO: 542028 - RNA, 14 nt, Homo sapiens
ugcacaucuacaca

SEQ ID NO: 542029 - RNA, 13 nt, Homo sapiens
ugcacaucugcug

SEQ ID NO: 542030 - RNA, 18 nt, Homo sapiens
ugcacaugaacauauguc

SEQ ID NO: 542031 - RNA, 20 nt, Homo sapiens
ugcacaugccuuaagccagu

SEQ ID NO: 542032 - RNA, 23 nt, Homo sapiens
ugcacaugguucaccaugcagug

SEQ ID NO: 542033 - RNA, 11 nt, Homo sapiens
ugcacauuguu

SEQ ID NO: 542034 - RNA, 20 nt, Homo sapiens
ugcaccaacaucuacaagau

SEQ ID NO: 542035 - RNA, 18 nt, Homo sapiens
ugcaccaacgagcuguac

SEQ ID NO: 542036 - RNA, 20 nt, Homo sapiens
ugcaccacuuccgucccauc

SEQ ID NO: 542037 - RNA, 15 nt, Homo sapiens
ugcaccauugcacuc

SEQ ID NO: 542038 - RNA, 15 nt, Homo sapiens
ugcaccuacugcuua

SEQ ID NO: 542039 - RNA, 24 nt, Homo sapiens
ugcaccuagcugugcaagaccuag

SEQ ID NO: 542040 - RNA, 16 nt, Homo sapiens
ugcaccucagggccaa

SEQ ID NO: 542041 - RNA, 15 nt, Homo sapiens
ugcacgcccaugugu

SEQ ID NO: 542042 - RNA, 14 nt, Homo sapiens
ugcacuagccugug

SEQ ID NO: 542043 - RNA, 15 nt, Homo sapiens
ugcacuauugcacau

SEQ ID NO: 542044 - RNA, 18 nt, Homo sapiens
ugcacucagcucuuggcu

SEQ ID NO: 542045 - RNA, 19 nt, Homo sapiens
ugcacuccagccuggcaau

SEQ ID NO: 542046 - RNA, 20 nt, Homo sapiens
ugcacuccagccugggcaac

SEQ ID NO: 542047 - RNA, 21 nt, Homo sapiens
ugcacuccagccugggggaca

SEQ ID NO: 542048 - RNA, 20 nt, Homo sapiens
ugcacuccagcuugggcaac

SEQ ID NO: 542049 - RNA, 18 nt, Homo sapiens
ugcacuccagucuggcaa

SEQ ID NO: 542050 - RNA, 19 nt, Homo sapiens
ugcacuccagucuggcaac

SEQ ID NO: 542051 - RNA, 12 nt, Homo sapiens
ugcacugaacag

SEQ ID NO: 542052 - RNA, 16 nt, Homo sapiens
ugcacugacagccuug

SEQ ID NO: 542053 - RNA, 11 nt, Homo sapiens
ugcacugcugu

SEQ ID NO: 542054 - RNA, 22 nt, Homo sapiens
ugcacuggggagcccgucucag

SEQ ID NO: 542055 - RNA, 14 nt, Homo sapiens
ugcacuggggccac

SEQ ID NO: 542056 - RNA, 17 nt, Homo sapiens
ugcacuguauugcuccu

SEQ ID NO: 542057 - RNA, 20 nt, Homo sapiens
ugcacuucaaauucaaauaa

SEQ ID NO: 542058 - RNA, 16 nt, Homo sapiens
ugcacuugaacacuga

SEQ ID NO: 542059 - RNA, 23 nt, Homo sapiens
ugcacuuguggcaacagauaagu

SEQ ID NO: 542060 - RNA, 22 nt, Homo sapiens
ugcacuuuagauauacauauca

SEQ ID NO: 542061 - RNA, 12 nt, Homo sapiens
ugcacuuucuau

SEQ ID NO: 542062 - RNA, 20 nt, Homo sapiens
ugcacuuuuuuauaagagcu

SEQ ID NO: 542063 - RNA, 18 nt, Homo sapiens
ugcagaaccacaaacaau

SEQ ID NO: 542064 - RNA, 14 nt, Homo sapiens
ugcagaacugccau

SEQ ID NO: 542065 - RNA, 23 nt, Homo sapiens
ugcagaacuuaaucuggacacac

SEQ ID NO: 542066 - RNA, 13 nt, Homo sapiens
ugcagaaggccaa

SEQ ID NO: 542067 - RNA, 16 nt, Homo sapiens
ugcagaagucccaaga

SEQ ID NO: 542068 - RNA, 17 nt, Homo sapiens
ugcagaauccaaaguaa

SEQ ID NO: 542069 - RNA, 18 nt, Homo sapiens
ugcagaauccaaaguaaa

SEQ ID NO: 542070 - RNA, 20 nt, Homo sapiens
ugcagaauucaaaagugauu

SEQ ID NO: 542071 - RNA, 20 nt, Homo sapiens
ugcagagaaagaaagggaaa

SEQ ID NO: 542072 - RNA, 19 nt, Homo sapiens
ugcagagacucauuucaca

SEQ ID NO: 542073 - RNA, 14 nt, Homo sapiens
ugcagagaugacug

SEQ ID NO: 542074 - RNA, 16 nt, Homo sapiens
ugcagaggcaccucaa

SEQ ID NO: 542075 - RNA, 22 nt, Homo sapiens
ugcagagggugggguacuggag

SEQ ID NO: 542076 - RNA, 19 nt, Homo sapiens
ugcagagguaaaaguguga

SEQ ID NO: 542077 - RNA, 14 nt, Homo sapiens
ugcagagguccaaa

SEQ ID NO: 542078 - RNA, 16 nt, Homo sapiens
ugcagaguaggcagcu

SEQ ID NO: 542079 - RNA, 21 nt, Homo sapiens
ugcagaguauaugaggcuuga

SEQ ID NO: 542080 - RNA, 20 nt, Homo sapiens
ugcagagucacucacaccgu

SEQ ID NO: 542081 - RNA, 14 nt, Homo sapiens
ugcagauaucacag

SEQ ID NO: 542082 - RNA, 21 nt, Homo sapiens
ugcagaugaucagggauccaa

SEQ ID NO: 542083 - RNA, 21 nt, Homo sapiens
ugcagaugccacccuagccaa

SEQ ID NO: 542084 - RNA, 13 nt, Homo sapiens
ugcagaugcugcu

SEQ ID NO: 542085 - RNA, 16 nt, Homo sapiens
ugcagauuccucagau

SEQ ID NO: 542086 - RNA, 21 nt, Homo sapiens
ugcagauuuucuuaaggaauu

SEQ ID NO: 542087 - RNA, 14 nt, Homo sapiens
ugcagcaaccagaa

SEQ ID NO: 542088 - RNA, 17 nt, Homo sapiens
ugcagcaaugaagggaa

SEQ ID NO: 542089 - RNA, 18 nt, Homo sapiens
ugcagcaccucucaggau

SEQ ID NO: 542090 - RNA, 19 nt, Homo sapiens
ugcagcaccucucaggauu

SEQ ID NO: 542091 - RNA, 14 nt, Homo sapiens
ugcagcacucuuau

SEQ ID NO: 542092 - RNA, 15 nt, Homo sapiens
ugcagcacucuuauc

SEQ ID NO: 542093 - RNA, 11 nt, Homo sapiens
ugcagccacac

SEQ ID NO: 542094 - RNA, 16 nt, Homo sapiens
ugcagccaccacaucc

SEQ ID NO: 542095 - RNA, 21 nt, Homo sapiens
ugcagccaccacaucccuuca

SEQ ID NO: 542096 - RNA, 22 nt, Homo sapiens
ugcagccacuggcuuggaacac

SEQ ID NO: 542097 - RNA, 14 nt, Homo sapiens
ugcagccagcauua

SEQ ID NO: 542098 - RNA, 19 nt, Homo sapiens
ugcagcccagaauagcuuu

SEQ ID NO: 542099 - RNA, 16 nt, Homo sapiens
ugcagcccucuugccc

SEQ ID NO: 542100 - RNA, 15 nt, Homo sapiens
ugcagccucucuggc

SEQ ID NO: 542101 - RNA, 16 nt, Homo sapiens
ugcagccuugaccucc

SEQ ID NO: 542102 - RNA, 13 nt, Homo sapiens
ugcagcuacugga

SEQ ID NO: 542103 - RNA, 15 nt, Homo sapiens
ugcagcuacuggaau

SEQ ID NO: 542104 - RNA, 13 nt, Homo sapiens
ugcagcuaucugg

SEQ ID NO: 542105 - RNA, 12 nt, Homo sapiens
ugcagcucucua

SEQ ID NO: 542106 - RNA, 15 nt, Homo sapiens
ugcagcucugaccca

SEQ ID NO: 542107 - RNA, 20 nt, Homo sapiens
ugcagcuggaaaagggucuu

SEQ ID NO: 542108 - RNA, 14 nt, Homo sapiens
ugcagcugucacag

SEQ ID NO: 542109 - RNA, 16 nt, Homo sapiens
ugcaggaaaagcaaaa

SEQ ID NO: 542110 - RNA, 16 nt, Homo sapiens
ugcaggacuugagaag

SEQ ID NO: 542111 - RNA, 20 nt, Homo sapiens
ugcaggacuugagaagaccu

SEQ ID NO: 542112 - RNA, 18 nt, Homo sapiens
ugcaggaucccuacugcc

SEQ ID NO: 542113 - RNA, 20 nt, Homo sapiens
ugcaggaucccuacugccaa

SEQ ID NO: 542114 - RNA, 21 nt, Homo sapiens
ugcaggauuuguuguucugac

SEQ ID NO: 542115 - RNA, 22 nt, Homo sapiens
ugcaggcaggaacaaacagggc

SEQ ID NO: 542116 - RNA, 21 nt, Homo sapiens
ugcaggcugccucuucugccc

SEQ ID NO: 542117 - RNA, 16 nt, Homo sapiens
ugcaggggauggugug

SEQ ID NO: 542118 - RNA, 21 nt, Homo sapiens
ugcaggggaugguguggucaa

SEQ ID NO: 542119 - RNA, 16 nt, Homo sapiens
ugcagggguccacugu

SEQ ID NO: 542120 - RNA, 13 nt, Homo sapiens
ugcaggggucccc

SEQ ID NO: 542121 - RNA, 19 nt, Homo sapiens
ugcagggguccccccucaa

SEQ ID NO: 542122 - RNA, 16 nt, Homo sapiens
ugcaggggucucaugu

SEQ ID NO: 542123 - RNA, 20 nt, Homo sapiens
ugcagguggugggacacugg

SEQ ID NO: 542124 - RNA, 18 nt, Homo sapiens
ugcagguuuguuacauag

SEQ ID NO: 542125 - RNA, 18 nt, Homo sapiens
ugcaguacaggacauaua

SEQ ID NO: 542126 - RNA, 22 nt, Homo sapiens
ugcaguagagucaucuccauca

SEQ ID NO: 542127 - RNA, 13 nt, Homo sapiens
ugcaguaguauuu

SEQ ID NO: 542128 - RNA, 14 nt, Homo sapiens
ugcaguaguauuua

SEQ ID NO: 542129 - RNA, 16 nt, Homo sapiens
ugcaguaucucuuaca

SEQ ID NO: 542130 - RNA, 21 nt, Homo sapiens
ugcaguaucuguugcuugucu

SEQ ID NO: 542131 - RNA, 20 nt, Homo sapiens
ugcaguaugaacuauugccu

SEQ ID NO: 542132 - RNA, 14 nt, Homo sapiens
ugcagucacuguga

SEQ ID NO: 542133 - RNA, 13 nt, Homo sapiens
ugcagucaucucc

SEQ ID NO: 542134 - RNA, 15 nt, Homo sapiens
ugcaguccauuuccu

SEQ ID NO: 542135 - RNA, 17 nt, Homo sapiens
ugcagucccacacugug

SEQ ID NO: 542136 - RNA, 15 nt, Homo sapiens
ugcagucccuggaaa

SEQ ID NO: 542137 - RNA, 19 nt, Homo sapiens
ugcagucgggaccucccag

SEQ ID NO: 542138 - RNA, 13 nt, Homo sapiens
ugcagucugggug

SEQ ID NO: 542139 - RNA, 21 nt, Homo sapiens
gccuaaaaaguaucauuacau

SEQ ID NO: 542140 - RNA, 22 nt, Homo sapiens
gccuaaaaauucccuuccuguu

SEQ ID NO: 542141 - RNA, 20 nt, Homo sapiens
gccuaaaagugggcuugauu

SEQ ID NO: 542142 - RNA, 15 nt, Homo sapiens
gccuaaaaguuacuu

SEQ ID NO: 542143 - RNA, 15 nt, Homo sapiens
gccuaaauauaauua

SEQ ID NO: 542144 - RNA, 15 nt, Homo sapiens
gccuaaaugccuuag

SEQ ID NO: 542145 - RNA, 19 nt, Homo sapiens
gccuaaauuuaaugcugcc

SEQ ID NO: 542146 - RNA, 16 nt, Homo sapiens
gccuaacuaacuggca

SEQ ID NO: 542147 - RNA, 21 nt, Homo sapiens
gccuaauggcuuucacuuucu

SEQ ID NO: 542148 - RNA, 14 nt, Homo sapiens
gccuaauuuaccaa

SEQ ID NO: 542149 - RNA, 16 nt, Homo sapiens
gccuacaugcuuugug

SEQ ID NO: 542150 - RNA, 21 nt, Homo sapiens
gccuaccucuuagacauguug

SEQ ID NO: 542151 - RNA, 19 nt, Homo sapiens
gccuacuuaagagugcugu

SEQ ID NO: 542152 - RNA, 18 nt, Homo sapiens
gccuagcugcugucacau

SEQ ID NO: 542153 - RNA, 21 nt, Homo sapiens
gccuaggaguugaguacagug

SEQ ID NO: 542154 - RNA, 16 nt, Homo sapiens
gccuaggugcgcagug

SEQ ID NO: 542155 - RNA, 16 nt, Homo sapiens
gccuaucagcauuuua

SEQ ID NO: 542156 - RNA, 18 nt, Homo sapiens
gccuaucuggaagccacc

SEQ ID NO: 542157 - RNA, 22 nt, Homo sapiens
gccuaugauauuccccauuucc

SEQ ID NO: 542158 - RNA, 22 nt, Homo sapiens
gccuauuaucugucagcugcaa

SEQ ID NO: 542159 - RNA, 12 nt, Homo sapiens
gccuauuccagg

SEQ ID NO: 542160 - RNA, 23 nt, Homo sapiens
gccucaaaacagaagcagcuucu

SEQ ID NO: 542161 - RNA, 20 nt, Homo sapiens
gccucaagaacaaacacugc

SEQ ID NO: 542162 - RNA, 13 nt, Homo sapiens
gccucaaugccag

SEQ ID NO: 542163 - RNA, 17 nt, Homo sapiens
gccucacggagggccgu

SEQ ID NO: 542164 - RNA, 17 nt, Homo sapiens
gccucacucaccaucug

SEQ ID NO: 542165 - RNA, 12 nt, Homo sapiens
gccucacuuuua

SEQ ID NO: 542166 - RNA, 12 nt, Homo sapiens
gccucagccagg

SEQ ID NO: 542167 - RNA, 15 nt, Homo sapiens
gccucagcccagguc

SEQ ID NO: 542168 - RNA, 17 nt, Homo sapiens
gccucagcccugacccu

SEQ ID NO: 542169 - RNA, 15 nt, Homo sapiens
gccucagugacccau

SEQ ID NO: 542170 - RNA, 23 nt, Homo sapiens
gccucauauuuaaagacagggaa

SEQ ID NO: 542171 - RNA, 15 nt, Homo sapiens
gccucaucuccuuua

SEQ ID NO: 542172 - RNA, 12 nt, Homo sapiens
gccucaugggcc

SEQ ID NO: 542173 - RNA, 13 nt, Homo sapiens
gccucauuucacu

SEQ ID NO: 542174 - RNA, 23 nt, Homo sapiens
gccuccacaugcugccuggcaca

SEQ ID NO: 542175 - RNA, 20 nt, Homo sapiens
gccuccaccuccuaggcuca

SEQ ID NO: 542176 - RNA, 16 nt, Homo sapiens
gccuccagcaccaagg

SEQ ID NO: 542177 - RNA, 11 nt, Homo sapiens
gccuccagggc

SEQ ID NO: 542178 - RNA, 15 nt, Homo sapiens
gccuccagugcaguc

SEQ ID NO: 542179 - RNA, 18 nt, Homo sapiens
gccuccaugugggugcua

SEQ ID NO: 542180 - RNA, 23 nt, Homo sapiens
gccucccacacugaaaccaaaac

SEQ ID NO: 542181 - RNA, 21 nt, Homo sapiens
gccuccccaugggcacagugg

SEQ ID NO: 542182 - RNA, 22 nt, Homo sapiens
gccuccccauuucccaucugca

SEQ ID NO: 542183 - RNA, 16 nt, Homo sapiens
gccucccuugucucag

SEQ ID NO: 542184 - RNA, 18 nt, Homo sapiens
gccucccuuguggcagca

SEQ ID NO: 542185 - RNA, 13 nt, Homo sapiens
gccuccucagggg

SEQ ID NO: 542186 - RNA, 13 nt, Homo sapiens
gccuccucaguga

SEQ ID NO: 542187 - RNA, 20 nt, Homo sapiens
gccuccuccagaauggagcu

SEQ ID NO: 542188 - RNA, 22 nt, Homo sapiens
gccuccucccugggcagaaagu

SEQ ID NO: 542189 - RNA, 21 nt, Homo sapiens
gccuccucucucaaacugggg

SEQ ID NO: 542190 - RNA, 19 nt, Homo sapiens
gccuccuggaaucaguauu

SEQ ID NO: 542191 - RNA, 23 nt, Homo sapiens
gccuccugugacgugaggcccau

SEQ ID NO: 542192 - RNA, 16 nt, Homo sapiens
gccucgaaacacagaa

SEQ ID NO: 542193 - RNA, 18 nt, Homo sapiens
gccucgcagccuccggaa

SEQ ID NO: 542194 - RNA, 13 nt, Homo sapiens
gccucgggaccaa

SEQ ID NO: 542195 - RNA, 14 nt, Homo sapiens
gccucuacuuugau

SEQ ID NO: 542196 - RNA, 12 nt, Homo sapiens
gccucucagguu

SEQ ID NO: 542197 - RNA, 15 nt, Homo sapiens
gccucuccaucugua

SEQ ID NO: 542198 - RNA, 13 nt, Homo sapiens
gccucucucugcu

SEQ ID NO: 542199 - RNA, 22 nt, Homo sapiens
gccucucugccugggaugggcu

SEQ ID NO: 542200 - RNA, 14 nt, Homo sapiens
gccucucuugcccc

SEQ ID NO: 542201 - RNA, 14 nt, Homo sapiens
gccucugaagccua

SEQ ID NO: 542202 - RNA, 19 nt, Homo sapiens
gccucugaguuuugaugcu

SEQ ID NO: 542203 - RNA, 17 nt, Homo sapiens
gccucuggaaagcaaag

SEQ ID NO: 542204 - RNA, 13 nt, Homo sapiens
gccucugugcaca

SEQ ID NO: 542205 - RNA, 14 nt, Homo sapiens
gccucugugccuuc

SEQ ID NO: 542206 - RNA, 14 nt, Homo sapiens
gccucuguggcacu

SEQ ID NO: 542207 - RNA, 19 nt, Homo sapiens
gccucuuauuccaggagaa

SEQ ID NO: 542208 - RNA, 22 nt, Homo sapiens
gccucuuccgugacgucacugg

SEQ ID NO: 542209 - RNA, 16 nt, Homo sapiens
gccucuuggcuucuca

SEQ ID NO: 542210 - RNA, 19 nt, Homo sapiens
gccucuuggguucaaguga

SEQ ID NO: 542211 - RNA, 21 nt, Homo sapiens
gccugaaacccgcccucaggg

SEQ ID NO: 542212 - RNA, 14 nt, Homo sapiens
gccugaaagcaaga

SEQ ID NO: 542213 - RNA, 13 nt, Homo sapiens
gccugacgcauuc

SEQ ID NO: 542214 - RNA, 22 nt, Homo sapiens
gccugagcuggccuccuaugcc

SEQ ID NO: 542215 - RNA, 14 nt, Homo sapiens
gccugaggcuguaa

SEQ ID NO: 542216 - RNA, 17 nt, Homo sapiens
gccugagggcgagggga

SEQ ID NO: 542217 - RNA, 17 nt, Homo sapiens
gccugagucagugcucu

SEQ ID NO: 542218 - RNA, 18 nt, Homo sapiens
gccugagucuccugugcc

SEQ ID NO: 542219 - RNA, 22 nt, Homo sapiens
gccugauacuuuagccaucaua

SEQ ID NO: 542220 - RNA, 22 nt, Homo sapiens
gccugaucagcgccgcaccagc

SEQ ID NO: 542221 - RNA, 14 nt, Homo sapiens
gccugaucuugccu

SEQ ID NO: 542222 - RNA, 15 nt, Homo sapiens
gccugauuuugggga

SEQ ID NO: 542223 - RNA, 21 nt, Homo sapiens
gccugcacagugaagugcugg

SEQ ID NO: 542224 - RNA, 15 nt, Homo sapiens
gccugcaucugugaa

SEQ ID NO: 542225 - RNA, 16 nt, Homo sapiens
gccugcaucugugaaa

SEQ ID NO: 542226 - RNA, 16 nt, Homo sapiens
gccugccacugagcag

SEQ ID NO: 542227 - RNA, 21 nt, Homo sapiens
gccugccagcuucugccuuca

SEQ ID NO: 542228 - RNA, 20 nt, Homo sapiens
gccugcccccuaucuugucc

SEQ ID NO: 542229 - RNA, 18 nt, Homo sapiens
gccugcccgcugcaaugc

SEQ ID NO: 542230 - RNA, 19 nt, Homo sapiens
gccugcccugcccaggugg

SEQ ID NO: 542231 - RNA, 18 nt, Homo sapiens
gccugccgcugcaccugc

SEQ ID NO: 542232 - RNA, 18 nt, Homo sapiens
gccugccuucagcuagaa

SEQ ID NO: 542233 - RNA, 20 nt, Homo sapiens
gccugcggaccagaugaaug

SEQ ID NO: 542234 - RNA, 14 nt, Homo sapiens
gccugcgucuuccg

SEQ ID NO: 542235 - RNA, 22 nt, Homo sapiens
gccugcuauuugaaguguaauu

SEQ ID NO: 542236 - RNA, 16 nt, Homo sapiens
gccugcucccuagcca

SEQ ID NO: 542237 - RNA, 13 nt, Homo sapiens
gccugcuccucac

SEQ ID NO: 542238 - RNA, 18 nt, Homo sapiens
gccugcucugcugugagc

SEQ ID NO: 542239 - RNA, 13 nt, Homo sapiens
gccugcugugcug

SEQ ID NO: 542240 - RNA, 19 nt, Homo sapiens
gccugcuguggacccuguc

SEQ ID NO: 542241 - RNA, 21 nt, Homo sapiens
gccugcuucuucucuccacau

SEQ ID NO: 542242 - RNA, 15 nt, Homo sapiens
gccugcuuugcuuua

SEQ ID NO: 542243 - RNA, 21 nt, Homo sapiens
gccuggaacugcaucagugac

SEQ ID NO: 542244 - RNA, 14 nt, Homo sapiens
gccuggacccugug

SEQ ID NO: 542245 - RNA, 23 nt, Homo sapiens
gccuggacuagagggaccucucc

SEQ ID NO: 542246 - RNA, 16 nt, Homo sapiens
gccuggacuuuccugc

SEQ ID NO: 542247 - RNA, 20 nt, Homo sapiens
gccuggagacaaggugcuaa

SEQ ID NO: 542248 - RNA, 17 nt, Homo sapiens
gccuggagggcacuucc

SEQ ID NO: 542249 - RNA, 17 nt, Homo sapiens
gccuggaguugacugac

SEQ ID NO: 542250 - RNA, 19 nt, Homo sapiens
gccuggaucccugcccuuc

SEQ ID NO: 542251 - RNA, 23 nt, Homo sapiens
gccuggaucuccccacucuaggg

SEQ ID NO: 542252 - RNA, 19 nt, Homo sapiens
gccuggcaagugggugaaa

SEQ ID NO: 542253 - RNA, 21 nt, Homo sapiens
gccuggcacacgccuguauuc

SEQ ID NO: 542254 - RNA, 14 nt, Homo sapiens
gccuggcacaucag

SEQ ID NO: 542255 - RNA, 15 nt, Homo sapiens
gccuggcaucugugc

SEQ ID NO: 542256 - RNA, 16 nt, Homo sapiens
gccuggccaccagcca

SEQ ID NO: 542257 - RNA, 17 nt, Homo sapiens
gccuggccagcacccca

SEQ ID NO: 542258 - RNA, 14 nt, Homo sapiens
gccugggacccagc

SEQ ID NO: 542259 - RNA, 15 nt, Homo sapiens
ucaucuucacugcaa

SEQ ID NO: 542260 - RNA, 16 nt, Homo sapiens
ucaucuuggaacugca

SEQ ID NO: 542261 - RNA, 21 nt, Homo sapiens
gccugggcucccuugugcgug

SEQ ID NO: 542262 - RNA, 21 nt, Homo sapiens
gccuggggcaggucacuuuac

SEQ ID NO: 542263 - RNA, 23 nt, Homo sapiens
gccugggguggggucaugcccuc

SEQ ID NO: 542264 - RNA, 23 nt, Homo sapiens
gccugggucccacucaggugaaa

SEQ ID NO: 542265 - RNA, 15 nt, Homo sapiens
gccugggugacagug

SEQ ID NO: 542266 - RNA, 18 nt, Homo sapiens
gccugguagaauugggaa

SEQ ID NO: 542267 - RNA, 16 nt, Homo sapiens
gccuggucguuuucaa

SEQ ID NO: 542268 - RNA, 19 nt, Homo sapiens
gccuggugggggaagggga

SEQ ID NO: 542269 - RNA, 22 nt, Homo sapiens
gccuguaaacuaaaaucuguua

SEQ ID NO: 542270 - RNA, 14 nt, Homo sapiens
gccuguaaucccag

SEQ ID NO: 542271 - RNA, 22 nt, Homo sapiens
gccuguaaucccagcacuuugg

SEQ ID NO: 542272 - RNA, 19 nt, Homo sapiens
gccuguaauccuagcacuu

SEQ ID NO: 542273 - RNA, 20 nt, Homo sapiens
gccuguaauccuagcacuuu

SEQ ID NO: 542274 - RNA, 22 nt, Homo sapiens
gccuguaauccuagcacuuugg

SEQ ID NO: 542275 - RNA, 18 nt, Homo sapiens
gccuguacugaagcugaa

SEQ ID NO: 542276 - RNA, 13 nt, Homo sapiens
gccuguaguccca

SEQ ID NO: 542277 - RNA, 21 nt, Homo sapiens
gccugucccaggacucacccu

SEQ ID NO: 542278 - RNA, 23 nt, Homo sapiens
gccugucgcaugagaacauuaac

SEQ ID NO: 542279 - RNA, 21 nt, Homo sapiens
gccugucucuuuccacuuugu

SEQ ID NO: 542280 - RNA, 18 nt, Homo sapiens
gccugucuguuacacugg

SEQ ID NO: 542281 - RNA, 21 nt, Homo sapiens
gccugucuuaauuuucuuuca

SEQ ID NO: 542282 - RNA, 20 nt, Homo sapiens
gccugugagguaacugggau

SEQ ID NO: 542283 - RNA, 23 nt, Homo sapiens
gccugugauuaacuugcuuagua

SEQ ID NO: 542284 - RNA, 12 nt, Homo sapiens
gccugugccagc

SEQ ID NO: 542285 - RNA, 19 nt, Homo sapiens
gccugugccagcaccuuug

SEQ ID NO: 542286 - RNA, 15 nt, Homo sapiens
gccugugccaugccc

SEQ ID NO: 542287 - RNA, 23 nt, Homo sapiens
gccuguggcgccgucuccagggg

SEQ ID NO: 542288 - RNA, 10 nt, Homo sapiens
gccuguggug

SEQ ID NO: 542289 - RNA, 12 nt, Homo sapiens
gccuguggugcu

SEQ ID NO: 542290 - RNA, 20 nt, Homo sapiens
gccugugguuacagugcaga

SEQ ID NO: 542291 - RNA, 20 nt, Homo sapiens
gccuguuauaacucugcacu

SEQ ID NO: 542292 - RNA, 14 nt, Homo sapiens
gccuguuccaugaa

SEQ ID NO: 542293 - RNA, 23 nt, Homo sapiens
gccuguucuuuuaccacugacag

SEQ ID NO: 542294 - RNA, 20 nt, Homo sapiens
gccuguugaagaugcuugua

SEQ ID NO: 542295 - RNA, 17 nt, Homo sapiens
gccuguugaagguacau

SEQ ID NO: 542296 - RNA, 23 nt, Homo sapiens
gccuguuucuggauuugcaggug

SEQ ID NO: 542297 - RNA, 22 nt, Homo sapiens
gccuguuugcuuagcauuccua

SEQ ID NO: 542298 - RNA, 20 nt, Homo sapiens
gccuuaaaccuaccucccac

SEQ ID NO: 542299 - RNA, 15 nt, Homo sapiens
gccuuacacugaaaa

SEQ ID NO: 542300 - RNA, 20 nt, Homo sapiens
gccuuacaucuggcuggaaa

SEQ ID NO: 542301 - RNA, 20 nt, Homo sapiens
gccuuagaaauguaaacugc

SEQ ID NO: 542302 - RNA, 22 nt, Homo sapiens
gccuuagaaauguaaacugcca

SEQ ID NO: 542303 - RNA, 13 nt, Homo sapiens
gccuuagcaguaa

SEQ ID NO: 542304 - RNA, 14 nt, Homo sapiens
gccuuagcauguga

SEQ ID NO: 542305 - RNA, 15 nt, Homo sapiens
gccuuagggauacag

SEQ ID NO: 542306 - RNA, 16 nt, Homo sapiens
gccuuagggcacuggg

SEQ ID NO: 542307 - RNA, 18 nt, Homo sapiens
gccuuagucucaguuugu

SEQ ID NO: 542308 - RNA, 12 nt, Homo sapiens
gccuuagugggc

SEQ ID NO: 542309 - RNA, 15 nt, Homo sapiens
gccuuagugggccag

SEQ ID NO: 542310 - RNA, 17 nt, Homo sapiens
gccuuauuaaagcaaaa

SEQ ID NO: 542311 - RNA, 17 nt, Homo sapiens
gccuucagcaugccuga

SEQ ID NO: 542312 - RNA, 21 nt, Homo sapiens
gccuucccaaguugugcuuga

SEQ ID NO: 542313 - RNA, 22 nt, Homo sapiens
gccuucccugacacccugggcu

SEQ ID NO: 542314 - RNA, 18 nt, Homo sapiens
gccuucccugacuuacaa

SEQ ID NO: 542315 - RNA, 12 nt, Homo sapiens
gccuuccugacc

SEQ ID NO: 542316 - RNA, 20 nt, Homo sapiens
gccuuccugggcagccuuuc

SEQ ID NO: 542317 - RNA, 19 nt, Homo sapiens
gccuucgcacucaaugcca

SEQ ID NO: 542318 - RNA, 13 nt, Homo sapiens
gccuucucaggaa

SEQ ID NO: 542319 - RNA, 17 nt, Homo sapiens
gccuucugguuauuuau

SEQ ID NO: 542320 - RNA, 13 nt, Homo sapiens
gccuugaaaaaga

SEQ ID NO: 542321 - RNA, 18 nt, Homo sapiens
gccuugaaacaguuccau

SEQ ID NO: 542322 - RNA, 16 nt, Homo sapiens
gccuugaaaccaccuu

SEQ ID NO: 542323 - RNA, 16 nt, Homo sapiens
gccuugacaacagacu

SEQ ID NO: 542324 - RNA, 22 nt, Homo sapiens
gccuugacaucaguuccuuugu

SEQ ID NO: 542325 - RNA, 16 nt, Homo sapiens
gccuugagagacccag

SEQ ID NO: 542326 - RNA, 18 nt, Homo sapiens
gccuugcggaagccauag

SEQ ID NO: 542327 - RNA, 19 nt, Homo sapiens
gccuugcuuggcccaucca

SEQ ID NO: 542328 - RNA, 18 nt, Homo sapiens
gccuugguaugugccagg

SEQ ID NO: 542329 - RNA, 18 nt, Homo sapiens
gccuuguaagacccuuau

SEQ ID NO: 542330 - RNA, 19 nt, Homo sapiens
gccuugucucucacugcau

SEQ ID NO: 542331 - RNA, 21 nt, Homo sapiens
gccuugucucucacugcauuu

SEQ ID NO: 542332 - RNA, 16 nt, Homo sapiens
gccuugugucacuggc

SEQ ID NO: 542333 - RNA, 13 nt, Homo sapiens
gccuuguuccuca

SEQ ID NO: 542334 - RNA, 21 nt, Homo sapiens
gccuuguuucaccuuccaugu

SEQ ID NO: 542335 - RNA, 15 nt, Homo sapiens
gccuuuaagaaccuu

SEQ ID NO: 542336 - RNA, 12 nt, Homo sapiens
gccuuuaauauu

SEQ ID NO: 542337 - RNA, 21 nt, Homo sapiens
gccuuuaguuuuaacaguuca

SEQ ID NO: 542338 - RNA, 21 nt, Homo sapiens
gccuuuauuuuuaaccugcca

SEQ ID NO: 542339 - RNA, 19 nt, Homo sapiens
gccuuuccccccagagggc

SEQ ID NO: 542340 - RNA, 21 nt, Homo sapiens
gccuuucuaguccuauucuau

SEQ ID NO: 542341 - RNA, 23 nt, Homo sapiens
gccuuugucaauaaaccugucau

SEQ ID NO: 542342 - RNA, 20 nt, Homo sapiens
gccuuuguccccacacagcc

SEQ ID NO: 542343 - RNA, 15 nt, Homo sapiens
gccuuuguuucccau

SEQ ID NO: 542344 - RNA, 12 nt, Homo sapiens
gccuuuugcccg

SEQ ID NO: 542345 - RNA, 22 nt, Homo sapiens
gccuuuugcucacaaaaccugg

SEQ ID NO: 542346 - RNA, 17 nt, Homo sapiens
gccuuuugggcauucuc

SEQ ID NO: 542347 - RNA, 21 nt, Homo sapiens
gcgaaaguucuugguggugga

SEQ ID NO: 542348 - RNA, 17 nt, Homo sapiens
gcgaaccacccaaaaca

SEQ ID NO: 542349 - RNA, 13 nt, Homo sapiens
gcgacacucaggg

SEQ ID NO: 542350 - RNA, 22 nt, Homo sapiens
gcgacagauucauaaaguaaug

SEQ ID NO: 542351 - RNA, 21 nt, Homo sapiens
gcgagaaggaguguaugagug

SEQ ID NO: 542352 - RNA, 13 nt, Homo sapiens
gcgagacuccauc

SEQ ID NO: 542353 - RNA, 20 nt, Homo sapiens
gcgagagguggagugucaca

SEQ ID NO: 542354 - RNA, 20 nt, Homo sapiens
gcgagcagucagcauucuua

SEQ ID NO: 542355 - RNA, 16 nt, Homo sapiens
gcgaggccucucucag

SEQ ID NO: 542356 - RNA, 14 nt, Homo sapiens
gcgaggugggagag

SEQ ID NO: 542357 - RNA, 20 nt, Homo sapiens
gcgaucucagcucaccucaa

SEQ ID NO: 542358 - RNA, 18 nt, Homo sapiens
gcgaugaggggacauuuu

SEQ ID NO: 542359 - RNA, 11 nt, Homo sapiens
gcgaugugcaa

SEQ ID NO: 542360 - RNA, 16 nt, Homo sapiens
gcgauguggacgucac

SEQ ID NO: 542361 - RNA, 17 nt, Homo sapiens
gcgauugaaagggcaau

SEQ ID NO: 542362 - RNA, 14 nt, Homo sapiens
gcgauuugagggag

SEQ ID NO: 542363 - RNA, 20 nt, Homo sapiens
gcgcaauugcucaugcauag

SEQ ID NO: 542364 - RNA, 12 nt, Homo sapiens
gcgcaccuguag

SEQ ID NO: 542365 - RNA, 16 nt, Homo sapiens
gcgcagggacaugggg

SEQ ID NO: 542366 - RNA, 14 nt, Homo sapiens
gcgcaucaggccug

SEQ ID NO: 542367 - RNA, 16 nt, Homo sapiens
gcgcauugagccagug

SEQ ID NO: 542368 - RNA, 19 nt, Homo sapiens
gcgccagggcccaggccau

SEQ ID NO: 542369 - RNA, 15 nt, Homo sapiens
gcgcccuuaccuucc

SEQ ID NO: 542370 - RNA, 14 nt, Homo sapiens
gcgccgugcuguaa

SEQ ID NO: 542371 - RNA, 11 nt, Homo sapiens
gcgcgcugagc

SEQ ID NO: 542372 - RNA, 17 nt, Homo sapiens
gcgcggcgagggcaaag

SEQ ID NO: 542373 - RNA, 14 nt, Homo sapiens
gcgcgguggcucac

SEQ ID NO: 542374 - RNA, 14 nt, Homo sapiens
gcgcucccgcauuu

SEQ ID NO: 542375 - RNA, 11 nt, Homo sapiens
gcgcucgccac

SEQ ID NO: 542376 - RNA, 15 nt, Homo sapiens
gcgcucucuuugcaa

SEQ ID NO: 542377 - RNA, 20 nt, Homo sapiens
gcgcuguuuucucagcucca

SEQ ID NO: 542378 - RNA, 13 nt, Homo sapiens
gcgcuuacuccuc

SEQ ID NO: 542379 - RNA, 18 nt, Homo sapiens
gcgcuucccaacuucaua

SEQ ID NO: 542380 - RNA, 19 nt, Homo sapiens
gcgcuuuugucugcaaugg

SEQ ID NO: 542381 - RNA, 21 nt, Homo sapiens
gcggaaagccuguaagccugc

SEQ ID NO: 542382 - RNA, 12 nt, Homo sapiens
uccaaagaggcu

SEQ ID NO: 542383 - RNA, 15 nt, Homo sapiens
uccaaagaggcugcc

SEQ ID NO: 542384 - RNA, 20 nt, Homo sapiens
uccaaagcacauugaaagag

SEQ ID NO: 542385 - RNA, 14 nt, Homo sapiens
uccaaagcuuuauu

SEQ ID NO: 542386 - RNA, 17 nt, Homo sapiens
uccaaaggaaucuccag

SEQ ID NO: 542387 - RNA, 16 nt, Homo sapiens
uccaaaggcucuguua

SEQ ID NO: 542388 - RNA, 17 nt, Homo sapiens
uccaaaggucugauguc

SEQ ID NO: 542389 - RNA, 17 nt, Homo sapiens
uccaaaguacacuguuu

SEQ ID NO: 542390 - RNA, 22 nt, Homo sapiens
uccaaaguuauccccuccuuua

SEQ ID NO: 542391 - RNA, 14 nt, Homo sapiens
uccaaauaacauca

SEQ ID NO: 542392 - RNA, 15 nt, Homo sapiens
uccaaauaacaucaa

SEQ ID NO: 542393 - RNA, 15 nt, Homo sapiens
uccaaauaaccaugu

SEQ ID NO: 542394 - RNA, 12 nt, Homo sapiens
uccaaauaccca

SEQ ID NO: 542395 - RNA, 16 nt, Homo sapiens
uccaaaugcccagcuu

SEQ ID NO: 542396 - RNA, 15 nt, Homo sapiens
uccaaauggacauaa

SEQ ID NO: 542397 - RNA, 16 nt, Homo sapiens
uccaaauggcuauuau

SEQ ID NO: 542398 - RNA, 18 nt, Homo sapiens
uccaacaagaaugcauuc

SEQ ID NO: 542399 - RNA, 19 nt, Homo sapiens
uccaacacuuugagcauuu

SEQ ID NO: 542400 - RNA, 19 nt, Homo sapiens
uccaacagcucaagucuuc

SEQ ID NO: 542401 - RNA, 20 nt, Homo sapiens
uccaacauuucucacugaaa

SEQ ID NO: 542402 - RNA, 21 nt, Homo sapiens
uccaacauuucucacugaaag

SEQ ID NO: 542403 - RNA, 14 nt, Homo sapiens
uccaaccacuguac

SEQ ID NO: 542404 - RNA, 13 nt, Homo sapiens
uccaaccaggcag

SEQ ID NO: 542405 - RNA, 22 nt, Homo sapiens
uccaacccagccacgacugcca

SEQ ID NO: 542406 - RNA, 23 nt, Homo sapiens
uccaacccugccgucaccaccac

SEQ ID NO: 542407 - RNA, 17 nt, Homo sapiens
uccaacgccccuguggc

SEQ ID NO: 542408 - RNA, 18 nt, Homo sapiens
uccaacucuugguauuac

SEQ ID NO: 542409 - RNA, 13 nt, Homo sapiens
uccaacuuaacau

SEQ ID NO: 542410 - RNA, 22 nt, Homo sapiens
uccaacuugaugucaagcaaug

SEQ ID NO: 542411 - RNA, 16 nt, Homo sapiens
uccaagauguucuccu

SEQ ID NO: 542412 - RNA, 18 nt, Homo sapiens
uccaagcaaguagcuuuc

SEQ ID NO: 542413 - RNA, 15 nt, Homo sapiens
uccaagcacagagcc

SEQ ID NO: 542414 - RNA, 23 nt, Homo sapiens
uccaagccucucuggcacuuuga

SEQ ID NO: 542415 - RNA, 23 nt, Homo sapiens
uccaagccugaccacgcuuucua

SEQ ID NO: 542416 - RNA, 18 nt, Homo sapiens
uccaagcgcgcuguugau

SEQ ID NO: 542417 - RNA, 16 nt, Homo sapiens
uccaaggacauauugc

SEQ ID NO: 542418 - RNA, 23 nt, Homo sapiens
uccaaggaccucucucaaugcca

SEQ ID NO: 542419 - RNA, 20 nt, Homo sapiens
uccaaggaggggcuguaaaa

SEQ ID NO: 542420 - RNA, 19 nt, Homo sapiens
uccaaggauggaccacaca

SEQ ID NO: 542421 - RNA, 13 nt, Homo sapiens
uccaaggcuuuaa

SEQ ID NO: 542422 - RNA, 17 nt, Homo sapiens
uccaaggguacuaagga

SEQ ID NO: 542423 - RNA, 17 nt, Homo sapiens
uccaagugccacaugcc

SEQ ID NO: 542424 - RNA, 17 nt, Homo sapiens
uccaaguugagauuuua

SEQ ID NO: 542425 - RNA, 19 nt, Homo sapiens
uccaaguuuuaauuuuuaa

SEQ ID NO: 542426 - RNA, 15 nt, Homo sapiens
uccaauaggcauuug

SEQ ID NO: 542427 - RNA, 17 nt, Homo sapiens
uccaauauuggagcaua

SEQ ID NO: 542428 - RNA, 17 nt, Homo sapiens
uccaauauuuugccuuu

SEQ ID NO: 542429 - RNA, 18 nt, Homo sapiens
uccaauccacuaacacuu

SEQ ID NO: 542430 - RNA, 23 nt, Homo sapiens
uccaauccagaggaacaagcaug

SEQ ID NO: 542431 - RNA, 22 nt, Homo sapiens
uccaaugaaaaaauuaaaaccu

SEQ ID NO: 542432 - RNA, 22 nt, Homo sapiens
uccaaugauacccaacaguuua

SEQ ID NO: 542433 - RNA, 12 nt, Homo sapiens
uccaauguagcu

SEQ ID NO: 542434 - RNA, 11 nt, Homo sapiens
uccaaugucaa

SEQ ID NO: 542435 - RNA, 21 nt, Homo sapiens
uccaaugucugcugaggaguu

SEQ ID NO: 542436 - RNA, 22 nt, Homo sapiens
uccaaugugugcauggaacaaa

SEQ ID NO: 542437 - RNA, 19 nt, Homo sapiens
uccaauuccuugcacauag

SEQ ID NO: 542438 - RNA, 19 nt, Homo sapiens
uccaauuuggaaucuucuc

SEQ ID NO: 542439 - RNA, 20 nt, Homo sapiens
uccaauuuuuuaagugaaaa

SEQ ID NO: 542440 - RNA, 17 nt, Homo sapiens
uccacaaaaucugucca

SEQ ID NO: 542441 - RNA, 11 nt, Homo sapiens
uccacaaggaa

SEQ ID NO: 542442 - RNA, 20 nt, Homo sapiens
uccacaccacuguugccuuu

SEQ ID NO: 542443 - RNA, 19 nt, Homo sapiens
uccacaccccaucuugcuc

SEQ ID NO: 542444 - RNA, 17 nt, Homo sapiens
uccacaccuccaaugcu

SEQ ID NO: 542445 - RNA, 17 nt, Homo sapiens
uccacaccuuuuauuga

SEQ ID NO: 542446 - RNA, 13 nt, Homo sapiens
uccacacugagag

SEQ ID NO: 542447 - RNA, 12 nt, Homo sapiens
uccacagaggac

SEQ ID NO: 542448 - RNA, 14 nt, Homo sapiens
uccacagauuauca

SEQ ID NO: 542449 - RNA, 18 nt, Homo sapiens
uccacagauucacuuugu

SEQ ID NO: 542450 - RNA, 22 nt, Homo sapiens
uccacagccgccugaaagccac

SEQ ID NO: 542451 - RNA, 24 nt, Homo sapiens
uccacaggauauuaaacguguaaa

SEQ ID NO: 542452 - RNA, 15 nt, Homo sapiens
uccacaguuaucuua

SEQ ID NO: 542453 - RNA, 22 nt, Homo sapiens
uccacaguuaucuuagcuggau

SEQ ID NO: 542454 - RNA, 13 nt, Homo sapiens
uccacauccucua

SEQ ID NO: 542455 - RNA, 20 nt, Homo sapiens
uccacauccuuucuaaacaa

SEQ ID NO: 542456 - RNA, 12 nt, Homo sapiens
uccacauguuac

SEQ ID NO: 542457 - RNA, 18 nt, Homo sapiens
uccacauuauacauuuga

SEQ ID NO: 542458 - RNA, 15 nt, Homo sapiens
uccacauuugucaca

SEQ ID NO: 542459 - RNA, 17 nt, Homo sapiens
uccaccaaaugugcuuu

SEQ ID NO: 542460 - RNA, 17 nt, Homo sapiens
uccaccaagugucuaga

SEQ ID NO: 542461 - RNA, 21 nt, Homo sapiens
uccaccagacgccuuccucuc

SEQ ID NO: 542462 - RNA, 10 nt, Homo sapiens
uccaccagcc

SEQ ID NO: 542463 - RNA, 17 nt, Homo sapiens
uccaccagccugcugac

SEQ ID NO: 542464 - RNA, 20 nt, Homo sapiens
uccaccaggccucacuggcu

SEQ ID NO: 542465 - RNA, 14 nt, Homo sapiens
uccaccaugaacuu

SEQ ID NO: 542466 - RNA, 14 nt, Homo sapiens
uccacccaccucag

SEQ ID NO: 542467 - RNA, 20 nt, Homo sapiens
uccacccaggcugcacugca

SEQ ID NO: 542468 - RNA, 19 nt, Homo sapiens
uccaccccauccaauuuau

SEQ ID NO: 542469 - RNA, 16 nt, Homo sapiens
uccacccuauucccua

SEQ ID NO: 542470 - RNA, 21 nt, Homo sapiens
uccacccuuggccugucucau

SEQ ID NO: 542471 - RNA, 21 nt, Homo sapiens
uccaccucaucacuggacugc

SEQ ID NO: 542472 - RNA, 22 nt, Homo sapiens
uccaccucauggauugccacag

SEQ ID NO: 542473 - RNA, 22 nt, Homo sapiens
uccaccuccucuccaccugcug

SEQ ID NO: 542474 - RNA, 19 nt, Homo sapiens
uccaccugaggaacugucu

SEQ ID NO: 542475 - RNA, 12 nt, Homo sapiens
uccaccuguggg

SEQ ID NO: 542476 - RNA, 23 nt, Homo sapiens
uccaccuguggguguagccaggu

SEQ ID NO: 542477 - RNA, 24 nt, Homo sapiens
uccaccuuaaauuaaacaauuuau

SEQ ID NO: 542478 - RNA, 16 nt, Homo sapiens
uccaccuuccaaagga

SEQ ID NO: 542479 - RNA, 15 nt, Homo sapiens
uccaccuuguuacac

SEQ ID NO: 542480 - RNA, 14 nt, Homo sapiens
uccacgaagccuua

SEQ ID NO: 542481 - RNA, 20 nt, Homo sapiens
uccacggaaaaugcuaucca

SEQ ID NO: 542482 - RNA, 23 nt, Homo sapiens
uccacggagccacuccucugacu

SEQ ID NO: 542483 - RNA, 16 nt, Homo sapiens
uccacgucuuuucuca

SEQ ID NO: 542484 - RNA, 20 nt, Homo sapiens
uccacguguggccuccgucc

SEQ ID NO: 542485 - RNA, 19 nt, Homo sapiens
uccacguucugcucaucau

SEQ ID NO: 542486 - RNA, 18 nt, Homo sapiens
uccacuauuuucaaagaa

SEQ ID NO: 542487 - RNA, 15 nt, Homo sapiens
uccacucacuccagc

SEQ ID NO: 542488 - RNA, 22 nt, Homo sapiens
uccacucagcuguccugcagca

SEQ ID NO: 542489 - RNA, 12 nt, Homo sapiens
uccacucagguu

SEQ ID NO: 542490 - RNA, 17 nt, Homo sapiens
uccacucuacccuccca

SEQ ID NO: 542491 - RNA, 20 nt, Homo sapiens
uccacugcaaauaaagccuu

SEQ ID NO: 542492 - RNA, 19 nt, Homo sapiens
uccacugccuccugugacg

SEQ ID NO: 542493 - RNA, 22 nt, Homo sapiens
uccacugccuccugugacguga

SEQ ID NO: 542494 - RNA, 15 nt, Homo sapiens
uccacugucaagaaa

SEQ ID NO: 542495 - RNA, 18 nt, Homo sapiens
uccacuguguguugacac

SEQ ID NO: 542496 - RNA, 20 nt, Homo sapiens
uccacuuagaaauugcauuu

SEQ ID NO: 542497 - RNA, 13 nt, Homo sapiens
uccacuucuuccu

SEQ ID NO: 542498 - RNA, 23 nt, Homo sapiens
uccacuucuuguuccccacugac

SEQ ID NO: 542499 - RNA, 17 nt, Homo sapiens
uccacuugaagcacuua

SEQ ID NO: 542500 - RNA, 11 nt, Homo sapiens
uccacuuguau

SEQ ID NO: 542501 - RNA, 17 nt, Homo sapiens
uccacuuugaguaccaa

SEQ ID NO: 542502 - RNA, 21 nt, Homo sapiens
uccagaaacuuuaagaacaaa

SEQ ID NO: 542503 - RNA, 19 nt, Homo sapiens
gcuauuucuucuacugcua

SEQ ID NO: 542504 - RNA, 20 nt, Homo sapiens
gcuauuucuucuacugcuau

SEQ ID NO: 542505 - RNA, 16 nt, Homo sapiens
uccagaacacaaccuu

SEQ ID NO: 542506 - RNA, 17 nt, Homo sapiens
uccagaacucaaaugag

SEQ ID NO: 542507 - RNA, 14 nt, Homo sapiens
uccagaagggucau

SEQ ID NO: 542508 - RNA, 21 nt, Homo sapiens
uccagaaguccuuauguuaag

SEQ ID NO: 542509 - RNA, 16 nt, Homo sapiens
uccagaaucccaagac

SEQ ID NO: 542510 - RNA, 13 nt, Homo sapiens
uccagacacuuaa

SEQ ID NO: 542511 - RNA, 14 nt, Homo sapiens
uccagacacuuaac

SEQ ID NO: 542512 - RNA, 12 nt, Homo sapiens
uccagacagucg

SEQ ID NO: 542513 - RNA, 14 nt, Homo sapiens
uccagaccauucag

SEQ ID NO: 542514 - RNA, 16 nt, Homo sapiens
uccagacccccagcaa

SEQ ID NO: 542515 - RNA, 21 nt, Homo sapiens
uccagacuugaaauucucauc

SEQ ID NO: 542516 - RNA, 22 nt, Homo sapiens
uccagacuugggaaacuauuca

SEQ ID NO: 542517 - RNA, 13 nt, Homo sapiens
uccagacuuugaa

SEQ ID NO: 542518 - RNA, 17 nt, Homo sapiens
uccagagaccccaggaa

SEQ ID NO: 542519 - RNA, 15 nt, Homo sapiens
uccagagcagaguuu

SEQ ID NO: 542520 - RNA, 18 nt, Homo sapiens
uccagagcuggaucucuc

SEQ ID NO: 542521 - RNA, 21 nt, Homo sapiens
uccagagguggaggugggcug

SEQ ID NO: 542522 - RNA, 17 nt, Homo sapiens
uccagauagcagggcau

SEQ ID NO: 542523 - RNA, 19 nt, Homo sapiens
uccagauguggcuacugac

SEQ ID NO: 542524 - RNA, 17 nt, Homo sapiens
uccagcaagaagggagu

SEQ ID NO: 542525 - RNA, 22 nt, Homo sapiens
uccagccaccacccacaaucac

SEQ ID NO: 542526 - RNA, 11 nt, Homo sapiens
uccagcccagc

SEQ ID NO: 542527 - RNA, 16 nt, Homo sapiens
uccagcccagcacugg

SEQ ID NO: 542528 - RNA, 19 nt, Homo sapiens
uccagcccccagugcgcuc

SEQ ID NO: 542529 - RNA, 21 nt, Homo sapiens
uccagcccgcagcacauuucc

SEQ ID NO: 542530 - RNA, 14 nt, Homo sapiens
uccagccugaacag

SEQ ID NO: 542531 - RNA, 16 nt, Homo sapiens
uccagcggcccuguca

SEQ ID NO: 542532 - RNA, 18 nt, Homo sapiens
uccagcuaauucagguca

SEQ ID NO: 542533 - RNA, 17 nt, Homo sapiens
uccagcuccccccaaga

SEQ ID NO: 542534 - RNA, 10 nt, Homo sapiens
uccagcugcc

SEQ ID NO: 542535 - RNA, 19 nt, Homo sapiens
uccagcugccccucccuca

SEQ ID NO: 542536 - RNA, 18 nt, Homo sapiens
uccagcuuauagucuucc

SEQ ID NO: 542537 - RNA, 18 nt, Homo sapiens
uccaggaaaacugggaca

SEQ ID NO: 542538 - RNA, 18 nt, Homo sapiens
uccaggaaccacaccaca

SEQ ID NO: 542539 - RNA, 19 nt, Homo sapiens
uccaggaauaggcauuugc

SEQ ID NO: 542540 - RNA, 15 nt, Homo sapiens
uccaggagacauaua

SEQ ID NO: 542541 - RNA, 20 nt, Homo sapiens
uccaggauggaugcaucaca

SEQ ID NO: 542542 - RNA, 12 nt, Homo sapiens
uccaggcacuca

SEQ ID NO: 542543 - RNA, 14 nt, Homo sapiens
uccaggcaggccag

SEQ ID NO: 542544 - RNA, 12 nt, Homo sapiens
uccaggccucag

SEQ ID NO: 542545 - RNA, 17 nt, Homo sapiens
uccaggccuguacucau

SEQ ID NO: 542546 - RNA, 19 nt, Homo sapiens
uccaggcgaugugcaagug

SEQ ID NO: 542547 - RNA, 19 nt, Homo sapiens
uccaggcuacaaucuucau

SEQ ID NO: 542548 - RNA, 21 nt, Homo sapiens
uccaggcucugggcacagugc

SEQ ID NO: 542549 - RNA, 17 nt, Homo sapiens
uccaggcuggagugcaa

SEQ ID NO: 542550 - RNA, 15 nt, Homo sapiens
uccagggacaaagag

SEQ ID NO: 542551 - RNA, 16 nt, Homo sapiens
uccagggcaaggccau

SEQ ID NO: 542552 - RNA, 19 nt, Homo sapiens
uccagggucaaaguacaga

SEQ ID NO: 542553 - RNA, 21 nt, Homo sapiens
uccaggugguaagcaccagga

SEQ ID NO: 542554 - RNA, 22 nt, Homo sapiens
uccagguuuaugaaugacagua

SEQ ID NO: 542555 - RNA, 17 nt, Homo sapiens
uccaguauccacuuugc

SEQ ID NO: 542556 - RNA, 19 nt, Homo sapiens
uccaguauucuugucaaaa

SEQ ID NO: 542557 - RNA, 21 nt, Homo sapiens
uccaguauugaaaacuucaaa

SEQ ID NO: 542558 - RNA, 15 nt, Homo sapiens
uccagucacacuccc

SEQ ID NO: 542559 - RNA, 11 nt, Homo sapiens
uccagugcagg

SEQ ID NO: 542560 - RNA, 12 nt, Homo sapiens
uccagugcaguc

SEQ ID NO: 542561 - RNA, 20 nt, Homo sapiens
uccagugccagcaaugacau

SEQ ID NO: 542562 - RNA, 16 nt, Homo sapiens
uccaguggacccugga

SEQ ID NO: 542563 - RNA, 21 nt, Homo sapiens
uccaguguuuaaacuuugaca

SEQ ID NO: 542564 - RNA, 17 nt, Homo sapiens
uccaguguuugggauga

SEQ ID NO: 542565 - RNA, 23 nt, Homo sapiens
uccaguuauaagcguauuuagac

SEQ ID NO: 542566 - RNA, 21 nt, Homo sapiens
uccauaaacacccaugaauca

SEQ ID NO: 542567 - RNA, 18 nt, Homo sapiens
uccauaacugaacaucca

SEQ ID NO: 542568 - RNA, 19 nt, Homo sapiens
uccauaaugcuacugucuc

SEQ ID NO: 542569 - RNA, 13 nt, Homo sapiens
uccauauguuaua

SEQ ID NO: 542570 - RNA, 23 nt, Homo sapiens
uccauauuggacauccccagaaa

SEQ ID NO: 542571 - RNA, 18 nt, Homo sapiens
uccauauuuauuuaaaca

SEQ ID NO: 542572 - RNA, 23 nt, Homo sapiens
uccaucacccucuuccugugauc

SEQ ID NO: 542573 - RNA, 20 nt, Homo sapiens
uccaucaccugaaacacugg

SEQ ID NO: 542574 - RNA, 22 nt, Homo sapiens
uccaucaccugaaacacuggac

SEQ ID NO: 542575 - RNA, 21 nt, Homo sapiens
uccaucacuagccaugauaac

SEQ ID NO: 542576 - RNA, 19 nt, Homo sapiens
uccaucagagccagucuca

SEQ ID NO: 542577 - RNA, 17 nt, Homo sapiens
uccaucagauguguucc

SEQ ID NO: 542578 - RNA, 21 nt, Homo sapiens
uccaucagccaggacagucag

SEQ ID NO: 542579 - RNA, 17 nt, Homo sapiens
uccaucagcccaucuca

SEQ ID NO: 542580 - RNA, 18 nt, Homo sapiens
uccaucagcccaucucaa

SEQ ID NO: 542581 - RNA, 12 nt, Homo sapiens
uccaucccgaaa

SEQ ID NO: 542582 - RNA, 23 nt, Homo sapiens
uccauccugcucaggaaaccaca

SEQ ID NO: 542583 - RNA, 14 nt, Homo sapiens
uccaucugcaucuu

SEQ ID NO: 542584 - RNA, 12 nt, Homo sapiens
uccaucugucca

SEQ ID NO: 542585 - RNA, 15 nt, Homo sapiens
uccaugaaaauacca

SEQ ID NO: 542586 - RNA, 14 nt, Homo sapiens
uccaugaagaccac

SEQ ID NO: 542587 - RNA, 17 nt, Homo sapiens
uccaugacugcauuuua

SEQ ID NO: 542588 - RNA, 22 nt, Homo sapiens
uccaugacugcauuuuacugua

SEQ ID NO: 542589 - RNA, 23 nt, Homo sapiens
uccaugacugcauuuuacuguac

SEQ ID NO: 542590 - RNA, 22 nt, Homo sapiens
uccaugauuuuaaauugugauc

SEQ ID NO: 542591 - RNA, 18 nt, Homo sapiens
uccaugcaaguguuuuaa

SEQ ID NO: 542592 - RNA, 20 nt, Homo sapiens
uccaugcaccuaccuuagaa

SEQ ID NO: 542593 - RNA, 17 nt, Homo sapiens
uccaugcccagccaaua

SEQ ID NO: 542594 - RNA, 17 nt, Homo sapiens
uccaugcucaccaagga

SEQ ID NO: 542595 - RNA, 22 nt, Homo sapiens
uccaugcuccucaccugucuag

SEQ ID NO: 542596 - RNA, 22 nt, Homo sapiens
uccaugcugcaaaggagaagca

SEQ ID NO: 542597 - RNA, 19 nt, Homo sapiens
uccauggccaggcugccug

SEQ ID NO: 542598 - RNA, 14 nt, Homo sapiens
uccauggugugaga

SEQ ID NO: 542599 - RNA, 17 nt, Homo sapiens
uccauguaaauugcaaa

SEQ ID NO: 542600 - RNA, 13 nt, Homo sapiens
uccauguacugua

SEQ ID NO: 542601 - RNA, 12 nt, Homo sapiens
uccauguacuug

SEQ ID NO: 542602 - RNA, 15 nt, Homo sapiens
uccauguauauauuc

SEQ ID NO: 542603 - RNA, 14 nt, Homo sapiens
uccaugucaggcca

SEQ ID NO: 542604 - RNA, 17 nt, Homo sapiens
uccaugugugugcaagu

SEQ ID NO: 542605 - RNA, 15 nt, Homo sapiens
uccauguuauucucu

SEQ ID NO: 542606 - RNA, 16 nt, Homo sapiens
uccauguugcugccaa

SEQ ID NO: 542607 - RNA, 14 nt, Homo sapiens
uccauuacuugcca

SEQ ID NO: 542608 - RNA, 16 nt, Homo sapiens
uccauucaacugaaaa

SEQ ID NO: 542609 - RNA, 22 nt, Homo sapiens
uccauucacaagccuccuguac

SEQ ID NO: 542610 - RNA, 14 nt, Homo sapiens
uccauucacaccag

SEQ ID NO: 542611 - RNA, 14 nt, Homo sapiens
uccauuccagaaua

SEQ ID NO: 542612 - RNA, 15 nt, Homo sapiens
uccauugauucaggg

SEQ ID NO: 542613 - RNA, 19 nt, Homo sapiens
uccauugguuuaccuguga

SEQ ID NO: 542614 - RNA, 18 nt, Homo sapiens
uccauuuauaaccccagc

SEQ ID NO: 542615 - RNA, 21 nt, Homo sapiens
uccauuucucaaucagugcag

SEQ ID NO: 542616 - RNA, 15 nt, Homo sapiens
uccauuugacaaagu

SEQ ID NO: 542617 - RNA, 15 nt, Homo sapiens
uccauuugcuuuguc

SEQ ID NO: 542618 - RNA, 20 nt, Homo sapiens
uccauuuuaacaacugcucu

SEQ ID NO: 542619 - RNA, 21 nt, Homo sapiens
uccauuuuacagaagcauuuu

SEQ ID NO: 542620 - RNA, 22 nt, Homo sapiens
uccauuuuuaaccccauuugca

SEQ ID NO: 542621 - RNA, 14 nt, Homo sapiens
ucccaaagcucaga

SEQ ID NO: 542622 - RNA, 16 nt, Homo sapiens
ucccaaaucaauaaga

SEQ ID NO: 542623 - RNA, 20 nt, Homo sapiens
ucccaaaugaaaaccccagu

SEQ ID NO: 542624 - RNA, 16 nt, Homo sapiens
ucccaaauuugauuga

SEQ ID NO: 542625 - RNA, 17 nt, Homo sapiens
gcucugagcacagguga

SEQ ID NO: 542626 - RNA, 22 nt, Homo sapiens
gcucugcaaugggcacugggau

SEQ ID NO: 542627 - RNA, 17 nt, Homo sapiens
gcucugcccaccucucu

SEQ ID NO: 542628 - RNA, 19 nt, Homo sapiens
gcucugcccccucccccau

SEQ ID NO: 542629 - RNA, 14 nt, Homo sapiens
ucccaacccagaca

SEQ ID NO: 542630 - RNA, 19 nt, Homo sapiens
ucccaacuucauacuggca

SEQ ID NO: 542631 - RNA, 18 nt, Homo sapiens
ucccaagauaaaugguac

SEQ ID NO: 542632 - RNA, 21 nt, Homo sapiens
ucccaauaaaagugacucuca

SEQ ID NO: 542633 - RNA, 15 nt, Homo sapiens
ucccacaaugcugau

SEQ ID NO: 542634 - RNA, 13 nt, Homo sapiens
ucccacacaggcu

SEQ ID NO: 542635 - RNA, 14 nt, Homo sapiens
ucccacacugucca

SEQ ID NO: 542636 - RNA, 13 nt, Homo sapiens
ucccacaggacau

SEQ ID NO: 542637 - RNA, 16 nt, Homo sapiens
ucccacaggcccuucc

SEQ ID NO: 542638 - RNA, 17 nt, Homo sapiens
ucccacauccaacucca

SEQ ID NO: 542639 - RNA, 16 nt, Homo sapiens
ucccacaugaggccau

SEQ ID NO: 542640 - RNA, 20 nt, Homo sapiens
ucccacaugaggccaucuca

SEQ ID NO: 542641 - RNA, 21 nt, Homo sapiens
ucccaccaaccuccaguguca

SEQ ID NO: 542642 - RNA, 22 nt, Homo sapiens
ucccaccaacucugcacuccau

SEQ ID NO: 542643 - RNA, 16 nt, Homo sapiens
ucccacccaccuguag

SEQ ID NO: 542644 - RNA, 22 nt, Homo sapiens
ucccacccaccuguagggcuag

SEQ ID NO: 542645 - RNA, 23 nt, Homo sapiens
ucccaccucuccuuuugaggcuu

SEQ ID NO: 542646 - RNA, 23 nt, Homo sapiens
ucccaccucuucucuuccuguaa

SEQ ID NO: 542647 - RNA, 19 nt, Homo sapiens
ucccacggugcccaaacac

SEQ ID NO: 542648 - RNA, 22 nt, Homo sapiens
ucccacguacuuauaaagaagg

SEQ ID NO: 542649 - RNA, 16 nt, Homo sapiens
ucccacuaaaacugca

SEQ ID NO: 542650 - RNA, 18 nt, Homo sapiens
ucccacuacuguagaaag

SEQ ID NO: 542651 - RNA, 17 nt, Homo sapiens
ucccacucuucuugcag

SEQ ID NO: 542652 - RNA, 11 nt, Homo sapiens
ucccacuggaa

SEQ ID NO: 542653 - RNA, 15 nt, Homo sapiens
ucccacuugucaugu

SEQ ID NO: 542654 - RNA, 21 nt, Homo sapiens
ucccagaaacuccagacuugu

SEQ ID NO: 542655 - RNA, 17 nt, Homo sapiens
ucccagacauucauugu

SEQ ID NO: 542656 - RNA, 18 nt, Homo sapiens
ucccagagauguugagaa

SEQ ID NO: 542657 - RNA, 20 nt, Homo sapiens
ucccagaggagccaccaguu

SEQ ID NO: 542658 - RNA, 17 nt, Homo sapiens
ucccagagugcugggau

SEQ ID NO: 542659 - RNA, 16 nt, Homo sapiens
ucccagauaauggaga

SEQ ID NO: 542660 - RNA, 17 nt, Homo sapiens
ucccagauggcuggaag

SEQ ID NO: 542661 - RNA, 14 nt, Homo sapiens
ucccagauguaaag

SEQ ID NO: 542662 - RNA, 22 nt, Homo sapiens
ucccagcacuuugggaggccaa

SEQ ID NO: 542663 - RNA, 20 nt, Homo sapiens
ucccagcagcgguaccccag

SEQ ID NO: 542664 - RNA, 19 nt, Homo sapiens
ucccagcauaggauucauu

SEQ ID NO: 542665 - RNA, 17 nt, Homo sapiens
ucccagccacucgggag

SEQ ID NO: 542666 - RNA, 17 nt, Homo sapiens
ucccagccguggucaac

SEQ ID NO: 542667 - RNA, 16 nt, Homo sapiens
ucccagcgagccacag

SEQ ID NO: 542668 - RNA, 16 nt, Homo sapiens
ucccagcgcucuggga

SEQ ID NO: 542669 - RNA, 20 nt, Homo sapiens
ucccagcggcaccaacauca

SEQ ID NO: 542670 - RNA, 19 nt, Homo sapiens
ucccagcuauuccuacucu

SEQ ID NO: 542671 - RNA, 20 nt, Homo sapiens
ucccagcugcagaugccaca

SEQ ID NO: 542672 - RNA, 13 nt, Homo sapiens
ucccagcugugcu

SEQ ID NO: 542673 - RNA, 19 nt, Homo sapiens
ucccagcuucggcauuuga

SEQ ID NO: 542674 - RNA, 21 nt, Homo sapiens
ucccaggaaagaagcauuucu

SEQ ID NO: 542675 - RNA, 17 nt, Homo sapiens
ucccaggaagcagggag

SEQ ID NO: 542676 - RNA, 20 nt, Homo sapiens
ucccaggacagaaagaucuu

SEQ ID NO: 542677 - RNA, 16 nt, Homo sapiens
ucccaggcuucccaaa

SEQ ID NO: 542678 - RNA, 18 nt, Homo sapiens
ucccagggaugcucuuug

SEQ ID NO: 542679 - RNA, 16 nt, Homo sapiens
ucccagggcucugcag

SEQ ID NO: 542680 - RNA, 23 nt, Homo sapiens
ucccaggguggacuucagugugu

SEQ ID NO: 542681 - RNA, 23 nt, Homo sapiens
ucccaggugcgugugucucuguc

SEQ ID NO: 542682 - RNA, 19 nt, Homo sapiens
ucccaguccaccugaggaa

SEQ ID NO: 542683 - RNA, 12 nt, Homo sapiens
ucccagucucau

SEQ ID NO: 542684 - RNA, 15 nt, Homo sapiens
ucccagucucuggca

SEQ ID NO: 542685 - RNA, 18 nt, Homo sapiens
ucccaguguggcugaggc

SEQ ID NO: 542686 - RNA, 13 nt, Homo sapiens
ucccagugugugu

SEQ ID NO: 542687 - RNA, 13 nt, Homo sapiens
ucccaguguucca

SEQ ID NO: 542688 - RNA, 14 nt, Homo sapiens
ucccaguguuccau

SEQ ID NO: 542689 - RNA, 17 nt, Homo sapiens
ucccauauccugccuca

SEQ ID NO: 542690 - RNA, 14 nt, Homo sapiens
ucccauaucuugcc

SEQ ID NO: 542691 - RNA, 13 nt, Homo sapiens
ucccaucaauucu

SEQ ID NO: 542692 - RNA, 22 nt, Homo sapiens
ucccaucacuucccuacaugga

SEQ ID NO: 542693 - RNA, 20 nt, Homo sapiens
ucccauccccuggacuggga

SEQ ID NO: 542694 - RNA, 14 nt, Homo sapiens
ucccauccuugaug

SEQ ID NO: 542695 - RNA, 16 nt, Homo sapiens
ucccaucuccagggaa

SEQ ID NO: 542696 - RNA, 17 nt, Homo sapiens
ucccaugaacacacugu

SEQ ID NO: 542697 - RNA, 18 nt, Homo sapiens
ucccaugccuggucccaa

SEQ ID NO: 542698 - RNA, 17 nt, Homo sapiens
ucccauggcaccuucag

SEQ ID NO: 542699 - RNA, 14 nt, Homo sapiens
ucccauguauuuau

SEQ ID NO: 542700 - RNA, 15 nt, Homo sapiens
ucccauguugucaau

SEQ ID NO: 542701 - RNA, 12 nt, Homo sapiens
ucccauugccau

SEQ ID NO: 542702 - RNA, 18 nt, Homo sapiens
ucccauugguguugucau

SEQ ID NO: 542703 - RNA, 14 nt, Homo sapiens
ucccauuuucaucc

SEQ ID NO: 542704 - RNA, 20 nt, Homo sapiens
ucccauuuuugcuuagcuca

SEQ ID NO: 542705 - RNA, 16 nt, Homo sapiens
uccccaaccacuucau

SEQ ID NO: 542706 - RNA, 22 nt, Homo sapiens
uccccaacccaccucucuuccc

SEQ ID NO: 542707 - RNA, 15 nt, Homo sapiens
uccccaacuucccua

SEQ ID NO: 542708 - RNA, 13 nt, Homo sapiens
uccccaagccugg

SEQ ID NO: 542709 - RNA, 16 nt, Homo sapiens
uccccaauuacagggu

SEQ ID NO: 542710 - RNA, 14 nt, Homo sapiens
uccccacacuccac

SEQ ID NO: 542711 - RNA, 14 nt, Homo sapiens
uccccacaucccau

SEQ ID NO: 542712 - RNA, 20 nt, Homo sapiens
uccccacauucuauagccau

SEQ ID NO: 542713 - RNA, 14 nt, Homo sapiens
uccccacuccccca

SEQ ID NO: 542714 - RNA, 15 nt, Homo sapiens
uccccacucccgaaa

SEQ ID NO: 542715 - RNA, 14 nt, Homo sapiens
uccccagagcacug

SEQ ID NO: 542716 - RNA, 17 nt, Homo sapiens
uccccagagcuacaggc

SEQ ID NO: 542717 - RNA, 20 nt, Homo sapiens
uccccagcauugcaguaugg

SEQ ID NO: 542718 - RNA, 21 nt, Homo sapiens
uccccagcauugcaguauggu

SEQ ID NO: 542719 - RNA, 18 nt, Homo sapiens
uccccagccagggagcuu

SEQ ID NO: 542720 - RNA, 19 nt, Homo sapiens
uccccagcccuuuuguuga

SEQ ID NO: 542721 - RNA, 23 nt, Homo sapiens
uccccagccuccccgugccaaaa

SEQ ID NO: 542722 - RNA, 16 nt, Homo sapiens
uccccaggcaccucac

SEQ ID NO: 542723 - RNA, 24 nt, Homo sapiens
uccccagguccugucucugcacag

SEQ ID NO: 542724 - RNA, 22 nt, Homo sapiens
uccccagguguguuggggccuu

SEQ ID NO: 542725 - RNA, 15 nt, Homo sapiens
uccccaguacagggg

SEQ ID NO: 542726 - RNA, 16 nt, Homo sapiens
uccccagucccagaca

SEQ ID NO: 542727 - RNA, 21 nt, Homo sapiens
uccccaguucauugcacuuug

SEQ ID NO: 542728 - RNA, 19 nt, Homo sapiens
uccccaguucuacugaccu

SEQ ID NO: 542729 - RNA, 22 nt, Homo sapiens
uccccauauccaaguaccaaug

SEQ ID NO: 542730 - RNA, 12 nt, Homo sapiens
uccccaucagcu

SEQ ID NO: 542731 - RNA, 14 nt, Homo sapiens
uccccaucauccca

SEQ ID NO: 542732 - RNA, 21 nt, Homo sapiens
uccccaucauuacugguaaag

SEQ ID NO: 542733 - RNA, 21 nt, Homo sapiens
uccccaugggaucuugaggga

SEQ ID NO: 542734 - RNA, 18 nt, Homo sapiens
uccccaugggcacagugg

SEQ ID NO: 542735 - RNA, 18 nt, Homo sapiens
ucccccaaauuaacauca

SEQ ID NO: 542736 - RNA, 14 nt, Homo sapiens
ucccccaaccaagg

SEQ ID NO: 542737 - RNA, 15 nt, Homo sapiens
ucccccaaccaagga

SEQ ID NO: 542738 - RNA, 18 nt, Homo sapiens
ucccccaccgguccagcu

SEQ ID NO: 542739 - RNA, 19 nt, Homo sapiens
ucccccaccgguccagcug

SEQ ID NO: 542740 - RNA, 21 nt, Homo sapiens
ucccccacucucucacccacc

SEQ ID NO: 542741 - RNA, 13 nt, Homo sapiens
ucccccagcacuu

SEQ ID NO: 542742 - RNA, 19 nt, Homo sapiens
ucccccagcccugucaugu

SEQ ID NO: 542743 - RNA, 24 nt, Homo sapiens
ucccccagcccugucaugugccuu

SEQ ID NO: 542744 - RNA, 17 nt, Homo sapiens
ucccccagccucaaguc

SEQ ID NO: 542745 - RNA, 20 nt, Homo sapiens
ucccccagcuuucccgacac

SEQ ID NO: 542746 - RNA, 23 nt, Homo sapiens
uccccccccaggcccucccacca

SEQ ID NO: 542747 - RNA, 18 nt, Homo sapiens
ggagacugaagacucagc

SEQ ID NO: 542748 - RNA, 12 nt, Homo sapiens
ggagacuuguau

SEQ ID NO: 542749 - RNA, 17 nt, Homo sapiens
ggagacuuuuaucuacu

SEQ ID NO: 542750 - RNA, 14 nt, Homo sapiens
ggagagaacugaau

SEQ ID NO: 542751 - RNA, 14 nt, Homo sapiens
ggagagaagugagc

SEQ ID NO: 542752 - RNA, 14 nt, Homo sapiens
ggagagaaguuucu

SEQ ID NO: 542753 - RNA, 19 nt, Homo sapiens
ggagagagggcaaagggau

SEQ ID NO: 542754 - RNA, 19 nt, Homo sapiens
ggagagccagcuuugcuau

SEQ ID NO: 542755 - RNA, 14 nt, Homo sapiens
ggagaggacucugc

SEQ ID NO: 542756 - RNA, 18 nt, Homo sapiens
ggagaggggaagggccag

SEQ ID NO: 542757 - RNA, 20 nt, Homo sapiens
ggagaguacagugagccaag

SEQ ID NO: 542758 - RNA, 21 nt, Homo sapiens
ggagaguacagugagccaaga

SEQ ID NO: 542759 - RNA, 16 nt, Homo sapiens
ucguauaccuuauuaa

SEQ ID NO: 542760 - RNA, 16 nt, Homo sapiens
ucgucucccuggugcc

SEQ ID NO: 542761 - RNA, 20 nt, Homo sapiens
ucgucucggccccucugauu

SEQ ID NO: 542762 - RNA, 18 nt, Homo sapiens
ucgugaaaccccaucucu

SEQ ID NO: 542763 - RNA, 21 nt, Homo sapiens
ucgugauccacccaccuuggc

SEQ ID NO: 542764 - RNA, 16 nt, Homo sapiens
ucgugguagaagccag

SEQ ID NO: 542765 - RNA, 20 nt, Homo sapiens
ucgugguuuuuacauucaau

SEQ ID NO: 542766 - RNA, 17 nt, Homo sapiens
ucgugugauuuccuaca

SEQ ID NO: 542767 - RNA, 18 nt, Homo sapiens
ucguuagaaugucugccu

SEQ ID NO: 542768 - RNA, 20 nt, Homo sapiens
ucguuagccuuccucugauu

SEQ ID NO: 542769 - RNA, 19 nt, Homo sapiens
ucguugggccgcucugauu

SEQ ID NO: 542770 - RNA, 19 nt, Homo sapiens
ucguugguagagcccucag

SEQ ID NO: 542771 - RNA, 17 nt, Homo sapiens
ucguuuaaaaacaaagg

SEQ ID NO: 542772 - RNA, 13 nt, Homo sapiens
ucguuuuguacug

SEQ ID NO: 542773 - RNA, 15 nt, Homo sapiens
ucuaaaaacuuagaa

SEQ ID NO: 542774 - RNA, 16 nt, Homo sapiens
ucuaaaagauccuuuu

SEQ ID NO: 542775 - RNA, 21 nt, Homo sapiens
ucuaaaauugcuucuuuacca

SEQ ID NO: 542776 - RNA, 12 nt, Homo sapiens
ucuaaagaccau

SEQ ID NO: 542777 - RNA, 22 nt, Homo sapiens
ucuaaagcagaggcaacacugg

SEQ ID NO: 542778 - RNA, 18 nt, Homo sapiens
ucuaaagccaagcacuuu

SEQ ID NO: 542779 - RNA, 23 nt, Homo sapiens
ucuaaagcuuuggacaaguccuu

SEQ ID NO: 542780 - RNA, 16 nt, Homo sapiens
ucuaaaguagcuuucu

SEQ ID NO: 542781 - RNA, 22 nt, Homo sapiens
ucuaaaguguuggucuuucuaa

SEQ ID NO: 542782 - RNA, 22 nt, Homo sapiens
ucuaacaaaaccaaugugcaga

SEQ ID NO: 542783 - RNA, 15 nt, Homo sapiens
ucuaacacauuucau

SEQ ID NO: 542784 - RNA, 12 nt, Homo sapiens
ucuaacagauca

SEQ ID NO: 542785 - RNA, 15 nt, Homo sapiens
ucuaacagcaaauaa

SEQ ID NO: 542786 - RNA, 17 nt, Homo sapiens
ucuaacagcaaauaaca

SEQ ID NO: 542787 - RNA, 16 nt, Homo sapiens
ucuaacauguuaucaa

SEQ ID NO: 542788 - RNA, 16 nt, Homo sapiens
ucuaacccuguggaag

SEQ ID NO: 542789 - RNA, 15 nt, Homo sapiens
ucuaaccuugaaugc

SEQ ID NO: 542790 - RNA, 17 nt, Homo sapiens
ucuaacgggcauucaca

SEQ ID NO: 542791 - RNA, 18 nt, Homo sapiens
ucuaacucagaaacauca

SEQ ID NO: 542792 - RNA, 16 nt, Homo sapiens
ucuaacucagaauuau

SEQ ID NO: 542793 - RNA, 20 nt, Homo sapiens
ucuaacuuaagacagaauuu

SEQ ID NO: 542794 - RNA, 16 nt, Homo sapiens
ucuaagaaccaaaaaa

SEQ ID NO: 542795 - RNA, 17 nt, Homo sapiens
ucuaagagagcugccau

SEQ ID NO: 542796 - RNA, 22 nt, Homo sapiens
ucuaagccaaaaggauuccucu

SEQ ID NO: 542797 - RNA, 16 nt, Homo sapiens
ucuaagguaacauuua

SEQ ID NO: 542798 - RNA, 14 nt, Homo sapiens
ucuaagucuuucca

SEQ ID NO: 542799 - RNA, 13 nt, Homo sapiens
ucuaagugauaua

SEQ ID NO: 542800 - RNA, 15 nt, Homo sapiens
ucuaaguuagacucu

SEQ ID NO: 542801 - RNA, 19 nt, Homo sapiens
ucuaaguuuuguguacaga

SEQ ID NO: 542802 - RNA, 18 nt, Homo sapiens
ucuaauaaagucauuugu

SEQ ID NO: 542803 - RNA, 17 nt, Homo sapiens
ucuaauauuucuaguau

SEQ ID NO: 542804 - RNA, 16 nt, Homo sapiens
ucuaaugaagaauucu

SEQ ID NO: 542805 - RNA, 13 nt, Homo sapiens
ucuaauguacaau

SEQ ID NO: 542806 - RNA, 19 nt, Homo sapiens
ucuaaugugaaaaucauca

SEQ ID NO: 542807 - RNA, 12 nt, Homo sapiens
ucuaaugugcau

SEQ ID NO: 542808 - RNA, 21 nt, Homo sapiens
ucuaauuagaucaauuacuua

SEQ ID NO: 542809 - RNA, 21 nt, Homo sapiens
ucuaauuugcaccuuugucug

SEQ ID NO: 542810 - RNA, 22 nt, Homo sapiens
ucuaauuuucacacauagucuu

SEQ ID NO: 542811 - RNA, 19 nt, Homo sapiens
ucuacaaacucccacuugu

SEQ ID NO: 542812 - RNA, 14 nt, Homo sapiens
ucuacaaaggccau

SEQ ID NO: 542813 - RNA, 17 nt, Homo sapiens
ucuacaauuugccauug

SEQ ID NO: 542814 - RNA, 20 nt, Homo sapiens
ucuacacagauggaaucucu

SEQ ID NO: 542815 - RNA, 17 nt, Homo sapiens
ucuacacuguauuacau

SEQ ID NO: 542816 - RNA, 16 nt, Homo sapiens
ucuacagaauaaucca

SEQ ID NO: 542817 - RNA, 14 nt, Homo sapiens
ucuacagacuccaa

SEQ ID NO: 542818 - RNA, 18 nt, Homo sapiens
ucuacagacuccaaaagg

SEQ ID NO: 542819 - RNA, 19 nt, Homo sapiens
ucuacagacuccaaaaggc

SEQ ID NO: 542820 - RNA, 16 nt, Homo sapiens
ucuacagcagcacugu

SEQ ID NO: 542821 - RNA, 22 nt, Homo sapiens
ucuacaggucggggaccaaagg

SEQ ID NO: 542822 - RNA, 20 nt, Homo sapiens
ucuacagugccaacuccuca

SEQ ID NO: 542823 - RNA, 15 nt, Homo sapiens
ucuacaucacucuca

SEQ ID NO: 542824 - RNA, 17 nt, Homo sapiens
ucuacauccaauguaug

SEQ ID NO: 542825 - RNA, 13 nt, Homo sapiens
ucuaccagucuau

SEQ ID NO: 542826 - RNA, 15 nt, Homo sapiens
ucuacccuauacaac

SEQ ID NO: 542827 - RNA, 20 nt, Homo sapiens
ucuaccucaggcagcucaag

SEQ ID NO: 542828 - RNA, 16 nt, Homo sapiens
ucuaccugacuccuga

SEQ ID NO: 542829 - RNA, 16 nt, Homo sapiens
ucuaccuuuacuacau

SEQ ID NO: 542830 - RNA, 20 nt, Homo sapiens
ucuacggaccucacauccau

SEQ ID NO: 542831 - RNA, 21 nt, Homo sapiens
ucuacgugggagucugugcau

SEQ ID NO: 542832 - RNA, 20 nt, Homo sapiens
ucuacuaaaaauacaaaagu

SEQ ID NO: 542833 - RNA, 19 nt, Homo sapiens
ucuacuaagugaugcugug

SEQ ID NO: 542834 - RNA, 20 nt, Homo sapiens
ucuacuacaaacuucaaaga

SEQ ID NO: 542835 - RNA, 20 nt, Homo sapiens
ucuacuacccccacagaccu

SEQ ID NO: 542836 - RNA, 18 nt, Homo sapiens
ucuacucaggcuggugga

SEQ ID NO: 542837 - RNA, 17 nt, Homo sapiens
ucuacuccucccucuga

SEQ ID NO: 542838 - RNA, 21 nt, Homo sapiens
ucuacucugucuuaaaugaga

SEQ ID NO: 542839 - RNA, 17 nt, Homo sapiens
ucuacugaacaguccau

SEQ ID NO: 542840 - RNA, 21 nt, Homo sapiens
ucuacugaaugaccucucuac

SEQ ID NO: 542841 - RNA, 18 nt, Homo sapiens
ucuacugacuuuucccau

SEQ ID NO: 542842 - RNA, 15 nt, Homo sapiens
ucuacugaggugcua

SEQ ID NO: 542843 - RNA, 16 nt, Homo sapiens
ucuacugaggugcuau

SEQ ID NO: 542844 - RNA, 12 nt, Homo sapiens
ucuacugugguc

SEQ ID NO: 542845 - RNA, 19 nt, Homo sapiens
ucuacuuccccuucuugcc

SEQ ID NO: 542846 - RNA, 22 nt, Homo sapiens
ucuacuuccccuucuugccauu

SEQ ID NO: 542847 - RNA, 13 nt, Homo sapiens
ucuagaacuugac

SEQ ID NO: 542848 - RNA, 22 nt, Homo sapiens
ucuagaauguggauuugauuca

SEQ ID NO: 542849 - RNA, 23 nt, Homo sapiens
ucuagacaagauauuguacauaa

SEQ ID NO: 542850 - RNA, 22 nt, Homo sapiens
ucuagacacugccacacagggu

SEQ ID NO: 542851 - RNA, 16 nt, Homo sapiens
ucuagauacuguauca

SEQ ID NO: 542852 - RNA, 15 nt, Homo sapiens
ucuagcaccaggacu

SEQ ID NO: 542853 - RNA, 20 nt, Homo sapiens
ucuagccuggcuauguccua

SEQ ID NO: 542854 - RNA, 15 nt, Homo sapiens
ucuaggacugcagug

SEQ ID NO: 542855 - RNA, 21 nt, Homo sapiens
ucuaggauaacuugcuuucuu

SEQ ID NO: 542856 - RNA, 13 nt, Homo sapiens
ucuaggaugugau

SEQ ID NO: 542857 - RNA, 14 nt, Homo sapiens
ucuaggaugugaug

SEQ ID NO: 542858 - RNA, 18 nt, Homo sapiens
ucuaggcaucccagggga

SEQ ID NO: 542859 - RNA, 22 nt, Homo sapiens
ucuagggcuaguagaacuggau

SEQ ID NO: 542860 - RNA, 16 nt, Homo sapiens
ucuaggggugccucug

SEQ ID NO: 542861 - RNA, 13 nt, Homo sapiens
ucuaggguccagu

SEQ ID NO: 542862 - RNA, 22 nt, Homo sapiens
ucuagguaggggcccacuucac

SEQ ID NO: 542863 - RNA, 20 nt, Homo sapiens
ucuagguuucagcaacaaga

SEQ ID NO: 542864 - RNA, 17 nt, Homo sapiens
ucuaguaagaugcacug

SEQ ID NO: 542865 - RNA, 19 nt, Homo sapiens
ucuaguaucacuuuugcug

SEQ ID NO: 542866 - RNA, 14 nt, Homo sapiens
ucuagugacuuccu

SEQ ID NO: 542867 - RNA, 19 nt, Homo sapiens
ucuaguggguugaccuuua

SEQ ID NO: 542868 - RNA, 20 nt, Homo sapiens
ucuaguggguugaccuuuaa

SEQ ID NO: 542869 - RNA, 18 nt, Homo sapiens
ucuagugucuuuugccuu

SEQ ID NO: 542870 - RNA, 20 nt, Homo sapiens
ucuagugucuuuugccuuua

SEQ ID NO: 542871 - RNA, 14 nt, Homo sapiens
ucuaguuaaucaua

SEQ ID NO: 542872 - RNA, 16 nt, Homo sapiens
ucuaguucagcugccc

SEQ ID NO: 542873 - RNA, 14 nt, Homo sapiens
ucuaguucauugaa

SEQ ID NO: 542874 - RNA, 20 nt, Homo sapiens
ucuaguucuuuucauuugga

SEQ ID NO: 542875 - RNA, 21 nt, Homo sapiens
ucuaguuuuaugcgacagcuu

SEQ ID NO: 542876 - RNA, 18 nt, Homo sapiens
ucuauaaacagacaggcu

SEQ ID NO: 542877 - RNA, 20 nt, Homo sapiens
ucuauaaagaagaacuugca

SEQ ID NO: 542878 - RNA, 21 nt, Homo sapiens
ucuauaaagaagaacuugcau

SEQ ID NO: 542879 - RNA, 14 nt, Homo sapiens
ucuauaaggccaua

SEQ ID NO: 542880 - RNA, 20 nt, Homo sapiens
ucuauaauggaaacauuuac

SEQ ID NO: 542881 - RNA, 17 nt, Homo sapiens
ggagauaaucuagaaca

SEQ ID NO: 542882 - RNA, 14 nt, Homo sapiens
ggagauagugccag

SEQ ID NO: 542883 - RNA, 14 nt, Homo sapiens
ggagaucuucacuc

SEQ ID NO: 542884 - RNA, 20 nt, Homo sapiens
ggagaugaggccagaccaug

SEQ ID NO: 542885 - RNA, 23 nt, Homo sapiens
ggagaugccacuucucacucacc

SEQ ID NO: 542886 - RNA, 17 nt, Homo sapiens
ggagauggcagcaguga

SEQ ID NO: 542887 - RNA, 19 nt, Homo sapiens
ggagcaaagaaggagcuga

SEQ ID NO: 542888 - RNA, 18 nt, Homo sapiens
ggagcaaaucgugccuug

SEQ ID NO: 542889 - RNA, 15 nt, Homo sapiens
ggagcaaauguuucu

SEQ ID NO: 542890 - RNA, 14 nt, Homo sapiens
ggagcaaucugacc

SEQ ID NO: 542891 - RNA, 12 nt, Homo sapiens
ggagcacugggu

SEQ ID NO: 542892 - RNA, 16 nt, Homo sapiens
ggagcagagagguggc

SEQ ID NO: 542893 - RNA, 16 nt, Homo sapiens
ggagcagcagccacug

SEQ ID NO: 542894 - RNA, 13 nt, Homo sapiens
ggagcaggaccua

SEQ ID NO: 542895 - RNA, 18 nt, Homo sapiens
ggagcaggaccuacuagg

SEQ ID NO: 542896 - RNA, 18 nt, Homo sapiens
ggagcauagaagccacau

SEQ ID NO: 542897 - RNA, 19 nt, Homo sapiens
ggagcaucagccagugaau

SEQ ID NO: 542898 - RNA, 20 nt, Homo sapiens
ggagccaucacccucaccca

SEQ ID NO: 542899 - RNA, 20 nt, Homo sapiens
ggagccaugggucugugcug

SEQ ID NO: 542900 - RNA, 23 nt, Homo sapiens
ggagcccacagcgagccugugcc

SEQ ID NO: 542901 - RNA, 23 nt, Homo sapiens
ggagccccuccucccccggcugg

SEQ ID NO: 542902 - RNA, 20 nt, Homo sapiens
ggagccccugaaagccucac

SEQ ID NO: 542903 - RNA, 22 nt, Homo sapiens
ggagcccggcuuccacucccca

SEQ ID NO: 542904 - RNA, 20 nt, Homo sapiens
ggagcccucagacaucucca

SEQ ID NO: 542905 - RNA, 21 nt, Homo sapiens
ggagcccugaggaccucucag

SEQ ID NO: 542906 - RNA, 23 nt, Homo sapiens
ggagcccugaggaccucucagca

SEQ ID NO: 542907 - RNA, 12 nt, Homo sapiens
ggagccuggaac

SEQ ID NO: 542908 - RNA, 21 nt, Homo sapiens
ggagccuggcuccguccagga

SEQ ID NO: 542909 - RNA, 22 nt, Homo sapiens
ggagccugguucagacacagcu

SEQ ID NO: 542910 - RNA, 13 nt, Homo sapiens
ggagcgcuaccca

SEQ ID NO: 542911 - RNA, 15 nt, Homo sapiens
ggagcggggaucuga

SEQ ID NO: 542912 - RNA, 16 nt, Homo sapiens
ggagcucaagcccuug

SEQ ID NO: 542913 - RNA, 17 nt, Homo sapiens
ggagcucacacuccagu

SEQ ID NO: 542914 - RNA, 17 nt, Homo sapiens
ggagcucaggucccagg

SEQ ID NO: 542915 - RNA, 18 nt, Homo sapiens
ggagcucaucugcaaaag

SEQ ID NO: 542916 - RNA, 21 nt, Homo sapiens
ggagcugccuuggcucagaca

SEQ ID NO: 542917 - RNA, 23 nt, Homo sapiens
ggagcugcgcccuggauccucac

SEQ ID NO: 542918 - RNA, 15 nt, Homo sapiens
ggagcugcggccacu

SEQ ID NO: 542919 - RNA, 11 nt, Homo sapiens
ggagcugcuau

SEQ ID NO: 542920 - RNA, 18 nt, Homo sapiens
ggagcugcucucucauga

SEQ ID NO: 542921 - RNA, 15 nt, Homo sapiens
ggagcuggucugcca

SEQ ID NO: 542922 - RNA, 16 nt, Homo sapiens
ggagcuuuccaaagaa

SEQ ID NO: 542923 - RNA, 18 nt, Homo sapiens
ggagcuuucucaaugucu

SEQ ID NO: 542924 - RNA, 18 nt, Homo sapiens
ggaggaaugcucccccau

SEQ ID NO: 542925 - RNA, 15 nt, Homo sapiens
ggaggacagcugccu

SEQ ID NO: 542926 - RNA, 15 nt, Homo sapiens
ggaggacccuggaaa

SEQ ID NO: 542927 - RNA, 18 nt, Homo sapiens
ggaggaccuggggcacag

SEQ ID NO: 542928 - RNA, 15 nt, Homo sapiens
ggaggagagccacug

SEQ ID NO: 542929 - RNA, 12 nt, Homo sapiens
ggaggaggugac

SEQ ID NO: 542930 - RNA, 23 nt, Homo sapiens
ggaggaugucccugggccagggu

SEQ ID NO: 542931 - RNA, 23 nt, Homo sapiens
ggaggcaccagcucuguggccug

SEQ ID NO: 542932 - RNA, 23 nt, Homo sapiens
ggaggcagcgugggcucugccaa

SEQ ID NO: 542933 - RNA, 16 nt, Homo sapiens
ggaggccaaggugggc

SEQ ID NO: 542934 - RNA, 14 nt, Homo sapiens
ggaggccugaugcu

SEQ ID NO: 542935 - RNA, 18 nt, Homo sapiens
ggaggccuuccagcugcu

SEQ ID NO: 542936 - RNA, 14 nt, Homo sapiens
ggaggccuucccac

SEQ ID NO: 542937 - RNA, 20 nt, Homo sapiens
ggaggcgcugcugguguucu

SEQ ID NO: 542938 - RNA, 20 nt, Homo sapiens
ggaggcggagguugcaauga

SEQ ID NO: 542939 - RNA, 15 nt, Homo sapiens
ggaggcgguggcaga

SEQ ID NO: 542940 - RNA, 18 nt, Homo sapiens
ggaggcggugguagagag

SEQ ID NO: 542941 - RNA, 21 nt, Homo sapiens
ggaggcuccagagggcacucu

SEQ ID NO: 542942 - RNA, 14 nt, Homo sapiens
ggaggcugcaguga

SEQ ID NO: 542943 - RNA, 21 nt, Homo sapiens
ggagggacuuuuaaucaguga

SEQ ID NO: 542944 - RNA, 14 nt, Homo sapiens
ggagggagcucuga

SEQ ID NO: 542945 - RNA, 14 nt, Homo sapiens
ggagggcacagcag

SEQ ID NO: 542946 - RNA, 22 nt, Homo sapiens
ggagggcugcugggagccucuc

SEQ ID NO: 542947 - RNA, 18 nt, Homo sapiens
ggagggguauuuuugccc

SEQ ID NO: 542948 - RNA, 19 nt, Homo sapiens
ggagguagagguugcacug

SEQ ID NO: 542949 - RNA, 16 nt, Homo sapiens
ggaggucauacaugca

SEQ ID NO: 542950 - RNA, 14 nt, Homo sapiens
ggaggucucuguaa

SEQ ID NO: 542951 - RNA, 22 nt, Homo sapiens
ggaggugcuuaagcagaagcau

SEQ ID NO: 542952 - RNA, 20 nt, Homo sapiens
ggagguggagauugcaguga

SEQ ID NO: 542953 - RNA, 15 nt, Homo sapiens
ggagguucucagagc

SEQ ID NO: 542954 - RNA, 22 nt, Homo sapiens
ggaguaacaauacaaauggauu

SEQ ID NO: 542955 - RNA, 22 nt, Homo sapiens
ggaguaaucaggcagccuucau

SEQ ID NO: 542956 - RNA, 17 nt, Homo sapiens
ggaguaaucuguguaca

SEQ ID NO: 542957 - RNA, 22 nt, Homo sapiens
ggaguacaaaacaaucucucaa

SEQ ID NO: 542958 - RNA, 21 nt, Homo sapiens
ggaguaccuggaccuguccau

SEQ ID NO: 542959 - RNA, 20 nt, Homo sapiens
ggaguagcauggacucuggg

SEQ ID NO: 542960 - RNA, 16 nt, Homo sapiens
ggaguaggacauacca

SEQ ID NO: 542961 - RNA, 21 nt, Homo sapiens
ggagucucugccacccacuca

SEQ ID NO: 542962 - RNA, 13 nt, Homo sapiens
ggagucugcacau

SEQ ID NO: 542963 - RNA, 18 nt, Homo sapiens
ggagucugccacuuguca

SEQ ID NO: 542964 - RNA, 22 nt, Homo sapiens
ggagugaccaaaggugugcccu

SEQ ID NO: 542965 - RNA, 14 nt, Homo sapiens
ggagugcaccaaag

SEQ ID NO: 542966 - RNA, 12 nt, Homo sapiens
ggagugcaguuu

SEQ ID NO: 542967 - RNA, 15 nt, Homo sapiens
ggaguggccacuaag

SEQ ID NO: 542968 - RNA, 14 nt, Homo sapiens
ggaguggcugccau

SEQ ID NO: 542969 - RNA, 16 nt, Homo sapiens
ggagugggcaccucag

SEQ ID NO: 542970 - RNA, 16 nt, Homo sapiens
ggagugugugacauuc

SEQ ID NO: 542971 - RNA, 22 nt, Homo sapiens
ggaguguucaaaauacuacuga

SEQ ID NO: 542972 - RNA, 22 nt, Homo sapiens
ggaguguugggcaugugaucac

SEQ ID NO: 542973 - RNA, 18 nt, Homo sapiens
ggaguuaggcuauucaca

SEQ ID NO: 542974 - RNA, 17 nt, Homo sapiens
ggaguucccacccaagc

SEQ ID NO: 542975 - RNA, 18 nt, Homo sapiens
ggaguucucccaccaccu

SEQ ID NO: 542976 - RNA, 23 nt, Homo sapiens
ggaguuuuaauguuagaauuuag

SEQ ID NO: 542977 - RNA, 21 nt, Homo sapiens
ggaguuuucuggagugagcac

SEQ ID NO: 542978 - RNA, 22 nt, Homo sapiens
ggauaaagaauacuauuuccaa

SEQ ID NO: 542979 - RNA, 14 nt, Homo sapiens
ggauaaagccacuu

SEQ ID NO: 542980 - RNA, 17 nt, Homo sapiens
ggauaaccuugugccuu

SEQ ID NO: 542981 - RNA, 23 nt, Homo sapiens
ggauaaucacauuaucaucugaa

SEQ ID NO: 542982 - RNA, 19 nt, Homo sapiens
ggauaaucuguauucuugc

SEQ ID NO: 542983 - RNA, 21 nt, Homo sapiens
ggauacauaaugggccacuga

SEQ ID NO: 542984 - RNA, 17 nt, Homo sapiens
ggauacaucugcugugu

SEQ ID NO: 542985 - RNA, 20 nt, Homo sapiens
ggauacgacaguacacuguc

SEQ ID NO: 542986 - RNA, 17 nt, Homo sapiens
ggauacucauucucgaa

SEQ ID NO: 542987 - RNA, 23 nt, Homo sapiens
ggauagcccauagcuauuuuccu

SEQ ID NO: 542988 - RNA, 14 nt, Homo sapiens
ggauagucugucca

SEQ ID NO: 542989 - RNA, 19 nt, Homo sapiens
ggauauaagagggcuuuuu

SEQ ID NO: 542990 - RNA, 23 nt, Homo sapiens
ucuccaagcccuucugucuguca

SEQ ID NO: 542991 - RNA, 22 nt, Homo sapiens
ucuccaagcuuucagacaagaa

SEQ ID NO: 542992 - RNA, 19 nt, Homo sapiens
ucuccacuucuuguucccc

SEQ ID NO: 542993 - RNA, 14 nt, Homo sapiens
ucuccacuuuguug

SEQ ID NO: 542994 - RNA, 17 nt, Homo sapiens
ucuccagacccaccaca

SEQ ID NO: 542995 - RNA, 21 nt, Homo sapiens
ucuccagcucuggcuuccugc

SEQ ID NO: 542996 - RNA, 20 nt, Homo sapiens
ucuccaggauugaagagcau

SEQ ID NO: 542997 - RNA, 21 nt, Homo sapiens
ucuccagggguuuacagugaa

SEQ ID NO: 542998 - RNA, 21 nt, Homo sapiens
ucuccagguccucuacuuaau

SEQ ID NO: 542999 - RNA, 23 nt, Homo sapiens
ucuccauaaaugacacuacuuga

SEQ ID NO: 543000 - RNA, 14 nt, Homo sapiens
ucuccaucccugaa

SEQ ID NO: 543001 - RNA, 13 nt, Homo sapiens
ucuccaucuucca

SEQ ID NO: 543002 - RNA, 20 nt, Homo sapiens
ucuccaugaauuaguucucc

SEQ ID NO: 543003 - RNA, 20 nt, Homo sapiens
ggauccuauccuccuaccuc

SEQ ID NO: 543004 - RNA, 21 nt, Homo sapiens
ggauccuauucucaccaggaa

SEQ ID NO: 543005 - RNA, 14 nt, Homo sapiens
ggauccucccucau

SEQ ID NO: 543006 - RNA, 13 nt, Homo sapiens
ggauccugcacuc

SEQ ID NO: 543007 - RNA, 14 nt, Homo sapiens
ggauccuuugcugc

SEQ ID NO: 543008 - RNA, 14 nt, Homo sapiens
ggaucgaugugcuc

SEQ ID NO: 543009 - RNA, 13 nt, Homo sapiens
ggaucuaccagca

SEQ ID NO: 543010 - RNA, 17 nt, Homo sapiens
ggaucucucuagugaug

SEQ ID NO: 543011 - RNA, 22 nt, Homo sapiens
ggaugaagaacacagcaugugc

SEQ ID NO: 543012 - RNA, 20 nt, Homo sapiens
ggaugaagauucuccugugc

SEQ ID NO: 543013 - RNA, 22 nt, Homo sapiens
ggaugaaggccucccugucuaa

SEQ ID NO: 543014 - RNA, 22 nt, Homo sapiens
ggaugacauagccaauggacaa

SEQ ID NO: 543015 - RNA, 14 nt, Homo sapiens
ggaugagaauguga

SEQ ID NO: 543016 - RNA, 15 nt, Homo sapiens
ggaugagaaugugac

SEQ ID NO: 543017 - RNA, 12 nt, Homo sapiens
ggaugagucaga

SEQ ID NO: 543018 - RNA, 19 nt, Homo sapiens
ggaugaucuugauuguggg

SEQ ID NO: 543019 - RNA, 15 nt, Homo sapiens
ggaugaugcugucau

SEQ ID NO: 543020 - RNA, 16 nt, Homo sapiens
ggaugaugguugcaaa

SEQ ID NO: 543021 - RNA, 22 nt, Homo sapiens
ggaugauuucaucuucuggaau

SEQ ID NO: 543022 - RNA, 19 nt, Homo sapiens
ggaugccacagcccagcuu

SEQ ID NO: 543023 - RNA, 20 nt, Homo sapiens
ggaugcccgcugccugcacu

SEQ ID NO: 543024 - RNA, 23 nt, Homo sapiens
ggaugccgagguaaaaguucuuu

SEQ ID NO: 543025 - RNA, 16 nt, Homo sapiens
ggaugcggccauucaa

SEQ ID NO: 543026 - RNA, 15 nt, Homo sapiens
ggaugcuagugcugu

SEQ ID NO: 543027 - RNA, 20 nt, Homo sapiens
ggaugggacacccaacacuu

SEQ ID NO: 543028 - RNA, 14 nt, Homo sapiens
ggaugggaugcacu

SEQ ID NO: 543029 - RNA, 16 nt, Homo sapiens
ggaugggaugcacucu

SEQ ID NO: 543030 - RNA, 21 nt, Homo sapiens
ggauggggcagucucugccca

SEQ ID NO: 543031 - RNA, 20 nt, Homo sapiens
ggauggggugggcuuagggg

SEQ ID NO: 543032 - RNA, 21 nt, Homo sapiens
ggaugguggcuuuaggggaag

SEQ ID NO: 543033 - RNA, 15 nt, Homo sapiens
ggaugguugaaugag

SEQ ID NO: 543034 - RNA, 17 nt, Homo sapiens
ggaugucccugggccag

SEQ ID NO: 543035 - RNA, 16 nt, Homo sapiens
ggaugugcauucucca

SEQ ID NO: 543036 - RNA, 16 nt, Homo sapiens
ggauguguggggcaug

SEQ ID NO: 543037 - RNA, 14 nt, Homo sapiens
ggaugugugucuca

SEQ ID NO: 543038 - RNA, 15 nt, Homo sapiens
ggauguguuuugcac

SEQ ID NO: 543039 - RNA, 19 nt, Homo sapiens
ggauguugaacuggucauu

SEQ ID NO: 543040 - RNA, 22 nt, Homo sapiens
ggauguuuggaaaaaacucuga

SEQ ID NO: 543041 - RNA, 13 nt, Homo sapiens
ggauuacagggau

SEQ ID NO: 543042 - RNA, 12 nt, Homo sapiens
ggauuacaggug

SEQ ID NO: 543043 - RNA, 17 nt, Homo sapiens
ggauuacaguguagcua

SEQ ID NO: 543044 - RNA, 18 nt, Homo sapiens
ggauuacuauugcaaaag

SEQ ID NO: 543045 - RNA, 14 nt, Homo sapiens
ggauuaguacacac

SEQ ID NO: 543046 - RNA, 13 nt, Homo sapiens
ggauuauuaacua

SEQ ID NO: 543047 - RNA, 17 nt, Homo sapiens
ggauucaucagcauuug

SEQ ID NO: 543048 - RNA, 19 nt, Homo sapiens
ggauuccgucuucucucau

SEQ ID NO: 543049 - RNA, 14 nt, Homo sapiens
ggauuccugagcug

SEQ ID NO: 543050 - RNA, 13 nt, Homo sapiens
ggauucuguguuc

SEQ ID NO: 543051 - RNA, 17 nt, Homo sapiens
ggauugcuaugaaugau

SEQ ID NO: 543052 - RNA, 22 nt, Homo sapiens
ggauugggacgcacagugcagu

SEQ ID NO: 543053 - RNA, 23 nt, Homo sapiens
ggauuguuuaaagaagcucucca

SEQ ID NO: 543054 - RNA, 20 nt, Homo sapiens
ggauuuaauuuccaggguug

SEQ ID NO: 543055 - RNA, 15 nt, Homo sapiens
ggauuuaugacauua

SEQ ID NO: 543056 - RNA, 12 nt, Homo sapiens
ggauuuauguau

SEQ ID NO: 543057 - RNA, 21 nt, Homo sapiens
ggauuuccuugacuucuuuga

SEQ ID NO: 543058 - RNA, 20 nt, Homo sapiens
ggauuugaugcuguuugaca

SEQ ID NO: 543059 - RNA, 13 nt, Homo sapiens
ggauuugcucagg

SEQ ID NO: 543060 - RNA, 13 nt, Homo sapiens
ggauuuguugcca

SEQ ID NO: 543061 - RNA, 14 nt, Homo sapiens
ggauuuuaccaaag

SEQ ID NO: 543062 - RNA, 12 nt, Homo sapiens
ggauuuugaacg

SEQ ID NO: 543063 - RNA, 13 nt, Homo sapiens
ggauuuuugcucu

SEQ ID NO: 543064 - RNA, 16 nt, Homo sapiens
ggcaaaaaaauuaaau

SEQ ID NO: 543065 - RNA, 18 nt, Homo sapiens
ggcaaaacaaaaguacau

SEQ ID NO: 543066 - RNA, 20 nt, Homo sapiens
ggcaaaaccacuagaacucu

SEQ ID NO: 543067 - RNA, 12 nt, Homo sapiens
ggcaaacaggca

SEQ ID NO: 543068 - RNA, 12 nt, Homo sapiens
ggcaaagcagaa

SEQ ID NO: 543069 - RNA, 16 nt, Homo sapiens
ggcaaagggaugagcc

SEQ ID NO: 543070 - RNA, 21 nt, Homo sapiens
ggcaacaacagcaaaacucca

SEQ ID NO: 543071 - RNA, 14 nt, Homo sapiens
ggcaacaaugagca

SEQ ID NO: 543072 - RNA, 20 nt, Homo sapiens
ggcaacagagcaagacucca

SEQ ID NO: 543073 - RNA, 19 nt, Homo sapiens
ggcaacauucauugccaag

SEQ ID NO: 543074 - RNA, 14 nt, Homo sapiens
ggcaaccacauguc

SEQ ID NO: 543075 - RNA, 12 nt, Homo sapiens
ggcaacugugag

SEQ ID NO: 543076 - RNA, 16 nt, Homo sapiens
ggcaagagggggaccu

SEQ ID NO: 543077 - RNA, 16 nt, Homo sapiens
ggcaagauaaacacuu

SEQ ID NO: 543078 - RNA, 18 nt, Homo sapiens
ggcaaggauccugugcug

SEQ ID NO: 543079 - RNA, 15 nt, Homo sapiens
ggcaagggguuucca

SEQ ID NO: 543080 - RNA, 19 nt, Homo sapiens
ggcaagguugggcuggugc

SEQ ID NO: 543081 - RNA, 20 nt, Homo sapiens
ggcaagucuagagucucaga

SEQ ID NO: 543082 - RNA, 16 nt, Homo sapiens
ggcaaucucagaugca

SEQ ID NO: 543083 - RNA, 13 nt, Homo sapiens
ggcaaucuuugcc

SEQ ID NO: 543084 - RNA, 13 nt, Homo sapiens
ggcaauucacaaa

SEQ ID NO: 543085 - RNA, 18 nt, Homo sapiens
ggcaauuucaccaccaaa

SEQ ID NO: 543086 - RNA, 22 nt, Homo sapiens
ggcaauuucaccaccaaaugcc

SEQ ID NO: 543087 - RNA, 18 nt, Homo sapiens
ggcaauuuuugacauuaa

SEQ ID NO: 543088 - RNA, 15 nt, Homo sapiens
ggcacacacugugcc

SEQ ID NO: 543089 - RNA, 20 nt, Homo sapiens
ggcacacgccucccacuggg

SEQ ID NO: 543090 - RNA, 16 nt, Homo sapiens
ggcacaggagacucca

SEQ ID NO: 543091 - RNA, 19 nt, Homo sapiens
ggcacagggucugcucuuu

SEQ ID NO: 543092 - RNA, 20 nt, Homo sapiens
ggcacagggucugcucuuuc

SEQ ID NO: 543093 - RNA, 15 nt, Homo sapiens
ggcacaguccaggaa

SEQ ID NO: 543094 - RNA, 17 nt, Homo sapiens
ggcacauugcccauggc

SEQ ID NO: 543095 - RNA, 12 nt, Homo sapiens
ggcacauugugu

SEQ ID NO: 543096 - RNA, 17 nt, Homo sapiens
ggcaccaaccugcauuu

SEQ ID NO: 543097 - RNA, 14 nt, Homo sapiens
ggcaccacagagaa

SEQ ID NO: 543098 - RNA, 16 nt, Homo sapiens
ggcacccagaaucaga

SEQ ID NO: 543099 - RNA, 13 nt, Homo sapiens
ggcacccauagga

SEQ ID NO: 543100 - RNA, 14 nt, Homo sapiens
ggcacccuggucug

SEQ ID NO: 543101 - RNA, 13 nt, Homo sapiens
ggcaccuguaauc

SEQ ID NO: 543102 - RNA, 17 nt, Homo sapiens
ggcaccuguaaucccag

SEQ ID NO: 543103 - RNA, 20 nt, Homo sapiens
ggcaccuuccgacaucccag

SEQ ID NO: 543104 - RNA, 15 nt, Homo sapiens
ggcacgcccuacucc

SEQ ID NO: 543105 - RNA, 14 nt, Homo sapiens
ggcacgguggcuca

SEQ ID NO: 543106 - RNA, 14 nt, Homo sapiens
ggcacucagucucu

SEQ ID NO: 543107 - RNA, 14 nt, Homo sapiens
ggcacucccaucca

SEQ ID NO: 543108 - RNA, 21 nt, Homo sapiens
ggcacugaauuaaucaucuau

SEQ ID NO: 543109 - RNA, 11 nt, Homo sapiens
ggcacugccug

SEQ ID NO: 543110 - RNA, 13 nt, Homo sapiens
ggcacuguucaau

SEQ ID NO: 543111 - RNA, 20 nt, Homo sapiens
ggcacuuaagugcacuuuuu

SEQ ID NO: 543112 - RNA, 11 nt, Homo sapiens
ggcacuuguau

SEQ ID NO: 543113 - RNA, 16 nt, Homo sapiens
ggccccgagucacuca

SEQ ID NO: 543114 - RNA, 18 nt, Homo sapiens
ggccccucacccaccaug

SEQ ID NO: 543115 - RNA, 19 nt, Homo sapiens
ggccccucacccaccaugg

SEQ ID NO: 543116 - RNA, 19 nt, Homo sapiens
ggccccugcgugggggcca

SEQ ID NO: 543117 - RNA, 19 nt, Homo sapiens
ggcccgacagccuggcaca

SEQ ID NO: 543118 - RNA, 23 nt, Homo sapiens
ggcccgcaccgcugggagucuga

SEQ ID NO: 543119 - RNA, 13 nt, Homo sapiens
ggcccgccucucc

SEQ ID NO: 543120 - RNA, 15 nt, Homo sapiens
ggcccggccagccau

SEQ ID NO: 543121 - RNA, 15 nt, Homo sapiens
ggcccgggcacccac

SEQ ID NO: 543122 - RNA, 23 nt, Homo sapiens
ggcccuaagagguuuuuccucuu

SEQ ID NO: 543123 - RNA, 16 nt, Homo sapiens
ggcccucccccagcuc

SEQ ID NO: 543124 - RNA, 12 nt, Homo sapiens
ggcccucccucu

SEQ ID NO: 543125 - RNA, 21 nt, Homo sapiens
ggcccucccugucuccagggc

SEQ ID NO: 543126 - RNA, 18 nt, Homo sapiens
ggcccucuguggucacag

SEQ ID NO: 543127 - RNA, 19 nt, Homo sapiens
ggcccugacugucagggag

SEQ ID NO: 543128 - RNA, 20 nt, Homo sapiens
ucuccauguuuacacuucaa

SEQ ID NO: 543129 - RNA, 14 nt, Homo sapiens
ucucccacuccagc

SEQ ID NO: 543130 - RNA, 12 nt, Homo sapiens
ucucccagaugu

SEQ ID NO: 543131 - RNA, 21 nt, Homo sapiens
ucucccagggagugagcagcu

SEQ ID NO: 543132 - RNA, 20 nt, Homo sapiens
ucucccagggaugcucuuug

SEQ ID NO: 543133 - RNA, 15 nt, Homo sapiens
ucucccaggucccag

SEQ ID NO: 543134 - RNA, 17 nt, Homo sapiens
ucucccaguccauuucc

SEQ ID NO: 543135 - RNA, 14 nt, Homo sapiens
ucucccauccuuga

SEQ ID NO: 543136 - RNA, 18 nt, Homo sapiens
ucuccccaccccuuccaa

SEQ ID NO: 543137 - RNA, 23 nt, Homo sapiens
ucuccccaugggaucuugaggga

SEQ ID NO: 543138 - RNA, 17 nt, Homo sapiens
ucucccccugggcucug

SEQ ID NO: 543139 - RNA, 16 nt, Homo sapiens
ucuccccgauggggca

SEQ ID NO: 543140 - RNA, 19 nt, Homo sapiens
ucuccccgguaaugucacu

SEQ ID NO: 543141 - RNA, 21 nt, Homo sapiens
ucuccccucccuuguccuuga

SEQ ID NO: 543142 - RNA, 23 nt, Homo sapiens
ucuccccuccugcacacagggca

SEQ ID NO: 543143 - RNA, 20 nt, Homo sapiens
ucuccccugaccugugagcc

SEQ ID NO: 543144 - RNA, 15 nt, Homo sapiens
ucuccccuguucccc

SEQ ID NO: 543145 - RNA, 16 nt, Homo sapiens
ucucccguccauucca

SEQ ID NO: 543146 - RNA, 16 nt, Homo sapiens
ucucccuccaguccuc

SEQ ID NO: 543147 - RNA, 17 nt, Homo sapiens
ucucccuccaguccucu

SEQ ID NO: 543148 - RNA, 19 nt, Homo sapiens
ucucccuccccugccauuu

SEQ ID NO: 543149 - RNA, 16 nt, Homo sapiens
ucucccugcuuugguc

SEQ ID NO: 543150 - RNA, 19 nt, Homo sapiens
ucucccuggggcacuuuca

SEQ ID NO: 543151 - RNA, 21 nt, Homo sapiens
ucucccugucacacacuggac

SEQ ID NO: 543152 - RNA, 23 nt, Homo sapiens
ucucccuguuggucgguggguug

SEQ ID NO: 543153 - RNA, 15 nt, Homo sapiens
ucucccuuccuggca

SEQ ID NO: 543154 - RNA, 18 nt, Homo sapiens
ucuccuacuaugcaauuu

SEQ ID NO: 543155 - RNA, 20 nt, Homo sapiens
ucuccucacucugucccugu

SEQ ID NO: 543156 - RNA, 14 nt, Homo sapiens
ucuccucagaagaa

SEQ ID NO: 543157 - RNA, 12 nt, Homo sapiens
ucuccucuccau

SEQ ID NO: 543158 - RNA, 12 nt, Homo sapiens
ucuccugacccc

SEQ ID NO: 543159 - RNA, 12 nt, Homo sapiens
ucuccugagcua

SEQ ID NO: 543160 - RNA, 13 nt, Homo sapiens
ucuccugcaaaag

SEQ ID NO: 543161 - RNA, 18 nt, Homo sapiens
ucuccugcccaagcacuu

SEQ ID NO: 543162 - RNA, 12 nt, Homo sapiens
ucuccugcugau

SEQ ID NO: 543163 - RNA, 13 nt, Homo sapiens
ucuccugcuugua

SEQ ID NO: 543164 - RNA, 23 nt, Homo sapiens
ucuccugucugaaccugcccuua

SEQ ID NO: 543165 - RNA, 14 nt, Homo sapiens
ucuccugucugccc

SEQ ID NO: 543166 - RNA, 13 nt, Homo sapiens
ucuccugugccca

SEQ ID NO: 543167 - RNA, 16 nt, Homo sapiens
ucuccuuaaaaacugg

SEQ ID NO: 543168 - RNA, 14 nt, Homo sapiens
ucuccuucugaaag

SEQ ID NO: 543169 - RNA, 13 nt, Homo sapiens
ucuccuugccuuc

SEQ ID NO: 543170 - RNA, 15 nt, Homo sapiens
ucuccuuuacuaaau

SEQ ID NO: 543171 - RNA, 14 nt, Homo sapiens
ucuccuuugagcaa

SEQ ID NO: 543172 - RNA, 17 nt, Homo sapiens
ucuccuuugcacugagg

SEQ ID NO: 543173 - RNA, 15 nt, Homo sapiens
ucuccuuuuacuuca

SEQ ID NO: 543174 - RNA, 18 nt, Homo sapiens
ucuccuuuugaccaaaua

SEQ ID NO: 543175 - RNA, 19 nt, Homo sapiens
ucucgaacuccugaccuca

SEQ ID NO: 543176 - RNA, 17 nt, Homo sapiens
ucucgagcccagaugga

SEQ ID NO: 543177 - RNA, 15 nt, Homo sapiens
ucucgaucuccugac

SEQ ID NO: 543178 - RNA, 16 nt, Homo sapiens
ucucgcacaaugcaug

SEQ ID NO: 543179 - RNA, 21 nt, Homo sapiens
ucucgcucccuuucagguuua

SEQ ID NO: 543180 - RNA, 12 nt, Homo sapiens
ucucgcuuuguu

SEQ ID NO: 543181 - RNA, 17 nt, Homo sapiens
ucucggcucacugcaag

SEQ ID NO: 543182 - RNA, 20 nt, Homo sapiens
ucucggcuuauggcaaccuc

SEQ ID NO: 543183 - RNA, 14 nt, Homo sapiens
ucucgguuugccaa

SEQ ID NO: 543184 - RNA, 16 nt, Homo sapiens
ucucguauaauauuca

SEQ ID NO: 543185 - RNA, 15 nt, Homo sapiens
ucucgugguauguau

SEQ ID NO: 543186 - RNA, 13 nt, Homo sapiens
ucucuaaaacugc

SEQ ID NO: 543187 - RNA, 15 nt, Homo sapiens
ucucuaaaagcuuua

SEQ ID NO: 543188 - RNA, 16 nt, Homo sapiens
ucucuaaaucaaguau

SEQ ID NO: 543189 - RNA, 16 nt, Homo sapiens
ucucuaaccauucaaa

SEQ ID NO: 543190 - RNA, 21 nt, Homo sapiens
ucucuaacguccacuagcuua

SEQ ID NO: 543191 - RNA, 14 nt, Homo sapiens
ucucuacagacucc

SEQ ID NO: 543192 - RNA, 19 nt, Homo sapiens
ucucuaccacugcugauau

SEQ ID NO: 543193 - RNA, 15 nt, Homo sapiens
ucucuacuaaaacau

SEQ ID NO: 543194 - RNA, 19 nt, Homo sapiens
ucucuacuaccacaaggaa

SEQ ID NO: 543195 - RNA, 13 nt, Homo sapiens
ucucuagcacaau

SEQ ID NO: 543196 - RNA, 22 nt, Homo sapiens
ucucuagcacaauuugcacuaa

SEQ ID NO: 543197 - RNA, 18 nt, Homo sapiens
ucucuaggccuguugccu

SEQ ID NO: 543198 - RNA, 22 nt, Homo sapiens
ucucuagggcuaguagaacugg

SEQ ID NO: 543199 - RNA, 19 nt, Homo sapiens
ucucuaguuuccagaggcu

SEQ ID NO: 543200 - RNA, 23 nt, Homo sapiens
ucucuauaacagauccuuucaaa

SEQ ID NO: 543201 - RNA, 20 nt, Homo sapiens
ucucuauuaaaauacaaaaa

SEQ ID NO: 543202 - RNA, 22 nt, Homo sapiens
ucucuauuauguuaucauccuc

SEQ ID NO: 543203 - RNA, 16 nt, Homo sapiens
ucucucacaaagucca

SEQ ID NO: 543204 - RNA, 16 nt, Homo sapiens
ucucucacacaucaca

SEQ ID NO: 543205 - RNA, 13 nt, Homo sapiens
ucucucacaugga

SEQ ID NO: 543206 - RNA, 12 nt, Homo sapiens
ucucucauuccc

SEQ ID NO: 543207 - RNA, 23 nt, Homo sapiens
ucucucccaggucccagccccuu

SEQ ID NO: 543208 - RNA, 13 nt, Homo sapiens
ucucucuccaugu

SEQ ID NO: 543209 - RNA, 14 nt, Homo sapiens
ucucucucugugcu

SEQ ID NO: 543210 - RNA, 12 nt, Homo sapiens
ucucucugcucc

SEQ ID NO: 543211 - RNA, 16 nt, Homo sapiens
ucucucuucucuccag

SEQ ID NO: 543212 - RNA, 15 nt, Homo sapiens
ucucucuugcaggaa

SEQ ID NO: 543213 - RNA, 14 nt, Homo sapiens
ucucugaacugcaa

SEQ ID NO: 543214 - RNA, 16 nt, Homo sapiens
ucucugagcacccaag

SEQ ID NO: 543215 - RNA, 14 nt, Homo sapiens
ucucugagcaguga

SEQ ID NO: 543216 - RNA, 19 nt, Homo sapiens
ucucugagcagugaaugau

SEQ ID NO: 543217 - RNA, 17 nt, Homo sapiens
ucucugcaucuacuccc

SEQ ID NO: 543218 - RNA, 18 nt, Homo sapiens
ucucugcccucuucucau

SEQ ID NO: 543219 - RNA, 22 nt, Homo sapiens
ucucugccuguacugaagcuga

SEQ ID NO: 543220 - RNA, 20 nt, Homo sapiens
ucucugcuccuacauccagc

SEQ ID NO: 543221 - RNA, 20 nt, Homo sapiens
ucucuggaaaggggggagcu

SEQ ID NO: 543222 - RNA, 22 nt, Homo sapiens
ucucugggaaucaacagcauau

SEQ ID NO: 543223 - RNA, 18 nt, Homo sapiens
ucucuggucuuccagcga

SEQ ID NO: 543224 - RNA, 20 nt, Homo sapiens
ucucugucaugugcagauga

SEQ ID NO: 543225 - RNA, 12 nt, Homo sapiens
ucucugugcucu

SEQ ID NO: 543226 - RNA, 11 nt, Homo sapiens
ucucuguguau

SEQ ID NO: 543227 - RNA, 15 nt, Homo sapiens
ucucuguucagaaag

SEQ ID NO: 543228 - RNA, 16 nt, Homo sapiens
ucucuuaaaaugacaa

SEQ ID NO: 543229 - RNA, 16 nt, Homo sapiens
ucucuuaaucacuacu

SEQ ID NO: 543230 - RNA, 15 nt, Homo sapiens
ucucuuagcaacuca

SEQ ID NO: 543231 - RNA, 16 nt, Homo sapiens
ucucuuagcaacucag

SEQ ID NO: 543232 - RNA, 23 nt, Homo sapiens
ucucuucaccccuacacugugaa

SEQ ID NO: 543233 - RNA, 15 nt, Homo sapiens
ucucuucacucccaa

SEQ ID NO: 543234 - RNA, 14 nt, Homo sapiens
ucucuucugagcua

SEQ ID NO: 543235 - RNA, 16 nt, Homo sapiens
ucucuucuguccauca

SEQ ID NO: 543236 - RNA, 14 nt, Homo sapiens
ggcuaguugggaug

SEQ ID NO: 543237 - RNA, 23 nt, Homo sapiens
ggcuaucuaauuuuacacucugu

SEQ ID NO: 543238 - RNA, 20 nt, Homo sapiens
ggcuaugaaaaugagcccug

SEQ ID NO: 543239 - RNA, 19 nt, Homo sapiens
ggcuaugaggauaauggga

SEQ ID NO: 543240 - RNA, 20 nt, Homo sapiens
ggcuaugccuugcacacagg

SEQ ID NO: 543241 - RNA, 14 nt, Homo sapiens
ggcuauguaaacaa

SEQ ID NO: 543242 - RNA, 14 nt, Homo sapiens
ggcuauuauuuauu

SEQ ID NO: 543243 - RNA, 21 nt, Homo sapiens
ggcuauuauuuauuguauuag

SEQ ID NO: 543244 - RNA, 19 nt, Homo sapiens
ggcuauuuaaaacuuguaa

SEQ ID NO: 543245 - RNA, 17 nt, Homo sapiens
ggcuauuuggacucagg

SEQ ID NO: 543246 - RNA, 17 nt, Homo sapiens
ggcuauuuguguguaug

SEQ ID NO: 543247 - RNA, 15 nt, Homo sapiens
ggcucaacauugugu

SEQ ID NO: 543248 - RNA, 21 nt, Homo sapiens
ggcucaaggaaaggggguccc

SEQ ID NO: 543249 - RNA, 20 nt, Homo sapiens
ggcucacgcguucugggagc

SEQ ID NO: 543250 - RNA, 20 nt, Homo sapiens
ggcucagauuguaauaugua

SEQ ID NO: 543251 - RNA, 13 nt, Homo sapiens
ggcucagggcagu

SEQ ID NO: 543252 - RNA, 11 nt, Homo sapiens
ggcucaucucu

SEQ ID NO: 543253 - RNA, 18 nt, Homo sapiens
ucugaaccccucccucca

SEQ ID NO: 543254 - RNA, 15 nt, Homo sapiens
ucugaacucucaaaa

SEQ ID NO: 543255 - RNA, 18 nt, Homo sapiens
ucugaacugcaacacugg

SEQ ID NO: 543256 - RNA, 17 nt, Homo sapiens
ucugaagagccugaagc

SEQ ID NO: 543257 - RNA, 13 nt, Homo sapiens
ucugaagauguca

SEQ ID NO: 543258 - RNA, 12 nt, Homo sapiens
ucugaagccaca

SEQ ID NO: 543259 - RNA, 21 nt, Homo sapiens
ucugaaguacuuaaacuucca

SEQ ID NO: 543260 - RNA, 23 nt, Homo sapiens
ucugaagucacaucacaggacac

SEQ ID NO: 543261 - RNA, 15 nt, Homo sapiens
ucugaagucacugca

SEQ ID NO: 543262 - RNA, 17 nt, Homo sapiens
ucugaagucacugcaca

SEQ ID NO: 543263 - RNA, 14 nt, Homo sapiens
ucugaagugguuug

SEQ ID NO: 543264 - RNA, 21 nt, Homo sapiens
ucugaaguguccuaaauauua

SEQ ID NO: 543265 - RNA, 15 nt, Homo sapiens
ucugaagugugucca

SEQ ID NO: 543266 - RNA, 18 nt, Homo sapiens
ucugaauacacaguauuc

SEQ ID NO: 543267 - RNA, 19 nt, Homo sapiens
ucugaauauuaaagcucuu

SEQ ID NO: 543268 - RNA, 19 nt, Homo sapiens
ucugaaucaagcacacugu

SEQ ID NO: 543269 - RNA, 13 nt, Homo sapiens
ucugaaucagaaa

SEQ ID NO: 543270 - RNA, 15 nt, Homo sapiens
ucugaaucagaaaag

SEQ ID NO: 543271 - RNA, 18 nt, Homo sapiens
ucugacaguccuuggggu

SEQ ID NO: 543272 - RNA, 19 nt, Homo sapiens
ucugacccucccagucuca

SEQ ID NO: 543273 - RNA, 12 nt, Homo sapiens
ucugaccuguac

SEQ ID NO: 543274 - RNA, 18 nt, Homo sapiens
ucugacugucaccucgug

SEQ ID NO: 543275 - RNA, 19 nt, Homo sapiens
ucugacuuaagcaaaagaa

SEQ ID NO: 543276 - RNA, 16 nt, Homo sapiens
ucugagaaaaugcgag

SEQ ID NO: 543277 - RNA, 22 nt, Homo sapiens
ucugagaacuccucauucccug

SEQ ID NO: 543278 - RNA, 19 nt, Homo sapiens
ucugagacacaccccaaca

SEQ ID NO: 543279 - RNA, 14 nt, Homo sapiens
ucugagacucacag

SEQ ID NO: 543280 - RNA, 20 nt, Homo sapiens
ucugagacuccucauaccuc

SEQ ID NO: 543281 - RNA, 13 nt, Homo sapiens
ucugagcacuguu

SEQ ID NO: 543282 - RNA, 11 nt, Homo sapiens
ucugagcccac

SEQ ID NO: 543283 - RNA, 11 nt, Homo sapiens
ucugagccuug

SEQ ID NO: 543284 - RNA, 16 nt, Homo sapiens
ucugagcucccaccuc

SEQ ID NO: 543285 - RNA, 20 nt, Homo sapiens
ucugaggaguaaguguacaa

SEQ ID NO: 543286 - RNA, 23 nt, Homo sapiens
ucugaggcccugagcauucuugg

SEQ ID NO: 543287 - RNA, 16 nt, Homo sapiens
ucugaggccugaguga

SEQ ID NO: 543288 - RNA, 17 nt, Homo sapiens
ucugagggagcugagua

SEQ ID NO: 543289 - RNA, 21 nt, Homo sapiens
ucugaggggcuaccaggaaag

SEQ ID NO: 543290 - RNA, 20 nt, Homo sapiens
ucugaguagacauucuuaua

SEQ ID NO: 543291 - RNA, 21 nt, Homo sapiens
ucugagucacaggugugggau

SEQ ID NO: 543292 - RNA, 20 nt, Homo sapiens
ucugagugaaccuguauaag

SEQ ID NO: 543293 - RNA, 19 nt, Homo sapiens
ucugagugggcccagcaca

SEQ ID NO: 543294 - RNA, 16 nt, Homo sapiens
ucugauaccacugcac

SEQ ID NO: 543295 - RNA, 17 nt, Homo sapiens
ucugauaccacugcacu

SEQ ID NO: 543296 - RNA, 14 nt, Homo sapiens
ucugauacguguau

SEQ ID NO: 543297 - RNA, 15 nt, Homo sapiens
ucugauacguguaug

SEQ ID NO: 543298 - RNA, 15 nt, Homo sapiens
ucugauagacuuugu

SEQ ID NO: 543299 - RNA, 22 nt, Homo sapiens
ucugauaugcaguuuuccuuaa

SEQ ID NO: 543300 - RNA, 15 nt, Homo sapiens
ucugauauguaucca

SEQ ID NO: 543301 - RNA, 22 nt, Homo sapiens
ucugaucugcaguuuuugccug

SEQ ID NO: 543302 - RNA, 23 nt, Homo sapiens
ucugaugaugucggucuugcaaa

SEQ ID NO: 543303 - RNA, 13 nt, Homo sapiens
ucugaugugaugu

SEQ ID NO: 543304 - RNA, 15 nt, Homo sapiens
ucugauuacugucca

SEQ ID NO: 543305 - RNA, 18 nt, Homo sapiens
ucugauuacuguccagcu

SEQ ID NO: 543306 - RNA, 17 nt, Homo sapiens
ucugauucacagucuca

SEQ ID NO: 543307 - RNA, 20 nt, Homo sapiens
ucugauucuuuuuucaguca

SEQ ID NO: 543308 - RNA, 23 nt, Homo sapiens
ucugauuggcuggauugccuugu

SEQ ID NO: 543309 - RNA, 16 nt, Homo sapiens
ucugauuggugauuca

SEQ ID NO: 543310 - RNA, 13 nt, Homo sapiens
ucugcaaacauua

SEQ ID NO: 543311 - RNA, 21 nt, Homo sapiens
ucugcaaaggaaauaccaguu

SEQ ID NO: 543312 - RNA, 15 nt, Homo sapiens
ucugcaacaaaaagu

SEQ ID NO: 543313 - RNA, 14 nt, Homo sapiens
ucugcacaccuacu

SEQ ID NO: 543314 - RNA, 14 nt, Homo sapiens
ucugcacagauucu

SEQ ID NO: 543315 - RNA, 13 nt, Homo sapiens
ucugcacaugcag

SEQ ID NO: 543316 - RNA, 18 nt, Homo sapiens
ucugcacucuaaacugca

SEQ ID NO: 543317 - RNA, 12 nt, Homo sapiens
ucugcacuucau

SEQ ID NO: 543318 - RNA, 18 nt, Homo sapiens
ucugcagagucacucaca

SEQ ID NO: 543319 - RNA, 16 nt, Homo sapiens
ucugcagcuaacuuau

SEQ ID NO: 543320 - RNA, 14 nt, Homo sapiens
ucugcagcucugac

SEQ ID NO: 543321 - RNA, 20 nt, Homo sapiens
ucugcagcucugacccaaau

SEQ ID NO: 543322 - RNA, 17 nt, Homo sapiens
ucugcaggccacuguga

SEQ ID NO: 543323 - RNA, 18 nt, Homo sapiens
ucugcagggagcaacucu

SEQ ID NO: 543324 - RNA, 18 nt, Homo sapiens
ucugcagguugaagccau

SEQ ID NO: 543325 - RNA, 15 nt, Homo sapiens
ucugcaguagucucu

SEQ ID NO: 543326 - RNA, 19 nt, Homo sapiens
ucugcauccagagauucau

SEQ ID NO: 543327 - RNA, 15 nt, Homo sapiens
ucugcauccauuuga

SEQ ID NO: 543328 - RNA, 19 nt, Homo sapiens
ucugcaucccagcaccugc

SEQ ID NO: 543329 - RNA, 19 nt, Homo sapiens
ucugcauggaacagcauua

SEQ ID NO: 543330 - RNA, 23 nt, Homo sapiens
ucugcauuucgguggcuagucaa

SEQ ID NO: 543331 - RNA, 18 nt, Homo sapiens
ucugcauuuugcuauugu

SEQ ID NO: 543332 - RNA, 21 nt, Homo sapiens
ucugccacuugucaaagaagg

SEQ ID NO: 543333 - RNA, 14 nt, Homo sapiens
ucugccagaccuua

SEQ ID NO: 543334 - RNA, 18 nt, Homo sapiens
ucugccagccagcagcca

SEQ ID NO: 543335 - RNA, 12 nt, Homo sapiens
ucugccaggcaa

SEQ ID NO: 543336 - RNA, 12 nt, Homo sapiens
ucugccaggcac

SEQ ID NO: 543337 - RNA, 23 nt, Homo sapiens
ucugccaggggcuucccacuuug

SEQ ID NO: 543338 - RNA, 15 nt, Homo sapiens
ucugcccaauccauc

SEQ ID NO: 543339 - RNA, 15 nt, Homo sapiens
ucugcccaugggaag

SEQ ID NO: 543340 - RNA, 18 nt, Homo sapiens
ucugccccaccuugccag

SEQ ID NO: 543341 - RNA, 14 nt, Homo sapiens
ucugccccagucgu

SEQ ID NO: 543342 - RNA, 14 nt, Homo sapiens
ucugcccugccucc

SEQ ID NO: 543343 - RNA, 20 nt, Homo sapiens
ucugcccuuauggagcucac

SEQ ID NO: 543344 - RNA, 14 nt, Homo sapiens
ucugcccuuuccua

SEQ ID NO: 543345 - RNA, 14 nt, Homo sapiens
ucugccgcuaccuc

SEQ ID NO: 543346 - RNA, 16 nt, Homo sapiens
ucugccgcuaccuccc

SEQ ID NO: 543347 - RNA, 18 nt, Homo sapiens
ucugccuacaaaaccuca

SEQ ID NO: 543348 - RNA, 13 nt, Homo sapiens
ucugccucuggaa

SEQ ID NO: 543349 - RNA, 22 nt, Homo sapiens
ucugccugcaccccugcaguuu

SEQ ID NO: 543350 - RNA, 14 nt, Homo sapiens
ucugccuguacuga

SEQ ID NO: 543351 - RNA, 12 nt, Homo sapiens
ucugccugugga

SEQ ID NO: 543352 - RNA, 23 nt, Homo sapiens
ucugccuguggccuugcccgcca

SEQ ID NO: 543353 - RNA, 20 nt, Homo sapiens
ucugccuucuuccaggauca

SEQ ID NO: 543354 - RNA, 15 nt, Homo sapiens
ucugcuaaauaucac

SEQ ID NO: 543355 - RNA, 17 nt, Homo sapiens
ucugcuacccacugcca

SEQ ID NO: 543356 - RNA, 12 nt, Homo sapiens
ucugcuagggaa

SEQ ID NO: 543357 - RNA, 18 nt, Homo sapiens
ucugcucaucauucucug

SEQ ID NO: 543358 - RNA, 19 nt, Homo sapiens
ucugcuccagguucacuuu

SEQ ID NO: 543359 - RNA, 19 nt, Homo sapiens
gggaagacuuuaaaccacc

SEQ ID NO: 543360 - RNA, 17 nt, Homo sapiens
gggaagccccacuugaa

SEQ ID NO: 543361 - RNA, 21 nt, Homo sapiens
gggaagcugggggaagggugg

SEQ ID NO: 543362 - RNA, 15 nt, Homo sapiens
gggaaggccucccag

SEQ ID NO: 543363 - RNA, 21 nt, Homo sapiens
gggaagugagggcucacucag

SEQ ID NO: 543364 - RNA, 20 nt, Homo sapiens
gggaaguugucuccuuccau

SEQ ID NO: 543365 - RNA, 23 nt, Homo sapiens
gggaauacugugcauaagccauu

SEQ ID NO: 543366 - RNA, 14 nt, Homo sapiens
gggaaucuaagaga

SEQ ID NO: 543367 - RNA, 12 nt, Homo sapiens
gggaauggggac

SEQ ID NO: 543368 - RNA, 22 nt, Homo sapiens
gggaauggggacacggugucca

SEQ ID NO: 543369 - RNA, 19 nt, Homo sapiens
gggacaagacaaaaccaaa

SEQ ID NO: 543370 - RNA, 13 nt, Homo sapiens
gggacacuuucac

SEQ ID NO: 543371 - RNA, 17 nt, Homo sapiens
gggacagagcugaggau

SEQ ID NO: 543372 - RNA, 11 nt, Homo sapiens
gggacaggaug

SEQ ID NO: 543373 - RNA, 21 nt, Homo sapiens
gggacauuaguaacugcacac

SEQ ID NO: 543374 - RNA, 22 nt, Homo sapiens
gggaccaacugggcccaagaca

SEQ ID NO: 543375 - RNA, 16 nt, Homo sapiens
gggaccacaccucccu

SEQ ID NO: 543376 - RNA, 21 nt, Homo sapiens
gggaccacagacucacauccu

SEQ ID NO: 543377 - RNA, 14 nt, Homo sapiens
ucuggaaagugaug

SEQ ID NO: 543378 - RNA, 17 nt, Homo sapiens
ucuggaaagugauguca

SEQ ID NO: 543379 - RNA, 21 nt, Homo sapiens
ucuggaaauuuuuacuuuaaa

SEQ ID NO: 543380 - RNA, 21 nt, Homo sapiens
ucuggaaggccccucccagca

SEQ ID NO: 543381 - RNA, 16 nt, Homo sapiens
ucuggaauacaugaaa

SEQ ID NO: 543382 - RNA, 18 nt, Homo sapiens
ucuggaaucuggagacca

SEQ ID NO: 543383 - RNA, 19 nt, Homo sapiens
ucuggaauuucaaaccauu

SEQ ID NO: 543384 - RNA, 11 nt, Homo sapiens
ucuggacaaag

SEQ ID NO: 543385 - RNA, 20 nt, Homo sapiens
ucuggacaaagacuaccuga

SEQ ID NO: 543386 - RNA, 11 nt, Homo sapiens
ucuggacacag

SEQ ID NO: 543387 - RNA, 19 nt, Homo sapiens
ucuggaccccaucugugaa

SEQ ID NO: 543388 - RNA, 20 nt, Homo sapiens
ucuggaccccaucugugaau

SEQ ID NO: 543389 - RNA, 15 nt, Homo sapiens
ucuggaccuagggug

SEQ ID NO: 543390 - RNA, 18 nt, Homo sapiens
ucuggagaguaaucuggg

SEQ ID NO: 543391 - RNA, 19 nt, Homo sapiens
ucuggagcacuuguuuuaa

SEQ ID NO: 543392 - RNA, 23 nt, Homo sapiens
ucuggaucacagacacugcacag

SEQ ID NO: 543393 - RNA, 14 nt, Homo sapiens
ucuggaugaaggca

SEQ ID NO: 543394 - RNA, 21 nt, Homo sapiens
ucuggauggauuugaagcaaa

SEQ ID NO: 543395 - RNA, 17 nt, Homo sapiens
ucuggauucugaaucuc

SEQ ID NO: 543396 - RNA, 22 nt, Homo sapiens
ucuggauuguuuuuaaaccucc

SEQ ID NO: 543397 - RNA, 23 nt, Homo sapiens
ucuggcaaugggacucugagaac

SEQ ID NO: 543398 - RNA, 22 nt, Homo sapiens
ucuggcaucacgucagugcuca

SEQ ID NO: 543399 - RNA, 18 nt, Homo sapiens
ucuggcaucuuagaccuc

SEQ ID NO: 543400 - RNA, 12 nt, Homo sapiens
ucuggcaugaau

SEQ ID NO: 543401 - RNA, 19 nt, Homo sapiens
ucuggcauuuguuuccuca

SEQ ID NO: 543402 - RNA, 17 nt, Homo sapiens
ucuggccacaucuugac

SEQ ID NO: 543403 - RNA, 20 nt, Homo sapiens
ucuggccagaaaaggcauuu

SEQ ID NO: 543404 - RNA, 16 nt, Homo sapiens
ucuggcccacugagcc

SEQ ID NO: 543405 - RNA, 18 nt, Homo sapiens
ucuggcugaggauuucaa

SEQ ID NO: 543406 - RNA, 19 nt, Homo sapiens
ucuggcugccccaaccugc

SEQ ID NO: 543407 - RNA, 23 nt, Homo sapiens
ucuggcugccccaaccugcugaa

SEQ ID NO: 543408 - RNA, 17 nt, Homo sapiens
ucuggcuguguggccaa

SEQ ID NO: 543409 - RNA, 20 nt, Homo sapiens
ucugggaaucccagaauguc

SEQ ID NO: 543410 - RNA, 19 nt, Homo sapiens
ucugggacuuuuaaauuca

SEQ ID NO: 543411 - RNA, 21 nt, Homo sapiens
ucugggagcuacaaaauuuca

SEQ ID NO: 543412 - RNA, 15 nt, Homo sapiens
ucugggaggcccuga

SEQ ID NO: 543413 - RNA, 18 nt, Homo sapiens
ucugggauuaagggcaaa

SEQ ID NO: 543414 - RNA, 23 nt, Homo sapiens
ucugggauuaagggcaaaucuau

SEQ ID NO: 543415 - RNA, 20 nt, Homo sapiens
ucugggauucccaccaaggu

SEQ ID NO: 543416 - RNA, 17 nt, Homo sapiens
ucugggccaaguuccuc

SEQ ID NO: 543417 - RNA, 15 nt, Homo sapiens
ucugggccagugcac

SEQ ID NO: 543418 - RNA, 21 nt, Homo sapiens
ucugggccucugacucugagu

SEQ ID NO: 543419 - RNA, 19 nt, Homo sapiens
ucugggccucuuuuugccc

SEQ ID NO: 543420 - RNA, 15 nt, Homo sapiens
ucugggcuacugcca

SEQ ID NO: 543421 - RNA, 16 nt, Homo sapiens
ucugggcuauggacac

SEQ ID NO: 543422 - RNA, 18 nt, Homo sapiens
ucugggcugccaugugaa

SEQ ID NO: 543423 - RNA, 16 nt, Homo sapiens
ucugggcugggcaccu

SEQ ID NO: 543424 - RNA, 16 nt, Homo sapiens
ucugggggacagagaa

SEQ ID NO: 543425 - RNA, 12 nt, Homo sapiens
ucuggggguccc

SEQ ID NO: 543426 - RNA, 18 nt, Homo sapiens
ucugggucaucucucaca

SEQ ID NO: 543427 - RNA, 16 nt, Homo sapiens
ucugggucaugcacug

SEQ ID NO: 543428 - RNA, 19 nt, Homo sapiens
ucugggucaugcacugagg

SEQ ID NO: 543429 - RNA, 12 nt, Homo sapiens
ucugggugcaug

SEQ ID NO: 543430 - RNA, 17 nt, Homo sapiens
ucugguaggaaugcuuc

SEQ ID NO: 543431 - RNA, 19 nt, Homo sapiens
ucugguccuaagucccugc

SEQ ID NO: 543432 - RNA, 14 nt, Homo sapiens
ucuggucuguccac

SEQ ID NO: 543433 - RNA, 20 nt, Homo sapiens
ucugguuagaaaaaggacuc

SEQ ID NO: 543434 - RNA, 19 nt, Homo sapiens
ucugguuucuaccagcuca

SEQ ID NO: 543435 - RNA, 20 nt, Homo sapiens
ucugguuuuaacaauuuccu

SEQ ID NO: 543436 - RNA, 19 nt, Homo sapiens
ucuguaaaaacacugaaaa

SEQ ID NO: 543437 - RNA, 14 nt, Homo sapiens
ucuguaaaugacac

SEQ ID NO: 543438 - RNA, 18 nt, Homo sapiens
ucuguaaguguagcucaa

SEQ ID NO: 543439 - RNA, 12 nt, Homo sapiens
ucuguaaucuuc

SEQ ID NO: 543440 - RNA, 13 nt, Homo sapiens
ucuguaauugaau

SEQ ID NO: 543441 - RNA, 19 nt, Homo sapiens
ucuguacauauuacuguug

SEQ ID NO: 543442 - RNA, 24 nt, Homo sapiens
ucuguagaagcuaauaaauaauca

SEQ ID NO: 543443 - RNA, 21 nt, Homo sapiens
ucuguagagguuauuucugca

SEQ ID NO: 543444 - RNA, 14 nt, Homo sapiens
ucuguagcuuuaac

SEQ ID NO: 543445 - RNA, 15 nt, Homo sapiens
ucuguagggaacucu

SEQ ID NO: 543446 - RNA, 16 nt, Homo sapiens
ucuguaguuacugugg

SEQ ID NO: 543447 - RNA, 15 nt, Homo sapiens
ucuguauugcuggca

SEQ ID NO: 543448 - RNA, 16 nt, Homo sapiens
ucugucaaaacacugu

SEQ ID NO: 543449 - RNA, 22 nt, Homo sapiens
ucugucaagcuuacuacaguga

SEQ ID NO: 543450 - RNA, 14 nt, Homo sapiens
ucugucaaucacag

SEQ ID NO: 543451 - RNA, 18 nt, Homo sapiens
ucugucaccaacugaagu

SEQ ID NO: 543452 - RNA, 20 nt, Homo sapiens
ucugucacccuuguccuuga

SEQ ID NO: 543453 - RNA, 16 nt, Homo sapiens
ucugucaucucucugg

SEQ ID NO: 543454 - RNA, 21 nt, Homo sapiens
ucuguccagaggcugcaagga

SEQ ID NO: 543455 - RNA, 16 nt, Homo sapiens
ucugucccaaucuuac

SEQ ID NO: 543456 - RNA, 19 nt, Homo sapiens
ucuguccccgcuccccuaa

SEQ ID NO: 543457 - RNA, 20 nt, Homo sapiens
ucuguccuggaggcacuggg

SEQ ID NO: 543458 - RNA, 13 nt, Homo sapiens
ucugucuaccugg

SEQ ID NO: 543459 - RNA, 17 nt, Homo sapiens
ucugucuccaagaccuu

SEQ ID NO: 543460 - RNA, 23 nt, Homo sapiens
ucugucucuaaccauucaaauga

SEQ ID NO: 543461 - RNA, 14 nt, Homo sapiens
ucugucucuuggcu

SEQ ID NO: 543462 - RNA, 22 nt, Homo sapiens
ucugucugaauuauucugccua

SEQ ID NO: 543463 - RNA, 23 nt, Homo sapiens
ucugucuggcauuacaauugcag

SEQ ID NO: 543464 - RNA, 11 nt, Homo sapiens
ucugucuucaa

SEQ ID NO: 543465 - RNA, 17 nt, Homo sapiens
ucugucuuuauaaucua

SEQ ID NO: 543466 - RNA, 22 nt, Homo sapiens
ucugugaaaagggaucugcucc

SEQ ID NO: 543467 - RNA, 14 nt, Homo sapiens
ucugugaaauacug

SEQ ID NO: 543468 - RNA, 15 nt, Homo sapiens
ucugugacauacaua

SEQ ID NO: 543469 - RNA, 20 nt, Homo sapiens
ucugugagauaaaugcacau

SEQ ID NO: 543470 - RNA, 18 nt, Homo sapiens
ucugugccccguccuugu

SEQ ID NO: 543471 - RNA, 17 nt, Homo sapiens
ucugugcguguggcgug

SEQ ID NO: 543472 - RNA, 20 nt, Homo sapiens
ucugugcugaggccuuauca

SEQ ID NO: 543473 - RNA, 19 nt, Homo sapiens
ucugugcuucgacuacugc

SEQ ID NO: 543474 - RNA, 16 nt, Homo sapiens
ucugugcuuugacuca

SEQ ID NO: 543475 - RNA, 21 nt, Homo sapiens
ucuguggaucagagaugcacc

SEQ ID NO: 543476 - RNA, 14 nt, Homo sapiens
ucugugggcacugg

SEQ ID NO: 543477 - RNA, 19 nt, Homo sapiens
ucugugggcuccauguaga

SEQ ID NO: 543478 - RNA, 15 nt, Homo sapiens
ucuguguauauuaca

SEQ ID NO: 543479 - RNA, 18 nt, Homo sapiens
ucugugucucugcaucca

SEQ ID NO: 543480 - RNA, 18 nt, Homo sapiens
ucugugugugauuugcua

SEQ ID NO: 543481 - RNA, 16 nt, Homo sapiens
ucuguguugaagcacu

SEQ ID NO: 543482 - RNA, 21 nt, Homo sapiens
ucuguguugacccuuugucca

SEQ ID NO: 543483 - RNA, 13 nt, Homo sapiens
ucuguuaauguca

SEQ ID NO: 543484 - RNA, 18 nt, Homo sapiens
ucuguuaugcugugacac

SEQ ID NO: 543485 - RNA, 16 nt, Homo sapiens
ucuguuauuaacaaac

SEQ ID NO: 543486 - RNA, 16 nt, Homo sapiens
ucuguucagaugugca

SEQ ID NO: 543487 - RNA, 22 nt, Homo sapiens
ucuguucauuucacacagugaa

SEQ ID NO: 543488 - RNA, 17 nt, Homo sapiens
ucuguuccccauggcca

SEQ ID NO: 543489 - RNA, 22 nt, Homo sapiens
ucuguuggaugacuuugagauu

SEQ ID NO: 543490 - RNA, 21 nt, Homo sapiens
ucuguuggcagagcuuuugca

SEQ ID NO: 543491 - RNA, 21 nt, Homo sapiens
ucuguugucguaaagauuugg

SEQ ID NO: 543492 - RNA, 13 nt, Homo sapiens
ucuguuuagugaa

SEQ ID NO: 543493 - RNA, 17 nt, Homo sapiens
ucuguuucaaagcacaa

SEQ ID NO: 543494 - RNA, 17 nt, Homo sapiens
ucuguuuccuuguucca

SEQ ID NO: 543495 - RNA, 20 nt, Homo sapiens
ucuguuucuucaaugguucu

SEQ ID NO: 543496 - RNA, 23 nt, Homo sapiens
ucuguuugaaauucuagagccag

SEQ ID NO: 543497 - RNA, 19 nt, Homo sapiens
ucuguuugcguacuuguaa

SEQ ID NO: 543498 - RNA, 17 nt, Homo sapiens
ucuguuuugaaggcaaa

SEQ ID NO: 543499 - RNA, 23 nt, Homo sapiens
gggacccccucgccagcuuggcu

SEQ ID NO: 543500 - RNA, 16 nt, Homo sapiens
gggaccucccaggaca

SEQ ID NO: 543501 - RNA, 23 nt, Homo sapiens
gggaccugccacugcacaccagc

SEQ ID NO: 543502 - RNA, 12 nt, Homo sapiens
gggacuaggacc

SEQ ID NO: 543503 - RNA, 16 nt, Homo sapiens
gggacucagggccaug

SEQ ID NO: 543504 - RNA, 19 nt, Homo sapiens
gggacucuggcacagugau

SEQ ID NO: 543505 - RNA, 19 nt, Homo sapiens
gggagaaaaaaagggaucu

SEQ ID NO: 543506 - RNA, 21 nt, Homo sapiens
gggagaaaaagaaacacaaga

SEQ ID NO: 543507 - RNA, 15 nt, Homo sapiens
gggagaaagaccaug

SEQ ID NO: 543508 - RNA, 13 nt, Homo sapiens
gggagaacucauu

SEQ ID NO: 543509 - RNA, 17 nt, Homo sapiens
gggagaaggcagugauu

SEQ ID NO: 543510 - RNA, 14 nt, Homo sapiens
gggagaaggcauga

SEQ ID NO: 543511 - RNA, 23 nt, Homo sapiens
gggagacugacacgaagccagca

SEQ ID NO: 543512 - RNA, 20 nt, Homo sapiens
gggagacuuggggccagcgc

SEQ ID NO: 543513 - RNA, 17 nt, Homo sapiens
gggagaggugauucuca

SEQ ID NO: 543514 - RNA, 19 nt, Homo sapiens
gggagauggcagcagugaa

SEQ ID NO: 543515 - RNA, 19 nt, Homo sapiens
gggagcaaaucgugccuug

SEQ ID NO: 543516 - RNA, 20 nt, Homo sapiens
gggagcacuguucacaucau

SEQ ID NO: 543517 - RNA, 16 nt, Homo sapiens
gggagcaggcgguggg

SEQ ID NO: 543518 - RNA, 18 nt, Homo sapiens
gggagcgccggauuugcu

SEQ ID NO: 543519 - RNA, 23 nt, Homo sapiens
gggaggaaguuggcugagccauu

SEQ ID NO: 543520 - RNA, 14 nt, Homo sapiens
gggaggcaagaaaa

SEQ ID NO: 543521 - RNA, 13 nt, Homo sapiens
gggaggcagggga

SEQ ID NO: 543522 - RNA, 12 nt, Homo sapiens
gggaggcccaaa

SEQ ID NO: 543523 - RNA, 20 nt, Homo sapiens
gggaggcggagcuugcagug

SEQ ID NO: 543524 - RNA, 14 nt, Homo sapiens
gggaggcgucuuca

SEQ ID NO: 543525 - RNA, 13 nt, Homo sapiens
gggaggcuucccc

SEQ ID NO: 543526 - RNA, 20 nt, Homo sapiens
gggagguggagcuugcagug

SEQ ID NO: 543527 - RNA, 14 nt, Homo sapiens
gggagucuuugcac

SEQ ID NO: 543528 - RNA, 18 nt, Homo sapiens
gggagugcucaccgccuc

SEQ ID NO: 543529 - RNA, 21 nt, Homo sapiens
gggauaaccccaggcacuguu

SEQ ID NO: 543530 - RNA, 16 nt, Homo sapiens
gggauacccagugaug

SEQ ID NO: 543531 - RNA, 23 nt, Homo sapiens
gggauacuuuuaugcaaccauaa

SEQ ID NO: 543532 - RNA, 13 nt, Homo sapiens
gggauagaggaua

SEQ ID NO: 543533 - RNA, 16 nt, Homo sapiens
gggauaucuacugugg

SEQ ID NO: 543534 - RNA, 21 nt, Homo sapiens
gggaucacacccacgggugcu

SEQ ID NO: 543535 - RNA, 13 nt, Homo sapiens
gggaucagaucaa

SEQ ID NO: 543536 - RNA, 16 nt, Homo sapiens
gggaugauuugccgac

SEQ ID NO: 543537 - RNA, 15 nt, Homo sapiens
gggauggagaagcac

SEQ ID NO: 543538 - RNA, 23 nt, Homo sapiens
gggauggggcggcgguagcagcu

SEQ ID NO: 543539 - RNA, 10 nt, Homo sapiens
gggauguuuu

SEQ ID NO: 543540 - RNA, 15 nt, Homo sapiens
gggauguuuugacau

SEQ ID NO: 543541 - RNA, 13 nt, Homo sapiens
gggauuacaggcg

SEQ ID NO: 543542 - RNA, 15 nt, Homo sapiens
gggauucaggcugcu

SEQ ID NO: 543543 - RNA, 15 nt, Homo sapiens
gggauugaaaaucau

SEQ ID NO: 543544 - RNA, 22 nt, Homo sapiens
gggauugucuuacuguugcaua

SEQ ID NO: 543545 - RNA, 23 nt, Homo sapiens
gggauuucuucgcugcucuagcu

SEQ ID NO: 543546 - RNA, 12 nt, Homo sapiens
gggcaacagagc

SEQ ID NO: 543547 - RNA, 23 nt, Homo sapiens
gggcaacauagugagauucuguu

SEQ ID NO: 543548 - RNA, 19 nt, Homo sapiens
gggcaacgagugaaacucc

SEQ ID NO: 543549 - RNA, 19 nt, Homo sapiens
gggcaagagggaaggugac

SEQ ID NO: 543550 - RNA, 22 nt, Homo sapiens
gggcaccacccgcuuucuugcu

SEQ ID NO: 543551 - RNA, 11 nt, Homo sapiens
gggcacggugg

SEQ ID NO: 543552 - RNA, 17 nt, Homo sapiens
gggcacuacauaauugc

SEQ ID NO: 543553 - RNA, 22 nt, Homo sapiens
gggcagagccuuccacagugaa

SEQ ID NO: 543554 - RNA, 20 nt, Homo sapiens
gggcagcaaaacgacacugc

SEQ ID NO: 543555 - RNA, 20 nt, Homo sapiens
gggcagccccacagucccau

SEQ ID NO: 543556 - RNA, 12 nt, Homo sapiens
gggcagccuuuc

SEQ ID NO: 543557 - RNA, 20 nt, Homo sapiens
gggcaggagggcccuaccug

SEQ ID NO: 543558 - RNA, 16 nt, Homo sapiens
gggcaggcaggggcca

SEQ ID NO: 543559 - RNA, 21 nt, Homo sapiens
gggcaggcugggccaugucca

SEQ ID NO: 543560 - RNA, 14 nt, Homo sapiens
gggcagucauuauc

SEQ ID NO: 543561 - RNA, 21 nt, Homo sapiens
gggcagugucacugaguccuu

SEQ ID NO: 543562 - RNA, 21 nt, Homo sapiens
gggcauccuggaugauuucau

SEQ ID NO: 543563 - RNA, 19 nt, Homo sapiens
gggcauccugugccacuaa

SEQ ID NO: 543564 - RNA, 22 nt, Homo sapiens
gggcaucucccucugauuuccu

SEQ ID NO: 543565 - RNA, 14 nt, Homo sapiens
gggcaugcuuuauu

SEQ ID NO: 543566 - RNA, 16 nt, Homo sapiens
gggcauggguccaggg

SEQ ID NO: 543567 - RNA, 15 nt, Homo sapiens
gggccacacuaccca

SEQ ID NO: 543568 - RNA, 19 nt, Homo sapiens
gggccagaggaacugucca

SEQ ID NO: 543569 - RNA, 12 nt, Homo sapiens
gggccagcacuu

SEQ ID NO: 543570 - RNA, 21 nt, Homo sapiens
gggccagccccagcaccucau

SEQ ID NO: 543571 - RNA, 24 nt, Homo sapiens
gggccaggagcccacagugccugu

SEQ ID NO: 543572 - RNA, 17 nt, Homo sapiens
gggccagggcaaugcca

SEQ ID NO: 543573 - RNA, 18 nt, Homo sapiens
gggccagggucuguguga

SEQ ID NO: 543574 - RNA, 13 nt, Homo sapiens
gggccaguccucc

SEQ ID NO: 543575 - RNA, 13 nt, Homo sapiens
gggccagugcagu

SEQ ID NO: 543576 - RNA, 21 nt, Homo sapiens
gggccaugguggagggcacuu

SEQ ID NO: 543577 - RNA, 14 nt, Homo sapiens
gggcccacguguau

SEQ ID NO: 543578 - RNA, 19 nt, Homo sapiens
gggcccagcggucccugca

SEQ ID NO: 543579 - RNA, 14 nt, Homo sapiens
gggccccauccuca

SEQ ID NO: 543580 - RNA, 22 nt, Homo sapiens
gggccccgccagggcuggggac

SEQ ID NO: 543581 - RNA, 16 nt, Homo sapiens
gggcccgcaccgacca

SEQ ID NO: 543582 - RNA, 22 nt, Homo sapiens
gggcccugccccaccccaucca

SEQ ID NO: 543583 - RNA, 16 nt, Homo sapiens
gggcccuuccuuccau

SEQ ID NO: 543584 - RNA, 18 nt, Homo sapiens
gggccgcucugauuucag

SEQ ID NO: 543585 - RNA, 12 nt, Homo sapiens
gggccgugacag

SEQ ID NO: 543586 - RNA, 17 nt, Homo sapiens
gggccgugagggguccc

SEQ ID NO: 543587 - RNA, 14 nt, Homo sapiens
gggccucagacgag

SEQ ID NO: 543588 - RNA, 19 nt, Homo sapiens
gggccuccuucccaugccu

SEQ ID NO: 543589 - RNA, 12 nt, Homo sapiens
gggccucuccag

SEQ ID NO: 543590 - RNA, 16 nt, Homo sapiens
gggccugaccaaacag

SEQ ID NO: 543591 - RNA, 22 nt, Homo sapiens
gggccugcugcgucagaccagu

SEQ ID NO: 543592 - RNA, 13 nt, Homo sapiens
gggccugggacac

SEQ ID NO: 543593 - RNA, 21 nt, Homo sapiens
gggccuggggauguaaccaag

SEQ ID NO: 543594 - RNA, 19 nt, Homo sapiens
gggccuuucccucuucccu

SEQ ID NO: 543595 - RNA, 17 nt, Homo sapiens
gggcgcaagucaaagag

SEQ ID NO: 543596 - RNA, 21 nt, Homo sapiens
gggcggcaggaccagccagca

SEQ ID NO: 543597 - RNA, 17 nt, Homo sapiens
gggcggcccacacccag

SEQ ID NO: 543598 - RNA, 16 nt, Homo sapiens
gggcgggccagggugg

SEQ ID NO: 543599 - RNA, 13 nt, Homo sapiens
gggcuacugccac

SEQ ID NO: 543600 - RNA, 22 nt, Homo sapiens
gggcuagggagaaugcagagag

SEQ ID NO: 543601 - RNA, 17 nt, Homo sapiens
gggcuaguagaacugga

SEQ ID NO: 543602 - RNA, 14 nt, Homo sapiens
ucuuccugcccuug

SEQ ID NO: 543603 - RNA, 16 nt, Homo sapiens
ucuuccugcuuuccau

SEQ ID NO: 543604 - RNA, 20 nt, Homo sapiens
ucuuccuuacccugcgauuu

SEQ ID NO: 543605 - RNA, 19 nt, Homo sapiens
ucuuccuuuuauauaaaua

SEQ ID NO: 543606 - RNA, 14 nt, Homo sapiens
ucuuccuuuuauca

SEQ ID NO: 543607 - RNA, 13 nt, Homo sapiens
ucuucgauguacu

SEQ ID NO: 543608 - RNA, 14 nt, Homo sapiens
ucuucgauguacuu

SEQ ID NO: 543609 - RNA, 21 nt, Homo sapiens
ucuucgcccugcguuccuucc

SEQ ID NO: 543610 - RNA, 16 nt, Homo sapiens
ucuucuacuaccccca

SEQ ID NO: 543611 - RNA, 14 nt, Homo sapiens
ucuucuacuuuaag

SEQ ID NO: 543612 - RNA, 13 nt, Homo sapiens
ucuucuagugcuu

SEQ ID NO: 543613 - RNA, 14 nt, Homo sapiens
ucuucucaagaucc

SEQ ID NO: 543614 - RNA, 15 nt, Homo sapiens
ucuucucguuuucac

SEQ ID NO: 543615 - RNA, 14 nt, Homo sapiens
ucuucucuacucua

SEQ ID NO: 543616 - RNA, 15 nt, Homo sapiens
ucuucucugcacuua

SEQ ID NO: 543617 - RNA, 22 nt, Homo sapiens
ucuucugaauauuuuaucuuuc

SEQ ID NO: 543618 - RNA, 18 nt, Homo sapiens
ucuucugauuugucccua

SEQ ID NO: 543619 - RNA, 20 nt, Homo sapiens
ucuucugcaaaaauggauau

SEQ ID NO: 543620 - RNA, 20 nt, Homo sapiens
ucuucugggaacuuccucag

SEQ ID NO: 543621 - RNA, 24 nt, Homo sapiens
ucuucuguaauauuuacaauguau

SEQ ID NO: 543622 - RNA, 18 nt, Homo sapiens
gggcuucacugcugugac

SEQ ID NO: 543623 - RNA, 15 nt, Homo sapiens
gggcuugaagccaaa

SEQ ID NO: 543624 - RNA, 17 nt, Homo sapiens
gggcuuggcuuuucaca

SEQ ID NO: 543625 - RNA, 18 nt, Homo sapiens
ggggacaauaugugccaa

SEQ ID NO: 543626 - RNA, 13 nt, Homo sapiens
ggggacacuuccc

SEQ ID NO: 543627 - RNA, 21 nt, Homo sapiens
ggggacccaucuuccaccuca

SEQ ID NO: 543628 - RNA, 22 nt, Homo sapiens
ggggaccuuaagugauuugccu

SEQ ID NO: 543629 - RNA, 16 nt, Homo sapiens
ggggacugccuggaga

SEQ ID NO: 543630 - RNA, 16 nt, Homo sapiens
ggggagagacaggcag

SEQ ID NO: 543631 - RNA, 23 nt, Homo sapiens
ggggagcugggguacagguuugg

SEQ ID NO: 543632 - RNA, 22 nt, Homo sapiens
ggggaggccaagugcaggcugg

SEQ ID NO: 543633 - RNA, 14 nt, Homo sapiens
ggggaggggacaga

SEQ ID NO: 543634 - RNA, 15 nt, Homo sapiens
ggggaucgaugugcu

SEQ ID NO: 543635 - RNA, 16 nt, Homo sapiens
ggggauuuuuaugucu

SEQ ID NO: 543636 - RNA, 14 nt, Homo sapiens
ggggcagcacuccc

SEQ ID NO: 543637 - RNA, 17 nt, Homo sapiens
ggggcagcccugagugg

SEQ ID NO: 543638 - RNA, 19 nt, Homo sapiens
ggggccaggggaucccucu

SEQ ID NO: 543639 - RNA, 23 nt, Homo sapiens
ggggccaggucacccuuugcugu

SEQ ID NO: 543640 - RNA, 23 nt, Homo sapiens
ggggcccuccaugcgcagaugag

SEQ ID NO: 543641 - RNA, 21 nt, Homo sapiens
ggggcccuuggccccagagga

SEQ ID NO: 543642 - RNA, 21 nt, Homo sapiens
ggggccuggacacccaucuca

SEQ ID NO: 543643 - RNA, 19 nt, Homo sapiens
ggggcucacaccuguaauc

SEQ ID NO: 543644 - RNA, 16 nt, Homo sapiens
ggggcugcuccagugg

SEQ ID NO: 543645 - RNA, 14 nt, Homo sapiens
ggggcugcugugau

SEQ ID NO: 543646 - RNA, 16 nt, Homo sapiens
ggggcuggaaucucau

SEQ ID NO: 543647 - RNA, 19 nt, Homo sapiens
ggggcugucccgugcaugg

SEQ ID NO: 543648 - RNA, 22 nt, Homo sapiens
ggggcuguccugguugcagcca

SEQ ID NO: 543649 - RNA, 12 nt, Homo sapiens
ggggcuuguccu

SEQ ID NO: 543650 - RNA, 19 nt, Homo sapiens
gggggaaaaaaaaaaaaga

SEQ ID NO: 543651 - RNA, 24 nt, Homo sapiens
gggggaaaaguuagucaauccugu

SEQ ID NO: 543652 - RNA, 23 nt, Homo sapiens
gggggaagacuuuaaaccaccua

SEQ ID NO: 543653 - RNA, 14 nt, Homo sapiens
gggggaaggcgcug

SEQ ID NO: 543654 - RNA, 13 nt, Homo sapiens
gggggacguuucu

SEQ ID NO: 543655 - RNA, 18 nt, Homo sapiens
gggggagaagaagccgag

SEQ ID NO: 543656 - RNA, 23 nt, Homo sapiens
gggggagugggcgcaguggcuca

SEQ ID NO: 543657 - RNA, 15 nt, Homo sapiens
gggggccgugcccag

SEQ ID NO: 543658 - RNA, 18 nt, Homo sapiens
gggggcuagaaaucuguu

SEQ ID NO: 543659 - RNA, 10 nt, Homo sapiens
ggggggcccg

SEQ ID NO: 543660 - RNA, 11 nt, Homo sapiens
ggggggcuccc

SEQ ID NO: 543661 - RNA, 14 nt, Homo sapiens
gggggucaccaggu

SEQ ID NO: 543662 - RNA, 16 nt, Homo sapiens
ggggucaaaauuugcu

SEQ ID NO: 543663 - RNA, 13 nt, Homo sapiens
ggggucagggugc

SEQ ID NO: 543664 - RNA, 13 nt, Homo sapiens
ggggucugcagca

SEQ ID NO: 543665 - RNA, 20 nt, Homo sapiens
ggggucuguauauacauuuc

SEQ ID NO: 543666 - RNA, 23 nt, Homo sapiens
ggggugauaaggggccuugcucu

SEQ ID NO: 543667 - RNA, 23 nt, Homo sapiens
ggggugcagaugguacugcugag

SEQ ID NO: 543668 - RNA, 15 nt, Homo sapiens
gggguggggagcaug

SEQ ID NO: 543669 - RNA, 21 nt, Homo sapiens
ggggugugccugucuguuaca

SEQ ID NO: 543670 - RNA, 14 nt, Homo sapiens
gggguuagaccacu

SEQ ID NO: 543671 - RNA, 18 nt, Homo sapiens
gggguuuuguaaugacag

SEQ ID NO: 543672 - RNA, 16 nt, Homo sapiens
ggguacaaaaagucaa

SEQ ID NO: 543673 - RNA, 15 nt, Homo sapiens
ggguaccuggcuaug

SEQ ID NO: 543674 - RNA, 22 nt, Homo sapiens
ggguaccuuaagagacacucca

SEQ ID NO: 543675 - RNA, 20 nt, Homo sapiens
ggguagaaugauuaaucaaa

SEQ ID NO: 543676 - RNA, 22 nt, Homo sapiens
ggguaggcgggaaggaggguua

SEQ ID NO: 543677 - RNA, 16 nt, Homo sapiens
ggguaugucaguguca

SEQ ID NO: 543678 - RNA, 19 nt, Homo sapiens
ggguauuuaccacagcagc

SEQ ID NO: 543679 - RNA, 15 nt, Homo sapiens
gggucaaaccaagaa

SEQ ID NO: 543680 - RNA, 22 nt, Homo sapiens
gggucaaccuuuguguggcucc

SEQ ID NO: 543681 - RNA, 15 nt, Homo sapiens
gggucaggugccacu

SEQ ID NO: 543682 - RNA, 12 nt, Homo sapiens
ggguccaccagg

SEQ ID NO: 543683 - RNA, 22 nt, Homo sapiens
ggguccacugugagaggugaca

SEQ ID NO: 543684 - RNA, 22 nt, Homo sapiens
ggguccaggccuggccaugugg

SEQ ID NO: 543685 - RNA, 17 nt, Homo sapiens
ggguccccuugaaagaa

SEQ ID NO: 543686 - RNA, 20 nt, Homo sapiens
gggucucacucuguugccca

SEQ ID NO: 543687 - RNA, 16 nt, Homo sapiens
gggucugcccugccca

SEQ ID NO: 543688 - RNA, 18 nt, Homo sapiens
gggucugggccagugcac

SEQ ID NO: 543689 - RNA, 18 nt, Homo sapiens
gggucugugugaaugugg

SEQ ID NO: 543690 - RNA, 18 nt, Homo sapiens
gggucuucuaccucagac

SEQ ID NO: 543691 - RNA, 23 nt, Homo sapiens
gggucuugcggcugaagugucac

SEQ ID NO: 543692 - RNA, 20 nt, Homo sapiens
gggucuuuaauaaaacaaca

SEQ ID NO: 543693 - RNA, 20 nt, Homo sapiens
gggucuuugugagagugagc

SEQ ID NO: 543694 - RNA, 16 nt, Homo sapiens
gggugacggcccucau

SEQ ID NO: 543695 - RNA, 17 nt, Homo sapiens
gggugcaaagacucuga

SEQ ID NO: 543696 - RNA, 20 nt, Homo sapiens
gggugcagcccucuugcccg

SEQ ID NO: 543697 - RNA, 14 nt, Homo sapiens
gggugcagcuguca

SEQ ID NO: 543698 - RNA, 18 nt, Homo sapiens
gggugccgcgagccaggc

SEQ ID NO: 543699 - RNA, 17 nt, Homo sapiens
gggugcuuccuccucag

SEQ ID NO: 543700 - RNA, 21 nt, Homo sapiens
ggguggaaagugcucagugaa

SEQ ID NO: 543701 - RNA, 21 nt, Homo sapiens
ggguggaggggagugugugca

SEQ ID NO: 543702 - RNA, 15 nt, Homo sapiens
ggguggaucaccuga

SEQ ID NO: 543703 - RNA, 20 nt, Homo sapiens
ggguggcacucaacucugag

SEQ ID NO: 543704 - RNA, 16 nt, Homo sapiens
gggugggccacucucc

SEQ ID NO: 543705 - RNA, 14 nt, Homo sapiens
ggguggggagcaaa

SEQ ID NO: 543706 - RNA, 19 nt, Homo sapiens
ggguggucugagcaccccc

SEQ ID NO: 543707 - RNA, 22 nt, Homo sapiens
gggugugggaagaccaaaggaa

SEQ ID NO: 543708 - RNA, 20 nt, Homo sapiens
gggugugggucaaaccaaga

SEQ ID NO: 543709 - RNA, 14 nt, Homo sapiens
gggugugucugcuc

SEQ ID NO: 543710 - RNA, 17 nt, Homo sapiens
ggguguguguagccaag

SEQ ID NO: 543711 - RNA, 14 nt, Homo sapiens
ggguuacuauuucu

SEQ ID NO: 543712 - RNA, 19 nt, Homo sapiens
ggguuagagccaagcugca

SEQ ID NO: 543713 - RNA, 21 nt, Homo sapiens
ggguuaguuuacaaucagcca

SEQ ID NO: 543714 - RNA, 18 nt, Homo sapiens
ggguuauguaucagaaga

SEQ ID NO: 543715 - RNA, 14 nt, Homo sapiens
ggguuauucagaac

SEQ ID NO: 543716 - RNA, 21 nt, Homo sapiens
ggguuccuccucuccuacucg

SEQ ID NO: 543717 - RNA, 22 nt, Homo sapiens
ggguucuuauuuugcauuccag

SEQ ID NO: 543718 - RNA, 17 nt, Homo sapiens
ggguugagcuguugccu

SEQ ID NO: 543719 - RNA, 19 nt, Homo sapiens
ggguuggacuguaagggau

SEQ ID NO: 543720 - RNA, 20 nt, Homo sapiens
ggguuucaccaucuuggcca

SEQ ID NO: 543721 - RNA, 17 nt, Homo sapiens
ggguuucauauccagcu

SEQ ID NO: 543722 - RNA, 14 nt, Homo sapiens
ggguuuugcuacau

SEQ ID NO: 543723 - RNA, 14 nt, Homo sapiens
ucuuugaggugauu

SEQ ID NO: 543724 - RNA, 18 nt, Homo sapiens
ucuuugauuauuugcaug

SEQ ID NO: 543725 - RNA, 23 nt, Homo sapiens
ucuuugauuauuugcauguuaug

SEQ ID NO: 543726 - RNA, 18 nt, Homo sapiens
ucuuugauuuguaccauu

SEQ ID NO: 543727 - RNA, 22 nt, Homo sapiens
ucuuugcaggaggcccaaccuc

SEQ ID NO: 543728 - RNA, 21 nt, Homo sapiens
ucuuugccggaggaaaagcag

SEQ ID NO: 543729 - RNA, 22 nt, Homo sapiens
ucuuugcucccuccaaucuuga

SEQ ID NO: 543730 - RNA, 20 nt, Homo sapiens
ucuuugcucccugcaagaaa

SEQ ID NO: 543731 - RNA, 15 nt, Homo sapiens
ucuuugcugcaguca

SEQ ID NO: 543732 - RNA, 15 nt, Homo sapiens
ucuuuggcgaccucc

SEQ ID NO: 543733 - RNA, 17 nt, Homo sapiens
ucuuuggggaauggaag

SEQ ID NO: 543734 - RNA, 14 nt, Homo sapiens
ucuuuguacauuuu

SEQ ID NO: 543735 - RNA, 21 nt, Homo sapiens
ucuuugucaccacguggggcu

SEQ ID NO: 543736 - RNA, 16 nt, Homo sapiens
ucuuuuaaaaucauga

SEQ ID NO: 543737 - RNA, 14 nt, Homo sapiens
ucuuuuaacagccu

SEQ ID NO: 543738 - RNA, 13 nt, Homo sapiens
ucuuuucaucaaa

SEQ ID NO: 543739 - RNA, 15 nt, Homo sapiens
ucuuuucaucuggga

SEQ ID NO: 543740 - RNA, 23 nt, Homo sapiens
ucuuuucugcaucaucuguagau

SEQ ID NO: 543741 - RNA, 16 nt, Homo sapiens
ucuuuugacaccuuag

SEQ ID NO: 543742 - RNA, 11 nt, Homo sapiens
ucuuuugcucu

SEQ ID NO: 543743 - RNA, 17 nt, Homo sapiens
ucuuuugguuucugcuu

SEQ ID NO: 543744 - RNA, 15 nt, Homo sapiens
gguacuacaaccaau

SEQ ID NO: 543745 - RNA, 21 nt, Homo sapiens
gguacuauuuagauauaacac

SEQ ID NO: 543746 - RNA, 21 nt, Homo sapiens
gguacuuuuaugauguauauu

SEQ ID NO: 543747 - RNA, 16 nt, Homo sapiens
gguagaaaaauuauua

SEQ ID NO: 543748 - RNA, 17 nt, Homo sapiens
gguagaaagauggggca

SEQ ID NO: 543749 - RNA, 22 nt, Homo sapiens
gguagaaggggaggacacuggu

SEQ ID NO: 543750 - RNA, 12 nt, Homo sapiens
gguagagucauu

SEQ ID NO: 543751 - RNA, 21 nt, Homo sapiens
gguagcauucuucuuuuggca

SEQ ID NO: 543752 - RNA, 14 nt, Homo sapiens
gguagcgagcugcu

SEQ ID NO: 543753 - RNA, 20 nt, Homo sapiens
gguagggugggagugguuua

SEQ ID NO: 543754 - RNA, 15 nt, Homo sapiens
gguagguugggacac

SEQ ID NO: 543755 - RNA, 19 nt, Homo sapiens
gguaguacuccugcaaaau

SEQ ID NO: 543756 - RNA, 14 nt, Homo sapiens
gguaguacugggaa

SEQ ID NO: 543757 - RNA, 19 nt, Homo sapiens
gguagugaccuaaccacuu

SEQ ID NO: 543758 - RNA, 13 nt, Homo sapiens
gguauaauguuua

SEQ ID NO: 543759 - RNA, 16 nt, Homo sapiens
gguaucaucuucucau

SEQ ID NO: 543760 - RNA, 16 nt, Homo sapiens
gguauccugcccagug

SEQ ID NO: 543761 - RNA, 12 nt, Homo sapiens
gguaugagcuga

SEQ ID NO: 543762 - RNA, 16 nt, Homo sapiens
gguauggcagaggugc

SEQ ID NO: 543763 - RNA, 15 nt, Homo sapiens
gguauggccaugccc

SEQ ID NO: 543764 - RNA, 21 nt, Homo sapiens
gguauuaaauugauguugcug

SEQ ID NO: 543765 - RNA, 16 nt, Homo sapiens
gguauuacacuguauu

SEQ ID NO: 543766 - RNA, 17 nt, Homo sapiens
gguauuuaccacagcag

SEQ ID NO: 543767 - RNA, 18 nt, Homo sapiens
gguauuuuaagugauguc

SEQ ID NO: 543768 - RNA, 19 nt, Homo sapiens
ggucaaacaaacucucuga

SEQ ID NO: 543769 - RNA, 16 nt, Homo sapiens
ggucaaaucaacugaa

SEQ ID NO: 543770 - RNA, 19 nt, Homo sapiens
ggucaaccuuuguguggcu

SEQ ID NO: 543771 - RNA, 16 nt, Homo sapiens
ggucaaguaagaagac

SEQ ID NO: 543772 - RNA, 17 nt, Homo sapiens
ggucacauugugccuuu

SEQ ID NO: 543773 - RNA, 14 nt, Homo sapiens
ggucaccagcugcu

SEQ ID NO: 543774 - RNA, 17 nt, Homo sapiens
ggucaccccuccaggaa

SEQ ID NO: 543775 - RNA, 22 nt, Homo sapiens
ggucacuguccuugaacccaac

SEQ ID NO: 543776 - RNA, 23 nt, Homo sapiens
ggucacuuaaagggucuuaugaa

SEQ ID NO: 543777 - RNA, 20 nt, Homo sapiens
ggucagaaagauaagccagu

SEQ ID NO: 543778 - RNA, 23 nt, Homo sapiens
ggucagagagaccucauccugcu

SEQ ID NO: 543779 - RNA, 16 nt, Homo sapiens
ggucagccuccucucc

SEQ ID NO: 543780 - RNA, 22 nt, Homo sapiens
ggucaggaggaaaagacuaaca

SEQ ID NO: 543781 - RNA, 23 nt, Homo sapiens
ggucaggggcucccuacauuccc

SEQ ID NO: 543782 - RNA, 24 nt, Homo sapiens
ggucagggggagucuuugcaccaa

SEQ ID NO: 543783 - RNA, 12 nt, Homo sapiens
ggucaguccaug

SEQ ID NO: 543784 - RNA, 16 nt, Homo sapiens
ggucagucuaacaguu

SEQ ID NO: 543785 - RNA, 13 nt, Homo sapiens
ggucauacaugca

SEQ ID NO: 543786 - RNA, 14 nt, Homo sapiens
ggucauacaugcau

SEQ ID NO: 543787 - RNA, 19 nt, Homo sapiens
ggucaucucggcuguuccu

SEQ ID NO: 543788 - RNA, 21 nt, Homo sapiens
ggucaucucucacacauucca

SEQ ID NO: 543789 - RNA, 21 nt, Homo sapiens
ggucauuggccacugucucca

SEQ ID NO: 543790 - RNA, 18 nt, Homo sapiens
ggucauuuccuaugcaaa

SEQ ID NO: 543791 - RNA, 16 nt, Homo sapiens
gguccaauccuaggac

SEQ ID NO: 543792 - RNA, 22 nt, Homo sapiens
gguccacaacacacagauuuga

SEQ ID NO: 543793 - RNA, 11 nt, Homo sapiens
gguccacagag

SEQ ID NO: 543794 - RNA, 15 nt, Homo sapiens
gguccaccaugcaga

SEQ ID NO: 543795 - RNA, 20 nt, Homo sapiens
gguccacucccugcuccacg

SEQ ID NO: 543796 - RNA, 15 nt, Homo sapiens
gguccacuguguuua

SEQ ID NO: 543797 - RNA, 22 nt, Homo sapiens
gguccagcuugcucuucagugg

SEQ ID NO: 543798 - RNA, 15 nt, Homo sapiens
gguccaggaaggcag

SEQ ID NO: 543799 - RNA, 15 nt, Homo sapiens
gguccaucucagaga

SEQ ID NO: 543800 - RNA, 16 nt, Homo sapiens
ggucccacgagggugc

SEQ ID NO: 543801 - RNA, 20 nt, Homo sapiens
ggucccauuucucacugaga

SEQ ID NO: 543802 - RNA, 21 nt, Homo sapiens
ggucccauuucucacugagaa

SEQ ID NO: 543803 - RNA, 22 nt, Homo sapiens
gguccccccacagcuccaggac

SEQ ID NO: 543804 - RNA, 23 nt, Homo sapiens
gguccccccaccgcucaguguca

SEQ ID NO: 543805 - RNA, 20 nt, Homo sapiens
ggucccucuucucuccucag

SEQ ID NO: 543806 - RNA, 19 nt, Homo sapiens
gguccucugucagucacag

SEQ ID NO: 543807 - RNA, 20 nt, Homo sapiens
gguccugaaaguaacucaua

SEQ ID NO: 543808 - RNA, 17 nt, Homo sapiens
gguccugcccuuccuga

SEQ ID NO: 543809 - RNA, 19 nt, Homo sapiens
gguccuucaaacaauguaa

SEQ ID NO: 543810 - RNA, 15 nt, Homo sapiens
gguccuuuucagagu

SEQ ID NO: 543811 - RNA, 15 nt, Homo sapiens
ggucggggaccaaag

SEQ ID NO: 543812 - RNA, 18 nt, Homo sapiens
ggucgucaaugaugaguc

SEQ ID NO: 543813 - RNA, 15 nt, Homo sapiens
ggucguccaagcaaa

SEQ ID NO: 543814 - RNA, 18 nt, Homo sapiens
ggucuaccucaucucuga

SEQ ID NO: 543815 - RNA, 20 nt, Homo sapiens
ggucucaaacuccugaccuc

SEQ ID NO: 543816 - RNA, 20 nt, Homo sapiens
ggucucacaguguugcccag

SEQ ID NO: 543817 - RNA, 22 nt, Homo sapiens
ggucucauagguugagcaauuu

SEQ ID NO: 543818 - RNA, 17 nt, Homo sapiens
ggucucgcagccugaag

SEQ ID NO: 543819 - RNA, 21 nt, Homo sapiens
ggucucuggcccuucuugccu

SEQ ID NO: 543820 - RNA, 21 nt, Homo sapiens
ggucugagucuauguucaaag

SEQ ID NO: 543821 - RNA, 13 nt, Homo sapiens
ggucugggccagu

SEQ ID NO: 543822 - RNA, 15 nt, Homo sapiens
ggucuguagggauuu

SEQ ID NO: 543823 - RNA, 13 nt, Homo sapiens
ggucugugcugac

SEQ ID NO: 543824 - RNA, 15 nt, Homo sapiens
ggucuguuggggucu

SEQ ID NO: 543825 - RNA, 21 nt, Homo sapiens
ggucuuaggaugucuguaaua

SEQ ID NO: 543826 - RNA, 12 nt, Homo sapiens
ggucuucaagac

SEQ ID NO: 543827 - RNA, 20 nt, Homo sapiens
ggucuucaagacgacagcuc

SEQ ID NO: 543828 - RNA, 17 nt, Homo sapiens
ggucuucagccucccuc

SEQ ID NO: 543829 - RNA, 22 nt, Homo sapiens
ggucuuccuuuggcaugggaug

SEQ ID NO: 543830 - RNA, 13 nt, Homo sapiens
ggucuugacucau

SEQ ID NO: 543831 - RNA, 15 nt, Homo sapiens
ggucuuucuccucag

SEQ ID NO: 543832 - RNA, 17 nt, Homo sapiens
ggugaaaauccaucuca

SEQ ID NO: 543833 - RNA, 17 nt, Homo sapiens
ggugaaaccccaucucu

SEQ ID NO: 543834 - RNA, 22 nt, Homo sapiens
ggugaaacuaacagauaagcaa

SEQ ID NO: 543835 - RNA, 16 nt, Homo sapiens
ggugaaagauggaacu

SEQ ID NO: 543836 - RNA, 14 nt, Homo sapiens
ggugacaccucccc

SEQ ID NO: 543837 - RNA, 19 nt, Homo sapiens
ggugacagggccgugagca

SEQ ID NO: 543838 - RNA, 16 nt, Homo sapiens
ggugacuucaggugga

SEQ ID NO: 543839 - RNA, 19 nt, Homo sapiens
ggugagagcacccacugaa

SEQ ID NO: 543840 - RNA, 17 nt, Homo sapiens
ggugagauggaaggaau

SEQ ID NO: 543841 - RNA, 19 nt, Homo sapiens
ggugagcagaaguggagcu

SEQ ID NO: 543842 - RNA, 15 nt, Homo sapiens
ggugaggucuguucc

SEQ ID NO: 543843 - RNA, 12 nt, Homo sapiens
ggugagugcaag

SEQ ID NO: 543844 - RNA, 12 nt, Homo sapiens
ggugagugugca

SEQ ID NO: 543845 - RNA, 15 nt, Homo sapiens
ugagcagagacauga

SEQ ID NO: 543846 - RNA, 13 nt, Homo sapiens
ugagcagccuuuc

SEQ ID NO: 543847 - RNA, 19 nt, Homo sapiens
ugagcagugccagcuuucu

SEQ ID NO: 543848 - RNA, 20 nt, Homo sapiens
ugagcaguuagcucauuuga

SEQ ID NO: 543849 - RNA, 17 nt, Homo sapiens
ugagcauuuuuaaggga

SEQ ID NO: 543850 - RNA, 20 nt, Homo sapiens
ugagccagcccuccuugacc

SEQ ID NO: 543851 - RNA, 12 nt, Homo sapiens
ugagccagguaa

SEQ ID NO: 543852 - RNA, 18 nt, Homo sapiens
ugagccagugagggcagu

SEQ ID NO: 543853 - RNA, 17 nt, Homo sapiens
ugagcccacaaagccuu

SEQ ID NO: 543854 - RNA, 15 nt, Homo sapiens
ugagccccagugcug

SEQ ID NO: 543855 - RNA, 16 nt, Homo sapiens
ugagccccuaccccac

SEQ ID NO: 543856 - RNA, 21 nt, Homo sapiens
ugagccccuggaggcacugaa

SEQ ID NO: 543857 - RNA, 18 nt, Homo sapiens
ugagcccggaugcuucuc

SEQ ID NO: 543858 - RNA, 23 nt, Homo sapiens
ugagcccucucacuccagccaaa

SEQ ID NO: 543859 - RNA, 19 nt, Homo sapiens
ugagccgagaucaugccau

SEQ ID NO: 543860 - RNA, 20 nt, Homo sapiens
ugagccgugaacugugcaua

SEQ ID NO: 543861 - RNA, 14 nt, Homo sapiens
ugagccuccaugcc

SEQ ID NO: 543862 - RNA, 15 nt, Homo sapiens
ugagccucuuuguaa

SEQ ID NO: 543863 - RNA, 13 nt, Homo sapiens
ugagccuuggccc

SEQ ID NO: 543864 - RNA, 14 nt, Homo sapiens
ugagcgaucauuua

SEQ ID NO: 543865 - RNA, 14 nt, Homo sapiens
ugagcgcauggcaa

SEQ ID NO: 543866 - RNA, 22 nt, Homo sapiens
ugagcgcccccgagcccugacu

SEQ ID NO: 543867 - RNA, 18 nt, Homo sapiens
ugagcgggaggcagaguu

SEQ ID NO: 543868 - RNA, 22 nt, Homo sapiens
ugagcgucacugcccaccaaag

SEQ ID NO: 543869 - RNA, 12 nt, Homo sapiens
ugagcgucagca

SEQ ID NO: 543870 - RNA, 22 nt, Homo sapiens
ugagcgucagcauccagguuua

SEQ ID NO: 543871 - RNA, 21 nt, Homo sapiens
ugagcuauugcuguucucuug

SEQ ID NO: 543872 - RNA, 22 nt, Homo sapiens
ugagcuauuuccauuccagaau

SEQ ID NO: 543873 - RNA, 13 nt, Homo sapiens
ugagcucugggaa

SEQ ID NO: 543874 - RNA, 21 nt, Homo sapiens
gucacaauaaauggccagugc

SEQ ID NO: 543875 - RNA, 12 nt, Homo sapiens
gucacacacuga

SEQ ID NO: 543876 - RNA, 13 nt, Homo sapiens
gucacacacugga

SEQ ID NO: 543877 - RNA, 18 nt, Homo sapiens
gucacacgauaaagggau

SEQ ID NO: 543878 - RNA, 14 nt, Homo sapiens
gucacagaugaaga

SEQ ID NO: 543879 - RNA, 13 nt, Homo sapiens
gucacagggccaa

SEQ ID NO: 543880 - RNA, 21 nt, Homo sapiens
gucacagggccaacuugaggg

SEQ ID NO: 543881 - RNA, 21 nt, Homo sapiens
gucacaguaaugcaagcaaag

SEQ ID NO: 543882 - RNA, 21 nt, Homo sapiens
gucaccagaauauuucuuuca

SEQ ID NO: 543883 - RNA, 18 nt, Homo sapiens
gucaccauacacacuguu

SEQ ID NO: 543884 - RNA, 20 nt, Homo sapiens
gucacccugugggugucucc

SEQ ID NO: 543885 - RNA, 16 nt, Homo sapiens
gucacccuucugggca

SEQ ID NO: 543886 - RNA, 18 nt, Homo sapiens
gucaccggucagugccuu

SEQ ID NO: 543887 - RNA, 16 nt, Homo sapiens
gucacgcaagcuaguu

SEQ ID NO: 543888 - RNA, 15 nt, Homo sapiens
gucacgcggcagcuu

SEQ ID NO: 543889 - RNA, 18 nt, Homo sapiens
gucacuagaaguccugcu

SEQ ID NO: 543890 - RNA, 11 nt, Homo sapiens
gucacuccugg

SEQ ID NO: 543891 - RNA, 12 nt, Homo sapiens
gucacugccaac

SEQ ID NO: 543892 - RNA, 23 nt, Homo sapiens
gucacuguuuuuuucccaggugu

SEQ ID NO: 543893 - RNA, 15 nt, Homo sapiens
gucacuucuccugcu

SEQ ID NO: 543894 - RNA, 13 nt, Homo sapiens
gucacuugggagc

SEQ ID NO: 543895 - RNA, 21 nt, Homo sapiens
gucagaaaaagcuagcacuaa

SEQ ID NO: 543896 - RNA, 14 nt, Homo sapiens
gucagaaguucaag

SEQ ID NO: 543897 - RNA, 21 nt, Homo sapiens
gucagaauccuuuacauucaa

SEQ ID NO: 543898 - RNA, 22 nt, Homo sapiens
gucagaaugugaaaaaggaaua

SEQ ID NO: 543899 - RNA, 23 nt, Homo sapiens
gucagaauuucuuugucauucaa

SEQ ID NO: 543900 - RNA, 18 nt, Homo sapiens
gucagaccaguacuggga

SEQ ID NO: 543901 - RNA, 22 nt, Homo sapiens
gucagacuuugcugcauuuuac

SEQ ID NO: 543902 - RNA, 14 nt, Homo sapiens
gucagagcacuccc

SEQ ID NO: 543903 - RNA, 13 nt, Homo sapiens
gucagaguagaag

SEQ ID NO: 543904 - RNA, 21 nt, Homo sapiens
gucagaguccagugcucugcc

SEQ ID NO: 543905 - RNA, 20 nt, Homo sapiens
gucagauuugaacucuucaa

SEQ ID NO: 543906 - RNA, 18 nt, Homo sapiens
gucagcagagcuucagag

SEQ ID NO: 543907 - RNA, 12 nt, Homo sapiens
gucagcauguac

SEQ ID NO: 543908 - RNA, 22 nt, Homo sapiens
gucagccaccugggaacacagu

SEQ ID NO: 543909 - RNA, 13 nt, Homo sapiens
gucagcuguuacu

SEQ ID NO: 543910 - RNA, 12 nt, Homo sapiens
gucagcuugcuc

SEQ ID NO: 543911 - RNA, 19 nt, Homo sapiens
gucaggaaaacuguuccaa

SEQ ID NO: 543912 - RNA, 14 nt, Homo sapiens
gucaggaacagaag

SEQ ID NO: 543913 - RNA, 22 nt, Homo sapiens
gucaggaccaucagagaggcaa

SEQ ID NO: 543914 - RNA, 15 nt, Homo sapiens
gucaggcaauugauu

SEQ ID NO: 543915 - RNA, 21 nt, Homo sapiens
gucagggagaggucaccagcu

SEQ ID NO: 543916 - RNA, 15 nt, Homo sapiens
gucaggggagaagcu

SEQ ID NO: 543917 - RNA, 22 nt, Homo sapiens
gucaggggcggggagggugaca

SEQ ID NO: 543918 - RNA, 12 nt, Homo sapiens
gucagggugcug

SEQ ID NO: 543919 - RNA, 14 nt, Homo sapiens
gucagguucuugcc

SEQ ID NO: 543920 - RNA, 14 nt, Homo sapiens
gucagucagggaca

SEQ ID NO: 543921 - RNA, 16 nt, Homo sapiens
gucagucaugauggca

SEQ ID NO: 543922 - RNA, 20 nt, Homo sapiens
gucaguccaggaugcuaaca

SEQ ID NO: 543923 - RNA, 19 nt, Homo sapiens
gucagugccaugacugaga

SEQ ID NO: 543924 - RNA, 21 nt, Homo sapiens
gucagugcugccuguccccau

SEQ ID NO: 543925 - RNA, 20 nt, Homo sapiens
gucagugcuucgugccucga

SEQ ID NO: 543926 - RNA, 18 nt, Homo sapiens
gucagugguggucuucaa

SEQ ID NO: 543927 - RNA, 15 nt, Homo sapiens
gucaguuagcaucau

SEQ ID NO: 543928 - RNA, 19 nt, Homo sapiens
gucaguuguacuucugcuc

SEQ ID NO: 543929 - RNA, 23 nt, Homo sapiens
gucauaaaaugcauacuguugau

SEQ ID NO: 543930 - RNA, 18 nt, Homo sapiens
gucauaccuuuggauuua

SEQ ID NO: 543931 - RNA, 10 nt, Homo sapiens
gucauagaaa

SEQ ID NO: 543932 - RNA, 21 nt, Homo sapiens
gucauaguggguggauuuguu

SEQ ID NO: 543933 - RNA, 20 nt, Homo sapiens
gucaucacuccucugucaua

SEQ ID NO: 543934 - RNA, 13 nt, Homo sapiens
gucaucagauuau

SEQ ID NO: 543935 - RNA, 22 nt, Homo sapiens
gucaucaucauagguaacaguu

SEQ ID NO: 543936 - RNA, 18 nt, Homo sapiens
gucaucauuacuugggaa

SEQ ID NO: 543937 - RNA, 13 nt, Homo sapiens
gucauccaaagaa

SEQ ID NO: 543938 - RNA, 17 nt, Homo sapiens
gucauccagcucacuca

SEQ ID NO: 543939 - RNA, 14 nt, Homo sapiens
gucauccucuggaa

SEQ ID NO: 543940 - RNA, 20 nt, Homo sapiens
gucaucugcaugucuacuca

SEQ ID NO: 543941 - RNA, 18 nt, Homo sapiens
gucaugaccuagaugacc

SEQ ID NO: 543942 - RNA, 15 nt, Homo sapiens
gucaugcacaugccu

SEQ ID NO: 543943 - RNA, 18 nt, Homo sapiens
gucaugccacugcacucu

SEQ ID NO: 543944 - RNA, 11 nt, Homo sapiens
gucaugcccuc

SEQ ID NO: 543945 - RNA, 21 nt, Homo sapiens
gucauuauuuuuguuagcaaa

SEQ ID NO: 543946 - RNA, 23 nt, Homo sapiens
gucauuauuuuuguuagcaaaga

SEQ ID NO: 543947 - RNA, 19 nt, Homo sapiens
gucauucaagccugugaau

SEQ ID NO: 543948 - RNA, 13 nt, Homo sapiens
gucauucauucaa

SEQ ID NO: 543949 - RNA, 15 nt, Homo sapiens
gucauugagggacca

SEQ ID NO: 543950 - RNA, 17 nt, Homo sapiens
gucauugcaccuaucuc

SEQ ID NO: 543951 - RNA, 23 nt, Homo sapiens
gucauuggccacugucuccacuc

SEQ ID NO: 543952 - RNA, 19 nt, Homo sapiens
gucauuggccgacaucaca

SEQ ID NO: 543953 - RNA, 21 nt, Homo sapiens
gucauuucauuccauugccua

SEQ ID NO: 543954 - RNA, 15 nt, Homo sapiens
gucauuuccagacaa

SEQ ID NO: 543955 - RNA, 17 nt, Homo sapiens
gucauuugacugucuca

SEQ ID NO: 543956 - RNA, 21 nt, Homo sapiens
gucauuuggugccaguauuuu

SEQ ID NO: 543957 - RNA, 23 nt, Homo sapiens
gucauuuuuaacagcaugcugcu

SEQ ID NO: 543958 - RNA, 13 nt, Homo sapiens
guccaaaacugcc

SEQ ID NO: 543959 - RNA, 16 nt, Homo sapiens
guccaaauccaaccuc

SEQ ID NO: 543960 - RNA, 17 nt, Homo sapiens
guccaacaagaaugcau

SEQ ID NO: 543961 - RNA, 20 nt, Homo sapiens
guccaacaagaaugcauucc

SEQ ID NO: 543962 - RNA, 22 nt, Homo sapiens
guccaacauuuuuucccaguga

SEQ ID NO: 543963 - RNA, 15 nt, Homo sapiens
guccaaccagaaaca

SEQ ID NO: 543964 - RNA, 13 nt, Homo sapiens
guccaagucuucu

SEQ ID NO: 543965 - RNA, 19 nt, Homo sapiens
guccaaguggcugugacau

SEQ ID NO: 543966 - RNA, 22 nt, Homo sapiens
guccaagugugugugcgugugu

SEQ ID NO: 543967 - RNA, 15 nt, Homo sapiens
ugaguccccuacucc

SEQ ID NO: 543968 - RNA, 16 nt, Homo sapiens
ugaguccuaggacuua

SEQ ID NO: 543969 - RNA, 20 nt, Homo sapiens
ugagucgagauugcacugcu

SEQ ID NO: 543970 - RNA, 15 nt, Homo sapiens
ugagucuccugugcc

SEQ ID NO: 543971 - RNA, 20 nt, Homo sapiens
ugagucugaguccugucucu

SEQ ID NO: 543972 - RNA, 17 nt, Homo sapiens
ugagucuuggugcuauc

SEQ ID NO: 543973 - RNA, 22 nt, Homo sapiens
ugagugaaaauuuuuacauuca

SEQ ID NO: 543974 - RNA, 18 nt, Homo sapiens
ugagugaauagcuuucag

SEQ ID NO: 543975 - RNA, 21 nt, Homo sapiens
ugagugagaggguuugaguca

SEQ ID NO: 543976 - RNA, 14 nt, Homo sapiens
ugagugaucacugg

SEQ ID NO: 543977 - RNA, 11 nt, Homo sapiens
ugagugcaagg

SEQ ID NO: 543978 - RNA, 19 nt, Homo sapiens
ugagugcacugacugugaa

SEQ ID NO: 543979 - RNA, 21 nt, Homo sapiens
ugagugcugggcacugcucca

SEQ ID NO: 543980 - RNA, 17 nt, Homo sapiens
ugaguggaugauguuuc

SEQ ID NO: 543981 - RNA, 20 nt, Homo sapiens
ugagugggaauccgggacac

SEQ ID NO: 543982 - RNA, 15 nt, Homo sapiens
ugagugggugaauaa

SEQ ID NO: 543983 - RNA, 23 nt, Homo sapiens
ugaguggucacuggucagggcag

SEQ ID NO: 543984 - RNA, 15 nt, Homo sapiens
ugaguguaaguguga

SEQ ID NO: 543985 - RNA, 17 nt, Homo sapiens
ugagugugugugcaugg

SEQ ID NO: 543986 - RNA, 17 nt, Homo sapiens
ugaguuaauuuuaccaa

SEQ ID NO: 543987 - RNA, 20 nt, Homo sapiens
ugaguuaugauguaaucucu

SEQ ID NO: 543988 - RNA, 22 nt, Homo sapiens
ugaguucuggaagggacuuuag

SEQ ID NO: 543989 - RNA, 19 nt, Homo sapiens
ugaguugcccaucuuguuu

SEQ ID NO: 543990 - RNA, 15 nt, Homo sapiens
ugaguugcuuuucag

SEQ ID NO: 543991 - RNA, 14 nt, Homo sapiens
ugaguuguggugga

SEQ ID NO: 543992 - RNA, 17 nt, Homo sapiens
ugaguuucuguucuccc

SEQ ID NO: 543993 - RNA, 14 nt, Homo sapiens
ugaguuuucagugg

SEQ ID NO: 543994 - RNA, 15 nt, Homo sapiens
ugaguuuuguauuca

SEQ ID NO: 543995 - RNA, 21 nt, Homo sapiens
ugaguuuuugauagcuuuauu

SEQ ID NO: 543996 - RNA, 15 nt, Homo sapiens
ugauaaaacacugcc

SEQ ID NO: 543997 - RNA, 15 nt, Homo sapiens
ugauaaagcaguauu

SEQ ID NO: 543998 - RNA, 15 nt, Homo sapiens
gaucagcgacccuga

SEQ ID NO: 543999 - RNA, 16 nt, Homo sapiens
gaucaguacugacuuu

SEQ ID NO: 544000 - RNA, 15 nt, Homo sapiens
gaucaguauuucacu

SEQ ID NO: 544001 - RNA, 18 nt, Homo sapiens
gaucaguggugucuguga

SEQ ID NO: 544002 - RNA, 23 nt, Homo sapiens
gaucauacguaccccaaaccuca

SEQ ID NO: 544003 - RNA, 21 nt, Homo sapiens
gaucauauuucacaauccugu

SEQ ID NO: 544004 - RNA, 18 nt, Homo sapiens
gaucaucgccagaggugc

SEQ ID NO: 544005 - RNA, 21 nt, Homo sapiens
gaucauuacauggcugugguu

SEQ ID NO: 544006 - RNA, 21 nt, Homo sapiens
gaucauuuguuggaaugaauu

SEQ ID NO: 544007 - RNA, 22 nt, Homo sapiens
gauccaaggccgcggcccagac

SEQ ID NO: 544008 - RNA, 14 nt, Homo sapiens
gauccaauaugacu

SEQ ID NO: 544009 - RNA, 14 nt, Homo sapiens
gauccacacugaga

SEQ ID NO: 544010 - RNA, 15 nt, Homo sapiens
gauccacuucucuca

SEQ ID NO: 544011 - RNA, 15 nt, Homo sapiens
gauccagaauggagu

SEQ ID NO: 544012 - RNA, 15 nt, Homo sapiens
gauccaggugccaag

SEQ ID NO: 544013 - RNA, 18 nt, Homo sapiens
gaucccaagacaaugaaa

SEQ ID NO: 544014 - RNA, 16 nt, Homo sapiens
gauccccaagugugaa

SEQ ID NO: 544015 - RNA, 23 nt, Homo sapiens
gauccccccacagccccugguca

SEQ ID NO: 544016 - RNA, 19 nt, Homo sapiens
gaucccgagguauggcaga

SEQ ID NO: 544017 - RNA, 15 nt, Homo sapiens
gaucccuacugccaa

SEQ ID NO: 544018 - RNA, 19 nt, Homo sapiens
gaucccuacugccaaccug

SEQ ID NO: 544019 - RNA, 20 nt, Homo sapiens
gauccuagugaccaaauuca

SEQ ID NO: 544020 - RNA, 19 nt, Homo sapiens
gauccuccaacagcuguca

SEQ ID NO: 544021 - RNA, 16 nt, Homo sapiens
gauccucccaucucag

SEQ ID NO: 544022 - RNA, 13 nt, Homo sapiens
gauccugcacucu

SEQ ID NO: 544023 - RNA, 14 nt, Homo sapiens
gauccuucaaagag

SEQ ID NO: 544024 - RNA, 20 nt, Homo sapiens
gauccuucgggugcuggaag

SEQ ID NO: 544025 - RNA, 14 nt, Homo sapiens
gaucgcaccacugc

SEQ ID NO: 544026 - RNA, 20 nt, Homo sapiens
gaucgugcuacugcacucca

SEQ ID NO: 544027 - RNA, 18 nt, Homo sapiens
gaucuaauuaaacuaaag

SEQ ID NO: 544028 - RNA, 17 nt, Homo sapiens
gaucuacacccaccaga

SEQ ID NO: 544029 - RNA, 19 nt, Homo sapiens
gaucuauagcagaguccuu

SEQ ID NO: 544030 - RNA, 22 nt, Homo sapiens
gaucuauauuuuuguacugaau

SEQ ID NO: 544031 - RNA, 18 nt, Homo sapiens
gaucucagagcauuucaa

SEQ ID NO: 544032 - RNA, 19 nt, Homo sapiens
gaucuccaacagccagugu

SEQ ID NO: 544033 - RNA, 20 nt, Homo sapiens
gaucuccaacagccagugug

SEQ ID NO: 544034 - RNA, 18 nt, Homo sapiens
gaucuccaaggaccaggu

SEQ ID NO: 544035 - RNA, 17 nt, Homo sapiens
gaucuccauauguuaca

SEQ ID NO: 544036 - RNA, 15 nt, Homo sapiens
gaucuccccacucua

SEQ ID NO: 544037 - RNA, 19 nt, Homo sapiens
gaucucccugccgccucaa

SEQ ID NO: 544038 - RNA, 24 nt, Homo sapiens
gaucugaacauacagagcccacau

SEQ ID NO: 544039 - RNA, 17 nt, Homo sapiens
gaucuggcuuacagggg

SEQ ID NO: 544040 - RNA, 10 nt, Homo sapiens
gaucugugau

SEQ ID NO: 544041 - RNA, 11 nt, Homo sapiens
gaucugugaua

SEQ ID NO: 544042 - RNA, 18 nt, Homo sapiens
gaucuuaaagcauucccc

SEQ ID NO: 544043 - RNA, 20 nt, Homo sapiens
gaucuuaaagcauuccccaa

SEQ ID NO: 544044 - RNA, 21 nt, Homo sapiens
gaucuuaauauaaauucacuu

SEQ ID NO: 544045 - RNA, 14 nt, Homo sapiens
gaucuucacucugg

SEQ ID NO: 544046 - RNA, 18 nt, Homo sapiens
gaucuucagaacugcccu

SEQ ID NO: 544047 - RNA, 17 nt, Homo sapiens
gaucuucauuaccaaua

SEQ ID NO: 544048 - RNA, 15 nt, Homo sapiens
gaucuucccacagga

SEQ ID NO: 544049 - RNA, 18 nt, Homo sapiens
gaucuugaauagucucau

SEQ ID NO: 544050 - RNA, 18 nt, Homo sapiens
gaucuuucugcaggaaau

SEQ ID NO: 544051 - RNA, 16 nt, Homo sapiens
gaucuuucuuuuccca

SEQ ID NO: 544052 - RNA, 15 nt, Homo sapiens
gaucuuugacucuuu

SEQ ID NO: 544053 - RNA, 18 nt, Homo sapiens
gaucuuugagcccauucu

SEQ ID NO: 544054 - RNA, 23 nt, Homo sapiens
gaugaaaacauagcaucucagga

SEQ ID NO: 544055 - RNA, 14 nt, Homo sapiens
gaugaaaacauuca

SEQ ID NO: 544056 - RNA, 19 nt, Homo sapiens
gaugaaaaugaaucuucac

SEQ ID NO: 544057 - RNA, 20 nt, Homo sapiens
gaugaaaaugaaucuucaca

SEQ ID NO: 544058 - RNA, 14 nt, Homo sapiens
gaugaaacuccuga

SEQ ID NO: 544059 - RNA, 16 nt, Homo sapiens
gaugaaagcugauuac

SEQ ID NO: 544060 - RNA, 14 nt, Homo sapiens
gaugaacaucuaac

SEQ ID NO: 544061 - RNA, 13 nt, Homo sapiens
gaugaagaccaaa

SEQ ID NO: 544062 - RNA, 15 nt, Homo sapiens
gaugaagaccaaaga

SEQ ID NO: 544063 - RNA, 12 nt, Homo sapiens
gaugaauaccuu

SEQ ID NO: 544064 - RNA, 15 nt, Homo sapiens
gaugaauucuuccuc

SEQ ID NO: 544065 - RNA, 19 nt, Homo sapiens
gaugaauuuuaucagccau

SEQ ID NO: 544066 - RNA, 20 nt, Homo sapiens
gaugacaauguuuacucaaa

SEQ ID NO: 544067 - RNA, 11 nt, Homo sapiens
gaugacauuuc

SEQ ID NO: 544068 - RNA, 15 nt, Homo sapiens
gaugacccuuuucau

SEQ ID NO: 544069 - RNA, 16 nt, Homo sapiens
gaugacuauuacuuuu

SEQ ID NO: 544070 - RNA, 16 nt, Homo sapiens
gaugagaaucaugcac

SEQ ID NO: 544071 - RNA, 18 nt, Homo sapiens
gaugagggaauccuguca

SEQ ID NO: 544072 - RNA, 18 nt, Homo sapiens
gaugaggggccacugacc

SEQ ID NO: 544073 - RNA, 13 nt, Homo sapiens
gaugagguugcuu

SEQ ID NO: 544074 - RNA, 15 nt, Homo sapiens
gaugaguuacuugaa

SEQ ID NO: 544075 - RNA, 22 nt, Homo sapiens
gaugaguuucacuguacugcau

SEQ ID NO: 544076 - RNA, 16 nt, Homo sapiens
gaugauaaaacacaaa

SEQ ID NO: 544077 - RNA, 13 nt, Homo sapiens
gaugauacaucca

SEQ ID NO: 544078 - RNA, 23 nt, Homo sapiens
gaugauacuuggaugcagcucuu

SEQ ID NO: 544079 - RNA, 15 nt, Homo sapiens
gaugauauucucacc

SEQ ID NO: 544080 - RNA, 21 nt, Homo sapiens
gaugaucccagucacuccucu

SEQ ID NO: 544081 - RNA, 16 nt, Homo sapiens
gaugauucaagccauu

SEQ ID NO: 544082 - RNA, 17 nt, Homo sapiens
gaugauuucucaaaaau

SEQ ID NO: 544083 - RNA, 23 nt, Homo sapiens
gaugcaaucgguuuaaacauggc

SEQ ID NO: 544084 - RNA, 15 nt, Homo sapiens
gaugcaaugugcuac

SEQ ID NO: 544085 - RNA, 16 nt, Homo sapiens
gaugcacuuaugcagu

SEQ ID NO: 544086 - RNA, 20 nt, Homo sapiens
gaugcagcauuuuguauuug

SEQ ID NO: 544087 - RNA, 17 nt, Homo sapiens
gaugcaggggauggugu

SEQ ID NO: 544088 - RNA, 22 nt, Homo sapiens
gaugcaguuucaaguaccaaaa

SEQ ID NO: 544089 - RNA, 20 nt, Homo sapiens
gaugccacgcacuuccucuc

SEQ ID NO: 544090 - RNA, 21 nt, Homo sapiens
gaugccacuucucacucacca

SEQ ID NO: 544091 - RNA, 16 nt, Homo sapiens
gaugccagggacccac

SEQ ID NO: 544092 - RNA, 17 nt, Homo sapiens
gaugccagggcuggaag

SEQ ID NO: 544093 - RNA, 20 nt, Homo sapiens
gaugccccugacaucaucau

SEQ ID NO: 544094 - RNA, 16 nt, Homo sapiens
gaugcuauuuaugcaa

SEQ ID NO: 544095 - RNA, 17 nt, Homo sapiens
gaugcuccugguggcug

SEQ ID NO: 544096 - RNA, 12 nt, Homo sapiens
gaugcugaccca

SEQ ID NO: 544097 - RNA, 19 nt, Homo sapiens
gaugcugagcgaagcuaua

SEQ ID NO: 544098 - RNA, 12 nt, Homo sapiens
gaugcugcuaug

SEQ ID NO: 544099 - RNA, 16 nt, Homo sapiens
uaguauuucucaggaa

SEQ ID NO: 544100 - RNA, 16 nt, Homo sapiens
uagucaaggaggaaag

SEQ ID NO: 544101 - RNA, 16 nt, Homo sapiens
uagucaauccugucau

SEQ ID NO: 544102 - RNA, 23 nt, Homo sapiens
uagucaauccugucauauaauaa

SEQ ID NO: 544103 - RNA, 20 nt, Homo sapiens
uagucaauuucuacuucugg

SEQ ID NO: 544104 - RNA, 18 nt, Homo sapiens
uagucagcuacuucugaa

SEQ ID NO: 544105 - RNA, 19 nt, Homo sapiens
uagucagggcaugcuuuau

SEQ ID NO: 544106 - RNA, 23 nt, Homo sapiens
uagucauaccuggaaugugucaa

SEQ ID NO: 544107 - RNA, 12 nt, Homo sapiens
uagucauacucc

SEQ ID NO: 544108 - RNA, 23 nt, Homo sapiens
uagucauacucccugguguagug

SEQ ID NO: 544109 - RNA, 21 nt, Homo sapiens
uagucaucuuaaauuucaaac

SEQ ID NO: 544110 - RNA, 17 nt, Homo sapiens
uagucauggauaacuac

SEQ ID NO: 544111 - RNA, 20 nt, Homo sapiens
uagucauugucauaaguaaa

SEQ ID NO: 544112 - RNA, 16 nt, Homo sapiens
uaguccaaagacuuaa

SEQ ID NO: 544113 - RNA, 14 nt, Homo sapiens
uaguccaauuccuu

SEQ ID NO: 544114 - RNA, 12 nt, Homo sapiens
uagucccagaaa

SEQ ID NO: 544115 - RNA, 23 nt, Homo sapiens
uagucccagaaauaaacugagaa

SEQ ID NO: 544116 - RNA, 15 nt, Homo sapiens
uagucccagcuacuu

SEQ ID NO: 544117 - RNA, 18 nt, Homo sapiens
uaguccuauucuauugca

SEQ ID NO: 544118 - RNA, 17 nt, Homo sapiens
uagucgaacaauucaua

SEQ ID NO: 544119 - RNA, 13 nt, Homo sapiens
uagucucuuuaaa

SEQ ID NO: 544120 - RNA, 19 nt, Homo sapiens
uauaaugauucauaagaca

SEQ ID NO: 544121 - RNA, 23 nt, Homo sapiens
uauaaugggcucuccggggccau

SEQ ID NO: 544122 - RNA, 16 nt, Homo sapiens
uauaauguaagcucua

SEQ ID NO: 544123 - RNA, 20 nt, Homo sapiens
uauaauguauuuucagcuca

SEQ ID NO: 544124 - RNA, 17 nt, Homo sapiens
uauaauuguaccaaccu

SEQ ID NO: 544125 - RNA, 20 nt, Homo sapiens
uauaauuucaaaccacacau

SEQ ID NO: 544126 - RNA, 12 nt, Homo sapiens
uauacacauaca

SEQ ID NO: 544127 - RNA, 13 nt, Homo sapiens
uauacacauacau

SEQ ID NO: 544128 - RNA, 13 nt, Homo sapiens
uauacacauauau

SEQ ID NO: 544129 - RNA, 23 nt, Homo sapiens
uauacaccuuagucuuuccuuag

SEQ ID NO: 544130 - RNA, 12 nt, Homo sapiens
uauacacugugu

SEQ ID NO: 544131 - RNA, 23 nt, Homo sapiens
uauacacuuacacuuuaugcaca

SEQ ID NO: 544132 - RNA, 15 nt, Homo sapiens
uauacagacaggaag

SEQ ID NO: 544133 - RNA, 12 nt, Homo sapiens
uauacagagccu

SEQ ID NO: 544134 - RNA, 15 nt, Homo sapiens
uauacaggcauaaaa

SEQ ID NO: 544135 - RNA, 14 nt, Homo sapiens
uauacaguacacag

SEQ ID NO: 544136 - RNA, 17 nt, Homo sapiens
uauacauaaacaagacc

SEQ ID NO: 544137 - RNA, 15 nt, Homo sapiens
uauacauacauguau

SEQ ID NO: 544138 - RNA, 20 nt, Homo sapiens
uauacauguaggaguguuua

SEQ ID NO: 544139 - RNA, 16 nt, Homo sapiens
uauacauuacaaucau

SEQ ID NO: 544140 - RNA, 21 nt, Homo sapiens
uauacauuaguuuuaaucucu

SEQ ID NO: 544141 - RNA, 16 nt, Homo sapiens
uauacauugaauucau

SEQ ID NO: 544142 - RNA, 12 nt, Homo sapiens
uauacauuugau

SEQ ID NO: 544143 - RNA, 13 nt, Homo sapiens
uauaccaaaaggg

SEQ ID NO: 544144 - RNA, 11 nt, Homo sapiens
uauaccaaagc

SEQ ID NO: 544145 - RNA, 18 nt, Homo sapiens
uauaccaauauuuacuca

SEQ ID NO: 544146 - RNA, 23 nt, Homo sapiens
uauaccuccuauauguccauuua

SEQ ID NO: 544147 - RNA, 23 nt, Homo sapiens
uauaccugccuuuuaaguuugaa

SEQ ID NO: 544148 - RNA, 19 nt, Homo sapiens
uauacgcuggcaacacaga

SEQ ID NO: 544149 - RNA, 16 nt, Homo sapiens
uauacucuaaaaugga

SEQ ID NO: 544150 - RNA, 18 nt, Homo sapiens
uauacucuguagucucag

SEQ ID NO: 544151 - RNA, 20 nt, Homo sapiens
uauacugggcagaaugaagu

SEQ ID NO: 544152 - RNA, 20 nt, Homo sapiens
uauacugguucacauccuac

SEQ ID NO: 544153 - RNA, 15 nt, Homo sapiens
uauacuguacuuaau

SEQ ID NO: 544154 - RNA, 19 nt, Homo sapiens
uauacuguagcugaugaaa

SEQ ID NO: 544155 - RNA, 15 nt, Homo sapiens
uauacuguaggcaca

SEQ ID NO: 544156 - RNA, 19 nt, Homo sapiens
uauacuguaugugccaaag

SEQ ID NO: 544157 - RNA, 19 nt, Homo sapiens
uauacuuaagaauacacag

SEQ ID NO: 544158 - RNA, 17 nt, Homo sapiens
uauacuucacuggugua

SEQ ID NO: 544159 - RNA, 16 nt, Homo sapiens
uauagaaugagugcag

SEQ ID NO: 544160 - RNA, 17 nt, Homo sapiens
uauagaauggaacucaa

SEQ ID NO: 544161 - RNA, 16 nt, Homo sapiens
uauagacauuauguga

SEQ ID NO: 544162 - RNA, 17 nt, Homo sapiens
uauagacauucucacau

SEQ ID NO: 544163 - RNA, 14 nt, Homo sapiens
uauagacucuagga

SEQ ID NO: 544164 - RNA, 19 nt, Homo sapiens
uauagagaauaaggcacaa

SEQ ID NO: 544165 - RNA, 15 nt, Homo sapiens
uauagauguuuacua

SEQ ID NO: 544166 - RNA, 17 nt, Homo sapiens
uauagccaauauaacua

SEQ ID NO: 544167 - RNA, 12 nt, Homo sapiens
uauagccuuuaa

SEQ ID NO: 544168 - RNA, 20 nt, Homo sapiens
uauagcuaauaacaugugaa

SEQ ID NO: 544169 - RNA, 13 nt, Homo sapiens
uauagcucaggac

SEQ ID NO: 544170 - RNA, 16 nt, Homo sapiens
uauagcugcuuggauu

SEQ ID NO: 544171 - RNA, 21 nt, Homo sapiens
uauagcugugugaacguguau

SEQ ID NO: 544172 - RNA, 21 nt, Homo sapiens
uauaggaaaacaauaauuuua

SEQ ID NO: 544173 - RNA, 19 nt, Homo sapiens
uauaggguguggcuccuac

SEQ ID NO: 544174 - RNA, 14 nt, Homo sapiens
uauaggucauggga

SEQ ID NO: 544175 - RNA, 14 nt, Homo sapiens
uauaguacuggcau

SEQ ID NO: 544176 - RNA, 17 nt, Homo sapiens
uauaguaugaaugcagu

SEQ ID NO: 544177 - RNA, 19 nt, Homo sapiens
uauaguaugaaugcagugg

SEQ ID NO: 544178 - RNA, 16 nt, Homo sapiens
uauaguaugugacuuu

SEQ ID NO: 544179 - RNA, 20 nt, Homo sapiens
uauaguccagacacuuaacu

SEQ ID NO: 544180 - RNA, 22 nt, Homo sapiens
uauagucgaacaauucauauau

SEQ ID NO: 544181 - RNA, 13 nt, Homo sapiens
uauagucuuccag

SEQ ID NO: 544182 - RNA, 22 nt, Homo sapiens
uauaguguucacaaacugugaa

SEQ ID NO: 544183 - RNA, 20 nt, Homo sapiens
uauaguuaugcauacauaca

SEQ ID NO: 544184 - RNA, 16 nt, Homo sapiens
uauaguuuauugacaa

SEQ ID NO: 544185 - RNA, 21 nt, Homo sapiens
uauaguuuauugacaauaauu

SEQ ID NO: 544186 - RNA, 19 nt, Homo sapiens
uauaguuucaccacuccuc

SEQ ID NO: 544187 - RNA, 20 nt, Homo sapiens
uauaguuuucccuauugaau

SEQ ID NO: 544188 - RNA, 23 nt, Homo sapiens
uauauaaacaauaaaaacaacuu

SEQ ID NO: 544189 - RNA, 11 nt, Homo sapiens
uauauaaacuc

SEQ ID NO: 544190 - RNA, 16 nt, Homo sapiens
uauauaaagacugccu

SEQ ID NO: 544191 - RNA, 21 nt, Homo sapiens
uauauaaaugugauugcagcu

SEQ ID NO: 544192 - RNA, 20 nt, Homo sapiens
uauauaauaaagcuacugau

SEQ ID NO: 544193 - RNA, 16 nt, Homo sapiens
uauauaauaacuuuau

SEQ ID NO: 544194 - RNA, 18 nt, Homo sapiens
uauauaauccauuccucu

SEQ ID NO: 544195 - RNA, 17 nt, Homo sapiens
uauauaauuuacuuugu

SEQ ID NO: 544196 - RNA, 14 nt, Homo sapiens
uauauaauuuccuc

SEQ ID NO: 544197 - RNA, 15 nt, Homo sapiens
uauauacacauacau

SEQ ID NO: 544198 - RNA, 15 nt, Homo sapiens
uauauacauacugca

SEQ ID NO: 544199 - RNA, 13 nt, Homo sapiens
uauauacauauau

SEQ ID NO: 544200 - RNA, 15 nt, Homo sapiens
uauauacauggaauc

SEQ ID NO: 544201 - RNA, 13 nt, Homo sapiens
uauauaccaagcu

SEQ ID NO: 544202 - RNA, 12 nt, Homo sapiens
uauauagccaau

SEQ ID NO: 544203 - RNA, 17 nt, Homo sapiens
uauauaggugugugaga

SEQ ID NO: 544204 - RNA, 17 nt, Homo sapiens
uauauagguugugcaaa

SEQ ID NO: 544205 - RNA, 13 nt, Homo sapiens
uauauaguagcau

SEQ ID NO: 544206 - RNA, 12 nt, Homo sapiens
uauauauacaua

SEQ ID NO: 544207 - RNA, 11 nt, Homo sapiens
uauauauagua

SEQ ID NO: 544208 - RNA, 19 nt, Homo sapiens
uauauauaguagcauuuca

SEQ ID NO: 544209 - RNA, 13 nt, Homo sapiens
uauauauauugcu

SEQ ID NO: 544210 - RNA, 17 nt, Homo sapiens
uauauauggggcuuuag

SEQ ID NO: 544211 - RNA, 16 nt, Homo sapiens
uauauaugugugugua

SEQ ID NO: 544212 - RNA, 18 nt, Homo sapiens
uauaucacuucacuguuc

SEQ ID NO: 544213 - RNA, 15 nt, Homo sapiens
uauauccauguacug

SEQ ID NO: 544214 - RNA, 15 nt, Homo sapiens
uauaucccauugaaa

SEQ ID NO: 544215 - RNA, 14 nt, Homo sapiens
uauauccuauauag

SEQ ID NO: 544216 - RNA, 15 nt, Homo sapiens
uauaucuaccccaga

SEQ ID NO: 544217 - RNA, 16 nt, Homo sapiens
uauaucugaagagcua

SEQ ID NO: 544218 - RNA, 15 nt, Homo sapiens
uauaucuuguuuaca

SEQ ID NO: 544219 - RNA, 19 nt, Homo sapiens
uauaugccucauacacaua

SEQ ID NO: 544220 - RNA, 16 nt, Homo sapiens
uauauggcuucaaguu

SEQ ID NO: 544221 - RNA, 15 nt, Homo sapiens
uauauggggcuuuag

SEQ ID NO: 544222 - RNA, 14 nt, Homo sapiens
uauauguaacugaa

SEQ ID NO: 544223 - RNA, 16 nt, Homo sapiens
uauauguacagcucuc

SEQ ID NO: 544224 - RNA, 21 nt, Homo sapiens
gauucagcgaagucucauggg

SEQ ID NO: 544225 - RNA, 21 nt, Homo sapiens
gauucauucucauaauuccua

SEQ ID NO: 544226 - RNA, 13 nt, Homo sapiens
gauuccaaaaagc

SEQ ID NO: 544227 - RNA, 18 nt, Homo sapiens
gauuccaaaaagcacaua

SEQ ID NO: 544228 - RNA, 22 nt, Homo sapiens
gauuccaacauuucucacugaa

SEQ ID NO: 544229 - RNA, 13 nt, Homo sapiens
gauuccacuuuua

SEQ ID NO: 544230 - RNA, 17 nt, Homo sapiens
gauuccagucuacuuga

SEQ ID NO: 544231 - RNA, 21 nt, Homo sapiens
gauuccguauugguauacuuu

SEQ ID NO: 544232 - RNA, 18 nt, Homo sapiens
gauuccucuuuguuuauc

SEQ ID NO: 544233 - RNA, 15 nt, Homo sapiens
gauucuaccacacag

SEQ ID NO: 544234 - RNA, 15 nt, Homo sapiens
gauucuaugucucau

SEQ ID NO: 544235 - RNA, 12 nt, Homo sapiens
gauucuccagua

SEQ ID NO: 544236 - RNA, 15 nt, Homo sapiens
gauucugaaucucaa

SEQ ID NO: 544237 - RNA, 19 nt, Homo sapiens
gauucugcaguaaaucuuu

SEQ ID NO: 544238 - RNA, 17 nt, Homo sapiens
gauucuguagcuuuaac

SEQ ID NO: 544239 - RNA, 21 nt, Homo sapiens
gauucuguguuccuguccaaa

SEQ ID NO: 544240 - RNA, 15 nt, Homo sapiens
gauucuucucuuaau

SEQ ID NO: 544241 - RNA, 14 nt, Homo sapiens
gauucuuuguuaca

SEQ ID NO: 544242 - RNA, 19 nt, Homo sapiens
gauugaaucaacaugcuuu

SEQ ID NO: 544243 - RNA, 11 nt, Homo sapiens
gcaugugccaa

SEQ ID NO: 544244 - RNA, 21 nt, Homo sapiens
gcaugugcccuccugagggag

SEQ ID NO: 544245 - RNA, 19 nt, Homo sapiens
gcauguggccuuuaucuca

SEQ ID NO: 544246 - RNA, 16 nt, Homo sapiens
gcauguguauuuccag

SEQ ID NO: 544247 - RNA, 14 nt, Homo sapiens
gcaugugugugaug

SEQ ID NO: 544248 - RNA, 17 nt, Homo sapiens
gcauguucauugcaaac

SEQ ID NO: 544249 - RNA, 23 nt, Homo sapiens
gcauguuccugccccacaggaau

SEQ ID NO: 544250 - RNA, 18 nt, Homo sapiens
gcauguucugugacugaa

SEQ ID NO: 544251 - RNA, 18 nt, Homo sapiens
gcauguuuauucuguucc

SEQ ID NO: 544252 - RNA, 16 nt, Homo sapiens
gcauuaaaacaaagga

SEQ ID NO: 544253 - RNA, 13 nt, Homo sapiens
gcauuaaacaaaa

SEQ ID NO: 544254 - RNA, 15 nt, Homo sapiens
gcauuaaacauuuga

SEQ ID NO: 544255 - RNA, 18 nt, Homo sapiens
gcauuaagugaaaggauu

SEQ ID NO: 544256 - RNA, 14 nt, Homo sapiens
gcauuacaauugca

SEQ ID NO: 544257 - RNA, 15 nt, Homo sapiens
gcauuacaguauuuu

SEQ ID NO: 544258 - RNA, 19 nt, Homo sapiens
gcauuagggaaaacuuaau

SEQ ID NO: 544259 - RNA, 22 nt, Homo sapiens
gcauuaucuuugucuguucacu

SEQ ID NO: 544260 - RNA, 20 nt, Homo sapiens
gcauuauguacacaggucaa

SEQ ID NO: 544261 - RNA, 17 nt, Homo sapiens
gcauuauguccacugug

SEQ ID NO: 544262 - RNA, 22 nt, Homo sapiens
gcauucaaaaagacagcagaca

SEQ ID NO: 544263 - RNA, 17 nt, Homo sapiens
gcauucaaguguacagu

SEQ ID NO: 544264 - RNA, 15 nt, Homo sapiens
gcauucagcacacac

SEQ ID NO: 544265 - RNA, 19 nt, Homo sapiens
gcauucauuuuuauagcaa

SEQ ID NO: 544266 - RNA, 20 nt, Homo sapiens
gcauuccagccccuauguua

SEQ ID NO: 544267 - RNA, 14 nt, Homo sapiens
gcauuccaugacca

SEQ ID NO: 544268 - RNA, 19 nt, Homo sapiens
gcauuccuuacuugcacug

SEQ ID NO: 544269 - RNA, 23 nt, Homo sapiens
gcauuccuuacuugcacuguuac

SEQ ID NO: 544270 - RNA, 17 nt, Homo sapiens
gcauucuacaccuggac

SEQ ID NO: 544271 - RNA, 18 nt, Homo sapiens
gcauucuagauuacuuuu

SEQ ID NO: 544272 - RNA, 14 nt, Homo sapiens
gcauucuaguuuca

SEQ ID NO: 544273 - RNA, 17 nt, Homo sapiens
gcauucucucauucccu

SEQ ID NO: 544274 - RNA, 20 nt, Homo sapiens
gcauucuucuuuuggcaaua

SEQ ID NO: 544275 - RNA, 16 nt, Homo sapiens
gcauugaaaugagcac

SEQ ID NO: 544276 - RNA, 15 nt, Homo sapiens
gcauugaaaugcaau

SEQ ID NO: 544277 - RNA, 15 nt, Homo sapiens
gcauugaacauuucu

SEQ ID NO: 544278 - RNA, 10 nt, Homo sapiens
gcauugcugg

SEQ ID NO: 544279 - RNA, 17 nt, Homo sapiens
gcauugcuuugcccugg

SEQ ID NO: 544280 - RNA, 21 nt, Homo sapiens
gcauuggugacucacuucaau

SEQ ID NO: 544281 - RNA, 19 nt, Homo sapiens
gcauugucccugugccuaa

SEQ ID NO: 544282 - RNA, 22 nt, Homo sapiens
gcauugucccugugccuaacac

SEQ ID NO: 544283 - RNA, 18 nt, Homo sapiens
gcauugucuguaaugaca

SEQ ID NO: 544284 - RNA, 20 nt, Homo sapiens
gcauuguuucaaaauaguca

SEQ ID NO: 544285 - RNA, 21 nt, Homo sapiens
gcauuuacagaaacgcaucca

SEQ ID NO: 544286 - RNA, 18 nt, Homo sapiens
gcauuuagucuugccagg

SEQ ID NO: 544287 - RNA, 16 nt, Homo sapiens
gcauuucaccugugac

SEQ ID NO: 544288 - RNA, 15 nt, Homo sapiens
gcauuuccagacuug

SEQ ID NO: 544289 - RNA, 17 nt, Homo sapiens
gcauuuccuaggauaaa

SEQ ID NO: 544290 - RNA, 15 nt, Homo sapiens
gcauuugauuuugcc

SEQ ID NO: 544291 - RNA, 12 nt, Homo sapiens
gcauuugccacu

SEQ ID NO: 544292 - RNA, 14 nt, Homo sapiens
gcauuuggaaccaa

SEQ ID NO: 544293 - RNA, 16 nt, Homo sapiens
gcauuuggcacugaga

SEQ ID NO: 544294 - RNA, 19 nt, Homo sapiens
gcauuuggugguuucagaa

SEQ ID NO: 544295 - RNA, 22 nt, Homo sapiens
gcauuuguuuccucaucuuuaa

SEQ ID NO: 544296 - RNA, 19 nt, Homo sapiens
gcauuuucacauuuugccu

SEQ ID NO: 544297 - RNA, 21 nt, Homo sapiens
gcauuuuccugccugguuucu

SEQ ID NO: 544298 - RNA, 18 nt, Homo sapiens
gcauuuucuucacagugc

SEQ ID NO: 544299 - RNA, 10 nt, Homo sapiens
gcauuuugcu

SEQ ID NO: 544300 - RNA, 15 nt, Homo sapiens
gcauuuuuaaauaca

SEQ ID NO: 544301 - RNA, 22 nt, Homo sapiens
gcauuuuuuaaaagcauggcua

SEQ ID NO: 544302 - RNA, 17 nt, Homo sapiens
gccaaaacaagccaaag

SEQ ID NO: 544303 - RNA, 19 nt, Homo sapiens
gccaaaagcugcucaggga

SEQ ID NO: 544304 - RNA, 10 nt, Homo sapiens
gccaaacaaa

SEQ ID NO: 544305 - RNA, 22 nt, Homo sapiens
gccaaacaaaacugaaccacaa

SEQ ID NO: 544306 - RNA, 14 nt, Homo sapiens
gccaaacaauaugc

SEQ ID NO: 544307 - RNA, 15 nt, Homo sapiens
gccaaacacacugua

SEQ ID NO: 544308 - RNA, 17 nt, Homo sapiens
gccaaacacuagcucug

SEQ ID NO: 544309 - RNA, 23 nt, Homo sapiens
gccaaacagcaagaagcuguuac

SEQ ID NO: 544310 - RNA, 14 nt, Homo sapiens
gccaaaccaagcaa

SEQ ID NO: 544311 - RNA, 20 nt, Homo sapiens
gccaaacccaugaggcaaug

SEQ ID NO: 544312 - RNA, 15 nt, Homo sapiens
gccaaacucugccag

SEQ ID NO: 544313 - RNA, 16 nt, Homo sapiens
gccaaagaaccaaaga

SEQ ID NO: 544314 - RNA, 14 nt, Homo sapiens
gccaaagacuguaa

SEQ ID NO: 544315 - RNA, 16 nt, Homo sapiens
gccaaagauaaucucu

SEQ ID NO: 544316 - RNA, 14 nt, Homo sapiens
gccaaagaucacuu

SEQ ID NO: 544317 - RNA, 20 nt, Homo sapiens
gccaaauaagauucccauug

SEQ ID NO: 544318 - RNA, 18 nt, Homo sapiens
gccaaccaagaugcaaau

SEQ ID NO: 544319 - RNA, 20 nt, Homo sapiens
gccaaccauaccuuccuucc

SEQ ID NO: 544320 - RNA, 12 nt, Homo sapiens
gccaacccagcc

SEQ ID NO: 544321 - RNA, 17 nt, Homo sapiens
gccaaccugaugccccu

SEQ ID NO: 544322 - RNA, 14 nt, Homo sapiens
gccaacgagacaca

SEQ ID NO: 544323 - RNA, 15 nt, Homo sapiens
gccaacuuguaaaua

SEQ ID NO: 544324 - RNA, 17 nt, Homo sapiens
gccaagaaacacugccu

SEQ ID NO: 544325 - RNA, 18 nt, Homo sapiens
gccaagaaucaagcuaga

SEQ ID NO: 544326 - RNA, 16 nt, Homo sapiens
gccaagacagugaagu

SEQ ID NO: 544327 - RNA, 12 nt, Homo sapiens
gccaagacuccu

SEQ ID NO: 544328 - RNA, 15 nt, Homo sapiens
gccaagagaccagcc

SEQ ID NO: 544329 - RNA, 20 nt, Homo sapiens
gccaagaucgcgccacugca

SEQ ID NO: 544330 - RNA, 19 nt, Homo sapiens
gccaagauggaagucaccu

SEQ ID NO: 544331 - RNA, 22 nt, Homo sapiens
gccaagcuuugaggcucuguca

SEQ ID NO: 544332 - RNA, 11 nt, Homo sapiens
gccaaggagcu

SEQ ID NO: 544333 - RNA, 17 nt, Homo sapiens
gccaaggagcugcuaua

SEQ ID NO: 544334 - RNA, 22 nt, Homo sapiens
gccaaggcggguggaucacuug

SEQ ID NO: 544335 - RNA, 19 nt, Homo sapiens
gccaagggcagcaccaucu

SEQ ID NO: 544336 - RNA, 17 nt, Homo sapiens
gccaagggggugacugg

SEQ ID NO: 544337 - RNA, 22 nt, Homo sapiens
gccaaggggugggccugugaau

SEQ ID NO: 544338 - RNA, 13 nt, Homo sapiens
gccaagguaggca

SEQ ID NO: 544339 - RNA, 20 nt, Homo sapiens
gccaagguaggcagaucacc

SEQ ID NO: 544340 - RNA, 18 nt, Homo sapiens
gccaaguccacuguccuc

SEQ ID NO: 544341 - RNA, 12 nt, Homo sapiens
gccaagugcagg

SEQ ID NO: 544342 - RNA, 18 nt, Homo sapiens
gccaauaaaaaugucuca

SEQ ID NO: 544343 - RNA, 15 nt, Homo sapiens
gccaauccacuccuu

SEQ ID NO: 544344 - RNA, 18 nt, Homo sapiens
gccaaucuucaguauuuu

SEQ ID NO: 544345 - RNA, 19 nt, Homo sapiens
gccaauggacaagcagugu

SEQ ID NO: 544346 - RNA, 15 nt, Homo sapiens
gccacaagucuucca

SEQ ID NO: 544347 - RNA, 19 nt, Homo sapiens
gccacaaugcaguucugag

SEQ ID NO: 544348 - RNA, 19 nt, Homo sapiens
gccacacggcucucaccag

SEQ ID NO: 544349 - RNA, 15 nt, Homo sapiens
gccacacguuguaua

SEQ ID NO: 544350 - RNA, 12 nt, Homo sapiens
gccacacucugg

SEQ ID NO: 544351 - RNA, 16 nt, Homo sapiens
gccacagaagccagga

SEQ ID NO: 544352 - RNA, 17 nt, Homo sapiens
gccacaguagaacuguc

SEQ ID NO: 544353 - RNA, 13 nt, Homo sapiens
gccacaguggcca

SEQ ID NO: 544354 - RNA, 19 nt, Homo sapiens
gccacagugucacugguca

SEQ ID NO: 544355 - RNA, 14 nt, Homo sapiens
gccaccaacauaaa

SEQ ID NO: 544356 - RNA, 20 nt, Homo sapiens
gccaccagacuuggccucca

SEQ ID NO: 544357 - RNA, 13 nt, Homo sapiens
ucacauacaaauc

SEQ ID NO: 544358 - RNA, 18 nt, Homo sapiens
ucacauacaaaucaucca

SEQ ID NO: 544359 - RNA, 20 nt, Homo sapiens
ucacauacaaaucauccauc

SEQ ID NO: 544360 - RNA, 17 nt, Homo sapiens
ucacauccugggaucca

SEQ ID NO: 544361 - RNA, 16 nt, Homo sapiens
ucacaucucccccaua

SEQ ID NO: 544362 - RNA, 17 nt, Homo sapiens
ucacaucuuaaauucau

SEQ ID NO: 544363 - RNA, 22 nt, Homo sapiens
ucacaucuuccaccagcaccuu

SEQ ID NO: 544364 - RNA, 11 nt, Homo sapiens
ucacaugacca

SEQ ID NO: 544365 - RNA, 18 nt, Homo sapiens
ucacaugagcuauuucca

SEQ ID NO: 544366 - RNA, 16 nt, Homo sapiens
gccaccucaccaagga

SEQ ID NO: 544367 - RNA, 11 nt, Homo sapiens
gccaccucucc

SEQ ID NO: 544368 - RNA, 23 nt, Homo sapiens
gccaccucucuccuuugcugagg

SEQ ID NO: 544369 - RNA, 22 nt, Homo sapiens
gccaccuuggaggaggaugcca

SEQ ID NO: 544370 - RNA, 19 nt, Homo sapiens
gccacgcugauaauaugca

SEQ ID NO: 544371 - RNA, 22 nt, Homo sapiens
gccacggagggaggcaccaugc

SEQ ID NO: 544372 - RNA, 16 nt, Homo sapiens
gccacucauuccugua

SEQ ID NO: 544373 - RNA, 19 nt, Homo sapiens
gccacugacugagauggag

SEQ ID NO: 544374 - RNA, 23 nt, Homo sapiens
gccacugcacaccagcccagcuc

SEQ ID NO: 544375 - RNA, 13 nt, Homo sapiens
gccacugcacucc

SEQ ID NO: 544376 - RNA, 15 nt, Homo sapiens
gccacugccaagcuu

SEQ ID NO: 544377 - RNA, 14 nt, Homo sapiens
gccacugggcaccu

SEQ ID NO: 544378 - RNA, 11 nt, Homo sapiens
gccacugggcu

SEQ ID NO: 544379 - RNA, 16 nt, Homo sapiens
gccacuugacauuccu

SEQ ID NO: 544380 - RNA, 16 nt, Homo sapiens
gccacuuuacccaccu

SEQ ID NO: 544381 - RNA, 18 nt, Homo sapiens
gccagaaagcacuacaau

SEQ ID NO: 544382 - RNA, 12 nt, Homo sapiens
gccagacacuga

SEQ ID NO: 544383 - RNA, 23 nt, Homo sapiens
gccagaccagcaggcuggccuau

SEQ ID NO: 544384 - RNA, 22 nt, Homo sapiens
gccagacuggacaggcaaagac

SEQ ID NO: 544385 - RNA, 22 nt, Homo sapiens
gccagagaaaauguuggaagag

SEQ ID NO: 544386 - RNA, 21 nt, Homo sapiens
gccagagagaacaacaggcag

SEQ ID NO: 544387 - RNA, 17 nt, Homo sapiens
gccagaggaacugucca

SEQ ID NO: 544388 - RNA, 21 nt, Homo sapiens
gccagaggaauccuggcagcc

SEQ ID NO: 544389 - RNA, 20 nt, Homo sapiens
gccagaggcucuaauguaca

SEQ ID NO: 544390 - RNA, 21 nt, Homo sapiens
gccagaggcucuaauguacaa

SEQ ID NO: 544391 - RNA, 23 nt, Homo sapiens
gccagaggcucuaauguacaaua

SEQ ID NO: 544392 - RNA, 13 nt, Homo sapiens
gccagaguuccug

SEQ ID NO: 544393 - RNA, 22 nt, Homo sapiens
gccagauuuuuuaaaauuuaua

SEQ ID NO: 544394 - RNA, 16 nt, Homo sapiens
gccagcaaggcagguu

SEQ ID NO: 544395 - RNA, 19 nt, Homo sapiens
gccagcaauaaaaacuguc

SEQ ID NO: 544396 - RNA, 20 nt, Homo sapiens
gccagcacaggggccccaga

SEQ ID NO: 544397 - RNA, 19 nt, Homo sapiens
gccagcagucuaccugcuc

SEQ ID NO: 544398 - RNA, 16 nt, Homo sapiens
gccagcauacauuuuc

SEQ ID NO: 544399 - RNA, 17 nt, Homo sapiens
gccagcauauacugaag

SEQ ID NO: 544400 - RNA, 18 nt, Homo sapiens
gccagcauuaccacagcu

SEQ ID NO: 544401 - RNA, 14 nt, Homo sapiens
gccagccaucaaau

SEQ ID NO: 544402 - RNA, 15 nt, Homo sapiens
gccagcccuccuuga

SEQ ID NO: 544403 - RNA, 18 nt, Homo sapiens
gccagccucagaaggccc

SEQ ID NO: 544404 - RNA, 21 nt, Homo sapiens
gccagccuccggcggggaccc

SEQ ID NO: 544405 - RNA, 13 nt, Homo sapiens
gccagccuggucc

SEQ ID NO: 544406 - RNA, 14 nt, Homo sapiens
gccagcuacuuccu

SEQ ID NO: 544407 - RNA, 16 nt, Homo sapiens
gccagcucagucccau

SEQ ID NO: 544408 - RNA, 23 nt, Homo sapiens
gccagcucugaggggaggcaccu

SEQ ID NO: 544409 - RNA, 16 nt, Homo sapiens
gccagcugugcacuuu

SEQ ID NO: 544410 - RNA, 17 nt, Homo sapiens
gccagcugugcacuuuc

SEQ ID NO: 544411 - RNA, 22 nt, Homo sapiens
gccagcugugggacaauuaucu

SEQ ID NO: 544412 - RNA, 19 nt, Homo sapiens
gccagcuuaucucaggggu

SEQ ID NO: 544413 - RNA, 21 nt, Homo sapiens
gccagcuuggggccaccaaag

SEQ ID NO: 544414 - RNA, 22 nt, Homo sapiens
gccaggaacccuccuccuguca

SEQ ID NO: 544415 - RNA, 20 nt, Homo sapiens
gccaggaagaucccccagaa

SEQ ID NO: 544416 - RNA, 14 nt, Homo sapiens
gccaggaagccaga

SEQ ID NO: 544417 - RNA, 17 nt, Homo sapiens
gccaggacaaugaaaua

SEQ ID NO: 544418 - RNA, 15 nt, Homo sapiens
gccaggacaugaaga

SEQ ID NO: 544419 - RNA, 18 nt, Homo sapiens
gccaggacaugaagaaaa

SEQ ID NO: 544420 - RNA, 13 nt, Homo sapiens
gccaggacugugu

SEQ ID NO: 544421 - RNA, 15 nt, Homo sapiens
gccaggacuguguuu

SEQ ID NO: 544422 - RNA, 21 nt, Homo sapiens
gccaggagcccacagugccug

SEQ ID NO: 544423 - RNA, 20 nt, Homo sapiens
gccaggagcuggacaccuac

SEQ ID NO: 544424 - RNA, 21 nt, Homo sapiens
gccaggaggggaaacaucaca

SEQ ID NO: 544425 - RNA, 19 nt, Homo sapiens
gccaggagucugugcucuu

SEQ ID NO: 544426 - RNA, 13 nt, Homo sapiens
gccaggcacuuug

SEQ ID NO: 544427 - RNA, 14 nt, Homo sapiens
gccaggcacuuuga

SEQ ID NO: 544428 - RNA, 15 nt, Homo sapiens
gccaggcacuuugag

SEQ ID NO: 544429 - RNA, 18 nt, Homo sapiens
gccaggcaugguggccca

SEQ ID NO: 544430 - RNA, 19 nt, Homo sapiens
gccaggccagagggcagug

SEQ ID NO: 544431 - RNA, 17 nt, Homo sapiens
gccaggccugaccucaa

SEQ ID NO: 544432 - RNA, 21 nt, Homo sapiens
gccaggcuaucuggccugaga

SEQ ID NO: 544433 - RNA, 21 nt, Homo sapiens
gccaggcugaauuacagugaa

SEQ ID NO: 544434 - RNA, 20 nt, Homo sapiens
gccaggcugccaaggccaga

SEQ ID NO: 544435 - RNA, 18 nt, Homo sapiens
gccagggagcuugccaca

SEQ ID NO: 544436 - RNA, 16 nt, Homo sapiens
gccagggcaaugccau

SEQ ID NO: 544437 - RNA, 14 nt, Homo sapiens
gccaggggcaguuu

SEQ ID NO: 544438 - RNA, 21 nt, Homo sapiens
gccagggugagggagggccaa

SEQ ID NO: 544439 - RNA, 23 nt, Homo sapiens
gccaggucacccuuugcugugag

SEQ ID NO: 544440 - RNA, 16 nt, Homo sapiens
gccagucacugcugca

SEQ ID NO: 544441 - RNA, 22 nt, Homo sapiens
gccagucccgggggccugcccu

SEQ ID NO: 544442 - RNA, 11 nt, Homo sapiens
gccagugacag

SEQ ID NO: 544443 - RNA, 22 nt, Homo sapiens
gccagugcaagaccgagauuga

SEQ ID NO: 544444 - RNA, 16 nt, Homo sapiens
gccagugccagggugg

SEQ ID NO: 544445 - RNA, 18 nt, Homo sapiens
gccagugccucucacccc

SEQ ID NO: 544446 - RNA, 21 nt, Homo sapiens
gccagugggccugguagcaca

SEQ ID NO: 544447 - RNA, 16 nt, Homo sapiens
gccaguguguguuucc

SEQ ID NO: 544448 - RNA, 23 nt, Homo sapiens
gccaguuucucugccuucuucca

SEQ ID NO: 544449 - RNA, 21 nt, Homo sapiens
gccaguuugaccuuugucuuc

SEQ ID NO: 544450 - RNA, 16 nt, Homo sapiens
gccaguuuuaccagcg

SEQ ID NO: 544451 - RNA, 14 nt, Homo sapiens
gccauacuuuacaa

SEQ ID NO: 544452 - RNA, 14 nt, Homo sapiens
gccauagccccaua

SEQ ID NO: 544453 - RNA, 22 nt, Homo sapiens
gccaucaaacauaauucucuca

SEQ ID NO: 544454 - RNA, 21 nt, Homo sapiens
gccaucaaagaguccuggacg

SEQ ID NO: 544455 - RNA, 17 nt, Homo sapiens
gccaucaaauagugaau

SEQ ID NO: 544456 - RNA, 19 nt, Homo sapiens
gccaucauccuccauugcu

SEQ ID NO: 544457 - RNA, 14 nt, Homo sapiens
gccauccaccuuca

SEQ ID NO: 544458 - RNA, 20 nt, Homo sapiens
gccauccauuugugcaaaau

SEQ ID NO: 544459 - RNA, 21 nt, Homo sapiens
gccauccucacaugugacaaa

SEQ ID NO: 544460 - RNA, 15 nt, Homo sapiens
gccaucguucaucca

SEQ ID NO: 544461 - RNA, 13 nt, Homo sapiens
gccaucucagguu

SEQ ID NO: 544462 - RNA, 17 nt, Homo sapiens
gccaucuugaucugugu

SEQ ID NO: 544463 - RNA, 14 nt, Homo sapiens
gccaugaaccaaau

SEQ ID NO: 544464 - RNA, 11 nt, Homo sapiens
gccaugaaucu

SEQ ID NO: 544465 - RNA, 17 nt, Homo sapiens
gccaugacaagaacaaa

SEQ ID NO: 544466 - RNA, 23 nt, Homo sapiens
gccaugacaagaacaaagccacu

SEQ ID NO: 544467 - RNA, 16 nt, Homo sapiens
gccaugagaugauaca

SEQ ID NO: 544468 - RNA, 22 nt, Homo sapiens
gccaugauaacugcaauuuuaa

SEQ ID NO: 544469 - RNA, 15 nt, Homo sapiens
gccaugauguauauc

SEQ ID NO: 544470 - RNA, 22 nt, Homo sapiens
gccaugcagaccucaugcccag

SEQ ID NO: 544471 - RNA, 16 nt, Homo sapiens
gccaugcccuccaugu

SEQ ID NO: 544472 - RNA, 23 nt, Homo sapiens
gccaugccuggagacauaucacu

SEQ ID NO: 544473 - RNA, 17 nt, Homo sapiens
gccaugcgaggggccag

SEQ ID NO: 544474 - RNA, 23 nt, Homo sapiens
gccauggaagguucucugugcuc

SEQ ID NO: 544475 - RNA, 14 nt, Homo sapiens
gccauggcuuucau

SEQ ID NO: 544476 - RNA, 17 nt, Homo sapiens
gccauggugauggugua

SEQ ID NO: 544477 - RNA, 21 nt, Homo sapiens
gccauguuuagauuccaggau

SEQ ID NO: 544478 - RNA, 17 nt, Homo sapiens
gccauguuuuugccaaa

SEQ ID NO: 544479 - RNA, 13 nt, Homo sapiens
gccauuaccccau

SEQ ID NO: 544480 - RNA, 20 nt, Homo sapiens
ucacugcauuuggucagggg

SEQ ID NO: 544481 - RNA, 17 nt, Homo sapiens
ucacugccaucacauca

SEQ ID NO: 544482 - RNA, 17 nt, Homo sapiens
ucacugccccucucuca

SEQ ID NO: 544483 - RNA, 18 nt, Homo sapiens
ucacugccccucucucag

SEQ ID NO: 544484 - RNA, 14 nt, Homo sapiens
ucacugcucaagaa

SEQ ID NO: 544485 - RNA, 19 nt, Homo sapiens
ucacugcucuggacugugu

SEQ ID NO: 544486 - RNA, 11 nt, Homo sapiens
ucacugcugau

SEQ ID NO: 544487 - RNA, 17 nt, Homo sapiens
gccccucggcucuggag

SEQ ID NO: 544488 - RNA, 19 nt, Homo sapiens
gccccucugaccugcacug

SEQ ID NO: 544489 - RNA, 19 nt, Homo sapiens
gccccucuucccuuccucc

SEQ ID NO: 544490 - RNA, 15 nt, Homo sapiens
gccccugaaagccau

SEQ ID NO: 544491 - RNA, 17 nt, Homo sapiens
gccccugcuccagaaga

SEQ ID NO: 544492 - RNA, 22 nt, Homo sapiens
gccccugggguggccaccagua

SEQ ID NO: 544493 - RNA, 15 nt, Homo sapiens
gccccuuccauggua

SEQ ID NO: 544494 - RNA, 22 nt, Homo sapiens
gccccuucuggggguggugggc

SEQ ID NO: 544495 - RNA, 17 nt, Homo sapiens
gccccuugcaagccaua

SEQ ID NO: 544496 - RNA, 13 nt, Homo sapiens
gccccuuguccug

SEQ ID NO: 544497 - RNA, 17 nt, Homo sapiens
gccccuuugccauagcc

SEQ ID NO: 544498 - RNA, 18 nt, Homo sapiens
gcccgacagccuggcaca

SEQ ID NO: 544499 - RNA, 17 nt, Homo sapiens
gcccgaucuccacuguu

SEQ ID NO: 544500 - RNA, 15 nt, Homo sapiens
gcccgcagcccagac

SEQ ID NO: 544501 - RNA, 17 nt, Homo sapiens
gcccgcaggaucaggug

SEQ ID NO: 544502 - RNA, 15 nt, Homo sapiens
gcccgcugcaaugcc

SEQ ID NO: 544503 - RNA, 16 nt, Homo sapiens
gcccgcugcgugccau

SEQ ID NO: 544504 - RNA, 22 nt, Homo sapiens
gcccggggcugucccgugcaug

SEQ ID NO: 544505 - RNA, 16 nt, Homo sapiens
gcccgucggagcugcc

SEQ ID NO: 544506 - RNA, 22 nt, Homo sapiens
gcccguuuuaccaauaaacuga

SEQ ID NO: 544507 - RNA, 13 nt, Homo sapiens
gcccuaaucucac

SEQ ID NO: 544508 - RNA, 13 nt, Homo sapiens
gcccuacucaccu

SEQ ID NO: 544509 - RNA, 16 nt, Homo sapiens
gcccuacucaccugag

SEQ ID NO: 544510 - RNA, 17 nt, Homo sapiens
gcccuacuccacugccc

SEQ ID NO: 544511 - RNA, 17 nt, Homo sapiens
gcccuagaugcacgugg

SEQ ID NO: 544512 - RNA, 19 nt, Homo sapiens
gcccuagcccagacucuga

SEQ ID NO: 544513 - RNA, 23 nt, Homo sapiens
gcccuauggauuugaaguuugcc

SEQ ID NO: 544514 - RNA, 15 nt, Homo sapiens
gcccucaagcaauau

SEQ ID NO: 544515 - RNA, 15 nt, Homo sapiens
gcccucaccagccuu

SEQ ID NO: 544516 - RNA, 16 nt, Homo sapiens
gcccucagaacaaucc

SEQ ID NO: 544517 - RNA, 20 nt, Homo sapiens
gcccucauuacugggccuua

SEQ ID NO: 544518 - RNA, 21 nt, Homo sapiens
gcccucccccaaacagacucg

SEQ ID NO: 544519 - RNA, 18 nt, Homo sapiens
gcccuccucugcacuccc

SEQ ID NO: 544520 - RNA, 17 nt, Homo sapiens
gcccuccuuagaccuga

SEQ ID NO: 544521 - RNA, 17 nt, Homo sapiens
gcccuccuugacccuga

SEQ ID NO: 544522 - RNA, 15 nt, Homo sapiens
gcccucgacacucac

SEQ ID NO: 544523 - RNA, 11 nt, Homo sapiens
gcccucgcugc

SEQ ID NO: 544524 - RNA, 14 nt, Homo sapiens
gcccucgcugcuuc

SEQ ID NO: 544525 - RNA, 22 nt, Homo sapiens
gcccucuacagccugacuuucu

SEQ ID NO: 544526 - RNA, 22 nt, Homo sapiens
gcccucuccccaccccuuccaa

SEQ ID NO: 544527 - RNA, 15 nt, Homo sapiens
gcccucucucugggc

SEQ ID NO: 544528 - RNA, 16 nt, Homo sapiens
gcccucucugcuccuu

SEQ ID NO: 544529 - RNA, 11 nt, Homo sapiens
gcccucugaaa

SEQ ID NO: 544530 - RNA, 21 nt, Homo sapiens
gcccucugucuaccugggaga

SEQ ID NO: 544531 - RNA, 13 nt, Homo sapiens
gcccucugugguc

SEQ ID NO: 544532 - RNA, 19 nt, Homo sapiens
gcccucuguggucacagag

SEQ ID NO: 544533 - RNA, 14 nt, Homo sapiens
gcccucuuaucuca

SEQ ID NO: 544534 - RNA, 23 nt, Homo sapiens
gcccucuuccugacgaaacuggc

SEQ ID NO: 544535 - RNA, 14 nt, Homo sapiens
gcccugaccaugca

SEQ ID NO: 544536 - RNA, 14 nt, Homo sapiens
gcccugacccagag

SEQ ID NO: 544537 - RNA, 11 nt, Homo sapiens
gcccugaccuc

SEQ ID NO: 544538 - RNA, 23 nt, Homo sapiens
gcccugaccuuggcugacugggg

SEQ ID NO: 544539 - RNA, 14 nt, Homo sapiens
gcccugacuccugg

SEQ ID NO: 544540 - RNA, 14 nt, Homo sapiens
gcccugagcauucu

SEQ ID NO: 544541 - RNA, 16 nt, Homo sapiens
gcccugaguccaagag

SEQ ID NO: 544542 - RNA, 20 nt, Homo sapiens
gcccugauguguccucaggg

SEQ ID NO: 544543 - RNA, 16 nt, Homo sapiens
gcccugcaccugugca

SEQ ID NO: 544544 - RNA, 17 nt, Homo sapiens
gcccugcaccugugcag

SEQ ID NO: 544545 - RNA, 17 nt, Homo sapiens
gcccugcacgucauggg

SEQ ID NO: 544546 - RNA, 15 nt, Homo sapiens
gcccugcagccagcu

SEQ ID NO: 544547 - RNA, 18 nt, Homo sapiens
gcccugcagcccaaaacc

SEQ ID NO: 544548 - RNA, 23 nt, Homo sapiens
gcccugcauaauguuaagcuuua

SEQ ID NO: 544549 - RNA, 15 nt, Homo sapiens
gcccugccaucuucc

SEQ ID NO: 544550 - RNA, 18 nt, Homo sapiens
gcccugcccuuggcacca

SEQ ID NO: 544551 - RNA, 12 nt, Homo sapiens
gcccugcuccuc

SEQ ID NO: 544552 - RNA, 20 nt, Homo sapiens
gcccuggacagauggcccaa

SEQ ID NO: 544553 - RNA, 21 nt, Homo sapiens
gcccuggagaagcagcuaaca

SEQ ID NO: 544554 - RNA, 19 nt, Homo sapiens
gcccuggaugcccaggaau

SEQ ID NO: 544555 - RNA, 15 nt, Homo sapiens
gcccuggccaagcuu

SEQ ID NO: 544556 - RNA, 18 nt, Homo sapiens
gcccugggacaucaggag

SEQ ID NO: 544557 - RNA, 23 nt, Homo sapiens
gcccugggcugggugcugggaag

SEQ ID NO: 544558 - RNA, 14 nt, Homo sapiens
gcccuggggagaaa

SEQ ID NO: 544559 - RNA, 23 nt, Homo sapiens
gcccuguccaaaagcgcccucac

SEQ ID NO: 544560 - RNA, 12 nt, Homo sapiens
gcccuguggcag

SEQ ID NO: 544561 - RNA, 15 nt, Homo sapiens
gcccuguguccugag

SEQ ID NO: 544562 - RNA, 16 nt, Homo sapiens
gcccuguuggcagcuc

SEQ ID NO: 544563 - RNA, 16 nt, Homo sapiens
gcccuuauggccaaua

SEQ ID NO: 544564 - RNA, 18 nt, Homo sapiens
gcccuuauugaacauucu

SEQ ID NO: 544565 - RNA, 22 nt, Homo sapiens
gcccuucagucuuaauacuuua

SEQ ID NO: 544566 - RNA, 21 nt, Homo sapiens
gcccuucccacaggacauuuc

SEQ ID NO: 544567 - RNA, 16 nt, Homo sapiens
gcccuucccccugcaa

SEQ ID NO: 544568 - RNA, 17 nt, Homo sapiens
gcccuuccccuucccac

SEQ ID NO: 544569 - RNA, 21 nt, Homo sapiens
gcccuugaagauaucuugaaa

SEQ ID NO: 544570 - RNA, 17 nt, Homo sapiens
gcccuugagcuacuuca

SEQ ID NO: 544571 - RNA, 17 nt, Homo sapiens
gcccuugcuuaccucuc

SEQ ID NO: 544572 - RNA, 15 nt, Homo sapiens
gcccuuggagcugcc

SEQ ID NO: 544573 - RNA, 19 nt, Homo sapiens
gcccuuggcaccaccaggg

SEQ ID NO: 544574 - RNA, 20 nt, Homo sapiens
gcccuuggcaccaccagggu

SEQ ID NO: 544575 - RNA, 20 nt, Homo sapiens
gcccuuuauuuauaauacau

SEQ ID NO: 544576 - RNA, 12 nt, Homo sapiens
gcccuuuccucc

SEQ ID NO: 544577 - RNA, 18 nt, Homo sapiens
gcccuuuggaaagccauu

SEQ ID NO: 544578 - RNA, 19 nt, Homo sapiens
gccgaaaaggauaugcagu

SEQ ID NO: 544579 - RNA, 14 nt, Homo sapiens
gccgaaugugcagg

SEQ ID NO: 544580 - RNA, 22 nt, Homo sapiens
gccgagaacaccgagcacugaa

SEQ ID NO: 544581 - RNA, 19 nt, Homo sapiens
gccgagagcagacaccagc

SEQ ID NO: 544582 - RNA, 21 nt, Homo sapiens
gccgagaucacgucacugcac

SEQ ID NO: 544583 - RNA, 15 nt, Homo sapiens
gccgagugcacugca

SEQ ID NO: 544584 - RNA, 19 nt, Homo sapiens
gccgcacccugcaccugcu

SEQ ID NO: 544585 - RNA, 17 nt, Homo sapiens
gccgcaggugggugcug

SEQ ID NO: 544586 - RNA, 23 nt, Homo sapiens
gccgcaggugggugcugcccugu

SEQ ID NO: 544587 - RNA, 21 nt, Homo sapiens
gccgcaguuuggagucacugu

SEQ ID NO: 544588 - RNA, 19 nt, Homo sapiens
gccgcccuccacaccucua

SEQ ID NO: 544589 - RNA, 14 nt, Homo sapiens
gccgccugcuccuc

SEQ ID NO: 544590 - RNA, 21 nt, Homo sapiens
gccgcggcuguugcucaggag

SEQ ID NO: 544591 - RNA, 21 nt, Homo sapiens
gccgcuccccuuggaccucca

SEQ ID NO: 544592 - RNA, 13 nt, Homo sapiens
gccgcuccugcuu

SEQ ID NO: 544593 - RNA, 15 nt, Homo sapiens
gccgcugcaggaaac

SEQ ID NO: 544594 - RNA, 20 nt, Homo sapiens
gccggaaggaaugucagggc

SEQ ID NO: 544595 - RNA, 20 nt, Homo sapiens
gccggccacacuggucacag

SEQ ID NO: 544596 - RNA, 18 nt, Homo sapiens
gccggcucuuuccuugcu

SEQ ID NO: 544597 - RNA, 15 nt, Homo sapiens
gccggcuguggagca

SEQ ID NO: 544598 - RNA, 18 nt, Homo sapiens
gccggcuucaaguggcag

SEQ ID NO: 544599 - RNA, 18 nt, Homo sapiens
gccgggaggcagugcuga

SEQ ID NO: 544600 - RNA, 18 nt, Homo sapiens
gccgggucacccugugac

SEQ ID NO: 544601 - RNA, 21 nt, Homo sapiens
gccguacucuuuggggcagcu

SEQ ID NO: 544602 - RNA, 16 nt, Homo sapiens
gccgucacgcuuucau

SEQ ID NO: 544603 - RNA, 17 nt, Homo sapiens
gccgucacgcuuucaug

SEQ ID NO: 544604 - RNA, 18 nt, Homo sapiens
gccguccauggcaccagc

SEQ ID NO: 544605 - RNA, 18 nt, Homo sapiens
gccgucugugugguggga

SEQ ID NO: 544606 - RNA, 15 nt, Homo sapiens
ucagucaauucugau

SEQ ID NO: 544607 - RNA, 20 nt, Homo sapiens
ucagucacacacacauacaa

SEQ ID NO: 544608 - RNA, 14 nt, Homo sapiens
ucagucacagccac

SEQ ID NO: 544609 - RNA, 13 nt, Homo sapiens
uacaauuugccau

SEQ ID NO: 544610 - RNA, 15 nt, Homo sapiens
uacaauuuuagucac

SEQ ID NO: 544611 - RNA, 20 nt, Homo sapiens
uacaauuuuauaggugaaag

SEQ ID NO: 544612 - RNA, 20 nt, Homo sapiens
uacaauuuuuuaucaugcau

SEQ ID NO: 544613 - RNA, 22 nt, Homo sapiens
uacaauuuuuuaucaugcaugu

SEQ ID NO: 544614 - RNA, 21 nt, Homo sapiens
uacacaaauuauaagcauaca

SEQ ID NO: 544615 - RNA, 17 nt, Homo sapiens
uacacaacuuugcaaau

SEQ ID NO: 544616 - RNA, 21 nt, Homo sapiens
uacacaauauacgaaaagcca

SEQ ID NO: 544617 - RNA, 20 nt, Homo sapiens
uacacaauuaauucaucccu

SEQ ID NO: 544618 - RNA, 13 nt, Homo sapiens
uacacacauauac

SEQ ID NO: 544619 - RNA, 20 nt, Homo sapiens
uacacacauauauauuacaa

SEQ ID NO: 544620 - RNA, 16 nt, Homo sapiens
uacacagaugaaggug

SEQ ID NO: 544621 - RNA, 15 nt, Homo sapiens
uacacagcccaagag

SEQ ID NO: 544622 - RNA, 14 nt, Homo sapiens
uacacagcuuuaug

SEQ ID NO: 544623 - RNA, 21 nt, Homo sapiens
uacacaggacugaaaagggaa

SEQ ID NO: 544624 - RNA, 17 nt, Homo sapiens
uacacaggagucuucag

SEQ ID NO: 544625 - RNA, 18 nt, Homo sapiens
uacacaguaagucauuua

SEQ ID NO: 544626 - RNA, 15 nt, Homo sapiens
uacacauacauacau

SEQ ID NO: 544627 - RNA, 16 nt, Homo sapiens
uacacauagcauguaa

SEQ ID NO: 544628 - RNA, 20 nt, Homo sapiens
uacacauuuuucagauauaa

SEQ ID NO: 544629 - RNA, 14 nt, Homo sapiens
uacaccacugcaaa

SEQ ID NO: 544630 - RNA, 18 nt, Homo sapiens
uacaccaguuuagcccug

SEQ ID NO: 544631 - RNA, 14 nt, Homo sapiens
uacacccaccagag

SEQ ID NO: 544632 - RNA, 15 nt, Homo sapiens
uacaccugaggacaa

SEQ ID NO: 544633 - RNA, 13 nt, Homo sapiens
uacacgacucagu

SEQ ID NO: 544634 - RNA, 20 nt, Homo sapiens
uacacggaccaucgccucug

SEQ ID NO: 544635 - RNA, 13 nt, Homo sapiens
uacacggcuguga

SEQ ID NO: 544636 - RNA, 18 nt, Homo sapiens
uacacgggacugacgcaa

SEQ ID NO: 544637 - RNA, 18 nt, Homo sapiens
uacacuaaauccccucac

SEQ ID NO: 544638 - RNA, 15 nt, Homo sapiens
uacacuacauuguac

SEQ ID NO: 544639 - RNA, 14 nt, Homo sapiens
uacacuauguucua

SEQ ID NO: 544640 - RNA, 21 nt, Homo sapiens
uacacuccacuugaagcacuu

SEQ ID NO: 544641 - RNA, 17 nt, Homo sapiens
uacacugaggacugugg

SEQ ID NO: 544642 - RNA, 17 nt, Homo sapiens
uacacugaggagagauu

SEQ ID NO: 544643 - RNA, 18 nt, Homo sapiens
uacacugauacacuugaa

SEQ ID NO: 544644 - RNA, 13 nt, Homo sapiens
uacacuggucuaa

SEQ ID NO: 544645 - RNA, 12 nt, Homo sapiens
uacacugugaac

SEQ ID NO: 544646 - RNA, 20 nt, Homo sapiens
uacacuguguaaauacccau

SEQ ID NO: 544647 - RNA, 22 nt, Homo sapiens
uacacuugugcacccucuaucc

SEQ ID NO: 544648 - RNA, 23 nt, Homo sapiens
uacacuuuaugccggaugugcuu

SEQ ID NO: 544649 - RNA, 14 nt, Homo sapiens
uacacuuuguugca

SEQ ID NO: 544650 - RNA, 15 nt, Homo sapiens
uacagaaaagaaauu

SEQ ID NO: 544651 - RNA, 17 nt, Homo sapiens
uacagaaaagacucuga

SEQ ID NO: 544652 - RNA, 17 nt, Homo sapiens
uacagaaagaagcaguu

SEQ ID NO: 544653 - RNA, 21 nt, Homo sapiens
uacagaaagaagcaguucuca

SEQ ID NO: 544654 - RNA, 17 nt, Homo sapiens
uacagaaaguagugcug

SEQ ID NO: 544655 - RNA, 14 nt, Homo sapiens
uacagaaaugacug

SEQ ID NO: 544656 - RNA, 16 nt, Homo sapiens
uacagaacaagaaucu

SEQ ID NO: 544657 - RNA, 13 nt, Homo sapiens
uacagaacacauu

SEQ ID NO: 544658 - RNA, 16 nt, Homo sapiens
uacagaacucacagua

SEQ ID NO: 544659 - RNA, 14 nt, Homo sapiens
uacagaagcauuuu

SEQ ID NO: 544660 - RNA, 23 nt, Homo sapiens
uacagaaguccccucuacuuuaa

SEQ ID NO: 544661 - RNA, 20 nt, Homo sapiens
uacagaaucguuuuguacug

SEQ ID NO: 544662 - RNA, 12 nt, Homo sapiens
uacagacauaca

SEQ ID NO: 544663 - RNA, 16 nt, Homo sapiens
uacagacauuaaauaa

SEQ ID NO: 544664 - RNA, 15 nt, Homo sapiens
uacagacugaugcca

SEQ ID NO: 544665 - RNA, 18 nt, Homo sapiens
uacagacuucuccagacc

SEQ ID NO: 544666 - RNA, 18 nt, Homo sapiens
uacagagaaaagacauaa

SEQ ID NO: 544667 - RNA, 18 nt, Homo sapiens
uacagagaugcaaugaua

SEQ ID NO: 544668 - RNA, 19 nt, Homo sapiens
uacagagcacauuugucag

SEQ ID NO: 544669 - RNA, 12 nt, Homo sapiens
uacagagccaca

SEQ ID NO: 544670 - RNA, 13 nt, Homo sapiens
uacagagccacag

SEQ ID NO: 544671 - RNA, 14 nt, Homo sapiens
uacagaggucucug

SEQ ID NO: 544672 - RNA, 19 nt, Homo sapiens
uacagauagaguuccauau

SEQ ID NO: 544673 - RNA, 18 nt, Homo sapiens
uacagaucaggccuucuu

SEQ ID NO: 544674 - RNA, 22 nt, Homo sapiens
uacagaucaucuuggaacugca

SEQ ID NO: 544675 - RNA, 13 nt, Homo sapiens
uacagaugaacuc

SEQ ID NO: 544676 - RNA, 15 nt, Homo sapiens
uacagaugaaugaua

SEQ ID NO: 544677 - RNA, 23 nt, Homo sapiens
uacagauggagcaaauguccuaa

SEQ ID NO: 544678 - RNA, 14 nt, Homo sapiens
uacagauucugcua

SEQ ID NO: 544679 - RNA, 12 nt, Homo sapiens
uacagcaaaaag

SEQ ID NO: 544680 - RNA, 14 nt, Homo sapiens
uacagcagcacugu

SEQ ID NO: 544681 - RNA, 16 nt, Homo sapiens
uacagcaggugcucaa

SEQ ID NO: 544682 - RNA, 23 nt, Homo sapiens
gaaaagcuuaaaaaaauuacugu

SEQ ID NO: 544683 - RNA, 22 nt, Homo sapiens
gaaaagcuuguccaucacucua

SEQ ID NO: 544684 - RNA, 15 nt, Homo sapiens
gaaaaggaaaacaau

SEQ ID NO: 544685 - RNA, 13 nt, Homo sapiens
gaaaaggacaaau

SEQ ID NO: 544686 - RNA, 16 nt, Homo sapiens
gaaaaggauaugcagu

SEQ ID NO: 544687 - RNA, 16 nt, Homo sapiens
gaaaaggguguugcua

SEQ ID NO: 544688 - RNA, 21 nt, Homo sapiens
gaaaaggucugaggacugagc

SEQ ID NO: 544689 - RNA, 16 nt, Homo sapiens
gaaaaguacauuuaau

SEQ ID NO: 544690 - RNA, 14 nt, Homo sapiens
gaaaagugcauauu

SEQ ID NO: 544691 - RNA, 20 nt, Homo sapiens
gaaaagugcauauuuaucca

SEQ ID NO: 544692 - RNA, 23 nt, Homo sapiens
gaaaaguguccuucuugcucccc

SEQ ID NO: 544693 - RNA, 13 nt, Homo sapiens
gaaaaguucuccu

SEQ ID NO: 544694 - RNA, 17 nt, Homo sapiens
gaaaaguugggcuuuca

SEQ ID NO: 544695 - RNA, 18 nt, Homo sapiens
gaaaauaaaaaugcuaua

SEQ ID NO: 544696 - RNA, 16 nt, Homo sapiens
gaaaauaaacaucagu

SEQ ID NO: 544697 - RNA, 19 nt, Homo sapiens
gaaaauaaauucagaucaa

SEQ ID NO: 544698 - RNA, 19 nt, Homo sapiens
gaaaauagaaacuugcuua

SEQ ID NO: 544699 - RNA, 21 nt, Homo sapiens
gaaaauaggggaugguccagg

SEQ ID NO: 544700 - RNA, 15 nt, Homo sapiens
gaaaauaguguaaga

SEQ ID NO: 544701 - RNA, 14 nt, Homo sapiens
gaaaauaucuugcu

SEQ ID NO: 544702 - RNA, 15 nt, Homo sapiens
gaaaauauucuuugu

SEQ ID NO: 544703 - RNA, 21 nt, Homo sapiens
gaaaauauuuuguugccuuca

SEQ ID NO: 544704 - RNA, 12 nt, Homo sapiens
gaaaaucauauu

SEQ ID NO: 544705 - RNA, 20 nt, Homo sapiens
gaaaauccacuaugacaucu

SEQ ID NO: 544706 - RNA, 18 nt, Homo sapiens
gaaaaucgaguuggcaaa

SEQ ID NO: 544707 - RNA, 12 nt, Homo sapiens
gaaaaugaaucu

SEQ ID NO: 544708 - RNA, 22 nt, Homo sapiens
gaaaaugcagcagggaugcccu

SEQ ID NO: 544709 - RNA, 22 nt, Homo sapiens
gaaaaugccagagcuugugaac

SEQ ID NO: 544710 - RNA, 18 nt, Homo sapiens
gaaaaugcgagacucuga

SEQ ID NO: 544711 - RNA, 14 nt, Homo sapiens
gaaaauggccaugc

SEQ ID NO: 544712 - RNA, 17 nt, Homo sapiens
gaaaaugucacauucua

SEQ ID NO: 544713 - RNA, 17 nt, Homo sapiens
gaaaauguccaggaaag

SEQ ID NO: 544714 - RNA, 15 nt, Homo sapiens
gaaaaugucuuucuc

SEQ ID NO: 544715 - RNA, 12 nt, Homo sapiens
gaaaaugugcaa

SEQ ID NO: 544716 - RNA, 23 nt, Homo sapiens
gaaaauguuuugaaaagaacaaa

SEQ ID NO: 544717 - RNA, 14 nt, Homo sapiens
gaaaauuauuugca

SEQ ID NO: 544718 - RNA, 13 nt, Homo sapiens
gaaaauugcaaua

SEQ ID NO: 544719 - RNA, 18 nt, Homo sapiens
gaaaauugcacuauugca

SEQ ID NO: 544720 - RNA, 19 nt, Homo sapiens
gaaaauuggaacucuacuc

SEQ ID NO: 544721 - RNA, 22 nt, Homo sapiens
gaaaauugggcaugccauuaca

SEQ ID NO: 544722 - RNA, 19 nt, Homo sapiens
gaaaauuuaucauguuuua

SEQ ID NO: 544723 - RNA, 20 nt, Homo sapiens
gaaaauuugaaaauguccuu

SEQ ID NO: 544724 - RNA, 16 nt, Homo sapiens
gaaaauuuuacuucca

SEQ ID NO: 544725 - RNA, 18 nt, Homo sapiens
gaaaauuuuuacauucau

SEQ ID NO: 544726 - RNA, 22 nt, Homo sapiens
gaaacaaagaagguuaccaaga

SEQ ID NO: 544727 - RNA, 22 nt, Homo sapiens
gaaacaacaauuucuacuuuga

SEQ ID NO: 544728 - RNA, 23 nt, Homo sapiens
gaaacaacaauuucuacuuugaa

SEQ ID NO: 544729 - RNA, 14 nt, Homo sapiens
gaaacaacauuuau

SEQ ID NO: 544730 - RNA, 14 nt, Homo sapiens
gaaacaagauuguu

SEQ ID NO: 544731 - RNA, 14 nt, Homo sapiens
gaagagggucccuc

SEQ ID NO: 544732 - RNA, 23 nt, Homo sapiens
gaagaguguuucuuccacaacag

SEQ ID NO: 544733 - RNA, 20 nt, Homo sapiens
gaagaguuucuccuuuugac

SEQ ID NO: 544734 - RNA, 15 nt, Homo sapiens
gaagauaaacacaaa

SEQ ID NO: 544735 - RNA, 21 nt, Homo sapiens
gaagauagaugcacuuaugca

SEQ ID NO: 544736 - RNA, 21 nt, Homo sapiens
gaagaucauauacgugaaaau

SEQ ID NO: 544737 - RNA, 15 nt, Homo sapiens
gaagauccacauccu

SEQ ID NO: 544738 - RNA, 18 nt, Homo sapiens
gaagauccacauccucua

SEQ ID NO: 544739 - RNA, 23 nt, Homo sapiens
gaagauccacauccucuacaggu

SEQ ID NO: 544740 - RNA, 20 nt, Homo sapiens
gaagauccuagugaccaaau

SEQ ID NO: 544741 - RNA, 17 nt, Homo sapiens
gaagaucuugauggugu

SEQ ID NO: 544742 - RNA, 15 nt, Homo sapiens
gaagaugaacuuugu

SEQ ID NO: 544743 - RNA, 22 nt, Homo sapiens
gaagaugaauggucuggcaaua

SEQ ID NO: 544744 - RNA, 15 nt, Homo sapiens
gaagaugauaccuga

SEQ ID NO: 544745 - RNA, 13 nt, Homo sapiens
gaagaugccuuga

SEQ ID NO: 544746 - RNA, 16 nt, Homo sapiens
gaagaugggguuugua

SEQ ID NO: 544747 - RNA, 17 nt, Homo sapiens
gaagauguguaaacagg

SEQ ID NO: 544748 - RNA, 22 nt, Homo sapiens
gaagauuauuuacugacauaua

SEQ ID NO: 544749 - RNA, 17 nt, Homo sapiens
gaagauuuaugaugcac

SEQ ID NO: 544750 - RNA, 13 nt, Homo sapiens
gaagcaaaugcua

SEQ ID NO: 544751 - RNA, 18 nt, Homo sapiens
gaagcaacagcuucagaa

SEQ ID NO: 544752 - RNA, 13 nt, Homo sapiens
gaagcaagccaga

SEQ ID NO: 544753 - RNA, 17 nt, Homo sapiens
gaagcaauuuguugcug

SEQ ID NO: 544754 - RNA, 20 nt, Homo sapiens
gaagcaauuuguugcugcuu

SEQ ID NO: 544755 - RNA, 18 nt, Homo sapiens
gaagcacagcuccugcca

SEQ ID NO: 544756 - RNA, 12 nt, Homo sapiens
gaagcacuacac

SEQ ID NO: 544757 - RNA, 23 nt, Homo sapiens
gaagcacuccucgguacucccau

SEQ ID NO: 544758 - RNA, 13 nt, Homo sapiens
gaagcacugagca

SEQ ID NO: 544759 - RNA, 18 nt, Homo sapiens
gaagcagacuuuucagaa

SEQ ID NO: 544760 - RNA, 13 nt, Homo sapiens
gaagcagcacugu

SEQ ID NO: 544761 - RNA, 15 nt, Homo sapiens
gaagcagcacuguga

SEQ ID NO: 544762 - RNA, 16 nt, Homo sapiens
gaagcagccucagagu

SEQ ID NO: 544763 - RNA, 20 nt, Homo sapiens
gaagcagguucuugauguca

SEQ ID NO: 544764 - RNA, 19 nt, Homo sapiens
gaagcagugccuuccauaa

SEQ ID NO: 544765 - RNA, 19 nt, Homo sapiens
gaagcauauuuugcugguu

SEQ ID NO: 544766 - RNA, 21 nt, Homo sapiens
gaagcaucacauaaaaaugau

SEQ ID NO: 544767 - RNA, 18 nt, Homo sapiens
gaagcaucauuuccccaa

SEQ ID NO: 544768 - RNA, 16 nt, Homo sapiens
gaagcauccugugcug

SEQ ID NO: 544769 - RNA, 20 nt, Homo sapiens
gaagcaugaauaacauuuaa

SEQ ID NO: 544770 - RNA, 19 nt, Homo sapiens
gaagcaugcuuugcugcua

SEQ ID NO: 544771 - RNA, 13 nt, Homo sapiens
gaagccacagacu

SEQ ID NO: 544772 - RNA, 15 nt, Homo sapiens
gaagccacagacucu

SEQ ID NO: 544773 - RNA, 15 nt, Homo sapiens
gaagccaccuuccca

SEQ ID NO: 544774 - RNA, 20 nt, Homo sapiens
gaagccacuauuacugggac

SEQ ID NO: 544775 - RNA, 19 nt, Homo sapiens
gaagccaguggagcugguc

SEQ ID NO: 544776 - RNA, 14 nt, Homo sapiens
gaagccccacuuga

SEQ ID NO: 544777 - RNA, 19 nt, Homo sapiens
gaagcccccucuuccuccc

SEQ ID NO: 544778 - RNA, 14 nt, Homo sapiens
gaagccccgucucu

SEQ ID NO: 544779 - RNA, 20 nt, Homo sapiens
gaagccccuacccugugagc

SEQ ID NO: 544780 - RNA, 22 nt, Homo sapiens
gaagccuccguggaacauucug

SEQ ID NO: 544781 - RNA, 14 nt, Homo sapiens
gaagccugcugauu

SEQ ID NO: 544782 - RNA, 12 nt, Homo sapiens
gaagccuguccu

SEQ ID NO: 544783 - RNA, 16 nt, Homo sapiens
gaagccuguccucacc

SEQ ID NO: 544784 - RNA, 19 nt, Homo sapiens
gaagccuucagcuccaggg

SEQ ID NO: 544785 - RNA, 18 nt, Homo sapiens
gaagccuugcugaacuaa

SEQ ID NO: 544786 - RNA, 17 nt, Homo sapiens
gaagcgagauguguggc

SEQ ID NO: 544787 - RNA, 21 nt, Homo sapiens
gaagcuaaugaacucuuucaa

SEQ ID NO: 544788 - RNA, 18 nt, Homo sapiens
gaagcuacuucuccacug

SEQ ID NO: 544789 - RNA, 20 nt, Homo sapiens
gaagcuagugaccaucuuca

SEQ ID NO: 544790 - RNA, 22 nt, Homo sapiens
gaagcuccggauggaggccagc

SEQ ID NO: 544791 - RNA, 18 nt, Homo sapiens
gaagcucgcauccagaca

SEQ ID NO: 544792 - RNA, 16 nt, Homo sapiens
gaagcucuucuuccca

SEQ ID NO: 544793 - RNA, 15 nt, Homo sapiens
gaagcugaaaugcag

SEQ ID NO: 544794 - RNA, 22 nt, Homo sapiens
gaagcugaggccuaugcagaca

SEQ ID NO: 544795 - RNA, 16 nt, Homo sapiens
gaagcuggccugagag

SEQ ID NO: 544796 - RNA, 22 nt, Homo sapiens
gaagcuggggaggagcuuuguu

SEQ ID NO: 544797 - RNA, 14 nt, Homo sapiens
gaagcuggugaaag

SEQ ID NO: 544798 - RNA, 16 nt, Homo sapiens
gaagcuggugcgcccu

SEQ ID NO: 544799 - RNA, 19 nt, Homo sapiens
gaagcuuaaaaucugugaa

SEQ ID NO: 544800 - RNA, 17 nt, Homo sapiens
gaagcuucuaauuagau

SEQ ID NO: 544801 - RNA, 15 nt, Homo sapiens
gaaggaaaagcaaga

SEQ ID NO: 544802 - RNA, 15 nt, Homo sapiens
gaaggaaaaugggga

SEQ ID NO: 544803 - RNA, 16 nt, Homo sapiens
gaaggaaauaacauug

SEQ ID NO: 544804 - RNA, 19 nt, Homo sapiens
gaaggaacucuggcuucca

SEQ ID NO: 544805 - RNA, 13 nt, Homo sapiens
gaaggaagugaag

SEQ ID NO: 544806 - RNA, 18 nt, Homo sapiens
gaaggacacagugaugaa

SEQ ID NO: 544807 - RNA, 21 nt, Homo sapiens
gaaggacuaugaaaagcuaga

SEQ ID NO: 544808 - RNA, 23 nt, Homo sapiens
gaaggagccacgugaauggcccu

SEQ ID NO: 544809 - RNA, 14 nt, Homo sapiens
gaaggagcuuucau

SEQ ID NO: 544810 - RNA, 16 nt, Homo sapiens
gaaggauguuuagcag

SEQ ID NO: 544811 - RNA, 16 nt, Homo sapiens
gaaggcaaaagaaaga

SEQ ID NO: 544812 - RNA, 14 nt, Homo sapiens
uagaaaauucauaa

SEQ ID NO: 544813 - RNA, 15 nt, Homo sapiens
uagaaacaauacugu

SEQ ID NO: 544814 - RNA, 15 nt, Homo sapiens
uagaaacauuguaaa

SEQ ID NO: 544815 - RNA, 17 nt, Homo sapiens
uagaaacuauuggugcu

SEQ ID NO: 544816 - RNA, 20 nt, Homo sapiens
uagaaagaaggacccagaac

SEQ ID NO: 544817 - RNA, 16 nt, Homo sapiens
uagaaagaccacuggc

SEQ ID NO: 544818 - RNA, 22 nt, Homo sapiens
uagaaagacuacauguuacuaa

SEQ ID NO: 544819 - RNA, 13 nt, Homo sapiens
uagaaagaugaca

SEQ ID NO: 544820 - RNA, 22 nt, Homo sapiens
uagaaagauggggcauauucau

SEQ ID NO: 544821 - RNA, 20 nt, Homo sapiens
uagaaagcuggcaacaugaa

SEQ ID NO: 544822 - RNA, 17 nt, Homo sapiens
uagaaaggaacugcaau

SEQ ID NO: 544823 - RNA, 22 nt, Homo sapiens
uagaaaggaagccuugcucauu

SEQ ID NO: 544824 - RNA, 13 nt, Homo sapiens
uagaaaguagcca

SEQ ID NO: 544825 - RNA, 15 nt, Homo sapiens
uagaaauaaugguca

SEQ ID NO: 544826 - RNA, 19 nt, Homo sapiens
uagaaauacccaacgcaca

SEQ ID NO: 544827 - RNA, 19 nt, Homo sapiens
uagaaaucaggccuugcuu

SEQ ID NO: 544828 - RNA, 18 nt, Homo sapiens
uagaaaugaccaauauua

SEQ ID NO: 544829 - RNA, 14 nt, Homo sapiens
uagaaaugagccag

SEQ ID NO: 544830 - RNA, 13 nt, Homo sapiens
uagaaauggauuu

SEQ ID NO: 544831 - RNA, 17 nt, Homo sapiens
uagaaauguaaacugcc

SEQ ID NO: 544832 - RNA, 22 nt, Homo sapiens
uagaaauuaacaaaugugcugc

SEQ ID NO: 544833 - RNA, 22 nt, Homo sapiens
uagaaauuauauuuuagccuuu

SEQ ID NO: 544834 - RNA, 22 nt, Homo sapiens
uagaacaaaggacagaguauga

SEQ ID NO: 544835 - RNA, 17 nt, Homo sapiens
uagaacaacgccuguca

SEQ ID NO: 544836 - RNA, 18 nt, Homo sapiens
uagaacaacgccugucac

SEQ ID NO: 544837 - RNA, 17 nt, Homo sapiens
uagaacaccugccuucu

SEQ ID NO: 544838 - RNA, 19 nt, Homo sapiens
uagaacacugccucugagu

SEQ ID NO: 544839 - RNA, 20 nt, Homo sapiens
uagaacaugugucuaucugc

SEQ ID NO: 544840 - RNA, 23 nt, Homo sapiens
uagaacauucacuuuuguuaaca

SEQ ID NO: 544841 - RNA, 11 nt, Homo sapiens
uagaaccagcc

SEQ ID NO: 544842 - RNA, 20 nt, Homo sapiens
uagaacggaauguguggggu

SEQ ID NO: 544843 - RNA, 16 nt, Homo sapiens
uagaacuaucugcauu

SEQ ID NO: 544844 - RNA, 18 nt, Homo sapiens
uagaacucuccaucuuau

SEQ ID NO: 544845 - RNA, 19 nt, Homo sapiens
uagaacuucauggaucaga

SEQ ID NO: 544846 - RNA, 19 nt, Homo sapiens
uagaacuugcagcugaugu

SEQ ID NO: 544847 - RNA, 22 nt, Homo sapiens
uagaagaaaagcccauuuucaa

SEQ ID NO: 544848 - RNA, 14 nt, Homo sapiens
uagaagacugucag

SEQ ID NO: 544849 - RNA, 18 nt, Homo sapiens
uagaagagaaaugcugcu

SEQ ID NO: 544850 - RNA, 19 nt, Homo sapiens
uagaagagauuucuaaaag

SEQ ID NO: 544851 - RNA, 21 nt, Homo sapiens
uagaagaggguuuuagguaga

SEQ ID NO: 544852 - RNA, 16 nt, Homo sapiens
gagaaugagaagggaa

SEQ ID NO: 544853 - RNA, 15 nt, Homo sapiens
gagaaugucacugua

SEQ ID NO: 544854 - RNA, 16 nt, Homo sapiens
gagaauguuguauuca

SEQ ID NO: 544855 - RNA, 18 nt, Homo sapiens
gagaauucacagaaccua

SEQ ID NO: 544856 - RNA, 20 nt, Homo sapiens
gagaauugugcuuucaccag

SEQ ID NO: 544857 - RNA, 21 nt, Homo sapiens
gagaauuuacgagcagggaug

SEQ ID NO: 544858 - RNA, 19 nt, Homo sapiens
gagacaauguuuucuucaa

SEQ ID NO: 544859 - RNA, 16 nt, Homo sapiens
gagacacauugccuuc

SEQ ID NO: 544860 - RNA, 18 nt, Homo sapiens
gagacaccacaaggcagc

SEQ ID NO: 544861 - RNA, 22 nt, Homo sapiens
gagacagaagccuggacucugc

SEQ ID NO: 544862 - RNA, 14 nt, Homo sapiens
gagacagauaacuc

SEQ ID NO: 544863 - RNA, 15 nt, Homo sapiens
gagacagauaccucc

SEQ ID NO: 544864 - RNA, 19 nt, Homo sapiens
gagacagauauacugggag

SEQ ID NO: 544865 - RNA, 23 nt, Homo sapiens
gagacagauauacugggagaaau

SEQ ID NO: 544866 - RNA, 22 nt, Homo sapiens
gagacagcugauacuucauuua

SEQ ID NO: 544867 - RNA, 15 nt, Homo sapiens
gagacaggcaaacug

SEQ ID NO: 544868 - RNA, 20 nt, Homo sapiens
gagacaggcaccccucccag

SEQ ID NO: 544869 - RNA, 14 nt, Homo sapiens
gagacaguucaaga

SEQ ID NO: 544870 - RNA, 16 nt, Homo sapiens
gagacauaucacucaa

SEQ ID NO: 544871 - RNA, 15 nt, Homo sapiens
gagacccaacagcag

SEQ ID NO: 544872 - RNA, 21 nt, Homo sapiens
gagaccccaggaacaauaaaa

SEQ ID NO: 544873 - RNA, 23 nt, Homo sapiens
gagacccguagaugccagggcug

SEQ ID NO: 544874 - RNA, 14 nt, Homo sapiens
gagacccucucagc

SEQ ID NO: 544875 - RNA, 13 nt, Homo sapiens
gagacccugccac

SEQ ID NO: 544876 - RNA, 15 nt, Homo sapiens
gagaccuuggcugcu

SEQ ID NO: 544877 - RNA, 23 nt, Homo sapiens
gagaccuuugaugaauucuuccu

SEQ ID NO: 544878 - RNA, 15 nt, Homo sapiens
gagacgcacacagcu

SEQ ID NO: 544879 - RNA, 14 nt, Homo sapiens
gagacgcaggaaug

SEQ ID NO: 544880 - RNA, 14 nt, Homo sapiens
gagacgccauguga

SEQ ID NO: 544881 - RNA, 23 nt, Homo sapiens
gagacucagggccccagcacuaa

SEQ ID NO: 544882 - RNA, 15 nt, Homo sapiens
gagacuccaccucaa

SEQ ID NO: 544883 - RNA, 22 nt, Homo sapiens
gagacuccacucaggugcacac

SEQ ID NO: 544884 - RNA, 12 nt, Homo sapiens
gagacucuaggg

SEQ ID NO: 544885 - RNA, 16 nt, Homo sapiens
gagacucuagggucca

SEQ ID NO: 544886 - RNA, 18 nt, Homo sapiens
gagacucuaggguccagu

SEQ ID NO: 544887 - RNA, 17 nt, Homo sapiens
gagacugcaggggucca

SEQ ID NO: 544888 - RNA, 14 nt, Homo sapiens
gagacugcgggaug

SEQ ID NO: 544889 - RNA, 17 nt, Homo sapiens
gagacuggaccgcugac

SEQ ID NO: 544890 - RNA, 14 nt, Homo sapiens
gagacugggagcca

SEQ ID NO: 544891 - RNA, 22 nt, Homo sapiens
gagacugggagccacuucuccc

SEQ ID NO: 544892 - RNA, 17 nt, Homo sapiens
gagacuguagauugcuu

SEQ ID NO: 544893 - RNA, 14 nt, Homo sapiens
gagacuuggggcca

SEQ ID NO: 544894 - RNA, 20 nt, Homo sapiens
gagacuuucuucuagugcuu

SEQ ID NO: 544895 - RNA, 21 nt, Homo sapiens
gagacuuucuucuagugcuuu

SEQ ID NO: 544896 - RNA, 13 nt, Homo sapiens
gagagacccaagg

SEQ ID NO: 544897 - RNA, 21 nt, Homo sapiens
gagagagcuagagggacaaag

SEQ ID NO: 544898 - RNA, 13 nt, Homo sapiens
gagagagggcaaa

SEQ ID NO: 544899 - RNA, 19 nt, Homo sapiens
gagagagucuuacucugcc

SEQ ID NO: 544900 - RNA, 16 nt, Homo sapiens
gagagcaaaugcuauu

SEQ ID NO: 544901 - RNA, 20 nt, Homo sapiens
gagagcacuagaagugguuu

SEQ ID NO: 544902 - RNA, 16 nt, Homo sapiens
gagagcaggcuggcag

SEQ ID NO: 544903 - RNA, 19 nt, Homo sapiens
gagagcccacugcaguuag

SEQ ID NO: 544904 - RNA, 22 nt, Homo sapiens
gagagcccggcgccccugccac

SEQ ID NO: 544905 - RNA, 23 nt, Homo sapiens
gagagcccugggcuggaggcuga

SEQ ID NO: 544906 - RNA, 19 nt, Homo sapiens
gagagcggggaugugacau

SEQ ID NO: 544907 - RNA, 14 nt, Homo sapiens
gagagcuguauuaa

SEQ ID NO: 544908 - RNA, 22 nt, Homo sapiens
gagaggaaagaccuacauuccc

SEQ ID NO: 544909 - RNA, 13 nt, Homo sapiens
gagaggaacccag

SEQ ID NO: 544910 - RNA, 15 nt, Homo sapiens
gagaggaugugcaag

SEQ ID NO: 544911 - RNA, 22 nt, Homo sapiens
gagaggcagcuaucugcacucu

SEQ ID NO: 544912 - RNA, 16 nt, Homo sapiens
gagaggcaggcauaga

SEQ ID NO: 544913 - RNA, 21 nt, Homo sapiens
gagaggccuggagcccacaac

SEQ ID NO: 544914 - RNA, 16 nt, Homo sapiens
gagaggcgucugcugu

SEQ ID NO: 544915 - RNA, 15 nt, Homo sapiens
gagaggcucugagaa

SEQ ID NO: 544916 - RNA, 19 nt, Homo sapiens
gagaggcugggaauggagg

SEQ ID NO: 544917 - RNA, 19 nt, Homo sapiens
gagagggaccaugugucac

SEQ ID NO: 544918 - RNA, 15 nt, Homo sapiens
gagagggacuggcag

SEQ ID NO: 544919 - RNA, 18 nt, Homo sapiens
gagagggaggucacugga

SEQ ID NO: 544920 - RNA, 15 nt, Homo sapiens
gagagggcacaucuc

SEQ ID NO: 544921 - RNA, 18 nt, Homo sapiens
gagaggggacucaaacag

SEQ ID NO: 544922 - RNA, 20 nt, Homo sapiens
gagagggggcucuccaaagg

SEQ ID NO: 544923 - RNA, 13 nt, Homo sapiens
gagagggugacaa

SEQ ID NO: 544924 - RNA, 16 nt, Homo sapiens
gagagggugacaagau

SEQ ID NO: 544925 - RNA, 20 nt, Homo sapiens
gagaggugccagcaacugaa

SEQ ID NO: 544926 - RNA, 17 nt, Homo sapiens
gagaguaauggguuuca

SEQ ID NO: 544927 - RNA, 20 nt, Homo sapiens
gagaguccagugaguccagg

SEQ ID NO: 544928 - RNA, 18 nt, Homo sapiens
gagagucccagagcucau

SEQ ID NO: 544929 - RNA, 20 nt, Homo sapiens
gagaguccucuggauggcac

SEQ ID NO: 544930 - RNA, 16 nt, Homo sapiens
gagaguggcuccuccc

SEQ ID NO: 544931 - RNA, 12 nt, Homo sapiens
gagagugugcuc

SEQ ID NO: 544932 - RNA, 14 nt, Homo sapiens
gagaguuccuucuc

SEQ ID NO: 544933 - RNA, 20 nt, Homo sapiens
gagauaacagccucuugccc

SEQ ID NO: 544934 - RNA, 15 nt, Homo sapiens
gagauaauuguuuca

SEQ ID NO: 544935 - RNA, 17 nt, Homo sapiens
gagauagcauugugaac

SEQ ID NO: 544936 - RNA, 13 nt, Homo sapiens
gagauagggaaaa

SEQ ID NO: 544937 - RNA, 15 nt, Homo sapiens
gagauagugcuggaa

SEQ ID NO: 544938 - RNA, 13 nt, Homo sapiens
gagauauuuacau

SEQ ID NO: 544939 - RNA, 20 nt, Homo sapiens
gagaucacgccacugcacuc

SEQ ID NO: 544940 - RNA, 22 nt, Homo sapiens
gagaucacgucacugcacucca

SEQ ID NO: 544941 - RNA, 12 nt, Homo sapiens
gagaucaugcca

SEQ ID NO: 544942 - RNA, 21 nt, Homo sapiens
gagaucaugccacuacacucc

SEQ ID NO: 544943 - RNA, 11 nt, Homo sapiens
gagauccuccu

SEQ ID NO: 544944 - RNA, 23 nt, Homo sapiens
gagauccuuuagugcacccagug

SEQ ID NO: 544945 - RNA, 20 nt, Homo sapiens
gagaucgcaucauugcacuc

SEQ ID NO: 544946 - RNA, 21 nt, Homo sapiens
gagaucgcgccauugcacucc

SEQ ID NO: 544947 - RNA, 19 nt, Homo sapiens
gagaucgugcuacugcacu

SEQ ID NO: 544948 - RNA, 16 nt, Homo sapiens
gagaucguuguuuaca

SEQ ID NO: 544949 - RNA, 21 nt, Homo sapiens
gagaucuaaggaugucacagg

SEQ ID NO: 544950 - RNA, 15 nt, Homo sapiens
gagaugaccagggau

SEQ ID NO: 544951 - RNA, 12 nt, Homo sapiens
gagaugauuucc

SEQ ID NO: 544952 - RNA, 18 nt, Homo sapiens
gagaugcagcuacuggaa

SEQ ID NO: 544953 - RNA, 12 nt, Homo sapiens
gagaugcagcug

SEQ ID NO: 544954 - RNA, 16 nt, Homo sapiens
gagaugcagucacuua

SEQ ID NO: 544955 - RNA, 22 nt, Homo sapiens
gagaugccacuucucacucacc

SEQ ID NO: 544956 - RNA, 20 nt, Homo sapiens
gagaugcuucucuccuugcc

SEQ ID NO: 544957 - RNA, 20 nt, Homo sapiens
gagauggaaguugcagugag

SEQ ID NO: 544958 - RNA, 22 nt, Homo sapiens
gagauggagucuugcucuguca

SEQ ID NO: 544959 - RNA, 15 nt, Homo sapiens
gagauggccaugcuc

SEQ ID NO: 544960 - RNA, 23 nt, Homo sapiens
gagauggccuggggaagcuguga

SEQ ID NO: 544961 - RNA, 21 nt, Homo sapiens
gagaugggggcuucuuccuca

SEQ ID NO: 544962 - RNA, 13 nt, Homo sapiens
gagauguacugca

SEQ ID NO: 544963 - RNA, 21 nt, Homo sapiens
gagauguucgcucgugcagua

SEQ ID NO: 544964 - RNA, 15 nt, Homo sapiens
gagauguuugccaaa

SEQ ID NO: 544965 - RNA, 17 nt, Homo sapiens
gagauuaccuccugaga

SEQ ID NO: 544966 - RNA, 18 nt, Homo sapiens
gagauuacuuugcugccu

SEQ ID NO: 544967 - RNA, 21 nt, Homo sapiens
gagauuccaguuuacaaucac

SEQ ID NO: 544968 - RNA, 16 nt, Homo sapiens
gagauucugugaucuu

SEQ ID NO: 544969 - RNA, 20 nt, Homo sapiens
gagauugagcagaagaucaa

SEQ ID NO: 544970 - RNA, 22 nt, Homo sapiens
gagauugcacuauugcacucca

SEQ ID NO: 544971 - RNA, 14 nt, Homo sapiens
gagauugcacugcu

SEQ ID NO: 544972 - RNA, 21 nt, Homo sapiens
gagauugcgccauugcacucc

SEQ ID NO: 544973 - RNA, 22 nt, Homo sapiens
gagauuggccagugagaagcug

SEQ ID NO: 544974 - RNA, 16 nt, Homo sapiens
gagcugauacuuugac

SEQ ID NO: 544975 - RNA, 15 nt, Homo sapiens
gagcugcacugauca

SEQ ID NO: 544976 - RNA, 17 nt, Homo sapiens
gagcugcucucucauga

SEQ ID NO: 544977 - RNA, 17 nt, Homo sapiens
gagcugcucugcuauau

SEQ ID NO: 544978 - RNA, 14 nt, Homo sapiens
gagcuggaucucuc

SEQ ID NO: 544979 - RNA, 17 nt, Homo sapiens
gagcuggccuccuaugc

SEQ ID NO: 544980 - RNA, 20 nt, Homo sapiens
gagcuggccucucuagcaca

SEQ ID NO: 544981 - RNA, 23 nt, Homo sapiens
gagcugggaguagcauggacucu

SEQ ID NO: 544982 - RNA, 18 nt, Homo sapiens
gagcuguaaaaauguuac

SEQ ID NO: 544983 - RNA, 11 nt, Homo sapiens
gagcugugcag

SEQ ID NO: 544984 - RNA, 17 nt, Homo sapiens
gagcuguguucuugcca

SEQ ID NO: 544985 - RNA, 21 nt, Homo sapiens
gagcuuaaagauaguuacaaa

SEQ ID NO: 544986 - RNA, 19 nt, Homo sapiens
gagcuuagccuugugcccu

SEQ ID NO: 544987 - RNA, 19 nt, Homo sapiens
gagcuuccaaaugugucag

SEQ ID NO: 544988 - RNA, 19 nt, Homo sapiens
gagcuugcaugcuugcaua

SEQ ID NO: 544989 - RNA, 14 nt, Homo sapiens
gagcuuucugcuau

SEQ ID NO: 544990 - RNA, 20 nt, Homo sapiens
gagcuuugaaagcagucacu

SEQ ID NO: 544991 - RNA, 18 nt, Homo sapiens
gaggaaaaaagaaccaaa

SEQ ID NO: 544992 - RNA, 15 nt, Homo sapiens
gaggaaauucuuucc

SEQ ID NO: 544993 - RNA, 14 nt, Homo sapiens
gaggaacacugcac

SEQ ID NO: 544994 - RNA, 17 nt, Homo sapiens
gaggaacacugcacucu

SEQ ID NO: 544995 - RNA, 13 nt, Homo sapiens
gaggaacccaaga

SEQ ID NO: 544996 - RNA, 18 nt, Homo sapiens
gaggaacuguccagagag

SEQ ID NO: 544997 - RNA, 22 nt, Homo sapiens
gaggaagaacuacagcucuuaa

SEQ ID NO: 544998 - RNA, 17 nt, Homo sapiens
gaggaagacaggcaaau

SEQ ID NO: 544999 - RNA, 16 nt, Homo sapiens
gaggaagcccaggcuc

SEQ ID NO: 545000 - RNA, 13 nt, Homo sapiens
gaggaagccucua

SEQ ID NO: 545001 - RNA, 13 nt, Homo sapiens
gaggaaguuuugu

SEQ ID NO: 545002 - RNA, 18 nt, Homo sapiens
gaggaaguuuugucuaau

SEQ ID NO: 545003 - RNA, 22 nt, Homo sapiens
gaggacaagggaaaugucaggg

SEQ ID NO: 545004 - RNA, 17 nt, Homo sapiens
gaggacaauacuggggu

SEQ ID NO: 545005 - RNA, 21 nt, Homo sapiens
gaggacagagcaggggcucca

SEQ ID NO: 545006 - RNA, 13 nt, Homo sapiens
gaggacucaccac

SEQ ID NO: 545007 - RNA, 18 nt, Homo sapiens
gaggacucuauucuuuaa

SEQ ID NO: 545008 - RNA, 22 nt, Homo sapiens
gaggacuguccucccacagacc

SEQ ID NO: 545009 - RNA, 18 nt, Homo sapiens
gaggacuuugauugcaca

SEQ ID NO: 545010 - RNA, 16 nt, Homo sapiens
gaggagaagcaauggg

SEQ ID NO: 545011 - RNA, 23 nt, Homo sapiens
gaggagcaagguuuaaauuuguu

SEQ ID NO: 545012 - RNA, 20 nt, Homo sapiens
gaggagcaccuccgccagau

SEQ ID NO: 545013 - RNA, 23 nt, Homo sapiens
gaggagcaguguggggggacaga

SEQ ID NO: 545014 - RNA, 16 nt, Homo sapiens
gaggagcuggaaccau

SEQ ID NO: 545015 - RNA, 16 nt, Homo sapiens
gaggagggaggccagg

SEQ ID NO: 545016 - RNA, 14 nt, Homo sapiens
gaggagguucacug

SEQ ID NO: 545017 - RNA, 13 nt, Homo sapiens
gaggaguaacaau

SEQ ID NO: 545018 - RNA, 14 nt, Homo sapiens
gaggaguaauggca

SEQ ID NO: 545019 - RNA, 20 nt, Homo sapiens
gaggagucucaacauguguu

SEQ ID NO: 545020 - RNA, 14 nt, Homo sapiens
gaggaguuccuuga

SEQ ID NO: 545021 - RNA, 22 nt, Homo sapiens
gaggaugaauguaugugcacug

SEQ ID NO: 545022 - RNA, 19 nt, Homo sapiens
gaggaugaugccaguuacu

SEQ ID NO: 545023 - RNA, 14 nt, Homo sapiens
gaggauguggcugu

SEQ ID NO: 545024 - RNA, 18 nt, Homo sapiens
gaggauugcuaucuggag

SEQ ID NO: 545025 - RNA, 20 nt, Homo sapiens
gaggcaagaaaaggacaaau

SEQ ID NO: 545026 - RNA, 20 nt, Homo sapiens
gaggcaagagaauugcuuga

SEQ ID NO: 545027 - RNA, 12 nt, Homo sapiens
gaggcaccucca

SEQ ID NO: 545028 - RNA, 23 nt, Homo sapiens
gaggcacugggaagccuagagaa

SEQ ID NO: 545029 - RNA, 18 nt, Homo sapiens
gaggcagacagcagcuca

SEQ ID NO: 545030 - RNA, 18 nt, Homo sapiens
gaggcagagguugcagug

SEQ ID NO: 545031 - RNA, 20 nt, Homo sapiens
gaggcagagguugcagugag

SEQ ID NO: 545032 - RNA, 21 nt, Homo sapiens
gaggcagauaagaaggugcga

SEQ ID NO: 545033 - RNA, 20 nt, Homo sapiens
gaggcaggagaaucacuuga

SEQ ID NO: 545034 - RNA, 20 nt, Homo sapiens
gaggcaggagaauggcguga

SEQ ID NO: 545035 - RNA, 20 nt, Homo sapiens
gaggcaggagaauugcugga

SEQ ID NO: 545036 - RNA, 18 nt, Homo sapiens
gaggcaggagaauugcuu

SEQ ID NO: 545037 - RNA, 12 nt, Homo sapiens
gaggcaggugag

SEQ ID NO: 545038 - RNA, 13 nt, Homo sapiens
gaggcaucaguug

SEQ ID NO: 545039 - RNA, 21 nt, Homo sapiens
gaggcaugguguguggugcua

SEQ ID NO: 545040 - RNA, 20 nt, Homo sapiens
gaggccaaggugggcggauc

SEQ ID NO: 545041 - RNA, 16 nt, Homo sapiens
gaggccacacucagca

SEQ ID NO: 545042 - RNA, 16 nt, Homo sapiens
gaggccaccucuccaa

SEQ ID NO: 545043 - RNA, 18 nt, Homo sapiens
gaggccaggcagauccca

SEQ ID NO: 545044 - RNA, 21 nt, Homo sapiens
gaggccagggcagcaagggac

SEQ ID NO: 545045 - RNA, 19 nt, Homo sapiens
gaggccaguaccuuuccau

SEQ ID NO: 545046 - RNA, 23 nt, Homo sapiens
gaggccauccaagauggcaugaa

SEQ ID NO: 545047 - RNA, 10 nt, Homo sapiens
gaggcccaaa

SEQ ID NO: 545048 - RNA, 23 nt, Homo sapiens
gaggccuaugcagacaucucugg

SEQ ID NO: 545049 - RNA, 13 nt, Homo sapiens
gaggccucaccau

SEQ ID NO: 545050 - RNA, 13 nt, Homo sapiens
gaggccucucuca

SEQ ID NO: 545051 - RNA, 16 nt, Homo sapiens
gaggccucucucagga

SEQ ID NO: 545052 - RNA, 17 nt, Homo sapiens
gaggccucucucaggag

SEQ ID NO: 545053 - RNA, 20 nt, Homo sapiens
gaggccugcauguccggcug

SEQ ID NO: 545054 - RNA, 21 nt, Homo sapiens
gaggcgcugcugguguucuua

SEQ ID NO: 545055 - RNA, 14 nt, Homo sapiens
gaggcuacagcaga

SEQ ID NO: 545056 - RNA, 22 nt, Homo sapiens
gaggcuauggaggguccuccuc

SEQ ID NO: 545057 - RNA, 21 nt, Homo sapiens
gaggcucagggaaaggccagu

SEQ ID NO: 545058 - RNA, 19 nt, Homo sapiens
gaggcucccaaucagcuuu

SEQ ID NO: 545059 - RNA, 18 nt, Homo sapiens
gaggcuccggauguuucu

SEQ ID NO: 545060 - RNA, 19 nt, Homo sapiens
gaggcucugucacugagca

SEQ ID NO: 545061 - RNA, 13 nt, Homo sapiens
gaggcucuucagu

SEQ ID NO: 545062 - RNA, 14 nt, Homo sapiens
gaggcugcacugga

SEQ ID NO: 545063 - RNA, 19 nt, Homo sapiens
gaggcuggguucauuugug

SEQ ID NO: 545064 - RNA, 22 nt, Homo sapiens
gaggcuucugauacguguauga

SEQ ID NO: 545065 - RNA, 20 nt, Homo sapiens
gaggcuugccccacccaaca

SEQ ID NO: 545066 - RNA, 12 nt, Homo sapiens
gaggcuuggaaa

SEQ ID NO: 545067 - RNA, 20 nt, Homo sapiens
gaggcuuugggagcaaaaua

SEQ ID NO: 545068 - RNA, 14 nt, Homo sapiens
gagggaaaaugagu

SEQ ID NO: 545069 - RNA, 17 nt, Homo sapiens
cucaaaugcacaucuca

SEQ ID NO: 545070 - RNA, 18 nt, Homo sapiens
cucaaccaaugccaaaaa

SEQ ID NO: 545071 - RNA, 18 nt, Homo sapiens
cucaaccuaacacauuaa

SEQ ID NO: 545072 - RNA, 15 nt, Homo sapiens
cucaacucacagcuu

SEQ ID NO: 545073 - RNA, 15 nt, Homo sapiens
cucaacuguuuucau

SEQ ID NO: 545074 - RNA, 17 nt, Homo sapiens
cucaacuuuaagauaga

SEQ ID NO: 545075 - RNA, 23 nt, Homo sapiens
cucaagaaauaaaaggaagccaa

SEQ ID NO: 545076 - RNA, 15 nt, Homo sapiens
cucaagaaaucaaaa

SEQ ID NO: 545077 - RNA, 15 nt, Homo sapiens
cucaagaauaaaaua

SEQ ID NO: 545078 - RNA, 14 nt, Homo sapiens
cucaagcaauauua

SEQ ID NO: 545079 - RNA, 18 nt, Homo sapiens
cucaagcccgcggggaca

SEQ ID NO: 545080 - RNA, 23 nt, Homo sapiens
cucaagcccgcggggacauuggg

SEQ ID NO: 545081 - RNA, 21 nt, Homo sapiens
cucaaggcugugcaggcacau

SEQ ID NO: 545082 - RNA, 20 nt, Homo sapiens
cucaagugagccaagaaaca

SEQ ID NO: 545083 - RNA, 15 nt, Homo sapiens
cuguggucacaguga

SEQ ID NO: 545084 - RNA, 19 nt, Homo sapiens
cuguggugccucucuuggc

SEQ ID NO: 545085 - RNA, 16 nt, Homo sapiens
cugugguggucugugu

SEQ ID NO: 545086 - RNA, 20 nt, Homo sapiens
cugugguuccucugcucacc

SEQ ID NO: 545087 - RNA, 22 nt, Homo sapiens
cuguguaaaacuauauucucag

SEQ ID NO: 545088 - RNA, 19 nt, Homo sapiens
cuguguaagcucacaucca

SEQ ID NO: 545089 - RNA, 22 nt, Homo sapiens
cuguguacagaauucugcuacc

SEQ ID NO: 545090 - RNA, 15 nt, Homo sapiens
cuguguacuuuucaa

SEQ ID NO: 545091 - RNA, 18 nt, Homo sapiens
cuguguagacuauuugcu

SEQ ID NO: 545092 - RNA, 19 nt, Homo sapiens
cuguguagagaaugucacu

SEQ ID NO: 545093 - RNA, 14 nt, Homo sapiens
cuguguagcucuca

SEQ ID NO: 545094 - RNA, 19 nt, Homo sapiens
cuguguauguuuuauauca

SEQ ID NO: 545095 - RNA, 13 nt, Homo sapiens
cuguguauuccaa

SEQ ID NO: 545096 - RNA, 15 nt, Homo sapiens
cuguguauucuaguu

SEQ ID NO: 545097 - RNA, 22 nt, Homo sapiens
cuguguauuuucagucaaaacu

SEQ ID NO: 545098 - RNA, 19 nt, Homo sapiens
cugugucagcgggugcacc

SEQ ID NO: 545099 - RNA, 19 nt, Homo sapiens
cugugucaguggaugcugc

SEQ ID NO: 545100 - RNA, 14 nt, Homo sapiens
cugugucauuccaa

SEQ ID NO: 545101 - RNA, 22 nt, Homo sapiens
cugugucauucuguuagauacu

SEQ ID NO: 545102 - RNA, 15 nt, Homo sapiens
cugugucguagccaa

SEQ ID NO: 545103 - RNA, 19 nt, Homo sapiens
cugugucugccugucccca

SEQ ID NO: 545104 - RNA, 18 nt, Homo sapiens
cugugucuggcguucuca

SEQ ID NO: 545105 - RNA, 13 nt, Homo sapiens
cugugucugugua

SEQ ID NO: 545106 - RNA, 14 nt, Homo sapiens
cugugucuguguau

SEQ ID NO: 545107 - RNA, 23 nt, Homo sapiens
cugugugaccucaggccagugug

SEQ ID NO: 545108 - RNA, 16 nt, Homo sapiens
cugugugagauuguga

SEQ ID NO: 545109 - RNA, 22 nt, Homo sapiens
cugugugcccucccucacuugu

SEQ ID NO: 545110 - RNA, 21 nt, Homo sapiens
cuguguggucuccaugcucac

SEQ ID NO: 545111 - RNA, 14 nt, Homo sapiens
cuguguguccaaaa

SEQ ID NO: 545112 - RNA, 15 nt, Homo sapiens
cugugugugugaaug

SEQ ID NO: 545113 - RNA, 23 nt, Homo sapiens
cuguguguuuucccaaagcacuu

SEQ ID NO: 545114 - RNA, 17 nt, Homo sapiens
cuguguuccuggcaaua

SEQ ID NO: 545115 - RNA, 23 nt, Homo sapiens
cuguguugcccugacuggaguuc

SEQ ID NO: 545116 - RNA, 14 nt, Homo sapiens
cuguuaaccaaagg

SEQ ID NO: 545117 - RNA, 22 nt, Homo sapiens
cuguuaacuuuuguaccaaaua

SEQ ID NO: 545118 - RNA, 14 nt, Homo sapiens
cuguuaauagucau

SEQ ID NO: 545119 - RNA, 14 nt, Homo sapiens
cuguuacaguaaug

SEQ ID NO: 545120 - RNA, 13 nt, Homo sapiens
cuguuaccagagg

SEQ ID NO: 545121 - RNA, 18 nt, Homo sapiens
cuguuacuaaauccuuuu

SEQ ID NO: 545122 - RNA, 18 nt, Homo sapiens
cuguuacuugaaauacca

SEQ ID NO: 545123 - RNA, 22 nt, Homo sapiens
cuguuacuugaaauaccaguga

SEQ ID NO: 545124 - RNA, 23 nt, Homo sapiens
cuguuacuugaaauaccagugaa

SEQ ID NO: 545125 - RNA, 16 nt, Homo sapiens
cuguuacuugcuucag

SEQ ID NO: 545126 - RNA, 15 nt, Homo sapiens
cuguuagcaagugug

SEQ ID NO: 545127 - RNA, 19 nt, Homo sapiens
cuguuagggcugaaucuuc

SEQ ID NO: 545128 - RNA, 16 nt, Homo sapiens
cuguuagucauuugcu

SEQ ID NO: 545129 - RNA, 15 nt, Homo sapiens
cuguuaguguuaaaa

SEQ ID NO: 545130 - RNA, 22 nt, Homo sapiens
cuguuaguuuuguaaaaacuga

SEQ ID NO: 545131 - RNA, 23 nt, Homo sapiens
cuguuauccugcuagcuguagaa

SEQ ID NO: 545132 - RNA, 19 nt, Homo sapiens
cuguuaucugcuagaucua

SEQ ID NO: 545133 - RNA, 18 nt, Homo sapiens
cuguuauggggacuuuau

SEQ ID NO: 545134 - RNA, 14 nt, Homo sapiens
cuguuauuaacaaa

SEQ ID NO: 545135 - RNA, 15 nt, Homo sapiens
guucuguuucagagc

SEQ ID NO: 545136 - RNA, 22 nt, Homo sapiens
guucuuaaauguuuauacugua

SEQ ID NO: 545137 - RNA, 13 nt, Homo sapiens
guucuuagagugu

SEQ ID NO: 545138 - RNA, 14 nt, Homo sapiens
guucuuagugacac

SEQ ID NO: 545139 - RNA, 13 nt, Homo sapiens
guucuuaguguca

SEQ ID NO: 545140 - RNA, 16 nt, Homo sapiens
guucuuagugucacuu

SEQ ID NO: 545141 - RNA, 12 nt, Homo sapiens
guucuucagggc

SEQ ID NO: 545142 - RNA, 17 nt, Homo sapiens
guucuucagggccaguc

SEQ ID NO: 545143 - RNA, 21 nt, Homo sapiens
guucuucuucccaguucuuga

SEQ ID NO: 545144 - RNA, 22 nt, Homo sapiens
guucuucuuucucuguauuccg

SEQ ID NO: 545145 - RNA, 22 nt, Homo sapiens
guucuuguuuuauauaccuggc

SEQ ID NO: 545146 - RNA, 22 nt, Homo sapiens
guucuuugauuuguaccauucc

SEQ ID NO: 545147 - RNA, 15 nt, Homo sapiens
guucuuuugacugaa

SEQ ID NO: 545148 - RNA, 13 nt, Homo sapiens
guucuuuugcaau

SEQ ID NO: 545149 - RNA, 14 nt, Homo sapiens
guucuuuugcaaua

SEQ ID NO: 545150 - RNA, 15 nt, Homo sapiens
guugaagaaggguua

SEQ ID NO: 545151 - RNA, 16 nt, Homo sapiens
guugaauaaugcuguu

SEQ ID NO: 545152 - RNA, 19 nt, Homo sapiens
guugaaugagcgucagcau

SEQ ID NO: 545153 - RNA, 15 nt, Homo sapiens
guugacaauucugca

SEQ ID NO: 545154 - RNA, 15 nt, Homo sapiens
guugacuacugcuau

SEQ ID NO: 545155 - RNA, 12 nt, Homo sapiens
guugacugcugc

SEQ ID NO: 545156 - RNA, 13 nt, Homo sapiens
guugagauuugac

SEQ ID NO: 545157 - RNA, 22 nt, Homo sapiens
guugagauuuuuaagaacuuca

SEQ ID NO: 545158 - RNA, 11 nt, Homo sapiens
guugagcaauu

SEQ ID NO: 545159 - RNA, 16 nt, Homo sapiens
guugagcuauugcugu

SEQ ID NO: 545160 - RNA, 15 nt, Homo sapiens
guugaggcugucaca

SEQ ID NO: 545161 - RNA, 18 nt, Homo sapiens
guugaggggcuccuggaa

SEQ ID NO: 545162 - RNA, 17 nt, Homo sapiens
guugaguaaaacacaua

SEQ ID NO: 545163 - RNA, 19 nt, Homo sapiens
guugagucgucaucacuuu

SEQ ID NO: 545164 - RNA, 12 nt, Homo sapiens
guugagugccag

SEQ ID NO: 545165 - RNA, 12 nt, Homo sapiens
guugaguucaag

SEQ ID NO: 545166 - RNA, 13 nt, Homo sapiens
guugaugaggcag

SEQ ID NO: 545167 - RNA, 18 nt, Homo sapiens
guugauuauuuucugcua

SEQ ID NO: 545168 - RNA, 20 nt, Homo sapiens
guugauuguauaaaugcaau

SEQ ID NO: 545169 - RNA, 13 nt, Homo sapiens
guugcacugauau

SEQ ID NO: 545170 - RNA, 20 nt, Homo sapiens
guugcagagauuuccuccau

SEQ ID NO: 545171 - RNA, 18 nt, Homo sapiens
guugcagccagggccagu

SEQ ID NO: 545172 - RNA, 10 nt, Homo sapiens
guugcagcug

SEQ ID NO: 545173 - RNA, 19 nt, Homo sapiens
guugcaggaccucagguga

SEQ ID NO: 545174 - RNA, 11 nt, Homo sapiens
guugcagugag

SEQ ID NO: 545175 - RNA, 19 nt, Homo sapiens
guugcauuuaugaugcagu

SEQ ID NO: 545176 - RNA, 20 nt, Homo sapiens
guugccacaguagaacuguc

SEQ ID NO: 545177 - RNA, 13 nt, Homo sapiens
guugccagugaua

SEQ ID NO: 545178 - RNA, 20 nt, Homo sapiens
guugcccucuaccugacucc

SEQ ID NO: 545179 - RNA, 17 nt, Homo sapiens
guugccucucuugcccc

SEQ ID NO: 545180 - RNA, 18 nt, Homo sapiens
guugccugacuccugggu

SEQ ID NO: 545181 - RNA, 23 nt, Homo sapiens
guugcuauuguaaggucuuugua

SEQ ID NO: 545182 - RNA, 18 nt, Homo sapiens
guugcucaaaucuauuca

SEQ ID NO: 545183 - RNA, 14 nt, Homo sapiens
guugcugcaucucc

SEQ ID NO: 545184 - RNA, 16 nt, Homo sapiens
guugcuggacugucau

SEQ ID NO: 545185 - RNA, 15 nt, Homo sapiens
guugcuguaugucuc

SEQ ID NO: 545186 - RNA, 22 nt, Homo sapiens
guugcuguuauuauauuugaca

SEQ ID NO: 545187 - RNA, 14 nt, Homo sapiens
guugcuuacagugu

SEQ ID NO: 545188 - RNA, 15 nt, Homo sapiens
guugcuuuagucacu

SEQ ID NO: 545189 - RNA, 17 nt, Homo sapiens
guugcuuuagucacuaa

SEQ ID NO: 545190 - RNA, 12 nt, Homo sapiens
guugcuuuucag

SEQ ID NO: 545191 - RNA, 18 nt, Homo sapiens
guuggaaaaugugcaaua

SEQ ID NO: 545192 - RNA, 14 nt, Homo sapiens
guuggaaauauuca

SEQ ID NO: 545193 - RNA, 15 nt, Homo sapiens
guuggaaaugugcaa

SEQ ID NO: 545194 - RNA, 22 nt, Homo sapiens
guuggaaaugugcaaccacugc

SEQ ID NO: 545195 - RNA, 21 nt, Homo sapiens
guuggacaaaccgagugcaau

SEQ ID NO: 545196 - RNA, 17 nt, Homo sapiens
guuggacagacacuguu

SEQ ID NO: 545197 - RNA, 22 nt, Homo sapiens
guuggacagacacuguugcaaa

SEQ ID NO: 545198 - RNA, 22 nt, Homo sapiens
guuggagagagauguuccucuu

SEQ ID NO: 545199 - RNA, 22 nt, Homo sapiens
guuggagaguacggcuaccugg

SEQ ID NO: 545200 - RNA, 16 nt, Homo sapiens
guuggaugaugagcag

SEQ ID NO: 545201 - RNA, 16 nt, Homo sapiens
guuggauguaguuuag

SEQ ID NO: 545202 - RNA, 14 nt, Homo sapiens
guuggcacaugccu

SEQ ID NO: 545203 - RNA, 18 nt, Homo sapiens
guuggccaggauggucuc

SEQ ID NO: 545204 - RNA, 19 nt, Homo sapiens
guuggggaaaccuucaucu

SEQ ID NO: 545205 - RNA, 13 nt, Homo sapiens
cuugucauugccu

SEQ ID NO: 545206 - RNA, 20 nt, Homo sapiens
cuuguccacgucuuuucuca

SEQ ID NO: 545207 - RNA, 15 nt, Homo sapiens
cuuguccauguaaua

SEQ ID NO: 545208 - RNA, 19 nt, Homo sapiens
cuugucccucuuugaggga

SEQ ID NO: 545209 - RNA, 23 nt, Homo sapiens
cuuguccgcugggugguacccuc

SEQ ID NO: 545210 - RNA, 12 nt, Homo sapiens
cuuguccugacu

SEQ ID NO: 545211 - RNA, 15 nt, Homo sapiens
cuuguccugaugcug

SEQ ID NO: 545212 - RNA, 16 nt, Homo sapiens
cuuguccugaugcugu

SEQ ID NO: 545213 - RNA, 19 nt, Homo sapiens
cuugucuaauuuucacaca

SEQ ID NO: 545214 - RNA, 17 nt, Homo sapiens
cuugucucagauggugu

SEQ ID NO: 545215 - RNA, 16 nt, Homo sapiens
cuugugacgugcacug

SEQ ID NO: 545216 - RNA, 22 nt, Homo sapiens
cuugugagagcccauucccacc

SEQ ID NO: 545217 - RNA, 16 nt, Homo sapiens
cuugugcccaggguuu

SEQ ID NO: 545218 - RNA, 21 nt, Homo sapiens
cuugugccucccuucccagug

SEQ ID NO: 545219 - RNA, 19 nt, Homo sapiens
cuugugcuucuucacuuac

SEQ ID NO: 545220 - RNA, 19 nt, Homo sapiens
cuuguggaaugcugccuuu

SEQ ID NO: 545221 - RNA, 13 nt, Homo sapiens
cuuguggcugaga

SEQ ID NO: 545222 - RNA, 23 nt, Homo sapiens
cuugugggagcacagucagugac

SEQ ID NO: 545223 - RNA, 14 nt, Homo sapiens
cuuguggguccaug

SEQ ID NO: 545224 - RNA, 12 nt, Homo sapiens
cuugugucuccc

SEQ ID NO: 545225 - RNA, 22 nt, Homo sapiens
cuugugucuuuggaggugcugc

SEQ ID NO: 545226 - RNA, 20 nt, Homo sapiens
cuugugugauguuuuacaca

SEQ ID NO: 545227 - RNA, 17 nt, Homo sapiens
cuuguguuacuugccaa

SEQ ID NO: 545228 - RNA, 17 nt, Homo sapiens
cuuguguuauauagcca

SEQ ID NO: 545229 - RNA, 19 nt, Homo sapiens
cuuguguuauuuaaugagu

SEQ ID NO: 545230 - RNA, 13 nt, Homo sapiens
cuuguuaauguca

SEQ ID NO: 545231 - RNA, 21 nt, Homo sapiens
cuuguuaaugucauugcuaaa

SEQ ID NO: 545232 - RNA, 18 nt, Homo sapiens
cuuguuaauuuuauucaa

SEQ ID NO: 545233 - RNA, 17 nt, Homo sapiens
cuuguuagaaugcaagc

SEQ ID NO: 545234 - RNA, 13 nt, Homo sapiens
cuuguucuacuga

SEQ ID NO: 545235 - RNA, 17 nt, Homo sapiens
cuuguucuguacuugua

SEQ ID NO: 545236 - RNA, 16 nt, Homo sapiens
cuuguucuuuggccag

SEQ ID NO: 545237 - RNA, 14 nt, Homo sapiens
cuuguugcugcauc

SEQ ID NO: 545238 - RNA, 17 nt, Homo sapiens
cuuguugcugcaucucc

SEQ ID NO: 545239 - RNA, 13 nt, Homo sapiens
cuuguugucucca

SEQ ID NO: 545240 - RNA, 22 nt, Homo sapiens
cuuguuguugaacauggcuaaa

SEQ ID NO: 545241 - RNA, 18 nt, Homo sapiens
cuuguuguuuuuaagucc

SEQ ID NO: 545242 - RNA, 16 nt, Homo sapiens
cuuguuuacagcacua

SEQ ID NO: 545243 - RNA, 23 nt, Homo sapiens
cuuguuucacacuagucacauuc

SEQ ID NO: 545244 - RNA, 14 nt, Homo sapiens
cuuguuucacucca

SEQ ID NO: 545245 - RNA, 20 nt, Homo sapiens
cuuguuuccuuuugggcuca

SEQ ID NO: 545246 - RNA, 15 nt, Homo sapiens
cuuguuugucuucca

SEQ ID NO: 545247 - RNA, 14 nt, Homo sapiens
cuuguuuguugcag

SEQ ID NO: 545248 - RNA, 22 nt, Homo sapiens
cuuguuuuaacguucugcugcu

SEQ ID NO: 545249 - RNA, 19 nt, Homo sapiens
cuuguuuuaaguugcuuua

SEQ ID NO: 545250 - RNA, 22 nt, Homo sapiens
cuuguuuuacccuauacaucca

SEQ ID NO: 545251 - RNA, 16 nt, Homo sapiens
cuuguuuuaugcucag

SEQ ID NO: 545252 - RNA, 15 nt, Homo sapiens
cuuguuuucuucaca

SEQ ID NO: 545253 - RNA, 13 nt, Homo sapiens
cuuguuuuggaca

SEQ ID NO: 545254 - RNA, 22 nt, Homo sapiens
cuuguuuuuuuaauucauuaac

SEQ ID NO: 545255 - RNA, 19 nt, Homo sapiens
cuuuaaaaagaaaaucaag

SEQ ID NO: 545256 - RNA, 12 nt, Homo sapiens
cuuuaaaaccag

SEQ ID NO: 545257 - RNA, 13 nt, Homo sapiens
cuuuaaaaggcaa

SEQ ID NO: 545258 - RNA, 20 nt, Homo sapiens
cuuuaaaaguaucuuuaaca

SEQ ID NO: 545259 - RNA, 23 nt, Homo sapiens
cuuuaaaauaaaaaagcaaaaac

SEQ ID NO: 545260 - RNA, 18 nt, Homo sapiens
cuuuaaaauuacauucua

SEQ ID NO: 545261 - RNA, 13 nt, Homo sapiens
cuuuaaaauucua

SEQ ID NO: 545262 - RNA, 17 nt, Homo sapiens
cuuuaaacaaauaugaa

SEQ ID NO: 545263 - RNA, 11 nt, Homo sapiens
cuuuaaaccac

SEQ ID NO: 545264 - RNA, 22 nt, Homo sapiens
cuuuaaacuacccuccagagug

SEQ ID NO: 545265 - RNA, 17 nt, Homo sapiens
cuuuaaaguaccuguag

SEQ ID NO: 545266 - RNA, 13 nt, Homo sapiens
cuuuaaaugcaac

SEQ ID NO: 545267 - RNA, 15 nt, Homo sapiens
cuuuaaauggcuuua

SEQ ID NO: 545268 - RNA, 12 nt, Homo sapiens
cuuuaagcacua

SEQ ID NO: 545269 - RNA, 19 nt, Homo sapiens
cuuuaagguauugugcauc

SEQ ID NO: 545270 - RNA, 18 nt, Homo sapiens
uaacuauauuugcuuuuu

SEQ ID NO: 545271 - RNA, 16 nt, Homo sapiens
uaacuauuuuuccuca

SEQ ID NO: 545272 - RNA, 15 nt, Homo sapiens
uaacucacugccuag

SEQ ID NO: 545273 - RNA, 15 nt, Homo sapiens
uaacucccuccacca

SEQ ID NO: 545274 - RNA, 20 nt, Homo sapiens
uaacuccuuuuccacuuuaa

SEQ ID NO: 545275 - RNA, 22 nt, Homo sapiens
uaacucuuacagcuuugccuug

SEQ ID NO: 545276 - RNA, 20 nt, Homo sapiens
uaacucuucuaacacaaaau

SEQ ID NO: 545277 - RNA, 22 nt, Homo sapiens
uaacucuuuauuuuuugccaua

SEQ ID NO: 545278 - RNA, 21 nt, Homo sapiens
uaacugaaggagaaggugccc

SEQ ID NO: 545279 - RNA, 21 nt, Homo sapiens
uaacugcaaagugaaguugcu

SEQ ID NO: 545280 - RNA, 17 nt, Homo sapiens
uaacugcaccugggcag

SEQ ID NO: 545281 - RNA, 21 nt, Homo sapiens
uaacugcauugagaacugcau

SEQ ID NO: 545282 - RNA, 12 nt, Homo sapiens
uaacugcuucuu

SEQ ID NO: 545283 - RNA, 17 nt, Homo sapiens
uaacuggaaaacagaac

SEQ ID NO: 545284 - RNA, 22 nt, Homo sapiens
uaacuguauuuuugaagacuau

SEQ ID NO: 545285 - RNA, 14 nt, Homo sapiens
uaacugugugagau

SEQ ID NO: 545286 - RNA, 12 nt, Homo sapiens
uaacuguucaaa

SEQ ID NO: 545287 - RNA, 12 nt, Homo sapiens
uaacuguucuca

SEQ ID NO: 545288 - RNA, 13 nt, Homo sapiens
uaacuguuucccu

SEQ ID NO: 545289 - RNA, 16 nt, Homo sapiens
uaacuuaaaauuacaa

SEQ ID NO: 545290 - RNA, 13 nt, Homo sapiens
uaacuuacacuga

SEQ ID NO: 545291 - RNA, 13 nt, Homo sapiens
uaacuuagaagga

SEQ ID NO: 545292 - RNA, 19 nt, Homo sapiens
uaacuuaguaagugcuuuu

SEQ ID NO: 545293 - RNA, 21 nt, Homo sapiens
uaacuucugacuuacugucag

SEQ ID NO: 545294 - RNA, 18 nt, Homo sapiens
uaacuucuuucacugaua

SEQ ID NO: 545295 - RNA, 21 nt, Homo sapiens
uaacuuggccauguucuccau

SEQ ID NO: 545296 - RNA, 19 nt, Homo sapiens
uaacuuuaccaugcucaau

SEQ ID NO: 545297 - RNA, 16 nt, Homo sapiens
uaacuuuauugcauau

SEQ ID NO: 545298 - RNA, 18 nt, Homo sapiens
uaacuuucagaggcaaua

SEQ ID NO: 545299 - RNA, 17 nt, Homo sapiens
uaacuuuccacucuucc

SEQ ID NO: 545300 - RNA, 11 nt, Homo sapiens
uaacuuugaac

SEQ ID NO: 545301 - RNA, 16 nt, Homo sapiens
uaacuuugacuuucuu

SEQ ID NO: 545302 - RNA, 15 nt, Homo sapiens
uaagaaaaaaagcac

SEQ ID NO: 545303 - RNA, 17 nt, Homo sapiens
uaagaaaaaugagcaua

SEQ ID NO: 545304 - RNA, 22 nt, Homo sapiens
uaagaaaacaaaaucuaaaaca

SEQ ID NO: 545305 - RNA, 17 nt, Homo sapiens
uaagaaaauaaccuuua

SEQ ID NO: 545306 - RNA, 16 nt, Homo sapiens
uaagaaacccucuguc

SEQ ID NO: 545307 - RNA, 17 nt, Homo sapiens
uaagaaacuagcagauu

SEQ ID NO: 545308 - RNA, 21 nt, Homo sapiens
uaagaaacuagcagauuugua

SEQ ID NO: 545309 - RNA, 13 nt, Homo sapiens
uaagaaagacuau

SEQ ID NO: 545310 - RNA, 13 nt, Homo sapiens
uaagaaagcacua

SEQ ID NO: 545311 - RNA, 21 nt, Homo sapiens
uaagaaagugcgaguccucca

SEQ ID NO: 545312 - RNA, 14 nt, Homo sapiens
uaagaaauacucau

SEQ ID NO: 545313 - RNA, 12 nt, Homo sapiens
uaagaaccaaaa

SEQ ID NO: 545314 - RNA, 19 nt, Homo sapiens
uaagaacuguacauuguga

SEQ ID NO: 545315 - RNA, 17 nt, Homo sapiens
uaagaagaaaauugcug

SEQ ID NO: 545316 - RNA, 16 nt, Homo sapiens
uaagaagagaauuccu

SEQ ID NO: 545317 - RNA, 16 nt, Homo sapiens
uaagaagagauuucuc

SEQ ID NO: 545318 - RNA, 18 nt, Homo sapiens
uaagaaguccuaucucau

SEQ ID NO: 545319 - RNA, 14 nt, Homo sapiens
uaagaauaguagau

SEQ ID NO: 545320 - RNA, 17 nt, Homo sapiens
uaagaaugcagauuccu

SEQ ID NO: 545321 - RNA, 16 nt, Homo sapiens
uaagaauuagacaucu

SEQ ID NO: 545322 - RNA, 13 nt, Homo sapiens
uaagaauucucuc

SEQ ID NO: 545323 - RNA, 13 nt, Homo sapiens
uaagaauuucaca

SEQ ID NO: 545324 - RNA, 17 nt, Homo sapiens
uaagaauuucacaagcu

SEQ ID NO: 545325 - RNA, 15 nt, Homo sapiens
uaagacacaaaugca

SEQ ID NO: 545326 - RNA, 18 nt, Homo sapiens
uaagacaugauuuccuug

SEQ ID NO: 545327 - RNA, 21 nt, Homo sapiens
uaagacaugauuuccuugaau

SEQ ID NO: 545328 - RNA, 12 nt, Homo sapiens
cuuuauugcacu

SEQ ID NO: 545329 - RNA, 17 nt, Homo sapiens
cuuuauuuguaaaccau

SEQ ID NO: 545330 - RNA, 12 nt, Homo sapiens
cuuuauuuuaga

SEQ ID NO: 545331 - RNA, 14 nt, Homo sapiens
cuuucaaagaaauc

SEQ ID NO: 545332 - RNA, 19 nt, Homo sapiens
cuuucaacauguacaggaa

SEQ ID NO: 545333 - RNA, 14 nt, Homo sapiens
cuuucaacuagaaa

SEQ ID NO: 545334 - RNA, 15 nt, Homo sapiens
cuuucaaguguccug

SEQ ID NO: 545335 - RNA, 18 nt, Homo sapiens
cuuucaauauuuauuucc

SEQ ID NO: 545336 - RNA, 15 nt, Homo sapiens
cuuucacacuggauc

SEQ ID NO: 545337 - RNA, 15 nt, Homo sapiens
cuuucaccagaauuu

SEQ ID NO: 545338 - RNA, 14 nt, Homo sapiens
cuuucagcauuagg

SEQ ID NO: 545339 - RNA, 19 nt, Homo sapiens
cuuucagcauuaggcuuuu

SEQ ID NO: 545340 - RNA, 17 nt, Homo sapiens
cuuucaggcuaccuuuu

SEQ ID NO: 545341 - RNA, 19 nt, Homo sapiens
cuuucagguccaggccagu

SEQ ID NO: 545342 - RNA, 21 nt, Homo sapiens
cuuucagguuuacuauguuua

SEQ ID NO: 545343 - RNA, 16 nt, Homo sapiens
cuuucagucccaaagc

SEQ ID NO: 545344 - RNA, 21 nt, Homo sapiens
cuuucauccacuagugcaaau

SEQ ID NO: 545345 - RNA, 23 nt, Homo sapiens
cuuucaucccucgggugugcuau

SEQ ID NO: 545346 - RNA, 16 nt, Homo sapiens
cuuucaucggugccug

SEQ ID NO: 545347 - RNA, 11 nt, Homo sapiens
cuuucauguca

SEQ ID NO: 545348 - RNA, 14 nt, Homo sapiens
cuuucauuaggcaa

SEQ ID NO: 545349 - RNA, 21 nt, Homo sapiens
cuuucauuaggcaaaguacaa

SEQ ID NO: 545350 - RNA, 18 nt, Homo sapiens
cuuucauuugcuuuggaa

SEQ ID NO: 545351 - RNA, 13 nt, Homo sapiens
cuuuccaaaaccu

SEQ ID NO: 545352 - RNA, 16 nt, Homo sapiens
cuuuccaaacaccacu

SEQ ID NO: 545353 - RNA, 18 nt, Homo sapiens
cuuucccaaccccaggaa

SEQ ID NO: 545354 - RNA, 22 nt, Homo sapiens
cuuucccagucccauuccucag

SEQ ID NO: 545355 - RNA, 19 nt, Homo sapiens
cuuuccccaaaacucuccu

SEQ ID NO: 545356 - RNA, 16 nt, Homo sapiens
cuuuccccccauguug

SEQ ID NO: 545357 - RNA, 21 nt, Homo sapiens
cuuucccccuucccgccuucc

SEQ ID NO: 545358 - RNA, 15 nt, Homo sapiens
cuuucccugccacau

SEQ ID NO: 545359 - RNA, 19 nt, Homo sapiens
cuuucccuucaguacccuc

SEQ ID NO: 545360 - RNA, 17 nt, Homo sapiens
cuuuccuaaagccaaag

SEQ ID NO: 545361 - RNA, 14 nt, Homo sapiens
cuuuccuacucuca

SEQ ID NO: 545362 - RNA, 16 nt, Homo sapiens
cuuuccucccccagcg

SEQ ID NO: 545363 - RNA, 13 nt, Homo sapiens
cuuuccuccugag

SEQ ID NO: 545364 - RNA, 16 nt, Homo sapiens
cuuuccucgccugaca

SEQ ID NO: 545365 - RNA, 16 nt, Homo sapiens
cuuuccucuagcuuuu

SEQ ID NO: 545366 - RNA, 16 nt, Homo sapiens
cuuuccugaauccaaa

SEQ ID NO: 545367 - RNA, 17 nt, Homo sapiens
cuuuccugaauccaaac

SEQ ID NO: 545368 - RNA, 15 nt, Homo sapiens
cuuuccugcaacuca

SEQ ID NO: 545369 - RNA, 15 nt, Homo sapiens
cuuuccuuuccauug

SEQ ID NO: 545370 - RNA, 13 nt, Homo sapiens
cuuucgaggccug

SEQ ID NO: 545371 - RNA, 15 nt, Homo sapiens
cuuucuaaagacagg

SEQ ID NO: 545372 - RNA, 15 nt, Homo sapiens
cuuucuaauguuucu

SEQ ID NO: 545373 - RNA, 19 nt, Homo sapiens
cuuucuagguucaaaagaa

SEQ ID NO: 545374 - RNA, 13 nt, Homo sapiens
cuuucuaugcugu

SEQ ID NO: 545375 - RNA, 14 nt, Homo sapiens
cuuucucaaagagg

SEQ ID NO: 545376 - RNA, 21 nt, Homo sapiens
cuuucucaaucuugaacucau

SEQ ID NO: 545377 - RNA, 17 nt, Homo sapiens
cuuucuccagaucagac

SEQ ID NO: 545378 - RNA, 16 nt, Homo sapiens
cuuucuccaggaccaa

SEQ ID NO: 545379 - RNA, 12 nt, Homo sapiens
cuuucucuaaaa

SEQ ID NO: 545380 - RNA, 14 nt, Homo sapiens
cuuucucucaguga

SEQ ID NO: 545381 - RNA, 18 nt, Homo sapiens
cuuucugaaauuagggcc

SEQ ID NO: 545382 - RNA, 16 nt, Homo sapiens
cuuucugacaaaaagu

SEQ ID NO: 545383 - RNA, 20 nt, Homo sapiens
cuuucugagaguuggcucag

SEQ ID NO: 545384 - RNA, 18 nt, Homo sapiens
cuuucugccaacuuuguu

SEQ ID NO: 545385 - RNA, 15 nt, Homo sapiens
cuuucugcuuugcac

SEQ ID NO: 545386 - RNA, 15 nt, Homo sapiens
cuuucuggaaaagag

SEQ ID NO: 545387 - RNA, 15 nt, Homo sapiens
cuuucugugaagcua

SEQ ID NO: 545388 - RNA, 22 nt, Homo sapiens
cuuucugugcagagaugacugu

SEQ ID NO: 545389 - RNA, 23 nt, Homo sapiens
cuuucuguuacugauguucaaua

SEQ ID NO: 545390 - RNA, 15 nt, Homo sapiens
cuuucuguugccaca

SEQ ID NO: 545391 - RNA, 21 nt, Homo sapiens
cuuucuucaccaagugcaaua

SEQ ID NO: 545392 - RNA, 14 nt, Homo sapiens
cuuucuucccauga

SEQ ID NO: 545393 - RNA, 11 nt, Homo sapiens
cuuucuugucu

SEQ ID NO: 545394 - RNA, 21 nt, Homo sapiens
cuuucuuguugcugcaucucc

SEQ ID NO: 545395 - RNA, 17 nt, Homo sapiens
uaagggaaaaguucucc

SEQ ID NO: 545396 - RNA, 11 nt, Homo sapiens
uaagggaacaa

SEQ ID NO: 545397 - RNA, 20 nt, Homo sapiens
uaagggaaggaacucuggcu

SEQ ID NO: 545398 - RNA, 23 nt, Homo sapiens
uaagggagggggcgcuggagcuu

SEQ ID NO: 545399 - RNA, 22 nt, Homo sapiens
uaagggcagugcccauguguac

SEQ ID NO: 545400 - RNA, 20 nt, Homo sapiens
uaagguacuuaaagcuucua

SEQ ID NO: 545401 - RNA, 21 nt, Homo sapiens
uaagguauauaaauuuuccca

SEQ ID NO: 545402 - RNA, 15 nt, Homo sapiens
uaagguauugugcau

SEQ ID NO: 545403 - RNA, 17 nt, Homo sapiens
uaaggucuguaguauac

SEQ ID NO: 545404 - RNA, 12 nt, Homo sapiens
uaaggugcaguu

SEQ ID NO: 545405 - RNA, 19 nt, Homo sapiens
uaaggugcaguucccccaa

SEQ ID NO: 545406 - RNA, 20 nt, Homo sapiens
uaaggugggaggguggcaag

SEQ ID NO: 545407 - RNA, 20 nt, Homo sapiens
uaagguugucuacgggggca

SEQ ID NO: 545408 - RNA, 16 nt, Homo sapiens
uaagguuuccagucag

SEQ ID NO: 545409 - RNA, 16 nt, Homo sapiens
uaaguaaauacaguag

SEQ ID NO: 545410 - RNA, 21 nt, Homo sapiens
uaaguaauugcauuucugcuc

SEQ ID NO: 545411 - RNA, 15 nt, Homo sapiens
uaaguacacaauaag

SEQ ID NO: 545412 - RNA, 17 nt, Homo sapiens
uaaguaccacucaggcc

SEQ ID NO: 545413 - RNA, 14 nt, Homo sapiens
uaaguaucagaggu

SEQ ID NO: 545414 - RNA, 14 nt, Homo sapiens
uaaguaugggauga

SEQ ID NO: 545415 - RNA, 20 nt, Homo sapiens
uaaguauuuuccuguuguca

SEQ ID NO: 545416 - RNA, 15 nt, Homo sapiens
uaaguauuuugauca

SEQ ID NO: 545417 - RNA, 16 nt, Homo sapiens
uaaguccaguguuucu

SEQ ID NO: 545418 - RNA, 14 nt, Homo sapiens
uaagucuacauuaa

SEQ ID NO: 545419 - RNA, 14 nt, Homo sapiens
uaagucucugugaa

SEQ ID NO: 545420 - RNA, 13 nt, Homo sapiens
uaagucuguuauu

SEQ ID NO: 545421 - RNA, 16 nt, Homo sapiens
uaagucuuuacucuga

SEQ ID NO: 545422 - RNA, 18 nt, Homo sapiens
uaagugaagugauacuau

SEQ ID NO: 545423 - RNA, 13 nt, Homo sapiens
uaagugcauuugu

SEQ ID NO: 545424 - RNA, 17 nt, Homo sapiens
uaaguguauuuugaaau

SEQ ID NO: 545425 - RNA, 21 nt, Homo sapiens
uaaguguguuguuuaaucuga

SEQ ID NO: 545426 - RNA, 18 nt, Homo sapiens
uaaguuaauguauauaaa

SEQ ID NO: 545427 - RNA, 19 nt, Homo sapiens
uaaguuacacauuuuucag

SEQ ID NO: 545428 - RNA, 16 nt, Homo sapiens
uaaguuaucuuugaau

SEQ ID NO: 545429 - RNA, 14 nt, Homo sapiens
uaaguuauuuacuu

SEQ ID NO: 545430 - RNA, 20 nt, Homo sapiens
uaaguucaggcagcacauca

SEQ ID NO: 545431 - RNA, 18 nt, Homo sapiens
uaaguuccuacuaggcaa

SEQ ID NO: 545432 - RNA, 17 nt, Homo sapiens
uaaguuguaccaaaaca

SEQ ID NO: 545433 - RNA, 13 nt, Homo sapiens
uaaguugucaaag

SEQ ID NO: 545434 - RNA, 22 nt, Homo sapiens
uaaguugucuaaacaaugcuga

SEQ ID NO: 545435 - RNA, 16 nt, Homo sapiens
uaaguuguuauuucag

SEQ ID NO: 545436 - RNA, 23 nt, Homo sapiens
uaaguuucaggauacaugugccg

SEQ ID NO: 545437 - RNA, 20 nt, Homo sapiens
uaaguuugaaacuaacucau

SEQ ID NO: 545438 - RNA, 22 nt, Homo sapiens
uaauaaaaaauauucuugucaa

SEQ ID NO: 545439 - RNA, 19 nt, Homo sapiens
uaauaaaacugcacagugc

SEQ ID NO: 545440 - RNA, 16 nt, Homo sapiens
uaauaaaaguacaugu

SEQ ID NO: 545441 - RNA, 13 nt, Homo sapiens
uaauaaacauguc

SEQ ID NO: 545442 - RNA, 15 nt, Homo sapiens
uaauaaacuacacaa

SEQ ID NO: 545443 - RNA, 15 nt, Homo sapiens
uaauaaacuacucuu

SEQ ID NO: 545444 - RNA, 15 nt, Homo sapiens
uaauaaagacagggu

SEQ ID NO: 545445 - RNA, 14 nt, Homo sapiens
uaauaaagcauucu

SEQ ID NO: 545446 - RNA, 18 nt, Homo sapiens
uaauaaagcauucuuuaa

SEQ ID NO: 545447 - RNA, 21 nt, Homo sapiens
uaauaaaucuaggaugugaug

SEQ ID NO: 545448 - RNA, 22 nt, Homo sapiens
uaauaaauuuuagugugccuuc

SEQ ID NO: 545449 - RNA, 12 nt, Homo sapiens
uaauaacaaacg

SEQ ID NO: 545450 - RNA, 13 nt, Homo sapiens
uaauaacagcucc

SEQ ID NO: 545451 - RNA, 12 nt, Homo sapiens
cuuuuuuacacu

SEQ ID NO: 545452 - RNA, 18 nt, Homo sapiens
cuuuuuuauacucaauca

SEQ ID NO: 545453 - RNA, 17 nt, Homo sapiens
cuuuuuucaaaagaaag

SEQ ID NO: 545454 - RNA, 21 nt, Homo sapiens
cuuuuuucacggaaguuuuca

SEQ ID NO: 545455 - RNA, 12 nt, Homo sapiens
cuuuuuugccag

SEQ ID NO: 545456 - RNA, 13 nt, Homo sapiens
cuuuuuugccaga

SEQ ID NO: 545457 - RNA, 14 nt, Homo sapiens
cuuuuuuucuguca

SEQ ID NO: 545458 - RNA, 20 nt, Homo sapiens
cuuuuuuucuuguccucauu

SEQ ID NO: 545459 - RNA, 17 nt, Homo sapiens
cuuuuuuuguauaguua

SEQ ID NO: 545460 - RNA, 14 nt, Homo sapiens
gaaaaaaagcacaa

SEQ ID NO: 545461 - RNA, 17 nt, Homo sapiens
gaaaaaaaguacaugua

SEQ ID NO: 545462 - RNA, 17 nt, Homo sapiens
gaaaaaaauguacauuu

SEQ ID NO: 545463 - RNA, 14 nt, Homo sapiens
gaaaaaaauuacua

SEQ ID NO: 545464 - RNA, 16 nt, Homo sapiens
gaaaaaagaaccaaaa

SEQ ID NO: 545465 - RNA, 19 nt, Homo sapiens
gaaaaaaguuuugaugaaa

SEQ ID NO: 545466 - RNA, 20 nt, Homo sapiens
gaaaaaaugcagggugauuu

SEQ ID NO: 545467 - RNA, 17 nt, Homo sapiens
gaaaaaauuaaaaccug

SEQ ID NO: 545468 - RNA, 19 nt, Homo sapiens
gaaaaaauuagcugggcau

SEQ ID NO: 545469 - RNA, 16 nt, Homo sapiens
gaaaaacaaaugccau

SEQ ID NO: 545470 - RNA, 16 nt, Homo sapiens
gaaaaacagcauguac

SEQ ID NO: 545471 - RNA, 19 nt, Homo sapiens
gaaaaaccaccaccaucac

SEQ ID NO: 545472 - RNA, 12 nt, Homo sapiens
gaaaaacuugug

SEQ ID NO: 545473 - RNA, 13 nt, Homo sapiens
gaaaaagaacaaa

SEQ ID NO: 545474 - RNA, 20 nt, Homo sapiens
gaaaaagcaaguguucacug

SEQ ID NO: 545475 - RNA, 22 nt, Homo sapiens
gaaaaaggacucugcuucaguc

SEQ ID NO: 545476 - RNA, 20 nt, Homo sapiens
gaaaaauaguaaacauuaag

SEQ ID NO: 545477 - RNA, 18 nt, Homo sapiens
gaaaaauauuccaagcuu

SEQ ID NO: 545478 - RNA, 23 nt, Homo sapiens
gaaaaauauugcugaacuacuuu

SEQ ID NO: 545479 - RNA, 18 nt, Homo sapiens
gaaaaauauuuauucauu

SEQ ID NO: 545480 - RNA, 19 nt, Homo sapiens
gaaaaaucuaagugauaua

SEQ ID NO: 545481 - RNA, 17 nt, Homo sapiens
gaaaaaugaaaagcaau

SEQ ID NO: 545482 - RNA, 19 nt, Homo sapiens
gaaaaaugaggaauccaaa

SEQ ID NO: 545483 - RNA, 17 nt, Homo sapiens
gaaaaaugccacucccu

SEQ ID NO: 545484 - RNA, 14 nt, Homo sapiens
gaaaaaugccauca

SEQ ID NO: 545485 - RNA, 18 nt, Homo sapiens
gaaaaauguaaauacuca

SEQ ID NO: 545486 - RNA, 18 nt, Homo sapiens
gaaaacaacuuggcauuu

SEQ ID NO: 545487 - RNA, 17 nt, Homo sapiens
gaaaacaaucaaauauu

SEQ ID NO: 545488 - RNA, 14 nt, Homo sapiens
gaaaacacagccuc

SEQ ID NO: 545489 - RNA, 15 nt, Homo sapiens
gaaaacacugugcac

SEQ ID NO: 545490 - RNA, 14 nt, Homo sapiens
gaaaacacuuucau

SEQ ID NO: 545491 - RNA, 16 nt, Homo sapiens
gaaaacagaacacuua

SEQ ID NO: 545492 - RNA, 16 nt, Homo sapiens
gaaaacagaugaccau

SEQ ID NO: 545493 - RNA, 17 nt, Homo sapiens
gaaaacagaugaccaua

SEQ ID NO: 545494 - RNA, 21 nt, Homo sapiens
gaaaacauaacccacucuguc

SEQ ID NO: 545495 - RNA, 21 nt, Homo sapiens
gaaaacaugcuacacacugca

SEQ ID NO: 545496 - RNA, 11 nt, Homo sapiens
gaaaacauuca

SEQ ID NO: 545497 - RNA, 14 nt, Homo sapiens
gaaaacauugcuuu

SEQ ID NO: 545498 - RNA, 19 nt, Homo sapiens
gaaaaccaacuaauauaca

SEQ ID NO: 545499 - RNA, 12 nt, Homo sapiens
gaaaaccauaug

SEQ ID NO: 545500 - RNA, 12 nt, Homo sapiens
gaaaaccaucac

SEQ ID NO: 545501 - RNA, 13 nt, Homo sapiens
gaaaaccaucaca

SEQ ID NO: 545502 - RNA, 12 nt, Homo sapiens
gaaaaccccgcc

SEQ ID NO: 545503 - RNA, 17 nt, Homo sapiens
gaaaaccucuccugacc

SEQ ID NO: 545504 - RNA, 22 nt, Homo sapiens
gaaaaccugaagacugaggaca

SEQ ID NO: 545505 - RNA, 18 nt, Homo sapiens
gaaaacuacugauacuuu

SEQ ID NO: 545506 - RNA, 22 nt, Homo sapiens
gaaaacuagauugcuaguuuau

SEQ ID NO: 545507 - RNA, 23 nt, Homo sapiens
gaaaacucaaccagagucaccca

SEQ ID NO: 545508 - RNA, 13 nt, Homo sapiens
gaaaacuguaguc

SEQ ID NO: 545509 - RNA, 18 nt, Homo sapiens
gaaaacuucagaagcaaa

SEQ ID NO: 545510 - RNA, 21 nt, Homo sapiens
gaaaagaaaccagagucaaau

SEQ ID NO: 545511 - RNA, 11 nt, Homo sapiens
gaaaagacucu

SEQ ID NO: 545512 - RNA, 15 nt, Homo sapiens
gaaaagaguauguag

SEQ ID NO: 545513 - RNA, 15 nt, Homo sapiens
gaaaagauugaaaau

SEQ ID NO: 545514 - RNA, 15 nt, Homo sapiens
gaaaagcaacauuca

SEQ ID NO: 545515 - RNA, 21 nt, Homo sapiens
gaaaagcaauacuguuuccau

SEQ ID NO: 545516 - RNA, 19 nt, Homo sapiens
gaaaagcacagccucagaa

SEQ ID NO: 545517 - RNA, 22 nt, Homo sapiens
gaaaagcacagccucagaauaa

SEQ ID NO: 545518 - RNA, 19 nt, Homo sapiens
gaaaagcacuuugaaaaau

SEQ ID NO: 545519 - RNA, 23 nt, Homo sapiens
gaaaagcccccaguuaauacucc

SEQ ID NO: 545520 - RNA, 19 nt, Homo sapiens
gaaaagcggacaucagcug

SEQ ID NO: 545521 - RNA, 14 nt, Homo sapiens
gaaaagcugccauu

SEQ ID NO: 545522 - RNA, 23 nt, Homo sapiens
uaauuuuguuuauauuuucccau

SEQ ID NO: 545523 - RNA, 15 nt, Homo sapiens
uaauuuuuacaugga

SEQ ID NO: 545524 - RNA, 22 nt, Homo sapiens
uaauuuuuccuauauugcauua

SEQ ID NO: 545525 - RNA, 13 nt, Homo sapiens
uaauuuuugcaaa

SEQ ID NO: 545526 - RNA, 17 nt, Homo sapiens
uaauuuuugugagguau

SEQ ID NO: 545527 - RNA, 17 nt, Homo sapiens
uaauuuuuuacuuucag

SEQ ID NO: 545528 - RNA, 19 nt, Homo sapiens
uaauuuuuuuuccuugccu

SEQ ID NO: 545529 - RNA, 16 nt, Homo sapiens
uacaaaaaaauacaaa

SEQ ID NO: 545530 - RNA, 16 nt, Homo sapiens
uacaaaaaaguaaccu

SEQ ID NO: 545531 - RNA, 18 nt, Homo sapiens
uacaaaacuacaugagaa

SEQ ID NO: 545532 - RNA, 21 nt, Homo sapiens
uacaaaacugcuuugugcaua

SEQ ID NO: 545533 - RNA, 12 nt, Homo sapiens
uacaaacauaag

SEQ ID NO: 545534 - RNA, 17 nt, Homo sapiens
uacaaacucccacuugu

SEQ ID NO: 545535 - RNA, 14 nt, Homo sapiens
uacaaacugcaaua

SEQ ID NO: 545536 - RNA, 15 nt, Homo sapiens
uacaaaguacagaaa

SEQ ID NO: 545537 - RNA, 22 nt, Homo sapiens
uacaaauagguagagucauuca

SEQ ID NO: 545538 - RNA, 18 nt, Homo sapiens
uacaaaucaaagauuugu

SEQ ID NO: 545539 - RNA, 23 nt, Homo sapiens
uacaaaugucuucaugaccuacu

SEQ ID NO: 545540 - RNA, 17 nt, Homo sapiens
uacaaauuuaugcauuu

SEQ ID NO: 545541 - RNA, 15 nt, Homo sapiens
uacaacagugagaaa

SEQ ID NO: 545542 - RNA, 17 nt, Homo sapiens
uacaaccaagcucucug

SEQ ID NO: 545543 - RNA, 14 nt, Homo sapiens
uacaaccagcccaa

SEQ ID NO: 545544 - RNA, 16 nt, Homo sapiens
uacaacccauaaucau

SEQ ID NO: 545545 - RNA, 21 nt, Homo sapiens
uacaacgccgagugcacugca

SEQ ID NO: 545546 - RNA, 16 nt, Homo sapiens
uacaacuucagcagua

SEQ ID NO: 545547 - RNA, 23 nt, Homo sapiens
uacaagacaggacccugggacca

SEQ ID NO: 545548 - RNA, 20 nt, Homo sapiens
uacaagauugaaaaucuugu

SEQ ID NO: 545549 - RNA, 18 nt, Homo sapiens
uacaaggacuuagugcau

SEQ ID NO: 545550 - RNA, 14 nt, Homo sapiens
uacaaggcuuuauc

SEQ ID NO: 545551 - RNA, 19 nt, Homo sapiens
uacaaggcuuuaucucagg

SEQ ID NO: 545552 - RNA, 14 nt, Homo sapiens
uacaagguaauugu

SEQ ID NO: 545553 - RNA, 22 nt, Homo sapiens
uacaaguaauauuauuacuuua

SEQ ID NO: 545554 - RNA, 13 nt, Homo sapiens
uacaaguguauau

SEQ ID NO: 545555 - RNA, 13 nt, Homo sapiens
uacaaguuucaga

SEQ ID NO: 545556 - RNA, 13 nt, Homo sapiens
uacaaguuugcua

SEQ ID NO: 545557 - RNA, 21 nt, Homo sapiens
uacaauaaaacuuugcugcca

SEQ ID NO: 545558 - RNA, 18 nt, Homo sapiens
uacaauaaagcaaugugg

SEQ ID NO: 545559 - RNA, 14 nt, Homo sapiens
uacaauacaaugua

SEQ ID NO: 545560 - RNA, 23 nt, Homo sapiens
uacaauacggcuaaucuuucauu

SEQ ID NO: 545561 - RNA, 17 nt, Homo sapiens
uacaauagacauugcaa

SEQ ID NO: 545562 - RNA, 23 nt, Homo sapiens
uacaauaggugcuuauucucaaa

SEQ ID NO: 545563 - RNA, 18 nt, Homo sapiens
uacaaucagcagucuagu

SEQ ID NO: 545564 - RNA, 14 nt, Homo sapiens
uacaauccugcauu

SEQ ID NO: 545565 - RNA, 17 nt, Homo sapiens
uacaauccuguuuauaa

SEQ ID NO: 545566 - RNA, 17 nt, Homo sapiens
uacaaucugcacuuuaa

SEQ ID NO: 545567 - RNA, 13 nt, Homo sapiens
uacaaucuucauu

SEQ ID NO: 545568 - RNA, 17 nt, Homo sapiens
uacaaugaucaccgacu

SEQ ID NO: 545569 - RNA, 20 nt, Homo sapiens
uacaauuaaaacuaagcaca

SEQ ID NO: 545570 - RNA, 22 nt, Homo sapiens
uacaauuauuuuuacaguucuc

SEQ ID NO: 545571 - RNA, 18 nt, Homo sapiens
uacaauuggcacuaaaga

SEQ ID NO: 545572 - RNA, 13 nt, Homo sapiens
uacaauugugagc

SEQ ID NO: 545573 - RNA, 15 nt, Homo sapiens
cucagcuacugcaaa

SEQ ID NO: 545574 - RNA, 23 nt, Homo sapiens
cucagcuaugcccggaccuccau

SEQ ID NO: 545575 - RNA, 22 nt, Homo sapiens
cucagcucugguccaggcccug

SEQ ID NO: 545576 - RNA, 14 nt, Homo sapiens
cucagcucuuccau

SEQ ID NO: 545577 - RNA, 12 nt, Homo sapiens
cucagcugccag

SEQ ID NO: 545578 - RNA, 20 nt, Homo sapiens
cucagcuucccaaguagcug

SEQ ID NO: 545579 - RNA, 18 nt, Homo sapiens
cucagcuuucccugccac

SEQ ID NO: 545580 - RNA, 15 nt, Homo sapiens
cucaggagaagggau

SEQ ID NO: 545581 - RNA, 14 nt, Homo sapiens
cucaggagacuugu

SEQ ID NO: 545582 - RNA, 21 nt, Homo sapiens
cucaggagagugugcaacugg

SEQ ID NO: 545583 - RNA, 22 nt, Homo sapiens
cucaggauauuaguuaaugagc

SEQ ID NO: 545584 - RNA, 22 nt, Homo sapiens
cucaggauccagucccuuacac

SEQ ID NO: 545585 - RNA, 23 nt, Homo sapiens
cucaggcaaagaaaaugaaaugc

SEQ ID NO: 545586 - RNA, 22 nt, Homo sapiens
cucaggcaaggggcauuucaca

SEQ ID NO: 545587 - RNA, 19 nt, Homo sapiens
cucaggcacacagcuacuc

SEQ ID NO: 545588 - RNA, 15 nt, Homo sapiens
cucaggccacagugg

SEQ ID NO: 545589 - RNA, 21 nt, Homo sapiens
cucaggccuaggugcgcagug

SEQ ID NO: 545590 - RNA, 17 nt, Homo sapiens
cucagggacagagccau

SEQ ID NO: 545591 - RNA, 16 nt, Homo sapiens
ggcauccacccagugc

SEQ ID NO: 545592 - RNA, 14 nt, Homo sapiens
ggcauccgcaaugu

SEQ ID NO: 545593 - RNA, 22 nt, Homo sapiens
ggcaucuauuuccucugugcaa

SEQ ID NO: 545594 - RNA, 20 nt, Homo sapiens
ggcaucucuuccccagagag

SEQ ID NO: 545595 - RNA, 14 nt, Homo sapiens
ggcaucugugcgug

SEQ ID NO: 545596 - RNA, 22 nt, Homo sapiens
ggcaucuuugccuugggcugcu

SEQ ID NO: 545597 - RNA, 19 nt, Homo sapiens
ggcaugaagcugcauauga

SEQ ID NO: 545598 - RNA, 19 nt, Homo sapiens
ggcaugagccacugcaccu

SEQ ID NO: 545599 - RNA, 20 nt, Homo sapiens
ggcaugagccacugugcuug

SEQ ID NO: 545600 - RNA, 20 nt, Homo sapiens
ggcaugagcuacuaugccca

SEQ ID NO: 545601 - RNA, 20 nt, Homo sapiens
ggcaugagggaucacagggc

SEQ ID NO: 545602 - RNA, 12 nt, Homo sapiens
ggcaugggagac

SEQ ID NO: 545603 - RNA, 21 nt, Homo sapiens
ggcauguggccuuuaucucaa

SEQ ID NO: 545604 - RNA, 20 nt, Homo sapiens
ggcauuuuugagaaagcaaa

SEQ ID NO: 545605 - RNA, 19 nt, Homo sapiens
ggccaaaaccaaugcugau

SEQ ID NO: 545606 - RNA, 18 nt, Homo sapiens
ggccaaauaugcacuuuc

SEQ ID NO: 545607 - RNA, 14 nt, Homo sapiens
ggccaacuaggcag

SEQ ID NO: 545608 - RNA, 19 nt, Homo sapiens
ggccaaggugaauagcaca

SEQ ID NO: 545609 - RNA, 22 nt, Homo sapiens
ggccaauaacuuuucaccaaug

SEQ ID NO: 545610 - RNA, 19 nt, Homo sapiens
ggccaaugggagagcucuu

SEQ ID NO: 545611 - RNA, 14 nt, Homo sapiens
ggccacaacagggc

SEQ ID NO: 545612 - RNA, 19 nt, Homo sapiens
ggccacaacagggcauuuu

SEQ ID NO: 545613 - RNA, 13 nt, Homo sapiens
ggccacagcgugc

SEQ ID NO: 545614 - RNA, 20 nt, Homo sapiens
ggccaccugcaggacccugu

SEQ ID NO: 545615 - RNA, 22 nt, Homo sapiens
ggccaccugccugcgucuuccg

SEQ ID NO: 545616 - RNA, 18 nt, Homo sapiens
ggccacggagcaguucag

SEQ ID NO: 545617 - RNA, 16 nt, Homo sapiens
ggccacugucaaggca

SEQ ID NO: 545618 - RNA, 17 nt, Homo sapiens
ggccacuguggccagag

SEQ ID NO: 545619 - RNA, 22 nt, Homo sapiens
ggccagacuggaagacacuuca

SEQ ID NO: 545620 - RNA, 14 nt, Homo sapiens
ggccagagccaugc

SEQ ID NO: 545621 - RNA, 16 nt, Homo sapiens
ggccagagccaugcca

SEQ ID NO: 545622 - RNA, 17 nt, Homo sapiens
ggccagagucuguuuca

SEQ ID NO: 545623 - RNA, 12 nt, Homo sapiens
ggccagcacuuc

SEQ ID NO: 545624 - RNA, 13 nt, Homo sapiens
ggccagccagugc

SEQ ID NO: 545625 - RNA, 23 nt, Homo sapiens
ggccagccccacccccagccagg

SEQ ID NO: 545626 - RNA, 15 nt, Homo sapiens
ggccagcccggcugg

SEQ ID NO: 545627 - RNA, 20 nt, Homo sapiens
ggccaggaguuugagaccag

SEQ ID NO: 545628 - RNA, 19 nt, Homo sapiens
ggccaggcuggagugcagu

SEQ ID NO: 545629 - RNA, 23 nt, Homo sapiens
ggccagggucugugugaaugugg

SEQ ID NO: 545630 - RNA, 11 nt, Homo sapiens
ggccagggugg

SEQ ID NO: 545631 - RNA, 20 nt, Homo sapiens
ggccaguggaagaaacaccc

SEQ ID NO: 545632 - RNA, 11 nt, Homo sapiens
ggccaucucaa

SEQ ID NO: 545633 - RNA, 13 nt, Homo sapiens
ggccaugccucag

SEQ ID NO: 545634 - RNA, 23 nt, Homo sapiens
ggccaugccuggagacauaucac

SEQ ID NO: 545635 - RNA, 15 nt, Homo sapiens
ggccauguccaaaga

SEQ ID NO: 545636 - RNA, 23 nt, Homo sapiens
ggccauuggguuuggggccaugg

SEQ ID NO: 545637 - RNA, 13 nt, Homo sapiens
ggccauuugcaau

SEQ ID NO: 545638 - RNA, 18 nt, Homo sapiens
ggcccaaagaaagagcua

SEQ ID NO: 545639 - RNA, 14 nt, Homo sapiens
ggcccaagagcaga

SEQ ID NO: 545640 - RNA, 14 nt, Homo sapiens
ggcccaagggaugg

SEQ ID NO: 545641 - RNA, 16 nt, Homo sapiens
ggcccaagucccuguu

SEQ ID NO: 545642 - RNA, 15 nt, Homo sapiens
ggcccaaguugcagu

SEQ ID NO: 545643 - RNA, 21 nt, Homo sapiens
ggcccagcacauggccauaga

SEQ ID NO: 545644 - RNA, 20 nt, Homo sapiens
ggcccagcuguagccauggc

SEQ ID NO: 545645 - RNA, 16 nt, Homo sapiens
ggcccaggaccagcug

SEQ ID NO: 545646 - RNA, 22 nt, Homo sapiens
ggcccaggccuugcugacucuc

SEQ ID NO: 545647 - RNA, 22 nt, Homo sapiens
ggcccagggcccgggcacccac

SEQ ID NO: 545648 - RNA, 17 nt, Homo sapiens
ggcccaggucucucaac

SEQ ID NO: 545649 - RNA, 13 nt, Homo sapiens
ggcccaguccucu

SEQ ID NO: 545650 - RNA, 13 nt, Homo sapiens
ggcccagugacaa

SEQ ID NO: 545651 - RNA, 17 nt, Homo sapiens
ggcccagugcauaugca

SEQ ID NO: 545652 - RNA, 17 nt, Homo sapiens
ggccccaguccaugcuu

SEQ ID NO: 545653 - RNA, 12 nt, Homo sapiens
ggccccaucucu

SEQ ID NO: 545654 - RNA, 23 nt, Homo sapiens
ggcccccaaugacacccaugcca

SEQ ID NO: 545655 - RNA, 21 nt, Homo sapiens
ggcccccgaccaacacuugca

SEQ ID NO: 545656 - RNA, 14 nt, Homo sapiens
ggccccucacccac

SEQ ID NO: 545657 - RNA, 22 nt, Homo sapiens
ggcccucccaucuccccgcuga

SEQ ID NO: 545658 - RNA, 18 nt, Homo sapiens
ggcccuccccacaaugcc

SEQ ID NO: 545659 - RNA, 22 nt, Homo sapiens
ggcccucccucccuagcccuuc

SEQ ID NO: 545660 - RNA, 18 nt, Homo sapiens
ggcccuccucucccaucc

SEQ ID NO: 545661 - RNA, 15 nt, Homo sapiens
ggcccucugcugagc

SEQ ID NO: 545662 - RNA, 13 nt, Homo sapiens
ggcccucuguggu

SEQ ID NO: 545663 - RNA, 15 nt, Homo sapiens
ggcccucuuaucuca

SEQ ID NO: 545664 - RNA, 20 nt, Homo sapiens
ggcccuguccuaagcacuuu

SEQ ID NO: 545665 - RNA, 21 nt, Homo sapiens
ggcccuguccuggcaucagua

SEQ ID NO: 545666 - RNA, 16 nt, Homo sapiens
ggcccuucacuuccau

SEQ ID NO: 545667 - RNA, 23 nt, Homo sapiens
ggcccuucccacaggacauuucu

SEQ ID NO: 545668 - RNA, 23 nt, Homo sapiens
ggcccuuccucuuugguggcaug

SEQ ID NO: 545669 - RNA, 20 nt, Homo sapiens
ggccgaaaaggauaugcagu

SEQ ID NO: 545670 - RNA, 13 nt, Homo sapiens
ggccgagagcaga

SEQ ID NO: 545671 - RNA, 19 nt, Homo sapiens
ggccgcagcucuugcccuu

SEQ ID NO: 545672 - RNA, 22 nt, Homo sapiens
ggccgccagcguguggagcaga

SEQ ID NO: 545673 - RNA, 22 nt, Homo sapiens
ggccgccaucugcgcagggugg

SEQ ID NO: 545674 - RNA, 14 nt, Homo sapiens
ggccgccugagacc

SEQ ID NO: 545675 - RNA, 16 nt, Homo sapiens
ggccguggcacagcug

SEQ ID NO: 545676 - RNA, 22 nt, Homo sapiens
ggccuaaucacucugagucaca

SEQ ID NO: 545677 - RNA, 15 nt, Homo sapiens
ggccuauauauuuaa

SEQ ID NO: 545678 - RNA, 14 nt, Homo sapiens
ggccuauuccagga

SEQ ID NO: 545679 - RNA, 13 nt, Homo sapiens
ggccucaagaaca

SEQ ID NO: 545680 - RNA, 20 nt, Homo sapiens
ggccucaagggaugucucac

SEQ ID NO: 545681 - RNA, 12 nt, Homo sapiens
ggccuccaggag

SEQ ID NO: 545682 - RNA, 20 nt, Homo sapiens
ggccucccacccgaugcugc

SEQ ID NO: 545683 - RNA, 22 nt, Homo sapiens
ggccucccagagugcugggauu

SEQ ID NO: 545684 - RNA, 18 nt, Homo sapiens
ggccuccccaauccaggc

SEQ ID NO: 545685 - RNA, 17 nt, Homo sapiens
ggccucccccgugacag

SEQ ID NO: 545686 - RNA, 13 nt, Homo sapiens
ggccucccuagca

SEQ ID NO: 545687 - RNA, 20 nt, Homo sapiens
ggccuccggcgucuugccca

SEQ ID NO: 545688 - RNA, 13 nt, Homo sapiens
ggccuccguccug

SEQ ID NO: 545689 - RNA, 20 nt, Homo sapiens
ggccuccugacagcaauaaa

SEQ ID NO: 545690 - RNA, 23 nt, Homo sapiens
ggccucgaaaaccaucacaugac

SEQ ID NO: 545691 - RNA, 20 nt, Homo sapiens
ggccucggcagaacucucug

SEQ ID NO: 545692 - RNA, 23 nt, Homo sapiens
ggccucucucucucuccucagga

SEQ ID NO: 545693 - RNA, 16 nt, Homo sapiens
ggccugacugcucaga

SEQ ID NO: 545694 - RNA, 19 nt, Homo sapiens
ggcuggaguggaguggcgu

SEQ ID NO: 545695 - RNA, 14 nt, Homo sapiens
ggcuggccaaggug

SEQ ID NO: 545696 - RNA, 14 nt, Homo sapiens
ggcuggccucccaa

SEQ ID NO: 545697 - RNA, 18 nt, Homo sapiens
ggcuggcugaguggaaug

SEQ ID NO: 545698 - RNA, 17 nt, Homo sapiens
ggcugggacguggcuca

SEQ ID NO: 545699 - RNA, 19 nt, Homo sapiens
ggcugggaguccuuaccuc

SEQ ID NO: 545700 - RNA, 13 nt, Homo sapiens
ggcugggccaugu

SEQ ID NO: 545701 - RNA, 12 nt, Homo sapiens
ggcuggggaccc

SEQ ID NO: 545702 - RNA, 17 nt, Homo sapiens
ggcuggggcuugcccuu

SEQ ID NO: 545703 - RNA, 21 nt, Homo sapiens
ggcuggggguggacuugggaa

SEQ ID NO: 545704 - RNA, 14 nt, Homo sapiens
ggcuggguggcacc

SEQ ID NO: 545705 - RNA, 18 nt, Homo sapiens
ggcuggucuuggugaaca

SEQ ID NO: 545706 - RNA, 21 nt, Homo sapiens
ggcuggugcucacagcuguaa

SEQ ID NO: 545707 - RNA, 20 nt, Homo sapiens
ggcugguggcccaggaccau

SEQ ID NO: 545708 - RNA, 22 nt, Homo sapiens
ggcugguuuuguaagaugcugg

SEQ ID NO: 545709 - RNA, 12 nt, Homo sapiens
ggcuguacugcu

SEQ ID NO: 545710 - RNA, 14 nt, Homo sapiens
ggcuguaguuacau

SEQ ID NO: 545711 - RNA, 18 nt, Homo sapiens
ggcugucaucagccugug

SEQ ID NO: 545712 - RNA, 21 nt, Homo sapiens
ggcugucugucaccagcuauc

SEQ ID NO: 545713 - RNA, 15 nt, Homo sapiens
ggcugucugugccau

SEQ ID NO: 545714 - RNA, 22 nt, Homo sapiens
cucagggagcagggaaggccug

SEQ ID NO: 545715 - RNA, 17 nt, Homo sapiens
cucaggggacacuggcc

SEQ ID NO: 545716 - RNA, 15 nt, Homo sapiens
cucagggguuucauu

SEQ ID NO: 545717 - RNA, 21 nt, Homo sapiens
cucagggucugcuucccccac

SEQ ID NO: 545718 - RNA, 14 nt, Homo sapiens
cucagggugcagag

SEQ ID NO: 545719 - RNA, 14 nt, Homo sapiens
cucagguaguacug

SEQ ID NO: 545720 - RNA, 22 nt, Homo sapiens
cucagguccgcccgaccaggau

SEQ ID NO: 545721 - RNA, 21 nt, Homo sapiens
cucaggugaaaauccaucuca

SEQ ID NO: 545722 - RNA, 22 nt, Homo sapiens
cucaggugaaaauccaucucau

SEQ ID NO: 545723 - RNA, 16 nt, Homo sapiens
cucagguguugccaaa

SEQ ID NO: 545724 - RNA, 23 nt, Homo sapiens
cucagguucuucagggccagucc

SEQ ID NO: 545725 - RNA, 21 nt, Homo sapiens
cucaguaaacgggaacaugcc

SEQ ID NO: 545726 - RNA, 16 nt, Homo sapiens
cucaguaaguuggcaa

SEQ ID NO: 545727 - RNA, 18 nt, Homo sapiens
cucaguauccaugcucuu

SEQ ID NO: 545728 - RNA, 21 nt, Homo sapiens
cucagucugggugggacuuau

SEQ ID NO: 545729 - RNA, 16 nt, Homo sapiens
cucagugacuguugua

SEQ ID NO: 545730 - RNA, 13 nt, Homo sapiens
cucagugcaucuu

SEQ ID NO: 545731 - RNA, 22 nt, Homo sapiens
cucagugccacuugacauuccu

SEQ ID NO: 545732 - RNA, 19 nt, Homo sapiens
cucagugcuugggcuccac

SEQ ID NO: 545733 - RNA, 15 nt, Homo sapiens
cucaguggaucuuca

SEQ ID NO: 545734 - RNA, 21 nt, Homo sapiens
cucagugggacaaaccagagc

SEQ ID NO: 545735 - RNA, 21 nt, Homo sapiens
cucaguguuuuggacuccauc

SEQ ID NO: 545736 - RNA, 20 nt, Homo sapiens
cucaguucuacacugauaca

SEQ ID NO: 545737 - RNA, 22 nt, Homo sapiens
cucaguucuugagggccucccc

SEQ ID NO: 545738 - RNA, 17 nt, Homo sapiens
cucaguuggugcugcuu

SEQ ID NO: 545739 - RNA, 18 nt, Homo sapiens
cucaguuggugcugcuuu

SEQ ID NO: 545740 - RNA, 14 nt, Homo sapiens
cucaguuugcauau

SEQ ID NO: 545741 - RNA, 19 nt, Homo sapiens
cucaguuugugugucuuaa

SEQ ID NO: 545742 - RNA, 18 nt, Homo sapiens
cucauaacuugagaccua

SEQ ID NO: 545743 - RNA, 18 nt, Homo sapiens
cucauagauuauuaucua

SEQ ID NO: 545744 - RNA, 14 nt, Homo sapiens
cucauagcauuaac

SEQ ID NO: 545745 - RNA, 21 nt, Homo sapiens
cucauaguucucuuuaagcca

SEQ ID NO: 545746 - RNA, 19 nt, Homo sapiens
cucauaugcauguagucac

SEQ ID NO: 545747 - RNA, 14 nt, Homo sapiens
cucaucacuggacu

SEQ ID NO: 545748 - RNA, 18 nt, Homo sapiens
cucaucaguaguucacau

SEQ ID NO: 545749 - RNA, 22 nt, Homo sapiens
cucaucauaaaauaaaguauau

SEQ ID NO: 545750 - RNA, 21 nt, Homo sapiens
cucaucauagcaauaacauuc

SEQ ID NO: 545751 - RNA, 13 nt, Homo sapiens
cucaucauccuug

SEQ ID NO: 545752 - RNA, 13 nt, Homo sapiens
cucauccaugcac

SEQ ID NO: 545753 - RNA, 17 nt, Homo sapiens
cucauccaugcacuuua

SEQ ID NO: 545754 - RNA, 12 nt, Homo sapiens
cucauccuggca

SEQ ID NO: 545755 - RNA, 15 nt, Homo sapiens
cucaucucuccucca

SEQ ID NO: 545756 - RNA, 13 nt, Homo sapiens
cucaucugugauu

SEQ ID NO: 545757 - RNA, 19 nt, Homo sapiens
cucaucuguuauccugcua

SEQ ID NO: 545758 - RNA, 22 nt, Homo sapiens
cucaucuuagguuggcaaaaag

SEQ ID NO: 545759 - RNA, 23 nt, Homo sapiens
cucaucuuuuaucuaacuauaug

SEQ ID NO: 545760 - RNA, 11 nt, Homo sapiens
cucaugaacua

SEQ ID NO: 545761 - RNA, 22 nt, Homo sapiens
cucaugaaugaaaauacaucuu

SEQ ID NO: 545762 - RNA, 18 nt, Homo sapiens
cucaugacuuuugguuaa

SEQ ID NO: 545763 - RNA, 21 nt, Homo sapiens
cucaugauaccaccuuuacug

SEQ ID NO: 545764 - RNA, 13 nt, Homo sapiens
cucaugauccaac

SEQ ID NO: 545765 - RNA, 11 nt, Homo sapiens
cucaugaucuu

SEQ ID NO: 545766 - RNA, 20 nt, Homo sapiens
cucaugcccugccaagcagc

SEQ ID NO: 545767 - RNA, 22 nt, Homo sapiens
cucaugcccugccaagcagcag

SEQ ID NO: 545768 - RNA, 21 nt, Homo sapiens
cucauggcuguguccacugca

SEQ ID NO: 545769 - RNA, 17 nt, Homo sapiens
cucauguguuugcauaa

SEQ ID NO: 545770 - RNA, 23 nt, Homo sapiens
cucauguuguugaggcugucaca

SEQ ID NO: 545771 - RNA, 17 nt, Homo sapiens
cucauguuuuuggaaac

SEQ ID NO: 545772 - RNA, 22 nt, Homo sapiens
cucauuacuggguauauaccca

SEQ ID NO: 545773 - RNA, 12 nt, Homo sapiens
cucauuagacug

SEQ ID NO: 545774 - RNA, 16 nt, Homo sapiens
cucauuaggaucugau

SEQ ID NO: 545775 - RNA, 19 nt, Homo sapiens
cucauuagugguacugggg

SEQ ID NO: 545776 - RNA, 16 nt, Homo sapiens
cucauuccaccuuccc

SEQ ID NO: 545777 - RNA, 13 nt, Homo sapiens
cucauuccuguag

SEQ ID NO: 545778 - RNA, 22 nt, Homo sapiens
cucauucuuuauucuauuuuag

SEQ ID NO: 545779 - RNA, 12 nt, Homo sapiens
cucauugaagca

SEQ ID NO: 545780 - RNA, 19 nt, Homo sapiens
cucauuggccugcccuuca

SEQ ID NO: 545781 - RNA, 23 nt, Homo sapiens
cucauugucuuguuauguacaaa

SEQ ID NO: 545782 - RNA, 22 nt, Homo sapiens
cucauuguuuauuaacaaauua

SEQ ID NO: 545783 - RNA, 21 nt, Homo sapiens
cucauuuaaaagcauaaggcc

SEQ ID NO: 545784 - RNA, 18 nt, Homo sapiens
cucauuuaagaauuugaa

SEQ ID NO: 545785 - RNA, 17 nt, Homo sapiens
cucauuuauagauguca

SEQ ID NO: 545786 - RNA, 20 nt, Homo sapiens
cucauuucuggaaagugcaa

SEQ ID NO: 545787 - RNA, 21 nt, Homo sapiens
cuccaaaccagacggugacgc

SEQ ID NO: 545788 - RNA, 16 nt, Homo sapiens
cuccaaaccugucuug

SEQ ID NO: 545789 - RNA, 20 nt, Homo sapiens
cuccaaaggucugaugucuc

SEQ ID NO: 545790 - RNA, 22 nt, Homo sapiens
cuccaacaccaagcacagcagc

SEQ ID NO: 545791 - RNA, 15 nt, Homo sapiens
cuccaacacuuugag

SEQ ID NO: 545792 - RNA, 17 nt, Homo sapiens
cuccaacagccagugug

SEQ ID NO: 545793 - RNA, 18 nt, Homo sapiens
cuccaacaucacagccca

SEQ ID NO: 545794 - RNA, 24 nt, Homo sapiens
cuccaaccacugugccacugacuu

SEQ ID NO: 545795 - RNA, 17 nt, Homo sapiens
cuccaacccuagcaaaa

SEQ ID NO: 545796 - RNA, 23 nt, Homo sapiens
cuccaacccugccgucaccacca

SEQ ID NO: 545797 - RNA, 23 nt, Homo sapiens
cuccaacgccccuguggccaacu

SEQ ID NO: 545798 - RNA, 18 nt, Homo sapiens
cuccaagccugccuccca

SEQ ID NO: 545799 - RNA, 13 nt, Homo sapiens
cuccaagcuccau

SEQ ID NO: 545800 - RNA, 22 nt, Homo sapiens
cuccaagcuuucagacaagaau

SEQ ID NO: 545801 - RNA, 22 nt, Homo sapiens
cuccaaggaccucucucaaugc

SEQ ID NO: 545802 - RNA, 18 nt, Homo sapiens
cuccaagguaacccggcu

SEQ ID NO: 545803 - RNA, 20 nt, Homo sapiens
cuccacaaagcaaaggcagu

SEQ ID NO: 545804 - RNA, 23 nt, Homo sapiens
cuccacaauagcagacaguguuu

SEQ ID NO: 545805 - RNA, 20 nt, Homo sapiens
cuccacaccucuaaacaucu

SEQ ID NO: 545806 - RNA, 19 nt, Homo sapiens
cuccacagcgagggcagcu

SEQ ID NO: 545807 - RNA, 17 nt, Homo sapiens
cuccacagucaauauua

SEQ ID NO: 545808 - RNA, 22 nt, Homo sapiens
cuccacaucugccuuaaaacca

SEQ ID NO: 545809 - RNA, 19 nt, Homo sapiens
cuccacauguucaacuauu

SEQ ID NO: 545810 - RNA, 20 nt, Homo sapiens
cuccaccccacaacccaaaa

SEQ ID NO: 545811 - RNA, 18 nt, Homo sapiens
cuccaccccgacugcuca

SEQ ID NO: 545812 - RNA, 20 nt, Homo sapiens
cuccacccuccucuagccau

SEQ ID NO: 545813 - RNA, 22 nt, Homo sapiens
cuccacccugcauuuuccucuu

SEQ ID NO: 545814 - RNA, 14 nt, Homo sapiens
gccaggaccauggc

SEQ ID NO: 545815 - RNA, 22 nt, Homo sapiens
gccaggagcccacagugccugu

SEQ ID NO: 545816 - RNA, 15 nt, Homo sapiens
gccaggagcugucac

SEQ ID NO: 545817 - RNA, 20 nt, Homo sapiens
gccaggaucccccucuuugc

SEQ ID NO: 545818 - RNA, 22 nt, Homo sapiens
gccaggauggucucgaucuccu

SEQ ID NO: 545819 - RNA, 21 nt, Homo sapiens
gccaggcagaucccacuugca

SEQ ID NO: 545820 - RNA, 18 nt, Homo sapiens
gccaggcaugguggcuca

SEQ ID NO: 545821 - RNA, 18 nt, Homo sapiens
gccaggccagagggcagu

SEQ ID NO: 545822 - RNA, 19 nt, Homo sapiens
gccaggccuuacaucuggc

SEQ ID NO: 545823 - RNA, 21 nt, Homo sapiens
gccaggcuggucucaaacucc

SEQ ID NO: 545824 - RNA, 17 nt, Homo sapiens
gccaggcuguaagcauu

SEQ ID NO: 545825 - RNA, 21 nt, Homo sapiens
gccaggcuguaagcauucuga

SEQ ID NO: 545826 - RNA, 14 nt, Homo sapiens
gccaggcuugccug

SEQ ID NO: 545827 - RNA, 14 nt, Homo sapiens
gccagggaaacaaa

SEQ ID NO: 545828 - RNA, 20 nt, Homo sapiens
gccagggcuuccccaucagc

SEQ ID NO: 545829 - RNA, 21 nt, Homo sapiens
gccaggggauugucucagggc

SEQ ID NO: 545830 - RNA, 23 nt, Homo sapiens
gccaggugcuuuucccuauccac

SEQ ID NO: 545831 - RNA, 21 nt, Homo sapiens
gccaggugggcggacaaaagg

SEQ ID NO: 545832 - RNA, 22 nt, Homo sapiens
gccaguaaaugggggugcauuu

SEQ ID NO: 545833 - RNA, 22 nt, Homo sapiens
gccaguaccuccugccccaugc

SEQ ID NO: 545834 - RNA, 19 nt, Homo sapiens
gccaguccugccuggccag

SEQ ID NO: 545835 - RNA, 15 nt, Homo sapiens
gccaguccugcuacc

SEQ ID NO: 545836 - RNA, 16 nt, Homo sapiens
gccagucuugccuagg

SEQ ID NO: 545837 - RNA, 15 nt, Homo sapiens
gccagugagggcagu

SEQ ID NO: 545838 - RNA, 11 nt, Homo sapiens
gccagugcacc

SEQ ID NO: 545839 - RNA, 21 nt, Homo sapiens
gccaguggggccuguggaaug

SEQ ID NO: 545840 - RNA, 15 nt, Homo sapiens
gccagugugggaaug

SEQ ID NO: 545841 - RNA, 14 nt, Homo sapiens
gccaguuaaggaaa

SEQ ID NO: 545842 - RNA, 15 nt, Homo sapiens
gccaguucuccuucc

SEQ ID NO: 545843 - RNA, 22 nt, Homo sapiens
gccauaaaaauaaaucaguuca

SEQ ID NO: 545844 - RNA, 18 nt, Homo sapiens
gccauaaaaguaaaggau

SEQ ID NO: 545845 - RNA, 16 nt, Homo sapiens
gccauaagaaagcacu

SEQ ID NO: 545846 - RNA, 17 nt, Homo sapiens
gccauaagaaagcacua

SEQ ID NO: 545847 - RNA, 14 nt, Homo sapiens
gccauaagagguga

SEQ ID NO: 545848 - RNA, 19 nt, Homo sapiens
gccauaauucuaaguuauu

SEQ ID NO: 545849 - RNA, 18 nt, Homo sapiens
gccauacugccuuugcag

SEQ ID NO: 545850 - RNA, 20 nt, Homo sapiens
gccauagaggcccaggcacc

SEQ ID NO: 545851 - RNA, 19 nt, Homo sapiens
gccauagucuuaacugguc

SEQ ID NO: 545852 - RNA, 22 nt, Homo sapiens
ccauauaaaucucaaugaauuc

SEQ ID NO: 545853 - RNA, 13 nt, Homo sapiens
ccauauacuuuaa

SEQ ID NO: 545854 - RNA, 13 nt, Homo sapiens
ccauauagucuau

SEQ ID NO: 545855 - RNA, 21 nt, Homo sapiens
ccauauauuuaauaugucaaa

SEQ ID NO: 545856 - RNA, 16 nt, Homo sapiens
ccauaucugugaaaug

SEQ ID NO: 545857 - RNA, 22 nt, Homo sapiens
ccauaucuuaaagaaacagcuu

SEQ ID NO: 545858 - RNA, 22 nt, Homo sapiens
ccauaugauauuuugucuccua

SEQ ID NO: 545859 - RNA, 20 nt, Homo sapiens
ccauauggaggacugugaca

SEQ ID NO: 545860 - RNA, 14 nt, Homo sapiens
ccauaugugggugu

SEQ ID NO: 545861 - RNA, 15 nt, Homo sapiens
ccauauugagucaaa

SEQ ID NO: 545862 - RNA, 22 nt, Homo sapiens
ccauauugugcuucacaguaga

SEQ ID NO: 545863 - RNA, 19 nt, Homo sapiens
ccaucaacaagucuugaaa

SEQ ID NO: 545864 - RNA, 14 nt, Homo sapiens
ccaucaacuguauu

SEQ ID NO: 545865 - RNA, 17 nt, Homo sapiens
ccaucaauucuuagaau

SEQ ID NO: 545866 - RNA, 22 nt, Homo sapiens
ccaucaauucuuagaauaucua

SEQ ID NO: 545867 - RNA, 16 nt, Homo sapiens
ccaucacacauguuca

SEQ ID NO: 545868 - RNA, 12 nt, Homo sapiens
ccaucaccagac

SEQ ID NO: 545869 - RNA, 14 nt, Homo sapiens
ccaucaccagacag

SEQ ID NO: 545870 - RNA, 19 nt, Homo sapiens
ccaucacccucagcaguuc

SEQ ID NO: 545871 - RNA, 23 nt, Homo sapiens
ccaucacuagaagaaaagcccau

SEQ ID NO: 545872 - RNA, 12 nt, Homo sapiens
ccaucacuggag

SEQ ID NO: 545873 - RNA, 15 nt, Homo sapiens
ccaucagacugucaa

SEQ ID NO: 545874 - RNA, 13 nt, Homo sapiens
ccaucagccauuu

SEQ ID NO: 545875 - RNA, 17 nt, Homo sapiens
ccaucaggauccagucu

SEQ ID NO: 545876 - RNA, 21 nt, Homo sapiens
ccaucaggcaguguuaccugu

SEQ ID NO: 545877 - RNA, 23 nt, Homo sapiens
ccaucagugcucccucacauguc

SEQ ID NO: 545878 - RNA, 12 nt, Homo sapiens
ccaucaucccag

SEQ ID NO: 545879 - RNA, 13 nt, Homo sapiens
ccaucauuccuuu

SEQ ID NO: 545880 - RNA, 12 nt, Homo sapiens
ccauccaaauaa

SEQ ID NO: 545881 - RNA, 22 nt, Homo sapiens
ccauccagccgcugcacaucac

SEQ ID NO: 545882 - RNA, 13 nt, Homo sapiens
ccauccaguggag

SEQ ID NO: 545883 - RNA, 14 nt, Homo sapiens
ccauccauauacuu

SEQ ID NO: 545884 - RNA, 14 nt, Homo sapiens
ccaucccauuggca

SEQ ID NO: 545885 - RNA, 15 nt, Homo sapiens
ccaucccccugccuc

SEQ ID NO: 545886 - RNA, 23 nt, Homo sapiens
ccauccccugaugcccaggucac

SEQ ID NO: 545887 - RNA, 18 nt, Homo sapiens
ccaucccuaccacugugg

SEQ ID NO: 545888 - RNA, 17 nt, Homo sapiens
ccaucccuuuuuuuaca

SEQ ID NO: 545889 - RNA, 16 nt, Homo sapiens
ccauccucacauguga

SEQ ID NO: 545890 - RNA, 21 nt, Homo sapiens
ccauccuccccagcgccaucu

SEQ ID NO: 545891 - RNA, 22 nt, Homo sapiens
ccauccuccuuuucuccuugcc

SEQ ID NO: 545892 - RNA, 12 nt, Homo sapiens
ccauccugaugg

SEQ ID NO: 545893 - RNA, 16 nt, Homo sapiens
ccauccuguauucuuc

SEQ ID NO: 545894 - RNA, 19 nt, Homo sapiens
ccauccuguuuguaugaaa

SEQ ID NO: 545895 - RNA, 18 nt, Homo sapiens
ccauccuucccuuuggag

SEQ ID NO: 545896 - RNA, 22 nt, Homo sapiens
ccauccuugccaauagugucau

SEQ ID NO: 545897 - RNA, 22 nt, Homo sapiens
ccaucguccuuccucucaagcu

SEQ ID NO: 545898 - RNA, 15 nt, Homo sapiens
ccaucuaugucccuu

SEQ ID NO: 545899 - RNA, 20 nt, Homo sapiens
ccaucucacaccaguccaaa

SEQ ID NO: 545900 - RNA, 13 nt, Homo sapiens
ccaucuccaggga

SEQ ID NO: 545901 - RNA, 16 nt, Homo sapiens
ccaucucuaccaucau

SEQ ID NO: 545902 - RNA, 18 nt, Homo sapiens
ccaucucucccacuuccu

SEQ ID NO: 545903 - RNA, 13 nt, Homo sapiens
ccaucugagcugg

SEQ ID NO: 545904 - RNA, 18 nt, Homo sapiens
ccaucugcuuacaauucc

SEQ ID NO: 545905 - RNA, 19 nt, Homo sapiens
ccaucugcuuacaauuccc

SEQ ID NO: 545906 - RNA, 15 nt, Homo sapiens
ccaucuucuauucaa

SEQ ID NO: 545907 - RNA, 15 nt, Homo sapiens
ccaucuucuuuauac

SEQ ID NO: 545908 - RNA, 22 nt, Homo sapiens
ccaucuugaucuuugagcccau

SEQ ID NO: 545909 - RNA, 23 nt, Homo sapiens
ccaucuugugguaacuugcugcu

SEQ ID NO: 545910 - RNA, 15 nt, Homo sapiens
ccaucuuuugugaga

SEQ ID NO: 545911 - RNA, 23 nt, Homo sapiens
ccaucuuuugugagauguaauug

SEQ ID NO: 545912 - RNA, 22 nt, Homo sapiens
ccaugaaacuuuagagauuaac

SEQ ID NO: 545913 - RNA, 18 nt, Homo sapiens
ccaugaaagacuucucua

SEQ ID NO: 545914 - RNA, 14 nt, Homo sapiens
ccaugaagaccaca

SEQ ID NO: 545915 - RNA, 19 nt, Homo sapiens
ccaugaagcacugagcaga

SEQ ID NO: 545916 - RNA, 19 nt, Homo sapiens
ccaugaagcgaaacacaga

SEQ ID NO: 545917 - RNA, 13 nt, Homo sapiens
ccaugaagugugu

SEQ ID NO: 545918 - RNA, 15 nt, Homo sapiens
ccaugaaucaaagac

SEQ ID NO: 545919 - RNA, 22 nt, Homo sapiens
ccaugacaagaacaaagccacu

SEQ ID NO: 545920 - RNA, 21 nt, Homo sapiens
ccaugacccaccccugugcuc

SEQ ID NO: 545921 - RNA, 23 nt, Homo sapiens
ccaugacgacauacaugcuacuu

SEQ ID NO: 545922 - RNA, 21 nt, Homo sapiens
ccaugacgcacugcucaagaa

SEQ ID NO: 545923 - RNA, 13 nt, Homo sapiens
ccaugacugagaa

SEQ ID NO: 545924 - RNA, 21 nt, Homo sapiens
ccaugacugcauuuuacugua

SEQ ID NO: 545925 - RNA, 23 nt, Homo sapiens
ccaugacuggcugucugccugua

SEQ ID NO: 545926 - RNA, 20 nt, Homo sapiens
ccaugacuugggcuuucuga

SEQ ID NO: 545927 - RNA, 22 nt, Homo sapiens
ccaugagccugcccgcugcaau

SEQ ID NO: 545928 - RNA, 15 nt, Homo sapiens
ccaugagcucggggu

SEQ ID NO: 545929 - RNA, 21 nt, Homo sapiens
ccaugauguaaguuuaccuau

SEQ ID NO: 545930 - RNA, 20 nt, Homo sapiens
ccaugcaccucagggccaag

SEQ ID NO: 545931 - RNA, 17 nt, Homo sapiens
ccaugcagggggcuccu

SEQ ID NO: 545932 - RNA, 11 nt, Homo sapiens
ccaugccuguc

SEQ ID NO: 545933 - RNA, 20 nt, Homo sapiens
ccaugcugggccacugggga

SEQ ID NO: 545934 - RNA, 22 nt, Homo sapiens
ccauggacacuacacccagcaa

SEQ ID NO: 545935 - RNA, 17 nt, Homo sapiens
ccauggacccaauauuu

SEQ ID NO: 545936 - RNA, 19 nt, Homo sapiens
ccauggcaccuucagacuu

SEQ ID NO: 545937 - RNA, 13 nt, Homo sapiens
ccauggugagcuc

SEQ ID NO: 545938 - RNA, 16 nt, Homo sapiens
ccauggugcuuguuaa

SEQ ID NO: 545939 - RNA, 16 nt, Homo sapiens
ccauguaaauugcaaa

SEQ ID NO: 545940 - RNA, 17 nt, Homo sapiens
ccauguaagguugugca

SEQ ID NO: 545941 - RNA, 15 nt, Homo sapiens
gcccuggugcugcca

SEQ ID NO: 545942 - RNA, 17 nt, Homo sapiens
gcccugguguguuucca

SEQ ID NO: 545943 - RNA, 14 nt, Homo sapiens
gcccugucagugca

SEQ ID NO: 545944 - RNA, 18 nt, Homo sapiens
gcccugucauccagcuca

SEQ ID NO: 545945 - RNA, 18 nt, Homo sapiens
gcccugucaugugccuug

SEQ ID NO: 545946 - RNA, 19 nt, Homo sapiens
gcccuguccuaagcacuuu

SEQ ID NO: 545947 - RNA, 16 nt, Homo sapiens
gcccuuaaggacaaaa

SEQ ID NO: 545948 - RNA, 18 nt, Homo sapiens
gcccuuaaggacaaaaau

SEQ ID NO: 545949 - RNA, 16 nt, Homo sapiens
gcccuucaagugcacu

SEQ ID NO: 545950 - RNA, 15 nt, Homo sapiens
gcccuucacugucac

SEQ ID NO: 545951 - RNA, 17 nt, Homo sapiens
gcccuucacuuccauca

SEQ ID NO: 545952 - RNA, 20 nt, Homo sapiens
gcccuucagucuuaauacuu

SEQ ID NO: 545953 - RNA, 15 nt, Homo sapiens
gcccuucaugcauuu

SEQ ID NO: 545954 - RNA, 17 nt, Homo sapiens
gcccuuccagccuggga

SEQ ID NO: 545955 - RNA, 13 nt, Homo sapiens
gcccuuccagugg

SEQ ID NO: 545956 - RNA, 19 nt, Homo sapiens
gcccuucccccugcaaaaa

SEQ ID NO: 545957 - RNA, 19 nt, Homo sapiens
gcccuugcccugaccuccc

SEQ ID NO: 545958 - RNA, 20 nt, Homo sapiens
gcccuugggguaagccagag

SEQ ID NO: 545959 - RNA, 14 nt, Homo sapiens
gcccuugucacugg

SEQ ID NO: 545960 - RNA, 18 nt, Homo sapiens
gccgaaaacaggagcaaa

SEQ ID NO: 545961 - RNA, 20 nt, Homo sapiens
gccgaaaaggauaugcagua

SEQ ID NO: 545962 - RNA, 15 nt, Homo sapiens
gccgaagcucuggcu

SEQ ID NO: 545963 - RNA, 13 nt, Homo sapiens
gccgaaugugcag

SEQ ID NO: 545964 - RNA, 13 nt, Homo sapiens
gccgacaaugccc

SEQ ID NO: 545965 - RNA, 20 nt, Homo sapiens
gccgacucccccaaccaagg

SEQ ID NO: 545966 - RNA, 12 nt, Homo sapiens
gccgacugccug

SEQ ID NO: 545967 - RNA, 14 nt, Homo sapiens
gccgacuuggagac

SEQ ID NO: 545968 - RNA, 18 nt, Homo sapiens
gccgacuuggagacuccu

SEQ ID NO: 545969 - RNA, 15 nt, Homo sapiens
gccgaucccaggugc

SEQ ID NO: 545970 - RNA, 17 nt, Homo sapiens
gccgcaaaccacacugg

SEQ ID NO: 545971 - RNA, 19 nt, Homo sapiens
gccgcaaaccacacuggac

SEQ ID NO: 545972 - RNA, 16 nt, Homo sapiens
gccgcagccaacccgg

SEQ ID NO: 545973 - RNA, 13 nt, Homo sapiens
gccgcccaaagag

SEQ ID NO: 545974 - RNA, 19 nt, Homo sapiens
ccauucacuucauaaucca

SEQ ID NO: 545975 - RNA, 19 nt, Homo sapiens
ccauucagaaagcuucaaa

SEQ ID NO: 545976 - RNA, 15 nt, Homo sapiens
ccauucagaugaaua

SEQ ID NO: 545977 - RNA, 23 nt, Homo sapiens
ccauuccaaaauacaauguuauc

SEQ ID NO: 545978 - RNA, 16 nt, Homo sapiens
ccauuccaaagcuuua

SEQ ID NO: 545979 - RNA, 12 nt, Homo sapiens
ccauuccaaagu

SEQ ID NO: 545980 - RNA, 22 nt, Homo sapiens
ccauuccacuccacucagguuc

SEQ ID NO: 545981 - RNA, 16 nt, Homo sapiens
ccauuccauggaaaua

SEQ ID NO: 545982 - RNA, 18 nt, Homo sapiens
ccauucccagauguacca

SEQ ID NO: 545983 - RNA, 18 nt, Homo sapiens
ccauucuccugccucagc

SEQ ID NO: 545984 - RNA, 20 nt, Homo sapiens
ccauucucugccuguacuga

SEQ ID NO: 545985 - RNA, 20 nt, Homo sapiens
ccauucugucucuguacugu

SEQ ID NO: 545986 - RNA, 23 nt, Homo sapiens
ccauucuguuuggaucuauagaa

SEQ ID NO: 545987 - RNA, 20 nt, Homo sapiens
ccauugccccagaccuggaa

SEQ ID NO: 545988 - RNA, 22 nt, Homo sapiens
ccauuggaauaauaaauuugau

SEQ ID NO: 545989 - RNA, 23 nt, Homo sapiens
ccauuggaauaauaaauuugaua

SEQ ID NO: 545990 - RNA, 19 nt, Homo sapiens
ccauuggacagauuucagu

SEQ ID NO: 545991 - RNA, 17 nt, Homo sapiens
ccauuggauuuuuucca

SEQ ID NO: 545992 - RNA, 14 nt, Homo sapiens
ccauuguaauauua

SEQ ID NO: 545993 - RNA, 14 nt, Homo sapiens
ccauuguagcucuu

SEQ ID NO: 545994 - RNA, 14 nt, Homo sapiens
ccauuuaacauugu

SEQ ID NO: 545995 - RNA, 14 nt, Homo sapiens
ccauuuaaguaucu

SEQ ID NO: 545996 - RNA, 22 nt, Homo sapiens
ccauuuagaggauguggcugua

SEQ ID NO: 545997 - RNA, 17 nt, Homo sapiens
ccauuuauccacaggaa

SEQ ID NO: 545998 - RNA, 21 nt, Homo sapiens
ccauuuauuauuuuguaacuu

SEQ ID NO: 545999 - RNA, 19 nt, Homo sapiens
ccauuucugccucgcucac

SEQ ID NO: 546000 - RNA, 18 nt, Homo sapiens
ccauuucuggacaugacg

SEQ ID NO: 546001 - RNA, 13 nt, Homo sapiens
ccauuucuucucu

SEQ ID NO: 546002 - RNA, 19 nt, Homo sapiens
ccauuucuugaaaagccuu

SEQ ID NO: 546003 - RNA, 21 nt, Homo sapiens
ccauuucuugaaaagccuugg

SEQ ID NO: 546004 - RNA, 16 nt, Homo sapiens
ccauuugaacacauua

SEQ ID NO: 546005 - RNA, 17 nt, Homo sapiens
ccauuugaacacauuau

SEQ ID NO: 546006 - RNA, 12 nt, Homo sapiens
ccauuugcaaua

SEQ ID NO: 546007 - RNA, 21 nt, Homo sapiens
ccauuuggcaaugccaucauc

SEQ ID NO: 546008 - RNA, 20 nt, Homo sapiens
ccauuugugugugugcaagu

SEQ ID NO: 546009 - RNA, 17 nt, Homo sapiens
ccauuuguuuaaauuca

SEQ ID NO: 546010 - RNA, 15 nt, Homo sapiens
ccauuuuaaaaacca

SEQ ID NO: 546011 - RNA, 15 nt, Homo sapiens
ccauuuuaguuuuaa

SEQ ID NO: 546012 - RNA, 12 nt, Homo sapiens
ccauuuuguuaa

SEQ ID NO: 546013 - RNA, 19 nt, Homo sapiens
ccauuuuuuguauuuuaac

SEQ ID NO: 546014 - RNA, 23 nt, Homo sapiens
ccauuuuuuucauuguguucucu

SEQ ID NO: 546015 - RNA, 16 nt, Homo sapiens
cccaaaaaacuacuuc

SEQ ID NO: 546016 - RNA, 13 nt, Homo sapiens
cccaaaacacagg

SEQ ID NO: 546017 - RNA, 16 nt, Homo sapiens
cccaaacaacucagcu

SEQ ID NO: 546018 - RNA, 12 nt, Homo sapiens
cccaaacacuuc

SEQ ID NO: 546019 - RNA, 23 nt, Homo sapiens
cccaaacauguuguacauuucac

SEQ ID NO: 546020 - RNA, 19 nt, Homo sapiens
cccaaacuggagugcagug

SEQ ID NO: 546021 - RNA, 21 nt, Homo sapiens
cccaaacuuauggacacugcc

SEQ ID NO: 546022 - RNA, 12 nt, Homo sapiens
cccaaagagccu

SEQ ID NO: 546023 - RNA, 17 nt, Homo sapiens
cccaaaggauggucaca

SEQ ID NO: 546024 - RNA, 19 nt, Homo sapiens
cccaaagugcuaguauuau

SEQ ID NO: 546025 - RNA, 12 nt, Homo sapiens
cccaaaucugca

SEQ ID NO: 546026 - RNA, 22 nt, Homo sapiens
cccaacacaaacccccacucca

SEQ ID NO: 546027 - RNA, 15 nt, Homo sapiens
cccaacccaaugggc

SEQ ID NO: 546028 - RNA, 18 nt, Homo sapiens
cccaaccucauggucaug

SEQ ID NO: 546029 - RNA, 16 nt, Homo sapiens
cccaaccuucuuguca

SEQ ID NO: 546030 - RNA, 18 nt, Homo sapiens
cccaacuucauacuggca

SEQ ID NO: 546031 - RNA, 13 nt, Homo sapiens
cccaacuugccaa

SEQ ID NO: 546032 - RNA, 18 nt, Homo sapiens
cccaagacccuagugaaa

SEQ ID NO: 546033 - RNA, 18 nt, Homo sapiens
cccaagauugagcucucu

SEQ ID NO: 546034 - RNA, 18 nt, Homo sapiens
cccaagcacuucacagcu

SEQ ID NO: 546035 - RNA, 22 nt, Homo sapiens
cccaaggccuuuccuacaugcc

SEQ ID NO: 546036 - RNA, 19 nt, Homo sapiens
cccaagggacagcaaguga

SEQ ID NO: 546037 - RNA, 17 nt, Homo sapiens
cccaaguagcugggauu

SEQ ID NO: 546038 - RNA, 15 nt, Homo sapiens
cccaagucccuguca

SEQ ID NO: 546039 - RNA, 22 nt, Homo sapiens
cccaagucccugucauuugaac

SEQ ID NO: 546040 - RNA, 18 nt, Homo sapiens
cccaagugaaaucaaagg

SEQ ID NO: 546041 - RNA, 17 nt, Homo sapiens
cccaaguucaugcagcu

SEQ ID NO: 546042 - RNA, 16 nt, Homo sapiens
cccaaguuccacugcu

SEQ ID NO: 546043 - RNA, 17 nt, Homo sapiens
cccaauaaaagugacuc

SEQ ID NO: 546044 - RNA, 18 nt, Homo sapiens
cccaauaaaagugacucu

SEQ ID NO: 546045 - RNA, 17 nt, Homo sapiens
cccaauauuuaccagac

SEQ ID NO: 546046 - RNA, 22 nt, Homo sapiens
cccaaucucugccauaucagug

SEQ ID NO: 546047 - RNA, 18 nt, Homo sapiens
cccaaucuuucuauauaa

SEQ ID NO: 546048 - RNA, 19 nt, Homo sapiens
cccaaugacacccaugcca

SEQ ID NO: 546049 - RNA, 19 nt, Homo sapiens
cccacaaaacuucagugug

SEQ ID NO: 546050 - RNA, 14 nt, Homo sapiens
cccacaaugccaga

SEQ ID NO: 546051 - RNA, 10 nt, Homo sapiens
cccacaccca

SEQ ID NO: 546052 - RNA, 12 nt, Homo sapiens
cccacagaugau

SEQ ID NO: 546053 - RNA, 12 nt, Homo sapiens
cccacaguuuua

SEQ ID NO: 546054 - RNA, 17 nt, Homo sapiens
cccacauccaacuccag

SEQ ID NO: 546055 - RNA, 23 nt, Homo sapiens
cccacaucccacuggaucuggcu

SEQ ID NO: 546056 - RNA, 17 nt, Homo sapiens
cccaccaaucugcccuu

SEQ ID NO: 546057 - RNA, 15 nt, Homo sapiens
cccacccaacuaauu

SEQ ID NO: 546058 - RNA, 15 nt, Homo sapiens
cccacccggacaggu

SEQ ID NO: 546059 - RNA, 14 nt, Homo sapiens
cccacccugggacc

SEQ ID NO: 546060 - RNA, 15 nt, Homo sapiens
cccaccgguccagcu

SEQ ID NO: 546061 - RNA, 20 nt, Homo sapiens
cccacgcugaccaugcguca

SEQ ID NO: 546062 - RNA, 19 nt, Homo sapiens
cccacggcaccucggggac

SEQ ID NO: 546063 - RNA, 21 nt, Homo sapiens
cccacguaugugaaacacaca

SEQ ID NO: 546064 - RNA, 21 nt, Homo sapiens
cccacuagaagcaacuaggaa

SEQ ID NO: 546065 - RNA, 14 nt, Homo sapiens
cccacucaggggac

SEQ ID NO: 546066 - RNA, 18 nt, Homo sapiens
gccucgugccaugaucug

SEQ ID NO: 546067 - RNA, 18 nt, Homo sapiens
gccucguguccagacuca

SEQ ID NO: 546068 - RNA, 20 nt, Homo sapiens
gccucuacuuugauucugau

SEQ ID NO: 546069 - RNA, 17 nt, Homo sapiens
gccucuccaguuugcac

SEQ ID NO: 546070 - RNA, 18 nt, Homo sapiens
gccucuccuacuaugcaa

SEQ ID NO: 546071 - RNA, 21 nt, Homo sapiens
gccucugaucguaggaauuga

SEQ ID NO: 546072 - RNA, 16 nt, Homo sapiens
gccucugcuguagcuu

SEQ ID NO: 546073 - RNA, 18 nt, Homo sapiens
gccucuggaauugcucaa

SEQ ID NO: 546074 - RNA, 20 nt, Homo sapiens
gccucuggcaaguagcuuuc

SEQ ID NO: 546075 - RNA, 15 nt, Homo sapiens
gccucuggcucucau

SEQ ID NO: 546076 - RNA, 18 nt, Homo sapiens
gccucuggcucucauggg

SEQ ID NO: 546077 - RNA, 20 nt, Homo sapiens
gccucuggcucucauggggu

SEQ ID NO: 546078 - RNA, 23 nt, Homo sapiens
gccucuggcuucccuaaacugca

SEQ ID NO: 546079 - RNA, 16 nt, Homo sapiens
gccucugguugccucc

SEQ ID NO: 546080 - RNA, 14 nt, Homo sapiens
gccucuuccaggaa

SEQ ID NO: 546081 - RNA, 19 nt, Homo sapiens
gccucuuguugagugccag

SEQ ID NO: 546082 - RNA, 19 nt, Homo sapiens
gccucuuuucucugugcuu

SEQ ID NO: 546083 - RNA, 23 nt, Homo sapiens
gccugaaaaggacuucuggcuau

SEQ ID NO: 546084 - RNA, 13 nt, Homo sapiens
gccugaacacuca

SEQ ID NO: 546085 - RNA, 16 nt, Homo sapiens
gccugaacaugccccu

SEQ ID NO: 546086 - RNA, 18 nt, Homo sapiens
gccugaagaguccucuga

SEQ ID NO: 546087 - RNA, 20 nt, Homo sapiens
gccugaagcuggccuggacc

SEQ ID NO: 546088 - RNA, 12 nt, Homo sapiens
gccugacagaaa

SEQ ID NO: 546089 - RNA, 19 nt, Homo sapiens
gccugaccucaagcaacca

SEQ ID NO: 546090 - RNA, 15 nt, Homo sapiens
gccugacuccugggu

SEQ ID NO: 546091 - RNA, 15 nt, Homo sapiens
gccugacucuucccu

SEQ ID NO: 546092 - RNA, 17 nt, Homo sapiens
gccugagccucugcuuc

SEQ ID NO: 546093 - RNA, 16 nt, Homo sapiens
gccugaggugugugcc

SEQ ID NO: 546094 - RNA, 23 nt, Homo sapiens
gccugaggugugugccacucaga

SEQ ID NO: 546095 - RNA, 19 nt, Homo sapiens
gccugagucacccaugaag

SEQ ID NO: 546096 - RNA, 14 nt, Homo sapiens
cccuggacuauggu

SEQ ID NO: 546097 - RNA, 12 nt, Homo sapiens
cccuggagcuga

SEQ ID NO: 546098 - RNA, 19 nt, Homo sapiens
cccuggagugugucagagc

SEQ ID NO: 546099 - RNA, 20 nt, Homo sapiens
cccuggcagcagcaggugug

SEQ ID NO: 546100 - RNA, 21 nt, Homo sapiens
cccuggcccccaguagugugu

SEQ ID NO: 546101 - RNA, 15 nt, Homo sapiens
cccuggccuagcaua

SEQ ID NO: 546102 - RNA, 23 nt, Homo sapiens
cccuggccuuaaaaggggcccaa

SEQ ID NO: 546103 - RNA, 15 nt, Homo sapiens
cccuggcuccaguga

SEQ ID NO: 546104 - RNA, 20 nt, Homo sapiens
cccuggcuccucuacuguuu

SEQ ID NO: 546105 - RNA, 15 nt, Homo sapiens
cccuggcugcccugg

SEQ ID NO: 546106 - RNA, 14 nt, Homo sapiens
cccugggaaccacu

SEQ ID NO: 546107 - RNA, 14 nt, Homo sapiens
cccugggacaccca

SEQ ID NO: 546108 - RNA, 19 nt, Homo sapiens
cccugggccccaccaccua

SEQ ID NO: 546109 - RNA, 17 nt, Homo sapiens
cccuggggaaggagcca

SEQ ID NO: 546110 - RNA, 17 nt, Homo sapiens
cccuggggcaggggugc

SEQ ID NO: 546111 - RNA, 20 nt, Homo sapiens
cccugggggcugugauauua

SEQ ID NO: 546112 - RNA, 14 nt, Homo sapiens
cccugggguggcca

SEQ ID NO: 546113 - RNA, 20 nt, Homo sapiens
cccugggguggccaccagua

SEQ ID NO: 546114 - RNA, 23 nt, Homo sapiens
cccuggguuccgguuguugauau

SEQ ID NO: 546115 - RNA, 14 nt, Homo sapiens
cccuggugaaggau

SEQ ID NO: 546116 - RNA, 15 nt, Homo sapiens
cccugguguguuucc

SEQ ID NO: 546117 - RNA, 15 nt, Homo sapiens
cccuguacugaagaa

SEQ ID NO: 546118 - RNA, 22 nt, Homo sapiens
cccuguaguugacaauucugca

SEQ ID NO: 546119 - RNA, 14 nt, Homo sapiens
cccuguaugauucc

SEQ ID NO: 546120 - RNA, 17 nt, Homo sapiens
cccugucacacacugga

SEQ ID NO: 546121 - RNA, 21 nt, Homo sapiens
cccugucccaccaacucugca

SEQ ID NO: 546122 - RNA, 19 nt, Homo sapiens
cccugucccuucgagucca

SEQ ID NO: 546123 - RNA, 22 nt, Homo sapiens
cccugucccuucgaguccagga

SEQ ID NO: 546124 - RNA, 17 nt, Homo sapiens
cccuguccuaagcacuu

SEQ ID NO: 546125 - RNA, 21 nt, Homo sapiens
cccuguccuaagcacuuuaua

SEQ ID NO: 546126 - RNA, 16 nt, Homo sapiens
cccuguccuugcccuu

SEQ ID NO: 546127 - RNA, 16 nt, Homo sapiens
cccugucucuuaaaaa

SEQ ID NO: 546128 - RNA, 12 nt, Homo sapiens
cccugucugcuu

SEQ ID NO: 546129 - RNA, 21 nt, Homo sapiens
cccuguggcaggacacacaug

SEQ ID NO: 546130 - RNA, 22 nt, Homo sapiens
cccuguggccaacugcaaaaaa

SEQ ID NO: 546131 - RNA, 20 nt, Homo sapiens
cccuguguauucaccaccaa

SEQ ID NO: 546132 - RNA, 20 nt, Homo sapiens
cccuguguauucuagugaau

SEQ ID NO: 546133 - RNA, 20 nt, Homo sapiens
cccuguguccaccugugggu

SEQ ID NO: 546134 - RNA, 14 nt, Homo sapiens
cccuguucaugccg

SEQ ID NO: 546135 - RNA, 16 nt, Homo sapiens
cccuguucccuguucu

SEQ ID NO: 546136 - RNA, 16 nt, Homo sapiens
cccuguuucucuugaa

SEQ ID NO: 546137 - RNA, 14 nt, Homo sapiens
cccuuaaacuucca

SEQ ID NO: 546138 - RNA, 13 nt, Homo sapiens
cccuuaacccaag

SEQ ID NO: 546139 - RNA, 20 nt, Homo sapiens
cccuuaaggguugaaggcag

SEQ ID NO: 546140 - RNA, 22 nt, Homo sapiens
cccuuaauaacauacaaugacc

SEQ ID NO: 546141 - RNA, 21 nt, Homo sapiens
cccuuacagccucugacuuaa

SEQ ID NO: 546142 - RNA, 17 nt, Homo sapiens
cccuuauaauuggugca

SEQ ID NO: 546143 - RNA, 22 nt, Homo sapiens
cccuuauccaggacucugucaa

SEQ ID NO: 546144 - RNA, 18 nt, Homo sapiens
cccuuauguguuguguau

SEQ ID NO: 546145 - RNA, 22 nt, Homo sapiens
cccuuauuuguuuuguguuuca

SEQ ID NO: 546146 - RNA, 21 nt, Homo sapiens
cccuuccacuuugaguaccaa

SEQ ID NO: 546147 - RNA, 13 nt, Homo sapiens
cccuuccagauca

SEQ ID NO: 546148 - RNA, 18 nt, Homo sapiens
cccuuccagccugggaca

SEQ ID NO: 546149 - RNA, 11 nt, Homo sapiens
cccuuccccag

SEQ ID NO: 546150 - RNA, 19 nt, Homo sapiens
cccuuccuaccucugguga

SEQ ID NO: 546151 - RNA, 16 nt, Homo sapiens
cccuuccuuaugucuc

SEQ ID NO: 546152 - RNA, 17 nt, Homo sapiens
cccuucucccaguccaa

SEQ ID NO: 546153 - RNA, 23 nt, Homo sapiens
cccuucucccggcccucacuaag

SEQ ID NO: 546154 - RNA, 17 nt, Homo sapiens
cccuucuggacacugag

SEQ ID NO: 546155 - RNA, 13 nt, Homo sapiens
cccuucuugccau

SEQ ID NO: 546156 - RNA, 15 nt, Homo sapiens
cccuucuugccauua

SEQ ID NO: 546157 - RNA, 22 nt, Homo sapiens
cccuucuugguuuccaaaggca

SEQ ID NO: 546158 - RNA, 15 nt, Homo sapiens
cccuugaagcaauaa

SEQ ID NO: 546159 - RNA, 17 nt, Homo sapiens
cccuugagcuacuucaa

SEQ ID NO: 546160 - RNA, 18 nt, Homo sapiens
cccuugaggaaacaacag

SEQ ID NO: 546161 - RNA, 20 nt, Homo sapiens
cccuugauuuaaacacacag

SEQ ID NO: 546162 - RNA, 14 nt, Homo sapiens
cccuugcaagccau

SEQ ID NO: 546163 - RNA, 15 nt, Homo sapiens
cccuugccaucacac

SEQ ID NO: 546164 - RNA, 21 nt, Homo sapiens
cccuugcuuagccugugcugg

SEQ ID NO: 546165 - RNA, 17 nt, Homo sapiens
cccuuggcuucugugau

SEQ ID NO: 546166 - RNA, 19 nt, Homo sapiens
cccuuggggccuaugcaga

SEQ ID NO: 546167 - RNA, 19 nt, Homo sapiens
cccuuggggguucagggaa

SEQ ID NO: 546168 - RNA, 16 nt, Homo sapiens
cccuugguacugaaaa

SEQ ID NO: 546169 - RNA, 17 nt, Homo sapiens
cccuugucgugggaugg

SEQ ID NO: 546170 - RNA, 21 nt, Homo sapiens
cccuugugcgugggugaagcc

SEQ ID NO: 546171 - RNA, 17 nt, Homo sapiens
cccuuuaacucaugagg

SEQ ID NO: 546172 - RNA, 17 nt, Homo sapiens
cccuuucagaugucuuc

SEQ ID NO: 546173 - RNA, 14 nt, Homo sapiens
cccuuucagggcca

SEQ ID NO: 546174 - RNA, 21 nt, Homo sapiens
cccuuuccuccucaggcacac

SEQ ID NO: 546175 - RNA, 19 nt, Homo sapiens
cccuuugaugauuaauuca

SEQ ID NO: 546176 - RNA, 14 nt, Homo sapiens
cccuuugcuucaaa

SEQ ID NO: 546177 - RNA, 21 nt, Homo sapiens
cccuuuggagaacgccagucu

SEQ ID NO: 546178 - RNA, 18 nt, Homo sapiens
cccuuuuacauacugcug

SEQ ID NO: 546179 - RNA, 13 nt, Homo sapiens
cccuuuuacuuuu

SEQ ID NO: 546180 - RNA, 12 nt, Homo sapiens
cccuuuucauga

SEQ ID NO: 546181 - RNA, 20 nt, Homo sapiens
ccgaaaaggauaugcaguau

SEQ ID NO: 546182 - RNA, 13 nt, Homo sapiens
ccgaaaucagaag

SEQ ID NO: 546183 - RNA, 18 nt, Homo sapiens
ccgaacuuuaauuucagg

SEQ ID NO: 546184 - RNA, 16 nt, Homo sapiens
ccgaagccugagcuca

SEQ ID NO: 546185 - RNA, 19 nt, Homo sapiens
ccgaauauauuacugauuu

SEQ ID NO: 546186 - RNA, 18 nt, Homo sapiens
ccgaauuuagucacacca

SEQ ID NO: 546187 - RNA, 16 nt, Homo sapiens
ccgacccacugaccca

SEQ ID NO: 546188 - RNA, 19 nt, Homo sapiens
ccgacucccccaaccaagg

SEQ ID NO: 546189 - RNA, 17 nt, Homo sapiens
ccgacuccucaaaagca

SEQ ID NO: 546190 - RNA, 15 nt, Homo sapiens
ccgagccagcagcug

SEQ ID NO: 546191 - RNA, 19 nt, Homo sapiens
ccgagcucuccuuguuacc

SEQ ID NO: 546192 - RNA, 22 nt, Homo sapiens
ccgaggccugcauguccggcug

SEQ ID NO: 546193 - RNA, 21 nt, Homo sapiens
ccgagggacagcagauuccac

SEQ ID NO: 546194 - RNA, 15 nt, Homo sapiens
ccgaggggagggcag

SEQ ID NO: 546195 - RNA, 13 nt, Homo sapiens
ccgaguaccucca

SEQ ID NO: 546196 - RNA, 21 nt, Homo sapiens
ccgagucagacuuuguguuca

SEQ ID NO: 546197 - RNA, 13 nt, Homo sapiens
ccgagugcaauga

SEQ ID NO: 546198 - RNA, 20 nt, Homo sapiens
ccgauaauagguagccugcu

SEQ ID NO: 546199 - RNA, 21 nt, Homo sapiens
ccgauacuaguuugcuuugcu

SEQ ID NO: 546200 - RNA, 22 nt, Homo sapiens
gcuugucauauucgauguacuu

SEQ ID NO: 546201 - RNA, 20 nt, Homo sapiens
gcuuguccugcucucuucag

SEQ ID NO: 546202 - RNA, 12 nt, Homo sapiens
gcuugugaucuc

SEQ ID NO: 546203 - RNA, 18 nt, Homo sapiens
gcuuguuauugccucuac

SEQ ID NO: 546204 - RNA, 16 nt, Homo sapiens
gcuuguuguuugcgca

SEQ ID NO: 546205 - RNA, 16 nt, Homo sapiens
gcuuguuuacagcacu

SEQ ID NO: 546206 - RNA, 17 nt, Homo sapiens
gcuuguuucuuguuauu

SEQ ID NO: 546207 - RNA, 15 nt, Homo sapiens
gcuuguuugccugaa

SEQ ID NO: 546208 - RNA, 22 nt, Homo sapiens
gcuuguuuuccagucucuugua

SEQ ID NO: 546209 - RNA, 21 nt, Homo sapiens
gcuuguuuuuucuccuggacu

SEQ ID NO: 546210 - RNA, 20 nt, Homo sapiens
gcuuuaaacacccuucacau

SEQ ID NO: 546211 - RNA, 17 nt, Homo sapiens
gcuuuaaacucagggac

SEQ ID NO: 546212 - RNA, 20 nt, Homo sapiens
gcuuuaauaaaggccacagg

SEQ ID NO: 546213 - RNA, 21 nt, Homo sapiens
gcuuuaauaagcgagaccuaa

SEQ ID NO: 546214 - RNA, 16 nt, Homo sapiens
gcuuuaauaugagcuu

SEQ ID NO: 546215 - RNA, 13 nt, Homo sapiens
gcuuuacauauuc

SEQ ID NO: 546216 - RNA, 15 nt, Homo sapiens
gcuuuagucacuaau

SEQ ID NO: 546217 - RNA, 12 nt, Homo sapiens
ccuacccagcgu

SEQ ID NO: 546218 - RNA, 20 nt, Homo sapiens
ccuaccccuggcuguacugc

SEQ ID NO: 546219 - RNA, 14 nt, Homo sapiens
ccuacccugaaccu

SEQ ID NO: 546220 - RNA, 13 nt, Homo sapiens
ccuacccuuccag

SEQ ID NO: 546221 - RNA, 11 nt, Homo sapiens
ccuaccucagc

SEQ ID NO: 546222 - RNA, 15 nt, Homo sapiens
ccuaccucuggugau

SEQ ID NO: 546223 - RNA, 14 nt, Homo sapiens
ccuaccugucuucu

SEQ ID NO: 546224 - RNA, 11 nt, Homo sapiens
ccuaccuuuau

SEQ ID NO: 546225 - RNA, 19 nt, Homo sapiens
ccuacuagucaccagagac

SEQ ID NO: 546226 - RNA, 15 nt, Homo sapiens
ccuacugagcauuug

SEQ ID NO: 546227 - RNA, 15 nt, Homo sapiens
ccuacugcaaauggc

SEQ ID NO: 546228 - RNA, 13 nt, Homo sapiens
ccuacugcacuga

SEQ ID NO: 546229 - RNA, 15 nt, Homo sapiens
ccuacugcacugagu

SEQ ID NO: 546230 - RNA, 17 nt, Homo sapiens
ccuacugccaaccugga

SEQ ID NO: 546231 - RNA, 15 nt, Homo sapiens
ccuacugcuuacugu

SEQ ID NO: 546232 - RNA, 17 nt, Homo sapiens
ccuacuguuccuuucag

SEQ ID NO: 546233 - RNA, 22 nt, Homo sapiens
ccuacuuucuccugaaacccaa

SEQ ID NO: 546234 - RNA, 17 nt, Homo sapiens
ccuagaacacuaacuca

SEQ ID NO: 546235 - RNA, 16 nt, Homo sapiens
ccuagaacugugccua

SEQ ID NO: 546236 - RNA, 17 nt, Homo sapiens
ccuagaaguucuuugau

SEQ ID NO: 546237 - RNA, 16 nt, Homo sapiens
ccuagaauaaucucau

SEQ ID NO: 546238 - RNA, 15 nt, Homo sapiens
ccuagaaugcagcug

SEQ ID NO: 546239 - RNA, 14 nt, Homo sapiens
ccuagaauguuuca

SEQ ID NO: 546240 - RNA, 20 nt, Homo sapiens
ccuagacucugucuaccugg

SEQ ID NO: 546241 - RNA, 18 nt, Homo sapiens
ccuagagcuagauguguc

SEQ ID NO: 546242 - RNA, 22 nt, Homo sapiens
ccuagagucggccaccacagau

SEQ ID NO: 546243 - RNA, 20 nt, Homo sapiens
ccuagagucuuaaagcauuu

SEQ ID NO: 546244 - RNA, 13 nt, Homo sapiens
ccuagagugcagg

SEQ ID NO: 546245 - RNA, 13 nt, Homo sapiens
ccuagaugaccug

SEQ ID NO: 546246 - RNA, 19 nt, Homo sapiens
ccuagcaacauaucucugc

SEQ ID NO: 546247 - RNA, 20 nt, Homo sapiens
ccuagcaacauaucucugcc

SEQ ID NO: 546248 - RNA, 19 nt, Homo sapiens
ccuagcaccuggcuaguuu

SEQ ID NO: 546249 - RNA, 13 nt, Homo sapiens
ccuagcacuuugg

SEQ ID NO: 546250 - RNA, 17 nt, Homo sapiens
ccuagccaacaugguga

SEQ ID NO: 546251 - RNA, 18 nt, Homo sapiens
ccuagccagaggcucuaa

SEQ ID NO: 546252 - RNA, 15 nt, Homo sapiens
ccuagcccugggaca

SEQ ID NO: 546253 - RNA, 17 nt, Homo sapiens
ccuagccuaauuuacca

SEQ ID NO: 546254 - RNA, 14 nt, Homo sapiens
ccuagcugugucag

SEQ ID NO: 546255 - RNA, 23 nt, Homo sapiens
ccuaggacagccuuguuccucag

SEQ ID NO: 546256 - RNA, 18 nt, Homo sapiens
ccuaggccaaaugcacaa

SEQ ID NO: 546257 - RNA, 14 nt, Homo sapiens
ccuagggcacuuua

SEQ ID NO: 546258 - RNA, 18 nt, Homo sapiens
ccuagggccugguccaug

SEQ ID NO: 546259 - RNA, 22 nt, Homo sapiens
ccuagggguggcgcucagaccc

SEQ ID NO: 546260 - RNA, 20 nt, Homo sapiens
ccuaguagcugggaugacag

SEQ ID NO: 546261 - RNA, 15 nt, Homo sapiens
ccuaguaugccaaaa

SEQ ID NO: 546262 - RNA, 18 nt, Homo sapiens
ccuagucgggacuuguaa

SEQ ID NO: 546263 - RNA, 13 nt, Homo sapiens
ccuagugcuauuc

SEQ ID NO: 546264 - RNA, 21 nt, Homo sapiens
ccuaguuaguguuuugccuca

SEQ ID NO: 546265 - RNA, 19 nt, Homo sapiens
ccuauaauaaaauggcacc

SEQ ID NO: 546266 - RNA, 17 nt, Homo sapiens
ccuauaaucuuauacaa

SEQ ID NO: 546267 - RNA, 23 nt, Homo sapiens
ccuauacauuucuguucaucuua

SEQ ID NO: 546268 - RNA, 12 nt, Homo sapiens
ccuauaccauau

SEQ ID NO: 546269 - RNA, 19 nt, Homo sapiens
ccuauacguuucuguggag

SEQ ID NO: 546270 - RNA, 21 nt, Homo sapiens
ccuauagaaauagaacacugc

SEQ ID NO: 546271 - RNA, 19 nt, Homo sapiens
ccuauagcacugagcucac

SEQ ID NO: 546272 - RNA, 22 nt, Homo sapiens
ccuauaugcuggagauggacaa

SEQ ID NO: 546273 - RNA, 23 nt, Homo sapiens
ccuaucucauagggaugcuguga

SEQ ID NO: 546274 - RNA, 14 nt, Homo sapiens
ccuaucuccugaca

SEQ ID NO: 546275 - RNA, 19 nt, Homo sapiens
ccuaucuccugacagaagg

SEQ ID NO: 546276 - RNA, 22 nt, Homo sapiens
ccuaucuugauuucacuggaau

SEQ ID NO: 546277 - RNA, 21 nt, Homo sapiens
ccuaugcagacaucucuggag

SEQ ID NO: 546278 - RNA, 21 nt, Homo sapiens
ccuauggaauguaaagugcaa

SEQ ID NO: 546279 - RNA, 19 nt, Homo sapiens
ccuauguacuuaauccuuu

SEQ ID NO: 546280 - RNA, 14 nt, Homo sapiens
ccuauguaugccau

SEQ ID NO: 546281 - RNA, 23 nt, Homo sapiens
ccuaugucaauuuguauaucaug

SEQ ID NO: 546282 - RNA, 18 nt, Homo sapiens
ccuaugugggugggacca

SEQ ID NO: 546283 - RNA, 23 nt, Homo sapiens
ccuauguuuuuguucaaagccag

SEQ ID NO: 546284 - RNA, 23 nt, Homo sapiens
ccuauuagggaguuaugcaaaau

SEQ ID NO: 546285 - RNA, 12 nt, Homo sapiens
ccuauuccagga

SEQ ID NO: 546286 - RNA, 18 nt, Homo sapiens
ccuauuccaggaauuccu

SEQ ID NO: 546287 - RNA, 14 nt, Homo sapiens
ccuauuguaguaaa

SEQ ID NO: 546288 - RNA, 14 nt, Homo sapiens
ccuauugucauuaa

SEQ ID NO: 546289 - RNA, 15 nt, Homo sapiens
ccuauugucauuaaa

SEQ ID NO: 546290 - RNA, 14 nt, Homo sapiens
ccuauuguucacuu

SEQ ID NO: 546291 - RNA, 15 nt, Homo sapiens
ccuauuguucacuuu

SEQ ID NO: 546292 - RNA, 20 nt, Homo sapiens
ccuauuuccauucaacaaga

SEQ ID NO: 546293 - RNA, 11 nt, Homo sapiens
ccuauuugacu

SEQ ID NO: 546294 - RNA, 20 nt, Homo sapiens
ccuauuuggggcuugcaugc

SEQ ID NO: 546295 - RNA, 15 nt, Homo sapiens
ccuauuuguuuucau

SEQ ID NO: 546296 - RNA, 18 nt, Homo sapiens
ccuauuuucauuuguaca

SEQ ID NO: 546297 - RNA, 18 nt, Homo sapiens
ccuauuuucuuuuccauu

SEQ ID NO: 546298 - RNA, 16 nt, Homo sapiens
ccucaaagaggccuua

SEQ ID NO: 546299 - RNA, 22 nt, Homo sapiens
ccucaacauugcauggugcuag

SEQ ID NO: 546300 - RNA, 18 nt, Homo sapiens
ccucaaccuccuggguuc

SEQ ID NO: 546301 - RNA, 20 nt, Homo sapiens
ccucaaccuccuggguucaa

SEQ ID NO: 546302 - RNA, 23 nt, Homo sapiens
ccucaagaaauaaaaggaagcca

SEQ ID NO: 546303 - RNA, 17 nt, Homo sapiens
ccucaagccccauuucc

SEQ ID NO: 546304 - RNA, 21 nt, Homo sapiens
ccucaagccccauuuccucac

SEQ ID NO: 546305 - RNA, 23 nt, Homo sapiens
ccucaaggguuauagacugccau

SEQ ID NO: 546306 - RNA, 16 nt, Homo sapiens
ccucaaguuccaugcu

SEQ ID NO: 546307 - RNA, 22 nt, Homo sapiens
ccucaaguucuuggaccaguuu

SEQ ID NO: 546308 - RNA, 19 nt, Homo sapiens
ccucaauaaaaaguuuuau

SEQ ID NO: 546309 - RNA, 13 nt, Homo sapiens
ccucaauucacau

SEQ ID NO: 546310 - RNA, 19 nt, Homo sapiens
ccucaauuuuugucucaga

SEQ ID NO: 546311 - RNA, 20 nt, Homo sapiens
ccucacagagugcauuguga

SEQ ID NO: 546312 - RNA, 23 nt, Homo sapiens
ccucacagagugcauugugaggg

SEQ ID NO: 546313 - RNA, 18 nt, Homo sapiens
ccucacaggccccaggaa

SEQ ID NO: 546314 - RNA, 23 nt, Homo sapiens
ccucaccucugauagacuuugug

SEQ ID NO: 546315 - RNA, 23 nt, Homo sapiens
ccucacucauucccauguuguca

SEQ ID NO: 546316 - RNA, 22 nt, Homo sapiens
ccucacucuguuuccuggucag

SEQ ID NO: 546317 - RNA, 12 nt, Homo sapiens
ccucacugaaaa

SEQ ID NO: 546318 - RNA, 20 nt, Homo sapiens
ccucagaaaagugacagugg

SEQ ID NO: 546319 - RNA, 20 nt, Homo sapiens
ccucagaaagucaccaggac

SEQ ID NO: 546320 - RNA, 19 nt, Homo sapiens
ccucagaaggccccagaga

SEQ ID NO: 546321 - RNA, 21 nt, Homo sapiens
ccucagaauaaaagaugauuu

SEQ ID NO: 546322 - RNA, 15 nt, Homo sapiens
ccucagaauccacaa

SEQ ID NO: 546323 - RNA, 17 nt, Homo sapiens
ccucagaauugaucauu

SEQ ID NO: 546324 - RNA, 13 nt, Homo sapiens
ccucagagugcaa

SEQ ID NO: 546325 - RNA, 14 nt, Homo sapiens
ccucagaguggucg

SEQ ID NO: 546326 - RNA, 13 nt, Homo sapiens
ggacccucaggug

SEQ ID NO: 546327 - RNA, 13 nt, Homo sapiens
ggacccuccagag

SEQ ID NO: 546328 - RNA, 21 nt, Homo sapiens
ggacccuuggccuccauuucu

SEQ ID NO: 546329 - RNA, 23 nt, Homo sapiens
ggaccgcugauaagcauugacuu

SEQ ID NO: 546330 - RNA, 13 nt, Homo sapiens
ggaccguccaggg

SEQ ID NO: 546331 - RNA, 18 nt, Homo sapiens
ggaccucagugacucaga

SEQ ID NO: 546332 - RNA, 14 nt, Homo sapiens
ggaccucaguuuua

SEQ ID NO: 546333 - RNA, 20 nt, Homo sapiens
ggaccuccucccucauucau

SEQ ID NO: 546334 - RNA, 13 nt, Homo sapiens
ggaccucgugcca

SEQ ID NO: 546335 - RNA, 22 nt, Homo sapiens
ggaccugccccggaccuaccuc

SEQ ID NO: 546336 - RNA, 23 nt, Homo sapiens
ggaccuggcgugcucagacccaa

SEQ ID NO: 546337 - RNA, 17 nt, Homo sapiens
ggacgacgaugacaaug

SEQ ID NO: 546338 - RNA, 14 nt, Homo sapiens
ggagggcuguggug

SEQ ID NO: 546339 - RNA, 14 nt, Homo sapiens
ggaggggugguccu

SEQ ID NO: 546340 - RNA, 15 nt, Homo sapiens
ggagggugggaccaa

SEQ ID NO: 546341 - RNA, 14 nt, Homo sapiens
ggagguauuugaaa

SEQ ID NO: 546342 - RNA, 14 nt, Homo sapiens
ggaggucgacccca

SEQ ID NO: 546343 - RNA, 19 nt, Homo sapiens
ggagguggagauugcagug

SEQ ID NO: 546344 - RNA, 15 nt, Homo sapiens
ggagguugagugagc

SEQ ID NO: 546345 - RNA, 19 nt, Homo sapiens
ggagguugcaguaagccaa

SEQ ID NO: 546346 - RNA, 17 nt, Homo sapiens
ggaguaaaacuguauaa

SEQ ID NO: 546347 - RNA, 14 nt, Homo sapiens
ggaguaaguguaca

SEQ ID NO: 546348 - RNA, 17 nt, Homo sapiens
ggaguaaguguacaauu

SEQ ID NO: 546349 - RNA, 21 nt, Homo sapiens
ggaguacaaugcccagaucaa

SEQ ID NO: 546350 - RNA, 18 nt, Homo sapiens
ggaguagaaaaaucucau

SEQ ID NO: 546351 - RNA, 22 nt, Homo sapiens
ggaguauauuuccgcacuucag

SEQ ID NO: 546352 - RNA, 17 nt, Homo sapiens
ggagucacugagaccaa

SEQ ID NO: 546353 - RNA, 16 nt, Homo sapiens
ggagucagacauuuua

SEQ ID NO: 546354 - RNA, 19 nt, Homo sapiens
ggagucaggggcucugugu

SEQ ID NO: 546355 - RNA, 21 nt, Homo sapiens
ggagucccaaaugucaucagg

SEQ ID NO: 546356 - RNA, 18 nt, Homo sapiens
ggagucccuauaguuuca

SEQ ID NO: 546357 - RNA, 16 nt, Homo sapiens
ggagucccuuuggcaa

SEQ ID NO: 546358 - RNA, 22 nt, Homo sapiens
ggagucucugccacccacucag

SEQ ID NO: 546359 - RNA, 21 nt, Homo sapiens
ggagucuucagacccagagaa

SEQ ID NO: 546360 - RNA, 22 nt, Homo sapiens
ggagucuugcucugucacccag

SEQ ID NO: 546361 - RNA, 21 nt, Homo sapiens
ggagugaaaccuuuagggcag

SEQ ID NO: 546362 - RNA, 13 nt, Homo sapiens
ggagugaagccac

SEQ ID NO: 546363 - RNA, 15 nt, Homo sapiens
ggagugcaccaaaga

SEQ ID NO: 546364 - RNA, 22 nt, Homo sapiens
ggagugcaguggcgugaucucg

SEQ ID NO: 546365 - RNA, 20 nt, Homo sapiens
ggagugccugcuguggaccc

SEQ ID NO: 546366 - RNA, 16 nt, Homo sapiens
ggaguggaugcgauaa

SEQ ID NO: 546367 - RNA, 16 nt, Homo sapiens
ggagugguugcuauac

SEQ ID NO: 546368 - RNA, 21 nt, Homo sapiens
ggaguuaccuuaaacugugua

SEQ ID NO: 546369 - RNA, 18 nt, Homo sapiens
ggaguucaaaacauucau

SEQ ID NO: 546370 - RNA, 20 nt, Homo sapiens
ggaguucgaggcugcaguca

SEQ ID NO: 546371 - RNA, 13 nt, Homo sapiens
ggaguucucugau

SEQ ID NO: 546372 - RNA, 17 nt, Homo sapiens
ggaguugaaacugcuau

SEQ ID NO: 546373 - RNA, 13 nt, Homo sapiens
ggaguugccugac

SEQ ID NO: 546374 - RNA, 20 nt, Homo sapiens
ggaguugucguuuuuagcuu

SEQ ID NO: 546375 - RNA, 16 nt, Homo sapiens
ggaguuuuacugccug

SEQ ID NO: 546376 - RNA, 13 nt, Homo sapiens
ggauaaacaucac

SEQ ID NO: 546377 - RNA, 14 nt, Homo sapiens
ggauaaacaucaca

SEQ ID NO: 546378 - RNA, 21 nt, Homo sapiens
ggauaaagaaaagacauuuua

SEQ ID NO: 546379 - RNA, 16 nt, Homo sapiens
ggauaacacauuugau

SEQ ID NO: 546380 - RNA, 18 nt, Homo sapiens
ggauaaccuugugccuug

SEQ ID NO: 546381 - RNA, 21 nt, Homo sapiens
ggauaaguuucuauucuguca

SEQ ID NO: 546382 - RNA, 22 nt, Homo sapiens
ggauaauaaagauacuagagaa

SEQ ID NO: 546383 - RNA, 23 nt, Homo sapiens
ggauaauauccagccucccacaa

SEQ ID NO: 546384 - RNA, 20 nt, Homo sapiens
ggauaaugcuguugccucau

SEQ ID NO: 546385 - RNA, 19 nt, Homo sapiens
ggauacccuggagcaagac

SEQ ID NO: 546386 - RNA, 17 nt, Homo sapiens
ggauacuggugcaguca

SEQ ID NO: 546387 - RNA, 22 nt, Homo sapiens
ggauacuuuuaugcaaccauaa

SEQ ID NO: 546388 - RNA, 16 nt, Homo sapiens
ggauagacgaguugau

SEQ ID NO: 546389 - RNA, 17 nt, Homo sapiens
ggauagaggaaagggau

SEQ ID NO: 546390 - RNA, 19 nt, Homo sapiens
ggauaggcaggaacauaca

SEQ ID NO: 546391 - RNA, 15 nt, Homo sapiens
ggauauacugcagcu

SEQ ID NO: 546392 - RNA, 21 nt, Homo sapiens
ggauauacugcagcuuuacug

SEQ ID NO: 546393 - RNA, 20 nt, Homo sapiens
ggauauccuuucacucugca

SEQ ID NO: 546394 - RNA, 12 nt, Homo sapiens
ggauaugcagua

SEQ ID NO: 546395 - RNA, 22 nt, Homo sapiens
ggauauguuaaauguauagcug

SEQ ID NO: 546396 - RNA, 20 nt, Homo sapiens
ggauauuaacaacaauaaca

SEQ ID NO: 546397 - RNA, 20 nt, Homo sapiens
ggaucaauaggaaagcauau

SEQ ID NO: 546398 - RNA, 20 nt, Homo sapiens
ggaucacaaggucacuagau

SEQ ID NO: 546399 - RNA, 16 nt, Homo sapiens
ggaucagcccugccag

SEQ ID NO: 546400 - RNA, 19 nt, Homo sapiens
ggaucaguuaacuauugca

SEQ ID NO: 546401 - RNA, 16 nt, Homo sapiens
ggaucaugguacauuu

SEQ ID NO: 546402 - RNA, 22 nt, Homo sapiens
ggauccaauaugacucagagaa

SEQ ID NO: 546403 - RNA, 12 nt, Homo sapiens
ggauccagcacu

SEQ ID NO: 546404 - RNA, 14 nt, Homo sapiens
ggaucccaccccau

SEQ ID NO: 546405 - RNA, 19 nt, Homo sapiens
ggauccccccacagccccu

SEQ ID NO: 546406 - RNA, 14 nt, Homo sapiens
ggauccgcugccac

SEQ ID NO: 546407 - RNA, 17 nt, Homo sapiens
ggauccuccacagagag

SEQ ID NO: 546408 - RNA, 19 nt, Homo sapiens
ggauccucuccacuccaug

SEQ ID NO: 546409 - RNA, 14 nt, Homo sapiens
ggauccugcacucu

SEQ ID NO: 546410 - RNA, 13 nt, Homo sapiens
ggaucugggcaaa

SEQ ID NO: 546411 - RNA, 13 nt, Homo sapiens
ggaucugggcugu

SEQ ID NO: 546412 - RNA, 15 nt, Homo sapiens
ggaugaacaauuaua

SEQ ID NO: 546413 - RNA, 23 nt, Homo sapiens
ggaugaaucauauucauaugcag

SEQ ID NO: 546414 - RNA, 16 nt, Homo sapiens
ggaugagagggugcua

SEQ ID NO: 546415 - RNA, 14 nt, Homo sapiens
ggaugauaguugaa

SEQ ID NO: 546416 - RNA, 14 nt, Homo sapiens
ggaugcacauuucu

SEQ ID NO: 546417 - RNA, 19 nt, Homo sapiens
ggaugcagcaccucucagg

SEQ ID NO: 546418 - RNA, 12 nt, Homo sapiens
ggaugcaugugc

SEQ ID NO: 546419 - RNA, 21 nt, Homo sapiens
ggaugccaaccggucacccag

SEQ ID NO: 546420 - RNA, 22 nt, Homo sapiens
ggaugccaaccggucacccagg

SEQ ID NO: 546421 - RNA, 21 nt, Homo sapiens
ggaugcccccaggcagccacc

SEQ ID NO: 546422 - RNA, 13 nt, Homo sapiens
ggaugccuuagca

SEQ ID NO: 546423 - RNA, 16 nt, Homo sapiens
ggaugcggcuuucucu

SEQ ID NO: 546424 - RNA, 19 nt, Homo sapiens
ggaugcgugggaggcagaa

SEQ ID NO: 546425 - RNA, 19 nt, Homo sapiens
ggaugcuggccuuugcucu

SEQ ID NO: 546426 - RNA, 19 nt, Homo sapiens
ggaugcugggcucuguucu

SEQ ID NO: 546427 - RNA, 14 nt, Homo sapiens
ggauggcaccucag

SEQ ID NO: 546428 - RNA, 15 nt, Homo sapiens
ggauggccguggaug

SEQ ID NO: 546429 - RNA, 14 nt, Homo sapiens
ggauggggcuccca

SEQ ID NO: 546430 - RNA, 20 nt, Homo sapiens
ggauggggcuucacugcugu

SEQ ID NO: 546431 - RNA, 22 nt, Homo sapiens
ggauggggcuucacugcuguga

SEQ ID NO: 546432 - RNA, 17 nt, Homo sapiens
ggaugguggagggccac

SEQ ID NO: 546433 - RNA, 15 nt, Homo sapiens
ggaugucuuccuugg

SEQ ID NO: 546434 - RNA, 23 nt, Homo sapiens
ggauguggcuuaugagauacuuu

SEQ ID NO: 546435 - RNA, 16 nt, Homo sapiens
ggauguguuuugcacg

SEQ ID NO: 546436 - RNA, 15 nt, Homo sapiens
ggauguuuagcagug

SEQ ID NO: 546437 - RNA, 21 nt, Homo sapiens
ggauuaaaaaaaugugguaca

SEQ ID NO: 546438 - RNA, 18 nt, Homo sapiens
ggauuaaaaugagugaaa

SEQ ID NO: 546439 - RNA, 21 nt, Homo sapiens
ggauuagccgucccagugaaa

SEQ ID NO: 546440 - RNA, 22 nt, Homo sapiens
ggauuauuaagugauuauuuaa

SEQ ID NO: 546441 - RNA, 19 nt, Homo sapiens
ggauucagcgaagucucau

SEQ ID NO: 546442 - RNA, 21 nt, Homo sapiens
ggauuccacuguuuucuuugg

SEQ ID NO: 546443 - RNA, 17 nt, Homo sapiens
ggauucucuacugccaa

SEQ ID NO: 546444 - RNA, 23 nt, Homo sapiens
ggauucuuuucaucaaaaagccu

SEQ ID NO: 546445 - RNA, 16 nt, Homo sapiens
ggauugaagcccucca

SEQ ID NO: 546446 - RNA, 16 nt, Homo sapiens
ggauugcuaugaauga

SEQ ID NO: 546447 - RNA, 15 nt, Homo sapiens
ggauuggcuuugugc

SEQ ID NO: 546448 - RNA, 23 nt, Homo sapiens
ggauugggacgcacagugcaguu

SEQ ID NO: 546449 - RNA, 13 nt, Homo sapiens
ggauugggguccc

SEQ ID NO: 546450 - RNA, 12 nt, Homo sapiens
ggauugugcuuu

SEQ ID NO: 546451 - RNA, 15 nt, Homo sapiens
ccucucaguacuuug

SEQ ID NO: 546452 - RNA, 17 nt, Homo sapiens
ccucucaucaguguccu

SEQ ID NO: 546453 - RNA, 15 nt, Homo sapiens
ccucuccaacugccu

SEQ ID NO: 546454 - RNA, 16 nt, Homo sapiens
ccucuccaguuugcac

SEQ ID NO: 546455 - RNA, 14 nt, Homo sapiens
ccucucccagucca

SEQ ID NO: 546456 - RNA, 19 nt, Homo sapiens
ccucucccaguccauuucc

SEQ ID NO: 546457 - RNA, 22 nt, Homo sapiens
ccucuccccaagaggaacugaa

SEQ ID NO: 546458 - RNA, 18 nt, Homo sapiens
ccucuccccacugcucau

SEQ ID NO: 546459 - RNA, 17 nt, Homo sapiens
ccugagagucagggugg

SEQ ID NO: 546460 - RNA, 12 nt, Homo sapiens
ccugagaucccc

SEQ ID NO: 546461 - RNA, 21 nt, Homo sapiens
ccugagauccggcaacaucaa

SEQ ID NO: 546462 - RNA, 20 nt, Homo sapiens
ccugagaugauuuggucaga

SEQ ID NO: 546463 - RNA, 21 nt, Homo sapiens
ccugagauucagaugucauuu

SEQ ID NO: 546464 - RNA, 20 nt, Homo sapiens
ccugagcaaugucugugcua

SEQ ID NO: 546465 - RNA, 16 nt, Homo sapiens
ccugagccacagaaag

SEQ ID NO: 546466 - RNA, 19 nt, Homo sapiens
ccugagccccucaauccua

SEQ ID NO: 546467 - RNA, 20 nt, Homo sapiens
ccugagcccuacucccugca

SEQ ID NO: 546468 - RNA, 21 nt, Homo sapiens
ccugagcgaguguccagccaa

SEQ ID NO: 546469 - RNA, 13 nt, Homo sapiens
ccugagcuaaaua

SEQ ID NO: 546470 - RNA, 20 nt, Homo sapiens
ccugagcucgguggacccag

SEQ ID NO: 546471 - RNA, 18 nt, Homo sapiens
ccugaggacugauuucag

SEQ ID NO: 546472 - RNA, 17 nt, Homo sapiens
ccugaggaugggucaga

SEQ ID NO: 546473 - RNA, 15 nt, Homo sapiens
ccugaggguccccac

SEQ ID NO: 546474 - RNA, 14 nt, Homo sapiens
ccugaggucgucaa

SEQ ID NO: 546475 - RNA, 15 nt, Homo sapiens
ccugagguuugccag

SEQ ID NO: 546476 - RNA, 22 nt, Homo sapiens
ccugagucggccccacauggga

SEQ ID NO: 546477 - RNA, 21 nt, Homo sapiens
ccugaguuuuacccagacuca

SEQ ID NO: 546478 - RNA, 13 nt, Homo sapiens
ccugauacauuaa

SEQ ID NO: 546479 - RNA, 21 nt, Homo sapiens
ccugauauucaggcuacucau

SEQ ID NO: 546480 - RNA, 17 nt, Homo sapiens
ccugaucugcacauuuc

SEQ ID NO: 546481 - RNA, 20 nt, Homo sapiens
ccugauggaaguaaagccuc

SEQ ID NO: 546482 - RNA, 18 nt, Homo sapiens
ccugauggagugugcaga

SEQ ID NO: 546483 - RNA, 15 nt, Homo sapiens
ccugauggcacucug

SEQ ID NO: 546484 - RNA, 23 nt, Homo sapiens
ccugaugugggaacagcucuucu

SEQ ID NO: 546485 - RNA, 14 nt, Homo sapiens
ccugauguguccuc

SEQ ID NO: 546486 - RNA, 12 nt, Homo sapiens
ccugauguuaaa

SEQ ID NO: 546487 - RNA, 17 nt, Homo sapiens
ccugcaaaaggacucuc

SEQ ID NO: 546488 - RNA, 18 nt, Homo sapiens
ccugcaauguggugacac

SEQ ID NO: 546489 - RNA, 17 nt, Homo sapiens
ccugcaccccugcaguu

SEQ ID NO: 546490 - RNA, 21 nt, Homo sapiens
ccugcaccccugcaguuugag

SEQ ID NO: 546491 - RNA, 16 nt, Homo sapiens
ccugcaccgccgccac

SEQ ID NO: 546492 - RNA, 14 nt, Homo sapiens
ccugcaccugacag

SEQ ID NO: 546493 - RNA, 22 nt, Homo sapiens
ccugcacuaaagccagccugac

SEQ ID NO: 546494 - RNA, 13 nt, Homo sapiens
ccugcacugggaa

SEQ ID NO: 546495 - RNA, 18 nt, Homo sapiens
ccugcagaaguacuccua

SEQ ID NO: 546496 - RNA, 15 nt, Homo sapiens
ccugcagaaguccca

SEQ ID NO: 546497 - RNA, 17 nt, Homo sapiens
ccugcagaauccagcua

SEQ ID NO: 546498 - RNA, 18 nt, Homo sapiens
ccugcagcaaacacucca

SEQ ID NO: 546499 - RNA, 17 nt, Homo sapiens
ccugcaggacuugccac

SEQ ID NO: 546500 - RNA, 19 nt, Homo sapiens
ccugcaggccaagagcaga

SEQ ID NO: 546501 - RNA, 20 nt, Homo sapiens
ccugcagggacuccaugcug

SEQ ID NO: 546502 - RNA, 19 nt, Homo sapiens
ccugcaguggugugaaaca

SEQ ID NO: 546503 - RNA, 15 nt, Homo sapiens
ccugcaucugaccag

SEQ ID NO: 546504 - RNA, 15 nt, Homo sapiens
ccugcaucugugaaa

SEQ ID NO: 546505 - RNA, 21 nt, Homo sapiens
ccugcaugaaacauguucuca

SEQ ID NO: 546506 - RNA, 13 nt, Homo sapiens
ccugcaugguguu

SEQ ID NO: 546507 - RNA, 18 nt, Homo sapiens
ccugcauuucucuucuca

SEQ ID NO: 546508 - RNA, 14 nt, Homo sapiens
ccugccacagccag

SEQ ID NO: 546509 - RNA, 16 nt, Homo sapiens
ccugccaucuucccag

SEQ ID NO: 546510 - RNA, 17 nt, Homo sapiens
ccugcccaaacccuuaa

SEQ ID NO: 546511 - RNA, 17 nt, Homo sapiens
ccugcccaagcacuuca

SEQ ID NO: 546512 - RNA, 14 nt, Homo sapiens
ccugcccaaugaga

SEQ ID NO: 546513 - RNA, 16 nt, Homo sapiens
ccugcccaccaagaag

SEQ ID NO: 546514 - RNA, 16 nt, Homo sapiens
ccugcccagacaagau

SEQ ID NO: 546515 - RNA, 20 nt, Homo sapiens
ccugccccaccccauccagc

SEQ ID NO: 546516 - RNA, 22 nt, Homo sapiens
ccugcccccuccagucccccac

SEQ ID NO: 546517 - RNA, 23 nt, Homo sapiens
ccugcccuacagaggucucugcc

SEQ ID NO: 546518 - RNA, 22 nt, Homo sapiens
ccugcccuccccagagcacugg

SEQ ID NO: 546519 - RNA, 20 nt, Homo sapiens
ccugcccuucaacaauggcc

SEQ ID NO: 546520 - RNA, 13 nt, Homo sapiens
ccugccgucuuca

SEQ ID NO: 546521 - RNA, 17 nt, Homo sapiens
ccugccugcgucuuccg

SEQ ID NO: 546522 - RNA, 22 nt, Homo sapiens
ccugccuuuuaacguagauaua

SEQ ID NO: 546523 - RNA, 20 nt, Homo sapiens
ccugcgagacccaaggcuca

SEQ ID NO: 546524 - RNA, 16 nt, Homo sapiens
ccugcgagacgcacac

SEQ ID NO: 546525 - RNA, 23 nt, Homo sapiens
ccugcgggugaacaaagcagcca

SEQ ID NO: 546526 - RNA, 15 nt, Homo sapiens
ccugcgucauuucag

SEQ ID NO: 546527 - RNA, 17 nt, Homo sapiens
ccugcuaugacagcugg

SEQ ID NO: 546528 - RNA, 23 nt, Homo sapiens
ccugcuauuguuaauaaccuuaa

SEQ ID NO: 546529 - RNA, 18 nt, Homo sapiens
ccugcucacaaaaucacu

SEQ ID NO: 546530 - RNA, 19 nt, Homo sapiens
ccugcucaggaaaccacaa

SEQ ID NO: 546531 - RNA, 19 nt, Homo sapiens
ccugcucaucauauuccaa

SEQ ID NO: 546532 - RNA, 19 nt, Homo sapiens
ccugcuccacgaagccuua

SEQ ID NO: 546533 - RNA, 19 nt, Homo sapiens
ccugcucccagcagcccua

SEQ ID NO: 546534 - RNA, 22 nt, Homo sapiens
ccugcucccuagccagaggcuc

SEQ ID NO: 546535 - RNA, 23 nt, Homo sapiens
ccugcucucuggagguacugaga

SEQ ID NO: 546536 - RNA, 13 nt, Homo sapiens
ccugcucuugcag

SEQ ID NO: 546537 - RNA, 19 nt, Homo sapiens
ccugcugaaagcaguguau

SEQ ID NO: 546538 - RNA, 20 nt, Homo sapiens
ccugcugaggcagugugguu

SEQ ID NO: 546539 - RNA, 16 nt, Homo sapiens
ccugcugagucccuca

SEQ ID NO: 546540 - RNA, 20 nt, Homo sapiens
ccugcugcaucaguggguga

SEQ ID NO: 546541 - RNA, 18 nt, Homo sapiens
ccugcugccugcugagau

SEQ ID NO: 546542 - RNA, 21 nt, Homo sapiens
ccugcugcuguguuuuugcua

SEQ ID NO: 546543 - RNA, 19 nt, Homo sapiens
ccugcugcuugggacgugu

SEQ ID NO: 546544 - RNA, 10 nt, Homo sapiens
ccugcuggaa

SEQ ID NO: 546545 - RNA, 19 nt, Homo sapiens
ccugcuggugagaggugca

SEQ ID NO: 546546 - RNA, 22 nt, Homo sapiens
ccugcugugaugacuugccauu

SEQ ID NO: 546547 - RNA, 12 nt, Homo sapiens
ccugcugugauu

SEQ ID NO: 546548 - RNA, 16 nt, Homo sapiens
ccugcugugcugcuca

SEQ ID NO: 546549 - RNA, 23 nt, Homo sapiens
ccugcuguguggacuucaucuca

SEQ ID NO: 546550 - RNA, 18 nt, Homo sapiens
ccugcuuccugcuugcca

SEQ ID NO: 546551 - RNA, 16 nt, Homo sapiens
ccugcuuugggaagcc

SEQ ID NO: 546552 - RNA, 20 nt, Homo sapiens
ccugcuuuuuaugggagcug

SEQ ID NO: 546553 - RNA, 14 nt, Homo sapiens
ccuggaaauucugc

SEQ ID NO: 546554 - RNA, 13 nt, Homo sapiens
ccuggaacugcau

SEQ ID NO: 546555 - RNA, 15 nt, Homo sapiens
ccuggaagagggcaa

SEQ ID NO: 546556 - RNA, 20 nt, Homo sapiens
ccuggaaucaagaugucaga

SEQ ID NO: 546557 - RNA, 13 nt, Homo sapiens
ccuggacacacac

SEQ ID NO: 546558 - RNA, 14 nt, Homo sapiens
ccuggaccauucca

SEQ ID NO: 546559 - RNA, 12 nt, Homo sapiens
ccuggacugagc

SEQ ID NO: 546560 - RNA, 20 nt, Homo sapiens
ccuggacugggagguagaua

SEQ ID NO: 546561 - RNA, 15 nt, Homo sapiens
ccuggacuuuccugc

SEQ ID NO: 546562 - RNA, 18 nt, Homo sapiens
ccuggagacaaggugcua

SEQ ID NO: 546563 - RNA, 21 nt, Homo sapiens
ccuggagacauaucacucaau

SEQ ID NO: 546564 - RNA, 21 nt, Homo sapiens
ccuggagacguggaaccucug

SEQ ID NO: 546565 - RNA, 14 nt, Homo sapiens
ccuggagauccucc

SEQ ID NO: 546566 - RNA, 22 nt, Homo sapiens
ccuggagaugcagcuacuggaa

SEQ ID NO: 546567 - RNA, 13 nt, Homo sapiens
ccuggagcacuua

SEQ ID NO: 546568 - RNA, 24 nt, Homo sapiens
ccuggagcgccacacacugcacau

SEQ ID NO: 546569 - RNA, 18 nt, Homo sapiens
ccuggaggccgcagccaa

SEQ ID NO: 546570 - RNA, 17 nt, Homo sapiens
ccuggaucuaccagcau

SEQ ID NO: 546571 - RNA, 14 nt, Homo sapiens
ccuggaucuccuca

SEQ ID NO: 546572 - RNA, 19 nt, Homo sapiens
ccuggaucuccucaagucc

SEQ ID NO: 546573 - RNA, 21 nt, Homo sapiens
ccuggaugaucacuaauacua

SEQ ID NO: 546574 - RNA, 19 nt, Homo sapiens
ccuggaugucugggugacc

SEQ ID NO: 546575 - RNA, 22 nt, Homo sapiens
ccuggauuuauaguaugugacu

SEQ ID NO: 546576 - RNA, 22 nt, Homo sapiens
ccuggauuuuuuuuuuuaacua

SEQ ID NO: 546577 - RNA, 20 nt, Homo sapiens
ccuggcaaggcauuccucau

SEQ ID NO: 546578 - RNA, 13 nt, Homo sapiens
ccuggcacauuca

SEQ ID NO: 546579 - RNA, 19 nt, Homo sapiens
ccuggcagaacugagcucc

SEQ ID NO: 546580 - RNA, 16 nt, Homo sapiens
ccuugcagaacugcca

SEQ ID NO: 546581 - RNA, 15 nt, Homo sapiens
ccuugcagauaucug

SEQ ID NO: 546582 - RNA, 20 nt, Homo sapiens
ccuugcagauaucugcaugu

SEQ ID NO: 546583 - RNA, 14 nt, Homo sapiens
ccuugccagggcag

SEQ ID NO: 546584 - RNA, 13 nt, Homo sapiens
ccuugccaucaca

SEQ ID NO: 546585 - RNA, 14 nt, Homo sapiens
ccuugcccagagau

SEQ ID NO: 546586 - RNA, 22 nt, Homo sapiens
ccuugccuaaauuuaaugcugc

SEQ ID NO: 546587 - RNA, 19 nt, Homo sapiens
ccuugccucaaugccagua

SEQ ID NO: 546588 - RNA, 14 nt, Homo sapiens
ccuugcuaaccuaa

SEQ ID NO: 546589 - RNA, 21 nt, Homo sapiens
ccuugcugcauugauccagga

SEQ ID NO: 546590 - RNA, 21 nt, Homo sapiens
ccuugcuggacggggacuggg

SEQ ID NO: 546591 - RNA, 16 nt, Homo sapiens
ccuugcuuaccucuca

SEQ ID NO: 546592 - RNA, 21 nt, Homo sapiens
ccuuggaaaucugccaugagc

SEQ ID NO: 546593 - RNA, 13 nt, Homo sapiens
ccuuggaccucag

SEQ ID NO: 546594 - RNA, 15 nt, Homo sapiens
ccuuggaucaguggu

SEQ ID NO: 546595 - RNA, 17 nt, Homo sapiens
ccuuggcaguguggcag

SEQ ID NO: 546596 - RNA, 16 nt, Homo sapiens
ccuuggccucugcuaa

SEQ ID NO: 546597 - RNA, 15 nt, Homo sapiens
ccuuggcucaauccu

SEQ ID NO: 546598 - RNA, 16 nt, Homo sapiens
ccuuggcugucugugg

SEQ ID NO: 546599 - RNA, 13 nt, Homo sapiens
ccuuggcugugag

SEQ ID NO: 546600 - RNA, 20 nt, Homo sapiens
ccuuggcuuaccugaccucu

SEQ ID NO: 546601 - RNA, 17 nt, Homo sapiens
ccuuggcuucugugaug

SEQ ID NO: 546602 - RNA, 15 nt, Homo sapiens
ccuuggcuuguuauu

SEQ ID NO: 546603 - RNA, 19 nt, Homo sapiens
ccuugggaaggaaggcagu

SEQ ID NO: 546604 - RNA, 16 nt, Homo sapiens
ccuuggggagcacuug

SEQ ID NO: 546605 - RNA, 17 nt, Homo sapiens
ccuuggggagcacuugu

SEQ ID NO: 546606 - RNA, 19 nt, Homo sapiens
ccuuggggcucagccacag

SEQ ID NO: 546607 - RNA, 16 nt, Homo sapiens
ccuugggggaagacuu

SEQ ID NO: 546608 - RNA, 17 nt, Homo sapiens
ccuuggggucacuccuu

SEQ ID NO: 546609 - RNA, 18 nt, Homo sapiens
ccuuggucccaagccuga

SEQ ID NO: 546610 - RNA, 18 nt, Homo sapiens
ccuuggucuuuucuugcc

SEQ ID NO: 546611 - RNA, 17 nt, Homo sapiens
ccuuggugaaauucacc

SEQ ID NO: 546612 - RNA, 13 nt, Homo sapiens
ccuuguaccucaa

SEQ ID NO: 546613 - RNA, 18 nt, Homo sapiens
ccuugucaauacugagcc

SEQ ID NO: 546614 - RNA, 14 nt, Homo sapiens
ccuuguccuggguc

SEQ ID NO: 546615 - RNA, 13 nt, Homo sapiens
ccuugucugcacu

SEQ ID NO: 546616 - RNA, 13 nt, Homo sapiens
ccuugugccuugg

SEQ ID NO: 546617 - RNA, 13 nt, Homo sapiens
ccuugugucacug

SEQ ID NO: 546618 - RNA, 15 nt, Homo sapiens
ccuugugucucauau

SEQ ID NO: 546619 - RNA, 17 nt, Homo sapiens
ccuugugugugcccugg

SEQ ID NO: 546620 - RNA, 19 nt, Homo sapiens
ccuuguguguuuugagagu

SEQ ID NO: 546621 - RNA, 13 nt, Homo sapiens
ccuuguuaaucca

SEQ ID NO: 546622 - RNA, 14 nt, Homo sapiens
ccuuguuacacauu

SEQ ID NO: 546623 - RNA, 22 nt, Homo sapiens
ccuuguucucuaaguuccacug

SEQ ID NO: 546624 - RNA, 23 nt, Homo sapiens
ccuuguuggggaguggguggcag

SEQ ID NO: 546625 - RNA, 21 nt, Homo sapiens
ccuuguugucucugucucuca

SEQ ID NO: 546626 - RNA, 14 nt, Homo sapiens
ccuuguuucuacug

SEQ ID NO: 546627 - RNA, 15 nt, Homo sapiens
ccuuguuucuacugu

SEQ ID NO: 546628 - RNA, 18 nt, Homo sapiens
ccuuguuuguacuguaug

SEQ ID NO: 546629 - RNA, 17 nt, Homo sapiens
ccuuuaaaucugugaug

SEQ ID NO: 546630 - RNA, 15 nt, Homo sapiens
ccuuuaagaaccuua

SEQ ID NO: 546631 - RNA, 16 nt, Homo sapiens
ccuuuacguucaucac

SEQ ID NO: 546632 - RNA, 16 nt, Homo sapiens
ccuuuacuaucauucu

SEQ ID NO: 546633 - RNA, 18 nt, Homo sapiens
ccuuuacuccuggcucaa

SEQ ID NO: 546634 - RNA, 20 nt, Homo sapiens
ccuuuagaaacucaaaaacu

SEQ ID NO: 546635 - RNA, 20 nt, Homo sapiens
ccuuuaggaagguauguguc

SEQ ID NO: 546636 - RNA, 17 nt, Homo sapiens
ccuuuaguaaugaaugu

SEQ ID NO: 546637 - RNA, 17 nt, Homo sapiens
ccuuuagugcuuuguga

SEQ ID NO: 546638 - RNA, 18 nt, Homo sapiens
ccuuuauagagugucuca

SEQ ID NO: 546639 - RNA, 15 nt, Homo sapiens
ccuuuauauuugcuc

SEQ ID NO: 546640 - RNA, 23 nt, Homo sapiens
ccuuuaucaaaaaaagacucagc

SEQ ID NO: 546641 - RNA, 14 nt, Homo sapiens
ccuuuaucaccuca

SEQ ID NO: 546642 - RNA, 15 nt, Homo sapiens
ccuuuauccacuuuu

SEQ ID NO: 546643 - RNA, 19 nt, Homo sapiens
ccuuuaugcagagccacag

SEQ ID NO: 546644 - RNA, 17 nt, Homo sapiens
ccuuuauguaagaauga

SEQ ID NO: 546645 - RNA, 17 nt, Homo sapiens
ccuuucaagcggugccu

SEQ ID NO: 546646 - RNA, 14 nt, Homo sapiens
ccuuucagggccaa

SEQ ID NO: 546647 - RNA, 17 nt, Homo sapiens
ccuuucagugcaguuuc

SEQ ID NO: 546648 - RNA, 17 nt, Homo sapiens
ccuuucaugucuuucca

SEQ ID NO: 546649 - RNA, 11 nt, Homo sapiens
ccuuuccauaa

SEQ ID NO: 546650 - RNA, 16 nt, Homo sapiens
ccuuuccauaaggaau

SEQ ID NO: 546651 - RNA, 16 nt, Homo sapiens
ccuuucccaccauucc

SEQ ID NO: 546652 - RNA, 18 nt, Homo sapiens
ccuuucccucuucccuga

SEQ ID NO: 546653 - RNA, 14 nt, Homo sapiens
ccuuuccuccccau

SEQ ID NO: 546654 - RNA, 11 nt, Homo sapiens
ccuuuccuguc

SEQ ID NO: 546655 - RNA, 17 nt, Homo sapiens
ccuuuccuuaugucucc

SEQ ID NO: 546656 - RNA, 14 nt, Homo sapiens
ccuuucgacuugca

SEQ ID NO: 546657 - RNA, 20 nt, Homo sapiens
ccuuucuagccuuagacaaa

SEQ ID NO: 546658 - RNA, 11 nt, Homo sapiens
ccuuucuaguu

SEQ ID NO: 546659 - RNA, 14 nt, Homo sapiens
ccuuucuaguucaa

SEQ ID NO: 546660 - RNA, 14 nt, Homo sapiens
ccuuucuccuguga

SEQ ID NO: 546661 - RNA, 22 nt, Homo sapiens
ccuuucucgugguagaagccag

SEQ ID NO: 546662 - RNA, 19 nt, Homo sapiens
ccuuucucuaaaacugccu

SEQ ID NO: 546663 - RNA, 18 nt, Homo sapiens
ccuuucuucagacacuga

SEQ ID NO: 546664 - RNA, 17 nt, Homo sapiens
ccuuucuucagcucuga

SEQ ID NO: 546665 - RNA, 21 nt, Homo sapiens
ccuuucuugaauuagcauuuu

SEQ ID NO: 546666 - RNA, 20 nt, Homo sapiens
ccuuucuugagggaguucaa

SEQ ID NO: 546667 - RNA, 21 nt, Homo sapiens
ccuuugaaguagacucauucu

SEQ ID NO: 546668 - RNA, 13 nt, Homo sapiens
ccuuugcaaauca

SEQ ID NO: 546669 - RNA, 21 nt, Homo sapiens
ccuuugcucuugggaagacca

SEQ ID NO: 546670 - RNA, 16 nt, Homo sapiens
ccuuugcuucaaauaa

SEQ ID NO: 546671 - RNA, 19 nt, Homo sapiens
ccuuuggaaaauagauuuu

SEQ ID NO: 546672 - RNA, 16 nt, Homo sapiens
ccuuuggaaagccauu

SEQ ID NO: 546673 - RNA, 18 nt, Homo sapiens
ccuuuggaugcacuuuau

SEQ ID NO: 546674 - RNA, 21 nt, Homo sapiens
ccuuuguacgcuuugcucaaa

SEQ ID NO: 546675 - RNA, 17 nt, Homo sapiens
ccuuuguccugcguuuu

SEQ ID NO: 546676 - RNA, 18 nt, Homo sapiens
ccuuugugguuacaguuu

SEQ ID NO: 546677 - RNA, 22 nt, Homo sapiens
ccuuuguguauuuuucaauaau

SEQ ID NO: 546678 - RNA, 22 nt, Homo sapiens
ccuuuuaaaaggcccugugguc

SEQ ID NO: 546679 - RNA, 15 nt, Homo sapiens
ccuuuuaacucaccu

SEQ ID NO: 546680 - RNA, 15 nt, Homo sapiens
ccuuuuaacugccaa

SEQ ID NO: 546681 - RNA, 15 nt, Homo sapiens
ccuuuuaaguuugaa

SEQ ID NO: 546682 - RNA, 13 nt, Homo sapiens
ccuuuuacauacu

SEQ ID NO: 546683 - RNA, 18 nt, Homo sapiens
ccuuuuaccccugcacag

SEQ ID NO: 546684 - RNA, 16 nt, Homo sapiens
ccuuuuaccugcccaa

SEQ ID NO: 546685 - RNA, 21 nt, Homo sapiens
ccuuuuagccuaguucaucca

SEQ ID NO: 546686 - RNA, 16 nt, Homo sapiens
ccuuuuauaccagaga

SEQ ID NO: 546687 - RNA, 23 nt, Homo sapiens
ccuuuuauuuuuuaagguaacaa

SEQ ID NO: 546688 - RNA, 21 nt, Homo sapiens
ccuuuucaaaaccuaaaaaca

SEQ ID NO: 546689 - RNA, 13 nt, Homo sapiens
ccuuuucagggcc

SEQ ID NO: 546690 - RNA, 18 nt, Homo sapiens
ccuuuuccccagucccag

SEQ ID NO: 546691 - RNA, 22 nt, Homo sapiens
ccuuuucucacaaaaaggcaaa

SEQ ID NO: 546692 - RNA, 16 nt, Homo sapiens
ccuuuugccaaucuca

SEQ ID NO: 546693 - RNA, 11 nt, Homo sapiens
ccuuuugcccg

SEQ ID NO: 546694 - RNA, 21 nt, Homo sapiens
ccuuuugggcucaaagcccuu

SEQ ID NO: 546695 - RNA, 12 nt, Homo sapiens
ccuuuuuugcca

SEQ ID NO: 546696 - RNA, 13 nt, Homo sapiens
ccuuuuuugccag

SEQ ID NO: 546697 - RNA, 14 nt, Homo sapiens
ccuuuuuugccaga

SEQ ID NO: 546698 - RNA, 18 nt, Homo sapiens
ccuuuuuuuacauuucau

SEQ ID NO: 546699 - RNA, 22 nt, Homo sapiens
cgaaaagaagguauuuuuccaa

SEQ ID NO: 546700 - RNA, 20 nt, Homo sapiens
cgaaacuccauugagucauu

SEQ ID NO: 546701 - RNA, 21 nt, Homo sapiens
cgaacaauucauauauuugaa

SEQ ID NO: 546702 - RNA, 16 nt, Homo sapiens
cgaaccacccaaaaca

SEQ ID NO: 546703 - RNA, 15 nt, Homo sapiens
cuauauccugugacu

SEQ ID NO: 546704 - RNA, 17 nt, Homo sapiens
cuauauugcacugugac

SEQ ID NO: 546705 - RNA, 18 nt, Homo sapiens
cuauauuuagauuguuaa

SEQ ID NO: 546706 - RNA, 16 nt, Homo sapiens
cuauauuucagugaca

SEQ ID NO: 546707 - RNA, 12 nt, Homo sapiens
cuauauuugcua

SEQ ID NO: 546708 - RNA, 14 nt, Homo sapiens
cuauauuugcuaga

SEQ ID NO: 546709 - RNA, 14 nt, Homo sapiens
cuaucacagucuac

SEQ ID NO: 546710 - RNA, 12 nt, Homo sapiens
cuaucacuguac

SEQ ID NO: 546711 - RNA, 22 nt, Homo sapiens
cuaucacuuuaaauacuauuau

SEQ ID NO: 546712 - RNA, 18 nt, Homo sapiens
cuaucagcggcagcauuc

SEQ ID NO: 546713 - RNA, 20 nt, Homo sapiens
cuaucauaauucagcacuua

SEQ ID NO: 546714 - RNA, 16 nt, Homo sapiens
cuaucauggcauauaa

SEQ ID NO: 546715 - RNA, 18 nt, Homo sapiens
gccaagggcugagugucc

SEQ ID NO: 546716 - RNA, 16 nt, Homo sapiens
gccaagggggugacug

SEQ ID NO: 546717 - RNA, 21 nt, Homo sapiens
gccaaggggugggccugugaa

SEQ ID NO: 546718 - RNA, 21 nt, Homo sapiens
gccaaggucaugccacugcac

SEQ ID NO: 546719 - RNA, 14 nt, Homo sapiens
gccaagguccugcu

SEQ ID NO: 546720 - RNA, 23 nt, Homo sapiens
gccaaggugggguauuuaccaca

SEQ ID NO: 546721 - RNA, 16 nt, Homo sapiens
gccaaguccacugucc

SEQ ID NO: 546722 - RNA, 20 nt, Homo sapiens
gccaauaaagugaucugugu

SEQ ID NO: 546723 - RNA, 17 nt, Homo sapiens
gccaauauaacuaucuc

SEQ ID NO: 546724 - RNA, 17 nt, Homo sapiens
gccaauccacuccuucc

SEQ ID NO: 546725 - RNA, 11 nt, Homo sapiens
gccaaugcaac

SEQ ID NO: 546726 - RNA, 19 nt, Homo sapiens
gccaaugccccacuggcag

SEQ ID NO: 546727 - RNA, 14 nt, Homo sapiens
gccacaacccuguu

SEQ ID NO: 546728 - RNA, 16 nt, Homo sapiens
gccacacgcaugggca

SEQ ID NO: 546729 - RNA, 13 nt, Homo sapiens
gccacacuaccca

SEQ ID NO: 546730 - RNA, 13 nt, Homo sapiens
gccacacugggcc

SEQ ID NO: 546731 - RNA, 12 nt, Homo sapiens
gccacacugguc

SEQ ID NO: 546732 - RNA, 15 nt, Homo sapiens
gccacagaagccagg

SEQ ID NO: 546733 - RNA, 20 nt, Homo sapiens
gccacagcaccccgaaggga

SEQ ID NO: 546734 - RNA, 18 nt, Homo sapiens
gccacagcagguccucca

SEQ ID NO: 546735 - RNA, 18 nt, Homo sapiens
gccacagcccccuugccc

SEQ ID NO: 546736 - RNA, 22 nt, Homo sapiens
gccacagcugcuguucucagga

SEQ ID NO: 546737 - RNA, 16 nt, Homo sapiens
gccacaggacugagcc

SEQ ID NO: 546738 - RNA, 15 nt, Homo sapiens
gccacagucacugga

SEQ ID NO: 546739 - RNA, 16 nt, Homo sapiens
gccacagucacuggau

SEQ ID NO: 546740 - RNA, 16 nt, Homo sapiens
gccacaucccuuugaa

SEQ ID NO: 546741 - RNA, 19 nt, Homo sapiens
gccacaugguguggccauc

SEQ ID NO: 546742 - RNA, 18 nt, Homo sapiens
gccacauuuggaauacuu

SEQ ID NO: 546743 - RNA, 19 nt, Homo sapiens
gccacauuuucuuaaucca

SEQ ID NO: 546744 - RNA, 14 nt, Homo sapiens
gccaccacauuuag

SEQ ID NO: 546745 - RNA, 16 nt, Homo sapiens
gccaccacgucugcca

SEQ ID NO: 546746 - RNA, 13 nt, Homo sapiens
gccaccagggagc

SEQ ID NO: 546747 - RNA, 17 nt, Homo sapiens
gccaccaucauagcuca

SEQ ID NO: 546748 - RNA, 15 nt, Homo sapiens
gccaccauccugcag

SEQ ID NO: 546749 - RNA, 15 nt, Homo sapiens
gccacccauucuucc

SEQ ID NO: 546750 - RNA, 18 nt, Homo sapiens
gccaccgccagagcuccu

SEQ ID NO: 546751 - RNA, 23 nt, Homo sapiens
gccaccgugggggaacugacgcu

SEQ ID NO: 546752 - RNA, 13 nt, Homo sapiens
gccaccucagggc

SEQ ID NO: 546753 - RNA, 19 nt, Homo sapiens
gccaccucucccucaacaa

SEQ ID NO: 546754 - RNA, 15 nt, Homo sapiens
gccaccugcaggacc

SEQ ID NO: 546755 - RNA, 17 nt, Homo sapiens
gccaccuuugugcagcu

SEQ ID NO: 546756 - RNA, 18 nt, Homo sapiens
gccacgcuccaaacccca

SEQ ID NO: 546757 - RNA, 19 nt, Homo sapiens
gccacggagggaggcacca

SEQ ID NO: 546758 - RNA, 17 nt, Homo sapiens
gccacggccuugugucu

SEQ ID NO: 546759 - RNA, 24 nt, Homo sapiens
gccacguaugguggcucaugucua

SEQ ID NO: 546760 - RNA, 15 nt, Homo sapiens
gccacucaaagucaa

SEQ ID NO: 546761 - RNA, 20 nt, Homo sapiens
gccacucggggcaggccagc

SEQ ID NO: 546762 - RNA, 11 nt, Homo sapiens
gccacugaccc

SEQ ID NO: 546763 - RNA, 22 nt, Homo sapiens
gccacugagaagugcacuuuaa

SEQ ID NO: 546764 - RNA, 23 nt, Homo sapiens
gccacugagaagugcacuuuaag

SEQ ID NO: 546765 - RNA, 16 nt, Homo sapiens
gccacugcacaccagc

SEQ ID NO: 546766 - RNA, 22 nt, Homo sapiens
gccacugcaccugaccugcuga

SEQ ID NO: 546767 - RNA, 21 nt, Homo sapiens
gccacugccuuucagaaguga

SEQ ID NO: 546768 - RNA, 11 nt, Homo sapiens
gccacugggca

SEQ ID NO: 546769 - RNA, 14 nt, Homo sapiens
gccacuucaccaag

SEQ ID NO: 546770 - RNA, 23 nt, Homo sapiens
gccacuugguuuuuggcucuuuc

SEQ ID NO: 546771 - RNA, 15 nt, Homo sapiens
gccacuuugcaaagg

SEQ ID NO: 546772 - RNA, 22 nt, Homo sapiens
gccagacgugcuccugcugacc

SEQ ID NO: 546773 - RNA, 13 nt, Homo sapiens
gccagagaauaga

SEQ ID NO: 546774 - RNA, 16 nt, Homo sapiens
gccagagccucuggcc

SEQ ID NO: 546775 - RNA, 16 nt, Homo sapiens
gccagagcugugccug

SEQ ID NO: 546776 - RNA, 22 nt, Homo sapiens
gccagaggcucuaauguacaau

SEQ ID NO: 546777 - RNA, 18 nt, Homo sapiens
gccagaggguagggcaca

SEQ ID NO: 546778 - RNA, 19 nt, Homo sapiens
gccagaguagugaagcuaa

SEQ ID NO: 546779 - RNA, 19 nt, Homo sapiens
gccagaguggccuggccag

SEQ ID NO: 546780 - RNA, 18 nt, Homo sapiens
gccagaugauuguucaaa

SEQ ID NO: 546781 - RNA, 20 nt, Homo sapiens
gccagaugugaaaacaucuc

SEQ ID NO: 546782 - RNA, 22 nt, Homo sapiens
gccagauuaccgacacugucac

SEQ ID NO: 546783 - RNA, 18 nt, Homo sapiens
gccagcaaugacaucuca

SEQ ID NO: 546784 - RNA, 18 nt, Homo sapiens
gccagcacacagggcagu

SEQ ID NO: 546785 - RNA, 12 nt, Homo sapiens
gccagcacagaa

SEQ ID NO: 546786 - RNA, 21 nt, Homo sapiens
gccagcagcacagucacccau

SEQ ID NO: 546787 - RNA, 15 nt, Homo sapiens
gccagccagugccau

SEQ ID NO: 546788 - RNA, 17 nt, Homo sapiens
gccagccagugccauuc

SEQ ID NO: 546789 - RNA, 16 nt, Homo sapiens
gccagccaugcauugu

SEQ ID NO: 546790 - RNA, 16 nt, Homo sapiens
gccagccccaagcugg

SEQ ID NO: 546791 - RNA, 17 nt, Homo sapiens
gccagccggcuaugaaa

SEQ ID NO: 546792 - RNA, 13 nt, Homo sapiens
gccagccucagaa

SEQ ID NO: 546793 - RNA, 17 nt, Homo sapiens
gccagcuuaucucaggg

SEQ ID NO: 546794 - RNA, 22 nt, Homo sapiens
gccaggaaaagcccucaucuuc

SEQ ID NO: 546795 - RNA, 14 nt, Homo sapiens
gccaggacaucucu

SEQ ID NO: 546796 - RNA, 16 nt, Homo sapiens
cuucugcuuucacuua

SEQ ID NO: 546797 - RNA, 23 nt, Homo sapiens
cuucuggagauggauccuuccau

SEQ ID NO: 546798 - RNA, 19 nt, Homo sapiens
cuucuggccuccagccuuu

SEQ ID NO: 546799 - RNA, 15 nt, Homo sapiens
cuucugggaccauaa

SEQ ID NO: 546800 - RNA, 23 nt, Homo sapiens
cuucuggggcaggcugggccaug

SEQ ID NO: 546801 - RNA, 20 nt, Homo sapiens
cuucuggggguagaucucaa

SEQ ID NO: 546802 - RNA, 19 nt, Homo sapiens
cuucugggucaugcacuga

SEQ ID NO: 546803 - RNA, 17 nt, Homo sapiens
cuucuggugucauggug

SEQ ID NO: 546804 - RNA, 13 nt, Homo sapiens
cuucuguaaaggu

SEQ ID NO: 546805 - RNA, 21 nt, Homo sapiens
cuucuguaguguauuaaucuc

SEQ ID NO: 546806 - RNA, 17 nt, Homo sapiens
cuucuguguagucaaua

SEQ ID NO: 546807 - RNA, 22 nt, Homo sapiens
cuucuguuucuucucuugguga

SEQ ID NO: 546808 - RNA, 16 nt, Homo sapiens
cuucuucaccauuugg

SEQ ID NO: 546809 - RNA, 20 nt, Homo sapiens
cuucuucccuuaacuccaag

SEQ ID NO: 546810 - RNA, 14 nt, Homo sapiens
cuucuuccuuguag

SEQ ID NO: 546811 - RNA, 18 nt, Homo sapiens
cuucuugcaucuaaugaa

SEQ ID NO: 546812 - RNA, 16 nt, Homo sapiens
cuucuugcuucaguca

SEQ ID NO: 546813 - RNA, 21 nt, Homo sapiens
cuucuugggcugagugcagcc

SEQ ID NO: 546814 - RNA, 19 nt, Homo sapiens
cuucuugguggggaugaga

SEQ ID NO: 546815 - RNA, 19 nt, Homo sapiens
cuucuugguuuggggagaa

SEQ ID NO: 546816 - RNA, 19 nt, Homo sapiens
cuucuuguaguagucucau

SEQ ID NO: 546817 - RNA, 18 nt, Homo sapiens
cuucuuuacuaacacugg

SEQ ID NO: 546818 - RNA, 18 nt, Homo sapiens
cuucuuuagaacagggaa

SEQ ID NO: 546819 - RNA, 17 nt, Homo sapiens
cuucuuuagaugccaaa

SEQ ID NO: 546820 - RNA, 16 nt, Homo sapiens
cuucuuuccucuggag

SEQ ID NO: 546821 - RNA, 19 nt, Homo sapiens
cauaucugguauaugucau

SEQ ID NO: 546822 - RNA, 18 nt, Homo sapiens
cauaucuuaaaacuaaau

SEQ ID NO: 546823 - RNA, 20 nt, Homo sapiens
cauaucuuaaagaaacagcu

SEQ ID NO: 546824 - RNA, 18 nt, Homo sapiens
cauaugaaaaaaaugcau

SEQ ID NO: 546825 - RNA, 21 nt, Homo sapiens
cauaugacaauguugcauuua

SEQ ID NO: 546826 - RNA, 14 nt, Homo sapiens
cauaugauucugcu

SEQ ID NO: 546827 - RNA, 20 nt, Homo sapiens
cauaugcagccaaccaagau

SEQ ID NO: 546828 - RNA, 18 nt, Homo sapiens
cauauggagcucauguca

SEQ ID NO: 546829 - RNA, 14 nt, Homo sapiens
cauauggucccugg

SEQ ID NO: 546830 - RNA, 17 nt, Homo sapiens
cauauguaccauguaca

SEQ ID NO: 546831 - RNA, 21 nt, Homo sapiens
cauauguagccuucacacaga

SEQ ID NO: 546832 - RNA, 23 nt, Homo sapiens
cauauguaguauaauuucuagaa

SEQ ID NO: 546833 - RNA, 20 nt, Homo sapiens
cauauguauauauauauaug

SEQ ID NO: 546834 - RNA, 19 nt, Homo sapiens
cauauguguaaagauuuau

SEQ ID NO: 546835 - RNA, 22 nt, Homo sapiens
cauauguguguguggguaugug

SEQ ID NO: 546836 - RNA, 23 nt, Homo sapiens
cauauguguguguggguaugugu

SEQ ID NO: 546837 - RNA, 19 nt, Homo sapiens
cauauguugcucagucucc

SEQ ID NO: 546838 - RNA, 13 nt, Homo sapiens
cauauuaagcacu

SEQ ID NO: 546839 - RNA, 21 nt, Homo sapiens
cauauuaggugguucucuuca

SEQ ID NO: 546840 - RNA, 12 nt, Homo sapiens
cauauuaucuca

SEQ ID NO: 546841 - RNA, 13 nt, Homo sapiens
cauauuaucucau

SEQ ID NO: 546842 - RNA, 23 nt, Homo sapiens
cauauucugggcuccuggaacca

SEQ ID NO: 546843 - RNA, 21 nt, Homo sapiens
cauauucuuaaugacauuuca

SEQ ID NO: 546844 - RNA, 18 nt, Homo sapiens
cauauugaugugugucua

SEQ ID NO: 546845 - RNA, 15 nt, Homo sapiens
cauauuggacugaua

SEQ ID NO: 546846 - RNA, 13 nt, Homo sapiens
cauauuguagcuc

SEQ ID NO: 546847 - RNA, 17 nt, Homo sapiens
cauauuguagcucaaua

SEQ ID NO: 546848 - RNA, 17 nt, Homo sapiens
cauauugugauucugcc

SEQ ID NO: 546849 - RNA, 21 nt, Homo sapiens
cauauuuaagagauacuugau

SEQ ID NO: 546850 - RNA, 17 nt, Homo sapiens
cauauuuagcuuugcac

SEQ ID NO: 546851 - RNA, 19 nt, Homo sapiens
cauauuuagcuuugcacau

SEQ ID NO: 546852 - RNA, 18 nt, Homo sapiens
cauauuuuuaaacaaaga

SEQ ID NO: 546853 - RNA, 22 nt, Homo sapiens
cauauuuuuaaacaaagacagc

SEQ ID NO: 546854 - RNA, 16 nt, Homo sapiens
caucaaaaagccuuau

SEQ ID NO: 546855 - RNA, 17 nt, Homo sapiens
caucaaaagcaccagca

SEQ ID NO: 546856 - RNA, 15 nt, Homo sapiens
caucaaacauuugcc

SEQ ID NO: 546857 - RNA, 13 nt, Homo sapiens
caucaaaccugag

SEQ ID NO: 546858 - RNA, 18 nt, Homo sapiens
caucaaagaacaaacauc

SEQ ID NO: 546859 - RNA, 13 nt, Homo sapiens
caucaaauaguga

SEQ ID NO: 546860 - RNA, 22 nt, Homo sapiens
caucaagaugagagaacuggag

SEQ ID NO: 546861 - RNA, 14 nt, Homo sapiens
caucaaggucuuug

SEQ ID NO: 546862 - RNA, 13 nt, Homo sapiens
caucaagugcagu

SEQ ID NO: 546863 - RNA, 14 nt, Homo sapiens
caucaagugcaguc

SEQ ID NO: 546864 - RNA, 15 nt, Homo sapiens
caucaaguugugcca

SEQ ID NO: 546865 - RNA, 14 nt, Homo sapiens
caucaauacaacca

SEQ ID NO: 546866 - RNA, 19 nt, Homo sapiens
caucaaugcugaguuaaua

SEQ ID NO: 546867 - RNA, 16 nt, Homo sapiens
caucacaagaaaguca

SEQ ID NO: 546868 - RNA, 15 nt, Homo sapiens
caucacacauguuca

SEQ ID NO: 546869 - RNA, 13 nt, Homo sapiens
caucacaugacca

SEQ ID NO: 546870 - RNA, 19 nt, Homo sapiens
caucacauucccauggugg

SEQ ID NO: 546871 - RNA, 22 nt, Homo sapiens
caucaccccagaggccuuguca

SEQ ID NO: 546872 - RNA, 19 nt, Homo sapiens
caucacccucuuccuguga

SEQ ID NO: 546873 - RNA, 23 nt, Homo sapiens
caucacggauggugcaugggcuc

SEQ ID NO: 546874 - RNA, 16 nt, Homo sapiens
caucacguauguuaua

SEQ ID NO: 546875 - RNA, 16 nt, Homo sapiens
caucacguuagcuguc

SEQ ID NO: 546876 - RNA, 23 nt, Homo sapiens
caucacuccucugucauaugcag

SEQ ID NO: 546877 - RNA, 22 nt, Homo sapiens
caucacugaucuaagcaguggc

SEQ ID NO: 546878 - RNA, 23 nt, Homo sapiens
caucacugaucuaagcaguggca

SEQ ID NO: 546879 - RNA, 18 nt, Homo sapiens
caucacuguaaagacaaa

SEQ ID NO: 546880 - RNA, 17 nt, Homo sapiens
caucacuucccuacaug

SEQ ID NO: 546881 - RNA, 19 nt, Homo sapiens
caucagaccugucuuccaa

SEQ ID NO: 546882 - RNA, 22 nt, Homo sapiens
caucagagaugguaaucuacag

SEQ ID NO: 546883 - RNA, 14 nt, Homo sapiens
caucagagcagcua

SEQ ID NO: 546884 - RNA, 19 nt, Homo sapiens
caucagagguuugcuuccu

SEQ ID NO: 546885 - RNA, 13 nt, Homo sapiens
caucagccaguga

SEQ ID NO: 546886 - RNA, 14 nt, Homo sapiens
caucagccagugaa

SEQ ID NO: 546887 - RNA, 16 nt, Homo sapiens
caucagccauuugcca

SEQ ID NO: 546888 - RNA, 17 nt, Homo sapiens
caucagcccaucucaac

SEQ ID NO: 546889 - RNA, 16 nt, Homo sapiens
caucagccugcuucuu

SEQ ID NO: 546890 - RNA, 16 nt, Homo sapiens
caucagccuguagcuc

SEQ ID NO: 546891 - RNA, 15 nt, Homo sapiens
caucagcguaguguu

SEQ ID NO: 546892 - RNA, 19 nt, Homo sapiens
caucagcuguuuuuaguua

SEQ ID NO: 546893 - RNA, 15 nt, Homo sapiens
caucaggacucugac

SEQ ID NO: 546894 - RNA, 15 nt, Homo sapiens
caucaggcaguguua

SEQ ID NO: 546895 - RNA, 15 nt, Homo sapiens
caucagggacaggau

SEQ ID NO: 546896 - RNA, 19 nt, Homo sapiens
caucagggcccugccccag

SEQ ID NO: 546897 - RNA, 20 nt, Homo sapiens
caucagggccuuucuccucc

SEQ ID NO: 546898 - RNA, 21 nt, Homo sapiens
caucaggugaggugugcucca

SEQ ID NO: 546899 - RNA, 21 nt, Homo sapiens
caucagguuccaguugcuuga

SEQ ID NO: 546900 - RNA, 16 nt, Homo sapiens
caucaguagcaucugu

SEQ ID NO: 546901 - RNA, 17 nt, Homo sapiens
caucaguagcaucugua

SEQ ID NO: 546902 - RNA, 18 nt, Homo sapiens
caucaguagcaucuguaa

SEQ ID NO: 546903 - RNA, 14 nt, Homo sapiens
caucaguaguucac

SEQ ID NO: 546904 - RNA, 17 nt, Homo sapiens
caucaguauucugccau

SEQ ID NO: 546905 - RNA, 21 nt, Homo sapiens
caucaguguccucuugcucaa

SEQ ID NO: 546906 - RNA, 14 nt, Homo sapiens
caucaguguuaaaa

SEQ ID NO: 546907 - RNA, 21 nt, Homo sapiens
caucauaauuacauuccuaac

SEQ ID NO: 546908 - RNA, 14 nt, Homo sapiens
caucauauuccaac

SEQ ID NO: 546909 - RNA, 20 nt, Homo sapiens
caucauauuuuguugugcac

SEQ ID NO: 546910 - RNA, 14 nt, Homo sapiens
caucaucacuguaa

SEQ ID NO: 546911 - RNA, 20 nt, Homo sapiens
caucauccuaagcuauucag

SEQ ID NO: 546912 - RNA, 21 nt, Homo sapiens
caucauggaaagacugggaca

SEQ ID NO: 546913 - RNA, 16 nt, Homo sapiens
caucaugggcuggaca

SEQ ID NO: 546914 - RNA, 15 nt, Homo sapiens
caucauuacagauuc

SEQ ID NO: 546915 - RNA, 15 nt, Homo sapiens
caucauuacuuauga

SEQ ID NO: 546916 - RNA, 19 nt, Homo sapiens
caucauuacuuaugaugau

SEQ ID NO: 546917 - RNA, 21 nt, Homo sapiens
gcaucaauacaaccagcccaa

SEQ ID NO: 546918 - RNA, 23 nt, Homo sapiens
gcaucacggauggugcaugggcu

SEQ ID NO: 546919 - RNA, 20 nt, Homo sapiens
gcaucacguaccccacuggg

SEQ ID NO: 546920 - RNA, 13 nt, Homo sapiens
gcaucacugggug

SEQ ID NO: 546921 - RNA, 11 nt, Homo sapiens
gcaucagagau

SEQ ID NO: 546922 - RNA, 13 nt, Homo sapiens
gcaucagugacug

SEQ ID NO: 546923 - RNA, 14 nt, Homo sapiens
gcaucagugacuga

SEQ ID NO: 546924 - RNA, 15 nt, Homo sapiens
gcaucaguugcuaua

SEQ ID NO: 546925 - RNA, 17 nt, Homo sapiens
gcauccaacuccaggau

SEQ ID NO: 546926 - RNA, 20 nt, Homo sapiens
gcauccacccagugcugcca

SEQ ID NO: 546927 - RNA, 18 nt, Homo sapiens
gcauccagccuguguguu

SEQ ID NO: 546928 - RNA, 21 nt, Homo sapiens
gcauccauuugaacacauuau

SEQ ID NO: 546929 - RNA, 14 nt, Homo sapiens
gcaucccaggggac

SEQ ID NO: 546930 - RNA, 20 nt, Homo sapiens
gcauccccccugcucagcaa

SEQ ID NO: 546931 - RNA, 20 nt, Homo sapiens
gcauccccuuggcugugagg

SEQ ID NO: 546932 - RNA, 18 nt, Homo sapiens
gcaucccggaggaaaucu

SEQ ID NO: 546933 - RNA, 20 nt, Homo sapiens
gcaucccugaaacaucucaa

SEQ ID NO: 546934 - RNA, 14 nt, Homo sapiens
gcauccuggccaac

SEQ ID NO: 546935 - RNA, 20 nt, Homo sapiens
gcauccuggccaacauggug

SEQ ID NO: 546936 - RNA, 12 nt, Homo sapiens
gcauccugugaa

SEQ ID NO: 546937 - RNA, 16 nt, Homo sapiens
gcaucuacacaauuua

SEQ ID NO: 546938 - RNA, 12 nt, Homo sapiens
gcaucuacucua

SEQ ID NO: 546939 - RNA, 20 nt, Homo sapiens
gcaucuaucuggugauuucu

SEQ ID NO: 546940 - RNA, 13 nt, Homo sapiens
gcaucucagccua

SEQ ID NO: 546941 - RNA, 15 nt, Homo sapiens
gcaucucagugcagg

SEQ ID NO: 546942 - RNA, 14 nt, Homo sapiens
gcaucuccccucag

SEQ ID NO: 546943 - RNA, 14 nt, Homo sapiens
gcaucugcaacaaa

SEQ ID NO: 546944 - RNA, 23 nt, Homo sapiens
gcaucugggauucccaccaaggu

SEQ ID NO: 546945 - RNA, 17 nt, Homo sapiens
gcaucuggguagcugua

SEQ ID NO: 546946 - RNA, 23 nt, Homo sapiens
gcaucugugccagagauguacug

SEQ ID NO: 546947 - RNA, 22 nt, Homo sapiens
gcaucuucuggagucuccagug

SEQ ID NO: 546948 - RNA, 22 nt, Homo sapiens
gcaucuugcuaugagguuugcu

SEQ ID NO: 546949 - RNA, 16 nt, Homo sapiens
gcaucuugcuggcuac

SEQ ID NO: 546950 - RNA, 16 nt, Homo sapiens
gcaucuuuaacacagc

SEQ ID NO: 546951 - RNA, 14 nt, Homo sapiens
gcaucuuuccugcc

SEQ ID NO: 546952 - RNA, 21 nt, Homo sapiens
gcaucuuuucuguugccccau

SEQ ID NO: 546953 - RNA, 15 nt, Homo sapiens
gcaugaaacauguuc

SEQ ID NO: 546954 - RNA, 18 nt, Homo sapiens
gcaugaauaaaacacuca

SEQ ID NO: 546955 - RNA, 16 nt, Homo sapiens
gcaugaccacauagaa

SEQ ID NO: 546956 - RNA, 23 nt, Homo sapiens
gcaugaccugugaccagcacugu

SEQ ID NO: 546957 - RNA, 19 nt, Homo sapiens
gcaugagaaagaauuugag

SEQ ID NO: 546958 - RNA, 13 nt, Homo sapiens
gcaugagacuuuc

SEQ ID NO: 546959 - RNA, 15 nt, Homo sapiens
gcaugauaagagcau

SEQ ID NO: 546960 - RNA, 22 nt, Homo sapiens
gcaugaucuugagcaaguuccu

SEQ ID NO: 546961 - RNA, 15 nt, Homo sapiens
gcaugaugcccuccc

SEQ ID NO: 546962 - RNA, 19 nt, Homo sapiens
gcaugcacagcugcuuguc

SEQ ID NO: 546963 - RNA, 17 nt, Homo sapiens
gcaugccuggucuuucc

SEQ ID NO: 546964 - RNA, 15 nt, Homo sapiens
gcaugcgcaggcuca

SEQ ID NO: 546965 - RNA, 19 nt, Homo sapiens
gcaugcucaguuggugcug

SEQ ID NO: 546966 - RNA, 13 nt, Homo sapiens
gcaugcucuggaa

SEQ ID NO: 546967 - RNA, 20 nt, Homo sapiens
gcaugcugcccagccacucc

SEQ ID NO: 546968 - RNA, 16 nt, Homo sapiens
gcaugcugcuuugcca

SEQ ID NO: 546969 - RNA, 16 nt, Homo sapiens
gcauggaacacuucga

SEQ ID NO: 546970 - RNA, 14 nt, Homo sapiens
gcauggaacagcau

SEQ ID NO: 546971 - RNA, 17 nt, Homo sapiens
gcauggaacagcauuac

SEQ ID NO: 546972 - RNA, 20 nt, Homo sapiens
gcauggacucuggguuucau

SEQ ID NO: 546973 - RNA, 15 nt, Homo sapiens
gcauggguccagggc

SEQ ID NO: 546974 - RNA, 15 nt, Homo sapiens
gcauggugcagggag

SEQ ID NO: 546975 - RNA, 14 nt, Homo sapiens
gcauggugcaguug

SEQ ID NO: 546976 - RNA, 23 nt, Homo sapiens
gcaugguggaacccccaucucua

SEQ ID NO: 546977 - RNA, 16 nt, Homo sapiens
gcaugguguguggugc

SEQ ID NO: 546978 - RNA, 13 nt, Homo sapiens
gcauguacuugaa

SEQ ID NO: 546979 - RNA, 21 nt, Homo sapiens
gcaugucagacagaacuugaa

SEQ ID NO: 546980 - RNA, 13 nt, Homo sapiens
gcauguccuuugc

SEQ ID NO: 546981 - RNA, 18 nt, Homo sapiens
gcaugucucaauaguaaa

SEQ ID NO: 546982 - RNA, 15 nt, Homo sapiens
gcaugugcagcuauu

SEQ ID NO: 546983 - RNA, 14 nt, Homo sapiens
gcaugugucaugaa

SEQ ID NO: 546984 - RNA, 20 nt, Homo sapiens
gcaugugugcgagugugugc

SEQ ID NO: 546985 - RNA, 16 nt, Homo sapiens
gcauuacuauucacug

SEQ ID NO: 546986 - RNA, 21 nt, Homo sapiens
gcauuagcucuuagacccaca

SEQ ID NO: 546987 - RNA, 20 nt, Homo sapiens
gcauuaggaagaaaggagcu

SEQ ID NO: 546988 - RNA, 21 nt, Homo sapiens
gcauuaguguccccccuugaa

SEQ ID NO: 546989 - RNA, 15 nt, Homo sapiens
gcauucaaaugggcu

SEQ ID NO: 546990 - RNA, 14 nt, Homo sapiens
gcauucacauuuag

SEQ ID NO: 546991 - RNA, 13 nt, Homo sapiens
gcauucagacucc

SEQ ID NO: 546992 - RNA, 15 nt, Homo sapiens
gcauuccagaacaaa

SEQ ID NO: 546993 - RNA, 22 nt, Homo sapiens
gcauucggggaagcugcacaug

SEQ ID NO: 546994 - RNA, 22 nt, Homo sapiens
gcauucuuguugguagcaugua

SEQ ID NO: 546995 - RNA, 23 nt, Homo sapiens
cacuccaggcauauguuucccca

SEQ ID NO: 546996 - RNA, 13 nt, Homo sapiens
cacuccagugcca

SEQ ID NO: 546997 - RNA, 14 nt, Homo sapiens
cacuccagugccag

SEQ ID NO: 546998 - RNA, 15 nt, Homo sapiens
cacuccauguuugca

SEQ ID NO: 546999 - RNA, 12 nt, Homo sapiens
cacucccaaagc

SEQ ID NO: 547000 - RNA, 21 nt, Homo sapiens
cacuccccagagcugugccag

SEQ ID NO: 547001 - RNA, 20 nt, Homo sapiens
cugacaaguuauuacugucu

SEQ ID NO: 547002 - RNA, 22 nt, Homo sapiens
cugacaauauacaagcuuuuag

SEQ ID NO: 547003 - RNA, 18 nt, Homo sapiens
cugacacaagaauggucu

SEQ ID NO: 547004 - RNA, 14 nt, Homo sapiens
cugacacauagaaa

SEQ ID NO: 547005 - RNA, 18 nt, Homo sapiens
cugacacauagaaaacaa

SEQ ID NO: 547006 - RNA, 21 nt, Homo sapiens
cugacacauagaaaacaauca

SEQ ID NO: 547007 - RNA, 20 nt, Homo sapiens
cugacaccgucgaccaggaa

SEQ ID NO: 547008 - RNA, 16 nt, Homo sapiens
cugacacuuccugucc

SEQ ID NO: 547009 - RNA, 21 nt, Homo sapiens
cugacagcaucacgcugcauc

SEQ ID NO: 547010 - RNA, 12 nt, Homo sapiens
cugacagccuuu

SEQ ID NO: 547011 - RNA, 22 nt, Homo sapiens
cugacagggacaugcccugugu

SEQ ID NO: 547012 - RNA, 15 nt, Homo sapiens
cugacagggccagug

SEQ ID NO: 547013 - RNA, 16 nt, Homo sapiens
cugacaggugaugcuc

SEQ ID NO: 547014 - RNA, 15 nt, Homo sapiens
cugacaguaaaucuc

SEQ ID NO: 547015 - RNA, 18 nt, Homo sapiens
cugacaguauuaagggua

SEQ ID NO: 547016 - RNA, 14 nt, Homo sapiens
cugacaguuuacag

SEQ ID NO: 547017 - RNA, 17 nt, Homo sapiens
cugacauauaucuauua

SEQ ID NO: 547018 - RNA, 15 nt, Homo sapiens
cugacauuuaguuga

SEQ ID NO: 547019 - RNA, 11 nt, Homo sapiens
cugaccaaaac

SEQ ID NO: 547020 - RNA, 16 nt, Homo sapiens
cugaccaaaacaaaca

SEQ ID NO: 547021 - RNA, 15 nt, Homo sapiens
cugaccaagagagaa

SEQ ID NO: 547022 - RNA, 11 nt, Homo sapiens
cugaccacaga

SEQ ID NO: 547023 - RNA, 14 nt, Homo sapiens
cugacccaacuggg

SEQ ID NO: 547024 - RNA, 14 nt, Homo sapiens
cugacccaagagaa

SEQ ID NO: 547025 - RNA, 13 nt, Homo sapiens
cugaccccaaaga

SEQ ID NO: 547026 - RNA, 21 nt, Homo sapiens
cugaccccacuuaugcugcug

SEQ ID NO: 547027 - RNA, 22 nt, Homo sapiens
cugaccccagcauuuccagagc

SEQ ID NO: 547028 - RNA, 16 nt, Homo sapiens
cugaccccagugcugc

SEQ ID NO: 547029 - RNA, 22 nt, Homo sapiens
cugacccuucucucacuucuaa

SEQ ID NO: 547030 - RNA, 19 nt, Homo sapiens
cugaccucaggugauccac

SEQ ID NO: 547031 - RNA, 18 nt, Homo sapiens
cugaccugcggguccuca

SEQ ID NO: 547032 - RNA, 15 nt, Homo sapiens
cugaccuuccagagc

SEQ ID NO: 547033 - RNA, 14 nt, Homo sapiens
cugaccuugcacaa

SEQ ID NO: 547034 - RNA, 15 nt, Homo sapiens
cugaccuugugaucc

SEQ ID NO: 547035 - RNA, 15 nt, Homo sapiens
cugacgacaguacug

SEQ ID NO: 547036 - RNA, 22 nt, Homo sapiens
cugacgcaggcaccuucuuggc

SEQ ID NO: 547037 - RNA, 16 nt, Homo sapiens
cugacuaauuaggcaa

SEQ ID NO: 547038 - RNA, 13 nt, Homo sapiens
cugacuacaaauu

SEQ ID NO: 547039 - RNA, 21 nt, Homo sapiens
cugacuauugaaguugcagau

SEQ ID NO: 547040 - RNA, 15 nt, Homo sapiens
cugacucuaagaauu

SEQ ID NO: 547041 - RNA, 14 nt, Homo sapiens
cugacucugacuca

SEQ ID NO: 547042 - RNA, 20 nt, Homo sapiens
cugacugaagugaacuauga

SEQ ID NO: 547043 - RNA, 17 nt, Homo sapiens
cugacugaauaaccacu

SEQ ID NO: 547044 - RNA, 22 nt, Homo sapiens
cugacugauagcuuacacugag

SEQ ID NO: 547045 - RNA, 20 nt, Homo sapiens
cugacugcagccagccacag

SEQ ID NO: 547046 - RNA, 19 nt, Homo sapiens
cugacuguuuuuuuugcag

SEQ ID NO: 547047 - RNA, 20 nt, Homo sapiens
cugacuuaaguggcauuaaa

SEQ ID NO: 547048 - RNA, 19 nt, Homo sapiens
cugacuucagaguggacuu

SEQ ID NO: 547049 - RNA, 18 nt, Homo sapiens
cugacuuguuugucuucc

SEQ ID NO: 547050 - RNA, 19 nt, Homo sapiens
cugacuuguuugucuucca

SEQ ID NO: 547051 - RNA, 15 nt, Homo sapiens
cugacuuucucucca

SEQ ID NO: 547052 - RNA, 17 nt, Homo sapiens
cugacuuuuaaugucau

SEQ ID NO: 547053 - RNA, 21 nt, Homo sapiens
cugacuuuucccauucagcug

SEQ ID NO: 547054 - RNA, 21 nt, Homo sapiens
cugagaaagagaaugagaaga

SEQ ID NO: 547055 - RNA, 23 nt, Homo sapiens
cugagaaauaaaaagccugucau

SEQ ID NO: 547056 - RNA, 17 nt, Homo sapiens
cugagaaauagguauca

SEQ ID NO: 547057 - RNA, 18 nt, Homo sapiens
cugagaaauguuaaaggu

SEQ ID NO: 547058 - RNA, 14 nt, Homo sapiens
cugagaacagcaua

SEQ ID NO: 547059 - RNA, 14 nt, Homo sapiens
cugagaagaucuga

SEQ ID NO: 547060 - RNA, 15 nt, Homo sapiens
cugagaagcaguaua

SEQ ID NO: 547061 - RNA, 20 nt, Homo sapiens
cugagaagcaguauaagccu

SEQ ID NO: 547062 - RNA, 19 nt, Homo sapiens
cugagaagucaaacauuuc

SEQ ID NO: 547063 - RNA, 18 nt, Homo sapiens
cugagaaucagacugaca

SEQ ID NO: 547064 - RNA, 16 nt, Homo sapiens
cugagaauguggaaua

SEQ ID NO: 547065 - RNA, 14 nt, Homo sapiens
cugagacagacaca

SEQ ID NO: 547066 - RNA, 14 nt, Homo sapiens
cugagacugugcug

SEQ ID NO: 547067 - RNA, 17 nt, Homo sapiens
cugagagaauuggcuca

SEQ ID NO: 547068 - RNA, 22 nt, Homo sapiens
cugagaggcaggcauagaggcu

SEQ ID NO: 547069 - RNA, 19 nt, Homo sapiens
cugagaggggagaguccag

SEQ ID NO: 547070 - RNA, 22 nt, Homo sapiens
cugagaucgcgccauugcacuc

SEQ ID NO: 547071 - RNA, 18 nt, Homo sapiens
cugagaucuguugauuga

SEQ ID NO: 547072 - RNA, 18 nt, Homo sapiens
cugagauucuucguguau

SEQ ID NO: 547073 - RNA, 21 nt, Homo sapiens
cugagauuuuugauaucucaa

SEQ ID NO: 547074 - RNA, 17 nt, Homo sapiens
cugagcaacucuugauu

SEQ ID NO: 547075 - RNA, 13 nt, Homo sapiens
cugagcacaguca

SEQ ID NO: 547076 - RNA, 15 nt, Homo sapiens
cugagcaccguguca

SEQ ID NO: 547077 - RNA, 15 nt, Homo sapiens
cugagcacuuuugaa

SEQ ID NO: 547078 - RNA, 22 nt, Homo sapiens
cugagcagugaaugauucagug

SEQ ID NO: 547079 - RNA, 15 nt, Homo sapiens
cugagcauaaugcuc

SEQ ID NO: 547080 - RNA, 15 nt, Homo sapiens
cugagcauuugcacc

SEQ ID NO: 547081 - RNA, 14 nt, Homo sapiens
cugagccacagaaa

SEQ ID NO: 547082 - RNA, 18 nt, Homo sapiens
cugagccauuugcugcau

SEQ ID NO: 547083 - RNA, 20 nt, Homo sapiens
cugagccauuugcugcauuu

SEQ ID NO: 547084 - RNA, 23 nt, Homo sapiens
cugagccccucaauccuaucaca

SEQ ID NO: 547085 - RNA, 21 nt, Homo sapiens
cugagcccugguguguuucca

SEQ ID NO: 547086 - RNA, 17 nt, Homo sapiens
cugagccuccugaaguu

SEQ ID NO: 547087 - RNA, 14 nt, Homo sapiens
cugagccugaagag

SEQ ID NO: 547088 - RNA, 20 nt, Homo sapiens
cugagcuaucuccuaacuuu

SEQ ID NO: 547089 - RNA, 18 nt, Homo sapiens
cugagcuccccagaucuc

SEQ ID NO: 547090 - RNA, 18 nt, Homo sapiens
cugagcuguaucuugaug

SEQ ID NO: 547091 - RNA, 22 nt, Homo sapiens
cugagcuuggcguuuggaccca

SEQ ID NO: 547092 - RNA, 13 nt, Homo sapiens
cugaggaccagcc

SEQ ID NO: 547093 - RNA, 14 nt, Homo sapiens
cugaggaccucuca

SEQ ID NO: 547094 - RNA, 22 nt, Homo sapiens
cugaggacuguccucccacaga

SEQ ID NO: 547095 - RNA, 13 nt, Homo sapiens
cugaggauuucaa

SEQ ID NO: 547096 - RNA, 14 nt, Homo sapiens
cugaggcaagagaa

SEQ ID NO: 547097 - RNA, 18 nt, Homo sapiens
cugaggcagaaggauuac

SEQ ID NO: 547098 - RNA, 17 nt, Homo sapiens
cugaggcagacagcagc

SEQ ID NO: 547099 - RNA, 22 nt, Homo sapiens
cugaggcaggaggauugcuuga

SEQ ID NO: 547100 - RNA, 21 nt, Homo sapiens
cugaggcccagugcauaugca

SEQ ID NO: 547101 - RNA, 16 nt, Homo sapiens
cugaggcccugugaua

SEQ ID NO: 547102 - RNA, 20 nt, Homo sapiens
cugaggcgggagaaucaugu

SEQ ID NO: 547103 - RNA, 15 nt, Homo sapiens
cugagggcaguucug

SEQ ID NO: 547104 - RNA, 17 nt, Homo sapiens
cugagggcccuguggag

SEQ ID NO: 547105 - RNA, 21 nt, Homo sapiens
cugagggucacaguaccuuga

SEQ ID NO: 547106 - RNA, 23 nt, Homo sapiens
cugaggguugggguggggaagca

SEQ ID NO: 547107 - RNA, 17 nt, Homo sapiens
cugagguauaaagacaa

SEQ ID NO: 547108 - RNA, 16 nt, Homo sapiens
cugagguauggccaug

SEQ ID NO: 547109 - RNA, 15 nt, Homo sapiens
cugagguuggauuug

SEQ ID NO: 547110 - RNA, 19 nt, Homo sapiens
cugagguuuagaugugcaa

SEQ ID NO: 547111 - RNA, 17 nt, Homo sapiens
cugagguuugcacuucc

SEQ ID NO: 547112 - RNA, 18 nt, Homo sapiens
cugaguaauuaauaaaga

SEQ ID NO: 547113 - RNA, 16 nt, Homo sapiens
cugaguacuggaauaa

SEQ ID NO: 547114 - RNA, 15 nt, Homo sapiens
cugagucaucuguua

SEQ ID NO: 547115 - RNA, 18 nt, Homo sapiens
cugaguccaacaauguug

SEQ ID NO: 547116 - RNA, 23 nt, Homo sapiens
cugaguccagcuccccccaagau

SEQ ID NO: 547117 - RNA, 22 nt, Homo sapiens
cugagucccucacguuucuucc

SEQ ID NO: 547118 - RNA, 21 nt, Homo sapiens
cugaguccgccugcgccucca

SEQ ID NO: 547119 - RNA, 15 nt, Homo sapiens
cuaaauggcaugaca

SEQ ID NO: 547120 - RNA, 20 nt, Homo sapiens
cuaaauucaaagaaguacuu

SEQ ID NO: 547121 - RNA, 15 nt, Homo sapiens
cuaacaacauuguag

SEQ ID NO: 547122 - RNA, 11 nt, Homo sapiens
cuaacacaaaa

SEQ ID NO: 547123 - RNA, 23 nt, Homo sapiens
cuaacacccagucuguuccccau

SEQ ID NO: 547124 - RNA, 22 nt, Homo sapiens
cuaacacuuuaguuauauucac

SEQ ID NO: 547125 - RNA, 17 nt, Homo sapiens
cuaacagcaaauaacag

SEQ ID NO: 547126 - RNA, 14 nt, Homo sapiens
cuaacaggaacaaa

SEQ ID NO: 547127 - RNA, 17 nt, Homo sapiens
cuaacaggagaaugcac

SEQ ID NO: 547128 - RNA, 15 nt, Homo sapiens
cuaacaguggacaaa

SEQ ID NO: 547129 - RNA, 14 nt, Homo sapiens
cuaacauagauuua

SEQ ID NO: 547130 - RNA, 15 nt, Homo sapiens
cuaacauauguauua

SEQ ID NO: 547131 - RNA, 16 nt, Homo sapiens
cuaacaucuaaaaaua

SEQ ID NO: 547132 - RNA, 19 nt, Homo sapiens
cuaacaucuugaauacucu

SEQ ID NO: 547133 - RNA, 16 nt, Homo sapiens
cuaaccagccugguca

SEQ ID NO: 547134 - RNA, 11 nt, Homo sapiens
cuaaccaucug

SEQ ID NO: 547135 - RNA, 14 nt, Homo sapiens
cuaaccccuuccag

SEQ ID NO: 547136 - RNA, 17 nt, Homo sapiens
cuaacgacuucagggca

SEQ ID NO: 547137 - RNA, 22 nt, Homo sapiens
cuaacgauaaaagguaauaaca

SEQ ID NO: 547138 - RNA, 16 nt, Homo sapiens
cuaacguuuaauugcc

SEQ ID NO: 547139 - RNA, 17 nt, Homo sapiens
cuaacuagcauuguaaa

SEQ ID NO: 547140 - RNA, 16 nt, Homo sapiens
cuaacuaucaaauaga

SEQ ID NO: 547141 - RNA, 14 nt, Homo sapiens
cuaacucuauuaau

SEQ ID NO: 547142 - RNA, 22 nt, Homo sapiens
cuaacuugaaaagaaaaccaca

SEQ ID NO: 547143 - RNA, 19 nt, Homo sapiens
cuaacuuuucuuaagguuu

SEQ ID NO: 547144 - RNA, 19 nt, Homo sapiens
cuaagaaauaugcacaaua

SEQ ID NO: 547145 - RNA, 19 nt, Homo sapiens
cuaagaaauguuaucuuuu

SEQ ID NO: 547146 - RNA, 22 nt, Homo sapiens
cuaagaauuuuguuuuacuuuu

SEQ ID NO: 547147 - RNA, 12 nt, Homo sapiens
cuaagacuacua

SEQ ID NO: 547148 - RNA, 20 nt, Homo sapiens
cuaagaugaaaugcacugua

SEQ ID NO: 547149 - RNA, 13 nt, Homo sapiens
cuaagauuaccuu

SEQ ID NO: 547150 - RNA, 17 nt, Homo sapiens
cuaagcacagaaacuca

SEQ ID NO: 547151 - RNA, 22 nt, Homo sapiens
cuaagcaccugccucagcaauu

SEQ ID NO: 547152 - RNA, 21 nt, Homo sapiens
cuaagcacuuuauaaauauca

SEQ ID NO: 547153 - RNA, 23 nt, Homo sapiens
cuaagcacuuuaucuauaucuca

SEQ ID NO: 547154 - RNA, 22 nt, Homo sapiens
cuaagcaguaagcuaucuucaa

SEQ ID NO: 547155 - RNA, 20 nt, Homo sapiens
cuaagccacauggcugggau

SEQ ID NO: 547156 - RNA, 13 nt, Homo sapiens
cuaagccacucuu

SEQ ID NO: 547157 - RNA, 24 nt, Homo sapiens
cuaagccaggaccccaaugcgaca

SEQ ID NO: 547158 - RNA, 20 nt, Homo sapiens
cuaagccaggaggcuuuaag

SEQ ID NO: 547159 - RNA, 15 nt, Homo sapiens
cuaagccaguuuuca

SEQ ID NO: 547160 - RNA, 12 nt, Homo sapiens
cuaagccuccuu

SEQ ID NO: 547161 - RNA, 21 nt, Homo sapiens
cuaagccuguugcugaaguca

SEQ ID NO: 547162 - RNA, 17 nt, Homo sapiens
cuaagccuuuccauaag

SEQ ID NO: 547163 - RNA, 15 nt, Homo sapiens
cuaagcgcacauuca

SEQ ID NO: 547164 - RNA, 16 nt, Homo sapiens
cuaagcuauucaguaa

SEQ ID NO: 547165 - RNA, 13 nt, Homo sapiens
cuaagcuguaacc

SEQ ID NO: 547166 - RNA, 14 nt, Homo sapiens
cuaaggacauuucc

SEQ ID NO: 547167 - RNA, 19 nt, Homo sapiens
cuaaggagcgcuagugccu

SEQ ID NO: 547168 - RNA, 14 nt, Homo sapiens
cuaaggaucucuca

SEQ ID NO: 547169 - RNA, 21 nt, Homo sapiens
cuaaggaugucacagggccaa

SEQ ID NO: 547170 - RNA, 19 nt, Homo sapiens
cuaagguagacuacuuugg

SEQ ID NO: 547171 - RNA, 21 nt, Homo sapiens
cuaagguaguaacuuuccaua

SEQ ID NO: 547172 - RNA, 23 nt, Homo sapiens
cuaagucaagaucaacauuccag

SEQ ID NO: 547173 - RNA, 18 nt, Homo sapiens
cuaaguggaauagccucc

SEQ ID NO: 547174 - RNA, 19 nt, Homo sapiens
cuaaguuauuuacuuuuac

SEQ ID NO: 547175 - RNA, 23 nt, Homo sapiens
cuaaguugcugggauuacaggug

SEQ ID NO: 547176 - RNA, 17 nt, Homo sapiens
cuaauaaaaacaagaug

SEQ ID NO: 547177 - RNA, 18 nt, Homo sapiens
cuaauaaaauauaaucua

SEQ ID NO: 547178 - RNA, 19 nt, Homo sapiens
cuaauaaauauacuaugaa

SEQ ID NO: 547179 - RNA, 20 nt, Homo sapiens
cuaauaaauauacuaugaaa

SEQ ID NO: 547180 - RNA, 23 nt, Homo sapiens
cuaauaaauuuuagugugccuuc

SEQ ID NO: 547181 - RNA, 15 nt, Homo sapiens
cuaauaagugcuuuc

SEQ ID NO: 547182 - RNA, 17 nt, Homo sapiens
cuaauagagagauuagu

SEQ ID NO: 547183 - RNA, 14 nt, Homo sapiens
cuaauagagauuaa

SEQ ID NO: 547184 - RNA, 22 nt, Homo sapiens
cuaauagagugguacagcacug

SEQ ID NO: 547185 - RNA, 12 nt, Homo sapiens
cuaauauauaaa

SEQ ID NO: 547186 - RNA, 19 nt, Homo sapiens
cuaaucaaagccagggucu

SEQ ID NO: 547187 - RNA, 24 nt, Homo sapiens
cuaaucaagaaaaacaucuuuggc

SEQ ID NO: 547188 - RNA, 16 nt, Homo sapiens
cuaaucacaugugcug

SEQ ID NO: 547189 - RNA, 17 nt, Homo sapiens
cuaaucagcauucucac

SEQ ID NO: 547190 - RNA, 22 nt, Homo sapiens
cuaaucagcauucucacuccua

SEQ ID NO: 547191 - RNA, 15 nt, Homo sapiens
cuaaucccagcacuu

SEQ ID NO: 547192 - RNA, 16 nt, Homo sapiens
cuaaucccagcacuuu

SEQ ID NO: 547193 - RNA, 21 nt, Homo sapiens
cuaaucuucuuaugcaauuuc

SEQ ID NO: 547194 - RNA, 23 nt, Homo sapiens
cuaaugaagguuuucauuugcca

SEQ ID NO: 547195 - RNA, 16 nt, Homo sapiens
cuaaugagacugacca

SEQ ID NO: 547196 - RNA, 17 nt, Homo sapiens
cuaaugagacugaccau

SEQ ID NO: 547197 - RNA, 13 nt, Homo sapiens
cuaaugccucuuc

SEQ ID NO: 547198 - RNA, 14 nt, Homo sapiens
cuaaugcuaugcaa

SEQ ID NO: 547199 - RNA, 20 nt, Homo sapiens
cuaaugcuucaaguguugcu

SEQ ID NO: 547200 - RNA, 13 nt, Homo sapiens
cuaauggcuuuca

SEQ ID NO: 547201 - RNA, 16 nt, Homo sapiens
cuaauggggacacaga

SEQ ID NO: 547202 - RNA, 22 nt, Homo sapiens
cuaaugucucacuguucugcaa

SEQ ID NO: 547203 - RNA, 22 nt, Homo sapiens
cuaaugugaaaaucaucacuca

SEQ ID NO: 547204 - RNA, 19 nt, Homo sapiens
cuaaugugguuauuucucu

SEQ ID NO: 547205 - RNA, 22 nt, Homo sapiens
cuaauguugacuuuaauacucu

SEQ ID NO: 547206 - RNA, 18 nt, Homo sapiens
cuaauguugcuggaucag

SEQ ID NO: 547207 - RNA, 23 nt, Homo sapiens
cuaauguuugaacaaagcucaaa

SEQ ID NO: 547208 - RNA, 22 nt, Homo sapiens
cuaauguuugugagaagcuucu

SEQ ID NO: 547209 - RNA, 18 nt, Homo sapiens
cuaauuaaaaucuggaaa

SEQ ID NO: 547210 - RNA, 22 nt, Homo sapiens
cuaauuagagagcaucugcaac

SEQ ID NO: 547211 - RNA, 17 nt, Homo sapiens
cuaauucacagugcucu

SEQ ID NO: 547212 - RNA, 18 nt, Homo sapiens
cuaauucccagaguguga

SEQ ID NO: 547213 - RNA, 21 nt, Homo sapiens
cuaauucccauuuugcaaaau

SEQ ID NO: 547214 - RNA, 20 nt, Homo sapiens
caagaauauugcaaaauaca

SEQ ID NO: 547215 - RNA, 12 nt, Homo sapiens
caagaaugccag

SEQ ID NO: 547216 - RNA, 14 nt, Homo sapiens
caagaaugugcacu

SEQ ID NO: 547217 - RNA, 20 nt, Homo sapiens
caagaauuaaguauuuuccu

SEQ ID NO: 547218 - RNA, 20 nt, Homo sapiens
caagaauuaaucaagacucu

SEQ ID NO: 547219 - RNA, 16 nt, Homo sapiens
caagaauugaguauca

SEQ ID NO: 547220 - RNA, 20 nt, Homo sapiens
caagaauugaguaucacuuu

SEQ ID NO: 547221 - RNA, 13 nt, Homo sapiens
caagacaaaaagc

SEQ ID NO: 547222 - RNA, 15 nt, Homo sapiens
caagacaaaaagcca

SEQ ID NO: 547223 - RNA, 10 nt, Homo sapiens
caagacauag

SEQ ID NO: 547224 - RNA, 16 nt, Homo sapiens
caagaccacguuucua

SEQ ID NO: 547225 - RNA, 23 nt, Homo sapiens
caagaccagagacccaacagcag

SEQ ID NO: 547226 - RNA, 14 nt, Homo sapiens
caagaccagccugg

SEQ ID NO: 547227 - RNA, 16 nt, Homo sapiens
caagaccaucccugaa

SEQ ID NO: 547228 - RNA, 17 nt, Homo sapiens
caagacccccagcacuu

SEQ ID NO: 547229 - RNA, 16 nt, Homo sapiens
caagaccucugugcac

SEQ ID NO: 547230 - RNA, 12 nt, Homo sapiens
caagacuccuca

SEQ ID NO: 547231 - RNA, 23 nt, Homo sapiens
caagacugaauuaaugagaagau

SEQ ID NO: 547232 - RNA, 17 nt, Homo sapiens
caagacugagccagcuu

SEQ ID NO: 547233 - RNA, 20 nt, Homo sapiens
caagacuuggcaacagaagc

SEQ ID NO: 547234 - RNA, 21 nt, Homo sapiens
caagagaaucaacagaugaua

SEQ ID NO: 547235 - RNA, 14 nt, Homo sapiens
caagagacugaguc

SEQ ID NO: 547236 - RNA, 23 nt, Homo sapiens
caagagauagagaccaucuuugc

SEQ ID NO: 547237 - RNA, 16 nt, Homo sapiens
caagagcaugcacaug

SEQ ID NO: 547238 - RNA, 17 nt, Homo sapiens
caagagcugaaaaacuu

SEQ ID NO: 547239 - RNA, 16 nt, Homo sapiens
caagagcugagaaaca

SEQ ID NO: 547240 - RNA, 13 nt, Homo sapiens
caagaggaagacc

SEQ ID NO: 547241 - RNA, 22 nt, Homo sapiens
caagaggacugagacuggcacu

SEQ ID NO: 547242 - RNA, 17 nt, Homo sapiens
caagagggggaccugcc

SEQ ID NO: 547243 - RNA, 15 nt, Homo sapiens
caagaggguggauca

SEQ ID NO: 547244 - RNA, 14 nt, Homo sapiens
caagaggucccaag

SEQ ID NO: 547245 - RNA, 23 nt, Homo sapiens
caagagugaacauguacacaaag

SEQ ID NO: 547246 - RNA, 15 nt, Homo sapiens
caagaguggacugaa

SEQ ID NO: 547247 - RNA, 16 nt, Homo sapiens
caagauaaacacuuuc

SEQ ID NO: 547248 - RNA, 21 nt, Homo sapiens
caagauaauccuagagucuua

SEQ ID NO: 547249 - RNA, 14 nt, Homo sapiens
caagauaccuuugc

SEQ ID NO: 547250 - RNA, 17 nt, Homo sapiens
caagauauugaugauaa

SEQ ID NO: 547251 - RNA, 18 nt, Homo sapiens
caagauccuuaaugcaga

SEQ ID NO: 547252 - RNA, 19 nt, Homo sapiens
caagaucgcaccauugcac

SEQ ID NO: 547253 - RNA, 21 nt, Homo sapiens
caagaucgcaccauugcacuc

SEQ ID NO: 547254 - RNA, 12 nt, Homo sapiens
caagaucuccaa

SEQ ID NO: 547255 - RNA, 14 nt, Homo sapiens
caagaucugaauuu

SEQ ID NO: 547256 - RNA, 13 nt, Homo sapiens
caagaucuuucag

SEQ ID NO: 547257 - RNA, 16 nt, Homo sapiens
caagaugaaugcagau

SEQ ID NO: 547258 - RNA, 18 nt, Homo sapiens
caagaugaaugcagauua

SEQ ID NO: 547259 - RNA, 12 nt, Homo sapiens
caagaugagauu

SEQ ID NO: 547260 - RNA, 16 nt, Homo sapiens
caagauggagaugucu

SEQ ID NO: 547261 - RNA, 20 nt, Homo sapiens
caagauggcgaccaccaaag

SEQ ID NO: 547262 - RNA, 16 nt, Homo sapiens
caagauggguggcacc

SEQ ID NO: 547263 - RNA, 12 nt, Homo sapiens
caagauggucca

SEQ ID NO: 547264 - RNA, 18 nt, Homo sapiens
caagauucuuccuuuuaa

SEQ ID NO: 547265 - RNA, 17 nt, Homo sapiens
caagauuguaaguaaau

SEQ ID NO: 547266 - RNA, 21 nt, Homo sapiens
caagauuguccuuuucuccca

SEQ ID NO: 547267 - RNA, 15 nt, Homo sapiens
caagauuuugaagga

SEQ ID NO: 547268 - RNA, 21 nt, Homo sapiens
caagauuuuuuaauuguuuaa

SEQ ID NO: 547269 - RNA, 22 nt, Homo sapiens
caagauuuuuuaauuguuuaaa

SEQ ID NO: 547270 - RNA, 17 nt, Homo sapiens
caagcaaaaugcuuaca

SEQ ID NO: 547271 - RNA, 18 nt, Homo sapiens
caagcaaugggcaaugga

SEQ ID NO: 547272 - RNA, 19 nt, Homo sapiens
caagcaccugcaugugcug

SEQ ID NO: 547273 - RNA, 13 nt, Homo sapiens
caagcaccuguua

SEQ ID NO: 547274 - RNA, 13 nt, Homo sapiens
caagcacuuuaau

SEQ ID NO: 547275 - RNA, 17 nt, Homo sapiens
caagcagacuccagccc

SEQ ID NO: 547276 - RNA, 20 nt, Homo sapiens
caagcaggaaccccaggaga

SEQ ID NO: 547277 - RNA, 12 nt, Homo sapiens
caagcagugcac

SEQ ID NO: 547278 - RNA, 22 nt, Homo sapiens
caagcagugccugccuaugaaa

SEQ ID NO: 547279 - RNA, 20 nt, Homo sapiens
caagcaugaaccuuguuuaa

SEQ ID NO: 547280 - RNA, 22 nt, Homo sapiens
caagcauguaacuuauauuaau

SEQ ID NO: 547281 - RNA, 11 nt, Homo sapiens
caagcauuaag

SEQ ID NO: 547282 - RNA, 18 nt, Homo sapiens
caagccacagaagccagg

SEQ ID NO: 547283 - RNA, 23 nt, Homo sapiens
caagccagccuugcuccuggcug

SEQ ID NO: 547284 - RNA, 18 nt, Homo sapiens
caagccaguacgugcuaa

SEQ ID NO: 547285 - RNA, 14 nt, Homo sapiens
caagccaugugcuu

SEQ ID NO: 547286 - RNA, 13 nt, Homo sapiens
caagccauuccaa

SEQ ID NO: 547287 - RNA, 18 nt, Homo sapiens
caagcccuguugacacag

SEQ ID NO: 547288 - RNA, 18 nt, Homo sapiens
caagccucaaagucccuu

SEQ ID NO: 547289 - RNA, 17 nt, Homo sapiens
caagccugucuucagag

SEQ ID NO: 547290 - RNA, 18 nt, Homo sapiens
caagccugucuucagaga

SEQ ID NO: 547291 - RNA, 14 nt, Homo sapiens
caagcgaccaagga

SEQ ID NO: 547292 - RNA, 17 nt, Homo sapiens
caagcgcucauguugag

SEQ ID NO: 547293 - RNA, 14 nt, Homo sapiens
caagcggcccugug

SEQ ID NO: 547294 - RNA, 15 nt, Homo sapiens
caagcggcucaagaa

SEQ ID NO: 547295 - RNA, 22 nt, Homo sapiens
caagcuaaaauuagaugaacuc

SEQ ID NO: 547296 - RNA, 14 nt, Homo sapiens
caagcuagaaggcc

SEQ ID NO: 547297 - RNA, 22 nt, Homo sapiens
caagcuagaaggccacauguca

SEQ ID NO: 547298 - RNA, 18 nt, Homo sapiens
caagcuauaaaagcagga

SEQ ID NO: 547299 - RNA, 12 nt, Homo sapiens
caagcuauucaa

SEQ ID NO: 547300 - RNA, 16 nt, Homo sapiens
caagcuccaaauccaa

SEQ ID NO: 547301 - RNA, 22 nt, Homo sapiens
caagcucucugcaucuacuccc

SEQ ID NO: 547302 - RNA, 23 nt, Homo sapiens
caagcugacucgacaccguguca

SEQ ID NO: 547303 - RNA, 20 nt, Homo sapiens
caagcugagugacuguaggc

SEQ ID NO: 547304 - RNA, 13 nt, Homo sapiens
caagcugcugaaa

SEQ ID NO: 547305 - RNA, 17 nt, Homo sapiens
caagcuuaauaugugcu

SEQ ID NO: 547306 - RNA, 17 nt, Homo sapiens
caagcuuuuaguaucca

SEQ ID NO: 547307 - RNA, 19 nt, Homo sapiens
caaggaaacgcuaccucuc

SEQ ID NO: 547308 - RNA, 22 nt, Homo sapiens
caaggacaugagucuguaggag

SEQ ID NO: 547309 - RNA, 22 nt, Homo sapiens
caaggacgaauuugcacaguga

SEQ ID NO: 547310 - RNA, 17 nt, Homo sapiens
caaggagcacaagccac

SEQ ID NO: 547311 - RNA, 23 nt, Homo sapiens
caaggaggccuggggaggcccua

SEQ ID NO: 547312 - RNA, 18 nt, Homo sapiens
caaggagggugagugcaa

SEQ ID NO: 547313 - RNA, 18 nt, Homo sapiens
caaggagucacugagacc

SEQ ID NO: 547314 - RNA, 16 nt, Homo sapiens
caaggauccugugcug

SEQ ID NO: 547315 - RNA, 18 nt, Homo sapiens
caaggaugcugucaagca

SEQ ID NO: 547316 - RNA, 21 nt, Homo sapiens
caaggaugcugucaagcaccu

SEQ ID NO: 547317 - RNA, 14 nt, Homo sapiens
caaggcaagaucua

SEQ ID NO: 547318 - RNA, 16 nt, Homo sapiens
caaggcaggugccucc

SEQ ID NO: 547319 - RNA, 13 nt, Homo sapiens
caaggcagugcau

SEQ ID NO: 547320 - RNA, 23 nt, Homo sapiens
caaggcauuugucuuuguaauau

SEQ ID NO: 547321 - RNA, 11 nt, Homo sapiens
caaggccuuca

SEQ ID NO: 547322 - RNA, 15 nt, Homo sapiens
caaggccuugcucac

SEQ ID NO: 547323 - RNA, 23 nt, Homo sapiens
caaggcggguggaucacuugaga

SEQ ID NO: 547324 - RNA, 15 nt, Homo sapiens
caaggcuaguuccuu

SEQ ID NO: 547325 - RNA, 17 nt, Homo sapiens
caaggcugaccaagaga

SEQ ID NO: 547326 - RNA, 15 nt, Homo sapiens
caaggcugcagugag

SEQ ID NO: 547327 - RNA, 21 nt, Homo sapiens
caaggcuggccagcaaggcag

SEQ ID NO: 547328 - RNA, 17 nt, Homo sapiens
caagggacaaguauuaa

SEQ ID NO: 547329 - RNA, 17 nt, Homo sapiens
caagggaucugguccua

SEQ ID NO: 547330 - RNA, 15 nt, Homo sapiens
caagggaugugcuua

SEQ ID NO: 547331 - RNA, 21 nt, Homo sapiens
caagggcuuuguuuugcacac

SEQ ID NO: 547332 - RNA, 15 nt, Homo sapiens
caaggggacaucuua

SEQ ID NO: 547333 - RNA, 22 nt, Homo sapiens
caaggggcugaaaagaucugaa

SEQ ID NO: 547334 - RNA, 19 nt, Homo sapiens
caagggggacugucuuuca

SEQ ID NO: 547335 - RNA, 16 nt, Homo sapiens
caaggggucuguauau

SEQ ID NO: 547336 - RNA, 19 nt, Homo sapiens
caaggguggcaggucacug

SEQ ID NO: 547337 - RNA, 17 nt, Homo sapiens
caaggguuggaggcaau

SEQ ID NO: 547338 - RNA, 14 nt, Homo sapiens
caaggucuuugguu

SEQ ID NO: 547339 - RNA, 17 nt, Homo sapiens
caaggugaauagcacag

SEQ ID NO: 547340 - RNA, 12 nt, Homo sapiens
caaggugacaaa

SEQ ID NO: 547341 - RNA, 22 nt, Homo sapiens
caagguggccacagugucacug

SEQ ID NO: 547342 - RNA, 18 nt, Homo sapiens
caagguggugugaucuua

SEQ ID NO: 547343 - RNA, 14 nt, Homo sapiens
caagguguuuccau

SEQ ID NO: 547344 - RNA, 18 nt, Homo sapiens
caaguaaaacaaaaccac

SEQ ID NO: 547345 - RNA, 15 nt, Homo sapiens
caaguaacacuuuaa

SEQ ID NO: 547346 - RNA, 12 nt, Homo sapiens
caaguacaugug

SEQ ID NO: 547347 - RNA, 21 nt, Homo sapiens
caaguacugguugacuuucua

SEQ ID NO: 547348 - RNA, 15 nt, Homo sapiens
caaguagcugcaaca

SEQ ID NO: 547349 - RNA, 19 nt, Homo sapiens
caaguagcugggauuacag

SEQ ID NO: 547350 - RNA, 22 nt, Homo sapiens
caaguagcugggauuacaggca

SEQ ID NO: 547351 - RNA, 18 nt, Homo sapiens
caaguauauaauauguca

SEQ ID NO: 547352 - RNA, 14 nt, Homo sapiens
caaguaugccuuaa

SEQ ID NO: 547353 - RNA, 19 nt, Homo sapiens
caaguauguugagaguugc

SEQ ID NO: 547354 - RNA, 21 nt, Homo sapiens
caaguauguuuguacaguaug

SEQ ID NO: 547355 - RNA, 22 nt, Homo sapiens
caaguauuauuuuacaaucaac

SEQ ID NO: 547356 - RNA, 21 nt, Homo sapiens
caaguauugucgguuaccucu

SEQ ID NO: 547357 - RNA, 18 nt, Homo sapiens
caagucaagugaaaaagg

SEQ ID NO: 547358 - RNA, 16 nt, Homo sapiens
caagucaccaugcuga

SEQ ID NO: 547359 - RNA, 18 nt, Homo sapiens
caagucaccaugcugaau

SEQ ID NO: 547360 - RNA, 12 nt, Homo sapiens
caagucaccucc

SEQ ID NO: 547361 - RNA, 13 nt, Homo sapiens
caagucaccugca

SEQ ID NO: 547362 - RNA, 17 nt, Homo sapiens
cuacaaacuucaaagag

SEQ ID NO: 547363 - RNA, 18 nt, Homo sapiens
cuacaaagcuuugcuaca

SEQ ID NO: 547364 - RNA, 14 nt, Homo sapiens
cuacaacaaaagga

SEQ ID NO: 547365 - RNA, 11 nt, Homo sapiens
cuacaagccaa

SEQ ID NO: 547366 - RNA, 22 nt, Homo sapiens
cuacaaggcuacaguaaccaaa

SEQ ID NO: 547367 - RNA, 20 nt, Homo sapiens
cuacaauuuucucccaggaa

SEQ ID NO: 547368 - RNA, 20 nt, Homo sapiens
cuacacacauaccuucaugu

SEQ ID NO: 547369 - RNA, 14 nt, Homo sapiens
cuacacagacauua

SEQ ID NO: 547370 - RNA, 15 nt, Homo sapiens
cuacacagacauuaa

SEQ ID NO: 547371 - RNA, 16 nt, Homo sapiens
cuacacguaaguauaa

SEQ ID NO: 547372 - RNA, 19 nt, Homo sapiens
cuacacucaccugcacuaa

SEQ ID NO: 547373 - RNA, 16 nt, Homo sapiens
cuacacugauacacuu

SEQ ID NO: 547374 - RNA, 24 nt, Homo sapiens
cuacagaaauugaaaaugaccaaa

SEQ ID NO: 547375 - RNA, 22 nt, Homo sapiens
cuacagaagaaacuggggcucc

SEQ ID NO: 547376 - RNA, 16 nt, Homo sapiens
cuacagaagggcagug

SEQ ID NO: 547377 - RNA, 13 nt, Homo sapiens
cuacagacauuaa

SEQ ID NO: 547378 - RNA, 14 nt, Homo sapiens
cuacagacuaaaga

SEQ ID NO: 547379 - RNA, 14 nt, Homo sapiens
cuacagcagcacug

SEQ ID NO: 547380 - RNA, 20 nt, Homo sapiens
cuacagcucuuaaauguagc

SEQ ID NO: 547381 - RNA, 18 nt, Homo sapiens
cuacagggaauuuguacg

SEQ ID NO: 547382 - RNA, 19 nt, Homo sapiens
cuacagggacacuaucacu

SEQ ID NO: 547383 - RNA, 22 nt, Homo sapiens
cuacagggagaaaauccagguc

SEQ ID NO: 547384 - RNA, 19 nt, Homo sapiens
cuacagggccacaacugcc

SEQ ID NO: 547385 - RNA, 17 nt, Homo sapiens
cuacaguaaccaaaaca

SEQ ID NO: 547386 - RNA, 17 nt, Homo sapiens
cuacaguuuuaacugug

SEQ ID NO: 547387 - RNA, 15 nt, Homo sapiens
cuacauaacuuccua

SEQ ID NO: 547388 - RNA, 18 nt, Homo sapiens
cuacauaaggaugaaggu

SEQ ID NO: 547389 - RNA, 15 nt, Homo sapiens
cuacauauaugcaau

SEQ ID NO: 547390 - RNA, 19 nt, Homo sapiens
cuacaucuaguuaaucaua

SEQ ID NO: 547391 - RNA, 23 nt, Homo sapiens
cuacaucuucugccuuagucuca

SEQ ID NO: 547392 - RNA, 16 nt, Homo sapiens
cuacaugaugacucaa

SEQ ID NO: 547393 - RNA, 22 nt, Homo sapiens
cuacaugcugaaaaauauagcc

SEQ ID NO: 547394 - RNA, 14 nt, Homo sapiens
cuacauuaucucac

SEQ ID NO: 547395 - RNA, 20 nt, Homo sapiens
cuacauuuuuuaaaacugaa

SEQ ID NO: 547396 - RNA, 21 nt, Homo sapiens
cuaccaaagcaccuuagcugg

SEQ ID NO: 547397 - RNA, 19 nt, Homo sapiens
cuaccaaauucauuugacu

SEQ ID NO: 547398 - RNA, 15 nt, Homo sapiens
cuaccaagcagcuca

SEQ ID NO: 547399 - RNA, 14 nt, Homo sapiens
cuaccaauguagac

SEQ ID NO: 547400 - RNA, 13 nt, Homo sapiens
cuaccagcauaaa

SEQ ID NO: 547401 - RNA, 15 nt, Homo sapiens
cuaccagcuccucca

SEQ ID NO: 547402 - RNA, 15 nt, Homo sapiens
cuaccaggaugcuaa

SEQ ID NO: 547403 - RNA, 11 nt, Homo sapiens
cuaccaggugg

SEQ ID NO: 547404 - RNA, 13 nt, Homo sapiens
cuaccagucuauu

SEQ ID NO: 547405 - RNA, 15 nt, Homo sapiens
cuacccacaugcacu

SEQ ID NO: 547406 - RNA, 16 nt, Homo sapiens
cuaccccuugugggca

SEQ ID NO: 547407 - RNA, 14 nt, Homo sapiens
cuacccgagcccag

SEQ ID NO: 547408 - RNA, 22 nt, Homo sapiens
cuacccuauucuauccaucucc

SEQ ID NO: 547409 - RNA, 13 nt, Homo sapiens
cuacccugccucc

SEQ ID NO: 547410 - RNA, 14 nt, Homo sapiens
cuacccugcugacc

SEQ ID NO: 547411 - RNA, 19 nt, Homo sapiens
cuacccuuccagugcccua

SEQ ID NO: 547412 - RNA, 18 nt, Homo sapiens
cuaccuagggcacuuuaa

SEQ ID NO: 547413 - RNA, 17 nt, Homo sapiens
cuaccuauaacacucua

SEQ ID NO: 547414 - RNA, 12 nt, Homo sapiens
cuaccucaaggg

SEQ ID NO: 547415 - RNA, 15 nt, Homo sapiens
cuaccucuggugaug

SEQ ID NO: 547416 - RNA, 20 nt, Homo sapiens
cuaccugagaucacuaaaua

SEQ ID NO: 547417 - RNA, 22 nt, Homo sapiens
cuaccugauggaaguaaagccu

SEQ ID NO: 547418 - RNA, 19 nt, Homo sapiens
cuaccugcuuggucuuuca

SEQ ID NO: 547419 - RNA, 18 nt, Homo sapiens
cuaccuggcagauacuca

SEQ ID NO: 547420 - RNA, 19 nt, Homo sapiens
cuaccuggguccuuuucag

SEQ ID NO: 547421 - RNA, 20 nt, Homo sapiens
cuaccuugcuagcuagccag

SEQ ID NO: 547422 - RNA, 16 nt, Homo sapiens
cuacggagaaacucau

SEQ ID NO: 547423 - RNA, 13 nt, Homo sapiens
cuacgugcuccuc

SEQ ID NO: 547424 - RNA, 14 nt, Homo sapiens
cuacguucucuuua

SEQ ID NO: 547425 - RNA, 19 nt, Homo sapiens
cuacuaaaaauacaaaaau

SEQ ID NO: 547426 - RNA, 15 nt, Homo sapiens
cuacuaaaaaugcaa

SEQ ID NO: 547427 - RNA, 17 nt, Homo sapiens
cuacuaaaaaugcaaaa

SEQ ID NO: 547428 - RNA, 19 nt, Homo sapiens
cuacuacaaacuucaaaga

SEQ ID NO: 547429 - RNA, 14 nt, Homo sapiens
cuacuacccauugu

SEQ ID NO: 547430 - RNA, 17 nt, Homo sapiens
cuacuaccuagggcacu

SEQ ID NO: 547431 - RNA, 16 nt, Homo sapiens
cuacuacucugccaau

SEQ ID NO: 547432 - RNA, 22 nt, Homo sapiens
cuacuaugugcugggugccucc

SEQ ID NO: 547433 - RNA, 20 nt, Homo sapiens
cuacucaggaggcugaggca

SEQ ID NO: 547434 - RNA, 23 nt, Homo sapiens
cuacucaggaggcugaggcagaa

SEQ ID NO: 547435 - RNA, 10 nt, Homo sapiens
cuacuccucc

SEQ ID NO: 547436 - RNA, 15 nt, Homo sapiens
cuacuccucugcagu

SEQ ID NO: 547437 - RNA, 20 nt, Homo sapiens
cuacucuagggaaaaaccag

SEQ ID NO: 547438 - RNA, 14 nt, Homo sapiens
cuacugaaugucau

SEQ ID NO: 547439 - RNA, 17 nt, Homo sapiens
cuacugacagggagcag

SEQ ID NO: 547440 - RNA, 12 nt, Homo sapiens
cuacugacauau

SEQ ID NO: 547441 - RNA, 14 nt, Homo sapiens
cuacugacuuuucc

SEQ ID NO: 547442 - RNA, 17 nt, Homo sapiens
cuacugagcauuugcac

SEQ ID NO: 547443 - RNA, 13 nt, Homo sapiens
cuacugcacugag

SEQ ID NO: 547444 - RNA, 16 nt, Homo sapiens
cuacugcacugaguua

SEQ ID NO: 547445 - RNA, 17 nt, Homo sapiens
cuacugccccucuccga

SEQ ID NO: 547446 - RNA, 19 nt, Homo sapiens
cuacugccucggaucucuc

SEQ ID NO: 547447 - RNA, 16 nt, Homo sapiens
cuacuguacacggacc

SEQ ID NO: 547448 - RNA, 13 nt, Homo sapiens
cuacuguguuccu

SEQ ID NO: 547449 - RNA, 13 nt, Homo sapiens
cuacuguugcaca

SEQ ID NO: 547450 - RNA, 17 nt, Homo sapiens
cuacuuccccuucuugc

SEQ ID NO: 547451 - RNA, 19 nt, Homo sapiens
cuacuuccugugacuucag

SEQ ID NO: 547452 - RNA, 14 nt, Homo sapiens
cuacuugaccuaag

SEQ ID NO: 547453 - RNA, 12 nt, Homo sapiens
cuacuugaguua

SEQ ID NO: 547454 - RNA, 16 nt, Homo sapiens
cuacuugucauaucac

SEQ ID NO: 547455 - RNA, 21 nt, Homo sapiens
cuacuuuaagcacuacauaaa

SEQ ID NO: 547456 - RNA, 15 nt, Homo sapiens
cuacuuucaucuuaa

SEQ ID NO: 547457 - RNA, 15 nt, Homo sapiens
cuacuuuuugcaccu

SEQ ID NO: 547458 - RNA, 17 nt, Homo sapiens
cuacuuuuuuuugacau

SEQ ID NO: 547459 - RNA, 21 nt, Homo sapiens
cuagaaaaauguucuuuaaag

SEQ ID NO: 547460 - RNA, 18 nt, Homo sapiens
cuagaaaaggcagcuaaa

SEQ ID NO: 547461 - RNA, 19 nt, Homo sapiens
cuagaaacaaacaucuaau

SEQ ID NO: 547462 - RNA, 23 nt, Homo sapiens
cacaaaucaaagcaagggcucca

SEQ ID NO: 547463 - RNA, 15 nt, Homo sapiens
cacaaaugauagcau

SEQ ID NO: 547464 - RNA, 14 nt, Homo sapiens
cacaaaugguagca

SEQ ID NO: 547465 - RNA, 14 nt, Homo sapiens
cacaacagugaaaa

SEQ ID NO: 547466 - RNA, 16 nt, Homo sapiens
cacaaccacucauuca

SEQ ID NO: 547467 - RNA, 14 nt, Homo sapiens
cacaacccaaaagg

SEQ ID NO: 547468 - RNA, 17 nt, Homo sapiens
cacaacgcaccagacac

SEQ ID NO: 547469 - RNA, 12 nt, Homo sapiens
cacaacucccuu

SEQ ID NO: 547470 - RNA, 13 nt, Homo sapiens
cacaacuucagga

SEQ ID NO: 547471 - RNA, 21 nt, Homo sapiens
cacaacuuggguucuucucag

SEQ ID NO: 547472 - RNA, 18 nt, Homo sapiens
cacaacuugucacccaaa

SEQ ID NO: 547473 - RNA, 13 nt, Homo sapiens
cacaagaagacca

SEQ ID NO: 547474 - RNA, 20 nt, Homo sapiens
cacaagaagaccagacugug

SEQ ID NO: 547475 - RNA, 22 nt, Homo sapiens
cacaagaagaccagacugugga

SEQ ID NO: 547476 - RNA, 22 nt, Homo sapiens
cacaagaauugaguaucacuuu

SEQ ID NO: 547477 - RNA, 15 nt, Homo sapiens
cacaagccacagaag

SEQ ID NO: 547478 - RNA, 18 nt, Homo sapiens
cacaagccacagaagcca

SEQ ID NO: 547479 - RNA, 20 nt, Homo sapiens
cacaagcuuuuuuacacaaa

SEQ ID NO: 547480 - RNA, 18 nt, Homo sapiens
cacaaggaaggcauuugg

SEQ ID NO: 547481 - RNA, 20 nt, Homo sapiens
cacaaggcugaccaagagag

SEQ ID NO: 547482 - RNA, 21 nt, Homo sapiens
cacaaggcugaccaagagaga

SEQ ID NO: 547483 - RNA, 14 nt, Homo sapiens
cacaaguccuguga

SEQ ID NO: 547484 - RNA, 12 nt, Homo sapiens
cacaagucuccu

SEQ ID NO: 547485 - RNA, 17 nt, Homo sapiens
cacaggcccuagcuuua

SEQ ID NO: 547486 - RNA, 17 nt, Homo sapiens
cacagggagugcacaua

SEQ ID NO: 547487 - RNA, 21 nt, Homo sapiens
cacagggcaaaaucgccauag

SEQ ID NO: 547488 - RNA, 13 nt, Homo sapiens
cacaggugucugc

SEQ ID NO: 547489 - RNA, 21 nt, Homo sapiens
cacagguucucacuagaugac

SEQ ID NO: 547490 - RNA, 17 nt, Homo sapiens
cacaguaaaaguaaaga

SEQ ID NO: 547491 - RNA, 18 nt, Homo sapiens
cacaguaccggauucucu

SEQ ID NO: 547492 - RNA, 17 nt, Homo sapiens
cacaguacuuuauugua

SEQ ID NO: 547493 - RNA, 14 nt, Homo sapiens
cacaguagaacugu

SEQ ID NO: 547494 - RNA, 21 nt, Homo sapiens
cacaguagaacugucugugaa

SEQ ID NO: 547495 - RNA, 22 nt, Homo sapiens
cacaguccaaccagaaacaccc

SEQ ID NO: 547496 - RNA, 18 nt, Homo sapiens
cacaguccaggaacaagc

SEQ ID NO: 547497 - RNA, 22 nt, Homo sapiens
cacagucucuuuaaucuucagu

SEQ ID NO: 547498 - RNA, 20 nt, Homo sapiens
cacagugaccuuagcuacau

SEQ ID NO: 547499 - RNA, 14 nt, Homo sapiens
cacagugacuuccu

SEQ ID NO: 547500 - RNA, 20 nt, Homo sapiens
cacagugacuuccuggggau

SEQ ID NO: 547501 - RNA, 18 nt, Homo sapiens
cacagugaugaauguacu

SEQ ID NO: 547502 - RNA, 19 nt, Homo sapiens
cacagugaugaauguacua

SEQ ID NO: 547503 - RNA, 12 nt, Homo sapiens
cacagugcugcc

SEQ ID NO: 547504 - RNA, 21 nt, Homo sapiens
cacaguggauggacggacaag

SEQ ID NO: 547505 - RNA, 21 nt, Homo sapiens
cacaguuaauucccugcuaaa

SEQ ID NO: 547506 - RNA, 18 nt, Homo sapiens
cacaguuagguagcuuua

SEQ ID NO: 547507 - RNA, 22 nt, Homo sapiens
cacaguuaucuuagcuggauau

SEQ ID NO: 547508 - RNA, 15 nt, Homo sapiens
cacaguugccaugua

SEQ ID NO: 547509 - RNA, 20 nt, Homo sapiens
cacauaauuuugugcaugaa

SEQ ID NO: 547510 - RNA, 13 nt, Homo sapiens
cacauacccaccc

SEQ ID NO: 547511 - RNA, 22 nt, Homo sapiens
cacauacgggcuuuaauaguca

SEQ ID NO: 547512 - RNA, 21 nt, Homo sapiens
cacauagauucaccuguaaaa

SEQ ID NO: 547513 - RNA, 19 nt, Homo sapiens
cacauagcgccgugcugua

SEQ ID NO: 547514 - RNA, 17 nt, Homo sapiens
cacauauaucaaaguga

SEQ ID NO: 547515 - RNA, 21 nt, Homo sapiens
cacaucaauuacaagcuguag

SEQ ID NO: 547516 - RNA, 23 nt, Homo sapiens
cacaucauggaccaaaugugcca

SEQ ID NO: 547517 - RNA, 22 nt, Homo sapiens
cacauccaaccccccaccugcc

SEQ ID NO: 547518 - RNA, 18 nt, Homo sapiens
cacauccagccuuggaau

SEQ ID NO: 547519 - RNA, 17 nt, Homo sapiens
cacaucccaucgucucg

SEQ ID NO: 547520 - RNA, 18 nt, Homo sapiens
cacauccccagaauccau

SEQ ID NO: 547521 - RNA, 20 nt, Homo sapiens
cacauccugaccuugcacaa

SEQ ID NO: 547522 - RNA, 19 nt, Homo sapiens
cacauccugggauccagug

SEQ ID NO: 547523 - RNA, 23 nt, Homo sapiens
cacauccugggauccaguguaua

SEQ ID NO: 547524 - RNA, 19 nt, Homo sapiens
cacauccuucucacugcca

SEQ ID NO: 547525 - RNA, 14 nt, Homo sapiens
cacaucuaaugucu

SEQ ID NO: 547526 - RNA, 16 nt, Homo sapiens
cacaucuaaugucucu

SEQ ID NO: 547527 - RNA, 15 nt, Homo sapiens
cacaucuauugcaga

SEQ ID NO: 547528 - RNA, 17 nt, Homo sapiens
cacaucucugccuggaa

SEQ ID NO: 547529 - RNA, 18 nt, Homo sapiens
cacaucugccagaccuua

SEQ ID NO: 547530 - RNA, 16 nt, Homo sapiens
cacaucuuguaacuua

SEQ ID NO: 547531 - RNA, 15 nt, Homo sapiens
cacaucuuuccucaa

SEQ ID NO: 547532 - RNA, 19 nt, Homo sapiens
cacaugaaaccuacacacu

SEQ ID NO: 547533 - RNA, 17 nt, Homo sapiens
cacaugaccacauagca

SEQ ID NO: 547534 - RNA, 19 nt, Homo sapiens
cacaugaccacauagcaug

SEQ ID NO: 547535 - RNA, 14 nt, Homo sapiens
cacaugaccuccau

SEQ ID NO: 547536 - RNA, 22 nt, Homo sapiens
cacaugagacaauuuugcuuca

SEQ ID NO: 547537 - RNA, 21 nt, Homo sapiens
cacaugagaugguauauccuu

SEQ ID NO: 547538 - RNA, 17 nt, Homo sapiens
cacaugaggccaucuca

SEQ ID NO: 547539 - RNA, 15 nt, Homo sapiens
cacaugaugugcaua

SEQ ID NO: 547540 - RNA, 15 nt, Homo sapiens
cacaugcacacacac

SEQ ID NO: 547541 - RNA, 16 nt, Homo sapiens
cacaugcccaugauga

SEQ ID NO: 547542 - RNA, 17 nt, Homo sapiens
cacaugcccaugaugag

SEQ ID NO: 547543 - RNA, 12 nt, Homo sapiens
cacaugccuuaa

SEQ ID NO: 547544 - RNA, 22 nt, Homo sapiens
cacaugccuuuuaaaaguucuu

SEQ ID NO: 547545 - RNA, 9 nt, Homo sapiens
cacaugcua

SEQ ID NO: 547546 - RNA, 14 nt, Homo sapiens
cacauggacaugug

SEQ ID NO: 547547 - RNA, 22 nt, Homo sapiens
cacauggaggacccaacaggag

SEQ ID NO: 547548 - RNA, 22 nt, Homo sapiens
cacaugggaguuuagugugaua

SEQ ID NO: 547549 - RNA, 14 nt, Homo sapiens
cacaugggugcaau

SEQ ID NO: 547550 - RNA, 15 nt, Homo sapiens
cacauggugugaguc

SEQ ID NO: 547551 - RNA, 18 nt, Homo sapiens
cacauggugugaguccaa

SEQ ID NO: 547552 - RNA, 13 nt, Homo sapiens
cacauguacauaa

SEQ ID NO: 547553 - RNA, 17 nt, Homo sapiens
cacaugucaguaccuuc

SEQ ID NO: 547554 - RNA, 14 nt, Homo sapiens
cacauguggccaug

SEQ ID NO: 547555 - RNA, 14 nt, Homo sapiens
cacaugugugcgug

SEQ ID NO: 547556 - RNA, 18 nt, Homo sapiens
cacauguuacugcuucau

SEQ ID NO: 547557 - RNA, 16 nt, Homo sapiens
cacauguucaacuauu

SEQ ID NO: 547558 - RNA, 13 nt, Homo sapiens
cacauuaagcacu

SEQ ID NO: 547559 - RNA, 14 nt, Homo sapiens
cacauuaagcacug

SEQ ID NO: 547560 - RNA, 17 nt, Homo sapiens
cacauuaaguggcuuuu

SEQ ID NO: 547561 - RNA, 21 nt, Homo sapiens
cacauuaguacuuauguugca

SEQ ID NO: 547562 - RNA, 20 nt, Homo sapiens
cacauuaucgggagcagugu

SEQ ID NO: 547563 - RNA, 17 nt, Homo sapiens
cacauucccaucuguca

SEQ ID NO: 547564 - RNA, 21 nt, Homo sapiens
cacauucccaugguggccuca

SEQ ID NO: 547565 - RNA, 14 nt, Homo sapiens
cacauucgucacag

SEQ ID NO: 547566 - RNA, 14 nt, Homo sapiens
cacauucuacuuca

SEQ ID NO: 547567 - RNA, 21 nt, Homo sapiens
cacauucuuaaauauuuccau

SEQ ID NO: 547568 - RNA, 14 nt, Homo sapiens
cacauugacagugg

SEQ ID NO: 547569 - RNA, 12 nt, Homo sapiens
cacauugaucau

SEQ ID NO: 547570 - RNA, 22 nt, Homo sapiens
cacauugaucauuuuuauauga

SEQ ID NO: 547571 - RNA, 12 nt, Homo sapiens
cacauugcccau

SEQ ID NO: 547572 - RNA, 12 nt, Homo sapiens
cacauugccuuc

SEQ ID NO: 547573 - RNA, 13 nt, Homo sapiens
cacauugccuucu

SEQ ID NO: 547574 - RNA, 18 nt, Homo sapiens
cacauugcugauaugcaa

SEQ ID NO: 547575 - RNA, 18 nt, Homo sapiens
cacauuggaaugccuugg

SEQ ID NO: 547576 - RNA, 23 nt, Homo sapiens
cacauuggauucaucagcauuug

SEQ ID NO: 547577 - RNA, 16 nt, Homo sapiens
cacauugucaucagag

SEQ ID NO: 547578 - RNA, 20 nt, Homo sapiens
cacauuuagaaaagugaauu

SEQ ID NO: 547579 - RNA, 15 nt, Homo sapiens
cacauuuaugaauca

SEQ ID NO: 547580 - RNA, 17 nt, Homo sapiens
cacauuucuaugccaaa

SEQ ID NO: 547581 - RNA, 19 nt, Homo sapiens
cacauuugcccaauuccag

SEQ ID NO: 547582 - RNA, 20 nt, Homo sapiens
cacauuugggauguuccuuu

SEQ ID NO: 547583 - RNA, 21 nt, Homo sapiens
cacauuuuaaaagugccauua

SEQ ID NO: 547584 - RNA, 20 nt, Homo sapiens
cacauuuuaagugcuucaca

SEQ ID NO: 547585 - RNA, 20 nt, Homo sapiens
cacauuuuuaaaagaacaau

SEQ ID NO: 547586 - RNA, 18 nt, Homo sapiens
cuauagcacugagcucac

SEQ ID NO: 547587 - RNA, 22 nt, Homo sapiens
cuauagccuaagcggcuguuua

SEQ ID NO: 547588 - RNA, 14 nt, Homo sapiens
cuauagcucaggac

SEQ ID NO: 547589 - RNA, 21 nt, Homo sapiens
cuauagugaacucccaucuau

SEQ ID NO: 547590 - RNA, 16 nt, Homo sapiens
cuauaguucacugaca

SEQ ID NO: 547591 - RNA, 19 nt, Homo sapiens
cuauauaauaaagcuacug

SEQ ID NO: 547592 - RNA, 18 nt, Homo sapiens
cuauauaccaaagcacau

SEQ ID NO: 547593 - RNA, 17 nt, Homo sapiens
cuauauacuauaugauu

SEQ ID NO: 547594 - RNA, 20 nt, Homo sapiens
cuauauaguuccuugccuua

SEQ ID NO: 547595 - RNA, 22 nt, Homo sapiens
cuauauauccaagaagcaugca

SEQ ID NO: 547596 - RNA, 22 nt, Homo sapiens
cuauaucaaaaaaccuuuacag

SEQ ID NO: 547597 - RNA, 19 nt, Homo sapiens
cuauaucaaacaugcacac

SEQ ID NO: 547598 - RNA, 18 nt, Homo sapiens
cuauauguaguauaaaga

SEQ ID NO: 547599 - RNA, 18 nt, Homo sapiens
cuauauuaucaugcaaau

SEQ ID NO: 547600 - RNA, 21 nt, Homo sapiens
cuauauuccuuuuucuaugaa

SEQ ID NO: 547601 - RNA, 20 nt, Homo sapiens
cuauauucucaguguagggc

SEQ ID NO: 547602 - RNA, 17 nt, Homo sapiens
cuauauuuauacuguau

SEQ ID NO: 547603 - RNA, 18 nt, Homo sapiens
cuauauuuauacuguaua

SEQ ID NO: 547604 - RNA, 21 nt, Homo sapiens
cuauauuugcuuuuugcuaac

SEQ ID NO: 547605 - RNA, 15 nt, Homo sapiens
cuaucacacaguggg

SEQ ID NO: 547606 - RNA, 22 nt, Homo sapiens
cugagugcgggcugaggccaga

SEQ ID NO: 547607 - RNA, 15 nt, Homo sapiens
cugagugcugggcac

SEQ ID NO: 547608 - RNA, 17 nt, Homo sapiens
cugaguggggagcaguu

SEQ ID NO: 547609 - RNA, 16 nt, Homo sapiens
cugaguggucugacac

SEQ ID NO: 547610 - RNA, 13 nt, Homo sapiens
cugaguguggacu

SEQ ID NO: 547611 - RNA, 19 nt, Homo sapiens
cugaguuauuuugcuaaac

SEQ ID NO: 547612 - RNA, 19 nt, Homo sapiens
cugaguuccggggugcaau

SEQ ID NO: 547613 - RNA, 13 nt, Homo sapiens
cugauaaacacaa

SEQ ID NO: 547614 - RNA, 15 nt, Homo sapiens
cugauaaacauuaaa

SEQ ID NO: 547615 - RNA, 20 nt, Homo sapiens
cugauaaacauuaaacacug

SEQ ID NO: 547616 - RNA, 21 nt, Homo sapiens
cugauaaacauuaaacacugu

SEQ ID NO: 547617 - RNA, 22 nt, Homo sapiens
cugauacacagaauauaaucuu

SEQ ID NO: 547618 - RNA, 14 nt, Homo sapiens
cugauacauuaaaa

SEQ ID NO: 547619 - RNA, 16 nt, Homo sapiens
cugauaccacugcacu

SEQ ID NO: 547620 - RNA, 12 nt, Homo sapiens
cugauaccucaa

SEQ ID NO: 547621 - RNA, 15 nt, Homo sapiens
cugauacuuuagcca

SEQ ID NO: 547622 - RNA, 19 nt, Homo sapiens
cugauacuuugacaguguu

SEQ ID NO: 547623 - RNA, 14 nt, Homo sapiens
cugauagcuuacac

SEQ ID NO: 547624 - RNA, 23 nt, Homo sapiens
cugauauaacaaacuacauguaa

SEQ ID NO: 547625 - RNA, 13 nt, Homo sapiens
cugauauaauuua

SEQ ID NO: 547626 - RNA, 15 nt, Homo sapiens
cugauauuaaucaaa

SEQ ID NO: 547627 - RNA, 21 nt, Homo sapiens
cugaucaccuguuagcauugc

SEQ ID NO: 547628 - RNA, 14 nt, Homo sapiens
cugaucgugcuaaa

SEQ ID NO: 547629 - RNA, 19 nt, Homo sapiens
cugaucucagagcauuuca

SEQ ID NO: 547630 - RNA, 17 nt, Homo sapiens
cugaucuggcagacuca

SEQ ID NO: 547631 - RNA, 19 nt, Homo sapiens
cugaucuuauucuguggug

SEQ ID NO: 547632 - RNA, 21 nt, Homo sapiens
cugaugacacaggcugacuca

SEQ ID NO: 547633 - RNA, 22 nt, Homo sapiens
cugaugaguuucacuguacugc

SEQ ID NO: 547634 - RNA, 20 nt, Homo sapiens
cugaugaugucggucuugca

SEQ ID NO: 547635 - RNA, 14 nt, Homo sapiens
cugaugcugggacc

SEQ ID NO: 547636 - RNA, 16 nt, Homo sapiens
cugauggaacugugua

SEQ ID NO: 547637 - RNA, 18 nt, Homo sapiens
cugauggccuuaauuucc

SEQ ID NO: 547638 - RNA, 15 nt, Homo sapiens
cugaugggacaucaa

SEQ ID NO: 547639 - RNA, 17 nt, Homo sapiens
cugaugguggcucuggu

SEQ ID NO: 547640 - RNA, 14 nt, Homo sapiens
cugauguaaaacgg

SEQ ID NO: 547641 - RNA, 20 nt, Homo sapiens
cugaugugggagcugaacca

SEQ ID NO: 547642 - RNA, 18 nt, Homo sapiens
cugauguuaaaauuccau

SEQ ID NO: 547643 - RNA, 23 nt, Homo sapiens
cugauuaaaaaaucucccaaagc

SEQ ID NO: 547644 - RNA, 20 nt, Homo sapiens
cugauuaaaaauaccuucua

SEQ ID NO: 547645 - RNA, 14 nt, Homo sapiens
cugauuaguauuca

SEQ ID NO: 547646 - RNA, 22 nt, Homo sapiens
cugauucacagucucauuuuga

SEQ ID NO: 547647 - RNA, 15 nt, Homo sapiens
cugauucacugcaug

SEQ ID NO: 547648 - RNA, 13 nt, Homo sapiens
cugauucaguggg

SEQ ID NO: 547649 - RNA, 19 nt, Homo sapiens
cugauuccagaacaaauca

SEQ ID NO: 547650 - RNA, 13 nt, Homo sapiens
cugauuggcaugu

SEQ ID NO: 547651 - RNA, 16 nt, Homo sapiens
cugauuggugauucaa

SEQ ID NO: 547652 - RNA, 16 nt, Homo sapiens
cugauuuaacuuguau

SEQ ID NO: 547653 - RNA, 15 nt, Homo sapiens
cugauuuacauucaa

SEQ ID NO: 547654 - RNA, 18 nt, Homo sapiens
cugauuuccuucugcuau

SEQ ID NO: 547655 - RNA, 17 nt, Homo sapiens
cugauuuuaacaauaac

SEQ ID NO: 547656 - RNA, 16 nt, Homo sapiens
cugcaaaaaaagccuc

SEQ ID NO: 547657 - RNA, 23 nt, Homo sapiens
cugcaaaaaugaaauccagugag

SEQ ID NO: 547658 - RNA, 16 nt, Homo sapiens
cugcaaaaugucuuaa

SEQ ID NO: 547659 - RNA, 14 nt, Homo sapiens
cugcaaaccuuccu

SEQ ID NO: 547660 - RNA, 16 nt, Homo sapiens
cugcaaagcccagcuu

SEQ ID NO: 547661 - RNA, 16 nt, Homo sapiens
cugcaaauuaauguau

SEQ ID NO: 547662 - RNA, 13 nt, Homo sapiens
cugcaacacugga

SEQ ID NO: 547663 - RNA, 14 nt, Homo sapiens
cugcaacacuuuga

SEQ ID NO: 547664 - RNA, 13 nt, Homo sapiens
cugcaagaccacg

SEQ ID NO: 547665 - RNA, 22 nt, Homo sapiens
cugcaaggugaaacgacucaaa

SEQ ID NO: 547666 - RNA, 17 nt, Homo sapiens
cugcaauuuuaauugau

SEQ ID NO: 547667 - RNA, 15 nt, Homo sapiens
cugcacaaacaauau

SEQ ID NO: 547668 - RNA, 13 nt, Homo sapiens
cugcacacagaau

SEQ ID NO: 547669 - RNA, 13 nt, Homo sapiens
cugcacacugccu

SEQ ID NO: 547670 - RNA, 18 nt, Homo sapiens
cugcacagaaacuugaac

SEQ ID NO: 547671 - RNA, 16 nt, Homo sapiens
cugcacagcugguguc

SEQ ID NO: 547672 - RNA, 22 nt, Homo sapiens
cugcacagugacuucugagauc

SEQ ID NO: 547673 - RNA, 17 nt, Homo sapiens
cugcacagugcaucuca

SEQ ID NO: 547674 - RNA, 12 nt, Homo sapiens
cugcacauuuca

SEQ ID NO: 547675 - RNA, 16 nt, Homo sapiens
cugcacccacccagga

SEQ ID NO: 547676 - RNA, 20 nt, Homo sapiens
cugcaccccucugcccucau

SEQ ID NO: 547677 - RNA, 12 nt, Homo sapiens
cugcaccuguca

SEQ ID NO: 547678 - RNA, 14 nt, Homo sapiens
cugcaccuuugcac

SEQ ID NO: 547679 - RNA, 17 nt, Homo sapiens
cugcacuaaaacccauc

SEQ ID NO: 547680 - RNA, 19 nt, Homo sapiens
cugcacuccagucuggcaa

SEQ ID NO: 547681 - RNA, 18 nt, Homo sapiens
cugcacucccaccugaca

SEQ ID NO: 547682 - RNA, 17 nt, Homo sapiens
cugcacugaucacccaa

SEQ ID NO: 547683 - RNA, 16 nt, Homo sapiens
cugcacugucugagaa

SEQ ID NO: 547684 - RNA, 13 nt, Homo sapiens
cugcacugugaac

SEQ ID NO: 547685 - RNA, 17 nt, Homo sapiens
cugcacuuauacccaug

SEQ ID NO: 547686 - RNA, 17 nt, Homo sapiens
cugcacuuucacuaaga

SEQ ID NO: 547687 - RNA, 10 nt, Homo sapiens
cugcacuuuu

SEQ ID NO: 547688 - RNA, 17 nt, Homo sapiens
cugcagaaacuacugac

SEQ ID NO: 547689 - RNA, 15 nt, Homo sapiens
cugcagaaauuugca

SEQ ID NO: 547690 - RNA, 17 nt, Homo sapiens
cugcagaagaugugaug

SEQ ID NO: 547691 - RNA, 14 nt, Homo sapiens
cugcagaaggccaa

SEQ ID NO: 547692 - RNA, 17 nt, Homo sapiens
cugcagaaggccaagaa

SEQ ID NO: 547693 - RNA, 16 nt, Homo sapiens
cugcagaauccagcua

SEQ ID NO: 547694 - RNA, 12 nt, Homo sapiens
cugcagacaccu

SEQ ID NO: 547695 - RNA, 14 nt, Homo sapiens
cugcagacauucuc

SEQ ID NO: 547696 - RNA, 13 nt, Homo sapiens
cugcagaccaucc

SEQ ID NO: 547697 - RNA, 12 nt, Homo sapiens
cugcagaccaug

SEQ ID NO: 547698 - RNA, 15 nt, Homo sapiens
cugcagaccaugcca

SEQ ID NO: 547699 - RNA, 17 nt, Homo sapiens
cugcagaccaugccaga

SEQ ID NO: 547700 - RNA, 18 nt, Homo sapiens
cugcagaccucacuguca

SEQ ID NO: 547701 - RNA, 20 nt, Homo sapiens
cugcagagcacaaacuucag

SEQ ID NO: 547702 - RNA, 14 nt, Homo sapiens
cugcagaggauuua

SEQ ID NO: 547703 - RNA, 17 nt, Homo sapiens
cugcagagggacagaug

SEQ ID NO: 547704 - RNA, 13 nt, Homo sapiens
cugcagccaaaga

SEQ ID NO: 547705 - RNA, 20 nt, Homo sapiens
cugcagcccaccagacguca

SEQ ID NO: 547706 - RNA, 15 nt, Homo sapiens
cugcagccccccaga

SEQ ID NO: 547707 - RNA, 16 nt, Homo sapiens
cugcagccccccagag

SEQ ID NO: 547708 - RNA, 21 nt, Homo sapiens
cugcagccccgcgccuccuuc

SEQ ID NO: 547709 - RNA, 23 nt, Homo sapiens
cugcagcccgccuuggcuuucuc

SEQ ID NO: 547710 - RNA, 16 nt, Homo sapiens
cugcagccucaaccuc

SEQ ID NO: 547711 - RNA, 16 nt, Homo sapiens
cugcagccugguagaa

SEQ ID NO: 547712 - RNA, 19 nt, Homo sapiens
cugcagcugggccccaugc

SEQ ID NO: 547713 - RNA, 13 nt, Homo sapiens
cugcagcugugag

SEQ ID NO: 547714 - RNA, 21 nt, Homo sapiens
cugcaggaucccuacugccaa

SEQ ID NO: 547715 - RNA, 13 nt, Homo sapiens
cugcaggccaaga

SEQ ID NO: 547716 - RNA, 17 nt, Homo sapiens
cugcaggcuuugccauu

SEQ ID NO: 547717 - RNA, 21 nt, Homo sapiens
cugcagggccuauaugccagc

SEQ ID NO: 547718 - RNA, 17 nt, Homo sapiens
cugcaggggcuacguua

SEQ ID NO: 547719 - RNA, 21 nt, Homo sapiens
cugcaggggucucaugugguc

SEQ ID NO: 547720 - RNA, 12 nt, Homo sapiens
cugcaggggugc

SEQ ID NO: 547721 - RNA, 15 nt, Homo sapiens
cugcaggucaacagc

SEQ ID NO: 547722 - RNA, 12 nt, Homo sapiens
cugcagguugaa

SEQ ID NO: 547723 - RNA, 19 nt, Homo sapiens
cugcagguugaagccaugu

SEQ ID NO: 547724 - RNA, 15 nt, Homo sapiens
cugcaguaaaacaca

SEQ ID NO: 547725 - RNA, 20 nt, Homo sapiens
cugcaguacaacaguuuuag

SEQ ID NO: 547726 - RNA, 21 nt, Homo sapiens
cugcaguagucucugugcuuu

SEQ ID NO: 547727 - RNA, 14 nt, Homo sapiens
cugcagucaucucc

SEQ ID NO: 547728 - RNA, 15 nt, Homo sapiens
cacuugaagcacuua

SEQ ID NO: 547729 - RNA, 14 nt, Homo sapiens
cugcagucccacac

SEQ ID NO: 547730 - RNA, 20 nt, Homo sapiens
cugcagugaggggcccucca

SEQ ID NO: 547731 - RNA, 16 nt, Homo sapiens
cugcagugcucauuca

SEQ ID NO: 547732 - RNA, 20 nt, Homo sapiens
cugcagugcucauucaucac

SEQ ID NO: 547733 - RNA, 21 nt, Homo sapiens
cugcaguuagagcugagcacu

SEQ ID NO: 547734 - RNA, 16 nt, Homo sapiens
cugcaguuccugagua

SEQ ID NO: 547735 - RNA, 16 nt, Homo sapiens
cugcaguuugggagac

SEQ ID NO: 547736 - RNA, 15 nt, Homo sapiens
cugcaguuuuuccca

SEQ ID NO: 547737 - RNA, 21 nt, Homo sapiens
cugcauaguauuccauugugu

SEQ ID NO: 547738 - RNA, 19 nt, Homo sapiens
cugcauagucuguuccuuu

SEQ ID NO: 547739 - RNA, 14 nt, Homo sapiens
cugcaucaggugua

SEQ ID NO: 547740 - RNA, 16 nt, Homo sapiens
cugcaucagugacuga

SEQ ID NO: 547741 - RNA, 14 nt, Homo sapiens
cugcaucccugcuc

SEQ ID NO: 547742 - RNA, 23 nt, Homo sapiens
cugcaucuccccucagauuccac

SEQ ID NO: 547743 - RNA, 23 nt, Homo sapiens
cugcaucuuuucuguugccccau

SEQ ID NO: 547744 - RNA, 12 nt, Homo sapiens
cugcaugcucug

SEQ ID NO: 547745 - RNA, 23 nt, Homo sapiens
cugcaugcugcccagccacucca

SEQ ID NO: 547746 - RNA, 19 nt, Homo sapiens
cugcauggaccuaacauuc

SEQ ID NO: 547747 - RNA, 14 nt, Homo sapiens
cugcauggcaucag

SEQ ID NO: 547748 - RNA, 18 nt, Homo sapiens
cugcauguuaagugccau

SEQ ID NO: 547749 - RNA, 19 nt, Homo sapiens
cugcauguuaagugccauu

SEQ ID NO: 547750 - RNA, 15 nt, Homo sapiens
cugcauuagucucau

SEQ ID NO: 547751 - RNA, 15 nt, Homo sapiens
cugcauuccugauga

SEQ ID NO: 547752 - RNA, 13 nt, Homo sapiens
cugcauugcuaga

SEQ ID NO: 547753 - RNA, 16 nt, Homo sapiens
cugcauuuacacacac

SEQ ID NO: 547754 - RNA, 15 nt, Homo sapiens
cugcauuuauggugu

SEQ ID NO: 547755 - RNA, 22 nt, Homo sapiens
cugcauuuuaauuuuaaccaaa

SEQ ID NO: 547756 - RNA, 14 nt, Homo sapiens
cugcauuuuacaca

SEQ ID NO: 547757 - RNA, 18 nt, Homo sapiens
cugcauuuuacuguacag

SEQ ID NO: 547758 - RNA, 14 nt, Homo sapiens
cugccaacauacuu

SEQ ID NO: 547759 - RNA, 23 nt, Homo sapiens
cugccaagcuuccugugcccuca

SEQ ID NO: 547760 - RNA, 17 nt, Homo sapiens
cugccacacucuccauc

SEQ ID NO: 547761 - RNA, 19 nt, Homo sapiens
cugccaccaagauguguuc

SEQ ID NO: 547762 - RNA, 20 nt, Homo sapiens
cugccaccaggcacugccug

SEQ ID NO: 547763 - RNA, 14 nt, Homo sapiens
cugccacccacuca

SEQ ID NO: 547764 - RNA, 16 nt, Homo sapiens
cugccacgucccgcug

SEQ ID NO: 547765 - RNA, 12 nt, Homo sapiens
cugccacuccau

SEQ ID NO: 547766 - RNA, 12 nt, Homo sapiens
cugccacugccg

SEQ ID NO: 547767 - RNA, 13 nt, Homo sapiens
cugccacuucugc

SEQ ID NO: 547768 - RNA, 14 nt, Homo sapiens
cugccagacacugc

SEQ ID NO: 547769 - RNA, 19 nt, Homo sapiens
cugccagcaggggugugau

SEQ ID NO: 547770 - RNA, 21 nt, Homo sapiens
cugccaggcggcccuggggag

SEQ ID NO: 547771 - RNA, 17 nt, Homo sapiens
cugccaucaccgcuggg

SEQ ID NO: 547772 - RNA, 17 nt, Homo sapiens
cugccaucaugccugac

SEQ ID NO: 547773 - RNA, 17 nt, Homo sapiens
cugccaucuagccagcc

SEQ ID NO: 547774 - RNA, 12 nt, Homo sapiens
cugccauggaag

SEQ ID NO: 547775 - RNA, 13 nt, Homo sapiens
cugccauguacua

SEQ ID NO: 547776 - RNA, 14 nt, Homo sapiens
cugccauguugccc

SEQ ID NO: 547777 - RNA, 17 nt, Homo sapiens
cugccauguugccccuu

SEQ ID NO: 547778 - RNA, 19 nt, Homo sapiens
cugccauuauuuucuguca

SEQ ID NO: 547779 - RNA, 14 nt, Homo sapiens
cugccauuuaccag

SEQ ID NO: 547780 - RNA, 11 nt, Homo sapiens
cugccauuucc

SEQ ID NO: 547781 - RNA, 23 nt, Homo sapiens
cugcccaaugccuugacaacaga

SEQ ID NO: 547782 - RNA, 14 nt, Homo sapiens
cugcccaccaaagg

SEQ ID NO: 547783 - RNA, 16 nt, Homo sapiens
cugcccaccuccugga

SEQ ID NO: 547784 - RNA, 14 nt, Homo sapiens
cugcccaccucucu

SEQ ID NO: 547785 - RNA, 17 nt, Homo sapiens
cugcccagacaagauuu

SEQ ID NO: 547786 - RNA, 13 nt, Homo sapiens
cugcccagacuga

SEQ ID NO: 547787 - RNA, 17 nt, Homo sapiens
cugcccagaugcccuuu

SEQ ID NO: 547788 - RNA, 15 nt, Homo sapiens
cugcccagcucugag

SEQ ID NO: 547789 - RNA, 17 nt, Homo sapiens
cugcccaggacugcauu

SEQ ID NO: 547790 - RNA, 19 nt, Homo sapiens
cugcccaggccuaucugga

SEQ ID NO: 547791 - RNA, 16 nt, Homo sapiens
cugcccaggugugagc

SEQ ID NO: 547792 - RNA, 14 nt, Homo sapiens
cugcccagugcaaa

SEQ ID NO: 547793 - RNA, 22 nt, Homo sapiens
cugccccacggagacagaggaa

SEQ ID NO: 547794 - RNA, 13 nt, Homo sapiens
cugccccacuucu

SEQ ID NO: 547795 - RNA, 13 nt, Homo sapiens
cugcccccagaaa

SEQ ID NO: 547796 - RNA, 20 nt, Homo sapiens
cugcccccagacccauguga

SEQ ID NO: 547797 - RNA, 18 nt, Homo sapiens
cugccccggaccuaccuc

SEQ ID NO: 547798 - RNA, 18 nt, Homo sapiens
cugccccuccccaaaaga

SEQ ID NO: 547799 - RNA, 14 nt, Homo sapiens
cugccccuguugag

SEQ ID NO: 547800 - RNA, 13 nt, Homo sapiens
cugccccuuccac

SEQ ID NO: 547801 - RNA, 15 nt, Homo sapiens
cugcccuaaacccug

SEQ ID NO: 547802 - RNA, 19 nt, Homo sapiens
cugcccucacaucuuccac

SEQ ID NO: 547803 - RNA, 21 nt, Homo sapiens
cugcccuccccagagcacugg

SEQ ID NO: 547804 - RNA, 14 nt, Homo sapiens
cugcccucccucag

SEQ ID NO: 547805 - RNA, 21 nt, Homo sapiens
cugcccuccuuugccuuccac

SEQ ID NO: 547806 - RNA, 20 nt, Homo sapiens
cugcccuuauccgcugucca

SEQ ID NO: 547807 - RNA, 14 nt, Homo sapiens
cugcccuucucacg

SEQ ID NO: 547808 - RNA, 22 nt, Homo sapiens
cugcccuucucacgggcucuau

SEQ ID NO: 547809 - RNA, 15 nt, Homo sapiens
cugcccuuggcacca

SEQ ID NO: 547810 - RNA, 16 nt, Homo sapiens
cugcccuugucacugg

SEQ ID NO: 547811 - RNA, 17 nt, Homo sapiens
cugcccuuuggccaaca

SEQ ID NO: 547812 - RNA, 16 nt, Homo sapiens
cugccgcugcaccacg

SEQ ID NO: 547813 - RNA, 16 nt, Homo sapiens
cugccuaaaaugaauu

SEQ ID NO: 547814 - RNA, 20 nt, Homo sapiens
cugccuacacacacagccua

SEQ ID NO: 547815 - RNA, 17 nt, Homo sapiens
cugccuacuccaaaaug

SEQ ID NO: 547816 - RNA, 17 nt, Homo sapiens
cugccuauuaucuguca

SEQ ID NO: 547817 - RNA, 18 nt, Homo sapiens
cugccuccccaacccugc

SEQ ID NO: 547818 - RNA, 20 nt, Homo sapiens
cugccuccucagccauggga

SEQ ID NO: 547819 - RNA, 16 nt, Homo sapiens
cugccucggacuccau

SEQ ID NO: 547820 - RNA, 21 nt, Homo sapiens
cugccucggccucccaaagug

SEQ ID NO: 547821 - RNA, 18 nt, Homo sapiens
cugccucuuucccuagga

SEQ ID NO: 547822 - RNA, 16 nt, Homo sapiens
cugccugcacuggaac

SEQ ID NO: 547823 - RNA, 17 nt, Homo sapiens
cugccugcauggcauca

SEQ ID NO: 547824 - RNA, 15 nt, Homo sapiens
cugccugccaaagua

SEQ ID NO: 547825 - RNA, 16 nt, Homo sapiens
cugccugccucuuggc

SEQ ID NO: 547826 - RNA, 19 nt, Homo sapiens
cugccugcggaccagauga

SEQ ID NO: 547827 - RNA, 15 nt, Homo sapiens
cugccugcuguguua

SEQ ID NO: 547828 - RNA, 19 nt, Homo sapiens
cugccuuaaaaccaaagag

SEQ ID NO: 547829 - RNA, 20 nt, Homo sapiens
cugccuuaggguagugcuaa

SEQ ID NO: 547830 - RNA, 18 nt, Homo sapiens
cugccuuaucuugcaccc

SEQ ID NO: 547831 - RNA, 20 nt, Homo sapiens
cugccuuauuaaagcaaaaa

SEQ ID NO: 547832 - RNA, 14 nt, Homo sapiens
cugccuucucagga

SEQ ID NO: 547833 - RNA, 18 nt, Homo sapiens
cugccuucucaugaucca

SEQ ID NO: 547834 - RNA, 16 nt, Homo sapiens
cugccuuggacugugu

SEQ ID NO: 547835 - RNA, 21 nt, Homo sapiens
cugccuuugaucacaggagca

SEQ ID NO: 547836 - RNA, 21 nt, Homo sapiens
cugccuuuguugaggugcaag

SEQ ID NO: 547837 - RNA, 18 nt, Homo sapiens
cugcgaaugggauccuga

SEQ ID NO: 547838 - RNA, 17 nt, Homo sapiens
cugcgagagaaagggag

SEQ ID NO: 547839 - RNA, 15 nt, Homo sapiens
cugcgaggacaucaa

SEQ ID NO: 547840 - RNA, 18 nt, Homo sapiens
cugcgcuucccugcaguc

SEQ ID NO: 547841 - RNA, 14 nt, Homo sapiens
cugcguccaccagg

SEQ ID NO: 547842 - RNA, 12 nt, Homo sapiens
cugcgucuuccg

SEQ ID NO: 547843 - RNA, 12 nt, Homo sapiens
cugcgugccauc

SEQ ID NO: 547844 - RNA, 17 nt, Homo sapiens
cugcguuaugaagagcu

SEQ ID NO: 547845 - RNA, 22 nt, Homo sapiens
cugcuaaagggagaaaugccag

SEQ ID NO: 547846 - RNA, 15 nt, Homo sapiens
cugcuaacuccuagc

SEQ ID NO: 547847 - RNA, 20 nt, Homo sapiens
cugcuaaggcuccuccuugc

SEQ ID NO: 547848 - RNA, 23 nt, Homo sapiens
cugcuaauaccucuuacuuugcu

SEQ ID NO: 547849 - RNA, 16 nt, Homo sapiens
cugcuaauagcugcua

SEQ ID NO: 547850 - RNA, 12 nt, Homo sapiens
cugcuaccucac

SEQ ID NO: 547851 - RNA, 16 nt, Homo sapiens
cugcuaccucacuggg

SEQ ID NO: 547852 - RNA, 15 nt, Homo sapiens
cagagccucuggccc

SEQ ID NO: 547853 - RNA, 17 nt, Homo sapiens
cagagcgagacuccauc

SEQ ID NO: 547854 - RNA, 23 nt, Homo sapiens
cugcuagcaaauggcagaaccaa

SEQ ID NO: 547855 - RNA, 17 nt, Homo sapiens
cugcuagggaauaucaa

SEQ ID NO: 547856 - RNA, 16 nt, Homo sapiens
cugcuauuauguaaca

SEQ ID NO: 547857 - RNA, 19 nt, Homo sapiens
cugcucacggaccccaugu

SEQ ID NO: 547858 - RNA, 12 nt, Homo sapiens
cugcucacuguc

SEQ ID NO: 547859 - RNA, 14 nt, Homo sapiens
cugcucauccaaag

SEQ ID NO: 547860 - RNA, 23 nt, Homo sapiens
cugcuccaaaggaaauccaaaaa

SEQ ID NO: 547861 - RNA, 12 nt, Homo sapiens
cugcuccagaag

SEQ ID NO: 547862 - RNA, 12 nt, Homo sapiens
cugcuccagcug

SEQ ID NO: 547863 - RNA, 16 nt, Homo sapiens
cugcuccagugcagga

SEQ ID NO: 547864 - RNA, 18 nt, Homo sapiens
cugcuccaguguaucuca

SEQ ID NO: 547865 - RNA, 21 nt, Homo sapiens
cugcucccaaauaaacuccag

SEQ ID NO: 547866 - RNA, 14 nt, Homo sapiens
cugcucccacagaa

SEQ ID NO: 547867 - RNA, 19 nt, Homo sapiens
cugcucccccugguggugg

SEQ ID NO: 547868 - RNA, 15 nt, Homo sapiens
cugcuccuacaucca

SEQ ID NO: 547869 - RNA, 18 nt, Homo sapiens
cugcucggccgucuucac

SEQ ID NO: 547870 - RNA, 13 nt, Homo sapiens
cugcucguggcca

SEQ ID NO: 547871 - RNA, 15 nt, Homo sapiens
cugcucguggccaaa

SEQ ID NO: 547872 - RNA, 19 nt, Homo sapiens
cugcucuacagaaggacau

SEQ ID NO: 547873 - RNA, 15 nt, Homo sapiens
cugcucuacuuugag

SEQ ID NO: 547874 - RNA, 17 nt, Homo sapiens
cugcucugccuguggag

SEQ ID NO: 547875 - RNA, 12 nt, Homo sapiens
cugcucugcuau

SEQ ID NO: 547876 - RNA, 14 nt, Homo sapiens
cugcucugcuauau

SEQ ID NO: 547877 - RNA, 22 nt, Homo sapiens
cugcucuggaaaaugugaccca

SEQ ID NO: 547878 - RNA, 20 nt, Homo sapiens
cugcucugguuagaaaaagg

SEQ ID NO: 547879 - RNA, 16 nt, Homo sapiens
cugcugacauucccau

SEQ ID NO: 547880 - RNA, 11 nt, Homo sapiens
cugcugaccaa

SEQ ID NO: 547881 - RNA, 22 nt, Homo sapiens
cugcugaccaauugugcugcca

SEQ ID NO: 547882 - RNA, 13 nt, Homo sapiens
cugcugacuggca

SEQ ID NO: 547883 - RNA, 20 nt, Homo sapiens
cugcugagucagacugucag

SEQ ID NO: 547884 - RNA, 19 nt, Homo sapiens
cugcugagugcaccacuuc

SEQ ID NO: 547885 - RNA, 21 nt, Homo sapiens
cugcugcccagugcaaaccac

SEQ ID NO: 547886 - RNA, 16 nt, Homo sapiens
cugcugccugcugaga

SEQ ID NO: 547887 - RNA, 19 nt, Homo sapiens
cugcugccuggccacugcu

SEQ ID NO: 547888 - RNA, 16 nt, Homo sapiens
cugcugcuccacggcg

SEQ ID NO: 547889 - RNA, 16 nt, Homo sapiens
cugcugcuccagugca

SEQ ID NO: 547890 - RNA, 22 nt, Homo sapiens
cugcugcuucuccaagcuuuca

SEQ ID NO: 547891 - RNA, 13 nt, Homo sapiens
cugcugcuucugc

SEQ ID NO: 547892 - RNA, 13 nt, Homo sapiens
cugcuggaaacac

SEQ ID NO: 547893 - RNA, 20 nt, Homo sapiens
cugcuggagaggaacccaga

SEQ ID NO: 547894 - RNA, 23 nt, Homo sapiens
cugcuggcaucaggucugggcaa

SEQ ID NO: 547895 - RNA, 23 nt, Homo sapiens
cugcuggggcugaacaugccugc

SEQ ID NO: 547896 - RNA, 14 nt, Homo sapiens
cugcugggugugac

SEQ ID NO: 547897 - RNA, 18 nt, Homo sapiens
cugcuggugucuaguguu

SEQ ID NO: 547898 - RNA, 22 nt, Homo sapiens
cugcuguagaaaaaaaaauuca

SEQ ID NO: 547899 - RNA, 17 nt, Homo sapiens
cugcuguauuuauagua

SEQ ID NO: 547900 - RNA, 18 nt, Homo sapiens
cugcugucucaucacaua

SEQ ID NO: 547901 - RNA, 13 nt, Homo sapiens
cugcugucuucca

SEQ ID NO: 547902 - RNA, 11 nt, Homo sapiens
cugcugugaac

SEQ ID NO: 547903 - RNA, 14 nt, Homo sapiens
cugcugugaaucug

SEQ ID NO: 547904 - RNA, 17 nt, Homo sapiens
cugcugugcacauuuau

SEQ ID NO: 547905 - RNA, 22 nt, Homo sapiens
cugcuguguggacuucaucuca

SEQ ID NO: 547906 - RNA, 21 nt, Homo sapiens
cugcuguuuggcuuaacacau

SEQ ID NO: 547907 - RNA, 21 nt, Homo sapiens
cugcuuacaauucccugcugu

SEQ ID NO: 547908 - RNA, 13 nt, Homo sapiens
cugcuuacuaaug

SEQ ID NO: 547909 - RNA, 16 nt, Homo sapiens
cugcuuacuaaugugc

SEQ ID NO: 547910 - RNA, 15 nt, Homo sapiens
cugcuucaugggaaa

SEQ ID NO: 547911 - RNA, 10 nt, Homo sapiens
cugcuuccag

SEQ ID NO: 547912 - RNA, 14 nt, Homo sapiens
cugcuucucggggu

SEQ ID NO: 547913 - RNA, 16 nt, Homo sapiens
cugcuucugauaugca

SEQ ID NO: 547914 - RNA, 16 nt, Homo sapiens
cugcuucuuggagcuu

SEQ ID NO: 547915 - RNA, 14 nt, Homo sapiens
cugcuugaacccag

SEQ ID NO: 547916 - RNA, 14 nt, Homo sapiens
cugcuugaccaaag

SEQ ID NO: 547917 - RNA, 19 nt, Homo sapiens
cugcuugaccguacucuca

SEQ ID NO: 547918 - RNA, 22 nt, Homo sapiens
cugcuugaggaaaacaagcauu

SEQ ID NO: 547919 - RNA, 20 nt, Homo sapiens
cugcuugauuuuaauacauu

SEQ ID NO: 547920 - RNA, 22 nt, Homo sapiens
cugcuugauuuuaauacauuga

SEQ ID NO: 547921 - RNA, 15 nt, Homo sapiens
cugcuugcacuuugu

SEQ ID NO: 547922 - RNA, 18 nt, Homo sapiens
cugcuugcagccaggaga

SEQ ID NO: 547923 - RNA, 22 nt, Homo sapiens
cugcuuggauaugaaacuguag

SEQ ID NO: 547924 - RNA, 15 nt, Homo sapiens
cugcuugugaucuca

SEQ ID NO: 547925 - RNA, 17 nt, Homo sapiens
cugcuugugaucucaca

SEQ ID NO: 547926 - RNA, 23 nt, Homo sapiens
cugcuugugaucucacacacaga

SEQ ID NO: 547927 - RNA, 18 nt, Homo sapiens
cugcuuuaaacugcauuu

SEQ ID NO: 547928 - RNA, 21 nt, Homo sapiens
cugcuuucuuguugcugcauc

SEQ ID NO: 547929 - RNA, 13 nt, Homo sapiens
cugcuuugccaag

SEQ ID NO: 547930 - RNA, 21 nt, Homo sapiens
cugcuuuguuuggaugccuca

SEQ ID NO: 547931 - RNA, 18 nt, Homo sapiens
cugcuuuuaacucuagaa

SEQ ID NO: 547932 - RNA, 19 nt, Homo sapiens
cuggaaaaauuccagaaga

SEQ ID NO: 547933 - RNA, 22 nt, Homo sapiens
cuggaaaacagaaaccauucua

SEQ ID NO: 547934 - RNA, 18 nt, Homo sapiens
cuggaaaacagaacacuu

SEQ ID NO: 547935 - RNA, 22 nt, Homo sapiens
cuggaaaacucaggauucucac

SEQ ID NO: 547936 - RNA, 15 nt, Homo sapiens
cuggaaaacugccuu

SEQ ID NO: 547937 - RNA, 19 nt, Homo sapiens
cuggaaacaagugacccca

SEQ ID NO: 547938 - RNA, 22 nt, Homo sapiens
cuggaaacugcucccaucauuc

SEQ ID NO: 547939 - RNA, 20 nt, Homo sapiens
cuggaaaggcucagucucag

SEQ ID NO: 547940 - RNA, 13 nt, Homo sapiens
cuggaaagugaug

SEQ ID NO: 547941 - RNA, 16 nt, Homo sapiens
cuggaaaucauaauaa

SEQ ID NO: 547942 - RNA, 15 nt, Homo sapiens
cuggaaauucugcug

SEQ ID NO: 547943 - RNA, 14 nt, Homo sapiens
cuggaacauuccag

SEQ ID NO: 547944 - RNA, 22 nt, Homo sapiens
cuggaacccgagacuuggccau

SEQ ID NO: 547945 - RNA, 23 nt, Homo sapiens
cuggaacuggcugugaagaccca

SEQ ID NO: 547946 - RNA, 22 nt, Homo sapiens
cuggaagacaacccaggcagua

SEQ ID NO: 547947 - RNA, 14 nt, Homo sapiens
cuggaagacacuuc

SEQ ID NO: 547948 - RNA, 22 nt, Homo sapiens
cuggaagaucagcacccuaaga

SEQ ID NO: 547949 - RNA, 20 nt, Homo sapiens
cuggaagcauccugugcugu

SEQ ID NO: 547950 - RNA, 12 nt, Homo sapiens
cuggaagccaaa

SEQ ID NO: 547951 - RNA, 17 nt, Homo sapiens
cuggaagccugccgaaa

SEQ ID NO: 547952 - RNA, 22 nt, Homo sapiens
cuggaagcugauuaaaacacac

SEQ ID NO: 547953 - RNA, 13 nt, Homo sapiens
cuggaagcuguca

SEQ ID NO: 547954 - RNA, 19 nt, Homo sapiens
cuggaaggacacagugaug

SEQ ID NO: 547955 - RNA, 14 nt, Homo sapiens
cuggaaggacaucu

SEQ ID NO: 547956 - RNA, 14 nt, Homo sapiens
cuggaaggggccac

SEQ ID NO: 547957 - RNA, 13 nt, Homo sapiens
cuggaaucaaaua

SEQ ID NO: 547958 - RNA, 18 nt, Homo sapiens
cuggaaucuuccccaagg

SEQ ID NO: 547959 - RNA, 23 nt, Homo sapiens
cuggaaugcaguggugugcucug

SEQ ID NO: 547960 - RNA, 13 nt, Homo sapiens
cuggaauugcuca

SEQ ID NO: 547961 - RNA, 17 nt, Homo sapiens
cuggacaaagaauucca

SEQ ID NO: 547962 - RNA, 13 nt, Homo sapiens
cuggacaagccaa

SEQ ID NO: 547963 - RNA, 14 nt, Homo sapiens
cuggacacugucca

SEQ ID NO: 547964 - RNA, 16 nt, Homo sapiens
cuggacacuguccaug

SEQ ID NO: 547965 - RNA, 17 nt, Homo sapiens
cuggacagcagaagccu

SEQ ID NO: 547966 - RNA, 22 nt, Homo sapiens
cuggacaggcaaagacugcagu

SEQ ID NO: 547967 - RNA, 23 nt, Homo sapiens
cuggacaggcaaagacugcagua

SEQ ID NO: 547968 - RNA, 15 nt, Homo sapiens
cuggaccacugggca

SEQ ID NO: 547969 - RNA, 15 nt, Homo sapiens
cuggaccauuccagg

SEQ ID NO: 547970 - RNA, 15 nt, Homo sapiens
cuggaccccacuggc

SEQ ID NO: 547971 - RNA, 20 nt, Homo sapiens
cuggaccgcugacugcacca

SEQ ID NO: 547972 - RNA, 20 nt, Homo sapiens
cuggaccugccuccugccug

SEQ ID NO: 547973 - RNA, 16 nt, Homo sapiens
cuggaccuugggccua

SEQ ID NO: 547974 - RNA, 14 nt, Homo sapiens
cugguuccuuucau

SEQ ID NO: 547975 - RNA, 21 nt, Homo sapiens
cugguucuguuuugcacccag

SEQ ID NO: 547976 - RNA, 22 nt, Homo sapiens
cugguugaaaaauggcaaagaa

SEQ ID NO: 547977 - RNA, 23 nt, Homo sapiens
cugguugaacucugguggcacag

SEQ ID NO: 547978 - RNA, 21 nt, Homo sapiens
cugguugauuuguaacacagu

SEQ ID NO: 547979 - RNA, 18 nt, Homo sapiens
cagauuauuuuuccucug

SEQ ID NO: 547980 - RNA, 21 nt, Homo sapiens
cagauucaauauuaugaauuc

SEQ ID NO: 547981 - RNA, 22 nt, Homo sapiens
cagauucauaaaguaaugauga

SEQ ID NO: 547982 - RNA, 22 nt, Homo sapiens
cagauuccaggcgaugugcaag

SEQ ID NO: 547983 - RNA, 15 nt, Homo sapiens
cagauucccagagca

SEQ ID NO: 547984 - RNA, 17 nt, Homo sapiens
cagauucugauucccuu

SEQ ID NO: 547985 - RNA, 12 nt, Homo sapiens
cagauucuucag

SEQ ID NO: 547986 - RNA, 13 nt, Homo sapiens
cagauuggaccag

SEQ ID NO: 547987 - RNA, 20 nt, Homo sapiens
cagauuuaaaaaaagaacau

SEQ ID NO: 547988 - RNA, 15 nt, Homo sapiens
cagauuuacacuggg

SEQ ID NO: 547989 - RNA, 16 nt, Homo sapiens
cagauuuacacuggga

SEQ ID NO: 547990 - RNA, 19 nt, Homo sapiens
cagauuuccuaacucuggu

SEQ ID NO: 547991 - RNA, 13 nt, Homo sapiens
cagauuugcacug

SEQ ID NO: 547992 - RNA, 17 nt, Homo sapiens
cagauuugccauucaag

SEQ ID NO: 547993 - RNA, 17 nt, Homo sapiens
cagauuugcuguucacc

SEQ ID NO: 547994 - RNA, 14 nt, Homo sapiens
cagauuuguguuau

SEQ ID NO: 547995 - RNA, 19 nt, Homo sapiens
cagauuuuagacuuaccuu

SEQ ID NO: 547996 - RNA, 17 nt, Homo sapiens
cagauuuucaugcaaaa

SEQ ID NO: 547997 - RNA, 21 nt, Homo sapiens
cagauuuucuaagaaccaaaa

SEQ ID NO: 547998 - RNA, 16 nt, Homo sapiens
cagauuuugcuguaua

SEQ ID NO: 547999 - RNA, 21 nt, Homo sapiens
cagauuuuucugaagggcaua

SEQ ID NO: 548000 - RNA, 19 nt, Homo sapiens
cagauuuuuuccucugcau

SEQ ID NO: 548001 - RNA, 16 nt, Homo sapiens
cagcaaaagaagacaa

SEQ ID NO: 548002 - RNA, 23 nt, Homo sapiens
cagcaaaagaagacaacauuucu

SEQ ID NO: 548003 - RNA, 19 nt, Homo sapiens
cagcaaacccugaugugac

SEQ ID NO: 548004 - RNA, 17 nt, Homo sapiens
cagcaacccuccuauca

SEQ ID NO: 548005 - RNA, 18 nt, Homo sapiens
cagcaaccucuucaugag

SEQ ID NO: 548006 - RNA, 23 nt, Homo sapiens
cagcaacugaauaaauaccucuu

SEQ ID NO: 548007 - RNA, 20 nt, Homo sapiens
cagcaacugcccuuccaggu

SEQ ID NO: 548008 - RNA, 20 nt, Homo sapiens
cagcaacuucuucuccaucc

SEQ ID NO: 548009 - RNA, 20 nt, Homo sapiens
cagcaagcccuacagagcug

SEQ ID NO: 548010 - RNA, 16 nt, Homo sapiens
cagcaaggauggagcu

SEQ ID NO: 548011 - RNA, 17 nt, Homo sapiens
cagcaagggaccugcuc

SEQ ID NO: 548012 - RNA, 16 nt, Homo sapiens
cagcaaggggacaucu

SEQ ID NO: 548013 - RNA, 13 nt, Homo sapiens
cagcaagucccag

SEQ ID NO: 548014 - RNA, 22 nt, Homo sapiens
cagcaagucccagacaaggaga

SEQ ID NO: 548015 - RNA, 15 nt, Homo sapiens
cagcaauacucauca

SEQ ID NO: 548016 - RNA, 12 nt, Homo sapiens
cagcaaugauua

SEQ ID NO: 548017 - RNA, 21 nt, Homo sapiens
cagcaaugauuacucuuugag

SEQ ID NO: 548018 - RNA, 17 nt, Homo sapiens
cagcaauggcgcugugc

SEQ ID NO: 548019 - RNA, 21 nt, Homo sapiens
cagcaauggugucaguaucca

SEQ ID NO: 548020 - RNA, 17 nt, Homo sapiens
cagcaaugugccuucua

SEQ ID NO: 548021 - RNA, 20 nt, Homo sapiens
cagcaauucuccugccucag

SEQ ID NO: 548022 - RNA, 14 nt, Homo sapiens
cagcacaaggccau

SEQ ID NO: 548023 - RNA, 17 nt, Homo sapiens
cagcacaagggcacauu

SEQ ID NO: 548024 - RNA, 19 nt, Homo sapiens
cagcacacgaguuccagac

SEQ ID NO: 548025 - RNA, 12 nt, Homo sapiens
cagcacagccaa

SEQ ID NO: 548026 - RNA, 19 nt, Homo sapiens
cagcacagcgaagacugcu

SEQ ID NO: 548027 - RNA, 15 nt, Homo sapiens
cagcacaguuuuuaa

SEQ ID NO: 548028 - RNA, 15 nt, Homo sapiens
cagcacaugugcugc

SEQ ID NO: 548029 - RNA, 16 nt, Homo sapiens
cagcaccaaccacagc

SEQ ID NO: 548030 - RNA, 13 nt, Homo sapiens
cagcaccagugaa

SEQ ID NO: 548031 - RNA, 20 nt, Homo sapiens
cagcaccccccauuuuuuca

SEQ ID NO: 548032 - RNA, 15 nt, Homo sapiens
cagcaccuacagugu

SEQ ID NO: 548033 - RNA, 18 nt, Homo sapiens
cagcaccuuucucugaga

SEQ ID NO: 548034 - RNA, 22 nt, Homo sapiens
cagcacuaaacuuggugcuuau

SEQ ID NO: 548035 - RNA, 15 nt, Homo sapiens
cagcacucuuaucua

SEQ ID NO: 548036 - RNA, 15 nt, Homo sapiens
cagcacugacuggaa

SEQ ID NO: 548037 - RNA, 20 nt, Homo sapiens
cagcacuggaagccagagaa

SEQ ID NO: 548038 - RNA, 18 nt, Homo sapiens
cagcacuuguguugucug

SEQ ID NO: 548039 - RNA, 11 nt, Homo sapiens
cagcacuuugg

SEQ ID NO: 548040 - RNA, 19 nt, Homo sapiens
cagcacuuugguaggcaaa

SEQ ID NO: 548041 - RNA, 15 nt, Homo sapiens
cagcagaaagguuag

SEQ ID NO: 548042 - RNA, 14 nt, Homo sapiens
cagcagaagcccca

SEQ ID NO: 548043 - RNA, 18 nt, Homo sapiens
cagcagagaagcuguagg

SEQ ID NO: 548044 - RNA, 18 nt, Homo sapiens
cagcagagaucugcaggc

SEQ ID NO: 548045 - RNA, 19 nt, Homo sapiens
cagcagagguuugcugaca

SEQ ID NO: 548046 - RNA, 17 nt, Homo sapiens
cagcagaucauuuagga

SEQ ID NO: 548047 - RNA, 17 nt, Homo sapiens
cagcagaugccagugaa

SEQ ID NO: 548048 - RNA, 22 nt, Homo sapiens
cagcagauguaguuucagacuu

SEQ ID NO: 548049 - RNA, 17 nt, Homo sapiens
cagcagcaaauuuucag

SEQ ID NO: 548050 - RNA, 23 nt, Homo sapiens
cagcagcacagucacccauggaa

SEQ ID NO: 548051 - RNA, 15 nt, Homo sapiens
cagcagcagcuuuca

SEQ ID NO: 548052 - RNA, 15 nt, Homo sapiens
cagcagcagugccau

SEQ ID NO: 548053 - RNA, 17 nt, Homo sapiens
cagcagccagcucucag

SEQ ID NO: 548054 - RNA, 16 nt, Homo sapiens
cagcagccagucucag

SEQ ID NO: 548055 - RNA, 17 nt, Homo sapiens
cagcagcgguaccccag

SEQ ID NO: 548056 - RNA, 15 nt, Homo sapiens
cagcagcugauucca

SEQ ID NO: 548057 - RNA, 17 nt, Homo sapiens
cagcagcugauuccaga

SEQ ID NO: 548058 - RNA, 23 nt, Homo sapiens
cagcaggauuggauguuguguau

SEQ ID NO: 548059 - RNA, 20 nt, Homo sapiens
cagcaggcacguuaacucga

SEQ ID NO: 548060 - RNA, 21 nt, Homo sapiens
cagcaguagcaaacuuuucac

SEQ ID NO: 548061 - RNA, 19 nt, Homo sapiens
cagcaguccacaaagcauu

SEQ ID NO: 548062 - RNA, 18 nt, Homo sapiens
cagcagugaguaaucaau

SEQ ID NO: 548063 - RNA, 17 nt, Homo sapiens
cagcagugaucucaggg

SEQ ID NO: 548064 - RNA, 20 nt, Homo sapiens
cagcagugccuugugcaaug

SEQ ID NO: 548065 - RNA, 18 nt, Homo sapiens
cagcagugguauuaauac

SEQ ID NO: 548066 - RNA, 17 nt, Homo sapiens
cagcagugucacucugu

SEQ ID NO: 548067 - RNA, 12 nt, Homo sapiens
cagcaguuuuau

SEQ ID NO: 548068 - RNA, 21 nt, Homo sapiens
cagcauagggucacuuugcca

SEQ ID NO: 548069 - RNA, 23 nt, Homo sapiens
cagcauauguguaaagauuuaua

SEQ ID NO: 548070 - RNA, 14 nt, Homo sapiens
cagcaucauugcau

SEQ ID NO: 548071 - RNA, 16 nt, Homo sapiens
cagcauccacacugcc

SEQ ID NO: 548072 - RNA, 19 nt, Homo sapiens
cagcaucccagccuugaga

SEQ ID NO: 548073 - RNA, 18 nt, Homo sapiens
cagcaucgugaucacuga

SEQ ID NO: 548074 - RNA, 13 nt, Homo sapiens
cagcaucuuucac

SEQ ID NO: 548075 - RNA, 13 nt, Homo sapiens
cagcaugccugaa

SEQ ID NO: 548076 - RNA, 16 nt, Homo sapiens
cagcaugccugaacua

SEQ ID NO: 548077 - RNA, 16 nt, Homo sapiens
cagcauggguccuuga

SEQ ID NO: 548078 - RNA, 19 nt, Homo sapiens
cagcauuauucuucagaag

SEQ ID NO: 548079 - RNA, 18 nt, Homo sapiens
cagcauuccaugaccaga

SEQ ID NO: 548080 - RNA, 18 nt, Homo sapiens
cagcauucccaccaacaa

SEQ ID NO: 548081 - RNA, 15 nt, Homo sapiens
cagcauugcugguuc

SEQ ID NO: 548082 - RNA, 19 nt, Homo sapiens
cagcauugucucguguaca

SEQ ID NO: 548083 - RNA, 21 nt, Homo sapiens
cagcauuuagacccugcauuu

SEQ ID NO: 548084 - RNA, 18 nt, Homo sapiens
cagcauuuagucuugcca

SEQ ID NO: 548085 - RNA, 17 nt, Homo sapiens
cagcauuuccacaccaa

SEQ ID NO: 548086 - RNA, 20 nt, Homo sapiens
cagcauuuuacuacuuuaaa

SEQ ID NO: 548087 - RNA, 18 nt, Homo sapiens
cagccaaacccugucuga

SEQ ID NO: 548088 - RNA, 14 nt, Homo sapiens
cagccaaaggggag

SEQ ID NO: 548089 - RNA, 15 nt, Homo sapiens
cagccaaaggggagc

SEQ ID NO: 548090 - RNA, 17 nt, Homo sapiens
cagccaacaugugacua

SEQ ID NO: 548091 - RNA, 18 nt, Homo sapiens
cagccaagacccaacagg

SEQ ID NO: 548092 - RNA, 13 nt, Homo sapiens
cagccacacuggg

SEQ ID NO: 548093 - RNA, 15 nt, Homo sapiens
cagccacauugagac

SEQ ID NO: 548094 - RNA, 23 nt, Homo sapiens
cagccacauugagacuuucuucu

SEQ ID NO: 548095 - RNA, 22 nt, Homo sapiens
cagccacccguggggugcugcc

SEQ ID NO: 548096 - RNA, 22 nt, Homo sapiens
cuuaacuccuuuuccacuuuaa

SEQ ID NO: 548097 - RNA, 18 nt, Homo sapiens
cuuaacugcauuuuuaga

SEQ ID NO: 548098 - RNA, 22 nt, Homo sapiens
cuuaagaacugcuucaugugaa

SEQ ID NO: 548099 - RNA, 18 nt, Homo sapiens
cuuaagaacugcuuucuu

SEQ ID NO: 548100 - RNA, 12 nt, Homo sapiens
cuuaagaacugu

SEQ ID NO: 548101 - RNA, 15 nt, Homo sapiens
cuuaagaauacacag

SEQ ID NO: 548102 - RNA, 22 nt, Homo sapiens
cuuaagacgugauuuugcugua

SEQ ID NO: 548103 - RNA, 19 nt, Homo sapiens
cuuaagacuuuugggacau

SEQ ID NO: 548104 - RNA, 21 nt, Homo sapiens
cuuaagagacacuccaaaccu

SEQ ID NO: 548105 - RNA, 21 nt, Homo sapiens
cuuaagagauuggaucaagua

SEQ ID NO: 548106 - RNA, 14 nt, Homo sapiens
cuuaagcaaaagaa

SEQ ID NO: 548107 - RNA, 12 nt, Homo sapiens
cuuaagcaaagg

SEQ ID NO: 548108 - RNA, 16 nt, Homo sapiens
cuuaagcagaagcauu

SEQ ID NO: 548109 - RNA, 11 nt, Homo sapiens
cuuaagccaua

SEQ ID NO: 548110 - RNA, 16 nt, Homo sapiens
cuuaagcccagugcac

SEQ ID NO: 548111 - RNA, 21 nt, Homo sapiens
cuuaagcccagugcacugaaa

SEQ ID NO: 548112 - RNA, 21 nt, Homo sapiens
cuuaagcuuccgccgucucaa

SEQ ID NO: 548113 - RNA, 20 nt, Homo sapiens
cuuaaggaagaagaguauua

SEQ ID NO: 548114 - RNA, 19 nt, Homo sapiens
cuuaagggaaaaguucucc

SEQ ID NO: 548115 - RNA, 20 nt, Homo sapiens
caguaggcaguagacuauaa

SEQ ID NO: 548116 - RNA, 16 nt, Homo sapiens
caguagucccugcaca

SEQ ID NO: 548117 - RNA, 23 nt, Homo sapiens
caguagucccugcacagugacuu

SEQ ID NO: 548118 - RNA, 18 nt, Homo sapiens
caguaguguacauuacca

SEQ ID NO: 548119 - RNA, 21 nt, Homo sapiens
caguaguucacauacaaauca

SEQ ID NO: 548120 - RNA, 20 nt, Homo sapiens
caguaguuugaucaguugaa

SEQ ID NO: 548121 - RNA, 21 nt, Homo sapiens
caguaguuuugacacuuccca

SEQ ID NO: 548122 - RNA, 22 nt, Homo sapiens
caguauaccuggcaauucacaa

SEQ ID NO: 548123 - RNA, 23 nt, Homo sapiens
caguauacucagcuaacaaaccu

SEQ ID NO: 548124 - RNA, 21 nt, Homo sapiens
caguauauucuuuccucaaaa

SEQ ID NO: 548125 - RNA, 21 nt, Homo sapiens
caguauauucuuugguuguga

SEQ ID NO: 548126 - RNA, 23 nt, Homo sapiens
caguaucacgauuugcaggauuc

SEQ ID NO: 548127 - RNA, 15 nt, Homo sapiens
caguaucaugcgaug

SEQ ID NO: 548128 - RNA, 20 nt, Homo sapiens
caguauccacaauagcugac

SEQ ID NO: 548129 - RNA, 16 nt, Homo sapiens
caguauccacacauaa

SEQ ID NO: 548130 - RNA, 20 nt, Homo sapiens
caguauccaggcuuuguaca

SEQ ID NO: 548131 - RNA, 20 nt, Homo sapiens
caguaucuauauauguguau

SEQ ID NO: 548132 - RNA, 21 nt, Homo sapiens
caguaucuauauauguguaug

SEQ ID NO: 548133 - RNA, 15 nt, Homo sapiens
caguaucuugggcau

SEQ ID NO: 548134 - RNA, 15 nt, Homo sapiens
caguaugagucaaug

SEQ ID NO: 548135 - RNA, 17 nt, Homo sapiens
caguaugugauggacug

SEQ ID NO: 548136 - RNA, 21 nt, Homo sapiens
caguauguuuguuucauugug

SEQ ID NO: 548137 - RNA, 12 nt, Homo sapiens
caguauuaugca

SEQ ID NO: 548138 - RNA, 16 nt, Homo sapiens
caguauucucagagca

SEQ ID NO: 548139 - RNA, 22 nt, Homo sapiens
caguauucucagagcauguguc

SEQ ID NO: 548140 - RNA, 16 nt, Homo sapiens
caguauucugacaugu

SEQ ID NO: 548141 - RNA, 17 nt, Homo sapiens
caguauuuuguguccuc

SEQ ID NO: 548142 - RNA, 16 nt, Homo sapiens
cagucaaaggcauuuu

SEQ ID NO: 548143 - RNA, 17 nt, Homo sapiens
cagucaaaggcauuuug

SEQ ID NO: 548144 - RNA, 15 nt, Homo sapiens
cagucaaggauggau

SEQ ID NO: 548145 - RNA, 16 nt, Homo sapiens
cagucaaguucagagu

SEQ ID NO: 548146 - RNA, 21 nt, Homo sapiens
cagucacauugauguaaggac

SEQ ID NO: 548147 - RNA, 19 nt, Homo sapiens
cagucaccgacaacaugcu

SEQ ID NO: 548148 - RNA, 19 nt, Homo sapiens
cagucacuugggagcugcu

SEQ ID NO: 548149 - RNA, 19 nt, Homo sapiens
cagucagagggcaacagga

SEQ ID NO: 548150 - RNA, 22 nt, Homo sapiens
cagucagauccuguuacuugcu

SEQ ID NO: 548151 - RNA, 20 nt, Homo sapiens
cagucagcucucuccuuuca

SEQ ID NO: 548152 - RNA, 18 nt, Homo sapiens
cagucaggcccaggcacu

SEQ ID NO: 548153 - RNA, 21 nt, Homo sapiens
cagucauggcaccaaagccac

SEQ ID NO: 548154 - RNA, 16 nt, Homo sapiens
cagucauguaugcaag

SEQ ID NO: 548155 - RNA, 13 nt, Homo sapiens
cagucauuguacu

SEQ ID NO: 548156 - RNA, 16 nt, Homo sapiens
caguccaccugaggaa

SEQ ID NO: 548157 - RNA, 16 nt, Homo sapiens
caguccauuuccuaau

SEQ ID NO: 548158 - RNA, 14 nt, Homo sapiens
cagucccacacugu

SEQ ID NO: 548159 - RNA, 15 nt, Homo sapiens
cagucccacacugug

SEQ ID NO: 548160 - RNA, 19 nt, Homo sapiens
cagucccacacuguggcca

SEQ ID NO: 548161 - RNA, 17 nt, Homo sapiens
cagucccagacaauucc

SEQ ID NO: 548162 - RNA, 15 nt, Homo sapiens
cagucccaugaccuu

SEQ ID NO: 548163 - RNA, 16 nt, Homo sapiens
cagucccucacaccug

SEQ ID NO: 548164 - RNA, 14 nt, Homo sapiens
caguccuagcagaa

SEQ ID NO: 548165 - RNA, 19 nt, Homo sapiens
caguccuccgcuacgcaca

SEQ ID NO: 548166 - RNA, 23 nt, Homo sapiens
caguccuggagggaguggguuaa

SEQ ID NO: 548167 - RNA, 21 nt, Homo sapiens
cagucguacugauucuaaugg

SEQ ID NO: 548168 - RNA, 18 nt, Homo sapiens
cagucuaaggucucaugc

SEQ ID NO: 548169 - RNA, 19 nt, Homo sapiens
cagucuacugacuuuuccc

SEQ ID NO: 548170 - RNA, 16 nt, Homo sapiens
cagucuagugcaaaag

SEQ ID NO: 548171 - RNA, 13 nt, Homo sapiens
cagucuauggguu

SEQ ID NO: 548172 - RNA, 13 nt, Homo sapiens
cagucuauuucca

SEQ ID NO: 548173 - RNA, 18 nt, Homo sapiens
cagucucccagauguugc

SEQ ID NO: 548174 - RNA, 16 nt, Homo sapiens
cagucuccgugguuga

SEQ ID NO: 548175 - RNA, 22 nt, Homo sapiens
cagucucggguggcuagucaga

SEQ ID NO: 548176 - RNA, 17 nt, Homo sapiens
cagucucugaauacaca

SEQ ID NO: 548177 - RNA, 22 nt, Homo sapiens
cagucucuucgaggcuuuacag

SEQ ID NO: 548178 - RNA, 14 nt, Homo sapiens
cagucucuucugau

SEQ ID NO: 548179 - RNA, 22 nt, Homo sapiens
cagucucuucugauuaaagaga

SEQ ID NO: 548180 - RNA, 15 nt, Homo sapiens
cagucugcuuagaaa

SEQ ID NO: 548181 - RNA, 15 nt, Homo sapiens
cagucugucuacugu

SEQ ID NO: 548182 - RNA, 19 nt, Homo sapiens
cagucugucuacuguggug

SEQ ID NO: 548183 - RNA, 17 nt, Homo sapiens
cagucuuccauuugcaa

SEQ ID NO: 548184 - RNA, 18 nt, Homo sapiens
cagucuuccuuguggaau

SEQ ID NO: 548185 - RNA, 22 nt, Homo sapiens
cagucuugcaacagugccaugu

SEQ ID NO: 548186 - RNA, 17 nt, Homo sapiens
cagucuuuuguccugca

SEQ ID NO: 548187 - RNA, 19 nt, Homo sapiens
cagucuuuuuaaacuugua

SEQ ID NO: 548188 - RNA, 14 nt, Homo sapiens
cagugaaagccaga

SEQ ID NO: 548189 - RNA, 21 nt, Homo sapiens
cagugaaccaaagagacugga

SEQ ID NO: 548190 - RNA, 19 nt, Homo sapiens
cagugaagaugcaaucaga

SEQ ID NO: 548191 - RNA, 20 nt, Homo sapiens
cagugaagcagcacugugag

SEQ ID NO: 548192 - RNA, 13 nt, Homo sapiens
cagugaaggcuaa

SEQ ID NO: 548193 - RNA, 16 nt, Homo sapiens
cagugaauccagacca

SEQ ID NO: 548194 - RNA, 16 nt, Homo sapiens
cagugaaucuguuuca

SEQ ID NO: 548195 - RNA, 18 nt, Homo sapiens
cagugaaugaagcugaug

SEQ ID NO: 548196 - RNA, 20 nt, Homo sapiens
cagugaaugugucuggaccu

SEQ ID NO: 548197 - RNA, 14 nt, Homo sapiens
cagugacaaacaua

SEQ ID NO: 548198 - RNA, 14 nt, Homo sapiens
cagugacaacaucg

SEQ ID NO: 548199 - RNA, 19 nt, Homo sapiens
cagugaccagucacugacc

SEQ ID NO: 548200 - RNA, 14 nt, Homo sapiens
cagugaccauggca

SEQ ID NO: 548201 - RNA, 19 nt, Homo sapiens
cagugacuuguucugagua

SEQ ID NO: 548202 - RNA, 18 nt, Homo sapiens
cagugagaaaaagcuccu

SEQ ID NO: 548203 - RNA, 18 nt, Homo sapiens
cagugagaacaucuggcc

SEQ ID NO: 548204 - RNA, 21 nt, Homo sapiens
cagugagaguacucacuuuuc

SEQ ID NO: 548205 - RNA, 13 nt, Homo sapiens
cagugagcacuag

SEQ ID NO: 548206 - RNA, 15 nt, Homo sapiens
cagugagccauguuc

SEQ ID NO: 548207 - RNA, 14 nt, Homo sapiens
cagugagcccagau

SEQ ID NO: 548208 - RNA, 14 nt, Homo sapiens
cagugagcucuuua

SEQ ID NO: 548209 - RNA, 16 nt, Homo sapiens
cagugagcugagauca

SEQ ID NO: 548210 - RNA, 23 nt, Homo sapiens
cagugagcuggggccgucugugu

SEQ ID NO: 548211 - RNA, 12 nt, Homo sapiens
cagugaguccag

SEQ ID NO: 548212 - RNA, 22 nt, Homo sapiens
cagugauauauuucuaugugua

SEQ ID NO: 548213 - RNA, 15 nt, Homo sapiens
cagugaucuccauau

SEQ ID NO: 548214 - RNA, 23 nt, Homo sapiens
cagugauggcgcgggaggcacca

SEQ ID NO: 548215 - RNA, 21 nt, Homo sapiens
cagugaugugaucauagcuca

SEQ ID NO: 548216 - RNA, 18 nt, Homo sapiens
cagugcaaaccacuucuc

SEQ ID NO: 548217 - RNA, 13 nt, Homo sapiens
cuuccagcaauaa

SEQ ID NO: 548218 - RNA, 20 nt, Homo sapiens
cuuccagccugggacacaca

SEQ ID NO: 548219 - RNA, 22 nt, Homo sapiens
cuuccaggagccaccuugccac

SEQ ID NO: 548220 - RNA, 16 nt, Homo sapiens
cuuccaggcacucaaa

SEQ ID NO: 548221 - RNA, 23 nt, Homo sapiens
cuuccagguguuacuguaauucc

SEQ ID NO: 548222 - RNA, 22 nt, Homo sapiens
cuuccauaauuaugacaguuau

SEQ ID NO: 548223 - RNA, 21 nt, Homo sapiens
cuuccaucagcgggucuccuc

SEQ ID NO: 548224 - RNA, 14 nt, Homo sapiens
cuuccauccuguca

SEQ ID NO: 548225 - RNA, 12 nt, Homo sapiens
cuuccaugagaa

SEQ ID NO: 548226 - RNA, 14 nt, Homo sapiens
cuuccaugcccugg

SEQ ID NO: 548227 - RNA, 12 nt, Homo sapiens
cuuccauuccau

SEQ ID NO: 548228 - RNA, 13 nt, Homo sapiens
cuucccaaaacca

SEQ ID NO: 548229 - RNA, 14 nt, Homo sapiens
cuucccacacuguc

SEQ ID NO: 548230 - RNA, 22 nt, Homo sapiens
cuucccagcucugacccuucua

SEQ ID NO: 548231 - RNA, 22 nt, Homo sapiens
cuucccagggaccagcaccuuc

SEQ ID NO: 548232 - RNA, 15 nt, Homo sapiens
cuucccauacuugca

SEQ ID NO: 548233 - RNA, 22 nt, Homo sapiens
cuuccccaauuggcucuaguca

SEQ ID NO: 548234 - RNA, 13 nt, Homo sapiens
cuuccccagagag

SEQ ID NO: 548235 - RNA, 17 nt, Homo sapiens
cuuccccccaucucuga

SEQ ID NO: 548236 - RNA, 21 nt, Homo sapiens
cuuccccucuuuuggccaaau

SEQ ID NO: 548237 - RNA, 15 nt, Homo sapiens
cuuccccuuccuaau

SEQ ID NO: 548238 - RNA, 17 nt, Homo sapiens
cuuccccuucuugccau

SEQ ID NO: 548239 - RNA, 13 nt, Homo sapiens
cuucccguucuua

SEQ ID NO: 548240 - RNA, 18 nt, Homo sapiens
cauaagggagauuguaua

SEQ ID NO: 548241 - RNA, 16 nt, Homo sapiens
cauaaguauuaugucu

SEQ ID NO: 548242 - RNA, 16 nt, Homo sapiens
cauaagugaaaaucuu

SEQ ID NO: 548243 - RNA, 18 nt, Homo sapiens
cauaaguuccuauaccuu

SEQ ID NO: 548244 - RNA, 21 nt, Homo sapiens
cauaaguuuacugaaucuuca

SEQ ID NO: 548245 - RNA, 23 nt, Homo sapiens
cauaaguuuacugaaucuucaag

SEQ ID NO: 548246 - RNA, 16 nt, Homo sapiens
cauaauaaaaggaguu

SEQ ID NO: 548247 - RNA, 16 nt, Homo sapiens
cauaauaaauaucugu

SEQ ID NO: 548248 - RNA, 18 nt, Homo sapiens
cauaauaaauaucuguac

SEQ ID NO: 548249 - RNA, 17 nt, Homo sapiens
cauaauacaugauugca

SEQ ID NO: 548250 - RNA, 14 nt, Homo sapiens
cauaauaccucaca

SEQ ID NO: 548251 - RNA, 13 nt, Homo sapiens
cauaaucauguaa

SEQ ID NO: 548252 - RNA, 21 nt, Homo sapiens
cauaaucuauaaacaaugaaa

SEQ ID NO: 548253 - RNA, 14 nt, Homo sapiens
cauaaucuguacaa

SEQ ID NO: 548254 - RNA, 19 nt, Homo sapiens
cauaaucuguacaaugaac

SEQ ID NO: 548255 - RNA, 15 nt, Homo sapiens
cauaaugcgugcaua

SEQ ID NO: 548256 - RNA, 12 nt, Homo sapiens
cauaauggacua

SEQ ID NO: 548257 - RNA, 22 nt, Homo sapiens
cauaauguauuuaaccagucuu

SEQ ID NO: 548258 - RNA, 17 nt, Homo sapiens
cauaauguuaagcuuua

SEQ ID NO: 548259 - RNA, 16 nt, Homo sapiens
cauaauguuccagaca

SEQ ID NO: 548260 - RNA, 17 nt, Homo sapiens
cauaauucagcacuuaa

SEQ ID NO: 548261 - RNA, 14 nt, Homo sapiens
cauaauucuuccaa

SEQ ID NO: 548262 - RNA, 18 nt, Homo sapiens
cauaauuggacucuguca

SEQ ID NO: 548263 - RNA, 20 nt, Homo sapiens
cauaauugugauuagacaga

SEQ ID NO: 548264 - RNA, 19 nt, Homo sapiens
cauacaaacaaugcaacca

SEQ ID NO: 548265 - RNA, 19 nt, Homo sapiens
cauacaaacauaaggcaca

SEQ ID NO: 548266 - RNA, 15 nt, Homo sapiens
cauacaaaucaucca

SEQ ID NO: 548267 - RNA, 17 nt, Homo sapiens
cauacaagauucuuccu

SEQ ID NO: 548268 - RNA, 13 nt, Homo sapiens
cauacaauuccaa

SEQ ID NO: 548269 - RNA, 18 nt, Homo sapiens
cauacacacacacacaua

SEQ ID NO: 548270 - RNA, 15 nt, Homo sapiens
cauacacacaugccc

SEQ ID NO: 548271 - RNA, 13 nt, Homo sapiens
cauacacacuguu

SEQ ID NO: 548272 - RNA, 21 nt, Homo sapiens
cauacacacuguugucaaaaa

SEQ ID NO: 548273 - RNA, 12 nt, Homo sapiens
cauacacauaau

SEQ ID NO: 548274 - RNA, 17 nt, Homo sapiens
cauacacugugaacuca

SEQ ID NO: 548275 - RNA, 14 nt, Homo sapiens
cauacaugcauaca

SEQ ID NO: 548276 - RNA, 18 nt, Homo sapiens
cauacaugcauacaaaga

SEQ ID NO: 548277 - RNA, 22 nt, Homo sapiens
cauacauucccucuaauuugaa

SEQ ID NO: 548278 - RNA, 21 nt, Homo sapiens
cauacauuuaugcacauucac

SEQ ID NO: 548279 - RNA, 20 nt, Homo sapiens
cauaccauuauuauguaaau

SEQ ID NO: 548280 - RNA, 23 nt, Homo sapiens
cauacccuuacucugccagagua

SEQ ID NO: 548281 - RNA, 21 nt, Homo sapiens
cauaccuuguuuuuaaucucc

SEQ ID NO: 548282 - RNA, 22 nt, Homo sapiens
cauacguguuaggaggcugcau

SEQ ID NO: 548283 - RNA, 14 nt, Homo sapiens
cauacucaagguga

SEQ ID NO: 548284 - RNA, 17 nt, Homo sapiens
cauacucccuauuuuca

SEQ ID NO: 548285 - RNA, 21 nt, Homo sapiens
cauacucccuauuuucauucc

SEQ ID NO: 548286 - RNA, 21 nt, Homo sapiens
cauacucccuuucagggccag

SEQ ID NO: 548287 - RNA, 17 nt, Homo sapiens
cauacucugcuuagaau

SEQ ID NO: 548288 - RNA, 14 nt, Homo sapiens
cauacuguucaaug

SEQ ID NO: 548289 - RNA, 13 nt, Homo sapiens
cauacuguucacu

SEQ ID NO: 548290 - RNA, 15 nt, Homo sapiens
cauacuguucacuca

SEQ ID NO: 548291 - RNA, 19 nt, Homo sapiens
cauacuuaaaaauuuauua

SEQ ID NO: 548292 - RNA, 15 nt, Homo sapiens
cauacuuaacauuuc

SEQ ID NO: 548293 - RNA, 17 nt, Homo sapiens
cauacuuaacauuucau

SEQ ID NO: 548294 - RNA, 11 nt, Homo sapiens
cauacuuguga

SEQ ID NO: 548295 - RNA, 23 nt, Homo sapiens
cauagaaaauuaaacacaaagug

SEQ ID NO: 548296 - RNA, 14 nt, Homo sapiens
cauagaagagccaa

SEQ ID NO: 548297 - RNA, 22 nt, Homo sapiens
cauagagaucuauguacuguaa

SEQ ID NO: 548298 - RNA, 13 nt, Homo sapiens
cauagagcuuuuu

SEQ ID NO: 548299 - RNA, 22 nt, Homo sapiens
cauagagcuuuuuaauagcacu

SEQ ID NO: 548300 - RNA, 13 nt, Homo sapiens
cauagaggcuucu

SEQ ID NO: 548301 - RNA, 15 nt, Homo sapiens
cauagauugcaaaua

SEQ ID NO: 548302 - RNA, 23 nt, Homo sapiens
cauagauuugcagcucaguagua

SEQ ID NO: 548303 - RNA, 16 nt, Homo sapiens
cauagcaaacagagga

SEQ ID NO: 548304 - RNA, 17 nt, Homo sapiens
cauagcaccuaacaaca

SEQ ID NO: 548305 - RNA, 16 nt, Homo sapiens
cauagccauggaaccc

SEQ ID NO: 548306 - RNA, 19 nt, Homo sapiens
cauagcgccgugcuguaaa

SEQ ID NO: 548307 - RNA, 20 nt, Homo sapiens
cauagcucaccaggacuguu

SEQ ID NO: 548308 - RNA, 21 nt, Homo sapiens
cauagcucacuguaaccucaa

SEQ ID NO: 548309 - RNA, 18 nt, Homo sapiens
cauagcuccuucccagga

SEQ ID NO: 548310 - RNA, 14 nt, Homo sapiens
cauagcugaucaug

SEQ ID NO: 548311 - RNA, 16 nt, Homo sapiens
cauaggacauacugca

SEQ ID NO: 548312 - RNA, 19 nt, Homo sapiens
cauaggaggggucuggaca

SEQ ID NO: 548313 - RNA, 23 nt, Homo sapiens
cauaggcugacuuuugcagaugg

SEQ ID NO: 548314 - RNA, 15 nt, Homo sapiens
cauagggccuccuua

SEQ ID NO: 548315 - RNA, 19 nt, Homo sapiens
cauagggucacuuugccau

SEQ ID NO: 548316 - RNA, 21 nt, Homo sapiens
cauagggugcucugaggucaa

SEQ ID NO: 548317 - RNA, 18 nt, Homo sapiens
cauagguaacaguuauau

SEQ ID NO: 548318 - RNA, 13 nt, Homo sapiens
cauaggucugaaa

SEQ ID NO: 548319 - RNA, 16 nt, Homo sapiens
cauaggugacagggcc

SEQ ID NO: 548320 - RNA, 21 nt, Homo sapiens
cauaggugcaguuugcuucua

SEQ ID NO: 548321 - RNA, 18 nt, Homo sapiens
cauaguauuggagcacau

SEQ ID NO: 548322 - RNA, 23 nt, Homo sapiens
cauagucuuuggagaaaugcuua

SEQ ID NO: 548323 - RNA, 19 nt, Homo sapiens
cauagugaccuguguuuca

SEQ ID NO: 548324 - RNA, 17 nt, Homo sapiens
cauagugcaaaacugug

SEQ ID NO: 548325 - RNA, 13 nt, Homo sapiens
cauagugcacuag

SEQ ID NO: 548326 - RNA, 22 nt, Homo sapiens
cauaguggguggauuuguugcc

SEQ ID NO: 548327 - RNA, 22 nt, Homo sapiens
cauauaauguaaaaagaucuac

SEQ ID NO: 548328 - RNA, 22 nt, Homo sapiens
cauauaauuuucacuucugucu

SEQ ID NO: 548329 - RNA, 12 nt, Homo sapiens
cauauacauaua

SEQ ID NO: 548330 - RNA, 13 nt, Homo sapiens
cauauaccagcaa

SEQ ID NO: 548331 - RNA, 23 nt, Homo sapiens
cauauacugccauguacuaguuu

SEQ ID NO: 548332 - RNA, 16 nt, Homo sapiens
cauauagaaugcagag

SEQ ID NO: 548333 - RNA, 21 nt, Homo sapiens
cauauagauuguccuuuugca

SEQ ID NO: 548334 - RNA, 22 nt, Homo sapiens
cauauagauuguccuuuugcaa

SEQ ID NO: 548335 - RNA, 21 nt, Homo sapiens
cauauauacccacauguacag

SEQ ID NO: 548336 - RNA, 19 nt, Homo sapiens
cauauauauaguuaugcau

SEQ ID NO: 548337 - RNA, 20 nt, Homo sapiens
cauauauauaguuaugcaua

SEQ ID NO: 548338 - RNA, 18 nt, Homo sapiens
uuggagcucuauccauau

SEQ ID NO: 548339 - RNA, 11 nt, Homo sapiens
uuggagcugcc

SEQ ID NO: 548340 - RNA, 19 nt, Homo sapiens
uuggagcuuuuuucuuuaa

SEQ ID NO: 548341 - RNA, 13 nt, Homo sapiens
uuggaggugcugc

SEQ ID NO: 548342 - RNA, 14 nt, Homo sapiens
uuggagucacugua

SEQ ID NO: 548343 - RNA, 20 nt, Homo sapiens
uuggaguguaaaccaaauac

SEQ ID NO: 548344 - RNA, 20 nt, Homo sapiens
uuggauacauacaccagcau

SEQ ID NO: 548345 - RNA, 16 nt, Homo sapiens
uuggauggagacucca

SEQ ID NO: 548346 - RNA, 19 nt, Homo sapiens
uuggauggagacuccauga

SEQ ID NO: 548347 - RNA, 21 nt, Homo sapiens
uuggauuaugaagugacucuc

SEQ ID NO: 548348 - RNA, 18 nt, Homo sapiens
uuggauuauucauuuaaa

SEQ ID NO: 548349 - RNA, 15 nt, Homo sapiens
uuggauuccuuuaug

SEQ ID NO: 548350 - RNA, 17 nt, Homo sapiens
uuggauuuauucugcca

SEQ ID NO: 548351 - RNA, 20 nt, Homo sapiens
uuggcaacagaagcaguuga

SEQ ID NO: 548352 - RNA, 14 nt, Homo sapiens
uuggcacauuucau

SEQ ID NO: 548353 - RNA, 13 nt, Homo sapiens
uuggcaccuguag

SEQ ID NO: 548354 - RNA, 15 nt, Homo sapiens
uuggcacugagauau

SEQ ID NO: 548355 - RNA, 16 nt, Homo sapiens
uuggcaguggacucag

SEQ ID NO: 548356 - RNA, 17 nt, Homo sapiens
uuggcaguggacucaga

SEQ ID NO: 548357 - RNA, 15 nt, Homo sapiens
uuggcaugaccucau

SEQ ID NO: 548358 - RNA, 22 nt, Homo sapiens
uuggccaaacaucagaccuguc

SEQ ID NO: 548359 - RNA, 16 nt, Homo sapiens
uuggccccacuuugaa

SEQ ID NO: 548360 - RNA, 14 nt, Homo sapiens
uuggccgagcuccu

SEQ ID NO: 548361 - RNA, 15 nt, Homo sapiens
uuggccugcugugau

SEQ ID NO: 548362 - RNA, 17 nt, Homo sapiens
uuggccugugagccauu

SEQ ID NO: 548363 - RNA, 13 nt, Homo sapiens
uuggccuucuggg

SEQ ID NO: 548364 - RNA, 15 nt, Homo sapiens
uuggcuacacacaaa

SEQ ID NO: 548365 - RNA, 18 nt, Homo sapiens
uuggcuccagucuuccga

SEQ ID NO: 548366 - RNA, 23 nt, Homo sapiens
uuggcucccgggggccccaccuc

SEQ ID NO: 548367 - RNA, 18 nt, Homo sapiens
uuggcugagccauugagu

SEQ ID NO: 548368 - RNA, 16 nt, Homo sapiens
uuggcugcguacucca

SEQ ID NO: 548369 - RNA, 24 nt, Homo sapiens
uuggcugcguacuccacuggucug

SEQ ID NO: 548370 - RNA, 22 nt, Homo sapiens
uuggcuggcuuguuugauuuca

SEQ ID NO: 548371 - RNA, 14 nt, Homo sapiens
uuggcuuaaauaau

SEQ ID NO: 548372 - RNA, 14 nt, Homo sapiens
uuggcuucagggga

SEQ ID NO: 548373 - RNA, 16 nt, Homo sapiens
uuggcuuucauguuau

SEQ ID NO: 548374 - RNA, 13 nt, Homo sapiens
uuggcuuugccag

SEQ ID NO: 548375 - RNA, 21 nt, Homo sapiens
uugggaacggacugguaugua

SEQ ID NO: 548376 - RNA, 21 nt, Homo sapiens
uugggacagcaugacugugca

SEQ ID NO: 548377 - RNA, 19 nt, Homo sapiens
uugggaccgaaagcaaagg

SEQ ID NO: 548378 - RNA, 14 nt, Homo sapiens
uugggagcugccaa

SEQ ID NO: 548379 - RNA, 18 nt, Homo sapiens
uugggaggauacagagga

SEQ ID NO: 548380 - RNA, 16 nt, Homo sapiens
uugggaggcugaggca

SEQ ID NO: 548381 - RNA, 22 nt, Homo sapiens
uugggaggcugaggcaagagaa

SEQ ID NO: 548382 - RNA, 22 nt, Homo sapiens
uugggaggcugaggcaggagaa

SEQ ID NO: 548383 - RNA, 13 nt, Homo sapiens
uugggagggucag

SEQ ID NO: 548384 - RNA, 23 nt, Homo sapiens
uugggagggugguucaacaaaga

SEQ ID NO: 548385 - RNA, 15 nt, Homo sapiens
uugggauaguguucu

SEQ ID NO: 548386 - RNA, 20 nt, Homo sapiens
uugggauauccuuucacucu

SEQ ID NO: 548387 - RNA, 16 nt, Homo sapiens
uugggauauucugaaa

SEQ ID NO: 548388 - RNA, 21 nt, Homo sapiens
uugggauauucugaaacuuga

SEQ ID NO: 548389 - RNA, 16 nt, Homo sapiens
uugggauggcuuguag

SEQ ID NO: 548390 - RNA, 21 nt, Homo sapiens
uugggauuuacuaguagccaa

SEQ ID NO: 548391 - RNA, 12 nt, Homo sapiens
uugggcauuuaa

SEQ ID NO: 548392 - RNA, 22 nt, Homo sapiens
uugggcccaagaacugcagaua

SEQ ID NO: 548393 - RNA, 19 nt, Homo sapiens
uugggccuaaaacaguauu

SEQ ID NO: 548394 - RNA, 16 nt, Homo sapiens
uugggcugcuccucau

SEQ ID NO: 548395 - RNA, 20 nt, Homo sapiens
uugggcuggaugccgaggua

SEQ ID NO: 548396 - RNA, 14 nt, Homo sapiens
uuggggaaauccau

SEQ ID NO: 548397 - RNA, 22 nt, Homo sapiens
uuggggacuaacccaaugccug

SEQ ID NO: 548398 - RNA, 10 nt, Homo sapiens
uuggggacuc

SEQ ID NO: 548399 - RNA, 15 nt, Homo sapiens
uuggggagacaucaa

SEQ ID NO: 548400 - RNA, 19 nt, Homo sapiens
uuggggagcaggaggccaa

SEQ ID NO: 548401 - RNA, 16 nt, Homo sapiens
uuggggcagaccccag

SEQ ID NO: 548402 - RNA, 15 nt, Homo sapiens
uuggggccaccaaag

SEQ ID NO: 548403 - RNA, 22 nt, Homo sapiens
uuggggggucagggugcugucc

SEQ ID NO: 548404 - RNA, 13 nt, Homo sapiens
uuggggucucuuu

SEQ ID NO: 548405 - RNA, 18 nt, Homo sapiens
uugggucacgguggcagu

SEQ ID NO: 548406 - RNA, 19 nt, Homo sapiens
uuggguggcucacuacuga

SEQ ID NO: 548407 - RNA, 18 nt, Homo sapiens
uugggugugugguggauu

SEQ ID NO: 548408 - RNA, 15 nt, Homo sapiens
uugguaaauggcaaa

SEQ ID NO: 548409 - RNA, 17 nt, Homo sapiens
uugguaaucucugugaa

SEQ ID NO: 548410 - RNA, 21 nt, Homo sapiens
uugguacuagauacugaaugu

SEQ ID NO: 548411 - RNA, 16 nt, Homo sapiens
uugguauaauguuuaa

SEQ ID NO: 548412 - RNA, 20 nt, Homo sapiens
uugguauacuuuugcuucag

SEQ ID NO: 548413 - RNA, 23 nt, Homo sapiens
uugguaucuacuucuacauccaa

SEQ ID NO: 548414 - RNA, 20 nt, Homo sapiens
uugguauucaccgugccuga

SEQ ID NO: 548415 - RNA, 24 nt, Homo sapiens
uugguauuugcaccaacauaguca

SEQ ID NO: 548416 - RNA, 14 nt, Homo sapiens
uuggucagcguuac

SEQ ID NO: 548417 - RNA, 12 nt, Homo sapiens
uuggucaggggg

SEQ ID NO: 548418 - RNA, 23 nt, Homo sapiens
uugguccagagcggaggcugugu

SEQ ID NO: 548419 - RNA, 13 nt, Homo sapiens
uugguccuaagca

SEQ ID NO: 548420 - RNA, 14 nt, Homo sapiens
uugguccuuuacac

SEQ ID NO: 548421 - RNA, 17 nt, Homo sapiens
uuggucugggacuuccu

SEQ ID NO: 548422 - RNA, 23 nt, Homo sapiens
uuggucuguuuugccuucaccca

SEQ ID NO: 548423 - RNA, 16 nt, Homo sapiens
uuggugaauuucacaa

SEQ ID NO: 548424 - RNA, 16 nt, Homo sapiens
uuggugcugcuuucuu

SEQ ID NO: 548425 - RNA, 19 nt, Homo sapiens
uuggugugugugacaauuc

SEQ ID NO: 548426 - RNA, 15 nt, Homo sapiens
uugguguugacauac

SEQ ID NO: 548427 - RNA, 13 nt, Homo sapiens
uugguuauucuaa

SEQ ID NO: 548428 - RNA, 14 nt, Homo sapiens
uugguucuuugguc

SEQ ID NO: 548429 - RNA, 18 nt, Homo sapiens
uugguuuaugacuuuguc

SEQ ID NO: 548430 - RNA, 22 nt, Homo sapiens
uugguuuccaaaggcauuuuau

SEQ ID NO: 548431 - RNA, 14 nt, Homo sapiens
uugguuugacccag

SEQ ID NO: 548432 - RNA, 17 nt, Homo sapiens
uugguuugugugaucau

SEQ ID NO: 548433 - RNA, 16 nt, Homo sapiens
uugguuuugugcacau

SEQ ID NO: 548434 - RNA, 20 nt, Homo sapiens
uuguaaaacaaaauuugacu

SEQ ID NO: 548435 - RNA, 15 nt, Homo sapiens
uuguaaaggauauca

SEQ ID NO: 548436 - RNA, 22 nt, Homo sapiens
uuguaaaggauaucaaugccuu

SEQ ID NO: 548437 - RNA, 17 nt, Homo sapiens
uuguaaaguuagccuuu

SEQ ID NO: 548438 - RNA, 12 nt, Homo sapiens
uuguaaauauuc

SEQ ID NO: 548439 - RNA, 12 nt, Homo sapiens
uuguaacaagaa

SEQ ID NO: 548440 - RNA, 22 nt, Homo sapiens
uuguaacgacuucuccaucucc

SEQ ID NO: 548441 - RNA, 13 nt, Homo sapiens
uuguaacuccacc

SEQ ID NO: 548442 - RNA, 21 nt, Homo sapiens
uuguaagaaaaugagacaaaa

SEQ ID NO: 548443 - RNA, 22 nt, Homo sapiens
uuguaagugagagagacaagaa

SEQ ID NO: 548444 - RNA, 16 nt, Homo sapiens
uuguaagugcugcuau

SEQ ID NO: 548445 - RNA, 23 nt, Homo sapiens
uuguaauaaaaugguacauuucu

SEQ ID NO: 548446 - RNA, 14 nt, Homo sapiens
uuguaauaagcaau

SEQ ID NO: 548447 - RNA, 23 nt, Homo sapiens
uuguaaucccaguuacucaggag

SEQ ID NO: 548448 - RNA, 21 nt, Homo sapiens
uuguaaucgauuugucuguca

SEQ ID NO: 548449 - RNA, 20 nt, Homo sapiens
uugcaggauggugucucuuc

SEQ ID NO: 548450 - RNA, 12 nt, Homo sapiens
uugcagguaccg

SEQ ID NO: 548451 - RNA, 18 nt, Homo sapiens
uugcaggugaacagccuc

SEQ ID NO: 548452 - RNA, 19 nt, Homo sapiens
uugcaguaagccaagguca

SEQ ID NO: 548453 - RNA, 15 nt, Homo sapiens
uugcagucacuguga

SEQ ID NO: 548454 - RNA, 16 nt, Homo sapiens
uugcagucacugugau

SEQ ID NO: 548455 - RNA, 16 nt, Homo sapiens
uugcagucucccagau

SEQ ID NO: 548456 - RNA, 17 nt, Homo sapiens
uugcagugaauucauau

SEQ ID NO: 548457 - RNA, 15 nt, Homo sapiens
uugaauuccauggaa

SEQ ID NO: 548458 - RNA, 23 nt, Homo sapiens
uugaauuguuacaucaugcugga

SEQ ID NO: 548459 - RNA, 22 nt, Homo sapiens
uugaauuuuucuuccucuccac

SEQ ID NO: 548460 - RNA, 19 nt, Homo sapiens
uugaauuuuuugaaauggg

SEQ ID NO: 548461 - RNA, 19 nt, Homo sapiens
uugacaaagaaacccaagu

SEQ ID NO: 548462 - RNA, 19 nt, Homo sapiens
uugacaaagugccgugaua

SEQ ID NO: 548463 - RNA, 17 nt, Homo sapiens
uugacaacaucccacag

SEQ ID NO: 548464 - RNA, 21 nt, Homo sapiens
uuaauacauucuaugacauuu

SEQ ID NO: 548465 - RNA, 20 nt, Homo sapiens
uuaauacauugaucaggcca

SEQ ID NO: 548466 - RNA, 18 nt, Homo sapiens
uuaauaccacagcuauuu

SEQ ID NO: 548467 - RNA, 22 nt, Homo sapiens
uuaauagcaacagagcacuuga

SEQ ID NO: 548468 - RNA, 21 nt, Homo sapiens
uuaauagggauuuuuucagcu

SEQ ID NO: 548469 - RNA, 13 nt, Homo sapiens
uuaauauacuaga

SEQ ID NO: 548470 - RNA, 18 nt, Homo sapiens
uuaauauauaguccagac

SEQ ID NO: 548471 - RNA, 12 nt, Homo sapiens
uucuucaacucc

SEQ ID NO: 548472 - RNA, 22 nt, Homo sapiens
uucuucaccuaagucucuguga

SEQ ID NO: 548473 - RNA, 16 nt, Homo sapiens
uucuucaccucuucca

SEQ ID NO: 548474 - RNA, 22 nt, Homo sapiens
uucuucaccucuuccacuccuu

SEQ ID NO: 548475 - RNA, 18 nt, Homo sapiens
uuaaagcaaaauaguauu

SEQ ID NO: 548476 - RNA, 19 nt, Homo sapiens
uuaaagcauauuggugcua

SEQ ID NO: 548477 - RNA, 13 nt, Homo sapiens
uuaaagccuccuc

SEQ ID NO: 548478 - RNA, 22 nt, Homo sapiens
uuaaaggcugugguaguacucc

SEQ ID NO: 548479 - RNA, 22 nt, Homo sapiens
uuaaaggguauacuaagugaua

SEQ ID NO: 548480 - RNA, 16 nt, Homo sapiens
uuaaagguagucaaga

SEQ ID NO: 548481 - RNA, 12 nt, Homo sapiens
uuaaaguaguuc

SEQ ID NO: 548482 - RNA, 21 nt, Homo sapiens
uuaaagucagguccaauuugu

SEQ ID NO: 548483 - RNA, 17 nt, Homo sapiens
uuaaaguggcaaucuca

SEQ ID NO: 548484 - RNA, 16 nt, Homo sapiens
uguuagugucugucca

SEQ ID NO: 548485 - RNA, 14 nt, Homo sapiens
uguuaguucccaac

SEQ ID NO: 548486 - RNA, 21 nt, Homo sapiens
uguuauaaagacacaugcacg

SEQ ID NO: 548487 - RNA, 19 nt, Homo sapiens
uguuauaacucugcacuac

SEQ ID NO: 548488 - RNA, 17 nt, Homo sapiens
uguuauacacagcuuua

SEQ ID NO: 548489 - RNA, 14 nt, Homo sapiens
uguuauagcuuuaa

SEQ ID NO: 548490 - RNA, 14 nt, Homo sapiens
uguuauaucaggga

SEQ ID NO: 548491 - RNA, 14 nt, Homo sapiens
uguuaucagucaua

SEQ ID NO: 548492 - RNA, 22 nt, Homo sapiens
uguuaucgaacacauucaguga

SEQ ID NO: 548493 - RNA, 18 nt, Homo sapiens
uguuaucuaucaacuaua

SEQ ID NO: 548494 - RNA, 20 nt, Homo sapiens
uguuaucuguguagcaagcu

SEQ ID NO: 548495 - RNA, 15 nt, Homo sapiens
uguuaugaacaucca

SEQ ID NO: 548496 - RNA, 19 nt, Homo sapiens
uguuaugagaaauuaguca

SEQ ID NO: 548497 - RNA, 12 nt, Homo sapiens
uguuauguacaa

SEQ ID NO: 548498 - RNA, 12 nt, Homo sapiens
uguuaugugauc

SEQ ID NO: 548499 - RNA, 23 nt, Homo sapiens
uguuauuauauuccguagguaga

SEQ ID NO: 548500 - RNA, 16 nt, Homo sapiens
uguuauugauguugcu

SEQ ID NO: 548501 - RNA, 20 nt, Homo sapiens
uguuauuguugaacauacuu

SEQ ID NO: 548502 - RNA, 23 nt, Homo sapiens
uguuauuuaaagaagaaacgucu

SEQ ID NO: 548503 - RNA, 15 nt, Homo sapiens
uguuauuuaacagcu

SEQ ID NO: 548504 - RNA, 13 nt, Homo sapiens
uguuauuuacacu

SEQ ID NO: 548505 - RNA, 15 nt, Homo sapiens
uguuauuuacacugg

SEQ ID NO: 548506 - RNA, 19 nt, Homo sapiens
uguuauuuacacuggucua

SEQ ID NO: 548507 - RNA, 16 nt, Homo sapiens
uguuauuuauaguguu

SEQ ID NO: 548508 - RNA, 11 nt, Homo sapiens
uguucaaagac

SEQ ID NO: 548509 - RNA, 15 nt, Homo sapiens
uguucaaugguucug

SEQ ID NO: 548510 - RNA, 17 nt, Homo sapiens
uguucaauguuccauuc

SEQ ID NO: 548511 - RNA, 12 nt, Homo sapiens
uguucaauguuu

SEQ ID NO: 548512 - RNA, 19 nt, Homo sapiens
uguucacaacagugaaaag

SEQ ID NO: 548513 - RNA, 21 nt, Homo sapiens
uguucacaacauaaggagaau

SEQ ID NO: 548514 - RNA, 15 nt, Homo sapiens
uguucacugcuccuu

SEQ ID NO: 548515 - RNA, 15 nt, Homo sapiens
uguucacuguggcau

SEQ ID NO: 548516 - RNA, 16 nt, Homo sapiens
uguucagggcugugau

SEQ ID NO: 548517 - RNA, 16 nt, Homo sapiens
uguucauccucauugc

SEQ ID NO: 548518 - RNA, 11 nt, Homo sapiens
uguucaugccg

SEQ ID NO: 548519 - RNA, 24 nt, Homo sapiens
uguucauggguuuaccacuaacuc

SEQ ID NO: 548520 - RNA, 22 nt, Homo sapiens
uguuccaugaaggcagagccau

SEQ ID NO: 548521 - RNA, 16 nt, Homo sapiens
uguucccagagcacuu

SEQ ID NO: 548522 - RNA, 16 nt, Homo sapiens
uguucccccugugcag

SEQ ID NO: 548523 - RNA, 14 nt, Homo sapiens
uguuccccuaguuc

SEQ ID NO: 548524 - RNA, 16 nt, Homo sapiens
uguuccccugcucugu

SEQ ID NO: 548525 - RNA, 17 nt, Homo sapiens
uguuccucaagguccau

SEQ ID NO: 548526 - RNA, 13 nt, Homo sapiens
uguuccucuagua

SEQ ID NO: 548527 - RNA, 17 nt, Homo sapiens
uguuccugaaaauugca

SEQ ID NO: 548528 - RNA, 21 nt, Homo sapiens
uguuccugaauacaagccuau

SEQ ID NO: 548529 - RNA, 18 nt, Homo sapiens
uguucggguuaagugaug

SEQ ID NO: 548530 - RNA, 14 nt, Homo sapiens
uguucguguugccc

SEQ ID NO: 548531 - RNA, 16 nt, Homo sapiens
uguucuaugaacaacu

SEQ ID NO: 548532 - RNA, 22 nt, Homo sapiens
uguucuauuuuuguuuacaaac

SEQ ID NO: 548533 - RNA, 19 nt, Homo sapiens
uguucucaacuucaaaagu

SEQ ID NO: 548534 - RNA, 13 nt, Homo sapiens
uguucucacuuau

SEQ ID NO: 548535 - RNA, 19 nt, Homo sapiens
uguucuccggguguggccu

SEQ ID NO: 548536 - RNA, 20 nt, Homo sapiens
uguucucuaggccuucagga

SEQ ID NO: 548537 - RNA, 21 nt, Homo sapiens
uguucucucugugcucuugca

SEQ ID NO: 548538 - RNA, 23 nt, Homo sapiens
uguucugaauaauuucuuacuaa

SEQ ID NO: 548539 - RNA, 13 nt, Homo sapiens
uguucugauuaga

SEQ ID NO: 548540 - RNA, 20 nt, Homo sapiens
uguucuguagcuuucuggaa

SEQ ID NO: 548541 - RNA, 15 nt, Homo sapiens
uguucugucuuccca

SEQ ID NO: 548542 - RNA, 13 nt, Homo sapiens
uguucugugccug

SEQ ID NO: 548543 - RNA, 14 nt, Homo sapiens
uguucugugccugc

SEQ ID NO: 548544 - RNA, 13 nt, Homo sapiens
uguucuguucugg

SEQ ID NO: 548545 - RNA, 20 nt, Homo sapiens
uguucuguuuggcacuugua

SEQ ID NO: 548546 - RNA, 15 nt, Homo sapiens
uguucuuaauuguga

SEQ ID NO: 548547 - RNA, 15 nt, Homo sapiens
uguucuuagagugua

SEQ ID NO: 548548 - RNA, 13 nt, Homo sapiens
uguucuucacuuc

SEQ ID NO: 548549 - RNA, 15 nt, Homo sapiens
uguucuugaagcagu

SEQ ID NO: 548550 - RNA, 20 nt, Homo sapiens
uguucuuuaguagcaacuaa

SEQ ID NO: 548551 - RNA, 14 nt, Homo sapiens
uguucuuugucuca

SEQ ID NO: 548552 - RNA, 21 nt, Homo sapiens
uguucuuuuuucuuaccaccu

SEQ ID NO: 548553 - RNA, 16 nt, Homo sapiens
uguugaagcacuguug

SEQ ID NO: 548554 - RNA, 14 nt, Homo sapiens
uguugaaguuuaca

SEQ ID NO: 548555 - RNA, 14 nt, Homo sapiens
uguugaauaaugcu

SEQ ID NO: 548556 - RNA, 18 nt, Homo sapiens
uguugaaucaaagugauu

SEQ ID NO: 548557 - RNA, 21 nt, Homo sapiens
uguugacauuagucucaguga

SEQ ID NO: 548558 - RNA, 18 nt, Homo sapiens
uguugacauucugaaugc

SEQ ID NO: 548559 - RNA, 21 nt, Homo sapiens
uguugagacugauucagagga

SEQ ID NO: 548560 - RNA, 18 nt, Homo sapiens
uguugauaaaccauaaau

SEQ ID NO: 548561 - RNA, 22 nt, Homo sapiens
uguugauacuagcauacuuaaa

SEQ ID NO: 548562 - RNA, 11 nt, Homo sapiens
uguugauccca

SEQ ID NO: 548563 - RNA, 15 nt, Homo sapiens
uguugauggcaaaaa

SEQ ID NO: 548564 - RNA, 16 nt, Homo sapiens
uguugauggcaaaaaa

SEQ ID NO: 548565 - RNA, 13 nt, Homo sapiens
uguugcaaacuca

SEQ ID NO: 548566 - RNA, 17 nt, Homo sapiens
uguugcaaacucagugc

SEQ ID NO: 548567 - RNA, 13 nt, Homo sapiens
uguugcaagcccc

SEQ ID NO: 548568 - RNA, 14 nt, Homo sapiens
uguugcacacucac

SEQ ID NO: 548569 - RNA, 12 nt, Homo sapiens
uguugcacugaa

SEQ ID NO: 548570 - RNA, 16 nt, Homo sapiens
uguugccauggugaug

SEQ ID NO: 548571 - RNA, 20 nt, Homo sapiens
uguugcccacauuaagcacu

SEQ ID NO: 548572 - RNA, 22 nt, Homo sapiens
uguugccuccucccauccagcg

SEQ ID NO: 548573 - RNA, 14 nt, Homo sapiens
uguugccuuuaugg

SEQ ID NO: 548574 - RNA, 21 nt, Homo sapiens
uguugcguucaaagaggugaa

SEQ ID NO: 548575 - RNA, 19 nt, Homo sapiens
uguugcuaauuugccacag

SEQ ID NO: 548576 - RNA, 13 nt, Homo sapiens
uguugcuagggag

SEQ ID NO: 548577 - RNA, 14 nt, Homo sapiens
uguugcugcaucuc

SEQ ID NO: 548578 - RNA, 23 nt, Homo sapiens
uguugcugcaucuccccucagau

SEQ ID NO: 548579 - RNA, 15 nt, Homo sapiens
uguugcugcuacugu

SEQ ID NO: 548580 - RNA, 16 nt, Homo sapiens
uguugcuucugaauca

SEQ ID NO: 548581 - RNA, 12 nt, Homo sapiens
uguuggcagcuc

SEQ ID NO: 548582 - RNA, 16 nt, Homo sapiens
uguuggcccucaccag

SEQ ID NO: 548583 - RNA, 18 nt, Homo sapiens
uguuggcuccagucuucc

SEQ ID NO: 548584 - RNA, 15 nt, Homo sapiens
uguuggcuucucaau

SEQ ID NO: 548585 - RNA, 21 nt, Homo sapiens
uguuggcuuucccuuaucaaa

SEQ ID NO: 548586 - RNA, 13 nt, Homo sapiens
uguuggggaccuu

SEQ ID NO: 548587 - RNA, 16 nt, Homo sapiens
uguuggggcaguggua

SEQ ID NO: 548588 - RNA, 13 nt, Homo sapiens
uguuguaugggga

SEQ ID NO: 548589 - RNA, 20 nt, Homo sapiens
uguugucaauaacagguuug

SEQ ID NO: 548590 - RNA, 18 nt, Homo sapiens
uguugucacccaagagau

SEQ ID NO: 548591 - RNA, 10 nt, Homo sapiens
uguugugaua

SEQ ID NO: 548592 - RNA, 19 nt, Homo sapiens
uguugugauauagaacaaa

SEQ ID NO: 548593 - RNA, 20 nt, Homo sapiens
uguuguguauagaugcaaga

SEQ ID NO: 548594 - RNA, 18 nt, Homo sapiens
uguuguugaggcugucac

SEQ ID NO: 548595 - RNA, 13 nt, Homo sapiens
uguuguugccaaa

SEQ ID NO: 548596 - RNA, 13 nt, Homo sapiens
uguuguuggcaag

SEQ ID NO: 548597 - RNA, 15 nt, Homo sapiens
uguuguuuaaucuga

SEQ ID NO: 548598 - RNA, 17 nt, Homo sapiens
uguuuaaaaaguaauaa

SEQ ID NO: 548599 - RNA, 22 nt, Homo sapiens
uguuuaaaauucucuuugguca

SEQ ID NO: 548600 - RNA, 12 nt, Homo sapiens
uguuuaaaccca

SEQ ID NO: 548601 - RNA, 13 nt, Homo sapiens
uguuuaacacuuc

SEQ ID NO: 548602 - RNA, 13 nt, Homo sapiens
uguuuaacauaua

SEQ ID NO: 548603 - RNA, 19 nt, Homo sapiens
uguuuaagaaaaaauaaca

SEQ ID NO: 548604 - RNA, 19 nt, Homo sapiens
uguuuaagcccagccaagu

SEQ ID NO: 548605 - RNA, 11 nt, Homo sapiens
uguuuacaaag

SEQ ID NO: 548606 - RNA, 14 nt, Homo sapiens
uguuuacaaagcau

SEQ ID NO: 548607 - RNA, 17 nt, Homo sapiens
uguuuacagcacuacuc

SEQ ID NO: 548608 - RNA, 17 nt, Homo sapiens
uguuuacugagccuuaa

SEQ ID NO: 548609 - RNA, 18 nt, Homo sapiens
uguuuagaaaucauagaa

SEQ ID NO: 548610 - RNA, 14 nt, Homo sapiens
uguuuagaacacac

SEQ ID NO: 548611 - RNA, 17 nt, Homo sapiens
uguuuaggccucauuuc

SEQ ID NO: 548612 - RNA, 12 nt, Homo sapiens
uguuuaguugca

SEQ ID NO: 548613 - RNA, 13 nt, Homo sapiens
uguuuauacugua

SEQ ID NO: 548614 - RNA, 16 nt, Homo sapiens
uguuuauauaguuuag

SEQ ID NO: 548615 - RNA, 16 nt, Homo sapiens
uguuuaucaagccaua

SEQ ID NO: 548616 - RNA, 20 nt, Homo sapiens
uguuuauccuuucauauagu

SEQ ID NO: 548617 - RNA, 14 nt, Homo sapiens
uguuuaugccacag

SEQ ID NO: 548618 - RNA, 14 nt, Homo sapiens
uguuuauucuucca

SEQ ID NO: 548619 - RNA, 18 nt, Homo sapiens
uguuuauuuaaugcugug

SEQ ID NO: 548620 - RNA, 16 nt, Homo sapiens
uuuugcaacuagguau

SEQ ID NO: 548621 - RNA, 18 nt, Homo sapiens
uuuugcacacuuugccau

SEQ ID NO: 548622 - RNA, 20 nt, Homo sapiens
uuuugcaguucccacauuaa

SEQ ID NO: 548623 - RNA, 22 nt, Homo sapiens
uuuugcauguaugacuuaauaa

SEQ ID NO: 548624 - RNA, 10 nt, Homo sapiens
uuuugccaaa

SEQ ID NO: 548625 - RNA, 17 nt, Homo sapiens
uuuugccauuagccaag

SEQ ID NO: 548626 - RNA, 17 nt, Homo sapiens
uuuugcucaguuccaug

SEQ ID NO: 548627 - RNA, 13 nt, Homo sapiens
uuuugcuguagaa

SEQ ID NO: 548628 - RNA, 14 nt, Homo sapiens
aauaauuugcacug

SEQ ID NO: 548629 - RNA, 12 nt, Homo sapiens
aauacaaaaaug

SEQ ID NO: 548630 - RNA, 12 nt, Homo sapiens
aauacaaaaauu

SEQ ID NO: 548631 - RNA, 14 nt, Homo sapiens
aauacaacauguag

SEQ ID NO: 548632 - RNA, 17 nt, Homo sapiens
aauacaacuccuauuca

SEQ ID NO: 548633 - RNA, 19 nt, Homo sapiens
aauacaauauuaaguccaa

SEQ ID NO: 548634 - RNA, 15 nt, Homo sapiens
aauacaauguacaau

SEQ ID NO: 548635 - RNA, 16 nt, Homo sapiens
aauacaauguacaauu

SEQ ID NO: 548636 - RNA, 16 nt, Homo sapiens
aauacacaacacacac

SEQ ID NO: 548637 - RNA, 20 nt, Homo sapiens
aauacacaauccuccaagaa

SEQ ID NO: 548638 - RNA, 11 nt, Homo sapiens
aauacacaauu

SEQ ID NO: 548639 - RNA, 13 nt, Homo sapiens
aauacagaaucaa

SEQ ID NO: 548640 - RNA, 18 nt, Homo sapiens
aauacagcuucauuaucu

SEQ ID NO: 548641 - RNA, 17 nt, Homo sapiens
aauacagggcaugcauu

SEQ ID NO: 548642 - RNA, 17 nt, Homo sapiens
aauacaguagaagcuca

SEQ ID NO: 548643 - RNA, 17 nt, Homo sapiens
aauacaguaucucaggg

SEQ ID NO: 548644 - RNA, 21 nt, Homo sapiens
aauacaugaaaugucuggucu

SEQ ID NO: 548645 - RNA, 21 nt, Homo sapiens
aauacaugaagcuucaugcac

SEQ ID NO: 548646 - RNA, 13 nt, Homo sapiens
aauacauguucau

SEQ ID NO: 548647 - RNA, 19 nt, Homo sapiens
aauacauuuaaaacauuaa

SEQ ID NO: 548648 - RNA, 20 nt, Homo sapiens
aauaccauaggaagacauaa

SEQ ID NO: 548649 - RNA, 21 nt, Homo sapiens
aauaccauggguuauuuaugc

SEQ ID NO: 548650 - RNA, 18 nt, Homo sapiens
aauaccauuaaaacugcu

SEQ ID NO: 548651 - RNA, 14 nt, Homo sapiens
aauacccuagaaga

SEQ ID NO: 548652 - RNA, 21 nt, Homo sapiens
aauaccuagaccuaaacggcu

SEQ ID NO: 548653 - RNA, 20 nt, Homo sapiens
aauaccucaaccuaugguau

SEQ ID NO: 548654 - RNA, 23 nt, Homo sapiens
aauaccuccaaagauauuuucag

SEQ ID NO: 548655 - RNA, 19 nt, Homo sapiens
aauaccuccuccagaucag

SEQ ID NO: 548656 - RNA, 18 nt, Homo sapiens
aauacgguaaggauacuu

SEQ ID NO: 548657 - RNA, 14 nt, Homo sapiens
aauacguacauguu

SEQ ID NO: 548658 - RNA, 15 nt, Homo sapiens
aauacuaaacuacau

SEQ ID NO: 548659 - RNA, 18 nt, Homo sapiens
aauacuaugcaguaucuc

SEQ ID NO: 548660 - RNA, 16 nt, Homo sapiens
aauacucugcagugau

SEQ ID NO: 548661 - RNA, 18 nt, Homo sapiens
aauacucugcagugauua

SEQ ID NO: 548662 - RNA, 21 nt, Homo sapiens
aauacugcagagggacagaug

SEQ ID NO: 548663 - RNA, 18 nt, Homo sapiens
aauacugccggucaccca

SEQ ID NO: 548664 - RNA, 17 nt, Homo sapiens
aauacugcuacagcaau

SEQ ID NO: 548665 - RNA, 13 nt, Homo sapiens
aauacuggccaug

SEQ ID NO: 548666 - RNA, 17 nt, Homo sapiens
aauacuguaggaacaag

SEQ ID NO: 548667 - RNA, 14 nt, Homo sapiens
aauacuuacuauaa

SEQ ID NO: 548668 - RNA, 24 nt, Homo sapiens
aauacuugaauauggaacauaugc

SEQ ID NO: 548669 - RNA, 18 nt, Homo sapiens
aauacuuuacaaaccauu

SEQ ID NO: 548670 - RNA, 11 nt, Homo sapiens
aauacuuucag

SEQ ID NO: 548671 - RNA, 13 nt, Homo sapiens
aauacuuuugcug

SEQ ID NO: 548672 - RNA, 16 nt, Homo sapiens
aauacuuuugcugaug

SEQ ID NO: 548673 - RNA, 19 nt, Homo sapiens
aauaugggcucaagucacu

SEQ ID NO: 548674 - RNA, 18 nt, Homo sapiens
aauauggguugcauuugg

SEQ ID NO: 548675 - RNA, 22 nt, Homo sapiens
aauauguaauuucaaaauacau

SEQ ID NO: 548676 - RNA, 12 nt, Homo sapiens
aauauguacaag

SEQ ID NO: 548677 - RNA, 19 nt, Homo sapiens
aauaugucaccuggcacau

SEQ ID NO: 548678 - RNA, 12 nt, Homo sapiens
aauaugugaaug

SEQ ID NO: 548679 - RNA, 11 nt, Homo sapiens
aauaugugcuu

SEQ ID NO: 548680 - RNA, 20 nt, Homo sapiens
aauauguucuuuuaaaugau

SEQ ID NO: 548681 - RNA, 17 nt, Homo sapiens
aauauguuugugccuua

SEQ ID NO: 548682 - RNA, 20 nt, Homo sapiens
aauauuaccaacuacauugg

SEQ ID NO: 548683 - RNA, 17 nt, Homo sapiens
aauauuauguuccucaa

SEQ ID NO: 548684 - RNA, 18 nt, Homo sapiens
aauauuauuccucaaaaa

SEQ ID NO: 548685 - RNA, 13 nt, Homo sapiens
aauauuccuuuau

SEQ ID NO: 548686 - RNA, 22 nt, Homo sapiens
aauauuccuuuauuuugcugcu

SEQ ID NO: 548687 - RNA, 15 nt, Homo sapiens
aauauuccuuugcau

SEQ ID NO: 548688 - RNA, 14 nt, Homo sapiens
aauauucuugucca

SEQ ID NO: 548689 - RNA, 19 nt, Homo sapiens
aauauugauguuaacaaga

SEQ ID NO: 548690 - RNA, 22 nt, Homo sapiens
aauauugccaaugcuacaguaa

SEQ ID NO: 548691 - RNA, 19 nt, Homo sapiens
aauauugcugaacuacuuu

SEQ ID NO: 548692 - RNA, 17 nt, Homo sapiens
aauauuguaaauacugg

SEQ ID NO: 548693 - RNA, 17 nt, Homo sapiens
aauauuguauacuacca

SEQ ID NO: 548694 - RNA, 23 nt, Homo sapiens
aauauuguccauuguccaauccu

SEQ ID NO: 548695 - RNA, 23 nt, Homo sapiens
aauauuguucuauuuguauauau

SEQ ID NO: 548696 - RNA, 22 nt, Homo sapiens
aauauuguugacaacugugacu

SEQ ID NO: 548697 - RNA, 23 nt, Homo sapiens
aauauuguugacaacugugacug

SEQ ID NO: 548698 - RNA, 18 nt, Homo sapiens
aauauuuaaacagcagug

SEQ ID NO: 548699 - RNA, 14 nt, Homo sapiens
aauauuuaccagac

SEQ ID NO: 548700 - RNA, 23 nt, Homo sapiens
aauauuuacuaacuaaauaccau

SEQ ID NO: 548701 - RNA, 17 nt, Homo sapiens
aauauuuauuaccucug

SEQ ID NO: 548702 - RNA, 20 nt, Homo sapiens
aauauuuauuauuuucaccu

SEQ ID NO: 548703 - RNA, 11 nt, Homo sapiens
aauauuuccau

SEQ ID NO: 548704 - RNA, 23 nt, Homo sapiens
aauauuuccaucagcccaucuca

SEQ ID NO: 548705 - RNA, 20 nt, Homo sapiens
aauauuuuacauacacugua

SEQ ID NO: 548706 - RNA, 15 nt, Homo sapiens
aauauuuuagccuua

SEQ ID NO: 548707 - RNA, 21 nt, Homo sapiens
aauauuuuguaaugcugcaca

SEQ ID NO: 548708 - RNA, 23 nt, Homo sapiens
aauauuuuuauaucaugcaaaau

SEQ ID NO: 548709 - RNA, 17 nt, Homo sapiens
aauauuuuuaugugcaa

SEQ ID NO: 548710 - RNA, 19 nt, Homo sapiens
aauauuuuuaugugcaaua

SEQ ID NO: 548711 - RNA, 21 nt, Homo sapiens
aaucaaaauugucucuucuga

SEQ ID NO: 548712 - RNA, 15 nt, Homo sapiens
aaucaaagaauuaca

SEQ ID NO: 548713 - RNA, 22 nt, Homo sapiens
aaucaaagugucuagacauauu

SEQ ID NO: 548714 - RNA, 22 nt, Homo sapiens
aaucaaaucucuuccacauggg

SEQ ID NO: 548715 - RNA, 17 nt, Homo sapiens
acaggcgcaacuccucc

SEQ ID NO: 548716 - RNA, 15 nt, Homo sapiens
acaggcgugagccac

SEQ ID NO: 548717 - RNA, 18 nt, Homo sapiens
acagggaagaaacuuucu

SEQ ID NO: 548718 - RNA, 19 nt, Homo sapiens
acagggacaugcccugugu

SEQ ID NO: 548719 - RNA, 15 nt, Homo sapiens
acagggagugcacau

SEQ ID NO: 548720 - RNA, 15 nt, Homo sapiens
acagggcaguccuua

SEQ ID NO: 548721 - RNA, 15 nt, Homo sapiens
acagggcauggccag

SEQ ID NO: 548722 - RNA, 17 nt, Homo sapiens
acagggccacaacugcc

SEQ ID NO: 548723 - RNA, 17 nt, Homo sapiens
acagggccagugcaguu

SEQ ID NO: 548724 - RNA, 20 nt, Homo sapiens
acagggcgagacuccgucuc

SEQ ID NO: 548725 - RNA, 15 nt, Homo sapiens
acagggcucacaggg

SEQ ID NO: 548726 - RNA, 19 nt, Homo sapiens
acaggggccccagaucugc

SEQ ID NO: 548727 - RNA, 20 nt, Homo sapiens
acagggucucuagugcugug

SEQ ID NO: 548728 - RNA, 19 nt, Homo sapiens
acagggucugcucuuucuc

SEQ ID NO: 548729 - RNA, 14 nt, Homo sapiens
acagggugcuccuu

SEQ ID NO: 548730 - RNA, 21 nt, Homo sapiens
acaggguuuuguauucuuuac

SEQ ID NO: 548731 - RNA, 23 nt, Homo sapiens
acagguaucauuaacugccacuu

SEQ ID NO: 548732 - RNA, 21 nt, Homo sapiens
acagguggggccucagccugg

SEQ ID NO: 548733 - RNA, 14 nt, Homo sapiens
acagguucucacua

SEQ ID NO: 548734 - RNA, 17 nt, Homo sapiens
acaguaacugccaucaa

SEQ ID NO: 548735 - RNA, 12 nt, Homo sapiens
acaguaagcaua

SEQ ID NO: 548736 - RNA, 22 nt, Homo sapiens
acaguaauaaauuaaaccaaca

SEQ ID NO: 548737 - RNA, 12 nt, Homo sapiens
acaguaauguca

SEQ ID NO: 548738 - RNA, 18 nt, Homo sapiens
acaguaccggauucucuc

SEQ ID NO: 548739 - RNA, 12 nt, Homo sapiens
acaguaccugau

SEQ ID NO: 548740 - RNA, 13 nt, Homo sapiens
acaguagaagcuc

SEQ ID NO: 548741 - RNA, 16 nt, Homo sapiens
acaguaggauguggaa

SEQ ID NO: 548742 - RNA, 16 nt, Homo sapiens
acaguaucccacaucc

SEQ ID NO: 548743 - RNA, 14 nt, Homo sapiens
acaguaucucaggg

SEQ ID NO: 548744 - RNA, 18 nt, Homo sapiens
acaguaugagucaaugug

SEQ ID NO: 548745 - RNA, 21 nt, Homo sapiens
acaguaugagucaaugugcag

SEQ ID NO: 548746 - RNA, 19 nt, Homo sapiens
acagucaauggauccacaa

SEQ ID NO: 548747 - RNA, 22 nt, Homo sapiens
acagucacugauguacaauuaa

SEQ ID NO: 548748 - RNA, 12 nt, Homo sapiens
acagucagcucu

SEQ ID NO: 548749 - RNA, 12 nt, Homo sapiens
acagucagugac

SEQ ID NO: 548750 - RNA, 17 nt, Homo sapiens
acagucauguaugcaag

SEQ ID NO: 548751 - RNA, 16 nt, Homo sapiens
acaguccaagcccugg

SEQ ID NO: 548752 - RNA, 18 nt, Homo sapiens
acaguccacaggggccac

SEQ ID NO: 548753 - RNA, 19 nt, Homo sapiens
acagucccccacccaccuc

SEQ ID NO: 548754 - RNA, 15 nt, Homo sapiens
acagucccuauggaa

SEQ ID NO: 548755 - RNA, 16 nt, Homo sapiens
acaguccuauguacag

SEQ ID NO: 548756 - RNA, 21 nt, Homo sapiens
acaguccuguccucuggauca

SEQ ID NO: 548757 - RNA, 16 nt, Homo sapiens
acaguccuugggguua

SEQ ID NO: 548758 - RNA, 16 nt, Homo sapiens
acagucucuuucuucc

SEQ ID NO: 548759 - RNA, 18 nt, Homo sapiens
acagucugagacuccuca

SEQ ID NO: 548760 - RNA, 21 nt, Homo sapiens
acagugaaauacauccuucaa

SEQ ID NO: 548761 - RNA, 18 nt, Homo sapiens
acagugaagcagcacugu

SEQ ID NO: 548762 - RNA, 20 nt, Homo sapiens
acagugaagcagcacuguga

SEQ ID NO: 548763 - RNA, 22 nt, Homo sapiens
acagugaagcagcacugugagu

SEQ ID NO: 548764 - RNA, 18 nt, Homo sapiens
acagugacuucugagauc

SEQ ID NO: 548765 - RNA, 17 nt, Homo sapiens
acagugagaaagggcau

SEQ ID NO: 548766 - RNA, 12 nt, Homo sapiens
acagugaugccg

SEQ ID NO: 548767 - RNA, 11 nt, Homo sapiens
acagugcaguu

SEQ ID NO: 548768 - RNA, 13 nt, Homo sapiens
acagugcaguuua

SEQ ID NO: 548769 - RNA, 15 nt, Homo sapiens
acagugcauuugccu

SEQ ID NO: 548770 - RNA, 15 nt, Homo sapiens
acagugccaacuccu

SEQ ID NO: 548771 - RNA, 17 nt, Homo sapiens
acagugccaacuccuca

SEQ ID NO: 548772 - RNA, 11 nt, Homo sapiens
acagugcuuug

SEQ ID NO: 548773 - RNA, 13 nt, Homo sapiens
acaguggacaaag

SEQ ID NO: 548774 - RNA, 20 nt, Homo sapiens
acaguguaggcauuuaacuc

SEQ ID NO: 548775 - RNA, 14 nt, Homo sapiens
acaguguugcccag

SEQ ID NO: 548776 - RNA, 19 nt, Homo sapiens
acaguguuuuuauugcucg

SEQ ID NO: 548777 - RNA, 14 nt, Homo sapiens
acaguucugaagaa

SEQ ID NO: 548778 - RNA, 16 nt, Homo sapiens
acaguucugucauaug

SEQ ID NO: 548779 - RNA, 14 nt, Homo sapiens
acaguucugugguu

SEQ ID NO: 548780 - RNA, 20 nt, Homo sapiens
acaguuuagugcuuuacaug

SEQ ID NO: 548781 - RNA, 22 nt, Homo sapiens
acaguuugccugcuguauuuau

SEQ ID NO: 548782 - RNA, 17 nt, Homo sapiens
acaguuuuaacugugga

SEQ ID NO: 548783 - RNA, 18 nt, Homo sapiens
acaguuuuaacuguggau

SEQ ID NO: 548784 - RNA, 20 nt, Homo sapiens
acaguuuuacaauagacauu

SEQ ID NO: 548785 - RNA, 11 nt, Homo sapiens
acaguuuucag

SEQ ID NO: 548786 - RNA, 15 nt, Homo sapiens
acaguuuucuauucu

SEQ ID NO: 548787 - RNA, 23 nt, Homo sapiens
acauaaaaaauaaaguaccacac

SEQ ID NO: 548788 - RNA, 13 nt, Homo sapiens
acauaaaaaccaa

SEQ ID NO: 548789 - RNA, 20 nt, Homo sapiens
acauaaaacaaaaccaagcc

SEQ ID NO: 548790 - RNA, 21 nt, Homo sapiens
acauaaaagaauuuuuuuguc

SEQ ID NO: 548791 - RNA, 17 nt, Homo sapiens
acauaaaauaagagauc

SEQ ID NO: 548792 - RNA, 13 nt, Homo sapiens
acauaaacuguca

SEQ ID NO: 548793 - RNA, 15 nt, Homo sapiens
acauaaagacugugc

SEQ ID NO: 548794 - RNA, 13 nt, Homo sapiens
acauaaccaacau

SEQ ID NO: 548795 - RNA, 23 nt, Homo sapiens
acauaacuaguggcucucaguua

SEQ ID NO: 548796 - RNA, 20 nt, Homo sapiens
acauaacuccaucuacaccu

SEQ ID NO: 548797 - RNA, 13 nt, Homo sapiens
acauaacuugaua

SEQ ID NO: 548798 - RNA, 12 nt, Homo sapiens
acauaagacaga

SEQ ID NO: 548799 - RNA, 21 nt, Homo sapiens
acauaagacagacagcaguuu

SEQ ID NO: 548800 - RNA, 22 nt, Homo sapiens
acauaaguguugguagcacuua

SEQ ID NO: 548801 - RNA, 14 nt, Homo sapiens
acauaaguuccuau

SEQ ID NO: 548802 - RNA, 23 nt, Homo sapiens
acauaauaauagcagugguaaaa

SEQ ID NO: 548803 - RNA, 14 nt, Homo sapiens
acauaaucauggau

SEQ ID NO: 548804 - RNA, 17 nt, Homo sapiens
acauaaugcgugcauac

SEQ ID NO: 548805 - RNA, 23 nt, Homo sapiens
acauaauuccagucacaguuuuu

SEQ ID NO: 548806 - RNA, 13 nt, Homo sapiens
aagucuccaguca

SEQ ID NO: 548807 - RNA, 20 nt, Homo sapiens
aagucuccagucaccuacaa

SEQ ID NO: 548808 - RNA, 18 nt, Homo sapiens
aagucugggauguagaac

SEQ ID NO: 548809 - RNA, 23 nt, Homo sapiens
aagucugggauguagaacuucaa

SEQ ID NO: 548810 - RNA, 16 nt, Homo sapiens
aagucuucagggaagg

SEQ ID NO: 548811 - RNA, 14 nt, Homo sapiens
aagucuuccacuuu

SEQ ID NO: 548812 - RNA, 16 nt, Homo sapiens
aagugaaccaucucag

SEQ ID NO: 548813 - RNA, 13 nt, Homo sapiens
aagugaacuauga

SEQ ID NO: 548814 - RNA, 14 nt, Homo sapiens
aagugaacuugaug

SEQ ID NO: 548815 - RNA, 17 nt, Homo sapiens
aagugaagacaaugacu

SEQ ID NO: 548816 - RNA, 18 nt, Homo sapiens
aagugaagagauccuucu

SEQ ID NO: 548817 - RNA, 13 nt, Homo sapiens
aagugaauaaccu

SEQ ID NO: 548818 - RNA, 19 nt, Homo sapiens
aagugagaaaaugccucaa

SEQ ID NO: 548819 - RNA, 23 nt, Homo sapiens
aagugagcagagauguacugcaa

SEQ ID NO: 548820 - RNA, 19 nt, Homo sapiens
aagugaggggaacagggug

SEQ ID NO: 548821 - RNA, 15 nt, Homo sapiens
aagugaucaaacuac

SEQ ID NO: 548822 - RNA, 19 nt, Homo sapiens
aagugauccuuccaccuca

SEQ ID NO: 548823 - RNA, 19 nt, Homo sapiens
aagugauucuuccaccuca

SEQ ID NO: 548824 - RNA, 17 nt, Homo sapiens
aagugcauauuuaucca

SEQ ID NO: 548825 - RNA, 12 nt, Homo sapiens
aagugcaucuac

SEQ ID NO: 548826 - RNA, 21 nt, Homo sapiens
aagugcccaacugcagaccaa

SEQ ID NO: 548827 - RNA, 16 nt, Homo sapiens
aagugccuuuaucuca

SEQ ID NO: 548828 - RNA, 14 nt, Homo sapiens
aagugcgugaaugu

SEQ ID NO: 548829 - RNA, 23 nt, Homo sapiens
aagugcgugccgugugaguguga

SEQ ID NO: 548830 - RNA, 22 nt, Homo sapiens
aagugcuggaacuuuagugaaa

SEQ ID NO: 548831 - RNA, 23 nt, Homo sapiens
aagugcugggauuacagguguga

SEQ ID NO: 548832 - RNA, 20 nt, Homo sapiens
aagugcugugcaagguauua

SEQ ID NO: 548833 - RNA, 11 nt, Homo sapiens
aagugcuguuu

SEQ ID NO: 548834 - RNA, 16 nt, Homo sapiens
aaguggaaaaugcaau

SEQ ID NO: 548835 - RNA, 18 nt, Homo sapiens
aaguggaaacaacccaaa

SEQ ID NO: 548836 - RNA, 19 nt, Homo sapiens
aaguggaguugacucugga

SEQ ID NO: 548837 - RNA, 13 nt, Homo sapiens
aaguggauuacaa

SEQ ID NO: 548838 - RNA, 15 nt, Homo sapiens
aaguggcaagaccaa

SEQ ID NO: 548839 - RNA, 12 nt, Homo sapiens
aaguggcagcuu

SEQ ID NO: 548840 - RNA, 15 nt, Homo sapiens
aagugggcagucacc

SEQ ID NO: 548841 - RNA, 19 nt, Homo sapiens
aaguggggaaguguuccag

SEQ ID NO: 548842 - RNA, 13 nt, Homo sapiens
aagugggugaaug

SEQ ID NO: 548843 - RNA, 18 nt, Homo sapiens
aagugguaaauacuguga

SEQ ID NO: 548844 - RNA, 16 nt, Homo sapiens
aagugguuacuuugug

SEQ ID NO: 548845 - RNA, 16 nt, Homo sapiens
aagugguugcauucua

SEQ ID NO: 548846 - RNA, 11 nt, Homo sapiens
aaguguacaau

SEQ ID NO: 548847 - RNA, 14 nt, Homo sapiens
aaguguacaugugu

SEQ ID NO: 548848 - RNA, 15 nt, Homo sapiens
aagugucaacucuuu

SEQ ID NO: 548849 - RNA, 21 nt, Homo sapiens
aaguguccccuauggggaugg

SEQ ID NO: 548850 - RNA, 18 nt, Homo sapiens
aagugucuacaugugcca

SEQ ID NO: 548851 - RNA, 17 nt, Homo sapiens
aagugucucugccuuga

SEQ ID NO: 548852 - RNA, 21 nt, Homo sapiens
aagugucugugugcaagugug

SEQ ID NO: 548853 - RNA, 21 nt, Homo sapiens
aagugugcuggccucucugac

SEQ ID NO: 548854 - RNA, 13 nt, Homo sapiens
aagugugugcaug

SEQ ID NO: 548855 - RNA, 23 nt, Homo sapiens
aagugugugccaccaugccucac

SEQ ID NO: 548856 - RNA, 21 nt, Homo sapiens
aaguguuaaggcaacauuccu

SEQ ID NO: 548857 - RNA, 20 nt, Homo sapiens
aaguguucacaacagugaaa

SEQ ID NO: 548858 - RNA, 19 nt, Homo sapiens
aaguguuguguuccuggcu

SEQ ID NO: 548859 - RNA, 16 nt, Homo sapiens
aaguguuuagcuguca

SEQ ID NO: 548860 - RNA, 20 nt, Homo sapiens
aaguguuuguuggcaauuau

SEQ ID NO: 548861 - RNA, 16 nt, Homo sapiens
aaguguuuuuuauuga

SEQ ID NO: 548862 - RNA, 17 nt, Homo sapiens
aaguuaaaacaaaggaa

SEQ ID NO: 548863 - RNA, 14 nt, Homo sapiens
aaguuacauuguua

SEQ ID NO: 548864 - RNA, 14 nt, Homo sapiens
aaguuacuacugau

SEQ ID NO: 548865 - RNA, 20 nt, Homo sapiens
aaguuacuagguaacuucau

SEQ ID NO: 548866 - RNA, 17 nt, Homo sapiens
aaguuacuuaauugcca

SEQ ID NO: 548867 - RNA, 12 nt, Homo sapiens
aaguuacuuuau

SEQ ID NO: 548868 - RNA, 13 nt, Homo sapiens
aaguuacuuuaug

SEQ ID NO: 548869 - RNA, 14 nt, Homo sapiens
aaguuagccuccac

SEQ ID NO: 548870 - RNA, 14 nt, Homo sapiens
aaguuagucaaucc

SEQ ID NO: 548871 - RNA, 20 nt, Homo sapiens
aaguuagucaauccugucau

SEQ ID NO: 548872 - RNA, 22 nt, Homo sapiens
aaguuagucaauccugucauau

SEQ ID NO: 548873 - RNA, 18 nt, Homo sapiens
aaguuaguuccacugaga

SEQ ID NO: 548874 - RNA, 22 nt, Homo sapiens
aaguuauacuguggcuaugcaa

SEQ ID NO: 548875 - RNA, 14 nt, Homo sapiens
aaguuauugauguu

SEQ ID NO: 548876 - RNA, 23 nt, Homo sapiens
aaguuauuuacuuuuaccacuau

SEQ ID NO: 548877 - RNA, 17 nt, Homo sapiens
aaguucaggcucugaga

SEQ ID NO: 548878 - RNA, 20 nt, Homo sapiens
aaguucagugauaacucuga

SEQ ID NO: 548879 - RNA, 14 nt, Homo sapiens
aaguucauaggguc

SEQ ID NO: 548880 - RNA, 18 nt, Homo sapiens
aauaaaaugguacauuuc

SEQ ID NO: 548881 - RNA, 13 nt, Homo sapiens
aauaaaauguuau

SEQ ID NO: 548882 - RNA, 18 nt, Homo sapiens
aauaaaauuuaggaccaa

SEQ ID NO: 548883 - RNA, 12 nt, Homo sapiens
aauaaaccacuu

SEQ ID NO: 548884 - RNA, 17 nt, Homo sapiens
aauaaacuagacucuga

SEQ ID NO: 548885 - RNA, 19 nt, Homo sapiens
aauaaacuagauuacauuc

SEQ ID NO: 548886 - RNA, 13 nt, Homo sapiens
aauaaacuccuac

SEQ ID NO: 548887 - RNA, 15 nt, Homo sapiens
aauaaacuccuacua

SEQ ID NO: 548888 - RNA, 18 nt, Homo sapiens
aauaaacuccuacuaaau

SEQ ID NO: 548889 - RNA, 20 nt, Homo sapiens
aauaaacuguguuuacucag

SEQ ID NO: 548890 - RNA, 20 nt, Homo sapiens
aauaaagaauuaacagagau

SEQ ID NO: 548891 - RNA, 21 nt, Homo sapiens
aauaaagacauuuccuaccug

SEQ ID NO: 548892 - RNA, 15 nt, Homo sapiens
aauaaagcaaugugg

SEQ ID NO: 548893 - RNA, 13 nt, Homo sapiens
aauaaaggaagca

SEQ ID NO: 548894 - RNA, 13 nt, Homo sapiens
aauaaagguuuaa

SEQ ID NO: 548895 - RNA, 14 nt, Homo sapiens
aauaaaguccugac

SEQ ID NO: 548896 - RNA, 13 nt, Homo sapiens
aauaaaguuauuc

SEQ ID NO: 548897 - RNA, 18 nt, Homo sapiens
aauaaaguucuguacuca

SEQ ID NO: 548898 - RNA, 13 nt, Homo sapiens
aauaaauaauuaa

SEQ ID NO: 548899 - RNA, 17 nt, Homo sapiens
aauaaauaauucuuccu

SEQ ID NO: 548900 - RNA, 13 nt, Homo sapiens
aauaaauacgugu

SEQ ID NO: 548901 - RNA, 22 nt, Homo sapiens
aauaaauagcuauauccaugua

SEQ ID NO: 548902 - RNA, 15 nt, Homo sapiens
aauaaauauuacagu

SEQ ID NO: 548903 - RNA, 15 nt, Homo sapiens
aauaaaucuuuggaa

SEQ ID NO: 548904 - RNA, 12 nt, Homo sapiens
aauaaaugacaa

SEQ ID NO: 548905 - RNA, 22 nt, Homo sapiens
aauaaaugagagggaaucgacu

SEQ ID NO: 548906 - RNA, 16 nt, Homo sapiens
aauaaauguacauuaa

SEQ ID NO: 548907 - RNA, 15 nt, Homo sapiens
aauaaaugucacugc

SEQ ID NO: 548908 - RNA, 16 nt, Homo sapiens
aauaaaugucuugccu

SEQ ID NO: 548909 - RNA, 14 nt, Homo sapiens
aauaaauguugcca

SEQ ID NO: 548910 - RNA, 22 nt, Homo sapiens
aauaaauucagccaacauguga

SEQ ID NO: 548911 - RNA, 15 nt, Homo sapiens
aauaaauucuaccuc

SEQ ID NO: 548912 - RNA, 22 nt, Homo sapiens
aauaaauugacauaaccaacau

SEQ ID NO: 548913 - RNA, 16 nt, Homo sapiens
aauaacaaagcacaua

SEQ ID NO: 548914 - RNA, 12 nt, Homo sapiens
aauaacacuguc

SEQ ID NO: 548915 - RNA, 15 nt, Homo sapiens
aauaacaggcauuug

SEQ ID NO: 548916 - RNA, 14 nt, Homo sapiens
aauaacaguauuuu

SEQ ID NO: 548917 - RNA, 18 nt, Homo sapiens
aauaacauuuaaauucca

SEQ ID NO: 548918 - RNA, 22 nt, Homo sapiens
aauaacauuuaaauuccacaga

SEQ ID NO: 548919 - RNA, 17 nt, Homo sapiens
aauaacauuuuauacaa

SEQ ID NO: 548920 - RNA, 23 nt, Homo sapiens
aauaacgggcugcccucagcuca

SEQ ID NO: 548921 - RNA, 23 nt, Homo sapiens
aauaacuaaaagguaugcaauca

SEQ ID NO: 548922 - RNA, 18 nt, Homo sapiens
aauaacucuccaguaaca

SEQ ID NO: 548923 - RNA, 12 nt, Homo sapiens
aauaacuugaag

SEQ ID NO: 548924 - RNA, 17 nt, Homo sapiens
aauaagaaacaugaugu

SEQ ID NO: 548925 - RNA, 20 nt, Homo sapiens
aauaagaagggggagugaaa

SEQ ID NO: 548926 - RNA, 22 nt, Homo sapiens
aauaagauguaguaacacugug

SEQ ID NO: 548927 - RNA, 13 nt, Homo sapiens
aauaagcaaaaag

SEQ ID NO: 548928 - RNA, 14 nt, Homo sapiens
aauaagcaggaugu

SEQ ID NO: 548929 - RNA, 22 nt, Homo sapiens
aauaagcuuuuaaacaagucau

SEQ ID NO: 548930 - RNA, 13 nt, Homo sapiens
aauaaggcacaaa

SEQ ID NO: 548931 - RNA, 15 nt, Homo sapiens
aauaaggcccagagc

SEQ ID NO: 548932 - RNA, 15 nt, Homo sapiens
aauaaguacauauag

SEQ ID NO: 548933 - RNA, 15 nt, Homo sapiens
aauaaguacugugua

SEQ ID NO: 548934 - RNA, 17 nt, Homo sapiens
aauaagugcuuuccuua

SEQ ID NO: 548935 - RNA, 16 nt, Homo sapiens
aauaaguuuguguuag

SEQ ID NO: 548936 - RNA, 19 nt, Homo sapiens
aauaaguuuucaguggacu

SEQ ID NO: 548937 - RNA, 20 nt, Homo sapiens
aauaaguuuucaguggacua

SEQ ID NO: 548938 - RNA, 14 nt, Homo sapiens
aauaauaaacagug

SEQ ID NO: 548939 - RNA, 21 nt, Homo sapiens
aauaauaaagaauagcuuuaa

SEQ ID NO: 548940 - RNA, 21 nt, Homo sapiens
aauaauaaaguagcaaaacaa

SEQ ID NO: 548941 - RNA, 15 nt, Homo sapiens
aauaauaaaucuggu

SEQ ID NO: 548942 - RNA, 14 nt, Homo sapiens
aauaauaccuaagc

SEQ ID NO: 548943 - RNA, 17 nt, Homo sapiens
aauaauaucccacuggg

SEQ ID NO: 548944 - RNA, 22 nt, Homo sapiens
aauaauaugaugccacuuugca

SEQ ID NO: 548945 - RNA, 18 nt, Homo sapiens
aauaauaugcugccaaau

SEQ ID NO: 548946 - RNA, 15 nt, Homo sapiens
aauaauauuagcuua

SEQ ID NO: 548947 - RNA, 16 nt, Homo sapiens
aauaaucaaugcaguu

SEQ ID NO: 548948 - RNA, 12 nt, Homo sapiens
aauaaugaagua

SEQ ID NO: 548949 - RNA, 14 nt, Homo sapiens
aauaaugacacucc

SEQ ID NO: 548950 - RNA, 20 nt, Homo sapiens
aauaauguuguaauucaugc

SEQ ID NO: 548951 - RNA, 22 nt, Homo sapiens
aauaauuaaagcuuaaacugaa

SEQ ID NO: 548952 - RNA, 13 nt, Homo sapiens
aauaauucaaguc

SEQ ID NO: 548953 - RNA, 14 nt, Homo sapiens
aauaauugauuuca

SEQ ID NO: 548954 - RNA, 15 nt, Homo sapiens
aauaauugauuucaa

SEQ ID NO: 548955 - RNA, 18 nt, Homo sapiens
aauaauugcucauaagca

SEQ ID NO: 548956 - RNA, 20 nt, Homo sapiens
aauaauugcucauaagcaau

SEQ ID NO: 548957 - RNA, 19 nt, Homo sapiens
acauaucuacacuucgcac

SEQ ID NO: 548958 - RNA, 17 nt, Homo sapiens
acauauuaggaaaauau

SEQ ID NO: 548959 - RNA, 17 nt, Homo sapiens
acauauucaaugcaagu

SEQ ID NO: 548960 - RNA, 22 nt, Homo sapiens
acauauuuaagagauacuugau

SEQ ID NO: 548961 - RNA, 16 nt, Homo sapiens
acauauuuguggaaua

SEQ ID NO: 548962 - RNA, 21 nt, Homo sapiens
acaucaaguaugguaggggag

SEQ ID NO: 548963 - RNA, 12 nt, Homo sapiens
acaucaauguuc

SEQ ID NO: 548964 - RNA, 13 nt, Homo sapiens
acaucaauguuca

SEQ ID NO: 548965 - RNA, 14 nt, Homo sapiens
acaucaauguucau

SEQ ID NO: 548966 - RNA, 22 nt, Homo sapiens
acaucaauuucuaaauacuuuu

SEQ ID NO: 548967 - RNA, 14 nt, Homo sapiens
acaucacauuccca

SEQ ID NO: 548968 - RNA, 12 nt, Homo sapiens
acaucaccuuuu

SEQ ID NO: 548969 - RNA, 15 nt, Homo sapiens
acaucacucugcugc

SEQ ID NO: 548970 - RNA, 19 nt, Homo sapiens
acaucagcaaacaggauca

SEQ ID NO: 548971 - RNA, 14 nt, Homo sapiens
acaucagcaagacu

SEQ ID NO: 548972 - RNA, 17 nt, Homo sapiens
acaucagcaauuucaga

SEQ ID NO: 548973 - RNA, 16 nt, Homo sapiens
acaucagcuaguggcu

SEQ ID NO: 548974 - RNA, 16 nt, Homo sapiens
acaucaguauaguguu

SEQ ID NO: 548975 - RNA, 16 nt, Homo sapiens
acaucaguuacucuga

SEQ ID NO: 548976 - RNA, 20 nt, Homo sapiens
acaucaguuguuuguuugau

SEQ ID NO: 548977 - RNA, 17 nt, Homo sapiens
acaucauucaugacaac

SEQ ID NO: 548978 - RNA, 22 nt, Homo sapiens
acauccaaccccccaccugcca

SEQ ID NO: 548979 - RNA, 21 nt, Homo sapiens
acauccguugugcuugccugc

SEQ ID NO: 548980 - RNA, 22 nt, Homo sapiens
acauccucugucuauuugagac

SEQ ID NO: 548981 - RNA, 18 nt, Homo sapiens
acauccuguaagugcuua

SEQ ID NO: 548982 - RNA, 17 nt, Homo sapiens
acauccuuaagucaaaa

SEQ ID NO: 548983 - RNA, 17 nt, Homo sapiens
acaucgugaaacccugu

SEQ ID NO: 548984 - RNA, 17 nt, Homo sapiens
acaucguugagacauca

SEQ ID NO: 548985 - RNA, 13 nt, Homo sapiens
acaucuaaugucu

SEQ ID NO: 548986 - RNA, 17 nt, Homo sapiens
acaucucaggggccaga

SEQ ID NO: 548987 - RNA, 18 nt, Homo sapiens
acaucuccccucuacccc

SEQ ID NO: 548988 - RNA, 21 nt, Homo sapiens
acaucuccccucucaccucau

SEQ ID NO: 548989 - RNA, 21 nt, Homo sapiens
acaucuccuccauacucagga

SEQ ID NO: 548990 - RNA, 20 nt, Homo sapiens
acaucucgggaguccucuag

SEQ ID NO: 548991 - RNA, 23 nt, Homo sapiens
acaucucugcaguuuuucccaag

SEQ ID NO: 548992 - RNA, 22 nt, Homo sapiens
acaucucugcuuucacucuuua

SEQ ID NO: 548993 - RNA, 13 nt, Homo sapiens
acaucugcaauau

SEQ ID NO: 548994 - RNA, 16 nt, Homo sapiens
acaucugcacuccuga

SEQ ID NO: 548995 - RNA, 22 nt, Homo sapiens
acaucugcacuccugaacacac

SEQ ID NO: 548996 - RNA, 15 nt, Homo sapiens
acaucugcauuuuca

SEQ ID NO: 548997 - RNA, 10 nt, Homo sapiens
acaucugccu

SEQ ID NO: 548998 - RNA, 16 nt, Homo sapiens
acaucugcuggugggu

SEQ ID NO: 548999 - RNA, 19 nt, Homo sapiens
acaucugcuuccacugugu

SEQ ID NO: 549000 - RNA, 18 nt, Homo sapiens
acaucugggugcccugaa

SEQ ID NO: 549001 - RNA, 15 nt, Homo sapiens
acaucuguauacccu

SEQ ID NO: 549002 - RNA, 11 nt, Homo sapiens
acaucugucac

SEQ ID NO: 549003 - RNA, 13 nt, Homo sapiens
acaucuuaccucu

SEQ ID NO: 549004 - RNA, 20 nt, Homo sapiens
acaucuuuagugucugagcu

SEQ ID NO: 549005 - RNA, 13 nt, Homo sapiens
acaucuuucacau

SEQ ID NO: 549006 - RNA, 18 nt, Homo sapiens
acaucuuucccuaaagaa

SEQ ID NO: 549007 - RNA, 14 nt, Homo sapiens
acaucuuuccuguc

SEQ ID NO: 549008 - RNA, 17 nt, Homo sapiens
acaucuuuuacauucug

SEQ ID NO: 549009 - RNA, 18 nt, Homo sapiens
acaugaaaaaauacucaa

SEQ ID NO: 549010 - RNA, 20 nt, Homo sapiens
acaugaaaaacaggugacau

SEQ ID NO: 549011 - RNA, 16 nt, Homo sapiens
acaugaauacuaucca

SEQ ID NO: 549012 - RNA, 19 nt, Homo sapiens
acaugagaacaaacagauc

SEQ ID NO: 549013 - RNA, 12 nt, Homo sapiens
acaugagcacac

SEQ ID NO: 549014 - RNA, 16 nt, Homo sapiens
acaugaggccaucuca

SEQ ID NO: 549015 - RNA, 13 nt, Homo sapiens
acaugagucugua

SEQ ID NO: 549016 - RNA, 21 nt, Homo sapiens
acaugauggagcgcaccugcc

SEQ ID NO: 549017 - RNA, 14 nt, Homo sapiens
acaugaugugagau

SEQ ID NO: 549018 - RNA, 18 nt, Homo sapiens
acaugauuuuacaaguau

SEQ ID NO: 549019 - RNA, 23 nt, Homo sapiens
acaugcaaagauccccaaaacag

SEQ ID NO: 549020 - RNA, 21 nt, Homo sapiens
acaugcacacacacacaucuc

SEQ ID NO: 549021 - RNA, 14 nt, Homo sapiens
acaugcacucagcu

SEQ ID NO: 549022 - RNA, 21 nt, Homo sapiens
acaugcagcaaggggacaucu

SEQ ID NO: 549023 - RNA, 23 nt, Homo sapiens
acaugcagcccagaauagcuuug

SEQ ID NO: 549024 - RNA, 21 nt, Homo sapiens
acaugccagggccaugucaga

SEQ ID NO: 549025 - RNA, 20 nt, Homo sapiens
acaugccucugccaaaggau

SEQ ID NO: 549026 - RNA, 17 nt, Homo sapiens
acaugccugccaaagac

SEQ ID NO: 549027 - RNA, 20 nt, Homo sapiens
acaugcgaccgugaccagga

SEQ ID NO: 549028 - RNA, 20 nt, Homo sapiens
acaugcggugccaugaaggg

SEQ ID NO: 549029 - RNA, 12 nt, Homo sapiens
acaugcucuuuu

SEQ ID NO: 549030 - RNA, 21 nt, Homo sapiens
acaugcugagguuuugaauaa

SEQ ID NO: 549031 - RNA, 15 nt, Homo sapiens
acaugcugccuggca

SEQ ID NO: 549032 - RNA, 23 nt, Homo sapiens
acaugcuguuaccagagccucuu

SEQ ID NO: 549033 - RNA, 15 nt, Homo sapiens
acaugcuuaccagau

SEQ ID NO: 549034 - RNA, 22 nt, Homo sapiens
acaugcuuuucugccacuccau

SEQ ID NO: 549035 - RNA, 18 nt, Homo sapiens
acauggaauaacauguaa

SEQ ID NO: 549036 - RNA, 14 nt, Homo sapiens
acauggagauguaa

SEQ ID NO: 549037 - RNA, 15 nt, Homo sapiens
acauggaugccaacc

SEQ ID NO: 549038 - RNA, 18 nt, Homo sapiens
acauggcaauugcacuca

SEQ ID NO: 549039 - RNA, 20 nt, Homo sapiens
acauggccagugugauccca

SEQ ID NO: 549040 - RNA, 24 nt, Homo sapiens
acauggcuaaauacaauggguauc

SEQ ID NO: 549041 - RNA, 18 nt, Homo sapiens
acauggucaaaauuucac

SEQ ID NO: 549042 - RNA, 23 nt, Homo sapiens
acauggugaaaccucaucucuac

SEQ ID NO: 549043 - RNA, 22 nt, Homo sapiens
acauguaauugcagauaacuuu

SEQ ID NO: 549044 - RNA, 21 nt, Homo sapiens
acauguaugcuauuacauaca

SEQ ID NO: 549045 - RNA, 18 nt, Homo sapiens
acauguaugugcauuuca

SEQ ID NO: 549046 - RNA, 15 nt, Homo sapiens
acauguauugcacau

SEQ ID NO: 549047 - RNA, 20 nt, Homo sapiens
acaugucuagccacugauca

SEQ ID NO: 549048 - RNA, 17 nt, Homo sapiens
acaugugcagucacugg

SEQ ID NO: 549049 - RNA, 19 nt, Homo sapiens
acaugugccgaaugugcag

SEQ ID NO: 549050 - RNA, 17 nt, Homo sapiens
accaaggauauuuacag

SEQ ID NO: 549051 - RNA, 15 nt, Homo sapiens
accaaggcagugcau

SEQ ID NO: 549052 - RNA, 21 nt, Homo sapiens
accaaggcgggagcaucucuu

SEQ ID NO: 549053 - RNA, 23 nt, Homo sapiens
accaagggggcggggacugcugg

SEQ ID NO: 549054 - RNA, 23 nt, Homo sapiens
accaaggggugggccacagccau

SEQ ID NO: 549055 - RNA, 19 nt, Homo sapiens
accaaguaaaacaaaacca

SEQ ID NO: 549056 - RNA, 23 nt, Homo sapiens
accaagugucuagagucauguga

SEQ ID NO: 549057 - RNA, 13 nt, Homo sapiens
accaauaaacagc

SEQ ID NO: 549058 - RNA, 13 nt, Homo sapiens
accaauaauguau

SEQ ID NO: 549059 - RNA, 13 nt, Homo sapiens
accaauaccuccu

SEQ ID NO: 549060 - RNA, 16 nt, Homo sapiens
accaauaccuccucca

SEQ ID NO: 549061 - RNA, 19 nt, Homo sapiens
accaauacuacugacgucc

SEQ ID NO: 549062 - RNA, 13 nt, Homo sapiens
accaauagcuuua

SEQ ID NO: 549063 - RNA, 20 nt, Homo sapiens
accaauauuaacacgcugcc

SEQ ID NO: 549064 - RNA, 16 nt, Homo sapiens
accaauauuguacagu

SEQ ID NO: 549065 - RNA, 20 nt, Homo sapiens
accaauauuguacaguuuuu

SEQ ID NO: 549066 - RNA, 14 nt, Homo sapiens
accaaugaacuuua

SEQ ID NO: 549067 - RNA, 17 nt, Homo sapiens
accaaugagcuguaucu

SEQ ID NO: 549068 - RNA, 13 nt, Homo sapiens
accaauggaaaaa

SEQ ID NO: 549069 - RNA, 15 nt, Homo sapiens
accaaugggccucca

SEQ ID NO: 549070 - RNA, 12 nt, Homo sapiens
accaauguagaa

SEQ ID NO: 549071 - RNA, 19 nt, Homo sapiens
accaauucuggacagacag

SEQ ID NO: 549072 - RNA, 18 nt, Homo sapiens
accaauugggucaggaag

SEQ ID NO: 549073 - RNA, 20 nt, Homo sapiens
acugacccccaucugagcug

SEQ ID NO: 549074 - RNA, 16 nt, Homo sapiens
acugacccuaacugca

SEQ ID NO: 549075 - RNA, 12 nt, Homo sapiens
acugaccuaccu

SEQ ID NO: 549076 - RNA, 19 nt, Homo sapiens
acugacuccaaccauucaa

SEQ ID NO: 549077 - RNA, 14 nt, Homo sapiens
acugacucuguuau

SEQ ID NO: 549078 - RNA, 17 nt, Homo sapiens
acugacugccuugcuaa

SEQ ID NO: 549079 - RNA, 21 nt, Homo sapiens
acugacuggauucauucucau

SEQ ID NO: 549080 - RNA, 12 nt, Homo sapiens
acugacugugaa

SEQ ID NO: 549081 - RNA, 20 nt, Homo sapiens
acugacuucauuugugccac

SEQ ID NO: 549082 - RNA, 20 nt, Homo sapiens
acugacuuguuugucuucca

SEQ ID NO: 549083 - RNA, 21 nt, Homo sapiens
acuggcuucucuugagucaca

SEQ ID NO: 549084 - RNA, 17 nt, Homo sapiens
acuggcuuuugccugua

SEQ ID NO: 549085 - RNA, 15 nt, Homo sapiens
acugggaaucucaua

SEQ ID NO: 549086 - RNA, 22 nt, Homo sapiens
acugggacagcccaggaaacaa

SEQ ID NO: 549087 - RNA, 16 nt, Homo sapiens
acugggacgccuucag

SEQ ID NO: 549088 - RNA, 21 nt, Homo sapiens
acugggagagcugguggugca

SEQ ID NO: 549089 - RNA, 16 nt, Homo sapiens
acugggcaacacugca

SEQ ID NO: 549090 - RNA, 19 nt, Homo sapiens
acugggcaaugauggcaau

SEQ ID NO: 549091 - RNA, 22 nt, Homo sapiens
acugggcccuggggaagguauc

SEQ ID NO: 549092 - RNA, 13 nt, Homo sapiens
acuuaugccauag

SEQ ID NO: 549093 - RNA, 18 nt, Homo sapiens
acuuauggaacagggaug

SEQ ID NO: 549094 - RNA, 20 nt, Homo sapiens
acuuauguauuuaugaccuu

SEQ ID NO: 549095 - RNA, 15 nt, Homo sapiens
acuuauuaacuaaga

SEQ ID NO: 549096 - RNA, 17 nt, Homo sapiens
acuuauuggaacucugc

SEQ ID NO: 549097 - RNA, 22 nt, Homo sapiens
acuuauuggaacucugcuugau

SEQ ID NO: 549098 - RNA, 19 nt, Homo sapiens
acuuauuucauaaacaacu

SEQ ID NO: 549099 - RNA, 17 nt, Homo sapiens
acuuauuuucagugcau

SEQ ID NO: 549100 - RNA, 17 nt, Homo sapiens
acuucaaaaacauuuca

SEQ ID NO: 549101 - RNA, 22 nt, Homo sapiens
acuucaaaagccauaacuugaa

SEQ ID NO: 549102 - RNA, 15 nt, Homo sapiens
acuucaaagcugaau

SEQ ID NO: 549103 - RNA, 14 nt, Homo sapiens
acuucaaauguggu

SEQ ID NO: 549104 - RNA, 13 nt, Homo sapiens
acuucaaauucaa

SEQ ID NO: 549105 - RNA, 14 nt, Homo sapiens
acuucaaauucaaa

SEQ ID NO: 549106 - RNA, 18 nt, Homo sapiens
acuucaagacaucaccau

SEQ ID NO: 549107 - RNA, 23 nt, Homo sapiens
acuucaaguauaacaacuuugaa

SEQ ID NO: 549108 - RNA, 19 nt, Homo sapiens
acuucaaguuaaagugaau

SEQ ID NO: 549109 - RNA, 20 nt, Homo sapiens
acuucaaugggcucuuccaa

SEQ ID NO: 549110 - RNA, 15 nt, Homo sapiens
acuucaaugugucau

SEQ ID NO: 549111 - RNA, 15 nt, Homo sapiens
acuucacacuaugga

SEQ ID NO: 549112 - RNA, 14 nt, Homo sapiens
acuucacauugcaa

SEQ ID NO: 549113 - RNA, 14 nt, Homo sapiens
acuucaccuacauu

SEQ ID NO: 549114 - RNA, 16 nt, Homo sapiens
acuucaccuuuccucu

SEQ ID NO: 549115 - RNA, 21 nt, Homo sapiens
acuucacgggcaaucaugagc

SEQ ID NO: 549116 - RNA, 22 nt, Homo sapiens
acuucacgggcaaucaugagca

SEQ ID NO: 549117 - RNA, 20 nt, Homo sapiens
acuucacuaccaagcagcuc

SEQ ID NO: 549118 - RNA, 19 nt, Homo sapiens
acuucagaaagacagugac

SEQ ID NO: 549119 - RNA, 23 nt, Homo sapiens
acuucagauugaacuuacuguag

SEQ ID NO: 549120 - RNA, 19 nt, Homo sapiens
acuucagcaguaccuauaa

SEQ ID NO: 549121 - RNA, 11 nt, Homo sapiens
acuucagucuu

SEQ ID NO: 549122 - RNA, 17 nt, Homo sapiens
acuucaguugcuuugca

SEQ ID NO: 549123 - RNA, 21 nt, Homo sapiens
acuucauagaaaccucucuau

SEQ ID NO: 549124 - RNA, 22 nt, Homo sapiens
acuucauauuguugcauugcuu

SEQ ID NO: 549125 - RNA, 20 nt, Homo sapiens
acuucaucaaaaucauggau

SEQ ID NO: 549126 - RNA, 19 nt, Homo sapiens
acuucauucucgugaguca

SEQ ID NO: 549127 - RNA, 16 nt, Homo sapiens
acuucauuuauaugaa

SEQ ID NO: 549128 - RNA, 23 nt, Homo sapiens
acuuccaagcuggcuuuucccau

SEQ ID NO: 549129 - RNA, 13 nt, Homo sapiens
acuuccaagugau

SEQ ID NO: 549130 - RNA, 20 nt, Homo sapiens
acuuccaggggaaccugcca

SEQ ID NO: 549131 - RNA, 21 nt, Homo sapiens
acuuccaguguuggcugugug

SEQ ID NO: 549132 - RNA, 22 nt, Homo sapiens
acuuccaugagaagaagcagau

SEQ ID NO: 549133 - RNA, 17 nt, Homo sapiens
acuuccccuucuugcca

SEQ ID NO: 549134 - RNA, 18 nt, Homo sapiens
acuuccccuucuugccau

SEQ ID NO: 549135 - RNA, 16 nt, Homo sapiens
acuuccuccacagucc

SEQ ID NO: 549136 - RNA, 17 nt, Homo sapiens
acuuccucccacugucu

SEQ ID NO: 549137 - RNA, 14 nt, Homo sapiens
acuuccucugccac

SEQ ID NO: 549138 - RNA, 13 nt, Homo sapiens
acuuccugcagua

SEQ ID NO: 549139 - RNA, 14 nt, Homo sapiens
acuuccugcaguga

SEQ ID NO: 549140 - RNA, 21 nt, Homo sapiens
acuuccuggcuccuucacuga

SEQ ID NO: 549141 - RNA, 19 nt, Homo sapiens
acuuccugugacuucagcu

SEQ ID NO: 549142 - RNA, 15 nt, Homo sapiens
acuuccugugccuuu

SEQ ID NO: 549143 - RNA, 23 nt, Homo sapiens
acuuccugugccuuuccuaucac

SEQ ID NO: 549144 - RNA, 17 nt, Homo sapiens
acuucggcucucuggac

SEQ ID NO: 549145 - RNA, 15 nt, Homo sapiens
acuucuaaaugcaua

SEQ ID NO: 549146 - RNA, 14 nt, Homo sapiens
acuucuacauccaa

SEQ ID NO: 549147 - RNA, 15 nt, Homo sapiens
acuucuaguuucacg

SEQ ID NO: 549148 - RNA, 14 nt, Homo sapiens
acuucucaagauac

SEQ ID NO: 549149 - RNA, 11 nt, Homo sapiens
acuucucacca

SEQ ID NO: 549150 - RNA, 23 nt, Homo sapiens
acuucucauuuuuuaaaaaagcu

SEQ ID NO: 549151 - RNA, 19 nt, Homo sapiens
acuucuccugaaugcaucc

SEQ ID NO: 549152 - RNA, 17 nt, Homo sapiens
acuucucuauuaucuca

SEQ ID NO: 549153 - RNA, 13 nt, Homo sapiens
acuucucucagga

SEQ ID NO: 549154 - RNA, 20 nt, Homo sapiens
acuucucucaucugggcaaa

SEQ ID NO: 549155 - RNA, 19 nt, Homo sapiens
acuucucugaaauauuuag

SEQ ID NO: 549156 - RNA, 18 nt, Homo sapiens
acuucucuuaaguggucu

SEQ ID NO: 549157 - RNA, 18 nt, Homo sapiens
acuucucuuccucccuca

SEQ ID NO: 549158 - RNA, 20 nt, Homo sapiens
acuucugagaucuguugauu

SEQ ID NO: 549159 - RNA, 14 nt, Homo sapiens
acuucugcagcuau

SEQ ID NO: 549160 - RNA, 19 nt, Homo sapiens
acuucugcgggcucccucc

SEQ ID NO: 549161 - RNA, 21 nt, Homo sapiens
acuucugcuccauagacauca

SEQ ID NO: 549162 - RNA, 16 nt, Homo sapiens
acuucugcuggcauca

SEQ ID NO: 549163 - RNA, 19 nt, Homo sapiens
acuucuggagaaagcucau

SEQ ID NO: 549164 - RNA, 19 nt, Homo sapiens
acuucuggaugcccaucca

SEQ ID NO: 549165 - RNA, 22 nt, Homo sapiens
acuucuggaugcccauccacug

SEQ ID NO: 549166 - RNA, 15 nt, Homo sapiens
acuucuggcuccuca

SEQ ID NO: 549167 - RNA, 19 nt, Homo sapiens
acuucuucaccucuuccac

SEQ ID NO: 549168 - RNA, 11 nt, Homo sapiens
acuucuuggcu

SEQ ID NO: 549169 - RNA, 22 nt, Homo sapiens
acuucuuuaagcggacccgcua

SEQ ID NO: 549170 - RNA, 19 nt, Homo sapiens
acuucuuuacuaacacugg

SEQ ID NO: 549171 - RNA, 20 nt, Homo sapiens
acuucuuuacuaacacuggc

SEQ ID NO: 549172 - RNA, 17 nt, Homo sapiens
acuugaaacagauucag

SEQ ID NO: 549173 - RNA, 20 nt, Homo sapiens
acuugaaagcauccaugugu

SEQ ID NO: 549174 - RNA, 13 nt, Homo sapiens
acuugaaauacca

SEQ ID NO: 549175 - RNA, 20 nt, Homo sapiens
acuugaaauucucaucaguc

SEQ ID NO: 549176 - RNA, 14 nt, Homo sapiens
acuugaacacugau

SEQ ID NO: 549177 - RNA, 21 nt, Homo sapiens
acuugaaucaaagcaguuaac

SEQ ID NO: 549178 - RNA, 13 nt, Homo sapiens
acuugacauuccu

SEQ ID NO: 549179 - RNA, 18 nt, Homo sapiens
acuugaccuaaacuucua

SEQ ID NO: 549180 - RNA, 21 nt, Homo sapiens
acuugagaaccagucuccuca

SEQ ID NO: 549181 - RNA, 13 nt, Homo sapiens
acuugagcaccgu

SEQ ID NO: 549182 - RNA, 17 nt, Homo sapiens
acuugagcgugaaucug

SEQ ID NO: 549183 - RNA, 23 nt, Homo sapiens
acuugaguuagcauaauacagaa

SEQ ID NO: 549184 - RNA, 20 nt, Homo sapiens
acuugaugacccccaaccaa

SEQ ID NO: 549185 - RNA, 19 nt, Homo sapiens
acuugauggaaggaucucu

SEQ ID NO: 549186 - RNA, 19 nt, Homo sapiens
acuugauguguuaucucuu

SEQ ID NO: 549187 - RNA, 15 nt, Homo sapiens
acuugauugucuccu

SEQ ID NO: 549188 - RNA, 14 nt, Homo sapiens
acuugcaaugggca

SEQ ID NO: 549189 - RNA, 15 nt, Homo sapiens
acuugcacaaaauca

SEQ ID NO: 549190 - RNA, 20 nt, Homo sapiens
acuugcacaaaaucacacag

SEQ ID NO: 549191 - RNA, 19 nt, Homo sapiens
acuugcacagggauucuca

SEQ ID NO: 549192 - RNA, 19 nt, Homo sapiens
acuugcacgcccaugugug

SEQ ID NO: 549193 - RNA, 12 nt, Homo sapiens
acuugcacuguu

SEQ ID NO: 549194 - RNA, 15 nt, Homo sapiens
acuugcagguacuuu

SEQ ID NO: 549195 - RNA, 15 nt, Homo sapiens
acuugcauacagaga

SEQ ID NO: 549196 - RNA, 16 nt, Homo sapiens
acuugcauaccugcuu

SEQ ID NO: 549197 - RNA, 15 nt, Homo sapiens
acuugcauugugauu

SEQ ID NO: 549198 - RNA, 16 nt, Homo sapiens
acuugcccaaguccca

SEQ ID NO: 549199 - RNA, 12 nt, Homo sapiens
acuugccuccac

SEQ ID NO: 549200 - RNA, 16 nt, Homo sapiens
acuugccucugcacac

SEQ ID NO: 549201 - RNA, 22 nt, Homo sapiens
acuugccugugcuacaauucau

SEQ ID NO: 549202 - RNA, 21 nt, Homo sapiens
acuugccuguucagagcacuc

SEQ ID NO: 549203 - RNA, 23 nt, Homo sapiens
acuugcucucuuucccacuccua

SEQ ID NO: 549204 - RNA, 22 nt, Homo sapiens
acuugcuuuaccuuuucagggc

SEQ ID NO: 549205 - RNA, 21 nt, Homo sapiens
acuugcuuuaugccuucuuau

SEQ ID NO: 549206 - RNA, 23 nt, Homo sapiens
acuuggaaccuuggaaaugacca

SEQ ID NO: 549207 - RNA, 15 nt, Homo sapiens
acuuggaacuaggcu

SEQ ID NO: 549208 - RNA, 13 nt, Homo sapiens
acuuggacaucuc

SEQ ID NO: 549209 - RNA, 21 nt, Homo sapiens
acuuggacccaaaaaaucauc

SEQ ID NO: 549210 - RNA, 18 nt, Homo sapiens
acuuggaccucagccaac

SEQ ID NO: 549211 - RNA, 17 nt, Homo sapiens
acuuggacucuugcucu

SEQ ID NO: 549212 - RNA, 12 nt, Homo sapiens
acuuggcacuua

SEQ ID NO: 549213 - RNA, 23 nt, Homo sapiens
acuuggcucgaaucucugugccu

SEQ ID NO: 549214 - RNA, 19 nt, Homo sapiens
acuuguagucuccaugcaa

SEQ ID NO: 549215 - RNA, 14 nt, Homo sapiens
acuugucucuucau

SEQ ID NO: 549216 - RNA, 22 nt, Homo sapiens
acuugugauuuuuauaauacaa

SEQ ID NO: 549217 - RNA, 22 nt, Homo sapiens
acuugugcugaucgugcuaaau

SEQ ID NO: 549218 - RNA, 23 nt, Homo sapiens
acuuguggagcgccagcucugcc

SEQ ID NO: 549219 - RNA, 22 nt, Homo sapiens
acuugugugugggcugugagug

SEQ ID NO: 549220 - RNA, 12 nt, Homo sapiens
acuuguguuacu

SEQ ID NO: 549221 - RNA, 14 nt, Homo sapiens
acuuguuaccuuaa

SEQ ID NO: 549222 - RNA, 16 nt, Homo sapiens
acuuguuaguacauaa

SEQ ID NO: 549223 - RNA, 12 nt, Homo sapiens
acuuuaaaacca

SEQ ID NO: 549224 - RNA, 16 nt, Homo sapiens
acuuuaaaagcauuuu

SEQ ID NO: 549225 - RNA, 21 nt, Homo sapiens
acuuuaaaauucaaguuauac

SEQ ID NO: 549226 - RNA, 18 nt, Homo sapiens
acuuuaaagauaagucua

SEQ ID NO: 549227 - RNA, 15 nt, Homo sapiens
acuuuaaagcccuuu

SEQ ID NO: 549228 - RNA, 19 nt, Homo sapiens
acuuuaaagcguuugcaca

SEQ ID NO: 549229 - RNA, 15 nt, Homo sapiens
acuuuaaauacuauu

SEQ ID NO: 549230 - RNA, 16 nt, Homo sapiens
acuuuaagaaguaauu

SEQ ID NO: 549231 - RNA, 14 nt, Homo sapiens
acuuuaaguauaca

SEQ ID NO: 549232 - RNA, 15 nt, Homo sapiens
acuuuaaucacugcu

SEQ ID NO: 549233 - RNA, 21 nt, Homo sapiens
acuuuaaugaacuaacugaca

SEQ ID NO: 549234 - RNA, 23 nt, Homo sapiens
acuuuacaggagguuguggaugc

SEQ ID NO: 549235 - RNA, 15 nt, Homo sapiens
acuuuaccucucugu

SEQ ID NO: 549236 - RNA, 19 nt, Homo sapiens
acuuuacuuguguuauaua

SEQ ID NO: 549237 - RNA, 13 nt, Homo sapiens
acuuuagaaauaa

SEQ ID NO: 549238 - RNA, 20 nt, Homo sapiens
acuuuagaguagcaugagag

SEQ ID NO: 549239 - RNA, 18 nt, Homo sapiens
acuuuagguagaugaacu

SEQ ID NO: 549240 - RNA, 16 nt, Homo sapiens
acuuuauaaauaucaa

SEQ ID NO: 549241 - RNA, 15 nt, Homo sapiens
acuuuauacacuucu

SEQ ID NO: 549242 - RNA, 15 nt, Homo sapiens
acuuuaucaaugugu

SEQ ID NO: 549243 - RNA, 19 nt, Homo sapiens
acuuuauucagagcuaaua

SEQ ID NO: 549244 - RNA, 16 nt, Homo sapiens
acuuucagagaauuac

SEQ ID NO: 549245 - RNA, 22 nt, Homo sapiens
acuuucagugcuuuuacuaucu

SEQ ID NO: 549246 - RNA, 23 nt, Homo sapiens
acuuucauccucaagcucagggc

SEQ ID NO: 549247 - RNA, 19 nt, Homo sapiens
acuuucauccugguuucca

SEQ ID NO: 549248 - RNA, 12 nt, Homo sapiens
acuuucauguca

SEQ ID NO: 549249 - RNA, 19 nt, Homo sapiens
acuuucccuagaaagccau

SEQ ID NO: 549250 - RNA, 16 nt, Homo sapiens
acuuuccugacuuaca

SEQ ID NO: 549251 - RNA, 11 nt, Homo sapiens
acuuuccugca

SEQ ID NO: 549252 - RNA, 16 nt, Homo sapiens
acuuuccuguugucua

SEQ ID NO: 549253 - RNA, 14 nt, Homo sapiens
acuuucucaaugcu

SEQ ID NO: 549254 - RNA, 22 nt, Homo sapiens
acuuucugauuacuguccagcu

SEQ ID NO: 549255 - RNA, 13 nt, Homo sapiens
acuuucuguuacu

SEQ ID NO: 549256 - RNA, 18 nt, Homo sapiens
acuuucuguuccuuccuc

SEQ ID NO: 549257 - RNA, 22 nt, Homo sapiens
acuuucuucuagugcuuuucag

SEQ ID NO: 549258 - RNA, 19 nt, Homo sapiens
acuuucuucucuuucccaa

SEQ ID NO: 549259 - RNA, 12 nt, Homo sapiens
acuuugaaaaua

SEQ ID NO: 549260 - RNA, 16 nt, Homo sapiens
acuuugaaacuauuaa

SEQ ID NO: 549261 - RNA, 23 nt, Homo sapiens
acuuugaccucugcagcaauaaa

SEQ ID NO: 549262 - RNA, 13 nt, Homo sapiens
acuuugacuuucu

SEQ ID NO: 549263 - RNA, 15 nt, Homo sapiens
acuuugagaagcuga

SEQ ID NO: 549264 - RNA, 17 nt, Homo sapiens
acuuugagcugagugcu

SEQ ID NO: 549265 - RNA, 19 nt, Homo sapiens
acuuugagcugagugcuga

SEQ ID NO: 549266 - RNA, 14 nt, Homo sapiens
acuuugaucucugc

SEQ ID NO: 549267 - RNA, 22 nt, Homo sapiens
acuuugauucugauaaugcuca

SEQ ID NO: 549268 - RNA, 12 nt, Homo sapiens
acuuugcuccuc

SEQ ID NO: 549269 - RNA, 11 nt, Homo sapiens
acuuugcucuc

SEQ ID NO: 549270 - RNA, 19 nt, Homo sapiens
acuuugcugcauuuuacac

SEQ ID NO: 549271 - RNA, 17 nt, Homo sapiens
acuuugcuuaguauuga

SEQ ID NO: 549272 - RNA, 20 nt, Homo sapiens
acuuugcuugagaauccucu

SEQ ID NO: 549273 - RNA, 17 nt, Homo sapiens
acuuugcuugcuuugaa

SEQ ID NO: 549274 - RNA, 20 nt, Homo sapiens
acuuuggaggcaaaucuuuc

SEQ ID NO: 549275 - RNA, 17 nt, Homo sapiens
acuuuggcugaacuaca

SEQ ID NO: 549276 - RNA, 16 nt, Homo sapiens
acuuugggaucaaaua

SEQ ID NO: 549277 - RNA, 17 nt, Homo sapiens
acuuugggauucuuucc

SEQ ID NO: 549278 - RNA, 23 nt, Homo sapiens
acuuugggggaggagaacaugag

SEQ ID NO: 549279 - RNA, 21 nt, Homo sapiens
acuuugguuauuggaaggcaa

SEQ ID NO: 549280 - RNA, 18 nt, Homo sapiens
acuuugguuccugugaua

SEQ ID NO: 549281 - RNA, 23 nt, Homo sapiens
acuuuguaauaccagaacucuaa

SEQ ID NO: 549282 - RNA, 15 nt, Homo sapiens
acuuuguacuugugu

SEQ ID NO: 549283 - RNA, 19 nt, Homo sapiens
acuuuguauauuuguuaca

SEQ ID NO: 549284 - RNA, 13 nt, Homo sapiens
acuuugugcauuc

SEQ ID NO: 549285 - RNA, 14 nt, Homo sapiens
acuuuguguauuaa

SEQ ID NO: 549286 - RNA, 23 nt, Homo sapiens
acuuuuaaguugcugaugaacuc

SEQ ID NO: 549287 - RNA, 13 nt, Homo sapiens
acuuuuacaguaa

SEQ ID NO: 549288 - RNA, 14 nt, Homo sapiens
acuuuuauaaugaa

SEQ ID NO: 549289 - RNA, 17 nt, Homo sapiens
acuuuuaucuacuucuc

SEQ ID NO: 549290 - RNA, 18 nt, Homo sapiens
acuuuuaucuacuucucu

SEQ ID NO: 549291 - RNA, 18 nt, Homo sapiens
acuuuuaugcaaccauaa

SEQ ID NO: 549292 - RNA, 19 nt, Homo sapiens
acuuuucaauuugucaugu

SEQ ID NO: 549293 - RNA, 13 nt, Homo sapiens
acuuuucaccaau

SEQ ID NO: 549294 - RNA, 17 nt, Homo sapiens
acuuuucaccaaugagc

SEQ ID NO: 549295 - RNA, 15 nt, Homo sapiens
acuuuucccauucag

SEQ ID NO: 549296 - RNA, 17 nt, Homo sapiens
acuuuucuaacauaugu

SEQ ID NO: 549297 - RNA, 18 nt, Homo sapiens
acuuuucuguucaucacc

SEQ ID NO: 549298 - RNA, 13 nt, Homo sapiens
acuuuugaagucc

SEQ ID NO: 549299 - RNA, 11 nt, Homo sapiens
acuuuugacuu

SEQ ID NO: 549300 - RNA, 18 nt, Homo sapiens
acuuuuggcuccucuagu

SEQ ID NO: 549301 - RNA, 23 nt, Homo sapiens
acuuuugggcguaagaccaaaug

SEQ ID NO: 549302 - RNA, 19 nt, Homo sapiens
acuuuuuaaaauaauaaca

SEQ ID NO: 549303 - RNA, 17 nt, Homo sapiens
acuuuuuacccagaaca

SEQ ID NO: 549304 - RNA, 11 nt, Homo sapiens
acuuuuuccag

SEQ ID NO: 549305 - RNA, 17 nt, Homo sapiens
acuuuuuccuggcucau

SEQ ID NO: 549306 - RNA, 19 nt, Homo sapiens
acuuuuucugagcuuuuca

SEQ ID NO: 549307 - RNA, 23 nt, Homo sapiens
acuuuuucuggucucuaccacug

SEQ ID NO: 549308 - RNA, 18 nt, Homo sapiens
acuuuuucuuguauucau

SEQ ID NO: 549309 - RNA, 12 nt, Homo sapiens
acuuuuuuacac

SEQ ID NO: 549310 - RNA, 20 nt, Homo sapiens
acuuuuuuugguauaauguu

SEQ ID NO: 549311 - RNA, 18 nt, Homo sapiens
agaaaaaaaaaacacuug

SEQ ID NO: 549312 - RNA, 21 nt, Homo sapiens
agaaaaaaaacuuuggcuuuc

SEQ ID NO: 549313 - RNA, 18 nt, Homo sapiens
agaaaaaaaagugucuca

SEQ ID NO: 549314 - RNA, 18 nt, Homo sapiens
agaaaaaaacaugaauuu

SEQ ID NO: 549315 - RNA, 20 nt, Homo sapiens
agaaaaaaauauauaauacc

SEQ ID NO: 549316 - RNA, 15 nt, Homo sapiens
agaaaaacaaugaaa

SEQ ID NO: 549317 - RNA, 18 nt, Homo sapiens
agaaaaacacaaacauuc

SEQ ID NO: 549318 - RNA, 17 nt, Homo sapiens
agaaaaacaccgcuucu

SEQ ID NO: 549319 - RNA, 11 nt, Homo sapiens
agaaaaaccac

SEQ ID NO: 549320 - RNA, 20 nt, Homo sapiens
agaaaaacuacagcaucauu

SEQ ID NO: 549321 - RNA, 14 nt, Homo sapiens
agaaaaagaagaac

SEQ ID NO: 549322 - RNA, 15 nt, Homo sapiens
agaaaaaggugccau

SEQ ID NO: 549323 - RNA, 17 nt, Homo sapiens
agaaaacaaguauauaa

SEQ ID NO: 549324 - RNA, 15 nt, Homo sapiens
agaaaacauaaucuu

SEQ ID NO: 549325 - RNA, 12 nt, Homo sapiens
agaaaacaucuu

SEQ ID NO: 549326 - RNA, 20 nt, Homo sapiens
agaaaacccuugggccagaa

SEQ ID NO: 549327 - RNA, 21 nt, Homo sapiens
agaaaaccucuggcacauuga

SEQ ID NO: 549328 - RNA, 18 nt, Homo sapiens
agaaaacucccaauacaa

SEQ ID NO: 549329 - RNA, 22 nt, Homo sapiens
agaaaagaauuuuaguguuaau

SEQ ID NO: 549330 - RNA, 23 nt, Homo sapiens
agcauccccagccacaacugcca

SEQ ID NO: 549331 - RNA, 15 nt, Homo sapiens
agcaucccccaaagu

SEQ ID NO: 549332 - RNA, 20 nt, Homo sapiens
agcaucccccaaaguucaca

SEQ ID NO: 549333 - RNA, 21 nt, Homo sapiens
agcauccggccaaaugcaaaa

SEQ ID NO: 549334 - RNA, 14 nt, Homo sapiens
agcauccugugcug

SEQ ID NO: 549335 - RNA, 23 nt, Homo sapiens
agcacauuuuaaaagugccauua

SEQ ID NO: 549336 - RNA, 15 nt, Homo sapiens
agcaccacccuaguc

SEQ ID NO: 549337 - RNA, 15 nt, Homo sapiens
agcaccaggacucag

SEQ ID NO: 549338 - RNA, 14 nt, Homo sapiens
agcacccaagccag

SEQ ID NO: 549339 - RNA, 22 nt, Homo sapiens
auucucuguaaguguagcucaa

SEQ ID NO: 549340 - RNA, 19 nt, Homo sapiens
auucucugucucauccauc

SEQ ID NO: 549341 - RNA, 20 nt, Homo sapiens
auucucuuaaucacuacugu

SEQ ID NO: 549342 - RNA, 15 nt, Homo sapiens
auucucuuacugcuu

SEQ ID NO: 549343 - RNA, 20 nt, Homo sapiens
auucucuuuuuuucuugucc

SEQ ID NO: 549344 - RNA, 18 nt, Homo sapiens
auucugaaauacuuuuga

SEQ ID NO: 549345 - RNA, 16 nt, Homo sapiens
auucugagccauucac

SEQ ID NO: 549346 - RNA, 23 nt, Homo sapiens
auucugauucuuuuuuaugcaga

SEQ ID NO: 549347 - RNA, 19 nt, Homo sapiens
auucugccaaaccugugua

SEQ ID NO: 549348 - RNA, 16 nt, Homo sapiens
auucugccuagagugu

SEQ ID NO: 549349 - RNA, 17 nt, Homo sapiens
auucugccuagagugua

SEQ ID NO: 549350 - RNA, 22 nt, Homo sapiens
auucugccuccauucugaccau

SEQ ID NO: 549351 - RNA, 17 nt, Homo sapiens
auucugcuucucaucua

SEQ ID NO: 549352 - RNA, 15 nt, Homo sapiens
auucuggaaucacaa

SEQ ID NO: 549353 - RNA, 16 nt, Homo sapiens
auucuggaaucacaaa

SEQ ID NO: 549354 - RNA, 14 nt, Homo sapiens
auucugggaaucca

SEQ ID NO: 549355 - RNA, 17 nt, Homo sapiens
auucugggaauccacag

SEQ ID NO: 549356 - RNA, 21 nt, Homo sapiens
auucugggcuccuggaaccaa

SEQ ID NO: 549357 - RNA, 23 nt, Homo sapiens
auucugggcuccuggaaccaauc

SEQ ID NO: 549358 - RNA, 22 nt, Homo sapiens
auucugguauacauugaauuca

SEQ ID NO: 549359 - RNA, 22 nt, Homo sapiens
auucuguaaaauuaaacaaaua

SEQ ID NO: 549360 - RNA, 14 nt, Homo sapiens
auucuguaauuaca

SEQ ID NO: 549361 - RNA, 20 nt, Homo sapiens
auucugucuggcauuacaau

SEQ ID NO: 549362 - RNA, 15 nt, Homo sapiens
auucugugaccaaaa

SEQ ID NO: 549363 - RNA, 17 nt, Homo sapiens
auucuguugcuuuacag

SEQ ID NO: 549364 - RNA, 16 nt, Homo sapiens
auucuuaagcacuuug

SEQ ID NO: 549365 - RNA, 22 nt, Homo sapiens
auucuuacaauugcacugcugu

SEQ ID NO: 549366 - RNA, 14 nt, Homo sapiens
auucuuacauauga

SEQ ID NO: 549367 - RNA, 16 nt, Homo sapiens
auucuuagaauaucua

SEQ ID NO: 549368 - RNA, 15 nt, Homo sapiens
auucuuagugacuuu

SEQ ID NO: 549369 - RNA, 20 nt, Homo sapiens
auucuuauuuaaguuauuga

SEQ ID NO: 549370 - RNA, 18 nt, Homo sapiens
auucuuauuucacuaaau

SEQ ID NO: 549371 - RNA, 20 nt, Homo sapiens
auucuucaaccucauugaca

SEQ ID NO: 549372 - RNA, 23 nt, Homo sapiens
auucuucaaccucauugacaaga

SEQ ID NO: 549373 - RNA, 21 nt, Homo sapiens
auucuucagauacaaacugca

SEQ ID NO: 549374 - RNA, 13 nt, Homo sapiens
auucuuccagaau

SEQ ID NO: 549375 - RNA, 17 nt, Homo sapiens
auucuuccaucaucacu

SEQ ID NO: 549376 - RNA, 18 nt, Homo sapiens
auucuuccccgaaucaca

SEQ ID NO: 549377 - RNA, 12 nt, Homo sapiens
auucuucuaauu

SEQ ID NO: 549378 - RNA, 13 nt, Homo sapiens
auucuucuaccac

SEQ ID NO: 549379 - RNA, 21 nt, Homo sapiens
auucuucugagcacuguuuau

SEQ ID NO: 549380 - RNA, 16 nt, Homo sapiens
auucuugaaguucaug

SEQ ID NO: 549381 - RNA, 21 nt, Homo sapiens
auucuugauuuauuugcuucu

SEQ ID NO: 549382 - RNA, 17 nt, Homo sapiens
auucuuguucagauuaa

SEQ ID NO: 549383 - RNA, 22 nt, Homo sapiens
auucuuguuugaauuccuccuc

SEQ ID NO: 549384 - RNA, 19 nt, Homo sapiens
auucuuuaagaaccuuauu

SEQ ID NO: 549385 - RNA, 13 nt, Homo sapiens
auucuuuaccuca

SEQ ID NO: 549386 - RNA, 14 nt, Homo sapiens
auucuuuaccucag

SEQ ID NO: 549387 - RNA, 22 nt, Homo sapiens
auucuuuagagauuauaacaaa

SEQ ID NO: 549388 - RNA, 17 nt, Homo sapiens
auucuuuauucuuuacu

SEQ ID NO: 549389 - RNA, 18 nt, Homo sapiens
auucuuuauucuuuacua

SEQ ID NO: 549390 - RNA, 15 nt, Homo sapiens
auucuuucacuugau

SEQ ID NO: 549391 - RNA, 15 nt, Homo sapiens
auucuuuccccagag

SEQ ID NO: 549392 - RNA, 18 nt, Homo sapiens
auucuuucuaaacuacaa

SEQ ID NO: 549393 - RNA, 19 nt, Homo sapiens
auucuuuuucaguuuuacc

SEQ ID NO: 549394 - RNA, 20 nt, Homo sapiens
auucuuuuuuaauaaacuac

SEQ ID NO: 549395 - RNA, 20 nt, Homo sapiens
auugaaaagaccuacagacu

SEQ ID NO: 549396 - RNA, 14 nt, Homo sapiens
auugaaaagcacag

SEQ ID NO: 549397 - RNA, 17 nt, Homo sapiens
auugaaacccuccaaau

SEQ ID NO: 549398 - RNA, 14 nt, Homo sapiens
auugaaagaaccag

SEQ ID NO: 549399 - RNA, 21 nt, Homo sapiens
auugaaaggcauucucugaag

SEQ ID NO: 549400 - RNA, 18 nt, Homo sapiens
auugaaauuuacugugag

SEQ ID NO: 549401 - RNA, 15 nt, Homo sapiens
auugaacagcuguga

SEQ ID NO: 549402 - RNA, 13 nt, Homo sapiens
auugaagcuuugu

SEQ ID NO: 549403 - RNA, 14 nt, Homo sapiens
auugaagcuuugug

SEQ ID NO: 549404 - RNA, 21 nt, Homo sapiens
auugaaucccuuaaacucagg

SEQ ID NO: 549405 - RNA, 19 nt, Homo sapiens
auugaaucugauuggacau

SEQ ID NO: 549406 - RNA, 12 nt, Homo sapiens
auugaaugcgcu

SEQ ID NO: 549407 - RNA, 15 nt, Homo sapiens
auugaaugcgcuuua

SEQ ID NO: 549408 - RNA, 21 nt, Homo sapiens
auugaauguuuccaaccugga

SEQ ID NO: 549409 - RNA, 20 nt, Homo sapiens
auuucucuauguuuauucua

SEQ ID NO: 549410 - RNA, 16 nt, Homo sapiens
auuucucugauuugca

SEQ ID NO: 549411 - RNA, 17 nt, Homo sapiens
auuucugaaaugugcag

SEQ ID NO: 549412 - RNA, 21 nt, Homo sapiens
auuucugauauaacaaacuac

SEQ ID NO: 549413 - RNA, 24 nt, Homo sapiens
auuucugcacaugguucaccaugc

SEQ ID NO: 549414 - RNA, 14 nt, Homo sapiens
auuucugccaggca

SEQ ID NO: 549415 - RNA, 16 nt, Homo sapiens
auuucuguauacugua

SEQ ID NO: 549416 - RNA, 13 nt, Homo sapiens
auuucugucaaau

SEQ ID NO: 549417 - RNA, 13 nt, Homo sapiens
auuucuguguugc

SEQ ID NO: 549418 - RNA, 22 nt, Homo sapiens
auuucuguuauggggacuuuau

SEQ ID NO: 549419 - RNA, 18 nt, Homo sapiens
auuucuguucacuuugua

SEQ ID NO: 549420 - RNA, 21 nt, Homo sapiens
auuucuuagugcuucagaguu

SEQ ID NO: 549421 - RNA, 14 nt, Homo sapiens
auuucuucaaauaa

SEQ ID NO: 549422 - RNA, 19 nt, Homo sapiens
auuucuucaaaucucagca

SEQ ID NO: 549423 - RNA, 13 nt, Homo sapiens
auuucuucagucc

SEQ ID NO: 549424 - RNA, 17 nt, Homo sapiens
auuucuucuacugcuau

SEQ ID NO: 549425 - RNA, 19 nt, Homo sapiens
auuucuucucccuccuccc

SEQ ID NO: 549426 - RNA, 16 nt, Homo sapiens
auuucuuguugcucaa

SEQ ID NO: 549427 - RNA, 23 nt, Homo sapiens
auuucuuucuuugcaccaaagac

SEQ ID NO: 549428 - RNA, 24 nt, Homo sapiens
auuucuuucuuugcaccaaagaca

SEQ ID NO: 549429 - RNA, 20 nt, Homo sapiens
auuucuuugaucuggacaga

SEQ ID NO: 549430 - RNA, 11 nt, Homo sapiens
auuucuuugcc

SEQ ID NO: 549431 - RNA, 23 nt, Homo sapiens
auuucuuugucggcggcuugaua

SEQ ID NO: 549432 - RNA, 15 nt, Homo sapiens
auuucuuuguuauca

SEQ ID NO: 549433 - RNA, 15 nt, Homo sapiens
auuucuuuucaggga

SEQ ID NO: 549434 - RNA, 22 nt, Homo sapiens
auuugaaaaaaacuucauucuc

SEQ ID NO: 549435 - RNA, 16 nt, Homo sapiens
auuugaaaaguauuau

SEQ ID NO: 549436 - RNA, 23 nt, Homo sapiens
auuugaaaccccuguaggccuca

SEQ ID NO: 549437 - RNA, 16 nt, Homo sapiens
auuugaaauauggucu

SEQ ID NO: 549438 - RNA, 21 nt, Homo sapiens
auuugaacacuuggugaguag

SEQ ID NO: 549439 - RNA, 22 nt, Homo sapiens
auuugaaccagugauccauguc

SEQ ID NO: 549440 - RNA, 19 nt, Homo sapiens
auuugaacucuucaaucuc

SEQ ID NO: 549441 - RNA, 22 nt, Homo sapiens
auuugaaugugguuacuuccua

SEQ ID NO: 549442 - RNA, 18 nt, Homo sapiens
auuugaauuucaguaaac

SEQ ID NO: 549443 - RNA, 22 nt, Homo sapiens
auuugaccggaucuacacccac

SEQ ID NO: 549444 - RNA, 15 nt, Homo sapiens
auuugacucuuucaa

SEQ ID NO: 549445 - RNA, 17 nt, Homo sapiens
auuugagaauacauaaa

SEQ ID NO: 549446 - RNA, 20 nt, Homo sapiens
auuugagaauuuuguuucaa

SEQ ID NO: 549447 - RNA, 20 nt, Homo sapiens
auuugagagaagccacgcug

SEQ ID NO: 549448 - RNA, 17 nt, Homo sapiens
auuugagauaaagucaa

SEQ ID NO: 549449 - RNA, 19 nt, Homo sapiens
auuugagauaaagucaaau

SEQ ID NO: 549450 - RNA, 17 nt, Homo sapiens
auuugaggugaaauuca

SEQ ID NO: 549451 - RNA, 18 nt, Homo sapiens
auuugaggugaaauucag

SEQ ID NO: 549452 - RNA, 16 nt, Homo sapiens
auuugauaaacauucc

SEQ ID NO: 549453 - RNA, 23 nt, Homo sapiens
auuugauaguugguguucaaaaa

SEQ ID NO: 549454 - RNA, 15 nt, Homo sapiens
auuugaugugacuuu

SEQ ID NO: 549455 - RNA, 19 nt, Homo sapiens
auuugcaaaggcgacaaua

SEQ ID NO: 549456 - RNA, 21 nt, Homo sapiens
auuugcaagggaaaagucucu

SEQ ID NO: 549457 - RNA, 19 nt, Homo sapiens
auuugcaauucauguaaca

SEQ ID NO: 549458 - RNA, 16 nt, Homo sapiens
auuugcacuaaaucag

SEQ ID NO: 549459 - RNA, 14 nt, Homo sapiens
auuugcagagacag

SEQ ID NO: 549460 - RNA, 14 nt, Homo sapiens
auuugcaguauuca

SEQ ID NO: 549461 - RNA, 11 nt, Homo sapiens
auuugcauuac

SEQ ID NO: 549462 - RNA, 17 nt, Homo sapiens
auuugccaauuuacuuu

SEQ ID NO: 549463 - RNA, 17 nt, Homo sapiens
auuugccagagccaaau

SEQ ID NO: 549464 - RNA, 19 nt, Homo sapiens
auuugccuccagugcaguc

SEQ ID NO: 549465 - RNA, 21 nt, Homo sapiens
auuugccuguaacaagccaga

SEQ ID NO: 549466 - RNA, 22 nt, Homo sapiens
auuugcuaaucaaagccagggu

SEQ ID NO: 549467 - RNA, 18 nt, Homo sapiens
auuugcuauuuauuaaau

SEQ ID NO: 549468 - RNA, 15 nt, Homo sapiens
auuugcucuuugaca

SEQ ID NO: 549469 - RNA, 19 nt, Homo sapiens
auuugcugagcauguacug

SEQ ID NO: 549470 - RNA, 17 nt, Homo sapiens
auuugcuguuuuaaaca

SEQ ID NO: 549471 - RNA, 16 nt, Homo sapiens
auuugcuugcaaucua

SEQ ID NO: 549472 - RNA, 17 nt, Homo sapiens
auuugcuugcaaucuaa

SEQ ID NO: 549473 - RNA, 13 nt, Homo sapiens
auuuggaaauuca

SEQ ID NO: 549474 - RNA, 21 nt, Homo sapiens
agccaggguguggcccugcca

SEQ ID NO: 549475 - RNA, 15 nt, Homo sapiens
agccagguaauguga

SEQ ID NO: 549476 - RNA, 14 nt, Homo sapiens
agccaggugcaaaa

SEQ ID NO: 549477 - RNA, 18 nt, Homo sapiens
agccagguucccaggagg

SEQ ID NO: 549478 - RNA, 13 nt, Homo sapiens
agccagucaugga

SEQ ID NO: 549479 - RNA, 13 nt, Homo sapiens
agccagucucaga

SEQ ID NO: 549480 - RNA, 16 nt, Homo sapiens
aguggauugcauuucu

SEQ ID NO: 549481 - RNA, 15 nt, Homo sapiens
aguggauuggcuuug

SEQ ID NO: 549482 - RNA, 15 nt, Homo sapiens
aguggcaagaccaaa

SEQ ID NO: 549483 - RNA, 20 nt, Homo sapiens
aguggcaaguaaguuauaga

SEQ ID NO: 549484 - RNA, 20 nt, Homo sapiens
aguggcacaaucauggcuca

SEQ ID NO: 549485 - RNA, 18 nt, Homo sapiens
aguggcaugugcugugac

SEQ ID NO: 549486 - RNA, 17 nt, Homo sapiens
aguggccaagccugcug

SEQ ID NO: 549487 - RNA, 20 nt, Homo sapiens
aguggcccccgggccugcac

SEQ ID NO: 549488 - RNA, 23 nt, Homo sapiens
aguggcccuuucaacaaugucuu

SEQ ID NO: 549489 - RNA, 19 nt, Homo sapiens
aguggccuagagcacucuc

SEQ ID NO: 549490 - RNA, 14 nt, Homo sapiens
aguggcgugaucuc

SEQ ID NO: 549491 - RNA, 19 nt, Homo sapiens
aguggcgugggagccagcc

SEQ ID NO: 549492 - RNA, 19 nt, Homo sapiens
aguggcuacugacuacccu

SEQ ID NO: 549493 - RNA, 14 nt, Homo sapiens
aguggcugcuucuc

SEQ ID NO: 549494 - RNA, 19 nt, Homo sapiens
aguggcuucccagcucuga

SEQ ID NO: 549495 - RNA, 15 nt, Homo sapiens
aguggcuucuuucca

SEQ ID NO: 549496 - RNA, 13 nt, Homo sapiens
agugggacccaua

SEQ ID NO: 549497 - RNA, 14 nt, Homo sapiens
agugggacccauag

SEQ ID NO: 549498 - RNA, 14 nt, Homo sapiens
agugggacucugau

SEQ ID NO: 549499 - RNA, 16 nt, Homo sapiens
agugggccuccaagga

SEQ ID NO: 549500 - RNA, 12 nt, Homo sapiens
agugggcuguga

SEQ ID NO: 549501 - RNA, 20 nt, Homo sapiens
aguggggggaggaagcagag

SEQ ID NO: 549502 - RNA, 19 nt, Homo sapiens
aguggguaauccaggcaca

SEQ ID NO: 549503 - RNA, 19 nt, Homo sapiens
agugggugaauaauacagu

SEQ ID NO: 549504 - RNA, 20 nt, Homo sapiens
agugggugccccccuugcca

SEQ ID NO: 549505 - RNA, 22 nt, Homo sapiens
agugguaaaaguauuugcuuaa

SEQ ID NO: 549506 - RNA, 17 nt, Homo sapiens
agugguaaauacuguga

SEQ ID NO: 549507 - RNA, 21 nt, Homo sapiens
agugguaaucauaugugucuu

SEQ ID NO: 549508 - RNA, 16 nt, Homo sapiens
agugguaguaauuucc

SEQ ID NO: 549509 - RNA, 16 nt, Homo sapiens
agugguauccugugac

SEQ ID NO: 549510 - RNA, 17 nt, Homo sapiens
aguggucccagaaccua

SEQ ID NO: 549511 - RNA, 14 nt, Homo sapiens
aguggugcaaucac

SEQ ID NO: 549512 - RNA, 20 nt, Homo sapiens
aguggugcaaucacagcuca

SEQ ID NO: 549513 - RNA, 14 nt, Homo sapiens
aguggugcugcuuu

SEQ ID NO: 549514 - RNA, 16 nt, Homo sapiens
agugguggucuucaag

SEQ ID NO: 549515 - RNA, 15 nt, Homo sapiens
aguggugugaucucg

SEQ ID NO: 549516 - RNA, 14 nt, Homo sapiens
agugguuacuuugu

SEQ ID NO: 549517 - RNA, 14 nt, Homo sapiens
aguguaaaccaaau

SEQ ID NO: 549518 - RNA, 16 nt, Homo sapiens
aguguacaugugugaa

SEQ ID NO: 549519 - RNA, 22 nt, Homo sapiens
aguguacaugugugaaaacaau

SEQ ID NO: 549520 - RNA, 18 nt, Homo sapiens
aguguacauuaccauaua

SEQ ID NO: 549521 - RNA, 15 nt, Homo sapiens
aguguaccauuugcc

SEQ ID NO: 549522 - RNA, 12 nt, Homo sapiens
aguguaccuccu

SEQ ID NO: 549523 - RNA, 17 nt, Homo sapiens
aguguagcuaccuacau

SEQ ID NO: 549524 - RNA, 20 nt, Homo sapiens
aguguaguuaaggagccuaa

SEQ ID NO: 549525 - RNA, 17 nt, Homo sapiens
aguguaugacugcacau

SEQ ID NO: 549526 - RNA, 17 nt, Homo sapiens
aguguaugauuacuggc

SEQ ID NO: 549527 - RNA, 17 nt, Homo sapiens
aguguaugcacgugugc

SEQ ID NO: 549528 - RNA, 13 nt, Homo sapiens
agugucaacucuu

SEQ ID NO: 549529 - RNA, 18 nt, Homo sapiens
agugucaagguguggaag

SEQ ID NO: 549530 - RNA, 17 nt, Homo sapiens
agugucaccaauuccac

SEQ ID NO: 549531 - RNA, 12 nt, Homo sapiens
agugucacuuac

SEQ ID NO: 549532 - RNA, 23 nt, Homo sapiens
agugucaggcgccgcacuuccuu

SEQ ID NO: 549533 - RNA, 14 nt, Homo sapiens
aguguccucuugcu

SEQ ID NO: 549534 - RNA, 17 nt, Homo sapiens
aguguccucuugcucaa

SEQ ID NO: 549535 - RNA, 19 nt, Homo sapiens
aguguccuggaaauucugc

SEQ ID NO: 549536 - RNA, 18 nt, Homo sapiens
agugucucagggugcaga

SEQ ID NO: 549537 - RNA, 20 nt, Homo sapiens
agugucuggguuuggcccaa

SEQ ID NO: 549538 - RNA, 17 nt, Homo sapiens
agugucuuagcauauuu

SEQ ID NO: 549539 - RNA, 14 nt, Homo sapiens
agugugaccacuga

SEQ ID NO: 549540 - RNA, 19 nt, Homo sapiens
agugugagagugugagcag

SEQ ID NO: 549541 - RNA, 19 nt, Homo sapiens
aguguggaaccacugacua

SEQ ID NO: 549542 - RNA, 18 nt, Homo sapiens
aguguggacuuggcaggu

SEQ ID NO: 549543 - RNA, 15 nt, Homo sapiens
aguguggagacgggu

SEQ ID NO: 549544 - RNA, 22 nt, Homo sapiens
aguguggcccagggaagccaaa

SEQ ID NO: 549545 - RNA, 15 nt, Homo sapiens
aguguggcuaaccaa

SEQ ID NO: 549546 - RNA, 21 nt, Homo sapiens
aguguggcugaggccacccag

SEQ ID NO: 549547 - RNA, 13 nt, Homo sapiens
agugugggccagg

SEQ ID NO: 549548 - RNA, 14 nt, Homo sapiens
aguguguaugucag

SEQ ID NO: 549549 - RNA, 22 nt, Homo sapiens
aguguguccuggggacuuccuc

SEQ ID NO: 549550 - RNA, 13 nt, Homo sapiens
agugugugcaugu

SEQ ID NO: 549551 - RNA, 15 nt, Homo sapiens
aguguguguucuucc

SEQ ID NO: 549552 - RNA, 16 nt, Homo sapiens
aguguuaaaacaugaa

SEQ ID NO: 549553 - RNA, 14 nt, Homo sapiens
aguguuaccuguua

SEQ ID NO: 549554 - RNA, 13 nt, Homo sapiens
aguguucaagaaa

SEQ ID NO: 549555 - RNA, 18 nt, Homo sapiens
aguguucacaaacuguga

SEQ ID NO: 549556 - RNA, 18 nt, Homo sapiens
aguguucagacaguuuau

SEQ ID NO: 549557 - RNA, 17 nt, Homo sapiens
aguguucaguaaacaaa

SEQ ID NO: 549558 - RNA, 20 nt, Homo sapiens
aguguuccccuuccacugag

SEQ ID NO: 549559 - RNA, 22 nt, Homo sapiens
aguguucuccuuuuaagggugg

SEQ ID NO: 549560 - RNA, 17 nt, Homo sapiens
aguguucugauuccuuc

SEQ ID NO: 549561 - RNA, 19 nt, Homo sapiens
aguguucugauuccuucaa

SEQ ID NO: 549562 - RNA, 12 nt, Homo sapiens
aguguugcccag

SEQ ID NO: 549563 - RNA, 23 nt, Homo sapiens
aguguugcccaggcuggucucaa

SEQ ID NO: 549564 - RNA, 13 nt, Homo sapiens
aguguuuaacugg

SEQ ID NO: 549565 - RNA, 15 nt, Homo sapiens
aguguuuaacuggca

SEQ ID NO: 549566 - RNA, 17 nt, Homo sapiens
aguguuuaugugcuauu

SEQ ID NO: 549567 - RNA, 21 nt, Homo sapiens
aguguuucuaauaaacuugga

SEQ ID NO: 549568 - RNA, 16 nt, Homo sapiens
aguguuugcaauggug

SEQ ID NO: 549569 - RNA, 17 nt, Homo sapiens
aguguuuuuauugcucg

SEQ ID NO: 549570 - RNA, 21 nt, Homo sapiens
aguuaaaagacugcagcugcu

SEQ ID NO: 549571 - RNA, 22 nt, Homo sapiens
aguuaaaagccuaccuaagcau

SEQ ID NO: 549572 - RNA, 19 nt, Homo sapiens
aguuaaaaucacauuuuaa

SEQ ID NO: 549573 - RNA, 23 nt, Homo sapiens
aguuaaagugaauaaccacuuaa

SEQ ID NO: 549574 - RNA, 21 nt, Homo sapiens
aguuaaucccuuugucuguca

SEQ ID NO: 549575 - RNA, 17 nt, Homo sapiens
aguuacaaaauacaaaa

SEQ ID NO: 549576 - RNA, 18 nt, Homo sapiens
aguuacaaaauacaaaag

SEQ ID NO: 549577 - RNA, 23 nt, Homo sapiens
aguuacaguucugugguuucaug

SEQ ID NO: 549578 - RNA, 19 nt, Homo sapiens
aguuaccaaacauuacaaa

SEQ ID NO: 549579 - RNA, 22 nt, Homo sapiens
aguuaccuuauaguuacugugu

SEQ ID NO: 549580 - RNA, 12 nt, Homo sapiens
aguuacuaccug

SEQ ID NO: 549581 - RNA, 12 nt, Homo sapiens
aguuacuacuga

SEQ ID NO: 549582 - RNA, 18 nt, Homo sapiens
aguuacuagguaacuuca

SEQ ID NO: 549583 - RNA, 14 nt, Homo sapiens
aguuacugugguca

SEQ ID NO: 549584 - RNA, 15 nt, Homo sapiens
aucagucaacaacuu

SEQ ID NO: 549585 - RNA, 16 nt, Homo sapiens
aucagucauaacuaaa

SEQ ID NO: 549586 - RNA, 23 nt, Homo sapiens
aucagugacagaguucacuauaa

SEQ ID NO: 549587 - RNA, 16 nt, Homo sapiens
aucagugacugaauuc

SEQ ID NO: 549588 - RNA, 13 nt, Homo sapiens
aucagugcaguga

SEQ ID NO: 549589 - RNA, 14 nt, Homo sapiens
aucagugguuuuau

SEQ ID NO: 549590 - RNA, 16 nt, Homo sapiens
aucaguguaccauuug

SEQ ID NO: 549591 - RNA, 14 nt, Homo sapiens
aucaguuacucuga

SEQ ID NO: 549592 - RNA, 19 nt, Homo sapiens
aucaguugaaggcuagaag

SEQ ID NO: 549593 - RNA, 16 nt, Homo sapiens
aucaguugaggccagg

SEQ ID NO: 549594 - RNA, 16 nt, Homo sapiens
aucauaaaacuugaug

SEQ ID NO: 549595 - RNA, 18 nt, Homo sapiens
aucauaacuauacuugau

SEQ ID NO: 549596 - RNA, 16 nt, Homo sapiens
aucauaagacaaugga

SEQ ID NO: 549597 - RNA, 23 nt, Homo sapiens
aucauauaauaaauguacauuaa

SEQ ID NO: 549598 - RNA, 17 nt, Homo sapiens
aucauauucauaugcag

SEQ ID NO: 549599 - RNA, 20 nt, Homo sapiens
aucauauuccaacccagcca

SEQ ID NO: 549600 - RNA, 21 nt, Homo sapiens
aucauauugguauucacuaau

SEQ ID NO: 549601 - RNA, 19 nt, Homo sapiens
aucaucaaaaacuuuggag

SEQ ID NO: 549602 - RNA, 13 nt, Homo sapiens
aucaucaaaaaga

SEQ ID NO: 549603 - RNA, 18 nt, Homo sapiens
aucaucaaaaagaacaac

SEQ ID NO: 549604 - RNA, 20 nt, Homo sapiens
aucaucaaagcucacaccaa

SEQ ID NO: 549605 - RNA, 23 nt, Homo sapiens
aucaucaacuaccauucuauucc

SEQ ID NO: 549606 - RNA, 19 nt, Homo sapiens
aucaucaaguaauacaaac

SEQ ID NO: 549607 - RNA, 12 nt, Homo sapiens
aucaucacugua

SEQ ID NO: 549608 - RNA, 16 nt, Homo sapiens
aucaucaucauucuca

SEQ ID NO: 549609 - RNA, 17 nt, Homo sapiens
aucaucgaagucuuccc

SEQ ID NO: 549610 - RNA, 22 nt, Homo sapiens
aucaucuauaaagaagaacuug

SEQ ID NO: 549611 - RNA, 13 nt, Homo sapiens
aucaucuccaguu

SEQ ID NO: 549612 - RNA, 18 nt, Homo sapiens
aucaucuccugccuuccu

SEQ ID NO: 549613 - RNA, 12 nt, Homo sapiens
aucaucucugca

SEQ ID NO: 549614 - RNA, 17 nt, Homo sapiens
aucaucuguagauacua

SEQ ID NO: 549615 - RNA, 21 nt, Homo sapiens
aucccaacaccaaacucuuaa

SEQ ID NO: 549616 - RNA, 16 nt, Homo sapiens
aucccaacauucugca

SEQ ID NO: 549617 - RNA, 17 nt, Homo sapiens
aucccaagaaauggaau

SEQ ID NO: 549618 - RNA, 12 nt, Homo sapiens
aucccacaucca

SEQ ID NO: 549619 - RNA, 15 nt, Homo sapiens
aucccacauccaacu

SEQ ID NO: 549620 - RNA, 12 nt, Homo sapiens
aucccaccaaau

SEQ ID NO: 549621 - RNA, 20 nt, Homo sapiens
aucccacuaaagugucaagg

SEQ ID NO: 549622 - RNA, 17 nt, Homo sapiens
aucccacucuucuugca

SEQ ID NO: 549623 - RNA, 16 nt, Homo sapiens
aucccagcaccugccu

SEQ ID NO: 549624 - RNA, 15 nt, Homo sapiens
aucccagcacuuugg

SEQ ID NO: 549625 - RNA, 18 nt, Homo sapiens
aucccagcuacuuggaag

SEQ ID NO: 549626 - RNA, 20 nt, Homo sapiens
aucccaggggcuuaucucuu

SEQ ID NO: 549627 - RNA, 12 nt, Homo sapiens
aucccagugugu

SEQ ID NO: 549628 - RNA, 14 nt, Homo sapiens
aucccaguuacuca

SEQ ID NO: 549629 - RNA, 15 nt, Homo sapiens
aucccaguuacucag

SEQ ID NO: 549630 - RNA, 17 nt, Homo sapiens
aucccauggaaccacua

SEQ ID NO: 549631 - RNA, 17 nt, Homo sapiens
aucccauucugcgucau

SEQ ID NO: 549632 - RNA, 19 nt, Homo sapiens
aucccauugcaaacauuau

SEQ ID NO: 549633 - RNA, 22 nt, Homo sapiens
aucccauuucuugaaaagccuu

SEQ ID NO: 549634 - RNA, 14 nt, Homo sapiens
auccccaacuccau

SEQ ID NO: 549635 - RNA, 16 nt, Homo sapiens
auccccaagccuggca

SEQ ID NO: 549636 - RNA, 22 nt, Homo sapiens
auccccaagccuggcaagggaa

SEQ ID NO: 549637 - RNA, 19 nt, Homo sapiens
auccccaagugccugcuuu

SEQ ID NO: 549638 - RNA, 23 nt, Homo sapiens
auccccacagcuggcucugacaa

SEQ ID NO: 549639 - RNA, 23 nt, Homo sapiens
auccccacuagguucuuuuccau

SEQ ID NO: 549640 - RNA, 13 nt, Homo sapiens
auccccagacuca

SEQ ID NO: 549641 - RNA, 15 nt, Homo sapiens
auccccagcugccug

SEQ ID NO: 549642 - RNA, 14 nt, Homo sapiens
auccccagcuuucu

SEQ ID NO: 549643 - RNA, 16 nt, Homo sapiens
auccccaguuuuccau

SEQ ID NO: 549644 - RNA, 22 nt, Homo sapiens
auccccauucucugccuguacu

SEQ ID NO: 549645 - RNA, 19 nt, Homo sapiens
aucccccagccucaagucu

SEQ ID NO: 549646 - RNA, 19 nt, Homo sapiens
aucccccgcugguggcaga

SEQ ID NO: 549647 - RNA, 16 nt, Homo sapiens
aucucaccccauccca

SEQ ID NO: 549648 - RNA, 19 nt, Homo sapiens
aucucacuuaguccuuuau

SEQ ID NO: 549649 - RNA, 20 nt, Homo sapiens
aucucacuuccagauaucca

SEQ ID NO: 549650 - RNA, 21 nt, Homo sapiens
aucucacuuuucuccaugagu

SEQ ID NO: 549651 - RNA, 15 nt, Homo sapiens
aucucagaguccacu

SEQ ID NO: 549652 - RNA, 15 nt, Homo sapiens
aucucagccuaccau

SEQ ID NO: 549653 - RNA, 21 nt, Homo sapiens
aucucagcgccagcucuacca

SEQ ID NO: 549654 - RNA, 16 nt, Homo sapiens
aucucagcuaacauuc

SEQ ID NO: 549655 - RNA, 19 nt, Homo sapiens
aucucaggaaaaucuguga

SEQ ID NO: 549656 - RNA, 15 nt, Homo sapiens
aucucaggauuucac

SEQ ID NO: 549657 - RNA, 15 nt, Homo sapiens
aucucaguaccccau

SEQ ID NO: 549658 - RNA, 13 nt, Homo sapiens
aucucaguaugaa

SEQ ID NO: 549659 - RNA, 12 nt, Homo sapiens
aucucagugcag

SEQ ID NO: 549660 - RNA, 21 nt, Homo sapiens
aucucauccuuuccucuagcu

SEQ ID NO: 549661 - RNA, 16 nt, Homo sapiens
aucucauggcagcuaa

SEQ ID NO: 549662 - RNA, 15 nt, Homo sapiens
aucucauugcuuaca

SEQ ID NO: 549663 - RNA, 22 nt, Homo sapiens
aucucauuggacccuuccaugg

SEQ ID NO: 549664 - RNA, 23 nt, Homo sapiens
aucucauuggacccuuccauggu

SEQ ID NO: 549665 - RNA, 23 nt, Homo sapiens
aucuccaagcccuucugucuguc

SEQ ID NO: 549666 - RNA, 13 nt, Homo sapiens
aucuccacuguug

SEQ ID NO: 549667 - RNA, 21 nt, Homo sapiens
aucuccaggauugaagagcau

SEQ ID NO: 549668 - RNA, 17 nt, Homo sapiens
aucuccaggcuuucaau

SEQ ID NO: 549669 - RNA, 20 nt, Homo sapiens
aucuccaguagaaagcauaa

SEQ ID NO: 549670 - RNA, 23 nt, Homo sapiens
aucuccaguagaaagcauaacaa

SEQ ID NO: 549671 - RNA, 17 nt, Homo sapiens
aucuccagugugccaga

SEQ ID NO: 549672 - RNA, 19 nt, Homo sapiens
aucuccaucauaugccuga

SEQ ID NO: 549673 - RNA, 14 nt, Homo sapiens
aucucccacuccag

SEQ ID NO: 549674 - RNA, 18 nt, Homo sapiens
aucuccuauaaucuguca

SEQ ID NO: 549675 - RNA, 19 nt, Homo sapiens
aucuccuauaaucugucaa

SEQ ID NO: 549676 - RNA, 14 nt, Homo sapiens
aucuccugcugauu

SEQ ID NO: 549677 - RNA, 20 nt, Homo sapiens
aucuccuuuuaucuggugcc

SEQ ID NO: 549678 - RNA, 19 nt, Homo sapiens
aucucggcucacugcaagu

SEQ ID NO: 549679 - RNA, 15 nt, Homo sapiens
aucucuaaagagcau

SEQ ID NO: 549680 - RNA, 21 nt, Homo sapiens
aucucuaauuagucuaucaaa

SEQ ID NO: 549681 - RNA, 20 nt, Homo sapiens
aucucuacuaccacaaggaa

SEQ ID NO: 549682 - RNA, 16 nt, Homo sapiens
aucucuaguguagcug

SEQ ID NO: 549683 - RNA, 16 nt, Homo sapiens
aucucuauaacagauc

SEQ ID NO: 549684 - RNA, 19 nt, Homo sapiens
aucucucacacauuccagg

SEQ ID NO: 549685 - RNA, 17 nt, Homo sapiens
aucucuccagagcccuu

SEQ ID NO: 549686 - RNA, 15 nt, Homo sapiens
aucucuccagccgaa

SEQ ID NO: 549687 - RNA, 17 nt, Homo sapiens
aucucuccuccaagaca

SEQ ID NO: 549688 - RNA, 15 nt, Homo sapiens
aucucucuaccucca

SEQ ID NO: 549689 - RNA, 13 nt, Homo sapiens
aucucucuacuca

SEQ ID NO: 549690 - RNA, 18 nt, Homo sapiens
aucucucugcagcugccg

SEQ ID NO: 549691 - RNA, 13 nt, Homo sapiens
aucucugacuuaa

SEQ ID NO: 549692 - RNA, 15 nt, Homo sapiens
aucucugaggcaugg

SEQ ID NO: 549693 - RNA, 16 nt, Homo sapiens
aucucugcuuacuaau

SEQ ID NO: 549694 - RNA, 22 nt, Homo sapiens
aucucugggaguuauaggucau

SEQ ID NO: 549695 - RNA, 13 nt, Homo sapiens
aucucugucacau

SEQ ID NO: 549696 - RNA, 17 nt, Homo sapiens
aucucuuaauauugaga

SEQ ID NO: 549697 - RNA, 16 nt, Homo sapiens
aucucuuauuuuacaa

SEQ ID NO: 549698 - RNA, 17 nt, Homo sapiens
aucucuuauuuuacaau

SEQ ID NO: 549699 - RNA, 13 nt, Homo sapiens
aucucuuccacau

SEQ ID NO: 549700 - RNA, 16 nt, Homo sapiens
aucucuuccuacccaa

SEQ ID NO: 549701 - RNA, 21 nt, Homo sapiens
aucucuuccuccgaggccagu

SEQ ID NO: 549702 - RNA, 17 nt, Homo sapiens
aucucuugcccuuccua

SEQ ID NO: 549703 - RNA, 14 nt, Homo sapiens
aucucuuuugugga

SEQ ID NO: 549704 - RNA, 14 nt, Homo sapiens
aucugaaaauguau

SEQ ID NO: 549705 - RNA, 22 nt, Homo sapiens
aucugaaaugcuugaaaccaga

SEQ ID NO: 549706 - RNA, 13 nt, Homo sapiens
aucugaacacagu

SEQ ID NO: 549707 - RNA, 14 nt, Homo sapiens
aucugaaccaagau

SEQ ID NO: 549708 - RNA, 21 nt, Homo sapiens
aucugaacuuuuaaugaacuu

SEQ ID NO: 549709 - RNA, 19 nt, Homo sapiens
aucugaauaaaguguaaca

SEQ ID NO: 549710 - RNA, 15 nt, Homo sapiens
aucugaauaguguca

SEQ ID NO: 549711 - RNA, 13 nt, Homo sapiens
aucugacaaaaug

SEQ ID NO: 549712 - RNA, 21 nt, Homo sapiens
aucugacacaaaaaaaguuga

SEQ ID NO: 549713 - RNA, 15 nt, Homo sapiens
aucugacauauacuc

SEQ ID NO: 549714 - RNA, 23 nt, Homo sapiens
aucugacucacaagaagaccaga

SEQ ID NO: 549715 - RNA, 14 nt, Homo sapiens
aucugagaaacucu

SEQ ID NO: 549716 - RNA, 13 nt, Homo sapiens
aucugauguuaac

SEQ ID NO: 549717 - RNA, 15 nt, Homo sapiens
aucugcacauuucau

SEQ ID NO: 549718 - RNA, 19 nt, Homo sapiens
aucugcacucuaaacugca

SEQ ID NO: 549719 - RNA, 19 nt, Homo sapiens
aucugcaucuuaacaugcu

SEQ ID NO: 549720 - RNA, 22 nt, Homo sapiens
aucugccaagggccgacuaaga

SEQ ID NO: 549721 - RNA, 20 nt, Homo sapiens
aucugccccaguagucagaa

SEQ ID NO: 549722 - RNA, 18 nt, Homo sapiens
aucugcccucccuguuuc

SEQ ID NO: 549723 - RNA, 14 nt, Homo sapiens
aucugcgugacaau

SEQ ID NO: 549724 - RNA, 15 nt, Homo sapiens
aucugcugcauagcu

SEQ ID NO: 549725 - RNA, 19 nt, Homo sapiens
aucugcuguuaacugcaac

SEQ ID NO: 549726 - RNA, 20 nt, Homo sapiens
aucuggaagaagaugggcug

SEQ ID NO: 549727 - RNA, 14 nt, Homo sapiens
aucuggaaggacau

SEQ ID NO: 549728 - RNA, 17 nt, Homo sapiens
aucuggacacacuguua

SEQ ID NO: 549729 - RNA, 18 nt, Homo sapiens
aucugggaaagacaucca

SEQ ID NO: 549730 - RNA, 17 nt, Homo sapiens
aucuggguaucuuucca

SEQ ID NO: 549731 - RNA, 13 nt, Homo sapiens
aucugggugcaug

SEQ ID NO: 549732 - RNA, 22 nt, Homo sapiens
aucugguauauguaaguguuca

SEQ ID NO: 549733 - RNA, 16 nt, Homo sapiens
aucuggucccuugcag

SEQ ID NO: 549734 - RNA, 14 nt, Homo sapiens
aucuggucuuccag

SEQ ID NO: 549735 - RNA, 23 nt, Homo sapiens
aucuguaacaauuauguuuucag

SEQ ID NO: 549736 - RNA, 11 nt, Homo sapiens
aucuguacaau

SEQ ID NO: 549737 - RNA, 13 nt, Homo sapiens
aucuguacuuugu

SEQ ID NO: 549738 - RNA, 15 nt, Homo sapiens
aucuguacuuugugu

SEQ ID NO: 549739 - RNA, 14 nt, Homo sapiens
aucuguaucuugcc

SEQ ID NO: 549740 - RNA, 10 nt, Homo sapiens
aucugucaca

SEQ ID NO: 549741 - RNA, 22 nt, Homo sapiens
aucuguccagaggcugcaagga

SEQ ID NO: 549742 - RNA, 19 nt, Homo sapiens
aucugucuuucacuggaau

SEQ ID NO: 549743 - RNA, 14 nt, Homo sapiens
aucugucuuuccac

SEQ ID NO: 549744 - RNA, 17 nt, Homo sapiens
aucugugcaaauccuug

SEQ ID NO: 549745 - RNA, 10 nt, Homo sapiens
aucugugcac

SEQ ID NO: 549746 - RNA, 17 nt, Homo sapiens
aucugugccccaugccu

SEQ ID NO: 549747 - RNA, 15 nt, Homo sapiens
aucugugcuggccau

SEQ ID NO: 549748 - RNA, 20 nt, Homo sapiens
aucuguggaaugauucacau

SEQ ID NO: 549749 - RNA, 21 nt, Homo sapiens
aucugugggucugggagucac

SEQ ID NO: 549750 - RNA, 12 nt, Homo sapiens
aucuguguaaag

SEQ ID NO: 549751 - RNA, 20 nt, Homo sapiens
aucugugucaaaagccagau

SEQ ID NO: 549752 - RNA, 19 nt, Homo sapiens
aucuguguucgauggcuca

SEQ ID NO: 549753 - RNA, 16 nt, Homo sapiens
aucuguuauccugcua

SEQ ID NO: 549754 - RNA, 11 nt, Homo sapiens
aucuguuccuu

SEQ ID NO: 549755 - RNA, 13 nt, Homo sapiens
aucuguugcuaug

SEQ ID NO: 549756 - RNA, 16 nt, Homo sapiens
aucuuaaaacaaauuc

SEQ ID NO: 549757 - RNA, 18 nt, Homo sapiens
aucuuaaaacaaauucau

SEQ ID NO: 549758 - RNA, 13 nt, Homo sapiens
aucuuaaaacuaa

SEQ ID NO: 549759 - RNA, 13 nt, Homo sapiens
aucuuaacaaagc

SEQ ID NO: 549760 - RNA, 19 nt, Homo sapiens
aucuuaauauaaauucacu

SEQ ID NO: 549761 - RNA, 14 nt, Homo sapiens
aucuuaauguauau

SEQ ID NO: 549762 - RNA, 21 nt, Homo sapiens
aucuuacauauaauaaacuuu

SEQ ID NO: 549763 - RNA, 14 nt, Homo sapiens
aucuuacugaaggu

SEQ ID NO: 549764 - RNA, 17 nt, Homo sapiens
aucuuagauguuucaca

SEQ ID NO: 549765 - RNA, 14 nt, Homo sapiens
aucuuagugccuga

SEQ ID NO: 549766 - RNA, 15 nt, Homo sapiens
aucuuauuuaggaag

SEQ ID NO: 549767 - RNA, 22 nt, Homo sapiens
aucuucaauuuauuacugaaaa

SEQ ID NO: 549768 - RNA, 12 nt, Homo sapiens
aucuucacaaaa

SEQ ID NO: 549769 - RNA, 13 nt, Homo sapiens
aucuucaccucag

SEQ ID NO: 549770 - RNA, 19 nt, Homo sapiens
aucuucacgacaauguuga

SEQ ID NO: 549771 - RNA, 17 nt, Homo sapiens
guagagaagcaaguaaa

SEQ ID NO: 549772 - RNA, 18 nt, Homo sapiens
guagagacaauacaguaa

SEQ ID NO: 549773 - RNA, 21 nt, Homo sapiens
guagagacgguguuuugccau

SEQ ID NO: 549774 - RNA, 18 nt, Homo sapiens
guagagaugggguuucac

SEQ ID NO: 549775 - RNA, 22 nt, Homo sapiens
guagagcaaaggagacaaagca

SEQ ID NO: 549776 - RNA, 19 nt, Homo sapiens
guagaggcugggggcucca

SEQ ID NO: 549777 - RNA, 18 nt, Homo sapiens
guagagguuuuguuguuu

SEQ ID NO: 549778 - RNA, 17 nt, Homo sapiens
guagaguggugcugcuu

SEQ ID NO: 549779 - RNA, 22 nt, Homo sapiens
guagaguuugaaggaggugagg

SEQ ID NO: 549780 - RNA, 20 nt, Homo sapiens
guagauauuguuuucuguaa

SEQ ID NO: 549781 - RNA, 15 nt, Homo sapiens
guagaugacuacuug

SEQ ID NO: 549782 - RNA, 12 nt, Homo sapiens
guagaugggagg

SEQ ID NO: 549783 - RNA, 15 nt, Homo sapiens
guagaugugauuaac

SEQ ID NO: 549784 - RNA, 18 nt, Homo sapiens
guagauguggccuuugaa

SEQ ID NO: 549785 - RNA, 15 nt, Homo sapiens
guagauuacugaaaa

SEQ ID NO: 549786 - RNA, 16 nt, Homo sapiens
guagcaaacuuuucac

SEQ ID NO: 549787 - RNA, 16 nt, Homo sapiens
guagcaagaugcaaau

SEQ ID NO: 549788 - RNA, 16 nt, Homo sapiens
guagcacauuaccaau

SEQ ID NO: 549789 - RNA, 19 nt, Homo sapiens
guagcagggggagugcugg

SEQ ID NO: 549790 - RNA, 17 nt, Homo sapiens
guagcagugucuguaaa

SEQ ID NO: 549791 - RNA, 21 nt, Homo sapiens
guagcccuggguuuaauguca

SEQ ID NO: 549792 - RNA, 21 nt, Homo sapiens
guagccgcugggguguuaaug

SEQ ID NO: 549793 - RNA, 19 nt, Homo sapiens
guagccugggcucacugug

SEQ ID NO: 549794 - RNA, 23 nt, Homo sapiens
guagccugggcucacugugcugg

SEQ ID NO: 549795 - RNA, 20 nt, Homo sapiens
guagcgagcugcucugcuau

SEQ ID NO: 549796 - RNA, 15 nt, Homo sapiens
guagcuagccugaga

SEQ ID NO: 549797 - RNA, 19 nt, Homo sapiens
guagcuagcgugugccagg

SEQ ID NO: 549798 - RNA, 22 nt, Homo sapiens
guagcuaggacuacagacaugu

SEQ ID NO: 549799 - RNA, 16 nt, Homo sapiens
guagcucggcaccaac

SEQ ID NO: 549800 - RNA, 17 nt, Homo sapiens
guagcugcaacaacagg

SEQ ID NO: 549801 - RNA, 18 nt, Homo sapiens
guagcugggauuacaggc

SEQ ID NO: 549802 - RNA, 19 nt, Homo sapiens
guagcugggauuacaggca

SEQ ID NO: 549803 - RNA, 22 nt, Homo sapiens
guagcugugucauguauauacc

SEQ ID NO: 549804 - RNA, 21 nt, Homo sapiens
guagcuuaccagaagcuucca

SEQ ID NO: 549805 - RNA, 15 nt, Homo sapiens
guagcuucugcaguu

SEQ ID NO: 549806 - RNA, 23 nt, Homo sapiens
guaggaaacucaucuccuuccug

SEQ ID NO: 549807 - RNA, 17 nt, Homo sapiens
guaggaaagucacccaa

SEQ ID NO: 549808 - RNA, 17 nt, Homo sapiens
guaggagagagugcugc

SEQ ID NO: 549809 - RNA, 17 nt, Homo sapiens
guaggcacgaagcaauu

SEQ ID NO: 549810 - RNA, 12 nt, Homo sapiens
guagggagugaa

SEQ ID NO: 549811 - RNA, 11 nt, Homo sapiens
guaggggccac

SEQ ID NO: 549812 - RNA, 17 nt, Homo sapiens
guaggggcccacuucac

SEQ ID NO: 549813 - RNA, 20 nt, Homo sapiens
guagguacuucacauugcaa

SEQ ID NO: 549814 - RNA, 17 nt, Homo sapiens
guaggugucugccuuca

SEQ ID NO: 549815 - RNA, 16 nt, Homo sapiens
guaguaaacuuggaac

SEQ ID NO: 549816 - RNA, 21 nt, Homo sapiens
guagucauacucccuggugua

SEQ ID NO: 549817 - RNA, 16 nt, Homo sapiens
guagucauucuuacaa

SEQ ID NO: 549818 - RNA, 18 nt, Homo sapiens
guagugauuaacugugaa

SEQ ID NO: 549819 - RNA, 21 nt, Homo sapiens
guagugauuaacugugaauaa

SEQ ID NO: 549820 - RNA, 11 nt, Homo sapiens
guagugcaagc

SEQ ID NO: 549821 - RNA, 15 nt, Homo sapiens
guagugccacuguug

SEQ ID NO: 549822 - RNA, 17 nt, Homo sapiens
guaguuacuguggucac

SEQ ID NO: 549823 - RNA, 23 nt, Homo sapiens
guaguucaaagagucugucuuga

SEQ ID NO: 549824 - RNA, 17 nt, Homo sapiens
guaguucaauagucuaa

SEQ ID NO: 549825 - RNA, 15 nt, Homo sapiens
guaguugacaauucu

SEQ ID NO: 549826 - RNA, 22 nt, Homo sapiens
guaguuucuugaggccaaacac

SEQ ID NO: 549827 - RNA, 22 nt, Homo sapiens
guaguuuguuuuagaaccagcc

SEQ ID NO: 549828 - RNA, 17 nt, Homo sapiens
guaguuuucaaaacaca

SEQ ID NO: 549829 - RNA, 16 nt, Homo sapiens
guauaacaacuuugaa

SEQ ID NO: 549830 - RNA, 15 nt, Homo sapiens
guauaacugaguuaa

SEQ ID NO: 549831 - RNA, 15 nt, Homo sapiens
guauaauacuuugua

SEQ ID NO: 549832 - RNA, 15 nt, Homo sapiens
guauaaucuuuucau

SEQ ID NO: 549833 - RNA, 16 nt, Homo sapiens
guauaauuuaacuuca

SEQ ID NO: 549834 - RNA, 20 nt, Homo sapiens
guauaauuugaggugaaauu

SEQ ID NO: 549835 - RNA, 18 nt, Homo sapiens
guauacagcauugacuca

SEQ ID NO: 549836 - RNA, 11 nt, Homo sapiens
guauacuauag

SEQ ID NO: 549837 - RNA, 21 nt, Homo sapiens
guauagaaaaucuucauggaa

SEQ ID NO: 549838 - RNA, 17 nt, Homo sapiens
guauagcuggcaccuua

SEQ ID NO: 549839 - RNA, 19 nt, Homo sapiens
guauagcuuuauacucucu

SEQ ID NO: 549840 - RNA, 23 nt, Homo sapiens
guauaguaaaugccucauuuaau

SEQ ID NO: 549841 - RNA, 15 nt, Homo sapiens
guauaguacuggcau

SEQ ID NO: 549842 - RNA, 17 nt, Homo sapiens
guauaguugcuugccug

SEQ ID NO: 549843 - RNA, 15 nt, Homo sapiens
guauauagaagucua

SEQ ID NO: 549844 - RNA, 15 nt, Homo sapiens
guauauauaauacug

SEQ ID NO: 549845 - RNA, 19 nt, Homo sapiens
guauauauaguagcauuuc

SEQ ID NO: 549846 - RNA, 19 nt, Homo sapiens
guauauauuuacaugucuu

SEQ ID NO: 549847 - RNA, 14 nt, Homo sapiens
guauaucauucuac

SEQ ID NO: 549848 - RNA, 13 nt, Homo sapiens
guauauccaaaag

SEQ ID NO: 549849 - RNA, 19 nt, Homo sapiens
guauaucucaacagaauua

SEQ ID NO: 549850 - RNA, 12 nt, Homo sapiens
guauaugcauuc

SEQ ID NO: 549851 - RNA, 13 nt, Homo sapiens
guauaugcugaug

SEQ ID NO: 549852 - RNA, 20 nt, Homo sapiens
guauaugugcauggacugug

SEQ ID NO: 549853 - RNA, 11 nt, Homo sapiens
guauauuccau

SEQ ID NO: 549854 - RNA, 19 nt, Homo sapiens
guauauuuaauuuugacau

SEQ ID NO: 549855 - RNA, 17 nt, Homo sapiens
guauauuugguacugua

SEQ ID NO: 549856 - RNA, 19 nt, Homo sapiens
uauaauuuagacuuggauu

SEQ ID NO: 549857 - RNA, 18 nt, Homo sapiens
uauaauuuccucacugcc

SEQ ID NO: 549858 - RNA, 15 nt, Homo sapiens
uauaauuucuguuca

SEQ ID NO: 549859 - RNA, 12 nt, Homo sapiens
uaucacaaucuc

SEQ ID NO: 549860 - RNA, 17 nt, Homo sapiens
uaucacauuuaccauaa

SEQ ID NO: 549861 - RNA, 22 nt, Homo sapiens
uaucaccuagcagccucaaaac

SEQ ID NO: 549862 - RNA, 15 nt, Homo sapiens
uaucaccucauggcc

SEQ ID NO: 549863 - RNA, 22 nt, Homo sapiens
uaucaccucauucugaacccuu

SEQ ID NO: 549864 - RNA, 22 nt, Homo sapiens
uaucacucaauuucucugagga

SEQ ID NO: 549865 - RNA, 18 nt, Homo sapiens
uaucacuucacuguucuc

SEQ ID NO: 549866 - RNA, 15 nt, Homo sapiens
uaucagaauucucag

SEQ ID NO: 549867 - RNA, 21 nt, Homo sapiens
uaucagacucuguaauugaau

SEQ ID NO: 549868 - RNA, 20 nt, Homo sapiens
uaucagacuguaggauuuga

SEQ ID NO: 549869 - RNA, 16 nt, Homo sapiens
uaucagagcucuuaau

SEQ ID NO: 549870 - RNA, 13 nt, Homo sapiens
uaucagcaaaaaa

SEQ ID NO: 549871 - RNA, 16 nt, Homo sapiens
uaucaggcgucccaua

SEQ ID NO: 549872 - RNA, 22 nt, Homo sapiens
uaucaggggugcauucuggcca

SEQ ID NO: 549873 - RNA, 12 nt, Homo sapiens
uaucaguaccuc

SEQ ID NO: 549874 - RNA, 20 nt, Homo sapiens
uaucaguauucugacaugua

SEQ ID NO: 549875 - RNA, 15 nt, Homo sapiens
uaucaguauugugaa

SEQ ID NO: 549876 - RNA, 16 nt, Homo sapiens
uaucaguuaccaaaca

SEQ ID NO: 549877 - RNA, 20 nt, Homo sapiens
uaucaguuauaugauauucu

SEQ ID NO: 549878 - RNA, 16 nt, Homo sapiens
uaucaguugacagugu

SEQ ID NO: 549879 - RNA, 21 nt, Homo sapiens
uaucaguugagcuucauauac

SEQ ID NO: 549880 - RNA, 19 nt, Homo sapiens
uaucauaacuauacuugau

SEQ ID NO: 549881 - RNA, 15 nt, Homo sapiens
uaucauacuguucaa

SEQ ID NO: 549882 - RNA, 14 nt, Homo sapiens
uaucauaugaacuu

SEQ ID NO: 549883 - RNA, 20 nt, Homo sapiens
uaucauauuauuauccuccu

SEQ ID NO: 549884 - RNA, 19 nt, Homo sapiens
uaucaucugcuaaguaauu

SEQ ID NO: 549885 - RNA, 19 nt, Homo sapiens
uaucaugaaacacuucuca

SEQ ID NO: 549886 - RNA, 15 nt, Homo sapiens
uaucaugaagcacau

SEQ ID NO: 549887 - RNA, 16 nt, Homo sapiens
uaucaugguagucacu

SEQ ID NO: 549888 - RNA, 17 nt, Homo sapiens
uaucaugucuugugcau

SEQ ID NO: 549889 - RNA, 14 nt, Homo sapiens
uaucauuacauaua

SEQ ID NO: 549890 - RNA, 23 nt, Homo sapiens
uaucauugcuaaacugaugacuu

SEQ ID NO: 549891 - RNA, 20 nt, Homo sapiens
uaucauuggaacaacugaua

SEQ ID NO: 549892 - RNA, 16 nt, Homo sapiens
uauccaaagacuguac

SEQ ID NO: 549893 - RNA, 22 nt, Homo sapiens
uauccaaagggaauacucacau

SEQ ID NO: 549894 - RNA, 16 nt, Homo sapiens
uauccaagaccugaaa

SEQ ID NO: 549895 - RNA, 19 nt, Homo sapiens
uauccaauaggcauuugau

SEQ ID NO: 549896 - RNA, 13 nt, Homo sapiens
uauccaccaagaa

SEQ ID NO: 549897 - RNA, 22 nt, Homo sapiens
uauccacccagcccauucucuc

SEQ ID NO: 549898 - RNA, 18 nt, Homo sapiens
uauccaccucccuaccaa

SEQ ID NO: 549899 - RNA, 15 nt, Homo sapiens
uauccagaagccagu

SEQ ID NO: 549900 - RNA, 22 nt, Homo sapiens
uauccauauuuuacugaucucu

SEQ ID NO: 549901 - RNA, 20 nt, Homo sapiens
uaucccaaucaaagaauuac

SEQ ID NO: 549902 - RNA, 15 nt, Homo sapiens
uaucccaccaaccuc

SEQ ID NO: 549903 - RNA, 15 nt, Homo sapiens
uaucccagaccccuc

SEQ ID NO: 549904 - RNA, 18 nt, Homo sapiens
uaucccagagaacaauca

SEQ ID NO: 549905 - RNA, 21 nt, Homo sapiens
uaucccauggaaccacuaaaa

SEQ ID NO: 549906 - RNA, 23 nt, Homo sapiens
uauccccagggacagaaaccaag

SEQ ID NO: 549907 - RNA, 14 nt, Homo sapiens
uaucccuacuguaa

SEQ ID NO: 549908 - RNA, 15 nt, Homo sapiens
uaucccugguuccua

SEQ ID NO: 549909 - RNA, 16 nt, Homo sapiens
uaucccuuacuccaga

SEQ ID NO: 549910 - RNA, 22 nt, Homo sapiens
uauccguagaguagucaugaca

SEQ ID NO: 549911 - RNA, 18 nt, Homo sapiens
uauccuacugagcauuug

SEQ ID NO: 549912 - RNA, 18 nt, Homo sapiens
uauccuauaagaugacaa

SEQ ID NO: 549913 - RNA, 21 nt, Homo sapiens
uauccuccccuuuuaccacuc

SEQ ID NO: 549914 - RNA, 22 nt, Homo sapiens
uauccugauaaacauuaaacac

SEQ ID NO: 549915 - RNA, 15 nt, Homo sapiens
uauccugauuccaaa

SEQ ID NO: 549916 - RNA, 23 nt, Homo sapiens
uauccuguaauaaagcucuuuaa

SEQ ID NO: 549917 - RNA, 15 nt, Homo sapiens
uauccuuagcucaca

SEQ ID NO: 549918 - RNA, 22 nt, Homo sapiens
uauccuuccaaaaaauuaaaac

SEQ ID NO: 549919 - RNA, 15 nt, Homo sapiens
uauccuuucaagaca

SEQ ID NO: 549920 - RNA, 14 nt, Homo sapiens
uauccuuucacucu

SEQ ID NO: 549921 - RNA, 22 nt, Homo sapiens
uauccuuugugagccuaugaua

SEQ ID NO: 549922 - RNA, 19 nt, Homo sapiens
uaucgaauauaguucugug

SEQ ID NO: 549923 - RNA, 15 nt, Homo sapiens
uaucgccuuuugaca

SEQ ID NO: 549924 - RNA, 17 nt, Homo sapiens
uaucgggagcagugucu

SEQ ID NO: 549925 - RNA, 15 nt, Homo sapiens
uaucuaaaaucugcu

SEQ ID NO: 549926 - RNA, 22 nt, Homo sapiens
uaucuaauuuuacacucuguau

SEQ ID NO: 549927 - RNA, 17 nt, Homo sapiens
uaucuagcaaucacaac

SEQ ID NO: 549928 - RNA, 15 nt, Homo sapiens
uaucuaguucauuga

SEQ ID NO: 549929 - RNA, 20 nt, Homo sapiens
uaucuaugcaguuccaauca

SEQ ID NO: 549930 - RNA, 23 nt, Homo sapiens
uaucucaggggccaacuaggcag

SEQ ID NO: 549931 - RNA, 21 nt, Homo sapiens
uaucuccagcggcccugucau

SEQ ID NO: 549932 - RNA, 12 nt, Homo sapiens
uaucuccugaca

SEQ ID NO: 549933 - RNA, 21 nt, Homo sapiens
uaucucugaagcauguuucau

SEQ ID NO: 549934 - RNA, 11 nt, Homo sapiens
uaucucuggca

SEQ ID NO: 549935 - RNA, 14 nt, Homo sapiens
uaucugaauggaag

SEQ ID NO: 549936 - RNA, 14 nt, Homo sapiens
uaucugaggucaca

SEQ ID NO: 549937 - RNA, 21 nt, Homo sapiens
uaucugaguugccaagacaaa

SEQ ID NO: 549938 - RNA, 23 nt, Homo sapiens
uaucugauuuccuaaugucagag

SEQ ID NO: 549939 - RNA, 16 nt, Homo sapiens
uaucugcuuccauuaa

SEQ ID NO: 549940 - RNA, 20 nt, Homo sapiens
uaucuggaggccuuccagcu

SEQ ID NO: 549941 - RNA, 15 nt, Homo sapiens
uaucugggauucuac

SEQ ID NO: 549942 - RNA, 20 nt, Homo sapiens
uaucuggggaaaucaaaaca

SEQ ID NO: 549943 - RNA, 14 nt, Homo sapiens
uaucugucaucucu

SEQ ID NO: 549944 - RNA, 20 nt, Homo sapiens
uaucuguguuuguacugugc

SEQ ID NO: 549945 - RNA, 21 nt, Homo sapiens
uaucuucguuaguaaucugua

SEQ ID NO: 549946 - RNA, 18 nt, Homo sapiens
uaucuugaagucagccac

SEQ ID NO: 549947 - RNA, 18 nt, Homo sapiens
uaucuugauuucacugga

SEQ ID NO: 549948 - RNA, 19 nt, Homo sapiens
uaucuugcaccccaaagcu

SEQ ID NO: 549949 - RNA, 18 nt, Homo sapiens
uaucuuucgauaaacaac

SEQ ID NO: 549950 - RNA, 17 nt, Homo sapiens
uaucuuugugugacaug

SEQ ID NO: 549951 - RNA, 11 nt, Homo sapiens
uaucuuuucaa

SEQ ID NO: 549952 - RNA, 21 nt, Homo sapiens
uaugaaaaagaagaaucucau

SEQ ID NO: 549953 - RNA, 16 nt, Homo sapiens
uaugaaaacuagcauu

SEQ ID NO: 549954 - RNA, 19 nt, Homo sapiens
uaugaaaauacaacuuaaa

SEQ ID NO: 549955 - RNA, 23 nt, Homo sapiens
uaugaaaauauagacauucucac

SEQ ID NO: 549956 - RNA, 15 nt, Homo sapiens
uaugaaaaucuccau

SEQ ID NO: 549957 - RNA, 20 nt, Homo sapiens
uaugaaaaucuccaucucaa

SEQ ID NO: 549958 - RNA, 20 nt, Homo sapiens
uaugaaaccacugcuggcag

SEQ ID NO: 549959 - RNA, 16 nt, Homo sapiens
uaugaacaacuccaaa

SEQ ID NO: 549960 - RNA, 16 nt, Homo sapiens
uaugaacagaaaugca

SEQ ID NO: 549961 - RNA, 12 nt, Homo sapiens
uaugaacaucca

SEQ ID NO: 549962 - RNA, 14 nt, Homo sapiens
uaugaacaugcagu

SEQ ID NO: 549963 - RNA, 23 nt, Homo sapiens
uaugaaccuauuuucauuuguac

SEQ ID NO: 549964 - RNA, 16 nt, Homo sapiens
uaugaacuucucucag

SEQ ID NO: 549965 - RNA, 16 nt, Homo sapiens
uaugaaguagcaauuu

SEQ ID NO: 549966 - RNA, 20 nt, Homo sapiens
uaugaauaaagaaugccauu

SEQ ID NO: 549967 - RNA, 13 nt, Homo sapiens
uaugaauaucauu

SEQ ID NO: 549968 - RNA, 16 nt, Homo sapiens
uaugaaucacaguauu

SEQ ID NO: 549969 - RNA, 21 nt, Homo sapiens
uaugaaugacaguagucacac

SEQ ID NO: 549970 - RNA, 12 nt, Homo sapiens
uaugaaugcagu

SEQ ID NO: 549971 - RNA, 23 nt, Homo sapiens
uaugaauggguggaaagguguga

SEQ ID NO: 549972 - RNA, 22 nt, Homo sapiens
uaugacagugaagcagcacugu

SEQ ID NO: 549973 - RNA, 23 nt, Homo sapiens
uaugacagugaauauugcuuuua

SEQ ID NO: 549974 - RNA, 20 nt, Homo sapiens
uaugacuaauauaacuugaa

SEQ ID NO: 549975 - RNA, 16 nt, Homo sapiens
uaugacuccauucaaa

SEQ ID NO: 549976 - RNA, 18 nt, Homo sapiens
uaugacugauuacucaga

SEQ ID NO: 549977 - RNA, 17 nt, Homo sapiens
uaugagaaaaauauuca

SEQ ID NO: 549978 - RNA, 17 nt, Homo sapiens
uaugagaaaguucucau

SEQ ID NO: 549979 - RNA, 22 nt, Homo sapiens
uaugagaugguuaaaaaggcca

SEQ ID NO: 549980 - RNA, 11 nt, Homo sapiens
uagcugcuaua

SEQ ID NO: 549981 - RNA, 18 nt, Homo sapiens
uagcugguucacacugac

SEQ ID NO: 549982 - RNA, 23 nt, Homo sapiens
uagcugguucacacugaccaaga

SEQ ID NO: 549983 - RNA, 23 nt, Homo sapiens
uagcugugucauguauauaccuu

SEQ ID NO: 549984 - RNA, 22 nt, Homo sapiens
uagcuguuucaaaugugcauuu

SEQ ID NO: 549985 - RNA, 14 nt, Homo sapiens
uagcuuaacuaauu

SEQ ID NO: 549986 - RNA, 18 nt, Homo sapiens
uagcuuagcaucagaggu

SEQ ID NO: 549987 - RNA, 14 nt, Homo sapiens
uagcuuaguucuuc

SEQ ID NO: 549988 - RNA, 22 nt, Homo sapiens
uagcuucugcuuuucugcccug

SEQ ID NO: 549989 - RNA, 19 nt, Homo sapiens
uagcuucuucagagaucaa

SEQ ID NO: 549990 - RNA, 12 nt, Homo sapiens
uagcuugcuccc

SEQ ID NO: 549991 - RNA, 20 nt, Homo sapiens
uagcuuguauaguguaaaau

SEQ ID NO: 549992 - RNA, 23 nt, Homo sapiens
uagcuuuaaaaccugugugccau

SEQ ID NO: 549993 - RNA, 22 nt, Homo sapiens
uagcuuuaacuuguaaaccaca

SEQ ID NO: 549994 - RNA, 16 nt, Homo sapiens
uagcuuuagggcaaua

SEQ ID NO: 549995 - RNA, 22 nt, Homo sapiens
uagcuuuagggcaauauugcca

SEQ ID NO: 549996 - RNA, 23 nt, Homo sapiens
uagcuuuagggcaauauugccau

SEQ ID NO: 549997 - RNA, 16 nt, Homo sapiens
uagcuuucuccagauc

SEQ ID NO: 549998 - RNA, 22 nt, Homo sapiens
uagcuuugaaacuccaugcaaa

SEQ ID NO: 549999 - RNA, 13 nt, Homo sapiens
uagcuuugcacau

SEQ ID NO: 550000 - RNA, 15 nt, Homo sapiens
uaggaaaacauugca

SEQ ID NO: 550001 - RNA, 17 nt, Homo sapiens
uaggaaaagugaaucuu

SEQ ID NO: 550002 - RNA, 18 nt, Homo sapiens
uaggaaagcauaugcagc

SEQ ID NO: 550003 - RNA, 23 nt, Homo sapiens
uaggaaagucacccaaacacuuc

SEQ ID NO: 550004 - RNA, 15 nt, Homo sapiens
uaggaagacauaaaa

SEQ ID NO: 550005 - RNA, 16 nt, Homo sapiens
uaggaagagaaaccag

SEQ ID NO: 550006 - RNA, 18 nt, Homo sapiens
uaggaagggaucugagaa

SEQ ID NO: 550007 - RNA, 13 nt, Homo sapiens
uaggaaguaggaa

SEQ ID NO: 550008 - RNA, 13 nt, Homo sapiens
uaggacauaaaga

SEQ ID NO: 550009 - RNA, 16 nt, Homo sapiens
uaggacauugugucag

SEQ ID NO: 550010 - RNA, 17 nt, Homo sapiens
uaggaccaauaccuccu

SEQ ID NO: 550011 - RNA, 20 nt, Homo sapiens
uaggagacugcgucaagcaa

SEQ ID NO: 550012 - RNA, 13 nt, Homo sapiens
uaggagagccaac

SEQ ID NO: 550013 - RNA, 14 nt, Homo sapiens
uaggauaagcacua

SEQ ID NO: 550014 - RNA, 14 nt, Homo sapiens
uaggauaagccacu

SEQ ID NO: 550015 - RNA, 16 nt, Homo sapiens
uaggauagacacugga

SEQ ID NO: 550016 - RNA, 19 nt, Homo sapiens
uaggaugaaucauauucau

SEQ ID NO: 550017 - RNA, 12 nt, Homo sapiens
uaggauguggaa

SEQ ID NO: 550018 - RNA, 20 nt, Homo sapiens
uaggauuaaacacacacaaa

SEQ ID NO: 550019 - RNA, 15 nt, Homo sapiens
uaggauuaauaaaga

SEQ ID NO: 550020 - RNA, 15 nt, Homo sapiens
uaggcaaaguacaaa

SEQ ID NO: 550021 - RNA, 16 nt, Homo sapiens
uaggcaaaguacaaaa

SEQ ID NO: 550022 - RNA, 13 nt, Homo sapiens
uaggcacuuuaaa

SEQ ID NO: 550023 - RNA, 16 nt, Homo sapiens
uaggcagacacaggga

SEQ ID NO: 550024 - RNA, 12 nt, Homo sapiens
uaggcagaucac

SEQ ID NO: 550025 - RNA, 17 nt, Homo sapiens
uaggcagccugcaggga

SEQ ID NO: 550026 - RNA, 20 nt, Homo sapiens
uaggcaggaccaugggacca

SEQ ID NO: 550027 - RNA, 12 nt, Homo sapiens
uaggcauguaaa

SEQ ID NO: 550028 - RNA, 15 nt, Homo sapiens
uaggccacauugaca

SEQ ID NO: 550029 - RNA, 17 nt, Homo sapiens
uaggcgcuguucuugcu

SEQ ID NO: 550030 - RNA, 23 nt, Homo sapiens
uaggcggucaugugugcauguga

SEQ ID NO: 550031 - RNA, 17 nt, Homo sapiens
uaggcuauuaaaaaagu

SEQ ID NO: 550032 - RNA, 14 nt, Homo sapiens
uagggaagcucagg

SEQ ID NO: 550033 - RNA, 22 nt, Homo sapiens
uagggacaugaaauuuacaaag

SEQ ID NO: 550034 - RNA, 22 nt, Homo sapiens
uagggacucagggccaugccug

SEQ ID NO: 550035 - RNA, 14 nt, Homo sapiens
uagggacuuggggc

SEQ ID NO: 550036 - RNA, 18 nt, Homo sapiens
uagggagaugaguugcag

SEQ ID NO: 550037 - RNA, 22 nt, Homo sapiens
uagggaugccuuucuaguccua

SEQ ID NO: 550038 - RNA, 24 nt, Homo sapiens
uagggauuuuuggcuacacacaaa

SEQ ID NO: 550039 - RNA, 23 nt, Homo sapiens
uagggcacaaagacuucggggaa

SEQ ID NO: 550040 - RNA, 19 nt, Homo sapiens
uagggcacuuuaagucagu

SEQ ID NO: 550041 - RNA, 16 nt, Homo sapiens
uagggccgacgcugug

SEQ ID NO: 550042 - RNA, 17 nt, Homo sapiens
uagggcgacgucuucag

SEQ ID NO: 550043 - RNA, 17 nt, Homo sapiens
uagggcugcugcuucug

SEQ ID NO: 550044 - RNA, 18 nt, Homo sapiens
uagggcuggaagcacaga

SEQ ID NO: 550045 - RNA, 21 nt, Homo sapiens
uaggggaagggcuuugagggu

SEQ ID NO: 550046 - RNA, 13 nt, Homo sapiens
uaggggcaaaaau

SEQ ID NO: 550047 - RNA, 14 nt, Homo sapiens
uagggggaagacag

SEQ ID NO: 550048 - RNA, 23 nt, Homo sapiens
uagggggagcaaaucgugccuug

SEQ ID NO: 550049 - RNA, 16 nt, Homo sapiens
uaggggucaggcucca

SEQ ID NO: 550050 - RNA, 22 nt, Homo sapiens
uaggguuauuaguccaaaugug

SEQ ID NO: 550051 - RNA, 20 nt, Homo sapiens
uagguacuucacauugcaaa

SEQ ID NO: 550052 - RNA, 20 nt, Homo sapiens
uagguaggggcccacuucac

SEQ ID NO: 550053 - RNA, 17 nt, Homo sapiens
uagguaucauucaacuc

SEQ ID NO: 550054 - RNA, 21 nt, Homo sapiens
uagguauuucuaacgccagca

SEQ ID NO: 550055 - RNA, 16 nt, Homo sapiens
uaggucagauggaggu

SEQ ID NO: 550056 - RNA, 18 nt, Homo sapiens
uaggucucaucucuucag

SEQ ID NO: 550057 - RNA, 16 nt, Homo sapiens
uaggucuccucagggu

SEQ ID NO: 550058 - RNA, 17 nt, Homo sapiens
uaggucuccucagggug

SEQ ID NO: 550059 - RNA, 19 nt, Homo sapiens
uaggucuuucucucaguga

SEQ ID NO: 550060 - RNA, 13 nt, Homo sapiens
uaggugacauaua

SEQ ID NO: 550061 - RNA, 23 nt, Homo sapiens
uaggugcugaaugaagcugccau

SEQ ID NO: 550062 - RNA, 16 nt, Homo sapiens
uaggugugacuugaac

SEQ ID NO: 550063 - RNA, 24 nt, Homo sapiens
uagguuaguagcccuucagucuua

SEQ ID NO: 550064 - RNA, 19 nt, Homo sapiens
uagguucaggaagaccaca

SEQ ID NO: 550065 - RNA, 17 nt, Homo sapiens
uagguugaaacauaucu

SEQ ID NO: 550066 - RNA, 22 nt, Homo sapiens
uagguugaacuaugaacacugu

SEQ ID NO: 550067 - RNA, 13 nt, Homo sapiens
uagguuggcagua

SEQ ID NO: 550068 - RNA, 18 nt, Homo sapiens
uagguuucagcaacaaga

SEQ ID NO: 550069 - RNA, 13 nt, Homo sapiens
uaguaaaguuugu

SEQ ID NO: 550070 - RNA, 15 nt, Homo sapiens
uaguaaaugcgugcu

SEQ ID NO: 550071 - RNA, 12 nt, Homo sapiens
uaguaacaacuc

SEQ ID NO: 550072 - RNA, 16 nt, Homo sapiens
uaguaacauagacaaa

SEQ ID NO: 550073 - RNA, 12 nt, Homo sapiens
uaguaacaugug

SEQ ID NO: 550074 - RNA, 17 nt, Homo sapiens
uaguaauaagauggcug

SEQ ID NO: 550075 - RNA, 19 nt, Homo sapiens
uaguaauaccaaagacuau

SEQ ID NO: 550076 - RNA, 15 nt, Homo sapiens
uaguagaacucacag

SEQ ID NO: 550077 - RNA, 22 nt, Homo sapiens
uaguagaauauggacuuggaaa

SEQ ID NO: 550078 - RNA, 19 nt, Homo sapiens
uaguagauguggccuuuga

SEQ ID NO: 550079 - RNA, 15 nt, Homo sapiens
uaguagcaaacuggg

SEQ ID NO: 550080 - RNA, 17 nt, Homo sapiens
uaguaguuauuuguaua

SEQ ID NO: 550081 - RNA, 15 nt, Homo sapiens
uaguauaauugaccu

SEQ ID NO: 550082 - RNA, 13 nt, Homo sapiens
uaguauagcuuua

SEQ ID NO: 550083 - RNA, 21 nt, Homo sapiens
uaguaugggaaaaaaacugaa

SEQ ID NO: 550084 - RNA, 22 nt, Homo sapiens
uaguaugggaaaaaaacugaag

SEQ ID NO: 550085 - RNA, 16 nt, Homo sapiens
uaguauuaugauugca

SEQ ID NO: 550086 - RNA, 21 nt, Homo sapiens
uaguauucuugagggacaaug

SEQ ID NO: 550087 - RNA, 13 nt, Homo sapiens
uaguauuggagca

SEQ ID NO: 550088 - RNA, 12 nt, Homo sapiens
uaguauugugau

SEQ ID NO: 550089 - RNA, 22 nt, Homo sapiens
uaguauuuaacuacaucugccu

SEQ ID NO: 550090 - RNA, 17 nt, Homo sapiens
uaguauuuuugccaaaa

SEQ ID NO: 550091 - RNA, 16 nt, Homo sapiens
uagucaaggaaccuca

SEQ ID NO: 550092 - RNA, 12 nt, Homo sapiens
uagucaauccug

SEQ ID NO: 550093 - RNA, 13 nt, Homo sapiens
uagucacacauag

SEQ ID NO: 550094 - RNA, 20 nt, Homo sapiens
uagucagggcaugcuuuauu

SEQ ID NO: 550095 - RNA, 16 nt, Homo sapiens
uagucauggauaacua

SEQ ID NO: 550096 - RNA, 18 nt, Homo sapiens
ucuccucuuuuguaccca

SEQ ID NO: 550097 - RNA, 16 nt, Homo sapiens
ucuccugaaugcaucc

SEQ ID NO: 550098 - RNA, 14 nt, Homo sapiens
ucuccugcccagau

SEQ ID NO: 550099 - RNA, 15 nt, Homo sapiens
ucuccugccucagcc

SEQ ID NO: 550100 - RNA, 23 nt, Homo sapiens
ucuccugcgcccuucauugccac

SEQ ID NO: 550101 - RNA, 15 nt, Homo sapiens
ucuccugcucucaua

SEQ ID NO: 550102 - RNA, 22 nt, Homo sapiens
ucuccuguauuuaacaaaaagu

SEQ ID NO: 550103 - RNA, 16 nt, Homo sapiens
ucuccuguccaaccua

SEQ ID NO: 550104 - RNA, 14 nt, Homo sapiens
ucuccugugugcuu

SEQ ID NO: 550105 - RNA, 23 nt, Homo sapiens
ucuccuucccugcagagcuuugg

SEQ ID NO: 550106 - RNA, 21 nt, Homo sapiens
ucuccuuucucuuaugcuuaa

SEQ ID NO: 550107 - RNA, 14 nt, Homo sapiens
ucuccuuuugacca

SEQ ID NO: 550108 - RNA, 17 nt, Homo sapiens
ucuccuuuugaccaaau

SEQ ID NO: 550109 - RNA, 23 nt, Homo sapiens
ucuccuuuugaccaaauaaagua

SEQ ID NO: 550110 - RNA, 14 nt, Homo sapiens
ucucgaacuccuga

SEQ ID NO: 550111 - RNA, 20 nt, Homo sapiens
ucucgaagugcugagauuac

SEQ ID NO: 550112 - RNA, 17 nt, Homo sapiens
ucucgaaugcugagaag

SEQ ID NO: 550113 - RNA, 17 nt, Homo sapiens
ucucgcagauguuaccu

SEQ ID NO: 550114 - RNA, 19 nt, Homo sapiens
ucucgcaguacauguuacu

SEQ ID NO: 550115 - RNA, 18 nt, Homo sapiens
ucucgcuuuguugcccag

SEQ ID NO: 550116 - RNA, 17 nt, Homo sapiens
ucucggccccucugauu

SEQ ID NO: 550117 - RNA, 13 nt, Homo sapiens
ucucggccuucac

SEQ ID NO: 550118 - RNA, 21 nt, Homo sapiens
ucucgggacuagcugccuucg

SEQ ID NO: 550119 - RNA, 15 nt, Homo sapiens
ucucgguuugccaaa

SEQ ID NO: 550120 - RNA, 18 nt, Homo sapiens
ucucgugguaggacugua

SEQ ID NO: 550121 - RNA, 17 nt, Homo sapiens
ucucuaacaguggacaa

SEQ ID NO: 550122 - RNA, 17 nt, Homo sapiens
ucaguagauacuaaagc

SEQ ID NO: 550123 - RNA, 18 nt, Homo sapiens
ucaguauaauuuaacuuc

SEQ ID NO: 550124 - RNA, 17 nt, Homo sapiens
ucaguauccacacauaa

SEQ ID NO: 550125 - RNA, 15 nt, Homo sapiens
ucaguauucugacau

SEQ ID NO: 550126 - RNA, 21 nt, Homo sapiens
ucagucaacaacuuacacuua

SEQ ID NO: 550127 - RNA, 22 nt, Homo sapiens
ucaguccauugcucuugagucu

SEQ ID NO: 550128 - RNA, 16 nt, Homo sapiens
ucaguccccauggcac

SEQ ID NO: 550129 - RNA, 16 nt, Homo sapiens
ucagucccccaccaca

SEQ ID NO: 550130 - RNA, 23 nt, Homo sapiens
ucagucccuauguauuugcaguu

SEQ ID NO: 550131 - RNA, 21 nt, Homo sapiens
ucagucucugaauacacagua

SEQ ID NO: 550132 - RNA, 19 nt, Homo sapiens
ucagucugggugggacuua

SEQ ID NO: 550133 - RNA, 14 nt, Homo sapiens
ucagucuggugcuc

SEQ ID NO: 550134 - RNA, 13 nt, Homo sapiens
ucagucugugaaa

SEQ ID NO: 550135 - RNA, 21 nt, Homo sapiens
ucagucuguucacugcauuca

SEQ ID NO: 550136 - RNA, 18 nt, Homo sapiens
ucagucuuccuuguggaa

SEQ ID NO: 550137 - RNA, 18 nt, Homo sapiens
ucagugaauaaaccauca

SEQ ID NO: 550138 - RNA, 23 nt, Homo sapiens
ucagugacagaguucacuauaaa

SEQ ID NO: 550139 - RNA, 19 nt, Homo sapiens
ucagugacuguuguagcau

SEQ ID NO: 550140 - RNA, 18 nt, Homo sapiens
ucagugacuuugagcuga

SEQ ID NO: 550141 - RNA, 15 nt, Homo sapiens
ucagugauaccuccu

SEQ ID NO: 550142 - RNA, 16 nt, Homo sapiens
ucagugauuacuguca

SEQ ID NO: 550143 - RNA, 15 nt, Homo sapiens
ucagugcaccugccu

SEQ ID NO: 550144 - RNA, 14 nt, Homo sapiens
ucagugcaggagag

SEQ ID NO: 550145 - RNA, 13 nt, Homo sapiens
ucagugcaguuuc

SEQ ID NO: 550146 - RNA, 14 nt, Homo sapiens
ucagugcaguuucu

SEQ ID NO: 550147 - RNA, 20 nt, Homo sapiens
ucagugcaguuucuuuucac

SEQ ID NO: 550148 - RNA, 14 nt, Homo sapiens
ucagugccaugacu

SEQ ID NO: 550149 - RNA, 17 nt, Homo sapiens
ucagugcucagaaauuu

SEQ ID NO: 550150 - RNA, 21 nt, Homo sapiens
ucagugcucccucacauguca

SEQ ID NO: 550151 - RNA, 16 nt, Homo sapiens
ucagugcucgagacac

SEQ ID NO: 550152 - RNA, 19 nt, Homo sapiens
ucagugcugugucauucca

SEQ ID NO: 550153 - RNA, 16 nt, Homo sapiens
ucaguggacccugugg

SEQ ID NO: 550154 - RNA, 23 nt, Homo sapiens
ucagugggaaacaaacugucuaa

SEQ ID NO: 550155 - RNA, 16 nt, Homo sapiens
ucagugggacucugau

SEQ ID NO: 550156 - RNA, 16 nt, Homo sapiens
ucagugguagcucugg

SEQ ID NO: 550157 - RNA, 14 nt, Homo sapiens
ucaguguacaugga

SEQ ID NO: 550158 - RNA, 22 nt, Homo sapiens
ucaguguagaaccuaauucaau

SEQ ID NO: 550159 - RNA, 14 nt, Homo sapiens
ucaguguauuugua

SEQ ID NO: 550160 - RNA, 16 nt, Homo sapiens
ucagugugagucagaa

SEQ ID NO: 550161 - RNA, 15 nt, Homo sapiens
ucaguguuaaaugug

SEQ ID NO: 550162 - RNA, 21 nt, Homo sapiens
ucaguucccccaguaccucca

SEQ ID NO: 550163 - RNA, 22 nt, Homo sapiens
ucaguucccuccuucuuacaga

SEQ ID NO: 550164 - RNA, 13 nt, Homo sapiens
ucaguucuagucu

SEQ ID NO: 550165 - RNA, 15 nt, Homo sapiens
ucaguugacagugua

SEQ ID NO: 550166 - RNA, 16 nt, Homo sapiens
ucaguugcauucauua

SEQ ID NO: 550167 - RNA, 17 nt, Homo sapiens
ucaguugcuuugcccaa

SEQ ID NO: 550168 - RNA, 22 nt, Homo sapiens
ucaguugucucugaugcagcuu

SEQ ID NO: 550169 - RNA, 16 nt, Homo sapiens
ucaguuugacuacucu

SEQ ID NO: 550170 - RNA, 16 nt, Homo sapiens
ucaguuuuuuguuuua

SEQ ID NO: 550171 - RNA, 18 nt, Homo sapiens
ucauaaaaagacaacuca

SEQ ID NO: 550172 - RNA, 19 nt, Homo sapiens
ucauaaaaugcauacuguu

SEQ ID NO: 550173 - RNA, 19 nt, Homo sapiens
ucauaacuugagaccuaau

SEQ ID NO: 550174 - RNA, 21 nt, Homo sapiens
ucauaagaaugaauaauaauu

SEQ ID NO: 550175 - RNA, 16 nt, Homo sapiens
ucauaagacacuuaga

SEQ ID NO: 550176 - RNA, 15 nt, Homo sapiens
ucauaaggugcuauc

SEQ ID NO: 550177 - RNA, 18 nt, Homo sapiens
ucauaaguuaugccucug

SEQ ID NO: 550178 - RNA, 13 nt, Homo sapiens
ucauaauaccuca

SEQ ID NO: 550179 - RNA, 16 nt, Homo sapiens
ucauaauucagcacuu

SEQ ID NO: 550180 - RNA, 20 nt, Homo sapiens
ucauaauucagcacuuaacu

SEQ ID NO: 550181 - RNA, 20 nt, Homo sapiens
ucauaauuccuacagcacua

SEQ ID NO: 550182 - RNA, 20 nt, Homo sapiens
ucauacagcugugaagacuu

SEQ ID NO: 550183 - RNA, 13 nt, Homo sapiens
ucauacaugcaua

SEQ ID NO: 550184 - RNA, 14 nt, Homo sapiens
ucauaccucagugg

SEQ ID NO: 550185 - RNA, 18 nt, Homo sapiens
ucauacuaaacuucaccu

SEQ ID NO: 550186 - RNA, 16 nt, Homo sapiens
ucauacuaguagucau

SEQ ID NO: 550187 - RNA, 12 nt, Homo sapiens
ucauacuguaac

SEQ ID NO: 550188 - RNA, 16 nt, Homo sapiens
ucauagaggugagaaa

SEQ ID NO: 550189 - RNA, 18 nt, Homo sapiens
ucauagcuaauuuuugca

SEQ ID NO: 550190 - RNA, 12 nt, Homo sapiens
ucauagcucacu

SEQ ID NO: 550191 - RNA, 20 nt, Homo sapiens
ucauaggaaaaguacauuua

SEQ ID NO: 550192 - RNA, 20 nt, Homo sapiens
ucauaggauuaagcaguuua

SEQ ID NO: 550193 - RNA, 12 nt, Homo sapiens
ucauaggcagua

SEQ ID NO: 550194 - RNA, 23 nt, Homo sapiens
ucauagggauggcagugauucug

SEQ ID NO: 550195 - RNA, 22 nt, Homo sapiens
ucauaggggcagguccuagucg

SEQ ID NO: 550196 - RNA, 15 nt, Homo sapiens
ucauagggucucuuc

SEQ ID NO: 550197 - RNA, 14 nt, Homo sapiens
ucauaguaacuucu

SEQ ID NO: 550198 - RNA, 19 nt, Homo sapiens
ucauaguauuggagcacau

SEQ ID NO: 550199 - RNA, 20 nt, Homo sapiens
ucauagugccuuuuuccuua

SEQ ID NO: 550200 - RNA, 14 nt, Homo sapiens
ucauauaccagcaa

SEQ ID NO: 550201 - RNA, 16 nt, Homo sapiens
ucauauaccagcaaua

SEQ ID NO: 550202 - RNA, 18 nt, Homo sapiens
ucauauaguaaacacuca

SEQ ID NO: 550203 - RNA, 19 nt, Homo sapiens
ucauaucaugguagucacu

SEQ ID NO: 550204 - RNA, 19 nt, Homo sapiens
ucauaucuuuuaauugugu

SEQ ID NO: 550205 - RNA, 19 nt, Homo sapiens
ucauaugacugauuacuca

SEQ ID NO: 550206 - RNA, 13 nt, Homo sapiens
ucauauggagcuc

SEQ ID NO: 550207 - RNA, 15 nt, Homo sapiens
ucauauguugcucag

SEQ ID NO: 550208 - RNA, 18 nt, Homo sapiens
ucauauucaagcuucaga

SEQ ID NO: 550209 - RNA, 15 nt, Homo sapiens
ucauauugaauguuu

SEQ ID NO: 550210 - RNA, 21 nt, Homo sapiens
ucauauuucuaccugagugaa

SEQ ID NO: 550211 - RNA, 16 nt, Homo sapiens
ucauauuugucuuuga

SEQ ID NO: 550212 - RNA, 19 nt, Homo sapiens
ucauauuuugccacugccu

SEQ ID NO: 550213 - RNA, 20 nt, Homo sapiens
ucauauuuuguauauaucug

SEQ ID NO: 550214 - RNA, 17 nt, Homo sapiens
ucaucaaaaacuuugga

SEQ ID NO: 550215 - RNA, 16 nt, Homo sapiens
ucaucaaaaagccuua

SEQ ID NO: 550216 - RNA, 19 nt, Homo sapiens
ucaucaaacauuugccaag

SEQ ID NO: 550217 - RNA, 21 nt, Homo sapiens
ucaucaaagcucacaccaaau

SEQ ID NO: 550218 - RNA, 19 nt, Homo sapiens
ucaucaacacgagaauaca

SEQ ID NO: 550219 - RNA, 18 nt, Homo sapiens
ucaucaauggggccaguc

SEQ ID NO: 550220 - RNA, 12 nt, Homo sapiens
ucaucacuggau

SEQ ID NO: 550221 - RNA, 19 nt, Homo sapiens
ucaucacuggaugaagauu

SEQ ID NO: 550222 - RNA, 12 nt, Homo sapiens
ucaucacuguaa

SEQ ID NO: 550223 - RNA, 13 nt, Homo sapiens
ucaucacuguaaa

SEQ ID NO: 550224 - RNA, 22 nt, Homo sapiens
ucaucagaagauaacuugagca

SEQ ID NO: 550225 - RNA, 18 nt, Homo sapiens
ucaucagagaacagucau

SEQ ID NO: 550226 - RNA, 17 nt, Homo sapiens
ucaucagauaugcuuac

SEQ ID NO: 550227 - RNA, 14 nt, Homo sapiens
ucaucaggucauua

SEQ ID NO: 550228 - RNA, 21 nt, Homo sapiens
ucaucauuuguggcagucccu

SEQ ID NO: 550229 - RNA, 22 nt, Homo sapiens
ucauccaauaccccuuuacuag

SEQ ID NO: 550230 - RNA, 22 nt, Homo sapiens
ucauccacucuacuaaugccuc

SEQ ID NO: 550231 - RNA, 14 nt, Homo sapiens
ucauccacuuucca

SEQ ID NO: 550232 - RNA, 14 nt, Homo sapiens
ucauccagcucacu

SEQ ID NO: 550233 - RNA, 17 nt, Homo sapiens
ucauccagcucacucau

SEQ ID NO: 550234 - RNA, 19 nt, Homo sapiens
ucauccccaggggucccag

SEQ ID NO: 550235 - RNA, 13 nt, Homo sapiens
uccacuacugcua

SEQ ID NO: 550236 - RNA, 20 nt, Homo sapiens
uccacuaggguccaccagga

SEQ ID NO: 550237 - RNA, 14 nt, Homo sapiens
uccacuagugcaaa

SEQ ID NO: 550238 - RNA, 17 nt, Homo sapiens
uccacuauuuucaaaga

SEQ ID NO: 550239 - RNA, 14 nt, Homo sapiens
uccacucacuccag

SEQ ID NO: 550240 - RNA, 21 nt, Homo sapiens
uccacuccagauuuuuuacag

SEQ ID NO: 550241 - RNA, 18 nt, Homo sapiens
uccacuccuccuacugua

SEQ ID NO: 550242 - RNA, 22 nt, Homo sapiens
uccacuccugaccccucuccuc

SEQ ID NO: 550243 - RNA, 21 nt, Homo sapiens
uccacugcguuguccacaaga

SEQ ID NO: 550244 - RNA, 19 nt, Homo sapiens
uccacuggaaaaguguaau

SEQ ID NO: 550245 - RNA, 11 nt, Homo sapiens
uccacuuagaa

SEQ ID NO: 550246 - RNA, 21 nt, Homo sapiens
uccagaaaaaugaaaagcaau

SEQ ID NO: 550247 - RNA, 22 nt, Homo sapiens
ucugacaauauacaagcuuuua

SEQ ID NO: 550248 - RNA, 18 nt, Homo sapiens
ucugacaaugcugagguu

SEQ ID NO: 550249 - RNA, 19 nt, Homo sapiens
ucugacacauuagccuuga

SEQ ID NO: 550250 - RNA, 19 nt, Homo sapiens
ucugacagcagccugugag

SEQ ID NO: 550251 - RNA, 17 nt, Homo sapiens
ucugacccaaagcaaaa

SEQ ID NO: 550252 - RNA, 20 nt, Homo sapiens
ucugacccaaagcaaaacau

SEQ ID NO: 550253 - RNA, 16 nt, Homo sapiens
ucugacccuccuucua

SEQ ID NO: 550254 - RNA, 16 nt, Homo sapiens
ucugacucacaagaag

SEQ ID NO: 550255 - RNA, 20 nt, Homo sapiens
ucugacucacaagaagacca

SEQ ID NO: 550256 - RNA, 15 nt, Homo sapiens
ucugacucugagcua

SEQ ID NO: 550257 - RNA, 22 nt, Homo sapiens
ucugacugagagcccacugcag

SEQ ID NO: 550258 - RNA, 15 nt, Homo sapiens
ucugacuuacuguca

SEQ ID NO: 550259 - RNA, 19 nt, Homo sapiens
ucugagaaacucuacaugu

SEQ ID NO: 550260 - RNA, 24 nt, Homo sapiens
ucugagacaccugaugaccuguua

SEQ ID NO: 550261 - RNA, 14 nt, Homo sapiens
ucugagaccaaagu

SEQ ID NO: 550262 - RNA, 20 nt, Homo sapiens
ucugagaggcucuccgugca

SEQ ID NO: 550263 - RNA, 21 nt, Homo sapiens
ucugagaggggagaguccagu

SEQ ID NO: 550264 - RNA, 15 nt, Homo sapiens
ucugagauugaauau

SEQ ID NO: 550265 - RNA, 20 nt, Homo sapiens
ucugagauuuuugauaucuc

SEQ ID NO: 550266 - RNA, 21 nt, Homo sapiens
ucugagcacagcugcauuaaa

SEQ ID NO: 550267 - RNA, 15 nt, Homo sapiens
ucugagcacccccuc

SEQ ID NO: 550268 - RNA, 15 nt, Homo sapiens
ucugagcuauuucau

SEQ ID NO: 550269 - RNA, 15 nt, Homo sapiens
ucugagcuccaccuc

SEQ ID NO: 550270 - RNA, 13 nt, Homo sapiens
ucugagcuggacg

SEQ ID NO: 550271 - RNA, 14 nt, Homo sapiens
ucugagcugugcag

SEQ ID NO: 550272 - RNA, 19 nt, Homo sapiens
ucugaggccugagugagug

SEQ ID NO: 550273 - RNA, 14 nt, Homo sapiens
ucugaguaacauca

SEQ ID NO: 550274 - RNA, 14 nt, Homo sapiens
ucugaguaagcccu

SEQ ID NO: 550275 - RNA, 17 nt, Homo sapiens
ucuggaccccaucugug

SEQ ID NO: 550276 - RNA, 13 nt, Homo sapiens
ucuggacuccacc

SEQ ID NO: 550277 - RNA, 14 nt, Homo sapiens
ucuggagaagacua

SEQ ID NO: 550278 - RNA, 16 nt, Homo sapiens
ucuggagccaagucca

SEQ ID NO: 550279 - RNA, 13 nt, Homo sapiens
ucuggagccagag

SEQ ID NO: 550280 - RNA, 21 nt, Homo sapiens
ucuggagcggaauuuaccuga

SEQ ID NO: 550281 - RNA, 20 nt, Homo sapiens
ucuggaggacggucagucca

SEQ ID NO: 550282 - RNA, 14 nt, Homo sapiens
ucuggaguggaaaa

SEQ ID NO: 550283 - RNA, 17 nt, Homo sapiens
ucuggauucaaauuuau

SEQ ID NO: 550284 - RNA, 15 nt, Homo sapiens
ucuggauucugaauc

SEQ ID NO: 550285 - RNA, 23 nt, Homo sapiens
ucuggcaacagagcaagacucca

SEQ ID NO: 550286 - RNA, 20 nt, Homo sapiens
ucuggcaacccuagucugcu

SEQ ID NO: 550287 - RNA, 19 nt, Homo sapiens
ucuggcaagccugucuuca

SEQ ID NO: 550288 - RNA, 13 nt, Homo sapiens
ucuggcacacucc

SEQ ID NO: 550289 - RNA, 14 nt, Homo sapiens
ucuggcacacuccc

SEQ ID NO: 550290 - RNA, 18 nt, Homo sapiens
ucuggccaaaagcaguaa

SEQ ID NO: 550291 - RNA, 16 nt, Homo sapiens
ucuggccaaauaugca

SEQ ID NO: 550292 - RNA, 20 nt, Homo sapiens
ucuggccaaauaugcacuuu

SEQ ID NO: 550293 - RNA, 15 nt, Homo sapiens
ucuggccccugagag

SEQ ID NO: 550294 - RNA, 20 nt, Homo sapiens
ucuggcccuugcuuaccucu

SEQ ID NO: 550295 - RNA, 14 nt, Homo sapiens
ucuggcucuugagg

SEQ ID NO: 550296 - RNA, 18 nt, Homo sapiens
ucuggcugaacccugugc

SEQ ID NO: 550297 - RNA, 19 nt, Homo sapiens
ucuggcuggaaagcagagc

SEQ ID NO: 550298 - RNA, 18 nt, Homo sapiens
ucuggcuguguugcccug

SEQ ID NO: 550299 - RNA, 20 nt, Homo sapiens
ucuggcuucccuaaacugca

SEQ ID NO: 550300 - RNA, 13 nt, Homo sapiens
ucuggcuugcccc

SEQ ID NO: 550301 - RNA, 14 nt, Homo sapiens
ucugggaagggaga

SEQ ID NO: 550302 - RNA, 17 nt, Homo sapiens
ucugggacaaaacugga

SEQ ID NO: 550303 - RNA, 15 nt, Homo sapiens
ucugggagaaaauca

SEQ ID NO: 550304 - RNA, 12 nt, Homo sapiens
ucuguugauuga

SEQ ID NO: 550305 - RNA, 17 nt, Homo sapiens
ucuguugccauggugau

SEQ ID NO: 550306 - RNA, 18 nt, Homo sapiens
ucuguuuaucaagccaua

SEQ ID NO: 550307 - RNA, 18 nt, Homo sapiens
ucuguuucaaagcacaau

SEQ ID NO: 550308 - RNA, 22 nt, Homo sapiens
ucuguuucuuaagggcacacac

SEQ ID NO: 550309 - RNA, 14 nt, Homo sapiens
ucuguuugacuuua

SEQ ID NO: 550310 - RNA, 14 nt, Homo sapiens
ucuguuugagauuu

SEQ ID NO: 550311 - RNA, 13 nt, Homo sapiens
ucuguuuguuuaa

SEQ ID NO: 550312 - RNA, 13 nt, Homo sapiens
ucuguuuugccug

SEQ ID NO: 550313 - RNA, 19 nt, Homo sapiens
ucuguuuuguuuugcugaa

SEQ ID NO: 550314 - RNA, 14 nt, Homo sapiens
ucuguuuuuagacc

SEQ ID NO: 550315 - RNA, 15 nt, Homo sapiens
ucuuaaaaacaacga

SEQ ID NO: 550316 - RNA, 22 nt, Homo sapiens
ucuuaaaaacaacgaaagaagg

SEQ ID NO: 550317 - RNA, 22 nt, Homo sapiens
ucuuaaaauauaagaccucugg

SEQ ID NO: 550318 - RNA, 13 nt, Homo sapiens
ucuuaaaauaucu

SEQ ID NO: 550319 - RNA, 15 nt, Homo sapiens
ucuuaaaauguuaac

SEQ ID NO: 550320 - RNA, 15 nt, Homo sapiens
ucuuaaacacaaauu

SEQ ID NO: 550321 - RNA, 23 nt, Homo sapiens
ucuuaaacacaaauuucauuucc

SEQ ID NO: 550322 - RNA, 22 nt, Homo sapiens
ucuuaaacuaaaugugcaauag

SEQ ID NO: 550323 - RNA, 17 nt, Homo sapiens
ucuuaaauauuuccauc

SEQ ID NO: 550324 - RNA, 13 nt, Homo sapiens
ucuuaagacguga

SEQ ID NO: 550325 - RNA, 13 nt, Homo sapiens
ucuuaagcacuuu

SEQ ID NO: 550326 - RNA, 14 nt, Homo sapiens
ucuuaagcacuuug

SEQ ID NO: 550327 - RNA, 18 nt, Homo sapiens
ucuuaagccuaaaugccu

SEQ ID NO: 550328 - RNA, 17 nt, Homo sapiens
ucuuaaggaacaucucu

SEQ ID NO: 550329 - RNA, 12 nt, Homo sapiens
ucuuaauacugu

SEQ ID NO: 550330 - RNA, 17 nt, Homo sapiens
ucuuaauucuuagcuca

SEQ ID NO: 550331 - RNA, 22 nt, Homo sapiens
ucuuacacaaggggcaaaugaa

SEQ ID NO: 550332 - RNA, 14 nt, Homo sapiens
ucuuacagcacauc

SEQ ID NO: 550333 - RNA, 13 nt, Homo sapiens
ucuuacauaugau

SEQ ID NO: 550334 - RNA, 16 nt, Homo sapiens
uggauaaaacugugua

SEQ ID NO: 550335 - RNA, 13 nt, Homo sapiens
uggauaaauugca

SEQ ID NO: 550336 - RNA, 15 nt, Homo sapiens
uggauaacuuuacag

SEQ ID NO: 550337 - RNA, 13 nt, Homo sapiens
uggauacagcugc

SEQ ID NO: 550338 - RNA, 15 nt, Homo sapiens
uggauagucugucca

SEQ ID NO: 550339 - RNA, 15 nt, Homo sapiens
uggauaugacccaca

SEQ ID NO: 550340 - RNA, 18 nt, Homo sapiens
uggauauuuuuuacuuua

SEQ ID NO: 550341 - RNA, 15 nt, Homo sapiens
uggaucacaccucag

SEQ ID NO: 550342 - RNA, 15 nt, Homo sapiens
uggaucaccauuaua

SEQ ID NO: 550343 - RNA, 13 nt, Homo sapiens
uggauccagcacu

SEQ ID NO: 550344 - RNA, 16 nt, Homo sapiens
uggaucccugcccuuc

SEQ ID NO: 550345 - RNA, 15 nt, Homo sapiens
uggaucuaccagcau

SEQ ID NO: 550346 - RNA, 13 nt, Homo sapiens
uggaucuaccugg

SEQ ID NO: 550347 - RNA, 22 nt, Homo sapiens
uggaucuuggagaaugugagaa

SEQ ID NO: 550348 - RNA, 20 nt, Homo sapiens
uggaugaaucucccacucca

SEQ ID NO: 550349 - RNA, 17 nt, Homo sapiens
uggaugaugaaacauuc

SEQ ID NO: 550350 - RNA, 13 nt, Homo sapiens
uggaugauucaga

SEQ ID NO: 550351 - RNA, 20 nt, Homo sapiens
uggaugauucagaaauugga

SEQ ID NO: 550352 - RNA, 14 nt, Homo sapiens
uggaugcagaucca

SEQ ID NO: 550353 - RNA, 22 nt, Homo sapiens
uggaugcagcaccucucaggau

SEQ ID NO: 550354 - RNA, 17 nt, Homo sapiens
uggaugcaucacacuca

SEQ ID NO: 550355 - RNA, 20 nt, Homo sapiens
uggaugccugggucucuggg

SEQ ID NO: 550356 - RNA, 17 nt, Homo sapiens
uggaugcgcagugccuu

SEQ ID NO: 550357 - RNA, 14 nt, Homo sapiens
uggauggacuugua

SEQ ID NO: 550358 - RNA, 21 nt, Homo sapiens
uggaugggagugggcaccuca

SEQ ID NO: 550359 - RNA, 15 nt, Homo sapiens
uggaugggaugcacu

SEQ ID NO: 550360 - RNA, 18 nt, Homo sapiens
uggaugggaugcacucuc

SEQ ID NO: 550361 - RNA, 15 nt, Homo sapiens
uggauguaaugcacu

SEQ ID NO: 550362 - RNA, 14 nt, Homo sapiens
uggauguagucagu

SEQ ID NO: 550363 - RNA, 17 nt, Homo sapiens
uggaugucaaacaguaa

SEQ ID NO: 550364 - RNA, 16 nt, Homo sapiens
uggauguggggucccc

SEQ ID NO: 550365 - RNA, 23 nt, Homo sapiens
uggaugugguuaccgaguaucug

SEQ ID NO: 550366 - RNA, 19 nt, Homo sapiens
uggauguguucucuaggcc

SEQ ID NO: 550367 - RNA, 21 nt, Homo sapiens
uggauuacaggcaugugccac

SEQ ID NO: 550368 - RNA, 15 nt, Homo sapiens
uggauuacuauugca

SEQ ID NO: 550369 - RNA, 17 nt, Homo sapiens
uggauuacuauugcaaa

SEQ ID NO: 550370 - RNA, 23 nt, Homo sapiens
uggauuacuauugcaaaagggaa

SEQ ID NO: 550371 - RNA, 15 nt, Homo sapiens
uggauuaugaaguga

SEQ ID NO: 550372 - RNA, 14 nt, Homo sapiens
uggauuauuuagau

SEQ ID NO: 550373 - RNA, 12 nt, Homo sapiens
uggauugccaca

SEQ ID NO: 550374 - RNA, 15 nt, Homo sapiens
uggauugugguucca

SEQ ID NO: 550375 - RNA, 15 nt, Homo sapiens
uggauuuaguuucag

SEQ ID NO: 550376 - RNA, 18 nt, Homo sapiens
uggauuuauagcuaugaa

SEQ ID NO: 550377 - RNA, 23 nt, Homo sapiens
uggauuuaucccccgcaaagaca

SEQ ID NO: 550378 - RNA, 16 nt, Homo sapiens
uggauuuaugacauua

SEQ ID NO: 550379 - RNA, 23 nt, Homo sapiens
uggauuugcaggugaacagccuc

SEQ ID NO: 550380 - RNA, 19 nt, Homo sapiens
uggauuuucuacuguaaga

SEQ ID NO: 550381 - RNA, 22 nt, Homo sapiens
uggauuuugggagugacucaag

SEQ ID NO: 550382 - RNA, 13 nt, Homo sapiens
uggcaaaagaaaa

SEQ ID NO: 550383 - RNA, 12 nt, Homo sapiens
uggcaaagcuca

SEQ ID NO: 550384 - RNA, 22 nt, Homo sapiens
uggcaaaucucuauuaggaaau

SEQ ID NO: 550385 - RNA, 21 nt, Homo sapiens
uggcaaauguaacugugccag

SEQ ID NO: 550386 - RNA, 20 nt, Homo sapiens
uggcaacaaaaaguaaugaa

SEQ ID NO: 550387 - RNA, 17 nt, Homo sapiens
uggcaacauuguacaag

SEQ ID NO: 550388 - RNA, 18 nt, Homo sapiens
uggcaacauuguacaagu

SEQ ID NO: 550389 - RNA, 13 nt, Homo sapiens
uggcaaccuuccu

SEQ ID NO: 550390 - RNA, 16 nt, Homo sapiens
uggcaagcucuaucac

SEQ ID NO: 550391 - RNA, 21 nt, Homo sapiens
gagcuugugcuccucuugauu

SEQ ID NO: 550392 - RNA, 20 nt, Homo sapiens
gagcuuuccuucuccaggaa

SEQ ID NO: 550393 - RNA, 18 nt, Homo sapiens
gagcuuuguccugaagga

SEQ ID NO: 550394 - RNA, 16 nt, Homo sapiens
gagcuuuucacuguga

SEQ ID NO: 550395 - RNA, 18 nt, Homo sapiens
gagcuuuugaugccaggu

SEQ ID NO: 550396 - RNA, 22 nt, Homo sapiens
gaggaaaaggaaaaaaagcaaa

SEQ ID NO: 550397 - RNA, 21 nt, Homo sapiens
gaggaaaaguaaggugcaguu

SEQ ID NO: 550398 - RNA, 21 nt, Homo sapiens
gaggaaagggaaggcuggcag

SEQ ID NO: 550399 - RNA, 12 nt, Homo sapiens
gaggaaagggag

SEQ ID NO: 550400 - RNA, 21 nt, Homo sapiens
gaggaaagugcguucucccag

SEQ ID NO: 550401 - RNA, 14 nt, Homo sapiens
gaggaaauccauug

SEQ ID NO: 550402 - RNA, 18 nt, Homo sapiens
gaggaacaagcaugucuc

SEQ ID NO: 550403 - RNA, 15 nt, Homo sapiens
gaggaacacagagaa

SEQ ID NO: 550404 - RNA, 13 nt, Homo sapiens
gaggaacagguuc

SEQ ID NO: 550405 - RNA, 23 nt, Homo sapiens
gaggaagaagauguccgugagaa

SEQ ID NO: 550406 - RNA, 19 nt, Homo sapiens
gaggaaggaacagcaaugg

SEQ ID NO: 550407 - RNA, 22 nt, Homo sapiens
gaggaaggggcgauuugaggga

SEQ ID NO: 550408 - RNA, 17 nt, Homo sapiens
gaggaauugauugucag

SEQ ID NO: 550409 - RNA, 15 nt, Homo sapiens
gaggaauuggccgcu

SEQ ID NO: 550410 - RNA, 16 nt, Homo sapiens
gaggaauuuggcugcu

SEQ ID NO: 550411 - RNA, 11 nt, Homo sapiens
gaggacacaau

SEQ ID NO: 550412 - RNA, 16 nt, Homo sapiens
gaggacaguggcacaa

SEQ ID NO: 550413 - RNA, 19 nt, Homo sapiens
gaggacaugcgugugucag

SEQ ID NO: 550414 - RNA, 22 nt, Homo sapiens
gaggacauucuggaaaagcaaa

SEQ ID NO: 550415 - RNA, 16 nt, Homo sapiens
gaggacucaccacugc

SEQ ID NO: 550416 - RNA, 15 nt, Homo sapiens
gaggacuguccuccc

SEQ ID NO: 550417 - RNA, 19 nt, Homo sapiens
gaggacuucuggcagggaa

SEQ ID NO: 550418 - RNA, 19 nt, Homo sapiens
gaggacuuuuuugauuaag

SEQ ID NO: 550419 - RNA, 15 nt, Homo sapiens
gaggagaaaugcaau

SEQ ID NO: 550420 - RNA, 17 nt, Homo sapiens
gaggagauauggaguga

SEQ ID NO: 550421 - RNA, 16 nt, Homo sapiens
gaggagcacaguuugu

SEQ ID NO: 550422 - RNA, 22 nt, Homo sapiens
gaggagggaugcugccugaguc

SEQ ID NO: 550423 - RNA, 18 nt, Homo sapiens
gaggagggcgugacucac

SEQ ID NO: 550424 - RNA, 17 nt, Homo sapiens
gaggaguaccgccagca

SEQ ID NO: 550425 - RNA, 20 nt, Homo sapiens
gaggaguggugggugcaguc

SEQ ID NO: 550426 - RNA, 23 nt, Homo sapiens
gaggauacgacaguacacuguca

SEQ ID NO: 550427 - RNA, 13 nt, Homo sapiens
gaggaucacugga

SEQ ID NO: 550428 - RNA, 21 nt, Homo sapiens
gaggaugccacgcacuuccuc

SEQ ID NO: 550429 - RNA, 21 nt, Homo sapiens
gaggauuccgucuucucucau

SEQ ID NO: 550430 - RNA, 12 nt, Homo sapiens
gaggauugccuu

SEQ ID NO: 550431 - RNA, 16 nt, Homo sapiens
gaggauuucaucucuu

SEQ ID NO: 550432 - RNA, 17 nt, Homo sapiens
gaggcaaacagcaagag

SEQ ID NO: 550433 - RNA, 15 nt, Homo sapiens
gaggcaaagguucua

SEQ ID NO: 550434 - RNA, 21 nt, Homo sapiens
gaggcaacccgugcucagcug

SEQ ID NO: 550435 - RNA, 19 nt, Homo sapiens
gaggcaagugugggccacu

SEQ ID NO: 550436 - RNA, 21 nt, Homo sapiens
gaggcaagugugggggguccu

SEQ ID NO: 550437 - RNA, 16 nt, Homo sapiens
gaggcacccucagaga

SEQ ID NO: 550438 - RNA, 20 nt, Homo sapiens
gaggcacucagugagccucc

SEQ ID NO: 550439 - RNA, 20 nt, Homo sapiens
gaggcagagguugcagugaa

SEQ ID NO: 550440 - RNA, 14 nt, Homo sapiens
gaggcagaucuuug

SEQ ID NO: 550441 - RNA, 23 nt, Homo sapiens
gaggcagcgugaaagcagaugag

SEQ ID NO: 550442 - RNA, 20 nt, Homo sapiens
gaggcaggagaaucgcuuga

SEQ ID NO: 550443 - RNA, 20 nt, Homo sapiens
gaggcaggaggauugcuuga

SEQ ID NO: 550444 - RNA, 15 nt, Homo sapiens
gaggcaggcauuccu

SEQ ID NO: 550445 - RNA, 16 nt, Homo sapiens
gaggcaggcggaucau

SEQ ID NO: 550446 - RNA, 23 nt, Homo sapiens
gaggccacgucccaccccaccuc

SEQ ID NO: 550447 - RNA, 12 nt, Homo sapiens
gaggccaucuca

SEQ ID NO: 550448 - RNA, 19 nt, Homo sapiens
gaggccccuggagccagau

SEQ ID NO: 550449 - RNA, 18 nt, Homo sapiens
gaggcccuccugugcugg

SEQ ID NO: 550450 - RNA, 19 nt, Homo sapiens
gaggccgcuuagugcugcu

SEQ ID NO: 550451 - RNA, 22 nt, Homo sapiens
gaggccguggcucugaugcuga

SEQ ID NO: 550452 - RNA, 17 nt, Homo sapiens
gaggccucauccagggc

SEQ ID NO: 550453 - RNA, 17 nt, Homo sapiens
gaggccuggacuuuccu

SEQ ID NO: 550454 - RNA, 23 nt, Homo sapiens
gaggccuggggugggacagggag

SEQ ID NO: 550455 - RNA, 23 nt, Homo sapiens
gaggccuuauuuugaacugccuc

SEQ ID NO: 550456 - RNA, 12 nt, Homo sapiens
gaggcuauuaaa

SEQ ID NO: 550457 - RNA, 16 nt, Homo sapiens
gaggcugaggcaagag

SEQ ID NO: 550458 - RNA, 22 nt, Homo sapiens
gaggcugaggcagaaggauuac

SEQ ID NO: 550459 - RNA, 18 nt, Homo sapiens
gaggcugaggcgggugga

SEQ ID NO: 550460 - RNA, 19 nt, Homo sapiens
gaggcugcagcaggugcug

SEQ ID NO: 550461 - RNA, 14 nt, Homo sapiens
gaggcugcaugcuc

SEQ ID NO: 550462 - RNA, 16 nt, Homo sapiens
gaggcugccccucuca

SEQ ID NO: 550463 - RNA, 20 nt, Homo sapiens
gaggcugggccccugggaug

SEQ ID NO: 550464 - RNA, 17 nt, Homo sapiens
gaggcugucacaguccu

SEQ ID NO: 550465 - RNA, 12 nt, Homo sapiens
gaggcugugauu

SEQ ID NO: 550466 - RNA, 18 nt, Homo sapiens
gaggcuuuaaaaagaaaa

SEQ ID NO: 550467 - RNA, 15 nt, Homo sapiens
gaggcuuuacagugu

SEQ ID NO: 550468 - RNA, 20 nt, Homo sapiens
gccaggccuuacaucuggcu

SEQ ID NO: 550469 - RNA, 21 nt, Homo sapiens
gccaggcugccugugugcaug

SEQ ID NO: 550470 - RNA, 18 nt, Homo sapiens
gccaggcuggagugcagu

SEQ ID NO: 550471 - RNA, 19 nt, Homo sapiens
gccaggcuggagugcagug

SEQ ID NO: 550472 - RNA, 17 nt, Homo sapiens
gccaggcuugcagucuc

SEQ ID NO: 550473 - RNA, 16 nt, Homo sapiens
gccagggccaugucag

SEQ ID NO: 550474 - RNA, 18 nt, Homo sapiens
gccagggcccugcagagg

SEQ ID NO: 550475 - RNA, 21 nt, Homo sapiens
gccagggcuauagcucaggac

SEQ ID NO: 550476 - RNA, 16 nt, Homo sapiens
gccaggggcaguuuua

SEQ ID NO: 550477 - RNA, 19 nt, Homo sapiens
gccagggucugugugaaug

SEQ ID NO: 550478 - RNA, 13 nt, Homo sapiens
gccaggugcagug

SEQ ID NO: 550479 - RNA, 18 nt, Homo sapiens
gccagguugggggcagug

SEQ ID NO: 550480 - RNA, 20 nt, Homo sapiens
gccaguaaucuuuauacugg

SEQ ID NO: 550481 - RNA, 22 nt, Homo sapiens
gccaguacagagaaauucugug

SEQ ID NO: 550482 - RNA, 11 nt, Homo sapiens
gccaguauuuu

SEQ ID NO: 550483 - RNA, 15 nt, Homo sapiens
gccagucacugcugc

SEQ ID NO: 550484 - RNA, 17 nt, Homo sapiens
gccagugagaagcugag

SEQ ID NO: 550485 - RNA, 17 nt, Homo sapiens
gccagugagggcagucc

SEQ ID NO: 550486 - RNA, 14 nt, Homo sapiens
gccagugccucuca

SEQ ID NO: 550487 - RNA, 21 nt, Homo sapiens
gccaguggugcuaaaugcuac

SEQ ID NO: 550488 - RNA, 18 nt, Homo sapiens
gccaguguguguuuccca

SEQ ID NO: 550489 - RNA, 18 nt, Homo sapiens
gccaguuacuugcuuuac

SEQ ID NO: 550490 - RNA, 18 nt, Homo sapiens
gccaguuccgucuucccu

SEQ ID NO: 550491 - RNA, 13 nt, Homo sapiens
gccaguucuccuu

SEQ ID NO: 550492 - RNA, 17 nt, Homo sapiens
gccaguugaucugcucu

SEQ ID NO: 550493 - RNA, 16 nt, Homo sapiens
gccaguuuuacuguga

SEQ ID NO: 550494 - RNA, 20 nt, Homo sapiens
gccauaaaacauuaagaaaa

SEQ ID NO: 550495 - RNA, 18 nt, Homo sapiens
gccauaagaaagcacuau

SEQ ID NO: 550496 - RNA, 22 nt, Homo sapiens
gccauaagaggugaucucuggg

SEQ ID NO: 550497 - RNA, 17 nt, Homo sapiens
gccauaauucuaaguua

SEQ ID NO: 550498 - RNA, 14 nt, Homo sapiens
gccauagaggccca

SEQ ID NO: 550499 - RNA, 21 nt, Homo sapiens
gccauagaggcccaggcacca

SEQ ID NO: 550500 - RNA, 18 nt, Homo sapiens
gccauagccaggcucucu

SEQ ID NO: 550501 - RNA, 17 nt, Homo sapiens
gccauauaugcuguauu

SEQ ID NO: 550502 - RNA, 23 nt, Homo sapiens
gccaucagacaacacccuggccu

SEQ ID NO: 550503 - RNA, 17 nt, Homo sapiens
gccaucaugccugacua

SEQ ID NO: 550504 - RNA, 13 nt, Homo sapiens
gccauccaggguc

SEQ ID NO: 550505 - RNA, 21 nt, Homo sapiens
gccauccccaccuucaccucg

SEQ ID NO: 550506 - RNA, 21 nt, Homo sapiens
gccaucccccucucacgccac

SEQ ID NO: 550507 - RNA, 23 nt, Homo sapiens
gccaucccuuuuuuuacauuuca

SEQ ID NO: 550508 - RNA, 21 nt, Homo sapiens
gccauccugauggaccugccc

SEQ ID NO: 550509 - RNA, 15 nt, Homo sapiens
gccaucuuucuuugg

SEQ ID NO: 550510 - RNA, 19 nt, Homo sapiens
gccaugaggccucagugga

SEQ ID NO: 550511 - RNA, 22 nt, Homo sapiens
gccaugaguuccagaaaguaaa

SEQ ID NO: 550512 - RNA, 21 nt, Homo sapiens
gccaugcaacgggauugaagg

SEQ ID NO: 550513 - RNA, 15 nt, Homo sapiens
gccaugcaaugccaa

SEQ ID NO: 550514 - RNA, 23 nt, Homo sapiens
gccaugcagcggccugagcagua

SEQ ID NO: 550515 - RNA, 20 nt, Homo sapiens
gccaugcaggaagaggccca

SEQ ID NO: 550516 - RNA, 23 nt, Homo sapiens
gccaugccaggccagagggcagu

SEQ ID NO: 550517 - RNA, 15 nt, Homo sapiens
gccaugcccaaggcc

SEQ ID NO: 550518 - RNA, 18 nt, Homo sapiens
gccaugccuccucaggag

SEQ ID NO: 550519 - RNA, 18 nt, Homo sapiens
gccaugccuggagacaua

SEQ ID NO: 550520 - RNA, 22 nt, Homo sapiens
gccaugcucaaccccccuccca

SEQ ID NO: 550521 - RNA, 15 nt, Homo sapiens
gccaugcugggccac

SEQ ID NO: 550522 - RNA, 16 nt, Homo sapiens
gccauggaauaaacca

SEQ ID NO: 550523 - RNA, 23 nt, Homo sapiens
gccaugguaacuaaaacuuuuca

SEQ ID NO: 550524 - RNA, 15 nt, Homo sapiens
gccauguggacuggu

SEQ ID NO: 550525 - RNA, 12 nt, Homo sapiens
gccauguucucc

SEQ ID NO: 550526 - RNA, 23 nt, Homo sapiens
gccauguuucaagaaaauggauu

SEQ ID NO: 550527 - RNA, 16 nt, Homo sapiens
gccauguuuuugccaa

SEQ ID NO: 550528 - RNA, 14 nt, Homo sapiens
ggacaagacacuga

SEQ ID NO: 550529 - RNA, 21 nt, Homo sapiens
ggacaagacccccagcacuug

SEQ ID NO: 550530 - RNA, 23 nt, Homo sapiens
ggacaagaguugagcagccuuuc

SEQ ID NO: 550531 - RNA, 14 nt, Homo sapiens
ggacaaggccuugc

SEQ ID NO: 550532 - RNA, 18 nt, Homo sapiens
ggacaauuaucuguguca

SEQ ID NO: 550533 - RNA, 23 nt, Homo sapiens
ggacacagcgcgguuuuuuccac

SEQ ID NO: 550534 - RNA, 15 nt, Homo sapiens
ggacaccacuaggug

SEQ ID NO: 550535 - RNA, 16 nt, Homo sapiens
ggacacccacagcugc

SEQ ID NO: 550536 - RNA, 14 nt, Homo sapiens
ggacacuccagugc

SEQ ID NO: 550537 - RNA, 11 nt, Homo sapiens
ggacacugaga

SEQ ID NO: 550538 - RNA, 21 nt, Homo sapiens
ggacacugugcccagcccgga

SEQ ID NO: 550539 - RNA, 20 nt, Homo sapiens
ggacacuguggagacuuucu

SEQ ID NO: 550540 - RNA, 16 nt, Homo sapiens
ggacagaacauugccu

SEQ ID NO: 550541 - RNA, 20 nt, Homo sapiens
ggacagacggaaaugaaauu

SEQ ID NO: 550542 - RNA, 23 nt, Homo sapiens
ggacagaggggacucugggcuau

SEQ ID NO: 550543 - RNA, 12 nt, Homo sapiens
ggacagaugacc

SEQ ID NO: 550544 - RNA, 21 nt, Homo sapiens
ggacagauggacgcaggcccu

SEQ ID NO: 550545 - RNA, 19 nt, Homo sapiens
ggacagauggcccaaggga

SEQ ID NO: 550546 - RNA, 13 nt, Homo sapiens
ggacagguggugc

SEQ ID NO: 550547 - RNA, 16 nt, Homo sapiens
ggacagucagcucucu

SEQ ID NO: 550548 - RNA, 13 nt, Homo sapiens
ggacauaagacag

SEQ ID NO: 550549 - RNA, 23 nt, Homo sapiens
ggacaucaaagugguaaauacug

SEQ ID NO: 550550 - RNA, 17 nt, Homo sapiens
ggacaugaagauucuuu

SEQ ID NO: 550551 - RNA, 16 nt, Homo sapiens
ggacaugcccugugug

SEQ ID NO: 550552 - RNA, 17 nt, Homo sapiens
ggacauuuaaaauucaa

SEQ ID NO: 550553 - RNA, 14 nt, Homo sapiens
ggaccaacccuguu

SEQ ID NO: 550554 - RNA, 18 nt, Homo sapiens
ggaccaaggggugggcca

SEQ ID NO: 550555 - RNA, 13 nt, Homo sapiens
ggaccaauaccuc

SEQ ID NO: 550556 - RNA, 14 nt, Homo sapiens
ggaccacaggcaug

SEQ ID NO: 550557 - RNA, 19 nt, Homo sapiens
ggaccacaggcaugcacca

SEQ ID NO: 550558 - RNA, 14 nt, Homo sapiens
ggaccacauuuuau

SEQ ID NO: 550559 - RNA, 14 nt, Homo sapiens
ggaccaccaaugga

SEQ ID NO: 550560 - RNA, 16 nt, Homo sapiens
ggaccaccuagucugu

SEQ ID NO: 550561 - RNA, 21 nt, Homo sapiens
ggaccacuaaaucuccaagac

SEQ ID NO: 550562 - RNA, 16 nt, Homo sapiens
ggaccagaagcauuuc

SEQ ID NO: 550563 - RNA, 19 nt, Homo sapiens
ggaccagaagcauuucacc

SEQ ID NO: 550564 - RNA, 16 nt, Homo sapiens
ggaccagcccauuggc

SEQ ID NO: 550565 - RNA, 17 nt, Homo sapiens
ggaccaggacugcagcu

SEQ ID NO: 550566 - RNA, 22 nt, Homo sapiens
ggaccagucccgucgugcaguc

SEQ ID NO: 550567 - RNA, 15 nt, Homo sapiens
ggaccauccuugaca

SEQ ID NO: 550568 - RNA, 20 nt, Homo sapiens
ggacccacgaaacugcccug

SEQ ID NO: 550569 - RNA, 17 nt, Homo sapiens
ggaccccaucugugaau

SEQ ID NO: 550570 - RNA, 15 nt, Homo sapiens
ggacccccacuaaga

SEQ ID NO: 550571 - RNA, 14 nt, Homo sapiens
ggacccuccacuca

SEQ ID NO: 550572 - RNA, 22 nt, Homo sapiens
ggaccuaaaaaggucuguuaau

SEQ ID NO: 550573 - RNA, 13 nt, Homo sapiens
ggaccuaccuccc

SEQ ID NO: 550574 - RNA, 19 nt, Homo sapiens
ggaccugaguuugggagag

SEQ ID NO: 550575 - RNA, 18 nt, Homo sapiens
ggaccuggcacaccuuag

SEQ ID NO: 550576 - RNA, 14 nt, Homo sapiens
ggaccuguccaugc

SEQ ID NO: 550577 - RNA, 20 nt, Homo sapiens
ggaccuugggaucagaucaa

SEQ ID NO: 550578 - RNA, 19 nt, Homo sapiens
ggacgaggaguaauggcau

SEQ ID NO: 550579 - RNA, 21 nt, Homo sapiens
ggacgaggaguaauggcauuu

SEQ ID NO: 550580 - RNA, 20 nt, Homo sapiens
ggacgcacgcucgcugccau

SEQ ID NO: 550581 - RNA, 22 nt, Homo sapiens
ggacgcacgcucgcugccauca

SEQ ID NO: 550582 - RNA, 18 nt, Homo sapiens
ggacgugcgcgaugccug

SEQ ID NO: 550583 - RNA, 13 nt, Homo sapiens
ggacgugcucaga

SEQ ID NO: 550584 - RNA, 14 nt, Homo sapiens
ggacuaacccaaug

SEQ ID NO: 550585 - RNA, 13 nt, Homo sapiens
ggacuacaaccaa

SEQ ID NO: 550586 - RNA, 18 nt, Homo sapiens
ggacuagaaaaacuuggg

SEQ ID NO: 550587 - RNA, 18 nt, Homo sapiens
ggacuaggagcacuguag

SEQ ID NO: 550588 - RNA, 23 nt, Homo sapiens
ggacuaucaacaccacuaggaau

SEQ ID NO: 550589 - RNA, 10 nt, Homo sapiens
ggacuauuau

SEQ ID NO: 550590 - RNA, 19 nt, Homo sapiens
ggacuauuuaugaaggcaa

SEQ ID NO: 550591 - RNA, 20 nt, Homo sapiens
ggacucauauauuuaagccu

SEQ ID NO: 550592 - RNA, 20 nt, Homo sapiens
ggacuccaaccucagggacu

SEQ ID NO: 550593 - RNA, 16 nt, Homo sapiens
ggacuccaucgcuaaa

SEQ ID NO: 550594 - RNA, 12 nt, Homo sapiens
ggacuccaugcu

SEQ ID NO: 550595 - RNA, 15 nt, Homo sapiens
ggacuccaugcuccu

SEQ ID NO: 550596 - RNA, 17 nt, Homo sapiens
ggacuccaugcugccag

SEQ ID NO: 550597 - RNA, 11 nt, Homo sapiens
ggacuccucaa

SEQ ID NO: 550598 - RNA, 23 nt, Homo sapiens
ggacuccucaaaccacuugccug

SEQ ID NO: 550599 - RNA, 16 nt, Homo sapiens
ggacucuacacuguga

SEQ ID NO: 550600 - RNA, 15 nt, Homo sapiens
ggauccuagccuuau

SEQ ID NO: 550601 - RNA, 15 nt, Homo sapiens
ggauccuccacagag

SEQ ID NO: 550602 - RNA, 17 nt, Homo sapiens
ggauccuuugcugcuga

SEQ ID NO: 550603 - RNA, 14 nt, Homo sapiens
ggaucgaguguagc

SEQ ID NO: 550604 - RNA, 14 nt, Homo sapiens
ggaucuacacccac

SEQ ID NO: 550605 - RNA, 14 nt, Homo sapiens
ggaucuccugucca

SEQ ID NO: 550606 - RNA, 12 nt, Homo sapiens
ggaucugaggga

SEQ ID NO: 550607 - RNA, 21 nt, Homo sapiens
ggaucugauaaggaucuagga

SEQ ID NO: 550608 - RNA, 16 nt, Homo sapiens
ggaucuguccaaggaa

SEQ ID NO: 550609 - RNA, 14 nt, Homo sapiens
ggaucuguuccuug

SEQ ID NO: 550610 - RNA, 20 nt, Homo sapiens
ggaucuucauggccucagga

SEQ ID NO: 550611 - RNA, 23 nt, Homo sapiens
ggaucuucccacaggagggccag

SEQ ID NO: 550612 - RNA, 22 nt, Homo sapiens
ggaucuugaauguggucucagg

SEQ ID NO: 550613 - RNA, 21 nt, Homo sapiens
ggaugaaggcaaaaacuguac

SEQ ID NO: 550614 - RNA, 12 nt, Homo sapiens
ggaugaauggaa

SEQ ID NO: 550615 - RNA, 17 nt, Homo sapiens
ggaugacaugugccauu

SEQ ID NO: 550616 - RNA, 15 nt, Homo sapiens
ggaugaggggugcug

SEQ ID NO: 550617 - RNA, 21 nt, Homo sapiens
ggaugauacuuggaugcagcu

SEQ ID NO: 550618 - RNA, 18 nt, Homo sapiens
ggaugaugaaacauucau

SEQ ID NO: 550619 - RNA, 13 nt, Homo sapiens
ggaugauguuucg

SEQ ID NO: 550620 - RNA, 23 nt, Homo sapiens
ggaugauuaagagauugccauuu

SEQ ID NO: 550621 - RNA, 17 nt, Homo sapiens
ggaugauucaagccauu

SEQ ID NO: 550622 - RNA, 19 nt, Homo sapiens
ggaugauucaagccauucc

SEQ ID NO: 550623 - RNA, 22 nt, Homo sapiens
ggaugcaggguuugagaauguu

SEQ ID NO: 550624 - RNA, 15 nt, Homo sapiens
ggaugcuggccuuug

SEQ ID NO: 550625 - RNA, 13 nt, Homo sapiens
ggaugcugugccu

SEQ ID NO: 550626 - RNA, 18 nt, Homo sapiens
ggauggaaauguagugcu

SEQ ID NO: 550627 - RNA, 21 nt, Homo sapiens
ggauggagcugaaaacauaac

SEQ ID NO: 550628 - RNA, 14 nt, Homo sapiens
ggauggaggccaga

SEQ ID NO: 550629 - RNA, 21 nt, Homo sapiens
ggauggcaucaaacagggcaa

SEQ ID NO: 550630 - RNA, 21 nt, Homo sapiens
ggauggcgaggccucucucag

SEQ ID NO: 550631 - RNA, 16 nt, Homo sapiens
ggaugggaacacuggu

SEQ ID NO: 550632 - RNA, 23 nt, Homo sapiens
ggaugggaggagagccacugggc

SEQ ID NO: 550633 - RNA, 18 nt, Homo sapiens
ggauggggcuucacugcu

SEQ ID NO: 550634 - RNA, 14 nt, Homo sapiens
ggaugguggcacag

SEQ ID NO: 550635 - RNA, 12 nt, Homo sapiens
ggauguacuuaa

SEQ ID NO: 550636 - RNA, 17 nt, Homo sapiens
ggaugucacagggccaa

SEQ ID NO: 550637 - RNA, 18 nt, Homo sapiens
ggaugucccugggccagg

SEQ ID NO: 550638 - RNA, 12 nt, Homo sapiens
ggaugucuuccu

SEQ ID NO: 550639 - RNA, 10 nt, Homo sapiens
ggaugugaug

SEQ ID NO: 550640 - RNA, 11 nt, Homo sapiens
ggaugugauga

SEQ ID NO: 550641 - RNA, 17 nt, Homo sapiens
ggauuaaccucugcacu

SEQ ID NO: 550642 - RNA, 21 nt, Homo sapiens
ggauuaauguuuuguacaauu

SEQ ID NO: 550643 - RNA, 13 nt, Homo sapiens
ggauuacaggcau

SEQ ID NO: 550644 - RNA, 14 nt, Homo sapiens
ggauuacuauugca

SEQ ID NO: 550645 - RNA, 14 nt, Homo sapiens
ggauuccacuaucu

SEQ ID NO: 550646 - RNA, 12 nt, Homo sapiens
ggauucuauuua

SEQ ID NO: 550647 - RNA, 16 nt, Homo sapiens
ggauucugaaucucaa

SEQ ID NO: 550648 - RNA, 18 nt, Homo sapiens
ggauugucccuguguugu

SEQ ID NO: 550649 - RNA, 22 nt, Homo sapiens
ggauugucuuacuguugcauaa

SEQ ID NO: 550650 - RNA, 18 nt, Homo sapiens
ggauuuaacagucauuua

SEQ ID NO: 550651 - RNA, 14 nt, Homo sapiens
ggauuuaauuucca

SEQ ID NO: 550652 - RNA, 16 nt, Homo sapiens
ggauuucauacuguaa

SEQ ID NO: 550653 - RNA, 18 nt, Homo sapiens
ggauuucauuuguaacuu

SEQ ID NO: 550654 - RNA, 14 nt, Homo sapiens
ggauuuccagggau

SEQ ID NO: 550655 - RNA, 23 nt, Homo sapiens
ggauuugggcuacccuaaaggga

SEQ ID NO: 550656 - RNA, 15 nt, Homo sapiens
ggauuuuaccaaagc

SEQ ID NO: 550657 - RNA, 14 nt, Homo sapiens
ggauuuuaguuuaa

SEQ ID NO: 550658 - RNA, 15 nt, Homo sapiens
ggauuuucacauucu

SEQ ID NO: 550659 - RNA, 22 nt, Homo sapiens
ggauuuugaacgcuuaagucau

SEQ ID NO: 550660 - RNA, 22 nt, Homo sapiens
ggauuuuuuuccuccccaccuu

SEQ ID NO: 550661 - RNA, 17 nt, Homo sapiens
ggcaaaaacaaaacucu

SEQ ID NO: 550662 - RNA, 21 nt, Homo sapiens
ggcaaaagagucaacaguauc

SEQ ID NO: 550663 - RNA, 17 nt, Homo sapiens
ggcaaaaggaauuaaau

SEQ ID NO: 550664 - RNA, 18 nt, Homo sapiens
ggcaaacuuuucuuucuu

SEQ ID NO: 550665 - RNA, 22 nt, Homo sapiens
ggcaaagagagucgcaucucag

SEQ ID NO: 550666 - RNA, 15 nt, Homo sapiens
ggcaaagccuaguga

SEQ ID NO: 550667 - RNA, 13 nt, Homo sapiens
ggcaaaguacaaa

SEQ ID NO: 550668 - RNA, 15 nt, Homo sapiens
ggcaaauaacaguaa

SEQ ID NO: 550669 - RNA, 23 nt, Homo sapiens
ggcaacaauacaugcugcuaauu

SEQ ID NO: 550670 - RNA, 18 nt, Homo sapiens
ggcaacagagcaagaucc

SEQ ID NO: 550671 - RNA, 20 nt, Homo sapiens
ggcaacagagcgagauucca

SEQ ID NO: 550672 - RNA, 23 nt, Homo sapiens
ggcaacagagcgagauuccaucu

SEQ ID NO: 550673 - RNA, 12 nt, Homo sapiens
ggcaacaucaac

SEQ ID NO: 550674 - RNA, 16 nt, Homo sapiens
ggcaacgcacaaaaca

SEQ ID NO: 550675 - RNA, 16 nt, Homo sapiens
gccaagagaauauccg

SEQ ID NO: 550676 - RNA, 17 nt, Homo sapiens
gccaagagguacuguaa

SEQ ID NO: 550677 - RNA, 21 nt, Homo sapiens
gccaagaguccaggaggcccu

SEQ ID NO: 550678 - RNA, 18 nt, Homo sapiens
gccaagagugaagggaag

SEQ ID NO: 550679 - RNA, 16 nt, Homo sapiens
gccaagauuguccuuu

SEQ ID NO: 550680 - RNA, 21 nt, Homo sapiens
gccaagauuuuccucuuguga

SEQ ID NO: 550681 - RNA, 19 nt, Homo sapiens
gccaagcagugccugccua

SEQ ID NO: 550682 - RNA, 11 nt, Homo sapiens
gccaagccagu

SEQ ID NO: 550683 - RNA, 20 nt, Homo sapiens
gccaagcccaauacagccau

SEQ ID NO: 550684 - RNA, 17 nt, Homo sapiens
gccaagcuaaucugccu

SEQ ID NO: 550685 - RNA, 23 nt, Homo sapiens
gccaagcuaauuuauagcaagau

SEQ ID NO: 550686 - RNA, 15 nt, Homo sapiens
gccaagcuuccugug

SEQ ID NO: 550687 - RNA, 21 nt, Homo sapiens
gccaaggagggugagugcaag

SEQ ID NO: 550688 - RNA, 19 nt, Homo sapiens
gccaaggagucacugagac

SEQ ID NO: 550689 - RNA, 18 nt, Homo sapiens
gccaaggcuaauccaauu

SEQ ID NO: 550690 - RNA, 19 nt, Homo sapiens
gccaagggaaccugugucc

SEQ ID NO: 550691 - RNA, 20 nt, Homo sapiens
gccaaggggugggccuguga

SEQ ID NO: 550692 - RNA, 17 nt, Homo sapiens
gccaaggugggauuugu

SEQ ID NO: 550693 - RNA, 14 nt, Homo sapiens
gccaagguguccag

SEQ ID NO: 550694 - RNA, 23 nt, Homo sapiens
gccaaguccagauuuacacuggg

SEQ ID NO: 550695 - RNA, 17 nt, Homo sapiens
gccaagugaguugaaua

SEQ ID NO: 550696 - RNA, 24 nt, Homo sapiens
gccaagugcccucucugaaccuca

SEQ ID NO: 550697 - RNA, 17 nt, Homo sapiens
gccaagugccuaugcaa

SEQ ID NO: 550698 - RNA, 13 nt, Homo sapiens
gccaagugugccc

SEQ ID NO: 550699 - RNA, 20 nt, Homo sapiens
gccaaguuuuauaauccuua

SEQ ID NO: 550700 - RNA, 21 nt, Homo sapiens
gccaauaaaaaguucagaguu

SEQ ID NO: 550701 - RNA, 22 nt, Homo sapiens
gccaauaacuuuucaccaauga

SEQ ID NO: 550702 - RNA, 13 nt, Homo sapiens
gccaauauaacua

SEQ ID NO: 550703 - RNA, 17 nt, Homo sapiens
gccaaucagaacuggcu

SEQ ID NO: 550704 - RNA, 11 nt, Homo sapiens
gccaaucucaa

SEQ ID NO: 550705 - RNA, 18 nt, Homo sapiens
gccaauggagacugucuc

SEQ ID NO: 550706 - RNA, 20 nt, Homo sapiens
gccaauuaaaaacaugaauu

SEQ ID NO: 550707 - RNA, 12 nt, Homo sapiens
gccaauuuacuu

SEQ ID NO: 550708 - RNA, 23 nt, Homo sapiens
gccaauuuccucuccacugcugg

SEQ ID NO: 550709 - RNA, 19 nt, Homo sapiens
gccacaaaacugacaguaa

SEQ ID NO: 550710 - RNA, 20 nt, Homo sapiens
gccacaaaacugacaguaaa

SEQ ID NO: 550711 - RNA, 14 nt, Homo sapiens
gccacaacugcccc

SEQ ID NO: 550712 - RNA, 16 nt, Homo sapiens
gccacaagucuuccag

SEQ ID NO: 550713 - RNA, 20 nt, Homo sapiens
gccacaauccacgcuucucc

SEQ ID NO: 550714 - RNA, 20 nt, Homo sapiens
gccacacacaguuacagagu

SEQ ID NO: 550715 - RNA, 18 nt, Homo sapiens
gccacacccagcggcccc

SEQ ID NO: 550716 - RNA, 13 nt, Homo sapiens
gccacacccaggu

SEQ ID NO: 550717 - RNA, 18 nt, Homo sapiens
gccacaccugagcgcugu

SEQ ID NO: 550718 - RNA, 22 nt, Homo sapiens
gccacacucagcacaaggccau

SEQ ID NO: 550719 - RNA, 14 nt, Homo sapiens
gccacacucuccau

SEQ ID NO: 550720 - RNA, 22 nt, Homo sapiens
gccacacugugggacucuucuu

SEQ ID NO: 550721 - RNA, 21 nt, Homo sapiens
gccacagaccuaggauuucau

SEQ ID NO: 550722 - RNA, 15 nt, Homo sapiens
gccacagagaaguuu

SEQ ID NO: 550723 - RNA, 11 nt, Homo sapiens
gccacagccau

SEQ ID NO: 550724 - RNA, 21 nt, Homo sapiens
gccacaguggggcugcaggca

SEQ ID NO: 550725 - RNA, 17 nt, Homo sapiens
gccacagugucacuggu

SEQ ID NO: 550726 - RNA, 17 nt, Homo sapiens
gccaccaaagcugccca

SEQ ID NO: 550727 - RNA, 20 nt, Homo sapiens
gccaccaacauaaaacaaaa

SEQ ID NO: 550728 - RNA, 18 nt, Homo sapiens
gccaccaacuuacaaaaa

SEQ ID NO: 550729 - RNA, 18 nt, Homo sapiens
gccaccaagauguguucu

SEQ ID NO: 550730 - RNA, 17 nt, Homo sapiens
gccaccacccucaggug

SEQ ID NO: 550731 - RNA, 22 nt, Homo sapiens
gccaccagggagcuuccuggcu

SEQ ID NO: 550732 - RNA, 16 nt, Homo sapiens
gccacccauucuuccc

SEQ ID NO: 550733 - RNA, 18 nt, Homo sapiens
cucagccuacuccgcuca

SEQ ID NO: 550734 - RNA, 23 nt, Homo sapiens
cucagccuacuuucacacuaaga

SEQ ID NO: 550735 - RNA, 14 nt, Homo sapiens
cucagccucugcaa

SEQ ID NO: 550736 - RNA, 14 nt, Homo sapiens
cucagccucugcca

SEQ ID NO: 550737 - RNA, 16 nt, Homo sapiens
cucagccugagccucu

SEQ ID NO: 550738 - RNA, 22 nt, Homo sapiens
cucagccuguugcggaucuuca

SEQ ID NO: 550739 - RNA, 17 nt, Homo sapiens
cucagcuaacauuccau

SEQ ID NO: 550740 - RNA, 22 nt, Homo sapiens
cucagcuaagcucacguccuga

SEQ ID NO: 550741 - RNA, 19 nt, Homo sapiens
cucagcuaucacaucacaa

SEQ ID NO: 550742 - RNA, 14 nt, Homo sapiens
cucagcuccacaac

SEQ ID NO: 550743 - RNA, 15 nt, Homo sapiens
cucagcucucuggga

SEQ ID NO: 550744 - RNA, 15 nt, Homo sapiens
cucagcugcacauuc

SEQ ID NO: 550745 - RNA, 17 nt, Homo sapiens
cucagcugcacauuccu

SEQ ID NO: 550746 - RNA, 18 nt, Homo sapiens
cucagcuguccugcagca

SEQ ID NO: 550747 - RNA, 23 nt, Homo sapiens
cucagcuucuucacaggcacucc

SEQ ID NO: 550748 - RNA, 18 nt, Homo sapiens
cucagcuuugagaagccu

SEQ ID NO: 550749 - RNA, 23 nt, Homo sapiens
cucaggaaacgagacuuuccauu

SEQ ID NO: 550750 - RNA, 14 nt, Homo sapiens
cucaggaaggacau

SEQ ID NO: 550751 - RNA, 23 nt, Homo sapiens
cucaggccaauggcaacugccau

SEQ ID NO: 550752 - RNA, 15 nt, Homo sapiens
cucaggcccaugcua

SEQ ID NO: 550753 - RNA, 15 nt, Homo sapiens
cucaggcucuugacu

SEQ ID NO: 550754 - RNA, 18 nt, Homo sapiens
cucaggggacacuggccc

SEQ ID NO: 550755 - RNA, 20 nt, Homo sapiens
cucaggggccaacuaggcag

SEQ ID NO: 550756 - RNA, 22 nt, Homo sapiens
cucagguagaagguugacacag

SEQ ID NO: 550757 - RNA, 16 nt, Homo sapiens
cucagguagauuuugu

SEQ ID NO: 550758 - RNA, 17 nt, Homo sapiens
cucagguaguacuggga

SEQ ID NO: 550759 - RNA, 14 nt, Homo sapiens
cucagguguagcug

SEQ ID NO: 550760 - RNA, 16 nt, Homo sapiens
cucaggugugccuguu

SEQ ID NO: 550761 - RNA, 15 nt, Homo sapiens
cucagguguugccaa

SEQ ID NO: 550762 - RNA, 19 nt, Homo sapiens
cucagguuccuuuuucaaa

SEQ ID NO: 550763 - RNA, 17 nt, Homo sapiens
cucaguaaaauguuuaa

SEQ ID NO: 550764 - RNA, 22 nt, Homo sapiens
cucagucucccagcuaauugag

SEQ ID NO: 550765 - RNA, 23 nt, Homo sapiens
cucagugcagcaauauauuacca

SEQ ID NO: 550766 - RNA, 12 nt, Homo sapiens
cucagugccacu

SEQ ID NO: 550767 - RNA, 13 nt, Homo sapiens
cucagugggacaa

SEQ ID NO: 550768 - RNA, 15 nt, Homo sapiens
cucagugucauuuau

SEQ ID NO: 550769 - RNA, 16 nt, Homo sapiens
cucaguuggugcugcu

SEQ ID NO: 550770 - RNA, 17 nt, Homo sapiens
cucaguuucacuuucac

SEQ ID NO: 550771 - RNA, 16 nt, Homo sapiens
cucaguuucuaggcac

SEQ ID NO: 550772 - RNA, 16 nt, Homo sapiens
cucauaaaccaaugug

SEQ ID NO: 550773 - RNA, 18 nt, Homo sapiens
cucauaaugaagacauag

SEQ ID NO: 550774 - RNA, 12 nt, Homo sapiens
cucauaccucag

SEQ ID NO: 550775 - RNA, 14 nt, Homo sapiens
cucauagaggugag

SEQ ID NO: 550776 - RNA, 16 nt, Homo sapiens
cucauagguugagcaa

SEQ ID NO: 550777 - RNA, 18 nt, Homo sapiens
cucauagguugagcaauu

SEQ ID NO: 550778 - RNA, 15 nt, Homo sapiens
cucauauaagacaaa

SEQ ID NO: 550779 - RNA, 22 nt, Homo sapiens
cucauaugccaccccaugugcc

SEQ ID NO: 550780 - RNA, 13 nt, Homo sapiens
cucauauugugau

SEQ ID NO: 550781 - RNA, 21 nt, Homo sapiens
cucauauuuaaagacagggaa

SEQ ID NO: 550782 - RNA, 13 nt, Homo sapiens
cucaucacuagga

SEQ ID NO: 550783 - RNA, 13 nt, Homo sapiens
cucaucacuggau

SEQ ID NO: 550784 - RNA, 19 nt, Homo sapiens
cucaucccacgcacuccau

SEQ ID NO: 550785 - RNA, 19 nt, Homo sapiens
cucauccuggcacgcccua

SEQ ID NO: 550786 - RNA, 16 nt, Homo sapiens
cucauccuuuacauuu

SEQ ID NO: 550787 - RNA, 14 nt, Homo sapiens
cucaucuaugucau

SEQ ID NO: 550788 - RNA, 21 nt, Homo sapiens
cucaucuguggagcugccaca

SEQ ID NO: 550789 - RNA, 14 nt, Homo sapiens
cucaucuuacugua

SEQ ID NO: 550790 - RNA, 15 nt, Homo sapiens
cucaucuuacuguac

SEQ ID NO: 550791 - RNA, 16 nt, Homo sapiens
cucaucuuucuccuuc

SEQ ID NO: 550792 - RNA, 13 nt, Homo sapiens
cucaugacacugu

SEQ ID NO: 550793 - RNA, 16 nt, Homo sapiens
cucaugagaagccaag

SEQ ID NO: 550794 - RNA, 20 nt, Homo sapiens
cucaugauguauuguugcuu

SEQ ID NO: 550795 - RNA, 17 nt, Homo sapiens
cucaugcagaagccuga

SEQ ID NO: 550796 - RNA, 22 nt, Homo sapiens
cucaugcagaagccugagcuca

SEQ ID NO: 550797 - RNA, 18 nt, Homo sapiens
cucaugccuguaauccca

SEQ ID NO: 550798 - RNA, 20 nt, Homo sapiens
cucaugccuguaaucccaac

SEQ ID NO: 550799 - RNA, 20 nt, Homo sapiens
cucaugccuguaaucccagc

SEQ ID NO: 550800 - RNA, 17 nt, Homo sapiens
cucaugccuguaaucuc

SEQ ID NO: 550801 - RNA, 18 nt, Homo sapiens
cucaugccuguaaucuca

SEQ ID NO: 550802 - RNA, 21 nt, Homo sapiens
cucaugcugcagaggguacuu

SEQ ID NO: 550803 - RNA, 15 nt, Homo sapiens
cucaugcuuagaaag

SEQ ID NO: 550804 - RNA, 16 nt, Homo sapiens
cucaugcuucuucuca

SEQ ID NO: 550805 - RNA, 17 nt, Homo sapiens
cucaugggaagaugucu

SEQ ID NO: 550806 - RNA, 18 nt, Homo sapiens
cucaugggaaggggagga

SEQ ID NO: 550807 - RNA, 23 nt, Homo sapiens
cucauggguggcacucagucucu

SEQ ID NO: 550808 - RNA, 16 nt, Homo sapiens
cucauguuacucagug

SEQ ID NO: 550809 - RNA, 20 nt, Homo sapiens
cucauguuccuuuugaaauu

SEQ ID NO: 550810 - RNA, 17 nt, Homo sapiens
cucauuaauagcugccu

SEQ ID NO: 550811 - RNA, 16 nt, Homo sapiens
cucauuagaauuacca

SEQ ID NO: 550812 - RNA, 16 nt, Homo sapiens
cucauucaucuugcaa

SEQ ID NO: 550813 - RNA, 20 nt, Homo sapiens
cucauucuugaggagcauua

SEQ ID NO: 550814 - RNA, 13 nt, Homo sapiens
cucauugacaaga

SEQ ID NO: 550815 - RNA, 23 nt, Homo sapiens
cucauugacaagaacugaaacca

SEQ ID NO: 550816 - RNA, 16 nt, Homo sapiens
cucauugcuuaauucu

SEQ ID NO: 550817 - RNA, 18 nt, Homo sapiens
cucauuuaaaacaggcaa

SEQ ID NO: 550818 - RNA, 17 nt, Homo sapiens
cucauuuagaacuugca

SEQ ID NO: 550819 - RNA, 21 nt, Homo sapiens
cucauuuagaacuugcagcug

SEQ ID NO: 550820 - RNA, 21 nt, Homo sapiens
cucauuuauagaugucaggaa

SEQ ID NO: 550821 - RNA, 13 nt, Homo sapiens
cucauuucaucuc

SEQ ID NO: 550822 - RNA, 16 nt, Homo sapiens
cucauuucauucucac

SEQ ID NO: 550823 - RNA, 21 nt, Homo sapiens
cucauuugagauaaagucaaa

SEQ ID NO: 550824 - RNA, 19 nt, Homo sapiens
cucauuuggauugccuuac

SEQ ID NO: 550825 - RNA, 21 nt, Homo sapiens
cuccaaaaacagcaggccauc

SEQ ID NO: 550826 - RNA, 21 nt, Homo sapiens
cuccaaaacaauuuucugcag

SEQ ID NO: 550827 - RNA, 13 nt, Homo sapiens
cuccaaaaccucc

SEQ ID NO: 550828 - RNA, 13 nt, Homo sapiens
cuccaaaagcacu

SEQ ID NO: 550829 - RNA, 19 nt, Homo sapiens
cuccaaaauauuaacauuc

SEQ ID NO: 550830 - RNA, 13 nt, Homo sapiens
cuccaaacugaag

SEQ ID NO: 550831 - RNA, 17 nt, Homo sapiens
cuccaaauagcauuagu

SEQ ID NO: 550832 - RNA, 23 nt, Homo sapiens
cuccaaauccaaggaaacaugca

SEQ ID NO: 550833 - RNA, 13 nt, Homo sapiens
cuccaacaccaag

SEQ ID NO: 550834 - RNA, 17 nt, Homo sapiens
cuccaacccugccguca

SEQ ID NO: 550835 - RNA, 19 nt, Homo sapiens
cuccaacugaaauguuaag

SEQ ID NO: 550836 - RNA, 22 nt, Homo sapiens
cuccaagcgcgguuacuauggc

SEQ ID NO: 550837 - RNA, 22 nt, Homo sapiens
cuccaagggacccuuugccuuu

SEQ ID NO: 550838 - RNA, 15 nt, Homo sapiens
cuccaaucaguguuu

SEQ ID NO: 550839 - RNA, 20 nt, Homo sapiens
cuccacaccuccaaugcugc

SEQ ID NO: 550840 - RNA, 21 nt, Homo sapiens
cuccacagagauacacagaua

SEQ ID NO: 550841 - RNA, 22 nt, Homo sapiens
cuccacagagugagccagugag

SEQ ID NO: 550842 - RNA, 15 nt, Homo sapiens
cuccacagugcugcu

SEQ ID NO: 550843 - RNA, 16 nt, Homo sapiens
cuccacagugcugcuu

SEQ ID NO: 550844 - RNA, 13 nt, Homo sapiens
cuccacauauuuc

SEQ ID NO: 550845 - RNA, 11 nt, Homo sapiens
cuccacaugcu

SEQ ID NO: 550846 - RNA, 14 nt, Homo sapiens
cuccaccacauccu

SEQ ID NO: 550847 - RNA, 19 nt, Homo sapiens
cuccaccagccugcugaca

SEQ ID NO: 550848 - RNA, 19 nt, Homo sapiens
cuccacccuauauguagua

SEQ ID NO: 550849 - RNA, 14 nt, Homo sapiens
cuccaccucuucac

SEQ ID NO: 550850 - RNA, 15 nt, Homo sapiens
cuccacgaagccuua

SEQ ID NO: 550851 - RNA, 13 nt, Homo sapiens
cucccuguuagaa

SEQ ID NO: 550852 - RNA, 20 nt, Homo sapiens
cucccuguuaucugcuagau

SEQ ID NO: 550853 - RNA, 12 nt, Homo sapiens
cucccuguucac

SEQ ID NO: 550854 - RNA, 14 nt, Homo sapiens
cucccuuccaggaa

SEQ ID NO: 550855 - RNA, 16 nt, Homo sapiens
cucccuucccaguggg

SEQ ID NO: 550856 - RNA, 14 nt, Homo sapiens
cucccuucuugggu

SEQ ID NO: 550857 - RNA, 20 nt, Homo sapiens
cucccuugcucagugccucc

SEQ ID NO: 550858 - RNA, 23 nt, Homo sapiens
cucccuugggaagggcagggaau

SEQ ID NO: 550859 - RNA, 20 nt, Homo sapiens
cucccuuggugguggggaca

SEQ ID NO: 550860 - RNA, 23 nt, Homo sapiens
cucccuuucuaucguucucucuu

SEQ ID NO: 550861 - RNA, 14 nt, Homo sapiens
cucccuuugaugau

SEQ ID NO: 550862 - RNA, 18 nt, Homo sapiens
cucccuuugccagugccu

SEQ ID NO: 550863 - RNA, 12 nt, Homo sapiens
cuccguccuguc

SEQ ID NO: 550864 - RNA, 13 nt, Homo sapiens
cuccguccuguca

SEQ ID NO: 550865 - RNA, 22 nt, Homo sapiens
cuccuaacccuuaucaccagcu

SEQ ID NO: 550866 - RNA, 18 nt, Homo sapiens
cuccuaagcaacuaggcc

SEQ ID NO: 550867 - RNA, 23 nt, Homo sapiens
cuccuaaucuuaucaauucugau

SEQ ID NO: 550868 - RNA, 13 nt, Homo sapiens
cuccuaauucugc

SEQ ID NO: 550869 - RNA, 13 nt, Homo sapiens
cuccuacauccag

SEQ ID NO: 550870 - RNA, 13 nt, Homo sapiens
cuccuaccccuuc

SEQ ID NO: 550871 - RNA, 19 nt, Homo sapiens
cuccuaccugucuucuggc

SEQ ID NO: 550872 - RNA, 18 nt, Homo sapiens
cuccuaccuuuugucucu

SEQ ID NO: 550873 - RNA, 12 nt, Homo sapiens
cuccuacuguau

SEQ ID NO: 550874 - RNA, 22 nt, Homo sapiens
cuccuagaagaaccaaauaccu

SEQ ID NO: 550875 - RNA, 16 nt, Homo sapiens
cuccuagggcauugua

SEQ ID NO: 550876 - RNA, 13 nt, Homo sapiens
cuccuauacucua

SEQ ID NO: 550877 - RNA, 14 nt, Homo sapiens
cuccuauacucuau

SEQ ID NO: 550878 - RNA, 14 nt, Homo sapiens
cuccuaucuguguu

SEQ ID NO: 550879 - RNA, 18 nt, Homo sapiens
cuccucaaaccacuugcc

SEQ ID NO: 550880 - RNA, 20 nt, Homo sapiens
cuccucacaguugccaugua

SEQ ID NO: 550881 - RNA, 22 nt, Homo sapiens
cuccucacaguugccauguaga

SEQ ID NO: 550882 - RNA, 19 nt, Homo sapiens
cuccucacccaccucuggg

SEQ ID NO: 550883 - RNA, 19 nt, Homo sapiens
cuccucagagcgccaggaa

SEQ ID NO: 550884 - RNA, 20 nt, Homo sapiens
cuccucaggcccagcugcuc

SEQ ID NO: 550885 - RNA, 17 nt, Homo sapiens
cuccucaguuucucaaa

SEQ ID NO: 550886 - RNA, 14 nt, Homo sapiens
cuccucccauguca

SEQ ID NO: 550887 - RNA, 17 nt, Homo sapiens
cuccuccccacaucccc

SEQ ID NO: 550888 - RNA, 14 nt, Homo sapiens
cuccuccccuuuca

SEQ ID NO: 550889 - RNA, 15 nt, Homo sapiens
cuccucccugucaua

SEQ ID NO: 550890 - RNA, 21 nt, Homo sapiens
cuccuccugcccuccaucuca

SEQ ID NO: 550891 - RNA, 13 nt, Homo sapiens
cuccuccugucaa

SEQ ID NO: 550892 - RNA, 18 nt, Homo sapiens
cuccucgggaaacacaca

SEQ ID NO: 550893 - RNA, 19 nt, Homo sapiens
cuccucucccauccuugau

SEQ ID NO: 550894 - RNA, 18 nt, Homo sapiens
cuccucugcagugccuug

SEQ ID NO: 550895 - RNA, 18 nt, Homo sapiens
cuccucugcuaugcauuu

SEQ ID NO: 550896 - RNA, 13 nt, Homo sapiens
cuccucugcucuu

SEQ ID NO: 550897 - RNA, 14 nt, Homo sapiens
cuccucuugccacu

SEQ ID NO: 550898 - RNA, 14 nt, Homo sapiens
cuccugaagccaca

SEQ ID NO: 550899 - RNA, 23 nt, Homo sapiens
cuccugaaguugcugcugugaau

SEQ ID NO: 550900 - RNA, 13 nt, Homo sapiens
cuccugaaugcau

SEQ ID NO: 550901 - RNA, 20 nt, Homo sapiens
cuccugaccucaagugaucu

SEQ ID NO: 550902 - RNA, 23 nt, Homo sapiens
cuccugaccucaagugaucuguc

SEQ ID NO: 550903 - RNA, 20 nt, Homo sapiens
cuccugaccucaggugaucc

SEQ ID NO: 550904 - RNA, 14 nt, Homo sapiens
cuccugacuuuuaa

SEQ ID NO: 550905 - RNA, 18 nt, Homo sapiens
cuccugauggagugugca

SEQ ID NO: 550906 - RNA, 13 nt, Homo sapiens
cuccugauggcca

SEQ ID NO: 550907 - RNA, 13 nt, Homo sapiens
cuccugcacuuug

SEQ ID NO: 550908 - RNA, 15 nt, Homo sapiens
cuccugccaggguga

SEQ ID NO: 550909 - RNA, 15 nt, Homo sapiens
cuccugccauagucu

SEQ ID NO: 550910 - RNA, 23 nt, Homo sapiens
cuccugcccagcuccucacauac

SEQ ID NO: 550911 - RNA, 18 nt, Homo sapiens
cuccugccuaauuuugaa

SEQ ID NO: 550912 - RNA, 23 nt, Homo sapiens
cuccugcgcccuucauugccaca

SEQ ID NO: 550913 - RNA, 22 nt, Homo sapiens
cuccugcggcucagccuugcac

SEQ ID NO: 550914 - RNA, 15 nt, Homo sapiens
cuccugcugauccag

SEQ ID NO: 550915 - RNA, 14 nt, Homo sapiens
cuccuggaaccuug

SEQ ID NO: 550916 - RNA, 15 nt, Homo sapiens
cuccuggaaccuugc

SEQ ID NO: 550917 - RNA, 16 nt, Homo sapiens
cuccuggagauagcug

SEQ ID NO: 550918 - RNA, 17 nt, Homo sapiens
cuccuggcaaucaauac

SEQ ID NO: 550919 - RNA, 23 nt, Homo sapiens
cuccuggcaaucaauacagcuuc

SEQ ID NO: 550920 - RNA, 20 nt, Homo sapiens
cuccuggccucaagggaucc

SEQ ID NO: 550921 - RNA, 15 nt, Homo sapiens
cuccuggccuggcca

SEQ ID NO: 550922 - RNA, 19 nt, Homo sapiens
cuccugggcucaagcaauc

SEQ ID NO: 550923 - RNA, 19 nt, Homo sapiens
cuccugggcucaagugauc

SEQ ID NO: 550924 - RNA, 16 nt, Homo sapiens
cuccuggggucacuca

SEQ ID NO: 550925 - RNA, 14 nt, Homo sapiens
cuccugguccugga

SEQ ID NO: 550926 - RNA, 16 nt, Homo sapiens
cuccuggucuugagau

SEQ ID NO: 550927 - RNA, 21 nt, Homo sapiens
cuccugucuuaugguccagaa

SEQ ID NO: 550928 - RNA, 16 nt, Homo sapiens
cuccugugaauggagg

SEQ ID NO: 550929 - RNA, 22 nt, Homo sapiens
cuccugugacgcacagcacucc

SEQ ID NO: 550930 - RNA, 20 nt, Homo sapiens
cuccugugggagaucuucac

SEQ ID NO: 550931 - RNA, 21 nt, Homo sapiens
cuccuguuuguugagugcacu

SEQ ID NO: 550932 - RNA, 23 nt, Homo sapiens
cuccuguuuuuuucaggcuccua

SEQ ID NO: 550933 - RNA, 23 nt, Homo sapiens
cuccuuaauuuaauugcuuugaa

SEQ ID NO: 550934 - RNA, 13 nt, Homo sapiens
cuccuucaaugca

SEQ ID NO: 550935 - RNA, 15 nt, Homo sapiens
cuccuucagcagcua

SEQ ID NO: 550936 - RNA, 16 nt, Homo sapiens
cuccuuccacauguac

SEQ ID NO: 550937 - RNA, 14 nt, Homo sapiens
cuccuuccaccaca

SEQ ID NO: 550938 - RNA, 15 nt, Homo sapiens
cuccuuccaccacaa

SEQ ID NO: 550939 - RNA, 13 nt, Homo sapiens
cuccuuccagacc

SEQ ID NO: 550940 - RNA, 13 nt, Homo sapiens
cuccuuccagugu

SEQ ID NO: 550941 - RNA, 22 nt, Homo sapiens
cuccuucccauuucucuacacu

SEQ ID NO: 550942 - RNA, 21 nt, Homo sapiens
cuccuugcccucaagcaauau

SEQ ID NO: 550943 - RNA, 17 nt, Homo sapiens
cuccuugcuuccugucu

SEQ ID NO: 550944 - RNA, 22 nt, Homo sapiens
cuccuuggauguagucaguuag

SEQ ID NO: 550945 - RNA, 19 nt, Homo sapiens
cuccuuguaaagacuguag

SEQ ID NO: 550946 - RNA, 21 nt, Homo sapiens
cuccuugucaauacugagcca

SEQ ID NO: 550947 - RNA, 15 nt, Homo sapiens
cuccuuuaccuuuca

SEQ ID NO: 550948 - RNA, 13 nt, Homo sapiens
cuccuuuacuaaa

SEQ ID NO: 550949 - RNA, 14 nt, Homo sapiens
cuccuuugcacuga

SEQ ID NO: 550950 - RNA, 14 nt, Homo sapiens
cuccuuuuaagggu

SEQ ID NO: 550951 - RNA, 15 nt, Homo sapiens
cuccuuuuacagaau

SEQ ID NO: 550952 - RNA, 20 nt, Homo sapiens
cuccuuuuuaauacauuaag

SEQ ID NO: 550953 - RNA, 19 nt, Homo sapiens
cucgaaaaagaaucugcuu

SEQ ID NO: 550954 - RNA, 14 nt, Homo sapiens
cucgaaacacagaa

SEQ ID NO: 550955 - RNA, 15 nt, Homo sapiens
cucgaaacacagaaa

SEQ ID NO: 550956 - RNA, 22 nt, Homo sapiens
cucgaacuauuuucaaagacuu

SEQ ID NO: 550957 - RNA, 20 nt, Homo sapiens
cucgaacuccugaccucagg

SEQ ID NO: 550958 - RNA, 22 nt, Homo sapiens
cucgaacuccugaccucaggug

SEQ ID NO: 550959 - RNA, 15 nt, Homo sapiens
cucgagacacaguga

SEQ ID NO: 550960 - RNA, 16 nt, Homo sapiens
cucgagcaguccugcc

SEQ ID NO: 550961 - RNA, 15 nt, Homo sapiens
cucgcaugacuguua

SEQ ID NO: 550962 - RNA, 14 nt, Homo sapiens
cucgcccgcccacu

SEQ ID NO: 550963 - RNA, 23 nt, Homo sapiens
cucgcccuccuuucugugcccua

SEQ ID NO: 550964 - RNA, 12 nt, Homo sapiens
cucgccuaggcc

SEQ ID NO: 550965 - RNA, 13 nt, Homo sapiens
cucggacuuggca

SEQ ID NO: 550966 - RNA, 18 nt, Homo sapiens
cucggagaagagcgcagu

SEQ ID NO: 550967 - RNA, 17 nt, Homo sapiens
cugucuccaugcuggau

SEQ ID NO: 550968 - RNA, 13 nt, Homo sapiens
cugucuccuuuga

SEQ ID NO: 550969 - RNA, 17 nt, Homo sapiens
cugucucuagcuguucu

SEQ ID NO: 550970 - RNA, 19 nt, Homo sapiens
cugucugaaggacacuucc

SEQ ID NO: 550971 - RNA, 14 nt, Homo sapiens
cugucugacaaccu

SEQ ID NO: 550972 - RNA, 20 nt, Homo sapiens
cugucugagaauuuccaaaa

SEQ ID NO: 550973 - RNA, 19 nt, Homo sapiens
cugucugagacucacagga

SEQ ID NO: 550974 - RNA, 14 nt, Homo sapiens
cugucugcccugaa

SEQ ID NO: 550975 - RNA, 22 nt, Homo sapiens
cugucuggauccuauccuccua

SEQ ID NO: 550976 - RNA, 16 nt, Homo sapiens
cugucuggcugaggau

SEQ ID NO: 550977 - RNA, 17 nt, Homo sapiens
cugucugucaccagcua

SEQ ID NO: 550978 - RNA, 17 nt, Homo sapiens
cugucugucuucuccua

SEQ ID NO: 550979 - RNA, 19 nt, Homo sapiens
cugucuuacuauuauagca

SEQ ID NO: 550980 - RNA, 19 nt, Homo sapiens
cugucuucagagaacccac

SEQ ID NO: 550981 - RNA, 19 nt, Homo sapiens
cugucuucagcacauucca

SEQ ID NO: 550982 - RNA, 20 nt, Homo sapiens
cugucuuuauaaucuacucc

SEQ ID NO: 550983 - RNA, 23 nt, Homo sapiens
cugucuuucaaugacacccugau

SEQ ID NO: 550984 - RNA, 14 nt, Homo sapiens
cugucuuugcugag

SEQ ID NO: 550985 - RNA, 14 nt, Homo sapiens
cugucuuuguggga

SEQ ID NO: 550986 - RNA, 20 nt, Homo sapiens
cugugaaaccuuuaccuuuu

SEQ ID NO: 550987 - RNA, 18 nt, Homo sapiens
cugugaaauucacaguaa

SEQ ID NO: 550988 - RNA, 20 nt, Homo sapiens
cugugaaauucacaguaaua

SEQ ID NO: 550989 - RNA, 14 nt, Homo sapiens
cugugaacagcuug

SEQ ID NO: 550990 - RNA, 14 nt, Homo sapiens
cugugaacugauca

SEQ ID NO: 550991 - RNA, 20 nt, Homo sapiens
cugugaauaaaaacccugua

SEQ ID NO: 550992 - RNA, 21 nt, Homo sapiens
cugugaauaaaaacccuguau

SEQ ID NO: 550993 - RNA, 15 nt, Homo sapiens
cugugaauacuugaa

SEQ ID NO: 550994 - RNA, 17 nt, Homo sapiens
cugugaauuucaaaaaa

SEQ ID NO: 550995 - RNA, 10 nt, Homo sapiens
cugugacacu

SEQ ID NO: 550996 - RNA, 19 nt, Homo sapiens
cugugacgagguggcaguc

SEQ ID NO: 550997 - RNA, 21 nt, Homo sapiens
cugugacucccccucuuucac

SEQ ID NO: 550998 - RNA, 23 nt, Homo sapiens
cugugacugaagaagaugagccu

SEQ ID NO: 550999 - RNA, 19 nt, Homo sapiens
cugugagacagugggaaau

SEQ ID NO: 551000 - RNA, 19 nt, Homo sapiens
cugugagaggugacacugu

SEQ ID NO: 551001 - RNA, 19 nt, Homo sapiens
cugugagccggagcucaug

SEQ ID NO: 551002 - RNA, 23 nt, Homo sapiens
cugugagcuggagagaacccaga

SEQ ID NO: 551003 - RNA, 18 nt, Homo sapiens
cugugagggagugcagaa

SEQ ID NO: 551004 - RNA, 18 nt, Homo sapiens
cugugauaacucugcaaa

SEQ ID NO: 551005 - RNA, 17 nt, Homo sapiens
cugugauaugccauagg

SEQ ID NO: 551006 - RNA, 20 nt, Homo sapiens
cugugauauuuuaaauaucc

SEQ ID NO: 551007 - RNA, 14 nt, Homo sapiens
cugugauccuagca

SEQ ID NO: 551008 - RNA, 22 nt, Homo sapiens
cugugauuaggugaagggaugg

SEQ ID NO: 551009 - RNA, 13 nt, Homo sapiens
cugugauuuugcc

SEQ ID NO: 551010 - RNA, 15 nt, Homo sapiens
cugugcaaagggaac

SEQ ID NO: 551011 - RNA, 18 nt, Homo sapiens
cugugcaaauccuugaua

SEQ ID NO: 551012 - RNA, 22 nt, Homo sapiens
cugugcaaccucuuggccugau

SEQ ID NO: 551013 - RNA, 15 nt, Homo sapiens
cugugcagaccuuac

SEQ ID NO: 551014 - RNA, 17 nt, Homo sapiens
cugugcaguagccguuu

SEQ ID NO: 551015 - RNA, 15 nt, Homo sapiens
cugugcagucacugg

SEQ ID NO: 551016 - RNA, 19 nt, Homo sapiens
cugugccagacauugcucu

SEQ ID NO: 551017 - RNA, 20 nt, Homo sapiens
cugugcccggggaaaggcaa

SEQ ID NO: 551018 - RNA, 18 nt, Homo sapiens
cugugccuaacaccagcg

SEQ ID NO: 551019 - RNA, 15 nt, Homo sapiens
cugugcuaugaauuu

SEQ ID NO: 551020 - RNA, 14 nt, Homo sapiens
cugugcugggggaa

SEQ ID NO: 551021 - RNA, 18 nt, Homo sapiens
cugugcugggugagcucu

SEQ ID NO: 551022 - RNA, 19 nt, Homo sapiens
cugugcugggugagcucuu

SEQ ID NO: 551023 - RNA, 19 nt, Homo sapiens
cugugcugguguccugacc

SEQ ID NO: 551024 - RNA, 20 nt, Homo sapiens
cugugcuucgacuacugcuc

SEQ ID NO: 551025 - RNA, 16 nt, Homo sapiens
cugugcuuugacucac

SEQ ID NO: 551026 - RNA, 23 nt, Homo sapiens
cuguggaaaagccaucucagguu

SEQ ID NO: 551027 - RNA, 16 nt, Homo sapiens
cuguggaacauaaaaa

SEQ ID NO: 551028 - RNA, 21 nt, Homo sapiens
cuguggaacuacauuacugua

SEQ ID NO: 551029 - RNA, 13 nt, Homo sapiens
cuguggaaugagu

SEQ ID NO: 551030 - RNA, 18 nt, Homo sapiens
cuguggaccacccuagca

SEQ ID NO: 551031 - RNA, 20 nt, Homo sapiens
cuguggagauggacucagga

SEQ ID NO: 551032 - RNA, 19 nt, Homo sapiens
cuguggagccccagcauau

SEQ ID NO: 551033 - RNA, 21 nt, Homo sapiens
cuguggaggccugaugcugcc

SEQ ID NO: 551034 - RNA, 18 nt, Homo sapiens
cuguggaugauaaaacac

SEQ ID NO: 551035 - RNA, 20 nt, Homo sapiens
cuguggaugaugguugcaaa

SEQ ID NO: 551036 - RNA, 15 nt, Homo sapiens
cuguggcacauucuu

SEQ ID NO: 551037 - RNA, 15 nt, Homo sapiens
cuguggcacuggcca

SEQ ID NO: 551038 - RNA, 15 nt, Homo sapiens
cuguggcagaguuac

SEQ ID NO: 551039 - RNA, 17 nt, Homo sapiens
cuguggccaacugcaaa

SEQ ID NO: 551040 - RNA, 20 nt, Homo sapiens
cuguggcucugcaugacaaa

SEQ ID NO: 551041 - RNA, 15 nt, Homo sapiens
cuguggcugcuagca

SEQ ID NO: 551042 - RNA, 21 nt, Homo sapiens
cuguggcugcuagcacuugga

SEQ ID NO: 551043 - RNA, 21 nt, Homo sapiens
cuguggcuucuaggugcccga

SEQ ID NO: 551044 - RNA, 19 nt, Homo sapiens
cuguggggaucucaggggc

SEQ ID NO: 551045 - RNA, 21 nt, Homo sapiens
cuguggggcccuugggccacg

SEQ ID NO: 551046 - RNA, 16 nt, Homo sapiens
cuguggggccugaugg

SEQ ID NO: 551047 - RNA, 21 nt, Homo sapiens
cuguggggcugaauugccagg

SEQ ID NO: 551048 - RNA, 17 nt, Homo sapiens
cuguggggcuuacagaa

SEQ ID NO: 551049 - RNA, 15 nt, Homo sapiens
cuguggucacuugua

SEQ ID NO: 551050 - RNA, 12 nt, Homo sapiens
cuguggugagaa

SEQ ID NO: 551051 - RNA, 18 nt, Homo sapiens
cugugguuacagugcaga

SEQ ID NO: 551052 - RNA, 21 nt, Homo sapiens
cuguguaaaacuauauucuca

SEQ ID NO: 551053 - RNA, 21 nt, Homo sapiens
cuguguacagaauucugcuac

SEQ ID NO: 551054 - RNA, 13 nt, Homo sapiens
cuguguacugugg

SEQ ID NO: 551055 - RNA, 14 nt, Homo sapiens
cuguguacugugga

SEQ ID NO: 551056 - RNA, 16 nt, Homo sapiens
cuguguaucauuaaaa

SEQ ID NO: 551057 - RNA, 16 nt, Homo sapiens
cugugucaaaagccag

SEQ ID NO: 551058 - RNA, 15 nt, Homo sapiens
cuguguccaucugac

SEQ ID NO: 551059 - RNA, 14 nt, Homo sapiens
cugugucccaugac

SEQ ID NO: 551060 - RNA, 22 nt, Homo sapiens
cuguguccucuuccaccacaga

SEQ ID NO: 551061 - RNA, 21 nt, Homo sapiens
cugugucggauacacacucga

SEQ ID NO: 551062 - RNA, 19 nt, Homo sapiens
cugugucuccucucagagu

SEQ ID NO: 551063 - RNA, 15 nt, Homo sapiens
cugugugaaggugaa

SEQ ID NO: 551064 - RNA, 20 nt, Homo sapiens
cugugugaaugugggcacug

SEQ ID NO: 551065 - RNA, 16 nt, Homo sapiens
cugugugauugacagc

SEQ ID NO: 551066 - RNA, 19 nt, Homo sapiens
cugugugcaagugugugca

SEQ ID NO: 551067 - RNA, 22 nt, Homo sapiens
cugugugcaagugugugcacau

SEQ ID NO: 551068 - RNA, 23 nt, Homo sapiens
cugugugcaagugugugcacaug

SEQ ID NO: 551069 - RNA, 23 nt, Homo sapiens
cugugugccauuuuaagaguuac

SEQ ID NO: 551070 - RNA, 21 nt, Homo sapiens
cuguguggacugugaugccac

SEQ ID NO: 551071 - RNA, 23 nt, Homo sapiens
cuguguggacugugaugccacac

SEQ ID NO: 551072 - RNA, 22 nt, Homo sapiens
cugugugggauacuuaguggua

SEQ ID NO: 551073 - RNA, 22 nt, Homo sapiens
cuguguguuuucccaaagcacu

SEQ ID NO: 551074 - RNA, 23 nt, Homo sapiens
cuguguuacugcuuugcaaagac

SEQ ID NO: 551075 - RNA, 13 nt, Homo sapiens
cuguguuaggggu

SEQ ID NO: 551076 - RNA, 16 nt, Homo sapiens
cuguguuccuggcaau

SEQ ID NO: 551077 - RNA, 17 nt, Homo sapiens
cuguguucgauggcuca

SEQ ID NO: 551078 - RNA, 16 nt, Homo sapiens
cuguguugaagcacug

SEQ ID NO: 551079 - RNA, 21 nt, Homo sapiens
cuguguugccaagcuccaagc

SEQ ID NO: 551080 - RNA, 14 nt, Homo sapiens
cuguguugccacag

SEQ ID NO: 551081 - RNA, 21 nt, Homo sapiens
cuguguugcccugacuggagu

SEQ ID NO: 551082 - RNA, 22 nt, Homo sapiens
cuguguugucaacaaaccaagc

SEQ ID NO: 551083 - RNA, 20 nt, Homo sapiens
cuguguuuuuccuccauaaa

SEQ ID NO: 551084 - RNA, 22 nt, Homo sapiens
cuguuaaaauguacacuggaua

SEQ ID NO: 551085 - RNA, 20 nt, Homo sapiens
cuguuaaacaacucuuuaaa

SEQ ID NO: 551086 - RNA, 13 nt, Homo sapiens
cuguuccuugaaa

SEQ ID NO: 551087 - RNA, 20 nt, Homo sapiens
cuguucuaauggauuauaau

SEQ ID NO: 551088 - RNA, 13 nt, Homo sapiens
cuguucuagggaa

SEQ ID NO: 551089 - RNA, 16 nt, Homo sapiens
cuguucugaaaccuua

SEQ ID NO: 551090 - RNA, 19 nt, Homo sapiens
cuguucugaaaggagacau

SEQ ID NO: 551091 - RNA, 20 nt, Homo sapiens
cuguucugaaaggagacauu

SEQ ID NO: 551092 - RNA, 23 nt, Homo sapiens
cuguucugaaaggagacauugcu

SEQ ID NO: 551093 - RNA, 19 nt, Homo sapiens
cuguucugggggacagaga

SEQ ID NO: 551094 - RNA, 23 nt, Homo sapiens
cuguucuguuggaugacuuugag

SEQ ID NO: 551095 - RNA, 20 nt, Homo sapiens
cuguucuuacaaaugugaaa

SEQ ID NO: 551096 - RNA, 17 nt, Homo sapiens
cuguucuuguauuguau

SEQ ID NO: 551097 - RNA, 17 nt, Homo sapiens
cuguucuuuugcaauaa

SEQ ID NO: 551098 - RNA, 22 nt, Homo sapiens
cuguugaaaauuauuuuaaaca

SEQ ID NO: 551099 - RNA, 14 nt, Homo sapiens
cuguugaagucuca

SEQ ID NO: 551100 - RNA, 23 nt, Homo sapiens
cuguugaauuauguuuugacaca

SEQ ID NO: 551101 - RNA, 23 nt, Homo sapiens
cuguugaucccacuucacuguga

SEQ ID NO: 551102 - RNA, 21 nt, Homo sapiens
cuguugccagugcuuugcaca

SEQ ID NO: 551103 - RNA, 21 nt, Homo sapiens
cuguugcggaucuucauggcc

SEQ ID NO: 551104 - RNA, 12 nt, Homo sapiens
cuguugcucaaa

SEQ ID NO: 551105 - RNA, 14 nt, Homo sapiens
cuguugcucaggag

SEQ ID NO: 551106 - RNA, 11 nt, Homo sapiens
cuguugcuugu

SEQ ID NO: 551107 - RNA, 23 nt, Homo sapiens
cuguugcuugucuugauuaacuu

SEQ ID NO: 551108 - RNA, 22 nt, Homo sapiens
cuguugcuuuaauaugagcuuc

SEQ ID NO: 551109 - RNA, 15 nt, Homo sapiens
cuguuguaugccugg

SEQ ID NO: 551110 - RNA, 20 nt, Homo sapiens
cuguugucaaaaaguuccau

SEQ ID NO: 551111 - RNA, 17 nt, Homo sapiens
cuguuuaaaguggcaau

SEQ ID NO: 551112 - RNA, 15 nt, Homo sapiens
cuguuuaacauuucc

SEQ ID NO: 551113 - RNA, 23 nt, Homo sapiens
cuguuuacaaaagcccaauguaa

SEQ ID NO: 551114 - RNA, 14 nt, Homo sapiens
cuguuucaaagcac

SEQ ID NO: 551115 - RNA, 15 nt, Homo sapiens
cuguuuccauccagu

SEQ ID NO: 551116 - RNA, 20 nt, Homo sapiens
cuguuucccuuucacuggca

SEQ ID NO: 551117 - RNA, 16 nt, Homo sapiens
cuguuuccuagcugug

SEQ ID NO: 551118 - RNA, 16 nt, Homo sapiens
cuguuucucaugaagc

SEQ ID NO: 551119 - RNA, 21 nt, Homo sapiens
cuguuucuuaagggcacacac

SEQ ID NO: 551120 - RNA, 16 nt, Homo sapiens
cuguuucuucuuguga

SEQ ID NO: 551121 - RNA, 17 nt, Homo sapiens
cuguuugacaacauguu

SEQ ID NO: 551122 - RNA, 20 nt, Homo sapiens
cuguuugcguacuuguaaua

SEQ ID NO: 551123 - RNA, 18 nt, Homo sapiens
cuguuuggagauccucau

SEQ ID NO: 551124 - RNA, 17 nt, Homo sapiens
cuguuuggcuuaacaca

SEQ ID NO: 551125 - RNA, 16 nt, Homo sapiens
cuguuugucugaacaa

SEQ ID NO: 551126 - RNA, 13 nt, Homo sapiens
cuguuugucugau

SEQ ID NO: 551127 - RNA, 18 nt, Homo sapiens
cuguuugucugauguggc

SEQ ID NO: 551128 - RNA, 20 nt, Homo sapiens
cuguuuuagauaucccuuac

SEQ ID NO: 551129 - RNA, 17 nt, Homo sapiens
cuguuuuagcugaggga

SEQ ID NO: 551130 - RNA, 17 nt, Homo sapiens
cuguuuuccuuaccuau

SEQ ID NO: 551131 - RNA, 17 nt, Homo sapiens
cuguuuucguaccuucc

SEQ ID NO: 551132 - RNA, 15 nt, Homo sapiens
cuguuuucucucggc

SEQ ID NO: 551133 - RNA, 14 nt, Homo sapiens
cuguuuugccuuca

SEQ ID NO: 551134 - RNA, 21 nt, Homo sapiens
cuguuuuguaagugcugcuau

SEQ ID NO: 551135 - RNA, 20 nt, Homo sapiens
cuguuuuuacuaaguuuuca

SEQ ID NO: 551136 - RNA, 20 nt, Homo sapiens
cuguuuuuagagcuuccaaa

SEQ ID NO: 551137 - RNA, 17 nt, Homo sapiens
cuguuuuuguaguggua

SEQ ID NO: 551138 - RNA, 19 nt, Homo sapiens
cuguuuuuuucaggcuccu

SEQ ID NO: 551139 - RNA, 20 nt, Homo sapiens
cuguuuuuuucccagguguu

SEQ ID NO: 551140 - RNA, 23 nt, Homo sapiens
cuuaaaaaaauagaaauuauucu

SEQ ID NO: 551141 - RNA, 16 nt, Homo sapiens
cuuaaaaaacauauau

SEQ ID NO: 551142 - RNA, 15 nt, Homo sapiens
cuuaaaaaaugucca

SEQ ID NO: 551143 - RNA, 22 nt, Homo sapiens
cuuaaaacaaauucauuauucu

SEQ ID NO: 551144 - RNA, 14 nt, Homo sapiens
cuuaaaacuaaaug

SEQ ID NO: 551145 - RNA, 13 nt, Homo sapiens
cuuaaaauaguuu

SEQ ID NO: 551146 - RNA, 20 nt, Homo sapiens
cuuaaaaugacaaagccauu

SEQ ID NO: 551147 - RNA, 14 nt, Homo sapiens
cuuaaaauguuaac

SEQ ID NO: 551148 - RNA, 14 nt, Homo sapiens
cuuaaaauugugag

SEQ ID NO: 551149 - RNA, 23 nt, Homo sapiens
cuuaaaauuuuucuuaagacaga

SEQ ID NO: 551150 - RNA, 14 nt, Homo sapiens
cuuaaacacacauu

SEQ ID NO: 551151 - RNA, 21 nt, Homo sapiens
cuuaaacuaaauaaugaauaa

SEQ ID NO: 551152 - RNA, 19 nt, Homo sapiens
cuuaaacuaauacgugcca

SEQ ID NO: 551153 - RNA, 22 nt, Homo sapiens
cuuaaacuaugaaccuucuuaa

SEQ ID NO: 551154 - RNA, 22 nt, Homo sapiens
cuuaaacucagcuacugcaaau

SEQ ID NO: 551155 - RNA, 22 nt, Homo sapiens
cuuaaacuccuggccucaagca

SEQ ID NO: 551156 - RNA, 19 nt, Homo sapiens
cuuaaacucuggacacucu

SEQ ID NO: 551157 - RNA, 16 nt, Homo sapiens
cuuaaacucuguuaca

SEQ ID NO: 551158 - RNA, 12 nt, Homo sapiens
cuuaaacuucca

SEQ ID NO: 551159 - RNA, 17 nt, Homo sapiens
cuuaaacuugcaucacu

SEQ ID NO: 551160 - RNA, 20 nt, Homo sapiens
cuuaaagaaacagcuuucaa

SEQ ID NO: 551161 - RNA, 19 nt, Homo sapiens
cuuaaagcacagucugaug

SEQ ID NO: 551162 - RNA, 13 nt, Homo sapiens
cuuaaagcuugau

SEQ ID NO: 551163 - RNA, 23 nt, Homo sapiens
cuuaaauaauaaacaguggaaua

SEQ ID NO: 551164 - RNA, 16 nt, Homo sapiens
cuuaaauaauuugggu

SEQ ID NO: 551165 - RNA, 21 nt, Homo sapiens
cuuaaauauauaauguugcca

SEQ ID NO: 551166 - RNA, 15 nt, Homo sapiens
cuuaaauauuuccau

SEQ ID NO: 551167 - RNA, 18 nt, Homo sapiens
cuuaaauauuuccaucag

SEQ ID NO: 551168 - RNA, 13 nt, Homo sapiens
cuuaaaucauggg

SEQ ID NO: 551169 - RNA, 21 nt, Homo sapiens
cuuaaaugcucauuuucuggu

SEQ ID NO: 551170 - RNA, 21 nt, Homo sapiens
cuuaaauggaauuauuuugaa

SEQ ID NO: 551171 - RNA, 22 nt, Homo sapiens
cuuaaauguagcaauggcacug

SEQ ID NO: 551172 - RNA, 23 nt, Homo sapiens
cuuaaauugguauuaacuaugau

SEQ ID NO: 551173 - RNA, 22 nt, Homo sapiens
cuuaaauuucaaaccauuuacc

SEQ ID NO: 551174 - RNA, 15 nt, Homo sapiens
cuuaacacuauuuaa

SEQ ID NO: 551175 - RNA, 17 nt, Homo sapiens
cuuaacagaugcaaugu

SEQ ID NO: 551176 - RNA, 12 nt, Homo sapiens
cuuaacauucau

SEQ ID NO: 551177 - RNA, 13 nt, Homo sapiens
cuuaacauuucau

SEQ ID NO: 551178 - RNA, 19 nt, Homo sapiens
cuuaacauuucauuguaca

SEQ ID NO: 551179 - RNA, 23 nt, Homo sapiens
cuuaaccagucucucaagugaug

SEQ ID NO: 551180 - RNA, 16 nt, Homo sapiens
cuuaacccaaggagca

SEQ ID NO: 551181 - RNA, 18 nt, Homo sapiens
cuuaaccuuuuaauacug

SEQ ID NO: 551182 - RNA, 16 nt, Homo sapiens
cuuaacggaccaaagc

SEQ ID NO: 551183 - RNA, 17 nt, Homo sapiens
cuuaacucugaugguuc

SEQ ID NO: 551184 - RNA, 20 nt, Homo sapiens
cuuaacuuguuugguaguua

SEQ ID NO: 551185 - RNA, 18 nt, Homo sapiens
cuuaacuuugaaccauaa

SEQ ID NO: 551186 - RNA, 20 nt, Homo sapiens
cuuaacuuugaaccauaaag

SEQ ID NO: 551187 - RNA, 21 nt, Homo sapiens
cuuaagaacugcuucauguga

SEQ ID NO: 551188 - RNA, 22 nt, Homo sapiens
cuuaagaaguuagaaggcuuaa

SEQ ID NO: 551189 - RNA, 13 nt, Homo sapiens
cuuaagaauacac

SEQ ID NO: 551190 - RNA, 17 nt, Homo sapiens
cuuaaugagacuuuaaa

SEQ ID NO: 551191 - RNA, 12 nt, Homo sapiens
cuuaaugcaaau

SEQ ID NO: 551192 - RNA, 12 nt, Homo sapiens
cuuaaugcacag

SEQ ID NO: 551193 - RNA, 21 nt, Homo sapiens
cuuaauggaagguuggaucca

SEQ ID NO: 551194 - RNA, 14 nt, Homo sapiens
cuuaaugguuuccu

SEQ ID NO: 551195 - RNA, 14 nt, Homo sapiens
cuuaauguuccuca

SEQ ID NO: 551196 - RNA, 22 nt, Homo sapiens
cuuaauguucugaauaauuucu

SEQ ID NO: 551197 - RNA, 22 nt, Homo sapiens
cuuaauguuucuuagagccaag

SEQ ID NO: 551198 - RNA, 15 nt, Homo sapiens
cuuaauuauuauaaa

SEQ ID NO: 551199 - RNA, 17 nt, Homo sapiens
cuuaauuccuuucucau

SEQ ID NO: 551200 - RNA, 23 nt, Homo sapiens
cuuaauuuccuuuuugacacuga

SEQ ID NO: 551201 - RNA, 20 nt, Homo sapiens
cuuacaaaaagaaaugucaa

SEQ ID NO: 551202 - RNA, 14 nt, Homo sapiens
cuuacaauucccug

SEQ ID NO: 551203 - RNA, 20 nt, Homo sapiens
cuuacacagguuucagaaaa

SEQ ID NO: 551204 - RNA, 12 nt, Homo sapiens
cuuacacauaau

SEQ ID NO: 551205 - RNA, 13 nt, Homo sapiens
cuuacacaucuca

SEQ ID NO: 551206 - RNA, 19 nt, Homo sapiens
cuuacacugaggacugugg

SEQ ID NO: 551207 - RNA, 18 nt, Homo sapiens
cuuacacuuuaugcacaa

SEQ ID NO: 551208 - RNA, 12 nt, Homo sapiens
cuuacagaauua

SEQ ID NO: 551209 - RNA, 20 nt, Homo sapiens
cuuacaggaaaaccugcaga

SEQ ID NO: 551210 - RNA, 14 nt, Homo sapiens
cuuacagucccaga

SEQ ID NO: 551211 - RNA, 17 nt, Homo sapiens
cuuacauguguaaaggu

SEQ ID NO: 551212 - RNA, 17 nt, Homo sapiens
cuuaccaaacucaggug

SEQ ID NO: 551213 - RNA, 15 nt, Homo sapiens
cuuaccaacuuucug

SEQ ID NO: 551214 - RNA, 13 nt, Homo sapiens
cuuaccacagugu

SEQ ID NO: 551215 - RNA, 14 nt, Homo sapiens
cuuaccacaguguu

SEQ ID NO: 551216 - RNA, 18 nt, Homo sapiens
cuuaccagaagcuuccau

SEQ ID NO: 551217 - RNA, 23 nt, Homo sapiens
cuuaccagauccuuuuccagaaa

SEQ ID NO: 551218 - RNA, 17 nt, Homo sapiens
cuuaccaggcaccaaaa

SEQ ID NO: 551219 - RNA, 13 nt, Homo sapiens
cuuaccauauguu

SEQ ID NO: 551220 - RNA, 15 nt, Homo sapiens
cuuacccaauuuccc

SEQ ID NO: 551221 - RNA, 21 nt, Homo sapiens
cuuacccccccuaaguguaau

SEQ ID NO: 551222 - RNA, 18 nt, Homo sapiens
cuuaccuaucuguggaaa

SEQ ID NO: 551223 - RNA, 17 nt, Homo sapiens
cuuaccuuuccugaugc

SEQ ID NO: 551224 - RNA, 13 nt, Homo sapiens
cuuacuacacuga

SEQ ID NO: 551225 - RNA, 16 nt, Homo sapiens
cuuacuacacugagga

SEQ ID NO: 551226 - RNA, 13 nt, Homo sapiens
cuuacuauagucu

SEQ ID NO: 551227 - RNA, 14 nt, Homo sapiens
cuuacugcaggcaa

SEQ ID NO: 551228 - RNA, 14 nt, Homo sapiens
cuuacuguaacgga

SEQ ID NO: 551229 - RNA, 15 nt, Homo sapiens
cuuacuuaggugugg

SEQ ID NO: 551230 - RNA, 13 nt, Homo sapiens
cuuacuuccagca

SEQ ID NO: 551231 - RNA, 14 nt, Homo sapiens
cuuacuugcacugu

SEQ ID NO: 551232 - RNA, 23 nt, Homo sapiens
cuuagaaacaaaaagagcuuucc

SEQ ID NO: 551233 - RNA, 15 nt, Homo sapiens
cuuagaaauaacaga

SEQ ID NO: 551234 - RNA, 21 nt, Homo sapiens
cuuagaaauguaaacugccau

SEQ ID NO: 551235 - RNA, 18 nt, Homo sapiens
cuuagaaauugcauuucc

SEQ ID NO: 551236 - RNA, 20 nt, Homo sapiens
cuuagaacauuuuaauucau

SEQ ID NO: 551237 - RNA, 21 nt, Homo sapiens
cuuagacauaacaaaacacuc

SEQ ID NO: 551238 - RNA, 17 nt, Homo sapiens
cuuagaccuauacugaa

SEQ ID NO: 551239 - RNA, 13 nt, Homo sapiens
cuuagaccucagc

SEQ ID NO: 551240 - RNA, 22 nt, Homo sapiens
cuuagauaacuucuugaaaaag

SEQ ID NO: 551241 - RNA, 15 nt, Homo sapiens
cuuagauacuaauaa

SEQ ID NO: 551242 - RNA, 21 nt, Homo sapiens
cuuagcauagauuugcagcuc

SEQ ID NO: 551243 - RNA, 22 nt, Homo sapiens
cuuagcuauugcucugagaaag

SEQ ID NO: 551244 - RNA, 18 nt, Homo sapiens
cuuagcugucucagagau

SEQ ID NO: 551245 - RNA, 21 nt, Homo sapiens
cuuagcuuaucuuucuuucca

SEQ ID NO: 551246 - RNA, 15 nt, Homo sapiens
cuuaggcaugcacag

SEQ ID NO: 551247 - RNA, 23 nt, Homo sapiens
cuuaggcuuuguaugacagugaa

SEQ ID NO: 551248 - RNA, 17 nt, Homo sapiens
cuuagggaaguugucuc

SEQ ID NO: 551249 - RNA, 22 nt, Homo sapiens
cuuagggggagcccuggugcua

SEQ ID NO: 551250 - RNA, 17 nt, Homo sapiens
cuuaggugugaggucca

SEQ ID NO: 551251 - RNA, 23 nt, Homo sapiens
cuuaggugugagguccaggguug

SEQ ID NO: 551252 - RNA, 17 nt, Homo sapiens
cuuagguuggcaaaaag

SEQ ID NO: 551253 - RNA, 15 nt, Homo sapiens
cuuaguaagugcuuu

SEQ ID NO: 551254 - RNA, 14 nt, Homo sapiens
cuuaguagucaaaa

SEQ ID NO: 551255 - RNA, 18 nt, Homo sapiens
cuuaguaguuuuuacaaa

SEQ ID NO: 551256 - RNA, 18 nt, Homo sapiens
cuuaguauuucucaggaa

SEQ ID NO: 551257 - RNA, 17 nt, Homo sapiens
cuuagucacuuauuuca

SEQ ID NO: 551258 - RNA, 12 nt, Homo sapiens
cuuagugacaaa

SEQ ID NO: 551259 - RNA, 17 nt, Homo sapiens
cuuaguuaucaguauuu

SEQ ID NO: 551260 - RNA, 23 nt, Homo sapiens
cuuaguucugguugauucacuca

SEQ ID NO: 551261 - RNA, 13 nt, Homo sapiens
cuuaguugcugua

SEQ ID NO: 551262 - RNA, 18 nt, Homo sapiens
cuuaguuguucaguugcc

SEQ ID NO: 551263 - RNA, 17 nt, Homo sapiens
cuuauaacuguuuuaga

SEQ ID NO: 551264 - RNA, 20 nt, Homo sapiens
cuuauaagaaagaucaaaga

SEQ ID NO: 551265 - RNA, 20 nt, Homo sapiens
cuuauaaguuaaaacaaagg

SEQ ID NO: 551266 - RNA, 18 nt, Homo sapiens
cuuauaauuguucucaga

SEQ ID NO: 551267 - RNA, 14 nt, Homo sapiens
cuuauacccaugaa

SEQ ID NO: 551268 - RNA, 21 nt, Homo sapiens
cuuauacgaguaauaugccug

SEQ ID NO: 551269 - RNA, 20 nt, Homo sapiens
cuuauacucuugagaaugaa

SEQ ID NO: 551270 - RNA, 16 nt, Homo sapiens
cuuauacuguacaaua

SEQ ID NO: 551271 - RNA, 19 nt, Homo sapiens
cuuauaucauguaccucag

SEQ ID NO: 551272 - RNA, 15 nt, Homo sapiens
cuuaucaaaggacac

SEQ ID NO: 551273 - RNA, 18 nt, Homo sapiens
cuuaucaacuaaugauuu

SEQ ID NO: 551274 - RNA, 18 nt, Homo sapiens
cuuauccccucagaaucc

SEQ ID NO: 551275 - RNA, 23 nt, Homo sapiens
cuuaucgggcuccagccaucuca

SEQ ID NO: 551276 - RNA, 16 nt, Homo sapiens
cuuaucugauacuuau

SEQ ID NO: 551277 - RNA, 17 nt, Homo sapiens
cuuaucugugcgugaaa

SEQ ID NO: 551278 - RNA, 15 nt, Homo sapiens
cuuaugaaacuaaga

SEQ ID NO: 551279 - RNA, 18 nt, Homo sapiens
cuuaugagauacuuugca

SEQ ID NO: 551280 - RNA, 18 nt, Homo sapiens
cuuaugagcgucacugcc

SEQ ID NO: 551281 - RNA, 15 nt, Homo sapiens
cuuaugauacuugag

SEQ ID NO: 551282 - RNA, 22 nt, Homo sapiens
cuuaugauacuugagguaccag

SEQ ID NO: 551283 - RNA, 13 nt, Homo sapiens
cuuaugauucaga

SEQ ID NO: 551284 - RNA, 21 nt, Homo sapiens
cuuaugcaaucuauguuugca

SEQ ID NO: 551285 - RNA, 15 nt, Homo sapiens
cuuaugcuacacaga

SEQ ID NO: 551286 - RNA, 14 nt, Homo sapiens
cuuauggacacugc

SEQ ID NO: 551287 - RNA, 15 nt, Homo sapiens
cuuauguauuuauga

SEQ ID NO: 551288 - RNA, 15 nt, Homo sapiens
cuuaugucaaaugga

SEQ ID NO: 551289 - RNA, 13 nt, Homo sapiens
cuuaugugagccc

SEQ ID NO: 551290 - RNA, 17 nt, Homo sapiens
cuuauuaaucauacaaa

SEQ ID NO: 551291 - RNA, 20 nt, Homo sapiens
cuuauuaugcauaaagccaa

SEQ ID NO: 551292 - RNA, 19 nt, Homo sapiens
cuuauucccaguguuccau

SEQ ID NO: 551293 - RNA, 21 nt, Homo sapiens
cuuauucugucuggcauuaca

SEQ ID NO: 551294 - RNA, 23 nt, Homo sapiens
gaaaugggaaaugagaacauucc

SEQ ID NO: 551295 - RNA, 19 nt, Homo sapiens
gaaaugggcaguucuccca

SEQ ID NO: 551296 - RNA, 16 nt, Homo sapiens
gaaaugguacugccca

SEQ ID NO: 551297 - RNA, 18 nt, Homo sapiens
gaaaugguggugcuuuaa

SEQ ID NO: 551298 - RNA, 22 nt, Homo sapiens
gaaauguaccggcuuccauccu

SEQ ID NO: 551299 - RNA, 22 nt, Homo sapiens
gaaauguucguuuucuccugcc

SEQ ID NO: 551300 - RNA, 16 nt, Homo sapiens
gaaauuaagaaggcaa

SEQ ID NO: 551301 - RNA, 17 nt, Homo sapiens
gaaauuaagacuuuaug

SEQ ID NO: 551302 - RNA, 21 nt, Homo sapiens
gaaauuacuggaaggcuucca

SEQ ID NO: 551303 - RNA, 11 nt, Homo sapiens
gaaauuacuuc

SEQ ID NO: 551304 - RNA, 14 nt, Homo sapiens
gaaauuauuauuca

SEQ ID NO: 551305 - RNA, 14 nt, Homo sapiens
gaaauucuguggug

SEQ ID NO: 551306 - RNA, 11 nt, Homo sapiens
gaaauugcaau

SEQ ID NO: 551307 - RNA, 13 nt, Homo sapiens
gaaauugcuauuu

SEQ ID NO: 551308 - RNA, 21 nt, Homo sapiens
gaaauuggaagaagcacugau

SEQ ID NO: 551309 - RNA, 15 nt, Homo sapiens
gaaauuguacauauu

SEQ ID NO: 551310 - RNA, 16 nt, Homo sapiens
gaaauuguagugcaaa

SEQ ID NO: 551311 - RNA, 18 nt, Homo sapiens
gaaauuguagugcaaaau

SEQ ID NO: 551312 - RNA, 14 nt, Homo sapiens
gaaauuuacuacag

SEQ ID NO: 551313 - RNA, 20 nt, Homo sapiens
gaaauuuacugugagacugu

SEQ ID NO: 551314 - RNA, 13 nt, Homo sapiens
gaaauuucugugc

SEQ ID NO: 551315 - RNA, 15 nt, Homo sapiens
gaaauuuuuacuuua

SEQ ID NO: 551316 - RNA, 18 nt, Homo sapiens
gaacaaaaauugagacau

SEQ ID NO: 551317 - RNA, 18 nt, Homo sapiens
gaacaaaacaucaaaaug

SEQ ID NO: 551318 - RNA, 20 nt, Homo sapiens
gaacaaaagaauaacauuuu

SEQ ID NO: 551319 - RNA, 20 nt, Homo sapiens
gaacaaaauguaaagccagc

SEQ ID NO: 551320 - RNA, 15 nt, Homo sapiens
gaacaaagugcuaga

SEQ ID NO: 551321 - RNA, 23 nt, Homo sapiens
gaacaaauuauaaaaaccaugga

SEQ ID NO: 551322 - RNA, 19 nt, Homo sapiens
gaacaacagaaauuaucug

SEQ ID NO: 551323 - RNA, 21 nt, Homo sapiens
gaacaauaaaaugucuucucc

SEQ ID NO: 551324 - RNA, 22 nt, Homo sapiens
gaacaauaaaaugucuucuccc

SEQ ID NO: 551325 - RNA, 21 nt, Homo sapiens
gaacaaugaauuauccagcau

SEQ ID NO: 551326 - RNA, 20 nt, Homo sapiens
gaacaaugacgugccuaccu

SEQ ID NO: 551327 - RNA, 21 nt, Homo sapiens
gaacaaugggaggcugugauu

SEQ ID NO: 551328 - RNA, 16 nt, Homo sapiens
gaacacaaaacuugaa

SEQ ID NO: 551329 - RNA, 15 nt, Homo sapiens
gaacacacagacuuu

SEQ ID NO: 551330 - RNA, 18 nt, Homo sapiens
gaacacacagacuuucug

SEQ ID NO: 551331 - RNA, 12 nt, Homo sapiens
gaacacacuugg

SEQ ID NO: 551332 - RNA, 15 nt, Homo sapiens
gaacacagcaugugc

SEQ ID NO: 551333 - RNA, 17 nt, Homo sapiens
gaacacagcaugugcca

SEQ ID NO: 551334 - RNA, 17 nt, Homo sapiens
gaacacaggagauucca

SEQ ID NO: 551335 - RNA, 14 nt, Homo sapiens
gaacaccaauauua

SEQ ID NO: 551336 - RNA, 14 nt, Homo sapiens
gaacacguggguau

SEQ ID NO: 551337 - RNA, 20 nt, Homo sapiens
gaacacguuggcucaguccu

SEQ ID NO: 551338 - RNA, 22 nt, Homo sapiens
gaacacuaacucaccagcccca

SEQ ID NO: 551339 - RNA, 18 nt, Homo sapiens
gaacacucuuuugcuuua

SEQ ID NO: 551340 - RNA, 17 nt, Homo sapiens
gaacacugcacucuuaa

SEQ ID NO: 551341 - RNA, 19 nt, Homo sapiens
gaacacuggaacauuccag

SEQ ID NO: 551342 - RNA, 23 nt, Homo sapiens
gaacacuggaacauuccagugga

SEQ ID NO: 551343 - RNA, 16 nt, Homo sapiens
gaacacugugaccagg

SEQ ID NO: 551344 - RNA, 23 nt, Homo sapiens
gaacacuuuagguagaugaacua

SEQ ID NO: 551345 - RNA, 19 nt, Homo sapiens
gaacagaauugcuccugca

SEQ ID NO: 551346 - RNA, 20 nt, Homo sapiens
gaacagacaacagaagucau

SEQ ID NO: 551347 - RNA, 22 nt, Homo sapiens
gaacagauggggucugugacug

SEQ ID NO: 551348 - RNA, 19 nt, Homo sapiens
gaacagcaauggugucagu

SEQ ID NO: 551349 - RNA, 23 nt, Homo sapiens
gaacagccgcuccugucugccag

SEQ ID NO: 551350 - RNA, 14 nt, Homo sapiens
gaacagcugugagc

SEQ ID NO: 551351 - RNA, 18 nt, Homo sapiens
gaacagguaguauuacac

SEQ ID NO: 551352 - RNA, 20 nt, Homo sapiens
gaacagguguuuuuccacaa

SEQ ID NO: 551353 - RNA, 20 nt, Homo sapiens
gaacaguaaagaaagcagaa

SEQ ID NO: 551354 - RNA, 21 nt, Homo sapiens
gaacaguaaagaaagcagaau

SEQ ID NO: 551355 - RNA, 14 nt, Homo sapiens
gaacaguagcuuug

SEQ ID NO: 551356 - RNA, 17 nt, Homo sapiens
gaacauaaaaaggacau

SEQ ID NO: 551357 - RNA, 14 nt, Homo sapiens
gaacaucacauucc

SEQ ID NO: 551358 - RNA, 17 nt, Homo sapiens
gaacaucauaacccaug

SEQ ID NO: 551359 - RNA, 12 nt, Homo sapiens
gaacauccucca

SEQ ID NO: 551360 - RNA, 13 nt, Homo sapiens
gaacauccuccac

SEQ ID NO: 551361 - RNA, 21 nt, Homo sapiens
gaacauccuccacugacuucc

SEQ ID NO: 551362 - RNA, 16 nt, Homo sapiens
gaacaugaaaugcccu

SEQ ID NO: 551363 - RNA, 15 nt, Homo sapiens
gaacauugcauauaa

SEQ ID NO: 551364 - RNA, 18 nt, Homo sapiens
gaacauugcauauaacuu

SEQ ID NO: 551365 - RNA, 15 nt, Homo sapiens
gaacauuguacuguu

SEQ ID NO: 551366 - RNA, 20 nt, Homo sapiens
gaacauuguucugaacacuu

SEQ ID NO: 551367 - RNA, 21 nt, Homo sapiens
gaaccaaaucuggaagccaaa

SEQ ID NO: 551368 - RNA, 18 nt, Homo sapiens
gaaccaaggcagccucca

SEQ ID NO: 551369 - RNA, 14 nt, Homo sapiens
gaaccaaugcaaga

SEQ ID NO: 551370 - RNA, 12 nt, Homo sapiens
gaaccacauauu

SEQ ID NO: 551371 - RNA, 20 nt, Homo sapiens
gaaccacucauugucuuuga

SEQ ID NO: 551372 - RNA, 18 nt, Homo sapiens
gaaccagauucuauccuc

SEQ ID NO: 551373 - RNA, 14 nt, Homo sapiens
gaaccagcaucuca

SEQ ID NO: 551374 - RNA, 23 nt, Homo sapiens
gaaccagccguauuuuacaugaa

SEQ ID NO: 551375 - RNA, 17 nt, Homo sapiens
gaaccauucccuaguca

SEQ ID NO: 551376 - RNA, 19 nt, Homo sapiens
gaaccccacgcccugucua

SEQ ID NO: 551377 - RNA, 16 nt, Homo sapiens
gaaccccucugucuuc

SEQ ID NO: 551378 - RNA, 19 nt, Homo sapiens
gaacccugcuugcacuuug

SEQ ID NO: 551379 - RNA, 19 nt, Homo sapiens
gaaccgaacauaucauuug

SEQ ID NO: 551380 - RNA, 19 nt, Homo sapiens
gaaccgaggggcucaggaa

SEQ ID NO: 551381 - RNA, 13 nt, Homo sapiens
gaaccgcacagcu

SEQ ID NO: 551382 - RNA, 20 nt, Homo sapiens
gaaccuagauugcaccauug

SEQ ID NO: 551383 - RNA, 15 nt, Homo sapiens
gaaccucugucucau

SEQ ID NO: 551384 - RNA, 13 nt, Homo sapiens
gaaccugugcuca

SEQ ID NO: 551385 - RNA, 13 nt, Homo sapiens
gaaccuucuuaac

SEQ ID NO: 551386 - RNA, 22 nt, Homo sapiens
gaaccuucuuaacaucacuguc

SEQ ID NO: 551387 - RNA, 23 nt, Homo sapiens
gaaccuucuuaacaucacugucu

SEQ ID NO: 551388 - RNA, 21 nt, Homo sapiens
gaaccuuuaaaguaaaggccu

SEQ ID NO: 551389 - RNA, 21 nt, Homo sapiens
gaacgagcacuggccagagag

SEQ ID NO: 551390 - RNA, 15 nt, Homo sapiens
gaacgcgacuuccac

SEQ ID NO: 551391 - RNA, 15 nt, Homo sapiens
gaacgcguguguaca

SEQ ID NO: 551392 - RNA, 17 nt, Homo sapiens
gaacgguaaauuucugu

SEQ ID NO: 551393 - RNA, 16 nt, Homo sapiens
gaacgucuaguacaau

SEQ ID NO: 551394 - RNA, 16 nt, Homo sapiens
gaacuaaaauucuguc

SEQ ID NO: 551395 - RNA, 23 nt, Homo sapiens
gaacuaauaaauacauacgguca

SEQ ID NO: 551396 - RNA, 14 nt, Homo sapiens
gaacuaaugaggau

SEQ ID NO: 551397 - RNA, 21 nt, Homo sapiens
gaacuacaaagcuucuauccc

SEQ ID NO: 551398 - RNA, 20 nt, Homo sapiens
gaacuacggggcuuacagga

SEQ ID NO: 551399 - RNA, 13 nt, Homo sapiens
gaacuacuaaagu

SEQ ID NO: 551400 - RNA, 15 nt, Homo sapiens
gaacuaguuuaaugu

SEQ ID NO: 551401 - RNA, 14 nt, Homo sapiens
gaacuauaacuguu

SEQ ID NO: 551402 - RNA, 19 nt, Homo sapiens
gaacuaugaacacugucau

SEQ ID NO: 551403 - RNA, 20 nt, Homo sapiens
gaacuauuuucaaagacuua

SEQ ID NO: 551404 - RNA, 13 nt, Homo sapiens
gaacucacagaaa

SEQ ID NO: 551405 - RNA, 13 nt, Homo sapiens
gaacucacaguac

SEQ ID NO: 551406 - RNA, 19 nt, Homo sapiens
gaacucaccagugaguuag

SEQ ID NO: 551407 - RNA, 22 nt, Homo sapiens
gaacucacugcgauggggguca

SEQ ID NO: 551408 - RNA, 11 nt, Homo sapiens
gaacuccacuc

SEQ ID NO: 551409 - RNA, 16 nt, Homo sapiens
gaacuccauacagccu

SEQ ID NO: 551410 - RNA, 15 nt, Homo sapiens
gaacuccugaccuca

SEQ ID NO: 551411 - RNA, 21 nt, Homo sapiens
gaacuccugaccucaagugau

SEQ ID NO: 551412 - RNA, 22 nt, Homo sapiens
gaacucuggggagccugagcca

SEQ ID NO: 551413 - RNA, 18 nt, Homo sapiens
gaacucuguaaaaccuca

SEQ ID NO: 551414 - RNA, 21 nt, Homo sapiens
gaacucuucaaucucuugcac

SEQ ID NO: 551415 - RNA, 23 nt, Homo sapiens
gaacucuucuuugcugcauuccu

SEQ ID NO: 551416 - RNA, 13 nt, Homo sapiens
gaagccuugccua

SEQ ID NO: 551417 - RNA, 21 nt, Homo sapiens
gaagcggauuuccagggauau

SEQ ID NO: 551418 - RNA, 24 nt, Homo sapiens
gaagcgucgccccaguggcacuga

SEQ ID NO: 551419 - RNA, 21 nt, Homo sapiens
gaagcuaauguaggacuguau

SEQ ID NO: 551420 - RNA, 17 nt, Homo sapiens
gaagcucacccaauaaa

SEQ ID NO: 551421 - RNA, 14 nt, Homo sapiens
gaagcucuucuucc

SEQ ID NO: 551422 - RNA, 19 nt, Homo sapiens
gaagcucuuggacaacagc

SEQ ID NO: 551423 - RNA, 15 nt, Homo sapiens
gaagcugcaggcuuu

SEQ ID NO: 551424 - RNA, 15 nt, Homo sapiens
gaagcugcauaugau

SEQ ID NO: 551425 - RNA, 13 nt, Homo sapiens
gaagcugcugacc

SEQ ID NO: 551426 - RNA, 18 nt, Homo sapiens
gaagcuggagugcugcuu

SEQ ID NO: 551427 - RNA, 15 nt, Homo sapiens
gaagcugggcugucu

SEQ ID NO: 551428 - RNA, 18 nt, Homo sapiens
gaagcuucaugcacuuaa

SEQ ID NO: 551429 - RNA, 14 nt, Homo sapiens
gaagcuucaugcca

SEQ ID NO: 551430 - RNA, 16 nt, Homo sapiens
gaagcuuuaagcaaau

SEQ ID NO: 551431 - RNA, 18 nt, Homo sapiens
gaaggaaauaaucaucua

SEQ ID NO: 551432 - RNA, 14 nt, Homo sapiens
gaaggaacuuccag

SEQ ID NO: 551433 - RNA, 21 nt, Homo sapiens
gaaggaagucagcaugccucu

SEQ ID NO: 551434 - RNA, 13 nt, Homo sapiens
gaaggaugaauga

SEQ ID NO: 551435 - RNA, 13 nt, Homo sapiens
gaaggauuaccug

SEQ ID NO: 551436 - RNA, 14 nt, Homo sapiens
gaaggcaaacccau

SEQ ID NO: 551437 - RNA, 23 nt, Homo sapiens
gaaggcaaauauaagcugggaaa

SEQ ID NO: 551438 - RNA, 19 nt, Homo sapiens
gaaggcaagagggggugga

SEQ ID NO: 551439 - RNA, 14 nt, Homo sapiens
gaaggcauaugcac

SEQ ID NO: 551440 - RNA, 22 nt, Homo sapiens
gaaggccuuucuucuguguuaa

SEQ ID NO: 551441 - RNA, 12 nt, Homo sapiens
gaaggcuaugua

SEQ ID NO: 551442 - RNA, 13 nt, Homo sapiens
gaaggcuucacuc

SEQ ID NO: 551443 - RNA, 16 nt, Homo sapiens
gaaggcuucucuccac

SEQ ID NO: 551444 - RNA, 20 nt, Homo sapiens
gaaggcuuuaauaaaggcca

SEQ ID NO: 551445 - RNA, 23 nt, Homo sapiens
gagguuucacccuuaacccaagg

SEQ ID NO: 551446 - RNA, 16 nt, Homo sapiens
gaguaaauacagguag

SEQ ID NO: 551447 - RNA, 13 nt, Homo sapiens
gaguaacaguaaa

SEQ ID NO: 551448 - RNA, 15 nt, Homo sapiens
gaguaauaugccugc

SEQ ID NO: 551449 - RNA, 14 nt, Homo sapiens
gaguaaucugugua

SEQ ID NO: 551450 - RNA, 17 nt, Homo sapiens
gaguaaucuguguacaa

SEQ ID NO: 551451 - RNA, 15 nt, Homo sapiens
gaguacaaacacagg

SEQ ID NO: 551452 - RNA, 23 nt, Homo sapiens
gaguaccaaauccacaagccauu

SEQ ID NO: 551453 - RNA, 13 nt, Homo sapiens
gaguaccuggacc

SEQ ID NO: 551454 - RNA, 15 nt, Homo sapiens
gaguagaaaauguga

SEQ ID NO: 551455 - RNA, 14 nt, Homo sapiens
gaguagaauugcau

SEQ ID NO: 551456 - RNA, 17 nt, Homo sapiens
gaguagaauugcauuga

SEQ ID NO: 551457 - RNA, 16 nt, Homo sapiens
gaguagggaguucauc

SEQ ID NO: 551458 - RNA, 12 nt, Homo sapiens
gaguauaugcac

SEQ ID NO: 551459 - RNA, 21 nt, Homo sapiens
gaguauauuuccgcacuucag

SEQ ID NO: 551460 - RNA, 15 nt, Homo sapiens
gaguauguugucaua

SEQ ID NO: 551461 - RNA, 19 nt, Homo sapiens
gaguauuccaugagcugcu

SEQ ID NO: 551462 - RNA, 21 nt, Homo sapiens
gagucaaaugggaaaaaaaca

SEQ ID NO: 551463 - RNA, 18 nt, Homo sapiens
gagucaaugugcagugua

SEQ ID NO: 551464 - RNA, 14 nt, Homo sapiens
gagucacacagugu

SEQ ID NO: 551465 - RNA, 13 nt, Homo sapiens
gagucacaccaga

SEQ ID NO: 551466 - RNA, 14 nt, Homo sapiens
gagucacaccagaa

SEQ ID NO: 551467 - RNA, 13 nt, Homo sapiens
gagucaccaggaa

SEQ ID NO: 551468 - RNA, 23 nt, Homo sapiens
gagucacccaugaagacaggaca

SEQ ID NO: 551469 - RNA, 23 nt, Homo sapiens
gagucaccuccuccacucacucc

SEQ ID NO: 551470 - RNA, 15 nt, Homo sapiens
gagucacugccaagu

SEQ ID NO: 551471 - RNA, 15 nt, Homo sapiens
gagucagacugucag

SEQ ID NO: 551472 - RNA, 23 nt, Homo sapiens
gagucaggaguuuuacugccugu

SEQ ID NO: 551473 - RNA, 17 nt, Homo sapiens
gagucaggcaauugauu

SEQ ID NO: 551474 - RNA, 20 nt, Homo sapiens
gagucaggccuuaauuuuca

SEQ ID NO: 551475 - RNA, 16 nt, Homo sapiens
gaguccaacaauguug

SEQ ID NO: 551476 - RNA, 19 nt, Homo sapiens
gaguccagugaguccaggc

SEQ ID NO: 551477 - RNA, 20 nt, Homo sapiens
gagucccucacguuucuucc

SEQ ID NO: 551478 - RNA, 22 nt, Homo sapiens
gagucccucacguuucuucccc

SEQ ID NO: 551479 - RNA, 15 nt, Homo sapiens
gaguccuaggacuua

SEQ ID NO: 551480 - RNA, 15 nt, Homo sapiens
gaguccucacuccca

SEQ ID NO: 551481 - RNA, 13 nt, Homo sapiens
gaguccuuaccuc

SEQ ID NO: 551482 - RNA, 22 nt, Homo sapiens
gagucuagccuggacaacacag

SEQ ID NO: 551483 - RNA, 18 nt, Homo sapiens
gagucuauguucaaagac

SEQ ID NO: 551484 - RNA, 14 nt, Homo sapiens
gagucucacuuugg

SEQ ID NO: 551485 - RNA, 19 nt, Homo sapiens
gagucucugauacacagua

SEQ ID NO: 551486 - RNA, 17 nt, Homo sapiens
gagucucuucuccacug

SEQ ID NO: 551487 - RNA, 17 nt, Homo sapiens
gagucugucacacucuc

SEQ ID NO: 551488 - RNA, 17 nt, Homo sapiens
gagucugugcauuugug

SEQ ID NO: 551489 - RNA, 16 nt, Homo sapiens
gagucuuaucauuuga

SEQ ID NO: 551490 - RNA, 20 nt, Homo sapiens
gagucuuguuuuuuacucaa

SEQ ID NO: 551491 - RNA, 16 nt, Homo sapiens
gagugaaaccaugacu

SEQ ID NO: 551492 - RNA, 18 nt, Homo sapiens
gagugaaggggccaagga

SEQ ID NO: 551493 - RNA, 12 nt, Homo sapiens
gagugaauuuga

SEQ ID NO: 551494 - RNA, 14 nt, Homo sapiens
gagugacagucaua

SEQ ID NO: 551495 - RNA, 15 nt, Homo sapiens
gagugagcaaccagc

SEQ ID NO: 551496 - RNA, 15 nt, Homo sapiens
gagugauauacucca

SEQ ID NO: 551497 - RNA, 17 nt, Homo sapiens
gagugauaugauccaga

SEQ ID NO: 551498 - RNA, 13 nt, Homo sapiens
gagugaucuuucc

SEQ ID NO: 551499 - RNA, 15 nt, Homo sapiens
gagugauugcagcuu

SEQ ID NO: 551500 - RNA, 15 nt, Homo sapiens
gagugcaaugaauga

SEQ ID NO: 551501 - RNA, 14 nt, Homo sapiens
gagugcaccaaaga

SEQ ID NO: 551502 - RNA, 15 nt, Homo sapiens
gagugcaccaaagag

SEQ ID NO: 551503 - RNA, 20 nt, Homo sapiens
gagugcaccacuucaaguga

SEQ ID NO: 551504 - RNA, 14 nt, Homo sapiens
gagugcagugccac

SEQ ID NO: 551505 - RNA, 20 nt, Homo sapiens
gagugcaguggcaugaucau

SEQ ID NO: 551506 - RNA, 20 nt, Homo sapiens
gagugcaguggcgugaucuc

SEQ ID NO: 551507 - RNA, 19 nt, Homo sapiens
gagugcaguuuccaauccc

SEQ ID NO: 551508 - RNA, 19 nt, Homo sapiens
gagugcauugugaggguua

SEQ ID NO: 551509 - RNA, 19 nt, Homo sapiens
gagugcugaggggcacucu

SEQ ID NO: 551510 - RNA, 16 nt, Homo sapiens
gaguggaguugaaacu

SEQ ID NO: 551511 - RNA, 16 nt, Homo sapiens
gaguggaucuguagaa

SEQ ID NO: 551512 - RNA, 19 nt, Homo sapiens
gaguggccccucaccuggg

SEQ ID NO: 551513 - RNA, 16 nt, Homo sapiens
gaguggguuucacaag

SEQ ID NO: 551514 - RNA, 14 nt, Homo sapiens
gaguggugggugca

SEQ ID NO: 551515 - RNA, 16 nt, Homo sapiens
gagugguuuccaaugu

SEQ ID NO: 551516 - RNA, 19 nt, Homo sapiens
gaguguccuuaguguauaa

SEQ ID NO: 551517 - RNA, 15 nt, Homo sapiens
gagugugcagacuga

SEQ ID NO: 551518 - RNA, 14 nt, Homo sapiens
gagugugggccagg

SEQ ID NO: 551519 - RNA, 13 nt, Homo sapiens
gaguguggugugu

SEQ ID NO: 551520 - RNA, 17 nt, Homo sapiens
gagugugugcaugugug

SEQ ID NO: 551521 - RNA, 21 nt, Homo sapiens
gaguguugggcaugugaucac

SEQ ID NO: 551522 - RNA, 14 nt, Homo sapiens
gaucacagcugcuu

SEQ ID NO: 551523 - RNA, 23 nt, Homo sapiens
gaucacagggccccagaaggcag

SEQ ID NO: 551524 - RNA, 12 nt, Homo sapiens
gaucacugccac

SEQ ID NO: 551525 - RNA, 19 nt, Homo sapiens
gaucagacagcuugaauca

SEQ ID NO: 551526 - RNA, 11 nt, Homo sapiens
gaucagaucaa

SEQ ID NO: 551527 - RNA, 14 nt, Homo sapiens
gaucagaugaacuc

SEQ ID NO: 551528 - RNA, 17 nt, Homo sapiens
gaucaggcugcuggaaa

SEQ ID NO: 551529 - RNA, 17 nt, Homo sapiens
gaucaguguuacugccu

SEQ ID NO: 551530 - RNA, 17 nt, Homo sapiens
gaucaguugaggccagg

SEQ ID NO: 551531 - RNA, 17 nt, Homo sapiens
gaucauagcucacugua

SEQ ID NO: 551532 - RNA, 13 nt, Homo sapiens
gaucaucagucac

SEQ ID NO: 551533 - RNA, 22 nt, Homo sapiens
gaucaucgccagaggugcuuca

SEQ ID NO: 551534 - RNA, 17 nt, Homo sapiens
gaucaucuaauucucug

SEQ ID NO: 551535 - RNA, 14 nt, Homo sapiens
gaucaugaaaccaa

SEQ ID NO: 551536 - RNA, 16 nt, Homo sapiens
gaucaugauagacuug

SEQ ID NO: 551537 - RNA, 18 nt, Homo sapiens
gaucaugauguagagugu

SEQ ID NO: 551538 - RNA, 20 nt, Homo sapiens
gaucaugggagcaugcuuac

SEQ ID NO: 551539 - RNA, 19 nt, Homo sapiens
gaucauugaaauucugaga

SEQ ID NO: 551540 - RNA, 19 nt, Homo sapiens
gaucauuugagcucaggag

SEQ ID NO: 551541 - RNA, 21 nt, Homo sapiens
gauccaacuucagcaaugaau

SEQ ID NO: 551542 - RNA, 21 nt, Homo sapiens
gauccaauaugacucagagaa

SEQ ID NO: 551543 - RNA, 14 nt, Homo sapiens
gauccacccaccuc

SEQ ID NO: 551544 - RNA, 15 nt, Homo sapiens
gauccagacuguaag

SEQ ID NO: 551545 - RNA, 17 nt, Homo sapiens
gauccagccucauaccu

SEQ ID NO: 551546 - RNA, 15 nt, Homo sapiens
gauccaguugcacua

SEQ ID NO: 551547 - RNA, 20 nt, Homo sapiens
gauccauccaucuccaggga

SEQ ID NO: 551548 - RNA, 18 nt, Homo sapiens
gaucccacucuucuugca

SEQ ID NO: 551549 - RNA, 13 nt, Homo sapiens
gaucccacuggaa

SEQ ID NO: 551550 - RNA, 21 nt, Homo sapiens
gauccccacuguccuaccagu

SEQ ID NO: 551551 - RNA, 14 nt, Homo sapiens
gauccccagcuuuc

SEQ ID NO: 551552 - RNA, 22 nt, Homo sapiens
gauccccccuuuccuucuaauu

SEQ ID NO: 551553 - RNA, 16 nt, Homo sapiens
gauccccucucuuccu

SEQ ID NO: 551554 - RNA, 13 nt, Homo sapiens
gauccgacuuugg

SEQ ID NO: 551555 - RNA, 13 nt, Homo sapiens
gauccgcggggac

SEQ ID NO: 551556 - RNA, 23 nt, Homo sapiens
gauccucauauggcccaguguca

SEQ ID NO: 551557 - RNA, 12 nt, Homo sapiens
gauccugcacuc

SEQ ID NO: 551558 - RNA, 15 nt, Homo sapiens
gauccugggggacca

SEQ ID NO: 551559 - RNA, 17 nt, Homo sapiens
gauccuguuacuugcuu

SEQ ID NO: 551560 - RNA, 18 nt, Homo sapiens
gauccuuagagguccucu

SEQ ID NO: 551561 - RNA, 15 nt, Homo sapiens
gauccuucaaagagu

SEQ ID NO: 551562 - RNA, 18 nt, Homo sapiens
gaucgccaaccuuucccc

SEQ ID NO: 551563 - RNA, 17 nt, Homo sapiens
gaucgcgccacugcacu

SEQ ID NO: 551564 - RNA, 20 nt, Homo sapiens
gaucgcgccacugcacuccg

SEQ ID NO: 551565 - RNA, 20 nt, Homo sapiens
gaucggagccuccucucuca

SEQ ID NO: 551566 - RNA, 18 nt, Homo sapiens
gaucggcggccacugcgc

SEQ ID NO: 551567 - RNA, 17 nt, Homo sapiens
gaucgguucugugccuu

SEQ ID NO: 551568 - RNA, 19 nt, Homo sapiens
gaucuaagccuuuccauaa

SEQ ID NO: 551569 - RNA, 14 nt, Homo sapiens
gaucuaauuuacau

SEQ ID NO: 551570 - RNA, 21 nt, Homo sapiens
ugcaaagacugaguguucaaa

SEQ ID NO: 551571 - RNA, 17 nt, Homo sapiens
ugcaaagaucuuuucca

SEQ ID NO: 551572 - RNA, 16 nt, Homo sapiens
ugcaaaggaaauacca

SEQ ID NO: 551573 - RNA, 20 nt, Homo sapiens
ugcaaaggaaauaccaguuc

SEQ ID NO: 551574 - RNA, 21 nt, Homo sapiens
ugcaaaggcgcagugcuucuc

SEQ ID NO: 551575 - RNA, 20 nt, Homo sapiens
ugcaaaguucccuacuuccu

SEQ ID NO: 551576 - RNA, 22 nt, Homo sapiens
ugcaaauaggcagaauggaauc

SEQ ID NO: 551577 - RNA, 13 nt, Homo sapiens
ugcaaaugcuuua

SEQ ID NO: 551578 - RNA, 18 nt, Homo sapiens
ugcaaaugucaguuuccu

SEQ ID NO: 551579 - RNA, 16 nt, Homo sapiens
ugcaaaugucuuccag

SEQ ID NO: 551580 - RNA, 22 nt, Homo sapiens
ugcaacagcuacagucuaaaau

SEQ ID NO: 551581 - RNA, 15 nt, Homo sapiens
ugcaacagugccaug

SEQ ID NO: 551582 - RNA, 18 nt, Homo sapiens
ugcaacagugccauguua

SEQ ID NO: 551583 - RNA, 13 nt, Homo sapiens
ugcaaccaggaac

SEQ ID NO: 551584 - RNA, 16 nt, Homo sapiens
ugcaaccauaagacaa

SEQ ID NO: 551585 - RNA, 16 nt, Homo sapiens
ugcaacccuuaccccu

SEQ ID NO: 551586 - RNA, 22 nt, Homo sapiens
ugcaaccuccgccucucagguu

SEQ ID NO: 551587 - RNA, 14 nt, Homo sapiens
ugcaaccucugccu

SEQ ID NO: 551588 - RNA, 17 nt, Homo sapiens
ugcaaccucugccuccc

SEQ ID NO: 551589 - RNA, 21 nt, Homo sapiens
ugcaaccucuuggccugauca

SEQ ID NO: 551590 - RNA, 15 nt, Homo sapiens
ugcaacuaaggacaa

SEQ ID NO: 551591 - RNA, 13 nt, Homo sapiens
ugcaacucacuga

SEQ ID NO: 551592 - RNA, 22 nt, Homo sapiens
ugcaacugggucugacaugaac

SEQ ID NO: 551593 - RNA, 16 nt, Homo sapiens
ugcaagaagcuuuauu

SEQ ID NO: 551594 - RNA, 19 nt, Homo sapiens
ugcaagacaaaguugaaug

SEQ ID NO: 551595 - RNA, 21 nt, Homo sapiens
ugcaagacauagaauaguguu

SEQ ID NO: 551596 - RNA, 21 nt, Homo sapiens
ugcaagaccgagauugaggga

SEQ ID NO: 551597 - RNA, 19 nt, Homo sapiens
ugcaagcacagcauaccug

SEQ ID NO: 551598 - RNA, 22 nt, Homo sapiens
ugcaagccccugcuccagaaga

SEQ ID NO: 551599 - RNA, 12 nt, Homo sapiens
ugcaagccuguc

SEQ ID NO: 551600 - RNA, 23 nt, Homo sapiens
ugcaagcuucuuuuaguuguauc

SEQ ID NO: 551601 - RNA, 22 nt, Homo sapiens
ugcaaggauucagcauuauucc

SEQ ID NO: 551602 - RNA, 19 nt, Homo sapiens
ugcaaggcaaauguuuauu

SEQ ID NO: 551603 - RNA, 18 nt, Homo sapiens
ugcaaggggaaaaucuca

SEQ ID NO: 551604 - RNA, 21 nt, Homo sapiens
ugcaagguauuacacucugua

SEQ ID NO: 551605 - RNA, 16 nt, Homo sapiens
ugcaaguauacuaggg

SEQ ID NO: 551606 - RNA, 19 nt, Homo sapiens
ugcaagugugugcacaugu

SEQ ID NO: 551607 - RNA, 17 nt, Homo sapiens
ugcaagugugugcaugu

SEQ ID NO: 551608 - RNA, 19 nt, Homo sapiens
ugcaagugugugcaugugu

SEQ ID NO: 551609 - RNA, 15 nt, Homo sapiens
ugcaauaacagcugc

SEQ ID NO: 551610 - RNA, 18 nt, Homo sapiens
ugcaauaauccaccccca

SEQ ID NO: 551611 - RNA, 13 nt, Homo sapiens
ugcaauaaugaca

SEQ ID NO: 551612 - RNA, 16 nt, Homo sapiens
ugcaauagagacugua

SEQ ID NO: 551613 - RNA, 16 nt, Homo sapiens
ugcaauauaagcauaa

SEQ ID NO: 551614 - RNA, 16 nt, Homo sapiens
ugcaauaugaauucaa

SEQ ID NO: 551615 - RNA, 19 nt, Homo sapiens
uggcgugcucagacccaac

SEQ ID NO: 551616 - RNA, 14 nt, Homo sapiens
uggcguuacugcuu

SEQ ID NO: 551617 - RNA, 15 nt, Homo sapiens
uggcuaacugaugaa

SEQ ID NO: 551618 - RNA, 17 nt, Homo sapiens
uggcuaacugaugaauu

SEQ ID NO: 551619 - RNA, 14 nt, Homo sapiens
uggcuaacuggcga

SEQ ID NO: 551620 - RNA, 22 nt, Homo sapiens
uggcuaauucccagagugugaa

SEQ ID NO: 551621 - RNA, 21 nt, Homo sapiens
uggcuacacacaaaccaguau

SEQ ID NO: 551622 - RNA, 16 nt, Homo sapiens
uggcuauaaucuuauc

SEQ ID NO: 551623 - RNA, 13 nt, Homo sapiens
uggcuaugcaaca

SEQ ID NO: 551624 - RNA, 20 nt, Homo sapiens
uggcuauguccuaauaauau

SEQ ID NO: 551625 - RNA, 16 nt, Homo sapiens
uggcucaacauugugu

SEQ ID NO: 551626 - RNA, 15 nt, Homo sapiens
uggcucacaaacagu

SEQ ID NO: 551627 - RNA, 17 nt, Homo sapiens
uggcucaggggagcaag

SEQ ID NO: 551628 - RNA, 14 nt, Homo sapiens
uggcucaucucuuu

SEQ ID NO: 551629 - RNA, 20 nt, Homo sapiens
uggcucaugccuguaauccc

SEQ ID NO: 551630 - RNA, 17 nt, Homo sapiens
uggcucaugucuauaau

SEQ ID NO: 551631 - RNA, 19 nt, Homo sapiens
uggcuccaacacugcugcu

SEQ ID NO: 551632 - RNA, 15 nt, Homo sapiens
uggcucccagggugg

SEQ ID NO: 551633 - RNA, 15 nt, Homo sapiens
uggcucccaugacca

SEQ ID NO: 551634 - RNA, 16 nt, Homo sapiens
uggcuccucuacuguu

SEQ ID NO: 551635 - RNA, 12 nt, Homo sapiens
uggcuccuugcc

SEQ ID NO: 551636 - RNA, 13 nt, Homo sapiens
uggcucucauggg

SEQ ID NO: 551637 - RNA, 21 nt, Homo sapiens
uggcucucuccaggauccaga

SEQ ID NO: 551638 - RNA, 19 nt, Homo sapiens
uggcucugaugcugagcga

SEQ ID NO: 551639 - RNA, 19 nt, Homo sapiens
uggcucugccccucagggg

SEQ ID NO: 551640 - RNA, 22 nt, Homo sapiens
uggcucugggggacccaggugg

SEQ ID NO: 551641 - RNA, 14 nt, Homo sapiens
uggcugacuggggc

SEQ ID NO: 551642 - RNA, 19 nt, Homo sapiens
uggcugaugauccagaaca

SEQ ID NO: 551643 - RNA, 21 nt, Homo sapiens
uggcugaugaugucuucuggu

SEQ ID NO: 551644 - RNA, 20 nt, Homo sapiens
uggcugcaccuuuuugcaug

SEQ ID NO: 551645 - RNA, 13 nt, Homo sapiens
uggcugcccagga

SEQ ID NO: 551646 - RNA, 15 nt, Homo sapiens
uggcugcuagcacuu

SEQ ID NO: 551647 - RNA, 14 nt, Homo sapiens
uggcugcuaggcca

SEQ ID NO: 551648 - RNA, 16 nt, Homo sapiens
uggcugcuuuguucaa

SEQ ID NO: 551649 - RNA, 22 nt, Homo sapiens
uggcuggacuguagaaggugag

SEQ ID NO: 551650 - RNA, 18 nt, Homo sapiens
uggcuggcucuaccuucc

SEQ ID NO: 551651 - RNA, 12 nt, Homo sapiens
uggcuggcugcc

SEQ ID NO: 551652 - RNA, 15 nt, Homo sapiens
uggcugggcccagaa

SEQ ID NO: 551653 - RNA, 16 nt, Homo sapiens
uggcuggugcccauga

SEQ ID NO: 551654 - RNA, 15 nt, Homo sapiens
uggcugugaaauuca

SEQ ID NO: 551655 - RNA, 17 nt, Homo sapiens
uggcuuaaauaaucucu

SEQ ID NO: 551656 - RNA, 17 nt, Homo sapiens
uggcuuagggcuggaag

SEQ ID NO: 551657 - RNA, 21 nt, Homo sapiens
uggcuuaugaugagccauauu

SEQ ID NO: 551658 - RNA, 21 nt, Homo sapiens
uggcuucauacccacucccug

SEQ ID NO: 551659 - RNA, 18 nt, Homo sapiens
uggcuucgucauuugcaa

SEQ ID NO: 551660 - RNA, 13 nt, Homo sapiens
uggcuucuaggug

SEQ ID NO: 551661 - RNA, 22 nt, Homo sapiens
uggcuugacuguuuucuuuaug

SEQ ID NO: 551662 - RNA, 15 nt, Homo sapiens
uggcuugccccagga

SEQ ID NO: 551663 - RNA, 19 nt, Homo sapiens
uggcuuguuugauuucaac

SEQ ID NO: 551664 - RNA, 18 nt, Homo sapiens
uggcuuuagcuaccucac

SEQ ID NO: 551665 - RNA, 17 nt, Homo sapiens
uggcuuucauaaaucau

SEQ ID NO: 551666 - RNA, 11 nt, Homo sapiens
uggcuuuccag

SEQ ID NO: 551667 - RNA, 23 nt, Homo sapiens
uggcuuugguccccagcauugca

SEQ ID NO: 551668 - RNA, 20 nt, Homo sapiens
uggcuuuucaccccagagga

SEQ ID NO: 551669 - RNA, 20 nt, Homo sapiens
uggcuuuucauagugcucag

SEQ ID NO: 551670 - RNA, 21 nt, Homo sapiens
uggcuuuuccuggacagcuag

SEQ ID NO: 551671 - RNA, 20 nt, Homo sapiens
uggcuuuugccccagaaagg

SEQ ID NO: 551672 - RNA, 15 nt, Homo sapiens
uggcuuuugugcauu

SEQ ID NO: 551673 - RNA, 22 nt, Homo sapiens
ugggaaaaauucagagaguuag

SEQ ID NO: 551674 - RNA, 16 nt, Homo sapiens
ugggaacacgugugca

SEQ ID NO: 551675 - RNA, 13 nt, Homo sapiens
ugggaaccagcau

SEQ ID NO: 551676 - RNA, 20 nt, Homo sapiens
ugggaagagcguagacaggu

SEQ ID NO: 551677 - RNA, 21 nt, Homo sapiens
ugggaagauaggcucugcaca

SEQ ID NO: 551678 - RNA, 12 nt, Homo sapiens
ugggaagaugua

SEQ ID NO: 551679 - RNA, 20 nt, Homo sapiens
cuugccaagggucccugugu

SEQ ID NO: 551680 - RNA, 14 nt, Homo sapiens
cuugccacugcacu

SEQ ID NO: 551681 - RNA, 13 nt, Homo sapiens
cuugccagcauuu

SEQ ID NO: 551682 - RNA, 15 nt, Homo sapiens
cuugcccacuggccg

SEQ ID NO: 551683 - RNA, 19 nt, Homo sapiens
cuugcccagacuacagggc

SEQ ID NO: 551684 - RNA, 21 nt, Homo sapiens
cuugcccagcagcucaagaag

SEQ ID NO: 551685 - RNA, 18 nt, Homo sapiens
cuugcccaguacauuuaa

SEQ ID NO: 551686 - RNA, 15 nt, Homo sapiens
cuugcccaucagcca

SEQ ID NO: 551687 - RNA, 22 nt, Homo sapiens
cuugcccaucagccauuugcca

SEQ ID NO: 551688 - RNA, 16 nt, Homo sapiens
cuugcccccauuucac

SEQ ID NO: 551689 - RNA, 21 nt, Homo sapiens
cuugccugcaugaaacauguu

SEQ ID NO: 551690 - RNA, 22 nt, Homo sapiens
cuugccugcaugaaacauguuc

SEQ ID NO: 551691 - RNA, 16 nt, Homo sapiens
cuugccuuuuaaguua

SEQ ID NO: 551692 - RNA, 14 nt, Homo sapiens
cuugcggaagccau

SEQ ID NO: 551693 - RNA, 15 nt, Homo sapiens
cuugcggaagccaua

SEQ ID NO: 551694 - RNA, 14 nt, Homo sapiens
cuugcgucccauga

SEQ ID NO: 551695 - RNA, 15 nt, Homo sapiens
cuugcuaaagcacuu

SEQ ID NO: 551696 - RNA, 20 nt, Homo sapiens
cuugcucaaccauggcugaa

SEQ ID NO: 551697 - RNA, 18 nt, Homo sapiens
cuugcucauaugcaugua

SEQ ID NO: 551698 - RNA, 22 nt, Homo sapiens
cuugcucucuuucccacuccua

SEQ ID NO: 551699 - RNA, 20 nt, Homo sapiens
cuugcucugagcacagguga

SEQ ID NO: 551700 - RNA, 18 nt, Homo sapiens
cuugcugacucucugagc

SEQ ID NO: 551701 - RNA, 23 nt, Homo sapiens
cuugcugcccgcgggagacagcu

SEQ ID NO: 551702 - RNA, 13 nt, Homo sapiens
cuugcugccugaa

SEQ ID NO: 551703 - RNA, 22 nt, Homo sapiens
cuugcuggguugaucuagaugu

SEQ ID NO: 551704 - RNA, 16 nt, Homo sapiens
cuugcugugcuucaaa

SEQ ID NO: 551705 - RNA, 13 nt, Homo sapiens
cuugcuguuuuca

SEQ ID NO: 551706 - RNA, 14 nt, Homo sapiens
cuugcuuagccugu

SEQ ID NO: 551707 - RNA, 22 nt, Homo sapiens
cuugcuuaugacaucacuugua

SEQ ID NO: 551708 - RNA, 19 nt, Homo sapiens
cuugcuucucuagcucucu

SEQ ID NO: 551709 - RNA, 16 nt, Homo sapiens
cuugcuugcaauaggu

SEQ ID NO: 551710 - RNA, 19 nt, Homo sapiens
cuugcuuguuccugcauua

SEQ ID NO: 551711 - RNA, 22 nt, Homo sapiens
cuugcuuuaccuuuucagggcu

SEQ ID NO: 551712 - RNA, 23 nt, Homo sapiens
cuugcuuuccugggccuuugcaa

SEQ ID NO: 551713 - RNA, 19 nt, Homo sapiens
cuugcuuugggcuuugcag

SEQ ID NO: 551714 - RNA, 19 nt, Homo sapiens
cuugcuuuuugcccguuga

SEQ ID NO: 551715 - RNA, 13 nt, Homo sapiens
cuuggaagccagg

SEQ ID NO: 551716 - RNA, 16 nt, Homo sapiens
cuuggacaaaccuaga

SEQ ID NO: 551717 - RNA, 12 nt, Homo sapiens
cuuggacaccau

SEQ ID NO: 551718 - RNA, 21 nt, Homo sapiens
cuuggacuguguuuuuccucc

SEQ ID NO: 551719 - RNA, 20 nt, Homo sapiens
cuuggagacaaaaucuuaaa

SEQ ID NO: 551720 - RNA, 23 nt, Homo sapiens
cuuggagagagaggcugccucag

SEQ ID NO: 551721 - RNA, 21 nt, Homo sapiens
cuuggagagcaaaggcccaug

SEQ ID NO: 551722 - RNA, 17 nt, Homo sapiens
cuuggagcccgugcagu

SEQ ID NO: 551723 - RNA, 16 nt, Homo sapiens
cuuggaggaaugacaa

SEQ ID NO: 551724 - RNA, 14 nt, Homo sapiens
cuuggagggcucag

SEQ ID NO: 551725 - RNA, 21 nt, Homo sapiens
cuuggagugcacugagaacag

SEQ ID NO: 551726 - RNA, 16 nt, Homo sapiens
cuuggagugugugaua

SEQ ID NO: 551727 - RNA, 15 nt, Homo sapiens
cuuggauaccagcuc

SEQ ID NO: 551728 - RNA, 16 nt, Homo sapiens
cuuggaucagaugaac

SEQ ID NO: 551729 - RNA, 21 nt, Homo sapiens
cuuggcauacaaaauauuuaa

SEQ ID NO: 551730 - RNA, 17 nt, Homo sapiens
cuuggccaaggugguga

SEQ ID NO: 551731 - RNA, 20 nt, Homo sapiens
cuuggccagaagggggccau

SEQ ID NO: 551732 - RNA, 22 nt, Homo sapiens
cuuggccagaagggggccauga

SEQ ID NO: 551733 - RNA, 24 nt, Homo sapiens
cuuggccccagacgcauagacuga

SEQ ID NO: 551734 - RNA, 13 nt, Homo sapiens
cuuggccccagag

SEQ ID NO: 551735 - RNA, 17 nt, Homo sapiens
cuuggccuacagucauc

SEQ ID NO: 551736 - RNA, 23 nt, Homo sapiens
cuuggccucccaaagugcugaga

SEQ ID NO: 551737 - RNA, 16 nt, Homo sapiens
cuuggcggacacuggg

SEQ ID NO: 551738 - RNA, 17 nt, Homo sapiens
cuuggcuccacugggau

SEQ ID NO: 551739 - RNA, 16 nt, Homo sapiens
cuuggcucgaugcugu

SEQ ID NO: 551740 - RNA, 14 nt, Homo sapiens
cuuggcugacauga

SEQ ID NO: 551741 - RNA, 17 nt, Homo sapiens
cuuggcugcaggcaaca

SEQ ID NO: 551742 - RNA, 19 nt, Homo sapiens
cuuggcuuauccacuuuga

SEQ ID NO: 551743 - RNA, 14 nt, Homo sapiens
cuuggcuucucagc

SEQ ID NO: 551744 - RNA, 20 nt, Homo sapiens
cuuggcuucuuaaaaacugu

SEQ ID NO: 551745 - RNA, 18 nt, Homo sapiens
cuugggaaggaaggcagu

SEQ ID NO: 551746 - RNA, 23 nt, Homo sapiens
cuugggaaggaaggcagugccug

SEQ ID NO: 551747 - RNA, 16 nt, Homo sapiens
cuugggacauggcaca

SEQ ID NO: 551748 - RNA, 17 nt, Homo sapiens
cuugggacucaggucug

SEQ ID NO: 551749 - RNA, 19 nt, Homo sapiens
cuugggacucaggucugua

SEQ ID NO: 551750 - RNA, 23 nt, Homo sapiens
cuugggaguauguugucauaaca

SEQ ID NO: 551751 - RNA, 21 nt, Homo sapiens
cuugggcacuuuuuaauucac

SEQ ID NO: 551752 - RNA, 20 nt, Homo sapiens
cuugggcaugggggagccuu

SEQ ID NO: 551753 - RNA, 16 nt, Homo sapiens
cuugggcuacuggcag

SEQ ID NO: 551754 - RNA, 17 nt, Homo sapiens
cuugggcugagugcagc

SEQ ID NO: 551755 - RNA, 21 nt, Homo sapiens
cuugggcugagugcagccaaa

SEQ ID NO: 551756 - RNA, 17 nt, Homo sapiens
cuuggggaaauggggcu

SEQ ID NO: 551757 - RNA, 17 nt, Homo sapiens
cuuggggagcacuuguc

SEQ ID NO: 551758 - RNA, 15 nt, Homo sapiens
cuugggggucagggg

SEQ ID NO: 551759 - RNA, 21 nt, Homo sapiens
cuugggguacucuugauguga

SEQ ID NO: 551760 - RNA, 17 nt, Homo sapiens
cuuggguagggcagaca

SEQ ID NO: 551761 - RNA, 19 nt, Homo sapiens
cuugggucagguucuugcc

SEQ ID NO: 551762 - RNA, 13 nt, Homo sapiens
cuugggucccgga

SEQ ID NO: 551763 - RNA, 15 nt, Homo sapiens
cuugggucccggagu

SEQ ID NO: 551764 - RNA, 17 nt, Homo sapiens
cuuggguugaucucuua

SEQ ID NO: 551765 - RNA, 13 nt, Homo sapiens
cuugguaaucuuc

SEQ ID NO: 551766 - RNA, 15 nt, Homo sapiens
cuugguauuacccuc

SEQ ID NO: 551767 - RNA, 16 nt, Homo sapiens
cuuggugccggucaca

SEQ ID NO: 551768 - RNA, 12 nt, Homo sapiens
cuuggugcuauc

SEQ ID NO: 551769 - RNA, 16 nt, Homo sapiens
cuugguggagcagcca

SEQ ID NO: 551770 - RNA, 17 nt, Homo sapiens
cuuggugugauugcaca

SEQ ID NO: 551771 - RNA, 21 nt, Homo sapiens
cuugguuguauaaagcaaaag

SEQ ID NO: 551772 - RNA, 19 nt, Homo sapiens
cuugguuuccaaaggcauu

SEQ ID NO: 551773 - RNA, 19 nt, Homo sapiens
cuuguaaagacacaucuua

SEQ ID NO: 551774 - RNA, 21 nt, Homo sapiens
cuuguaauaccugauugauca

SEQ ID NO: 551775 - RNA, 20 nt, Homo sapiens
cuuguacccccagguggaag

SEQ ID NO: 551776 - RNA, 12 nt, Homo sapiens
cuuguaccucaa

SEQ ID NO: 551777 - RNA, 18 nt, Homo sapiens
cuuguagcuguuacugca

SEQ ID NO: 551778 - RNA, 19 nt, Homo sapiens
cuuguaggauaagugaaau

SEQ ID NO: 551779 - RNA, 13 nt, Homo sapiens
cuuguaggaucua

SEQ ID NO: 551780 - RNA, 18 nt, Homo sapiens
cuuguauagcaugaaaua

SEQ ID NO: 551781 - RNA, 16 nt, Homo sapiens
cuuguauauacgcauc

SEQ ID NO: 551782 - RNA, 13 nt, Homo sapiens
cuuguaucaauau

SEQ ID NO: 551783 - RNA, 22 nt, Homo sapiens
cuuguauuaaacucuucacaaa

SEQ ID NO: 551784 - RNA, 18 nt, Homo sapiens
cuuguauuucuagcauua

SEQ ID NO: 551785 - RNA, 19 nt, Homo sapiens
cuugucaagccugugcaaa

SEQ ID NO: 551786 - RNA, 21 nt, Homo sapiens
cuugucaagccugugcaaaaa

SEQ ID NO: 551787 - RNA, 15 nt, Homo sapiens
cuugucaaucccaac

SEQ ID NO: 551788 - RNA, 16 nt, Homo sapiens
cuugucacgaauucca

SEQ ID NO: 551789 - RNA, 17 nt, Homo sapiens
cuugucacgaauuccau

SEQ ID NO: 551790 - RNA, 24 nt, Homo sapiens
cuugucacgaauuccaucuuguaa

SEQ ID NO: 551791 - RNA, 14 nt, Homo sapiens
cuugucagauguau

SEQ ID NO: 551792 - RNA, 22 nt, Homo sapiens
cuugucauaaaaugcauacugu

SEQ ID NO: 551793 - RNA, 20 nt, Homo sapiens
cuugucauauucgauguacu

SEQ ID NO: 551794 - RNA, 17 nt, Homo sapiens
cuugucaugugacaggu

SEQ ID NO: 551795 - RNA, 22 nt, Homo sapiens
cuugucauuuuuaauauuacug

SEQ ID NO: 551796 - RNA, 19 nt, Homo sapiens
cuuguccaucacucuagua

SEQ ID NO: 551797 - RNA, 19 nt, Homo sapiens
cuugucuccccuguucccc

SEQ ID NO: 551798 - RNA, 12 nt, Homo sapiens
cuugucuucccc

SEQ ID NO: 551799 - RNA, 17 nt, Homo sapiens
cuugugaaguggaaaug

SEQ ID NO: 551800 - RNA, 21 nt, Homo sapiens
gaaaccugucauuguauucag

SEQ ID NO: 551801 - RNA, 17 nt, Homo sapiens
gaaaccuuauuguaccu

SEQ ID NO: 551802 - RNA, 17 nt, Homo sapiens
gaaacgagacuuuccau

SEQ ID NO: 551803 - RNA, 15 nt, Homo sapiens
gaaacggaagcucau

SEQ ID NO: 551804 - RNA, 12 nt, Homo sapiens
gaaacgugaaag

SEQ ID NO: 551805 - RNA, 15 nt, Homo sapiens
gaaacuaaacucuua

SEQ ID NO: 551806 - RNA, 14 nt, Homo sapiens
gaaacuaagccagg

SEQ ID NO: 551807 - RNA, 18 nt, Homo sapiens
gaaacuaagccaggccug

SEQ ID NO: 551808 - RNA, 20 nt, Homo sapiens
gaaacuaauauuuuauguga

SEQ ID NO: 551809 - RNA, 17 nt, Homo sapiens
gaaacuagcuuuugcca

SEQ ID NO: 551810 - RNA, 16 nt, Homo sapiens
gaaacuauacauuuau

SEQ ID NO: 551811 - RNA, 16 nt, Homo sapiens
gaaacucaaaaauauu

SEQ ID NO: 551812 - RNA, 14 nt, Homo sapiens
gaaacucacacucc

SEQ ID NO: 551813 - RNA, 17 nt, Homo sapiens
gaaacucagauguccaa

SEQ ID NO: 551814 - RNA, 21 nt, Homo sapiens
gaaacucaguaugcugccccu

SEQ ID NO: 551815 - RNA, 13 nt, Homo sapiens
gaaacuccauuga

SEQ ID NO: 551816 - RNA, 15 nt, Homo sapiens
gaaacucuacccuga

SEQ ID NO: 551817 - RNA, 16 nt, Homo sapiens
gaaacucuacccugaa

SEQ ID NO: 551818 - RNA, 17 nt, Homo sapiens
gaaacucuuucauucuu

SEQ ID NO: 551819 - RNA, 23 nt, Homo sapiens
gaaacugagguauggccaugccc

SEQ ID NO: 551820 - RNA, 22 nt, Homo sapiens
gaaacugauuucuucagaauua

SEQ ID NO: 551821 - RNA, 23 nt, Homo sapiens
gaaacugcccuggcuccagugaa

SEQ ID NO: 551822 - RNA, 17 nt, Homo sapiens
gaaacuguccaccaaga

SEQ ID NO: 551823 - RNA, 18 nt, Homo sapiens
gaaacuuaccaauugaug

SEQ ID NO: 551824 - RNA, 22 nt, Homo sapiens
gaaacuuuuuuuuccuacuauc

SEQ ID NO: 551825 - RNA, 18 nt, Homo sapiens
gaaagaaagcaccuguuu

SEQ ID NO: 551826 - RNA, 19 nt, Homo sapiens
gaaagaaauuuggcuauaa

SEQ ID NO: 551827 - RNA, 12 nt, Homo sapiens
gaaagaagacau

SEQ ID NO: 551828 - RNA, 20 nt, Homo sapiens
gaaagaagccaggugcaaaa

SEQ ID NO: 551829 - RNA, 21 nt, Homo sapiens
gaaagaagccaggugcaaaag

SEQ ID NO: 551830 - RNA, 16 nt, Homo sapiens
gaaagaaggcauggac

SEQ ID NO: 551831 - RNA, 15 nt, Homo sapiens
gaaagaaucagucuu

SEQ ID NO: 551832 - RNA, 13 nt, Homo sapiens
gaaagaaugcauu

SEQ ID NO: 551833 - RNA, 14 nt, Homo sapiens
gaaagaauguuacu

SEQ ID NO: 551834 - RNA, 21 nt, Homo sapiens
gaaagacauagccaacugcug

SEQ ID NO: 551835 - RNA, 15 nt, Homo sapiens
gaaagacauccauaa

SEQ ID NO: 551836 - RNA, 23 nt, Homo sapiens
gaaagaccaggccaaugucaggg

SEQ ID NO: 551837 - RNA, 17 nt, Homo sapiens
gaaagauccccuaauaa

SEQ ID NO: 551838 - RNA, 13 nt, Homo sapiens
gaaagaugcagug

SEQ ID NO: 551839 - RNA, 14 nt, Homo sapiens
gaaagauggaacuu

SEQ ID NO: 551840 - RNA, 16 nt, Homo sapiens
gaaagauuacuuagag

SEQ ID NO: 551841 - RNA, 17 nt, Homo sapiens
gaaagcaaaaaauaccu

SEQ ID NO: 551842 - RNA, 18 nt, Homo sapiens
gaaagcaaguguucacaa

SEQ ID NO: 551843 - RNA, 21 nt, Homo sapiens
gaaagcaaguguucacaacag

SEQ ID NO: 551844 - RNA, 14 nt, Homo sapiens
gaaagcaauaacuu

SEQ ID NO: 551845 - RNA, 23 nt, Homo sapiens
gaaagcaucauuauuugcagaga

SEQ ID NO: 551846 - RNA, 21 nt, Homo sapiens
gaaagcaugucucugcuucca

SEQ ID NO: 551847 - RNA, 22 nt, Homo sapiens
gaaagcaugucucugcuuccau

SEQ ID NO: 551848 - RNA, 15 nt, Homo sapiens
gaaagccucuggcaa

SEQ ID NO: 551849 - RNA, 18 nt, Homo sapiens
gaaagcuccuuccagacc

SEQ ID NO: 551850 - RNA, 17 nt, Homo sapiens
gaaagcuggugucugau

SEQ ID NO: 551851 - RNA, 20 nt, Homo sapiens
gaaagcuuuauacaguugaa

SEQ ID NO: 551852 - RNA, 22 nt, Homo sapiens
gaaagcuuuuauuccuuugaau

SEQ ID NO: 551853 - RNA, 16 nt, Homo sapiens
gaaaggaacacuggcu

SEQ ID NO: 551854 - RNA, 16 nt, Homo sapiens
gaaaggaacugcaaua

SEQ ID NO: 551855 - RNA, 13 nt, Homo sapiens
gaaaggaagcauu

SEQ ID NO: 551856 - RNA, 15 nt, Homo sapiens
gaaaggacuguggac

SEQ ID NO: 551857 - RNA, 14 nt, Homo sapiens
gaaaggagacuaga

SEQ ID NO: 551858 - RNA, 20 nt, Homo sapiens
gaaaggauugauuugaacuu

SEQ ID NO: 551859 - RNA, 13 nt, Homo sapiens
gaaaggccaauaa

SEQ ID NO: 551860 - RNA, 13 nt, Homo sapiens
gaaaggcucaguc

SEQ ID NO: 551861 - RNA, 14 nt, Homo sapiens
gaaaggcucauuua

SEQ ID NO: 551862 - RNA, 20 nt, Homo sapiens
gaaaggcucauuuaaaacag

SEQ ID NO: 551863 - RNA, 17 nt, Homo sapiens
gaaagggaaaagggaga

SEQ ID NO: 551864 - RNA, 13 nt, Homo sapiens
gaaagggagcuau

SEQ ID NO: 551865 - RNA, 13 nt, Homo sapiens
gaaaggggcccca

SEQ ID NO: 551866 - RNA, 19 nt, Homo sapiens
gaaagggguuggggugaca

SEQ ID NO: 551867 - RNA, 20 nt, Homo sapiens
gaaaggguaguucaaagagu

SEQ ID NO: 551868 - RNA, 20 nt, Homo sapiens
gaaaggguuuguaauacuuu

SEQ ID NO: 551869 - RNA, 21 nt, Homo sapiens
gaaagguacuauauuugcuag

SEQ ID NO: 551870 - RNA, 17 nt, Homo sapiens
gaaaggucauccaaaga

SEQ ID NO: 551871 - RNA, 18 nt, Homo sapiens
gaaaggucauccaaagaa

SEQ ID NO: 551872 - RNA, 18 nt, Homo sapiens
gaaaggucucagcuugua

SEQ ID NO: 551873 - RNA, 16 nt, Homo sapiens
gaaagguuauguuagc

SEQ ID NO: 551874 - RNA, 23 nt, Homo sapiens
gaaagguuuuauucuauauugcu

SEQ ID NO: 551875 - RNA, 22 nt, Homo sapiens
gaaaguaaauauuucaggcaua

SEQ ID NO: 551876 - RNA, 16 nt, Homo sapiens
gaaaguaaaucugaga

SEQ ID NO: 551877 - RNA, 24 nt, Homo sapiens
gaaaguaauauaaugaugcugucu

SEQ ID NO: 551878 - RNA, 18 nt, Homo sapiens
gaaaguauagauggccaa

SEQ ID NO: 551879 - RNA, 16 nt, Homo sapiens
gaaagucaccaggacu

SEQ ID NO: 551880 - RNA, 14 nt, Homo sapiens
gaaagugcauauga

SEQ ID NO: 551881 - RNA, 21 nt, Homo sapiens
gaaagugucugcaguagggga

SEQ ID NO: 551882 - RNA, 19 nt, Homo sapiens
gaaaguguuuaacuuguca

SEQ ID NO: 551883 - RNA, 19 nt, Homo sapiens
gaaaguuccaaauguuuau

SEQ ID NO: 551884 - RNA, 19 nt, Homo sapiens
gaaaguucuugguggugga

SEQ ID NO: 551885 - RNA, 16 nt, Homo sapiens
gaaaguugcuuuuauu

SEQ ID NO: 551886 - RNA, 22 nt, Homo sapiens
gaaaguuucagauuugccauuc

SEQ ID NO: 551887 - RNA, 15 nt, Homo sapiens
gaaauaaaaauaccu

SEQ ID NO: 551888 - RNA, 16 nt, Homo sapiens
gaaauaaacugugcaa

SEQ ID NO: 551889 - RNA, 19 nt, Homo sapiens
gaaauaaagagcuguuaua

SEQ ID NO: 551890 - RNA, 19 nt, Homo sapiens
gaaauaaaggaugugauug

SEQ ID NO: 551891 - RNA, 18 nt, Homo sapiens
gaaauaaaguuggugaca

SEQ ID NO: 551892 - RNA, 19 nt, Homo sapiens
gaaauaaaguuggugacag

SEQ ID NO: 551893 - RNA, 22 nt, Homo sapiens
gaaauaaauucugacuuaugaa

SEQ ID NO: 551894 - RNA, 16 nt, Homo sapiens
gaaauaagcugugauu

SEQ ID NO: 551895 - RNA, 19 nt, Homo sapiens
gaaauaaguuuuuguuuca

SEQ ID NO: 551896 - RNA, 18 nt, Homo sapiens
gaaauaauaaaacuauua

SEQ ID NO: 551897 - RNA, 21 nt, Homo sapiens
gaaauaaugcauuucugugga

SEQ ID NO: 551898 - RNA, 23 nt, Homo sapiens
gaaauacacagugcugaccagac

SEQ ID NO: 551899 - RNA, 16 nt, Homo sapiens
gaaauacagucuucca

SEQ ID NO: 551900 - RNA, 22 nt, Homo sapiens
gaaauaccagugaaccaaagag

SEQ ID NO: 551901 - RNA, 19 nt, Homo sapiens
gaaauacccaacgcacaaa

SEQ ID NO: 551902 - RNA, 13 nt, Homo sapiens
gaaauacugagau

SEQ ID NO: 551903 - RNA, 18 nt, Homo sapiens
gaaauacugagaugcugg

SEQ ID NO: 551904 - RNA, 13 nt, Homo sapiens
gaaauacuuucag

SEQ ID NO: 551905 - RNA, 22 nt, Homo sapiens
gaaauaguaccuucaauacuua

SEQ ID NO: 551906 - RNA, 23 nt, Homo sapiens
gaaauauaggauagacacuggac

SEQ ID NO: 551907 - RNA, 15 nt, Homo sapiens
gaaauauagugcaau

SEQ ID NO: 551908 - RNA, 22 nt, Homo sapiens
gaaauauauauguguguguaug

SEQ ID NO: 551909 - RNA, 14 nt, Homo sapiens
gaaauauauuacuu

SEQ ID NO: 551910 - RNA, 21 nt, Homo sapiens
gaaauauccacccagcaggca

SEQ ID NO: 551911 - RNA, 13 nt, Homo sapiens
gaaauaugaucca

SEQ ID NO: 551912 - RNA, 12 nt, Homo sapiens
gaaauaugcaua

SEQ ID NO: 551913 - RNA, 13 nt, Homo sapiens
gaaauaugugaug

SEQ ID NO: 551914 - RNA, 20 nt, Homo sapiens
gaaauaugugguuuccacga

SEQ ID NO: 551915 - RNA, 22 nt, Homo sapiens
gaaauauugauaguaaggcaau

SEQ ID NO: 551916 - RNA, 19 nt, Homo sapiens
gaaaucaaaagggccaaag

SEQ ID NO: 551917 - RNA, 14 nt, Homo sapiens
gaaaucaacuugug

SEQ ID NO: 551918 - RNA, 16 nt, Homo sapiens
gaaaucaauguguaca

SEQ ID NO: 551919 - RNA, 17 nt, Homo sapiens
gaaauccauuccauuuu

SEQ ID NO: 551920 - RNA, 19 nt, Homo sapiens
gaaaucuagaagacuguca

SEQ ID NO: 551921 - RNA, 22 nt, Homo sapiens
gaaccuguccuaaggaaccuuc

SEQ ID NO: 551922 - RNA, 23 nt, Homo sapiens
gaaccuguuuaauguuaugagga

SEQ ID NO: 551923 - RNA, 14 nt, Homo sapiens
gaaccuuaaugaca

SEQ ID NO: 551924 - RNA, 15 nt, Homo sapiens
gaaccuugcuguccu

SEQ ID NO: 551925 - RNA, 19 nt, Homo sapiens
gaaccuugucccagccagu

SEQ ID NO: 551926 - RNA, 21 nt, Homo sapiens
gaaccuugucccagccaguga

SEQ ID NO: 551927 - RNA, 15 nt, Homo sapiens
gaacgcagaagaaag

SEQ ID NO: 551928 - RNA, 12 nt, Homo sapiens
gaacgcuuucau

SEQ ID NO: 551929 - RNA, 13 nt, Homo sapiens
gaacguccuuccu

SEQ ID NO: 551930 - RNA, 14 nt, Homo sapiens
gaacguugccacac

SEQ ID NO: 551931 - RNA, 20 nt, Homo sapiens
gaacguuuuuccuguucuua

SEQ ID NO: 551932 - RNA, 19 nt, Homo sapiens
gaacuaaauuuaagcuuaa

SEQ ID NO: 551933 - RNA, 15 nt, Homo sapiens
gaacuaacaugcaaa

SEQ ID NO: 551934 - RNA, 14 nt, Homo sapiens
gaacuaacugacag

SEQ ID NO: 551935 - RNA, 21 nt, Homo sapiens
gaacuaaguuuuguguguaua

SEQ ID NO: 551936 - RNA, 21 nt, Homo sapiens
gaacuacgggcugcucuacug

SEQ ID NO: 551937 - RNA, 18 nt, Homo sapiens
gaacuagccaaaccagga

SEQ ID NO: 551938 - RNA, 11 nt, Homo sapiens
gaacuaugaac

SEQ ID NO: 551939 - RNA, 17 nt, Homo sapiens
gaacuaugaacacuguc

SEQ ID NO: 551940 - RNA, 20 nt, Homo sapiens
gaacuaugaacacugucauc

SEQ ID NO: 551941 - RNA, 16 nt, Homo sapiens
gaacuaugaacuacaa

SEQ ID NO: 551942 - RNA, 14 nt, Homo sapiens
gaacuauguacuuu

SEQ ID NO: 551943 - RNA, 19 nt, Homo sapiens
gaacuauucugggggcccg

SEQ ID NO: 551944 - RNA, 17 nt, Homo sapiens
gaacuauuguggguuuu

SEQ ID NO: 551945 - RNA, 23 nt, Homo sapiens
gaacucagcacauucgggaccaa

SEQ ID NO: 551946 - RNA, 22 nt, Homo sapiens
gaacucaguuaaaucuuugaag

SEQ ID NO: 551947 - RNA, 18 nt, Homo sapiens
gaacucuacuucagucaa

SEQ ID NO: 551948 - RNA, 23 nt, Homo sapiens
gaacucuccccuugucugcacug

SEQ ID NO: 551949 - RNA, 19 nt, Homo sapiens
gaacucucugccuguaaau

SEQ ID NO: 551950 - RNA, 19 nt, Homo sapiens
gaacucugguggcacagga

SEQ ID NO: 551951 - RNA, 13 nt, Homo sapiens
gaacucuguaaaa

SEQ ID NO: 551952 - RNA, 14 nt, Homo sapiens
gaacugaaacuuuu

SEQ ID NO: 551953 - RNA, 23 nt, Homo sapiens
gaacugaaguuuccgcccccgcc

SEQ ID NO: 551954 - RNA, 22 nt, Homo sapiens
gaacugaauaaacaggaaaaug

SEQ ID NO: 551955 - RNA, 14 nt, Homo sapiens
gaacugacaaugaa

SEQ ID NO: 551956 - RNA, 18 nt, Homo sapiens
gaacugauucacaucuca

SEQ ID NO: 551957 - RNA, 22 nt, Homo sapiens
gaacugcauucuucugagcacu

SEQ ID NO: 551958 - RNA, 15 nt, Homo sapiens
gaacugcuucuaaga

SEQ ID NO: 551959 - RNA, 19 nt, Homo sapiens
gaacuggaggaguuccuug

SEQ ID NO: 551960 - RNA, 23 nt, Homo sapiens
gaacugugcauagugcugggaug

SEQ ID NO: 551961 - RNA, 17 nt, Homo sapiens
gaacugugcaucaacca

SEQ ID NO: 551962 - RNA, 19 nt, Homo sapiens
gaacuguggugccacauga

SEQ ID NO: 551963 - RNA, 21 nt, Homo sapiens
gaacuguuagguucugaugac

SEQ ID NO: 551964 - RNA, 12 nt, Homo sapiens
gaacuguucaca

SEQ ID NO: 551965 - RNA, 16 nt, Homo sapiens
gaacuguucacacugc

SEQ ID NO: 551966 - RNA, 21 nt, Homo sapiens
gaacuuaauaacuguguacug

SEQ ID NO: 551967 - RNA, 19 nt, Homo sapiens
gaacuuacuguagccucag

SEQ ID NO: 551968 - RNA, 16 nt, Homo sapiens
gaacuuagauguuaaa

SEQ ID NO: 551969 - RNA, 17 nt, Homo sapiens
gaacuuauucucuguag

SEQ ID NO: 551970 - RNA, 14 nt, Homo sapiens
gaacuuauuuacac

SEQ ID NO: 551971 - RNA, 15 nt, Homo sapiens
gaacuugagcgugaa

SEQ ID NO: 551972 - RNA, 14 nt, Homo sapiens
gaacuugccuuaaa

SEQ ID NO: 551973 - RNA, 19 nt, Homo sapiens
gaacuuuaaaaaagcaaau

SEQ ID NO: 551974 - RNA, 17 nt, Homo sapiens
gaacuuuaaaaaauaaa

SEQ ID NO: 551975 - RNA, 14 nt, Homo sapiens
gaacuuuaagcaac

SEQ ID NO: 551976 - RNA, 17 nt, Homo sapiens
gaacuuuaagucucacc

SEQ ID NO: 551977 - RNA, 18 nt, Homo sapiens
gaagaaaagcugccauuu

SEQ ID NO: 551978 - RNA, 17 nt, Homo sapiens
gaagaaaccguauccau

SEQ ID NO: 551979 - RNA, 16 nt, Homo sapiens
gaagaaauuuaugaag

SEQ ID NO: 551980 - RNA, 20 nt, Homo sapiens
gaagaaauuuaugaagcaga

SEQ ID NO: 551981 - RNA, 22 nt, Homo sapiens
gaagaacagauaaucccuguau

SEQ ID NO: 551982 - RNA, 13 nt, Homo sapiens
gaagaacaguaac

SEQ ID NO: 551983 - RNA, 20 nt, Homo sapiens
gaagaacaucaagauaccuu

SEQ ID NO: 551984 - RNA, 16 nt, Homo sapiens
gaagaaccaaauaccu

SEQ ID NO: 551985 - RNA, 15 nt, Homo sapiens
gaagaaccauuuaca

SEQ ID NO: 551986 - RNA, 21 nt, Homo sapiens
gaagaaccgauacacuuggca

SEQ ID NO: 551987 - RNA, 11 nt, Homo sapiens
gaagaacugac

SEQ ID NO: 551988 - RNA, 15 nt, Homo sapiens
gaagaacugcacuuu

SEQ ID NO: 551989 - RNA, 14 nt, Homo sapiens
gaagaacuugcaug

SEQ ID NO: 551990 - RNA, 22 nt, Homo sapiens
gaagaagggagacgaaaaucca

SEQ ID NO: 551991 - RNA, 20 nt, Homo sapiens
gaagaagucuaagagugaag

SEQ ID NO: 551992 - RNA, 21 nt, Homo sapiens
gaagaagucuaagagugaagu

SEQ ID NO: 551993 - RNA, 15 nt, Homo sapiens
gaagaauaaauucua

SEQ ID NO: 551994 - RNA, 17 nt, Homo sapiens
gaagaauaucaaauaau

SEQ ID NO: 551995 - RNA, 13 nt, Homo sapiens
gaagaaugaaaau

SEQ ID NO: 551996 - RNA, 22 nt, Homo sapiens
gaagaaugcacaagaauggauc

SEQ ID NO: 551997 - RNA, 18 nt, Homo sapiens
gaagaauuauaacccaga

SEQ ID NO: 551998 - RNA, 19 nt, Homo sapiens
gaagaauuauaacccagaa

SEQ ID NO: 551999 - RNA, 15 nt, Homo sapiens
gaagaauuggaauaa

SEQ ID NO: 552000 - RNA, 12 nt, Homo sapiens
gaagacacugca

SEQ ID NO: 552001 - RNA, 11 nt, Homo sapiens
gaagacauaaa

SEQ ID NO: 552002 - RNA, 16 nt, Homo sapiens
gaagacauccugagca

SEQ ID NO: 552003 - RNA, 23 nt, Homo sapiens
gaagacauccugagcagugccag

SEQ ID NO: 552004 - RNA, 22 nt, Homo sapiens
gaagacauuugccuuuuguuaa

SEQ ID NO: 552005 - RNA, 11 nt, Homo sapiens
gaagacauuuu

SEQ ID NO: 552006 - RNA, 13 nt, Homo sapiens
gaagaccaaagac

SEQ ID NO: 552007 - RNA, 21 nt, Homo sapiens
gaagaccaagacacagaucac

SEQ ID NO: 552008 - RNA, 17 nt, Homo sapiens
gaagaccagcuuugcag

SEQ ID NO: 552009 - RNA, 21 nt, Homo sapiens
gaagaccaguccuguuugcag

SEQ ID NO: 552010 - RNA, 16 nt, Homo sapiens
gaagacccacgugcua

SEQ ID NO: 552011 - RNA, 21 nt, Homo sapiens
gaagaccuaaagugcuugcuu

SEQ ID NO: 552012 - RNA, 18 nt, Homo sapiens
gaagacgccaaaaacaau

SEQ ID NO: 552013 - RNA, 16 nt, Homo sapiens
gaagacuauuugccau

SEQ ID NO: 552014 - RNA, 14 nt, Homo sapiens
gaagacucaguaug

SEQ ID NO: 552015 - RNA, 16 nt, Homo sapiens
gaagacucaguaugcu

SEQ ID NO: 552016 - RNA, 20 nt, Homo sapiens
gaagacuuuaaaccaccuag

SEQ ID NO: 552017 - RNA, 16 nt, Homo sapiens
gaagagaaaggacuca

SEQ ID NO: 552018 - RNA, 17 nt, Homo sapiens
gaagagaaaggacucag

SEQ ID NO: 552019 - RNA, 16 nt, Homo sapiens
gaagagaaaugcugcu

SEQ ID NO: 552020 - RNA, 13 nt, Homo sapiens
gaagagacaggca

SEQ ID NO: 552021 - RNA, 14 nt, Homo sapiens
gaagagaccaagac

SEQ ID NO: 552022 - RNA, 18 nt, Homo sapiens
gaagagaugacaaaccau

SEQ ID NO: 552023 - RNA, 15 nt, Homo sapiens
gaagagcaagggaca

SEQ ID NO: 552024 - RNA, 13 nt, Homo sapiens
gaagagcauugca

SEQ ID NO: 552025 - RNA, 15 nt, Homo sapiens
gaagagccaggacau

SEQ ID NO: 552026 - RNA, 23 nt, Homo sapiens
gaagagcccgcagggccaugcag

SEQ ID NO: 552027 - RNA, 19 nt, Homo sapiens
gaagagcguagacaggugu

SEQ ID NO: 552028 - RNA, 15 nt, Homo sapiens
gaagagcugucuucc

SEQ ID NO: 552029 - RNA, 17 nt, Homo sapiens
gaagagcugucuucccc

SEQ ID NO: 552030 - RNA, 16 nt, Homo sapiens
gaagaggccuucccau

SEQ ID NO: 552031 - RNA, 19 nt, Homo sapiens
gaagaggcggaagaaagcu

SEQ ID NO: 552032 - RNA, 13 nt, Homo sapiens
gaagagggucccu

SEQ ID NO: 552033 - RNA, 13 nt, Homo sapiens
gaagagucuucca

SEQ ID NO: 552034 - RNA, 22 nt, Homo sapiens
gaagaguggguuucacaaguga

SEQ ID NO: 552035 - RNA, 22 nt, Homo sapiens
gaagauauaacauucaguuccc

SEQ ID NO: 552036 - RNA, 16 nt, Homo sapiens
gaagaucaagccaguu

SEQ ID NO: 552037 - RNA, 19 nt, Homo sapiens
gaagaucauauacgugaaa

SEQ ID NO: 552038 - RNA, 21 nt, Homo sapiens
gaagaugaauggucuggcaau

SEQ ID NO: 552039 - RNA, 19 nt, Homo sapiens
gaagauggcauccugugaa

SEQ ID NO: 552040 - RNA, 20 nt, Homo sapiens
gaagauggcauccugugaag

SEQ ID NO: 552041 - RNA, 22 nt, Homo sapiens
gaagauguccgugagaacauca

SEQ ID NO: 552042 - RNA, 16 nt, Homo sapiens
gaagauguugguuaug

SEQ ID NO: 552043 - RNA, 16 nt, Homo sapiens
gcagacucgggaccaa

SEQ ID NO: 552044 - RNA, 20 nt, Homo sapiens
gcagagaaccaaaggggcca

SEQ ID NO: 552045 - RNA, 19 nt, Homo sapiens
gcagagaugacuguccaag

SEQ ID NO: 552046 - RNA, 14 nt, Homo sapiens
gcagagccaggaag

SEQ ID NO: 552047 - RNA, 22 nt, Homo sapiens
gcagagcccggccccaccuccc

SEQ ID NO: 552048 - RNA, 20 nt, Homo sapiens
gcagagccucguuucugcuu

SEQ ID NO: 552049 - RNA, 20 nt, Homo sapiens
gcagaggaagagacaugaga

SEQ ID NO: 552050 - RNA, 18 nt, Homo sapiens
gcagaggcaacacuggaa

SEQ ID NO: 552051 - RNA, 19 nt, Homo sapiens
gcagagguaaaagugugag

SEQ ID NO: 552052 - RNA, 17 nt, Homo sapiens
gcagaggucagacuaag

SEQ ID NO: 552053 - RNA, 23 nt, Homo sapiens
gcagaguuuguguguugucuuga

SEQ ID NO: 552054 - RNA, 14 nt, Homo sapiens
gcagauacauauga

SEQ ID NO: 552055 - RNA, 22 nt, Homo sapiens
gcagauagcccaggagcaacag

SEQ ID NO: 552056 - RNA, 15 nt, Homo sapiens
gcagaucugugccug

SEQ ID NO: 552057 - RNA, 14 nt, Homo sapiens
gcagaugccaguga

SEQ ID NO: 552058 - RNA, 15 nt, Homo sapiens
gcagaugcugcugaa

SEQ ID NO: 552059 - RNA, 18 nt, Homo sapiens
gcagaugcugucacuggc

SEQ ID NO: 552060 - RNA, 23 nt, Homo sapiens
gcagauguggauuugaauccaag

SEQ ID NO: 552061 - RNA, 16 nt, Homo sapiens
gcagauucagugcaau

SEQ ID NO: 552062 - RNA, 12 nt, Homo sapiens
gcagauuuccau

SEQ ID NO: 552063 - RNA, 14 nt, Homo sapiens
gcagauuugcacug

SEQ ID NO: 552064 - RNA, 21 nt, Homo sapiens
gcagcaaaacgacacugcgca

SEQ ID NO: 552065 - RNA, 21 nt, Homo sapiens
gcagcaaggaaagcucacgaa

SEQ ID NO: 552066 - RNA, 19 nt, Homo sapiens
gcagcaagggaccugcuca

SEQ ID NO: 552067 - RNA, 14 nt, Homo sapiens
gcagcaaugaaggg

SEQ ID NO: 552068 - RNA, 22 nt, Homo sapiens
gcagcaaugaagggaagugcau

SEQ ID NO: 552069 - RNA, 20 nt, Homo sapiens
gcagcacagcagacuaguua

SEQ ID NO: 552070 - RNA, 21 nt, Homo sapiens
gcagcacagucacccauggaa

SEQ ID NO: 552071 - RNA, 19 nt, Homo sapiens
gcagcaccguucugugcac

SEQ ID NO: 552072 - RNA, 13 nt, Homo sapiens
gcagcacugugag

SEQ ID NO: 552073 - RNA, 21 nt, Homo sapiens
gcagcagcaaggaaagcucac

SEQ ID NO: 552074 - RNA, 16 nt, Homo sapiens
gcagcaggugaccucc

SEQ ID NO: 552075 - RNA, 15 nt, Homo sapiens
gcagcauacacagau

SEQ ID NO: 552076 - RNA, 21 nt, Homo sapiens
gcagcaugagacuuucugcug

SEQ ID NO: 552077 - RNA, 13 nt, Homo sapiens
gcagcauggagcu

SEQ ID NO: 552078 - RNA, 18 nt, Homo sapiens
gcagccaaacccaugagg

SEQ ID NO: 552079 - RNA, 14 nt, Homo sapiens
gcagccaaccaaga

SEQ ID NO: 552080 - RNA, 19 nt, Homo sapiens
gcagccacaaccaaaaaau

SEQ ID NO: 552081 - RNA, 16 nt, Homo sapiens
gcagccacugugcuga

SEQ ID NO: 552082 - RNA, 16 nt, Homo sapiens
gcagccagccaucaaa

SEQ ID NO: 552083 - RNA, 15 nt, Homo sapiens
gcagcccucuugccc

SEQ ID NO: 552084 - RNA, 16 nt, Homo sapiens
gcagcccucuugcccg

SEQ ID NO: 552085 - RNA, 18 nt, Homo sapiens
gcagcccuguguguguca

SEQ ID NO: 552086 - RNA, 21 nt, Homo sapiens
gcagcccuugggcaguucuca

SEQ ID NO: 552087 - RNA, 23 nt, Homo sapiens
gcagccuaaugagagugcacugc

SEQ ID NO: 552088 - RNA, 19 nt, Homo sapiens
gcagccucaaaacggguca

SEQ ID NO: 552089 - RNA, 24 nt, Homo sapiens
gcagccucagaguggucgagugac

SEQ ID NO: 552090 - RNA, 18 nt, Homo sapiens
gcagccuggggucugaca

SEQ ID NO: 552091 - RNA, 19 nt, Homo sapiens
gcagccuggggucugacaa

SEQ ID NO: 552092 - RNA, 13 nt, Homo sapiens
gcagccugucacc

SEQ ID NO: 552093 - RNA, 20 nt, Homo sapiens
gcagcgcgugcggugcaaag

SEQ ID NO: 552094 - RNA, 20 nt, Homo sapiens
gcagcgucacucuaccuaau

SEQ ID NO: 552095 - RNA, 19 nt, Homo sapiens
gcagcuaaaggaagugaau

SEQ ID NO: 552096 - RNA, 14 nt, Homo sapiens
gcagcuacuccccu

SEQ ID NO: 552097 - RNA, 22 nt, Homo sapiens
gcagcucagcucuuuggaucag

SEQ ID NO: 552098 - RNA, 20 nt, Homo sapiens
gcagcucccuuucucaggag

SEQ ID NO: 552099 - RNA, 13 nt, Homo sapiens
gcagcucugugac

SEQ ID NO: 552100 - RNA, 20 nt, Homo sapiens
gcagcugauuccagaacaaa

SEQ ID NO: 552101 - RNA, 20 nt, Homo sapiens
gcagcugcagcagcaguucc

SEQ ID NO: 552102 - RNA, 23 nt, Homo sapiens
gcagcugggcuuggccuggagag

SEQ ID NO: 552103 - RNA, 18 nt, Homo sapiens
gcagcuggggcuagggga

SEQ ID NO: 552104 - RNA, 15 nt, Homo sapiens
gcagcuggugacugg

SEQ ID NO: 552105 - RNA, 19 nt, Homo sapiens
gcagcugguggaagaccug

SEQ ID NO: 552106 - RNA, 15 nt, Homo sapiens
gcagcuuagggcccu

SEQ ID NO: 552107 - RNA, 15 nt, Homo sapiens
gcagcuucaccagag

SEQ ID NO: 552108 - RNA, 18 nt, Homo sapiens
gcagcuucucuccacuga

SEQ ID NO: 552109 - RNA, 14 nt, Homo sapiens
gcagcuucugggac

SEQ ID NO: 552110 - RNA, 20 nt, Homo sapiens
gcagcuuuauguucauuugu

SEQ ID NO: 552111 - RNA, 23 nt, Homo sapiens
gcaggaagggugggaagggauaa

SEQ ID NO: 552112 - RNA, 13 nt, Homo sapiens
gcaggaccaaggg

SEQ ID NO: 552113 - RNA, 16 nt, Homo sapiens
gcaggaccucaccaaa

SEQ ID NO: 552114 - RNA, 16 nt, Homo sapiens
gcaggagaagaacaag

SEQ ID NO: 552115 - RNA, 14 nt, Homo sapiens
gcaggagaaucacu

SEQ ID NO: 552116 - RNA, 19 nt, Homo sapiens
gcaggagaaucacuggaac

SEQ ID NO: 552117 - RNA, 17 nt, Homo sapiens
gcaggagaaucgcuuga

SEQ ID NO: 552118 - RNA, 23 nt, Homo sapiens
gcaggagagaaugcccagugacc

SEQ ID NO: 552119 - RNA, 14 nt, Homo sapiens
gcaggaguggugca

SEQ ID NO: 552120 - RNA, 20 nt, Homo sapiens
gcaggaguggugcagacaga

SEQ ID NO: 552121 - RNA, 19 nt, Homo sapiens
gcaggaugauuguacagaa

SEQ ID NO: 552122 - RNA, 15 nt, Homo sapiens
gcaggcagccuugac

SEQ ID NO: 552123 - RNA, 16 nt, Homo sapiens
gcaggcccacucccca

SEQ ID NO: 552124 - RNA, 14 nt, Homo sapiens
gcaggcccagugac

SEQ ID NO: 552125 - RNA, 20 nt, Homo sapiens
gcaggcccguggcaggagga

SEQ ID NO: 552126 - RNA, 20 nt, Homo sapiens
gcaggccgugugucugucag

SEQ ID NO: 552127 - RNA, 21 nt, Homo sapiens
gcaggcguguggcagccacac

SEQ ID NO: 552128 - RNA, 15 nt, Homo sapiens
gcaggcucagacucu

SEQ ID NO: 552129 - RNA, 14 nt, Homo sapiens
gcaggcugggccau

SEQ ID NO: 552130 - RNA, 15 nt, Homo sapiens
gcaggcugggccaug

SEQ ID NO: 552131 - RNA, 15 nt, Homo sapiens
gcagggacuccaugc

SEQ ID NO: 552132 - RNA, 13 nt, Homo sapiens
gcagggacuguaa

SEQ ID NO: 552133 - RNA, 17 nt, Homo sapiens
gcagggaugauggcaga

SEQ ID NO: 552134 - RNA, 17 nt, Homo sapiens
gcagggcccagugacaa

SEQ ID NO: 552135 - RNA, 20 nt, Homo sapiens
gcagggccuugcccagagau

SEQ ID NO: 552136 - RNA, 16 nt, Homo sapiens
gcaggggcauugcuga

SEQ ID NO: 552137 - RNA, 23 nt, Homo sapiens
gcagggguccuuggugugacccu

SEQ ID NO: 552138 - RNA, 22 nt, Homo sapiens
gcaggguauggugagaaaccaa

SEQ ID NO: 552139 - RNA, 22 nt, Homo sapiens
gcaggguccacgccucugcugu

SEQ ID NO: 552140 - RNA, 22 nt, Homo sapiens
gcagggugugugcuagccucug

SEQ ID NO: 552141 - RNA, 17 nt, Homo sapiens
gcagguaggucggcacu

SEQ ID NO: 552142 - RNA, 12 nt, Homo sapiens
gcaggugccucc

SEQ ID NO: 552143 - RNA, 20 nt, Homo sapiens
gcagguggggagacugggcu

SEQ ID NO: 552144 - RNA, 23 nt, Homo sapiens
gcagguuggugggggccucggug

SEQ ID NO: 552145 - RNA, 22 nt, Homo sapiens
gcagguuuguuuucagcacuga

SEQ ID NO: 552146 - RNA, 22 nt, Homo sapiens
gcaguaaacuaagggugucaag

SEQ ID NO: 552147 - RNA, 20 nt, Homo sapiens
gcaguaaauacuugcaguug

SEQ ID NO: 552148 - RNA, 13 nt, Homo sapiens
gcaguacauguua

SEQ ID NO: 552149 - RNA, 12 nt, Homo sapiens
gcaguaccauuc

SEQ ID NO: 552150 - RNA, 13 nt, Homo sapiens
gcaguaccauuca

SEQ ID NO: 552151 - RNA, 13 nt, Homo sapiens
gcaguacuuugug

SEQ ID NO: 552152 - RNA, 19 nt, Homo sapiens
gcaguagaaauaauaugca

SEQ ID NO: 552153 - RNA, 20 nt, Homo sapiens
gcaguagaaauaauaugcau

SEQ ID NO: 552154 - RNA, 23 nt, Homo sapiens
gcaguauauaggugcuggaugua

SEQ ID NO: 552155 - RNA, 20 nt, Homo sapiens
gcaguauguacuucagugca

SEQ ID NO: 552156 - RNA, 22 nt, Homo sapiens
gcaguauguacuucagugcacc

SEQ ID NO: 552157 - RNA, 18 nt, Homo sapiens
gcaguaugugauggacug

SEQ ID NO: 552158 - RNA, 21 nt, Homo sapiens
gcaguauuggacaaagagcau

SEQ ID NO: 552159 - RNA, 21 nt, Homo sapiens
gcagucaccacccagcccuuc

SEQ ID NO: 552160 - RNA, 15 nt, Homo sapiens
gcaguccaggccucu

SEQ ID NO: 552161 - RNA, 21 nt, Homo sapiens
gcagucccccgagagguggga

SEQ ID NO: 552162 - RNA, 13 nt, Homo sapiens
gcaguccuacuca

SEQ ID NO: 552163 - RNA, 21 nt, Homo sapiens
gcagucgaugcguucacucca

SEQ ID NO: 552164 - RNA, 16 nt, Homo sapiens
gccauuacuacuguac

SEQ ID NO: 552165 - RNA, 20 nt, Homo sapiens
gccauuaugcaaauggagau

SEQ ID NO: 552166 - RNA, 12 nt, Homo sapiens
gccauuauuuaa

SEQ ID NO: 552167 - RNA, 19 nt, Homo sapiens
gccauuccacuccacucag

SEQ ID NO: 552168 - RNA, 20 nt, Homo sapiens
gccauuccacuccacucagg

SEQ ID NO: 552169 - RNA, 15 nt, Homo sapiens
gccauucuucagguc

SEQ ID NO: 552170 - RNA, 21 nt, Homo sapiens
gccauugaaaugucaaauuga

SEQ ID NO: 552171 - RNA, 18 nt, Homo sapiens
gccauugcacuccagccu

SEQ ID NO: 552172 - RNA, 21 nt, Homo sapiens
gccauugcagcuugaaaaaga

SEQ ID NO: 552173 - RNA, 18 nt, Homo sapiens
gccauuggggcagggacc

SEQ ID NO: 552174 - RNA, 20 nt, Homo sapiens
gccauugugaaccaaugcaa

SEQ ID NO: 552175 - RNA, 13 nt, Homo sapiens
gccauuguucacc

SEQ ID NO: 552176 - RNA, 18 nt, Homo sapiens
gccauuguuucuccuggg

SEQ ID NO: 552177 - RNA, 16 nt, Homo sapiens
gccauuuucagaauca

SEQ ID NO: 552178 - RNA, 17 nt, Homo sapiens
gcccaaauggcagggau

SEQ ID NO: 552179 - RNA, 15 nt, Homo sapiens
gcccaacugcgcaga

SEQ ID NO: 552180 - RNA, 14 nt, Homo sapiens
gcccaagaauagau

SEQ ID NO: 552181 - RNA, 17 nt, Homo sapiens
gcccaagggcuccagac

SEQ ID NO: 552182 - RNA, 20 nt, Homo sapiens
gcccaaguaccacgcagugc

SEQ ID NO: 552183 - RNA, 13 nt, Homo sapiens
gcccaagugggca

SEQ ID NO: 552184 - RNA, 11 nt, Homo sapiens
gcccaauccau

SEQ ID NO: 552185 - RNA, 19 nt, Homo sapiens
gcccacaacuugucaccca

SEQ ID NO: 552186 - RNA, 15 nt, Homo sapiens
gcccacacccaggcc

SEQ ID NO: 552187 - RNA, 22 nt, Homo sapiens
gcccacagcugagaauguggaa

SEQ ID NO: 552188 - RNA, 13 nt, Homo sapiens
gcccacagugccu

SEQ ID NO: 552189 - RNA, 22 nt, Homo sapiens
gcccacagugccuguacaggaa

SEQ ID NO: 552190 - RNA, 13 nt, Homo sapiens
gcccacauuaagc

SEQ ID NO: 552191 - RNA, 12 nt, Homo sapiens
gcccaccaaagg

SEQ ID NO: 552192 - RNA, 18 nt, Homo sapiens
gcccacccagauucugaa

SEQ ID NO: 552193 - RNA, 21 nt, Homo sapiens
gcccacccccacccccagugc

SEQ ID NO: 552194 - RNA, 16 nt, Homo sapiens
gcccacccuccagcuu

SEQ ID NO: 552195 - RNA, 13 nt, Homo sapiens
gcccacgaucccc

SEQ ID NO: 552196 - RNA, 21 nt, Homo sapiens
gcccacugcugcaguagggga

SEQ ID NO: 552197 - RNA, 19 nt, Homo sapiens
gcccacuguuaauauucua

SEQ ID NO: 552198 - RNA, 21 nt, Homo sapiens
gcccagaauccccaagugccu

SEQ ID NO: 552199 - RNA, 22 nt, Homo sapiens
gcccagaauccccaagugccug

SEQ ID NO: 552200 - RNA, 17 nt, Homo sapiens
gcccagacacagacugg

SEQ ID NO: 552201 - RNA, 20 nt, Homo sapiens
gcccagacacagacuggcaa

SEQ ID NO: 552202 - RNA, 12 nt, Homo sapiens
gcccagacuaca

SEQ ID NO: 552203 - RNA, 16 nt, Homo sapiens
gcccagaggcuccauc

SEQ ID NO: 552204 - RNA, 16 nt, Homo sapiens
gcccagaggguggcaa

SEQ ID NO: 552205 - RNA, 22 nt, Homo sapiens
gcccagauucuaccacacagca

SEQ ID NO: 552206 - RNA, 14 nt, Homo sapiens
gcccagcacauagc

SEQ ID NO: 552207 - RNA, 21 nt, Homo sapiens
gcccagcaggcccagcaugca

SEQ ID NO: 552208 - RNA, 17 nt, Homo sapiens
gcccagcaugcaggugg

SEQ ID NO: 552209 - RNA, 20 nt, Homo sapiens
gcccagccaacugccccggg

SEQ ID NO: 552210 - RNA, 20 nt, Homo sapiens
gcccagccauuaccauggag

SEQ ID NO: 552211 - RNA, 19 nt, Homo sapiens
gcccagccccuacugcugu

SEQ ID NO: 552212 - RNA, 22 nt, Homo sapiens
gcccagccccuagaaacccaag

SEQ ID NO: 552213 - RNA, 16 nt, Homo sapiens
gcccagccucaucucu

SEQ ID NO: 552214 - RNA, 13 nt, Homo sapiens
gcccagccuggga

SEQ ID NO: 552215 - RNA, 12 nt, Homo sapiens
gcccagcuacau

SEQ ID NO: 552216 - RNA, 14 nt, Homo sapiens
gcccagcuacauuc

SEQ ID NO: 552217 - RNA, 16 nt, Homo sapiens
gcccaggacugcauug

SEQ ID NO: 552218 - RNA, 17 nt, Homo sapiens
gcccaggacugcauugu

SEQ ID NO: 552219 - RNA, 14 nt, Homo sapiens
gcccaggcacuggg

SEQ ID NO: 552220 - RNA, 15 nt, Homo sapiens
gcccaggcaggccac

SEQ ID NO: 552221 - RNA, 17 nt, Homo sapiens
gcccaggcaggucugca

SEQ ID NO: 552222 - RNA, 18 nt, Homo sapiens
gcccaggcuagagugcaa

SEQ ID NO: 552223 - RNA, 19 nt, Homo sapiens
gcccaggcuagagugcaau

SEQ ID NO: 552224 - RNA, 20 nt, Homo sapiens
gcccaggcuagagugcaaug

SEQ ID NO: 552225 - RNA, 19 nt, Homo sapiens
gcccaggcuggaguacaau

SEQ ID NO: 552226 - RNA, 20 nt, Homo sapiens
gcccaggcuggagugcaaug

SEQ ID NO: 552227 - RNA, 19 nt, Homo sapiens
gcccaggcuggagugcagu

SEQ ID NO: 552228 - RNA, 20 nt, Homo sapiens
gcccaggcuggagugcagug

SEQ ID NO: 552229 - RNA, 20 nt, Homo sapiens
gcccaggcugggaacucauc

SEQ ID NO: 552230 - RNA, 20 nt, Homo sapiens
gcccagggaagccaaaagau

SEQ ID NO: 552231 - RNA, 18 nt, Homo sapiens
gcccagggagaggccaug

SEQ ID NO: 552232 - RNA, 23 nt, Homo sapiens
gcccagggaggggggaugcugcu

SEQ ID NO: 552233 - RNA, 15 nt, Homo sapiens
gcccagggcaucuug

SEQ ID NO: 552234 - RNA, 15 nt, Homo sapiens
gcccaguacauuuaa

SEQ ID NO: 552235 - RNA, 16 nt, Homo sapiens
gcccagugcauaugca

SEQ ID NO: 552236 - RNA, 14 nt, Homo sapiens
gcccaguguucucc

SEQ ID NO: 552237 - RNA, 19 nt, Homo sapiens
gcccaucagccauuugcca

SEQ ID NO: 552238 - RNA, 22 nt, Homo sapiens
gcccaucaggcaguguuaccug

SEQ ID NO: 552239 - RNA, 18 nt, Homo sapiens
gcccaucucaggugccac

SEQ ID NO: 552240 - RNA, 20 nt, Homo sapiens
gcccaugcuaugaguuuucu

SEQ ID NO: 552241 - RNA, 13 nt, Homo sapiens
gcccauggcauuu

SEQ ID NO: 552242 - RNA, 18 nt, Homo sapiens
gcccaugggauauguggu

SEQ ID NO: 552243 - RNA, 23 nt, Homo sapiens
gcccaugggauaugugguguaua

SEQ ID NO: 552244 - RNA, 15 nt, Homo sapiens
gcccauugcugccaa

SEQ ID NO: 552245 - RNA, 16 nt, Homo sapiens
gcccauuucuccauac

SEQ ID NO: 552246 - RNA, 15 nt, Homo sapiens
gccccaaauuccugu

SEQ ID NO: 552247 - RNA, 16 nt, Homo sapiens
gccccaaccugcugaa

SEQ ID NO: 552248 - RNA, 22 nt, Homo sapiens
gccccaagcuucugagucuaga

SEQ ID NO: 552249 - RNA, 14 nt, Homo sapiens
gccccacuccuucc

SEQ ID NO: 552250 - RNA, 20 nt, Homo sapiens
gccccacuggacaacacuga

SEQ ID NO: 552251 - RNA, 18 nt, Homo sapiens
gccccagacugagcucuc

SEQ ID NO: 552252 - RNA, 15 nt, Homo sapiens
gccccagacugggcc

SEQ ID NO: 552253 - RNA, 19 nt, Homo sapiens
gccccaggcauugccaagg

SEQ ID NO: 552254 - RNA, 13 nt, Homo sapiens
gccccagggcuau

SEQ ID NO: 552255 - RNA, 20 nt, Homo sapiens
gcccccaauaaaggcagcug

SEQ ID NO: 552256 - RNA, 21 nt, Homo sapiens
gcccccaccggaacugggcug

SEQ ID NO: 552257 - RNA, 22 nt, Homo sapiens
gcccccaccgggcugcaggugc

SEQ ID NO: 552258 - RNA, 21 nt, Homo sapiens
gcccccaccgugggcagggag

SEQ ID NO: 552259 - RNA, 21 nt, Homo sapiens
gcccccagaggcucagcacuu

SEQ ID NO: 552260 - RNA, 20 nt, Homo sapiens
gcccccauacuuggcugcuu

SEQ ID NO: 552261 - RNA, 14 nt, Homo sapiens
gccccccagucucc

SEQ ID NO: 552262 - RNA, 16 nt, Homo sapiens
gcccccccuuccacuu

SEQ ID NO: 552263 - RNA, 19 nt, Homo sapiens
gcccccgacggcugugacg

SEQ ID NO: 552264 - RNA, 20 nt, Homo sapiens
gcccccgagcugggggccau

SEQ ID NO: 552265 - RNA, 16 nt, Homo sapiens
gcccccgccacaaccc

SEQ ID NO: 552266 - RNA, 15 nt, Homo sapiens
gcccccgccccagag

SEQ ID NO: 552267 - RNA, 15 nt, Homo sapiens
gcccccucuccuucu

SEQ ID NO: 552268 - RNA, 16 nt, Homo sapiens
gcccccugccagugaa

SEQ ID NO: 552269 - RNA, 21 nt, Homo sapiens
gcccccugggcuggggccuca

SEQ ID NO: 552270 - RNA, 20 nt, Homo sapiens
gcccccuucucccacacugc

SEQ ID NO: 552271 - RNA, 13 nt, Homo sapiens
gccccgacuccag

SEQ ID NO: 552272 - RNA, 14 nt, Homo sapiens
gccccgccacagcc

SEQ ID NO: 552273 - RNA, 13 nt, Homo sapiens
gccccuacugcug

SEQ ID NO: 552274 - RNA, 17 nt, Homo sapiens
gccccuagaaacccaag

SEQ ID NO: 552275 - RNA, 13 nt, Homo sapiens
gccccuccaaacc

SEQ ID NO: 552276 - RNA, 17 nt, Homo sapiens
gccccuccacccaucca

SEQ ID NO: 552277 - RNA, 13 nt, Homo sapiens
gccccuccuugca

SEQ ID NO: 552278 - RNA, 14 nt, Homo sapiens
gccccucucaccaa

SEQ ID NO: 552279 - RNA, 12 nt, Homo sapiens
gccccucugauu

SEQ ID NO: 552280 - RNA, 16 nt, Homo sapiens
gccccugcacaaagcc

SEQ ID NO: 552281 - RNA, 15 nt, Homo sapiens
gccccuggcccagag

SEQ ID NO: 552282 - RNA, 20 nt, Homo sapiens
gccccuguauggcacuggca

SEQ ID NO: 552283 - RNA, 19 nt, Homo sapiens
gccccugucucggggcuug

SEQ ID NO: 552284 - RNA, 16 nt, Homo sapiens
gcccgagcuguuguau

SEQ ID NO: 552285 - RNA, 17 nt, Homo sapiens
gcccgcagcacauuucc

SEQ ID NO: 552286 - RNA, 17 nt, Homo sapiens
ggugcaagaccuagucc

SEQ ID NO: 552287 - RNA, 17 nt, Homo sapiens
ggugcaaucacagcuca

SEQ ID NO: 552288 - RNA, 18 nt, Homo sapiens
ggugcagaugguacugcu

SEQ ID NO: 552289 - RNA, 14 nt, Homo sapiens
ggugcagugccgcu

SEQ ID NO: 552290 - RNA, 15 nt, Homo sapiens
ggugccccacagcua

SEQ ID NO: 552291 - RNA, 15 nt, Homo sapiens
ggugcccuccuaucc

SEQ ID NO: 552292 - RNA, 16 nt, Homo sapiens
ggugccucugugcaca

SEQ ID NO: 552293 - RNA, 23 nt, Homo sapiens
ggugcuacacccuuuuccagcug

SEQ ID NO: 552294 - RNA, 20 nt, Homo sapiens
ggugcuaucgcaccacugug

SEQ ID NO: 552295 - RNA, 17 nt, Homo sapiens
ggugcucuuucccuuua

SEQ ID NO: 552296 - RNA, 17 nt, Homo sapiens
ggugcugcuuucuuguu

SEQ ID NO: 552297 - RNA, 16 nt, Homo sapiens
gguggaaggcagacag

SEQ ID NO: 552298 - RNA, 17 nt, Homo sapiens
gguggagaugaggugcu

SEQ ID NO: 552299 - RNA, 15 nt, Homo sapiens
gguggagcagccaga

SEQ ID NO: 552300 - RNA, 17 nt, Homo sapiens
gguggaggcugcaguga

SEQ ID NO: 552301 - RNA, 20 nt, Homo sapiens
gguggaggguggggggcgcu

SEQ ID NO: 552302 - RNA, 13 nt, Homo sapiens
gguggaugugaug

SEQ ID NO: 552303 - RNA, 20 nt, Homo sapiens
gguggcaaaguacuugucau

SEQ ID NO: 552304 - RNA, 12 nt, Homo sapiens
gguggcaauaaa

SEQ ID NO: 552305 - RNA, 23 nt, Homo sapiens
gguggcagaaucuguuaccagag

SEQ ID NO: 552306 - RNA, 17 nt, Homo sapiens
gguggcccacgccugua

SEQ ID NO: 552307 - RNA, 19 nt, Homo sapiens
gguggccccgacaggucuu

SEQ ID NO: 552308 - RNA, 22 nt, Homo sapiens
gguggcccugacugucagggag

SEQ ID NO: 552309 - RNA, 14 nt, Homo sapiens
gguggcccugugcc

SEQ ID NO: 552310 - RNA, 17 nt, Homo sapiens
gguggcccuugcaguuc

SEQ ID NO: 552311 - RNA, 15 nt, Homo sapiens
gguggcgcgcaccug

SEQ ID NO: 552312 - RNA, 18 nt, Homo sapiens
ggugggaccacagacuca

SEQ ID NO: 552313 - RNA, 22 nt, Homo sapiens
ggugggcccucugaacuugccu

SEQ ID NO: 552314 - RNA, 11 nt, Homo sapiens
gguggggaccu

SEQ ID NO: 552315 - RNA, 23 nt, Homo sapiens
gguggggaccuuggcagugugga

SEQ ID NO: 552316 - RNA, 22 nt, Homo sapiens
gguggggagcaaaucaucugca

SEQ ID NO: 552317 - RNA, 15 nt, Homo sapiens
gguggggugcacucg

SEQ ID NO: 552318 - RNA, 14 nt, Homo sapiens
ggugggguggcacc

SEQ ID NO: 552319 - RNA, 15 nt, Homo sapiens
gguggguggugggcu

SEQ ID NO: 552320 - RNA, 15 nt, Homo sapiens
gguggucugaauguu

SEQ ID NO: 552321 - RNA, 18 nt, Homo sapiens
gguggugaguucugacua

SEQ ID NO: 552322 - RNA, 17 nt, Homo sapiens
gguggugggaaccauga

SEQ ID NO: 552323 - RNA, 16 nt, Homo sapiens
ggugguuuuugcucuc

SEQ ID NO: 552324 - RNA, 24 nt, Homo sapiens
gguguacuuauauccacacugcac

SEQ ID NO: 552325 - RNA, 13 nt, Homo sapiens
gguguagcacuua

SEQ ID NO: 552326 - RNA, 18 nt, Homo sapiens
gguguauugaaguccucc

SEQ ID NO: 552327 - RNA, 17 nt, Homo sapiens
ggugucagucagggaca

SEQ ID NO: 552328 - RNA, 13 nt, Homo sapiens
ggugugaggucca

SEQ ID NO: 552329 - RNA, 17 nt, Homo sapiens
ggugugcaccuguaauc

SEQ ID NO: 552330 - RNA, 17 nt, Homo sapiens
ggugugcccuguacaca

SEQ ID NO: 552331 - RNA, 19 nt, Homo sapiens
ggugugcugagguguuaga

SEQ ID NO: 552332 - RNA, 13 nt, Homo sapiens
gguguggccucag

SEQ ID NO: 552333 - RNA, 20 nt, Homo sapiens
ggugugugugccaugucaca

SEQ ID NO: 552334 - RNA, 14 nt, Homo sapiens
gguguugucgggga

SEQ ID NO: 552335 - RNA, 18 nt, Homo sapiens
gguguuuuaagacugaau

SEQ ID NO: 552336 - RNA, 19 nt, Homo sapiens
gguuaaaaaaaaaagucac

SEQ ID NO: 552337 - RNA, 12 nt, Homo sapiens
gguuaaaggcca

SEQ ID NO: 552338 - RNA, 13 nt, Homo sapiens
gguuaacuuguau

SEQ ID NO: 552339 - RNA, 23 nt, Homo sapiens
gguuaaggccagggccucuccaa

SEQ ID NO: 552340 - RNA, 14 nt, Homo sapiens
gguuaaggggucca

SEQ ID NO: 552341 - RNA, 19 nt, Homo sapiens
gguuaaguuucucuucacc

SEQ ID NO: 552342 - RNA, 13 nt, Homo sapiens
gguuaauccagcu

SEQ ID NO: 552343 - RNA, 22 nt, Homo sapiens
gguuaauggcuaguacuguauu

SEQ ID NO: 552344 - RNA, 18 nt, Homo sapiens
gguuaccaccagccuuuc

SEQ ID NO: 552345 - RNA, 18 nt, Homo sapiens
gguuagagccaagcugca

SEQ ID NO: 552346 - RNA, 24 nt, Homo sapiens
gguuaguagcccuucagucuuaau

SEQ ID NO: 552347 - RNA, 15 nt, Homo sapiens
gguuauagacugcca

SEQ ID NO: 552348 - RNA, 18 nt, Homo sapiens
gguuaucaaaaauuucau

SEQ ID NO: 552349 - RNA, 18 nt, Homo sapiens
gguuauucagaaccuaaa

SEQ ID NO: 552350 - RNA, 18 nt, Homo sapiens
gguuauucuaagcccuuu

SEQ ID NO: 552351 - RNA, 12 nt, Homo sapiens
gguucaagugau

SEQ ID NO: 552352 - RNA, 17 nt, Homo sapiens
gguucaagugugcacug

SEQ ID NO: 552353 - RNA, 21 nt, Homo sapiens
gguucaauuucagaaguaaug

SEQ ID NO: 552354 - RNA, 11 nt, Homo sapiens
gguucacacag

SEQ ID NO: 552355 - RNA, 11 nt, Homo sapiens
gguucacugag

SEQ ID NO: 552356 - RNA, 16 nt, Homo sapiens
gguucagaaaugcugc

SEQ ID NO: 552357 - RNA, 19 nt, Homo sapiens
gguucagcuaagcuaggaa

SEQ ID NO: 552358 - RNA, 17 nt, Homo sapiens
gguucauaucaugaaga

SEQ ID NO: 552359 - RNA, 22 nt, Homo sapiens
gguuccauuuuuccucuguuca

SEQ ID NO: 552360 - RNA, 16 nt, Homo sapiens
gguuccgccacuccag

SEQ ID NO: 552361 - RNA, 18 nt, Homo sapiens
gguucguuuaccaaauag

SEQ ID NO: 552362 - RNA, 18 nt, Homo sapiens
gguucucagguucacuca

SEQ ID NO: 552363 - RNA, 14 nt, Homo sapiens
gguucugccucucc

SEQ ID NO: 552364 - RNA, 23 nt, Homo sapiens
gguucuuccuuucccuggagcug

SEQ ID NO: 552365 - RNA, 14 nt, Homo sapiens
gguucuugagccag

SEQ ID NO: 552366 - RNA, 20 nt, Homo sapiens
gguugaacucugguggcaca

SEQ ID NO: 552367 - RNA, 12 nt, Homo sapiens
gguugacuuucu

SEQ ID NO: 552368 - RNA, 14 nt, Homo sapiens
gguugaucuugcaa

SEQ ID NO: 552369 - RNA, 20 nt, Homo sapiens
gguugauuguuuaagccaga

SEQ ID NO: 552370 - RNA, 12 nt, Homo sapiens
gguugcagucac

SEQ ID NO: 552371 - RNA, 21 nt, Homo sapiens
gguugcagugagccaagauca

SEQ ID NO: 552372 - RNA, 21 nt, Homo sapiens
gguugccaccccaacccaaua

SEQ ID NO: 552373 - RNA, 19 nt, Homo sapiens
gguugccauggagaucuga

SEQ ID NO: 552374 - RNA, 16 nt, Homo sapiens
gguugccucucuugcc

SEQ ID NO: 552375 - RNA, 15 nt, Homo sapiens
gguugggcuggugcu

SEQ ID NO: 552376 - RNA, 18 nt, Homo sapiens
gguuggggugacagucau

SEQ ID NO: 552377 - RNA, 23 nt, Homo sapiens
gguugguuuccccugcacucccg

SEQ ID NO: 552378 - RNA, 17 nt, Homo sapiens
gguuguauaaagcaaaa

SEQ ID NO: 552379 - RNA, 15 nt, Homo sapiens
gguuguuucuguucc

SEQ ID NO: 552380 - RNA, 16 nt, Homo sapiens
gguuuaggauuacuua

SEQ ID NO: 552381 - RNA, 19 nt, Homo sapiens
gguuucaccguguuagcca

SEQ ID NO: 552382 - RNA, 16 nt, Homo sapiens
gguuuccaaagacagu

SEQ ID NO: 552383 - RNA, 22 nt, Homo sapiens
gguuucucucuacagugccaac

SEQ ID NO: 552384 - RNA, 15 nt, Homo sapiens
gguuucuggggucca

SEQ ID NO: 552385 - RNA, 19 nt, Homo sapiens
gguuugaauagacauuucu

SEQ ID NO: 552386 - RNA, 17 nt, Homo sapiens
gguuugacauugcuaag

SEQ ID NO: 552387 - RNA, 23 nt, Homo sapiens
gguuuguguugagcguuugcacg

SEQ ID NO: 552388 - RNA, 15 nt, Homo sapiens
gguuuucauuugcca

SEQ ID NO: 552389 - RNA, 21 nt, Homo sapiens
gguuuuuaucaaauuugccau

SEQ ID NO: 552390 - RNA, 22 nt, Homo sapiens
gguuuuucugauuagagugcaa

SEQ ID NO: 552391 - RNA, 13 nt, Homo sapiens
gguuuuugcaaau

SEQ ID NO: 552392 - RNA, 18 nt, Homo sapiens
gguuuuuguuaccuuuau

SEQ ID NO: 552393 - RNA, 19 nt, Homo sapiens
gguuuuuuucuucuguauu

SEQ ID NO: 552394 - RNA, 20 nt, Homo sapiens
guaaaaaaggagacaguuua

SEQ ID NO: 552395 - RNA, 16 nt, Homo sapiens
guaaaaaggccuccug

SEQ ID NO: 552396 - RNA, 22 nt, Homo sapiens
guaaaacaagaaaugcuuugag

SEQ ID NO: 552397 - RNA, 15 nt, Homo sapiens
guaaaacaaucuguu

SEQ ID NO: 552398 - RNA, 15 nt, Homo sapiens
guaaaacauuacuua

SEQ ID NO: 552399 - RNA, 13 nt, Homo sapiens
guaaaacauucac

SEQ ID NO: 552400 - RNA, 15 nt, Homo sapiens
guaaaacccaaaaca

SEQ ID NO: 552401 - RNA, 21 nt, Homo sapiens
guaaaaccccaucucuacuaa

SEQ ID NO: 552402 - RNA, 17 nt, Homo sapiens
guaaaacuauauucuca

SEQ ID NO: 552403 - RNA, 23 nt, Homo sapiens
guaaaacuauauucucaguguag

SEQ ID NO: 552404 - RNA, 18 nt, Homo sapiens
guaaaagaugaaguuuua

SEQ ID NO: 552405 - RNA, 16 nt, Homo sapiens
guaaaagcuuacacag

SEQ ID NO: 552406 - RNA, 15 nt, Homo sapiens
guaaaagucuaccug

SEQ ID NO: 552407 - RNA, 11 nt, Homo sapiens
guaaaaucacu

SEQ ID NO: 552408 - RNA, 21 nt, Homo sapiens
guauaaaggcuaaaagggaaa

SEQ ID NO: 552409 - RNA, 23 nt, Homo sapiens
guauaaauaaacacacuauggca

SEQ ID NO: 552410 - RNA, 23 nt, Homo sapiens
guauaaauguuauguuugcuaaa

SEQ ID NO: 552411 - RNA, 16 nt, Homo sapiens
guauaagcacugaaaa

SEQ ID NO: 552412 - RNA, 18 nt, Homo sapiens
guauaaugguugacuggg

SEQ ID NO: 552413 - RNA, 19 nt, Homo sapiens
guauaaugguugacugggu

SEQ ID NO: 552414 - RNA, 15 nt, Homo sapiens
guauacacacauaua

SEQ ID NO: 552415 - RNA, 16 nt, Homo sapiens
guauacauacauguau

SEQ ID NO: 552416 - RNA, 19 nt, Homo sapiens
guauaccaccuguacauac

SEQ ID NO: 552417 - RNA, 18 nt, Homo sapiens
guauacguauaaauauca

SEQ ID NO: 552418 - RNA, 17 nt, Homo sapiens
guauacuaagugauaca

SEQ ID NO: 552419 - RNA, 11 nt, Homo sapiens
guauacugugu

SEQ ID NO: 552420 - RNA, 18 nt, Homo sapiens
guauagaauaggcacuuu

SEQ ID NO: 552421 - RNA, 20 nt, Homo sapiens
guauagccuauacugcauua

SEQ ID NO: 552422 - RNA, 22 nt, Homo sapiens
guauaggccaucuguaaauauc

SEQ ID NO: 552423 - RNA, 23 nt, Homo sapiens
guauaguguucacaaacugugaa

SEQ ID NO: 552424 - RNA, 18 nt, Homo sapiens
guauauaaauacaugcac

SEQ ID NO: 552425 - RNA, 16 nt, Homo sapiens
guauauaauaugucac

SEQ ID NO: 552426 - RNA, 22 nt, Homo sapiens
guauauagagauuguacauuua

SEQ ID NO: 552427 - RNA, 15 nt, Homo sapiens
guauauauauauagu

SEQ ID NO: 552428 - RNA, 18 nt, Homo sapiens
guauaucacauaauucca

SEQ ID NO: 552429 - RNA, 22 nt, Homo sapiens
guauaucaugaaacacuucuca

SEQ ID NO: 552430 - RNA, 17 nt, Homo sapiens
guauauccuguauacuu

SEQ ID NO: 552431 - RNA, 15 nt, Homo sapiens
guauauuugucauga

SEQ ID NO: 552432 - RNA, 15 nt, Homo sapiens
guaucaaaugugaca

SEQ ID NO: 552433 - RNA, 14 nt, Homo sapiens
guaucaacacuguu

SEQ ID NO: 552434 - RNA, 20 nt, Homo sapiens
guaucaauggagcaugugug

SEQ ID NO: 552435 - RNA, 15 nt, Homo sapiens
guaucacaguguuuu

SEQ ID NO: 552436 - RNA, 20 nt, Homo sapiens
guaucacuuuaacucaggag

SEQ ID NO: 552437 - RNA, 21 nt, Homo sapiens
guaucagaucuaucuugucaa

SEQ ID NO: 552438 - RNA, 15 nt, Homo sapiens
guaucaggacccaga

SEQ ID NO: 552439 - RNA, 18 nt, Homo sapiens
guaucauauuaacauauu

SEQ ID NO: 552440 - RNA, 16 nt, Homo sapiens
guaucaucagugccuc

SEQ ID NO: 552441 - RNA, 16 nt, Homo sapiens
guauccagaagccagu

SEQ ID NO: 552442 - RNA, 23 nt, Homo sapiens
guauccaugcaccuaccuuagaa

SEQ ID NO: 552443 - RNA, 18 nt, Homo sapiens
guaucccgagucugggac

SEQ ID NO: 552444 - RNA, 16 nt, Homo sapiens
guaucccugcucugcu

SEQ ID NO: 552445 - RNA, 13 nt, Homo sapiens
guauccugcagcg

SEQ ID NO: 552446 - RNA, 13 nt, Homo sapiens
guauccugugaca

SEQ ID NO: 552447 - RNA, 17 nt, Homo sapiens
guauccugugacaugua

SEQ ID NO: 552448 - RNA, 17 nt, Homo sapiens
guaucucaguaccccau

SEQ ID NO: 552449 - RNA, 21 nt, Homo sapiens
guaucucuuuugaauccaugc

SEQ ID NO: 552450 - RNA, 22 nt, Homo sapiens
guaucugcucauuuugacaaag

SEQ ID NO: 552451 - RNA, 23 nt, Homo sapiens
guaucugucuuuccacucuggau

SEQ ID NO: 552452 - RNA, 23 nt, Homo sapiens
guaucuuaaaaaucuaugccuaa

SEQ ID NO: 552453 - RNA, 17 nt, Homo sapiens
guaucuucaaacuuuca

SEQ ID NO: 552454 - RNA, 18 nt, Homo sapiens
guaugaaggaaucauucc

SEQ ID NO: 552455 - RNA, 15 nt, Homo sapiens
guaugaaugcagugg

SEQ ID NO: 552456 - RNA, 15 nt, Homo sapiens
guaugaauuauucaa

SEQ ID NO: 552457 - RNA, 15 nt, Homo sapiens
guaugacugcacaug

SEQ ID NO: 552458 - RNA, 15 nt, Homo sapiens
guaugacuucugcug

SEQ ID NO: 552459 - RNA, 15 nt, Homo sapiens
guaugagucaaugug

SEQ ID NO: 552460 - RNA, 20 nt, Homo sapiens
guaugaugcuaaucuugucc

SEQ ID NO: 552461 - RNA, 15 nt, Homo sapiens
guaugcaaaccucau

SEQ ID NO: 552462 - RNA, 20 nt, Homo sapiens
guaugcagaaggcuacauau

SEQ ID NO: 552463 - RNA, 18 nt, Homo sapiens
guaugcauucacauuuag

SEQ ID NO: 552464 - RNA, 19 nt, Homo sapiens
guaugcauuuuauacaugu

SEQ ID NO: 552465 - RNA, 13 nt, Homo sapiens
guaugcuggccag

SEQ ID NO: 552466 - RNA, 18 nt, Homo sapiens
guauggcguugguuugug

SEQ ID NO: 552467 - RNA, 17 nt, Homo sapiens
guauggcuaauaccugu

SEQ ID NO: 552468 - RNA, 15 nt, Homo sapiens
guaugggaagccaua

SEQ ID NO: 552469 - RNA, 22 nt, Homo sapiens
guauguaaaucuucauggugau

SEQ ID NO: 552470 - RNA, 18 nt, Homo sapiens
guauguacaauacaaugu

SEQ ID NO: 552471 - RNA, 17 nt, Homo sapiens
guauguacuaagcagua

SEQ ID NO: 552472 - RNA, 16 nt, Homo sapiens
guaugucagugucacu

SEQ ID NO: 552473 - RNA, 15 nt, Homo sapiens
guauguccuuuucug

SEQ ID NO: 552474 - RNA, 22 nt, Homo sapiens
guaugucuacacguaaguauaa

SEQ ID NO: 552475 - RNA, 16 nt, Homo sapiens
guaugugcacugucac

SEQ ID NO: 552476 - RNA, 12 nt, Homo sapiens
guaugugcauua

SEQ ID NO: 552477 - RNA, 15 nt, Homo sapiens
guaugugccaaagcu

SEQ ID NO: 552478 - RNA, 18 nt, Homo sapiens
guauguguaaaacaaucu

SEQ ID NO: 552479 - RNA, 14 nt, Homo sapiens
guauguguguauau

SEQ ID NO: 552480 - RNA, 15 nt, Homo sapiens
guauguuauugcaua

SEQ ID NO: 552481 - RNA, 21 nt, Homo sapiens
guauguucccucuugucccuu

SEQ ID NO: 552482 - RNA, 21 nt, Homo sapiens
guauguucguugcagcacugc

SEQ ID NO: 552483 - RNA, 19 nt, Homo sapiens
guauguucuaaccuuuaca

SEQ ID NO: 552484 - RNA, 14 nt, Homo sapiens
guauuaaaaagccu

SEQ ID NO: 552485 - RNA, 13 nt, Homo sapiens
guauuaaagacag

SEQ ID NO: 552486 - RNA, 15 nt, Homo sapiens
guauuaaguuguuaa

SEQ ID NO: 552487 - RNA, 22 nt, Homo sapiens
guauuaauaaagcauucuuuaa

SEQ ID NO: 552488 - RNA, 14 nt, Homo sapiens
guauuacacuguau

SEQ ID NO: 552489 - RNA, 17 nt, Homo sapiens
guauuacagcuuucaca

SEQ ID NO: 552490 - RNA, 24 nt, Homo sapiens
guauuacccuccuaauagucauac

SEQ ID NO: 552491 - RNA, 13 nt, Homo sapiens
guauuacugcugc

SEQ ID NO: 552492 - RNA, 12 nt, Homo sapiens
guauuacugcuu

SEQ ID NO: 552493 - RNA, 13 nt, Homo sapiens
guauuacuuccuc

SEQ ID NO: 552494 - RNA, 19 nt, Homo sapiens
guauuauaauuguugauau

SEQ ID NO: 552495 - RNA, 22 nt, Homo sapiens
guauuauuacggagacuuucaa

SEQ ID NO: 552496 - RNA, 22 nt, Homo sapiens
guauuauuuuacaaucaacaaa

SEQ ID NO: 552497 - RNA, 21 nt, Homo sapiens
guauucccacucaccagcccu

SEQ ID NO: 552498 - RNA, 19 nt, Homo sapiens
guauuccgauacaaagugu

SEQ ID NO: 552499 - RNA, 21 nt, Homo sapiens
guauuccuuuauacacagugg

SEQ ID NO: 552500 - RNA, 21 nt, Homo sapiens
guauucuagugaaugaaucuc

SEQ ID NO: 552501 - RNA, 13 nt, Homo sapiens
guauucucagagc

SEQ ID NO: 552502 - RNA, 16 nt, Homo sapiens
guauucucucuaugca

SEQ ID NO: 552503 - RNA, 16 nt, Homo sapiens
guauucucuuccucau

SEQ ID NO: 552504 - RNA, 16 nt, Homo sapiens
guauucuucaaccagu

SEQ ID NO: 552505 - RNA, 17 nt, Homo sapiens
guauucuucaaccagug

SEQ ID NO: 552506 - RNA, 18 nt, Homo sapiens
guauucuuuuccaagcuc

SEQ ID NO: 552507 - RNA, 15 nt, Homo sapiens
guauugaaaacacuu

SEQ ID NO: 552508 - RNA, 16 nt, Homo sapiens
guauugaaaacacuua

SEQ ID NO: 552509 - RNA, 18 nt, Homo sapiens
guauugaaauguuugcau

SEQ ID NO: 552510 - RNA, 18 nt, Homo sapiens
guauugacaggaauacuu

SEQ ID NO: 552511 - RNA, 18 nt, Homo sapiens
guauugagggccagugau

SEQ ID NO: 552512 - RNA, 12 nt, Homo sapiens
guauugcaccuu

SEQ ID NO: 552513 - RNA, 17 nt, Homo sapiens
guauugucuacucugaa

SEQ ID NO: 552514 - RNA, 16 nt, Homo sapiens
guauuuaauucuucac

SEQ ID NO: 552515 - RNA, 15 nt, Homo sapiens
guauuuacagacaca

SEQ ID NO: 552516 - RNA, 17 nt, Homo sapiens
guauuuagcugccaaau

SEQ ID NO: 552517 - RNA, 14 nt, Homo sapiens
guauuuaggggcaa

SEQ ID NO: 552518 - RNA, 15 nt, Homo sapiens
guauuucacagagca

SEQ ID NO: 552519 - RNA, 14 nt, Homo sapiens
guauuucagccaug

SEQ ID NO: 552520 - RNA, 19 nt, Homo sapiens
guauuuccagugcaauugu

SEQ ID NO: 552521 - RNA, 20 nt, Homo sapiens
guauuugaaauaagaauuca

SEQ ID NO: 552522 - RNA, 16 nt, Homo sapiens
guauuugcugccagac

SEQ ID NO: 552523 - RNA, 22 nt, Homo sapiens
guauuuggcuugucacaggaau

SEQ ID NO: 552524 - RNA, 21 nt, Homo sapiens
guauuuguuccugccacugug

SEQ ID NO: 552525 - RNA, 15 nt, Homo sapiens
guauuuuaacuacuu

SEQ ID NO: 552526 - RNA, 16 nt, Homo sapiens
guauuuuacuuuucca

SEQ ID NO: 552527 - RNA, 15 nt, Homo sapiens
guauuuuaugaucuu

SEQ ID NO: 552528 - RNA, 19 nt, Homo sapiens
guauuuuccuggauuuaua

SEQ ID NO: 552529 - RNA, 20 nt, Homo sapiens
guauuuuguuuuugucuuaa

SEQ ID NO: 552530 - RNA, 22 nt, Homo sapiens
gucugugcauuucugguugcac

SEQ ID NO: 552531 - RNA, 19 nt, Homo sapiens
gucugugucagcgggugca

SEQ ID NO: 552532 - RNA, 20 nt, Homo sapiens
gucugugugguggagccagg

SEQ ID NO: 552533 - RNA, 15 nt, Homo sapiens
gucuguuacacugga

SEQ ID NO: 552534 - RNA, 20 nt, Homo sapiens
gucuguuuauuaacuacuga

SEQ ID NO: 552535 - RNA, 12 nt, Homo sapiens
gucuguuugcaa

SEQ ID NO: 552536 - RNA, 18 nt, Homo sapiens
gucuguuuggacugcaga

SEQ ID NO: 552537 - RNA, 19 nt, Homo sapiens
gucuguuuggacugcagaa

SEQ ID NO: 552538 - RNA, 15 nt, Homo sapiens
gucuguuuguuguau

SEQ ID NO: 552539 - RNA, 17 nt, Homo sapiens
gucuuaaagcauuucag

SEQ ID NO: 552540 - RNA, 13 nt, Homo sapiens
gucuuagcaagaa

SEQ ID NO: 552541 - RNA, 12 nt, Homo sapiens
gucuuagugcaa

SEQ ID NO: 552542 - RNA, 15 nt, Homo sapiens
gucuuaucauuugaa

SEQ ID NO: 552543 - RNA, 14 nt, Homo sapiens
gucuuauccuccac

SEQ ID NO: 552544 - RNA, 19 nt, Homo sapiens
gucuucaaggaucuccugu

SEQ ID NO: 552545 - RNA, 14 nt, Homo sapiens
gucuucagacccag

SEQ ID NO: 552546 - RNA, 23 nt, Homo sapiens
gucuucagccuagccgaccucag

SEQ ID NO: 552547 - RNA, 17 nt, Homo sapiens
gucuucagggaagguca

SEQ ID NO: 552548 - RNA, 21 nt, Homo sapiens
gucuucaguuuccgaaucucu

SEQ ID NO: 552549 - RNA, 17 nt, Homo sapiens
gucuuccaggcacucaa

SEQ ID NO: 552550 - RNA, 20 nt, Homo sapiens
gucuuccaggcacucaaaag

SEQ ID NO: 552551 - RNA, 9 nt, Homo sapiens
gucuucccc

SEQ ID NO: 552552 - RNA, 14 nt, Homo sapiens
gucuucccuaccuc

SEQ ID NO: 552553 - RNA, 23 nt, Homo sapiens
gucuuccuuagcuaaaugcaauu

SEQ ID NO: 552554 - RNA, 16 nt, Homo sapiens
gucuuccuuguggaau

SEQ ID NO: 552555 - RNA, 17 nt, Homo sapiens
gucuucuagcugcagau

SEQ ID NO: 552556 - RNA, 16 nt, Homo sapiens
gucuucucucucugcu

SEQ ID NO: 552557 - RNA, 17 nt, Homo sapiens
gucuucugccuguuaua

SEQ ID NO: 552558 - RNA, 20 nt, Homo sapiens
gucuucugcuguucuucacu

SEQ ID NO: 552559 - RNA, 22 nt, Homo sapiens
gucuucuuuuguggugucuucc

SEQ ID NO: 552560 - RNA, 16 nt, Homo sapiens
gucuugacucauggca

SEQ ID NO: 552561 - RNA, 20 nt, Homo sapiens
gucuuggggacuaacccaau

SEQ ID NO: 552562 - RNA, 18 nt, Homo sapiens
gucuuggggccacuuuca

SEQ ID NO: 552563 - RNA, 14 nt, Homo sapiens
gucuuggugcuauc

SEQ ID NO: 552564 - RNA, 17 nt, Homo sapiens
gucuugguucuaaaggu

SEQ ID NO: 552565 - RNA, 17 nt, Homo sapiens
gucuuguguauuugucu

SEQ ID NO: 552566 - RNA, 22 nt, Homo sapiens
gucuuuagggguugggcuggau

SEQ ID NO: 552567 - RNA, 20 nt, Homo sapiens
gucuuucacagcuccuccca

SEQ ID NO: 552568 - RNA, 21 nt, Homo sapiens
gucuuucacuggaaugaagac

SEQ ID NO: 552569 - RNA, 21 nt, Homo sapiens
gucuuucccauuucuaccuaa

SEQ ID NO: 552570 - RNA, 19 nt, Homo sapiens
gucuuuccuaaggcugcaa

SEQ ID NO: 552571 - RNA, 20 nt, Homo sapiens
gucuuuccugaaccaugugg

SEQ ID NO: 552572 - RNA, 19 nt, Homo sapiens
gucuuucugaauugcacau

SEQ ID NO: 552573 - RNA, 13 nt, Homo sapiens
gucuuucugacau

SEQ ID NO: 552574 - RNA, 23 nt, Homo sapiens
gucuuucugacaucagcagagaa

SEQ ID NO: 552575 - RNA, 21 nt, Homo sapiens
gucuuugcaccaaagaugucc

SEQ ID NO: 552576 - RNA, 18 nt, Homo sapiens
gucuuugcagggcacaga

SEQ ID NO: 552577 - RNA, 21 nt, Homo sapiens
gucuuuucauugcuaccucua

SEQ ID NO: 552578 - RNA, 17 nt, Homo sapiens
gucuuuuccacuccuau

SEQ ID NO: 552579 - RNA, 17 nt, Homo sapiens
gucuuuuuuauguuaaa

SEQ ID NO: 552580 - RNA, 17 nt, Homo sapiens
gugaaaauccaucucau

SEQ ID NO: 552581 - RNA, 13 nt, Homo sapiens
gugaaaaugccac

SEQ ID NO: 552582 - RNA, 20 nt, Homo sapiens
gugaaaauuuuuacauucau

SEQ ID NO: 552583 - RNA, 20 nt, Homo sapiens
gugaaacacacaauguggac

SEQ ID NO: 552584 - RNA, 21 nt, Homo sapiens
gugaaaccccaucucuacuaa

SEQ ID NO: 552585 - RNA, 17 nt, Homo sapiens
gugaaaccucaucucua

SEQ ID NO: 552586 - RNA, 13 nt, Homo sapiens
gugaaacugcugu

SEQ ID NO: 552587 - RNA, 17 nt, Homo sapiens
gugaaacuugugcuaua

SEQ ID NO: 552588 - RNA, 14 nt, Homo sapiens
gugaaagacaauaa

SEQ ID NO: 552589 - RNA, 15 nt, Homo sapiens
gugaaaggugcuaua

SEQ ID NO: 552590 - RNA, 14 nt, Homo sapiens
gugaaaucaaugug

SEQ ID NO: 552591 - RNA, 21 nt, Homo sapiens
gugaaaugcuuuuauauucua

SEQ ID NO: 552592 - RNA, 17 nt, Homo sapiens
gugaaauuaagcauuuu

SEQ ID NO: 552593 - RNA, 16 nt, Homo sapiens
gugaaauuacuucugg

SEQ ID NO: 552594 - RNA, 17 nt, Homo sapiens
gugaaauucaguuauaa

SEQ ID NO: 552595 - RNA, 19 nt, Homo sapiens
gugaaauuugccucugucc

SEQ ID NO: 552596 - RNA, 19 nt, Homo sapiens
gugaacaaagcagccacga

SEQ ID NO: 552597 - RNA, 18 nt, Homo sapiens
gugaacacuagccagaca

SEQ ID NO: 552598 - RNA, 19 nt, Homo sapiens
gugaacauucccagcccag

SEQ ID NO: 552599 - RNA, 19 nt, Homo sapiens
gugaacauuuuuuauuuga

SEQ ID NO: 552600 - RNA, 13 nt, Homo sapiens
gugaaccaaagag

SEQ ID NO: 552601 - RNA, 15 nt, Homo sapiens
gugaaccaucauuau

SEQ ID NO: 552602 - RNA, 19 nt, Homo sapiens
gugaacgcugugaugcugu

SEQ ID NO: 552603 - RNA, 19 nt, Homo sapiens
gugaacuagggaagcucag

SEQ ID NO: 552604 - RNA, 13 nt, Homo sapiens
gugaacugugcau

SEQ ID NO: 552605 - RNA, 14 nt, Homo sapiens
gugaacuuacacuu

SEQ ID NO: 552606 - RNA, 21 nt, Homo sapiens
gugaagaacacuacugcuaaa

SEQ ID NO: 552607 - RNA, 22 nt, Homo sapiens
gugaagaggcugcuucucuaca

SEQ ID NO: 552608 - RNA, 18 nt, Homo sapiens
gugaagcagcacugugag

SEQ ID NO: 552609 - RNA, 17 nt, Homo sapiens
gugaagcucacacugau

SEQ ID NO: 552610 - RNA, 18 nt, Homo sapiens
gugaagggagagccagcu

SEQ ID NO: 552611 - RNA, 20 nt, Homo sapiens
gugaaggugguggggcugcc

SEQ ID NO: 552612 - RNA, 16 nt, Homo sapiens
gugaagugaaucugau

SEQ ID NO: 552613 - RNA, 18 nt, Homo sapiens
gugaauaaaaacccugua

SEQ ID NO: 552614 - RNA, 15 nt, Homo sapiens
gugaauaaaccauca

SEQ ID NO: 552615 - RNA, 16 nt, Homo sapiens
gugaauaaccacuuaa

SEQ ID NO: 552616 - RNA, 22 nt, Homo sapiens
gugaauacugcuacagcaauuu

SEQ ID NO: 552617 - RNA, 22 nt, Homo sapiens
gugaauacuuacuauaauuuga

SEQ ID NO: 552618 - RNA, 15 nt, Homo sapiens
gugaaugaaucucaa

SEQ ID NO: 552619 - RNA, 17 nt, Homo sapiens
gugaaugagaaaggugu

SEQ ID NO: 552620 - RNA, 16 nt, Homo sapiens
gugaaugauucagugu

SEQ ID NO: 552621 - RNA, 14 nt, Homo sapiens
gugaauuaggcugu

SEQ ID NO: 552622 - RNA, 16 nt, Homo sapiens
gugaauuaggcuguaa

SEQ ID NO: 552623 - RNA, 21 nt, Homo sapiens
gugaauuaggcuguaacuacu

SEQ ID NO: 552624 - RNA, 19 nt, Homo sapiens
gugaauuauugacacugaa

SEQ ID NO: 552625 - RNA, 14 nt, Homo sapiens
gugaauugacccau

SEQ ID NO: 552626 - RNA, 15 nt, Homo sapiens
gugaauuucuucacu

SEQ ID NO: 552627 - RNA, 13 nt, Homo sapiens
gugacaacaugcg

SEQ ID NO: 552628 - RNA, 23 nt, Homo sapiens
gugacaaccgaguggcugucauc

SEQ ID NO: 552629 - RNA, 17 nt, Homo sapiens
gugacagaaucuuguau

SEQ ID NO: 552630 - RNA, 17 nt, Homo sapiens
gugacagacuuuggaca

SEQ ID NO: 552631 - RNA, 11 nt, Homo sapiens
gugacagucau

SEQ ID NO: 552632 - RNA, 12 nt, Homo sapiens
gugacaugaagc

SEQ ID NO: 552633 - RNA, 18 nt, Homo sapiens
gugacaugcggcugccca

SEQ ID NO: 552634 - RNA, 18 nt, Homo sapiens
gugacauugcuggucauc

SEQ ID NO: 552635 - RNA, 14 nt, Homo sapiens
gugaccagggguga

SEQ ID NO: 552636 - RNA, 22 nt, Homo sapiens
gugacccccuucccgggcugca

SEQ ID NO: 552637 - RNA, 22 nt, Homo sapiens
gugaccccucagggguuucauu

SEQ ID NO: 552638 - RNA, 21 nt, Homo sapiens
gugaccccuccccagugccuc

SEQ ID NO: 552639 - RNA, 16 nt, Homo sapiens
gugaccgggggcugcu

SEQ ID NO: 552640 - RNA, 16 nt, Homo sapiens
gugaccguuugcuaua

SEQ ID NO: 552641 - RNA, 14 nt, Homo sapiens
gugaccuccacagc

SEQ ID NO: 552642 - RNA, 19 nt, Homo sapiens
gugaccuggaaucagugaa

SEQ ID NO: 552643 - RNA, 18 nt, Homo sapiens
gugacuccugaagggaag

SEQ ID NO: 552644 - RNA, 15 nt, Homo sapiens
gugacuucacuguau

SEQ ID NO: 552645 - RNA, 21 nt, Homo sapiens
gugacuugaacuagauugcau

SEQ ID NO: 552646 - RNA, 14 nt, Homo sapiens
gugacuuguucuga

SEQ ID NO: 552647 - RNA, 15 nt, Homo sapiens
gugagaaauagcuga

SEQ ID NO: 552648 - RNA, 21 nt, Homo sapiens
gugagaagcugaggccuaugc

SEQ ID NO: 552649 - RNA, 20 nt, Homo sapiens
gugagaaucaaaacucuccu

SEQ ID NO: 552650 - RNA, 23 nt, Homo sapiens
gugagacaguuuacuuugccaac

SEQ ID NO: 552651 - RNA, 15 nt, Homo sapiens
gugagagaaucugcc

SEQ ID NO: 552652 - RNA, 20 nt, Homo sapiens
uagaaucagccuagggguca

SEQ ID NO: 552653 - RNA, 14 nt, Homo sapiens
uagaauugcacaua

SEQ ID NO: 552654 - RNA, 17 nt, Homo sapiens
uagaauuuugaguauuc

SEQ ID NO: 552655 - RNA, 19 nt, Homo sapiens
uagaauuuugaguauucca

SEQ ID NO: 552656 - RNA, 17 nt, Homo sapiens
uagacaagcaagugcac

SEQ ID NO: 552657 - RNA, 21 nt, Homo sapiens
uagacaauccccacauaccau

SEQ ID NO: 552658 - RNA, 14 nt, Homo sapiens
uagacaccuagaaa

SEQ ID NO: 552659 - RNA, 16 nt, Homo sapiens
uagacagaguugcuua

SEQ ID NO: 552660 - RNA, 21 nt, Homo sapiens
uagacaucuaccuauacuuaa

SEQ ID NO: 552661 - RNA, 14 nt, Homo sapiens
uagaccaccuaaua

SEQ ID NO: 552662 - RNA, 19 nt, Homo sapiens
uagaccaccuaauaucaau

SEQ ID NO: 552663 - RNA, 15 nt, Homo sapiens
uagaccuauacugaa

SEQ ID NO: 552664 - RNA, 22 nt, Homo sapiens
uagaccuccacacccgugagaa

SEQ ID NO: 552665 - RNA, 12 nt, Homo sapiens
uagaccuuggca

SEQ ID NO: 552666 - RNA, 13 nt, Homo sapiens
uagacuacauuua

SEQ ID NO: 552667 - RNA, 15 nt, Homo sapiens
uagacucauucuuca

SEQ ID NO: 552668 - RNA, 24 nt, Homo sapiens
uagacuccuuugcuaaugcuaugc

SEQ ID NO: 552669 - RNA, 22 nt, Homo sapiens
uagacugagguauaaagacaag

SEQ ID NO: 552670 - RNA, 23 nt, Homo sapiens
uagacugccaugcuagacaagcu

SEQ ID NO: 552671 - RNA, 14 nt, Homo sapiens
uagacuguuucaca

SEQ ID NO: 552672 - RNA, 20 nt, Homo sapiens
uagacuguuucacauugcac

SEQ ID NO: 552673 - RNA, 21 nt, Homo sapiens
uagacuguuucacauugcacu

SEQ ID NO: 552674 - RNA, 19 nt, Homo sapiens
uagacuuucuuaucacuua

SEQ ID NO: 552675 - RNA, 15 nt, Homo sapiens
uagagaaaugaauua

SEQ ID NO: 552676 - RNA, 16 nt, Homo sapiens
uagagaacucuuucau

SEQ ID NO: 552677 - RNA, 19 nt, Homo sapiens
uagagaaguuacacagaaa

SEQ ID NO: 552678 - RNA, 16 nt, Homo sapiens
uagagacuucacccgg

SEQ ID NO: 552679 - RNA, 23 nt, Homo sapiens
uagagagauuggccagcaaaaac

SEQ ID NO: 552680 - RNA, 20 nt, Homo sapiens
uagagagcuuuucacuguga

SEQ ID NO: 552681 - RNA, 21 nt, Homo sapiens
uagagaggacaauacuggggu

SEQ ID NO: 552682 - RNA, 19 nt, Homo sapiens
uagagagggaaggucucag

SEQ ID NO: 552683 - RNA, 14 nt, Homo sapiens
uagagaguuaugaa

SEQ ID NO: 552684 - RNA, 22 nt, Homo sapiens
uagagauggggucucacagugu

SEQ ID NO: 552685 - RNA, 19 nt, Homo sapiens
uagagaugugucuauggcu

SEQ ID NO: 552686 - RNA, 17 nt, Homo sapiens
uagagcaaccuauauaa

SEQ ID NO: 552687 - RNA, 13 nt, Homo sapiens
uagagcagacagg

SEQ ID NO: 552688 - RNA, 21 nt, Homo sapiens
uagagcagccucguggagcuc

SEQ ID NO: 552689 - RNA, 12 nt, Homo sapiens
uagagccagcuu

SEQ ID NO: 552690 - RNA, 16 nt, Homo sapiens
uagagcuagauguguc

SEQ ID NO: 552691 - RNA, 19 nt, Homo sapiens
uagagcuagaugugucuua

SEQ ID NO: 552692 - RNA, 16 nt, Homo sapiens
uagagcucgccacgaa

SEQ ID NO: 552693 - RNA, 17 nt, Homo sapiens
uagagcugagagucuga

SEQ ID NO: 552694 - RNA, 16 nt, Homo sapiens
uagagcugagcacuuu

SEQ ID NO: 552695 - RNA, 16 nt, Homo sapiens
uagagcugcagggugg

SEQ ID NO: 552696 - RNA, 20 nt, Homo sapiens
uagagcuggaggcuguggga

SEQ ID NO: 552697 - RNA, 16 nt, Homo sapiens
uagagcuuagcauauc

SEQ ID NO: 552698 - RNA, 23 nt, Homo sapiens
uagaggaauccauguaaauugca

SEQ ID NO: 552699 - RNA, 20 nt, Homo sapiens
uagaggauuaguaagaucuc

SEQ ID NO: 552700 - RNA, 13 nt, Homo sapiens
uagaggcagugag

SEQ ID NO: 552701 - RNA, 17 nt, Homo sapiens
uagaggcuagcuucugc

SEQ ID NO: 552702 - RNA, 21 nt, Homo sapiens
uagaggggcucugggagacuu

SEQ ID NO: 552703 - RNA, 15 nt, Homo sapiens
uagagggggucucag

SEQ ID NO: 552704 - RNA, 23 nt, Homo sapiens
uagaggguagcuguggcuucuag

SEQ ID NO: 552705 - RNA, 21 nt, Homo sapiens
uagaggguugcugccuuucaa

SEQ ID NO: 552706 - RNA, 15 nt, Homo sapiens
uagaguauaccuccu

SEQ ID NO: 552707 - RNA, 14 nt, Homo sapiens
uagaguauaugcac

SEQ ID NO: 552708 - RNA, 16 nt, Homo sapiens
uagaguaucacuccca

SEQ ID NO: 552709 - RNA, 22 nt, Homo sapiens
uagaguaucacucccacuuccu

SEQ ID NO: 552710 - RNA, 16 nt, Homo sapiens
uagagucaauuugcug

SEQ ID NO: 552711 - RNA, 21 nt, Homo sapiens
uagagucacugauacacagaa

SEQ ID NO: 552712 - RNA, 18 nt, Homo sapiens
uagagucauguuugcacu

SEQ ID NO: 552713 - RNA, 12 nt, Homo sapiens
uagagugcaaug

SEQ ID NO: 552714 - RNA, 13 nt, Homo sapiens
uagaguggugcug

SEQ ID NO: 552715 - RNA, 15 nt, Homo sapiens
uagaguggugcugcu

SEQ ID NO: 552716 - RNA, 17 nt, Homo sapiens
uagaguguuguugcuga

SEQ ID NO: 552717 - RNA, 14 nt, Homo sapiens
uagaguuggauuaa

SEQ ID NO: 552718 - RNA, 17 nt, Homo sapiens
uagaguuucuguuugau

SEQ ID NO: 552719 - RNA, 20 nt, Homo sapiens
uagauaaacuauacacuuaa

SEQ ID NO: 552720 - RNA, 22 nt, Homo sapiens
uagauaauuuauuauacaccuu

SEQ ID NO: 552721 - RNA, 21 nt, Homo sapiens
uagauaauuucagggugcagc

SEQ ID NO: 552722 - RNA, 17 nt, Homo sapiens
uagauauaacacuaugu

SEQ ID NO: 552723 - RNA, 14 nt, Homo sapiens
uagauaugccuuaa

SEQ ID NO: 552724 - RNA, 17 nt, Homo sapiens
uagauauguuaagcaug

SEQ ID NO: 552725 - RNA, 22 nt, Homo sapiens
uagauauuaaaaguuaagcaaa

SEQ ID NO: 552726 - RNA, 16 nt, Homo sapiens
uagaucaacagaucaa

SEQ ID NO: 552727 - RNA, 19 nt, Homo sapiens
uagaucagaagacuacaaa

SEQ ID NO: 552728 - RNA, 16 nt, Homo sapiens
uagaucaucagucacc

SEQ ID NO: 552729 - RNA, 17 nt, Homo sapiens
uagaucccaugucaccu

SEQ ID NO: 552730 - RNA, 19 nt, Homo sapiens
uagaucccaugucaccuca

SEQ ID NO: 552731 - RNA, 20 nt, Homo sapiens
uagauccugguuaccacucu

SEQ ID NO: 552732 - RNA, 21 nt, Homo sapiens
uagaugccucgcucuuuucaa

SEQ ID NO: 552733 - RNA, 15 nt, Homo sapiens
uagauggaccugccu

SEQ ID NO: 552734 - RNA, 16 nt, Homo sapiens
uagauggaguuucacu

SEQ ID NO: 552735 - RNA, 17 nt, Homo sapiens
uagauguauauauuucc

SEQ ID NO: 552736 - RNA, 16 nt, Homo sapiens
uagauguaugcacaca

SEQ ID NO: 552737 - RNA, 22 nt, Homo sapiens
uagauguaugcacacacauaua

SEQ ID NO: 552738 - RNA, 23 nt, Homo sapiens
uagauguaugcacacacauauau

SEQ ID NO: 552739 - RNA, 15 nt, Homo sapiens
uagauuaauacucua

SEQ ID NO: 552740 - RNA, 13 nt, Homo sapiens
uagauucaccugu

SEQ ID NO: 552741 - RNA, 23 nt, Homo sapiens
uagauuccucuugccucucucag

SEQ ID NO: 552742 - RNA, 20 nt, Homo sapiens
uagauuguccuuuugcaaag

SEQ ID NO: 552743 - RNA, 20 nt, Homo sapiens
uagauuguuuugccacuuag

SEQ ID NO: 552744 - RNA, 18 nt, Homo sapiens
uagauuuauuuuuccauc

SEQ ID NO: 552745 - RNA, 17 nt, Homo sapiens
uagauuucuaaugaaga

SEQ ID NO: 552746 - RNA, 17 nt, Homo sapiens
uagauuuguacaggagu

SEQ ID NO: 552747 - RNA, 22 nt, Homo sapiens
uagcaaaaacauguaugugcau

SEQ ID NO: 552748 - RNA, 14 nt, Homo sapiens
uagcaaaauugagg

SEQ ID NO: 552749 - RNA, 21 nt, Homo sapiens
uagcaaauggcagaaccaaag

SEQ ID NO: 552750 - RNA, 17 nt, Homo sapiens
uagcaagacacaucccu

SEQ ID NO: 552751 - RNA, 15 nt, Homo sapiens
uagcaagaccugaaa

SEQ ID NO: 552752 - RNA, 17 nt, Homo sapiens
uagcaagagugugaaau

SEQ ID NO: 552753 - RNA, 15 nt, Homo sapiens
uagcaagaugcaaau

SEQ ID NO: 552754 - RNA, 22 nt, Homo sapiens
uagcaaugugccuugauugauu

SEQ ID NO: 552755 - RNA, 16 nt, Homo sapiens
uagcacaaacuacaau

SEQ ID NO: 552756 - RNA, 13 nt, Homo sapiens
uagcacaccucau

SEQ ID NO: 552757 - RNA, 19 nt, Homo sapiens
uagcacagagagggacaca

SEQ ID NO: 552758 - RNA, 19 nt, Homo sapiens
uagcacggccaccucucag

SEQ ID NO: 552759 - RNA, 14 nt, Homo sapiens
uagcacuauuuaca

SEQ ID NO: 552760 - RNA, 10 nt, Homo sapiens
uagcacugag

SEQ ID NO: 552761 - RNA, 12 nt, Homo sapiens
uagcacuuugcg

SEQ ID NO: 552762 - RNA, 14 nt, Homo sapiens
uagcagacaggccc

SEQ ID NO: 552763 - RNA, 14 nt, Homo sapiens
uagcagacaguguu

SEQ ID NO: 552764 - RNA, 20 nt, Homo sapiens
uagcagaggagccauguccu

SEQ ID NO: 552765 - RNA, 23 nt, Homo sapiens
uagcagaguccuuauucuucuca

SEQ ID NO: 552766 - RNA, 22 nt, Homo sapiens
uagcagccuggggugaccucua

SEQ ID NO: 552767 - RNA, 18 nt, Homo sapiens
uagcaggccuaagacaug

SEQ ID NO: 552768 - RNA, 19 nt, Homo sapiens
uagcagggauguuccuuac

SEQ ID NO: 552769 - RNA, 19 nt, Homo sapiens
uagcagggauucucucauc

SEQ ID NO: 552770 - RNA, 13 nt, Homo sapiens
uagcagucacuga

SEQ ID NO: 552771 - RNA, 16 nt, Homo sapiens
uagcaguguauuacuc

SEQ ID NO: 552772 - RNA, 20 nt, Homo sapiens
uagcaguucugcaaauagaa

SEQ ID NO: 552773 - RNA, 16 nt, Homo sapiens
uagugugugugcaugu

SEQ ID NO: 552774 - RNA, 22 nt, Homo sapiens
uaguguuggaaaaugugcaaua

SEQ ID NO: 552775 - RNA, 15 nt, Homo sapiens
uaguuaaaacacaua

SEQ ID NO: 552776 - RNA, 17 nt, Homo sapiens
uaguuaaaacacauauc

SEQ ID NO: 552777 - RNA, 20 nt, Homo sapiens
uaguuagaauuauaucacuu

SEQ ID NO: 552778 - RNA, 15 nt, Homo sapiens
uaguuagccaucuaa

SEQ ID NO: 552779 - RNA, 17 nt, Homo sapiens
uaguuaggauauugauu

SEQ ID NO: 552780 - RNA, 18 nt, Homo sapiens
uaguucacauacaaauca

SEQ ID NO: 552781 - RNA, 22 nt, Homo sapiens
uaguucacauacaaaucaucca

SEQ ID NO: 552782 - RNA, 18 nt, Homo sapiens
uaguucacugacacagua

SEQ ID NO: 552783 - RNA, 17 nt, Homo sapiens
uaguucaguagaauuac

SEQ ID NO: 552784 - RNA, 14 nt, Homo sapiens
uaguuccacugaga

SEQ ID NO: 552785 - RNA, 15 nt, Homo sapiens
uaguuccuuacuguu

SEQ ID NO: 552786 - RNA, 16 nt, Homo sapiens
uaguuguagacaaagu

SEQ ID NO: 552787 - RNA, 15 nt, Homo sapiens
uaguuguaucucuuu

SEQ ID NO: 552788 - RNA, 15 nt, Homo sapiens
uaguugucuuuccug

SEQ ID NO: 552789 - RNA, 23 nt, Homo sapiens
uaguuuaaacccaagaagggcac

SEQ ID NO: 552790 - RNA, 17 nt, Homo sapiens
uaguuucagagugugga

SEQ ID NO: 552791 - RNA, 15 nt, Homo sapiens
uaguuucaugagucu

SEQ ID NO: 552792 - RNA, 22 nt, Homo sapiens
uaguuucccuacugaacccugc

SEQ ID NO: 552793 - RNA, 19 nt, Homo sapiens
uaguuugacucaguauagg

SEQ ID NO: 552794 - RNA, 11 nt, Homo sapiens
uaguuugcaac

SEQ ID NO: 552795 - RNA, 16 nt, Homo sapiens
uaguuugcaacuucaa

SEQ ID NO: 552796 - RNA, 19 nt, Homo sapiens
uaguuugcaguuacacuaa

SEQ ID NO: 552797 - RNA, 21 nt, Homo sapiens
uaguuuguuuuagaaccagcc

SEQ ID NO: 552798 - RNA, 14 nt, Homo sapiens
uaguuuuacauaua

SEQ ID NO: 552799 - RNA, 16 nt, Homo sapiens
uaguuuuaguugcaga

SEQ ID NO: 552800 - RNA, 15 nt, Homo sapiens
uaguuuucagccuug

SEQ ID NO: 552801 - RNA, 22 nt, Homo sapiens
uaguuuuguaaaaacugaagaa

SEQ ID NO: 552802 - RNA, 22 nt, Homo sapiens
uaguuuuuaccuaccacagugu

SEQ ID NO: 552803 - RNA, 19 nt, Homo sapiens
uaguuuuucagucuauggg

SEQ ID NO: 552804 - RNA, 23 nt, Homo sapiens
uaguuuuugaucaagaaugcaau

SEQ ID NO: 552805 - RNA, 20 nt, Homo sapiens
uauaaaaaagaaagaauuaa

SEQ ID NO: 552806 - RNA, 16 nt, Homo sapiens
uauaaaaacagcuccu

SEQ ID NO: 552807 - RNA, 21 nt, Homo sapiens
uauaaaaaccaugcugguaua

SEQ ID NO: 552808 - RNA, 20 nt, Homo sapiens
uauaaaaauauuaagacaau

SEQ ID NO: 552809 - RNA, 21 nt, Homo sapiens
uauaaaacagucauggccuga

SEQ ID NO: 552810 - RNA, 23 nt, Homo sapiens
uauaaaauaguaugaaaauggaa

SEQ ID NO: 552811 - RNA, 21 nt, Homo sapiens
uauaaacaaaagaaucuucca

SEQ ID NO: 552812 - RNA, 12 nt, Homo sapiens
uauaaacagaca

SEQ ID NO: 552813 - RNA, 23 nt, Homo sapiens
uauaaagauacagaacucuuuca

SEQ ID NO: 552814 - RNA, 21 nt, Homo sapiens
uauaaagauacuaaaccagca

SEQ ID NO: 552815 - RNA, 15 nt, Homo sapiens
uauaaagauuguacu

SEQ ID NO: 552816 - RNA, 12 nt, Homo sapiens
uauaaagcaaau

SEQ ID NO: 552817 - RNA, 12 nt, Homo sapiens
uauaaagcagua

SEQ ID NO: 552818 - RNA, 23 nt, Homo sapiens
uauaaagcaguauuuuucuugac

SEQ ID NO: 552819 - RNA, 16 nt, Homo sapiens
uauaaagccuucagag

SEQ ID NO: 552820 - RNA, 20 nt, Homo sapiens
uauaaagguggugggcaaaa

SEQ ID NO: 552821 - RNA, 22 nt, Homo sapiens
uauaaauaacucuuauaacaca

SEQ ID NO: 552822 - RNA, 18 nt, Homo sapiens
uauaaauacacuuccugc

SEQ ID NO: 552823 - RNA, 23 nt, Homo sapiens
uauaaauaucaugcacaacuaua

SEQ ID NO: 552824 - RNA, 16 nt, Homo sapiens
uauaaaucaacaccuu

SEQ ID NO: 552825 - RNA, 16 nt, Homo sapiens
uauaaaugcaauaaga

SEQ ID NO: 552826 - RNA, 18 nt, Homo sapiens
uauaaauggaccauccuu

SEQ ID NO: 552827 - RNA, 16 nt, Homo sapiens
uauaaauugggauaaa

SEQ ID NO: 552828 - RNA, 20 nt, Homo sapiens
uauaaauuuauuuacugcua

SEQ ID NO: 552829 - RNA, 15 nt, Homo sapiens
uauaacaaacuacau

SEQ ID NO: 552830 - RNA, 14 nt, Homo sapiens
uauaacagaauuaa

SEQ ID NO: 552831 - RNA, 13 nt, Homo sapiens
uauaacaguguuu

SEQ ID NO: 552832 - RNA, 21 nt, Homo sapiens
uauaaccagacacauacucau

SEQ ID NO: 552833 - RNA, 18 nt, Homo sapiens
uauaaccccagccugacc

SEQ ID NO: 552834 - RNA, 19 nt, Homo sapiens
uauaacuagacaucugcug

SEQ ID NO: 552835 - RNA, 21 nt, Homo sapiens
uauaacuuccuggcuccuuca

SEQ ID NO: 552836 - RNA, 22 nt, Homo sapiens
uauaacuuuugguaucuacuuc

SEQ ID NO: 552837 - RNA, 18 nt, Homo sapiens
uauaagaaagaucaaaga

SEQ ID NO: 552838 - RNA, 19 nt, Homo sapiens
uauaagaaguccuaucuca

SEQ ID NO: 552839 - RNA, 15 nt, Homo sapiens
uauaagacuacuaua

SEQ ID NO: 552840 - RNA, 18 nt, Homo sapiens
uauaagcauguauauucu

SEQ ID NO: 552841 - RNA, 14 nt, Homo sapiens
uauaagccaguuca

SEQ ID NO: 552842 - RNA, 17 nt, Homo sapiens
uauaagguaugugcuau

SEQ ID NO: 552843 - RNA, 17 nt, Homo sapiens
uauaaguuguaccaaaa

SEQ ID NO: 552844 - RNA, 19 nt, Homo sapiens
uauaauaaagaaguguucu

SEQ ID NO: 552845 - RNA, 20 nt, Homo sapiens
uauaauaccaucagaaagaa

SEQ ID NO: 552846 - RNA, 15 nt, Homo sapiens
uauaauacuugcaac

SEQ ID NO: 552847 - RNA, 13 nt, Homo sapiens
uauaauaugucac

SEQ ID NO: 552848 - RNA, 14 nt, Homo sapiens
uauaauaugucacc

SEQ ID NO: 552849 - RNA, 18 nt, Homo sapiens
uauaauauuguacaguua

SEQ ID NO: 552850 - RNA, 17 nt, Homo sapiens
uauaaucuccauuucaa

SEQ ID NO: 552851 - RNA, 15 nt, Homo sapiens
uauaaucugaagaua

SEQ ID NO: 552852 - RNA, 14 nt, Homo sapiens
uauaaugguugacu

SEQ ID NO: 552853 - RNA, 17 nt, Homo sapiens
uauaauguaagcucuac

SEQ ID NO: 552854 - RNA, 22 nt, Homo sapiens
uauaauguacagaagagcaaaa

SEQ ID NO: 552855 - RNA, 17 nt, Homo sapiens
uauaauguuguauuuaa

SEQ ID NO: 552856 - RNA, 22 nt, Homo sapiens
uauaauguuguauuuaauuuua

SEQ ID NO: 552857 - RNA, 19 nt, Homo sapiens
uauaauuaaagaugccaua

SEQ ID NO: 552858 - RNA, 16 nt, Homo sapiens
uauaauuaauugucau

SEQ ID NO: 552859 - RNA, 16 nt, Homo sapiens
uauaauugaguuuuca

SEQ ID NO: 552860 - RNA, 16 nt, Homo sapiens
uauaauugguagccau

SEQ ID NO: 552861 - RNA, 18 nt, Homo sapiens
uauaauuggugcauagca

SEQ ID NO: 552862 - RNA, 20 nt, Homo sapiens
uauaauuuccauagugugag

SEQ ID NO: 552863 - RNA, 21 nt, Homo sapiens
uauacaaauuagaaaauguua

SEQ ID NO: 552864 - RNA, 16 nt, Homo sapiens
uauacaacgauuguau

SEQ ID NO: 552865 - RNA, 13 nt, Homo sapiens
uauacaccuuagu

SEQ ID NO: 552866 - RNA, 21 nt, Homo sapiens
uauacacuauuugugagcaaa

SEQ ID NO: 552867 - RNA, 21 nt, Homo sapiens
uauacagcauugacucagaua

SEQ ID NO: 552868 - RNA, 10 nt, Homo sapiens
uauacauaug

SEQ ID NO: 552869 - RNA, 11 nt, Homo sapiens
uauacaucucu

SEQ ID NO: 552870 - RNA, 15 nt, Homo sapiens
uauacauuacaauca

SEQ ID NO: 552871 - RNA, 21 nt, Homo sapiens
uauacauucuuuaucuugaca

SEQ ID NO: 552872 - RNA, 12 nt, Homo sapiens
uauacauuguga

SEQ ID NO: 552873 - RNA, 19 nt, Homo sapiens
uauaccaugugugcuaaua

SEQ ID NO: 552874 - RNA, 14 nt, Homo sapiens
uauaccauuuccuc

SEQ ID NO: 552875 - RNA, 20 nt, Homo sapiens
uauacccacauguacagaca

SEQ ID NO: 552876 - RNA, 22 nt, Homo sapiens
uauaccccaaauuguguauaua

SEQ ID NO: 552877 - RNA, 20 nt, Homo sapiens
uauacuagggagccauuuga

SEQ ID NO: 552878 - RNA, 15 nt, Homo sapiens
uauacucaaguuuca

SEQ ID NO: 552879 - RNA, 22 nt, Homo sapiens
uauacugaaggaaaaacacaag

SEQ ID NO: 552880 - RNA, 18 nt, Homo sapiens
uauacuguggcuaugcaa

SEQ ID NO: 552881 - RNA, 13 nt, Homo sapiens
uauacuugccauc

SEQ ID NO: 552882 - RNA, 17 nt, Homo sapiens
uauacuuuaguagacau

SEQ ID NO: 552883 - RNA, 11 nt, Homo sapiens
uauacuuucag

SEQ ID NO: 552884 - RNA, 21 nt, Homo sapiens
uauagaaauagaacacugccu

SEQ ID NO: 552885 - RNA, 21 nt, Homo sapiens
uauagaaggguaccuugaaca

SEQ ID NO: 552886 - RNA, 14 nt, Homo sapiens
uauagaaguagcaa

SEQ ID NO: 552887 - RNA, 15 nt, Homo sapiens
uauagacaaauaaua

SEQ ID NO: 552888 - RNA, 21 nt, Homo sapiens
uauagagggcuuaugauucag

SEQ ID NO: 552889 - RNA, 22 nt, Homo sapiens
uauagagguguaacacuuguca

SEQ ID NO: 552890 - RNA, 22 nt, Homo sapiens
uauagauuguccuuuugcaaag

SEQ ID NO: 552891 - RNA, 17 nt, Homo sapiens
uauagccuauacugcau

SEQ ID NO: 552892 - RNA, 21 nt, Homo sapiens
uauagcgauugaaagggcaau

SEQ ID NO: 552893 - RNA, 13 nt, Homo sapiens
uauagcuaaguac

SEQ ID NO: 552894 - RNA, 14 nt, Homo sapiens
ucgguccuggugcc

SEQ ID NO: 552895 - RNA, 21 nt, Homo sapiens
ucgguggcugccuuugaucac

SEQ ID NO: 552896 - RNA, 15 nt, Homo sapiens
ucggugguaccugag

SEQ ID NO: 552897 - RNA, 18 nt, Homo sapiens
ucggugugaacuuuucuc

SEQ ID NO: 552898 - RNA, 15 nt, Homo sapiens
ucggugugcugccaa

SEQ ID NO: 552899 - RNA, 19 nt, Homo sapiens
ucggugugcugccaacuug

SEQ ID NO: 552900 - RNA, 14 nt, Homo sapiens
ucgguguucugucc

SEQ ID NO: 552901 - RNA, 23 nt, Homo sapiens
ucgguguucugucccagugcggu

SEQ ID NO: 552902 - RNA, 19 nt, Homo sapiens
ucgguuguucuuuccucac

SEQ ID NO: 552903 - RNA, 14 nt, Homo sapiens
ucguaagucacuga

SEQ ID NO: 552904 - RNA, 13 nt, Homo sapiens
ucguagccaucuc

SEQ ID NO: 552905 - RNA, 14 nt, Homo sapiens
ucguagccaucucu

SEQ ID NO: 552906 - RNA, 18 nt, Homo sapiens
ucguaggaauugaggagu

SEQ ID NO: 552907 - RNA, 16 nt, Homo sapiens
ucguaucucuagaaag

SEQ ID NO: 552908 - RNA, 18 nt, Homo sapiens
ucguaugaucaguacuga

SEQ ID NO: 552909 - RNA, 21 nt, Homo sapiens
ucgucaacuuucuuagcucaa

SEQ ID NO: 552910 - RNA, 23 nt, Homo sapiens
ucgucacgagcacaauggucuua

SEQ ID NO: 552911 - RNA, 19 nt, Homo sapiens
ucgucagccaccugggaac

SEQ ID NO: 552912 - RNA, 18 nt, Homo sapiens
ucgucaucaggugcauag

SEQ ID NO: 552913 - RNA, 18 nt, Homo sapiens
ucguccaccccagugugc

SEQ ID NO: 552914 - RNA, 22 nt, Homo sapiens
ucguccgucugucucgaugccu

SEQ ID NO: 552915 - RNA, 16 nt, Homo sapiens
ucguccugcugcugcu

SEQ ID NO: 552916 - RNA, 17 nt, Homo sapiens
ucgucuuagcaagaagu

SEQ ID NO: 552917 - RNA, 13 nt, Homo sapiens
ucgugaaacccug

SEQ ID NO: 552918 - RNA, 13 nt, Homo sapiens
ucgugacaacaug

SEQ ID NO: 552919 - RNA, 17 nt, Homo sapiens
ucgugaccgcaggugau

SEQ ID NO: 552920 - RNA, 15 nt, Homo sapiens
ucgugagucauuuaa

SEQ ID NO: 552921 - RNA, 13 nt, Homo sapiens
ucgugcacucugc

SEQ ID NO: 552922 - RNA, 21 nt, Homo sapiens
ucguggguguguguagccaag

SEQ ID NO: 552923 - RNA, 21 nt, Homo sapiens
ucguguaauuggcccaaguca

SEQ ID NO: 552924 - RNA, 18 nt, Homo sapiens
ucguuauuguuguugcca

SEQ ID NO: 552925 - RNA, 13 nt, Homo sapiens
ucguugcagcacu

SEQ ID NO: 552926 - RNA, 17 nt, Homo sapiens
ucguugccugccacuga

SEQ ID NO: 552927 - RNA, 17 nt, Homo sapiens
ucuaaaaagaaaugaag

SEQ ID NO: 552928 - RNA, 12 nt, Homo sapiens
ucuaaaacugcc

SEQ ID NO: 552929 - RNA, 12 nt, Homo sapiens
ucuaaaagccau

SEQ ID NO: 552930 - RNA, 22 nt, Homo sapiens
ucuaaaagcguuggauguagca

SEQ ID NO: 552931 - RNA, 13 nt, Homo sapiens
ucuaaaagcuuuc

SEQ ID NO: 552932 - RNA, 16 nt, Homo sapiens
ucuaaaauaacuagua

SEQ ID NO: 552933 - RNA, 18 nt, Homo sapiens
ucuaaagaaaaaugccug

SEQ ID NO: 552934 - RNA, 22 nt, Homo sapiens
ucuaaagauggaaaaaccaccc

SEQ ID NO: 552935 - RNA, 12 nt, Homo sapiens
ucuaaagcugaa

SEQ ID NO: 552936 - RNA, 18 nt, Homo sapiens
ucuaaaggcuaccuuugu

SEQ ID NO: 552937 - RNA, 20 nt, Homo sapiens
ucuaaagguggugaggcaau

SEQ ID NO: 552938 - RNA, 14 nt, Homo sapiens
ucuaaaguguuuag

SEQ ID NO: 552939 - RNA, 19 nt, Homo sapiens
ucuaaaguguuuagcuguc

SEQ ID NO: 552940 - RNA, 15 nt, Homo sapiens
ucuaaaguuacuacu

SEQ ID NO: 552941 - RNA, 18 nt, Homo sapiens
ucuaaauaaggaauuucc

SEQ ID NO: 552942 - RNA, 19 nt, Homo sapiens
ucuaaaugggaauucucag

SEQ ID NO: 552943 - RNA, 14 nt, Homo sapiens
ucuaacaagucaua

SEQ ID NO: 552944 - RNA, 18 nt, Homo sapiens
ucuaacagcccuccucug

SEQ ID NO: 552945 - RNA, 12 nt, Homo sapiens
ucuaacauaugu

SEQ ID NO: 552946 - RNA, 14 nt, Homo sapiens
ucuaacauauguau

SEQ ID NO: 552947 - RNA, 22 nt, Homo sapiens
ucuaacauauucaaugcaagua

SEQ ID NO: 552948 - RNA, 16 nt, Homo sapiens
ucuaacauccuugucu

SEQ ID NO: 552949 - RNA, 23 nt, Homo sapiens
ucuaaccaagaggcugguuuugg

SEQ ID NO: 552950 - RNA, 12 nt, Homo sapiens
ucuaaccauuca

SEQ ID NO: 552951 - RNA, 20 nt, Homo sapiens
ucuaacuagaaaucugccaa

SEQ ID NO: 552952 - RNA, 14 nt, Homo sapiens
ucuaagaaccaaaa

SEQ ID NO: 552953 - RNA, 20 nt, Homo sapiens
ucuaagacuacuaugaacag

SEQ ID NO: 552954 - RNA, 20 nt, Homo sapiens
ucuaagagaacaaugugcua

SEQ ID NO: 552955 - RNA, 18 nt, Homo sapiens
ucuaagaugccagcauau

SEQ ID NO: 552956 - RNA, 15 nt, Homo sapiens
ucuaagccaacuuua

SEQ ID NO: 552957 - RNA, 17 nt, Homo sapiens
ucuaagccuuuccauaa

SEQ ID NO: 552958 - RNA, 14 nt, Homo sapiens
ucuaagggaccuca

SEQ ID NO: 552959 - RNA, 19 nt, Homo sapiens
ucuaagguaguaacuuucc

SEQ ID NO: 552960 - RNA, 13 nt, Homo sapiens
ucuaaguauuuga

SEQ ID NO: 552961 - RNA, 20 nt, Homo sapiens
ucuaaguggaaaaaguauua

SEQ ID NO: 552962 - RNA, 20 nt, Homo sapiens
ucuaaguuauuuacuuuuac

SEQ ID NO: 552963 - RNA, 15 nt, Homo sapiens
ucuaauaauuauuca

SEQ ID NO: 552964 - RNA, 12 nt, Homo sapiens
ucuaauacaaaa

SEQ ID NO: 552965 - RNA, 14 nt, Homo sapiens
ucuaauauggagau

SEQ ID NO: 552966 - RNA, 14 nt, Homo sapiens
ucuaauauggccac

SEQ ID NO: 552967 - RNA, 17 nt, Homo sapiens
ucuaaucccagcacuuu

SEQ ID NO: 552968 - RNA, 20 nt, Homo sapiens
ucuaaucuauaugauaugca

SEQ ID NO: 552969 - RNA, 15 nt, Homo sapiens
ucuaaugaagaauuc

SEQ ID NO: 552970 - RNA, 21 nt, Homo sapiens
ucuaaugagcuagugucuuau

SEQ ID NO: 552971 - RNA, 19 nt, Homo sapiens
ucuaauggggacacagauc

SEQ ID NO: 552972 - RNA, 14 nt, Homo sapiens
ucuaauguacaaua

SEQ ID NO: 552973 - RNA, 22 nt, Homo sapiens
ucuaauuagagaacuggaggaa

SEQ ID NO: 552974 - RNA, 17 nt, Homo sapiens
ucuaauuagucuaucaa

SEQ ID NO: 552975 - RNA, 17 nt, Homo sapiens
ucuaauuuauuaaucua

SEQ ID NO: 552976 - RNA, 14 nt, Homo sapiens
ucuaauuucugaaa

SEQ ID NO: 552977 - RNA, 22 nt, Homo sapiens
ucuacaaaagugaaccaucuca

SEQ ID NO: 552978 - RNA, 22 nt, Homo sapiens
ucuacaaauggugaaauuuaau

SEQ ID NO: 552979 - RNA, 16 nt, Homo sapiens
ucuacaaaugucuuca

SEQ ID NO: 552980 - RNA, 17 nt, Homo sapiens
ucuacaaucaguugacu

SEQ ID NO: 552981 - RNA, 21 nt, Homo sapiens
ucuacacagauggaaucucuu

SEQ ID NO: 552982 - RNA, 19 nt, Homo sapiens
ucuacacaguaaaaacuug

SEQ ID NO: 552983 - RNA, 16 nt, Homo sapiens
ucuacacauacagaaa

SEQ ID NO: 552984 - RNA, 19 nt, Homo sapiens
ucuacacccaccagaguga

SEQ ID NO: 552985 - RNA, 19 nt, Homo sapiens
ucuacagagcuucccugac

SEQ ID NO: 552986 - RNA, 16 nt, Homo sapiens
ucuacauccaauguau

SEQ ID NO: 552987 - RNA, 13 nt, Homo sapiens
ucuacaugugcca

SEQ ID NO: 552988 - RNA, 18 nt, Homo sapiens
ucuacauugagcauuuga

SEQ ID NO: 552989 - RNA, 21 nt, Homo sapiens
ucuacauuucaccuacuuugu

SEQ ID NO: 552990 - RNA, 15 nt, Homo sapiens
ucuacauuugagggc

SEQ ID NO: 552991 - RNA, 23 nt, Homo sapiens
ucuaccaaauaauuucauauuca

SEQ ID NO: 552992 - RNA, 17 nt, Homo sapiens
ucuaccaggcaaauuca

SEQ ID NO: 552993 - RNA, 18 nt, Homo sapiens
ucuaccagucuauuucca

SEQ ID NO: 552994 - RNA, 13 nt, Homo sapiens
ucuaccauuugaa

SEQ ID NO: 552995 - RNA, 16 nt, Homo sapiens
ucuaccauuugaauuu

SEQ ID NO: 552996 - RNA, 15 nt, Homo sapiens
ucuacccaaaggaua

SEQ ID NO: 552997 - RNA, 17 nt, Homo sapiens
ucuaccccugcuaagga

SEQ ID NO: 552998 - RNA, 20 nt, Homo sapiens
ucuacccggcccagagaccc

SEQ ID NO: 552999 - RNA, 15 nt, Homo sapiens
ucuacccuggcacua

SEQ ID NO: 553000 - RNA, 23 nt, Homo sapiens
ucuaccgggaggacagcugccug

SEQ ID NO: 553001 - RNA, 13 nt, Homo sapiens
ucuaccucaggca

SEQ ID NO: 553002 - RNA, 15 nt, Homo sapiens
ucuaccuguacacau

SEQ ID NO: 553003 - RNA, 14 nt, Homo sapiens
ucuaccuucagggu

SEQ ID NO: 553004 - RNA, 14 nt, Homo sapiens
ucuacgccagggga

SEQ ID NO: 553005 - RNA, 21 nt, Homo sapiens
ucuacguauggcuccacaccu

SEQ ID NO: 553006 - RNA, 16 nt, Homo sapiens
ucuacgugauuuggcu

SEQ ID NO: 553007 - RNA, 15 nt, Homo sapiens
ucuacuaaaaacaca

SEQ ID NO: 553008 - RNA, 19 nt, Homo sapiens
ucuacuaaaaacacaaaaa

SEQ ID NO: 553009 - RNA, 21 nt, Homo sapiens
ucuacuaacaaucagcuccuu

SEQ ID NO: 553010 - RNA, 20 nt, Homo sapiens
ucuacuacaugugacuggca

SEQ ID NO: 553011 - RNA, 17 nt, Homo sapiens
ucuacuaccacaaggaa

SEQ ID NO: 553012 - RNA, 23 nt, Homo sapiens
ucuacuagggaaaaauaaacaca

SEQ ID NO: 553013 - RNA, 17 nt, Homo sapiens
ucuacuccuaccucagc

SEQ ID NO: 553014 - RNA, 19 nt, Homo sapiens
ucuacugaaaauacaaaaa

SEQ ID NO: 553015 - RNA, 15 nt, Homo sapiens
ucuacugaaugucau

SEQ ID NO: 553016 - RNA, 14 nt, Homo sapiens
aaaaucguuuugcc

SEQ ID NO: 553017 - RNA, 17 nt, Homo sapiens
aaaaucuugugcuagaa

SEQ ID NO: 553018 - RNA, 22 nt, Homo sapiens
aaaaugaaaauuaggauuucau

SEQ ID NO: 553019 - RNA, 13 nt, Homo sapiens
aaaaugaacugaa

SEQ ID NO: 553020 - RNA, 23 nt, Homo sapiens
aaaaugaagguggaacaagcaca

SEQ ID NO: 553021 - RNA, 16 nt, Homo sapiens
aaaaugaaucuucaca

SEQ ID NO: 553022 - RNA, 17 nt, Homo sapiens
aaaaugaaucuucacaa

SEQ ID NO: 553023 - RNA, 16 nt, Homo sapiens
aaaaugacaccaucuu

SEQ ID NO: 553024 - RNA, 14 nt, Homo sapiens
aaaaugacuguaga

SEQ ID NO: 553025 - RNA, 15 nt, Homo sapiens
aaaaugacuguagaa

SEQ ID NO: 553026 - RNA, 14 nt, Homo sapiens
aaaaugagguacuc

SEQ ID NO: 553027 - RNA, 15 nt, Homo sapiens
aaaaugauccugcca

SEQ ID NO: 553028 - RNA, 18 nt, Homo sapiens
aaaaugaugggacaauaa

SEQ ID NO: 553029 - RNA, 15 nt, Homo sapiens
aaaaugcacguagcu

SEQ ID NO: 553030 - RNA, 17 nt, Homo sapiens
aaaaugcaguccugagg

SEQ ID NO: 553031 - RNA, 19 nt, Homo sapiens
aaaaugcaguccugaggag

SEQ ID NO: 553032 - RNA, 15 nt, Homo sapiens
aaaaugcauuaggga

SEQ ID NO: 553033 - RNA, 16 nt, Homo sapiens
aaaaugcucaaucuca

SEQ ID NO: 553034 - RNA, 11 nt, Homo sapiens
aaaaugcugcu

SEQ ID NO: 553035 - RNA, 15 nt, Homo sapiens
aaaaugcugcucuca

SEQ ID NO: 553036 - RNA, 18 nt, Homo sapiens
aaaaugcuugggaccaga

SEQ ID NO: 553037 - RNA, 22 nt, Homo sapiens
aaaauggagcucaguaacauaa

SEQ ID NO: 553038 - RNA, 19 nt, Homo sapiens
aaaauggaggccauugugu

SEQ ID NO: 553039 - RNA, 13 nt, Homo sapiens
aaaauggcagugg

SEQ ID NO: 553040 - RNA, 17 nt, Homo sapiens
aaaauggcgaacaugug

SEQ ID NO: 553041 - RNA, 21 nt, Homo sapiens
aaaauggucacguuuggugcu

SEQ ID NO: 553042 - RNA, 15 nt, Homo sapiens
aaaauguaaauacuc

SEQ ID NO: 553043 - RNA, 15 nt, Homo sapiens
aaaauguaaugauca

SEQ ID NO: 553044 - RNA, 16 nt, Homo sapiens
aaaauguagcaugaug

SEQ ID NO: 553045 - RNA, 22 nt, Homo sapiens
aaaaugucacuauaucuuccca

SEQ ID NO: 553046 - RNA, 15 nt, Homo sapiens
aaaaugucagaaaau

SEQ ID NO: 553047 - RNA, 17 nt, Homo sapiens
aaaaugucccaguguca

SEQ ID NO: 553048 - RNA, 15 nt, Homo sapiens
aaaaugucuucuccc

SEQ ID NO: 553049 - RNA, 12 nt, Homo sapiens
aaaaugugcaau

SEQ ID NO: 553050 - RNA, 13 nt, Homo sapiens
aaaaugugcaaua

SEQ ID NO: 553051 - RNA, 18 nt, Homo sapiens
aaaaugugcacacauaua

SEQ ID NO: 553052 - RNA, 18 nt, Homo sapiens
aaaaugugugaugaauca

SEQ ID NO: 553053 - RNA, 22 nt, Homo sapiens
aaaauguuaccacuacuuuaau

SEQ ID NO: 553054 - RNA, 23 nt, Homo sapiens
aaaauguucuguuugcuguggaa

SEQ ID NO: 553055 - RNA, 11 nt, Homo sapiens
aaaauguucuu

SEQ ID NO: 553056 - RNA, 13 nt, Homo sapiens
aaaauguugaaua

SEQ ID NO: 553057 - RNA, 16 nt, Homo sapiens
aaaauguugcagcuca

SEQ ID NO: 553058 - RNA, 15 nt, Homo sapiens
aaaauguuggaagag

SEQ ID NO: 553059 - RNA, 19 nt, Homo sapiens
aaaauuaaacaaauaugca

SEQ ID NO: 553060 - RNA, 11 nt, Homo sapiens
aaaauuacuuc

SEQ ID NO: 553061 - RNA, 15 nt, Homo sapiens
aaaauuagacuguga

SEQ ID NO: 553062 - RNA, 21 nt, Homo sapiens
aaaauuagccgggcauggugg

SEQ ID NO: 553063 - RNA, 21 nt, Homo sapiens
aaaauuagcugggcauggugg

SEQ ID NO: 553064 - RNA, 18 nt, Homo sapiens
aaaauuagugaguauaaa

SEQ ID NO: 553065 - RNA, 17 nt, Homo sapiens
aaaauuauacuaacuua

SEQ ID NO: 553066 - RNA, 19 nt, Homo sapiens
aaaauuaucaaaaagcuaa

SEQ ID NO: 553067 - RNA, 18 nt, Homo sapiens
aaaauuauuagaacauuc

SEQ ID NO: 553068 - RNA, 21 nt, Homo sapiens
aaaauuauuugaaaacauaua

SEQ ID NO: 553069 - RNA, 17 nt, Homo sapiens
aaaauucaagcauuuag

SEQ ID NO: 553070 - RNA, 14 nt, Homo sapiens
aaaauucacaugau

SEQ ID NO: 553071 - RNA, 14 nt, Homo sapiens
aaaauucauuugcu

SEQ ID NO: 553072 - RNA, 15 nt, Homo sapiens
aaaauuccuaucuca

SEQ ID NO: 553073 - RNA, 17 nt, Homo sapiens
aaaauucuuaaguaugu

SEQ ID NO: 553074 - RNA, 18 nt, Homo sapiens
aaaauucuuucacuugau

SEQ ID NO: 553075 - RNA, 22 nt, Homo sapiens
aaaauugagaccugagugaaga

SEQ ID NO: 553076 - RNA, 19 nt, Homo sapiens
aaaauugauuucuucucau

SEQ ID NO: 553077 - RNA, 15 nt, Homo sapiens
aaaauugcacuuuua

SEQ ID NO: 553078 - RNA, 20 nt, Homo sapiens
aaaauuguuuucacuuguau

SEQ ID NO: 553079 - RNA, 21 nt, Homo sapiens
aaaauuuacaauuugacauac

SEQ ID NO: 553080 - RNA, 18 nt, Homo sapiens
aaaauuugaaauuuagcu

SEQ ID NO: 553081 - RNA, 13 nt, Homo sapiens
aaaauuuuacuuc

SEQ ID NO: 553082 - RNA, 15 nt, Homo sapiens
aaaauuuuacuucca

SEQ ID NO: 553083 - RNA, 12 nt, Homo sapiens
aaaauuuugcuu

SEQ ID NO: 553084 - RNA, 21 nt, Homo sapiens
aaaauuuuguaaauaugcaaa

SEQ ID NO: 553085 - RNA, 18 nt, Homo sapiens
aaacaaaaaucuguguaa

SEQ ID NO: 553086 - RNA, 19 nt, Homo sapiens
aaacaaaaccaacucagac

SEQ ID NO: 553087 - RNA, 13 nt, Homo sapiens
aaacaaacaugac

SEQ ID NO: 553088 - RNA, 21 nt, Homo sapiens
aaacaaagaugccacauucaa

SEQ ID NO: 553089 - RNA, 18 nt, Homo sapiens
aaacaaauagucuaucaa

SEQ ID NO: 553090 - RNA, 22 nt, Homo sapiens
aaacaaaucucaaaguguacaa

SEQ ID NO: 553091 - RNA, 23 nt, Homo sapiens
aaacaagaauuuucuuugcucug

SEQ ID NO: 553092 - RNA, 21 nt, Homo sapiens
aaacaagacuccucaucauga

SEQ ID NO: 553093 - RNA, 16 nt, Homo sapiens
aaacaagaggacacaa

SEQ ID NO: 553094 - RNA, 18 nt, Homo sapiens
aaacguguaaauugcaca

SEQ ID NO: 553095 - RNA, 19 nt, Homo sapiens
aaacguuaguuaaucccuu

SEQ ID NO: 553096 - RNA, 22 nt, Homo sapiens
aaacuaauuuaguaauagccug

SEQ ID NO: 553097 - RNA, 15 nt, Homo sapiens
aaacuacaacgaaca

SEQ ID NO: 553098 - RNA, 18 nt, Homo sapiens
aaacuacacaucccuaau

SEQ ID NO: 553099 - RNA, 17 nt, Homo sapiens
aaacuacaguuguaaua

SEQ ID NO: 553100 - RNA, 16 nt, Homo sapiens
aaacuacaucuugaaa

SEQ ID NO: 553101 - RNA, 13 nt, Homo sapiens
aaacuacauuuua

SEQ ID NO: 553102 - RNA, 13 nt, Homo sapiens
aaacuacuucuuu

SEQ ID NO: 553103 - RNA, 22 nt, Homo sapiens
aaacuaguggcaauauccaaau

SEQ ID NO: 553104 - RNA, 15 nt, Homo sapiens
aaacuaucaagagag

SEQ ID NO: 553105 - RNA, 20 nt, Homo sapiens
aaacuauccugauuccaaau

SEQ ID NO: 553106 - RNA, 21 nt, Homo sapiens
aaacuaugugcuaucacaugu

SEQ ID NO: 553107 - RNA, 16 nt, Homo sapiens
aaacucaaaacaccca

SEQ ID NO: 553108 - RNA, 13 nt, Homo sapiens
aaacucaaaauau

SEQ ID NO: 553109 - RNA, 13 nt, Homo sapiens
aaacucaagacaa

SEQ ID NO: 553110 - RNA, 18 nt, Homo sapiens
aaacucaagacaaugcac

SEQ ID NO: 553111 - RNA, 19 nt, Homo sapiens
aaacucacacaaccaugac

SEQ ID NO: 553112 - RNA, 13 nt, Homo sapiens
aaacuccaucuca

SEQ ID NO: 553113 - RNA, 14 nt, Homo sapiens
aaacuccaugcaaa

SEQ ID NO: 553114 - RNA, 13 nt, Homo sapiens
aaacuccauucau

SEQ ID NO: 553115 - RNA, 15 nt, Homo sapiens
aaacucccaauggau

SEQ ID NO: 553116 - RNA, 16 nt, Homo sapiens
aaacucccgaccucag

SEQ ID NO: 553117 - RNA, 19 nt, Homo sapiens
aaacuccuggccucaagca

SEQ ID NO: 553118 - RNA, 13 nt, Homo sapiens
aaacuccugggcu

SEQ ID NO: 553119 - RNA, 18 nt, Homo sapiens
aaacuccuuaacuucagg

SEQ ID NO: 553120 - RNA, 22 nt, Homo sapiens
aaacuccuuguuaauccaguga

SEQ ID NO: 553121 - RNA, 17 nt, Homo sapiens
aaacuccuuuugguuua

SEQ ID NO: 553122 - RNA, 18 nt, Homo sapiens
aaacucucauuauuugug

SEQ ID NO: 553123 - RNA, 16 nt, Homo sapiens
aaacucuccuagucaa

SEQ ID NO: 553124 - RNA, 16 nt, Homo sapiens
aaacucugccagaaaa

SEQ ID NO: 553125 - RNA, 19 nt, Homo sapiens
aaacucuggggcucaagca

SEQ ID NO: 553126 - RNA, 23 nt, Homo sapiens
aaacucuguccacgauucacuca

SEQ ID NO: 553127 - RNA, 11 nt, Homo sapiens
aaacucuucag

SEQ ID NO: 553128 - RNA, 21 nt, Homo sapiens
aaacucuucgggagacauguu

SEQ ID NO: 553129 - RNA, 18 nt, Homo sapiens
aaacugaccaaacgcuua

SEQ ID NO: 553130 - RNA, 22 nt, Homo sapiens
aaacugagaaauuuacuacagu

SEQ ID NO: 553131 - RNA, 21 nt, Homo sapiens
aaacugagguauggccaugcc

SEQ ID NO: 553132 - RNA, 14 nt, Homo sapiens
aaacugaugacuua

SEQ ID NO: 553133 - RNA, 22 nt, Homo sapiens
aaacugcccuggcuccagugaa

SEQ ID NO: 553134 - RNA, 21 nt, Homo sapiens
aaacugccuuggcuucagggg

SEQ ID NO: 553135 - RNA, 15 nt, Homo sapiens
aaacugccuuugaua

SEQ ID NO: 553136 - RNA, 20 nt, Homo sapiens
aaacugcgaggacaucaaag

SEQ ID NO: 553137 - RNA, 19 nt, Homo sapiens
aaacugcggucagaugugg

SEQ ID NO: 553138 - RNA, 20 nt, Homo sapiens
aaacugcucccaucauuccu

SEQ ID NO: 553139 - RNA, 11 nt, Homo sapiens
aaacugcugaa

SEQ ID NO: 553140 - RNA, 15 nt, Homo sapiens
uuuuagccacucaaa

SEQ ID NO: 553141 - RNA, 18 nt, Homo sapiens
uuuuagcgugcucacuga

SEQ ID NO: 553142 - RNA, 19 nt, Homo sapiens
uuuuaguagagaugggguu

SEQ ID NO: 553143 - RNA, 19 nt, Homo sapiens
uuuuauaaaaaugagugcu

SEQ ID NO: 553144 - RNA, 16 nt, Homo sapiens
uuuuauaucaugcaaa

SEQ ID NO: 553145 - RNA, 21 nt, Homo sapiens
uuuuauaugcuuacugauaua

SEQ ID NO: 553146 - RNA, 13 nt, Homo sapiens
uuuuauauguugc

SEQ ID NO: 553147 - RNA, 21 nt, Homo sapiens
uuuuaucuuuaaucuccucuu

SEQ ID NO: 553148 - RNA, 16 nt, Homo sapiens
uuuuaugaacauugua

SEQ ID NO: 553149 - RNA, 15 nt, Homo sapiens
uuuuaugaucuuggc

SEQ ID NO: 553150 - RNA, 11 nt, Homo sapiens
uuuuaugcugg

SEQ ID NO: 553151 - RNA, 13 nt, Homo sapiens
uuuuaugucuuaa

SEQ ID NO: 553152 - RNA, 15 nt, Homo sapiens
uuuuauuaugcauua

SEQ ID NO: 553153 - RNA, 22 nt, Homo sapiens
uuuuauugcuucuuuuuggaga

SEQ ID NO: 553154 - RNA, 18 nt, Homo sapiens
uuuuauuuuugcaaaaua

SEQ ID NO: 553155 - RNA, 18 nt, Homo sapiens
uuuucaaagauguguugc

SEQ ID NO: 553156 - RNA, 17 nt, Homo sapiens
uuuucaacaaguaacuu

SEQ ID NO: 553157 - RNA, 18 nt, Homo sapiens
uuuucaagaugguguuau

SEQ ID NO: 553158 - RNA, 22 nt, Homo sapiens
uuuucaauaaugugaaugcuau

SEQ ID NO: 553159 - RNA, 22 nt, Homo sapiens
uuuucaaucaucaaaaaguaau

SEQ ID NO: 553160 - RNA, 22 nt, Homo sapiens
uuuucacaacaaaagcuuuuga

SEQ ID NO: 553161 - RNA, 13 nt, Homo sapiens
uuuucaccaauga

SEQ ID NO: 553162 - RNA, 13 nt, Homo sapiens
uuuucaccugaga

SEQ ID NO: 553163 - RNA, 23 nt, Homo sapiens
uuuucacgggaacucuccaaaua

SEQ ID NO: 553164 - RNA, 10 nt, Homo sapiens
uuuucacugc

SEQ ID NO: 553165 - RNA, 12 nt, Homo sapiens
uuuucacuugua

SEQ ID NO: 553166 - RNA, 13 nt, Homo sapiens
uuuucacuuugaa

SEQ ID NO: 553167 - RNA, 13 nt, Homo sapiens
uuuucagggcugg

SEQ ID NO: 553168 - RNA, 16 nt, Homo sapiens
uuuucaguaacccagc

SEQ ID NO: 553169 - RNA, 12 nt, Homo sapiens
uuuucaguauga

SEQ ID NO: 553170 - RNA, 16 nt, Homo sapiens
uuuucauaauaccuca

SEQ ID NO: 553171 - RNA, 17 nt, Homo sapiens
uuuucauagugcucaga

SEQ ID NO: 553172 - RNA, 21 nt, Homo sapiens
uuuucauccuauaagcuuaaa

SEQ ID NO: 553173 - RNA, 12 nt, Homo sapiens
uuuucauuugag

SEQ ID NO: 553174 - RNA, 11 nt, Homo sapiens
uuuuccaaaug

SEQ ID NO: 553175 - RNA, 22 nt, Homo sapiens
uuuuccacauaggaaaaugcca

SEQ ID NO: 553176 - RNA, 20 nt, Homo sapiens
uuuuccacuuguggaaaaaa

SEQ ID NO: 553177 - RNA, 12 nt, Homo sapiens
uuuuccaggaau

SEQ ID NO: 553178 - RNA, 18 nt, Homo sapiens
uuuuccaugacugcauuu

SEQ ID NO: 553179 - RNA, 23 nt, Homo sapiens
uuuuccauuguuugaaacaaaga

SEQ ID NO: 553180 - RNA, 11 nt, Homo sapiens
uuuucccaaag

SEQ ID NO: 553181 - RNA, 16 nt, Homo sapiens
uuuucccagcuuuuga

SEQ ID NO: 553182 - RNA, 23 nt, Homo sapiens
uuuucccccuugaggauugugga

SEQ ID NO: 553183 - RNA, 17 nt, Homo sapiens
uuuucccuuugccuuca

SEQ ID NO: 553184 - RNA, 16 nt, Homo sapiens
uuuuccucuuagauau

SEQ ID NO: 553185 - RNA, 22 nt, Homo sapiens
uuuuccuuaaauuuuuagccau

SEQ ID NO: 553186 - RNA, 23 nt, Homo sapiens
uuuuccuucuacagcagcacugu

SEQ ID NO: 553187 - RNA, 13 nt, Homo sapiens
uuuucgaacauuc

SEQ ID NO: 553188 - RNA, 20 nt, Homo sapiens
uuuucuacaugaugcccugc

SEQ ID NO: 553189 - RNA, 12 nt, Homo sapiens
uuuucuacugua

SEQ ID NO: 553190 - RNA, 15 nt, Homo sapiens
uuuucuagacugucu

SEQ ID NO: 553191 - RNA, 20 nt, Homo sapiens
uuuucuauagaaaaaguaaa

SEQ ID NO: 553192 - RNA, 14 nt, Homo sapiens
uuuucuaucaaaua

SEQ ID NO: 553193 - RNA, 21 nt, Homo sapiens
uuuucucaaccugggacuucc

SEQ ID NO: 553194 - RNA, 14 nt, Homo sapiens
uuuucucaauugua

SEQ ID NO: 553195 - RNA, 20 nt, Homo sapiens
uuuucucccacacaaaauag

SEQ ID NO: 553196 - RNA, 21 nt, Homo sapiens
uuuucucccaggaagcuuuga

SEQ ID NO: 553197 - RNA, 22 nt, Homo sapiens
uuuucuccuccgccugugucca

SEQ ID NO: 553198 - RNA, 15 nt, Homo sapiens
uuuucuccucugcuu

SEQ ID NO: 553199 - RNA, 13 nt, Homo sapiens
uuuucucucugga

SEQ ID NO: 553200 - RNA, 16 nt, Homo sapiens
uuuucuggacucugga

SEQ ID NO: 553201 - RNA, 13 nt, Homo sapiens
uuuucugguucua

SEQ ID NO: 553202 - RNA, 23 nt, Homo sapiens
uuuucugugauaacucugcaaag

SEQ ID NO: 553203 - RNA, 22 nt, Homo sapiens
uuuucuucagguaacacuacag

SEQ ID NO: 553204 - RNA, 22 nt, Homo sapiens
uuuucuuuuguucaacauugua

SEQ ID NO: 553205 - RNA, 23 nt, Homo sapiens
uuuucuuuuuuaaagacaggguc

SEQ ID NO: 553206 - RNA, 21 nt, Homo sapiens
uuuugaaaaggcgguacuagu

SEQ ID NO: 553207 - RNA, 16 nt, Homo sapiens
uuuugaaaaugggcuc

SEQ ID NO: 553208 - RNA, 19 nt, Homo sapiens
uuuugaaauaagaaagugc

SEQ ID NO: 553209 - RNA, 21 nt, Homo sapiens
uuuugaagaggccuaagucaa

SEQ ID NO: 553210 - RNA, 22 nt, Homo sapiens
uuuugacagcaugaaauguccu

SEQ ID NO: 553211 - RNA, 14 nt, Homo sapiens
uuuugauaauggcu

SEQ ID NO: 553212 - RNA, 15 nt, Homo sapiens
uuuugaugacuucag

SEQ ID NO: 553213 - RNA, 14 nt, Homo sapiens
uuuugaugagcuua

SEQ ID NO: 553214 - RNA, 22 nt, Homo sapiens
uuuugaugugaaaaucaugaaa

SEQ ID NO: 553215 - RNA, 15 nt, Homo sapiens
uuuugcaaucugugu

SEQ ID NO: 553216 - RNA, 13 nt, Homo sapiens
uuuugcacuauug

SEQ ID NO: 553217 - RNA, 16 nt, Homo sapiens
uuuugcauuuucacaa

SEQ ID NO: 553218 - RNA, 15 nt, Homo sapiens
uuuugccaaucucaa

SEQ ID NO: 553219 - RNA, 15 nt, Homo sapiens
uuuugcucaguucca

SEQ ID NO: 553220 - RNA, 11 nt, Homo sapiens
uuuugcugcua

SEQ ID NO: 553221 - RNA, 19 nt, Homo sapiens
uuuugcuugggaaacucaa

SEQ ID NO: 553222 - RNA, 20 nt, Homo sapiens
uuuuggaaucauacugccua

SEQ ID NO: 553223 - RNA, 21 nt, Homo sapiens
uuuuggaauuaugucugcuga

SEQ ID NO: 553224 - RNA, 17 nt, Homo sapiens
uuuuggaggauagcuca

SEQ ID NO: 553225 - RNA, 23 nt, Homo sapiens
uuuuggcaaugacucaaagucug

SEQ ID NO: 553226 - RNA, 16 nt, Homo sapiens
uuuuggcucucccacc

SEQ ID NO: 553227 - RNA, 12 nt, Homo sapiens
uuuuggcuuuau

SEQ ID NO: 553228 - RNA, 23 nt, Homo sapiens
uuuuggucuucagccucccucag

SEQ ID NO: 553229 - RNA, 13 nt, Homo sapiens
aaagcuuacacag

SEQ ID NO: 553230 - RNA, 14 nt, Homo sapiens
aaagcuuauggcug

SEQ ID NO: 553231 - RNA, 12 nt, Homo sapiens
aaagcuucacag

SEQ ID NO: 553232 - RNA, 13 nt, Homo sapiens
aaagcuuccccaa

SEQ ID NO: 553233 - RNA, 18 nt, Homo sapiens
aaagcuuuaaaugucugc

SEQ ID NO: 553234 - RNA, 18 nt, Homo sapiens
aaagcuuuacuacugugg

SEQ ID NO: 553235 - RNA, 23 nt, Homo sapiens
aaagcuuucauguaaacugugca

SEQ ID NO: 553236 - RNA, 23 nt, Homo sapiens
aaagcuuucugccaccccuaaac

SEQ ID NO: 553237 - RNA, 20 nt, Homo sapiens
aaaggaaaaugaaacuagaa

SEQ ID NO: 553238 - RNA, 22 nt, Homo sapiens
aaaggaaaauugcacuauugca

SEQ ID NO: 553239 - RNA, 19 nt, Homo sapiens
aaaggaaagauuugccaau

SEQ ID NO: 553240 - RNA, 22 nt, Homo sapiens
aaaggaacuaacuuacugucca

SEQ ID NO: 553241 - RNA, 17 nt, Homo sapiens
aaaggaagccuugcuca

SEQ ID NO: 553242 - RNA, 19 nt, Homo sapiens
aaaggaagcuccacuguca

SEQ ID NO: 553243 - RNA, 14 nt, Homo sapiens
aaaggaaguucucc

SEQ ID NO: 553244 - RNA, 16 nt, Homo sapiens
aaaggaauacauugca

SEQ ID NO: 553245 - RNA, 13 nt, Homo sapiens
aaaggaaucucca

SEQ ID NO: 553246 - RNA, 21 nt, Homo sapiens
aaaggacaccuuuuaacucac

SEQ ID NO: 553247 - RNA, 16 nt, Homo sapiens
aaaggacaucagcaaa

SEQ ID NO: 553248 - RNA, 14 nt, Homo sapiens
aaaggacccuguga

SEQ ID NO: 553249 - RNA, 13 nt, Homo sapiens
aaaggacucugcu

SEQ ID NO: 553250 - RNA, 19 nt, Homo sapiens
aaaggacucugcuucaguc

SEQ ID NO: 553251 - RNA, 21 nt, Homo sapiens
aaaggacucugcuucagucca

SEQ ID NO: 553252 - RNA, 21 nt, Homo sapiens
aaaggagccuugauaauacuu

SEQ ID NO: 553253 - RNA, 15 nt, Homo sapiens
aaaggaugugauaua

SEQ ID NO: 553254 - RNA, 18 nt, Homo sapiens
aaaggauuuuaccaaagc

SEQ ID NO: 553255 - RNA, 20 nt, Homo sapiens
aaaggauuuuaccaaagcau

SEQ ID NO: 553256 - RNA, 24 nt, Homo sapiens
aaaggcaaaaagcauguguuugca

SEQ ID NO: 553257 - RNA, 14 nt, Homo sapiens
aaaggcagucuccg

SEQ ID NO: 553258 - RNA, 20 nt, Homo sapiens
aaaggcauuucaaagucuca

SEQ ID NO: 553259 - RNA, 22 nt, Homo sapiens
aaaggccauuaaagcucaaggu

SEQ ID NO: 553260 - RNA, 16 nt, Homo sapiens
aaaggccucaucuccu

SEQ ID NO: 553261 - RNA, 21 nt, Homo sapiens
aaaggcuagguacacagcucu

SEQ ID NO: 553262 - RNA, 23 nt, Homo sapiens
aaaggcucgauuuuguaucugca

SEQ ID NO: 553263 - RNA, 21 nt, Homo sapiens
aaaggcuguggcaucagggua

SEQ ID NO: 553264 - RNA, 15 nt, Homo sapiens
aaagggaaacuggcu

SEQ ID NO: 553265 - RNA, 13 nt, Homo sapiens
aaagggaaguagu

SEQ ID NO: 553266 - RNA, 19 nt, Homo sapiens
aaagggaaguaguccuugg

SEQ ID NO: 553267 - RNA, 17 nt, Homo sapiens
aaagggagaaaugccag

SEQ ID NO: 553268 - RNA, 16 nt, Homo sapiens
aaagggauaguccaaa

SEQ ID NO: 553269 - RNA, 22 nt, Homo sapiens
aaagggauguuauuauccuugg

SEQ ID NO: 553270 - RNA, 14 nt, Homo sapiens
aaagggcaguuuug

SEQ ID NO: 553271 - RNA, 17 nt, Homo sapiens
aaagggccuugacauca

SEQ ID NO: 553272 - RNA, 13 nt, Homo sapiens
aaaggggcccaag

SEQ ID NO: 553273 - RNA, 21 nt, Homo sapiens
aaaggguguaggggccaccuc

SEQ ID NO: 553274 - RNA, 13 nt, Homo sapiens
aaagguacuauau

SEQ ID NO: 553275 - RNA, 13 nt, Homo sapiens
aaagguaugcauu

SEQ ID NO: 553276 - RNA, 20 nt, Homo sapiens
aaagguauuuugaauaccau

SEQ ID NO: 553277 - RNA, 15 nt, Homo sapiens
aaaggucagacugaa

SEQ ID NO: 553278 - RNA, 16 nt, Homo sapiens
aaaggucauccaaaga

SEQ ID NO: 553279 - RNA, 19 nt, Homo sapiens
aaaugaaggaaaagcaugu

SEQ ID NO: 553280 - RNA, 14 nt, Homo sapiens
aaaugaaggaugaa

SEQ ID NO: 553281 - RNA, 21 nt, Homo sapiens
aaaugaaggcagaaaaauguc

SEQ ID NO: 553282 - RNA, 19 nt, Homo sapiens
aaaugaaguuuugauuuau

SEQ ID NO: 553283 - RNA, 22 nt, Homo sapiens
aaaugacaaccugaauuaucua

SEQ ID NO: 553284 - RNA, 19 nt, Homo sapiens
aaaugacaagugagacaaa

SEQ ID NO: 553285 - RNA, 11 nt, Homo sapiens
aaaugacaauu

SEQ ID NO: 553286 - RNA, 14 nt, Homo sapiens
aaaugaccaagaca

SEQ ID NO: 553287 - RNA, 18 nt, Homo sapiens
aaaugacccaaagaccaa

SEQ ID NO: 553288 - RNA, 21 nt, Homo sapiens
aaaugacuauuucuacccuuu

SEQ ID NO: 553289 - RNA, 12 nt, Homo sapiens
aaaugacuguau

SEQ ID NO: 553290 - RNA, 13 nt, Homo sapiens
aaaugacuuugaa

SEQ ID NO: 553291 - RNA, 15 nt, Homo sapiens
aaaugauagcagaau

SEQ ID NO: 553292 - RNA, 13 nt, Homo sapiens
aaaugauauuuag

SEQ ID NO: 553293 - RNA, 13 nt, Homo sapiens
aaaugauccugcc

SEQ ID NO: 553294 - RNA, 12 nt, Homo sapiens
aaaugauggaau

SEQ ID NO: 553295 - RNA, 14 nt, Homo sapiens
aaaugccacucccu

SEQ ID NO: 553296 - RNA, 14 nt, Homo sapiens
aaaugcccaaaaga

SEQ ID NO: 553297 - RNA, 21 nt, Homo sapiens
aaaugcccaucuaugucccuu

SEQ ID NO: 553298 - RNA, 19 nt, Homo sapiens
aaaugccugguaccagagg

SEQ ID NO: 553299 - RNA, 14 nt, Homo sapiens
aaaugcuauauugc

SEQ ID NO: 553300 - RNA, 16 nt, Homo sapiens
aaaugcuuacagggcu

SEQ ID NO: 553301 - RNA, 20 nt, Homo sapiens
aaaugcuuagacucuugaag

SEQ ID NO: 553302 - RNA, 16 nt, Homo sapiens
aaauggaaaguaacuc

SEQ ID NO: 553303 - RNA, 19 nt, Homo sapiens
aaauggagaacaguuucau

SEQ ID NO: 553304 - RNA, 16 nt, Homo sapiens
aaauggaggaauauga

SEQ ID NO: 553305 - RNA, 18 nt, Homo sapiens
aaauggcaccgagacaau

SEQ ID NO: 553306 - RNA, 13 nt, Homo sapiens
aaauggcaugaca

SEQ ID NO: 553307 - RNA, 12 nt, Homo sapiens
aaauggccuagc

SEQ ID NO: 553308 - RNA, 20 nt, Homo sapiens
aaauggcuacacucaucuga

SEQ ID NO: 553309 - RNA, 18 nt, Homo sapiens
aaaugggaaaaccagacu

SEQ ID NO: 553310 - RNA, 22 nt, Homo sapiens
aaaugggaaaccaguucaugca

SEQ ID NO: 553311 - RNA, 15 nt, Homo sapiens
aaaugggaauucuca

SEQ ID NO: 553312 - RNA, 17 nt, Homo sapiens
aaaugggagacagccuc

SEQ ID NO: 553313 - RNA, 17 nt, Homo sapiens
aaaugggcagugaaggc

SEQ ID NO: 553314 - RNA, 16 nt, Homo sapiens
aaaugggccauuccag

SEQ ID NO: 553315 - RNA, 19 nt, Homo sapiens
aaaugggccugccugccuc

SEQ ID NO: 553316 - RNA, 20 nt, Homo sapiens
aaaugggcuacuuuguccuu

SEQ ID NO: 553317 - RNA, 15 nt, Homo sapiens
aaauggguuacuuga

SEQ ID NO: 553318 - RNA, 21 nt, Homo sapiens
aaauggucacguuuggugcuu

SEQ ID NO: 553319 - RNA, 22 nt, Homo sapiens
aaaugguccaggagaaggccaa

SEQ ID NO: 553320 - RNA, 21 nt, Homo sapiens
aaauggucucuaacauuuccu

SEQ ID NO: 553321 - RNA, 19 nt, Homo sapiens
aaauguaacugugccaguu

SEQ ID NO: 553322 - RNA, 13 nt, Homo sapiens
aaauguaacuuga

SEQ ID NO: 553323 - RNA, 13 nt, Homo sapiens
aaauguacaccag

SEQ ID NO: 553324 - RNA, 22 nt, Homo sapiens
aaauguacacuggauauguugu

SEQ ID NO: 553325 - RNA, 17 nt, Homo sapiens
aaauguacagacauauu

SEQ ID NO: 553326 - RNA, 21 nt, Homo sapiens
aaauguacagaguaaccuaua

SEQ ID NO: 553327 - RNA, 16 nt, Homo sapiens
aaauguacauuaauua

SEQ ID NO: 553328 - RNA, 18 nt, Homo sapiens
aaauguaccggcuuccau

SEQ ID NO: 553329 - RNA, 12 nt, Homo sapiens
aaauguagcaau

SEQ ID NO: 553330 - RNA, 22 nt, Homo sapiens
aaauguaugucugguuccccag

SEQ ID NO: 553331 - RNA, 14 nt, Homo sapiens
aaauguaugugcuc

SEQ ID NO: 553332 - RNA, 17 nt, Homo sapiens
aaaugucacaguaaugc

SEQ ID NO: 553333 - RNA, 10 nt, Homo sapiens
aaauguccuc

SEQ ID NO: 553334 - RNA, 14 nt, Homo sapiens
aaauguccucuuga

SEQ ID NO: 553335 - RNA, 13 nt, Homo sapiens
aaaugucuaucaa

SEQ ID NO: 553336 - RNA, 15 nt, Homo sapiens
aaaugucucauguca

SEQ ID NO: 553337 - RNA, 19 nt, Homo sapiens
aaaugucuggucuguccac

SEQ ID NO: 553338 - RNA, 15 nt, Homo sapiens
aaaugucuucuccca

SEQ ID NO: 553339 - RNA, 11 nt, Homo sapiens
aaaugucuugc

SEQ ID NO: 553340 - RNA, 22 nt, Homo sapiens
aaaugucuugcuguugacauau

SEQ ID NO: 553341 - RNA, 22 nt, Homo sapiens
aaaugugacccagauccucaca

SEQ ID NO: 553342 - RNA, 18 nt, Homo sapiens
aaaugugcaaccacugcu

SEQ ID NO: 553343 - RNA, 22 nt, Homo sapiens
aaauguggaggcuaucaacaaa

SEQ ID NO: 553344 - RNA, 18 nt, Homo sapiens
aaaugugguacauacaca

SEQ ID NO: 553345 - RNA, 19 nt, Homo sapiens
aaaugugguuacacacuuu

SEQ ID NO: 553346 - RNA, 18 nt, Homo sapiens
aaaugugguugcuuaauu

SEQ ID NO: 553347 - RNA, 13 nt, Homo sapiens
aacucuuaagcaa

SEQ ID NO: 553348 - RNA, 21 nt, Homo sapiens
aacucuucaguuaauucuuag

SEQ ID NO: 553349 - RNA, 21 nt, Homo sapiens
aacucuucgaagccuugccua

SEQ ID NO: 553350 - RNA, 20 nt, Homo sapiens
aacucuugguauuacccucc

SEQ ID NO: 553351 - RNA, 16 nt, Homo sapiens
aacugaaaaaugucag

SEQ ID NO: 553352 - RNA, 18 nt, Homo sapiens
aacugaaagguagacuuu

SEQ ID NO: 553353 - RNA, 15 nt, Homo sapiens
aacugaacauuccag

SEQ ID NO: 553354 - RNA, 14 nt, Homo sapiens
aacugaagccagaa

SEQ ID NO: 553355 - RNA, 18 nt, Homo sapiens
aacugaaggcuaaaaagc

SEQ ID NO: 553356 - RNA, 18 nt, Homo sapiens
aacugaauaaauaccucu

SEQ ID NO: 553357 - RNA, 16 nt, Homo sapiens
aacugaaucacuuaaa

SEQ ID NO: 553358 - RNA, 20 nt, Homo sapiens
aacugaaucuauggcuuuaa

SEQ ID NO: 553359 - RNA, 16 nt, Homo sapiens
aacugacaaugaaggg

SEQ ID NO: 553360 - RNA, 17 nt, Homo sapiens
aacugacauugcuccaa

SEQ ID NO: 553361 - RNA, 16 nt, Homo sapiens
aacugacucuguuauu

SEQ ID NO: 553362 - RNA, 18 nt, Homo sapiens
aacugacugccuugcuaa

SEQ ID NO: 553363 - RNA, 13 nt, Homo sapiens
aacugacuuucuc

SEQ ID NO: 553364 - RNA, 13 nt, Homo sapiens
aacugagagucau

SEQ ID NO: 553365 - RNA, 18 nt, Homo sapiens
aacugagagucauauaca

SEQ ID NO: 553366 - RNA, 17 nt, Homo sapiens
aacugaggcucaggcca

SEQ ID NO: 553367 - RNA, 19 nt, Homo sapiens
aacugaggcucaggccaca

SEQ ID NO: 553368 - RNA, 23 nt, Homo sapiens
aacugaggcucaggccacauaau

SEQ ID NO: 553369 - RNA, 16 nt, Homo sapiens
aacugauaaguuucau

SEQ ID NO: 553370 - RNA, 16 nt, Homo sapiens
aacugaucauguuuau

SEQ ID NO: 553371 - RNA, 18 nt, Homo sapiens
aacugauucacaucucau

SEQ ID NO: 553372 - RNA, 19 nt, Homo sapiens
aacugcaaauauugucaua

SEQ ID NO: 553373 - RNA, 16 nt, Homo sapiens
aacugcagaccucacu

SEQ ID NO: 553374 - RNA, 23 nt, Homo sapiens
aacugcauaagugaaaaucuuac

SEQ ID NO: 553375 - RNA, 10 nt, Homo sapiens
aacugcauuu

SEQ ID NO: 553376 - RNA, 19 nt, Homo sapiens
aacugcccuuccagguggg

SEQ ID NO: 553377 - RNA, 11 nt, Homo sapiens
aacugccucag

SEQ ID NO: 553378 - RNA, 22 nt, Homo sapiens
aacugcugcugugcacauuuau

SEQ ID NO: 553379 - RNA, 23 nt, Homo sapiens
aacugcuuugguuccuaaggaag

SEQ ID NO: 553380 - RNA, 17 nt, Homo sapiens
aacuggaaaacagaaca

SEQ ID NO: 553381 - RNA, 18 nt, Homo sapiens
aacuggacaagauuuccu

SEQ ID NO: 553382 - RNA, 19 nt, Homo sapiens
aacuggaggaguuccuuga

SEQ ID NO: 553383 - RNA, 17 nt, Homo sapiens
aacuggcaguuuuccau

SEQ ID NO: 553384 - RNA, 14 nt, Homo sapiens
aacuggcaucugac

SEQ ID NO: 553385 - RNA, 17 nt, Homo sapiens
aacugggcucaagugau

SEQ ID NO: 553386 - RNA, 14 nt, Homo sapiens
aacugggguugagg

SEQ ID NO: 553387 - RNA, 13 nt, Homo sapiens
aacugguacaauu

SEQ ID NO: 553388 - RNA, 23 nt, Homo sapiens
aacugguauuguuuacguuugau

SEQ ID NO: 553389 - RNA, 13 nt, Homo sapiens
aacuguacagugu

SEQ ID NO: 553390 - RNA, 20 nt, Homo sapiens
aacuguacuacaucuaguua

SEQ ID NO: 553391 - RNA, 13 nt, Homo sapiens
aacuguagcuauc

SEQ ID NO: 553392 - RNA, 20 nt, Homo sapiens
aacuguauacauuacaauca

SEQ ID NO: 553393 - RNA, 16 nt, Homo sapiens
aacuguauauauuccc

SEQ ID NO: 553394 - RNA, 24 nt, Homo sapiens
aacuguccggccccgagucacuca

SEQ ID NO: 553395 - RNA, 17 nt, Homo sapiens
aacugucucaaaaggau

SEQ ID NO: 553396 - RNA, 18 nt, Homo sapiens
aacugucuugugagcuga

SEQ ID NO: 553397 - RNA, 19 nt, Homo sapiens
aacugugaaauuuacaaau

SEQ ID NO: 553398 - RNA, 16 nt, Homo sapiens
aacugugcuccucacu

SEQ ID NO: 553399 - RNA, 13 nt, Homo sapiens
aacuguguugcca

SEQ ID NO: 553400 - RNA, 20 nt, Homo sapiens
aacuguugauugcaggaaua

SEQ ID NO: 553401 - RNA, 23 nt, Homo sapiens
aacuguuggagagagauguuccu

SEQ ID NO: 553402 - RNA, 14 nt, Homo sapiens
aacuguuuccccag

SEQ ID NO: 553403 - RNA, 22 nt, Homo sapiens
aacuguuuuagaaauugguaca

SEQ ID NO: 553404 - RNA, 18 nt, Homo sapiens
aacuguuuuagaccuaua

SEQ ID NO: 553405 - RNA, 12 nt, Homo sapiens
aacuguuuucuc

SEQ ID NO: 553406 - RNA, 13 nt, Homo sapiens
aacuguuuucuca

SEQ ID NO: 553407 - RNA, 23 nt, Homo sapiens
aacuguuuuguaagugcugcuau

SEQ ID NO: 553408 - RNA, 19 nt, Homo sapiens
aacuuaaaagucaguauca

SEQ ID NO: 553409 - RNA, 14 nt, Homo sapiens
aacuuaaacacaga

SEQ ID NO: 553410 - RNA, 20 nt, Homo sapiens
aaauacacuuccugcuuaaa

SEQ ID NO: 553411 - RNA, 17 nt, Homo sapiens
aaauacagauagauaua

SEQ ID NO: 553412 - RNA, 15 nt, Homo sapiens
aaauacagucuucca

SEQ ID NO: 553413 - RNA, 22 nt, Homo sapiens
aaauacauaucgcugacuucau

SEQ ID NO: 553414 - RNA, 21 nt, Homo sapiens
aaauacaugaagcuucaugca

SEQ ID NO: 553415 - RNA, 13 nt, Homo sapiens
aaauacauguuca

SEQ ID NO: 553416 - RNA, 16 nt, Homo sapiens
aaauaccaacuguaca

SEQ ID NO: 553417 - RNA, 15 nt, Homo sapiens
aaauaccagccagua

SEQ ID NO: 553418 - RNA, 20 nt, Homo sapiens
aaauaccagugaaccaaaga

SEQ ID NO: 553419 - RNA, 12 nt, Homo sapiens
aaauaccaguuc

SEQ ID NO: 553420 - RNA, 16 nt, Homo sapiens
aaauacccacuaacaa

SEQ ID NO: 553421 - RNA, 15 nt, Homo sapiens
aaauaccuuuucuca

SEQ ID NO: 553422 - RNA, 14 nt, Homo sapiens
aaauacgugucaaa

SEQ ID NO: 553423 - RNA, 20 nt, Homo sapiens
aaauacuaugcaguaucucu

SEQ ID NO: 553424 - RNA, 16 nt, Homo sapiens
aaauacuggacucagg

SEQ ID NO: 553425 - RNA, 13 nt, Homo sapiens
aaauacuggugca

SEQ ID NO: 553426 - RNA, 20 nt, Homo sapiens
aaauacuuagagcagugaag

SEQ ID NO: 553427 - RNA, 15 nt, Homo sapiens
aaauacuucuugaag

SEQ ID NO: 553428 - RNA, 15 nt, Homo sapiens
aaauacuuuuacucu

SEQ ID NO: 553429 - RNA, 15 nt, Homo sapiens
aaauagaaacuugcu

SEQ ID NO: 553430 - RNA, 15 nt, Homo sapiens
aaauagacaaaaagu

SEQ ID NO: 553431 - RNA, 14 nt, Homo sapiens
aaauagaccucuca

SEQ ID NO: 553432 - RNA, 20 nt, Homo sapiens
aaauagagcaaccaguacua

SEQ ID NO: 553433 - RNA, 17 nt, Homo sapiens
aaauagagccugaggga

SEQ ID NO: 553434 - RNA, 20 nt, Homo sapiens
aaauagaguaaauacaggua

SEQ ID NO: 553435 - RNA, 17 nt, Homo sapiens
aaauagcaaaagaagaa

SEQ ID NO: 553436 - RNA, 19 nt, Homo sapiens
aaauagcaagagugugaaa

SEQ ID NO: 553437 - RNA, 11 nt, Homo sapiens
aaauagcagua

SEQ ID NO: 553438 - RNA, 20 nt, Homo sapiens
aaauagcugaaaagggcacu

SEQ ID NO: 553439 - RNA, 20 nt, Homo sapiens
aaauagcugugaacagagag

SEQ ID NO: 553440 - RNA, 16 nt, Homo sapiens
aaauaggauugcuuca

SEQ ID NO: 553441 - RNA, 19 nt, Homo sapiens
aaauaggcagaauggaauc

SEQ ID NO: 553442 - RNA, 13 nt, Homo sapiens
aaauagucuucca

SEQ ID NO: 553443 - RNA, 20 nt, Homo sapiens
aaauaguguaagaacuguac

SEQ ID NO: 553444 - RNA, 22 nt, Homo sapiens
aaauaguguaagaacuguacau

SEQ ID NO: 553445 - RNA, 13 nt, Homo sapiens
aaauaguuugcaa

SEQ ID NO: 553446 - RNA, 13 nt, Homo sapiens
aaauauaaauauc

SEQ ID NO: 553447 - RNA, 16 nt, Homo sapiens
aaauauaagacauuug

SEQ ID NO: 553448 - RNA, 15 nt, Homo sapiens
aaauauaauaugcac

SEQ ID NO: 553449 - RNA, 14 nt, Homo sapiens
aaauauaauuuaca

SEQ ID NO: 553450 - RNA, 14 nt, Homo sapiens
aaauauauauguca

SEQ ID NO: 553451 - RNA, 23 nt, Homo sapiens
aaauauauauuauauauuuacaa

SEQ ID NO: 553452 - RNA, 21 nt, Homo sapiens
aaauauaucuagaacuaucau

SEQ ID NO: 553453 - RNA, 14 nt, Homo sapiens
aaauauauuucaga

SEQ ID NO: 553454 - RNA, 18 nt, Homo sapiens
aaauaucauacuguucaa

SEQ ID NO: 553455 - RNA, 16 nt, Homo sapiens
aaauaucuugcuuuca

SEQ ID NO: 553456 - RNA, 18 nt, Homo sapiens
aaauaucuuggccuaaac

SEQ ID NO: 553457 - RNA, 18 nt, Homo sapiens
aaauaugaaauuccagca

SEQ ID NO: 553458 - RNA, 15 nt, Homo sapiens
aaauaugagagcaau

SEQ ID NO: 553459 - RNA, 20 nt, Homo sapiens
aaauaugauuuuauuugaca

SEQ ID NO: 553460 - RNA, 16 nt, Homo sapiens
aaauauguauuuacca

SEQ ID NO: 553461 - RNA, 18 nt, Homo sapiens
aaauauguauuuuccuaa

SEQ ID NO: 553462 - RNA, 15 nt, Homo sapiens
aaauaugugacugac

SEQ ID NO: 553463 - RNA, 18 nt, Homo sapiens
aaauauuauuagauuuau

SEQ ID NO: 553464 - RNA, 20 nt, Homo sapiens
aaauauuauugguguuuacc

SEQ ID NO: 553465 - RNA, 16 nt, Homo sapiens
aaauauucaaguaaca

SEQ ID NO: 553466 - RNA, 18 nt, Homo sapiens
aaauauuccaagcuucau

SEQ ID NO: 553467 - RNA, 14 nt, Homo sapiens
aaauauugucauaa

SEQ ID NO: 553468 - RNA, 20 nt, Homo sapiens
aaauauugucauaggauuaa

SEQ ID NO: 553469 - RNA, 17 nt, Homo sapiens
aaauauuuaccuugaaa

SEQ ID NO: 553470 - RNA, 20 nt, Homo sapiens
aaauauuucacauccuguaa

SEQ ID NO: 553471 - RNA, 12 nt, Homo sapiens
aaauauuucagg

SEQ ID NO: 553472 - RNA, 13 nt, Homo sapiens
aaauauuucccau

SEQ ID NO: 553473 - RNA, 16 nt, Homo sapiens
aaauauuucugauacu

SEQ ID NO: 553474 - RNA, 18 nt, Homo sapiens
aaauauuuuagccuuaaa

SEQ ID NO: 553475 - RNA, 16 nt, Homo sapiens
aaauauuuugucuaaa

SEQ ID NO: 553476 - RNA, 18 nt, Homo sapiens
aaauauuuuuaugugcaa

SEQ ID NO: 553477 - RNA, 19 nt, Homo sapiens
aaaucaaaagggccaaaga

SEQ ID NO: 553478 - RNA, 15 nt, Homo sapiens
aaaucaacagaagca

SEQ ID NO: 553479 - RNA, 13 nt, Homo sapiens
aacuuaacauuca

SEQ ID NO: 553480 - RNA, 22 nt, Homo sapiens
aacuuaagcugggauaaucaca

SEQ ID NO: 553481 - RNA, 16 nt, Homo sapiens
aacuuaaggaagcaaa

SEQ ID NO: 553482 - RNA, 16 nt, Homo sapiens
aacuuaauaguauuua

SEQ ID NO: 553483 - RNA, 22 nt, Homo sapiens
aacuuacacugaucaauuucaa

SEQ ID NO: 553484 - RNA, 14 nt, Homo sapiens
aacuuagagaggua

SEQ ID NO: 553485 - RNA, 11 nt, Homo sapiens
aacuuagccau

SEQ ID NO: 553486 - RNA, 23 nt, Homo sapiens
aacuuagccauuuuucaaagcaa

SEQ ID NO: 553487 - RNA, 13 nt, Homo sapiens
aacuuagcuuuau

SEQ ID NO: 553488 - RNA, 16 nt, Homo sapiens
aacuucaccuacauua

SEQ ID NO: 553489 - RNA, 21 nt, Homo sapiens
aacuucaccuacauuaucuca

SEQ ID NO: 553490 - RNA, 20 nt, Homo sapiens
aacuucagaaagacagugac

SEQ ID NO: 553491 - RNA, 14 nt, Homo sapiens
aacuucagacugaa

SEQ ID NO: 553492 - RNA, 23 nt, Homo sapiens
aacuucaucaguguggcuucuau

SEQ ID NO: 553493 - RNA, 13 nt, Homo sapiens
aacuucauuugau

SEQ ID NO: 553494 - RNA, 20 nt, Homo sapiens
aacuuccaacaagccucaaa

SEQ ID NO: 553495 - RNA, 21 nt, Homo sapiens
aacuuccacaagagugaauuu

SEQ ID NO: 553496 - RNA, 23 nt, Homo sapiens
aacuuccacauuauacauuugau

SEQ ID NO: 553497 - RNA, 16 nt, Homo sapiens
aacuucccgucccaua

SEQ ID NO: 553498 - RNA, 21 nt, Homo sapiens
aacuucugacuuacugucagu

SEQ ID NO: 553499 - RNA, 21 nt, Homo sapiens
aacuucuugaaucuagggagg

SEQ ID NO: 553500 - RNA, 18 nt, Homo sapiens
aacuucuuucuauuugac

SEQ ID NO: 553501 - RNA, 18 nt, Homo sapiens
aacuucuuuuaaaccuca

SEQ ID NO: 553502 - RNA, 16 nt, Homo sapiens
aacuugaaaauauaug

SEQ ID NO: 553503 - RNA, 23 nt, Homo sapiens
aacuugagcucuguaacuuacac

SEQ ID NO: 553504 - RNA, 12 nt, Homo sapiens
aacuugcugcuu

SEQ ID NO: 553505 - RNA, 20 nt, Homo sapiens
aacuugggauaagaguguga

SEQ ID NO: 553506 - RNA, 12 nt, Homo sapiens
aacuugggccac

SEQ ID NO: 553507 - RNA, 18 nt, Homo sapiens
aacuugggggaggaggaa

SEQ ID NO: 553508 - RNA, 12 nt, Homo sapiens
aacuuguaaaua

SEQ ID NO: 553509 - RNA, 13 nt, Homo sapiens
aacuuguccuaug

SEQ ID NO: 553510 - RNA, 17 nt, Homo sapiens
aacuuguguacugauaa

SEQ ID NO: 553511 - RNA, 22 nt, Homo sapiens
aacuuuaccauaaagccuuuaa

SEQ ID NO: 553512 - RNA, 22 nt, Homo sapiens
aacuuuacuguccuaacauggu

SEQ ID NO: 553513 - RNA, 16 nt, Homo sapiens
aacuuuccaaacacca

SEQ ID NO: 553514 - RNA, 19 nt, Homo sapiens
aacuuuccucgccugacaa

SEQ ID NO: 553515 - RNA, 22 nt, Homo sapiens
aacuuuccucgccugacaacca

SEQ ID NO: 553516 - RNA, 18 nt, Homo sapiens
aacuuuccugacuuacaa

SEQ ID NO: 553517 - RNA, 23 nt, Homo sapiens
aacuuuccugacuuacaauacca

SEQ ID NO: 553518 - RNA, 23 nt, Homo sapiens
aacuuugacaaccaugagaccac

SEQ ID NO: 553519 - RNA, 18 nt, Homo sapiens
aacuuugaggaacauuca

SEQ ID NO: 553520 - RNA, 15 nt, Homo sapiens
aacuuugccucaaga

SEQ ID NO: 553521 - RNA, 20 nt, Homo sapiens
aacuuuggcuuucauauucu

SEQ ID NO: 553522 - RNA, 22 nt, Homo sapiens
aacuuuggcuuucauauucucu

SEQ ID NO: 553523 - RNA, 13 nt, Homo sapiens
aacuuuguauuaa

SEQ ID NO: 553524 - RNA, 19 nt, Homo sapiens
aacuuuguggaugucuucc

SEQ ID NO: 553525 - RNA, 20 nt, Homo sapiens
aacuuuguggaugucuuccu

SEQ ID NO: 553526 - RNA, 21 nt, Homo sapiens
aacuuuucaccaaugagccuu

SEQ ID NO: 553527 - RNA, 16 nt, Homo sapiens
aacuuuugacaaucaa

SEQ ID NO: 553528 - RNA, 17 nt, Homo sapiens
aacuuuugguaucuacu

SEQ ID NO: 553529 - RNA, 19 nt, Homo sapiens
aagaaaaaaaaagucuuug

SEQ ID NO: 553530 - RNA, 15 nt, Homo sapiens
aagaaaaaauaucuu

SEQ ID NO: 553531 - RNA, 16 nt, Homo sapiens
aagaaaaaauaucuug

SEQ ID NO: 553532 - RNA, 16 nt, Homo sapiens
aagaaaaacaccgcuu

SEQ ID NO: 553533 - RNA, 15 nt, Homo sapiens
aagaaaaaggaacua

SEQ ID NO: 553534 - RNA, 17 nt, Homo sapiens
aagaaaaagguuugcau

SEQ ID NO: 553535 - RNA, 14 nt, Homo sapiens
aagaaaaaugccug

SEQ ID NO: 553536 - RNA, 13 nt, Homo sapiens
aagaaaaccacaa

SEQ ID NO: 553537 - RNA, 16 nt, Homo sapiens
aagcagucuugcucug

SEQ ID NO: 553538 - RNA, 17 nt, Homo sapiens
aagcagugcacauuuca

SEQ ID NO: 553539 - RNA, 18 nt, Homo sapiens
aagcagugccuuccauaa

SEQ ID NO: 553540 - RNA, 20 nt, Homo sapiens
aagcaguggccuuauugcau

SEQ ID NO: 553541 - RNA, 17 nt, Homo sapiens
aagcaguggccuuuuuc

SEQ ID NO: 553542 - RNA, 20 nt, Homo sapiens
aagcaguuacuaauaugccu

SEQ ID NO: 553543 - RNA, 15 nt, Homo sapiens
aagcaguuaguuccu

SEQ ID NO: 553544 - RNA, 16 nt, Homo sapiens
aagcauagcuacaauu

SEQ ID NO: 553545 - RNA, 12 nt, Homo sapiens
aagcaucugcca

SEQ ID NO: 553546 - RNA, 15 nt, Homo sapiens
aagcaugaaaaagca

SEQ ID NO: 553547 - RNA, 16 nt, Homo sapiens
aagcaugaaacauuuc

SEQ ID NO: 553548 - RNA, 23 nt, Homo sapiens
aagcaugaucuuguuacugugau

SEQ ID NO: 553549 - RNA, 15 nt, Homo sapiens
aagcauguagccagu

SEQ ID NO: 553550 - RNA, 22 nt, Homo sapiens
aagcaugucucucugccaagau

SEQ ID NO: 553551 - RNA, 17 nt, Homo sapiens
aagcaugugagacuggu

SEQ ID NO: 553552 - RNA, 17 nt, Homo sapiens
aagcauugacuugccgu

SEQ ID NO: 553553 - RNA, 16 nt, Homo sapiens
aagcauuuucauuucu

SEQ ID NO: 553554 - RNA, 12 nt, Homo sapiens
aagcauuuugga

SEQ ID NO: 553555 - RNA, 14 nt, Homo sapiens
aagcauuuuuccau

SEQ ID NO: 553556 - RNA, 19 nt, Homo sapiens
aagcauuuuuuaaccuccu

SEQ ID NO: 553557 - RNA, 16 nt, Homo sapiens
aagccaaacucugcca

SEQ ID NO: 553558 - RNA, 23 nt, Homo sapiens
aagccaaagaaaaauaacccuuu

SEQ ID NO: 553559 - RNA, 19 nt, Homo sapiens
aagccaaauuuccaguuua

SEQ ID NO: 553560 - RNA, 14 nt, Homo sapiens
aagccaagcaaacc

SEQ ID NO: 553561 - RNA, 21 nt, Homo sapiens
aagccaagucagcuuugccuu

SEQ ID NO: 553562 - RNA, 19 nt, Homo sapiens
aagccaauucagacaggca

SEQ ID NO: 553563 - RNA, 21 nt, Homo sapiens
aagccaauucagacaggcaaa

SEQ ID NO: 553564 - RNA, 16 nt, Homo sapiens
aagccacacucugggc

SEQ ID NO: 553565 - RNA, 17 nt, Homo sapiens
aagccacagaagccagg

SEQ ID NO: 553566 - RNA, 12 nt, Homo sapiens
aagccacaucuu

SEQ ID NO: 553567 - RNA, 21 nt, Homo sapiens
aagccacauuauuucuagucc

SEQ ID NO: 553568 - RNA, 14 nt, Homo sapiens
aagccaccucacca

SEQ ID NO: 553569 - RNA, 15 nt, Homo sapiens
aagccacucuuccaa

SEQ ID NO: 553570 - RNA, 14 nt, Homo sapiens
aagccacuguauga

SEQ ID NO: 553571 - RNA, 16 nt, Homo sapiens
aagccagcaggagcuc

SEQ ID NO: 553572 - RNA, 20 nt, Homo sapiens
aagccagccaugcauuguua

SEQ ID NO: 553573 - RNA, 22 nt, Homo sapiens
aagccagggcuggagaacaaga

SEQ ID NO: 553574 - RNA, 20 nt, Homo sapiens
aagccaguuccgucuucccu

SEQ ID NO: 553575 - RNA, 22 nt, Homo sapiens
aagccauagagccccuccuggu

SEQ ID NO: 553576 - RNA, 17 nt, Homo sapiens
aagccaucauccuccau

SEQ ID NO: 553577 - RNA, 15 nt, Homo sapiens
aagccauucuuuuaa

SEQ ID NO: 553578 - RNA, 15 nt, Homo sapiens
aagcccaauauuaua

SEQ ID NO: 553579 - RNA, 21 nt, Homo sapiens
aagcccaauuuugacccuggu

SEQ ID NO: 553580 - RNA, 14 nt, Homo sapiens
aagcccacccagau

SEQ ID NO: 553581 - RNA, 17 nt, Homo sapiens
aagcccagcgguucaca

SEQ ID NO: 553582 - RNA, 18 nt, Homo sapiens
aagccccauuuccucaca

SEQ ID NO: 553583 - RNA, 19 nt, Homo sapiens
aagcccccagggccuccag

SEQ ID NO: 553584 - RNA, 16 nt, Homo sapiens
aagcccccccuuccac

SEQ ID NO: 553585 - RNA, 18 nt, Homo sapiens
aagccccccuuuggcacu

SEQ ID NO: 553586 - RNA, 18 nt, Homo sapiens
aagccccgacacacgggg

SEQ ID NO: 553587 - RNA, 17 nt, Homo sapiens
aagccccucguugccca

SEQ ID NO: 553588 - RNA, 21 nt, Homo sapiens
aagccccugugacccucucac

SEQ ID NO: 553589 - RNA, 16 nt, Homo sapiens
aagcccuccaaaagca

SEQ ID NO: 553590 - RNA, 20 nt, Homo sapiens
aagcccuccaaaagcacuua

SEQ ID NO: 553591 - RNA, 18 nt, Homo sapiens
aagcccuccccaucccau

SEQ ID NO: 553592 - RNA, 15 nt, Homo sapiens
aagcccuuuacuuga

SEQ ID NO: 553593 - RNA, 16 nt, Homo sapiens
aagcccuuuauuuccu

SEQ ID NO: 553594 - RNA, 13 nt, Homo sapiens
aagcccuuugcca

SEQ ID NO: 553595 - RNA, 16 nt, Homo sapiens
aagccuaaaugccuua

SEQ ID NO: 553596 - RNA, 14 nt, Homo sapiens
aagccuaauuccag

SEQ ID NO: 553597 - RNA, 18 nt, Homo sapiens
aagccuauguaugccaug

SEQ ID NO: 553598 - RNA, 16 nt, Homo sapiens
aagccucagaaaggga

SEQ ID NO: 553599 - RNA, 15 nt, Homo sapiens
aagccuccaaggguu

SEQ ID NO: 553600 - RNA, 20 nt, Homo sapiens
aagccuccccaguucuacug

SEQ ID NO: 553601 - RNA, 17 nt, Homo sapiens
aagccuccuauggaaug

SEQ ID NO: 553602 - RNA, 20 nt, Homo sapiens
aagccucgggccacaugggu

SEQ ID NO: 553603 - RNA, 13 nt, Homo sapiens
aagccugaggcug

SEQ ID NO: 553604 - RNA, 20 nt, Homo sapiens
aagccugaugcugacauuca

SEQ ID NO: 553605 - RNA, 17 nt, Homo sapiens
aagccuggacucugccc

SEQ ID NO: 553606 - RNA, 13 nt, Homo sapiens
aagccuggcaagg

SEQ ID NO: 553607 - RNA, 15 nt, Homo sapiens
aagccuggcacccac

SEQ ID NO: 553608 - RNA, 16 nt, Homo sapiens
aagccuggcacccacc

SEQ ID NO: 553609 - RNA, 17 nt, Homo sapiens
aagccuuaauuugcaca

SEQ ID NO: 553610 - RNA, 22 nt, Homo sapiens
aagccuuaucaagugucuucca

SEQ ID NO: 553611 - RNA, 13 nt, Homo sapiens
aagccuugccuaa

SEQ ID NO: 553612 - RNA, 17 nt, Homo sapiens
aagccuuuggcucuucu

SEQ ID NO: 553613 - RNA, 18 nt, Homo sapiens
aagcgagcagucagcauu

SEQ ID NO: 553614 - RNA, 19 nt, Homo sapiens
aagcgauuaugaaagcaac

SEQ ID NO: 553615 - RNA, 18 nt, Homo sapiens
aagcggagguugcaggga

SEQ ID NO: 553616 - RNA, 17 nt, Homo sapiens
aagcggauuuccaggga

SEQ ID NO: 553617 - RNA, 17 nt, Homo sapiens
aagcggcuguuuacugc

SEQ ID NO: 553618 - RNA, 19 nt, Homo sapiens
aagcguaauuuugccaaau

SEQ ID NO: 553619 - RNA, 21 nt, Homo sapiens
aagcguaauuuugccaaauaa

SEQ ID NO: 553620 - RNA, 16 nt, Homo sapiens
aagcguucagugaugu

SEQ ID NO: 553621 - RNA, 18 nt, Homo sapiens
aagcguuggauguagcau

SEQ ID NO: 553622 - RNA, 18 nt, Homo sapiens
aagcuaaaaugauuuuau

SEQ ID NO: 553623 - RNA, 22 nt, Homo sapiens
aagcuaaauccuuuacuguuag

SEQ ID NO: 553624 - RNA, 15 nt, Homo sapiens
aagcuaacuuccacu

SEQ ID NO: 553625 - RNA, 14 nt, Homo sapiens
aagcuaagccuuau

SEQ ID NO: 553626 - RNA, 17 nt, Homo sapiens
aagcuagaaggccacau

SEQ ID NO: 553627 - RNA, 20 nt, Homo sapiens
aagcucagggcccaucccuu

SEQ ID NO: 553628 - RNA, 16 nt, Homo sapiens
aagcuccacugucacc

SEQ ID NO: 553629 - RNA, 19 nt, Homo sapiens
aagcucuaguucuuaacaa

SEQ ID NO: 553630 - RNA, 20 nt, Homo sapiens
aagcucucccuuguuuacuc

SEQ ID NO: 553631 - RNA, 21 nt, Homo sapiens
aagcucuucacugaaacuggu

SEQ ID NO: 553632 - RNA, 14 nt, Homo sapiens
aagcucuucauuuc

SEQ ID NO: 553633 - RNA, 15 nt, Homo sapiens
aagcucuucuuccca

SEQ ID NO: 553634 - RNA, 19 nt, Homo sapiens
aagcugaaauuuuugugua

SEQ ID NO: 553635 - RNA, 21 nt, Homo sapiens
aagcugaaauuuuuguguaaa

SEQ ID NO: 553636 - RNA, 14 nt, Homo sapiens
aagcugaaugauuc

SEQ ID NO: 553637 - RNA, 19 nt, Homo sapiens
aagcugacuuggcacuuaa

SEQ ID NO: 553638 - RNA, 15 nt, Homo sapiens
aagcugauagccaga

SEQ ID NO: 553639 - RNA, 19 nt, Homo sapiens
aagcugauuacugucaaua

SEQ ID NO: 553640 - RNA, 18 nt, Homo sapiens
aagcugcacaugugccac

SEQ ID NO: 553641 - RNA, 18 nt, Homo sapiens
aagcugcaggcuuugcca

SEQ ID NO: 553642 - RNA, 14 nt, Homo sapiens
aagcugcauguuaa

SEQ ID NO: 553643 - RNA, 12 nt, Homo sapiens
aagcugccucaa

SEQ ID NO: 553644 - RNA, 20 nt, Homo sapiens
aagcugccugugccaugccc

SEQ ID NO: 553645 - RNA, 14 nt, Homo sapiens
aagcugcucaggga

SEQ ID NO: 553646 - RNA, 12 nt, Homo sapiens
aagcugcuccag

SEQ ID NO: 553647 - RNA, 14 nt, Homo sapiens
aagcugcuuuagaa

SEQ ID NO: 553648 - RNA, 16 nt, Homo sapiens
aagcuggaacauuuga

SEQ ID NO: 553649 - RNA, 17 nt, Homo sapiens
aagcuggagugcugcuu

SEQ ID NO: 553650 - RNA, 19 nt, Homo sapiens
aagcuggcuuuucccauuu

SEQ ID NO: 553651 - RNA, 22 nt, Homo sapiens
aagcugggagcacaggcacugc

SEQ ID NO: 553652 - RNA, 19 nt, Homo sapiens
aagcugggauaaucacauu

SEQ ID NO: 553653 - RNA, 22 nt, Homo sapiens
aagcuggugccccacugaauuu

SEQ ID NO: 553654 - RNA, 21 nt, Homo sapiens
aagcuguaagauaauguugcu

SEQ ID NO: 553655 - RNA, 17 nt, Homo sapiens
aagcuguaggacuguuu

SEQ ID NO: 553656 - RNA, 15 nt, Homo sapiens
aagcugugacuucuc

SEQ ID NO: 553657 - RNA, 23 nt, Homo sapiens
aagcuguguccuugcaccugcau

SEQ ID NO: 553658 - RNA, 16 nt, Homo sapiens
aagcuguuauuugcag

SEQ ID NO: 553659 - RNA, 14 nt, Homo sapiens
aagcuguugaaguc

SEQ ID NO: 553660 - RNA, 15 nt, Homo sapiens
aaguaucaugcauuc

SEQ ID NO: 553661 - RNA, 17 nt, Homo sapiens
aaguaucccuacuguaa

SEQ ID NO: 553662 - RNA, 21 nt, Homo sapiens
aaguaugaauauuacucucaa

SEQ ID NO: 553663 - RNA, 16 nt, Homo sapiens
aaguaugagggaaaau

SEQ ID NO: 553664 - RNA, 13 nt, Homo sapiens
aaguaugccuuaa

SEQ ID NO: 553665 - RNA, 16 nt, Homo sapiens
aaguaugguauuacaa

SEQ ID NO: 553666 - RNA, 18 nt, Homo sapiens
aaguauguaaacaggaga

SEQ ID NO: 553667 - RNA, 18 nt, Homo sapiens
aaguauguuuuuacauua

SEQ ID NO: 553668 - RNA, 16 nt, Homo sapiens
aaguauuauuuuacaa

SEQ ID NO: 553669 - RNA, 10 nt, Homo sapiens
aaguauuuaa

SEQ ID NO: 553670 - RNA, 12 nt, Homo sapiens
aaguauuugaaa

SEQ ID NO: 553671 - RNA, 13 nt, Homo sapiens
aagucaaaugcca

SEQ ID NO: 553672 - RNA, 14 nt, Homo sapiens
aagucaaaugucac

SEQ ID NO: 553673 - RNA, 17 nt, Homo sapiens
aagucaagcacauguaa

SEQ ID NO: 553674 - RNA, 12 nt, Homo sapiens
aagucacaucca

SEQ ID NO: 553675 - RNA, 15 nt, Homo sapiens
aagucacccuuccac

SEQ ID NO: 553676 - RNA, 22 nt, Homo sapiens
aagucacggcugcgcacugugu

SEQ ID NO: 553677 - RNA, 16 nt, Homo sapiens
aagucagagacagaua

SEQ ID NO: 553678 - RNA, 20 nt, Homo sapiens
aagucagagacagauaccuc

SEQ ID NO: 553679 - RNA, 22 nt, Homo sapiens
aagucagaucuggucuaguuaa

SEQ ID NO: 553680 - RNA, 17 nt, Homo sapiens
aagucagccacacuggg

SEQ ID NO: 553681 - RNA, 16 nt, Homo sapiens
aagucaggccaggugg

SEQ ID NO: 553682 - RNA, 17 nt, Homo sapiens
aagucaguggcuuugca

SEQ ID NO: 553683 - RNA, 14 nt, Homo sapiens
aagucaucuacuua

SEQ ID NO: 553684 - RNA, 22 nt, Homo sapiens
aagucaucucauuccacuguug

SEQ ID NO: 553685 - RNA, 13 nt, Homo sapiens
aagucaucuugcu

SEQ ID NO: 553686 - RNA, 20 nt, Homo sapiens
aagucaugaagcccaaguga

SEQ ID NO: 553687 - RNA, 14 nt, Homo sapiens
aagucaugccugag

SEQ ID NO: 553688 - RNA, 18 nt, Homo sapiens
aagucauuuuaacuuuau

SEQ ID NO: 553689 - RNA, 12 nt, Homo sapiens
aaguccacuuua

SEQ ID NO: 553690 - RNA, 22 nt, Homo sapiens
aaguccagcugggaagcccuuu

SEQ ID NO: 553691 - RNA, 15 nt, Homo sapiens
aaguccaguguuucu

SEQ ID NO: 553692 - RNA, 22 nt, Homo sapiens
aaguccauguuauucucucaca

SEQ ID NO: 553693 - RNA, 18 nt, Homo sapiens
aagucccagagcaccuca

SEQ ID NO: 553694 - RNA, 23 nt, Homo sapiens
aagucccucccccagcccuguca

SEQ ID NO: 553695 - RNA, 22 nt, Homo sapiens
aagucccuuccuauucuccugc

SEQ ID NO: 553696 - RNA, 16 nt, Homo sapiens
aagucccuugagacuc

SEQ ID NO: 553697 - RNA, 14 nt, Homo sapiens
aaguccuaucucau

SEQ ID NO: 553698 - RNA, 22 nt, Homo sapiens
aaguccugaaguagaugguuga

SEQ ID NO: 553699 - RNA, 21 nt, Homo sapiens
aaguccugcuggaucuugccu

SEQ ID NO: 553700 - RNA, 19 nt, Homo sapiens
aaguccuucaccucacuga

SEQ ID NO: 553701 - RNA, 14 nt, Homo sapiens
aagucgaugaacua

SEQ ID NO: 553702 - RNA, 17 nt, Homo sapiens
aagucuaaauaaaugaa

SEQ ID NO: 553703 - RNA, 14 nt, Homo sapiens
aagucuaacgcuga

SEQ ID NO: 553704 - RNA, 19 nt, Homo sapiens
aagucuaacgcugaacuga

SEQ ID NO: 553705 - RNA, 14 nt, Homo sapiens
aagucuacaacaua

SEQ ID NO: 553706 - RNA, 15 nt, Homo sapiens
aagucuagaaucaua

SEQ ID NO: 553707 - RNA, 23 nt, Homo sapiens
aagucucagacugauuucuugcg

SEQ ID NO: 553708 - RNA, 18 nt, Homo sapiens
aagucucagaugaacaau

SEQ ID NO: 553709 - RNA, 23 nt, Homo sapiens
aaucuccucuuuuagcugaugaa

SEQ ID NO: 553710 - RNA, 15 nt, Homo sapiens
aaucucuaccccuuu

SEQ ID NO: 553711 - RNA, 22 nt, Homo sapiens
aaucucuacgacuaaucaccua

SEQ ID NO: 553712 - RNA, 17 nt, Homo sapiens
aaucucuucaugcuuga

SEQ ID NO: 553713 - RNA, 14 nt, Homo sapiens
aaucucuugcacuc

SEQ ID NO: 553714 - RNA, 15 nt, Homo sapiens
aaucucuuuaccucc

SEQ ID NO: 553715 - RNA, 15 nt, Homo sapiens
aaucugaacucucaa

SEQ ID NO: 553716 - RNA, 13 nt, Homo sapiens
aaucugaccaaaa

SEQ ID NO: 553717 - RNA, 14 nt, Homo sapiens
aaucugaccaaaac

SEQ ID NO: 553718 - RNA, 21 nt, Homo sapiens
aaucugaccaaaacaaacaaa

SEQ ID NO: 553719 - RNA, 20 nt, Homo sapiens
aaucugagccagugcuuuaa

SEQ ID NO: 553720 - RNA, 23 nt, Homo sapiens
aaucugaggccuccucucucagu

SEQ ID NO: 553721 - RNA, 13 nt, Homo sapiens
aaucugauugcac

SEQ ID NO: 553722 - RNA, 13 nt, Homo sapiens
aaucugcacugug

SEQ ID NO: 553723 - RNA, 12 nt, Homo sapiens
aaucugcaguga

SEQ ID NO: 553724 - RNA, 21 nt, Homo sapiens
aaucugcagugaugcaauaac

SEQ ID NO: 553725 - RNA, 15 nt, Homo sapiens
aaucugggagaauuu

SEQ ID NO: 553726 - RNA, 14 nt, Homo sapiens
aaucuggucucuuc

SEQ ID NO: 553727 - RNA, 16 nt, Homo sapiens
aaucugugccugcacu

SEQ ID NO: 553728 - RNA, 19 nt, Homo sapiens
aaucuguggccacucgagu

SEQ ID NO: 553729 - RNA, 19 nt, Homo sapiens
aaucuguuaccauucugau

SEQ ID NO: 553730 - RNA, 19 nt, Homo sapiens
aaucuguuguuuguuugau

SEQ ID NO: 553731 - RNA, 18 nt, Homo sapiens
aaucuguuucucugcugu

SEQ ID NO: 553732 - RNA, 17 nt, Homo sapiens
aaucuuaaacaauguau

SEQ ID NO: 553733 - RNA, 13 nt, Homo sapiens
aaucuuaucuuug

SEQ ID NO: 553734 - RNA, 22 nt, Homo sapiens
aaucuuaucuuugcucccugca

SEQ ID NO: 553735 - RNA, 13 nt, Homo sapiens
aaucuuaugcucu

SEQ ID NO: 553736 - RNA, 15 nt, Homo sapiens
aaucuucaccucaga

SEQ ID NO: 553737 - RNA, 13 nt, Homo sapiens
aaucuucauuuaa

SEQ ID NO: 553738 - RNA, 18 nt, Homo sapiens
aaucuuccaucugcaucu

SEQ ID NO: 553739 - RNA, 21 nt, Homo sapiens
aaucuuccgauggaugaaucu

SEQ ID NO: 553740 - RNA, 19 nt, Homo sapiens
aaucuucucuuugacaauu

SEQ ID NO: 553741 - RNA, 21 nt, Homo sapiens
aaucuucugccuucucaugau

SEQ ID NO: 553742 - RNA, 15 nt, Homo sapiens
aaucuuuaccuguau

SEQ ID NO: 553743 - RNA, 17 nt, Homo sapiens
aaucuuuaggcuuucaa

SEQ ID NO: 553744 - RNA, 16 nt, Homo sapiens
aaucuuucaaaccagc

SEQ ID NO: 553745 - RNA, 19 nt, Homo sapiens
aaucuuucuuuaccugaga

SEQ ID NO: 553746 - RNA, 20 nt, Homo sapiens
aaucuuuggguaacuucaaa

SEQ ID NO: 553747 - RNA, 16 nt, Homo sapiens
aaucuuuguaccaaaa

SEQ ID NO: 553748 - RNA, 22 nt, Homo sapiens
aaucuuuguuaagguccugaaa

SEQ ID NO: 553749 - RNA, 15 nt, Homo sapiens
aaucuuuuucuccac

SEQ ID NO: 553750 - RNA, 19 nt, Homo sapiens
aaucuuuuugcuucuacuu

SEQ ID NO: 553751 - RNA, 16 nt, Homo sapiens
aaugaaaaacaaaaag

SEQ ID NO: 553752 - RNA, 20 nt, Homo sapiens
aaugaaaaacaaaaagcuaa

SEQ ID NO: 553753 - RNA, 16 nt, Homo sapiens
aaugaaaauucuaacc

SEQ ID NO: 553754 - RNA, 14 nt, Homo sapiens
aaugaaaauuguau

SEQ ID NO: 553755 - RNA, 17 nt, Homo sapiens
aaugaaagacucuucac

SEQ ID NO: 553756 - RNA, 12 nt, Homo sapiens
aaugaaauccag

SEQ ID NO: 553757 - RNA, 18 nt, Homo sapiens
aaugaacaucucuugaaa

SEQ ID NO: 553758 - RNA, 16 nt, Homo sapiens
aaugaaccuucuggcc

SEQ ID NO: 553759 - RNA, 21 nt, Homo sapiens
aaugaacgcguguucuguaau

SEQ ID NO: 553760 - RNA, 16 nt, Homo sapiens
aaugaacuaacugaca

SEQ ID NO: 553761 - RNA, 14 nt, Homo sapiens
aaugaagaccaugc

SEQ ID NO: 553762 - RNA, 13 nt, Homo sapiens
aaugaagacuguu

SEQ ID NO: 553763 - RNA, 21 nt, Homo sapiens
aaugaagguuaggauuuaaca

SEQ ID NO: 553764 - RNA, 15 nt, Homo sapiens
aaugaaugagccaaa

SEQ ID NO: 553765 - RNA, 14 nt, Homo sapiens
aaugaaugccuaaa

SEQ ID NO: 553766 - RNA, 14 nt, Homo sapiens
aaugaauuaauuca

SEQ ID NO: 553767 - RNA, 14 nt, Homo sapiens
aaugaauuuaucuu

SEQ ID NO: 553768 - RNA, 15 nt, Homo sapiens
aaugacaagccuucu

SEQ ID NO: 553769 - RNA, 20 nt, Homo sapiens
aaugacacagucuuggcuca

SEQ ID NO: 553770 - RNA, 23 nt, Homo sapiens
aaugacaccacacucugccugaa

SEQ ID NO: 553771 - RNA, 17 nt, Homo sapiens
aaugacagauucugaca

SEQ ID NO: 553772 - RNA, 12 nt, Homo sapiens
aaugacauccag

SEQ ID NO: 553773 - RNA, 23 nt, Homo sapiens
aaugacaucuucaaagcuugaag

SEQ ID NO: 553774 - RNA, 18 nt, Homo sapiens
aaugacauguuccuuuaa

SEQ ID NO: 553775 - RNA, 19 nt, Homo sapiens
aaugacauucaguauauaa

SEQ ID NO: 553776 - RNA, 14 nt, Homo sapiens
aaugaccaauauua

SEQ ID NO: 553777 - RNA, 13 nt, Homo sapiens
aaugacccaaaga

SEQ ID NO: 553778 - RNA, 14 nt, Homo sapiens
aaugacccaaagac

SEQ ID NO: 553779 - RNA, 21 nt, Homo sapiens
aaugaccgcacguucucugcc

SEQ ID NO: 553780 - RNA, 12 nt, Homo sapiens
aaugaccuguau

SEQ ID NO: 553781 - RNA, 16 nt, Homo sapiens
aaugacgucacaagac

SEQ ID NO: 553782 - RNA, 14 nt, Homo sapiens
aaugacucaaaguc

SEQ ID NO: 553783 - RNA, 19 nt, Homo sapiens
aaugacugccggucauuug

SEQ ID NO: 553784 - RNA, 21 nt, Homo sapiens
aaugacuuacuguacaugaaa

SEQ ID NO: 553785 - RNA, 19 nt, Homo sapiens
aaugacuuggguuuaacaa

SEQ ID NO: 553786 - RNA, 23 nt, Homo sapiens
aaugagaaacuuugaucucugcu

SEQ ID NO: 553787 - RNA, 21 nt, Homo sapiens
aaugagaaauuuuguugauau

SEQ ID NO: 553788 - RNA, 18 nt, Homo sapiens
aaugagacuuuaaaagca

SEQ ID NO: 553789 - RNA, 18 nt, Homo sapiens
aaugagcacccauuccaa

SEQ ID NO: 553790 - RNA, 17 nt, Homo sapiens
aauuuaauugcuuugaa

SEQ ID NO: 553791 - RNA, 18 nt, Homo sapiens
aauuuaauuuugcaggau

SEQ ID NO: 553792 - RNA, 17 nt, Homo sapiens
aauuuacacacuugcau

SEQ ID NO: 553793 - RNA, 14 nt, Homo sapiens
aauuuacacugcca

SEQ ID NO: 553794 - RNA, 15 nt, Homo sapiens
aauuuacacugccau

SEQ ID NO: 553795 - RNA, 18 nt, Homo sapiens
aauuuacagucaaucuau

SEQ ID NO: 553796 - RNA, 19 nt, Homo sapiens
aauuuaccuaagauuacaa

SEQ ID NO: 553797 - RNA, 19 nt, Homo sapiens
aauuuagaaauauaauuga

SEQ ID NO: 553798 - RNA, 15 nt, Homo sapiens
aauuuagagucaauu

SEQ ID NO: 553799 - RNA, 13 nt, Homo sapiens
aauuuagcccuuu

SEQ ID NO: 553800 - RNA, 14 nt, Homo sapiens
aauuuaggaccaau

SEQ ID NO: 553801 - RNA, 18 nt, Homo sapiens
aauuuaggaccaauaccu

SEQ ID NO: 553802 - RNA, 16 nt, Homo sapiens
aauuuagucacaccau

SEQ ID NO: 553803 - RNA, 22 nt, Homo sapiens
aauuuaguuauugauguauaaa

SEQ ID NO: 553804 - RNA, 18 nt, Homo sapiens
aauuuaguuuuagcagcu

SEQ ID NO: 553805 - RNA, 15 nt, Homo sapiens
aauuuauaagcauuu

SEQ ID NO: 553806 - RNA, 22 nt, Homo sapiens
aauuuauaguuaaggcuaaaaa

SEQ ID NO: 553807 - RNA, 19 nt, Homo sapiens
aauuuaucuuuaccaaaaa

SEQ ID NO: 553808 - RNA, 14 nt, Homo sapiens
aauuuaucuuucaa

SEQ ID NO: 553809 - RNA, 20 nt, Homo sapiens
aauuuaugaagcagauuuau

SEQ ID NO: 553810 - RNA, 18 nt, Homo sapiens
aauuuauuaaucuaaaaa

SEQ ID NO: 553811 - RNA, 18 nt, Homo sapiens
aauuuauucaauuccucu

SEQ ID NO: 553812 - RNA, 20 nt, Homo sapiens
aauuuauucacauauaucaa

SEQ ID NO: 553813 - RNA, 19 nt, Homo sapiens
aauuuauuuaaguucacaa

SEQ ID NO: 553814 - RNA, 20 nt, Homo sapiens
aauuucaaaaauauaacuua

SEQ ID NO: 553815 - RNA, 15 nt, Homo sapiens
aauuucaguaaacaa

SEQ ID NO: 553816 - RNA, 13 nt, Homo sapiens
aauuuccaggaaa

SEQ ID NO: 553817 - RNA, 14 nt, Homo sapiens
aauuuccucuccac

SEQ ID NO: 553818 - RNA, 13 nt, Homo sapiens
aauuuccugaugc

SEQ ID NO: 553819 - RNA, 20 nt, Homo sapiens
aauuuccuuuuugacacuga

SEQ ID NO: 553820 - RNA, 17 nt, Homo sapiens
aauuucuaaaaaacaga

SEQ ID NO: 553821 - RNA, 22 nt, Homo sapiens
aauuucuaaaguaaaauugaag

SEQ ID NO: 553822 - RNA, 11 nt, Homo sapiens
aauuucuacua

SEQ ID NO: 553823 - RNA, 14 nt, Homo sapiens
aauuucuacuuuga

SEQ ID NO: 553824 - RNA, 15 nt, Homo sapiens
acagaagggcaguga

SEQ ID NO: 553825 - RNA, 14 nt, Homo sapiens
acagaagggcucuu

SEQ ID NO: 553826 - RNA, 15 nt, Homo sapiens
acagaagucuccuca

SEQ ID NO: 553827 - RNA, 22 nt, Homo sapiens
acagaauggaaccaaaauguau

SEQ ID NO: 553828 - RNA, 12 nt, Homo sapiens
acagaauggauu

SEQ ID NO: 553829 - RNA, 20 nt, Homo sapiens
acagaauuuuuuaaauugac

SEQ ID NO: 553830 - RNA, 12 nt, Homo sapiens
acagacacugca

SEQ ID NO: 553831 - RNA, 20 nt, Homo sapiens
acagacacuggcauggauau

SEQ ID NO: 553832 - RNA, 16 nt, Homo sapiens
acagacacuguugcaa

SEQ ID NO: 553833 - RNA, 14 nt, Homo sapiens
acagacacuuacau

SEQ ID NO: 553834 - RNA, 16 nt, Homo sapiens
acagacacuuacaugg

SEQ ID NO: 553835 - RNA, 20 nt, Homo sapiens
acagacaggaauuuagaaaa

SEQ ID NO: 553836 - RNA, 20 nt, Homo sapiens
acagaccuaggauuucauga

SEQ ID NO: 553837 - RNA, 16 nt, Homo sapiens
acagaccucaagggac

SEQ ID NO: 553838 - RNA, 16 nt, Homo sapiens
acagaccugcucugga

SEQ ID NO: 553839 - RNA, 22 nt, Homo sapiens
acagacgcugcugucacaacca

SEQ ID NO: 553840 - RNA, 13 nt, Homo sapiens
acagacuccaaaa

SEQ ID NO: 553841 - RNA, 16 nt, Homo sapiens
acagacugauguguau

SEQ ID NO: 553842 - RNA, 15 nt, Homo sapiens
acagacuggcaauaa

SEQ ID NO: 553843 - RNA, 16 nt, Homo sapiens
acagacuggcaauaaa

SEQ ID NO: 553844 - RNA, 19 nt, Homo sapiens
acagagagcuugcugugac

SEQ ID NO: 553845 - RNA, 15 nt, Homo sapiens
acagagauacacaga

SEQ ID NO: 553846 - RNA, 22 nt, Homo sapiens
acagagauaccauucaacccag

SEQ ID NO: 553847 - RNA, 15 nt, Homo sapiens
acagagaugaaagag

SEQ ID NO: 553848 - RNA, 15 nt, Homo sapiens
acagagaugcaugcg

SEQ ID NO: 553849 - RNA, 18 nt, Homo sapiens
acagagauugaacuccaa

SEQ ID NO: 553850 - RNA, 18 nt, Homo sapiens
acagagcaggggcuccag

SEQ ID NO: 553851 - RNA, 17 nt, Homo sapiens
acagagcgagacuccau

SEQ ID NO: 553852 - RNA, 20 nt, Homo sapiens
acagagcgagauuccgucuc

SEQ ID NO: 553853 - RNA, 15 nt, Homo sapiens
acagagcguccuucc

SEQ ID NO: 553854 - RNA, 17 nt, Homo sapiens
acagagcugaagaacuu

SEQ ID NO: 553855 - RNA, 18 nt, Homo sapiens
acagagcuucccugacuc

SEQ ID NO: 553856 - RNA, 19 nt, Homo sapiens
acagagcuucccugacuca

SEQ ID NO: 553857 - RNA, 19 nt, Homo sapiens
acagaggauuguauugcaa

SEQ ID NO: 553858 - RNA, 19 nt, Homo sapiens
acagagggaagccaugugg

SEQ ID NO: 553859 - RNA, 17 nt, Homo sapiens
accauauugcccagggu

SEQ ID NO: 553860 - RNA, 19 nt, Homo sapiens
accauauugugcuucacag

SEQ ID NO: 553861 - RNA, 18 nt, Homo sapiens
accaucaaaaauauucca

SEQ ID NO: 553862 - RNA, 16 nt, Homo sapiens
accaucacugccauca

SEQ ID NO: 553863 - RNA, 19 nt, Homo sapiens
accaucacugccaucacau

SEQ ID NO: 553864 - RNA, 18 nt, Homo sapiens
accaucagcugcuuuuaa

SEQ ID NO: 553865 - RNA, 22 nt, Homo sapiens
accaucauuauaaacgugauga

SEQ ID NO: 553866 - RNA, 11 nt, Homo sapiens
accauccacag

SEQ ID NO: 553867 - RNA, 15 nt, Homo sapiens
accauccccuccuag

SEQ ID NO: 553868 - RNA, 12 nt, Homo sapiens
accaucccugaa

SEQ ID NO: 553869 - RNA, 17 nt, Homo sapiens
accaucgaucaugaugu

SEQ ID NO: 553870 - RNA, 20 nt, Homo sapiens
accaucugaagaaacuuccc

SEQ ID NO: 553871 - RNA, 16 nt, Homo sapiens
accaucugcugcaguu

SEQ ID NO: 553872 - RNA, 19 nt, Homo sapiens
accaucuggaaggacaucu

SEQ ID NO: 553873 - RNA, 19 nt, Homo sapiens
accaugagaccacuguuau

SEQ ID NO: 553874 - RNA, 22 nt, Homo sapiens
accaugagaccacuguuaucaa

SEQ ID NO: 553875 - RNA, 22 nt, Homo sapiens
accaugcacuauauuuguauau

SEQ ID NO: 553876 - RNA, 14 nt, Homo sapiens
accauggcacuaca

SEQ ID NO: 553877 - RNA, 22 nt, Homo sapiens
accauggccaccccagagccau

SEQ ID NO: 553878 - RNA, 22 nt, Homo sapiens
accauggguuauuuaugcuugu

SEQ ID NO: 553879 - RNA, 19 nt, Homo sapiens
accauggugagaaauugac

SEQ ID NO: 553880 - RNA, 21 nt, Homo sapiens
accauguauaugagcuuauaa

SEQ ID NO: 553881 - RNA, 16 nt, Homo sapiens
accauguuagccuuag

SEQ ID NO: 553882 - RNA, 20 nt, Homo sapiens
accauguucauuauaaucuc

SEQ ID NO: 553883 - RNA, 18 nt, Homo sapiens
accauguuggccaggcug

SEQ ID NO: 553884 - RNA, 14 nt, Homo sapiens
accauguuggucag

SEQ ID NO: 553885 - RNA, 15 nt, Homo sapiens
accauucaacccagc

SEQ ID NO: 553886 - RNA, 21 nt, Homo sapiens
accauuccaggaaaacuggga

SEQ ID NO: 553887 - RNA, 14 nt, Homo sapiens
accauuccuuucau

SEQ ID NO: 553888 - RNA, 22 nt, Homo sapiens
accauuggacagucucccugau

SEQ ID NO: 553889 - RNA, 23 nt, Homo sapiens
accauuuaauggggaggacaaaa

SEQ ID NO: 553890 - RNA, 14 nt, Homo sapiens
accauuucagagag

SEQ ID NO: 553891 - RNA, 23 nt, Homo sapiens
accauuugauagggaacugggga

SEQ ID NO: 553892 - RNA, 16 nt, Homo sapiens
accauuuuacauuucu

SEQ ID NO: 553893 - RNA, 15 nt, Homo sapiens
acccaaacccuaggu

SEQ ID NO: 553894 - RNA, 14 nt, Homo sapiens
acccaaagcaaaac

SEQ ID NO: 553895 - RNA, 12 nt, Homo sapiens
acccaacacuuu

SEQ ID NO: 553896 - RNA, 23 nt, Homo sapiens
acccaacgcggugcgcaccaacu

SEQ ID NO: 553897 - RNA, 13 nt, Homo sapiens
acccaacuugcca

SEQ ID NO: 553898 - RNA, 13 nt, Homo sapiens
acccaagacauca

SEQ ID NO: 553899 - RNA, 18 nt, Homo sapiens
acccaagcucuggggaug

SEQ ID NO: 553900 - RNA, 17 nt, Homo sapiens
acccaauaaaacugaug

SEQ ID NO: 553901 - RNA, 19 nt, Homo sapiens
acccaauaaaacugauguu

SEQ ID NO: 553902 - RNA, 19 nt, Homo sapiens
acccaauauuuaccagacc

SEQ ID NO: 553903 - RNA, 16 nt, Homo sapiens
acccacaagugucuaa

SEQ ID NO: 553904 - RNA, 13 nt, Homo sapiens
acccacacaagcg

SEQ ID NO: 553905 - RNA, 17 nt, Homo sapiens
acccacaccgucuuccu

SEQ ID NO: 553906 - RNA, 11 nt, Homo sapiens
acccacacugc

SEQ ID NO: 553907 - RNA, 21 nt, Homo sapiens
acccaccauggaccagcccau

SEQ ID NO: 553908 - RNA, 19 nt, Homo sapiens
acccacccaauuggcccaa

SEQ ID NO: 553909 - RNA, 14 nt, Homo sapiens
acccaccccaacuc

SEQ ID NO: 553910 - RNA, 14 nt, Homo sapiens
acccaccccugugc

SEQ ID NO: 553911 - RNA, 22 nt, Homo sapiens
acccaccgucucggcccugaac

SEQ ID NO: 553912 - RNA, 20 nt, Homo sapiens
acccaccuagaacacuaacu

SEQ ID NO: 553913 - RNA, 23 nt, Homo sapiens
acccacgugacaccaccgaauau

SEQ ID NO: 553914 - RNA, 18 nt, Homo sapiens
acccacucccugucaaug

SEQ ID NO: 553915 - RNA, 14 nt, Homo sapiens
acccacuuugucca

SEQ ID NO: 553916 - RNA, 17 nt, Homo sapiens
acccagacaaccaaaac

SEQ ID NO: 553917 - RNA, 22 nt, Homo sapiens
acccagacacaucgcacugugg

SEQ ID NO: 553918 - RNA, 13 nt, Homo sapiens
acccagaguccca

SEQ ID NO: 553919 - RNA, 22 nt, Homo sapiens
acccagaugacccccaucccuc

SEQ ID NO: 553920 - RNA, 14 nt, Homo sapiens
acccagaugcucuc

SEQ ID NO: 553921 - RNA, 14 nt, Homo sapiens
acccagauucugaa

SEQ ID NO: 553922 - RNA, 13 nt, Homo sapiens
acccagcaggcag

SEQ ID NO: 553923 - RNA, 18 nt, Homo sapiens
acccagcagugucacucu

SEQ ID NO: 553924 - RNA, 12 nt, Homo sapiens
acccagccaggc

SEQ ID NO: 553925 - RNA, 15 nt, Homo sapiens
acccagccaugcaau

SEQ ID NO: 553926 - RNA, 15 nt, Homo sapiens
acccagccauguguu

SEQ ID NO: 553927 - RNA, 16 nt, Homo sapiens
acccagcccagcuugc

SEQ ID NO: 553928 - RNA, 14 nt, Homo sapiens
acccaggaagggaa

SEQ ID NO: 553929 - RNA, 15 nt, Homo sapiens
acccaggaaugccac

SEQ ID NO: 553930 - RNA, 17 nt, Homo sapiens
acccaggcaaucuugcc

SEQ ID NO: 553931 - RNA, 22 nt, Homo sapiens
acccaggcaguaccauucagga

SEQ ID NO: 553932 - RNA, 16 nt, Homo sapiens
acccagggcuaugagg

SEQ ID NO: 553933 - RNA, 18 nt, Homo sapiens
acccagucaccucugucu

SEQ ID NO: 553934 - RNA, 18 nt, Homo sapiens
acccagucccacacugug

SEQ ID NO: 553935 - RNA, 20 nt, Homo sapiens
acccagucuucuacacagau

SEQ ID NO: 553936 - RNA, 22 nt, Homo sapiens
acccagugaggaugcugcagug

SEQ ID NO: 553937 - RNA, 20 nt, Homo sapiens
acccagugcgugaagaccaa

SEQ ID NO: 553938 - RNA, 20 nt, Homo sapiens
acccagugcugccaugccac

SEQ ID NO: 553939 - RNA, 23 nt, Homo sapiens
acccaguucugaauaacuugaag

SEQ ID NO: 553940 - RNA, 13 nt, Homo sapiens
acccauauguccu

SEQ ID NO: 553941 - RNA, 22 nt, Homo sapiens
acccaugaaucaaagacaugga

SEQ ID NO: 553942 - RNA, 15 nt, Homo sapiens
acccaugaggcaaug

SEQ ID NO: 553943 - RNA, 16 nt, Homo sapiens
acccauucacuacagg

SEQ ID NO: 553944 - RNA, 18 nt, Homo sapiens
acccauucacuacaggug

SEQ ID NO: 553945 - RNA, 17 nt, Homo sapiens
acccauucagagacugu

SEQ ID NO: 553946 - RNA, 12 nt, Homo sapiens
acccauucuucc

SEQ ID NO: 553947 - RNA, 21 nt, Homo sapiens
accccaaauuguguauauauc

SEQ ID NO: 553948 - RNA, 16 nt, Homo sapiens
accccaacccaauaaa

SEQ ID NO: 553949 - RNA, 19 nt, Homo sapiens
accccacaacacgccuaaa

SEQ ID NO: 553950 - RNA, 17 nt, Homo sapiens
accccacagacacuuac

SEQ ID NO: 553951 - RNA, 14 nt, Homo sapiens
accccacucagggg

SEQ ID NO: 553952 - RNA, 12 nt, Homo sapiens
accccacugcaa

SEQ ID NO: 553953 - RNA, 17 nt, Homo sapiens
accccacuuaugcugcu

SEQ ID NO: 553954 - RNA, 19 nt, Homo sapiens
accccagcaauuaugaaaa

SEQ ID NO: 553955 - RNA, 16 nt, Homo sapiens
accccagccauccagg

SEQ ID NO: 553956 - RNA, 12 nt, Homo sapiens
accccagccuca

SEQ ID NO: 553957 - RNA, 16 nt, Homo sapiens
accccagcucaugccc

SEQ ID NO: 553958 - RNA, 16 nt, Homo sapiens
accccaggaacaauaa

SEQ ID NO: 553959 - RNA, 17 nt, Homo sapiens
accccaggacaguuuau

SEQ ID NO: 553960 - RNA, 22 nt, Homo sapiens
accccaggacgcccucacugca

SEQ ID NO: 553961 - RNA, 21 nt, Homo sapiens
accccaggcaaggaugucuga

SEQ ID NO: 553962 - RNA, 15 nt, Homo sapiens
accccaggcacuguu

SEQ ID NO: 553963 - RNA, 19 nt, Homo sapiens
accccagggccagcuuuuc

SEQ ID NO: 553964 - RNA, 19 nt, Homo sapiens
accccagggccuacugcca

SEQ ID NO: 553965 - RNA, 11 nt, Homo sapiens
accccaggugg

SEQ ID NO: 553966 - RNA, 17 nt, Homo sapiens
accccagucgugaugug

SEQ ID NO: 553967 - RNA, 12 nt, Homo sapiens
accccaguuuuu

SEQ ID NO: 553968 - RNA, 11 nt, Homo sapiens
accccaucucu

SEQ ID NO: 553969 - RNA, 15 nt, Homo sapiens
accccaucugugaau

SEQ ID NO: 553970 - RNA, 16 nt, Homo sapiens
accccaugugccuuua

SEQ ID NO: 553971 - RNA, 14 nt, Homo sapiens
accccauuagucua

SEQ ID NO: 553972 - RNA, 21 nt, Homo sapiens
acccccaaaagaacacuauaa

SEQ ID NO: 553973 - RNA, 20 nt, Homo sapiens
acccccacagaccugcucug

SEQ ID NO: 553974 - RNA, 21 nt, Homo sapiens
acccccagcaacccuccuauc

SEQ ID NO: 553975 - RNA, 20 nt, Homo sapiens
acccccagguggaaggcaga

SEQ ID NO: 553976 - RNA, 21 nt, Homo sapiens
acccccaucuuuacaaagaaa

SEQ ID NO: 553977 - RNA, 12 nt, Homo sapiens
acccccaugaug

SEQ ID NO: 553978 - RNA, 18 nt, Homo sapiens
acccccgcaaguuugcac

SEQ ID NO: 553979 - RNA, 20 nt, Homo sapiens
acccccucuucaaagcagag

SEQ ID NO: 553980 - RNA, 16 nt, Homo sapiens
accccgacugcucagu

SEQ ID NO: 553981 - RNA, 20 nt, Homo sapiens
accccgagaccucacuuuau

SEQ ID NO: 553982 - RNA, 21 nt, Homo sapiens
accccgcacugcagacgggaa

SEQ ID NO: 553983 - RNA, 17 nt, Homo sapiens
accccgcggugcucugg

SEQ ID NO: 553984 - RNA, 18 nt, Homo sapiens
accccgggcaagacuuuu

SEQ ID NO: 553985 - RNA, 14 nt, Homo sapiens
accccgggcucucu

SEQ ID NO: 553986 - RNA, 12 nt, Homo sapiens
accccgugccac

SEQ ID NO: 553987 - RNA, 15 nt, Homo sapiens
accccucuaccuccu

SEQ ID NO: 553988 - RNA, 12 nt, Homo sapiens
accccucuggcc

SEQ ID NO: 553989 - RNA, 16 nt, Homo sapiens
accccucugucuucaa

SEQ ID NO: 553990 - RNA, 13 nt, Homo sapiens
accccugaccuca

SEQ ID NO: 553991 - RNA, 17 nt, Homo sapiens
accccugcuauauacua

SEQ ID NO: 553992 - RNA, 20 nt, Homo sapiens
accccugcuccccugagcug

SEQ ID NO: 553993 - RNA, 22 nt, Homo sapiens
accccugcuccccugagcugaa

SEQ ID NO: 553994 - RNA, 15 nt, Homo sapiens
accccugucccaugc

SEQ ID NO: 553995 - RNA, 17 nt, Homo sapiens
accccuguuucuggcac

SEQ ID NO: 553996 - RNA, 15 nt, Homo sapiens
accccuuagccuccc

SEQ ID NO: 553997 - RNA, 22 nt, Homo sapiens
acccgagcccagcuacauuccu

SEQ ID NO: 553998 - RNA, 13 nt, Homo sapiens
acccgagucaauu

SEQ ID NO: 553999 - RNA, 14 nt, Homo sapiens
acccgaugcugcuu

SEQ ID NO: 554000 - RNA, 22 nt, Homo sapiens
acccgccgcugccaccaucucc

SEQ ID NO: 554001 - RNA, 16 nt, Homo sapiens
acccgcucuggaccaa

SEQ ID NO: 554002 - RNA, 14 nt, Homo sapiens
acccggacaggugg

SEQ ID NO: 554003 - RNA, 23 nt, Homo sapiens
acccggagcucuacgugcuccuc

SEQ ID NO: 554004 - RNA, 22 nt, Homo sapiens
acccggccgccgccaggacugu

SEQ ID NO: 554005 - RNA, 17 nt, Homo sapiens
acccgggggagcccagu

SEQ ID NO: 554006 - RNA, 15 nt, Homo sapiens
acccguagaugccag

SEQ ID NO: 554007 - RNA, 13 nt, Homo sapiens
acccuaagaaaag

SEQ ID NO: 554008 - RNA, 21 nt, Homo sapiens
acccuaagccuccuuuugcuu

SEQ ID NO: 554009 - RNA, 13 nt, Homo sapiens
acccuacuuucug

SEQ ID NO: 554010 - RNA, 23 nt, Homo sapiens
acccuacuuucuggaaguggagu

SEQ ID NO: 554011 - RNA, 18 nt, Homo sapiens
acccuagccagagaauag

SEQ ID NO: 554012 - RNA, 20 nt, Homo sapiens
acccuaguucuaccucaggc

SEQ ID NO: 554013 - RNA, 17 nt, Homo sapiens
acccuaguuucccugaa

SEQ ID NO: 554014 - RNA, 18 nt, Homo sapiens
acccuauacaacuggaca

SEQ ID NO: 554015 - RNA, 16 nt, Homo sapiens
acccuaucuccugaca

SEQ ID NO: 554016 - RNA, 16 nt, Homo sapiens
acccuaucugugauuc

SEQ ID NO: 554017 - RNA, 20 nt, Homo sapiens
acccuaugugggugggacca

SEQ ID NO: 554018 - RNA, 22 nt, Homo sapiens
acccuaugugggugggaccaca

SEQ ID NO: 554019 - RNA, 14 nt, Homo sapiens
acccucagcacugu

SEQ ID NO: 554020 - RNA, 14 nt, Homo sapiens
acccucagcuguca

SEQ ID NO: 554021 - RNA, 11 nt, Homo sapiens
acccucaggcc

SEQ ID NO: 554022 - RNA, 13 nt, Homo sapiens
acccucauuccuu

SEQ ID NO: 554023 - RNA, 15 nt, Homo sapiens
acccuccaccucuca

SEQ ID NO: 554024 - RNA, 15 nt, Homo sapiens
acccuccacucagcu

SEQ ID NO: 554025 - RNA, 19 nt, Homo sapiens
acccuccacucagcugucc

SEQ ID NO: 554026 - RNA, 21 nt, Homo sapiens
acccuccacucagcuguccug

SEQ ID NO: 554027 - RNA, 19 nt, Homo sapiens
acccuccagaauccugaug

SEQ ID NO: 554028 - RNA, 19 nt, Homo sapiens
acccucccaaaacagggaa

SEQ ID NO: 554029 - RNA, 15 nt, Homo sapiens
acccucccagucuca

SEQ ID NO: 554030 - RNA, 19 nt, Homo sapiens
acccucccagucucaucuc

SEQ ID NO: 554031 - RNA, 22 nt, Homo sapiens
acccuccccaaggaugaccaca

SEQ ID NO: 554032 - RNA, 15 nt, Homo sapiens
acccuccccugagga

SEQ ID NO: 554033 - RNA, 17 nt, Homo sapiens
acccuccuaucaccucc

SEQ ID NO: 554034 - RNA, 16 nt, Homo sapiens
acccuccuccugucaa

SEQ ID NO: 554035 - RNA, 13 nt, Homo sapiens
acccuccucuugg

SEQ ID NO: 554036 - RNA, 14 nt, Homo sapiens
acccuccuguaaau

SEQ ID NO: 554037 - RNA, 14 nt, Homo sapiens
acccucgaugaagc

SEQ ID NO: 554038 - RNA, 12 nt, Homo sapiens
acccucucacua

SEQ ID NO: 554039 - RNA, 18 nt, Homo sapiens
acccucuccccacugcuc

SEQ ID NO: 554040 - RNA, 19 nt, Homo sapiens
acccucugggaaccuccca

SEQ ID NO: 554041 - RNA, 20 nt, Homo sapiens
acccugaaaggaacacuggc

SEQ ID NO: 554042 - RNA, 21 nt, Homo sapiens
acccugacacggacugugcau

SEQ ID NO: 554043 - RNA, 23 nt, Homo sapiens
acccugagccggccccaggcucg

SEQ ID NO: 554044 - RNA, 18 nt, Homo sapiens
acccugaguugcuuuuca

SEQ ID NO: 554045 - RNA, 15 nt, Homo sapiens
acccugaucuucacu

SEQ ID NO: 554046 - RNA, 15 nt, Homo sapiens
acccugcaaucacuu

SEQ ID NO: 554047 - RNA, 18 nt, Homo sapiens
acccugcaggacuugcca

SEQ ID NO: 554048 - RNA, 11 nt, Homo sapiens
acccugccauu

SEQ ID NO: 554049 - RNA, 18 nt, Homo sapiens
acccugccccugccuuga

SEQ ID NO: 554050 - RNA, 17 nt, Homo sapiens
acccugccccuugccau

SEQ ID NO: 554051 - RNA, 18 nt, Homo sapiens
acccugcccgcucccaac

SEQ ID NO: 554052 - RNA, 15 nt, Homo sapiens
acccugccgucacca

SEQ ID NO: 554053 - RNA, 18 nt, Homo sapiens
acccugccuuaucuugca

SEQ ID NO: 554054 - RNA, 22 nt, Homo sapiens
acccugcugaccucccagugac

SEQ ID NO: 554055 - RNA, 15 nt, Homo sapiens
acccuggaaaacaga

SEQ ID NO: 554056 - RNA, 18 nt, Homo sapiens
acccuggaauucagcacc

SEQ ID NO: 554057 - RNA, 16 nt, Homo sapiens
acccuggaccauucca

SEQ ID NO: 554058 - RNA, 20 nt, Homo sapiens
acccuggaccauuccaggaa

SEQ ID NO: 554059 - RNA, 23 nt, Homo sapiens
acccuggagcccauccagucucc

SEQ ID NO: 554060 - RNA, 16 nt, Homo sapiens
acccuggauaggcaag

SEQ ID NO: 554061 - RNA, 20 nt, Homo sapiens
acccuggaucaguccuuuga

SEQ ID NO: 554062 - RNA, 18 nt, Homo sapiens
acccugggaacaauuucc

SEQ ID NO: 554063 - RNA, 14 nt, Homo sapiens
acccugggugccau

SEQ ID NO: 554064 - RNA, 21 nt, Homo sapiens
acccuggugaccuccugucac

SEQ ID NO: 554065 - RNA, 21 nt, Homo sapiens
acccuguccucccgagcuccu

SEQ ID NO: 554066 - RNA, 20 nt, Homo sapiens
acccuguccugcagucccac

SEQ ID NO: 554067 - RNA, 11 nt, Homo sapiens
acccugugacc

SEQ ID NO: 554068 - RNA, 19 nt, Homo sapiens
acccugugcccuccguuau

SEQ ID NO: 554069 - RNA, 19 nt, Homo sapiens
acccuguggggccugaugg

SEQ ID NO: 554070 - RNA, 14 nt, Homo sapiens
acccuguuuuacaa

SEQ ID NO: 554071 - RNA, 14 nt, Homo sapiens
acccuuaauaacau

SEQ ID NO: 554072 - RNA, 18 nt, Homo sapiens
acccuucaucuuccugug

SEQ ID NO: 554073 - RNA, 10 nt, Homo sapiens
acccuuccag

SEQ ID NO: 554074 - RNA, 17 nt, Homo sapiens
acccuucccagcccuca

SEQ ID NO: 554075 - RNA, 15 nt, Homo sapiens
acccuuccucaccac

SEQ ID NO: 554076 - RNA, 17 nt, Homo sapiens
acccuucgagaucauca

SEQ ID NO: 554077 - RNA, 23 nt, Homo sapiens
acccuugaaccaauaaaggaaca

SEQ ID NO: 554078 - RNA, 17 nt, Homo sapiens
acccuugacaccugcug

SEQ ID NO: 554079 - RNA, 20 nt, Homo sapiens
acccuuuagacuguagccug

SEQ ID NO: 554080 - RNA, 16 nt, Homo sapiens
acccuuuagugcuuug

SEQ ID NO: 554081 - RNA, 19 nt, Homo sapiens
acccuuucaaacuauuuau

SEQ ID NO: 554082 - RNA, 20 nt, Homo sapiens
acccuuuggccccacuuuga

SEQ ID NO: 554083 - RNA, 20 nt, Homo sapiens
acccuuuggggguugaauag

SEQ ID NO: 554084 - RNA, 15 nt, Homo sapiens
acaaacgauuuggau

SEQ ID NO: 554085 - RNA, 18 nt, Homo sapiens
acaaacuauauauaauca

SEQ ID NO: 554086 - RNA, 20 nt, Homo sapiens
acaaacucucaccaugaugu

SEQ ID NO: 554087 - RNA, 14 nt, Homo sapiens
acaaacugucuaaa

SEQ ID NO: 554088 - RNA, 14 nt, Homo sapiens
acaaacuucaaaga

SEQ ID NO: 554089 - RNA, 18 nt, Homo sapiens
acaaacuucaaagaggaa

SEQ ID NO: 554090 - RNA, 15 nt, Homo sapiens
acaaagaaacaaaga

SEQ ID NO: 554091 - RNA, 15 nt, Homo sapiens
acaaagacucacucu

SEQ ID NO: 554092 - RNA, 16 nt, Homo sapiens
acaaagagaaugagaa

SEQ ID NO: 554093 - RNA, 21 nt, Homo sapiens
acaaagagaaugagaagacau

SEQ ID NO: 554094 - RNA, 16 nt, Homo sapiens
acaaagcaaaggcagu

SEQ ID NO: 554095 - RNA, 17 nt, Homo sapiens
acaaagcaaaggcaguc

SEQ ID NO: 554096 - RNA, 21 nt, Homo sapiens
acaaagcagaagguuaaguca

SEQ ID NO: 554097 - RNA, 14 nt, Homo sapiens
acaaagccaugcca

SEQ ID NO: 554098 - RNA, 18 nt, Homo sapiens
acaaagccuuugcuuugu

SEQ ID NO: 554099 - RNA, 13 nt, Homo sapiens
acaaagcuucuau

SEQ ID NO: 554100 - RNA, 18 nt, Homo sapiens
acaaaggacagaguauga

SEQ ID NO: 554101 - RNA, 17 nt, Homo sapiens
acaaaggagccuugaua

SEQ ID NO: 554102 - RNA, 12 nt, Homo sapiens
acaaaggccaca

SEQ ID NO: 554103 - RNA, 19 nt, Homo sapiens
acaaaguagaggaauccau

SEQ ID NO: 554104 - RNA, 14 nt, Homo sapiens
acaaaguauuugcu

SEQ ID NO: 554105 - RNA, 18 nt, Homo sapiens
acaaaguccacuuuacuc

SEQ ID NO: 554106 - RNA, 21 nt, Homo sapiens
acaaagugaggagaaugaaau

SEQ ID NO: 554107 - RNA, 13 nt, Homo sapiens
acaaaguuuuaaa

SEQ ID NO: 554108 - RNA, 15 nt, Homo sapiens
acaaauaaaauacuu

SEQ ID NO: 554109 - RNA, 21 nt, Homo sapiens
acaaauaaguggaaaccgugu

SEQ ID NO: 554110 - RNA, 22 nt, Homo sapiens
acaaauaauuuuuaaauauaag

SEQ ID NO: 554111 - RNA, 13 nt, Homo sapiens
acaaauacuacag

SEQ ID NO: 554112 - RNA, 19 nt, Homo sapiens
acaaauagguagagucauu

SEQ ID NO: 554113 - RNA, 13 nt, Homo sapiens
acaaauauacauu

SEQ ID NO: 554114 - RNA, 12 nt, Homo sapiens
acaaauaugcaa

SEQ ID NO: 554115 - RNA, 15 nt, Homo sapiens
acaaauaugucaguu

SEQ ID NO: 554116 - RNA, 11 nt, Homo sapiens
acaaugcugau

SEQ ID NO: 554117 - RNA, 12 nt, Homo sapiens
acaaugcugauu

SEQ ID NO: 554118 - RNA, 17 nt, Homo sapiens
acaaugguuuauuccca

SEQ ID NO: 554119 - RNA, 20 nt, Homo sapiens
acaauguggacgugcacuga

SEQ ID NO: 554120 - RNA, 19 nt, Homo sapiens
acaauguuuauaaaggcca

SEQ ID NO: 554121 - RNA, 18 nt, Homo sapiens
acaauucuucugucaagc

SEQ ID NO: 554122 - RNA, 15 nt, Homo sapiens
acaauugcaacagaa

SEQ ID NO: 554123 - RNA, 20 nt, Homo sapiens
acaauugcuuuaacagucaa

SEQ ID NO: 554124 - RNA, 22 nt, Homo sapiens
acaauugucuuaaaaccagaga

SEQ ID NO: 554125 - RNA, 15 nt, Homo sapiens
acaauuuaugaauug

SEQ ID NO: 554126 - RNA, 23 nt, Homo sapiens
acaauuuaugcgaaccuaugucu

SEQ ID NO: 554127 - RNA, 14 nt, Homo sapiens
acaauuucaauaaa

SEQ ID NO: 554128 - RNA, 15 nt, Homo sapiens
acaauuucaucccag

SEQ ID NO: 554129 - RNA, 13 nt, Homo sapiens
acaauuuccauau

SEQ ID NO: 554130 - RNA, 21 nt, Homo sapiens
acaauuucucauacuuagaaa

SEQ ID NO: 554131 - RNA, 23 nt, Homo sapiens
acacaaaacaacaaaaaccaaaa

SEQ ID NO: 554132 - RNA, 17 nt, Homo sapiens
acacaaaacauucaugu

SEQ ID NO: 554133 - RNA, 21 nt, Homo sapiens
acacaaagcuguugaaauauu

SEQ ID NO: 554134 - RNA, 14 nt, Homo sapiens
acacaaccaugacg

SEQ ID NO: 554135 - RNA, 13 nt, Homo sapiens
acacaacuuugca

SEQ ID NO: 554136 - RNA, 16 nt, Homo sapiens
acacaagcaaccaaug

SEQ ID NO: 554137 - RNA, 18 nt, Homo sapiens
acacaaguagaugccuga

SEQ ID NO: 554138 - RNA, 21 nt, Homo sapiens
acacaauaggucuuucucuca

SEQ ID NO: 554139 - RNA, 16 nt, Homo sapiens
acacaauggcaccucu

SEQ ID NO: 554140 - RNA, 13 nt, Homo sapiens
acacaauguggac

SEQ ID NO: 554141 - RNA, 17 nt, Homo sapiens
acacaauugauacuuca

SEQ ID NO: 554142 - RNA, 18 nt, Homo sapiens
acacaauuggaagucuaa

SEQ ID NO: 554143 - RNA, 15 nt, Homo sapiens
acacacaaagcacau

SEQ ID NO: 554144 - RNA, 12 nt, Homo sapiens
acacacacagcc

SEQ ID NO: 554145 - RNA, 19 nt, Homo sapiens
acacacacgaugcauuuaa

SEQ ID NO: 554146 - RNA, 22 nt, Homo sapiens
acacacacucuacccuauacaa

SEQ ID NO: 554147 - RNA, 15 nt, Homo sapiens
acacacagccuagca

SEQ ID NO: 554148 - RNA, 16 nt, Homo sapiens
acacacauaccuucau

SEQ ID NO: 554149 - RNA, 22 nt, Homo sapiens
acacaccagggaauacuauaca

SEQ ID NO: 554150 - RNA, 19 nt, Homo sapiens
acacacgagcaaacccaga

SEQ ID NO: 554151 - RNA, 22 nt, Homo sapiens
acacacguaccuucaugugauu

SEQ ID NO: 554152 - RNA, 20 nt, Homo sapiens
acacacuggaccccacuggc

SEQ ID NO: 554153 - RNA, 9 nt, Homo sapiens
acacacugu

SEQ ID NO: 554154 - RNA, 20 nt, Homo sapiens
acacacuguugucaaaaagu

SEQ ID NO: 554155 - RNA, 15 nt, Homo sapiens
acacagacugcgauu

SEQ ID NO: 554156 - RNA, 21 nt, Homo sapiens
acacagacuggcaauaaacuc

SEQ ID NO: 554157 - RNA, 22 nt, Homo sapiens
acacagagcaggacugcacagc

SEQ ID NO: 554158 - RNA, 16 nt, Homo sapiens
acacagaugugaaaug

SEQ ID NO: 554159 - RNA, 17 nt, Homo sapiens
acacagcaacaaugacu

SEQ ID NO: 554160 - RNA, 18 nt, Homo sapiens
acacagcaagacuccguc

SEQ ID NO: 554161 - RNA, 12 nt, Homo sapiens
acacagcacaag

SEQ ID NO: 554162 - RNA, 16 nt, Homo sapiens
acacagcacaagggca

SEQ ID NO: 554163 - RNA, 21 nt, Homo sapiens
acacagcacgggggccaagga

SEQ ID NO: 554164 - RNA, 15 nt, Homo sapiens
acacagcaugugcca

SEQ ID NO: 554165 - RNA, 19 nt, Homo sapiens
acacagccguguguucaaa

SEQ ID NO: 554166 - RNA, 11 nt, Homo sapiens
acacagcugcc

SEQ ID NO: 554167 - RNA, 15 nt, Homo sapiens
acacaggcagcuucc

SEQ ID NO: 554168 - RNA, 13 nt, Homo sapiens
acacaggcuucau

SEQ ID NO: 554169 - RNA, 14 nt, Homo sapiens
acacaggucagggc

SEQ ID NO: 554170 - RNA, 15 nt, Homo sapiens
acacaggucagggcu

SEQ ID NO: 554171 - RNA, 14 nt, Homo sapiens
acacagguguagac

SEQ ID NO: 554172 - RNA, 18 nt, Homo sapiens
acacaguaauugugacaa

SEQ ID NO: 554173 - RNA, 22 nt, Homo sapiens
acacagucuguuuucuauuugu

SEQ ID NO: 554174 - RNA, 15 nt, Homo sapiens
acacaguuacagagu

SEQ ID NO: 554175 - RNA, 19 nt, Homo sapiens
acacaguugggacccaaaa

SEQ ID NO: 554176 - RNA, 24 nt, Homo sapiens
acacauagaaaacaaucaaauauu

SEQ ID NO: 554177 - RNA, 21 nt, Homo sapiens
acacaucccggccucuuccac

SEQ ID NO: 554178 - RNA, 15 nt, Homo sapiens
acacaucuauugcag

SEQ ID NO: 554179 - RNA, 18 nt, Homo sapiens
acacaugcacacaugugc

SEQ ID NO: 554180 - RNA, 14 nt, Homo sapiens
acacaugccuuaaa

SEQ ID NO: 554181 - RNA, 20 nt, Homo sapiens
acacaugcuauguucugucu

SEQ ID NO: 554182 - RNA, 10 nt, Homo sapiens
acacaugugc

SEQ ID NO: 554183 - RNA, 21 nt, Homo sapiens
acacaugugcugauguuuaca

SEQ ID NO: 554184 - RNA, 18 nt, Homo sapiens
acacauuauuaagcaccg

SEQ ID NO: 554185 - RNA, 15 nt, Homo sapiens
acacauucagugaua

SEQ ID NO: 554186 - RNA, 16 nt, Homo sapiens
acacauuccagccagg

SEQ ID NO: 554187 - RNA, 17 nt, Homo sapiens
acacauucuuaacacau

SEQ ID NO: 554188 - RNA, 21 nt, Homo sapiens
acacauugaaugcgcuuuauu

SEQ ID NO: 554189 - RNA, 13 nt, Homo sapiens
acacauugcugau

SEQ ID NO: 554190 - RNA, 14 nt, Homo sapiens
acacauuugcccaa

SEQ ID NO: 554191 - RNA, 15 nt, Homo sapiens
acacauuugcccaau

SEQ ID NO: 554192 - RNA, 20 nt, Homo sapiens
acacauuugguuucugaaua

SEQ ID NO: 554193 - RNA, 17 nt, Homo sapiens
acaccaccaugcucaac

SEQ ID NO: 554194 - RNA, 14 nt, Homo sapiens
acaccagcagcccu

SEQ ID NO: 554195 - RNA, 17 nt, Homo sapiens
acaccaggagagcuucu

SEQ ID NO: 554196 - RNA, 18 nt, Homo sapiens
acaccaggccguccuccc

SEQ ID NO: 554197 - RNA, 20 nt, Homo sapiens
acaccaucuuaaaugacagu

SEQ ID NO: 554198 - RNA, 21 nt, Homo sapiens
acaccauucaucucuaacaua

SEQ ID NO: 554199 - RNA, 11 nt, Homo sapiens
acacccaaaaa

SEQ ID NO: 554200 - RNA, 21 nt, Homo sapiens
acacccaaaaauaucuccucc

SEQ ID NO: 554201 - RNA, 12 nt, Homo sapiens
acacccagguga

SEQ ID NO: 554202 - RNA, 19 nt, Homo sapiens
acacccagucuguucccca

SEQ ID NO: 554203 - RNA, 19 nt, Homo sapiens
acacccaucucaacagggu

SEQ ID NO: 554204 - RNA, 17 nt, Homo sapiens
acacccaugaaucaaag

SEQ ID NO: 554205 - RNA, 13 nt, Homo sapiens
acaccccacaggc

SEQ ID NO: 554206 - RNA, 13 nt, Homo sapiens
acaccccaugcac

SEQ ID NO: 554207 - RNA, 16 nt, Homo sapiens
accucuucccaugacu

SEQ ID NO: 554208 - RNA, 22 nt, Homo sapiens
accucuuccuccucgcugccag

SEQ ID NO: 554209 - RNA, 14 nt, Homo sapiens
accucuuccuugau

SEQ ID NO: 554210 - RNA, 18 nt, Homo sapiens
accucuucucuuccugua

SEQ ID NO: 554211 - RNA, 17 nt, Homo sapiens
accucuucuuucccucc

SEQ ID NO: 554212 - RNA, 17 nt, Homo sapiens
accucuugagccuugaa

SEQ ID NO: 554213 - RNA, 18 nt, Homo sapiens
accucuugcugccagcua

SEQ ID NO: 554214 - RNA, 17 nt, Homo sapiens
accucuuguuucugggu

SEQ ID NO: 554215 - RNA, 16 nt, Homo sapiens
accucuuuuaaaucua

SEQ ID NO: 554216 - RNA, 22 nt, Homo sapiens
accucuuuugagacuuugccca

SEQ ID NO: 554217 - RNA, 19 nt, Homo sapiens
accugaaaacacugugcac

SEQ ID NO: 554218 - RNA, 14 nt, Homo sapiens
accugaaacacugg

SEQ ID NO: 554219 - RNA, 13 nt, Homo sapiens
accugaaagaagc

SEQ ID NO: 554220 - RNA, 20 nt, Homo sapiens
accugaaauuuauucacaua

SEQ ID NO: 554221 - RNA, 21 nt, Homo sapiens
accugaaauuuauucacauau

SEQ ID NO: 554222 - RNA, 13 nt, Homo sapiens
accugaaccagcc

SEQ ID NO: 554223 - RNA, 13 nt, Homo sapiens
accugaagacacc

SEQ ID NO: 554224 - RNA, 19 nt, Homo sapiens
accugaagcugucaccucu

SEQ ID NO: 554225 - RNA, 14 nt, Homo sapiens
accugaagugugca

SEQ ID NO: 554226 - RNA, 17 nt, Homo sapiens
accugaaucagcuggac

SEQ ID NO: 554227 - RNA, 14 nt, Homo sapiens
accuugcuuuggac

SEQ ID NO: 554228 - RNA, 17 nt, Homo sapiens
accuugcuuuugcuucu

SEQ ID NO: 554229 - RNA, 17 nt, Homo sapiens
accuuggaaaugaccag

SEQ ID NO: 554230 - RNA, 21 nt, Homo sapiens
accuuggaaaugaccaggcca

SEQ ID NO: 554231 - RNA, 23 nt, Homo sapiens
accuuggaagggcguucuaggua

SEQ ID NO: 554232 - RNA, 21 nt, Homo sapiens
accuuggaauucgcuuucuaa

SEQ ID NO: 554233 - RNA, 16 nt, Homo sapiens
accuuggacauccucc

SEQ ID NO: 554234 - RNA, 14 nt, Homo sapiens
accuuggaccucag

SEQ ID NO: 554235 - RNA, 20 nt, Homo sapiens
accuuggaggaaugacaaua

SEQ ID NO: 554236 - RNA, 19 nt, Homo sapiens
accuuggaucagaugaacu

SEQ ID NO: 554237 - RNA, 18 nt, Homo sapiens
accuugggaucagaucaa

SEQ ID NO: 554238 - RNA, 16 nt, Homo sapiens
accuuggggucccucc

SEQ ID NO: 554239 - RNA, 14 nt, Homo sapiens
accuugucucauga

SEQ ID NO: 554240 - RNA, 19 nt, Homo sapiens
accuuguuggagccugcag

SEQ ID NO: 554241 - RNA, 20 nt, Homo sapiens
accuuuaggucaaacucccu

SEQ ID NO: 554242 - RNA, 23 nt, Homo sapiens
accuuucacaagggcaaacuuuu

SEQ ID NO: 554243 - RNA, 23 nt, Homo sapiens
accuuuccaguuuauaagacugg

SEQ ID NO: 554244 - RNA, 18 nt, Homo sapiens
agagguuaaggugcaaua

SEQ ID NO: 554245 - RNA, 22 nt, Homo sapiens
agagguuggagcaggaugaggg

SEQ ID NO: 554246 - RNA, 15 nt, Homo sapiens
agagguuucuugaau

SEQ ID NO: 554247 - RNA, 18 nt, Homo sapiens
agagguuugcugacaggu

SEQ ID NO: 554248 - RNA, 21 nt, Homo sapiens
agagguuugguuuccuguguc

SEQ ID NO: 554249 - RNA, 16 nt, Homo sapiens
agaguaaaaacugaau

SEQ ID NO: 554250 - RNA, 12 nt, Homo sapiens
agaguacuuugg

SEQ ID NO: 554251 - RNA, 12 nt, Homo sapiens
agaguagucaug

SEQ ID NO: 554252 - RNA, 14 nt, Homo sapiens
agaguaucacuccc

SEQ ID NO: 554253 - RNA, 19 nt, Homo sapiens
agaguaucagaucuaucuu

SEQ ID NO: 554254 - RNA, 17 nt, Homo sapiens
agagucaaaugggaaaa

SEQ ID NO: 554255 - RNA, 16 nt, Homo sapiens
agagucaacaguaucu

SEQ ID NO: 554256 - RNA, 21 nt, Homo sapiens
agagucagcucucugcccugu

SEQ ID NO: 554257 - RNA, 12 nt, Homo sapiens
agaguccaguga

SEQ ID NO: 554258 - RNA, 13 nt, Homo sapiens
agaguccucugga

SEQ ID NO: 554259 - RNA, 14 nt, Homo sapiens
agaguccucuggau

SEQ ID NO: 554260 - RNA, 22 nt, Homo sapiens
agagucuaauagucuuugccag

SEQ ID NO: 554261 - RNA, 15 nt, Homo sapiens
agagucuccaguuua

SEQ ID NO: 554262 - RNA, 14 nt, Homo sapiens
agagucugucuuga

SEQ ID NO: 554263 - RNA, 18 nt, Homo sapiens
agagucuuaaagcauuuc

SEQ ID NO: 554264 - RNA, 15 nt, Homo sapiens
agagugaauuugacc

SEQ ID NO: 554265 - RNA, 14 nt, Homo sapiens
agagugacagucau

SEQ ID NO: 554266 - RNA, 15 nt, Homo sapiens
agagugacagucaua

SEQ ID NO: 554267 - RNA, 22 nt, Homo sapiens
agagugaccauaugacccagga

SEQ ID NO: 554268 - RNA, 19 nt, Homo sapiens
agagugagaccauguuuca

SEQ ID NO: 554269 - RNA, 19 nt, Homo sapiens
agagugagacuccaccuca

SEQ ID NO: 554270 - RNA, 21 nt, Homo sapiens
agagugagcaaccagcuggaa

SEQ ID NO: 554271 - RNA, 14 nt, Homo sapiens
agagugauugcagc

SEQ ID NO: 554272 - RNA, 15 nt, Homo sapiens
agagugauugcagcu

SEQ ID NO: 554273 - RNA, 22 nt, Homo sapiens
agagugcaagccccugcuccag

SEQ ID NO: 554274 - RNA, 12 nt, Homo sapiens
agagugcacugc

SEQ ID NO: 554275 - RNA, 17 nt, Homo sapiens
agaguggcucacuggcu

SEQ ID NO: 554276 - RNA, 23 nt, Homo sapiens
agaguggcuuggccucaagagaa

SEQ ID NO: 554277 - RNA, 14 nt, Homo sapiens
agagugguuuccaa

SEQ ID NO: 554278 - RNA, 17 nt, Homo sapiens
agaguguagacuguggc

SEQ ID NO: 554279 - RNA, 14 nt, Homo sapiens
agagugucucaggg

SEQ ID NO: 554280 - RNA, 18 nt, Homo sapiens
agaguguggguccuucaa

SEQ ID NO: 554281 - RNA, 15 nt, Homo sapiens
agaguguucccugac

SEQ ID NO: 554282 - RNA, 15 nt, Homo sapiens
agaguuacaguucug

SEQ ID NO: 554283 - RNA, 14 nt, Homo sapiens
agaguuccuucuca

SEQ ID NO: 554284 - RNA, 14 nt, Homo sapiens
agaguuuacugaag

SEQ ID NO: 554285 - RNA, 22 nt, Homo sapiens
agaguuucuccuuuugaccaaa

SEQ ID NO: 554286 - RNA, 21 nt, Homo sapiens
agaguuugcuauuagagcauu

SEQ ID NO: 554287 - RNA, 19 nt, Homo sapiens
agaguuuguuaccuaccuu

SEQ ID NO: 554288 - RNA, 13 nt, Homo sapiens
agauaaagaccuu

SEQ ID NO: 554289 - RNA, 22 nt, Homo sapiens
agauaaauauugagcagaucua

SEQ ID NO: 554290 - RNA, 14 nt, Homo sapiens
agauaaaugugcug

SEQ ID NO: 554291 - RNA, 23 nt, Homo sapiens
agauaacaagaucuuucaggaaa

SEQ ID NO: 554292 - RNA, 13 nt, Homo sapiens
agauaacucuccu

SEQ ID NO: 554293 - RNA, 18 nt, Homo sapiens
agauaagaaaugaucuuu

SEQ ID NO: 554294 - RNA, 14 nt, Homo sapiens
agauaaguguaaau

SEQ ID NO: 554295 - RNA, 14 nt, Homo sapiens
agauaauaugagaa

SEQ ID NO: 554296 - RNA, 14 nt, Homo sapiens
agauaauguugcuu

SEQ ID NO: 554297 - RNA, 17 nt, Homo sapiens
agauaauuauaauauac

SEQ ID NO: 554298 - RNA, 20 nt, Homo sapiens
agauaauugaauaaguaccu

SEQ ID NO: 554299 - RNA, 15 nt, Homo sapiens
agauaauugcuauuu

SEQ ID NO: 554300 - RNA, 16 nt, Homo sapiens
agauacaagucaucca

SEQ ID NO: 554301 - RNA, 21 nt, Homo sapiens
agauacagagaugcaaugaua

SEQ ID NO: 554302 - RNA, 20 nt, Homo sapiens
agauacaggggaucauguua

SEQ ID NO: 554303 - RNA, 21 nt, Homo sapiens
agauacaugguugugaccuga

SEQ ID NO: 554304 - RNA, 17 nt, Homo sapiens
agauacuaucauuaaca

SEQ ID NO: 554305 - RNA, 19 nt, Homo sapiens
agauacuuugucagcaaua

SEQ ID NO: 554306 - RNA, 23 nt, Homo sapiens
agauagauauuccuauugugcaa

SEQ ID NO: 554307 - RNA, 14 nt, Homo sapiens
agauagcagggcau

SEQ ID NO: 554308 - RNA, 23 nt, Homo sapiens
agauagcccaggagcaacagccu

SEQ ID NO: 554309 - RNA, 22 nt, Homo sapiens
agauagcuucaccccaauccca

SEQ ID NO: 554310 - RNA, 18 nt, Homo sapiens
agauagggaaaaggggcu

SEQ ID NO: 554311 - RNA, 21 nt, Homo sapiens
agauagggggaagacagauau

SEQ ID NO: 554312 - RNA, 22 nt, Homo sapiens
agauagguggugccaguggcuu

SEQ ID NO: 554313 - RNA, 14 nt, Homo sapiens
agauaguaugcacu

SEQ ID NO: 554314 - RNA, 23 nt, Homo sapiens
agauaguuguguuuuuauuguua

SEQ ID NO: 554315 - RNA, 14 nt, Homo sapiens
agauauacauauca

SEQ ID NO: 554316 - RNA, 23 nt, Homo sapiens
agauauacauaucaaguauguug

SEQ ID NO: 554317 - RNA, 15 nt, Homo sapiens
agauauaugaauaug

SEQ ID NO: 554318 - RNA, 17 nt, Homo sapiens
agauaucagagcucuua

SEQ ID NO: 554319 - RNA, 15 nt, Homo sapiens
agauaugaguucuuc

SEQ ID NO: 554320 - RNA, 17 nt, Homo sapiens
agauaugauaccaaaga

SEQ ID NO: 554321 - RNA, 17 nt, Homo sapiens
agauaugcaaauggcua

SEQ ID NO: 554322 - RNA, 16 nt, Homo sapiens
agauauggcauugcac

SEQ ID NO: 554323 - RNA, 16 nt, Homo sapiens
agauauguuaagcaug

SEQ ID NO: 554324 - RNA, 18 nt, Homo sapiens
agauauuaaaugauguuu

SEQ ID NO: 554325 - RNA, 19 nt, Homo sapiens
agauauuagguccauucau

SEQ ID NO: 554326 - RNA, 20 nt, Homo sapiens
agauauuauuuuagcuucag

SEQ ID NO: 554327 - RNA, 19 nt, Homo sapiens
agauauucacuaaggacuu

SEQ ID NO: 554328 - RNA, 20 nt, Homo sapiens
agauauucacuaaggacuua

SEQ ID NO: 554329 - RNA, 13 nt, Homo sapiens
agauauugguuua

SEQ ID NO: 554330 - RNA, 15 nt, Homo sapiens
agauauuguacauaa

SEQ ID NO: 554331 - RNA, 14 nt, Homo sapiens
agaucaaauacuuu

SEQ ID NO: 554332 - RNA, 19 nt, Homo sapiens
agaucaaauauauuucaag

SEQ ID NO: 554333 - RNA, 13 nt, Homo sapiens
agaucaacuggaa

SEQ ID NO: 554334 - RNA, 14 nt, Homo sapiens
agaucaacuggaau

SEQ ID NO: 554335 - RNA, 21 nt, Homo sapiens
agaucaacuggaauggauggu

SEQ ID NO: 554336 - RNA, 20 nt, Homo sapiens
agaucaagaaaaaaagggag

SEQ ID NO: 554337 - RNA, 12 nt, Homo sapiens
agaucaagccag

SEQ ID NO: 554338 - RNA, 13 nt, Homo sapiens
agaucaagccagu

SEQ ID NO: 554339 - RNA, 16 nt, Homo sapiens
agaucaauuucuccca

SEQ ID NO: 554340 - RNA, 21 nt, Homo sapiens
agaucacaaagacagagacug

SEQ ID NO: 554341 - RNA, 18 nt, Homo sapiens
agaucacaccacuguacu

SEQ ID NO: 554342 - RNA, 18 nt, Homo sapiens
agaucacgccacugcacu

SEQ ID NO: 554343 - RNA, 10 nt, Homo sapiens
agaucacugc

SEQ ID NO: 554344 - RNA, 12 nt, Homo sapiens
agaucacugcca

SEQ ID NO: 554345 - RNA, 13 nt, Homo sapiens
agaucacugccac

SEQ ID NO: 554346 - RNA, 21 nt, Homo sapiens
agaucagccugggcaauguga

SEQ ID NO: 554347 - RNA, 19 nt, Homo sapiens
agaucagcgacccugagga

SEQ ID NO: 554348 - RNA, 20 nt, Homo sapiens
agaucaguauuucacugaua

SEQ ID NO: 554349 - RNA, 23 nt, Homo sapiens
agaucauaccacggcacuccagc

SEQ ID NO: 554350 - RNA, 17 nt, Homo sapiens
agauccaagaggcccug

SEQ ID NO: 554351 - RNA, 24 nt, Homo sapiens
agauccacccuaucccuguacaga

SEQ ID NO: 554352 - RNA, 22 nt, Homo sapiens
agauccacccucaaaugucaga

SEQ ID NO: 554353 - RNA, 15 nt, Homo sapiens
agauccagacuguaa

SEQ ID NO: 554354 - RNA, 17 nt, Homo sapiens
agauccccccuuuccuu

SEQ ID NO: 554355 - RNA, 22 nt, Homo sapiens
agauccccuguguggucuccau

SEQ ID NO: 554356 - RNA, 14 nt, Homo sapiens
agauccgcuccagc

SEQ ID NO: 554357 - RNA, 19 nt, Homo sapiens
agauccgggagacugacac

SEQ ID NO: 554358 - RNA, 19 nt, Homo sapiens
agauccucaagcagaccua

SEQ ID NO: 554359 - RNA, 16 nt, Homo sapiens
agauccuuuuccagaa

SEQ ID NO: 554360 - RNA, 16 nt, Homo sapiens
agaucgcaccacugca

SEQ ID NO: 554361 - RNA, 13 nt, Homo sapiens
agaucgcaucauu

SEQ ID NO: 554362 - RNA, 19 nt, Homo sapiens
agaucgccccacugcacuc

SEQ ID NO: 554363 - RNA, 17 nt, Homo sapiens
agaucgcgccacugcac

SEQ ID NO: 554364 - RNA, 16 nt, Homo sapiens
agaucggccacagggc

SEQ ID NO: 554365 - RNA, 18 nt, Homo sapiens
agaucuaguuacuguggu

SEQ ID NO: 554366 - RNA, 14 nt, Homo sapiens
agaucuauguacug

SEQ ID NO: 554367 - RNA, 17 nt, Homo sapiens
agaucuccacggucaga

SEQ ID NO: 554368 - RNA, 17 nt, Homo sapiens
agaucucgguuugccaa

SEQ ID NO: 554369 - RNA, 22 nt, Homo sapiens
agaucucucgaaugcugagaag

SEQ ID NO: 554370 - RNA, 19 nt, Homo sapiens
agaucucuuuguagccauc

SEQ ID NO: 554371 - RNA, 14 nt, Homo sapiens
agaucuggcugugg

SEQ ID NO: 554372 - RNA, 22 nt, Homo sapiens
agaucuguaaguaacuucacau

SEQ ID NO: 554373 - RNA, 15 nt, Homo sapiens
agaucugucccuuaa

SEQ ID NO: 554374 - RNA, 17 nt, Homo sapiens
agaucugucccuuaaua

SEQ ID NO: 554375 - RNA, 20 nt, Homo sapiens
agaucuugaauagucucauc

SEQ ID NO: 554376 - RNA, 16 nt, Homo sapiens
agaucuugaugguguu

SEQ ID NO: 554377 - RNA, 20 nt, Homo sapiens
agaucuuuaaacugcuuuau

SEQ ID NO: 554378 - RNA, 14 nt, Homo sapiens
agaucuuuacucuu

SEQ ID NO: 554379 - RNA, 18 nt, Homo sapiens
agaucuuuauaaccugau

SEQ ID NO: 554380 - RNA, 23 nt, Homo sapiens
agaucuuucaggacucuaccuca

SEQ ID NO: 554381 - RNA, 21 nt, Homo sapiens
agaucuuuucuugaccuagua

SEQ ID NO: 554382 - RNA, 15 nt, Homo sapiens
agaugaaauugccaa

SEQ ID NO: 554383 - RNA, 20 nt, Homo sapiens
agaugaacaugguguucaac

SEQ ID NO: 554384 - RNA, 14 nt, Homo sapiens
agaugaacauuuca

SEQ ID NO: 554385 - RNA, 17 nt, Homo sapiens
agaugaacugacugaag

SEQ ID NO: 554386 - RNA, 17 nt, Homo sapiens
agaugaagacaacagca

SEQ ID NO: 554387 - RNA, 17 nt, Homo sapiens
agaugaaguuuuauaca

SEQ ID NO: 554388 - RNA, 16 nt, Homo sapiens
agaugaauagauggaa

SEQ ID NO: 554389 - RNA, 19 nt, Homo sapiens
agaugaaucauugauugaa

SEQ ID NO: 554390 - RNA, 23 nt, Homo sapiens
agaugaauggucuggcaauauuc

SEQ ID NO: 554391 - RNA, 15 nt, Homo sapiens
agaugacaaaccaua

SEQ ID NO: 554392 - RNA, 14 nt, Homo sapiens
agaugacaaccucc

SEQ ID NO: 554393 - RNA, 18 nt, Homo sapiens
agaugaccagugccuugg

SEQ ID NO: 554394 - RNA, 20 nt, Homo sapiens
agaugaccguguacaauacc

SEQ ID NO: 554395 - RNA, 13 nt, Homo sapiens
agaugacucugag

SEQ ID NO: 554396 - RNA, 12 nt, Homo sapiens
agaugaggcaaa

SEQ ID NO: 554397 - RNA, 17 nt, Homo sapiens
agaugaggccagaccau

SEQ ID NO: 554398 - RNA, 16 nt, Homo sapiens
agaugagggguugagg

SEQ ID NO: 554399 - RNA, 16 nt, Homo sapiens
agaugagggugacugu

SEQ ID NO: 554400 - RNA, 19 nt, Homo sapiens
agaugaggugcucaauuaa

SEQ ID NO: 554401 - RNA, 17 nt, Homo sapiens
agaugagucagugccau

SEQ ID NO: 554402 - RNA, 22 nt, Homo sapiens
agaugauaaaaggaaucuggca

SEQ ID NO: 554403 - RNA, 15 nt, Homo sapiens
agaugauacuuccaa

SEQ ID NO: 554404 - RNA, 19 nt, Homo sapiens
agaugauggaugccaauau

SEQ ID NO: 554405 - RNA, 16 nt, Homo sapiens
agaugcaaugugcuac

SEQ ID NO: 554406 - RNA, 18 nt, Homo sapiens
agaugcacuuaugcagua

SEQ ID NO: 554407 - RNA, 18 nt, Homo sapiens
agaugcagccaccacauc

SEQ ID NO: 554408 - RNA, 14 nt, Homo sapiens
agaugcagggcagu

SEQ ID NO: 554409 - RNA, 18 nt, Homo sapiens
agaugcagggcagucauu

SEQ ID NO: 554410 - RNA, 14 nt, Homo sapiens
agaugcaggugaug

SEQ ID NO: 554411 - RNA, 14 nt, Homo sapiens
agaugcaucacugg

SEQ ID NO: 554412 - RNA, 16 nt, Homo sapiens
agaugcaucacugggu

SEQ ID NO: 554413 - RNA, 21 nt, Homo sapiens
agaugcaugacuuguguguga

SEQ ID NO: 554414 - RNA, 15 nt, Homo sapiens
agaugccacuucuca

SEQ ID NO: 554415 - RNA, 21 nt, Homo sapiens
agaugccagcauauacugaag

SEQ ID NO: 554416 - RNA, 12 nt, Homo sapiens
agaugccaguga

SEQ ID NO: 554417 - RNA, 23 nt, Homo sapiens
agaugccgcggaaggucccucag

SEQ ID NO: 554418 - RNA, 15 nt, Homo sapiens
agaugcguuugccuc

SEQ ID NO: 554419 - RNA, 21 nt, Homo sapiens
agaugcuagaaaaauguucuu

SEQ ID NO: 554420 - RNA, 15 nt, Homo sapiens
agaugcucacuuuau

SEQ ID NO: 554421 - RNA, 14 nt, Homo sapiens
agaugcugcugaag

SEQ ID NO: 554422 - RNA, 16 nt, Homo sapiens
agaugcuucucuugcu

SEQ ID NO: 554423 - RNA, 22 nt, Homo sapiens
agaugcuuuucugucucugccu

SEQ ID NO: 554424 - RNA, 22 nt, Homo sapiens
agauggaaaaacugaggcuuag

SEQ ID NO: 554425 - RNA, 17 nt, Homo sapiens
agauggacaacucaaug

SEQ ID NO: 554426 - RNA, 22 nt, Homo sapiens
agauggacacgagccacaagcu

SEQ ID NO: 554427 - RNA, 19 nt, Homo sapiens
agauggaccugccugcaua

SEQ ID NO: 554428 - RNA, 16 nt, Homo sapiens
agauggacuccagccu

SEQ ID NO: 554429 - RNA, 21 nt, Homo sapiens
agauggcagauucccacugcc

SEQ ID NO: 554430 - RNA, 21 nt, Homo sapiens
agauggcaugaaucgggcuaa

SEQ ID NO: 554431 - RNA, 14 nt, Homo sapiens
agauggccaugccc

SEQ ID NO: 554432 - RNA, 16 nt, Homo sapiens
agauggcugugccucu

SEQ ID NO: 554433 - RNA, 18 nt, Homo sapiens
agauggcuuuuccuggac

SEQ ID NO: 554434 - RNA, 19 nt, Homo sapiens
agaugggaaaucugccuau

SEQ ID NO: 554435 - RNA, 13 nt, Homo sapiens
agauggggaggag

SEQ ID NO: 554436 - RNA, 21 nt, Homo sapiens
agauggggucucacaguguug

SEQ ID NO: 554437 - RNA, 16 nt, Homo sapiens
agauggguggcaccaa

SEQ ID NO: 554438 - RNA, 21 nt, Homo sapiens
agaugguaccgugcaucgcac

SEQ ID NO: 554439 - RNA, 15 nt, Homo sapiens
agaugguagaacuaa

SEQ ID NO: 554440 - RNA, 21 nt, Homo sapiens
agaugguggccacagacugac

SEQ ID NO: 554441 - RNA, 23 nt, Homo sapiens
agaugguugagauaugaguucuu

SEQ ID NO: 554442 - RNA, 17 nt, Homo sapiens
agauguaaauagaugac

SEQ ID NO: 554443 - RNA, 17 nt, Homo sapiens
agauguacgacuugcau

SEQ ID NO: 554444 - RNA, 22 nt, Homo sapiens
agauguacuucucugugugcac

SEQ ID NO: 554445 - RNA, 12 nt, Homo sapiens
agauguacuugu

SEQ ID NO: 554446 - RNA, 13 nt, Homo sapiens
agaugucacagau

SEQ ID NO: 554447 - RNA, 20 nt, Homo sapiens
agaugucaggaaacauucag

SEQ ID NO: 554448 - RNA, 22 nt, Homo sapiens
agaugucauuuaguucagcauc

SEQ ID NO: 554449 - RNA, 13 nt, Homo sapiens
agauguccagggc

SEQ ID NO: 554450 - RNA, 18 nt, Homo sapiens
agaugucuagguacuuca

SEQ ID NO: 554451 - RNA, 17 nt, Homo sapiens
agaugucucuggggcag

SEQ ID NO: 554452 - RNA, 22 nt, Homo sapiens
agaugucuucaucacuucuucc

SEQ ID NO: 554453 - RNA, 23 nt, Homo sapiens
agaugucuucaucacuucuucca

SEQ ID NO: 554454 - RNA, 19 nt, Homo sapiens
agaugucuucugccuguua

SEQ ID NO: 554455 - RNA, 21 nt, Homo sapiens
agaugucuucugccuguuaua

SEQ ID NO: 554456 - RNA, 16 nt, Homo sapiens
agaugugaguccuguu

SEQ ID NO: 554457 - RNA, 19 nt, Homo sapiens
agauguggcaaagugcugu

SEQ ID NO: 554458 - RNA, 17 nt, Homo sapiens
agauguggcuacugaca

SEQ ID NO: 554459 - RNA, 20 nt, Homo sapiens
agauguggcuacugacauau

SEQ ID NO: 554460 - RNA, 13 nt, Homo sapiens
agauguguaaaca

SEQ ID NO: 554461 - RNA, 14 nt, Homo sapiens
agauguguucuccu

SEQ ID NO: 554462 - RNA, 15 nt, Homo sapiens
agauguuaaugggga

SEQ ID NO: 554463 - RNA, 17 nt, Homo sapiens
agauguuauuaugcuaa

SEQ ID NO: 554464 - RNA, 19 nt, Homo sapiens
agauguucuaagucuuucc

SEQ ID NO: 554465 - RNA, 17 nt, Homo sapiens
agauguuuaugauguaa

SEQ ID NO: 554466 - RNA, 22 nt, Homo sapiens
agauguuuuacgucugggagaa

SEQ ID NO: 554467 - RNA, 13 nt, Homo sapiens
agauuaaaaccaa

SEQ ID NO: 554468 - RNA, 18 nt, Homo sapiens
agauuaagaguugccaaa

SEQ ID NO: 554469 - RNA, 19 nt, Homo sapiens
agauuaccgacacugucac

SEQ ID NO: 554470 - RNA, 23 nt, Homo sapiens
agauuaguauuuuccacgucacu

SEQ ID NO: 554471 - RNA, 15 nt, Homo sapiens
agauuauaacaaauu

SEQ ID NO: 554472 - RNA, 14 nt, Homo sapiens
agauuauaugaagu

SEQ ID NO: 554473 - RNA, 22 nt, Homo sapiens
agauuauuaucuauuaucucaa

SEQ ID NO: 554474 - RNA, 22 nt, Homo sapiens
agauuauugugacuucacugua

SEQ ID NO: 554475 - RNA, 23 nt, Homo sapiens
agauuauugugacuucacuguau

SEQ ID NO: 554476 - RNA, 19 nt, Homo sapiens
agauuauuuacugacauau

SEQ ID NO: 554477 - RNA, 17 nt, Homo sapiens
agauuauuugugcauuu

SEQ ID NO: 554478 - RNA, 11 nt, Homo sapiens
agauucaccug

SEQ ID NO: 554479 - RNA, 13 nt, Homo sapiens
agauucagacuug

SEQ ID NO: 554480 - RNA, 19 nt, Homo sapiens
agauucagguaauacaaac

SEQ ID NO: 554481 - RNA, 22 nt, Homo sapiens
agauucauuauuuuuccacuuu

SEQ ID NO: 554482 - RNA, 14 nt, Homo sapiens
agauuccaaaaagc

SEQ ID NO: 554483 - RNA, 17 nt, Homo sapiens
agauuccaccuagagcu

SEQ ID NO: 554484 - RNA, 19 nt, Homo sapiens
agcugccuucccuagcuuu

SEQ ID NO: 554485 - RNA, 19 nt, Homo sapiens
agcugcuauccccaucucc

SEQ ID NO: 554486 - RNA, 11 nt, Homo sapiens
agcugcucccc

SEQ ID NO: 554487 - RNA, 20 nt, Homo sapiens
agcugcucugaaaucuccuu

SEQ ID NO: 554488 - RNA, 17 nt, Homo sapiens
agcugcucugagccaca

SEQ ID NO: 554489 - RNA, 16 nt, Homo sapiens
agcugcugaaacugua

SEQ ID NO: 554490 - RNA, 13 nt, Homo sapiens
agcugcugauaca

SEQ ID NO: 554491 - RNA, 14 nt, Homo sapiens
agcugcugcugcuc

SEQ ID NO: 554492 - RNA, 16 nt, Homo sapiens
agcugcuggcuugcag

SEQ ID NO: 554493 - RNA, 22 nt, Homo sapiens
aggagcccugaggaccucucag

SEQ ID NO: 554494 - RNA, 23 nt, Homo sapiens
aggagccgaccgggaauaaccuu

SEQ ID NO: 554495 - RNA, 22 nt, Homo sapiens
aggagccggugcucuggaagac

SEQ ID NO: 554496 - RNA, 22 nt, Homo sapiens
aggagccuugauaauacuugac

SEQ ID NO: 554497 - RNA, 23 nt, Homo sapiens
aggagcgcuagugccuugcccac

SEQ ID NO: 554498 - RNA, 18 nt, Homo sapiens
aggagcugauacuuugac

SEQ ID NO: 554499 - RNA, 21 nt, Homo sapiens
aggaggacgguuaacuuguau

SEQ ID NO: 554500 - RNA, 15 nt, Homo sapiens
aggaggagauggcca

SEQ ID NO: 554501 - RNA, 14 nt, Homo sapiens
aggaggagcaccuc

SEQ ID NO: 554502 - RNA, 13 nt, Homo sapiens
aggaggaggacac

SEQ ID NO: 554503 - RNA, 16 nt, Homo sapiens
aggaggauuugucuga

SEQ ID NO: 554504 - RNA, 13 nt, Homo sapiens
aggaggccaauaa

SEQ ID NO: 554505 - RNA, 17 nt, Homo sapiens
aggaggccccuggccca

SEQ ID NO: 554506 - RNA, 21 nt, Homo sapiens
aggaggcccuggugucaggca

SEQ ID NO: 554507 - RNA, 18 nt, Homo sapiens
aggaggcgcccuuggcuu

SEQ ID NO: 554508 - RNA, 17 nt, Homo sapiens
aggaggcugcaugcucu

SEQ ID NO: 554509 - RNA, 20 nt, Homo sapiens
aggaggcuuaggacuuucca

SEQ ID NO: 554510 - RNA, 19 nt, Homo sapiens
aggaggcuuggaaagcauc

SEQ ID NO: 554511 - RNA, 22 nt, Homo sapiens
aggagggcccggagaaacugag

SEQ ID NO: 554512 - RNA, 21 nt, Homo sapiens
aggaggggaggaacacugcac

SEQ ID NO: 554513 - RNA, 17 nt, Homo sapiens
aggagggugagugcaag

SEQ ID NO: 554514 - RNA, 19 nt, Homo sapiens
aggagggugugaguggcau

SEQ ID NO: 554515 - RNA, 16 nt, Homo sapiens
aggaggguugugcuac

SEQ ID NO: 554516 - RNA, 23 nt, Homo sapiens
aggagguccuuaggccucugaga

SEQ ID NO: 554517 - RNA, 23 nt, Homo sapiens
aggaggugcuaucgcaccacugu

SEQ ID NO: 554518 - RNA, 20 nt, Homo sapiens
aggagguggagguugcagug

SEQ ID NO: 554519 - RNA, 14 nt, Homo sapiens
aggaguaauggcau

SEQ ID NO: 554520 - RNA, 20 nt, Homo sapiens
aggagucccugguucauuga

SEQ ID NO: 554521 - RNA, 14 nt, Homo sapiens
aggagucgggagca

SEQ ID NO: 554522 - RNA, 18 nt, Homo sapiens
aggagucucaacaugugu

SEQ ID NO: 554523 - RNA, 22 nt, Homo sapiens
aggagucucugccacccacuca

SEQ ID NO: 554524 - RNA, 15 nt, Homo sapiens
aggagugguucucau

SEQ ID NO: 554525 - RNA, 17 nt, Homo sapiens
aggaguguccugcccau

SEQ ID NO: 554526 - RNA, 17 nt, Homo sapiens
aggagugugaccacuga

SEQ ID NO: 554527 - RNA, 18 nt, Homo sapiens
aggagugugaccacugaa

SEQ ID NO: 554528 - RNA, 13 nt, Homo sapiens
aggaguucaagac

SEQ ID NO: 554529 - RNA, 18 nt, Homo sapiens
aggaguucaagaccagcc

SEQ ID NO: 554530 - RNA, 13 nt, Homo sapiens
aggaguuccuuga

SEQ ID NO: 554531 - RNA, 18 nt, Homo sapiens
aggaguucgagaccagcc

SEQ ID NO: 554532 - RNA, 21 nt, Homo sapiens
aggaguuggaauguuguaguu

SEQ ID NO: 554533 - RNA, 23 nt, Homo sapiens
aggaguuucacccugaccauugc

SEQ ID NO: 554534 - RNA, 21 nt, Homo sapiens
aggaguuuuggcagccagacu

SEQ ID NO: 554535 - RNA, 21 nt, Homo sapiens
aggaguuuugggaaugcacuu

SEQ ID NO: 554536 - RNA, 14 nt, Homo sapiens
aggaguuuuguucc

SEQ ID NO: 554537 - RNA, 12 nt, Homo sapiens
aggauaacacaa

SEQ ID NO: 554538 - RNA, 20 nt, Homo sapiens
aggauaaccuugugccuugg

SEQ ID NO: 554539 - RNA, 18 nt, Homo sapiens
aggauacgacaguacacu

SEQ ID NO: 554540 - RNA, 22 nt, Homo sapiens
aggauagcgagaagaugcucug

SEQ ID NO: 554541 - RNA, 12 nt, Homo sapiens
aggauaugcagu

SEQ ID NO: 554542 - RNA, 21 nt, Homo sapiens
aggauauuaaauguugcuuua

SEQ ID NO: 554543 - RNA, 15 nt, Homo sapiens
aggauauuaacaaca

SEQ ID NO: 554544 - RNA, 23 nt, Homo sapiens
aggauauugguucuuccccucau

SEQ ID NO: 554545 - RNA, 18 nt, Homo sapiens
aggaucacuugagcccag

SEQ ID NO: 554546 - RNA, 14 nt, Homo sapiens
aggaucaggcugcu

SEQ ID NO: 554547 - RNA, 15 nt, Homo sapiens
aggaucaggcugcug

SEQ ID NO: 554548 - RNA, 17 nt, Homo sapiens
aggaucaguuaacuauu

SEQ ID NO: 554549 - RNA, 19 nt, Homo sapiens
aggauccucuccacuccau

SEQ ID NO: 554550 - RNA, 13 nt, Homo sapiens
aggaucgcucaag

SEQ ID NO: 554551 - RNA, 22 nt, Homo sapiens
aggaucuccuguccaucagcca

SEQ ID NO: 554552 - RNA, 14 nt, Homo sapiens
aggaucucucagga

SEQ ID NO: 554553 - RNA, 19 nt, Homo sapiens
aggaucuuauuuugugaac

SEQ ID NO: 554554 - RNA, 13 nt, Homo sapiens
aggaucuugccug

SEQ ID NO: 554555 - RNA, 23 nt, Homo sapiens
aggaugaaucauauucauaugca

SEQ ID NO: 554556 - RNA, 21 nt, Homo sapiens
aggaugaauguaugugcacug

SEQ ID NO: 554557 - RNA, 20 nt, Homo sapiens
aggaugauuguacagaauca

SEQ ID NO: 554558 - RNA, 15 nt, Homo sapiens
aggaugcagcacugc

SEQ ID NO: 554559 - RNA, 17 nt, Homo sapiens
aggaugccuuagcaugu

SEQ ID NO: 554560 - RNA, 19 nt, Homo sapiens
aggaugcugucaagcaccu

SEQ ID NO: 554561 - RNA, 19 nt, Homo sapiens
aggauggaugcaucacacu

SEQ ID NO: 554562 - RNA, 18 nt, Homo sapiens
aggauggcaaagagaguc

SEQ ID NO: 554563 - RNA, 23 nt, Homo sapiens
aggaugguggacuacaaaauaca

SEQ ID NO: 554564 - RNA, 12 nt, Homo sapiens
aggauggugggc

SEQ ID NO: 554565 - RNA, 21 nt, Homo sapiens
aggaugucccugggccagggu

SEQ ID NO: 554566 - RNA, 20 nt, Homo sapiens
aggauguggaaccuguuuaa

SEQ ID NO: 554567 - RNA, 23 nt, Homo sapiens
aggauguugccacuggcaaaugu

SEQ ID NO: 554568 - RNA, 16 nt, Homo sapiens
aggauguuuagcagug

SEQ ID NO: 554569 - RNA, 19 nt, Homo sapiens
aggauuauuuuaaauacaa

SEQ ID NO: 554570 - RNA, 21 nt, Homo sapiens
aggauuccaaaaacauuuuau

SEQ ID NO: 554571 - RNA, 22 nt, Homo sapiens
aggauugaaaauguccaggaaa

SEQ ID NO: 554572 - RNA, 17 nt, Homo sapiens
aggauugcuacugaugc

SEQ ID NO: 554573 - RNA, 14 nt, Homo sapiens
aggauugcuucaau

SEQ ID NO: 554574 - RNA, 15 nt, Homo sapiens
aggauuucaugauuu

SEQ ID NO: 554575 - RNA, 14 nt, Homo sapiens
aggauuuuaccaaa

SEQ ID NO: 554576 - RNA, 17 nt, Homo sapiens
aggauuuuuauugauug

SEQ ID NO: 554577 - RNA, 17 nt, Homo sapiens
aggauuuuugagcacaa

SEQ ID NO: 554578 - RNA, 17 nt, Homo sapiens
aggcaaagauuucauga

SEQ ID NO: 554579 - RNA, 20 nt, Homo sapiens
aggcaaaggcagaggaauuu

SEQ ID NO: 554580 - RNA, 15 nt, Homo sapiens
aggcaaaguacaaaa

SEQ ID NO: 554581 - RNA, 16 nt, Homo sapiens
aggcaaauauaagcug

SEQ ID NO: 554582 - RNA, 14 nt, Homo sapiens
aggcaaauguguac

SEQ ID NO: 554583 - RNA, 15 nt, Homo sapiens
aggcaaccagaggaa

SEQ ID NO: 554584 - RNA, 14 nt, Homo sapiens
aggcaacugugagu

SEQ ID NO: 554585 - RNA, 12 nt, Homo sapiens
aggcaagaucua

SEQ ID NO: 554586 - RNA, 20 nt, Homo sapiens
aggcaagcugaaauuuuaga

SEQ ID NO: 554587 - RNA, 15 nt, Homo sapiens
aggcaaggaugucug

SEQ ID NO: 554588 - RNA, 19 nt, Homo sapiens
aggcaaggcuaugugauua

SEQ ID NO: 554589 - RNA, 17 nt, Homo sapiens
aggcaaggggcauuuca

SEQ ID NO: 554590 - RNA, 13 nt, Homo sapiens
aggcaaugggagc

SEQ ID NO: 554591 - RNA, 21 nt, Homo sapiens
aggcaauuccugauggaaaau

SEQ ID NO: 554592 - RNA, 17 nt, Homo sapiens
aggcacaccagugcaag

SEQ ID NO: 554593 - RNA, 23 nt, Homo sapiens
aggcacagugggagcugagcugg

SEQ ID NO: 554594 - RNA, 14 nt, Homo sapiens
aggcaccagaagaa

SEQ ID NO: 554595 - RNA, 13 nt, Homo sapiens
aggcaccaggaag

SEQ ID NO: 554596 - RNA, 12 nt, Homo sapiens
aggcaccaugca

SEQ ID NO: 554597 - RNA, 17 nt, Homo sapiens
aggcacccucagagaag

SEQ ID NO: 554598 - RNA, 21 nt, Homo sapiens
aggcacccucagggagccucc

SEQ ID NO: 554599 - RNA, 19 nt, Homo sapiens
aggcaccugccaccaugcc

SEQ ID NO: 554600 - RNA, 20 nt, Homo sapiens
aggcacuguucaauacugua

SEQ ID NO: 554601 - RNA, 12 nt, Homo sapiens
aggcagaacucu

SEQ ID NO: 554602 - RNA, 16 nt, Homo sapiens
aggcagacuugcagag

SEQ ID NO: 554603 - RNA, 14 nt, Homo sapiens
aggcuggagcuggc

SEQ ID NO: 554604 - RNA, 16 nt, Homo sapiens
aggcuggaguacaaug

SEQ ID NO: 554605 - RNA, 18 nt, Homo sapiens
aggcuggagugcaauggu

SEQ ID NO: 554606 - RNA, 14 nt, Homo sapiens
aggcuggagugcag

SEQ ID NO: 554607 - RNA, 15 nt, Homo sapiens
aggcuggagugcagu

SEQ ID NO: 554608 - RNA, 20 nt, Homo sapiens
aggcuggagugcaguggcac

SEQ ID NO: 554609 - RNA, 19 nt, Homo sapiens
aggcuggauggcaccucag

SEQ ID NO: 554610 - RNA, 15 nt, Homo sapiens
aggcuggcagugaca

SEQ ID NO: 554611 - RNA, 22 nt, Homo sapiens
aggcuggcagugacagaacuaa

SEQ ID NO: 554612 - RNA, 16 nt, Homo sapiens
aggcuggccaaggugu

SEQ ID NO: 554613 - RNA, 16 nt, Homo sapiens
aggcuggcuuucagag

SEQ ID NO: 554614 - RNA, 22 nt, Homo sapiens
aggcugggaacucaucugguug

SEQ ID NO: 554615 - RNA, 18 nt, Homo sapiens
aggcugggugcagucacg

SEQ ID NO: 554616 - RNA, 13 nt, Homo sapiens
aggcuggucucaa

SEQ ID NO: 554617 - RNA, 23 nt, Homo sapiens
aggcugguuucuuucaugcuccu

SEQ ID NO: 554618 - RNA, 18 nt, Homo sapiens
aggcuguacgacacgggu

SEQ ID NO: 554619 - RNA, 18 nt, Homo sapiens
aggcugucugugccaugg

SEQ ID NO: 554620 - RNA, 21 nt, Homo sapiens
aggcugucuuagugcaaaaaa

SEQ ID NO: 554621 - RNA, 17 nt, Homo sapiens
aggcuguuguuggcuua

SEQ ID NO: 554622 - RNA, 18 nt, Homo sapiens
aggcuguuugagaaccau

SEQ ID NO: 554623 - RNA, 21 nt, Homo sapiens
aggcuucccacuauuuauuac

SEQ ID NO: 554624 - RNA, 23 nt, Homo sapiens
aggcuucucacggcgaccaauaa

SEQ ID NO: 554625 - RNA, 18 nt, Homo sapiens
aggcuucugauacgugua

SEQ ID NO: 554626 - RNA, 15 nt, Homo sapiens
aggcuugggauuugc

SEQ ID NO: 554627 - RNA, 20 nt, Homo sapiens
aggcuuuaaaaagaaaauca

SEQ ID NO: 554628 - RNA, 16 nt, Homo sapiens
aggcuuucuguugcca

SEQ ID NO: 554629 - RNA, 19 nt, Homo sapiens
aggcuuugaguuaacucac

SEQ ID NO: 554630 - RNA, 14 nt, Homo sapiens
aggcuuugccauug

SEQ ID NO: 554631 - RNA, 20 nt, Homo sapiens
aggcuuuuaagaaacacagg

SEQ ID NO: 554632 - RNA, 18 nt, Homo sapiens
agggaaaaguucuccuau

SEQ ID NO: 554633 - RNA, 14 nt, Homo sapiens
agggaaaaugagua

SEQ ID NO: 554634 - RNA, 17 nt, Homo sapiens
agggaaagccucuggca

SEQ ID NO: 554635 - RNA, 17 nt, Homo sapiens
agggaaagcuuccuccu

SEQ ID NO: 554636 - RNA, 22 nt, Homo sapiens
agggaaagugcauaugaaaucc

SEQ ID NO: 554637 - RNA, 22 nt, Homo sapiens
agggaaauuguuuauguguuau

SEQ ID NO: 554638 - RNA, 21 nt, Homo sapiens
agggaacccucuaagggaccu

SEQ ID NO: 554639 - RNA, 21 nt, Homo sapiens
agggaacccugcuugcacuuu

SEQ ID NO: 554640 - RNA, 15 nt, Homo sapiens
agggaaccugugucc

SEQ ID NO: 554641 - RNA, 19 nt, Homo sapiens
agggaagcuggccgagggu

SEQ ID NO: 554642 - RNA, 21 nt, Homo sapiens
agggaaggagcccagccagaa

SEQ ID NO: 554643 - RNA, 21 nt, Homo sapiens
agggaaguaacauuugccuua

SEQ ID NO: 554644 - RNA, 12 nt, Homo sapiens
agggaagugcau

SEQ ID NO: 554645 - RNA, 23 nt, Homo sapiens
agggaaguucaggcucugagaca

SEQ ID NO: 554646 - RNA, 21 nt, Homo sapiens
agggaauacuauacagccaua

SEQ ID NO: 554647 - RNA, 23 nt, Homo sapiens
agggaaugagaguuccuucucac

SEQ ID NO: 554648 - RNA, 16 nt, Homo sapiens
agggaauggagcucag

SEQ ID NO: 554649 - RNA, 18 nt, Homo sapiens
agggaaugggucugcaca

SEQ ID NO: 554650 - RNA, 20 nt, Homo sapiens
agggaaugggucugcacaga

SEQ ID NO: 554651 - RNA, 19 nt, Homo sapiens
agggaauugaggucugcuc

SEQ ID NO: 554652 - RNA, 14 nt, Homo sapiens
agggaauugcucag

SEQ ID NO: 554653 - RNA, 13 nt, Homo sapiens
agggacaagacaa

SEQ ID NO: 554654 - RNA, 16 nt, Homo sapiens
agggacagaaaccaag

SEQ ID NO: 554655 - RNA, 21 nt, Homo sapiens
agggacagagccccacgcugu

SEQ ID NO: 554656 - RNA, 21 nt, Homo sapiens
agggaccacacccuguacugu

SEQ ID NO: 554657 - RNA, 16 nt, Homo sapiens
agggacgccugggggu

SEQ ID NO: 554658 - RNA, 14 nt, Homo sapiens
agggacuccaugcu

SEQ ID NO: 554659 - RNA, 15 nt, Homo sapiens
agggacugaaaaccu

SEQ ID NO: 554660 - RNA, 13 nt, Homo sapiens
agggacuugccuc

SEQ ID NO: 554661 - RNA, 20 nt, Homo sapiens
agggagaauaaaauuccuau

SEQ ID NO: 554662 - RNA, 21 nt, Homo sapiens
agggagacccccaucuuuaca

SEQ ID NO: 554663 - RNA, 13 nt, Homo sapiens
agggagaggaaga

SEQ ID NO: 554664 - RNA, 16 nt, Homo sapiens
agggagccgagaucac

SEQ ID NO: 554665 - RNA, 15 nt, Homo sapiens
agggagcgcucucuu

SEQ ID NO: 554666 - RNA, 22 nt, Homo sapiens
agggagcuccagaaacuuucca

SEQ ID NO: 554667 - RNA, 14 nt, Homo sapiens
agggagcucugggg

SEQ ID NO: 554668 - RNA, 14 nt, Homo sapiens
agggagcugaguaa

SEQ ID NO: 554669 - RNA, 12 nt, Homo sapiens
agggagcuuccu

SEQ ID NO: 554670 - RNA, 18 nt, Homo sapiens
agggagcuugccacacuc

SEQ ID NO: 554671 - RNA, 12 nt, Homo sapiens
agggaggcucag

SEQ ID NO: 554672 - RNA, 16 nt, Homo sapiens
agggagggcugucauc

SEQ ID NO: 554673 - RNA, 19 nt, Homo sapiens
agggagggguuauagcuuc

SEQ ID NO: 554674 - RNA, 14 nt, Homo sapiens
agggagguggcaag

SEQ ID NO: 554675 - RNA, 22 nt, Homo sapiens
agggaggugggggccuccucag

SEQ ID NO: 554676 - RNA, 16 nt, Homo sapiens
agggagguuugugaga

SEQ ID NO: 554677 - RNA, 18 nt, Homo sapiens
agggaguucaaaacauuc

SEQ ID NO: 554678 - RNA, 22 nt, Homo sapiens
agggauaaccccaggcacuguu

SEQ ID NO: 554679 - RNA, 16 nt, Homo sapiens
agggauaauuggugca

SEQ ID NO: 554680 - RNA, 21 nt, Homo sapiens
agggauacacaggacugaaaa

SEQ ID NO: 554681 - RNA, 22 nt, Homo sapiens
agggaucuugcauucccagugg

SEQ ID NO: 554682 - RNA, 19 nt, Homo sapiens
agggaugcugccugaguca

SEQ ID NO: 554683 - RNA, 17 nt, Homo sapiens
agggauggcagugauuc

SEQ ID NO: 554684 - RNA, 17 nt, Homo sapiens
agggauuagguguucag

SEQ ID NO: 554685 - RNA, 23 nt, Homo sapiens
agggcaaaaucgccauaggccaa

SEQ ID NO: 554686 - RNA, 21 nt, Homo sapiens
agggcaaaucuauuacuuuug

SEQ ID NO: 554687 - RNA, 13 nt, Homo sapiens
agggcaagccacc

SEQ ID NO: 554688 - RNA, 21 nt, Homo sapiens
agggcacggggaccuggauag

SEQ ID NO: 554689 - RNA, 15 nt, Homo sapiens
agggcacuggagcug

SEQ ID NO: 554690 - RNA, 16 nt, Homo sapiens
agggcagccugucacc

SEQ ID NO: 554691 - RNA, 13 nt, Homo sapiens
agggcagcugccu

SEQ ID NO: 554692 - RNA, 17 nt, Homo sapiens
agggcagcuguggcuuc

SEQ ID NO: 554693 - RNA, 15 nt, Homo sapiens
agggcagcuuugcaa

SEQ ID NO: 554694 - RNA, 17 nt, Homo sapiens
agggcagcuuugcaaaa

SEQ ID NO: 554695 - RNA, 16 nt, Homo sapiens
agggcaggaacuugca

SEQ ID NO: 554696 - RNA, 17 nt, Homo sapiens
agggcauaccuugugca

SEQ ID NO: 554697 - RNA, 14 nt, Homo sapiens
agggcaucaucuau

SEQ ID NO: 554698 - RNA, 14 nt, Homo sapiens
agggccacauggga

SEQ ID NO: 554699 - RNA, 18 nt, Homo sapiens
agggccagagcaagcgcu

SEQ ID NO: 554700 - RNA, 12 nt, Homo sapiens
agggccagugau

SEQ ID NO: 554701 - RNA, 13 nt, Homo sapiens
agggccaugucag

SEQ ID NO: 554702 - RNA, 15 nt, Homo sapiens
agggccaugucagac

SEQ ID NO: 554703 - RNA, 17 nt, Homo sapiens
agggcccagcuguagcc

SEQ ID NO: 554704 - RNA, 16 nt, Homo sapiens
agggcccccaucucau

SEQ ID NO: 554705 - RNA, 14 nt, Homo sapiens
agggccgccugccu

SEQ ID NO: 554706 - RNA, 12 nt, Homo sapiens
agggccgugccc

SEQ ID NO: 554707 - RNA, 14 nt, Homo sapiens
agggcgaaggccau

SEQ ID NO: 554708 - RNA, 20 nt, Homo sapiens
agggcgagacuccgucucaa

SEQ ID NO: 554709 - RNA, 20 nt, Homo sapiens
agggcgagacucugucucaa

SEQ ID NO: 554710 - RNA, 14 nt, Homo sapiens
agggcgccuagucc

SEQ ID NO: 554711 - RNA, 18 nt, Homo sapiens
agggcgggcagagggcug

SEQ ID NO: 554712 - RNA, 23 nt, Homo sapiens
aggucgguuuagaugaaugcucc

SEQ ID NO: 554713 - RNA, 21 nt, Homo sapiens
aggucucacgggcaugggcac

SEQ ID NO: 554714 - RNA, 20 nt, Homo sapiens
aggucucaggagaagggaua

SEQ ID NO: 554715 - RNA, 15 nt, Homo sapiens
aggucucugaacuca

SEQ ID NO: 554716 - RNA, 13 nt, Homo sapiens
aggucuguaguau

SEQ ID NO: 554717 - RNA, 18 nt, Homo sapiens
aggucuucaaucuuaaaa

SEQ ID NO: 554718 - RNA, 11 nt, Homo sapiens
aggucuugacu

SEQ ID NO: 554719 - RNA, 15 nt, Homo sapiens
aggucuuucuccuca

SEQ ID NO: 554720 - RNA, 19 nt, Homo sapiens
aggugaaaauccaucucau

SEQ ID NO: 554721 - RNA, 19 nt, Homo sapiens
aggugaagucgggucaaaa

SEQ ID NO: 554722 - RNA, 15 nt, Homo sapiens
aggugaauagcacag

SEQ ID NO: 554723 - RNA, 18 nt, Homo sapiens
aggugacaaaccauuucc

SEQ ID NO: 554724 - RNA, 15 nt, Homo sapiens
aggugacaagcguca

SEQ ID NO: 554725 - RNA, 20 nt, Homo sapiens
aggugacaugucuacuuuuu

SEQ ID NO: 554726 - RNA, 15 nt, Homo sapiens
aggugaccaguggga

SEQ ID NO: 554727 - RNA, 15 nt, Homo sapiens
aggugagaacccugu

SEQ ID NO: 554728 - RNA, 13 nt, Homo sapiens
aggugaggcccaa

SEQ ID NO: 554729 - RNA, 21 nt, Homo sapiens
aggugaggcguucuccugcuu

SEQ ID NO: 554730 - RNA, 18 nt, Homo sapiens
aggugaggcucuucacau

SEQ ID NO: 554731 - RNA, 23 nt, Homo sapiens
aggugauccacccaccuuggccu

SEQ ID NO: 554732 - RNA, 17 nt, Homo sapiens
aggugauccaccugccu

SEQ ID NO: 554733 - RNA, 15 nt, Homo sapiens
aggugaucucuggga

SEQ ID NO: 554734 - RNA, 18 nt, Homo sapiens
aggugauucucagggcug

SEQ ID NO: 554735 - RNA, 19 nt, Homo sapiens
aggugcauagcaagugaaa

SEQ ID NO: 554736 - RNA, 19 nt, Homo sapiens
aggugcccgaguagcaucc

SEQ ID NO: 554737 - RNA, 11 nt, Homo sapiens
aggugccucau

SEQ ID NO: 554738 - RNA, 21 nt, Homo sapiens
aggugccugcucaggugcuau

SEQ ID NO: 554739 - RNA, 16 nt, Homo sapiens
aggugccuggccaugu

SEQ ID NO: 554740 - RNA, 18 nt, Homo sapiens
aggugccuggccauguca

SEQ ID NO: 554741 - RNA, 19 nt, Homo sapiens
aggugcguguucagcagaa

SEQ ID NO: 554742 - RNA, 19 nt, Homo sapiens
aggugcuaucgcaccacug

SEQ ID NO: 554743 - RNA, 23 nt, Homo sapiens
aggugcuaugucccaagagccau

SEQ ID NO: 554744 - RNA, 17 nt, Homo sapiens
aggugcugaaugaagcu

SEQ ID NO: 554745 - RNA, 20 nt, Homo sapiens
aggugcugacuucaucuccc

SEQ ID NO: 554746 - RNA, 22 nt, Homo sapiens
aggugcugauccuaagaauuuu

SEQ ID NO: 554747 - RNA, 19 nt, Homo sapiens
aggugcuucugccugugca

SEQ ID NO: 554748 - RNA, 21 nt, Homo sapiens
agguggaaaaacagcauguac

SEQ ID NO: 554749 - RNA, 18 nt, Homo sapiens
agguggaacaagcacaga

SEQ ID NO: 554750 - RNA, 14 nt, Homo sapiens
agguggaaguugca

SEQ ID NO: 554751 - RNA, 16 nt, Homo sapiens
agguggagugucacau

SEQ ID NO: 554752 - RNA, 20 nt, Homo sapiens
agguggauuccgagugguga

SEQ ID NO: 554753 - RNA, 24 nt, Homo sapiens
agguggcaagcugugacuucucca

SEQ ID NO: 554754 - RNA, 19 nt, Homo sapiens
agguggcaggaccaggacu

SEQ ID NO: 554755 - RNA, 11 nt, Homo sapiens
agguggcccag

SEQ ID NO: 554756 - RNA, 17 nt, Homo sapiens
agguggcucagugccac

SEQ ID NO: 554757 - RNA, 19 nt, Homo sapiens
aggugggaggaucauuuga

SEQ ID NO: 554758 - RNA, 14 nt, Homo sapiens
aggugggcaugcca

SEQ ID NO: 554759 - RNA, 16 nt, Homo sapiens
aggugggcaugccacc

SEQ ID NO: 554760 - RNA, 19 nt, Homo sapiens
aggugggcggaucaccuga

SEQ ID NO: 554761 - RNA, 18 nt, Homo sapiens
aggugggggccuccucag

SEQ ID NO: 554762 - RNA, 21 nt, Homo sapiens
aggugggucuaccucaucucu

SEQ ID NO: 554763 - RNA, 14 nt, Homo sapiens
aggugggugcugcc

SEQ ID NO: 554764 - RNA, 22 nt, Homo sapiens
aggugggugugggacaccuggg

SEQ ID NO: 554765 - RNA, 17 nt, Homo sapiens
agguggguugaaagcca

SEQ ID NO: 554766 - RNA, 21 nt, Homo sapiens
agguggguugaaagccaagga

SEQ ID NO: 554767 - RNA, 17 nt, Homo sapiens
agguggucccacggcug

SEQ ID NO: 554768 - RNA, 13 nt, Homo sapiens
agguggugcaaau

SEQ ID NO: 554769 - RNA, 16 nt, Homo sapiens
aggugguggcacugag

SEQ ID NO: 554770 - RNA, 20 nt, Homo sapiens
agguggugggcaaaaacaau

SEQ ID NO: 554771 - RNA, 19 nt, Homo sapiens
agguguaaaugggacaaaa

SEQ ID NO: 554772 - RNA, 16 nt, Homo sapiens
agguguagaccagagu

SEQ ID NO: 554773 - RNA, 20 nt, Homo sapiens
aggugucuagacugccaggg

SEQ ID NO: 554774 - RNA, 17 nt, Homo sapiens
aggugucuuaagccuuu

SEQ ID NO: 554775 - RNA, 15 nt, Homo sapiens
agguguguccuugaa

SEQ ID NO: 554776 - RNA, 24 nt, Homo sapiens
aggugugugugaacugggcacaga

SEQ ID NO: 554777 - RNA, 16 nt, Homo sapiens
agguguugccauuucu

SEQ ID NO: 554778 - RNA, 18 nt, Homo sapiens
agguuaaagcuaaacuga

SEQ ID NO: 554779 - RNA, 16 nt, Homo sapiens
agguuaaggugcaaua

SEQ ID NO: 554780 - RNA, 19 nt, Homo sapiens
agguuauagaguagaagau

SEQ ID NO: 554781 - RNA, 12 nt, Homo sapiens
agguuaucagug

SEQ ID NO: 554782 - RNA, 23 nt, Homo sapiens
agguuaucugccuggccuggcuc

SEQ ID NO: 554783 - RNA, 17 nt, Homo sapiens
agguuauuuugauguaa

SEQ ID NO: 554784 - RNA, 15 nt, Homo sapiens
agguucacaccauuu

SEQ ID NO: 554785 - RNA, 14 nt, Homo sapiens
agguucacaggggu

SEQ ID NO: 554786 - RNA, 15 nt, Homo sapiens
agguucacugagcuc

SEQ ID NO: 554787 - RNA, 12 nt, Homo sapiens
agguuccaguga

SEQ ID NO: 554788 - RNA, 13 nt, Homo sapiens
agguuccugugga

SEQ ID NO: 554789 - RNA, 22 nt, Homo sapiens
agguucucuuccuggcaucaua

SEQ ID NO: 554790 - RNA, 17 nt, Homo sapiens
agguucugguuccauuu

SEQ ID NO: 554791 - RNA, 15 nt, Homo sapiens
agguucuucagggcc

SEQ ID NO: 554792 - RNA, 12 nt, Homo sapiens
agguucuugaua

SEQ ID NO: 554793 - RNA, 15 nt, Homo sapiens
agguugaaacauauc

SEQ ID NO: 554794 - RNA, 21 nt, Homo sapiens
agguugcagcaugagacuuuc

SEQ ID NO: 554795 - RNA, 19 nt, Homo sapiens
agguuggugaaguguaaua

SEQ ID NO: 554796 - RNA, 14 nt, Homo sapiens
agguuggugacuga

SEQ ID NO: 554797 - RNA, 21 nt, Homo sapiens
agguugucuccaggccaugau

SEQ ID NO: 554798 - RNA, 18 nt, Homo sapiens
agguugucugaagucacu

SEQ ID NO: 554799 - RNA, 14 nt, Homo sapiens
agguuuacauucau

SEQ ID NO: 554800 - RNA, 15 nt, Homo sapiens
agguuuagaugugca

SEQ ID NO: 554801 - RNA, 15 nt, Homo sapiens
agguuucuccuugaa

SEQ ID NO: 554802 - RNA, 19 nt, Homo sapiens
agguuucuggcagccagua

SEQ ID NO: 554803 - RNA, 15 nt, Homo sapiens
agguuugcaccccuc

SEQ ID NO: 554804 - RNA, 17 nt, Homo sapiens
agguuugucccagucag

SEQ ID NO: 554805 - RNA, 21 nt, Homo sapiens
agguuuuaaccgcacaugcac

SEQ ID NO: 554806 - RNA, 22 nt, Homo sapiens
agguuuugcuugggaaacucaa

SEQ ID NO: 554807 - RNA, 13 nt, Homo sapiens
agguuuuguugcu

SEQ ID NO: 554808 - RNA, 22 nt, Homo sapiens
agguuuuuggcugaguacugga

SEQ ID NO: 554809 - RNA, 21 nt, Homo sapiens
aguaaaaaauuaaagcccaua

SEQ ID NO: 554810 - RNA, 15 nt, Homo sapiens
aguaaaaauugaacu

SEQ ID NO: 554811 - RNA, 13 nt, Homo sapiens
aguaaaauacuau

SEQ ID NO: 554812 - RNA, 20 nt, Homo sapiens
aguaaaggccucaucuccuu

SEQ ID NO: 554813 - RNA, 21 nt, Homo sapiens
aguaaagguacgauuauacuu

SEQ ID NO: 554814 - RNA, 15 nt, Homo sapiens
aguaaauagugucau

SEQ ID NO: 554815 - RNA, 20 nt, Homo sapiens
aguaaaucuuuuacaacugc

SEQ ID NO: 554816 - RNA, 21 nt, Homo sapiens
aguaacacaguggacuuccua

SEQ ID NO: 554817 - RNA, 20 nt, Homo sapiens
aguaacaugcauacuuuauu

SEQ ID NO: 554818 - RNA, 11 nt, Homo sapiens
aguaacaugug

SEQ ID NO: 554819 - RNA, 13 nt, Homo sapiens
auacuuacuauaa

SEQ ID NO: 554820 - RNA, 13 nt, Homo sapiens
auacuuacugaac

SEQ ID NO: 554821 - RNA, 17 nt, Homo sapiens
auacuucaauacuucau

SEQ ID NO: 554822 - RNA, 22 nt, Homo sapiens
auacuugauuuaaucaccacuc

SEQ ID NO: 554823 - RNA, 20 nt, Homo sapiens
auacuugccuucugauagua

SEQ ID NO: 554824 - RNA, 15 nt, Homo sapiens
auacuuuacaaacca

SEQ ID NO: 554825 - RNA, 19 nt, Homo sapiens
auacuuuauuucugaucua

SEQ ID NO: 554826 - RNA, 17 nt, Homo sapiens
auacuuugacaaggaaa

SEQ ID NO: 554827 - RNA, 16 nt, Homo sapiens
auacuuugucugaaaa

SEQ ID NO: 554828 - RNA, 20 nt, Homo sapiens
auacuuuuaugcaaccauaa

SEQ ID NO: 554829 - RNA, 21 nt, Homo sapiens
auacuuuuuaaaguuuaccau

SEQ ID NO: 554830 - RNA, 15 nt, Homo sapiens
auagaaaaguauguu

SEQ ID NO: 554831 - RNA, 19 nt, Homo sapiens
auagaaaauuaaacacaaa

SEQ ID NO: 554832 - RNA, 22 nt, Homo sapiens
auagaaaugguuuccucuggau

SEQ ID NO: 554833 - RNA, 14 nt, Homo sapiens
auagaaauuuugua

SEQ ID NO: 554834 - RNA, 16 nt, Homo sapiens
auagaacuacuuugaa

SEQ ID NO: 554835 - RNA, 23 nt, Homo sapiens
auagaaggcugucuuagugcaaa

SEQ ID NO: 554836 - RNA, 17 nt, Homo sapiens
auagaaguagcaaaaag

SEQ ID NO: 554837 - RNA, 17 nt, Homo sapiens
auagaauaaaagcuaua

SEQ ID NO: 554838 - RNA, 18 nt, Homo sapiens
auagaauaaaggcaguuu

SEQ ID NO: 554839 - RNA, 22 nt, Homo sapiens
auagaauacauggaaacgcaaa

SEQ ID NO: 554840 - RNA, 20 nt, Homo sapiens
auagaauggagggagcucca

SEQ ID NO: 554841 - RNA, 13 nt, Homo sapiens
auagaauugcaca

SEQ ID NO: 554842 - RNA, 13 nt, Homo sapiens
auagacaauuuau

SEQ ID NO: 554843 - RNA, 15 nt, Homo sapiens
auagacaauuugcac

SEQ ID NO: 554844 - RNA, 18 nt, Homo sapiens
auagacacugaucuggcu

SEQ ID NO: 554845 - RNA, 14 nt, Homo sapiens
auagacagugcugc

SEQ ID NO: 554846 - RNA, 19 nt, Homo sapiens
auagacaucaguauucugc

SEQ ID NO: 554847 - RNA, 13 nt, Homo sapiens
auagacauucuca

SEQ ID NO: 554848 - RNA, 20 nt, Homo sapiens
auagacugccaugcuagaca

SEQ ID NO: 554849 - RNA, 17 nt, Homo sapiens
auagacuuauugccaaa

SEQ ID NO: 554850 - RNA, 18 nt, Homo sapiens
auagagauuugucuaauu

SEQ ID NO: 554851 - RNA, 21 nt, Homo sapiens
auagagcaaaaucaacaugac

SEQ ID NO: 554852 - RNA, 18 nt, Homo sapiens
auagagcaaccaguacua

SEQ ID NO: 554853 - RNA, 13 nt, Homo sapiens
auagaguacugca

SEQ ID NO: 554854 - RNA, 17 nt, Homo sapiens
auagaguauugucuuua

SEQ ID NO: 554855 - RNA, 21 nt, Homo sapiens
auagagugguacagcacuguu

SEQ ID NO: 554856 - RNA, 15 nt, Homo sapiens
auagagugugaugua

SEQ ID NO: 554857 - RNA, 20 nt, Homo sapiens
auagauaagguuuccugcuc

SEQ ID NO: 554858 - RNA, 23 nt, Homo sapiens
auagauauuccuauugugcaaug

SEQ ID NO: 554859 - RNA, 21 nt, Homo sapiens
auagaugcacuuaugcaguaa

SEQ ID NO: 554860 - RNA, 22 nt, Homo sapiens
auagaugccgcggaaggucccu

SEQ ID NO: 554861 - RNA, 20 nt, Homo sapiens
auagaugucuagguacuuca

SEQ ID NO: 554862 - RNA, 19 nt, Homo sapiens
auagauuguccuuuugcaa

SEQ ID NO: 554863 - RNA, 20 nt, Homo sapiens
auagauuuaaagaauaugaa

SEQ ID NO: 554864 - RNA, 18 nt, Homo sapiens
auagcaacauuauuugua

SEQ ID NO: 554865 - RNA, 23 nt, Homo sapiens
auagcaguugaaacaagaagcca

SEQ ID NO: 554866 - RNA, 22 nt, Homo sapiens
auagcaguuuguaaaaguguaa

SEQ ID NO: 554867 - RNA, 23 nt, Homo sapiens
auagccaacugcuguucauguua

SEQ ID NO: 554868 - RNA, 16 nt, Homo sapiens
auagccauaugcaaua

SEQ ID NO: 554869 - RNA, 18 nt, Homo sapiens
auagcccucagacauuua

SEQ ID NO: 554870 - RNA, 21 nt, Homo sapiens
auagccuaauacaacauguag

SEQ ID NO: 554871 - RNA, 21 nt, Homo sapiens
auagcgcugaccaacgcacaa

SEQ ID NO: 554872 - RNA, 18 nt, Homo sapiens
auagcuaaguacacaaua

SEQ ID NO: 554873 - RNA, 18 nt, Homo sapiens
auagcuaggugacauaua

SEQ ID NO: 554874 - RNA, 17 nt, Homo sapiens
auagcuauauccaugua

SEQ ID NO: 554875 - RNA, 21 nt, Homo sapiens
auagcugccuucaaggacugu

SEQ ID NO: 554876 - RNA, 20 nt, Homo sapiens
auagcuggggcuucaccagu

SEQ ID NO: 554877 - RNA, 15 nt, Homo sapiens
auagcuugaagccca

SEQ ID NO: 554878 - RNA, 15 nt, Homo sapiens
auagcuuuuacucug

SEQ ID NO: 554879 - RNA, 17 nt, Homo sapiens
auaggaaagcauaugca

SEQ ID NO: 554880 - RNA, 13 nt, Homo sapiens
auaggacucugga

SEQ ID NO: 554881 - RNA, 17 nt, Homo sapiens
auaggauagacacugga

SEQ ID NO: 554882 - RNA, 16 nt, Homo sapiens
auaggauugcuucaau

SEQ ID NO: 554883 - RNA, 15 nt, Homo sapiens
auaggcagcaucuca

SEQ ID NO: 554884 - RNA, 18 nt, Homo sapiens
auaggcaggaacauacag

SEQ ID NO: 554885 - RNA, 15 nt, Homo sapiens
auaggcaugagccac

SEQ ID NO: 554886 - RNA, 18 nt, Homo sapiens
auaggcauuaacacaaag

SEQ ID NO: 554887 - RNA, 23 nt, Homo sapiens
auaggcggggcacgguggcucau

SEQ ID NO: 554888 - RNA, 19 nt, Homo sapiens
auagggacuuggggcuugg

SEQ ID NO: 554889 - RNA, 18 nt, Homo sapiens
auaggguauauuuuccua

SEQ ID NO: 554890 - RNA, 20 nt, Homo sapiens
auagguaacaguuauaucaa

SEQ ID NO: 554891 - RNA, 22 nt, Homo sapiens
auagguagaaacaaauacuuga

SEQ ID NO: 554892 - RNA, 17 nt, Homo sapiens
auagguauauauaugcc

SEQ ID NO: 554893 - RNA, 14 nt, Homo sapiens
auaggucacuccug

SEQ ID NO: 554894 - RNA, 15 nt, Homo sapiens
auagguugagcaauu

SEQ ID NO: 554895 - RNA, 17 nt, Homo sapiens
auagguugagcaauuuc

SEQ ID NO: 554896 - RNA, 19 nt, Homo sapiens
auaguaagccccugugacc

SEQ ID NO: 554897 - RNA, 21 nt, Homo sapiens
auaguaccaguaggggcuuau

SEQ ID NO: 554898 - RNA, 19 nt, Homo sapiens
auaguaccuucaauacuua

SEQ ID NO: 554899 - RNA, 11 nt, Homo sapiens
auaguacuggc

SEQ ID NO: 554900 - RNA, 19 nt, Homo sapiens
auaguacuggcaugguacg

SEQ ID NO: 554901 - RNA, 23 nt, Homo sapiens
auaguagaacgcuaucugggaag

SEQ ID NO: 554902 - RNA, 17 nt, Homo sapiens
auaguaggcacuaaaua

SEQ ID NO: 554903 - RNA, 18 nt, Homo sapiens
auaguaugaaaauggaaa

SEQ ID NO: 554904 - RNA, 20 nt, Homo sapiens
auaguauucaggugagcaau

SEQ ID NO: 554905 - RNA, 14 nt, Homo sapiens
auagucacaagagc

SEQ ID NO: 554906 - RNA, 14 nt, Homo sapiens
auagucgcagcuac

SEQ ID NO: 554907 - RNA, 12 nt, Homo sapiens
auagucuauuca

SEQ ID NO: 554908 - RNA, 18 nt, Homo sapiens
auagucuuaacuggucuc

SEQ ID NO: 554909 - RNA, 18 nt, Homo sapiens
auagucuuugccagucau

SEQ ID NO: 554910 - RNA, 18 nt, Homo sapiens
auagugaacauauggaaa

SEQ ID NO: 554911 - RNA, 16 nt, Homo sapiens
auagugcaacaucucu

SEQ ID NO: 554912 - RNA, 14 nt, Homo sapiens
auagugccuaaaau

SEQ ID NO: 554913 - RNA, 18 nt, Homo sapiens
auagugccuaaagugcug

SEQ ID NO: 554914 - RNA, 16 nt, Homo sapiens
auauaauuuauuucca

SEQ ID NO: 554915 - RNA, 16 nt, Homo sapiens
auauaauuucaaacca

SEQ ID NO: 554916 - RNA, 21 nt, Homo sapiens
auauaauuuccauagugugag

SEQ ID NO: 554917 - RNA, 14 nt, Homo sapiens
auauaauuuccuca

SEQ ID NO: 554918 - RNA, 20 nt, Homo sapiens
auauaauuuccucacugccu

SEQ ID NO: 554919 - RNA, 15 nt, Homo sapiens
auauacaaaacuuua

SEQ ID NO: 554920 - RNA, 13 nt, Homo sapiens
auauacacauaca

SEQ ID NO: 554921 - RNA, 19 nt, Homo sapiens
auauacaguaacuuuaugu

SEQ ID NO: 554922 - RNA, 15 nt, Homo sapiens
auauacauauaugag

SEQ ID NO: 554923 - RNA, 10 nt, Homo sapiens
auauacauga

SEQ ID NO: 554924 - RNA, 12 nt, Homo sapiens
auauaccaaauu

SEQ ID NO: 554925 - RNA, 21 nt, Homo sapiens
auauaccccaaauuguguaua

SEQ ID NO: 554926 - RNA, 19 nt, Homo sapiens
auauaccuuuuugugucaa

SEQ ID NO: 554927 - RNA, 17 nt, Homo sapiens
auauacgaaaagccagc

SEQ ID NO: 554928 - RNA, 13 nt, Homo sapiens
auauacucaaaac

SEQ ID NO: 554929 - RNA, 23 nt, Homo sapiens
auauacugcagcuuuacugccuu

SEQ ID NO: 554930 - RNA, 19 nt, Homo sapiens
auauacuuaagaauacaca

SEQ ID NO: 554931 - RNA, 15 nt, Homo sapiens
auauagagacaggac

SEQ ID NO: 554932 - RNA, 18 nt, Homo sapiens
auauagauuuuguaauau

SEQ ID NO: 554933 - RNA, 19 nt, Homo sapiens
auauaggauagacacugga

SEQ ID NO: 554934 - RNA, 15 nt, Homo sapiens
auauaggccagaguu

SEQ ID NO: 554935 - RNA, 20 nt, Homo sapiens
auauaguaacuacuuuuuau

SEQ ID NO: 554936 - RNA, 17 nt, Homo sapiens
auauaguuaugcauaca

SEQ ID NO: 554937 - RNA, 19 nt, Homo sapiens
auauaguuccuugccuuaa

SEQ ID NO: 554938 - RNA, 17 nt, Homo sapiens
auauauacccacaugua

SEQ ID NO: 554939 - RNA, 22 nt, Homo sapiens
auauauaugauguggacauaug

SEQ ID NO: 554940 - RNA, 12 nt, Homo sapiens
auauauaugugu

SEQ ID NO: 554941 - RNA, 15 nt, Homo sapiens
auauaucuaccccag

SEQ ID NO: 554942 - RNA, 16 nt, Homo sapiens
auauaugcacuaugua

SEQ ID NO: 554943 - RNA, 18 nt, Homo sapiens
auauaugccuucccccac

SEQ ID NO: 554944 - RNA, 21 nt, Homo sapiens
auauauggaccuagcuugagg

SEQ ID NO: 554945 - RNA, 19 nt, Homo sapiens
auauauuccgcacucaagg

SEQ ID NO: 554946 - RNA, 16 nt, Homo sapiens
auauauuguaaagaag

SEQ ID NO: 554947 - RNA, 16 nt, Homo sapiens
auauauuuaauauguc

SEQ ID NO: 554948 - RNA, 14 nt, Homo sapiens
auauauuuaauuga

SEQ ID NO: 554949 - RNA, 17 nt, Homo sapiens
auauauuuauaaggaaa

SEQ ID NO: 554950 - RNA, 14 nt, Homo sapiens
auaucaacucucac

SEQ ID NO: 554951 - RNA, 15 nt, Homo sapiens
auaucaagauguuaa

SEQ ID NO: 554952 - RNA, 13 nt, Homo sapiens
auaucaagcuuaa

SEQ ID NO: 554953 - RNA, 15 nt, Homo sapiens
auaucacgacagauu

SEQ ID NO: 554954 - RNA, 19 nt, Homo sapiens
auaucagacaagcacuauu

SEQ ID NO: 554955 - RNA, 21 nt, Homo sapiens
auaucagcuuuucugauggua

SEQ ID NO: 554956 - RNA, 13 nt, Homo sapiens
auaucaguaccuc

SEQ ID NO: 554957 - RNA, 13 nt, Homo sapiens
auaucagugacag

SEQ ID NO: 554958 - RNA, 13 nt, Homo sapiens
auaucaugaguga

SEQ ID NO: 554959 - RNA, 14 nt, Homo sapiens
auaucaugcaaaau

SEQ ID NO: 554960 - RNA, 15 nt, Homo sapiens
auaucaugcaaauuu

SEQ ID NO: 554961 - RNA, 19 nt, Homo sapiens
auaucaugcacacaauuag

SEQ ID NO: 554962 - RNA, 17 nt, Homo sapiens
auaucaugguagucacu

SEQ ID NO: 554963 - RNA, 16 nt, Homo sapiens
auaucauguaccucag

SEQ ID NO: 554964 - RNA, 13 nt, Homo sapiens
auaucauuaaaca

SEQ ID NO: 554965 - RNA, 22 nt, Homo sapiens
auaucauuggaacaacugauac

SEQ ID NO: 554966 - RNA, 16 nt, Homo sapiens
auaucauuugugaaga

SEQ ID NO: 554967 - RNA, 17 nt, Homo sapiens
auaucauuugugaagaa

SEQ ID NO: 554968 - RNA, 23 nt, Homo sapiens
auauccaaagggaauacucacau

SEQ ID NO: 554969 - RNA, 18 nt, Homo sapiens
auaucccaagugcacuuu

SEQ ID NO: 554970 - RNA, 23 nt, Homo sapiens
auauccuaggagguaaugaccau

SEQ ID NO: 554971 - RNA, 20 nt, Homo sapiens
auauccuugcgauguacagu

SEQ ID NO: 554972 - RNA, 15 nt, Homo sapiens
auauccuuucacucu

SEQ ID NO: 554973 - RNA, 14 nt, Homo sapiens
auaucgaucucuua

SEQ ID NO: 554974 - RNA, 13 nt, Homo sapiens
auaucuaaaaacu

SEQ ID NO: 554975 - RNA, 13 nt, Homo sapiens
auaucucuugccc

SEQ ID NO: 554976 - RNA, 16 nt, Homo sapiens
auaucugaaaauguau

SEQ ID NO: 554977 - RNA, 20 nt, Homo sapiens
auaucugaagagcuauuaua

SEQ ID NO: 554978 - RNA, 15 nt, Homo sapiens
auaucugcauguguc

SEQ ID NO: 554979 - RNA, 15 nt, Homo sapiens
auaucugucauauag

SEQ ID NO: 554980 - RNA, 19 nt, Homo sapiens
auaucuuaaagaaacagcu

SEQ ID NO: 554981 - RNA, 15 nt, Homo sapiens
auaucuugaaacaua

SEQ ID NO: 554982 - RNA, 12 nt, Homo sapiens
auaucuugccuu

SEQ ID NO: 554983 - RNA, 22 nt, Homo sapiens
auaucuugcgaauccaagcucc

SEQ ID NO: 554984 - RNA, 16 nt, Homo sapiens
auaucuugcuuucaaa

SEQ ID NO: 554985 - RNA, 23 nt, Homo sapiens
auaucuugcuuucaaauuggcac

SEQ ID NO: 554986 - RNA, 20 nt, Homo sapiens
auaucuuugaccucaaugga

SEQ ID NO: 554987 - RNA, 15 nt, Homo sapiens
auaugaaaaucucca

SEQ ID NO: 554988 - RNA, 21 nt, Homo sapiens
auaugaaaaucuccaucucaa

SEQ ID NO: 554989 - RNA, 15 nt, Homo sapiens
auaugaaacauuuaa

SEQ ID NO: 554990 - RNA, 18 nt, Homo sapiens
auaugaaacuaggguuug

SEQ ID NO: 554991 - RNA, 15 nt, Homo sapiens
auaugaauucaagaa

SEQ ID NO: 554992 - RNA, 14 nt, Homo sapiens
auaugacaauguug

SEQ ID NO: 554993 - RNA, 12 nt, Homo sapiens
auaugaccaaaa

SEQ ID NO: 554994 - RNA, 13 nt, Homo sapiens
auaugaccaaaau

SEQ ID NO: 554995 - RNA, 16 nt, Homo sapiens
auaugacccacacugc

SEQ ID NO: 554996 - RNA, 22 nt, Homo sapiens
auaugacuaauauaacuugaaa

SEQ ID NO: 554997 - RNA, 22 nt, Homo sapiens
auaugaggcuugacagagucug

SEQ ID NO: 554998 - RNA, 15 nt, Homo sapiens
auaugaguuacugaa

SEQ ID NO: 554999 - RNA, 19 nt, Homo sapiens
auaugauacucucagauuu

SEQ ID NO: 555000 - RNA, 16 nt, Homo sapiens
auaugauauguaaaca

SEQ ID NO: 555001 - RNA, 14 nt, Homo sapiens
auaugauccagagc

SEQ ID NO: 555002 - RNA, 12 nt, Homo sapiens
auaugauccauc

SEQ ID NO: 555003 - RNA, 16 nt, Homo sapiens
auaugaucggccauca

SEQ ID NO: 555004 - RNA, 20 nt, Homo sapiens
auaugaugaucuggauccac

SEQ ID NO: 555005 - RNA, 19 nt, Homo sapiens
auaugcaaaccaggauuuc

SEQ ID NO: 555006 - RNA, 14 nt, Homo sapiens
auaugcaagcagcu

SEQ ID NO: 555007 - RNA, 19 nt, Homo sapiens
auaugcaagugcaaaagaa

SEQ ID NO: 555008 - RNA, 20 nt, Homo sapiens
auaugcaauguauagugucu

SEQ ID NO: 555009 - RNA, 11 nt, Homo sapiens
augcaacauca

SEQ ID NO: 555010 - RNA, 12 nt, Homo sapiens
augcaaccauaa

SEQ ID NO: 555011 - RNA, 13 nt, Homo sapiens
augcaaccauaag

SEQ ID NO: 555012 - RNA, 18 nt, Homo sapiens
augcaaccuuuggaugca

SEQ ID NO: 555013 - RNA, 17 nt, Homo sapiens
augcaacucaucuucac

SEQ ID NO: 555014 - RNA, 16 nt, Homo sapiens
augcaagcuuggucaa

SEQ ID NO: 555015 - RNA, 13 nt, Homo sapiens
augcaagugcaaa

SEQ ID NO: 555016 - RNA, 16 nt, Homo sapiens
augcaaucagacaagu

SEQ ID NO: 555017 - RNA, 15 nt, Homo sapiens
augcaaucaggauuu

SEQ ID NO: 555018 - RNA, 19 nt, Homo sapiens
augcaauguaagcauacuu

SEQ ID NO: 555019 - RNA, 14 nt, Homo sapiens
augcaaugugcuac

SEQ ID NO: 555020 - RNA, 19 nt, Homo sapiens
augcaauuuggguuuuaga

SEQ ID NO: 555021 - RNA, 19 nt, Homo sapiens
augcacaaaacuuugauuc

SEQ ID NO: 555022 - RNA, 16 nt, Homo sapiens
augcacacacauauau

SEQ ID NO: 555023 - RNA, 20 nt, Homo sapiens
augcacacacuugcauacau

SEQ ID NO: 555024 - RNA, 18 nt, Homo sapiens
augcacacucaugcacac

SEQ ID NO: 555025 - RNA, 19 nt, Homo sapiens
augcaccucaaggucauca

SEQ ID NO: 555026 - RNA, 18 nt, Homo sapiens
augcaccuguagucucac

SEQ ID NO: 555027 - RNA, 22 nt, Homo sapiens
augcaccuuauauuucugugua

SEQ ID NO: 555028 - RNA, 14 nt, Homo sapiens
augcacguagcuga

SEQ ID NO: 555029 - RNA, 21 nt, Homo sapiens
augcacuauauguuuacacaa

SEQ ID NO: 555030 - RNA, 19 nt, Homo sapiens
augcacugaaaacuuagcc

SEQ ID NO: 555031 - RNA, 20 nt, Homo sapiens
augcagaacaccaauauuaa

SEQ ID NO: 555032 - RNA, 22 nt, Homo sapiens
augcagagggugggguacugga

SEQ ID NO: 555033 - RNA, 18 nt, Homo sapiens
augcagcaccucucagga

SEQ ID NO: 555034 - RNA, 19 nt, Homo sapiens
augcagcagggaugcccug

SEQ ID NO: 555035 - RNA, 17 nt, Homo sapiens
augcagcaucuuugugg

SEQ ID NO: 555036 - RNA, 15 nt, Homo sapiens
augcagcccaugccc

SEQ ID NO: 555037 - RNA, 15 nt, Homo sapiens
augcagcuacuggaa

SEQ ID NO: 555038 - RNA, 20 nt, Homo sapiens
augcagcugccuggggccca

SEQ ID NO: 555039 - RNA, 23 nt, Homo sapiens
augcagcuguggcagaguuacag

SEQ ID NO: 555040 - RNA, 23 nt, Homo sapiens
augcaggcagcacagcagacuag

SEQ ID NO: 555041 - RNA, 16 nt, Homo sapiens
augcagggagcacugu

SEQ ID NO: 555042 - RNA, 15 nt, Homo sapiens
augcagugcuuccaa

SEQ ID NO: 555043 - RNA, 20 nt, Homo sapiens
augcaguuaguauagcuuua

SEQ ID NO: 555044 - RNA, 15 nt, Homo sapiens
augcaguucugagca

SEQ ID NO: 555045 - RNA, 20 nt, Homo sapiens
augcaguugcagugaauuca

SEQ ID NO: 555046 - RNA, 13 nt, Homo sapiens
augcauaaacuau

SEQ ID NO: 555047 - RNA, 13 nt, Homo sapiens
augcauaaagcca

SEQ ID NO: 555048 - RNA, 16 nt, Homo sapiens
augcauaaagccaaau

SEQ ID NO: 555049 - RNA, 22 nt, Homo sapiens
augcauaaagccaaauuuccag

SEQ ID NO: 555050 - RNA, 18 nt, Homo sapiens
augcauauugcccuggag

SEQ ID NO: 555051 - RNA, 14 nt, Homo sapiens
augcaucacacuca

SEQ ID NO: 555052 - RNA, 12 nt, Homo sapiens
augcaugaacaa

SEQ ID NO: 555053 - RNA, 13 nt, Homo sapiens
augcauggcaaau

SEQ ID NO: 555054 - RNA, 22 nt, Homo sapiens
augcaugugaagaaaggguguu

SEQ ID NO: 555055 - RNA, 13 nt, Homo sapiens
augcaugugcugu

SEQ ID NO: 555056 - RNA, 17 nt, Homo sapiens
augcauuauaucaaauc

SEQ ID NO: 555057 - RNA, 15 nt, Homo sapiens
augcauugcuaaaau

SEQ ID NO: 555058 - RNA, 18 nt, Homo sapiens
augcauuucaagcagcug

SEQ ID NO: 555059 - RNA, 20 nt, Homo sapiens
augccaaaguagcugaugua

SEQ ID NO: 555060 - RNA, 22 nt, Homo sapiens
augccaaagugucuacaugugc

SEQ ID NO: 555061 - RNA, 15 nt, Homo sapiens
augccaaauguucca

SEQ ID NO: 555062 - RNA, 14 nt, Homo sapiens
augccaaauucuua

SEQ ID NO: 555063 - RNA, 17 nt, Homo sapiens
augccaagaaaguauuu

SEQ ID NO: 555064 - RNA, 21 nt, Homo sapiens
augccaagggggugacuggaa

SEQ ID NO: 555065 - RNA, 22 nt, Homo sapiens
augccacacggcucucaccagu

SEQ ID NO: 555066 - RNA, 22 nt, Homo sapiens
augccaccccaugugccuuuag

SEQ ID NO: 555067 - RNA, 15 nt, Homo sapiens
augccacccuagcca

SEQ ID NO: 555068 - RNA, 17 nt, Homo sapiens
augccacccuguuuuca

SEQ ID NO: 555069 - RNA, 14 nt, Homo sapiens
augccacuucucac

SEQ ID NO: 555070 - RNA, 14 nt, Homo sapiens
augccagcuacuuc

SEQ ID NO: 555071 - RNA, 21 nt, Homo sapiens
augccagcuacuuccuccucc

SEQ ID NO: 555072 - RNA, 23 nt, Homo sapiens
augccagugaaacuucaagcaaa

SEQ ID NO: 555073 - RNA, 18 nt, Homo sapiens
augcccacguaugugaaa

SEQ ID NO: 555074 - RNA, 21 nt, Homo sapiens
augccccgucccccucuggcu

SEQ ID NO: 555075 - RNA, 19 nt, Homo sapiens
augcccugcagagcaauaa

SEQ ID NO: 555076 - RNA, 17 nt, Homo sapiens
augcccuucacugucac

SEQ ID NO: 555077 - RNA, 19 nt, Homo sapiens
augccgagguaaaaguucu

SEQ ID NO: 555078 - RNA, 20 nt, Homo sapiens
augccguauaggaugucaga

SEQ ID NO: 555079 - RNA, 13 nt, Homo sapiens
augccguggauug

SEQ ID NO: 555080 - RNA, 22 nt, Homo sapiens
augccucagaggguagccuuga

SEQ ID NO: 555081 - RNA, 12 nt, Homo sapiens
augccucuggag

SEQ ID NO: 555082 - RNA, 17 nt, Homo sapiens
augccugcaaucccagc

SEQ ID NO: 555083 - RNA, 16 nt, Homo sapiens
augccugcacugggaa

SEQ ID NO: 555084 - RNA, 20 nt, Homo sapiens
augccugccaaagacguguc

SEQ ID NO: 555085 - RNA, 21 nt, Homo sapiens
augccugggucucugggcaca

SEQ ID NO: 555086 - RNA, 19 nt, Homo sapiens
augccuggucccaagacag

SEQ ID NO: 555087 - RNA, 23 nt, Homo sapiens
augccuguaauccuagcacuuug

SEQ ID NO: 555088 - RNA, 17 nt, Homo sapiens
augccuguaaucucagc

SEQ ID NO: 555089 - RNA, 19 nt, Homo sapiens
augccugugaagcagucag

SEQ ID NO: 555090 - RNA, 22 nt, Homo sapiens
augccuuaaaccuaccucccac

SEQ ID NO: 555091 - RNA, 15 nt, Homo sapiens
augccuuaagccaau

SEQ ID NO: 555092 - RNA, 20 nt, Homo sapiens
augccuuacgaaccaugccu

SEQ ID NO: 555093 - RNA, 22 nt, Homo sapiens
augccuuagaaauguaaacugc

SEQ ID NO: 555094 - RNA, 21 nt, Homo sapiens
augccuuucuguaaccaaaaa

SEQ ID NO: 555095 - RNA, 21 nt, Homo sapiens
auggcugguuaccaccagccu

SEQ ID NO: 555096 - RNA, 22 nt, Homo sapiens
auggcuuauuucuaugacaaau

SEQ ID NO: 555097 - RNA, 18 nt, Homo sapiens
auggcuuguucucuggaa

SEQ ID NO: 555098 - RNA, 19 nt, Homo sapiens
auggcuuugugauucaauc

SEQ ID NO: 555099 - RNA, 20 nt, Homo sapiens
augggaaaugagaacauucc

SEQ ID NO: 555100 - RNA, 16 nt, Homo sapiens
augggaagacugagcu

SEQ ID NO: 555101 - RNA, 18 nt, Homo sapiens
augggaagcagacaauaa

SEQ ID NO: 555102 - RNA, 18 nt, Homo sapiens
augggaaggguccaucuc

SEQ ID NO: 555103 - RNA, 12 nt, Homo sapiens
augggacagggg

SEQ ID NO: 555104 - RNA, 19 nt, Homo sapiens
augggacucauuguagaaa

SEQ ID NO: 555105 - RNA, 22 nt, Homo sapiens
augggacucugagaacuccuca

SEQ ID NO: 555106 - RNA, 15 nt, Homo sapiens
augggacuuaacucc

SEQ ID NO: 555107 - RNA, 19 nt, Homo sapiens
augggaucuugagggacca

SEQ ID NO: 555108 - RNA, 22 nt, Homo sapiens
augggaucuugagggaccaagc

SEQ ID NO: 555109 - RNA, 13 nt, Homo sapiens
augggaugcacuc

SEQ ID NO: 555110 - RNA, 16 nt, Homo sapiens
augggaugcuugccua

SEQ ID NO: 555111 - RNA, 22 nt, Homo sapiens
augggauugcacagagcuggag

SEQ ID NO: 555112 - RNA, 16 nt, Homo sapiens
augggccggucgggga

SEQ ID NO: 555113 - RNA, 16 nt, Homo sapiens
augggccugccugccu

SEQ ID NO: 555114 - RNA, 13 nt, Homo sapiens
auggggacacaga

SEQ ID NO: 555115 - RNA, 14 nt, Homo sapiens
auggggacccucca

SEQ ID NO: 555116 - RNA, 20 nt, Homo sapiens
auggggauuccacuaucuca

SEQ ID NO: 555117 - RNA, 16 nt, Homo sapiens
auggggcauguccuuu

SEQ ID NO: 555118 - RNA, 15 nt, Homo sapiens
augggggcaucucuu

SEQ ID NO: 555119 - RNA, 15 nt, Homo sapiens
auggggggugggggg

SEQ ID NO: 555120 - RNA, 16 nt, Homo sapiens
augggggugcauuuga

SEQ ID NO: 555121 - RNA, 23 nt, Homo sapiens
auggggguguaguauuuuugcca

SEQ ID NO: 555122 - RNA, 13 nt, Homo sapiens
auggggucuguga

SEQ ID NO: 555123 - RNA, 19 nt, Homo sapiens
auggggucugugacuggau

SEQ ID NO: 555124 - RNA, 15 nt, Homo sapiens
auggggugcaugaua

SEQ ID NO: 555125 - RNA, 12 nt, Homo sapiens
auggguccaggg

SEQ ID NO: 555126 - RNA, 17 nt, Homo sapiens
auggguccuugaugcca

SEQ ID NO: 555127 - RNA, 18 nt, Homo sapiens
auggguuauuuaugcuug

SEQ ID NO: 555128 - RNA, 20 nt, Homo sapiens
auggguuggcuguggggacc

SEQ ID NO: 555129 - RNA, 16 nt, Homo sapiens
augguaaaaguuacuu

SEQ ID NO: 555130 - RNA, 16 nt, Homo sapiens
augguacaaaccaaau

SEQ ID NO: 555131 - RNA, 21 nt, Homo sapiens
augguacuaguguuuuuuaga

SEQ ID NO: 555132 - RNA, 18 nt, Homo sapiens
augguacuauguuagccc

SEQ ID NO: 555133 - RNA, 14 nt, Homo sapiens
augguagaacuaaa

SEQ ID NO: 555134 - RNA, 18 nt, Homo sapiens
augguagcauacuuuaua

SEQ ID NO: 555135 - RNA, 18 nt, Homo sapiens
augguaggucaaguaaua

SEQ ID NO: 555136 - RNA, 20 nt, Homo sapiens
augguaucaauggauuuauc

SEQ ID NO: 555137 - RNA, 13 nt, Homo sapiens
augguaugaucaa

SEQ ID NO: 555138 - RNA, 17 nt, Homo sapiens
augguauggaaucugag

SEQ ID NO: 555139 - RNA, 20 nt, Homo sapiens
auggucaacacuuaaggguu

SEQ ID NO: 555140 - RNA, 22 nt, Homo sapiens
auggucaaguucccaacugagu

SEQ ID NO: 555141 - RNA, 15 nt, Homo sapiens
auggucacacacuga

SEQ ID NO: 555142 - RNA, 20 nt, Homo sapiens
auggucaugaauagucauua

SEQ ID NO: 555143 - RNA, 21 nt, Homo sapiens
auggucauuuccagacaaauu

SEQ ID NO: 555144 - RNA, 16 nt, Homo sapiens
auggucuaacacuggc

SEQ ID NO: 555145 - RNA, 14 nt, Homo sapiens
auggucucuaccua

SEQ ID NO: 555146 - RNA, 21 nt, Homo sapiens
auggucuuaaggaacaucucu

SEQ ID NO: 555147 - RNA, 22 nt, Homo sapiens
auggugagaugcagcuggaaaa

SEQ ID NO: 555148 - RNA, 12 nt, Homo sapiens
auggugagcucu

SEQ ID NO: 555149 - RNA, 19 nt, Homo sapiens
auggugaggcgaaggccag

SEQ ID NO: 555150 - RNA, 16 nt, Homo sapiens
augguggagggcacuu

SEQ ID NO: 555151 - RNA, 20 nt, Homo sapiens
augguggcgggcaccuguaa

SEQ ID NO: 555152 - RNA, 17 nt, Homo sapiens
auggugggcacagaagu

SEQ ID NO: 555153 - RNA, 14 nt, Homo sapiens
augguggguacaaa

SEQ ID NO: 555154 - RNA, 21 nt, Homo sapiens
augguggguacaaaaagucaa

SEQ ID NO: 555155 - RNA, 20 nt, Homo sapiens
auggugguggacaccuguaa

SEQ ID NO: 555156 - RNA, 23 nt, Homo sapiens
augguguagcccucccacuuugc

SEQ ID NO: 555157 - RNA, 17 nt, Homo sapiens
augguguggguguccug

SEQ ID NO: 555158 - RNA, 18 nt, Homo sapiens
augguguuaaagcuguac

SEQ ID NO: 555159 - RNA, 12 nt, Homo sapiens
augguguucucu

SEQ ID NO: 555160 - RNA, 18 nt, Homo sapiens
augguuaagaacugugaa

SEQ ID NO: 555161 - RNA, 14 nt, Homo sapiens
augguuaugugcau

SEQ ID NO: 555162 - RNA, 17 nt, Homo sapiens
augguucccaagcguca

SEQ ID NO: 555163 - RNA, 15 nt, Homo sapiens
augguucccaauaaa

SEQ ID NO: 555164 - RNA, 15 nt, Homo sapiens
augguucuccaagaa

SEQ ID NO: 555165 - RNA, 13 nt, Homo sapiens
augguucuuacag

SEQ ID NO: 555166 - RNA, 20 nt, Homo sapiens
augguuugugucaaaacugg

SEQ ID NO: 555167 - RNA, 14 nt, Homo sapiens
augguuuuacucau

SEQ ID NO: 555168 - RNA, 21 nt, Homo sapiens
augguuuuuaaagaaaccuca

SEQ ID NO: 555169 - RNA, 17 nt, Homo sapiens
auguaaaacuccauuca

SEQ ID NO: 555170 - RNA, 13 nt, Homo sapiens
auguaaacuacuu

SEQ ID NO: 555171 - RNA, 17 nt, Homo sapiens
auguaaacuuugucaug

SEQ ID NO: 555172 - RNA, 21 nt, Homo sapiens
auguaaagauauuuuuaucuu

SEQ ID NO: 555173 - RNA, 16 nt, Homo sapiens
auguaaaggccuuuaa

SEQ ID NO: 555174 - RNA, 15 nt, Homo sapiens
auguaaauaauugau

SEQ ID NO: 555175 - RNA, 14 nt, Homo sapiens
auguaaaugugcau

SEQ ID NO: 555176 - RNA, 16 nt, Homo sapiens
auguaaauugcaaaua

SEQ ID NO: 555177 - RNA, 15 nt, Homo sapiens
auguaacgaauggua

SEQ ID NO: 555178 - RNA, 13 nt, Homo sapiens
auguaacugcauu

SEQ ID NO: 555179 - RNA, 14 nt, Homo sapiens
auguaacugugcca

SEQ ID NO: 555180 - RNA, 17 nt, Homo sapiens
auguaagccaagucaug

SEQ ID NO: 555181 - RNA, 15 nt, Homo sapiens
auguaaguacuucca

SEQ ID NO: 555182 - RNA, 16 nt, Homo sapiens
auguaaguacuuccac

SEQ ID NO: 555183 - RNA, 19 nt, Homo sapiens
auguaauagugacagcaaa

SEQ ID NO: 555184 - RNA, 19 nt, Homo sapiens
auguaauauuaauaguuau

SEQ ID NO: 555185 - RNA, 22 nt, Homo sapiens
auguaaucucucugcagcugcc

SEQ ID NO: 555186 - RNA, 16 nt, Homo sapiens
auguaaugcauaggaa

SEQ ID NO: 555187 - RNA, 19 nt, Homo sapiens
auguaauggaacuuagcca

SEQ ID NO: 555188 - RNA, 21 nt, Homo sapiens
auguaauggaacuuagccauu

SEQ ID NO: 555189 - RNA, 13 nt, Homo sapiens
auguaaugucaag

SEQ ID NO: 555190 - RNA, 21 nt, Homo sapiens
auguaauuuguacaggggcca

SEQ ID NO: 555191 - RNA, 12 nt, Homo sapiens
auguacaaacua

SEQ ID NO: 555192 - RNA, 18 nt, Homo sapiens
auguacaauaaagcaaug

SEQ ID NO: 555193 - RNA, 23 nt, Homo sapiens
auguacaauaaagcaauguggua

SEQ ID NO: 555194 - RNA, 15 nt, Homo sapiens
auguacagacauauu

SEQ ID NO: 555195 - RNA, 16 nt, Homo sapiens
auguacagacauauuu

SEQ ID NO: 555196 - RNA, 19 nt, Homo sapiens
auguacaucuggccuugaa

SEQ ID NO: 555197 - RNA, 18 nt, Homo sapiens
auguacaugaagaagcua

SEQ ID NO: 555198 - RNA, 11 nt, Homo sapiens
auguacaugag

SEQ ID NO: 555199 - RNA, 15 nt, Homo sapiens
auguacauuuauuca

SEQ ID NO: 555200 - RNA, 19 nt, Homo sapiens
auguaccggcuuccauccu

SEQ ID NO: 555201 - RNA, 18 nt, Homo sapiens
auguacuuagcuguacua

SEQ ID NO: 555202 - RNA, 16 nt, Homo sapiens
auguacuuguuugcaa

SEQ ID NO: 555203 - RNA, 19 nt, Homo sapiens
auguagacuuuugcuuuau

SEQ ID NO: 555204 - RNA, 20 nt, Homo sapiens
auguagacuuuugcuuuaug

SEQ ID NO: 555205 - RNA, 15 nt, Homo sapiens
auguagauuuguaca

SEQ ID NO: 555206 - RNA, 21 nt, Homo sapiens
auguagcaaaacgcauggagu

SEQ ID NO: 555207 - RNA, 19 nt, Homo sapiens
auguagcauuaugcaauua

SEQ ID NO: 555208 - RNA, 14 nt, Homo sapiens
auguagcccugggu

SEQ ID NO: 555209 - RNA, 16 nt, Homo sapiens
auguaguuugcacuua

SEQ ID NO: 555210 - RNA, 20 nt, Homo sapiens
auguauaaaaauuaucaaaa

SEQ ID NO: 555211 - RNA, 22 nt, Homo sapiens
auguauaaauuaauacagagua

SEQ ID NO: 555212 - RNA, 12 nt, Homo sapiens
auguauacaaag

SEQ ID NO: 555213 - RNA, 12 nt, Homo sapiens
auguauacacac

SEQ ID NO: 555214 - RNA, 14 nt, Homo sapiens
auguauaccagccu

SEQ ID NO: 555215 - RNA, 19 nt, Homo sapiens
auguauauauauauaugca

SEQ ID NO: 555216 - RNA, 14 nt, Homo sapiens
auguauaugcacuu

SEQ ID NO: 555217 - RNA, 14 nt, Homo sapiens
augugugagugugu

SEQ ID NO: 555218 - RNA, 14 nt, Homo sapiens
augugugaugcaaa

SEQ ID NO: 555219 - RNA, 18 nt, Homo sapiens
augugugcauauuuagca

SEQ ID NO: 555220 - RNA, 12 nt, Homo sapiens
augugugugagu

SEQ ID NO: 555221 - RNA, 16 nt, Homo sapiens
auguguguguauauau

SEQ ID NO: 555222 - RNA, 21 nt, Homo sapiens
auguguguuucuguccuguaa

SEQ ID NO: 555223 - RNA, 18 nt, Homo sapiens
auguguucauucaagcua

SEQ ID NO: 555224 - RNA, 15 nt, Homo sapiens
auguguugcuauccu

SEQ ID NO: 555225 - RNA, 20 nt, Homo sapiens
auguguuuaaauacugcaau

SEQ ID NO: 555226 - RNA, 19 nt, Homo sapiens
auguguuucuccugagcua

SEQ ID NO: 555227 - RNA, 17 nt, Homo sapiens
auguguuuuaauuccaa

SEQ ID NO: 555228 - RNA, 20 nt, Homo sapiens
auguguuuuuaaggaaaaug

SEQ ID NO: 555229 - RNA, 15 nt, Homo sapiens
auguguuuuucacau

SEQ ID NO: 555230 - RNA, 21 nt, Homo sapiens
auguuaaagaugcacagaaua

SEQ ID NO: 555231 - RNA, 16 nt, Homo sapiens
auguuaaagcaucaga

SEQ ID NO: 555232 - RNA, 21 nt, Homo sapiens
auguuaaagguucacaggggu

SEQ ID NO: 555233 - RNA, 22 nt, Homo sapiens
auguuaacacucaugaagcaua

SEQ ID NO: 555234 - RNA, 15 nt, Homo sapiens
auguuaaccaaugua

SEQ ID NO: 555235 - RNA, 19 nt, Homo sapiens
auguuaaguccucccugac

SEQ ID NO: 555236 - RNA, 13 nt, Homo sapiens
auguuaaugcaaa

SEQ ID NO: 555237 - RNA, 22 nt, Homo sapiens
auguuaauuuuuugguacaaaa

SEQ ID NO: 555238 - RNA, 21 nt, Homo sapiens
auguuacaauuaaaaugacaa

SEQ ID NO: 555239 - RNA, 17 nt, Homo sapiens
auguuacacuaagggug

SEQ ID NO: 555240 - RNA, 12 nt, Homo sapiens
auguuacagauu

SEQ ID NO: 555241 - RNA, 21 nt, Homo sapiens
auguuacuaaaugguguuaca

SEQ ID NO: 555242 - RNA, 21 nt, Homo sapiens
auguuacucaugacuccuuuc

SEQ ID NO: 555243 - RNA, 14 nt, Homo sapiens
auguuacugaccag

SEQ ID NO: 555244 - RNA, 15 nt, Homo sapiens
auguuacugcuucau

SEQ ID NO: 555245 - RNA, 21 nt, Homo sapiens
auguuaguagaaauuuuacaa

SEQ ID NO: 555246 - RNA, 16 nt, Homo sapiens
auguuaguuaccuuau

SEQ ID NO: 555247 - RNA, 13 nt, Homo sapiens
auguuaucaacca

SEQ ID NO: 555248 - RNA, 17 nt, Homo sapiens
auguuaugcuccugcug

SEQ ID NO: 555249 - RNA, 11 nt, Homo sapiens
auguuaugcug

SEQ ID NO: 555250 - RNA, 15 nt, Homo sapiens
auguuauucucucac

SEQ ID NO: 555251 - RNA, 13 nt, Homo sapiens
auguucacuguga

SEQ ID NO: 555252 - RNA, 14 nt, Homo sapiens
auguucacugugag

SEQ ID NO: 555253 - RNA, 16 nt, Homo sapiens
auguucacuguggcau

SEQ ID NO: 555254 - RNA, 22 nt, Homo sapiens
auguucacuuuugacaaaggca

SEQ ID NO: 555255 - RNA, 19 nt, Homo sapiens
auguucagaauguacggaa

SEQ ID NO: 555256 - RNA, 12 nt, Homo sapiens
auguucagucac

SEQ ID NO: 555257 - RNA, 12 nt, Homo sapiens
auguuccagaca

SEQ ID NO: 555258 - RNA, 19 nt, Homo sapiens
aucaauagcaccccuacuc

SEQ ID NO: 555259 - RNA, 20 nt, Homo sapiens
aucaauaggaaagcauaugc

SEQ ID NO: 555260 - RNA, 15 nt, Homo sapiens
aucaauauacauaau

SEQ ID NO: 555261 - RNA, 19 nt, Homo sapiens
aucaauauugggccuaaaa

SEQ ID NO: 555262 - RNA, 15 nt, Homo sapiens
aucaaucuggugaau

SEQ ID NO: 555263 - RNA, 13 nt, Homo sapiens
aucaaugcaagag

SEQ ID NO: 555264 - RNA, 20 nt, Homo sapiens
aucaaugggugguauuugcu

SEQ ID NO: 555265 - RNA, 14 nt, Homo sapiens
aucaauggugcaaa

SEQ ID NO: 555266 - RNA, 16 nt, Homo sapiens
aucaaugucacuuaaa

SEQ ID NO: 555267 - RNA, 22 nt, Homo sapiens
aucaauucuauuacgugcaaua

SEQ ID NO: 555268 - RNA, 23 nt, Homo sapiens
aucaauucuauuacgugcaauac

SEQ ID NO: 555269 - RNA, 20 nt, Homo sapiens
aucaauucuuagaauaucua

SEQ ID NO: 555270 - RNA, 21 nt, Homo sapiens
aucaauuuuucccaguauuuu

SEQ ID NO: 555271 - RNA, 15 nt, Homo sapiens
aucacaaaccaagcc

SEQ ID NO: 555272 - RNA, 22 nt, Homo sapiens
aucacaaaggaaagauuugcca

SEQ ID NO: 555273 - RNA, 23 nt, Homo sapiens
aucacaaggcauucaaguguaca

SEQ ID NO: 555274 - RNA, 15 nt, Homo sapiens
aucacaaggucaaga

SEQ ID NO: 555275 - RNA, 18 nt, Homo sapiens
aucacacccacgggugcu

SEQ ID NO: 555276 - RNA, 17 nt, Homo sapiens
aucacaccugcccuaaa

SEQ ID NO: 555277 - RNA, 16 nt, Homo sapiens
aucacagccucugaaa

SEQ ID NO: 555278 - RNA, 17 nt, Homo sapiens
aucacagcucacugcag

SEQ ID NO: 555279 - RNA, 20 nt, Homo sapiens
aucacaggaaaauguaucca

SEQ ID NO: 555280 - RNA, 19 nt, Homo sapiens
aucacagucaauggaucca

SEQ ID NO: 555281 - RNA, 15 nt, Homo sapiens
aucacagucuacuga

SEQ ID NO: 555282 - RNA, 20 nt, Homo sapiens
aucacaguguuugcaauggu

SEQ ID NO: 555283 - RNA, 21 nt, Homo sapiens
aucacaguguuugcaauggug

SEQ ID NO: 555284 - RNA, 16 nt, Homo sapiens
aucacauccuggccug

SEQ ID NO: 555285 - RNA, 19 nt, Homo sapiens
aucaccaccgccucuggcc

SEQ ID NO: 555286 - RNA, 15 nt, Homo sapiens
aucaccacucaaaaa

SEQ ID NO: 555287 - RNA, 16 nt, Homo sapiens
aucaccugaaacacug

SEQ ID NO: 555288 - RNA, 15 nt, Homo sapiens
aucaccuguuagcau

SEQ ID NO: 555289 - RNA, 14 nt, Homo sapiens
aucacgacaggaaa

SEQ ID NO: 555290 - RNA, 17 nt, Homo sapiens
aucacgacgcugcagag

SEQ ID NO: 555291 - RNA, 18 nt, Homo sapiens
aucacgagaucaagagau

SEQ ID NO: 555292 - RNA, 18 nt, Homo sapiens
aucacgaggucaggagau

SEQ ID NO: 555293 - RNA, 21 nt, Homo sapiens
aucacgccacugcacuccagc

SEQ ID NO: 555294 - RNA, 14 nt, Homo sapiens
aucacgccuggcua

SEQ ID NO: 555295 - RNA, 22 nt, Homo sapiens
aucacgucacugcacuccagcu

SEQ ID NO: 555296 - RNA, 17 nt, Homo sapiens
aucacgucagugcucag

SEQ ID NO: 555297 - RNA, 18 nt, Homo sapiens
aucacgucagugcucaga

SEQ ID NO: 555298 - RNA, 15 nt, Homo sapiens
aucacucaaccuuau

SEQ ID NO: 555299 - RNA, 15 nt, Homo sapiens
aucacuccucuguca

SEQ ID NO: 555300 - RNA, 22 nt, Homo sapiens
aucacucuaauuaauuguaauc

SEQ ID NO: 555301 - RNA, 19 nt, Homo sapiens
aucacugaacuacuaaagu

SEQ ID NO: 555302 - RNA, 12 nt, Homo sapiens
aucacugaauuu

SEQ ID NO: 555303 - RNA, 21 nt, Homo sapiens
aucacugccacacucuccauc

SEQ ID NO: 555304 - RNA, 15 nt, Homo sapiens
aucacugguccaggu

SEQ ID NO: 555305 - RNA, 16 nt, Homo sapiens
aucacuguaaagacaa

SEQ ID NO: 555306 - RNA, 17 nt, Homo sapiens
aucacuguaaugaguca

SEQ ID NO: 555307 - RNA, 21 nt, Homo sapiens
aucacugucuugccagauuac

SEQ ID NO: 555308 - RNA, 22 nt, Homo sapiens
aucacuuaaacuugcaucacuu

SEQ ID NO: 555309 - RNA, 13 nt, Homo sapiens
aucacuuaucagu

SEQ ID NO: 555310 - RNA, 17 nt, Homo sapiens
aucacuuuaacucagga

SEQ ID NO: 555311 - RNA, 16 nt, Homo sapiens
aucagaaacuugugaa

SEQ ID NO: 555312 - RNA, 16 nt, Homo sapiens
aucagaacuguuggca

SEQ ID NO: 555313 - RNA, 13 nt, Homo sapiens
aucagacauacag

SEQ ID NO: 555314 - RNA, 21 nt, Homo sapiens
aucagaccaaacagugcuguu

SEQ ID NO: 555315 - RNA, 13 nt, Homo sapiens
aucagaccaugaa

SEQ ID NO: 555316 - RNA, 16 nt, Homo sapiens
aucagacuagugacaa

SEQ ID NO: 555317 - RNA, 23 nt, Homo sapiens
aucagagaacagucauguaugca

SEQ ID NO: 555318 - RNA, 15 nt, Homo sapiens
aucagagaguguaca

SEQ ID NO: 555319 - RNA, 17 nt, Homo sapiens
aucagagccagucucac

SEQ ID NO: 555320 - RNA, 19 nt, Homo sapiens
aucagaugacucucuccaa

SEQ ID NO: 555321 - RNA, 16 nt, Homo sapiens
aucagaugccucagag

SEQ ID NO: 555322 - RNA, 18 nt, Homo sapiens
aucagauguuuuggucaa

SEQ ID NO: 555323 - RNA, 17 nt, Homo sapiens
aucagcaggcuccaguu

SEQ ID NO: 555324 - RNA, 14 nt, Homo sapiens
aucagcaugacaaa

SEQ ID NO: 555325 - RNA, 23 nt, Homo sapiens
aucagcauuuuagaaacuacaaa

SEQ ID NO: 555326 - RNA, 15 nt, Homo sapiens
aucagccagcaagag

SEQ ID NO: 555327 - RNA, 22 nt, Homo sapiens
aucagccagcuaccccuugugg

SEQ ID NO: 555328 - RNA, 11 nt, Homo sapiens
aucagccagga

SEQ ID NO: 555329 - RNA, 12 nt, Homo sapiens
aucagccagguc

SEQ ID NO: 555330 - RNA, 15 nt, Homo sapiens
aucagccagucucag

SEQ ID NO: 555331 - RNA, 22 nt, Homo sapiens
aucagccauaagaaagcacuau

SEQ ID NO: 555332 - RNA, 16 nt, Homo sapiens
aucagccauuugccau

SEQ ID NO: 555333 - RNA, 16 nt, Homo sapiens
aucagcccaucucaac

SEQ ID NO: 555334 - RNA, 22 nt, Homo sapiens
aucagcccccagccuuguuucu

SEQ ID NO: 555335 - RNA, 19 nt, Homo sapiens
aucagcccugccagguggg

SEQ ID NO: 555336 - RNA, 21 nt, Homo sapiens
aucagccugggcaaugugaua

SEQ ID NO: 555337 - RNA, 16 nt, Homo sapiens
aucagccuuguccuaa

SEQ ID NO: 555338 - RNA, 18 nt, Homo sapiens
aucagcuucagaauggca

SEQ ID NO: 555339 - RNA, 21 nt, Homo sapiens
aucaggacagguggugcaaau

SEQ ID NO: 555340 - RNA, 21 nt, Homo sapiens
aucaggcuauguauggaauac

SEQ ID NO: 555341 - RNA, 21 nt, Homo sapiens
aucagggaggguuaggaaaac

SEQ ID NO: 555342 - RNA, 18 nt, Homo sapiens
aucagggccuuucuccuc

SEQ ID NO: 555343 - RNA, 17 nt, Homo sapiens
aucagggggaagaagca

SEQ ID NO: 555344 - RNA, 21 nt, Homo sapiens
aucaggggugcauucuggcca

SEQ ID NO: 555345 - RNA, 22 nt, Homo sapiens
aucagguagacuuuuaauauca

SEQ ID NO: 555346 - RNA, 18 nt, Homo sapiens
aucaggugaggugugcuc

SEQ ID NO: 555347 - RNA, 19 nt, Homo sapiens
aucaguaaaauuauacugu

SEQ ID NO: 555348 - RNA, 15 nt, Homo sapiens
aucaguauucugcca

SEQ ID NO: 555349 - RNA, 22 nt, Homo sapiens
caaccagccaggcagguccaca

SEQ ID NO: 555350 - RNA, 18 nt, Homo sapiens
caaccauaacacuugaug

SEQ ID NO: 555351 - RNA, 14 nt, Homo sapiens
caaccauaagacaa

SEQ ID NO: 555352 - RNA, 15 nt, Homo sapiens
caaccaugucauuuc

SEQ ID NO: 555353 - RNA, 18 nt, Homo sapiens
caaccauuugaaaccccu

SEQ ID NO: 555354 - RNA, 20 nt, Homo sapiens
caacccaauaaaacugaugu

SEQ ID NO: 555355 - RNA, 19 nt, Homo sapiens
caacccacaccgucuuccu

SEQ ID NO: 555356 - RNA, 12 nt, Homo sapiens
caacccacuuaa

SEQ ID NO: 555357 - RNA, 16 nt, Homo sapiens
caacccagcaaucuca

SEQ ID NO: 555358 - RNA, 20 nt, Homo sapiens
caacccauaaucauguaaau

SEQ ID NO: 555359 - RNA, 20 nt, Homo sapiens
caaccccccuccugcuccuc

SEQ ID NO: 555360 - RNA, 15 nt, Homo sapiens
caaccccugcuccag

SEQ ID NO: 555361 - RNA, 22 nt, Homo sapiens
caaccccuguacccagcuccuu

SEQ ID NO: 555362 - RNA, 23 nt, Homo sapiens
caacccgagucauucguucugug

SEQ ID NO: 555363 - RNA, 18 nt, Homo sapiens
caacccuaucuccugaca

SEQ ID NO: 555364 - RNA, 15 nt, Homo sapiens
caacccuguuuccug

SEQ ID NO: 555365 - RNA, 19 nt, Homo sapiens
caaccucauugacaagaac

SEQ ID NO: 555366 - RNA, 16 nt, Homo sapiens
caaccuccaacaacga

SEQ ID NO: 555367 - RNA, 19 nt, Homo sapiens
caaccuccgccuuccgggu

SEQ ID NO: 555368 - RNA, 14 nt, Homo sapiens
caaccugaagacac

SEQ ID NO: 555369 - RNA, 21 nt, Homo sapiens
caaccuguaguuuuacauaua

SEQ ID NO: 555370 - RNA, 14 nt, Homo sapiens
caaccugugaugag

SEQ ID NO: 555371 - RNA, 23 nt, Homo sapiens
caaccuuuguguggcuccuggua

SEQ ID NO: 555372 - RNA, 14 nt, Homo sapiens
caacgaguacuuca

SEQ ID NO: 555373 - RNA, 17 nt, Homo sapiens
caacggccaggaaaagc

SEQ ID NO: 555374 - RNA, 22 nt, Homo sapiens
caacguagcuucuaccaugaac

SEQ ID NO: 555375 - RNA, 21 nt, Homo sapiens
caacuaaugagggaaaucugu

SEQ ID NO: 555376 - RNA, 13 nt, Homo sapiens
caacuacuaauag

SEQ ID NO: 555377 - RNA, 21 nt, Homo sapiens
caacucaagguucuaguggga

SEQ ID NO: 555378 - RNA, 21 nt, Homo sapiens
caacucaagucccaggcccca

SEQ ID NO: 555379 - RNA, 16 nt, Homo sapiens
caacucacagcuucuc

SEQ ID NO: 555380 - RNA, 20 nt, Homo sapiens
caacucacugauucucuaca

SEQ ID NO: 555381 - RNA, 13 nt, Homo sapiens
caacucacuucca

SEQ ID NO: 555382 - RNA, 14 nt, Homo sapiens
caacucaucuucac

SEQ ID NO: 555383 - RNA, 12 nt, Homo sapiens
caacuccagggg

SEQ ID NO: 555384 - RNA, 23 nt, Homo sapiens
caacucuaaagccaagcacuuua

SEQ ID NO: 555385 - RNA, 18 nt, Homo sapiens
caacucuccaauguucua

SEQ ID NO: 555386 - RNA, 14 nt, Homo sapiens
caacucugcuccca

SEQ ID NO: 555387 - RNA, 13 nt, Homo sapiens
caacucuugcaca

SEQ ID NO: 555388 - RNA, 18 nt, Homo sapiens
caacucuuuuaagugccu

SEQ ID NO: 555389 - RNA, 20 nt, Homo sapiens
caacugaaaagacucagugu

SEQ ID NO: 555390 - RNA, 19 nt, Homo sapiens
caacugaagcuucaaaaag

SEQ ID NO: 555391 - RNA, 21 nt, Homo sapiens
caacugacuucauuugugcca

SEQ ID NO: 555392 - RNA, 12 nt, Homo sapiens
caacugcaaaaa

SEQ ID NO: 555393 - RNA, 17 nt, Homo sapiens
caacugcagaccaacua

SEQ ID NO: 555394 - RNA, 19 nt, Homo sapiens
caacugccauguuuugcca

SEQ ID NO: 555395 - RNA, 21 nt, Homo sapiens
caacugcccccgccacaaccc

SEQ ID NO: 555396 - RNA, 18 nt, Homo sapiens
caacugccugccuuaggg

SEQ ID NO: 555397 - RNA, 17 nt, Homo sapiens
caacugcugcugugcac

SEQ ID NO: 555398 - RNA, 22 nt, Homo sapiens
caacugggccugggauggggcu

SEQ ID NO: 555399 - RNA, 22 nt, Homo sapiens
caacugugaguagccuaugaau

SEQ ID NO: 555400 - RNA, 16 nt, Homo sapiens
caacuguggucaaucc

SEQ ID NO: 555401 - RNA, 18 nt, Homo sapiens
caacuguuggauucagaa

SEQ ID NO: 555402 - RNA, 14 nt, Homo sapiens
caacuuaacaugaa

SEQ ID NO: 555403 - RNA, 16 nt, Homo sapiens
caacuuaagcugggau

SEQ ID NO: 555404 - RNA, 21 nt, Homo sapiens
caacuuaagcugggauaauca

SEQ ID NO: 555405 - RNA, 17 nt, Homo sapiens
caacuuauuauaugacu

SEQ ID NO: 555406 - RNA, 14 nt, Homo sapiens
caacuucaaguaua

SEQ ID NO: 555407 - RNA, 13 nt, Homo sapiens
caacuucagcacc

SEQ ID NO: 555408 - RNA, 20 nt, Homo sapiens
caacuucagcaguaccuaua

SEQ ID NO: 555409 - RNA, 21 nt, Homo sapiens
caacuucauuugaugcuaaau

SEQ ID NO: 555410 - RNA, 16 nt, Homo sapiens
caacuugagggcccag

SEQ ID NO: 555411 - RNA, 22 nt, Homo sapiens
caacuugauuuuuucaaaaaag

SEQ ID NO: 555412 - RNA, 16 nt, Homo sapiens
caacuuggcauuucua

SEQ ID NO: 555413 - RNA, 18 nt, Homo sapiens
caacuuggguucuucuca

SEQ ID NO: 555414 - RNA, 19 nt, Homo sapiens
caacuugguucugcuucaa

SEQ ID NO: 555415 - RNA, 23 nt, Homo sapiens
caacuuguaacucuaugaacuua

SEQ ID NO: 555416 - RNA, 17 nt, Homo sapiens
caacuugucacccaaag

SEQ ID NO: 555417 - RNA, 12 nt, Homo sapiens
caacuuucugua

SEQ ID NO: 555418 - RNA, 17 nt, Homo sapiens
caacuuuucaaugugau

SEQ ID NO: 555419 - RNA, 22 nt, Homo sapiens
caacuuuucuaagaaaagcauu

SEQ ID NO: 555420 - RNA, 21 nt, Homo sapiens
caacuuuuuguuacagauuaa

SEQ ID NO: 555421 - RNA, 18 nt, Homo sapiens
caagaaaaguaagcccuu

SEQ ID NO: 555422 - RNA, 13 nt, Homo sapiens
caagaaaauauca

SEQ ID NO: 555423 - RNA, 15 nt, Homo sapiens
caagaaacacugccu

SEQ ID NO: 555424 - RNA, 16 nt, Homo sapiens
caagaaacacugccug

SEQ ID NO: 555425 - RNA, 15 nt, Homo sapiens
caagaaacauuucag

SEQ ID NO: 555426 - RNA, 22 nt, Homo sapiens
caagaaagcucacuguagcuuu

SEQ ID NO: 555427 - RNA, 19 nt, Homo sapiens
caagaaauaaaaaucaacu

SEQ ID NO: 555428 - RNA, 18 nt, Homo sapiens
caagaaaucaaaauccaa

SEQ ID NO: 555429 - RNA, 12 nt, Homo sapiens
caagaaaucuga

SEQ ID NO: 555430 - RNA, 12 nt, Homo sapiens
caagaaauggau

SEQ ID NO: 555431 - RNA, 20 nt, Homo sapiens
caagaaaugucucugcuccu

SEQ ID NO: 555432 - RNA, 13 nt, Homo sapiens
caagaaauuggaa

SEQ ID NO: 555433 - RNA, 23 nt, Homo sapiens
caagaacauuaucuuaguggaag

SEQ ID NO: 555434 - RNA, 15 nt, Homo sapiens
caagaagccuuuccu

SEQ ID NO: 555435 - RNA, 17 nt, Homo sapiens
caagaagugggugcccu

SEQ ID NO: 555436 - RNA, 14 nt, Homo sapiens
caagaaguguaguu

SEQ ID NO: 555437 - RNA, 23 nt, Homo sapiens
caagaauagaugcugacuguacu

SEQ ID NO: 555438 - RNA, 13 nt, Homo sapiens
caagaauagcauu

SEQ ID NO: 555439 - RNA, 19 nt, Homo sapiens
caagaauauuguauguuaa

SEQ ID NO: 555440 - RNA, 16 nt, Homo sapiens
caagaaucaccucaaa

SEQ ID NO: 555441 - RNA, 11 nt, Homo sapiens
caagaaugaga

SEQ ID NO: 555442 - RNA, 13 nt, Homo sapiens
caagaaugcauuc

SEQ ID NO: 555443 - RNA, 14 nt, Homo sapiens
caagaaugcauucc

SEQ ID NO: 555444 - RNA, 18 nt, Homo sapiens
caagaauguuaugugcaa

SEQ ID NO: 555445 - RNA, 19 nt, Homo sapiens
caagaauuaaguauuuucc

SEQ ID NO: 555446 - RNA, 22 nt, Homo sapiens
caagaauugaguaucacuuuaa

SEQ ID NO: 555447 - RNA, 16 nt, Homo sapiens
caagacaaaaccaaaa

SEQ ID NO: 555448 - RNA, 12 nt, Homo sapiens
caagacaccaaa

SEQ ID NO: 555449 - RNA, 15 nt, Homo sapiens
caagacacugagaua

SEQ ID NO: 555450 - RNA, 12 nt, Homo sapiens
caagacaggcag

SEQ ID NO: 555451 - RNA, 20 nt, Homo sapiens
caagacagugcccaugaaug

SEQ ID NO: 555452 - RNA, 19 nt, Homo sapiens
caagaccagccugggcaac

SEQ ID NO: 555453 - RNA, 12 nt, Homo sapiens
caagaccuaguc

SEQ ID NO: 555454 - RNA, 18 nt, Homo sapiens
caagaccucugugcacuu

SEQ ID NO: 555455 - RNA, 12 nt, Homo sapiens
caagacuccauc

SEQ ID NO: 555456 - RNA, 21 nt, Homo sapiens
caagacuccaucucaaaaaag

SEQ ID NO: 555457 - RNA, 20 nt, Homo sapiens
caagacucuuuggacacuca

SEQ ID NO: 555458 - RNA, 12 nt, Homo sapiens
caagacugagcc

SEQ ID NO: 555459 - RNA, 15 nt, Homo sapiens
caagacuuuagcuuu

SEQ ID NO: 555460 - RNA, 22 nt, Homo sapiens
caagacuuuaguuaccgagaca

SEQ ID NO: 555461 - RNA, 21 nt, Homo sapiens
caagacuuuugucugaucaag

SEQ ID NO: 555462 - RNA, 20 nt, Homo sapiens
caagagagaagcaaccacca

SEQ ID NO: 555463 - RNA, 15 nt, Homo sapiens
caagagaguaaacag

SEQ ID NO: 555464 - RNA, 19 nt, Homo sapiens
caagagaucuuucuuucca

SEQ ID NO: 555465 - RNA, 20 nt, Homo sapiens
caagagaugggaaugaggug

SEQ ID NO: 555466 - RNA, 19 nt, Homo sapiens
caagagaugggacaagcag

SEQ ID NO: 555467 - RNA, 16 nt, Homo sapiens
caagagcaucaggcuc

SEQ ID NO: 555468 - RNA, 13 nt, Homo sapiens
caagagcaugcac

SEQ ID NO: 555469 - RNA, 15 nt, Homo sapiens
caagagcuuacauaa

SEQ ID NO: 555470 - RNA, 13 nt, Homo sapiens
caagaggacacaa

SEQ ID NO: 555471 - RNA, 20 nt, Homo sapiens
caagaggcugguuuuggcau

SEQ ID NO: 555472 - RNA, 18 nt, Homo sapiens
uuugaugaaacucaugaa

SEQ ID NO: 555473 - RNA, 12 nt, Homo sapiens
uuugaugcauua

SEQ ID NO: 555474 - RNA, 16 nt, Homo sapiens
uuugauuuugauuuua

SEQ ID NO: 555475 - RNA, 16 nt, Homo sapiens
uuugcaaagugcaagg

SEQ ID NO: 555476 - RNA, 21 nt, Homo sapiens
uuugcaauagucuuauuaaaa

SEQ ID NO: 555477 - RNA, 21 nt, Homo sapiens
uuugcaauggcuauauggcaa

SEQ ID NO: 555478 - RNA, 14 nt, Homo sapiens
uuugcaaugucaca

SEQ ID NO: 555479 - RNA, 18 nt, Homo sapiens
uuugcacacuugugugug

SEQ ID NO: 555480 - RNA, 13 nt, Homo sapiens
uuugcacagugau

SEQ ID NO: 555481 - RNA, 21 nt, Homo sapiens
uuugcacuuaauggcuguuga

SEQ ID NO: 555482 - RNA, 15 nt, Homo sapiens
uuugcacuuggcaaa

SEQ ID NO: 555483 - RNA, 15 nt, Homo sapiens
uuugcaguucaccug

SEQ ID NO: 555484 - RNA, 16 nt, Homo sapiens
uuugcauagcucuccu

SEQ ID NO: 555485 - RNA, 22 nt, Homo sapiens
uuugcauauuuuuaaacaaaga

SEQ ID NO: 555486 - RNA, 9 nt, Homo sapiens
uuugccaaa

SEQ ID NO: 555487 - RNA, 17 nt, Homo sapiens
uuugccaaaauucauuu

SEQ ID NO: 555488 - RNA, 10 nt, Homo sapiens
uuugccaaau

SEQ ID NO: 555489 - RNA, 22 nt, Homo sapiens
uuugccaaggcuaauccaauua

SEQ ID NO: 555490 - RNA, 17 nt, Homo sapiens
uuugccaaggcucuccc

SEQ ID NO: 555491 - RNA, 14 nt, Homo sapiens
uuugccaagggagg

SEQ ID NO: 555492 - RNA, 14 nt, Homo sapiens
uuugccaguauuau

SEQ ID NO: 555493 - RNA, 13 nt, Homo sapiens
uuugccagugccu

SEQ ID NO: 555494 - RNA, 17 nt, Homo sapiens
uuugccagugccucuca

SEQ ID NO: 555495 - RNA, 21 nt, Homo sapiens
uuugccaucggaacugccuua

SEQ ID NO: 555496 - RNA, 20 nt, Homo sapiens
uuugcccccgacggcuguga

SEQ ID NO: 555497 - RNA, 20 nt, Homo sapiens
uuugccccuuccacuuugag

SEQ ID NO: 555498 - RNA, 14 nt, Homo sapiens
uuugcguacacaga

SEQ ID NO: 555499 - RNA, 17 nt, Homo sapiens
uuugcuagcaguaaaag

SEQ ID NO: 555500 - RNA, 14 nt, Homo sapiens
uuugcuauucuggc

SEQ ID NO: 555501 - RNA, 13 nt, Homo sapiens
uuugcucauggca

SEQ ID NO: 555502 - RNA, 15 nt, Homo sapiens
caagcugugcaggca

SEQ ID NO: 555503 - RNA, 18 nt, Homo sapiens
caagcuuaaagcuugauu

SEQ ID NO: 555504 - RNA, 15 nt, Homo sapiens
caagcuucccaagua

SEQ ID NO: 555505 - RNA, 14 nt, Homo sapiens
caagcuuuugcuug

SEQ ID NO: 555506 - RNA, 14 nt, Homo sapiens
caaggaaagccagg

SEQ ID NO: 555507 - RNA, 19 nt, Homo sapiens
caaggaaggcauuuggacc

SEQ ID NO: 555508 - RNA, 15 nt, Homo sapiens
caaggaauaaaugag

SEQ ID NO: 555509 - RNA, 20 nt, Homo sapiens
caaggaauggaaucuucucc

SEQ ID NO: 555510 - RNA, 22 nt, Homo sapiens
caaggaauuucccuguguggau

SEQ ID NO: 555511 - RNA, 16 nt, Homo sapiens
caaggaauuucugcuc

SEQ ID NO: 555512 - RNA, 12 nt, Homo sapiens
caaggacagggc

SEQ ID NO: 555513 - RNA, 16 nt, Homo sapiens
caaggacuccauugga

SEQ ID NO: 555514 - RNA, 14 nt, Homo sapiens
caaggacuuugcag

SEQ ID NO: 555515 - RNA, 15 nt, Homo sapiens
caaggagaauaugau

SEQ ID NO: 555516 - RNA, 19 nt, Homo sapiens
caaggagagagugagugca

SEQ ID NO: 555517 - RNA, 19 nt, Homo sapiens
caaggagggugagugcaag

SEQ ID NO: 555518 - RNA, 17 nt, Homo sapiens
caaggaugcacauauac

SEQ ID NO: 555519 - RNA, 18 nt, Homo sapiens
caaggauuuuguaagaag

SEQ ID NO: 555520 - RNA, 17 nt, Homo sapiens
caaggcaaaucucuccu

SEQ ID NO: 555521 - RNA, 15 nt, Homo sapiens
caaggcaacugugag

SEQ ID NO: 555522 - RNA, 20 nt, Homo sapiens
caaggcagccugaacacuca

SEQ ID NO: 555523 - RNA, 21 nt, Homo sapiens
caaggcaggaggaucacuuga

SEQ ID NO: 555524 - RNA, 18 nt, Homo sapiens
caaggccaagauuguccu

SEQ ID NO: 555525 - RNA, 15 nt, Homo sapiens
caaggccagugcuaa

SEQ ID NO: 555526 - RNA, 22 nt, Homo sapiens
caaggcccauaucugugaaaug

SEQ ID NO: 555527 - RNA, 24 nt, Homo sapiens
caaggcccugagcuuuguccugaa

SEQ ID NO: 555528 - RNA, 20 nt, Homo sapiens
caaggcccuuuccuuuggaa

SEQ ID NO: 555529 - RNA, 20 nt, Homo sapiens
caaggccgagggccaggcag

SEQ ID NO: 555530 - RNA, 19 nt, Homo sapiens
caaggcggguggaucacaa

SEQ ID NO: 555531 - RNA, 15 nt, Homo sapiens
caaggcugacuucuc

SEQ ID NO: 555532 - RNA, 23 nt, Homo sapiens
caaggcugcgggagaagaaguuu

SEQ ID NO: 555533 - RNA, 20 nt, Homo sapiens
caaggcugcuuagaauccaa

SEQ ID NO: 555534 - RNA, 19 nt, Homo sapiens
caaggcuggcagugacaga

SEQ ID NO: 555535 - RNA, 13 nt, Homo sapiens
caagggaaaaccc

SEQ ID NO: 555536 - RNA, 21 nt, Homo sapiens
caagggaauucggugugcacc

SEQ ID NO: 555537 - RNA, 17 nt, Homo sapiens
caagggaccugcucauc

SEQ ID NO: 555538 - RNA, 23 nt, Homo sapiens
caagggcugagauucuucgugua

SEQ ID NO: 555539 - RNA, 20 nt, Homo sapiens
caagggggacugucuuucag

SEQ ID NO: 555540 - RNA, 21 nt, Homo sapiens
caagggggcggggacugcugg

SEQ ID NO: 555541 - RNA, 16 nt, Homo sapiens
caagggggugacugga

SEQ ID NO: 555542 - RNA, 16 nt, Homo sapiens
caaggggugggccaca

SEQ ID NO: 555543 - RNA, 18 nt, Homo sapiens
caaggggugggccuguga

SEQ ID NO: 555544 - RNA, 17 nt, Homo sapiens
caaggucacacagugau

SEQ ID NO: 555545 - RNA, 19 nt, Homo sapiens
caaggucaugccacugcac

SEQ ID NO: 555546 - RNA, 13 nt, Homo sapiens
caagguccacucc

SEQ ID NO: 555547 - RNA, 15 nt, Homo sapiens
caagguccacucccu

SEQ ID NO: 555548 - RNA, 22 nt, Homo sapiens
caagguccucucaguucucucc

SEQ ID NO: 555549 - RNA, 21 nt, Homo sapiens
caagguccucugucagucaca

SEQ ID NO: 555550 - RNA, 16 nt, Homo sapiens
caaggugaauagcaca

SEQ ID NO: 555551 - RNA, 21 nt, Homo sapiens
caagguggccuuugugcugcg

SEQ ID NO: 555552 - RNA, 23 nt, Homo sapiens
caaggugggccuugcuaccucaa

SEQ ID NO: 555553 - RNA, 21 nt, Homo sapiens
caaggugggcggaucaccuga

SEQ ID NO: 555554 - RNA, 17 nt, Homo sapiens
caagguggucaguaaau

SEQ ID NO: 555555 - RNA, 18 nt, Homo sapiens
caagguucccaagacaau

SEQ ID NO: 555556 - RNA, 23 nt, Homo sapiens
caagguucugguuccauuuuucc

SEQ ID NO: 555557 - RNA, 21 nt, Homo sapiens
caagguucuucccuuuuacau

SEQ ID NO: 555558 - RNA, 19 nt, Homo sapiens
caagguugggcuggugcuc

SEQ ID NO: 555559 - RNA, 16 nt, Homo sapiens
caaguaaaaaggcuaa

SEQ ID NO: 555560 - RNA, 15 nt, Homo sapiens
caaguaacugaacca

SEQ ID NO: 555561 - RNA, 17 nt, Homo sapiens
caaguaacugggauuac

SEQ ID NO: 555562 - RNA, 17 nt, Homo sapiens
caaguaagaagacauga

SEQ ID NO: 555563 - RNA, 17 nt, Homo sapiens
caaguacaaguauauaa

SEQ ID NO: 555564 - RNA, 19 nt, Homo sapiens
caaguacauggcuagcuuu

SEQ ID NO: 555565 - RNA, 12 nt, Homo sapiens
caaguaccaaaa

SEQ ID NO: 555566 - RNA, 20 nt, Homo sapiens
caaguagcaggacuaggcau

SEQ ID NO: 555567 - RNA, 17 nt, Homo sapiens
caaguagcugggauuac

SEQ ID NO: 555568 - RNA, 16 nt, Homo sapiens
cacgugaaauuugccu

SEQ ID NO: 555569 - RNA, 19 nt, Homo sapiens
cacguggagauagugccag

SEQ ID NO: 555570 - RNA, 15 nt, Homo sapiens
cacguggggcccacu

SEQ ID NO: 555571 - RNA, 15 nt, Homo sapiens
cacguguccguccac

SEQ ID NO: 555572 - RNA, 19 nt, Homo sapiens
cacgugucuccccuuggua

SEQ ID NO: 555573 - RNA, 22 nt, Homo sapiens
cacgugucuuccacuuugcaua

SEQ ID NO: 555574 - RNA, 23 nt, Homo sapiens
cacuaaaacuuuccugacuuaca

SEQ ID NO: 555575 - RNA, 16 nt, Homo sapiens
cacuaaaagaucgcag

SEQ ID NO: 555576 - RNA, 14 nt, Homo sapiens
cacuaaacucuggg

SEQ ID NO: 555577 - RNA, 16 nt, Homo sapiens
cacuaaagcauucaau

SEQ ID NO: 555578 - RNA, 13 nt, Homo sapiens
cacuaacauauau

SEQ ID NO: 555579 - RNA, 18 nt, Homo sapiens
cacuaaggccgugucucu

SEQ ID NO: 555580 - RNA, 22 nt, Homo sapiens
cacuaagggguauguucccucu

SEQ ID NO: 555581 - RNA, 15 nt, Homo sapiens
cacuaaugcuuuaag

SEQ ID NO: 555582 - RNA, 22 nt, Homo sapiens
cacuaauuugauguuuacaggu

SEQ ID NO: 555583 - RNA, 17 nt, Homo sapiens
cacuacacccagcaaua

SEQ ID NO: 555584 - RNA, 23 nt, Homo sapiens
cacuacauaauugcuguucugcu

SEQ ID NO: 555585 - RNA, 15 nt, Homo sapiens
cacuacauucauuua

SEQ ID NO: 555586 - RNA, 14 nt, Homo sapiens
cacuacauuguaca

SEQ ID NO: 555587 - RNA, 17 nt, Homo sapiens
cacuacauuugcuccau

SEQ ID NO: 555588 - RNA, 13 nt, Homo sapiens
cacuaccacauua

SEQ ID NO: 555589 - RNA, 19 nt, Homo sapiens
cacuaccgaaugugucuuu

SEQ ID NO: 555590 - RNA, 15 nt, Homo sapiens
cacuagaaugcaagu

SEQ ID NO: 555591 - RNA, 16 nt, Homo sapiens
cacuagaaugcaagua

SEQ ID NO: 555592 - RNA, 20 nt, Homo sapiens
cacuagaauucaugugagaa

SEQ ID NO: 555593 - RNA, 14 nt, Homo sapiens
cacuagacaaaacu

SEQ ID NO: 555594 - RNA, 14 nt, Homo sapiens
cacuagacccacug

SEQ ID NO: 555595 - RNA, 15 nt, Homo sapiens
cacuagaugacugua

SEQ ID NO: 555596 - RNA, 21 nt, Homo sapiens
cacuagcaauaaaaugcuaau

SEQ ID NO: 555597 - RNA, 12 nt, Homo sapiens
cacuagccagac

SEQ ID NO: 555598 - RNA, 22 nt, Homo sapiens
cacuagccaugauaacugcaau

SEQ ID NO: 555599 - RNA, 15 nt, Homo sapiens
cacuagcccaaugaa

SEQ ID NO: 555600 - RNA, 12 nt, Homo sapiens
cacuagccugug

SEQ ID NO: 555601 - RNA, 20 nt, Homo sapiens
cacuaggaggucaucaaccg

SEQ ID NO: 555602 - RNA, 17 nt, Homo sapiens
cacuagucacauucuug

SEQ ID NO: 555603 - RNA, 17 nt, Homo sapiens
cacuagucuguguaacu

SEQ ID NO: 555604 - RNA, 22 nt, Homo sapiens
cacuaguuuaugcuaccuaguc

SEQ ID NO: 555605 - RNA, 19 nt, Homo sapiens
cacuauaauguaagcucua

SEQ ID NO: 555606 - RNA, 13 nt, Homo sapiens
cacuauaucacaa

SEQ ID NO: 555607 - RNA, 13 nt, Homo sapiens
cacuaucacuuua

SEQ ID NO: 555608 - RNA, 16 nt, Homo sapiens
cacuauccucacuccc

SEQ ID NO: 555609 - RNA, 19 nt, Homo sapiens
cacuaugaagauguuucaa

SEQ ID NO: 555610 - RNA, 12 nt, Homo sapiens
cacuaugcugcu

SEQ ID NO: 555611 - RNA, 15 nt, Homo sapiens
cacuaugugcaaaaa

SEQ ID NO: 555612 - RNA, 14 nt, Homo sapiens
cacuauuacuggga

SEQ ID NO: 555613 - RNA, 19 nt, Homo sapiens
cacuauucuuaagcacuuu

SEQ ID NO: 555614 - RNA, 21 nt, Homo sapiens
cacuauuguuccagcaguuuu

SEQ ID NO: 555615 - RNA, 21 nt, Homo sapiens
cacuauuuaaaauaagcacac

SEQ ID NO: 555616 - RNA, 19 nt, Homo sapiens
cacuauuuaucugugcaaa

SEQ ID NO: 555617 - RNA, 15 nt, Homo sapiens
cacuauuuccaaaag

SEQ ID NO: 555618 - RNA, 14 nt, Homo sapiens
cacucaaaauaugu

SEQ ID NO: 555619 - RNA, 16 nt, Homo sapiens
cacucaaaauauguca

SEQ ID NO: 555620 - RNA, 15 nt, Homo sapiens
cacucaaugccaacu

SEQ ID NO: 555621 - RNA, 16 nt, Homo sapiens
cacucaaugccaacuu

SEQ ID NO: 555622 - RNA, 17 nt, Homo sapiens
cacucacagauguuuga

SEQ ID NO: 555623 - RNA, 21 nt, Homo sapiens
cacucacuccacaacccaaga

SEQ ID NO: 555624 - RNA, 20 nt, Homo sapiens
cacucagaggcccccagugg

SEQ ID NO: 555625 - RNA, 17 nt, Homo sapiens
cacucagaguaaugucu

SEQ ID NO: 555626 - RNA, 13 nt, Homo sapiens
cacucagcugucc

SEQ ID NO: 555627 - RNA, 17 nt, Homo sapiens
cacucaggccacagugg

SEQ ID NO: 555628 - RNA, 17 nt, Homo sapiens
cacucaggggaccccac

SEQ ID NO: 555629 - RNA, 18 nt, Homo sapiens
cacucauuccuucacuca

SEQ ID NO: 555630 - RNA, 16 nt, Homo sapiens
cacucauuucaucuca

SEQ ID NO: 555631 - RNA, 13 nt, Homo sapiens
cacuccacacucu

SEQ ID NO: 555632 - RNA, 16 nt, Homo sapiens
cacuccacucugauuc

SEQ ID NO: 555633 - RNA, 14 nt, Homo sapiens
cacuccagcuccuu

SEQ ID NO: 555634 - RNA, 21 nt, Homo sapiens
cacuccaguggcagacaaaca

SEQ ID NO: 555635 - RNA, 14 nt, Homo sapiens
cacucccaguccaa

SEQ ID NO: 555636 - RNA, 15 nt, Homo sapiens
cacuccccacgggaa

SEQ ID NO: 555637 - RNA, 17 nt, Homo sapiens
cacucccucugccuuca

SEQ ID NO: 555638 - RNA, 21 nt, Homo sapiens
cacucccuugguggcaagagc

SEQ ID NO: 555639 - RNA, 23 nt, Homo sapiens
cacuccguccauccgacugcccc

SEQ ID NO: 555640 - RNA, 19 nt, Homo sapiens
cacuccucgguacucccau

SEQ ID NO: 555641 - RNA, 19 nt, Homo sapiens
cacucguuccccuccucuu

SEQ ID NO: 555642 - RNA, 13 nt, Homo sapiens
cacucuacuacau

SEQ ID NO: 555643 - RNA, 14 nt, Homo sapiens
cacucucauguugc

SEQ ID NO: 555644 - RNA, 21 nt, Homo sapiens
cacucuccaaacagucaccau

SEQ ID NO: 555645 - RNA, 19 nt, Homo sapiens
cacucuggagaguaaucug

SEQ ID NO: 555646 - RNA, 17 nt, Homo sapiens
cacucugggcuguaacg

SEQ ID NO: 555647 - RNA, 18 nt, Homo sapiens
cacucuguauugaaaaug

SEQ ID NO: 555648 - RNA, 18 nt, Homo sapiens
cacugaaaacaucuggaa

SEQ ID NO: 555649 - RNA, 22 nt, Homo sapiens
cacugaaaaugucacauucuau

SEQ ID NO: 555650 - RNA, 14 nt, Homo sapiens
cacugaaaccaaaa

SEQ ID NO: 555651 - RNA, 22 nt, Homo sapiens
cacugaaaugaccaagacaggu

SEQ ID NO: 555652 - RNA, 14 nt, Homo sapiens
cacugaacaaaacc

SEQ ID NO: 555653 - RNA, 17 nt, Homo sapiens
cacugaagcaccacagg

SEQ ID NO: 555654 - RNA, 13 nt, Homo sapiens
cacugaaucagcu

SEQ ID NO: 555655 - RNA, 13 nt, Homo sapiens
cacugacagccuu

SEQ ID NO: 555656 - RNA, 17 nt, Homo sapiens
cacugacagccuugccc

SEQ ID NO: 555657 - RNA, 15 nt, Homo sapiens
cacugacaguuaaua

SEQ ID NO: 555658 - RNA, 16 nt, Homo sapiens
cacugaccugccugua

SEQ ID NO: 555659 - RNA, 16 nt, Homo sapiens
cacugacuccugugga

SEQ ID NO: 555660 - RNA, 16 nt, Homo sapiens
cacugacucugacuca

SEQ ID NO: 555661 - RNA, 13 nt, Homo sapiens
cacugacugugaa

SEQ ID NO: 555662 - RNA, 22 nt, Homo sapiens
cacugagaagucaaacauuuca

SEQ ID NO: 555663 - RNA, 15 nt, Homo sapiens
cacugagagggcaau

SEQ ID NO: 555664 - RNA, 10 nt, Homo sapiens
cacugagaua

SEQ ID NO: 555665 - RNA, 15 nt, Homo sapiens
cacugagcacaguca

SEQ ID NO: 555666 - RNA, 16 nt, Homo sapiens
cacugaggguggcacu

SEQ ID NO: 555667 - RNA, 18 nt, Homo sapiens
cacugaggguggcacuca

SEQ ID NO: 555668 - RNA, 15 nt, Homo sapiens
cacugauaagacugu

SEQ ID NO: 555669 - RNA, 21 nt, Homo sapiens
cacugauauuuuagucauucu

SEQ ID NO: 555670 - RNA, 20 nt, Homo sapiens
cacugaucugcuagugcugu

SEQ ID NO: 555671 - RNA, 12 nt, Homo sapiens
cacugauucucu

SEQ ID NO: 555672 - RNA, 20 nt, Homo sapiens
cacugcaaauaaacuuggua

SEQ ID NO: 555673 - RNA, 15 nt, Homo sapiens
cacugcaacuuguga

SEQ ID NO: 555674 - RNA, 20 nt, Homo sapiens
cacugcacagugcaucucag

SEQ ID NO: 555675 - RNA, 18 nt, Homo sapiens
cacugcaccccaagagag

SEQ ID NO: 555676 - RNA, 13 nt, Homo sapiens
cacugcacccucc

SEQ ID NO: 555677 - RNA, 18 nt, Homo sapiens
cacugcagacuuguccag

SEQ ID NO: 555678 - RNA, 14 nt, Homo sapiens
cacugccacacucu

SEQ ID NO: 555679 - RNA, 15 nt, Homo sapiens
cacugccaccuugug

SEQ ID NO: 555680 - RNA, 12 nt, Homo sapiens
cacugccaugga

SEQ ID NO: 555681 - RNA, 11 nt, Homo sapiens
cacugccccac

SEQ ID NO: 555682 - RNA, 21 nt, Homo sapiens
cacugcccccugcugccaugu

SEQ ID NO: 555683 - RNA, 23 nt, Homo sapiens
cacugccuaggaggcuggccaag

SEQ ID NO: 555684 - RNA, 22 nt, Homo sapiens
cacugccuggcccaaaacgucu

SEQ ID NO: 555685 - RNA, 18 nt, Homo sapiens
cacugcgccacugccauc

SEQ ID NO: 555686 - RNA, 14 nt, Homo sapiens
cacugcggagucca

SEQ ID NO: 555687 - RNA, 15 nt, Homo sapiens
cacugcuaugccauu

SEQ ID NO: 555688 - RNA, 19 nt, Homo sapiens
cacugcucguggccaaaag

SEQ ID NO: 555689 - RNA, 15 nt, Homo sapiens
cacugcugcauucca

SEQ ID NO: 555690 - RNA, 20 nt, Homo sapiens
cacugcugcuccagugcagg

SEQ ID NO: 555691 - RNA, 18 nt, Homo sapiens
cagaacaaauuguuuaca

SEQ ID NO: 555692 - RNA, 18 nt, Homo sapiens
cagaacaguaugaauuug

SEQ ID NO: 555693 - RNA, 22 nt, Homo sapiens
cagaacaguggcucguauccca

SEQ ID NO: 555694 - RNA, 16 nt, Homo sapiens
cagaaccaaagcucaa

SEQ ID NO: 555695 - RNA, 14 nt, Homo sapiens
cagaaccacuccug

SEQ ID NO: 555696 - RNA, 16 nt, Homo sapiens
cagaacccagauuucc

SEQ ID NO: 555697 - RNA, 20 nt, Homo sapiens
cagaacggguucaguuuuag

SEQ ID NO: 555698 - RNA, 14 nt, Homo sapiens
cagaacuaacuuug

SEQ ID NO: 555699 - RNA, 16 nt, Homo sapiens
cagaacuaccaugaga

SEQ ID NO: 555700 - RNA, 14 nt, Homo sapiens
cagaacuacuucuu

SEQ ID NO: 555701 - RNA, 17 nt, Homo sapiens
cagaacucaaaugagcc

SEQ ID NO: 555702 - RNA, 22 nt, Homo sapiens
cagaacucgaugcacugaccug

SEQ ID NO: 555703 - RNA, 21 nt, Homo sapiens
cagaacucuccuuggauaauu

SEQ ID NO: 555704 - RNA, 14 nt, Homo sapiens
cagaacucuuucaa

SEQ ID NO: 555705 - RNA, 21 nt, Homo sapiens
cagaacuugaaugugucaggu

SEQ ID NO: 555706 - RNA, 16 nt, Homo sapiens
cagaacuuucuuucac

SEQ ID NO: 555707 - RNA, 13 nt, Homo sapiens
cagaagaaagggc

SEQ ID NO: 555708 - RNA, 15 nt, Homo sapiens
cagaagaaugggaau

SEQ ID NO: 555709 - RNA, 14 nt, Homo sapiens
cagaagacaaaaag

SEQ ID NO: 555710 - RNA, 16 nt, Homo sapiens
cagaagacacugcaaa

SEQ ID NO: 555711 - RNA, 20 nt, Homo sapiens
cagaagaccccugacucauc

SEQ ID NO: 555712 - RNA, 17 nt, Homo sapiens
cagaagacccgcucucc

SEQ ID NO: 555713 - RNA, 21 nt, Homo sapiens
cagaagagauggauauugaaa

SEQ ID NO: 555714 - RNA, 21 nt, Homo sapiens
cagaagagccuccuucagcag

SEQ ID NO: 555715 - RNA, 14 nt, Homo sapiens
cagaagaucugaaa

SEQ ID NO: 555716 - RNA, 18 nt, Homo sapiens
cagaagauuuucaagaac

SEQ ID NO: 555717 - RNA, 12 nt, Homo sapiens
cagaagcaaaaa

SEQ ID NO: 555718 - RNA, 15 nt, Homo sapiens
cagaagcacauauga

SEQ ID NO: 555719 - RNA, 23 nt, Homo sapiens
cagaagcaguugagucgucauca

SEQ ID NO: 555720 - RNA, 20 nt, Homo sapiens
cagaagcaugcacaaagaga

SEQ ID NO: 555721 - RNA, 15 nt, Homo sapiens
cagaagcauuucacc

SEQ ID NO: 555722 - RNA, 14 nt, Homo sapiens
cagaagccuuggaa

SEQ ID NO: 555723 - RNA, 15 nt, Homo sapiens
cagaagcugcuccuu

SEQ ID NO: 555724 - RNA, 16 nt, Homo sapiens
cagaaggaaaugaugg

SEQ ID NO: 555725 - RNA, 17 nt, Homo sapiens
cagaaggaaucuucuca

SEQ ID NO: 555726 - RNA, 18 nt, Homo sapiens
cagaaggacauauuuccu

SEQ ID NO: 555727 - RNA, 13 nt, Homo sapiens
cagaaggacucag

SEQ ID NO: 555728 - RNA, 22 nt, Homo sapiens
cagaaggagggcagagccaugg

SEQ ID NO: 555729 - RNA, 20 nt, Homo sapiens
cagaagguguguccuugaac

SEQ ID NO: 555730 - RNA, 23 nt, Homo sapiens
cagaagguguguccuugaacuga

SEQ ID NO: 555731 - RNA, 15 nt, Homo sapiens
cagaagguugcucua

SEQ ID NO: 555732 - RNA, 18 nt, Homo sapiens
cagaagguuugcaccccu

SEQ ID NO: 555733 - RNA, 14 nt, Homo sapiens
cagaaguacuccua

SEQ ID NO: 555734 - RNA, 16 nt, Homo sapiens
cagaaguaucaagcca

SEQ ID NO: 555735 - RNA, 19 nt, Homo sapiens
cagaaguuaguuuguauau

SEQ ID NO: 555736 - RNA, 16 nt, Homo sapiens
cagaauaaaaucucua

SEQ ID NO: 555737 - RNA, 16 nt, Homo sapiens
cagaauaaauaagcaa

SEQ ID NO: 555738 - RNA, 14 nt, Homo sapiens
cagaauagcacaaa

SEQ ID NO: 555739 - RNA, 20 nt, Homo sapiens
cagaauagcuuccaauaaag

SEQ ID NO: 555740 - RNA, 20 nt, Homo sapiens
cagaauaggaaaacauugca

SEQ ID NO: 555741 - RNA, 21 nt, Homo sapiens
cagaauaggaaaacauugcaa

SEQ ID NO: 555742 - RNA, 17 nt, Homo sapiens
cagaauauaauucccaa

SEQ ID NO: 555743 - RNA, 15 nt, Homo sapiens
cagaaucccuuaaca

SEQ ID NO: 555744 - RNA, 17 nt, Homo sapiens
cagaaucucaaauaacu

SEQ ID NO: 555745 - RNA, 14 nt, Homo sapiens
cagaaucuccaucc

SEQ ID NO: 555746 - RNA, 17 nt, Homo sapiens
cagaaucuguuaccaga

SEQ ID NO: 555747 - RNA, 18 nt, Homo sapiens
cagaaugcucacacugaa

SEQ ID NO: 555748 - RNA, 12 nt, Homo sapiens
cagaauggagcu

SEQ ID NO: 555749 - RNA, 15 nt, Homo sapiens
cagaauguacggaaa

SEQ ID NO: 555750 - RNA, 14 nt, Homo sapiens
cagaauguaucugu

SEQ ID NO: 555751 - RNA, 17 nt, Homo sapiens
cagaauguaucugugaa

SEQ ID NO: 555752 - RNA, 23 nt, Homo sapiens
cagaauguggguauugaguguga

SEQ ID NO: 555753 - RNA, 20 nt, Homo sapiens
cagaauucucagaaucucaa

SEQ ID NO: 555754 - RNA, 13 nt, Homo sapiens
cagaauucuucag

SEQ ID NO: 555755 - RNA, 17 nt, Homo sapiens
cagaauuggaaucacau

SEQ ID NO: 555756 - RNA, 14 nt, Homo sapiens
cagaauuguccuca

SEQ ID NO: 555757 - RNA, 17 nt, Homo sapiens
cagaauuuguugcuaau

SEQ ID NO: 555758 - RNA, 17 nt, Homo sapiens
cagacaaaguaauuccu

SEQ ID NO: 555759 - RNA, 15 nt, Homo sapiens
cagacaaaugugguu

SEQ ID NO: 555760 - RNA, 16 nt, Homo sapiens
cagacaacaccuuccu

SEQ ID NO: 555761 - RNA, 15 nt, Homo sapiens
cagacaacacuggga

SEQ ID NO: 555762 - RNA, 16 nt, Homo sapiens
cagacaacagaaguca

SEQ ID NO: 555763 - RNA, 14 nt, Homo sapiens
cagacaaccaaaac

SEQ ID NO: 555764 - RNA, 17 nt, Homo sapiens
cagacaagaaugugcac

SEQ ID NO: 555765 - RNA, 14 nt, Homo sapiens
cagacaagcacuau

SEQ ID NO: 555766 - RNA, 15 nt, Homo sapiens
cagacaagugacugu

SEQ ID NO: 555767 - RNA, 20 nt, Homo sapiens
cagacaauggcccaggucuc

SEQ ID NO: 555768 - RNA, 13 nt, Homo sapiens
cagacaauuccau

SEQ ID NO: 555769 - RNA, 14 nt, Homo sapiens
cagacacaggugua

SEQ ID NO: 555770 - RNA, 22 nt, Homo sapiens
cagagcuccaguuugcauuugg

SEQ ID NO: 555771 - RNA, 15 nt, Homo sapiens
cagagcucucugagg

SEQ ID NO: 555772 - RNA, 14 nt, Homo sapiens
cagagcucugggaa

SEQ ID NO: 555773 - RNA, 21 nt, Homo sapiens
cagagcugaagaacuuggcac

SEQ ID NO: 555774 - RNA, 19 nt, Homo sapiens
cagagcugaggcuuuggua

SEQ ID NO: 555775 - RNA, 17 nt, Homo sapiens
cagagcugucugaacuc

SEQ ID NO: 555776 - RNA, 14 nt, Homo sapiens
cagagcugugccug

SEQ ID NO: 555777 - RNA, 15 nt, Homo sapiens
cagaggaacaagcau

SEQ ID NO: 555778 - RNA, 15 nt, Homo sapiens
cagaggacacaggca

SEQ ID NO: 555779 - RNA, 15 nt, Homo sapiens
cagaggacgugcaga

SEQ ID NO: 555780 - RNA, 13 nt, Homo sapiens
cagaggagccaug

SEQ ID NO: 555781 - RNA, 16 nt, Homo sapiens
cagaggagccaugucc

SEQ ID NO: 555782 - RNA, 23 nt, Homo sapiens
cagaggagugcagccuucuccau

SEQ ID NO: 555783 - RNA, 14 nt, Homo sapiens
cagaggauggugag

SEQ ID NO: 555784 - RNA, 17 nt, Homo sapiens
cagaggcucuaauguac

SEQ ID NO: 555785 - RNA, 18 nt, Homo sapiens
cagaggcucuaauguaca

SEQ ID NO: 555786 - RNA, 20 nt, Homo sapiens
cagaggcucuaauguacaau

SEQ ID NO: 555787 - RNA, 19 nt, Homo sapiens
cagaggcugcagaaggcca

SEQ ID NO: 555788 - RNA, 17 nt, Homo sapiens
cagaggcuuaaucacac

SEQ ID NO: 555789 - RNA, 15 nt, Homo sapiens
cagaggcuucuucag

SEQ ID NO: 555790 - RNA, 16 nt, Homo sapiens
cagagggaaacacagc

SEQ ID NO: 555791 - RNA, 22 nt, Homo sapiens
cagagggagaauccaaggguug

SEQ ID NO: 555792 - RNA, 15 nt, Homo sapiens
cagagggcccaggca

SEQ ID NO: 555793 - RNA, 20 nt, Homo sapiens
cagagggcguguuguuuuac

SEQ ID NO: 555794 - RNA, 22 nt, Homo sapiens
cagagggguaggcagagccuuu

SEQ ID NO: 555795 - RNA, 14 nt, Homo sapiens
cagaggucuucagg

SEQ ID NO: 555796 - RNA, 20 nt, Homo sapiens
cagagguugcagugagccga

SEQ ID NO: 555797 - RNA, 17 nt, Homo sapiens
cagagguuugcuuccuc

SEQ ID NO: 555798 - RNA, 14 nt, Homo sapiens
cagaguacgugaaa

SEQ ID NO: 555799 - RNA, 13 nt, Homo sapiens
cagaguaucagau

SEQ ID NO: 555800 - RNA, 16 nt, Homo sapiens
cagagucaaauuugaa

SEQ ID NO: 555801 - RNA, 20 nt, Homo sapiens
cagaguccuuauucuucuca

SEQ ID NO: 555802 - RNA, 18 nt, Homo sapiens
cagagucucugauacaca

SEQ ID NO: 555803 - RNA, 22 nt, Homo sapiens
cagagucugccccacauguggc

SEQ ID NO: 555804 - RNA, 19 nt, Homo sapiens
cagagucuuggacucaugg

SEQ ID NO: 555805 - RNA, 23 nt, Homo sapiens
cagagugagacccagcccucauc

SEQ ID NO: 555806 - RNA, 16 nt, Homo sapiens
cagagugagagacauc

SEQ ID NO: 555807 - RNA, 22 nt, Homo sapiens
cagagugagcaagggggcccaa

SEQ ID NO: 555808 - RNA, 12 nt, Homo sapiens
cagagugcaagc

SEQ ID NO: 555809 - RNA, 13 nt, Homo sapiens
cagaguggagucu

SEQ ID NO: 555810 - RNA, 24 nt, Homo sapiens
cagaguggccuagagcacucucac

SEQ ID NO: 555811 - RNA, 17 nt, Homo sapiens
cagagugggacuuggag

SEQ ID NO: 555812 - RNA, 15 nt, Homo sapiens
cagaguggggagcuc

SEQ ID NO: 555813 - RNA, 18 nt, Homo sapiens
cagaguggggaugacaug

SEQ ID NO: 555814 - RNA, 24 nt, Homo sapiens
cagaguggggaugacaugcacuca

SEQ ID NO: 555815 - RNA, 21 nt, Homo sapiens
cagaguuccugcggagugaag

SEQ ID NO: 555816 - RNA, 24 nt, Homo sapiens
cagaguugcuuuaaaguaccugua

SEQ ID NO: 555817 - RNA, 13 nt, Homo sapiens
cagaguuguucug

SEQ ID NO: 555818 - RNA, 17 nt, Homo sapiens
cagaguuuacauucuaa

SEQ ID NO: 555819 - RNA, 23 nt, Homo sapiens
cagauaaauagaacuaucugcau

SEQ ID NO: 555820 - RNA, 14 nt, Homo sapiens
cagauaacucuccu

SEQ ID NO: 555821 - RNA, 19 nt, Homo sapiens
cagauacacuaaaguuaca

SEQ ID NO: 555822 - RNA, 15 nt, Homo sapiens
cagauacaucacugc

SEQ ID NO: 555823 - RNA, 22 nt, Homo sapiens
cagauagcaucuuauacgagua

SEQ ID NO: 555824 - RNA, 21 nt, Homo sapiens
cagauagcccaggagcaacag

SEQ ID NO: 555825 - RNA, 17 nt, Homo sapiens
cagauagucacagucaa

SEQ ID NO: 555826 - RNA, 15 nt, Homo sapiens
cagauaucugaaugg

SEQ ID NO: 555827 - RNA, 23 nt, Homo sapiens
cagauaucuuggacaaaucacau

SEQ ID NO: 555828 - RNA, 21 nt, Homo sapiens
cagauauguauuuaaauugaa

SEQ ID NO: 555829 - RNA, 18 nt, Homo sapiens
cagaucaacaauaccuuu

SEQ ID NO: 555830 - RNA, 17 nt, Homo sapiens
cagaucaagcugugaga

SEQ ID NO: 555831 - RNA, 17 nt, Homo sapiens
cagaucaccaccugaac

SEQ ID NO: 555832 - RNA, 20 nt, Homo sapiens
cagaucagauucuucucuua

SEQ ID NO: 555833 - RNA, 15 nt, Homo sapiens
cagauccagacugua

SEQ ID NO: 555834 - RNA, 19 nt, Homo sapiens
cagauccgugcgugaagua

SEQ ID NO: 555835 - RNA, 14 nt, Homo sapiens
cagauccucacaac

SEQ ID NO: 555836 - RNA, 19 nt, Homo sapiens
cagauccucacaaccaccu

SEQ ID NO: 555837 - RNA, 18 nt, Homo sapiens
cagauccuuuuccagaaa

SEQ ID NO: 555838 - RNA, 16 nt, Homo sapiens
cagaucgcaccacugc

SEQ ID NO: 555839 - RNA, 19 nt, Homo sapiens
cagaucgcaccacugcacu

SEQ ID NO: 555840 - RNA, 20 nt, Homo sapiens
cagaucgcaccacugcacuc

SEQ ID NO: 555841 - RNA, 16 nt, Homo sapiens
cagaucugaacacagu

SEQ ID NO: 555842 - RNA, 23 nt, Homo sapiens
cagaucuggucuaguuaaccuag

SEQ ID NO: 555843 - RNA, 15 nt, Homo sapiens
cagaucugugccugg

SEQ ID NO: 555844 - RNA, 21 nt, Homo sapiens
cagaucuuucuccuugaauau

SEQ ID NO: 555845 - RNA, 17 nt, Homo sapiens
cagaugaccuuuuggaa

SEQ ID NO: 555846 - RNA, 14 nt, Homo sapiens
cagaugagaacaaa

SEQ ID NO: 555847 - RNA, 21 nt, Homo sapiens
cagaugaguguguguucuucc

SEQ ID NO: 555848 - RNA, 19 nt, Homo sapiens
cagaugaucagggauccaa

SEQ ID NO: 555849 - RNA, 12 nt, Homo sapiens
cagaugaucucu

SEQ ID NO: 555850 - RNA, 12 nt, Homo sapiens
cagaugcaauug

SEQ ID NO: 555851 - RNA, 21 nt, Homo sapiens
cagaugcccacguaugugaaa

SEQ ID NO: 555852 - RNA, 21 nt, Homo sapiens
cagaugcuguuaguaccuaca

SEQ ID NO: 555853 - RNA, 18 nt, Homo sapiens
cagaugcuuuucugucuc

SEQ ID NO: 555854 - RNA, 20 nt, Homo sapiens
cagaugcuuuucugucucug

SEQ ID NO: 555855 - RNA, 19 nt, Homo sapiens
cagauggaaacucuuuaac

SEQ ID NO: 555856 - RNA, 17 nt, Homo sapiens
cagauggaaagaaagca

SEQ ID NO: 555857 - RNA, 16 nt, Homo sapiens
cagauggccccuccac

SEQ ID NO: 555858 - RNA, 23 nt, Homo sapiens
cagaugggcuguuucguguagug

SEQ ID NO: 555859 - RNA, 16 nt, Homo sapiens
cagauggggaaacuga

SEQ ID NO: 555860 - RNA, 15 nt, Homo sapiens
cagaugguacugcug

SEQ ID NO: 555861 - RNA, 20 nt, Homo sapiens
cagaugguagaacuaaacaa

SEQ ID NO: 555862 - RNA, 14 nt, Homo sapiens
cagauggugaccca

SEQ ID NO: 555863 - RNA, 21 nt, Homo sapiens
cagauguaaauagaacaaccu

SEQ ID NO: 555864 - RNA, 23 nt, Homo sapiens
cagauguaauguuuucuuugcaa

SEQ ID NO: 555865 - RNA, 12 nt, Homo sapiens
cagaugucccuu

SEQ ID NO: 555866 - RNA, 19 nt, Homo sapiens
cagaugugaaaacaucuca

SEQ ID NO: 555867 - RNA, 22 nt, Homo sapiens
cagaugugagccaccgugccug

SEQ ID NO: 555868 - RNA, 18 nt, Homo sapiens
cagauguuaugcuccugc

SEQ ID NO: 555869 - RNA, 22 nt, Homo sapiens
cagauguugaaaagaaagcaaa

SEQ ID NO: 555870 - RNA, 22 nt, Homo sapiens
cagauguugcaucccugaaaca

SEQ ID NO: 555871 - RNA, 22 nt, Homo sapiens
cagauguuuuacgucugggaga

SEQ ID NO: 555872 - RNA, 21 nt, Homo sapiens
cagauguuuuucuucauuaac

SEQ ID NO: 555873 - RNA, 19 nt, Homo sapiens
cagauuaugaguuacuguu

SEQ ID NO: 555874 - RNA, 20 nt, Homo sapiens
cagauucagugcaauccuua

SEQ ID NO: 555875 - RNA, 21 nt, Homo sapiens
cagauuccaggcgaugugcaa

SEQ ID NO: 555876 - RNA, 23 nt, Homo sapiens
cagauuccaggcgaugugcaagu

SEQ ID NO: 555877 - RNA, 19 nt, Homo sapiens
cagauuccuggcagagcca

SEQ ID NO: 555878 - RNA, 23 nt, Homo sapiens
cagauugaaaagaccuacagacu

SEQ ID NO: 555879 - RNA, 12 nt, Homo sapiens
cagauugaacuu

SEQ ID NO: 555880 - RNA, 16 nt, Homo sapiens
cagauuguccuggaac

SEQ ID NO: 555881 - RNA, 18 nt, Homo sapiens
cagauuuacacugggaga

SEQ ID NO: 555882 - RNA, 13 nt, Homo sapiens
cagauuucaggaa

SEQ ID NO: 555883 - RNA, 21 nt, Homo sapiens
cagauuugcuguucacccaca

SEQ ID NO: 555884 - RNA, 18 nt, Homo sapiens
cagauuugugcccauucc

SEQ ID NO: 555885 - RNA, 16 nt, Homo sapiens
cagauuuuacaaaaga

SEQ ID NO: 555886 - RNA, 20 nt, Homo sapiens
cagauuuuagacuuaccuug

SEQ ID NO: 555887 - RNA, 18 nt, Homo sapiens
cagauuuuuuccucugca

SEQ ID NO: 555888 - RNA, 17 nt, Homo sapiens
cagcaaaacgacacugc

SEQ ID NO: 555889 - RNA, 19 nt, Homo sapiens
cagcaaaagaaacuaucaa

SEQ ID NO: 555890 - RNA, 16 nt, Homo sapiens
cagcaaaauguugaag

SEQ ID NO: 555891 - RNA, 15 nt, Homo sapiens
ugguuccaagaaaga

SEQ ID NO: 555892 - RNA, 19 nt, Homo sapiens
ugguuccaugccugagggu

SEQ ID NO: 555893 - RNA, 19 nt, Homo sapiens
ugguuccuuggggggccaa

SEQ ID NO: 555894 - RNA, 20 nt, Homo sapiens
ugguucguguucauacugca

SEQ ID NO: 555895 - RNA, 12 nt, Homo sapiens
ugguucuaagaa

SEQ ID NO: 555896 - RNA, 15 nt, Homo sapiens
ugguugagguuucaa

SEQ ID NO: 555897 - RNA, 15 nt, Homo sapiens
ugguugcauuuguca

SEQ ID NO: 555898 - RNA, 20 nt, Homo sapiens
ugguuggaaaacacuuucau

SEQ ID NO: 555899 - RNA, 17 nt, Homo sapiens
ugguuguauaaagcaaa

SEQ ID NO: 555900 - RNA, 20 nt, Homo sapiens
ugguuguccccguaccacca

SEQ ID NO: 555901 - RNA, 20 nt, Homo sapiens
ugguuuccccugcacucccg

SEQ ID NO: 555902 - RNA, 15 nt, Homo sapiens
ugguuuccuauuucc

SEQ ID NO: 555903 - RNA, 13 nt, Homo sapiens
ugguuuguacuca

SEQ ID NO: 555904 - RNA, 20 nt, Homo sapiens
ugguuuguuauaucagggaa

SEQ ID NO: 555905 - RNA, 14 nt, Homo sapiens
ugguuuucuagccc

SEQ ID NO: 555906 - RNA, 21 nt, Homo sapiens
ugguuuuuaucaaauuugcca

SEQ ID NO: 555907 - RNA, 14 nt, Homo sapiens
uguaaaaaauggag

SEQ ID NO: 555908 - RNA, 12 nt, Homo sapiens
uguaaaaaccuu

SEQ ID NO: 555909 - RNA, 20 nt, Homo sapiens
uguaaaaaccuucccauaaa

SEQ ID NO: 555910 - RNA, 13 nt, Homo sapiens
uguaaaaauccuu

SEQ ID NO: 555911 - RNA, 20 nt, Homo sapiens
uguaaaaauccuuuugaaug

SEQ ID NO: 555912 - RNA, 22 nt, Homo sapiens
uguaaaaaugaaagugacuuua

SEQ ID NO: 555913 - RNA, 19 nt, Homo sapiens
uguaaaaauguuacgugaa

SEQ ID NO: 555914 - RNA, 14 nt, Homo sapiens
uguaaaacaaagag

SEQ ID NO: 555915 - RNA, 16 nt, Homo sapiens
uguaaaacccaaaaca

SEQ ID NO: 555916 - RNA, 19 nt, Homo sapiens
uguaaaauccacagcuaua

SEQ ID NO: 555917 - RNA, 15 nt, Homo sapiens
uguaaaauguauauu

SEQ ID NO: 555918 - RNA, 17 nt, Homo sapiens
uguaaacaaaccacagc

SEQ ID NO: 555919 - RNA, 15 nt, Homo sapiens
uguaaacacauguuc

SEQ ID NO: 555920 - RNA, 13 nt, Homo sapiens
uguaaaccaaaua

SEQ ID NO: 555921 - RNA, 13 nt, Homo sapiens
uguaaacguuaaa

SEQ ID NO: 555922 - RNA, 16 nt, Homo sapiens
uguaaacuacaaagua

SEQ ID NO: 555923 - RNA, 17 nt, Homo sapiens
uguaaacuuuaucacuu

SEQ ID NO: 555924 - RNA, 20 nt, Homo sapiens
uguaaacuuuuugugcugaa

SEQ ID NO: 555925 - RNA, 15 nt, Homo sapiens
uguaaagaaugucua

SEQ ID NO: 555926 - RNA, 15 nt, Homo sapiens
uguaaagacacaucu

SEQ ID NO: 555927 - RNA, 17 nt, Homo sapiens
uguaaagacacaucuua

SEQ ID NO: 555928 - RNA, 19 nt, Homo sapiens
uguaaagauguuuauuuca

SEQ ID NO: 555929 - RNA, 19 nt, Homo sapiens
uguaaagcuaaaauaaaga

SEQ ID NO: 555930 - RNA, 18 nt, Homo sapiens
uguaaauauucuugucca

SEQ ID NO: 555931 - RNA, 23 nt, Homo sapiens
uguaaaucugccacaaaaacagg

SEQ ID NO: 555932 - RNA, 15 nt, Homo sapiens
uguaaaugugacauu

SEQ ID NO: 555933 - RNA, 11 nt, Homo sapiens
uguaaauugca

SEQ ID NO: 555934 - RNA, 15 nt, Homo sapiens
uguaaauuucucaaa

SEQ ID NO: 555935 - RNA, 23 nt, Homo sapiens
uguaacaauuauguuuucagugc

SEQ ID NO: 555936 - RNA, 14 nt, Homo sapiens
uguaacacuuguca

SEQ ID NO: 555937 - RNA, 15 nt, Homo sapiens
uguaacauaaugcac

SEQ ID NO: 555938 - RNA, 14 nt, Homo sapiens
uguaacauccaugu

SEQ ID NO: 555939 - RNA, 22 nt, Homo sapiens
uguaacauuguaaaguauguga

SEQ ID NO: 555940 - RNA, 17 nt, Homo sapiens
uguaacccaccuugacc

SEQ ID NO: 555941 - RNA, 22 nt, Homo sapiens
uguaacccaccuugaccauaaa

SEQ ID NO: 555942 - RNA, 23 nt, Homo sapiens
uguaacguuuucuuucacacaca

SEQ ID NO: 555943 - RNA, 22 nt, Homo sapiens
uguaacucacauucucuuccca

SEQ ID NO: 555944 - RNA, 13 nt, Homo sapiens
uguaacugucagu

SEQ ID NO: 555945 - RNA, 17 nt, Homo sapiens
uguaacuguuacaguaa

SEQ ID NO: 555946 - RNA, 17 nt, Homo sapiens
uguaacuuaacuauuaa

SEQ ID NO: 555947 - RNA, 19 nt, Homo sapiens
uguaacuugaaccuaugaa

SEQ ID NO: 555948 - RNA, 20 nt, Homo sapiens
uguaacuuuuugcacuauug

SEQ ID NO: 555949 - RNA, 15 nt, Homo sapiens
uguaagaaaauguua

SEQ ID NO: 555950 - RNA, 19 nt, Homo sapiens
uguaagaacaacuaccuga

SEQ ID NO: 555951 - RNA, 18 nt, Homo sapiens
uguaagaguucagacuca

SEQ ID NO: 555952 - RNA, 19 nt, Homo sapiens
uguaagauaaaccaguuga

SEQ ID NO: 555953 - RNA, 17 nt, Homo sapiens
uguaagauaauguugcu

SEQ ID NO: 555954 - RNA, 23 nt, Homo sapiens
uguaagaucguucucugccucac

SEQ ID NO: 555955 - RNA, 14 nt, Homo sapiens
uguaagauuuucca

SEQ ID NO: 555956 - RNA, 14 nt, Homo sapiens
uguaagccaaguca

SEQ ID NO: 555957 - RNA, 17 nt, Homo sapiens
uguaagguacuuucaua

SEQ ID NO: 555958 - RNA, 14 nt, Homo sapiens
uguaaguacuucca

SEQ ID NO: 555959 - RNA, 21 nt, Homo sapiens
uguaagugagagagacaagaa

SEQ ID NO: 555960 - RNA, 22 nt, Homo sapiens
uguaaguuuaccuauguaacaa

SEQ ID NO: 555961 - RNA, 16 nt, Homo sapiens
uguaauacacagugag

SEQ ID NO: 555962 - RNA, 16 nt, Homo sapiens
uguaauacuucaccuc

SEQ ID NO: 555963 - RNA, 16 nt, Homo sapiens
uguaauagugacauau

SEQ ID NO: 555964 - RNA, 22 nt, Homo sapiens
uguaaucaaggccagugcuaaa

SEQ ID NO: 555965 - RNA, 14 nt, Homo sapiens
uguaaucacauucc

SEQ ID NO: 555966 - RNA, 14 nt, Homo sapiens
uguaaucagcaaua

SEQ ID NO: 555967 - RNA, 16 nt, Homo sapiens
uguaaucccagcacuu

SEQ ID NO: 555968 - RNA, 20 nt, Homo sapiens
uguaaucccagcuacucgag

SEQ ID NO: 555969 - RNA, 12 nt, Homo sapiens
uguaaucucagc

SEQ ID NO: 555970 - RNA, 15 nt, Homo sapiens
uguaaugcaaaaggc

SEQ ID NO: 555971 - RNA, 12 nt, Homo sapiens
uguaaugcugca

SEQ ID NO: 555972 - RNA, 14 nt, Homo sapiens
uguaaugcugcaca

SEQ ID NO: 555973 - RNA, 15 nt, Homo sapiens
uguaauggaaaccaa

SEQ ID NO: 555974 - RNA, 17 nt, Homo sapiens
uguaaugucaccaccuu

SEQ ID NO: 555975 - RNA, 13 nt, Homo sapiens
uguaauguguacu

SEQ ID NO: 555976 - RNA, 20 nt, Homo sapiens
uguaaugugugguggccuca

SEQ ID NO: 555977 - RNA, 20 nt, Homo sapiens
uguaauuaaaagcaaaucau

SEQ ID NO: 555978 - RNA, 23 nt, Homo sapiens
uguaauucaucagucauuauuag

SEQ ID NO: 555979 - RNA, 22 nt, Homo sapiens
uguaauuggaaucuucaccuca

SEQ ID NO: 555980 - RNA, 23 nt, Homo sapiens
uguacaauaaaaacauugccuuu

SEQ ID NO: 555981 - RNA, 23 nt, Homo sapiens
uguacaauaaagcaaugugguag

SEQ ID NO: 555982 - RNA, 20 nt, Homo sapiens
uguacaaugaacccccauga

SEQ ID NO: 555983 - RNA, 18 nt, Homo sapiens
uguacaaugguuuauucc

SEQ ID NO: 555984 - RNA, 13 nt, Homo sapiens
uguacaccaaggu

SEQ ID NO: 555985 - RNA, 14 nt, Homo sapiens
uguacaccaguuua

SEQ ID NO: 555986 - RNA, 16 nt, Homo sapiens
uguacaccccaggaca

SEQ ID NO: 555987 - RNA, 17 nt, Homo sapiens
uguacacugacuugaga

SEQ ID NO: 555988 - RNA, 19 nt, Homo sapiens
uguacagaguaaguucuca

SEQ ID NO: 555989 - RNA, 17 nt, Homo sapiens
uguacagaugaaugaua

SEQ ID NO: 555990 - RNA, 14 nt, Homo sapiens
uguacagauuuuau

SEQ ID NO: 555991 - RNA, 11 nt, Homo sapiens
uguacagguac

SEQ ID NO: 555992 - RNA, 15 nt, Homo sapiens
uguacaguaucagaa

SEQ ID NO: 555993 - RNA, 14 nt, Homo sapiens
uguacagucuugua

SEQ ID NO: 555994 - RNA, 19 nt, Homo sapiens
uguacagugaaaagucucc

SEQ ID NO: 555995 - RNA, 15 nt, Homo sapiens
uguacagugaaucug

SEQ ID NO: 555996 - RNA, 13 nt, Homo sapiens
uguacauacuggc

SEQ ID NO: 555997 - RNA, 18 nt, Homo sapiens
uguacaucccaaaggaug

SEQ ID NO: 555998 - RNA, 13 nt, Homo sapiens
uguacauuaccau

SEQ ID NO: 555999 - RNA, 14 nt, Homo sapiens
uguacauuaccaua

SEQ ID NO: 556000 - RNA, 13 nt, Homo sapiens
uguacauuucacc

SEQ ID NO: 556001 - RNA, 19 nt, Homo sapiens
uguaccaaaacauccacuu

SEQ ID NO: 556002 - RNA, 14 nt, Homo sapiens
uguaccacaucugc

SEQ ID NO: 556003 - RNA, 13 nt, Homo sapiens
uguaccaguuugu

SEQ ID NO: 556004 - RNA, 13 nt, Homo sapiens
uguaccauguaca

SEQ ID NO: 556005 - RNA, 19 nt, Homo sapiens
uguacuaaaaaccaaugaa

SEQ ID NO: 556006 - RNA, 16 nt, Homo sapiens
uguacuaccuguguau

SEQ ID NO: 556007 - RNA, 15 nt, Homo sapiens
uguacuaguccucua

SEQ ID NO: 556008 - RNA, 23 nt, Homo sapiens
uguacugcaaagucgccagucac

SEQ ID NO: 556009 - RNA, 16 nt, Homo sapiens
uguacuguacauaaau

SEQ ID NO: 556010 - RNA, 22 nt, Homo sapiens
uguacuuauauccacacugcac

SEQ ID NO: 556011 - RNA, 15 nt, Homo sapiens
uguacuuccaccucc

SEQ ID NO: 556012 - RNA, 19 nt, Homo sapiens
uguacuuuaaaaagaugua

SEQ ID NO: 556013 - RNA, 13 nt, Homo sapiens
uguagaacuucaa

SEQ ID NO: 556014 - RNA, 18 nt, Homo sapiens
uguagaagauggcacuua

SEQ ID NO: 556015 - RNA, 22 nt, Homo sapiens
ugggucauagaaauucuuuaua

SEQ ID NO: 556016 - RNA, 15 nt, Homo sapiens
ugggucaugcacuga

SEQ ID NO: 556017 - RNA, 20 nt, Homo sapiens
uggguccuaauuaccagucu

SEQ ID NO: 556018 - RNA, 23 nt, Homo sapiens
uggguccuggccuugugucacug

SEQ ID NO: 556019 - RNA, 16 nt, Homo sapiens
uggguccuucaaacaa

SEQ ID NO: 556020 - RNA, 18 nt, Homo sapiens
uggguccuugaugccaga

SEQ ID NO: 556021 - RNA, 16 nt, Homo sapiens
uggguccuuggcuccc

SEQ ID NO: 556022 - RNA, 14 nt, Homo sapiens
ugggucuaccucau

SEQ ID NO: 556023 - RNA, 15 nt, Homo sapiens
ugggucucagcugcu

SEQ ID NO: 556024 - RNA, 23 nt, Homo sapiens
ugggucucauuuagaacuugcag

SEQ ID NO: 556025 - RNA, 22 nt, Homo sapiens
ugggucugggagucacacagug

SEQ ID NO: 556026 - RNA, 13 nt, Homo sapiens
ugggucuguguca

SEQ ID NO: 556027 - RNA, 18 nt, Homo sapiens
ugggucuuggggacuaac

SEQ ID NO: 556028 - RNA, 16 nt, Homo sapiens
ugggugacaaagugag

SEQ ID NO: 556029 - RNA, 20 nt, Homo sapiens
ugggugacagagcaagugag

SEQ ID NO: 556030 - RNA, 17 nt, Homo sapiens
ugggugagcucuuccag

SEQ ID NO: 556031 - RNA, 23 nt, Homo sapiens
ugggugagcucuuccaggagcca

SEQ ID NO: 556032 - RNA, 21 nt, Homo sapiens
ugggugauuacauaaucugua

SEQ ID NO: 556033 - RNA, 12 nt, Homo sapiens
ugggugggacca

SEQ ID NO: 556034 - RNA, 16 nt, Homo sapiens
ugggugggaccacaga

SEQ ID NO: 556035 - RNA, 20 nt, Homo sapiens
ugggugguguauuugagaag

SEQ ID NO: 556036 - RNA, 19 nt, Homo sapiens
ugggugucauuucauucca

SEQ ID NO: 556037 - RNA, 14 nt, Homo sapiens
uggguguugaccac

SEQ ID NO: 556038 - RNA, 21 nt, Homo sapiens
uggguguuucaguuugaaaau

SEQ ID NO: 556039 - RNA, 18 nt, Homo sapiens
uggguuagagauggaguu

SEQ ID NO: 556040 - RNA, 23 nt, Homo sapiens
uggguugcaggaccucaggugag

SEQ ID NO: 556041 - RNA, 20 nt, Homo sapiens
uggguuggagggaaccacca

SEQ ID NO: 556042 - RNA, 14 nt, Homo sapiens
uggguuggcugugg

SEQ ID NO: 556043 - RNA, 14 nt, Homo sapiens
uggguugucaccaa

SEQ ID NO: 556044 - RNA, 17 nt, Homo sapiens
uggguuguguguuuauu

SEQ ID NO: 556045 - RNA, 17 nt, Homo sapiens
uggguuuauagacauua

SEQ ID NO: 556046 - RNA, 19 nt, Homo sapiens
uggguuuguuccuggggcu

SEQ ID NO: 556047 - RNA, 14 nt, Homo sapiens
ugguaaaaagaucc

SEQ ID NO: 556048 - RNA, 18 nt, Homo sapiens
ugguaaaaccccaucucu

SEQ ID NO: 556049 - RNA, 21 nt, Homo sapiens
ugguaaaaguauuugcuuaaa

SEQ ID NO: 556050 - RNA, 15 nt, Homo sapiens
ugguaaauacuguga

SEQ ID NO: 556051 - RNA, 14 nt, Homo sapiens
ugguaagcaccagg

SEQ ID NO: 556052 - RNA, 13 nt, Homo sapiens
ugguaagcauugu

SEQ ID NO: 556053 - RNA, 21 nt, Homo sapiens
ugguaaggccucuggacuggc

SEQ ID NO: 556054 - RNA, 13 nt, Homo sapiens
ugguaaguaacug

SEQ ID NO: 556055 - RNA, 19 nt, Homo sapiens
ugguaauaaguacugugua

SEQ ID NO: 556056 - RNA, 18 nt, Homo sapiens
ugguaauauugacuugua

SEQ ID NO: 556057 - RNA, 20 nt, Homo sapiens
ugguacaaucucaaauucuc

SEQ ID NO: 556058 - RNA, 18 nt, Homo sapiens
ugguaccuauuugacuua

SEQ ID NO: 556059 - RNA, 15 nt, Homo sapiens
ugguacucaagcccg

SEQ ID NO: 556060 - RNA, 19 nt, Homo sapiens
ugguagaaaggcaguucag

SEQ ID NO: 556061 - RNA, 22 nt, Homo sapiens
ugguagaacguaaccacggaaa

SEQ ID NO: 556062 - RNA, 22 nt, Homo sapiens
ugguagagagguuuuucuuggg

SEQ ID NO: 556063 - RNA, 15 nt, Homo sapiens
ugguagccaucucau

SEQ ID NO: 556064 - RNA, 15 nt, Homo sapiens
ugguagccucacuuu

SEQ ID NO: 556065 - RNA, 19 nt, Homo sapiens
ugguaguuguggcuuuuau

SEQ ID NO: 556066 - RNA, 13 nt, Homo sapiens
ugguauacauuga

SEQ ID NO: 556067 - RNA, 21 nt, Homo sapiens
ugguaucacugaacuacuaaa

SEQ ID NO: 556068 - RNA, 23 nt, Homo sapiens
ugguaucaucuucucauuuugca

SEQ ID NO: 556069 - RNA, 19 nt, Homo sapiens
ugguaucuuauuaaugagu

SEQ ID NO: 556070 - RNA, 20 nt, Homo sapiens
ugguaugcuggccagcaccc

SEQ ID NO: 556071 - RNA, 13 nt, Homo sapiens
ugguaugugccag

SEQ ID NO: 556072 - RNA, 12 nt, Homo sapiens
ugguaugugcua

SEQ ID NO: 556073 - RNA, 18 nt, Homo sapiens
ugguauuauauaauucaa

SEQ ID NO: 556074 - RNA, 16 nt, Homo sapiens
uggucaaguaguuuga

SEQ ID NO: 556075 - RNA, 19 nt, Homo sapiens
uggucaauccgaaguauga

SEQ ID NO: 556076 - RNA, 20 nt, Homo sapiens
uggucaauccgaaguaugag

SEQ ID NO: 556077 - RNA, 21 nt, Homo sapiens
uggucacaccccugugugaua

SEQ ID NO: 556078 - RNA, 14 nt, Homo sapiens
uggucacauacaau

SEQ ID NO: 556079 - RNA, 13 nt, Homo sapiens
uggucaccaaauc

SEQ ID NO: 556080 - RNA, 22 nt, Homo sapiens
uggucaccaaggcagugcaugc

SEQ ID NO: 556081 - RNA, 16 nt, Homo sapiens
uggucaccuugcacuc

SEQ ID NO: 556082 - RNA, 14 nt, Homo sapiens
uggucagauuugaa

SEQ ID NO: 556083 - RNA, 19 nt, Homo sapiens
uggucagguuauacuccuc

SEQ ID NO: 556084 - RNA, 15 nt, Homo sapiens
uggucauccaaacuc

SEQ ID NO: 556085 - RNA, 23 nt, Homo sapiens
uggucauuauuucagugugcaua

SEQ ID NO: 556086 - RNA, 18 nt, Homo sapiens
uggucauuuccuaugcaa

SEQ ID NO: 556087 - RNA, 19 nt, Homo sapiens
uggucauuuccuaugcaaa

SEQ ID NO: 556088 - RNA, 14 nt, Homo sapiens
ugguccaggguuga

SEQ ID NO: 556089 - RNA, 17 nt, Homo sapiens
uggucccaggcuuccca

SEQ ID NO: 556090 - RNA, 14 nt, Homo sapiens
uggucgagugacac

SEQ ID NO: 556091 - RNA, 15 nt, Homo sapiens
uggucggccaguaca

SEQ ID NO: 556092 - RNA, 15 nt, Homo sapiens
uggucuccaugcuca

SEQ ID NO: 556093 - RNA, 14 nt, Homo sapiens
uggucucuaucucc

SEQ ID NO: 556094 - RNA, 15 nt, Homo sapiens
uggucugccagaaua

SEQ ID NO: 556095 - RNA, 19 nt, Homo sapiens
uggucuguggaucagcauu

SEQ ID NO: 556096 - RNA, 20 nt, Homo sapiens
uggucuguggaucagcauuu

SEQ ID NO: 556097 - RNA, 18 nt, Homo sapiens
uggucuugagaugucuuc

SEQ ID NO: 556098 - RNA, 20 nt, Homo sapiens
uggucuuuccuaucauggag

SEQ ID NO: 556099 - RNA, 15 nt, Homo sapiens
uggugaaaagcucca

SEQ ID NO: 556100 - RNA, 23 nt, Homo sapiens
uggugaaaccccaucucuacuaa

SEQ ID NO: 556101 - RNA, 21 nt, Homo sapiens
uggugacagccuugggccuuu

SEQ ID NO: 556102 - RNA, 14 nt, Homo sapiens
uggugacaguccaa

SEQ ID NO: 556103 - RNA, 22 nt, Homo sapiens
uggugaccugcggcaguaugua

SEQ ID NO: 556104 - RNA, 19 nt, Homo sapiens
uggugagaugcagcuggaa

SEQ ID NO: 556105 - RNA, 20 nt, Homo sapiens
uggugagcucugggaagugu

SEQ ID NO: 556106 - RNA, 12 nt, Homo sapiens
uggugcaaaaaa

SEQ ID NO: 556107 - RNA, 15 nt, Homo sapiens
uggugcaaacacagc

SEQ ID NO: 556108 - RNA, 20 nt, Homo sapiens
uggugccaccagccuuccug

SEQ ID NO: 556109 - RNA, 17 nt, Homo sapiens
uggugcgcccugucucu

SEQ ID NO: 556110 - RNA, 23 nt, Homo sapiens
uggugcuaaaugcuacauacucc

SEQ ID NO: 556111 - RNA, 20 nt, Homo sapiens
uggugcuagaagacagacau

SEQ ID NO: 556112 - RNA, 20 nt, Homo sapiens
ugguggacgagaaggugcuu

SEQ ID NO: 556113 - RNA, 24 nt, Homo sapiens
ugguggaguguagccuccaccuga

SEQ ID NO: 556114 - RNA, 20 nt, Homo sapiens
ugguggcaacauucauugcc

SEQ ID NO: 556115 - RNA, 21 nt, Homo sapiens
ugguggccacgagguuaaaga

SEQ ID NO: 556116 - RNA, 19 nt, Homo sapiens
ugguggcccacgccuguaa

SEQ ID NO: 556117 - RNA, 18 nt, Homo sapiens
uggugggggucaggugga

SEQ ID NO: 556118 - RNA, 16 nt, Homo sapiens
ugguggguucagggga

SEQ ID NO: 556119 - RNA, 22 nt, Homo sapiens
uggugguuaaaagggaacacaa

SEQ ID NO: 556120 - RNA, 18 nt, Homo sapiens
ugguguaauuuuguccuc

SEQ ID NO: 556121 - RNA, 17 nt, Homo sapiens
uggugugaccauguuca

SEQ ID NO: 556122 - RNA, 11 nt, Homo sapiens
uggugugauuu

SEQ ID NO: 556123 - RNA, 21 nt, Homo sapiens
ugguguggccagcacucugaa

SEQ ID NO: 556124 - RNA, 20 nt, Homo sapiens
ugguguugggaagggguccu

SEQ ID NO: 556125 - RNA, 13 nt, Homo sapiens
ugguguuuacaca

SEQ ID NO: 556126 - RNA, 18 nt, Homo sapiens
ugguguuuacccaguauu

SEQ ID NO: 556127 - RNA, 15 nt, Homo sapiens
ugguguuucccuucc

SEQ ID NO: 556128 - RNA, 18 nt, Homo sapiens
ugguuaccaccagccuuu

SEQ ID NO: 556129 - RNA, 12 nt, Homo sapiens
ugguuaucugaa

SEQ ID NO: 556130 - RNA, 13 nt, Homo sapiens
ugguuaugugcau

SEQ ID NO: 556131 - RNA, 17 nt, Homo sapiens
ugguuauuggaaggcaa

SEQ ID NO: 556132 - RNA, 14 nt, Homo sapiens
ugguucacugcaac

SEQ ID NO: 556133 - RNA, 16 nt, Homo sapiens
ugguucagacacagcu

SEQ ID NO: 556134 - RNA, 19 nt, Homo sapiens
ugguucaggaaaacuacug

SEQ ID NO: 556135 - RNA, 16 nt, Homo sapiens
ugguucagugccuucc

SEQ ID NO: 556136 - RNA, 17 nt, Homo sapiens
ugguucauuaauucuau

SEQ ID NO: 556137 - RNA, 14 nt, Homo sapiens
ucccaaucuugccc

SEQ ID NO: 556138 - RNA, 15 nt, Homo sapiens
ucccaaucuuucuau

SEQ ID NO: 556139 - RNA, 21 nt, Homo sapiens
ucccaaugaaauacugagaug

SEQ ID NO: 556140 - RNA, 18 nt, Homo sapiens
ucccaauggauaaaucag

SEQ ID NO: 556141 - RNA, 13 nt, Homo sapiens
ucccaauguuuga

SEQ ID NO: 556142 - RNA, 16 nt, Homo sapiens
ucccacaaaagacaga

SEQ ID NO: 556143 - RNA, 16 nt, Homo sapiens
ucccacaccagccucc

SEQ ID NO: 556144 - RNA, 13 nt, Homo sapiens
ucccacaccaggu

SEQ ID NO: 556145 - RNA, 18 nt, Homo sapiens
ucccacacccuguuuuac

SEQ ID NO: 556146 - RNA, 12 nt, Homo sapiens
ucccacacuguc

SEQ ID NO: 556147 - RNA, 13 nt, Homo sapiens
ucccacacugugg

SEQ ID NO: 556148 - RNA, 17 nt, Homo sapiens
ucccacacuugugccag

SEQ ID NO: 556149 - RNA, 18 nt, Homo sapiens
ucccacaugggcccaggc

SEQ ID NO: 556150 - RNA, 12 nt, Homo sapiens
ucccaccacagc

SEQ ID NO: 556151 - RNA, 20 nt, Homo sapiens
ucccaccacagcagguguca

SEQ ID NO: 556152 - RNA, 23 nt, Homo sapiens
ucccaccacggggucugcagcaa

SEQ ID NO: 556153 - RNA, 21 nt, Homo sapiens
ucccaccauuccugccuuuaa

SEQ ID NO: 556154 - RNA, 21 nt, Homo sapiens
ucccacccaacagcucagaga

SEQ ID NO: 556155 - RNA, 15 nt, Homo sapiens
ucccacccagcuaaa

SEQ ID NO: 556156 - RNA, 23 nt, Homo sapiens
ucccacccccacccccagcucaa

SEQ ID NO: 556157 - RNA, 17 nt, Homo sapiens
ucccaccccggccucca

SEQ ID NO: 556158 - RNA, 15 nt, Homo sapiens
ucccacgagggugcc

SEQ ID NO: 556159 - RNA, 20 nt, Homo sapiens
ucccacgucuggccaggcac

SEQ ID NO: 556160 - RNA, 16 nt, Homo sapiens
ucccacgugucuucca

SEQ ID NO: 556161 - RNA, 17 nt, Homo sapiens
ucccacucaggugaaaa

SEQ ID NO: 556162 - RNA, 16 nt, Homo sapiens
ucccacucaguacugu

SEQ ID NO: 556163 - RNA, 17 nt, Homo sapiens
ucccacucccaucuccu

SEQ ID NO: 556164 - RNA, 20 nt, Homo sapiens
ucccacucccggccugucau

SEQ ID NO: 556165 - RNA, 16 nt, Homo sapiens
ucccacuccuucagga

SEQ ID NO: 556166 - RNA, 18 nt, Homo sapiens
ucccacuguuuaaggagu

SEQ ID NO: 556167 - RNA, 20 nt, Homo sapiens
ucccacuuugcuguuccuua

SEQ ID NO: 556168 - RNA, 22 nt, Homo sapiens
ucccagaaaaacuggcucugau

SEQ ID NO: 556169 - RNA, 18 nt, Homo sapiens
ucccagaaacaucucugg

SEQ ID NO: 556170 - RNA, 15 nt, Homo sapiens
ucccagaaguggcua

SEQ ID NO: 556171 - RNA, 19 nt, Homo sapiens
ucccagacaguggauauga

SEQ ID NO: 556172 - RNA, 18 nt, Homo sapiens
ucccagaggaugucacaa

SEQ ID NO: 556173 - RNA, 17 nt, Homo sapiens
ucccagaucacacauca

SEQ ID NO: 556174 - RNA, 15 nt, Homo sapiens
ucccagauguugcau

SEQ ID NO: 556175 - RNA, 17 nt, Homo sapiens
ucccagauuucaggaaa

SEQ ID NO: 556176 - RNA, 20 nt, Homo sapiens
ucccagcaccuauugaauua

SEQ ID NO: 556177 - RNA, 12 nt, Homo sapiens
ucccagcacuuu

SEQ ID NO: 556178 - RNA, 13 nt, Homo sapiens
ucccagcacuuug

SEQ ID NO: 556179 - RNA, 19 nt, Homo sapiens
uggcaauuucacugaugua

SEQ ID NO: 556180 - RNA, 15 nt, Homo sapiens
uggcacacgccugua

SEQ ID NO: 556181 - RNA, 22 nt, Homo sapiens
uggcacagaugcccacguaugu

SEQ ID NO: 556182 - RNA, 15 nt, Homo sapiens
uggcaccacugcacu

SEQ ID NO: 556183 - RNA, 21 nt, Homo sapiens
uggcaccuguagucccagcua

SEQ ID NO: 556184 - RNA, 15 nt, Homo sapiens
uggcacguauugcug

SEQ ID NO: 556185 - RNA, 15 nt, Homo sapiens
uggcacuacaggcac

SEQ ID NO: 556186 - RNA, 19 nt, Homo sapiens
uggcacucagggagcauuu

SEQ ID NO: 556187 - RNA, 16 nt, Homo sapiens
uggcacugacugggca

SEQ ID NO: 556188 - RNA, 12 nt, Homo sapiens
uggcacuggcca

SEQ ID NO: 556189 - RNA, 13 nt, Homo sapiens
uggcacuggccac

SEQ ID NO: 556190 - RNA, 12 nt, Homo sapiens
uggcacuuugaa

SEQ ID NO: 556191 - RNA, 15 nt, Homo sapiens
uggcagaaccaaagc

SEQ ID NO: 556192 - RNA, 20 nt, Homo sapiens
uggcagagccagagcuugaa

SEQ ID NO: 556193 - RNA, 13 nt, Homo sapiens
uggcagagccaug

SEQ ID NO: 556194 - RNA, 13 nt, Homo sapiens
uggcagcacggcc

SEQ ID NO: 556195 - RNA, 21 nt, Homo sapiens
uggcagcaucuucacuucuaa

SEQ ID NO: 556196 - RNA, 20 nt, Homo sapiens
uggcagcauucccaccaaca

SEQ ID NO: 556197 - RNA, 17 nt, Homo sapiens
uggcagccgugccuuca

SEQ ID NO: 556198 - RNA, 18 nt, Homo sapiens
uggcagcucuccagucag

SEQ ID NO: 556199 - RNA, 14 nt, Homo sapiens
uggcaggaccagga

SEQ ID NO: 556200 - RNA, 14 nt, Homo sapiens
uggcaggacuccag

SEQ ID NO: 556201 - RNA, 21 nt, Homo sapiens
uggcaggugucauaugacuga

SEQ ID NO: 556202 - RNA, 15 nt, Homo sapiens
uggcagucacaucuc

SEQ ID NO: 556203 - RNA, 19 nt, Homo sapiens
uggcagucugaauuuuuaa

SEQ ID NO: 556204 - RNA, 23 nt, Homo sapiens
uggcaucaaacagggcaaagugu

SEQ ID NO: 556205 - RNA, 21 nt, Homo sapiens
uggcaucacgucagugcucag

SEQ ID NO: 556206 - RNA, 15 nt, Homo sapiens
uggcauccugugacc

SEQ ID NO: 556207 - RNA, 12 nt, Homo sapiens
uggcaucugugc

SEQ ID NO: 556208 - RNA, 14 nt, Homo sapiens
uggcaucuugccaa

SEQ ID NO: 556209 - RNA, 16 nt, Homo sapiens
uggcauuacaauugca

SEQ ID NO: 556210 - RNA, 19 nt, Homo sapiens
uggcauuccuucugaccac

SEQ ID NO: 556211 - RNA, 15 nt, Homo sapiens
uggcauuugcaauaa

SEQ ID NO: 556212 - RNA, 11 nt, Homo sapiens
uggcauuugcu

SEQ ID NO: 556213 - RNA, 19 nt, Homo sapiens
uggccaagcaauuccucug

SEQ ID NO: 556214 - RNA, 20 nt, Homo sapiens
uggccaaggugaauagcaca

SEQ ID NO: 556215 - RNA, 15 nt, Homo sapiens
uggccacagugucac

SEQ ID NO: 556216 - RNA, 21 nt, Homo sapiens
uggccaccccuccccaguaca

SEQ ID NO: 556217 - RNA, 19 nt, Homo sapiens
uggccacccgcccacagcc

SEQ ID NO: 556218 - RNA, 23 nt, Homo sapiens
uggccaccuccagggacaaagag

SEQ ID NO: 556219 - RNA, 17 nt, Homo sapiens
uggccagacuucagcug

SEQ ID NO: 556220 - RNA, 18 nt, Homo sapiens
uggccagagccucuggcc

SEQ ID NO: 556221 - RNA, 19 nt, Homo sapiens
uggccagagccucuggccc

SEQ ID NO: 556222 - RNA, 22 nt, Homo sapiens
uggccaggccuuacaucuggcu

SEQ ID NO: 556223 - RNA, 19 nt, Homo sapiens
uggccaggcuggucucaaa

SEQ ID NO: 556224 - RNA, 22 nt, Homo sapiens
uggccaguagcuaaagugcaag

SEQ ID NO: 556225 - RNA, 14 nt, Homo sapiens
uggccagugcugcu

SEQ ID NO: 556226 - RNA, 19 nt, Homo sapiens
uggccaguuuguuccucua

SEQ ID NO: 556227 - RNA, 18 nt, Homo sapiens
uggccaugcccuccaugu

SEQ ID NO: 556228 - RNA, 22 nt, Homo sapiens
uggccaugucgccaaaaauaca

SEQ ID NO: 556229 - RNA, 15 nt, Homo sapiens
uggccauguucucca

SEQ ID NO: 556230 - RNA, 18 nt, Homo sapiens
uggcccacauuuuccuua

SEQ ID NO: 556231 - RNA, 16 nt, Homo sapiens
uggcccacgcacuucg

SEQ ID NO: 556232 - RNA, 20 nt, Homo sapiens
uggcccagcuccccaagaaa

SEQ ID NO: 556233 - RNA, 24 nt, Homo sapiens
uggccccuucacuucugaccacac

SEQ ID NO: 556234 - RNA, 20 nt, Homo sapiens
uggcccuauuuaaggcagau

SEQ ID NO: 556235 - RNA, 21 nt, Homo sapiens
uggcccucaaagcgagccguu

SEQ ID NO: 556236 - RNA, 19 nt, Homo sapiens
uggcccugcaaaaauauaa

SEQ ID NO: 556237 - RNA, 15 nt, Homo sapiens
uggcccugggggucu

SEQ ID NO: 556238 - RNA, 20 nt, Homo sapiens
uggcccugggggucugggcg

SEQ ID NO: 556239 - RNA, 14 nt, Homo sapiens
uggcccuuggaaua

SEQ ID NO: 556240 - RNA, 21 nt, Homo sapiens
uggccgaaaaggauaugcagu

SEQ ID NO: 556241 - RNA, 19 nt, Homo sapiens
uggccgggucccugagcuc

SEQ ID NO: 556242 - RNA, 22 nt, Homo sapiens
uggccgggugcgguggcucacg

SEQ ID NO: 556243 - RNA, 18 nt, Homo sapiens
uggccgucacgcuuucau

SEQ ID NO: 556244 - RNA, 23 nt, Homo sapiens
uggccgucccuaagcaugugucc

SEQ ID NO: 556245 - RNA, 22 nt, Homo sapiens
uggccuauccgcugccagccuu

SEQ ID NO: 556246 - RNA, 14 nt, Homo sapiens
uggccuccaaacac

SEQ ID NO: 556247 - RNA, 16 nt, Homo sapiens
uggccuccagccuuug

SEQ ID NO: 556248 - RNA, 23 nt, Homo sapiens
uggccucccaaagugcugggauu

SEQ ID NO: 556249 - RNA, 17 nt, Homo sapiens
uggccuccccugcugaa

SEQ ID NO: 556250 - RNA, 14 nt, Homo sapiens
uggccucucuagca

SEQ ID NO: 556251 - RNA, 14 nt, Homo sapiens
uggccucugcugaa

SEQ ID NO: 556252 - RNA, 23 nt, Homo sapiens
uggccucugcugaaugcagggaa

SEQ ID NO: 556253 - RNA, 13 nt, Homo sapiens
uggccucugugau

SEQ ID NO: 556254 - RNA, 15 nt, Homo sapiens
uggccugacugguug

SEQ ID NO: 556255 - RNA, 14 nt, Homo sapiens
uggccugccagaca

SEQ ID NO: 556256 - RNA, 15 nt, Homo sapiens
uggccuggaccauuc

SEQ ID NO: 556257 - RNA, 13 nt, Homo sapiens
uggccuggcacau

SEQ ID NO: 556258 - RNA, 22 nt, Homo sapiens
uggccugggaucuggcacacuc

SEQ ID NO: 556259 - RNA, 22 nt, Homo sapiens
uggccuggucccuguuuuccca

SEQ ID NO: 556260 - RNA, 16 nt, Homo sapiens
uggccugugccagcac

SEQ ID NO: 556261 - RNA, 16 nt, Homo sapiens
uggccugugucccaug

SEQ ID NO: 556262 - RNA, 18 nt, Homo sapiens
uggccuguuaugauucug

SEQ ID NO: 556263 - RNA, 21 nt, Homo sapiens
uggccuuaaaaggggcccaag

SEQ ID NO: 556264 - RNA, 19 nt, Homo sapiens
uggccuuaagaacuguguc

SEQ ID NO: 556265 - RNA, 18 nt, Homo sapiens
uggccuugaaacaguucc

SEQ ID NO: 556266 - RNA, 17 nt, Homo sapiens
uggccuugaaaccaccu

SEQ ID NO: 556267 - RNA, 17 nt, Homo sapiens
uggccuugugucacugg

SEQ ID NO: 556268 - RNA, 15 nt, Homo sapiens
uggccuuuaucucaa

SEQ ID NO: 556269 - RNA, 12 nt, Homo sapiens
uggccuuugaau

SEQ ID NO: 556270 - RNA, 18 nt, Homo sapiens
uggcgcauauuaagcacu

SEQ ID NO: 556271 - RNA, 21 nt, Homo sapiens
uggcgcgggaggcaccagcuc

SEQ ID NO: 556272 - RNA, 21 nt, Homo sapiens
uggcgcuuagagaggacaaua

SEQ ID NO: 556273 - RNA, 18 nt, Homo sapiens
uggcgcuuggaucugggg

SEQ ID NO: 556274 - RNA, 17 nt, Homo sapiens
uggcggacggcucugac

SEQ ID NO: 556275 - RNA, 23 nt, Homo sapiens
uggcggcuccauccguggcugca

SEQ ID NO: 556276 - RNA, 22 nt, Homo sapiens
uggcggcugugcaucaguggga

SEQ ID NO: 556277 - RNA, 15 nt, Homo sapiens
uggcgugagcugccc

SEQ ID NO: 556278 - RNA, 15 nt, Homo sapiens
uggcguuacugcuug

SEQ ID NO: 556279 - RNA, 22 nt, Homo sapiens
uggcuaacuauauuugcuuuuu

SEQ ID NO: 556280 - RNA, 14 nt, Homo sapiens
uggcuaauucccag

SEQ ID NO: 556281 - RNA, 19 nt, Homo sapiens
uggcuacacacaaaccagu

SEQ ID NO: 556282 - RNA, 17 nt, Homo sapiens
uggcuacugacuacccu

SEQ ID NO: 556283 - RNA, 13 nt, Homo sapiens
uggcuaguacugu

SEQ ID NO: 556284 - RNA, 16 nt, Homo sapiens
uggcuaguacuguauu

SEQ ID NO: 556285 - RNA, 21 nt, Homo sapiens
uggcuauaacaugucuuucag

SEQ ID NO: 556286 - RNA, 14 nt, Homo sapiens
uggcucacuacuga

SEQ ID NO: 556287 - RNA, 17 nt, Homo sapiens
uggcucagccagcacuu

SEQ ID NO: 556288 - RNA, 14 nt, Homo sapiens
uggcucagugccac

SEQ ID NO: 556289 - RNA, 18 nt, Homo sapiens
uggcucagugccaccuau

SEQ ID NO: 556290 - RNA, 15 nt, Homo sapiens
uggcucagugccuuc

SEQ ID NO: 556291 - RNA, 16 nt, Homo sapiens
uggcucagugccuucc

SEQ ID NO: 556292 - RNA, 16 nt, Homo sapiens
uggcucaugccuguaa

SEQ ID NO: 556293 - RNA, 21 nt, Homo sapiens
uggcucaugccuguaaucuca

SEQ ID NO: 556294 - RNA, 22 nt, Homo sapiens
uggcucaugccuguaaucucag

SEQ ID NO: 556295 - RNA, 20 nt, Homo sapiens
uggcuccaacacugcugcuc

SEQ ID NO: 556296 - RNA, 14 nt, Homo sapiens
uggcuccacuggga

SEQ ID NO: 556297 - RNA, 22 nt, Homo sapiens
uggcucccauucacucuuccag

SEQ ID NO: 556298 - RNA, 13 nt, Homo sapiens
uggcucccugugu

SEQ ID NO: 556299 - RNA, 13 nt, Homo sapiens
uggcuccuaucug

SEQ ID NO: 556300 - RNA, 23 nt, Homo sapiens
uggcuccuucacugaacaugccu

SEQ ID NO: 556301 - RNA, 13 nt, Homo sapiens
ugcuucuccauga

SEQ ID NO: 556302 - RNA, 16 nt, Homo sapiens
ugcuucuguguaguca

SEQ ID NO: 556303 - RNA, 19 nt, Homo sapiens
ugcuucuguguagucaaua

SEQ ID NO: 556304 - RNA, 22 nt, Homo sapiens
ugcuucuucuacuucagucuuc

SEQ ID NO: 556305 - RNA, 23 nt, Homo sapiens
ugcuugaaaugagaaacuuugau

SEQ ID NO: 556306 - RNA, 14 nt, Homo sapiens
ugcuugaauugcaa

SEQ ID NO: 556307 - RNA, 18 nt, Homo sapiens
ugcuugcccgcucccaca

SEQ ID NO: 556308 - RNA, 22 nt, Homo sapiens
ugcuugccucaguaaaaugaac

SEQ ID NO: 556309 - RNA, 13 nt, Homo sapiens
ugcuuggcacuua

SEQ ID NO: 556310 - RNA, 22 nt, Homo sapiens
ugcuuggcccacagucuggcuc

SEQ ID NO: 556311 - RNA, 18 nt, Homo sapiens
ugcuugguuaaaauggcu

SEQ ID NO: 556312 - RNA, 15 nt, Homo sapiens
ugcuuguaacaagaa

SEQ ID NO: 556313 - RNA, 19 nt, Homo sapiens
ugcuuguagaguuguacug

SEQ ID NO: 556314 - RNA, 15 nt, Homo sapiens
ugcuugucaucugca

SEQ ID NO: 556315 - RNA, 19 nt, Homo sapiens
ugcuugugccacacccucc

SEQ ID NO: 556316 - RNA, 12 nt, Homo sapiens
ugcuuguucccu

SEQ ID NO: 556317 - RNA, 18 nt, Homo sapiens
ugcuuguuuacagcacua

SEQ ID NO: 556318 - RNA, 19 nt, Homo sapiens
ugcuuuaaaaugucugugu

SEQ ID NO: 556319 - RNA, 19 nt, Homo sapiens
ugcuuuaaaguaccuguag

SEQ ID NO: 556320 - RNA, 22 nt, Homo sapiens
ugcuuuaaauggaaacagacuc

SEQ ID NO: 556321 - RNA, 15 nt, Homo sapiens
ugcuuuaacagucaa

SEQ ID NO: 556322 - RNA, 17 nt, Homo sapiens
ugcuuuaauaaaucacu

SEQ ID NO: 556323 - RNA, 16 nt, Homo sapiens
ugcuuuagaaguaaca

SEQ ID NO: 556324 - RNA, 18 nt, Homo sapiens
ugcuuuagcacaggacaa

SEQ ID NO: 556325 - RNA, 14 nt, Homo sapiens
ugcuuuauugaauu

SEQ ID NO: 556326 - RNA, 12 nt, Homo sapiens
ugcuuucaaguc

SEQ ID NO: 556327 - RNA, 22 nt, Homo sapiens
ugcuuucaagucugacucucca

SEQ ID NO: 556328 - RNA, 20 nt, Homo sapiens
ugcuuucacauuguacuuaa

SEQ ID NO: 556329 - RNA, 18 nt, Homo sapiens
ugcuuuccagacuuugaa

SEQ ID NO: 556330 - RNA, 20 nt, Homo sapiens
ugcuuucccauaucuugccu

SEQ ID NO: 556331 - RNA, 15 nt, Homo sapiens
ugcuuugacaaggca

SEQ ID NO: 556332 - RNA, 16 nt, Homo sapiens
ugcuuugccagagcag

SEQ ID NO: 556333 - RNA, 11 nt, Homo sapiens
ugcuuuggacu

SEQ ID NO: 556334 - RNA, 22 nt, Homo sapiens
ugcuuugggauuuaauuuccag

SEQ ID NO: 556335 - RNA, 18 nt, Homo sapiens
ugcuuuguaggugucuca

SEQ ID NO: 556336 - RNA, 17 nt, Homo sapiens
ugcuuuguaugcacuuu

SEQ ID NO: 556337 - RNA, 14 nt, Homo sapiens
ugcuuuuaaaugca

SEQ ID NO: 556338 - RNA, 15 nt, Homo sapiens
ugcuuuuaacucuag

SEQ ID NO: 556339 - RNA, 14 nt, Homo sapiens
ugcuuuucauguag

SEQ ID NO: 556340 - RNA, 16 nt, Homo sapiens
ugcuuuucauguagaa

SEQ ID NO: 556341 - RNA, 19 nt, Homo sapiens
ugcuuuucugccacuccau

SEQ ID NO: 556342 - RNA, 18 nt, Homo sapiens
ugcuuuugaaaaacaacu

SEQ ID NO: 556343 - RNA, 16 nt, Homo sapiens
ugcuuuugcuucuaga

SEQ ID NO: 556344 - RNA, 15 nt, Homo sapiens
ugcuuuuucagccau

SEQ ID NO: 556345 - RNA, 18 nt, Homo sapiens
ugcuuuuugcguacacag

SEQ ID NO: 556346 - RNA, 17 nt, Homo sapiens
ugcuuuuuuaaccaagg

SEQ ID NO: 556347 - RNA, 20 nt, Homo sapiens
uggaaaaaugccaucaaaug

SEQ ID NO: 556348 - RNA, 19 nt, Homo sapiens
uggaaaaccuccuuuacca

SEQ ID NO: 556349 - RNA, 16 nt, Homo sapiens
uggaaaacucaggauu

SEQ ID NO: 556350 - RNA, 14 nt, Homo sapiens
uggaaaacuguguu

SEQ ID NO: 556351 - RNA, 15 nt, Homo sapiens
uggaaaacuguguug

SEQ ID NO: 556352 - RNA, 19 nt, Homo sapiens
uggaaaagaacuguacugu

SEQ ID NO: 556353 - RNA, 19 nt, Homo sapiens
uggaaaagcaaaacuguag

SEQ ID NO: 556354 - RNA, 22 nt, Homo sapiens
uggaaaagcaacuucauuugac

SEQ ID NO: 556355 - RNA, 15 nt, Homo sapiens
uggagaguuugccug

SEQ ID NO: 556356 - RNA, 22 nt, Homo sapiens
uggagauggacaacucaaugaa

SEQ ID NO: 556357 - RNA, 22 nt, Homo sapiens
uggagcacauguuacugcuuca

SEQ ID NO: 556358 - RNA, 15 nt, Homo sapiens
uggagcaucaagcca

SEQ ID NO: 556359 - RNA, 17 nt, Homo sapiens
uggagcaugugugcaaa

SEQ ID NO: 556360 - RNA, 23 nt, Homo sapiens
uggagcccaggaguuugaggcug

SEQ ID NO: 556361 - RNA, 22 nt, Homo sapiens
uggagcccgcuucaagcucucu

SEQ ID NO: 556362 - RNA, 21 nt, Homo sapiens
uggagcccuaaccccuuccag

SEQ ID NO: 556363 - RNA, 14 nt, Homo sapiens
uggagccugccaag

SEQ ID NO: 556364 - RNA, 12 nt, Homo sapiens
uggagccuuuga

SEQ ID NO: 556365 - RNA, 16 nt, Homo sapiens
uggagcuacugaugaa

SEQ ID NO: 556366 - RNA, 16 nt, Homo sapiens
uggagcuggucugcca

SEQ ID NO: 556367 - RNA, 22 nt, Homo sapiens
uggaggaaaugguacugcccaa

SEQ ID NO: 556368 - RNA, 17 nt, Homo sapiens
uggaggaaguucuccag

SEQ ID NO: 556369 - RNA, 20 nt, Homo sapiens
uggaggacagagggagacag

SEQ ID NO: 556370 - RNA, 20 nt, Homo sapiens
uggaggaccagauugcucug

SEQ ID NO: 556371 - RNA, 10 nt, Homo sapiens
uggaggaccc

SEQ ID NO: 556372 - RNA, 18 nt, Homo sapiens
uggaggacggucagucca

SEQ ID NO: 556373 - RNA, 18 nt, Homo sapiens
uggaggagagaagaauga

SEQ ID NO: 556374 - RNA, 13 nt, Homo sapiens
uggaggcacuuua

SEQ ID NO: 556375 - RNA, 16 nt, Homo sapiens
uggaggcagcagcucc

SEQ ID NO: 556376 - RNA, 18 nt, Homo sapiens
uggaggccccaacccugu

SEQ ID NO: 556377 - RNA, 16 nt, Homo sapiens
uggaggccucuggccc

SEQ ID NO: 556378 - RNA, 16 nt, Homo sapiens
uggagggacaugacua

SEQ ID NO: 556379 - RNA, 14 nt, Homo sapiens
uggagggacuuuua

SEQ ID NO: 556380 - RNA, 14 nt, Homo sapiens
uggagggagcucca

SEQ ID NO: 556381 - RNA, 19 nt, Homo sapiens
uggagggcacuuccuccac

SEQ ID NO: 556382 - RNA, 22 nt, Homo sapiens
uggagggcagcuguggcuucua

SEQ ID NO: 556383 - RNA, 13 nt, Homo sapiens
uggaggggggagc

SEQ ID NO: 556384 - RNA, 17 nt, Homo sapiens
uggaggguaaaugaugu

SEQ ID NO: 556385 - RNA, 20 nt, Homo sapiens
uggaguauguuaaguugaag

SEQ ID NO: 556386 - RNA, 16 nt, Homo sapiens
uggaguauuggggucu

SEQ ID NO: 556387 - RNA, 13 nt, Homo sapiens
uggagucacugua

SEQ ID NO: 556388 - RNA, 14 nt, Homo sapiens
uggagucacuguag

SEQ ID NO: 556389 - RNA, 15 nt, Homo sapiens
uggagugcagugcca

SEQ ID NO: 556390 - RNA, 18 nt, Homo sapiens
uggagugcaguggcauga

SEQ ID NO: 556391 - RNA, 13 nt, Homo sapiens
uggagugucacau

SEQ ID NO: 556392 - RNA, 17 nt, Homo sapiens
uggagugucacaucucu

SEQ ID NO: 556393 - RNA, 19 nt, Homo sapiens
uggagugugucagagccca

SEQ ID NO: 556394 - RNA, 23 nt, Homo sapiens
uggaguuucucucuuguugucca

SEQ ID NO: 556395 - RNA, 15 nt, Homo sapiens
uggaguuucucuguu

SEQ ID NO: 556396 - RNA, 13 nt, Homo sapiens
uggaguuugacac

SEQ ID NO: 556397 - RNA, 15 nt, Homo sapiens
uggauaaaaugaggu

SEQ ID NO: 556398 - RNA, 15 nt, Homo sapiens
uggauaaauugcaca

SEQ ID NO: 556399 - RNA, 19 nt, Homo sapiens
uggauaagugcuaccuuaa

SEQ ID NO: 556400 - RNA, 18 nt, Homo sapiens
uggauaauuccccaagag

SEQ ID NO: 556401 - RNA, 22 nt, Homo sapiens
uggauacagcugcuuugagcua

SEQ ID NO: 556402 - RNA, 22 nt, Homo sapiens
uggauaggcacauagagaggga

SEQ ID NO: 556403 - RNA, 14 nt, Homo sapiens
uggauagucugucc

SEQ ID NO: 556404 - RNA, 21 nt, Homo sapiens
uggauaugacccacacugcca

SEQ ID NO: 556405 - RNA, 22 nt, Homo sapiens
uggauauguccagucauccugc

SEQ ID NO: 556406 - RNA, 16 nt, Homo sapiens
uggaucaauguaaugu

SEQ ID NO: 556407 - RNA, 18 nt, Homo sapiens
uggaucacagacacugca

SEQ ID NO: 556408 - RNA, 19 nt, Homo sapiens
uggaucacugauauuuuag

SEQ ID NO: 556409 - RNA, 21 nt, Homo sapiens
uggaucagggaauccagcucc

SEQ ID NO: 556410 - RNA, 19 nt, Homo sapiens
uggauccacaaggccugag

SEQ ID NO: 556411 - RNA, 15 nt, Homo sapiens
uggauccuagccuua

SEQ ID NO: 556412 - RNA, 21 nt, Homo sapiens
uggaucgaguguagcugugaa

SEQ ID NO: 556413 - RNA, 14 nt, Homo sapiens
uggaucuaccagca

SEQ ID NO: 556414 - RNA, 17 nt, Homo sapiens
uggaucugacccuccca

SEQ ID NO: 556415 - RNA, 23 nt, Homo sapiens
uggaucuggggugggaguaacag

SEQ ID NO: 556416 - RNA, 16 nt, Homo sapiens
uggaucuguccaagga

SEQ ID NO: 556417 - RNA, 18 nt, Homo sapiens
uggaugacuaacuaucaa

SEQ ID NO: 556418 - RNA, 19 nt, Homo sapiens
uggaugaggagacagaaua

SEQ ID NO: 556419 - RNA, 18 nt, Homo sapiens
uggaugcacacuucugac

SEQ ID NO: 556420 - RNA, 13 nt, Homo sapiens
uggaugcagcucu

SEQ ID NO: 556421 - RNA, 15 nt, Homo sapiens
uggaugcagcucuug

SEQ ID NO: 556422 - RNA, 17 nt, Homo sapiens
uggaugccaaccgguca

SEQ ID NO: 556423 - RNA, 11 nt, Homo sapiens
uggaugccuug

SEQ ID NO: 556424 - RNA, 19 nt, Homo sapiens
ugcucugcuggucuucaau

SEQ ID NO: 556425 - RNA, 19 nt, Homo sapiens
ugcucuggaagaccugaaa

SEQ ID NO: 556426 - RNA, 19 nt, Homo sapiens
ugcucuggagccugcagau

SEQ ID NO: 556427 - RNA, 20 nt, Homo sapiens
ugcucuggaggaaguucucc

SEQ ID NO: 556428 - RNA, 19 nt, Homo sapiens
ugcucugguuugagcaauu

SEQ ID NO: 556429 - RNA, 19 nt, Homo sapiens
ugcucuguccccaaaggac

SEQ ID NO: 556430 - RNA, 15 nt, Homo sapiens
ugcucuuaagccuaa

SEQ ID NO: 556431 - RNA, 15 nt, Homo sapiens
ugcucuuagcugucu

SEQ ID NO: 556432 - RNA, 19 nt, Homo sapiens
ugcucuugaucuguguuuc

SEQ ID NO: 556433 - RNA, 15 nt, Homo sapiens
ugcucuugcauucuc

SEQ ID NO: 556434 - RNA, 20 nt, Homo sapiens
ugcucuugggaagaccagcu

SEQ ID NO: 556435 - RNA, 15 nt, Homo sapiens
ugcucuuuugugaug

SEQ ID NO: 556436 - RNA, 18 nt, Homo sapiens
ugcugaaacucagugcaa

SEQ ID NO: 556437 - RNA, 12 nt, Homo sapiens
ugcugaaaucau

SEQ ID NO: 556438 - RNA, 21 nt, Homo sapiens
ugcugaaggacagaacauugc

SEQ ID NO: 556439 - RNA, 13 nt, Homo sapiens
ugcugaaugcagg

SEQ ID NO: 556440 - RNA, 15 nt, Homo sapiens
ugcugaaugucauuu

SEQ ID NO: 556441 - RNA, 20 nt, Homo sapiens
ugcugacaggugaugcucug

SEQ ID NO: 556442 - RNA, 23 nt, Homo sapiens
ugcugacaggugaugcucuggcu

SEQ ID NO: 556443 - RNA, 22 nt, Homo sapiens
ugcugacugggucagccuuccg

SEQ ID NO: 556444 - RNA, 18 nt, Homo sapiens
ugcugagccuccuugucu

SEQ ID NO: 556445 - RNA, 13 nt, Homo sapiens
ugcugagcuguga

SEQ ID NO: 556446 - RNA, 15 nt, Homo sapiens
ugcugaggccucgag

SEQ ID NO: 556447 - RNA, 18 nt, Homo sapiens
ugcugaggccucgagggg

SEQ ID NO: 556448 - RNA, 16 nt, Homo sapiens
ugcugagucagacugu

SEQ ID NO: 556449 - RNA, 23 nt, Homo sapiens
ugcugagugaaugaacaaaugaa

SEQ ID NO: 556450 - RNA, 15 nt, Homo sapiens
ugcugaucgugcuaa

SEQ ID NO: 556451 - RNA, 14 nt, Homo sapiens
ugcugcaaaccaca

SEQ ID NO: 556452 - RNA, 19 nt, Homo sapiens
ugcugcaaaggagaagcac

SEQ ID NO: 556453 - RNA, 21 nt, Homo sapiens
ugcugcagggacagcccugac

SEQ ID NO: 556454 - RNA, 13 nt, Homo sapiens
ugcugcaucuccc

SEQ ID NO: 556455 - RNA, 20 nt, Homo sapiens
ugcugccaaccauaccuucc

SEQ ID NO: 556456 - RNA, 17 nt, Homo sapiens
ugcugccagacacugag

SEQ ID NO: 556457 - RNA, 21 nt, Homo sapiens
ugcugccagccacuucauccc

SEQ ID NO: 556458 - RNA, 19 nt, Homo sapiens
ugcugccaguccucugcau

SEQ ID NO: 556459 - RNA, 21 nt, Homo sapiens
ugcugccauauuguagcucaa

SEQ ID NO: 556460 - RNA, 23 nt, Homo sapiens
ugcugccuuguuucaccuuccau

SEQ ID NO: 556461 - RNA, 22 nt, Homo sapiens
ugcugccuuuguugaggugcaa

SEQ ID NO: 556462 - RNA, 16 nt, Homo sapiens
ugcugcuacaaugucc

SEQ ID NO: 556463 - RNA, 13 nt, Homo sapiens
ugcugcuaugaaa

SEQ ID NO: 556464 - RNA, 16 nt, Homo sapiens
ugcugcuccagugcag

SEQ ID NO: 556465 - RNA, 18 nt, Homo sapiens
ugcugcucuaagcaccgu

SEQ ID NO: 556466 - RNA, 17 nt, Homo sapiens
ugcugcuggaaguagaa

SEQ ID NO: 556467 - RNA, 17 nt, Homo sapiens
ugcugcuggaucacagc

SEQ ID NO: 556468 - RNA, 16 nt, Homo sapiens
ugcugcuuccauuuga

SEQ ID NO: 556469 - RNA, 23 nt, Homo sapiens
ugcugcuucuccaagcuuucaga

SEQ ID NO: 556470 - RNA, 19 nt, Homo sapiens
ugcugcuugaggcaacuca

SEQ ID NO: 556471 - RNA, 17 nt, Homo sapiens
ugcugcuugaugaugag

SEQ ID NO: 556472 - RNA, 22 nt, Homo sapiens
ugcugcuugugccucccuuccc

SEQ ID NO: 556473 - RNA, 18 nt, Homo sapiens
ugcuggaaacacagucac

SEQ ID NO: 556474 - RNA, 16 nt, Homo sapiens
ugcuggaaaugcugac

SEQ ID NO: 556475 - RNA, 17 nt, Homo sapiens
ugcuggaacacugcuga

SEQ ID NO: 556476 - RNA, 19 nt, Homo sapiens
ugcuggaaccugcaaaaaa

SEQ ID NO: 556477 - RNA, 13 nt, Homo sapiens
ugcuggacuguca

SEQ ID NO: 556478 - RNA, 14 nt, Homo sapiens
ugcuggagacacuc

SEQ ID NO: 556479 - RNA, 19 nt, Homo sapiens
ugcuggagaggaacccaga

SEQ ID NO: 556480 - RNA, 14 nt, Homo sapiens
ugcuggcaguacug

SEQ ID NO: 556481 - RNA, 14 nt, Homo sapiens
ugcuggcucugaga

SEQ ID NO: 556482 - RNA, 18 nt, Homo sapiens
ugcugggaaccuagcaca

SEQ ID NO: 556483 - RNA, 15 nt, Homo sapiens
ugcugggacugagaa

SEQ ID NO: 556484 - RNA, 18 nt, Homo sapiens
ugcugggcugggcccucu

SEQ ID NO: 556485 - RNA, 21 nt, Homo sapiens
ugcuggggagacaaaucucag

SEQ ID NO: 556486 - RNA, 16 nt, Homo sapiens
ugcuggggccucagac

SEQ ID NO: 556487 - RNA, 19 nt, Homo sapiens
ugcuggguauaagcagaga

SEQ ID NO: 556488 - RNA, 13 nt, Homo sapiens
ugcuggucuucaa

SEQ ID NO: 556489 - RNA, 17 nt, Homo sapiens
ugcuggugaacacugug

SEQ ID NO: 556490 - RNA, 13 nt, Homo sapiens
ugcuggugcauca

SEQ ID NO: 556491 - RNA, 16 nt, Homo sapiens
ugcuguaaauacagga

SEQ ID NO: 556492 - RNA, 22 nt, Homo sapiens
ugcuguaacucagacauuccaa

SEQ ID NO: 556493 - RNA, 14 nt, Homo sapiens
ugcuguacaaaagc

SEQ ID NO: 556494 - RNA, 21 nt, Homo sapiens
ugcuguagaagauggcacuua

SEQ ID NO: 556495 - RNA, 14 nt, Homo sapiens
ugcuguauccacaa

SEQ ID NO: 556496 - RNA, 19 nt, Homo sapiens
ugcuguauccacaaaucau

SEQ ID NO: 556497 - RNA, 15 nt, Homo sapiens
ugcuguaugugagcu

SEQ ID NO: 556498 - RNA, 14 nt, Homo sapiens
ugcugucaaaacaa

SEQ ID NO: 556499 - RNA, 20 nt, Homo sapiens
ugcuguccugaucugugaua

SEQ ID NO: 556500 - RNA, 20 nt, Homo sapiens
ugcugucucaucacauaaaa

SEQ ID NO: 556501 - RNA, 20 nt, Homo sapiens
ugcugucuccaugcuggaua

SEQ ID NO: 556502 - RNA, 16 nt, Homo sapiens
ugcugugauaccuuag

SEQ ID NO: 556503 - RNA, 12 nt, Homo sapiens
ugcugugccuga

SEQ ID NO: 556504 - RNA, 22 nt, Homo sapiens
ugcugugcguggaaugcccuuc

SEQ ID NO: 556505 - RNA, 22 nt, Homo sapiens
ugcugugggugcagcugucaca

SEQ ID NO: 556506 - RNA, 23 nt, Homo sapiens
ugcugugucuccucucagaguga

SEQ ID NO: 556507 - RNA, 16 nt, Homo sapiens
ugcuguucagugcuuu

SEQ ID NO: 556508 - RNA, 13 nt, Homo sapiens
ugcuguucuuaca

SEQ ID NO: 556509 - RNA, 17 nt, Homo sapiens
ugcuguuggucaugugg

SEQ ID NO: 556510 - RNA, 14 nt, Homo sapiens
ugcuguuguucucg

SEQ ID NO: 556511 - RNA, 19 nt, Homo sapiens
ugcuguuuaaagucacauc

SEQ ID NO: 556512 - RNA, 21 nt, Homo sapiens
ugcuguuucacaauaccucau

SEQ ID NO: 556513 - RNA, 19 nt, Homo sapiens
ugcuguuuuguuauauaau

SEQ ID NO: 556514 - RNA, 21 nt, Homo sapiens
ugcuuaaaagguuaaauuuca

SEQ ID NO: 556515 - RNA, 22 nt, Homo sapiens
ugcuuaaaagguuaaauuucaa

SEQ ID NO: 556516 - RNA, 14 nt, Homo sapiens
ugcuuaaaauagca

SEQ ID NO: 556517 - RNA, 16 nt, Homo sapiens
ugcuuaaaauugugag

SEQ ID NO: 556518 - RNA, 16 nt, Homo sapiens
ugcuuaaacaaaguga

SEQ ID NO: 556519 - RNA, 18 nt, Homo sapiens
ugcuuaaugguagcaacu

SEQ ID NO: 556520 - RNA, 20 nt, Homo sapiens
ugcuuacaauucccugcugu

SEQ ID NO: 556521 - RNA, 12 nt, Homo sapiens
ugcuuacauuuu

SEQ ID NO: 556522 - RNA, 20 nt, Homo sapiens
ugcuuacuuuuuauauagca

SEQ ID NO: 556523 - RNA, 14 nt, Homo sapiens
ugcuuagaaauuca

SEQ ID NO: 556524 - RNA, 21 nt, Homo sapiens
ugcuuagagcauguucuugga

SEQ ID NO: 556525 - RNA, 19 nt, Homo sapiens
ugcuuagcccuucucugcu

SEQ ID NO: 556526 - RNA, 23 nt, Homo sapiens
ugcuuaguauucuugagggacaa

SEQ ID NO: 556527 - RNA, 17 nt, Homo sapiens
ugcuuagucccucaugc

SEQ ID NO: 556528 - RNA, 18 nt, Homo sapiens
ugcuuaguguacuuggag

SEQ ID NO: 556529 - RNA, 15 nt, Homo sapiens
ugcuuauucuugagc

SEQ ID NO: 556530 - RNA, 21 nt, Homo sapiens
ugcuucaacaacuuugugcuu

SEQ ID NO: 556531 - RNA, 22 nt, Homo sapiens
ugcuucacucaugcaaacugcu

SEQ ID NO: 556532 - RNA, 14 nt, Homo sapiens
ugcuucacuuuccu

SEQ ID NO: 556533 - RNA, 13 nt, Homo sapiens
ugcuucagaccau

SEQ ID NO: 556534 - RNA, 20 nt, Homo sapiens
ugcuucagaguuugugugua

SEQ ID NO: 556535 - RNA, 12 nt, Homo sapiens
ugcuucagccug

SEQ ID NO: 556536 - RNA, 16 nt, Homo sapiens
ugcuucaguugcauau

SEQ ID NO: 556537 - RNA, 14 nt, Homo sapiens
ugcuucaucauucc

SEQ ID NO: 556538 - RNA, 11 nt, Homo sapiens
ugcuucauuaa

SEQ ID NO: 556539 - RNA, 19 nt, Homo sapiens
ugcuucauuguacuaccug

SEQ ID NO: 556540 - RNA, 18 nt, Homo sapiens
ugcuuccucccaacaagc

SEQ ID NO: 556541 - RNA, 16 nt, Homo sapiens
ugcuuccugacaauca

SEQ ID NO: 556542 - RNA, 20 nt, Homo sapiens
ugcuuccugcuguaugugag

SEQ ID NO: 556543 - RNA, 20 nt, Homo sapiens
ugcuuccugucccacuacug

SEQ ID NO: 556544 - RNA, 15 nt, Homo sapiens
ugcuucuaauauuag

SEQ ID NO: 556545 - RNA, 18 nt, Homo sapiens
ugcuucuacaugaugcua

SEQ ID NO: 556546 - RNA, 15 nt, Homo sapiens
ugcuucuacuuucau

SEQ ID NO: 556547 - RNA, 18 nt, Homo sapiens
ugaccaaaggugugcccu

SEQ ID NO: 556548 - RNA, 19 nt, Homo sapiens
ugaccaaauaaaguaccau

SEQ ID NO: 556549 - RNA, 20 nt, Homo sapiens
ugaccaagagagaaagaagu

SEQ ID NO: 556550 - RNA, 20 nt, Homo sapiens
ugaccaagauacuuaagugc

SEQ ID NO: 556551 - RNA, 19 nt, Homo sapiens
ugaccaauauuguacaguu

SEQ ID NO: 556552 - RNA, 12 nt, Homo sapiens
ugaccacagcac

SEQ ID NO: 556553 - RNA, 15 nt, Homo sapiens
ugaccacagcacagc

SEQ ID NO: 556554 - RNA, 17 nt, Homo sapiens
ugaccacagcacagcca

SEQ ID NO: 556555 - RNA, 21 nt, Homo sapiens
ugaccaccgauuccagcugcg

SEQ ID NO: 556556 - RNA, 11 nt, Homo sapiens
ugaccaggaac

SEQ ID NO: 556557 - RNA, 22 nt, Homo sapiens
ugaccaggaucccaagccuccu

SEQ ID NO: 556558 - RNA, 22 nt, Homo sapiens
ugaccaggcauccuccacaaua

SEQ ID NO: 556559 - RNA, 14 nt, Homo sapiens
ugaccagugcaguu

SEQ ID NO: 556560 - RNA, 19 nt, Homo sapiens
ugaccaucccaacuuuggu

SEQ ID NO: 556561 - RNA, 23 nt, Homo sapiens
ugaccaucucuuaggucuaauga

SEQ ID NO: 556562 - RNA, 17 nt, Homo sapiens
ugaccaucugcuuuuau

SEQ ID NO: 556563 - RNA, 16 nt, Homo sapiens
ugaccauuauucacag

SEQ ID NO: 556564 - RNA, 12 nt, Homo sapiens
ugacccaaagac

SEQ ID NO: 556565 - RNA, 18 nt, Homo sapiens
ugacccaccccugugcuc

SEQ ID NO: 556566 - RNA, 21 nt, Homo sapiens
ugacccacccuagaucuuccc

SEQ ID NO: 556567 - RNA, 16 nt, Homo sapiens
ugacccagaacaggac

SEQ ID NO: 556568 - RNA, 23 nt, Homo sapiens
ugacccagaacaggacuccacac

SEQ ID NO: 556569 - RNA, 20 nt, Homo sapiens
ugaccccacuuaugcugcug

SEQ ID NO: 556570 - RNA, 14 nt, Homo sapiens
ugaccccaugucuc

SEQ ID NO: 556571 - RNA, 20 nt, Homo sapiens
ugacccccgcaaguuugcac

SEQ ID NO: 556572 - RNA, 20 nt, Homo sapiens
ugaccccuuccuccaggggu

SEQ ID NO: 556573 - RNA, 17 nt, Homo sapiens
ugacccucccagucuca

SEQ ID NO: 556574 - RNA, 12 nt, Homo sapiens
ugacccucucac

SEQ ID NO: 556575 - RNA, 16 nt, Homo sapiens
ugacccucucacuuug

SEQ ID NO: 556576 - RNA, 12 nt, Homo sapiens
ugacccugagaa

SEQ ID NO: 556577 - RNA, 15 nt, Homo sapiens
ugacccugaugaaaa

SEQ ID NO: 556578 - RNA, 18 nt, Homo sapiens
ugacccuugcugugaauu

SEQ ID NO: 556579 - RNA, 22 nt, Homo sapiens
ugacccuuuucaugauuuuaag

SEQ ID NO: 556580 - RNA, 15 nt, Homo sapiens
ugaccggaucuacac

SEQ ID NO: 556581 - RNA, 15 nt, Homo sapiens
ugaccuaccaggaca

SEQ ID NO: 556582 - RNA, 14 nt, Homo sapiens
ugaccuacccaaac

SEQ ID NO: 556583 - RNA, 15 nt, Homo sapiens
ugaccuaguuuucca

SEQ ID NO: 556584 - RNA, 14 nt, Homo sapiens
ugaccuauuuccag

SEQ ID NO: 556585 - RNA, 14 nt, Homo sapiens
ugaccucacuuuag

SEQ ID NO: 556586 - RNA, 21 nt, Homo sapiens
ugaccucagcugcacauuccu

SEQ ID NO: 556587 - RNA, 20 nt, Homo sapiens
ugaccucaggugaucugccc

SEQ ID NO: 556588 - RNA, 17 nt, Homo sapiens
ugaccuccaaccaggag

SEQ ID NO: 556589 - RNA, 17 nt, Homo sapiens
ugaccuccauuucccaa

SEQ ID NO: 556590 - RNA, 15 nt, Homo sapiens
ugaccucccagugac

SEQ ID NO: 556591 - RNA, 17 nt, Homo sapiens
ugaccuccgccauccac

SEQ ID NO: 556592 - RNA, 21 nt, Homo sapiens
ugaccucuauaaacuucagag

SEQ ID NO: 556593 - RNA, 23 nt, Homo sapiens
ugaccugaggagacaucuacaca

SEQ ID NO: 556594 - RNA, 22 nt, Homo sapiens
ugaccuggaaucagugaagcca

SEQ ID NO: 556595 - RNA, 17 nt, Homo sapiens
ugaccugugaccagcac

SEQ ID NO: 556596 - RNA, 23 nt, Homo sapiens
ugaccuguuauuaccauuagcau

SEQ ID NO: 556597 - RNA, 14 nt, Homo sapiens
ugaccuugaucaag

SEQ ID NO: 556598 - RNA, 21 nt, Homo sapiens
ugaaaccuuauuuuuucccaa

SEQ ID NO: 556599 - RNA, 16 nt, Homo sapiens
ugaaacguuuaugcuu

SEQ ID NO: 556600 - RNA, 14 nt, Homo sapiens
ugaaacuaacagau

SEQ ID NO: 556601 - RNA, 19 nt, Homo sapiens
ugaaacucauagacacuga

SEQ ID NO: 556602 - RNA, 15 nt, Homo sapiens
ugaaacuccgucuca

SEQ ID NO: 556603 - RNA, 18 nt, Homo sapiens
ugaaacuugugucauuga

SEQ ID NO: 556604 - RNA, 23 nt, Homo sapiens
ugaaagaaaaauaccaugucucu

SEQ ID NO: 556605 - RNA, 19 nt, Homo sapiens
ugaaagaacaauauagucu

SEQ ID NO: 556606 - RNA, 21 nt, Homo sapiens
ugaaagaacauggacuuguau

SEQ ID NO: 556607 - RNA, 17 nt, Homo sapiens
ugaaagaaccaaaagag

SEQ ID NO: 556608 - RNA, 14 nt, Homo sapiens
ugaaagaaccagag

SEQ ID NO: 556609 - RNA, 20 nt, Homo sapiens
ugaaagacaguccaagcccu

SEQ ID NO: 556610 - RNA, 17 nt, Homo sapiens
ugaaagagaaacacgua

SEQ ID NO: 556611 - RNA, 18 nt, Homo sapiens
ugaaagagucugggaccc

SEQ ID NO: 556612 - RNA, 18 nt, Homo sapiens
ugaaagaucucugucaca

SEQ ID NO: 556613 - RNA, 16 nt, Homo sapiens
ugaaagcaaguguuca

SEQ ID NO: 556614 - RNA, 10 nt, Homo sapiens
ugaaagcaga

SEQ ID NO: 556615 - RNA, 22 nt, Homo sapiens
ugaaagccaacaacucugccuu

SEQ ID NO: 556616 - RNA, 17 nt, Homo sapiens
ugaaaggacccugugag

SEQ ID NO: 556617 - RNA, 19 nt, Homo sapiens
ugaaaggagacauugcucu

SEQ ID NO: 556618 - RNA, 23 nt, Homo sapiens
ugaaaggagaugucuuggaacau

SEQ ID NO: 556619 - RNA, 13 nt, Homo sapiens
ugaaaggcuuuga

SEQ ID NO: 556620 - RNA, 14 nt, Homo sapiens
ugaaaggguuugau

SEQ ID NO: 556621 - RNA, 23 nt, Homo sapiens
ugaaagucacggcugcgcacugu

SEQ ID NO: 556622 - RNA, 13 nt, Homo sapiens
ugaaaguggacaa

SEQ ID NO: 556623 - RNA, 16 nt, Homo sapiens
ugaaaguggacaagga

SEQ ID NO: 556624 - RNA, 16 nt, Homo sapiens
ugaaaguugcuuuuau

SEQ ID NO: 556625 - RNA, 15 nt, Homo sapiens
ugaaauaaaagcaca

SEQ ID NO: 556626 - RNA, 18 nt, Homo sapiens
ugaaauaagaaagugcga

SEQ ID NO: 556627 - RNA, 19 nt, Homo sapiens
ugaaauaauguacaucugg

SEQ ID NO: 556628 - RNA, 14 nt, Homo sapiens
ugaaauaccaguga

SEQ ID NO: 556629 - RNA, 14 nt, Homo sapiens
ugaaauacugagau

SEQ ID NO: 556630 - RNA, 15 nt, Homo sapiens
ugaaauacugagaug

SEQ ID NO: 556631 - RNA, 20 nt, Homo sapiens
ugaaauauaguaaacacuug

SEQ ID NO: 556632 - RNA, 13 nt, Homo sapiens
ugaaauaucauca

SEQ ID NO: 556633 - RNA, 12 nt, Homo sapiens
ugaaauaugcau

SEQ ID NO: 556634 - RNA, 20 nt, Homo sapiens
ugaaauauuaaaaucacugu

SEQ ID NO: 556635 - RNA, 22 nt, Homo sapiens
ugaaaugaauguaaucuaauag

SEQ ID NO: 556636 - RNA, 16 nt, Homo sapiens
ugaaaugacauguucc

SEQ ID NO: 556637 - RNA, 16 nt, Homo sapiens
ugaaaugaccaagaca

SEQ ID NO: 556638 - RNA, 14 nt, Homo sapiens
ugaaaugauaugac

SEQ ID NO: 556639 - RNA, 14 nt, Homo sapiens
ugaaaugaugguaa

SEQ ID NO: 556640 - RNA, 21 nt, Homo sapiens
ugaaaugcacuguauugcucc

SEQ ID NO: 556641 - RNA, 12 nt, Homo sapiens
ugaaaugcauau

SEQ ID NO: 556642 - RNA, 16 nt, Homo sapiens
ugaaaugcaucagguc

SEQ ID NO: 556643 - RNA, 17 nt, Homo sapiens
ugaaaugcucaagaaug

SEQ ID NO: 556644 - RNA, 18 nt, Homo sapiens
ugaaaugcuggcauuugc

SEQ ID NO: 556645 - RNA, 11 nt, Homo sapiens
ugaaauggagu

SEQ ID NO: 556646 - RNA, 16 nt, Homo sapiens
ugaaauggauacuaca

SEQ ID NO: 556647 - RNA, 17 nt, Homo sapiens
ugaaauguaacaugaag

SEQ ID NO: 556648 - RNA, 17 nt, Homo sapiens
ugaaauguagaauugaa

SEQ ID NO: 556649 - RNA, 17 nt, Homo sapiens
ugaaaugugguuuuccu

SEQ ID NO: 556650 - RNA, 18 nt, Homo sapiens
ugaaauguuagucauugu

SEQ ID NO: 556651 - RNA, 18 nt, Homo sapiens
ugaaauguucaagucaug

SEQ ID NO: 556652 - RNA, 17 nt, Homo sapiens
ugaaauuaagaaggcaa

SEQ ID NO: 556653 - RNA, 20 nt, Homo sapiens
ugaaauuaauuugugaauuu

SEQ ID NO: 556654 - RNA, 16 nt, Homo sapiens
ugaaauuauacagaua

SEQ ID NO: 556655 - RNA, 20 nt, Homo sapiens
ugaaauuauguauguuuaca

SEQ ID NO: 556656 - RNA, 21 nt, Homo sapiens
ugaaauucacccccuuuccug

SEQ ID NO: 556657 - RNA, 16 nt, Homo sapiens
ugaaauugcuuugcug

SEQ ID NO: 556658 - RNA, 12 nt, Homo sapiens
ugaaauuuagua

SEQ ID NO: 556659 - RNA, 13 nt, Homo sapiens
ugaaauuuauuca

SEQ ID NO: 556660 - RNA, 19 nt, Homo sapiens
ugaaauuuguuauacuuca

SEQ ID NO: 556661 - RNA, 13 nt, Homo sapiens
ugaaauuuuaccg

SEQ ID NO: 556662 - RNA, 20 nt, Homo sapiens
ugaaauuuuagaaauauuca

SEQ ID NO: 556663 - RNA, 21 nt, Homo sapiens
ugaaauuuucuagacuuucug

SEQ ID NO: 556664 - RNA, 12 nt, Homo sapiens
ugaacaaacaau

SEQ ID NO: 556665 - RNA, 15 nt, Homo sapiens
ugaacaaauaugcuu

SEQ ID NO: 556666 - RNA, 14 nt, Homo sapiens
ugaacaacuccaaa

SEQ ID NO: 556667 - RNA, 12 nt, Homo sapiens
ugaacaagagcu

SEQ ID NO: 556668 - RNA, 13 nt, Homo sapiens
ugaacacacugug

SEQ ID NO: 556669 - RNA, 15 nt, Homo sapiens
ugaacacuagucugu

SEQ ID NO: 556670 - RNA, 23 nt, Homo sapiens
ugaacacucaguggcccauggca

SEQ ID NO: 556671 - RNA, 12 nt, Homo sapiens
ugaauacacuua

SEQ ID NO: 556672 - RNA, 21 nt, Homo sapiens
ugaauacagcauuuagcuugu

SEQ ID NO: 556673 - RNA, 21 nt, Homo sapiens
ugaauacauuaacggugcuaa

SEQ ID NO: 556674 - RNA, 21 nt, Homo sapiens
ugaauauaaauguuuuacuca

SEQ ID NO: 556675 - RNA, 13 nt, Homo sapiens
ugaauauucccaa

SEQ ID NO: 556676 - RNA, 16 nt, Homo sapiens
ugaauauuccuggacu

SEQ ID NO: 556677 - RNA, 13 nt, Homo sapiens
ugaauauuucaua

SEQ ID NO: 556678 - RNA, 18 nt, Homo sapiens
ugaaucaaaucucuucca

SEQ ID NO: 556679 - RNA, 14 nt, Homo sapiens
ugaaucaagcaaua

SEQ ID NO: 556680 - RNA, 23 nt, Homo sapiens
ugaaucacauuuuuuuaugcucu

SEQ ID NO: 556681 - RNA, 19 nt, Homo sapiens
ugaaucacuuaaaugucac

SEQ ID NO: 556682 - RNA, 20 nt, Homo sapiens
ugaaucagcugcugacuggc

SEQ ID NO: 556683 - RNA, 21 nt, Homo sapiens
ugaaucauuguauguggucau

SEQ ID NO: 556684 - RNA, 23 nt, Homo sapiens
ugaauccacccaaaucuauuguu

SEQ ID NO: 556685 - RNA, 22 nt, Homo sapiens
ugaaucccaucaggcuguuauu

SEQ ID NO: 556686 - RNA, 11 nt, Homo sapiens
ugaaucuacaa

SEQ ID NO: 556687 - RNA, 11 nt, Homo sapiens
ugaaucuggag

SEQ ID NO: 556688 - RNA, 17 nt, Homo sapiens
ugaaucuguaucuugcc

SEQ ID NO: 556689 - RNA, 20 nt, Homo sapiens
ugaaucugugccugcacuga

SEQ ID NO: 556690 - RNA, 12 nt, Homo sapiens
ugaaucuucacg

SEQ ID NO: 556691 - RNA, 13 nt, Homo sapiens
ugaaucuuucaua

SEQ ID NO: 556692 - RNA, 22 nt, Homo sapiens
ugaaugagaccuggaacaaauc

SEQ ID NO: 556693 - RNA, 23 nt, Homo sapiens
ugaaugagccaaaaugacuuuga

SEQ ID NO: 556694 - RNA, 13 nt, Homo sapiens
ugaaugaucuugu

SEQ ID NO: 556695 - RNA, 14 nt, Homo sapiens
ugaaugaugugaua

SEQ ID NO: 556696 - RNA, 19 nt, Homo sapiens
ugaaugcagaagcgcucca

SEQ ID NO: 556697 - RNA, 15 nt, Homo sapiens
ugaaugcagggaaug

SEQ ID NO: 556698 - RNA, 21 nt, Homo sapiens
ugaaugcagggaaugcaaucc

SEQ ID NO: 556699 - RNA, 19 nt, Homo sapiens
ugaaugccuaugguggauc

SEQ ID NO: 556700 - RNA, 19 nt, Homo sapiens
ugaaugccucaaugugacc

SEQ ID NO: 556701 - RNA, 22 nt, Homo sapiens
ugaaugcgugugcgugcaagca

SEQ ID NO: 556702 - RNA, 17 nt, Homo sapiens
ugaauggaaaacacaug

SEQ ID NO: 556703 - RNA, 21 nt, Homo sapiens
ugaauggacucaaacugccuu

SEQ ID NO: 556704 - RNA, 23 nt, Homo sapiens
ugaaugggagccagaauucacua

SEQ ID NO: 556705 - RNA, 18 nt, Homo sapiens
ugaauguaaacucggggg

SEQ ID NO: 556706 - RNA, 22 nt, Homo sapiens
ugaaugucauugaaaaacuaaa

SEQ ID NO: 556707 - RNA, 17 nt, Homo sapiens
ugaaugugguuacuucc

SEQ ID NO: 556708 - RNA, 21 nt, Homo sapiens
ugaauguuuguuucagugcca

SEQ ID NO: 556709 - RNA, 15 nt, Homo sapiens
ugaauuaagcccaau

SEQ ID NO: 556710 - RNA, 14 nt, Homo sapiens
ugaauuacagugaa

SEQ ID NO: 556711 - RNA, 18 nt, Homo sapiens
ugaauuagauuauuucug

SEQ ID NO: 556712 - RNA, 18 nt, Homo sapiens
ugaauuauauguucagau

SEQ ID NO: 556713 - RNA, 16 nt, Homo sapiens
ugaauuaugcuacuca

SEQ ID NO: 556714 - RNA, 18 nt, Homo sapiens
ugaauuauucugauucuu

SEQ ID NO: 556715 - RNA, 14 nt, Homo sapiens
ugaauucauguugg

SEQ ID NO: 556716 - RNA, 18 nt, Homo sapiens
ugaauucuggaaucacaa

SEQ ID NO: 556717 - RNA, 12 nt, Homo sapiens
ugaauucuggga

SEQ ID NO: 556718 - RNA, 13 nt, Homo sapiens
ugaauucugggaa

SEQ ID NO: 556719 - RNA, 17 nt, Homo sapiens
ugaauucugggaaucca

SEQ ID NO: 556720 - RNA, 22 nt, Homo sapiens
ugaauuguuaauucacagaaua

SEQ ID NO: 556721 - RNA, 14 nt, Homo sapiens
uccuugcugcauug

SEQ ID NO: 556722 - RNA, 15 nt, Homo sapiens
uccuuggccacagac

SEQ ID NO: 556723 - RNA, 15 nt, Homo sapiens
uccuuggcuuaccug

SEQ ID NO: 556724 - RNA, 17 nt, Homo sapiens
uccuuggggagcacuug

SEQ ID NO: 556725 - RNA, 18 nt, Homo sapiens
uccuuggggagcacuugu

SEQ ID NO: 556726 - RNA, 21 nt, Homo sapiens
uccuugguaccccuaaaaaga

SEQ ID NO: 556727 - RNA, 22 nt, Homo sapiens
uccuuguaauaccugauugauc

SEQ ID NO: 556728 - RNA, 23 nt, Homo sapiens
uccuuuaggucugguuguugcac

SEQ ID NO: 556729 - RNA, 20 nt, Homo sapiens
uccuuuaugaugacugcuua

SEQ ID NO: 556730 - RNA, 23 nt, Homo sapiens
uccuuucacccgcuccuacagcu

SEQ ID NO: 556731 - RNA, 15 nt, Homo sapiens
uccuuucacucugca

SEQ ID NO: 556732 - RNA, 19 nt, Homo sapiens
uccuuucuccaggaccaau

SEQ ID NO: 556733 - RNA, 21 nt, Homo sapiens
uccuuucugacugucccugcc

SEQ ID NO: 556734 - RNA, 20 nt, Homo sapiens
uccuuugaagaaaaagacac

SEQ ID NO: 556735 - RNA, 22 nt, Homo sapiens
uccuuuggccauuccaacagcu

SEQ ID NO: 556736 - RNA, 18 nt, Homo sapiens
uccuuuuaguauucuuag

SEQ ID NO: 556737 - RNA, 18 nt, Homo sapiens
uccuuuucacuuuauugc

SEQ ID NO: 556738 - RNA, 21 nt, Homo sapiens
uccuuuucaucuguuguucug

SEQ ID NO: 556739 - RNA, 17 nt, Homo sapiens
uccuuuuuaaaugacuu

SEQ ID NO: 556740 - RNA, 22 nt, Homo sapiens
uccuuuuuauuuuuuuguacag

SEQ ID NO: 556741 - RNA, 17 nt, Homo sapiens
uccuuuuucacuuugaa

SEQ ID NO: 556742 - RNA, 16 nt, Homo sapiens
uccuuuuugacacuga

SEQ ID NO: 556743 - RNA, 17 nt, Homo sapiens
uccuuuuugacacugaa

SEQ ID NO: 556744 - RNA, 18 nt, Homo sapiens
uccuuuuuugcaugugca

SEQ ID NO: 556745 - RNA, 17 nt, Homo sapiens
ucgaaaagaagguauuu

SEQ ID NO: 556746 - RNA, 18 nt, Homo sapiens
ucgaaaccugggauucag

SEQ ID NO: 556747 - RNA, 17 nt, Homo sapiens
ucgaaauacaagccauu

SEQ ID NO: 556748 - RNA, 15 nt, Homo sapiens
ucgaacaauucauau

SEQ ID NO: 556749 - RNA, 14 nt, Homo sapiens
ucgaagcuguuaau

SEQ ID NO: 556750 - RNA, 18 nt, Homo sapiens
ucgaaugaacaaagucca

SEQ ID NO: 556751 - RNA, 18 nt, Homo sapiens
ucgaauuuuucagaugau

SEQ ID NO: 556752 - RNA, 11 nt, Homo sapiens
ucgacugcuuu

SEQ ID NO: 556753 - RNA, 18 nt, Homo sapiens
ucgacugugaccuguggg

SEQ ID NO: 556754 - RNA, 13 nt, Homo sapiens
ucgagaagccagg

SEQ ID NO: 556755 - RNA, 14 nt, Homo sapiens
ucgagacacaguga

SEQ ID NO: 556756 - RNA, 13 nt, Homo sapiens
ucgagacauuccu

SEQ ID NO: 556757 - RNA, 16 nt, Homo sapiens
ucgagaccaaccugac

SEQ ID NO: 556758 - RNA, 19 nt, Homo sapiens
ucgagaucaucacuuccuu

SEQ ID NO: 556759 - RNA, 19 nt, Homo sapiens
ucgagcagaugaugccaac

SEQ ID NO: 556760 - RNA, 14 nt, Homo sapiens
ucgaggccugaagc

SEQ ID NO: 556761 - RNA, 19 nt, Homo sapiens
ucgauauuagaagcuauau

SEQ ID NO: 556762 - RNA, 19 nt, Homo sapiens
ucgauccuggauucacuca

SEQ ID NO: 556763 - RNA, 23 nt, Homo sapiens
ucgaugacugugaacugggcauu

SEQ ID NO: 556764 - RNA, 22 nt, Homo sapiens
ucgcaacaggaaggaaccagaa

SEQ ID NO: 556765 - RNA, 18 nt, Homo sapiens
ucgcaacccugccuguca

SEQ ID NO: 556766 - RNA, 14 nt, Homo sapiens
ucgcaggagucucu

SEQ ID NO: 556767 - RNA, 13 nt, Homo sapiens
ucgcaugacuguu

SEQ ID NO: 556768 - RNA, 17 nt, Homo sapiens
ucgcauuaagcacacac

SEQ ID NO: 556769 - RNA, 22 nt, Homo sapiens
ucgccagugccuggaacagugu

SEQ ID NO: 556770 - RNA, 20 nt, Homo sapiens
ucgccaugaucagacauaca

SEQ ID NO: 556771 - RNA, 15 nt, Homo sapiens
ucgccauuguucacc

SEQ ID NO: 556772 - RNA, 15 nt, Homo sapiens
ucgcccaacuccacc

SEQ ID NO: 556773 - RNA, 18 nt, Homo sapiens
ucgcccaggagacauccg

SEQ ID NO: 556774 - RNA, 21 nt, Homo sapiens
ucgcccaggcuggagugcagu

SEQ ID NO: 556775 - RNA, 21 nt, Homo sapiens
ucgccccaggcccucccugac

SEQ ID NO: 556776 - RNA, 18 nt, Homo sapiens
ucgccccaguggcacuga

SEQ ID NO: 556777 - RNA, 20 nt, Homo sapiens
ucgcccuccucccugucaua

SEQ ID NO: 556778 - RNA, 20 nt, Homo sapiens
ucgccggcuucaaguggcag

SEQ ID NO: 556779 - RNA, 21 nt, Homo sapiens
ucgcgauuaagagacagagaa

SEQ ID NO: 556780 - RNA, 15 nt, Homo sapiens
ucgcgcgacugagaa

SEQ ID NO: 556781 - RNA, 11 nt, Homo sapiens
ucgcuagucag

SEQ ID NO: 556782 - RNA, 23 nt, Homo sapiens
ucgcuauugauuuuuacuucaau

SEQ ID NO: 556783 - RNA, 22 nt, Homo sapiens
ucgcucagcaauagggugcagu

SEQ ID NO: 556784 - RNA, 13 nt, Homo sapiens
ucgcuccuccuuc

SEQ ID NO: 556785 - RNA, 17 nt, Homo sapiens
ucgcucgaugacuguga

SEQ ID NO: 556786 - RNA, 15 nt, Homo sapiens
ucgcugccagaugau

SEQ ID NO: 556787 - RNA, 17 nt, Homo sapiens
ucgcuggggauggaauu

SEQ ID NO: 556788 - RNA, 19 nt, Homo sapiens
uccugaggggcaucugccc

SEQ ID NO: 556789 - RNA, 15 nt, Homo sapiens
uccugaguuagauuu

SEQ ID NO: 556790 - RNA, 14 nt, Homo sapiens
uccugauaaacauu

SEQ ID NO: 556791 - RNA, 23 nt, Homo sapiens
uccugauaaacauuaaacacugu

SEQ ID NO: 556792 - RNA, 22 nt, Homo sapiens
uccugaucccagacccauuccu

SEQ ID NO: 556793 - RNA, 20 nt, Homo sapiens
uccugauccugacacauucu

SEQ ID NO: 556794 - RNA, 14 nt, Homo sapiens
uccugaucugugau

SEQ ID NO: 556795 - RNA, 21 nt, Homo sapiens
uccugaugaggagaaaggggc

SEQ ID NO: 556796 - RNA, 18 nt, Homo sapiens
uccugaugcuuuugucua

SEQ ID NO: 556797 - RNA, 18 nt, Homo sapiens
uccugauggaacuaagga

SEQ ID NO: 556798 - RNA, 17 nt, Homo sapiens
uccugauggcacucugu

SEQ ID NO: 556799 - RNA, 23 nt, Homo sapiens
uccugauuccuuuaaaugaauau

SEQ ID NO: 556800 - RNA, 15 nt, Homo sapiens
uccugcaaaccucac

SEQ ID NO: 556801 - RNA, 21 nt, Homo sapiens
uccugcagccuccuccugacc

SEQ ID NO: 556802 - RNA, 19 nt, Homo sapiens
uccugcauccucacugugg

SEQ ID NO: 556803 - RNA, 17 nt, Homo sapiens
uccugcauguucuguga

SEQ ID NO: 556804 - RNA, 16 nt, Homo sapiens
uccugccaccaagaug

SEQ ID NO: 556805 - RNA, 20 nt, Homo sapiens
uccugccaccagcauccaca

SEQ ID NO: 556806 - RNA, 14 nt, Homo sapiens
uccugccaggguga

SEQ ID NO: 556807 - RNA, 17 nt, Homo sapiens
uccugccauagucuuaa

SEQ ID NO: 556808 - RNA, 15 nt, Homo sapiens
uccugcccaagcacu

SEQ ID NO: 556809 - RNA, 16 nt, Homo sapiens
uccugccccaugcugc

SEQ ID NO: 556810 - RNA, 19 nt, Homo sapiens
uccugcccuccaucucagc

SEQ ID NO: 556811 - RNA, 11 nt, Homo sapiens
uccugcccuug

SEQ ID NO: 556812 - RNA, 19 nt, Homo sapiens
uccugccugcggaccagau

SEQ ID NO: 556813 - RNA, 18 nt, Homo sapiens
uccugccuguagcaguga

SEQ ID NO: 556814 - RNA, 19 nt, Homo sapiens
uccugcgcauggugcagug

SEQ ID NO: 556815 - RNA, 15 nt, Homo sapiens
uccugcggcaucaga

SEQ ID NO: 556816 - RNA, 14 nt, Homo sapiens
uccugcggcucagc

SEQ ID NO: 556817 - RNA, 16 nt, Homo sapiens
uccugcuagcuguaga

SEQ ID NO: 556818 - RNA, 17 nt, Homo sapiens
uccugcuauuacuaagg

SEQ ID NO: 556819 - RNA, 13 nt, Homo sapiens
uccugcucaggaa

SEQ ID NO: 556820 - RNA, 21 nt, Homo sapiens
uccugcugggcgugugugaca

SEQ ID NO: 556821 - RNA, 15 nt, Homo sapiens
uccugcuucugauau

SEQ ID NO: 556822 - RNA, 16 nt, Homo sapiens
uccuggaaacagcaug

SEQ ID NO: 556823 - RNA, 21 nt, Homo sapiens
uccuggaaggacacagugaug

SEQ ID NO: 556824 - RNA, 19 nt, Homo sapiens
uccuggaagggaccugguu

SEQ ID NO: 556825 - RNA, 15 nt, Homo sapiens
uccuggacucagggu

SEQ ID NO: 556826 - RNA, 13 nt, Homo sapiens
uccuggagugaua

SEQ ID NO: 556827 - RNA, 23 nt, Homo sapiens
uccuggcaaucaauacagcuuca

SEQ ID NO: 556828 - RNA, 13 nt, Homo sapiens
uccuggcacuaac

SEQ ID NO: 556829 - RNA, 21 nt, Homo sapiens
uccuggcagcccagagacuuu

SEQ ID NO: 556830 - RNA, 15 nt, Homo sapiens
uccuggcagcccugu

SEQ ID NO: 556831 - RNA, 16 nt, Homo sapiens
uccuggcaugacacuc

SEQ ID NO: 556832 - RNA, 17 nt, Homo sapiens
uccuggcaugacacucu

SEQ ID NO: 556833 - RNA, 19 nt, Homo sapiens
uccuggccaacauggugaa

SEQ ID NO: 556834 - RNA, 19 nt, Homo sapiens
uccuggcccugaaggugcc

SEQ ID NO: 556835 - RNA, 22 nt, Homo sapiens
uccuggcccugaaggugccacu

SEQ ID NO: 556836 - RNA, 22 nt, Homo sapiens
uccuggcccuggaaggugccac

SEQ ID NO: 556837 - RNA, 13 nt, Homo sapiens
uccuggccucaca

SEQ ID NO: 556838 - RNA, 20 nt, Homo sapiens
uccuggccuucugaacucca

SEQ ID NO: 556839 - RNA, 15 nt, Homo sapiens
uccuggcgacaucuu

SEQ ID NO: 556840 - RNA, 14 nt, Homo sapiens
uccugggaacacau

SEQ ID NO: 556841 - RNA, 20 nt, Homo sapiens
uccugggagcccccaccaca

SEQ ID NO: 556842 - RNA, 13 nt, Homo sapiens
uccugggcccucu

SEQ ID NO: 556843 - RNA, 22 nt, Homo sapiens
uccugggcucaagcaauccucc

SEQ ID NO: 556844 - RNA, 22 nt, Homo sapiens
uccuggguacugaaagccuuag

SEQ ID NO: 556845 - RNA, 14 nt, Homo sapiens
uccuggucugugaa

SEQ ID NO: 556846 - RNA, 17 nt, Homo sapiens
uccugguuccuuccuau

SEQ ID NO: 556847 - RNA, 19 nt, Homo sapiens
uccuguacaaucaugaaca

SEQ ID NO: 556848 - RNA, 19 nt, Homo sapiens
uccuguacauugugggaug

SEQ ID NO: 556849 - RNA, 16 nt, Homo sapiens
uccuguacauuucaca

SEQ ID NO: 556850 - RNA, 21 nt, Homo sapiens
uccuguacuuuuuccagacac

SEQ ID NO: 556851 - RNA, 20 nt, Homo sapiens
uccuguauaagcacugaaaa

SEQ ID NO: 556852 - RNA, 18 nt, Homo sapiens
uccuguauaccuccucca

SEQ ID NO: 556853 - RNA, 16 nt, Homo sapiens
uccuguauauuccaug

SEQ ID NO: 556854 - RNA, 22 nt, Homo sapiens
uccuguauauuccauguauaag

SEQ ID NO: 556855 - RNA, 19 nt, Homo sapiens
uccuguauucuacagcaga

SEQ ID NO: 556856 - RNA, 17 nt, Homo sapiens
uccuguauuuaacaaaa

SEQ ID NO: 556857 - RNA, 22 nt, Homo sapiens
uccugucaauggggguguagua

SEQ ID NO: 556858 - RNA, 16 nt, Homo sapiens
ucccuguguucugggc

SEQ ID NO: 556859 - RNA, 23 nt, Homo sapiens
ucccuguguugucccaucugccc

SEQ ID NO: 556860 - RNA, 23 nt, Homo sapiens
ucccuguucacggugacacaggu

SEQ ID NO: 556861 - RNA, 22 nt, Homo sapiens
ucccuuaauauugaggcugcag

SEQ ID NO: 556862 - RNA, 20 nt, Homo sapiens
ucccuuaggcauuauuuaau

SEQ ID NO: 556863 - RNA, 13 nt, Homo sapiens
ucccuucaaugcu

SEQ ID NO: 556864 - RNA, 13 nt, Homo sapiens
ucccuucauuuaa

SEQ ID NO: 556865 - RNA, 15 nt, Homo sapiens
ucccuuccagcaaua

SEQ ID NO: 556866 - RNA, 13 nt, Homo sapiens
ucccuuccuauuc

SEQ ID NO: 556867 - RNA, 15 nt, Homo sapiens
ucccuuccuuucucc

SEQ ID NO: 556868 - RNA, 17 nt, Homo sapiens
ucccuucuuugcugcug

SEQ ID NO: 556869 - RNA, 12 nt, Homo sapiens
ucccuugagggc

SEQ ID NO: 556870 - RNA, 15 nt, Homo sapiens
ucccuugcagggguc

SEQ ID NO: 556871 - RNA, 14 nt, Homo sapiens
ucccuugcuguaug

SEQ ID NO: 556872 - RNA, 22 nt, Homo sapiens
ucccuugcuuuucccucuuuuc

SEQ ID NO: 556873 - RNA, 22 nt, Homo sapiens
ucccuuggaauaaaaacauuuc

SEQ ID NO: 556874 - RNA, 14 nt, Homo sapiens
ucccuuggcacacu

SEQ ID NO: 556875 - RNA, 16 nt, Homo sapiens
ucccuuggguucugau

SEQ ID NO: 556876 - RNA, 14 nt, Homo sapiens
ucccuuguuuacuc

SEQ ID NO: 556877 - RNA, 17 nt, Homo sapiens
ucccuuuaucaguuuga

SEQ ID NO: 556878 - RNA, 15 nt, Homo sapiens
ucccuuucacuaaaa

SEQ ID NO: 556879 - RNA, 22 nt, Homo sapiens
ucccuuuccagauauucaaguc

SEQ ID NO: 556880 - RNA, 13 nt, Homo sapiens
ucccuuucuuccc

SEQ ID NO: 556881 - RNA, 13 nt, Homo sapiens
ucccuuugccagu

SEQ ID NO: 556882 - RNA, 17 nt, Homo sapiens
ucccuuuguugcacacu

SEQ ID NO: 556883 - RNA, 20 nt, Homo sapiens
ucccuuuuacauacugcugu

SEQ ID NO: 556884 - RNA, 23 nt, Homo sapiens
ucccuuuuaguuugaucagacag

SEQ ID NO: 556885 - RNA, 23 nt, Homo sapiens
uccgaaaaauccucuuccucuga

SEQ ID NO: 556886 - RNA, 22 nt, Homo sapiens
uccgaaggugucucuggucuuc

SEQ ID NO: 556887 - RNA, 22 nt, Homo sapiens
uccgacaaccgaugcuccagcc

SEQ ID NO: 556888 - RNA, 15 nt, Homo sapiens
uccgaggccaguacc

SEQ ID NO: 556889 - RNA, 17 nt, Homo sapiens
uccgaggccgugcagug

SEQ ID NO: 556890 - RNA, 18 nt, Homo sapiens
uccgagugugauuugaau

SEQ ID NO: 556891 - RNA, 23 nt, Homo sapiens
uccgaucaguggugucugugaag

SEQ ID NO: 556892 - RNA, 23 nt, Homo sapiens
uccgcaauguggagcagcagcca

SEQ ID NO: 556893 - RNA, 15 nt, Homo sapiens
uccgcaccagcugcu

SEQ ID NO: 556894 - RNA, 11 nt, Homo sapiens
uccgcacuuuc

SEQ ID NO: 556895 - RNA, 22 nt, Homo sapiens
uccgcaggcagacuacacagga

SEQ ID NO: 556896 - RNA, 13 nt, Homo sapiens
uccgccauuccaa

SEQ ID NO: 556897 - RNA, 20 nt, Homo sapiens
uccgcccccggauuugcuca

SEQ ID NO: 556898 - RNA, 14 nt, Homo sapiens
uccgcgcaggugcc

SEQ ID NO: 556899 - RNA, 18 nt, Homo sapiens
uccgcgggcugacugggc

SEQ ID NO: 556900 - RNA, 19 nt, Homo sapiens
uccgcgggcugacugggcc

SEQ ID NO: 556901 - RNA, 21 nt, Homo sapiens
uccgcuuucucuugcugccac

SEQ ID NO: 556902 - RNA, 20 nt, Homo sapiens
uccggauuucuaacaguccu

SEQ ID NO: 556903 - RNA, 23 nt, Homo sapiens
uccggcccccgucuuguaaaaag

SEQ ID NO: 556904 - RNA, 22 nt, Homo sapiens
uccggcugaaggcugagugucc

SEQ ID NO: 556905 - RNA, 13 nt, Homo sapiens
cuacaguucugug

SEQ ID NO: 556906 - RNA, 17 nt, Homo sapiens
uuccuacccuuccucac

SEQ ID NO: 556907 - RNA, 16 nt, Homo sapiens
uuccuagaaugcagcu

SEQ ID NO: 556908 - RNA, 22 nt, Homo sapiens
uuccuagaggugugcuauacca

SEQ ID NO: 556909 - RNA, 21 nt, Homo sapiens
uuccuagggaugugugagaau

SEQ ID NO: 556910 - RNA, 21 nt, Homo sapiens
uuccucaccaggagcccggcu

SEQ ID NO: 556911 - RNA, 13 nt, Homo sapiens
uuccucacugccu

SEQ ID NO: 556912 - RNA, 18 nt, Homo sapiens
uuccucauuagcauuuug

SEQ ID NO: 556913 - RNA, 13 nt, Homo sapiens
uuccuccauaaau

SEQ ID NO: 556914 - RNA, 15 nt, Homo sapiens
uuccuccauugcaca

SEQ ID NO: 556915 - RNA, 15 nt, Homo sapiens
uuccucccaacaagc

SEQ ID NO: 556916 - RNA, 20 nt, Homo sapiens
uuccuccucaggcacacagc

SEQ ID NO: 556917 - RNA, 14 nt, Homo sapiens
uuccuccugcagac

SEQ ID NO: 556918 - RNA, 18 nt, Homo sapiens
uuccucgccugacaacca

SEQ ID NO: 556919 - RNA, 19 nt, Homo sapiens
uuccucggugggccagagc

SEQ ID NO: 556920 - RNA, 17 nt, Homo sapiens
uuccucuaacucacugc

SEQ ID NO: 556921 - RNA, 19 nt, Homo sapiens
uuccucuaacucacugccu

SEQ ID NO: 556922 - RNA, 17 nt, Homo sapiens
uuccucuagaagccaag

SEQ ID NO: 556923 - RNA, 12 nt, Homo sapiens
uuccucuaguag

SEQ ID NO: 556924 - RNA, 16 nt, Homo sapiens
uuccucuauacaucuc

SEQ ID NO: 556925 - RNA, 15 nt, Homo sapiens
uuccucuauugagca

SEQ ID NO: 556926 - RNA, 23 nt, Homo sapiens
uuccucucugaguggacuggccu

SEQ ID NO: 556927 - RNA, 16 nt, Homo sapiens
uuccucugccaggugc

SEQ ID NO: 556928 - RNA, 19 nt, Homo sapiens
uuccugaaaauugcaauac

SEQ ID NO: 556929 - RNA, 14 nt, Homo sapiens
uuccugaagccaga

SEQ ID NO: 556930 - RNA, 20 nt, Homo sapiens
uuccugaauguguucuuggu

SEQ ID NO: 556931 - RNA, 13 nt, Homo sapiens
uuccugaguaccu

SEQ ID NO: 556932 - RNA, 18 nt, Homo sapiens
uuccugaucacuaugcau

SEQ ID NO: 556933 - RNA, 21 nt, Homo sapiens
uuccugcaacucaaggacuuu

SEQ ID NO: 556934 - RNA, 18 nt, Homo sapiens
uuccugcaucucugugaa

SEQ ID NO: 556935 - RNA, 14 nt, Homo sapiens
uuccugcauguucu

SEQ ID NO: 556936 - RNA, 20 nt, Homo sapiens
uuccugcauuucucuucuca

SEQ ID NO: 556937 - RNA, 22 nt, Homo sapiens
uuccugccacuguguacugugg

SEQ ID NO: 556938 - RNA, 12 nt, Homo sapiens
uuccugcccuac

SEQ ID NO: 556939 - RNA, 22 nt, Homo sapiens
uuccugccugcggaccagauga

SEQ ID NO: 556940 - RNA, 21 nt, Homo sapiens
uuccugcgcgucaucucugac

SEQ ID NO: 556941 - RNA, 22 nt, Homo sapiens
uuccugcgcgucaucucugaca

SEQ ID NO: 556942 - RNA, 22 nt, Homo sapiens
uuccugcuggccccuucugggg

SEQ ID NO: 556943 - RNA, 16 nt, Homo sapiens
uuccugcuuccgagau

SEQ ID NO: 556944 - RNA, 15 nt, Homo sapiens
uuccuggaaacagca

SEQ ID NO: 556945 - RNA, 19 nt, Homo sapiens
uuccuggaguacaaacaca

SEQ ID NO: 556946 - RNA, 15 nt, Homo sapiens
uuccuggcaauagug

SEQ ID NO: 556947 - RNA, 20 nt, Homo sapiens
uuccuggcccacucuguaau

SEQ ID NO: 556948 - RNA, 21 nt, Homo sapiens
uuccugguggauacuguagaa

SEQ ID NO: 556949 - RNA, 19 nt, Homo sapiens
uuuuaaaguacugguguca

SEQ ID NO: 556950 - RNA, 20 nt, Homo sapiens
uuuuaaauguauacuauagu

SEQ ID NO: 556951 - RNA, 15 nt, Homo sapiens
uuuuaacaauuccca

SEQ ID NO: 556952 - RNA, 13 nt, Homo sapiens
uuuuaacauucca

SEQ ID NO: 556953 - RNA, 21 nt, Homo sapiens
uuuuaaccuuccaagacugaa

SEQ ID NO: 556954 - RNA, 17 nt, Homo sapiens
uuuuaacucaccucuca

SEQ ID NO: 556955 - RNA, 17 nt, Homo sapiens
uuuuaacugacguagaa

SEQ ID NO: 556956 - RNA, 15 nt, Homo sapiens
uuuuaacugccaaga

SEQ ID NO: 556957 - RNA, 13 nt, Homo sapiens
uuuuaacuuucua

SEQ ID NO: 556958 - RNA, 15 nt, Homo sapiens
uuuuaagcugcaaau

SEQ ID NO: 556959 - RNA, 15 nt, Homo sapiens
uuuuaagugccuuua

SEQ ID NO: 556960 - RNA, 17 nt, Homo sapiens
uuuuaaguugucugucu

SEQ ID NO: 556961 - RNA, 21 nt, Homo sapiens
uuuuaauaacuuaucuauaaa

SEQ ID NO: 556962 - RNA, 13 nt, Homo sapiens
uuuuaaugaucuc

SEQ ID NO: 556963 - RNA, 13 nt, Homo sapiens
uuuuaaugcuguu

SEQ ID NO: 556964 - RNA, 12 nt, Homo sapiens
uuuuaauugauu

SEQ ID NO: 556965 - RNA, 19 nt, Homo sapiens
uuuuaauuuauuucaucca

SEQ ID NO: 556966 - RNA, 17 nt, Homo sapiens
uuuuacagugcuauuua

SEQ ID NO: 556967 - RNA, 22 nt, Homo sapiens
uuuuaccaaagcaucaauacaa

SEQ ID NO: 556968 - RNA, 17 nt, Homo sapiens
uuuuacccacacacaga

SEQ ID NO: 556969 - RNA, 15 nt, Homo sapiens
uuuuacccacaugac

SEQ ID NO: 556970 - RNA, 20 nt, Homo sapiens
uuuuacccuauacauccaca

SEQ ID NO: 556971 - RNA, 16 nt, Homo sapiens
uuuuacucugccuaca

SEQ ID NO: 556972 - RNA, 17 nt, Homo sapiens
uuuuacucuuaugauca

SEQ ID NO: 556973 - RNA, 15 nt, Homo sapiens
uuuuacugugauuca

SEQ ID NO: 556974 - RNA, 11 nt, Homo sapiens
uuuuacuucca

SEQ ID NO: 556975 - RNA, 17 nt, Homo sapiens
uuuuacuucucuauaca

SEQ ID NO: 556976 - RNA, 15 nt, Homo sapiens
uuuuacuuugguuua

SEQ ID NO: 556977 - RNA, 19 nt, Homo sapiens
uuuuagaaaucacaacaaa

SEQ ID NO: 556978 - RNA, 19 nt, Homo sapiens
uuuuagaggaagaccaaaa

SEQ ID NO: 556979 - RNA, 20 nt, Homo sapiens
uuuuagaguugcaacuuaag

SEQ ID NO: 556980 - RNA, 22 nt, Homo sapiens
uuuuagauuauuccaagccuua

SEQ ID NO: 556981 - RNA, 12 nt, Homo sapiens
uuuuagcuguga

SEQ ID NO: 556982 - RNA, 14 nt, Homo sapiens
uuuuagcuuuacaa

SEQ ID NO: 556983 - RNA, 14 nt, Homo sapiens
uuuuagugugugca

SEQ ID NO: 556984 - RNA, 19 nt, Homo sapiens
uuuuaguucaauacaguga

SEQ ID NO: 556985 - RNA, 20 nt, Homo sapiens
uuuuaguucaauacagugaa

SEQ ID NO: 556986 - RNA, 16 nt, Homo sapiens
uuuuaguugacucaca

SEQ ID NO: 556987 - RNA, 16 nt, Homo sapiens
uuuuauaaaagccuug

SEQ ID NO: 556988 - RNA, 20 nt, Homo sapiens
uuuuauaaaauuaagcaaug

SEQ ID NO: 556989 - RNA, 20 nt, Homo sapiens
uuuuauacaaaccuaccaaa

SEQ ID NO: 556990 - RNA, 22 nt, Homo sapiens
uuuuauagcugcuuggauucuc

SEQ ID NO: 556991 - RNA, 12 nt, Homo sapiens
uuuuauauagca

SEQ ID NO: 556992 - RNA, 13 nt, Homo sapiens
uuuuauauagucu

SEQ ID NO: 556993 - RNA, 15 nt, Homo sapiens
uuuuauaugcaacuu

SEQ ID NO: 556994 - RNA, 12 nt, Homo sapiens
uuuuauauguca

SEQ ID NO: 556995 - RNA, 20 nt, Homo sapiens
uuuuaucuucuuagcucauc

SEQ ID NO: 556996 - RNA, 20 nt, Homo sapiens
uuuuaugcagacagucuguu

SEQ ID NO: 556997 - RNA, 12 nt, Homo sapiens
uuuuaugcauug

SEQ ID NO: 556998 - RNA, 21 nt, Homo sapiens
uuuuaugccuucacuuuacaa

SEQ ID NO: 556999 - RNA, 19 nt, Homo sapiens
uuuuauggcuuuugugcau

SEQ ID NO: 557000 - RNA, 23 nt, Homo sapiens
uuuuauguguggcccaagacaau

SEQ ID NO: 557001 - RNA, 13 nt, Homo sapiens
uuuuauguucuug

SEQ ID NO: 557002 - RNA, 15 nt, Homo sapiens
uuuuauguucuuggc

SEQ ID NO: 557003 - RNA, 18 nt, Homo sapiens
uuuuauuaauuuauaugu

SEQ ID NO: 557004 - RNA, 14 nt, Homo sapiens
uuuuauucuauauu

SEQ ID NO: 557005 - RNA, 14 nt, Homo sapiens
uuuuauugccuuga

SEQ ID NO: 557006 - RNA, 12 nt, Homo sapiens
uuuuauugcucg

SEQ ID NO: 557007 - RNA, 14 nt, Homo sapiens
uuuuauuuaugaua

SEQ ID NO: 557008 - RNA, 16 nt, Homo sapiens
uuuucaaagauuuaaa

SEQ ID NO: 557009 - RNA, 17 nt, Homo sapiens
uuuucaaagcaguauag

SEQ ID NO: 557010 - RNA, 14 nt, Homo sapiens
uuuucaacauaacu

SEQ ID NO: 557011 - RNA, 20 nt, Homo sapiens
uuuucaaguuuacacuucau

SEQ ID NO: 557012 - RNA, 23 nt, Homo sapiens
uuuucaauguuagccacagugua

SEQ ID NO: 557013 - RNA, 16 nt, Homo sapiens
uuuucacauaugacaa

SEQ ID NO: 557014 - RNA, 13 nt, Homo sapiens
uuuucacaucucu

SEQ ID NO: 557015 - RNA, 23 nt, Homo sapiens
uuuucacucuaagucauguaugu

SEQ ID NO: 557016 - RNA, 17 nt, Homo sapiens
uuuucacuuuauugcua

SEQ ID NO: 557017 - RNA, 21 nt, Homo sapiens
uuuucagaaacucaucggaaa

SEQ ID NO: 557018 - RNA, 16 nt, Homo sapiens
uuuucaucccauuucc

SEQ ID NO: 557019 - RNA, 19 nt, Homo sapiens
uuuucaucccguaucacag

SEQ ID NO: 557020 - RNA, 11 nt, Homo sapiens
uuuucauucau

SEQ ID NO: 557021 - RNA, 23 nt, Homo sapiens
uuuucauugcccgaaaccagagc

SEQ ID NO: 557022 - RNA, 15 nt, Homo sapiens
uuuucauuuguaaaa

SEQ ID NO: 557023 - RNA, 22 nt, Homo sapiens
uuuuccacaagauucccagaga

SEQ ID NO: 557024 - RNA, 20 nt, Homo sapiens
uuuuccacggaaacagaacu

SEQ ID NO: 557025 - RNA, 14 nt, Homo sapiens
uuuucccauuucaa

SEQ ID NO: 557026 - RNA, 18 nt, Homo sapiens
uuuuccccaaaccauaaa

SEQ ID NO: 557027 - RNA, 19 nt, Homo sapiens
uuuucccucacuugcauca

SEQ ID NO: 557028 - RNA, 15 nt, Homo sapiens
uuuuccucuauugag

SEQ ID NO: 557029 - RNA, 20 nt, Homo sapiens
uuuucuaaaaaaagaaaaaa

SEQ ID NO: 557030 - RNA, 18 nt, Homo sapiens
uuuucuaaagccaggacu

SEQ ID NO: 557031 - RNA, 21 nt, Homo sapiens
uuuucuaagguucucauagga

SEQ ID NO: 557032 - RNA, 19 nt, Homo sapiens
uuuucuaaguguaaccuca

SEQ ID NO: 557033 - RNA, 18 nt, Homo sapiens
uuuucuaaugugcauuaa

SEQ ID NO: 557034 - RNA, 21 nt, Homo sapiens
uuuucuaccuauaacacucua

SEQ ID NO: 557035 - RNA, 22 nt, Homo sapiens
uuuucuaggccaaaaaugguga

SEQ ID NO: 557036 - RNA, 21 nt, Homo sapiens
uuuucuaggccuacaugcuuu

SEQ ID NO: 557037 - RNA, 20 nt, Homo sapiens
uuuucuauaaguuguaccaa

SEQ ID NO: 557038 - RNA, 16 nt, Homo sapiens
uuuucuauauggggau

SEQ ID NO: 557039 - RNA, 16 nt, Homo sapiens
uuuucuauauucucau

SEQ ID NO: 557040 - RNA, 14 nt, Homo sapiens
uuuucuauucuugg

SEQ ID NO: 557041 - RNA, 14 nt, Homo sapiens
uuuucucacaaaaa

SEQ ID NO: 557042 - RNA, 12 nt, Homo sapiens
uuuucucaguca

SEQ ID NO: 557043 - RNA, 22 nt, Homo sapiens
uuuucuccaacuuggucuuuca

SEQ ID NO: 557044 - RNA, 20 nt, Homo sapiens
uuuucuccacuuuguuggaa

SEQ ID NO: 557045 - RNA, 21 nt, Homo sapiens
uuuucuccugccugugcugug

SEQ ID NO: 557046 - RNA, 17 nt, Homo sapiens
uuuucucuaacuucuca

SEQ ID NO: 557047 - RNA, 15 nt, Homo sapiens
uuuucucugcauuua

SEQ ID NO: 557048 - RNA, 22 nt, Homo sapiens
uuuucucuggaaugguacaugu

SEQ ID NO: 557049 - RNA, 15 nt, Homo sapiens
uuuucucugugcuuc

SEQ ID NO: 557050 - RNA, 20 nt, Homo sapiens
uuuucucuuagaacauugua

SEQ ID NO: 557051 - RNA, 21 nt, Homo sapiens
uuuucugagcuuuucauggaa

SEQ ID NO: 557052 - RNA, 20 nt, Homo sapiens
uuuucuguaaauaaccuauu

SEQ ID NO: 557053 - RNA, 14 nt, Homo sapiens
uuuucugugccuga

SEQ ID NO: 557054 - RNA, 15 nt, Homo sapiens
uuuucuuaaccccua

SEQ ID NO: 557055 - RNA, 11 nt, Homo sapiens
uuuucuuacca

SEQ ID NO: 557056 - RNA, 22 nt, Homo sapiens
uuuucuuacuagaccuguaacu

SEQ ID NO: 557057 - RNA, 15 nt, Homo sapiens
uuuucuuacucugaa

SEQ ID NO: 557058 - RNA, 17 nt, Homo sapiens
uuuucuuauugcgcugc

SEQ ID NO: 557059 - RNA, 18 nt, Homo sapiens
uuuucuuauuuaacuuaa

SEQ ID NO: 557060 - RNA, 19 nt, Homo sapiens
uuuucuuauuuaacuuaac

SEQ ID NO: 557061 - RNA, 19 nt, Homo sapiens
uuuucuugccuugguuguc

SEQ ID NO: 557062 - RNA, 21 nt, Homo sapiens
uuuucuuguccucauucuugc

SEQ ID NO: 557063 - RNA, 15 nt, Homo sapiens
uuuucuuuaggacau

SEQ ID NO: 557064 - RNA, 11 nt, Homo sapiens
uuuucuuuauc

SEQ ID NO: 557065 - RNA, 17 nt, Homo sapiens
uuuucuuuuuuaucuug

SEQ ID NO: 557066 - RNA, 20 nt, Homo sapiens
uuuugaaaaagagaacagaa

SEQ ID NO: 557067 - RNA, 15 nt, Homo sapiens
uuuugaacagaacug

SEQ ID NO: 557068 - RNA, 15 nt, Homo sapiens
uuuugacacugguau

SEQ ID NO: 557069 - RNA, 16 nt, Homo sapiens
uuuugacuucagauug

SEQ ID NO: 557070 - RNA, 12 nt, Homo sapiens
uuuugagcacaa

SEQ ID NO: 557071 - RNA, 14 nt, Homo sapiens
uuuugauagcuuua

SEQ ID NO: 557072 - RNA, 11 nt, Homo sapiens
uuuugaugaaa

SEQ ID NO: 557073 - RNA, 17 nt, Homo sapiens
uuuauuaggauuaccca

SEQ ID NO: 557074 - RNA, 17 nt, Homo sapiens
uuuauuaugcaaccagu

SEQ ID NO: 557075 - RNA, 17 nt, Homo sapiens
uuuauuauuuucaccug

SEQ ID NO: 557076 - RNA, 21 nt, Homo sapiens
uuuauucccaaguaugccuua

SEQ ID NO: 557077 - RNA, 14 nt, Homo sapiens
uuuauuccuguaug

SEQ ID NO: 557078 - RNA, 21 nt, Homo sapiens
uuuauucuaugugcacacuua

SEQ ID NO: 557079 - RNA, 12 nt, Homo sapiens
uuuauucuuggu

SEQ ID NO: 557080 - RNA, 20 nt, Homo sapiens
uuuauuggcugagauaugaa

SEQ ID NO: 557081 - RNA, 13 nt, Homo sapiens
uuuauuuacaaau

SEQ ID NO: 557082 - RNA, 15 nt, Homo sapiens
uuuauuucaauguaa

SEQ ID NO: 557083 - RNA, 15 nt, Homo sapiens
uuuauuucugaucua

SEQ ID NO: 557084 - RNA, 16 nt, Homo sapiens
uuuauuucugaucuau

SEQ ID NO: 557085 - RNA, 21 nt, Homo sapiens
uuuauuucuucccgcacaaau

SEQ ID NO: 557086 - RNA, 14 nt, Homo sapiens
uuuauuuuuaacuc

SEQ ID NO: 557087 - RNA, 16 nt, Homo sapiens
uuucaaaaaaucugac

SEQ ID NO: 557088 - RNA, 20 nt, Homo sapiens
uuucaaaacaagauguguca

SEQ ID NO: 557089 - RNA, 12 nt, Homo sapiens
uuucaaaacaca

SEQ ID NO: 557090 - RNA, 19 nt, Homo sapiens
uuucaaaauauacauucaa

SEQ ID NO: 557091 - RNA, 20 nt, Homo sapiens
uuucaaaauuaauagcuuuu

SEQ ID NO: 557092 - RNA, 16 nt, Homo sapiens
uuucaaaccagcuuca

SEQ ID NO: 557093 - RNA, 23 nt, Homo sapiens
uuucaaacugaguaaauuggaaa

SEQ ID NO: 557094 - RNA, 12 nt, Homo sapiens
uuucaaacuuua

SEQ ID NO: 557095 - RNA, 13 nt, Homo sapiens
uuucaaagagaug

SEQ ID NO: 557096 - RNA, 14 nt, Homo sapiens
uuucaaaugaucuu

SEQ ID NO: 557097 - RNA, 15 nt, Homo sapiens
uuucaaauuggcacu

SEQ ID NO: 557098 - RNA, 23 nt, Homo sapiens
uuucaagaccuucuccccauucu

SEQ ID NO: 557099 - RNA, 19 nt, Homo sapiens
uuucaagagugagcuauca

SEQ ID NO: 557100 - RNA, 18 nt, Homo sapiens
uuucaaggacuauuuuag

SEQ ID NO: 557101 - RNA, 12 nt, Homo sapiens
uuucaagucucu

SEQ ID NO: 557102 - RNA, 13 nt, Homo sapiens
uuucaaguucaau

SEQ ID NO: 557103 - RNA, 20 nt, Homo sapiens
uuucaauaacaaagcacaua

SEQ ID NO: 557104 - RNA, 15 nt, Homo sapiens
uuugcauguuuugua

SEQ ID NO: 557105 - RNA, 21 nt, Homo sapiens
uuugcauuccuuacuugcacu

SEQ ID NO: 557106 - RNA, 20 nt, Homo sapiens
uuugccaccagaaaccacaa

SEQ ID NO: 557107 - RNA, 22 nt, Homo sapiens
uuugccauauggaggacuguga

SEQ ID NO: 557108 - RNA, 17 nt, Homo sapiens
uuugccaugacauuuca

SEQ ID NO: 557109 - RNA, 23 nt, Homo sapiens
uuugccaugacauuucaucuggg

SEQ ID NO: 557110 - RNA, 22 nt, Homo sapiens
uuugcccugcccucucccaaaa

SEQ ID NO: 557111 - RNA, 23 nt, Homo sapiens
uuugccuuccuuucuccaggacc

SEQ ID NO: 557112 - RNA, 18 nt, Homo sapiens
uuugccuuucuucugccc

SEQ ID NO: 557113 - RNA, 18 nt, Homo sapiens
uuugcgcagcccuaccuu

SEQ ID NO: 557114 - RNA, 13 nt, Homo sapiens
uuugcguacuugu

SEQ ID NO: 557115 - RNA, 12 nt, Homo sapiens
uuugcuacaaau

SEQ ID NO: 557116 - RNA, 15 nt, Homo sapiens
uuugcuagcagaaau

SEQ ID NO: 557117 - RNA, 17 nt, Homo sapiens
uuugcuaucacacagug

SEQ ID NO: 557118 - RNA, 22 nt, Homo sapiens
uuugcucauugcuguaccacau

SEQ ID NO: 557119 - RNA, 22 nt, Homo sapiens
uuugcucggauacuugccaaaa

SEQ ID NO: 557120 - RNA, 18 nt, Homo sapiens
uuugcucuuuucaaugug

SEQ ID NO: 557121 - RNA, 17 nt, Homo sapiens
uuugcugaguuguucua

SEQ ID NO: 557122 - RNA, 17 nt, Homo sapiens
uuugcugaugcuuuuga

SEQ ID NO: 557123 - RNA, 17 nt, Homo sapiens
uuugcugcagucaucua

SEQ ID NO: 557124 - RNA, 16 nt, Homo sapiens
uuugcuguacucuugc

SEQ ID NO: 557125 - RNA, 18 nt, Homo sapiens
uuugcuguggaacuacau

SEQ ID NO: 557126 - RNA, 14 nt, Homo sapiens
uuugcuuucaggga

SEQ ID NO: 557127 - RNA, 19 nt, Homo sapiens
uuugcuuuuccuucagggu

SEQ ID NO: 557128 - RNA, 19 nt, Homo sapiens
uuuggaaaugguacuucau

SEQ ID NO: 557129 - RNA, 22 nt, Homo sapiens
uuuggaaucuucucuuugacaa

SEQ ID NO: 557130 - RNA, 18 nt, Homo sapiens
uuuggaauuaugucugcu

SEQ ID NO: 557131 - RNA, 19 nt, Homo sapiens
ucccugucuccagcugccu

SEQ ID NO: 557132 - RNA, 16 nt, Homo sapiens
ucccugucuccagggc

SEQ ID NO: 557133 - RNA, 18 nt, Homo sapiens
ucccuguguucugggcug

SEQ ID NO: 557134 - RNA, 18 nt, Homo sapiens
ucccuguguugucucuag

SEQ ID NO: 557135 - RNA, 16 nt, Homo sapiens
ucccuuaauuuaaguc

SEQ ID NO: 557136 - RNA, 18 nt, Homo sapiens
ucccuuacccuccuccag

SEQ ID NO: 557137 - RNA, 18 nt, Homo sapiens
ucccuuccaagcuguguu

SEQ ID NO: 557138 - RNA, 12 nt, Homo sapiens
ucccuuccgucc

SEQ ID NO: 557139 - RNA, 20 nt, Homo sapiens
ucccuucgaaagccucucag

SEQ ID NO: 557140 - RNA, 17 nt, Homo sapiens
ucccuucucccagucca

SEQ ID NO: 557141 - RNA, 18 nt, Homo sapiens
ucccuucuggacacugag

SEQ ID NO: 557142 - RNA, 12 nt, Homo sapiens
ucccuugaccau

SEQ ID NO: 557143 - RNA, 12 nt, Homo sapiens
ucccuugaggga

SEQ ID NO: 557144 - RNA, 19 nt, Homo sapiens
ucccuugccucaaugccag

SEQ ID NO: 557145 - RNA, 16 nt, Homo sapiens
ucccuugcuguaugcu

SEQ ID NO: 557146 - RNA, 23 nt, Homo sapiens
ucccuuggaaaucugccaugagc

SEQ ID NO: 557147 - RNA, 20 nt, Homo sapiens
ucccuuggaaccuuuguacg

SEQ ID NO: 557148 - RNA, 17 nt, Homo sapiens
ucccuuucucccaguga

SEQ ID NO: 557149 - RNA, 13 nt, Homo sapiens
ucccuuucuggga

SEQ ID NO: 557150 - RNA, 19 nt, Homo sapiens
ucccuuucuugagggaguu

SEQ ID NO: 557151 - RNA, 16 nt, Homo sapiens
ucccuuucuuggccag

SEQ ID NO: 557152 - RNA, 14 nt, Homo sapiens
ucccuuugauucuc

SEQ ID NO: 557153 - RNA, 16 nt, Homo sapiens
ucccuuuggagaugcu

SEQ ID NO: 557154 - RNA, 21 nt, Homo sapiens
ucccuuuguugcacacucacu

SEQ ID NO: 557155 - RNA, 22 nt, Homo sapiens
ucccuuuugcuagagcugacag

SEQ ID NO: 557156 - RNA, 17 nt, Homo sapiens
ucccuuuuuauauccca

SEQ ID NO: 557157 - RNA, 19 nt, Homo sapiens
ucccuuuuuuuacauuuca

SEQ ID NO: 557158 - RNA, 22 nt, Homo sapiens
uccgagaugacccaaucugccu

SEQ ID NO: 557159 - RNA, 13 nt, Homo sapiens
uccgagcauucca

SEQ ID NO: 557160 - RNA, 16 nt, Homo sapiens
uccgagcggcuacaaa

SEQ ID NO: 557161 - RNA, 17 nt, Homo sapiens
uccgaugaguaaaaagu

SEQ ID NO: 557162 - RNA, 18 nt, Homo sapiens
uccgauuccccuguagca

SEQ ID NO: 557163 - RNA, 17 nt, Homo sapiens
uccgcacuucagaauuc

SEQ ID NO: 557164 - RNA, 23 nt, Homo sapiens
uccgcagaagcccugaugugucc

SEQ ID NO: 557165 - RNA, 20 nt, Homo sapiens
uccgcaguuccugucccuuc

SEQ ID NO: 557166 - RNA, 15 nt, Homo sapiens
uccgccagaccucaa

SEQ ID NO: 557167 - RNA, 14 nt, Homo sapiens
uccgccagauccug

SEQ ID NO: 557168 - RNA, 16 nt, Homo sapiens
uccgccagauccugca

SEQ ID NO: 557169 - RNA, 20 nt, Homo sapiens
uccgccauuccaagucaaca

SEQ ID NO: 557170 - RNA, 13 nt, Homo sapiens
uccgccuaccuca

SEQ ID NO: 557171 - RNA, 17 nt, Homo sapiens
uccgcgcaggugccaac

SEQ ID NO: 557172 - RNA, 19 nt, Homo sapiens
uccgcggccugcaccgacc

SEQ ID NO: 557173 - RNA, 14 nt, Homo sapiens
uccggcggggaccc

SEQ ID NO: 557174 - RNA, 20 nt, Homo sapiens
uccgggcaggggagccaggg

SEQ ID NO: 557175 - RNA, 14 nt, Homo sapiens
uccggggugcaaug

SEQ ID NO: 557176 - RNA, 22 nt, Homo sapiens
uccggggugggugggugggcag

SEQ ID NO: 557177 - RNA, 20 nt, Homo sapiens
uccgguccccugccuggaac

SEQ ID NO: 557178 - RNA, 18 nt, Homo sapiens
uccguccaggagccugug

SEQ ID NO: 557179 - RNA, 12 nt, Homo sapiens
uccguccauccc

SEQ ID NO: 557180 - RNA, 19 nt, Homo sapiens
uccgucccccaaacauguu

SEQ ID NO: 557181 - RNA, 14 nt, Homo sapiens
uccgucucuguccu

SEQ ID NO: 557182 - RNA, 22 nt, Homo sapiens
uccgugcugacagcugcuccua

SEQ ID NO: 557183 - RNA, 20 nt, Homo sapiens
uccgugguuugaacacgaaa

SEQ ID NO: 557184 - RNA, 23 nt, Homo sapiens
uccguguuuguuuaguacuuuua

SEQ ID NO: 557185 - RNA, 20 nt, Homo sapiens
uccguucacaugugugguac

SEQ ID NO: 557186 - RNA, 13 nt, Homo sapiens
uccuaaaaucaca

SEQ ID NO: 557187 - RNA, 14 nt, Homo sapiens
uccuaaacauaauu

SEQ ID NO: 557188 - RNA, 15 nt, Homo sapiens
uccuaaacccaauga

SEQ ID NO: 557189 - RNA, 20 nt, Homo sapiens
uccuaaacucucuagcuuaa

SEQ ID NO: 557190 - RNA, 12 nt, Homo sapiens
uccuaaagccaa

SEQ ID NO: 557191 - RNA, 16 nt, Homo sapiens
uccuaaaguaacauca

SEQ ID NO: 557192 - RNA, 15 nt, Homo sapiens
uccuaaaguacugga

SEQ ID NO: 557193 - RNA, 23 nt, Homo sapiens
uccuaacaggaugaaaguucccc

SEQ ID NO: 557194 - RNA, 21 nt, Homo sapiens
uccuaacugaaagaugaucau

SEQ ID NO: 557195 - RNA, 12 nt, Homo sapiens
uccuaagcaaaa

SEQ ID NO: 557196 - RNA, 13 nt, Homo sapiens
uccuaagcacuuu

SEQ ID NO: 557197 - RNA, 18 nt, Homo sapiens
uccuaaguauauuaauau

SEQ ID NO: 557198 - RNA, 19 nt, Homo sapiens
uccuaagucucuuacaaaa

SEQ ID NO: 557199 - RNA, 16 nt, Homo sapiens
uccuaauaauauccca

SEQ ID NO: 557200 - RNA, 13 nt, Homo sapiens
uccuaauacuguc

SEQ ID NO: 557201 - RNA, 14 nt, Homo sapiens
uccuaauacuguca

SEQ ID NO: 557202 - RNA, 22 nt, Homo sapiens
uccuaauaugcuuuacaaucug

SEQ ID NO: 557203 - RNA, 15 nt, Homo sapiens
uccuaaucaaaaagg

SEQ ID NO: 557204 - RNA, 12 nt, Homo sapiens
uccuacacuuga

SEQ ID NO: 557205 - RNA, 18 nt, Homo sapiens
uccuacaguacaaucagc

SEQ ID NO: 557206 - RNA, 14 nt, Homo sapiens
uccuaccuccaaag

SEQ ID NO: 557207 - RNA, 21 nt, Homo sapiens
uccuaccuggggacuccucaa

SEQ ID NO: 557208 - RNA, 16 nt, Homo sapiens
uccuacguauccugca

SEQ ID NO: 557209 - RNA, 16 nt, Homo sapiens
uccuacuaaaucccuc

SEQ ID NO: 557210 - RNA, 19 nt, Homo sapiens
uccuacuuauaaaguagaa

SEQ ID NO: 557211 - RNA, 19 nt, Homo sapiens
uccuacuucucuuguaaaa

SEQ ID NO: 557212 - RNA, 15 nt, Homo sapiens
uccuacuuuacauau

SEQ ID NO: 557213 - RNA, 16 nt, Homo sapiens
uccuagaaugcagcug

SEQ ID NO: 557214 - RNA, 20 nt, Homo sapiens
uccuagacuugaaaguuuuc

SEQ ID NO: 557215 - RNA, 21 nt, Homo sapiens
uccuagagucuuaaagcauuu

SEQ ID NO: 557216 - RNA, 16 nt, Homo sapiens
uccuagcaaguaagaa

SEQ ID NO: 557217 - RNA, 23 nt, Homo sapiens
uccuagguauuuacccaagagaa

SEQ ID NO: 557218 - RNA, 20 nt, Homo sapiens
uccuaguaauaaagugaaau

SEQ ID NO: 557219 - RNA, 22 nt, Homo sapiens
uccuaguuguucagcauggcau

SEQ ID NO: 557220 - RNA, 15 nt, Homo sapiens
uccuauaaucuguca

SEQ ID NO: 557221 - RNA, 16 nt, Homo sapiens
uccuauaaucugucaa

SEQ ID NO: 557222 - RNA, 14 nt, Homo sapiens
uccuauauccugug

SEQ ID NO: 557223 - RNA, 18 nt, Homo sapiens
uccuaucaccuauuucca

SEQ ID NO: 557224 - RNA, 12 nt, Homo sapiens
uccuauccugua

SEQ ID NO: 557225 - RNA, 21 nt, Homo sapiens
uccuauccuuggagagcagcu

SEQ ID NO: 557226 - RNA, 21 nt, Homo sapiens
uccuaugcgcucaugagcguc

SEQ ID NO: 557227 - RNA, 20 nt, Homo sapiens
uccuauggguugucaccaag

SEQ ID NO: 557228 - RNA, 15 nt, Homo sapiens
uccuauguaacugca

SEQ ID NO: 557229 - RNA, 14 nt, Homo sapiens
uccuauuuaucaua

SEQ ID NO: 557230 - RNA, 20 nt, Homo sapiens
uccuauuucuccaaagccuu

SEQ ID NO: 557231 - RNA, 18 nt, Homo sapiens
uccuauuuuucaauggga

SEQ ID NO: 557232 - RNA, 18 nt, Homo sapiens
uccucaaaucagucuucc

SEQ ID NO: 557233 - RNA, 21 nt, Homo sapiens
uccucaaaucagucuuccuug

SEQ ID NO: 557234 - RNA, 15 nt, Homo sapiens
uccucaaguacucaa

SEQ ID NO: 557235 - RNA, 20 nt, Homo sapiens
uccuguccaaccuaaccccu

SEQ ID NO: 557236 - RNA, 16 nt, Homo sapiens
uccuguccguguuugu

SEQ ID NO: 557237 - RNA, 17 nt, Homo sapiens
uccuguccuaucacucu

SEQ ID NO: 557238 - RNA, 20 nt, Homo sapiens
uccuguccuuuuaacaccuu

SEQ ID NO: 557239 - RNA, 14 nt, Homo sapiens
uccugucuccuuug

SEQ ID NO: 557240 - RNA, 14 nt, Homo sapiens
uccugugaauuucu

SEQ ID NO: 557241 - RNA, 10 nt, Homo sapiens
uccugugacg

SEQ ID NO: 557242 - RNA, 21 nt, Homo sapiens
uccugugacgcacagcacucc

SEQ ID NO: 557243 - RNA, 13 nt, Homo sapiens
uccugugacuguc

SEQ ID NO: 557244 - RNA, 13 nt, Homo sapiens
uccugugauccac

SEQ ID NO: 557245 - RNA, 16 nt, Homo sapiens
uccugugccaaccuga

SEQ ID NO: 557246 - RNA, 16 nt, Homo sapiens
uccugugccagaggaa

SEQ ID NO: 557247 - RNA, 19 nt, Homo sapiens
uccugugcccucaccccaa

SEQ ID NO: 557248 - RNA, 23 nt, Homo sapiens
uccuguggguguucuuuccugcc

SEQ ID NO: 557249 - RNA, 21 nt, Homo sapiens
uccuguguggccugccuucac

SEQ ID NO: 557250 - RNA, 21 nt, Homo sapiens
uccuguguuaucugugguuuu

SEQ ID NO: 557251 - RNA, 17 nt, Homo sapiens
uccuguucacaccagag

SEQ ID NO: 557252 - RNA, 19 nt, Homo sapiens
uccuguucacaccagagaa

SEQ ID NO: 557253 - RNA, 20 nt, Homo sapiens
uccuguucgguuccagacac

SEQ ID NO: 557254 - RNA, 15 nt, Homo sapiens
uccuguuugucuaca

SEQ ID NO: 557255 - RNA, 20 nt, Homo sapiens
uccuguuuguugagugcacu

SEQ ID NO: 557256 - RNA, 23 nt, Homo sapiens
uccuuaaagcauuugcaacagcu

SEQ ID NO: 557257 - RNA, 20 nt, Homo sapiens
uccuuaaauaugugaaagga

SEQ ID NO: 557258 - RNA, 15 nt, Homo sapiens
uccuuaacuucaggg

SEQ ID NO: 557259 - RNA, 14 nt, Homo sapiens
uccuuaagcaucug

SEQ ID NO: 557260 - RNA, 23 nt, Homo sapiens
uccuuaauaacaacagaucugca

SEQ ID NO: 557261 - RNA, 23 nt, Homo sapiens
uccuuaauagccauaugcaauaa

SEQ ID NO: 557262 - RNA, 20 nt, Homo sapiens
uccuuacgcuuugucacaca

SEQ ID NO: 557263 - RNA, 15 nt, Homo sapiens
uccuuacuuuacugc

SEQ ID NO: 557264 - RNA, 16 nt, Homo sapiens
uccuuagacucuuuuc

SEQ ID NO: 557265 - RNA, 20 nt, Homo sapiens
uccuuagcuuagaccucagc

SEQ ID NO: 557266 - RNA, 17 nt, Homo sapiens
uccuuaguuggcuggaa

SEQ ID NO: 557267 - RNA, 17 nt, Homo sapiens
uccuuaucaaaggacac

SEQ ID NO: 557268 - RNA, 18 nt, Homo sapiens
uccuuauugggacuuuuc

SEQ ID NO: 557269 - RNA, 15 nt, Homo sapiens
uccuucaagaacucu

SEQ ID NO: 557270 - RNA, 18 nt, Homo sapiens
uccuucaagccuagcccu

SEQ ID NO: 557271 - RNA, 17 nt, Homo sapiens
uccuucaccucacugaa

SEQ ID NO: 557272 - RNA, 14 nt, Homo sapiens
uccuuccaccucag

SEQ ID NO: 557273 - RNA, 15 nt, Homo sapiens
uccuuccaccucagu

SEQ ID NO: 557274 - RNA, 18 nt, Homo sapiens
uccuuccagaccuuauca

SEQ ID NO: 557275 - RNA, 16 nt, Homo sapiens
uccuuccagcacugac

SEQ ID NO: 557276 - RNA, 16 nt, Homo sapiens
uccuucccccaucccc

SEQ ID NO: 557277 - RNA, 15 nt, Homo sapiens
uccuucccugggaag

SEQ ID NO: 557278 - RNA, 12 nt, Homo sapiens
uccuuccugacc

SEQ ID NO: 557279 - RNA, 14 nt, Homo sapiens
uccuuccuucaggg

SEQ ID NO: 557280 - RNA, 19 nt, Homo sapiens
uccuucgaaaggccuucag

SEQ ID NO: 557281 - RNA, 13 nt, Homo sapiens
uccuucgcacacu

SEQ ID NO: 557282 - RNA, 22 nt, Homo sapiens
uccuucuaagaggauacaaauu

SEQ ID NO: 557283 - RNA, 18 nt, Homo sapiens
uccuucuacagaaccuga

SEQ ID NO: 557284 - RNA, 14 nt, Homo sapiens
uccuucucugaaag

SEQ ID NO: 557285 - RNA, 13 nt, Homo sapiens
uccuucugagcuc

SEQ ID NO: 557286 - RNA, 18 nt, Homo sapiens
uccuucuggugucugcuu

SEQ ID NO: 557287 - RNA, 17 nt, Homo sapiens
uccuucuugacauuuau

SEQ ID NO: 557288 - RNA, 21 nt, Homo sapiens
uccuucuuguaguagucucau

SEQ ID NO: 557289 - RNA, 17 nt, Homo sapiens
uccuugaaaguaggaua

SEQ ID NO: 557290 - RNA, 23 nt, Homo sapiens
uccuugagaagugggagcacccu

SEQ ID NO: 557291 - RNA, 17 nt, Homo sapiens
uccuugcaaccaggcag

SEQ ID NO: 557292 - RNA, 11 nt, Homo sapiens
uccuugcagac

SEQ ID NO: 557293 - RNA, 20 nt, Homo sapiens
uccuugccuaaggugucuga

SEQ ID NO: 557294 - RNA, 19 nt, Homo sapiens
uccuugccugaacuccaga

SEQ ID NO: 557295 - RNA, 15 nt, Homo sapiens
uccuugccugugacu

SEQ ID NO: 557296 - RNA, 14 nt, Homo sapiens
uccuuggaacacau

SEQ ID NO: 557297 - RNA, 22 nt, Homo sapiens
uccuuggaccguaucacugguc

SEQ ID NO: 557298 - RNA, 21 nt, Homo sapiens
uccuuggcgcugccaccugcc

SEQ ID NO: 557299 - RNA, 20 nt, Homo sapiens
uccuuggcuuaccugaccuc

SEQ ID NO: 557300 - RNA, 15 nt, Homo sapiens
uccuuggcuugccug

SEQ ID NO: 557301 - RNA, 20 nt, Homo sapiens
uccuuguauuuaaauauuaa

SEQ ID NO: 557302 - RNA, 17 nt, Homo sapiens
uccuugucuauccuucc

SEQ ID NO: 557303 - RNA, 19 nt, Homo sapiens
uccuugugaagaugauaua

SEQ ID NO: 557304 - RNA, 21 nt, Homo sapiens
uccuugugccuucuuuguaua

SEQ ID NO: 557305 - RNA, 15 nt, Homo sapiens
uccuuuaaucacugc

SEQ ID NO: 557306 - RNA, 14 nt, Homo sapiens
uccuuuaccagaug

SEQ ID NO: 557307 - RNA, 19 nt, Homo sapiens
uccuuuaccccucauccaa

SEQ ID NO: 557308 - RNA, 20 nt, Homo sapiens
uccuuuaccuuucagugcag

SEQ ID NO: 557309 - RNA, 16 nt, Homo sapiens
uccuuuauccacuuuu

SEQ ID NO: 557310 - RNA, 15 nt, Homo sapiens
uccuuucacaaccuu

SEQ ID NO: 557311 - RNA, 23 nt, Homo sapiens
uccuuuccaagcuccucgugaua

SEQ ID NO: 557312 - RNA, 21 nt, Homo sapiens
uccuuuccugaucacuaugca

SEQ ID NO: 557313 - RNA, 16 nt, Homo sapiens
uccuuucuuccuccaa

SEQ ID NO: 557314 - RNA, 20 nt, Homo sapiens
uccuuucuucguacauaguc

SEQ ID NO: 557315 - RNA, 13 nt, Homo sapiens
uccuuucuugcag

SEQ ID NO: 557316 - RNA, 16 nt, Homo sapiens
uccuuugccugauccu

SEQ ID NO: 557317 - RNA, 19 nt, Homo sapiens
uccuuugcucccuguugcu

SEQ ID NO: 557318 - RNA, 16 nt, Homo sapiens
uccuuuggccauucca

SEQ ID NO: 557319 - RNA, 17 nt, Homo sapiens
uccuuugguccuucaaa

SEQ ID NO: 557320 - RNA, 16 nt, Homo sapiens
uccuuuuaagcaguga

SEQ ID NO: 557321 - RNA, 15 nt, Homo sapiens
uccuuuugaccaaau

SEQ ID NO: 557322 - RNA, 16 nt, Homo sapiens
uccuuuugaccaaaua

SEQ ID NO: 557323 - RNA, 15 nt, Homo sapiens
uccuuuuuaucugau

SEQ ID NO: 557324 - RNA, 14 nt, Homo sapiens
uccuuuuucacuuu

SEQ ID NO: 557325 - RNA, 20 nt, Homo sapiens
ucgaaaccuacaagauuucc

SEQ ID NO: 557326 - RNA, 20 nt, Homo sapiens
ucgaaccaaggcagccucca

SEQ ID NO: 557327 - RNA, 23 nt, Homo sapiens
ucgaacuauuuucaaagacuuaa

SEQ ID NO: 557328 - RNA, 15 nt, Homo sapiens
ucgaacuucacaacu

SEQ ID NO: 557329 - RNA, 14 nt, Homo sapiens
ucgaagcuccguga

SEQ ID NO: 557330 - RNA, 17 nt, Homo sapiens
ucgaagggauuguguau

SEQ ID NO: 557331 - RNA, 17 nt, Homo sapiens
ucgaaugagucuaagaa

SEQ ID NO: 557332 - RNA, 19 nt, Homo sapiens
ucgaauucucacaaggaaa

SEQ ID NO: 557333 - RNA, 19 nt, Homo sapiens
ucgacaaaggccacaggca

SEQ ID NO: 557334 - RNA, 18 nt, Homo sapiens
ucgacaccauccuggcua

SEQ ID NO: 557335 - RNA, 23 nt, Homo sapiens
ucgaccauaaaggguguaggggc

SEQ ID NO: 557336 - RNA, 12 nt, Homo sapiens
ucgagaccucac

SEQ ID NO: 557337 - RNA, 15 nt, Homo sapiens
ucuaaugugcauuaa

SEQ ID NO: 557338 - RNA, 23 nt, Homo sapiens
ucuaaugugguuauuucucugau

SEQ ID NO: 557339 - RNA, 18 nt, Homo sapiens
ucuaauuaaacuaaagag

SEQ ID NO: 557340 - RNA, 21 nt, Homo sapiens
ucuaauuaaauggcaucagca

SEQ ID NO: 557341 - RNA, 22 nt, Homo sapiens
ucuaauuagaucaauuacuuau

SEQ ID NO: 557342 - RNA, 18 nt, Homo sapiens
ucuaauucggauuugcca

SEQ ID NO: 557343 - RNA, 18 nt, Homo sapiens
ucuaauuuuacacucugu

SEQ ID NO: 557344 - RNA, 22 nt, Homo sapiens
ucuaauuuuggauggaguccag

SEQ ID NO: 557345 - RNA, 16 nt, Homo sapiens
ucuaauuuuuaagaau

SEQ ID NO: 557346 - RNA, 22 nt, Homo sapiens
ucuacaaaaaaugcagaacuua

SEQ ID NO: 557347 - RNA, 16 nt, Homo sapiens
ucuacaaaaauuuauu

SEQ ID NO: 557348 - RNA, 14 nt, Homo sapiens
ucuacaacauagca

SEQ ID NO: 557349 - RNA, 14 nt, Homo sapiens
ucuacaauacauau

SEQ ID NO: 557350 - RNA, 21 nt, Homo sapiens
ucuacaaucaguugacuuuaa

SEQ ID NO: 557351 - RNA, 17 nt, Homo sapiens
ucuacacugagguuuga

SEQ ID NO: 557352 - RNA, 12 nt, Homo sapiens
ucuacacuguau

SEQ ID NO: 557353 - RNA, 23 nt, Homo sapiens
ucuacagcagcacuguucugucc

SEQ ID NO: 557354 - RNA, 13 nt, Homo sapiens
ucuacagugccaa

SEQ ID NO: 557355 - RNA, 15 nt, Homo sapiens
ucuacaguuguccug

SEQ ID NO: 557356 - RNA, 23 nt, Homo sapiens
ucuacauagucagcuacuucuga

SEQ ID NO: 557357 - RNA, 14 nt, Homo sapiens
ucuacauaugaucu

SEQ ID NO: 557358 - RNA, 14 nt, Homo sapiens
ucuacaugaugcua

SEQ ID NO: 557359 - RNA, 18 nt, Homo sapiens
ucuacauuucacauuauu

SEQ ID NO: 557360 - RNA, 22 nt, Homo sapiens
ucucaaaaaaaaaaaaaugcac

SEQ ID NO: 557361 - RNA, 16 nt, Homo sapiens
ucucaaacuacuggca

SEQ ID NO: 557362 - RNA, 16 nt, Homo sapiens
ucucaaagaaggcauu

SEQ ID NO: 557363 - RNA, 16 nt, Homo sapiens
ucucaaaguguacaaa

SEQ ID NO: 557364 - RNA, 19 nt, Homo sapiens
ucucaaaugaaaauuuaau

SEQ ID NO: 557365 - RNA, 13 nt, Homo sapiens
ucucaaauucuca

SEQ ID NO: 557366 - RNA, 14 nt, Homo sapiens
ucucaaauucucaa

SEQ ID NO: 557367 - RNA, 13 nt, Homo sapiens
ucucaaauuuauu

SEQ ID NO: 557368 - RNA, 15 nt, Homo sapiens
ucucaacagaauuaa

SEQ ID NO: 557369 - RNA, 12 nt, Homo sapiens
ucucaacuucau

SEQ ID NO: 557370 - RNA, 19 nt, Homo sapiens
ucucaagcuaguguuucua

SEQ ID NO: 557371 - RNA, 23 nt, Homo sapiens
ucucaagggcuagcaucccugag

SEQ ID NO: 557372 - RNA, 18 nt, Homo sapiens
ucucaaguuaucagggua

SEQ ID NO: 557373 - RNA, 23 nt, Homo sapiens
ucucaauaacaaacuggcugcuu

SEQ ID NO: 557374 - RNA, 21 nt, Homo sapiens
ucucaauaugcuuacaaaguc

SEQ ID NO: 557375 - RNA, 16 nt, Homo sapiens
ucucaaucagugcagu

SEQ ID NO: 557376 - RNA, 16 nt, Homo sapiens
ucucaaucuugaacuc

SEQ ID NO: 557377 - RNA, 12 nt, Homo sapiens
ucucaauucuuu

SEQ ID NO: 557378 - RNA, 14 nt, Homo sapiens
ucucaauuugcagu

SEQ ID NO: 557379 - RNA, 14 nt, Homo sapiens
ucucacaagaugga

SEQ ID NO: 557380 - RNA, 13 nt, Homo sapiens
ucucacacaucac

SEQ ID NO: 557381 - RNA, 15 nt, Homo sapiens
ucucacccaggcaau

SEQ ID NO: 557382 - RNA, 21 nt, Homo sapiens
ucucacccgaccggugcauga

SEQ ID NO: 557383 - RNA, 20 nt, Homo sapiens
ucucaccucuccuacucacu

SEQ ID NO: 557384 - RNA, 18 nt, Homo sapiens
ucucaccuggacuccagu

SEQ ID NO: 557385 - RNA, 18 nt, Homo sapiens
ucuuuuuucccaagagca

SEQ ID NO: 557386 - RNA, 17 nt, Homo sapiens
ugaaaaaaaaaagacaa

SEQ ID NO: 557387 - RNA, 18 nt, Homo sapiens
ugaaaaacaaaaauaaca

SEQ ID NO: 557388 - RNA, 16 nt, Homo sapiens
ugaaaaacaaaauggg

SEQ ID NO: 557389 - RNA, 16 nt, Homo sapiens
ugaaaaacuaugucag

SEQ ID NO: 557390 - RNA, 13 nt, Homo sapiens
ugaaaaacuuaag

SEQ ID NO: 557391 - RNA, 22 nt, Homo sapiens
ugaaaaacuuaccuacugggga

SEQ ID NO: 557392 - RNA, 21 nt, Homo sapiens
ugaaaaaguuuggaagcacug

SEQ ID NO: 557393 - RNA, 20 nt, Homo sapiens
ugaaaaaucacauccuggcc

SEQ ID NO: 557394 - RNA, 18 nt, Homo sapiens
ugaaaaaucuaagugaua

SEQ ID NO: 557395 - RNA, 20 nt, Homo sapiens
ugaaaaaucuuaaguaccaa

SEQ ID NO: 557396 - RNA, 21 nt, Homo sapiens
ugaaaaaugguaauuguugcu

SEQ ID NO: 557397 - RNA, 18 nt, Homo sapiens
ugaaaaauguaaauacuc

SEQ ID NO: 557398 - RNA, 16 nt, Homo sapiens
ugaaaacacacauaca

SEQ ID NO: 557399 - RNA, 18 nt, Homo sapiens
ugaaaacauagcaucuca

SEQ ID NO: 557400 - RNA, 21 nt, Homo sapiens
ugaaaacaucuggaaggggau

SEQ ID NO: 557401 - RNA, 18 nt, Homo sapiens
ugaaaaccauaugauauu

SEQ ID NO: 557402 - RNA, 16 nt, Homo sapiens
ugaaaaccucuccuca

SEQ ID NO: 557403 - RNA, 21 nt, Homo sapiens
ugaaaacgcaaacaugaauau

SEQ ID NO: 557404 - RNA, 12 nt, Homo sapiens
ugaaaacucuau

SEQ ID NO: 557405 - RNA, 16 nt, Homo sapiens
ugaaaacucuuugcug

SEQ ID NO: 557406 - RNA, 21 nt, Homo sapiens
ugaaaacuuagagagguacaa

SEQ ID NO: 557407 - RNA, 13 nt, Homo sapiens
ugaaaagaacaaa

SEQ ID NO: 557408 - RNA, 21 nt, Homo sapiens
ugaaaagagaaugaugcucaa

SEQ ID NO: 557409 - RNA, 19 nt, Homo sapiens
ugaaaagauacugaugcau

SEQ ID NO: 557410 - RNA, 21 nt, Homo sapiens
ugaaaagauacugaugcauug

SEQ ID NO: 557411 - RNA, 13 nt, Homo sapiens
ugaaaagcaauac

SEQ ID NO: 557412 - RNA, 17 nt, Homo sapiens
ugaaaaggaaguuaaua

SEQ ID NO: 557413 - RNA, 19 nt, Homo sapiens
ugaaaaggacuucuggcua

SEQ ID NO: 557414 - RNA, 20 nt, Homo sapiens
ugaaaaggguacagaugugc

SEQ ID NO: 557415 - RNA, 15 nt, Homo sapiens
ugaaaaggguguugc

SEQ ID NO: 557416 - RNA, 18 nt, Homo sapiens
ugaaaaggguguugcuaa

SEQ ID NO: 557417 - RNA, 19 nt, Homo sapiens
ugaaaaggguguugcuaag

SEQ ID NO: 557418 - RNA, 12 nt, Homo sapiens
ugaaaaggugau

SEQ ID NO: 557419 - RNA, 17 nt, Homo sapiens
ugaaaagguugccugaa

SEQ ID NO: 557420 - RNA, 19 nt, Homo sapiens
ugaaaagugggcugugacu

SEQ ID NO: 557421 - RNA, 17 nt, Homo sapiens
ugaaaaguuacuaccug

SEQ ID NO: 557422 - RNA, 19 nt, Homo sapiens
ugaaaauaaauaaguuaua

SEQ ID NO: 557423 - RNA, 20 nt, Homo sapiens
ugaaaauaaccaugaauaca

SEQ ID NO: 557424 - RNA, 16 nt, Homo sapiens
ugaaaauaauggaauu

SEQ ID NO: 557425 - RNA, 15 nt, Homo sapiens
ugaaaauacagcagg

SEQ ID NO: 557426 - RNA, 18 nt, Homo sapiens
ugaaaauauagacauucu

SEQ ID NO: 557427 - RNA, 19 nt, Homo sapiens
ugaaaauauagacauucuc

SEQ ID NO: 557428 - RNA, 19 nt, Homo sapiens
ugaaaaugagcaucagaga

SEQ ID NO: 557429 - RNA, 19 nt, Homo sapiens
ugaaaaugguccaggagaa

SEQ ID NO: 557430 - RNA, 12 nt, Homo sapiens
ugaaaauguacu

SEQ ID NO: 557431 - RNA, 22 nt, Homo sapiens
ugaaaauguauguguaaguauu

SEQ ID NO: 557432 - RNA, 21 nt, Homo sapiens
ugaaaaugucagaaaccaguu

SEQ ID NO: 557433 - RNA, 19 nt, Homo sapiens
ugaaaauguuuuucugcca

SEQ ID NO: 557434 - RNA, 14 nt, Homo sapiens
ugaaaauugcaaua

SEQ ID NO: 557435 - RNA, 16 nt, Homo sapiens
ugaaaauugcaauaca

SEQ ID NO: 557436 - RNA, 16 nt, Homo sapiens
ugaaaauuuuacuucc

SEQ ID NO: 557437 - RNA, 19 nt, Homo sapiens
ugaaaauuuuuacauucau

SEQ ID NO: 557438 - RNA, 20 nt, Homo sapiens
ugaaacaagauaacugagaa

SEQ ID NO: 557439 - RNA, 16 nt, Homo sapiens
ugaaacacacgugcug

SEQ ID NO: 557440 - RNA, 11 nt, Homo sapiens
ugaaacacugg

SEQ ID NO: 557441 - RNA, 18 nt, Homo sapiens
ugaaacagccauguccaa

SEQ ID NO: 557442 - RNA, 15 nt, Homo sapiens
ugaaacauaucucuu

SEQ ID NO: 557443 - RNA, 16 nt, Homo sapiens
ugaaacauggcugugu

SEQ ID NO: 557444 - RNA, 21 nt, Homo sapiens
ugaaacauggcuguguuugca

SEQ ID NO: 557445 - RNA, 15 nt, Homo sapiens
ugaaacauguucuca

SEQ ID NO: 557446 - RNA, 14 nt, Homo sapiens
ugaaacauuuuagc

SEQ ID NO: 557447 - RNA, 15 nt, Homo sapiens
ugaaaccaaaacaua

SEQ ID NO: 557448 - RNA, 14 nt, Homo sapiens
ugaaaccaugacug

SEQ ID NO: 557449 - RNA, 15 nt, Homo sapiens
ugaaaccaugacugu

SEQ ID NO: 557450 - RNA, 14 nt, Homo sapiens
ugaaacccacagau

SEQ ID NO: 557451 - RNA, 14 nt, Homo sapiens
ugaaaccugagaug

SEQ ID NO: 557452 - RNA, 22 nt, Homo sapiens
ugaaaccugagauggagcugcc

SEQ ID NO: 557453 - RNA, 23 nt, Homo sapiens
ugaaacuagaagagauuucuaaa

SEQ ID NO: 557454 - RNA, 17 nt, Homo sapiens
ugaaacuaggguuugaa

SEQ ID NO: 557455 - RNA, 20 nt, Homo sapiens
ugaaacuccaugcaaaccau

SEQ ID NO: 557456 - RNA, 13 nt, Homo sapiens
ugaaacugcauaa

SEQ ID NO: 557457 - RNA, 15 nt, Homo sapiens
ugaaacugcugugaa

SEQ ID NO: 557458 - RNA, 22 nt, Homo sapiens
ugaaacugcuguuuucuaggcc

SEQ ID NO: 557459 - RNA, 18 nt, Homo sapiens
ugaaacuggcacugaauu

SEQ ID NO: 557460 - RNA, 22 nt, Homo sapiens
ugaaacuguggggcuuacagaa

SEQ ID NO: 557461 - RNA, 17 nt, Homo sapiens
ugaaacuugugcuauag

SEQ ID NO: 557462 - RNA, 23 nt, Homo sapiens
ugaaacuugugucauugauguaa

SEQ ID NO: 557463 - RNA, 24 nt, Homo sapiens
ugaaacuuuagagauuaacgacaa

SEQ ID NO: 557464 - RNA, 22 nt, Homo sapiens
ugaaagaaagcugagaagaaug

SEQ ID NO: 557465 - RNA, 22 nt, Homo sapiens
ugaaagaagagaugagaaauga

SEQ ID NO: 557466 - RNA, 17 nt, Homo sapiens
ugaaagaaucagucuug

SEQ ID NO: 557467 - RNA, 14 nt, Homo sapiens
ugaaagaccuucuc

SEQ ID NO: 557468 - RNA, 19 nt, Homo sapiens
ugaaagacucuucacucca

SEQ ID NO: 557469 - RNA, 17 nt, Homo sapiens
ugaaagagauuacuuaa

SEQ ID NO: 557470 - RNA, 22 nt, Homo sapiens
ugaaagagcaagugacuuucua

SEQ ID NO: 557471 - RNA, 22 nt, Homo sapiens
ugaaagaggacguguuacccac

SEQ ID NO: 557472 - RNA, 20 nt, Homo sapiens
ugaaagaggggugggaucca

SEQ ID NO: 557473 - RNA, 16 nt, Homo sapiens
ugaaagaugaucauuu

SEQ ID NO: 557474 - RNA, 14 nt, Homo sapiens
ugaaagcagaugag

SEQ ID NO: 557475 - RNA, 21 nt, Homo sapiens
ugaaagcuuuauacaguugaa

SEQ ID NO: 557476 - RNA, 15 nt, Homo sapiens
ugaaaggaacacugg

SEQ ID NO: 557477 - RNA, 21 nt, Homo sapiens
ugaaaggauaugaaucugaga

SEQ ID NO: 557478 - RNA, 12 nt, Homo sapiens
ugaaaggauuau

SEQ ID NO: 557479 - RNA, 17 nt, Homo sapiens
ugaaaggcauucucuga

SEQ ID NO: 557480 - RNA, 13 nt, Homo sapiens
ugaaagggcaaua

SEQ ID NO: 557481 - RNA, 23 nt, Homo sapiens
ugaaagguacuauauuugcuaga

SEQ ID NO: 557482 - RNA, 21 nt, Homo sapiens
ugaaaggugugcuagaacaag

SEQ ID NO: 557483 - RNA, 19 nt, Homo sapiens
ugaaaguguuuuacucuuu

SEQ ID NO: 557484 - RNA, 17 nt, Homo sapiens
ugaaaguugcuuuuauu

SEQ ID NO: 557485 - RNA, 20 nt, Homo sapiens
ugaaauaaaagcacacugcu

SEQ ID NO: 557486 - RNA, 20 nt, Homo sapiens
ugaaauaaaauuacacagua

SEQ ID NO: 557487 - RNA, 22 nt, Homo sapiens
ugaaauaccagugaaccaaaga

SEQ ID NO: 557488 - RNA, 23 nt, Homo sapiens
ugaaauaccuuuucucacaaaaa

SEQ ID NO: 557489 - RNA, 13 nt, Homo sapiens
ugaaauagcuuua

SEQ ID NO: 557490 - RNA, 13 nt, Homo sapiens
ugaaauaugcaua

SEQ ID NO: 557491 - RNA, 14 nt, Homo sapiens
ugaaauaugcaucu

SEQ ID NO: 557492 - RNA, 17 nt, Homo sapiens
ugaaauauugcuguaua

SEQ ID NO: 557493 - RNA, 22 nt, Homo sapiens
ugaaaucaagucaucuauaguu

SEQ ID NO: 557494 - RNA, 15 nt, Homo sapiens
ugaaaucucagaauu

SEQ ID NO: 557495 - RNA, 13 nt, Homo sapiens
ugaaaucuuuuaa

SEQ ID NO: 557496 - RNA, 15 nt, Homo sapiens
ugaaaugaccaagac

SEQ ID NO: 557497 - RNA, 15 nt, Homo sapiens
ugaaaugauaugacc

SEQ ID NO: 557498 - RNA, 15 nt, Homo sapiens
ugaaaugcuggcauu

SEQ ID NO: 557499 - RNA, 16 nt, Homo sapiens
ugaaaugcuuaugcuu

SEQ ID NO: 557500 - RNA, 22 nt, Homo sapiens
ugaaauggaggaucucuaaaga

SEQ ID NO: 557501 - RNA, 18 nt, Homo sapiens
ugaaauguauaauuaacu

SEQ ID NO: 557502 - RNA, 23 nt, Homo sapiens
ugaaauguaugugcucuuagcaa

SEQ ID NO: 557503 - RNA, 15 nt, Homo sapiens
ugaaauuaauuugug

SEQ ID NO: 557504 - RNA, 15 nt, Homo sapiens
ugaaauuacugugua

SEQ ID NO: 557505 - RNA, 19 nt, Homo sapiens
ugaaauuaguuuaccucau

SEQ ID NO: 557506 - RNA, 21 nt, Homo sapiens
ugaaauucaguuauaaaguca

SEQ ID NO: 557507 - RNA, 21 nt, Homo sapiens
ucuuaccagauccuuuuccag

SEQ ID NO: 557508 - RNA, 22 nt, Homo sapiens
ucuuacguggagagugcacuga

SEQ ID NO: 557509 - RNA, 14 nt, Homo sapiens
ucuuacuaaaaagu

SEQ ID NO: 557510 - RNA, 13 nt, Homo sapiens
ucuuacugugcuu

SEQ ID NO: 557511 - RNA, 17 nt, Homo sapiens
ucuuacuguugcauaac

SEQ ID NO: 557512 - RNA, 22 nt, Homo sapiens
ucuuacuuugaguuagugccau

SEQ ID NO: 557513 - RNA, 15 nt, Homo sapiens
ucuuagaaaugaagg

SEQ ID NO: 557514 - RNA, 14 nt, Homo sapiens
ucuuagaauaucua

SEQ ID NO: 557515 - RNA, 16 nt, Homo sapiens
ucuuagacuuugcaag

SEQ ID NO: 557516 - RNA, 19 nt, Homo sapiens
ucuuagaguugauuccuca

SEQ ID NO: 557517 - RNA, 20 nt, Homo sapiens
ucuuagauauucacuaagga

SEQ ID NO: 557518 - RNA, 23 nt, Homo sapiens
ucuuagauauucacuaaggacuu

SEQ ID NO: 557519 - RNA, 18 nt, Homo sapiens
ucuuagcacacucacaga

SEQ ID NO: 557520 - RNA, 16 nt, Homo sapiens
ucuuagcugucugcuc

SEQ ID NO: 557521 - RNA, 12 nt, Homo sapiens
ucuuagcuuucu

SEQ ID NO: 557522 - RNA, 16 nt, Homo sapiens
ucuuaguggaagacaa

SEQ ID NO: 557523 - RNA, 15 nt, Homo sapiens
ucuuagugucacuua

SEQ ID NO: 557524 - RNA, 14 nt, Homo sapiens
ucuuagugugccaa

SEQ ID NO: 557525 - RNA, 12 nt, Homo sapiens
ucuuaguuauug

SEQ ID NO: 557526 - RNA, 13 nt, Homo sapiens
ucuuaguucucac

SEQ ID NO: 557527 - RNA, 14 nt, Homo sapiens
ucuuaguugcugua

SEQ ID NO: 557528 - RNA, 14 nt, Homo sapiens
ucuuauacagauaa

SEQ ID NO: 557529 - RNA, 16 nt, Homo sapiens
ucuuaucccagugauc

SEQ ID NO: 557530 - RNA, 21 nt, Homo sapiens
ucuuauucuuucuaaacuaca

SEQ ID NO: 557531 - RNA, 12 nt, Homo sapiens
ucuuauugcaaa

SEQ ID NO: 557532 - RNA, 16 nt, Homo sapiens
ucuuauuuauaccuca

SEQ ID NO: 557533 - RNA, 14 nt, Homo sapiens
ucuuauuuccucaa

SEQ ID NO: 557534 - RNA, 15 nt, Homo sapiens
ucuuauuuugcauuc

SEQ ID NO: 557535 - RNA, 18 nt, Homo sapiens
ucuuauuuugcauuccag

SEQ ID NO: 557536 - RNA, 14 nt, Homo sapiens
ucuucaaacuguga

SEQ ID NO: 557537 - RNA, 18 nt, Homo sapiens
ucuucaagacgacagcuc

SEQ ID NO: 557538 - RNA, 13 nt, Homo sapiens
ucuucaagacucu

SEQ ID NO: 557539 - RNA, 14 nt, Homo sapiens
ucuucaagacucug

SEQ ID NO: 557540 - RNA, 19 nt, Homo sapiens
ucuucaauaugaaucuaua

SEQ ID NO: 557541 - RNA, 17 nt, Homo sapiens
ucuucacaaaacacuuc

SEQ ID NO: 557542 - RNA, 21 nt, Homo sapiens
ucuucaccccuacacugugaa

SEQ ID NO: 557543 - RNA, 22 nt, Homo sapiens
ucuucaccccuacacugugaag

SEQ ID NO: 557544 - RNA, 15 nt, Homo sapiens
ucuucaccuuauuca

SEQ ID NO: 557545 - RNA, 15 nt, Homo sapiens
ucuucacucuucacu

SEQ ID NO: 557546 - RNA, 18 nt, Homo sapiens
ucuucacuuaauccauuu

SEQ ID NO: 557547 - RNA, 20 nt, Homo sapiens
ucuucacuuccccacaggcu

SEQ ID NO: 557548 - RNA, 21 nt, Homo sapiens
ucuucacuugaguuggcugug

SEQ ID NO: 557549 - RNA, 16 nt, Homo sapiens
ucuucagaagacacug

SEQ ID NO: 557550 - RNA, 13 nt, Homo sapiens
ucuucagagacag

SEQ ID NO: 557551 - RNA, 22 nt, Homo sapiens
ucuucagagauaggccuguggg

SEQ ID NO: 557552 - RNA, 21 nt, Homo sapiens
ucuucagauauaagacuuucc

SEQ ID NO: 557553 - RNA, 13 nt, Homo sapiens
ucuucagccauag

SEQ ID NO: 557554 - RNA, 21 nt, Homo sapiens
ucuucagggaacugcauagau

SEQ ID NO: 557555 - RNA, 19 nt, Homo sapiens
ucuucagguucucaugaua

SEQ ID NO: 557556 - RNA, 18 nt, Homo sapiens
ucuucaugaccuacuuca

SEQ ID NO: 557557 - RNA, 20 nt, Homo sapiens
ucuucaugaguagugggcua

SEQ ID NO: 557558 - RNA, 12 nt, Homo sapiens
ucuucaugcaau

SEQ ID NO: 557559 - RNA, 20 nt, Homo sapiens
ucuucaugcuuuugcuugca

SEQ ID NO: 557560 - RNA, 13 nt, Homo sapiens
ucuucauggugau

SEQ ID NO: 557561 - RNA, 18 nt, Homo sapiens
ucuucauggugauaugca

SEQ ID NO: 557562 - RNA, 17 nt, Homo sapiens
ucuucauuucauuguau

SEQ ID NO: 557563 - RNA, 22 nt, Homo sapiens
ucuuccacccauucccccaugu

SEQ ID NO: 557564 - RNA, 19 nt, Homo sapiens
ucuuccagauuuccuuuca

SEQ ID NO: 557565 - RNA, 12 nt, Homo sapiens
ucuuccauucca

SEQ ID NO: 557566 - RNA, 17 nt, Homo sapiens
ucuuccauuugcaaggg

SEQ ID NO: 557567 - RNA, 13 nt, Homo sapiens
ucuucccaugacu

SEQ ID NO: 557568 - RNA, 14 nt, Homo sapiens
ucuucccccaaagc

SEQ ID NO: 557569 - RNA, 22 nt, Homo sapiens
ucuucccgcaaggccucucaga

SEQ ID NO: 557570 - RNA, 15 nt, Homo sapiens
ucuucccgcacaaau

SEQ ID NO: 557571 - RNA, 21 nt, Homo sapiens
ucuucccgcacaaauuccaca

SEQ ID NO: 557572 - RNA, 13 nt, Homo sapiens
ucuucccuaccuc

SEQ ID NO: 557573 - RNA, 15 nt, Homo sapiens
ucuucccuaccucag

SEQ ID NO: 557574 - RNA, 16 nt, Homo sapiens
ucuucccuuaccucaa

SEQ ID NO: 557575 - RNA, 19 nt, Homo sapiens
ucuucccuuuuacauacug

SEQ ID NO: 557576 - RNA, 23 nt, Homo sapiens
ucuucccuuuuacauacugcugu

SEQ ID NO: 557577 - RNA, 14 nt, Homo sapiens
ucuuccugacacuu

SEQ ID NO: 557578 - RNA, 19 nt, Homo sapiens
ucuuccugaguggugccaa

SEQ ID NO: 557579 - RNA, 16 nt, Homo sapiens
ucuuccugcacccaca

SEQ ID NO: 557580 - RNA, 23 nt, Homo sapiens
ucuuccuguugugacugccagga

SEQ ID NO: 557581 - RNA, 15 nt, Homo sapiens
ucuuccuuagacuua

SEQ ID NO: 557582 - RNA, 23 nt, Homo sapiens
ucuuccuuagcuaaaugcaauuu

SEQ ID NO: 557583 - RNA, 19 nt, Homo sapiens
ucuuccuuccuaauaggca

SEQ ID NO: 557584 - RNA, 21 nt, Homo sapiens
ucuuccuuggaggggggagcc

SEQ ID NO: 557585 - RNA, 16 nt, Homo sapiens
ucuuccuuucuaaucc

SEQ ID NO: 557586 - RNA, 15 nt, Homo sapiens
ucuucgcugcuagag

SEQ ID NO: 557587 - RNA, 17 nt, Homo sapiens
ucuucgggagacauguu

SEQ ID NO: 557588 - RNA, 15 nt, Homo sapiens
ucuucuaauuccuca

SEQ ID NO: 557589 - RNA, 15 nt, Homo sapiens
ucuucuaccucagac

SEQ ID NO: 557590 - RNA, 14 nt, Homo sapiens
ucuucuacugcuau

SEQ ID NO: 557591 - RNA, 17 nt, Homo sapiens
ucuucucauagcauuaa

SEQ ID NO: 557592 - RNA, 19 nt, Homo sapiens
ucuucucaucuuuuaucua

SEQ ID NO: 557593 - RNA, 15 nt, Homo sapiens
ucuucucccuuugaa

SEQ ID NO: 557594 - RNA, 21 nt, Homo sapiens
ucuucuccugccuaauuuuga

SEQ ID NO: 557595 - RNA, 15 nt, Homo sapiens
ucuucucuccacuuc

SEQ ID NO: 557596 - RNA, 20 nt, Homo sapiens
ucuucugaacucaaacugag

SEQ ID NO: 557597 - RNA, 16 nt, Homo sapiens
ucuucuggacugcaca

SEQ ID NO: 557598 - RNA, 21 nt, Homo sapiens
ucuucuggacugcacacuucc

SEQ ID NO: 557599 - RNA, 15 nt, Homo sapiens
ugaaauucucaucag

SEQ ID NO: 557600 - RNA, 11 nt, Homo sapiens
ugaaauucugc

SEQ ID NO: 557601 - RNA, 13 nt, Homo sapiens
ugaaauugccaaa

SEQ ID NO: 557602 - RNA, 18 nt, Homo sapiens
ugaaauuguagugcaaaa

SEQ ID NO: 557603 - RNA, 16 nt, Homo sapiens
ugaaauuguaucucag

SEQ ID NO: 557604 - RNA, 23 nt, Homo sapiens
ugaaauuguuuuaccagcuccca

SEQ ID NO: 557605 - RNA, 16 nt, Homo sapiens
ugaaauuuauucacau

SEQ ID NO: 557606 - RNA, 20 nt, Homo sapiens
ugaaauuuguuauacuucaa

SEQ ID NO: 557607 - RNA, 16 nt, Homo sapiens
ugaaauuuuaauugaa

SEQ ID NO: 557608 - RNA, 22 nt, Homo sapiens
ugaacaaaaccuacacacauac

SEQ ID NO: 557609 - RNA, 15 nt, Homo sapiens
ugaacaaacaaugaa

SEQ ID NO: 557610 - RNA, 19 nt, Homo sapiens
ugaacaaucaaagcacuug

SEQ ID NO: 557611 - RNA, 22 nt, Homo sapiens
ugaacaauugcuuuaacaguca

SEQ ID NO: 557612 - RNA, 18 nt, Homo sapiens
ugaacacaauugauacuu

SEQ ID NO: 557613 - RNA, 12 nt, Homo sapiens
ugaacacaucuu

SEQ ID NO: 557614 - RNA, 15 nt, Homo sapiens
ugaacacuagccaga

SEQ ID NO: 557615 - RNA, 19 nt, Homo sapiens
ugaacacucuacuacaugu

SEQ ID NO: 557616 - RNA, 20 nt, Homo sapiens
ugaacacucuuuugcuuuau

SEQ ID NO: 557617 - RNA, 21 nt, Homo sapiens
ugaacacugauuguccauuua

SEQ ID NO: 557618 - RNA, 19 nt, Homo sapiens
ugaacacuggcuaaagaua

SEQ ID NO: 557619 - RNA, 20 nt, Homo sapiens
ugaacagagagcgcuuuugu

SEQ ID NO: 557620 - RNA, 20 nt, Homo sapiens
ugaacagccacgucagcuuu

SEQ ID NO: 557621 - RNA, 14 nt, Homo sapiens
ugaacagcugugag

SEQ ID NO: 557622 - RNA, 19 nt, Homo sapiens
ugaacagcuugcugucacu

SEQ ID NO: 557623 - RNA, 13 nt, Homo sapiens
ugaacagguguuu

SEQ ID NO: 557624 - RNA, 22 nt, Homo sapiens
ugaacauccccucccaucauua

SEQ ID NO: 557625 - RNA, 15 nt, Homo sapiens
ugaacauccuuccuu

SEQ ID NO: 557626 - RNA, 18 nt, Homo sapiens
ugaacaugccugccaaag

SEQ ID NO: 557627 - RNA, 18 nt, Homo sapiens
ugaacauguuuacagguu

SEQ ID NO: 557628 - RNA, 22 nt, Homo sapiens
ugaacauuaaaauauagagaca

SEQ ID NO: 557629 - RNA, 23 nt, Homo sapiens
ugaacauuaauccacauguuuca

SEQ ID NO: 557630 - RNA, 12 nt, Homo sapiens
ugaacauuccag

SEQ ID NO: 557631 - RNA, 12 nt, Homo sapiens
ugaacauuucaa

SEQ ID NO: 557632 - RNA, 22 nt, Homo sapiens
ugaaccaagaccauugaauucu

SEQ ID NO: 557633 - RNA, 19 nt, Homo sapiens
ugaaccagaggguguggcu

SEQ ID NO: 557634 - RNA, 22 nt, Homo sapiens
ugaaccagugauccauguccug

SEQ ID NO: 557635 - RNA, 19 nt, Homo sapiens
ugaaccauucccuagucau

SEQ ID NO: 557636 - RNA, 13 nt, Homo sapiens
ugaacccaaaaag

SEQ ID NO: 557637 - RNA, 22 nt, Homo sapiens
ugaaccccuggccagcucugag

SEQ ID NO: 557638 - RNA, 16 nt, Homo sapiens
ugaacccuaaggugag

SEQ ID NO: 557639 - RNA, 12 nt, Homo sapiens
ugaacccugugc

SEQ ID NO: 557640 - RNA, 15 nt, Homo sapiens
ugaacccuugugcuu

SEQ ID NO: 557641 - RNA, 18 nt, Homo sapiens
ugaaccugcuuccuggcu

SEQ ID NO: 557642 - RNA, 13 nt, Homo sapiens
ugaaccuuaucaa

SEQ ID NO: 557643 - RNA, 15 nt, Homo sapiens
ugaaccuugagcaaa

SEQ ID NO: 557644 - RNA, 14 nt, Homo sapiens
ugaaccuuguuuaa

SEQ ID NO: 557645 - RNA, 15 nt, Homo sapiens
ugaacgcuuaaguca

SEQ ID NO: 557646 - RNA, 13 nt, Homo sapiens
ugaacguggaauu

SEQ ID NO: 557647 - RNA, 24 nt, Homo sapiens
ugaacuaaauuuaagcuuaagcca

SEQ ID NO: 557648 - RNA, 19 nt, Homo sapiens
ugaacuaaucugauguuaa

SEQ ID NO: 557649 - RNA, 13 nt, Homo sapiens
ugaacuacacugc

SEQ ID NO: 557650 - RNA, 14 nt, Homo sapiens
ugaacuaccaucug

SEQ ID NO: 557651 - RNA, 17 nt, Homo sapiens
ugaacuaccaucugaug

SEQ ID NO: 557652 - RNA, 22 nt, Homo sapiens
ugaacuaccaucugauguuuca

SEQ ID NO: 557653 - RNA, 14 nt, Homo sapiens
ugaacuacuaaagu

SEQ ID NO: 557654 - RNA, 15 nt, Homo sapiens
ugaacucuuaggcac

SEQ ID NO: 557655 - RNA, 17 nt, Homo sapiens
ugaacucuuucuggccu

SEQ ID NO: 557656 - RNA, 18 nt, Homo sapiens
ugaacugaggcccuguga

SEQ ID NO: 557657 - RNA, 20 nt, Homo sapiens
ugaacugaggcccugugaua

SEQ ID NO: 557658 - RNA, 17 nt, Homo sapiens
ugaacuguaguacaugg

SEQ ID NO: 557659 - RNA, 14 nt, Homo sapiens
ugaacuguauuuau

SEQ ID NO: 557660 - RNA, 12 nt, Homo sapiens
ugaacuguggaa

SEQ ID NO: 557661 - RNA, 18 nt, Homo sapiens
ugaacuguggugccacau

SEQ ID NO: 557662 - RNA, 15 nt, Homo sapiens
ugaacuucucucaga

SEQ ID NO: 557663 - RNA, 14 nt, Homo sapiens
ugaacuuugcaaag

SEQ ID NO: 557664 - RNA, 16 nt, Homo sapiens
ugaacuuuuaaugaac

SEQ ID NO: 557665 - RNA, 18 nt, Homo sapiens
ugaacuuuuaaugaacuu

SEQ ID NO: 557666 - RNA, 16 nt, Homo sapiens
ugaacuuuuguacuga

SEQ ID NO: 557667 - RNA, 17 nt, Homo sapiens
ugaagaaaaaaucagaa

SEQ ID NO: 557668 - RNA, 15 nt, Homo sapiens
ugaagaaaacuccuu

SEQ ID NO: 557669 - RNA, 22 nt, Homo sapiens
ugaagaacaguaacugccauca

SEQ ID NO: 557670 - RNA, 16 nt, Homo sapiens
ugaagaacugcacuuu

SEQ ID NO: 557671 - RNA, 13 nt, Homo sapiens
ugaagaauguaga

SEQ ID NO: 557672 - RNA, 15 nt, Homo sapiens
ugaagacaacagcau

SEQ ID NO: 557673 - RNA, 14 nt, Homo sapiens
ugaagacaaugacu

SEQ ID NO: 557674 - RNA, 20 nt, Homo sapiens
ugaagacccuggaguucaaa

SEQ ID NO: 557675 - RNA, 14 nt, Homo sapiens
ugaagaccuaaagu

SEQ ID NO: 557676 - RNA, 17 nt, Homo sapiens
ugaagacggauuacuaa

SEQ ID NO: 557677 - RNA, 15 nt, Homo sapiens
ugaagacuagaaaau

SEQ ID NO: 557678 - RNA, 22 nt, Homo sapiens
ugaagacucacuucucagcuga

SEQ ID NO: 557679 - RNA, 14 nt, Homo sapiens
ugaagacucugcag

SEQ ID NO: 557680 - RNA, 13 nt, Homo sapiens
ugaagacugcaca

SEQ ID NO: 557681 - RNA, 15 nt, Homo sapiens
ugaagacugcacagg

SEQ ID NO: 557682 - RNA, 20 nt, Homo sapiens
ugaagacugggugaggauaa

SEQ ID NO: 557683 - RNA, 12 nt, Homo sapiens
ugaagacuuccu

SEQ ID NO: 557684 - RNA, 16 nt, Homo sapiens
ugaagagacaggcacc

SEQ ID NO: 557685 - RNA, 14 nt, Homo sapiens
ugaagagauuucaa

SEQ ID NO: 557686 - RNA, 13 nt, Homo sapiens
ugaaggacuuuaa

SEQ ID NO: 557687 - RNA, 15 nt, Homo sapiens
ugaaggaucuugccu

SEQ ID NO: 557688 - RNA, 16 nt, Homo sapiens
ugaaggaucuugccug

SEQ ID NO: 557689 - RNA, 16 nt, Homo sapiens
ugaaggauuacucucc

SEQ ID NO: 557690 - RNA, 16 nt, Homo sapiens
ugaaggcaucaaauaa

SEQ ID NO: 557691 - RNA, 17 nt, Homo sapiens
ugaaggcaucaaauaaa

SEQ ID NO: 557692 - RNA, 15 nt, Homo sapiens
ugaaggcccugcuga

SEQ ID NO: 557693 - RNA, 13 nt, Homo sapiens
ugaaggcugagug

SEQ ID NO: 557694 - RNA, 17 nt, Homo sapiens
ugaaggcugaguguccg

SEQ ID NO: 557695 - RNA, 22 nt, Homo sapiens
ugaaggcuuuaauaaaggccac

SEQ ID NO: 557696 - RNA, 20 nt, Homo sapiens
ugaagggccacugggacccu

SEQ ID NO: 557697 - RNA, 16 nt, Homo sapiens
ugaaggggaggucaca

SEQ ID NO: 557698 - RNA, 20 nt, Homo sapiens
ugaaggggguggggaagaag

SEQ ID NO: 557699 - RNA, 18 nt, Homo sapiens
ugaagguauuggccuguu

SEQ ID NO: 557700 - RNA, 19 nt, Homo sapiens
ugaaggugauucaccaaaa

SEQ ID NO: 557701 - RNA, 19 nt, Homo sapiens
ugaagguggaacaagcaca

SEQ ID NO: 557702 - RNA, 21 nt, Homo sapiens
ugaagguucccaaggacauga

SEQ ID NO: 557703 - RNA, 15 nt, Homo sapiens
ugaaguaacugugga

SEQ ID NO: 557704 - RNA, 13 nt, Homo sapiens
ugaaguaagcaac

SEQ ID NO: 557705 - RNA, 17 nt, Homo sapiens
ugaaguaauaugcacac

SEQ ID NO: 557706 - RNA, 14 nt, Homo sapiens
ugaaguacauauua

SEQ ID NO: 557707 - RNA, 21 nt, Homo sapiens
ugaaguagaggacuaaccaug

SEQ ID NO: 557708 - RNA, 18 nt, Homo sapiens
ugaaguaggcauauauca

SEQ ID NO: 557709 - RNA, 20 nt, Homo sapiens
ugaagucagccacacugggc

SEQ ID NO: 557710 - RNA, 19 nt, Homo sapiens
ugaagucccagauacuugg

SEQ ID NO: 557711 - RNA, 16 nt, Homo sapiens
ugaaguccuccagaca

SEQ ID NO: 557712 - RNA, 17 nt, Homo sapiens
ugaaguccuccagacaa

SEQ ID NO: 557713 - RNA, 14 nt, Homo sapiens
ugaagucucccuug

SEQ ID NO: 557714 - RNA, 17 nt, Homo sapiens
ugaagucuucuccucca

SEQ ID NO: 557715 - RNA, 23 nt, Homo sapiens
ugaagugaccuggaaucagugaa

SEQ ID NO: 557716 - RNA, 18 nt, Homo sapiens
ugaagugcccuucccuug

SEQ ID NO: 557717 - RNA, 19 nt, Homo sapiens
ugaagugcuuaguguacuu

SEQ ID NO: 557718 - RNA, 22 nt, Homo sapiens
ugaaguggucugaauucuggaa

SEQ ID NO: 557719 - RNA, 23 nt, Homo sapiens
ugaaguggucugaauucuggaau

SEQ ID NO: 557720 - RNA, 22 nt, Homo sapiens
ugaagugugcacguugcuucag

SEQ ID NO: 557721 - RNA, 16 nt, Homo sapiens
ugaaguuacacaauua

SEQ ID NO: 557722 - RNA, 13 nt, Homo sapiens
ugaaguuugcuau

SEQ ID NO: 557723 - RNA, 20 nt, Homo sapiens
ugaauaaaaauauguacaag

SEQ ID NO: 557724 - RNA, 16 nt, Homo sapiens
ugaauaaaccaguauc

SEQ ID NO: 557725 - RNA, 21 nt, Homo sapiens
ugaauaaaguguaaguucaca

SEQ ID NO: 557726 - RNA, 16 nt, Homo sapiens
ugaauaaauaccucuu

SEQ ID NO: 557727 - RNA, 19 nt, Homo sapiens
ugaauaaauuuucaaaucc

SEQ ID NO: 557728 - RNA, 20 nt, Homo sapiens
ugaauaacauuuaaauucca

SEQ ID NO: 557729 - RNA, 21 nt, Homo sapiens
ugaauaacauuuaaauuccac

SEQ ID NO: 557730 - RNA, 13 nt, Homo sapiens
ugaauaaccacuu

SEQ ID NO: 557731 - RNA, 18 nt, Homo sapiens
ugaauaagcuuucucuca

SEQ ID NO: 557732 - RNA, 13 nt, Homo sapiens
ugaauaauacagu

SEQ ID NO: 557733 - RNA, 20 nt, Homo sapiens
ugaauaauacaguaucucag

SEQ ID NO: 557734 - RNA, 19 nt, Homo sapiens
ugaauacagcauuuagcuu

SEQ ID NO: 557735 - RNA, 18 nt, Homo sapiens
ugaauacagucucaucuu

SEQ ID NO: 557736 - RNA, 14 nt, Homo sapiens
ugaauacugcuaca

SEQ ID NO: 557737 - RNA, 14 nt, Homo sapiens
ugaauacuugcuau

SEQ ID NO: 557738 - RNA, 15 nt, Homo sapiens
ugaauagcuacuaua

SEQ ID NO: 557739 - RNA, 13 nt, Homo sapiens
ugaauagucucau

SEQ ID NO: 557740 - RNA, 17 nt, Homo sapiens
ugaauaguugcuuaauu

SEQ ID NO: 557741 - RNA, 19 nt, Homo sapiens
ugaauaugaugacaaucag

SEQ ID NO: 557742 - RNA, 21 nt, Homo sapiens
ugaauauggaacauaugcaca

SEQ ID NO: 557743 - RNA, 16 nt, Homo sapiens
ugaauauguugaucau

SEQ ID NO: 557744 - RNA, 15 nt, Homo sapiens
ugaauauuacucuca

SEQ ID NO: 557745 - RNA, 20 nt, Homo sapiens
ugaauauuuauauuucacua

SEQ ID NO: 557746 - RNA, 21 nt, Homo sapiens
ugaauauuuguuauguagaua

SEQ ID NO: 557747 - RNA, 20 nt, Homo sapiens
ugaaucauauucauaugcag

SEQ ID NO: 557748 - RNA, 13 nt, Homo sapiens
ugaaucccuuuag

SEQ ID NO: 557749 - RNA, 18 nt, Homo sapiens
ugaauccucuucuuuaua

SEQ ID NO: 557750 - RNA, 14 nt, Homo sapiens
ugaaucuaugccaa

SEQ ID NO: 557751 - RNA, 17 nt, Homo sapiens
ugaaucuguacauguuc

SEQ ID NO: 557752 - RNA, 20 nt, Homo sapiens
ugaaucuugcuguuuucaau

SEQ ID NO: 557753 - RNA, 16 nt, Homo sapiens
ugaaugaacuaguuua

SEQ ID NO: 557754 - RNA, 13 nt, Homo sapiens
ugaaugaagucaa

SEQ ID NO: 557755 - RNA, 22 nt, Homo sapiens
ugaaugaccagcagcagcuuuc

SEQ ID NO: 557756 - RNA, 16 nt, Homo sapiens
ugaaugagagguuccu

SEQ ID NO: 557757 - RNA, 18 nt, Homo sapiens
ugaaugaguaaacugaga

SEQ ID NO: 557758 - RNA, 15 nt, Homo sapiens
ugaaugauaaacucu

SEQ ID NO: 557759 - RNA, 15 nt, Homo sapiens
ugaaugauacccuga

SEQ ID NO: 557760 - RNA, 18 nt, Homo sapiens
ugaaugcacacuagccuc

SEQ ID NO: 557761 - RNA, 20 nt, Homo sapiens
ugaaugccuccuguggggaa

SEQ ID NO: 557762 - RNA, 19 nt, Homo sapiens
ugaaugcuauguucuggga

SEQ ID NO: 557763 - RNA, 23 nt, Homo sapiens
ugaaugcuccauuaauccaggga

SEQ ID NO: 557764 - RNA, 14 nt, Homo sapiens
ugaauggacucaaa

SEQ ID NO: 557765 - RNA, 15 nt, Homo sapiens
ugaauggccugccuu

SEQ ID NO: 557766 - RNA, 16 nt, Homo sapiens
ugaaugugcuggugaa

SEQ ID NO: 557767 - RNA, 13 nt, Homo sapiens
ugaaugugucacu

SEQ ID NO: 557768 - RNA, 18 nt, Homo sapiens
ugaaugugucacuacuca

SEQ ID NO: 557769 - RNA, 19 nt, Homo sapiens
ugaaugugugaauucaaua

SEQ ID NO: 557770 - RNA, 18 nt, Homo sapiens
ugacaauacugcugccuu

SEQ ID NO: 557771 - RNA, 16 nt, Homo sapiens
ugacaaucaacucuaa

SEQ ID NO: 557772 - RNA, 14 nt, Homo sapiens
ugacaauuacucag

SEQ ID NO: 557773 - RNA, 19 nt, Homo sapiens
ugacaauuuauguggauuu

SEQ ID NO: 557774 - RNA, 23 nt, Homo sapiens
ugacacaaagguggaauaaacau

SEQ ID NO: 557775 - RNA, 23 nt, Homo sapiens
ugacacaguuaucaaaaaguauu

SEQ ID NO: 557776 - RNA, 19 nt, Homo sapiens
ugacacaguuggauuuauu

SEQ ID NO: 557777 - RNA, 15 nt, Homo sapiens
ugacacauaugaaca

SEQ ID NO: 557778 - RNA, 18 nt, Homo sapiens
ugacaccaaaacaugccg

SEQ ID NO: 557779 - RNA, 14 nt, Homo sapiens
ugacacccaugcca

SEQ ID NO: 557780 - RNA, 22 nt, Homo sapiens
ugacacccuggccugaacugag

SEQ ID NO: 557781 - RNA, 19 nt, Homo sapiens
ugacaccgucgaccaggaa

SEQ ID NO: 557782 - RNA, 16 nt, Homo sapiens
ugacaccuuaguuccu

SEQ ID NO: 557783 - RNA, 11 nt, Homo sapiens
ugacacuauuc

SEQ ID NO: 557784 - RNA, 20 nt, Homo sapiens
ugacacucccuugggcuccc

SEQ ID NO: 557785 - RNA, 15 nt, Homo sapiens
ugacacuccuuucag

SEQ ID NO: 557786 - RNA, 12 nt, Homo sapiens
ugacacugauga

SEQ ID NO: 557787 - RNA, 16 nt, Homo sapiens
ugacagaccacaucuu

SEQ ID NO: 557788 - RNA, 20 nt, Homo sapiens
ugacagagcgagacuccauc

SEQ ID NO: 557789 - RNA, 23 nt, Homo sapiens
ugacagagcgagauuccgucuca

SEQ ID NO: 557790 - RNA, 18 nt, Homo sapiens
ugacagaucaagcuguga

SEQ ID NO: 557791 - RNA, 17 nt, Homo sapiens
ugacagcaggugggaaa

SEQ ID NO: 557792 - RNA, 23 nt, Homo sapiens
ugacagccccuuauuugcacuuc

SEQ ID NO: 557793 - RNA, 16 nt, Homo sapiens
ugacagcugucuuugg

SEQ ID NO: 557794 - RNA, 18 nt, Homo sapiens
ugacaggcagccuggaca

SEQ ID NO: 557795 - RNA, 16 nt, Homo sapiens
ugacaggugugagucu

SEQ ID NO: 557796 - RNA, 12 nt, Homo sapiens
ugacaguauauu

SEQ ID NO: 557797 - RNA, 21 nt, Homo sapiens
ugacaguauauuugaaacugu

SEQ ID NO: 557798 - RNA, 18 nt, Homo sapiens
ugacaguauuaaggguag

SEQ ID NO: 557799 - RNA, 22 nt, Homo sapiens
ugacagugaagcagcacuguga

SEQ ID NO: 557800 - RNA, 20 nt, Homo sapiens
ugacaguggaacuacauuag

SEQ ID NO: 557801 - RNA, 11 nt, Homo sapiens
ugacauaaaaa

SEQ ID NO: 557802 - RNA, 13 nt, Homo sapiens
ugacauaauaaua

SEQ ID NO: 557803 - RNA, 16 nt, Homo sapiens
ugacauaauauauucu

SEQ ID NO: 557804 - RNA, 12 nt, Homo sapiens
ugacauaccuac

SEQ ID NO: 557805 - RNA, 15 nt, Homo sapiens
ugacauaccuaccag

SEQ ID NO: 557806 - RNA, 16 nt, Homo sapiens
ugacauauucaaguga

SEQ ID NO: 557807 - RNA, 15 nt, Homo sapiens
ugacaucaguggcau

SEQ ID NO: 557808 - RNA, 10 nt, Homo sapiens
ugacaugaag

SEQ ID NO: 557809 - RNA, 11 nt, Homo sapiens
ugacaugaccc

SEQ ID NO: 557810 - RNA, 23 nt, Homo sapiens
ugacaugggccuuuaagaaccuu

SEQ ID NO: 557811 - RNA, 12 nt, Homo sapiens
ugacaugugcaa

SEQ ID NO: 557812 - RNA, 15 nt, Homo sapiens
ugacauguggggcca

SEQ ID NO: 557813 - RNA, 13 nt, Homo sapiens
ugacauuccauga

SEQ ID NO: 557814 - RNA, 19 nt, Homo sapiens
ugacauucuuagcuguaac

SEQ ID NO: 557815 - RNA, 18 nt, Homo sapiens
ugacauugaaaucuagga

SEQ ID NO: 557816 - RNA, 17 nt, Homo sapiens
ugacauugcguuugacc

SEQ ID NO: 557817 - RNA, 18 nt, Homo sapiens
ugacauuuauauauugaa

SEQ ID NO: 557818 - RNA, 22 nt, Homo sapiens
ugacauuugggagacaugugac

SEQ ID NO: 557819 - RNA, 23 nt, Homo sapiens
ugacauuugucagugauguugcc

SEQ ID NO: 557820 - RNA, 20 nt, Homo sapiens
ugaccaaauaaaguaccauu

SEQ ID NO: 557821 - RNA, 23 nt, Homo sapiens
ugaccaaggacuaacauuuuuaa

SEQ ID NO: 557822 - RNA, 24 nt, Homo sapiens
ugaccaaguuauaaaucaauguca

SEQ ID NO: 557823 - RNA, 19 nt, Homo sapiens
ugaccaauugugcugccau

SEQ ID NO: 557824 - RNA, 20 nt, Homo sapiens
ugaccaauugugcugccauu

SEQ ID NO: 557825 - RNA, 18 nt, Homo sapiens
ugaccacagcacagccaa

SEQ ID NO: 557826 - RNA, 22 nt, Homo sapiens
ugaccacauagaacaugugucu

SEQ ID NO: 557827 - RNA, 23 nt, Homo sapiens
ugaccacucuucuuuaagccaua

SEQ ID NO: 557828 - RNA, 19 nt, Homo sapiens
ugaccagaaaucaaaaagg

SEQ ID NO: 557829 - RNA, 21 nt, Homo sapiens
ugaccagccugucacccagcu

SEQ ID NO: 557830 - RNA, 22 nt, Homo sapiens
ugaccaggcgcccgggauccag

SEQ ID NO: 557831 - RNA, 13 nt, Homo sapiens
ugaccagugccuu

SEQ ID NO: 557832 - RNA, 13 nt, Homo sapiens
ugaccauacuaau

SEQ ID NO: 557833 - RNA, 23 nt, Homo sapiens
ugaccaugagguggggguuuugg

SEQ ID NO: 557834 - RNA, 15 nt, Homo sapiens
ugacccaaagaccaa

SEQ ID NO: 557835 - RNA, 13 nt, Homo sapiens
ugacccacacugc

SEQ ID NO: 557836 - RNA, 16 nt, Homo sapiens
ugacccacacuuccau

SEQ ID NO: 557837 - RNA, 15 nt, Homo sapiens
ugacccacugaucuc

SEQ ID NO: 557838 - RNA, 21 nt, Homo sapiens
ugacccagaggaagccucuau

SEQ ID NO: 557839 - RNA, 14 nt, Homo sapiens
ugaccccaaagagc

SEQ ID NO: 557840 - RNA, 19 nt, Homo sapiens
ugaccccagcauuuccaga

SEQ ID NO: 557841 - RNA, 14 nt, Homo sapiens
ugacccccagcucc

SEQ ID NO: 557842 - RNA, 23 nt, Homo sapiens
ugaccccuccuuucuuccuccaa

SEQ ID NO: 557843 - RNA, 14 nt, Homo sapiens
ugaccccugcucag

SEQ ID NO: 557844 - RNA, 21 nt, Homo sapiens
ugacccuaugggucuaggaca

SEQ ID NO: 557845 - RNA, 22 nt, Homo sapiens
ugacccugaaaggaacacuggc

SEQ ID NO: 557846 - RNA, 18 nt, Homo sapiens
ugacccugggcuucugua

SEQ ID NO: 557847 - RNA, 10 nt, Homo sapiens
ugacccugua

SEQ ID NO: 557848 - RNA, 14 nt, Homo sapiens
ugaccgggcacugg

SEQ ID NO: 557849 - RNA, 22 nt, Homo sapiens
ugaccgggcucacuugcucaaa

SEQ ID NO: 557850 - RNA, 24 nt, Homo sapiens
ugaccguacucucacauguggcaa

SEQ ID NO: 557851 - RNA, 14 nt, Homo sapiens
ugaccguguacaau

SEQ ID NO: 557852 - RNA, 15 nt, Homo sapiens
ugacucucacaagau

SEQ ID NO: 557853 - RNA, 12 nt, Homo sapiens
ugacucuggaag

SEQ ID NO: 557854 - RNA, 15 nt, Homo sapiens
ugacugaaacauuca

SEQ ID NO: 557855 - RNA, 19 nt, Homo sapiens
ugacugaagugaacuauga

SEQ ID NO: 557856 - RNA, 15 nt, Homo sapiens
ugacugagaauauaa

SEQ ID NO: 557857 - RNA, 23 nt, Homo sapiens
ugacugagaauauaauacuguau

SEQ ID NO: 557858 - RNA, 14 nt, Homo sapiens
ugacugcaccagcg

SEQ ID NO: 557859 - RNA, 17 nt, Homo sapiens
ugacugcacccagcucc

SEQ ID NO: 557860 - RNA, 21 nt, Homo sapiens
ugacugccucugccugucgca

SEQ ID NO: 557861 - RNA, 20 nt, Homo sapiens
ugacugcucagaacuugcug

SEQ ID NO: 557862 - RNA, 19 nt, Homo sapiens
ugacugggcaacacugcag

SEQ ID NO: 557863 - RNA, 15 nt, Homo sapiens
ugacugguugucaga

SEQ ID NO: 557864 - RNA, 21 nt, Homo sapiens
ugacugguuuacaggcccugc

SEQ ID NO: 557865 - RNA, 17 nt, Homo sapiens
ugacuguaucuguguag

SEQ ID NO: 557866 - RNA, 14 nt, Homo sapiens
ugacugucagggag

SEQ ID NO: 557867 - RNA, 13 nt, Homo sapiens
ugacuuacuguac

SEQ ID NO: 557868 - RNA, 15 nt, Homo sapiens
ugacuuacugucagu

SEQ ID NO: 557869 - RNA, 13 nt, Homo sapiens
ugacuuauuagga

SEQ ID NO: 557870 - RNA, 14 nt, Homo sapiens
ugacuucaaugaua

SEQ ID NO: 557871 - RNA, 13 nt, Homo sapiens
ugacuucacugua

SEQ ID NO: 557872 - RNA, 19 nt, Homo sapiens
ugacuuccccacugcucuc

SEQ ID NO: 557873 - RNA, 19 nt, Homo sapiens
ugacuucccuggucaccaa

SEQ ID NO: 557874 - RNA, 21 nt, Homo sapiens
ugacuucccuggucaccaagg

SEQ ID NO: 557875 - RNA, 21 nt, Homo sapiens
ugacuucuagcugucugugaa

SEQ ID NO: 557876 - RNA, 14 nt, Homo sapiens
ugacuugacuuuag

SEQ ID NO: 557877 - RNA, 16 nt, Homo sapiens
ugacuugugucccaug

SEQ ID NO: 557878 - RNA, 17 nt, Homo sapiens
ugacuugugucccauga

SEQ ID NO: 557879 - RNA, 18 nt, Homo sapiens
ugacuuucugauuacugu

SEQ ID NO: 557880 - RNA, 22 nt, Homo sapiens
ugacuuucugauuggugauuca

SEQ ID NO: 557881 - RNA, 16 nt, Homo sapiens
ugacuuugcuccucac

SEQ ID NO: 557882 - RNA, 17 nt, Homo sapiens
ugacuuuuucagaguug

SEQ ID NO: 557883 - RNA, 23 nt, Homo sapiens
ugagaaaaauagagcaaaaucaa

SEQ ID NO: 557884 - RNA, 17 nt, Homo sapiens
ugagaaaacucaaccag

SEQ ID NO: 557885 - RNA, 22 nt, Homo sapiens
ugagaaaagaaauuaguuucaa

SEQ ID NO: 557886 - RNA, 23 nt, Homo sapiens
ugagaaaaguuuaaagacacuua

SEQ ID NO: 557887 - RNA, 22 nt, Homo sapiens
ugagaaaauaucuugcuuucaa

SEQ ID NO: 557888 - RNA, 23 nt, Homo sapiens
ugagaaaaugccucaauucacau

SEQ ID NO: 557889 - RNA, 22 nt, Homo sapiens
ugagaaacuuugaucucugcuu

SEQ ID NO: 557890 - RNA, 17 nt, Homo sapiens
ugagaaagaaacuaaua

SEQ ID NO: 557891 - RNA, 16 nt, Homo sapiens
ugagaaauuccuuagu

SEQ ID NO: 557892 - RNA, 18 nt, Homo sapiens
ugagaaauuuaaacuaua

SEQ ID NO: 557893 - RNA, 20 nt, Homo sapiens
ugagaaccuuggaccacucc

SEQ ID NO: 557894 - RNA, 21 nt, Homo sapiens
ugagaacucguucaccuccaa

SEQ ID NO: 557895 - RNA, 17 nt, Homo sapiens
ugagaacugacuuucuc

SEQ ID NO: 557896 - RNA, 20 nt, Homo sapiens
ugagaacuuccaacaagccu

SEQ ID NO: 557897 - RNA, 14 nt, Homo sapiens
ugagaagaaugacu

SEQ ID NO: 557898 - RNA, 21 nt, Homo sapiens
ugagaagagugaggcagcgcc

SEQ ID NO: 557899 - RNA, 19 nt, Homo sapiens
ugagaagccuucagcucca

SEQ ID NO: 557900 - RNA, 22 nt, Homo sapiens
ugagaaggagggucucuugccc

SEQ ID NO: 557901 - RNA, 18 nt, Homo sapiens
ugagaaggagucagaaac

SEQ ID NO: 557902 - RNA, 19 nt, Homo sapiens
ugagaaguacuuuaccuga

SEQ ID NO: 557903 - RNA, 13 nt, Homo sapiens
ugagaagugcacu

SEQ ID NO: 557904 - RNA, 20 nt, Homo sapiens
ugagaagugucuaaaaacac

SEQ ID NO: 557905 - RNA, 14 nt, Homo sapiens
ugagaauauaaaaa

SEQ ID NO: 557906 - RNA, 15 nt, Homo sapiens
ugagaauguggaaua

SEQ ID NO: 557907 - RNA, 21 nt, Homo sapiens
ugagaauguucaucucuccag

SEQ ID NO: 557908 - RNA, 16 nt, Homo sapiens
ugagaauuguauguca

SEQ ID NO: 557909 - RNA, 21 nt, Homo sapiens
ugagacaggaaaaaccaacag

SEQ ID NO: 557910 - RNA, 22 nt, Homo sapiens
ugagacaguuuacuuugccaac

SEQ ID NO: 557911 - RNA, 16 nt, Homo sapiens
ugagacccagugcacu

SEQ ID NO: 557912 - RNA, 16 nt, Homo sapiens
ugagacccugucucaa

SEQ ID NO: 557913 - RNA, 22 nt, Homo sapiens
ugagacuacaagugugugccac

SEQ ID NO: 557914 - RNA, 14 nt, Homo sapiens
ugagacuccaccuc

SEQ ID NO: 557915 - RNA, 22 nt, Homo sapiens
ugagacuccacucaggugcaca

SEQ ID NO: 557916 - RNA, 18 nt, Homo sapiens
ugagacuccucauaccuc

SEQ ID NO: 557917 - RNA, 17 nt, Homo sapiens
ugagacucuagggucca

SEQ ID NO: 557918 - RNA, 17 nt, Homo sapiens
ugagacugaaauuuagu

SEQ ID NO: 557919 - RNA, 16 nt, Homo sapiens
ugagacugaacugugu

SEQ ID NO: 557920 - RNA, 21 nt, Homo sapiens
ugagacuugaaaccagaagaa

SEQ ID NO: 557921 - RNA, 22 nt, Homo sapiens
ugagacuuucuucuagugcuuu

SEQ ID NO: 557922 - RNA, 23 nt, Homo sapiens
ugagacuuucuucuagugcuuuu

SEQ ID NO: 557923 - RNA, 20 nt, Homo sapiens
ugagagaaggaugggucccc

SEQ ID NO: 557924 - RNA, 15 nt, Homo sapiens
ugagagaaguacaaa

SEQ ID NO: 557925 - RNA, 14 nt, Homo sapiens
ugagagacccaagg

SEQ ID NO: 557926 - RNA, 14 nt, Homo sapiens
ugagagagacaaga

SEQ ID NO: 557927 - RNA, 13 nt, Homo sapiens
ugagaggaugaau

SEQ ID NO: 557928 - RNA, 14 nt, Homo sapiens
ugagaggcaaugau

SEQ ID NO: 557929 - RNA, 18 nt, Homo sapiens
ugagaggcaggaaugggg

SEQ ID NO: 557930 - RNA, 23 nt, Homo sapiens
ugagaggcugucuguuguauuca

SEQ ID NO: 557931 - RNA, 15 nt, Homo sapiens
ugagaggugacacug

SEQ ID NO: 557932 - RNA, 22 nt, Homo sapiens
ugagaguaucaggucucccacg

SEQ ID NO: 557933 - RNA, 14 nt, Homo sapiens
ugagagucaaagcu

SEQ ID NO: 557934 - RNA, 20 nt, Homo sapiens
ugagaguggugcccuggaac

SEQ ID NO: 557935 - RNA, 14 nt, Homo sapiens
ugagaguugucucu

SEQ ID NO: 557936 - RNA, 17 nt, Homo sapiens
ugagaguuuacuuuuau

SEQ ID NO: 557937 - RNA, 18 nt, Homo sapiens
ugagauauacgcccucuu

SEQ ID NO: 557938 - RNA, 18 nt, Homo sapiens
ugagauccgggagacuga

SEQ ID NO: 557939 - RNA, 17 nt, Homo sapiens
ugagaucguuguuuaca

SEQ ID NO: 557940 - RNA, 19 nt, Homo sapiens
ugagaucuccacggucaga

SEQ ID NO: 557941 - RNA, 17 nt, Homo sapiens
ugagaugcagcuggaaa

SEQ ID NO: 557942 - RNA, 22 nt, Homo sapiens
ugagaugcaggugaugccauua

SEQ ID NO: 557943 - RNA, 14 nt, Homo sapiens
ugagauguguauca

SEQ ID NO: 557944 - RNA, 15 nt, Homo sapiens
ugagauguuuuacca

SEQ ID NO: 557945 - RNA, 21 nt, Homo sapiens
ugagauucagaugucauuuag

SEQ ID NO: 557946 - RNA, 19 nt, Homo sapiens
ugagauugaauuucacugu

SEQ ID NO: 557947 - RNA, 12 nt, Homo sapiens
ugagcaacucuu

SEQ ID NO: 557948 - RNA, 19 nt, Homo sapiens
ugagcaacucuugauuauc

SEQ ID NO: 557949 - RNA, 15 nt, Homo sapiens
ugagcaagacauacu

SEQ ID NO: 557950 - RNA, 19 nt, Homo sapiens
ugagcaagaugauguaaug

SEQ ID NO: 557951 - RNA, 22 nt, Homo sapiens
ugagcaagucuuagacaucaua

SEQ ID NO: 557952 - RNA, 18 nt, Homo sapiens
ugagcaaugucugugcua

SEQ ID NO: 557953 - RNA, 21 nt, Homo sapiens
ugagcacaaaauuaugcaaau

SEQ ID NO: 557954 - RNA, 14 nt, Homo sapiens
ugagcacacuuuag

SEQ ID NO: 557955 - RNA, 19 nt, Homo sapiens
ugagcaccagccugaaugc

SEQ ID NO: 557956 - RNA, 17 nt, Homo sapiens
ugagcacccaagccagg

SEQ ID NO: 557957 - RNA, 19 nt, Homo sapiens
ugagcacggacucucccag

SEQ ID NO: 557958 - RNA, 16 nt, Homo sapiens
ugagcagaagaucaag

SEQ ID NO: 557959 - RNA, 17 nt, Homo sapiens
ugagcagagauguacug

SEQ ID NO: 557960 - RNA, 20 nt, Homo sapiens
ugagcagagauguacugcaa

SEQ ID NO: 557961 - RNA, 20 nt, Homo sapiens
ugagcagcuacuguaacuuu

SEQ ID NO: 557962 - RNA, 18 nt, Homo sapiens
ugagcaugcacagcugcu

SEQ ID NO: 557963 - RNA, 19 nt, Homo sapiens
ugagccacagucacuggau

SEQ ID NO: 557964 - RNA, 23 nt, Homo sapiens
ugagccacugcucguggccaaaa

SEQ ID NO: 557965 - RNA, 15 nt, Homo sapiens
ugagccacugugcuu

SEQ ID NO: 557966 - RNA, 16 nt, Homo sapiens
ugagccaguggugcua

SEQ ID NO: 557967 - RNA, 16 nt, Homo sapiens
ugagccaucacuagaa

SEQ ID NO: 557968 - RNA, 14 nt, Homo sapiens
ugagccaucauuuc

SEQ ID NO: 557969 - RNA, 18 nt, Homo sapiens
ugagccaugcuacaguua

SEQ ID NO: 557970 - RNA, 22 nt, Homo sapiens
ugagcccacaaagccuuaucaa

SEQ ID NO: 557971 - RNA, 22 nt, Homo sapiens
ugagcccagcugggucaggcag

SEQ ID NO: 557972 - RNA, 21 nt, Homo sapiens
ugagcccccccaacacugugc

SEQ ID NO: 557973 - RNA, 14 nt, Homo sapiens
ugagccccuacccc

SEQ ID NO: 557974 - RNA, 15 nt, Homo sapiens
ugccuaacuuguaaa

SEQ ID NO: 557975 - RNA, 22 nt, Homo sapiens
ugccuaaggugucugaguuucu

SEQ ID NO: 557976 - RNA, 16 nt, Homo sapiens
ugccuaauuccuggca

SEQ ID NO: 557977 - RNA, 21 nt, Homo sapiens
ugccuaauuuugaacuaguaa

SEQ ID NO: 557978 - RNA, 13 nt, Homo sapiens
ugccuacagccag

SEQ ID NO: 557979 - RNA, 15 nt, Homo sapiens
ugccuacagccaggu

SEQ ID NO: 557980 - RNA, 18 nt, Homo sapiens
ugccuacuuuucuuuauu

SEQ ID NO: 557981 - RNA, 21 nt, Homo sapiens
ugccuagauuagguagacuuu

SEQ ID NO: 557982 - RNA, 13 nt, Homo sapiens
ugccuagggccug

SEQ ID NO: 557983 - RNA, 19 nt, Homo sapiens
ugccuaguaacacauaugu

SEQ ID NO: 557984 - RNA, 15 nt, Homo sapiens
ugccuaguccaacau

SEQ ID NO: 557985 - RNA, 18 nt, Homo sapiens
ugccuauuugaaguacag

SEQ ID NO: 557986 - RNA, 13 nt, Homo sapiens
ugccucaagacua

SEQ ID NO: 557987 - RNA, 23 nt, Homo sapiens
ugccucaccuaauaggcugggag

SEQ ID NO: 557988 - RNA, 16 nt, Homo sapiens
ugccucacuuccuaca

SEQ ID NO: 557989 - RNA, 14 nt, Homo sapiens
ugccucagcuuccc

SEQ ID NO: 557990 - RNA, 21 nt, Homo sapiens
ugccuccagugcaguccauuu

SEQ ID NO: 557991 - RNA, 22 nt, Homo sapiens
ugccuccauucugaccauuuca

SEQ ID NO: 557992 - RNA, 14 nt, Homo sapiens
ugccucccaugccu

SEQ ID NO: 557993 - RNA, 21 nt, Homo sapiens
ugccucccccuaaauuaauga

SEQ ID NO: 557994 - RNA, 21 nt, Homo sapiens
ugccuccccugucucuaagga

SEQ ID NO: 557995 - RNA, 18 nt, Homo sapiens
ugccucccuuucugggag

SEQ ID NO: 557996 - RNA, 21 nt, Homo sapiens
ugccuccucguuccuuucucc

SEQ ID NO: 557997 - RNA, 22 nt, Homo sapiens
ugccuccuggacuguucacggc

SEQ ID NO: 557998 - RNA, 17 nt, Homo sapiens
ugccuccugguuuccuu

SEQ ID NO: 557999 - RNA, 18 nt, Homo sapiens
ugccuccuuugcaccuga

SEQ ID NO: 558000 - RNA, 22 nt, Homo sapiens
ugccucuacuuugauucugaua

SEQ ID NO: 558001 - RNA, 12 nt, Homo sapiens
ugccucugcucc

SEQ ID NO: 558002 - RNA, 21 nt, Homo sapiens
ugccucuguggaagagauucc

SEQ ID NO: 558003 - RNA, 23 nt, Homo sapiens
ugccucuugaaugcagggacaaa

SEQ ID NO: 558004 - RNA, 13 nt, Homo sapiens
ugccucuuggccu

SEQ ID NO: 558005 - RNA, 22 nt, Homo sapiens
ugccugaaggcucacaccucau

SEQ ID NO: 558006 - RNA, 13 nt, Homo sapiens
ugccugacauuug

SEQ ID NO: 558007 - RNA, 13 nt, Homo sapiens
ugccugauuagau

SEQ ID NO: 558008 - RNA, 15 nt, Homo sapiens
ugccugcaugaaaca

SEQ ID NO: 558009 - RNA, 15 nt, Homo sapiens
ugccugccacccugc

SEQ ID NO: 558010 - RNA, 12 nt, Homo sapiens
ugccugccauuu

SEQ ID NO: 558011 - RNA, 14 nt, Homo sapiens
ugccugcucaggug

SEQ ID NO: 558012 - RNA, 16 nt, Homo sapiens
ugccugcuguauuuau

SEQ ID NO: 558013 - RNA, 23 nt, Homo sapiens
ugccuggagacagauacguaguu

SEQ ID NO: 558014 - RNA, 13 nt, Homo sapiens
ugccuggagacau

SEQ ID NO: 558015 - RNA, 20 nt, Homo sapiens
ugccuggccaggcagaucug

SEQ ID NO: 558016 - RNA, 22 nt, Homo sapiens
ugccugggaccugaaccuggag

SEQ ID NO: 558017 - RNA, 19 nt, Homo sapiens
ugccugggaucgugcauuu

SEQ ID NO: 558018 - RNA, 14 nt, Homo sapiens
ugccugguacagua

SEQ ID NO: 558019 - RNA, 15 nt, Homo sapiens
ugccuggucccaaga

SEQ ID NO: 558020 - RNA, 17 nt, Homo sapiens
ugccuggugugccucag

SEQ ID NO: 558021 - RNA, 13 nt, Homo sapiens
ugccugguuuuau

SEQ ID NO: 558022 - RNA, 18 nt, Homo sapiens
ugccuguaaucccaacac

SEQ ID NO: 558023 - RNA, 22 nt, Homo sapiens
ugccuguaaucucagcacuuug

SEQ ID NO: 558024 - RNA, 21 nt, Homo sapiens
ugccuguacuaaggagcauga

SEQ ID NO: 558025 - RNA, 19 nt, Homo sapiens
ugccugucuguuacacugg

SEQ ID NO: 558026 - RNA, 21 nt, Homo sapiens
ugccugugcaugaccugauca

SEQ ID NO: 558027 - RNA, 18 nt, Homo sapiens
ugccugugcuacaauuca

SEQ ID NO: 558028 - RNA, 15 nt, Homo sapiens
ugccuguguccugau

SEQ ID NO: 558029 - RNA, 16 nt, Homo sapiens
ugccuguuaauuuaua

SEQ ID NO: 558030 - RNA, 18 nt, Homo sapiens
ugccuguucuaugccuuu

SEQ ID NO: 558031 - RNA, 15 nt, Homo sapiens
ugccuuaaacacuca

SEQ ID NO: 558032 - RNA, 15 nt, Homo sapiens
ugccuuaagccaaua

SEQ ID NO: 558033 - RNA, 14 nt, Homo sapiens
ugccuuacaaaaua

SEQ ID NO: 558034 - RNA, 13 nt, Homo sapiens
ugccuuacuguac

SEQ ID NO: 558035 - RNA, 17 nt, Homo sapiens
ugccuuagcaugugacu

SEQ ID NO: 558036 - RNA, 19 nt, Homo sapiens
ugccuuaggguagugcuaa

SEQ ID NO: 558037 - RNA, 15 nt, Homo sapiens
ugccuucaccuccuc

SEQ ID NO: 558038 - RNA, 19 nt, Homo sapiens
ugccuuccuccuuauccua

SEQ ID NO: 558039 - RNA, 12 nt, Homo sapiens
ugccuuccugcc

SEQ ID NO: 558040 - RNA, 21 nt, Homo sapiens
ugccuucucacaucuguccag

SEQ ID NO: 558041 - RNA, 18 nt, Homo sapiens
ugccuucucaugauccaa

SEQ ID NO: 558042 - RNA, 13 nt, Homo sapiens
ugccuucugccaa

SEQ ID NO: 558043 - RNA, 14 nt, Homo sapiens
ugccuucuggccuu

SEQ ID NO: 558044 - RNA, 20 nt, Homo sapiens
ugccuucuuauugcuuuuau

SEQ ID NO: 558045 - RNA, 13 nt, Homo sapiens
cagcaaaguuaug

SEQ ID NO: 558046 - RNA, 22 nt, Homo sapiens
cagcaaauaacagucugagacu

SEQ ID NO: 558047 - RNA, 14 nt, Homo sapiens
cagcaacacagcca

SEQ ID NO: 558048 - RNA, 17 nt, Homo sapiens
cagcaacagcaaaucac

SEQ ID NO: 558049 - RNA, 20 nt, Homo sapiens
cagcaacggggaggccaagu

SEQ ID NO: 558050 - RNA, 15 nt, Homo sapiens
cagcaacugaccuga

SEQ ID NO: 558051 - RNA, 14 nt, Homo sapiens
cagcaagacuuuau

SEQ ID NO: 558052 - RNA, 19 nt, Homo sapiens
cagcaaggauggagcugaa

SEQ ID NO: 558053 - RNA, 21 nt, Homo sapiens
cagcaaggccuugguggagca

SEQ ID NO: 558054 - RNA, 21 nt, Homo sapiens
cagcaagggaccugcucauca

SEQ ID NO: 558055 - RNA, 21 nt, Homo sapiens
cagcaagguggccacaguguc

SEQ ID NO: 558056 - RNA, 23 nt, Homo sapiens
cagcaagucccagacaaggagag

SEQ ID NO: 558057 - RNA, 18 nt, Homo sapiens
cagcaauagggugcaguu

SEQ ID NO: 558058 - RNA, 14 nt, Homo sapiens
cagcaauauugccu

SEQ ID NO: 558059 - RNA, 22 nt, Homo sapiens
cagcaauucuccugccucagcc

SEQ ID NO: 558060 - RNA, 19 nt, Homo sapiens
cagcaauugucuacauuca

SEQ ID NO: 558061 - RNA, 20 nt, Homo sapiens
cagcaauugucuacauucag

SEQ ID NO: 558062 - RNA, 17 nt, Homo sapiens
cagcaauuucagaacca

SEQ ID NO: 558063 - RNA, 16 nt, Homo sapiens
cagcacacagggcagu

SEQ ID NO: 558064 - RNA, 20 nt, Homo sapiens
cagcacaccugccgucuuca

SEQ ID NO: 558065 - RNA, 20 nt, Homo sapiens
cagcacacgaguuccagacc

SEQ ID NO: 558066 - RNA, 21 nt, Homo sapiens
cagcacagcgaagacugcuaa

SEQ ID NO: 558067 - RNA, 15 nt, Homo sapiens
cagcacauagcuugc

SEQ ID NO: 558068 - RNA, 16 nt, Homo sapiens
cagcaccacauugccu

SEQ ID NO: 558069 - RNA, 21 nt, Homo sapiens
cagcaccagccccccucucaa

SEQ ID NO: 558070 - RNA, 17 nt, Homo sapiens
cagcacccccacccacc

SEQ ID NO: 558071 - RNA, 11 nt, Homo sapiens
cagcaccucau

SEQ ID NO: 558072 - RNA, 19 nt, Homo sapiens
cagcacucccuuuuuuaua

SEQ ID NO: 558073 - RNA, 22 nt, Homo sapiens
cagcacuccuguuccucuguua

SEQ ID NO: 558074 - RNA, 11 nt, Homo sapiens
cagcacuggac

SEQ ID NO: 558075 - RNA, 13 nt, Homo sapiens
cagcacuggugaa

SEQ ID NO: 558076 - RNA, 12 nt, Homo sapiens
cagcacugugag

SEQ ID NO: 558077 - RNA, 16 nt, Homo sapiens
cagcacuuguguuguc

SEQ ID NO: 558078 - RNA, 16 nt, Homo sapiens
cagcagaaaaucuuuu

SEQ ID NO: 558079 - RNA, 17 nt, Homo sapiens
cagcagaaauuaaauga

SEQ ID NO: 558080 - RNA, 17 nt, Homo sapiens
cagcagaacuucugaaa

SEQ ID NO: 558081 - RNA, 16 nt, Homo sapiens
cagcagaauggaggca

SEQ ID NO: 558082 - RNA, 12 nt, Homo sapiens
cagcagacacag

SEQ ID NO: 558083 - RNA, 19 nt, Homo sapiens
cagcagacugaccaucucc

SEQ ID NO: 558084 - RNA, 21 nt, Homo sapiens
cagcagacugaccaucuccca

SEQ ID NO: 558085 - RNA, 22 nt, Homo sapiens
cagcagaugcuguugugaagcu

SEQ ID NO: 558086 - RNA, 22 nt, Homo sapiens
cuaucucauagggaugcuguga

SEQ ID NO: 558087 - RNA, 13 nt, Homo sapiens
cuaucuccugaca

SEQ ID NO: 558088 - RNA, 23 nt, Homo sapiens
cuaucuccugacagaaggugcca

SEQ ID NO: 558089 - RNA, 20 nt, Homo sapiens
cuaucucuacugaaugucau

SEQ ID NO: 558090 - RNA, 20 nt, Homo sapiens
cuaucugauuuccuaauguc

SEQ ID NO: 558091 - RNA, 21 nt, Homo sapiens
cuaucugguuggaugguggcu

SEQ ID NO: 558092 - RNA, 21 nt, Homo sapiens
cuaucuuugauauuggcuuaa

SEQ ID NO: 558093 - RNA, 20 nt, Homo sapiens
cuaugaaaaugagcaucaga

SEQ ID NO: 558094 - RNA, 13 nt, Homo sapiens
cuaugacaucuaa

SEQ ID NO: 558095 - RNA, 21 nt, Homo sapiens
cuaugacuggaguaaaccaug

SEQ ID NO: 558096 - RNA, 13 nt, Homo sapiens
cuaugaguuuucu

SEQ ID NO: 558097 - RNA, 13 nt, Homo sapiens
cuaugauauaaca

SEQ ID NO: 558098 - RNA, 20 nt, Homo sapiens
cuaugauauuccccauuucc

SEQ ID NO: 558099 - RNA, 15 nt, Homo sapiens
cuaugaucacaguga

SEQ ID NO: 558100 - RNA, 19 nt, Homo sapiens
cuaugcaacagcucucacc

SEQ ID NO: 558101 - RNA, 22 nt, Homo sapiens
cuaugcaacagcucucaccuac

SEQ ID NO: 558102 - RNA, 11 nt, Homo sapiens
cuaugcaaggg

SEQ ID NO: 558103 - RNA, 23 nt, Homo sapiens
cuaugcaauuuuucaagagcucc

SEQ ID NO: 558104 - RNA, 18 nt, Homo sapiens
cuaugcauuaagaguaaa

SEQ ID NO: 558105 - RNA, 22 nt, Homo sapiens
cuaugcauuuucuucacagugc

SEQ ID NO: 558106 - RNA, 14 nt, Homo sapiens
cuaugccuguggug

SEQ ID NO: 558107 - RNA, 14 nt, Homo sapiens
cuaugccuugcaca

SEQ ID NO: 558108 - RNA, 11 nt, Homo sapiens
cuaugccuuua

SEQ ID NO: 558109 - RNA, 17 nt, Homo sapiens
cuaugcuggcuuuucac

SEQ ID NO: 558110 - RNA, 19 nt, Homo sapiens
cuauggauuugaaguuugc

SEQ ID NO: 558111 - RNA, 14 nt, Homo sapiens
cuauggccagucug

SEQ ID NO: 558112 - RNA, 22 nt, Homo sapiens
cuauggcccugcaaaaauauaa

SEQ ID NO: 558113 - RNA, 14 nt, Homo sapiens
cuauggcucugcaa

SEQ ID NO: 558114 - RNA, 18 nt, Homo sapiens
cuaugggacugcagugcc

SEQ ID NO: 558115 - RNA, 15 nt, Homo sapiens
cuaugggggcacuga

SEQ ID NO: 558116 - RNA, 18 nt, Homo sapiens
cuauggugagaugcagcu

SEQ ID NO: 558117 - RNA, 14 nt, Homo sapiens
cuaugguugccacc

SEQ ID NO: 558118 - RNA, 19 nt, Homo sapiens
cuauguaaacaaaccacag

SEQ ID NO: 558119 - RNA, 13 nt, Homo sapiens
cuauguacuuuaa

SEQ ID NO: 558120 - RNA, 15 nt, Homo sapiens
cuauguagcugaaaa

SEQ ID NO: 558121 - RNA, 16 nt, Homo sapiens
cuauguccauucucau

SEQ ID NO: 558122 - RNA, 22 nt, Homo sapiens
cuaugucuuguuuuaaguugcu

SEQ ID NO: 558123 - RNA, 15 nt, Homo sapiens
cuaugugauuacaag

SEQ ID NO: 558124 - RNA, 16 nt, Homo sapiens
cuaugugcacacuuac

SEQ ID NO: 558125 - RNA, 15 nt, Homo sapiens
cuauguggcuguauc

SEQ ID NO: 558126 - RNA, 20 nt, Homo sapiens
cuauguuaaugaguauguaa

SEQ ID NO: 558127 - RNA, 18 nt, Homo sapiens
cuauguuuggaguuuaau

SEQ ID NO: 558128 - RNA, 19 nt, Homo sapiens
cuauguuugugugauuucc

SEQ ID NO: 558129 - RNA, 20 nt, Homo sapiens
cuauuaaucaccucucugua

SEQ ID NO: 558130 - RNA, 20 nt, Homo sapiens
cuauuaaugaggucuuuaaa

SEQ ID NO: 558131 - RNA, 20 nt, Homo sapiens
cuauuauagcaacuuuaaga

SEQ ID NO: 558132 - RNA, 13 nt, Homo sapiens
cuauuaucucaau

SEQ ID NO: 558133 - RNA, 19 nt, Homo sapiens
cuauuauggaaaacugugu

SEQ ID NO: 558134 - RNA, 21 nt, Homo sapiens
cuauuauuuggagccugccaa

SEQ ID NO: 558135 - RNA, 20 nt, Homo sapiens
cuauucaggcuguuguuggc

SEQ ID NO: 558136 - RNA, 22 nt, Homo sapiens
cuauuccauggcuaacuggcga

SEQ ID NO: 558137 - RNA, 12 nt, Homo sapiens
cuauuccugcug

SEQ ID NO: 558138 - RNA, 16 nt, Homo sapiens
cuauucuauccaucuc

SEQ ID NO: 558139 - RNA, 23 nt, Homo sapiens
cuauucuggcaauaaacuuuuag

SEQ ID NO: 558140 - RNA, 18 nt, Homo sapiens
cuauucuuaagcacuuug

SEQ ID NO: 558141 - RNA, 20 nt, Homo sapiens
cuauucuuaagcacuuugaa

SEQ ID NO: 558142 - RNA, 14 nt, Homo sapiens
cuauugaacuguau

SEQ ID NO: 558143 - RNA, 16 nt, Homo sapiens
cuauugagcagagccu

SEQ ID NO: 558144 - RNA, 22 nt, Homo sapiens
cuauugcagagacucauuucac

SEQ ID NO: 558145 - RNA, 23 nt, Homo sapiens
cuauuguggguuuuuuugaaugu

SEQ ID NO: 558146 - RNA, 15 nt, Homo sapiens
cuauuguuacauuau

SEQ ID NO: 558147 - RNA, 21 nt, Homo sapiens
cuauuuaaaaaaaaagucaga

SEQ ID NO: 558148 - RNA, 13 nt, Homo sapiens
cuauuuaaagcau

SEQ ID NO: 558149 - RNA, 14 nt, Homo sapiens
cuauuuaacaacug

SEQ ID NO: 558150 - RNA, 15 nt, Homo sapiens
cuauuuaacaacugg

SEQ ID NO: 558151 - RNA, 16 nt, Homo sapiens
cuauuuaagugcaauu

SEQ ID NO: 558152 - RNA, 16 nt, Homo sapiens
cuauuuaaugcuucca

SEQ ID NO: 558153 - RNA, 14 nt, Homo sapiens
cuauuuaucuguag

SEQ ID NO: 558154 - RNA, 18 nt, Homo sapiens
cuauuuaugaaaaccaua

SEQ ID NO: 558155 - RNA, 13 nt, Homo sapiens
cuauuuaugcaac

SEQ ID NO: 558156 - RNA, 18 nt, Homo sapiens
cuauuuauugacuuugac

SEQ ID NO: 558157 - RNA, 15 nt, Homo sapiens
cuauuuauuuacaaa

SEQ ID NO: 558158 - RNA, 16 nt, Homo sapiens
cuauuucaucacaaga

SEQ ID NO: 558159 - RNA, 22 nt, Homo sapiens
cuauuucauguuuuugaucaaa

SEQ ID NO: 558160 - RNA, 18 nt, Homo sapiens
cuauuuccaaaagcacau

SEQ ID NO: 558161 - RNA, 18 nt, Homo sapiens
cuauuuccucugugcaaa

SEQ ID NO: 558162 - RNA, 15 nt, Homo sapiens
cuauuucuugaagaa

SEQ ID NO: 558163 - RNA, 15 nt, Homo sapiens
cuauuugaacaagug

SEQ ID NO: 558164 - RNA, 20 nt, Homo sapiens
cuauuugagauugaugacaa

SEQ ID NO: 558165 - RNA, 15 nt, Homo sapiens
cuauuuguacaauuu

SEQ ID NO: 558166 - RNA, 15 nt, Homo sapiens
cuauuuguucagaga

SEQ ID NO: 558167 - RNA, 17 nt, Homo sapiens
cuauuuguuuacaugca

SEQ ID NO: 558168 - RNA, 17 nt, Homo sapiens
cuauuuuaaguauguga

SEQ ID NO: 558169 - RNA, 18 nt, Homo sapiens
cuauuuuauuuguauuca

SEQ ID NO: 558170 - RNA, 22 nt, Homo sapiens
cuauuuucagagcaugauacaa

SEQ ID NO: 558171 - RNA, 17 nt, Homo sapiens
cuauuuugugaagccau

SEQ ID NO: 558172 - RNA, 24 nt, Homo sapiens
cucaaaaaaaaaaaaaugcacaua

SEQ ID NO: 558173 - RNA, 14 nt, Homo sapiens
cucaaaaaguuaaa

SEQ ID NO: 558174 - RNA, 17 nt, Homo sapiens
cucaaaaauaaugcaua

SEQ ID NO: 558175 - RNA, 15 nt, Homo sapiens
cucaaaacacccaaa

SEQ ID NO: 558176 - RNA, 16 nt, Homo sapiens
cucaaaacacccaaaa

SEQ ID NO: 558177 - RNA, 18 nt, Homo sapiens
cucaaaacacccaaaaau

SEQ ID NO: 558178 - RNA, 13 nt, Homo sapiens
cucaaaacaguaa

SEQ ID NO: 558179 - RNA, 14 nt, Homo sapiens
cucaaaaccuccaa

SEQ ID NO: 558180 - RNA, 11 nt, Homo sapiens
cucaaaaccug

SEQ ID NO: 558181 - RNA, 13 nt, Homo sapiens
cucaaaacuuaac

SEQ ID NO: 558182 - RNA, 21 nt, Homo sapiens
cucaaaagaaaaaaaaaagca

SEQ ID NO: 558183 - RNA, 11 nt, Homo sapiens
cucaaaaucuu

SEQ ID NO: 558184 - RNA, 12 nt, Homo sapiens
cucaaaauugau

SEQ ID NO: 558185 - RNA, 15 nt, Homo sapiens
cucaaaccacuugcc

SEQ ID NO: 558186 - RNA, 16 nt, Homo sapiens
cucaaaccacuugccu

SEQ ID NO: 558187 - RNA, 21 nt, Homo sapiens
cucaaacccuguggggccuga

SEQ ID NO: 558188 - RNA, 19 nt, Homo sapiens
cucaaacguacaagucagu

SEQ ID NO: 558189 - RNA, 23 nt, Homo sapiens
cucaaacuccugaccuugugauu

SEQ ID NO: 558190 - RNA, 13 nt, Homo sapiens
cucaaacuugaga

SEQ ID NO: 558191 - RNA, 19 nt, Homo sapiens
cucaaagaugcguuugccu

SEQ ID NO: 558192 - RNA, 15 nt, Homo sapiens
cucaaauaacuaaaa

SEQ ID NO: 558193 - RNA, 14 nt, Homo sapiens
cucaaaucuauuca

SEQ ID NO: 558194 - RNA, 18 nt, Homo sapiens
cucaaaucugagggagcu

SEQ ID NO: 558195 - RNA, 17 nt, Homo sapiens
cucaaaugacccaaaga

SEQ ID NO: 558196 - RNA, 22 nt, Homo sapiens
cucaaaugacccaaagaccaau

SEQ ID NO: 558197 - RNA, 18 nt, Homo sapiens
cucaaaugcacaucucau

SEQ ID NO: 558198 - RNA, 21 nt, Homo sapiens
cucaaaugcacaucucauggc

SEQ ID NO: 558199 - RNA, 20 nt, Homo sapiens
cucaacaaagcacaguguua

SEQ ID NO: 558200 - RNA, 15 nt, Homo sapiens
cucaacaaccugaau

SEQ ID NO: 558201 - RNA, 20 nt, Homo sapiens
cucaacaauauauguccuau

SEQ ID NO: 558202 - RNA, 21 nt, Homo sapiens
cucaacaauauauguccuaua

SEQ ID NO: 558203 - RNA, 23 nt, Homo sapiens
cucaacauguuacugaccagcaa

SEQ ID NO: 558204 - RNA, 20 nt, Homo sapiens
cucaacauugcauggugcua

SEQ ID NO: 558205 - RNA, 12 nt, Homo sapiens
cucaaccagagu

SEQ ID NO: 558206 - RNA, 19 nt, Homo sapiens
cucaacugccuacuccaaa

SEQ ID NO: 558207 - RNA, 21 nt, Homo sapiens
cucaacugccuacuccaaaau

SEQ ID NO: 558208 - RNA, 12 nt, Homo sapiens
cucaacuuuaag

SEQ ID NO: 558209 - RNA, 14 nt, Homo sapiens
cucaagaaagcccu

SEQ ID NO: 558210 - RNA, 16 nt, Homo sapiens
cucaagacaaugcacc

SEQ ID NO: 558211 - RNA, 15 nt, Homo sapiens
cucaagauucaguag

SEQ ID NO: 558212 - RNA, 19 nt, Homo sapiens
cucaagcagaccuacagca

SEQ ID NO: 558213 - RNA, 22 nt, Homo sapiens
cucaagcaugaagauaaacaca

SEQ ID NO: 558214 - RNA, 20 nt, Homo sapiens
cucaagccccauuuccucac

SEQ ID NO: 558215 - RNA, 17 nt, Homo sapiens
cucaaggaauuugcauu

SEQ ID NO: 558216 - RNA, 15 nt, Homo sapiens
cucaaggacuugaaa

SEQ ID NO: 558217 - RNA, 16 nt, Homo sapiens
cucaagggaugucuca

SEQ ID NO: 558218 - RNA, 23 nt, Homo sapiens
cucaaggggcuggaaucucauga

SEQ ID NO: 558219 - RNA, 21 nt, Homo sapiens
cucaaggguggcaggucacug

SEQ ID NO: 558220 - RNA, 18 nt, Homo sapiens
cucaaggucaucaaacau

SEQ ID NO: 558221 - RNA, 19 nt, Homo sapiens
cucaaguccaaggcuuuau

SEQ ID NO: 558222 - RNA, 17 nt, Homo sapiens
cucaagucuucccugau

SEQ ID NO: 558223 - RNA, 20 nt, Homo sapiens
cucaaguucauugaugaccc

SEQ ID NO: 558224 - RNA, 14 nt, Homo sapiens
cucaaguuccaugc

SEQ ID NO: 558225 - RNA, 19 nt, Homo sapiens
cucaaguuuuuguuuugua

SEQ ID NO: 558226 - RNA, 23 nt, Homo sapiens
cucaauaaaguacaagagcuuaa

SEQ ID NO: 558227 - RNA, 19 nt, Homo sapiens
cucaauaaaugauucuuag

SEQ ID NO: 558228 - RNA, 14 nt, Homo sapiens
cucaauacuugaau

SEQ ID NO: 558229 - RNA, 16 nt, Homo sapiens
cucaauccuaucacag

SEQ ID NO: 558230 - RNA, 23 nt, Homo sapiens
cucaaucucagcuaacauuccau

SEQ ID NO: 558231 - RNA, 19 nt, Homo sapiens
cucaauggagguuugcaaa

SEQ ID NO: 558232 - RNA, 21 nt, Homo sapiens
cucaauucuuuguauaugcau

SEQ ID NO: 558233 - RNA, 22 nt, Homo sapiens
cucaauucuuuguauaugcauu

SEQ ID NO: 558234 - RNA, 23 nt, Homo sapiens
cucaauugauccucccaucucag

SEQ ID NO: 558235 - RNA, 21 nt, Homo sapiens
cucaauuuugucuguacucau

SEQ ID NO: 558236 - RNA, 16 nt, Homo sapiens
cucaauuuuugucuca

SEQ ID NO: 558237 - RNA, 23 nt, Homo sapiens
cucacaaaaaggcaaauauugaa

SEQ ID NO: 558238 - RNA, 18 nt, Homo sapiens
cucacaaaccaugcaaau

SEQ ID NO: 558239 - RNA, 18 nt, Homo sapiens
cucacaaaguccacuuua

SEQ ID NO: 558240 - RNA, 16 nt, Homo sapiens
cucacaagaagaccag

SEQ ID NO: 558241 - RNA, 23 nt, Homo sapiens
cucacacuuuuggaaccaugccu

SEQ ID NO: 558242 - RNA, 20 nt, Homo sapiens
cucacagagacccaccuuca

SEQ ID NO: 558243 - RNA, 14 nt, Homo sapiens
cucacagagugcau

SEQ ID NO: 558244 - RNA, 22 nt, Homo sapiens
cucacagcaaggauggagcuga

SEQ ID NO: 558245 - RNA, 16 nt, Homo sapiens
cucacaguguacucua

SEQ ID NO: 558246 - RNA, 14 nt, Homo sapiens
cucacaguguugcc

SEQ ID NO: 558247 - RNA, 14 nt, Homo sapiens
cucacauaagccca

SEQ ID NO: 558248 - RNA, 21 nt, Homo sapiens
cucacauacccacacauucca

SEQ ID NO: 558249 - RNA, 22 nt, Homo sapiens
cucacauacugacuucaguggg

SEQ ID NO: 558250 - RNA, 18 nt, Homo sapiens
cucacauccucugucuau

SEQ ID NO: 558251 - RNA, 21 nt, Homo sapiens
cucacaugcacaggggcccau

SEQ ID NO: 558252 - RNA, 16 nt, Homo sapiens
cucacaugugacaaag

SEQ ID NO: 558253 - RNA, 22 nt, Homo sapiens
cucacauucauuaauauaugga

SEQ ID NO: 558254 - RNA, 14 nt, Homo sapiens
cucaccaaacacaa

SEQ ID NO: 558255 - RNA, 22 nt, Homo sapiens
cucaccaccacacuacacagca

SEQ ID NO: 558256 - RNA, 15 nt, Homo sapiens
cucaccacuaccagc

SEQ ID NO: 558257 - RNA, 18 nt, Homo sapiens
cucaccaggguuuaguuu

SEQ ID NO: 558258 - RNA, 19 nt, Homo sapiens
cucacccaccccugcacag

SEQ ID NO: 558259 - RNA, 20 nt, Homo sapiens
cucacccagucuucuacaca

SEQ ID NO: 558260 - RNA, 23 nt, Homo sapiens
cucacccccagguguugccauuu

SEQ ID NO: 558261 - RNA, 16 nt, Homo sapiens
cucacccuacucugga

SEQ ID NO: 558262 - RNA, 15 nt, Homo sapiens
cucacccuccacaaa

SEQ ID NO: 558263 - RNA, 15 nt, Homo sapiens
cucaccucuugccuu

SEQ ID NO: 558264 - RNA, 18 nt, Homo sapiens
cucaccuggacuccagua

SEQ ID NO: 558265 - RNA, 23 nt, Homo sapiens
cucaccugucuaggucuccucag

SEQ ID NO: 558266 - RNA, 18 nt, Homo sapiens
cucacgccuaugauccca

SEQ ID NO: 558267 - RNA, 20 nt, Homo sapiens
cucacgccuguaaucccagc

SEQ ID NO: 558268 - RNA, 18 nt, Homo sapiens
cucacgggcccugcccca

SEQ ID NO: 558269 - RNA, 23 nt, Homo sapiens
cucacuaagccccggcacuucua

SEQ ID NO: 558270 - RNA, 12 nt, Homo sapiens
cucacuaccugg

SEQ ID NO: 558271 - RNA, 15 nt, Homo sapiens
cucacuccaccaccc

SEQ ID NO: 558272 - RNA, 15 nt, Homo sapiens
cucacucccagucca

SEQ ID NO: 558273 - RNA, 16 nt, Homo sapiens
cucacucccauaagcu

SEQ ID NO: 558274 - RNA, 20 nt, Homo sapiens
cucacuccuaggagagccaa

SEQ ID NO: 558275 - RNA, 17 nt, Homo sapiens
cucacuccugaauucag

SEQ ID NO: 558276 - RNA, 22 nt, Homo sapiens
cucacucugggcuguaacgugg

SEQ ID NO: 558277 - RNA, 12 nt, Homo sapiens
cucacucuguca

SEQ ID NO: 558278 - RNA, 15 nt, Homo sapiens
cucacucuguuuccu

SEQ ID NO: 558279 - RNA, 20 nt, Homo sapiens
cucacugaaaacaucuggaa

SEQ ID NO: 558280 - RNA, 15 nt, Homo sapiens
cucacugaaacaugg

SEQ ID NO: 558281 - RNA, 18 nt, Homo sapiens
cucacugaggguaucuga

SEQ ID NO: 558282 - RNA, 15 nt, Homo sapiens
cucacugccauggaa

SEQ ID NO: 558283 - RNA, 16 nt, Homo sapiens
cucacugccguccuca

SEQ ID NO: 558284 - RNA, 21 nt, Homo sapiens
cucacugcugcaaauacugua

SEQ ID NO: 558285 - RNA, 22 nt, Homo sapiens
cucacugcugcaaauacuguau

SEQ ID NO: 558286 - RNA, 15 nt, Homo sapiens
cucacuggaggagca

SEQ ID NO: 558287 - RNA, 21 nt, Homo sapiens
cucacuggcugggaguccuua

SEQ ID NO: 558288 - RNA, 21 nt, Homo sapiens
cucacuguagcuuuuaggaau

SEQ ID NO: 558289 - RNA, 14 nt, Homo sapiens
cucacuguccuguu

SEQ ID NO: 558290 - RNA, 19 nt, Homo sapiens
cucacuguguuacugcuuu

SEQ ID NO: 558291 - RNA, 14 nt, Homo sapiens
cucacuguucugca

SEQ ID NO: 558292 - RNA, 17 nt, Homo sapiens
cucacuguugaauuuuc

SEQ ID NO: 558293 - RNA, 15 nt, Homo sapiens
cucacuucaaugugu

SEQ ID NO: 558294 - RNA, 20 nt, Homo sapiens
cucacuugaaugugucacua

SEQ ID NO: 558295 - RNA, 18 nt, Homo sapiens
cucacuuuuuacccagaa

SEQ ID NO: 558296 - RNA, 22 nt, Homo sapiens
cucagaaauguaguuugcacuu

SEQ ID NO: 558297 - RNA, 17 nt, Homo sapiens
cucagaacauacugauu

SEQ ID NO: 558298 - RNA, 14 nt, Homo sapiens
cucagaaccauuua

SEQ ID NO: 558299 - RNA, 20 nt, Homo sapiens
cucagaacuugcugcugucu

SEQ ID NO: 558300 - RNA, 18 nt, Homo sapiens
cucagaauaaaagaugau

SEQ ID NO: 558301 - RNA, 22 nt, Homo sapiens
cucagaauaaaagaugauuucu

SEQ ID NO: 558302 - RNA, 17 nt, Homo sapiens
cucagaauguuggcaaa

SEQ ID NO: 558303 - RNA, 21 nt, Homo sapiens
cucagaauucggugugcugcc

SEQ ID NO: 558304 - RNA, 23 nt, Homo sapiens
cucagacagaaccccuacaugaa

SEQ ID NO: 558305 - RNA, 21 nt, Homo sapiens
cucagacaucuccagugugcc

SEQ ID NO: 558306 - RNA, 13 nt, Homo sapiens
cucagacauucca

SEQ ID NO: 558307 - RNA, 17 nt, Homo sapiens
cucagaccaaucaucaa

SEQ ID NO: 558308 - RNA, 12 nt, Homo sapiens
cucagaccagcu

SEQ ID NO: 558309 - RNA, 20 nt, Homo sapiens
cucagacgacaccuggagac

SEQ ID NO: 558310 - RNA, 19 nt, Homo sapiens
cucagacuggagggcaagg

SEQ ID NO: 558311 - RNA, 21 nt, Homo sapiens
cucagagcaggggccagauga

SEQ ID NO: 558312 - RNA, 15 nt, Homo sapiens
cucagagcauuucaa

SEQ ID NO: 558313 - RNA, 12 nt, Homo sapiens
cucagaggccag

SEQ ID NO: 558314 - RNA, 20 nt, Homo sapiens
cucagaggcugagcccugua

SEQ ID NO: 558315 - RNA, 15 nt, Homo sapiens
cucagaguaaugucu

SEQ ID NO: 558316 - RNA, 18 nt, Homo sapiens
cucagagugcaagccccu

SEQ ID NO: 558317 - RNA, 17 nt, Homo sapiens
cucagagugguggggga

SEQ ID NO: 558318 - RNA, 17 nt, Homo sapiens
cucagauacuuaugaaa

SEQ ID NO: 558319 - RNA, 18 nt, Homo sapiens
cucagaucugaacacagu

SEQ ID NO: 558320 - RNA, 15 nt, Homo sapiens
cucagaucuugacag

SEQ ID NO: 558321 - RNA, 18 nt, Homo sapiens
cucagaugaacaauuaug

SEQ ID NO: 558322 - RNA, 20 nt, Homo sapiens
cucagcauagccugccugau

SEQ ID NO: 558323 - RNA, 17 nt, Homo sapiens
cucugccaagauccauc

SEQ ID NO: 558324 - RNA, 11 nt, Homo sapiens
cucugccagug

SEQ ID NO: 558325 - RNA, 21 nt, Homo sapiens
cucugccccaggcccuacuac

SEQ ID NO: 558326 - RNA, 17 nt, Homo sapiens
cucugccgcuaccuccc

SEQ ID NO: 558327 - RNA, 20 nt, Homo sapiens
cucugccuacagaacuucag

SEQ ID NO: 558328 - RNA, 16 nt, Homo sapiens
cucugccuacagccag

SEQ ID NO: 558329 - RNA, 17 nt, Homo sapiens
cucugccuccucuucaa

SEQ ID NO: 558330 - RNA, 15 nt, Homo sapiens
cucugccugggaugg

SEQ ID NO: 558331 - RNA, 14 nt, Homo sapiens
cucugccuuuauga

SEQ ID NO: 558332 - RNA, 20 nt, Homo sapiens
cucugccuuucuaagacuca

SEQ ID NO: 558333 - RNA, 19 nt, Homo sapiens
cucugcgucgguccuggug

SEQ ID NO: 558334 - RNA, 23 nt, Homo sapiens
cucugcuccagacucacuugcca

SEQ ID NO: 558335 - RNA, 17 nt, Homo sapiens
cucugcuccccugugaa

SEQ ID NO: 558336 - RNA, 18 nt, Homo sapiens
cucugcuccuacauccag

SEQ ID NO: 558337 - RNA, 13 nt, Homo sapiens
cucugcuccuuau

SEQ ID NO: 558338 - RNA, 14 nt, Homo sapiens
cucugcugaaggaa

SEQ ID NO: 558339 - RNA, 14 nt, Homo sapiens
cucugcuuacuuuu

SEQ ID NO: 558340 - RNA, 16 nt, Homo sapiens
cucugcuucaguccac

SEQ ID NO: 558341 - RNA, 20 nt, Homo sapiens
cucugcuucaguccacagua

SEQ ID NO: 558342 - RNA, 14 nt, Homo sapiens
cucugcuuccagca

SEQ ID NO: 558343 - RNA, 18 nt, Homo sapiens
cucugcuucuccaaggaa

SEQ ID NO: 558344 - RNA, 19 nt, Homo sapiens
cucugcuugauuuuugccu

SEQ ID NO: 558345 - RNA, 17 nt, Homo sapiens
cucuggaaaaugugacc

SEQ ID NO: 558346 - RNA, 15 nt, Homo sapiens
cucuggacaguugug

SEQ ID NO: 558347 - RNA, 16 nt, Homo sapiens
cucuggacaugauuua

SEQ ID NO: 558348 - RNA, 16 nt, Homo sapiens
cucuggaggaaguucu

SEQ ID NO: 558349 - RNA, 16 nt, Homo sapiens
cucuggagugugcauu

SEQ ID NO: 558350 - RNA, 15 nt, Homo sapiens
cucuggcacagugua

SEQ ID NO: 558351 - RNA, 14 nt, Homo sapiens
cucuggcacuuuga

SEQ ID NO: 558352 - RNA, 23 nt, Homo sapiens
cucuggccaggauggaggggugg

SEQ ID NO: 558353 - RNA, 23 nt, Homo sapiens
cucuggccucagccgacugcaca

SEQ ID NO: 558354 - RNA, 22 nt, Homo sapiens
cucuggcucucaugggguccaa

SEQ ID NO: 558355 - RNA, 15 nt, Homo sapiens
cucuggcuugcccca

SEQ ID NO: 558356 - RNA, 16 nt, Homo sapiens
cucuggcuugccccag

SEQ ID NO: 558357 - RNA, 15 nt, Homo sapiens
cucugggaagugugg

SEQ ID NO: 558358 - RNA, 14 nt, Homo sapiens
cucugggagacuuu

SEQ ID NO: 558359 - RNA, 15 nt, Homo sapiens
cucugggcacagccu

SEQ ID NO: 558360 - RNA, 17 nt, Homo sapiens
cucugggcuauggacac

SEQ ID NO: 558361 - RNA, 22 nt, Homo sapiens
cucuggggucuuuuuaugcauu

SEQ ID NO: 558362 - RNA, 13 nt, Homo sapiens
cucugggucuugg

SEQ ID NO: 558363 - RNA, 13 nt, Homo sapiens
cucugguccaguc

SEQ ID NO: 558364 - RNA, 20 nt, Homo sapiens
cucuguaaaaacacugaaaa

SEQ ID NO: 558365 - RNA, 15 nt, Homo sapiens
cucuguaaacuucca

SEQ ID NO: 558366 - RNA, 22 nt, Homo sapiens
cucuguaaagcuaaaauaaaga

SEQ ID NO: 558367 - RNA, 17 nt, Homo sapiens
cucuguacgggccaguu

SEQ ID NO: 558368 - RNA, 15 nt, Homo sapiens
cucuguacuuuucau

SEQ ID NO: 558369 - RNA, 13 nt, Homo sapiens
cucuguauguacu

SEQ ID NO: 558370 - RNA, 19 nt, Homo sapiens
cucuguauuccgauacaaa

SEQ ID NO: 558371 - RNA, 15 nt, Homo sapiens
cucuguccuacuucu

SEQ ID NO: 558372 - RNA, 21 nt, Homo sapiens
cucugucuaggacugcagugu

SEQ ID NO: 558373 - RNA, 19 nt, Homo sapiens
cucugucuuaaaugagaag

SEQ ID NO: 558374 - RNA, 18 nt, Homo sapiens
cucugugggucucuggaa

SEQ ID NO: 558375 - RNA, 14 nt, Homo sapiens
cucuguucacaaac

SEQ ID NO: 558376 - RNA, 22 nt, Homo sapiens
cucuguucucuccccucacauc

SEQ ID NO: 558377 - RNA, 15 nt, Homo sapiens
cucuguuguccuccc

SEQ ID NO: 558378 - RNA, 19 nt, Homo sapiens
cucuguuucccuuucacug

SEQ ID NO: 558379 - RNA, 14 nt, Homo sapiens
cucuguuuccugaa

SEQ ID NO: 558380 - RNA, 17 nt, Homo sapiens
cucuguuugugggacug

SEQ ID NO: 558381 - RNA, 14 nt, Homo sapiens
cucuuaagaucuga

SEQ ID NO: 558382 - RNA, 12 nt, Homo sapiens
cucuuaagccua

SEQ ID NO: 558383 - RNA, 22 nt, Homo sapiens
cucuuaaguggucuagucaagg

SEQ ID NO: 558384 - RNA, 15 nt, Homo sapiens
cucuuacaaccaaga

SEQ ID NO: 558385 - RNA, 12 nt, Homo sapiens
cucuuacacaua

SEQ ID NO: 558386 - RNA, 15 nt, Homo sapiens
cucuuaccuguuauu

SEQ ID NO: 558387 - RNA, 14 nt, Homo sapiens
cucuuagaagccau

SEQ ID NO: 558388 - RNA, 16 nt, Homo sapiens
cucuuagaagccaugg

SEQ ID NO: 558389 - RNA, 15 nt, Homo sapiens
cucuuagcacacuca

SEQ ID NO: 558390 - RNA, 16 nt, Homo sapiens
cucuuaguaacauaga

SEQ ID NO: 558391 - RNA, 13 nt, Homo sapiens
cucuuauugcaaa

SEQ ID NO: 558392 - RNA, 14 nt, Homo sapiens
cucuucaacaugac

SEQ ID NO: 558393 - RNA, 19 nt, Homo sapiens
cucuucaacaugacaucca

SEQ ID NO: 558394 - RNA, 17 nt, Homo sapiens
cucuucaaucucuggaa

SEQ ID NO: 558395 - RNA, 10 nt, Homo sapiens
cucuucacau

SEQ ID NO: 558396 - RNA, 22 nt, Homo sapiens
cucuucaccccuacacugugaa

SEQ ID NO: 558397 - RNA, 17 nt, Homo sapiens
cucuucagccccuagug

SEQ ID NO: 558398 - RNA, 22 nt, Homo sapiens
cucuucagguucuuagugucac

SEQ ID NO: 558399 - RNA, 14 nt, Homo sapiens
cucuucauccauuu

SEQ ID NO: 558400 - RNA, 12 nt, Homo sapiens
cucuuccagcaa

SEQ ID NO: 558401 - RNA, 14 nt, Homo sapiens
cucuucccaugacu

SEQ ID NO: 558402 - RNA, 16 nt, Homo sapiens
cucuucccaugacugc

SEQ ID NO: 558403 - RNA, 22 nt, Homo sapiens
cucuuccccagagaggcacuca

SEQ ID NO: 558404 - RNA, 18 nt, Homo sapiens
cucuuccccuugcccuug

SEQ ID NO: 558405 - RNA, 20 nt, Homo sapiens
cucuucccuccggacucuaa

SEQ ID NO: 558406 - RNA, 17 nt, Homo sapiens
cucuucccugaccuccc

SEQ ID NO: 558407 - RNA, 16 nt, Homo sapiens
cucuucccuuccucca

SEQ ID NO: 558408 - RNA, 19 nt, Homo sapiens
cucuuccuacccuuccuca

SEQ ID NO: 558409 - RNA, 22 nt, Homo sapiens
cucuuccuccucgcugccagau

SEQ ID NO: 558410 - RNA, 16 nt, Homo sapiens
cucuuccugcaaggac

SEQ ID NO: 558411 - RNA, 16 nt, Homo sapiens
cucuuccugugaucca

SEQ ID NO: 558412 - RNA, 12 nt, Homo sapiens
cucuuccuugaa

SEQ ID NO: 558413 - RNA, 13 nt, Homo sapiens
cucuuccuugaau

SEQ ID NO: 558414 - RNA, 18 nt, Homo sapiens
cucuucgauguacuuguu

SEQ ID NO: 558415 - RNA, 14 nt, Homo sapiens
cucuucuaacacaa

SEQ ID NO: 558416 - RNA, 18 nt, Homo sapiens
cucuucuaacacaaaaua

SEQ ID NO: 558417 - RNA, 23 nt, Homo sapiens
cucuucuggggcaggcugggcca

SEQ ID NO: 558418 - RNA, 13 nt, Homo sapiens
cucuucuguggac

SEQ ID NO: 558419 - RNA, 13 nt, Homo sapiens
cucuugaagcaua

SEQ ID NO: 558420 - RNA, 22 nt, Homo sapiens
cucuugagcaucaaucuuguua

SEQ ID NO: 558421 - RNA, 20 nt, Homo sapiens
cucuugagggagcuuagcca

SEQ ID NO: 558422 - RNA, 20 nt, Homo sapiens
cucuugaucucaaagcacaa

SEQ ID NO: 558423 - RNA, 17 nt, Homo sapiens
cucuugcccauccugac

SEQ ID NO: 558424 - RNA, 12 nt, Homo sapiens
cucuugccccuu

SEQ ID NO: 558425 - RNA, 15 nt, Homo sapiens
cucuugccucucuca

SEQ ID NO: 558426 - RNA, 12 nt, Homo sapiens
cucuugccuuaa

SEQ ID NO: 558427 - RNA, 18 nt, Homo sapiens
cucuugccuuuuacuuaa

SEQ ID NO: 558428 - RNA, 12 nt, Homo sapiens
cucuugcucaaa

SEQ ID NO: 558429 - RNA, 17 nt, Homo sapiens
cucuugcugaaagccaa

SEQ ID NO: 558430 - RNA, 13 nt, Homo sapiens
cucuugcugccac

SEQ ID NO: 558431 - RNA, 15 nt, Homo sapiens
cucuuggagcuguga

SEQ ID NO: 558432 - RNA, 23 nt, Homo sapiens
cucuuggcuuccagaaggcagca

SEQ ID NO: 558433 - RNA, 16 nt, Homo sapiens
cucuugggaagaccag

SEQ ID NO: 558434 - RNA, 20 nt, Homo sapiens
cucuugggaagaccagcuuu

SEQ ID NO: 558435 - RNA, 23 nt, Homo sapiens
cucuugggcccaggacuguugau

SEQ ID NO: 558436 - RNA, 20 nt, Homo sapiens
cucuugggcugagacuggau

SEQ ID NO: 558437 - RNA, 23 nt, Homo sapiens
cucuuguauuaaacucuucacaa

SEQ ID NO: 558438 - RNA, 14 nt, Homo sapiens
cucuuuccuccugc

SEQ ID NO: 558439 - RNA, 18 nt, Homo sapiens
cucuuuccuccugcuuca

SEQ ID NO: 558440 - RNA, 18 nt, Homo sapiens
cucuuucugcucugccau

SEQ ID NO: 558441 - RNA, 14 nt, Homo sapiens
cucuuuuagcugau

SEQ ID NO: 558442 - RNA, 18 nt, Homo sapiens
cucuuuugaauccaugcu

SEQ ID NO: 558443 - RNA, 19 nt, Homo sapiens
cucuuuugaauccaugcuu

SEQ ID NO: 558444 - RNA, 23 nt, Homo sapiens
cucuuuugugaugaacauauuca

SEQ ID NO: 558445 - RNA, 15 nt, Homo sapiens
cucuuuuucugugau

SEQ ID NO: 558446 - RNA, 17 nt, Homo sapiens
cugaaaaaucacauccu

SEQ ID NO: 558447 - RNA, 15 nt, Homo sapiens
cugaaaaaugcaaau

SEQ ID NO: 558448 - RNA, 15 nt, Homo sapiens
cugaaaaaugcucaa

SEQ ID NO: 558449 - RNA, 14 nt, Homo sapiens
cugaaaaccucucc

SEQ ID NO: 558450 - RNA, 21 nt, Homo sapiens
cugaaaacuaauguacuguac

SEQ ID NO: 558451 - RNA, 12 nt, Homo sapiens
cugaaaacuaca

SEQ ID NO: 558452 - RNA, 20 nt, Homo sapiens
cugaaaacuacaguuguaau

SEQ ID NO: 558453 - RNA, 15 nt, Homo sapiens
cugaaaagcauacaa

SEQ ID NO: 558454 - RNA, 15 nt, Homo sapiens
cugaaaagggaauca

SEQ ID NO: 558455 - RNA, 16 nt, Homo sapiens
cugaaaauauaaccag

SEQ ID NO: 558456 - RNA, 18 nt, Homo sapiens
cugaaaaucgaguuuuuc

SEQ ID NO: 558457 - RNA, 13 nt, Homo sapiens
cugaaaaucugga

SEQ ID NO: 558458 - RNA, 13 nt, Homo sapiens
cugaaaauucugu

SEQ ID NO: 558459 - RNA, 12 nt, Homo sapiens
cugaaaauugca

SEQ ID NO: 558460 - RNA, 13 nt, Homo sapiens
cugaaaauugcaa

SEQ ID NO: 558461 - RNA, 14 nt, Homo sapiens
cugaaaauuuauca

SEQ ID NO: 558462 - RNA, 13 nt, Homo sapiens
cugaaacaucuca

SEQ ID NO: 558463 - RNA, 18 nt, Homo sapiens
cugaaacaugaacccaaa

SEQ ID NO: 558464 - RNA, 22 nt, Homo sapiens
cugaaacaugaacccaaaaaga

SEQ ID NO: 558465 - RNA, 12 nt, Homo sapiens
cugaaaccaaaa

SEQ ID NO: 558466 - RNA, 23 nt, Homo sapiens
cugaaaccucugggucaucucuc

SEQ ID NO: 558467 - RNA, 18 nt, Homo sapiens
cugaaaccuuaguuucaa

SEQ ID NO: 558468 - RNA, 15 nt, Homo sapiens
cugaaagaagacauc

SEQ ID NO: 558469 - RNA, 18 nt, Homo sapiens
cugaaagacagaauguca

SEQ ID NO: 558470 - RNA, 20 nt, Homo sapiens
cugaaagaccuaugagcaaa

SEQ ID NO: 558471 - RNA, 14 nt, Homo sapiens
cugaaagacuugaa

SEQ ID NO: 558472 - RNA, 23 nt, Homo sapiens
cugaaagacuuggguugaacuau

SEQ ID NO: 558473 - RNA, 16 nt, Homo sapiens
cugaaagaucuuucag

SEQ ID NO: 558474 - RNA, 20 nt, Homo sapiens
cugaaagaugggcaaaagac

SEQ ID NO: 558475 - RNA, 15 nt, Homo sapiens
cugaaagccauuugu

SEQ ID NO: 558476 - RNA, 13 nt, Homo sapiens
cugaaagccucac

SEQ ID NO: 558477 - RNA, 23 nt, Homo sapiens
cugaaagcuuuauacaguugaau

SEQ ID NO: 558478 - RNA, 19 nt, Homo sapiens
cugaaaguccugcuuuccu

SEQ ID NO: 558479 - RNA, 19 nt, Homo sapiens
cugaaagucuucaugguga

SEQ ID NO: 558480 - RNA, 15 nt, Homo sapiens
cugaaaugaccaaga

SEQ ID NO: 558481 - RNA, 13 nt, Homo sapiens
cugaaaugccugc

SEQ ID NO: 558482 - RNA, 21 nt, Homo sapiens
cugaaauuguuuuaccagcuc

SEQ ID NO: 558483 - RNA, 19 nt, Homo sapiens
cugaacaaaaccuacacac

SEQ ID NO: 558484 - RNA, 21 nt, Homo sapiens
cugaacaaaauguaaagccag

SEQ ID NO: 558485 - RNA, 19 nt, Homo sapiens
cugaacaaucaaagcacuu

SEQ ID NO: 558486 - RNA, 18 nt, Homo sapiens
cugaacauccuuccuucc

SEQ ID NO: 558487 - RNA, 13 nt, Homo sapiens
cugaacaugccua

SEQ ID NO: 558488 - RNA, 15 nt, Homo sapiens
cugaacaugccugcc

SEQ ID NO: 558489 - RNA, 19 nt, Homo sapiens
cugaaccauuccaacuuca

SEQ ID NO: 558490 - RNA, 13 nt, Homo sapiens
cugaacccugugc

SEQ ID NO: 558491 - RNA, 18 nt, Homo sapiens
cugaaccuugaggggcua

SEQ ID NO: 558492 - RNA, 19 nt, Homo sapiens
cugaacuaaucugauguua

SEQ ID NO: 558493 - RNA, 15 nt, Homo sapiens
cugaacuacacugca

SEQ ID NO: 558494 - RNA, 20 nt, Homo sapiens
cugaacuccugccauagucu

SEQ ID NO: 558495 - RNA, 21 nt, Homo sapiens
cugaacucuucagaacacaca

SEQ ID NO: 558496 - RNA, 16 nt, Homo sapiens
cugaacugacaaugaa

SEQ ID NO: 558497 - RNA, 14 nt, Homo sapiens
cugaacuugaauua

SEQ ID NO: 558498 - RNA, 21 nt, Homo sapiens
cugaacuuuaucuguucuguu

SEQ ID NO: 558499 - RNA, 21 nt, Homo sapiens
cugaagaaacuucccaagugu

SEQ ID NO: 558500 - RNA, 17 nt, Homo sapiens
cugaagaaauccuggga

SEQ ID NO: 558501 - RNA, 14 nt, Homo sapiens
cugaagaagaugag

SEQ ID NO: 558502 - RNA, 23 nt, Homo sapiens
cugaagacauucaaaacgugaug

SEQ ID NO: 558503 - RNA, 22 nt, Homo sapiens
cugaagagcuauuauauaaaaa

SEQ ID NO: 558504 - RNA, 12 nt, Homo sapiens
cugaagauauau

SEQ ID NO: 558505 - RNA, 11 nt, Homo sapiens
cugaagccacu

SEQ ID NO: 558506 - RNA, 11 nt, Homo sapiens
cugaagccaga

SEQ ID NO: 558507 - RNA, 16 nt, Homo sapiens
cugaagccagauccac

SEQ ID NO: 558508 - RNA, 21 nt, Homo sapiens
cugaagcuuaggacuaccagc

SEQ ID NO: 558509 - RNA, 19 nt, Homo sapiens
cugaaggacagaacauugc

SEQ ID NO: 558510 - RNA, 15 nt, Homo sapiens
cugaaggcauaugca

SEQ ID NO: 558511 - RNA, 18 nt, Homo sapiens
cugaaggcuaaaaagcaa

SEQ ID NO: 558512 - RNA, 16 nt, Homo sapiens
cugaagggaaggcaaa

SEQ ID NO: 558513 - RNA, 20 nt, Homo sapiens
cugaaggggaggucacagcc

SEQ ID NO: 558514 - RNA, 19 nt, Homo sapiens
cugaaggugccacuccagu

SEQ ID NO: 558515 - RNA, 14 nt, Homo sapiens
cugaagucacauca

SEQ ID NO: 558516 - RNA, 16 nt, Homo sapiens
cugaagucacaucaca

SEQ ID NO: 558517 - RNA, 13 nt, Homo sapiens
cugaagugcuuag

SEQ ID NO: 558518 - RNA, 17 nt, Homo sapiens
cugaagugguugcauuc

SEQ ID NO: 558519 - RNA, 19 nt, Homo sapiens
cugaagugguugcauucua

SEQ ID NO: 558520 - RNA, 18 nt, Homo sapiens
cugaagugucacagccug

SEQ ID NO: 558521 - RNA, 14 nt, Homo sapiens
cugaaguuucacau

SEQ ID NO: 558522 - RNA, 15 nt, Homo sapiens
cugaaguuucauuua

SEQ ID NO: 558523 - RNA, 22 nt, Homo sapiens
cugaaguuucauuuaugauaca

SEQ ID NO: 558524 - RNA, 16 nt, Homo sapiens
cugaaguuuccgcccc

SEQ ID NO: 558525 - RNA, 19 nt, Homo sapiens
cugaauaaauaauucuucc

SEQ ID NO: 558526 - RNA, 20 nt, Homo sapiens
cugaauaaauaauucuuccu

SEQ ID NO: 558527 - RNA, 16 nt, Homo sapiens
cugaauaacuugaaga

SEQ ID NO: 558528 - RNA, 13 nt, Homo sapiens
cugaauaauauca

SEQ ID NO: 558529 - RNA, 13 nt, Homo sapiens
cugaauacaagcc

SEQ ID NO: 558530 - RNA, 13 nt, Homo sapiens
cugaauacauucu

SEQ ID NO: 558531 - RNA, 20 nt, Homo sapiens
cugaauacauucugcuuuca

SEQ ID NO: 558532 - RNA, 18 nt, Homo sapiens
cugaauagugucaccaau

SEQ ID NO: 558533 - RNA, 22 nt, Homo sapiens
cugaauagugucaccaauucca

SEQ ID NO: 558534 - RNA, 20 nt, Homo sapiens
cugaauauauaaacacucca

SEQ ID NO: 558535 - RNA, 20 nt, Homo sapiens
cugaauauuaaagcucuuca

SEQ ID NO: 558536 - RNA, 24 nt, Homo sapiens
cugaauauuuuuuauuucuaagua

SEQ ID NO: 558537 - RNA, 23 nt, Homo sapiens
cugaauccaaacuaauccaucac

SEQ ID NO: 558538 - RNA, 23 nt, Homo sapiens
cugaauccauaaaggcauaccuu

SEQ ID NO: 558539 - RNA, 12 nt, Homo sapiens
cugaaucuaccu

SEQ ID NO: 558540 - RNA, 18 nt, Homo sapiens
cugaaucuauggcuuuaa

SEQ ID NO: 558541 - RNA, 12 nt, Homo sapiens
cugaaucucaua

SEQ ID NO: 558542 - RNA, 18 nt, Homo sapiens
cugaaugcugcuacuuaa

SEQ ID NO: 558543 - RNA, 17 nt, Homo sapiens
cugaaugggagccagaa

SEQ ID NO: 558544 - RNA, 21 nt, Homo sapiens
cugaaugguuccaugccugag

SEQ ID NO: 558545 - RNA, 21 nt, Homo sapiens
cugaaugucccaacccagaca

SEQ ID NO: 558546 - RNA, 12 nt, Homo sapiens
cugaauguucug

SEQ ID NO: 558547 - RNA, 18 nt, Homo sapiens
cugaauuacaaccacaga

SEQ ID NO: 558548 - RNA, 18 nt, Homo sapiens
cugaauuaucuauuucau

SEQ ID NO: 558549 - RNA, 15 nt, Homo sapiens
cugaauucagcacca

SEQ ID NO: 558550 - RNA, 19 nt, Homo sapiens
cugaauucuggaaucacaa

SEQ ID NO: 558551 - RNA, 17 nt, Homo sapiens
cuuauugaacauucuag

SEQ ID NO: 558552 - RNA, 16 nt, Homo sapiens
cuuauugaucccacau

SEQ ID NO: 558553 - RNA, 17 nt, Homo sapiens
cuuauuguuccaagaca

SEQ ID NO: 558554 - RNA, 18 nt, Homo sapiens
cuuauuuaaagcuuucaa

SEQ ID NO: 558555 - RNA, 19 nt, Homo sapiens
cuuauuucuagaagcacau

SEQ ID NO: 558556 - RNA, 19 nt, Homo sapiens
cuuauuuugugaacuauau

SEQ ID NO: 558557 - RNA, 16 nt, Homo sapiens
cuuauuuuuauaauua

SEQ ID NO: 558558 - RNA, 21 nt, Homo sapiens
cuucaaaacggggcagccaaa

SEQ ID NO: 558559 - RNA, 21 nt, Homo sapiens
cuucaaaauaaaaaguaauga

SEQ ID NO: 558560 - RNA, 21 nt, Homo sapiens
cuucaaagucucaaugaaaua

SEQ ID NO: 558561 - RNA, 14 nt, Homo sapiens
cuucaaaucucagc

SEQ ID NO: 558562 - RNA, 22 nt, Homo sapiens
cuucaaaugucuaagguaguaa

SEQ ID NO: 558563 - RNA, 14 nt, Homo sapiens
cuucaaauguggua

SEQ ID NO: 558564 - RNA, 22 nt, Homo sapiens
cuucaaauuagaagacauuuau

SEQ ID NO: 558565 - RNA, 13 nt, Homo sapiens
cuucaaauucaaa

SEQ ID NO: 558566 - RNA, 17 nt, Homo sapiens
cuucaacguagucaucc

SEQ ID NO: 558567 - RNA, 17 nt, Homo sapiens
cuucaagaaauuacugg

SEQ ID NO: 558568 - RNA, 16 nt, Homo sapiens
cuucaagaacauucua

SEQ ID NO: 558569 - RNA, 13 nt, Homo sapiens
cuucaagaccaaa

SEQ ID NO: 558570 - RNA, 22 nt, Homo sapiens
cuucccggcgucccuaccuccu

SEQ ID NO: 558571 - RNA, 13 nt, Homo sapiens
cuucccuaccuca

SEQ ID NO: 558572 - RNA, 19 nt, Homo sapiens
cuucccuccucccauguca

SEQ ID NO: 558573 - RNA, 21 nt, Homo sapiens
cuucccucucugcagacuucc

SEQ ID NO: 558574 - RNA, 15 nt, Homo sapiens
cuucccuguucuccc

SEQ ID NO: 558575 - RNA, 16 nt, Homo sapiens
cuucccuuaacuccaa

SEQ ID NO: 558576 - RNA, 20 nt, Homo sapiens
cuucccuuaacuccaagaac

SEQ ID NO: 558577 - RNA, 15 nt, Homo sapiens
cuucccuuaccucaa

SEQ ID NO: 558578 - RNA, 14 nt, Homo sapiens
cuucccuuccucca

SEQ ID NO: 558579 - RNA, 19 nt, Homo sapiens
cuucccuuccuccauugca

SEQ ID NO: 558580 - RNA, 14 nt, Homo sapiens
cuuccgccgucuca

SEQ ID NO: 558581 - RNA, 14 nt, Homo sapiens
cuuccgugcugaac

SEQ ID NO: 558582 - RNA, 17 nt, Homo sapiens
cuuccuaauuccacagc

SEQ ID NO: 558583 - RNA, 15 nt, Homo sapiens
cuuccucacaccccu

SEQ ID NO: 558584 - RNA, 17 nt, Homo sapiens
cuuccucagccuccaaa

SEQ ID NO: 558585 - RNA, 14 nt, Homo sapiens
cuuccuccauugca

SEQ ID NO: 558586 - RNA, 21 nt, Homo sapiens
cuuccucccaacaagcagcug

SEQ ID NO: 558587 - RNA, 19 nt, Homo sapiens
cuuccuccccacacuccac

SEQ ID NO: 558588 - RNA, 17 nt, Homo sapiens
cuuccucccucauggaa

SEQ ID NO: 558589 - RNA, 22 nt, Homo sapiens
cuuccucucaagcuagccagag

SEQ ID NO: 558590 - RNA, 15 nt, Homo sapiens
cuuccucuccacugc

SEQ ID NO: 558591 - RNA, 22 nt, Homo sapiens
cuuccucucucggagcccucag

SEQ ID NO: 558592 - RNA, 21 nt, Homo sapiens
cuuccucucuggauacugcaa

SEQ ID NO: 558593 - RNA, 13 nt, Homo sapiens
cuuccucugguaa

SEQ ID NO: 558594 - RNA, 17 nt, Homo sapiens
cuuccucuuccagcaac

SEQ ID NO: 558595 - RNA, 20 nt, Homo sapiens
cuuccugaguggugccaaac

SEQ ID NO: 558596 - RNA, 14 nt, Homo sapiens
cuuccugauucauu

SEQ ID NO: 558597 - RNA, 22 nt, Homo sapiens
cuuccugcaaagggaacugaag

SEQ ID NO: 558598 - RNA, 12 nt, Homo sapiens
cuuccugcagug

SEQ ID NO: 558599 - RNA, 13 nt, Homo sapiens
cuuccugccccuc

SEQ ID NO: 558600 - RNA, 20 nt, Homo sapiens
cuuccugcugggacugagaa

SEQ ID NO: 558601 - RNA, 22 nt, Homo sapiens
cuuccugcuuaaacuugaccca

SEQ ID NO: 558602 - RNA, 15 nt, Homo sapiens
cuuccugcuuuccau

SEQ ID NO: 558603 - RNA, 18 nt, Homo sapiens
cuuccuggacacacucuc

SEQ ID NO: 558604 - RNA, 18 nt, Homo sapiens
cuuccuggaguacaaaca

SEQ ID NO: 558605 - RNA, 20 nt, Homo sapiens
cuuccuggcuccuucacuga

SEQ ID NO: 558606 - RNA, 15 nt, Homo sapiens
cuuccuggcuguaaa

SEQ ID NO: 558607 - RNA, 21 nt, Homo sapiens
cuuccugggcagccuuuccag

SEQ ID NO: 558608 - RNA, 14 nt, Homo sapiens
cuuccuggguccug

SEQ ID NO: 558609 - RNA, 21 nt, Homo sapiens
cuuccuggguccuguucccua

SEQ ID NO: 558610 - RNA, 12 nt, Homo sapiens
cuuccuguaaca

SEQ ID NO: 558611 - RNA, 15 nt, Homo sapiens
cuuccuguacuugaa

SEQ ID NO: 558612 - RNA, 15 nt, Homo sapiens
cuuccuguccagaga

SEQ ID NO: 558613 - RNA, 22 nt, Homo sapiens
cuuccugucccacuacuguaga

SEQ ID NO: 558614 - RNA, 17 nt, Homo sapiens
cuuccuguccugccucc

SEQ ID NO: 558615 - RNA, 14 nt, Homo sapiens
cuuccugugaucca

SEQ ID NO: 558616 - RNA, 15 nt, Homo sapiens
cuuccugugauccac

SEQ ID NO: 558617 - RNA, 18 nt, Homo sapiens
cuuccugugcccugcaaa

SEQ ID NO: 558618 - RNA, 19 nt, Homo sapiens
cuuccuguuucuucccaua

SEQ ID NO: 558619 - RNA, 16 nt, Homo sapiens
cuuccuuaaaugacuu

SEQ ID NO: 558620 - RNA, 16 nt, Homo sapiens
cuuccuuaugucucca

SEQ ID NO: 558621 - RNA, 15 nt, Homo sapiens
cuuccuucacuuugc

SEQ ID NO: 558622 - RNA, 22 nt, Homo sapiens
cuuccuugcaggagugacucaa

SEQ ID NO: 558623 - RNA, 20 nt, Homo sapiens
cuuccuuggaggggggagcc

SEQ ID NO: 558624 - RNA, 18 nt, Homo sapiens
cuuccuuuuaacugccaa

SEQ ID NO: 558625 - RNA, 22 nt, Homo sapiens
cuuccuuuugaaguuucauugg

SEQ ID NO: 558626 - RNA, 21 nt, Homo sapiens
cuucgaaaaucuagaggaaaa

SEQ ID NO: 558627 - RNA, 17 nt, Homo sapiens
cuucgacuacugcuccu

SEQ ID NO: 558628 - RNA, 23 nt, Homo sapiens
cuucgauacaccgggccuggaga

SEQ ID NO: 558629 - RNA, 12 nt, Homo sapiens
cuucgauguacu

SEQ ID NO: 558630 - RNA, 18 nt, Homo sapiens
cuucgguuucugagcaua

SEQ ID NO: 558631 - RNA, 19 nt, Homo sapiens
cuucuaaacccaauccaaa

SEQ ID NO: 558632 - RNA, 21 nt, Homo sapiens
cuucuaagaggauacaaauuu

SEQ ID NO: 558633 - RNA, 15 nt, Homo sapiens
cuucuacggccauga

SEQ ID NO: 558634 - RNA, 12 nt, Homo sapiens
cuucuacugcua

SEQ ID NO: 558635 - RNA, 17 nt, Homo sapiens
cuucuacuuguaaaaug

SEQ ID NO: 558636 - RNA, 15 nt, Homo sapiens
cuucuagaaucucgu

SEQ ID NO: 558637 - RNA, 19 nt, Homo sapiens
cuucuagagcuuagcauau

SEQ ID NO: 558638 - RNA, 22 nt, Homo sapiens
cuucuaggauagcuaacuguaa

SEQ ID NO: 558639 - RNA, 23 nt, Homo sapiens
cuucuagugagccugggccagga

SEQ ID NO: 558640 - RNA, 13 nt, Homo sapiens
cuucuaguggucu

SEQ ID NO: 558641 - RNA, 13 nt, Homo sapiens
cuucuaguuucac

SEQ ID NO: 558642 - RNA, 19 nt, Homo sapiens
cuucuauaauuuugccuuu

SEQ ID NO: 558643 - RNA, 18 nt, Homo sapiens
cuucuaucaggucccauc

SEQ ID NO: 558644 - RNA, 18 nt, Homo sapiens
cuucuaugagcccagauc

SEQ ID NO: 558645 - RNA, 15 nt, Homo sapiens
cuucuauggggucua

SEQ ID NO: 558646 - RNA, 18 nt, Homo sapiens
cuucuauuccauggcuaa

SEQ ID NO: 558647 - RNA, 22 nt, Homo sapiens
cuucuauuccauggcuaacugg

SEQ ID NO: 558648 - RNA, 17 nt, Homo sapiens
cuucuauuuaaugcuuc

SEQ ID NO: 558649 - RNA, 12 nt, Homo sapiens
cuucucaagacu

SEQ ID NO: 558650 - RNA, 16 nt, Homo sapiens
cuucucaagugccuua

SEQ ID NO: 558651 - RNA, 19 nt, Homo sapiens
cuucucagauuucugagga

SEQ ID NO: 558652 - RNA, 16 nt, Homo sapiens
cuucuccaaaugagau

SEQ ID NO: 558653 - RNA, 17 nt, Homo sapiens
cuucuccaagcuuucag

SEQ ID NO: 558654 - RNA, 15 nt, Homo sapiens
cuucuccaccaaaga

SEQ ID NO: 558655 - RNA, 14 nt, Homo sapiens
cuucuccacuggau

SEQ ID NO: 558656 - RNA, 15 nt, Homo sapiens
cuucuccagugguca

SEQ ID NO: 558657 - RNA, 20 nt, Homo sapiens
cuucuccaucccucuaauga

SEQ ID NO: 558658 - RNA, 15 nt, Homo sapiens
cuucuccaucuccug

SEQ ID NO: 558659 - RNA, 14 nt, Homo sapiens
cuucuccaugagac

SEQ ID NO: 558660 - RNA, 16 nt, Homo sapiens
cuucuccaugcugcaa

SEQ ID NO: 558661 - RNA, 11 nt, Homo sapiens
cuucucccacc

SEQ ID NO: 558662 - RNA, 14 nt, Homo sapiens
cuucucccauuucc

SEQ ID NO: 558663 - RNA, 15 nt, Homo sapiens
cuucuccgaggggcu

SEQ ID NO: 558664 - RNA, 14 nt, Homo sapiens
cuucuccuacuuag

SEQ ID NO: 558665 - RNA, 16 nt, Homo sapiens
cuucuccuccaugaac

SEQ ID NO: 558666 - RNA, 20 nt, Homo sapiens
cuucuccucucugggccuuu

SEQ ID NO: 558667 - RNA, 17 nt, Homo sapiens
cuucuccugcugcuccu

SEQ ID NO: 558668 - RNA, 16 nt, Homo sapiens
cuucucguuaaggaga

SEQ ID NO: 558669 - RNA, 13 nt, Homo sapiens
cuucucuacagac

SEQ ID NO: 558670 - RNA, 21 nt, Homo sapiens
cuucucuacagacuccaaaag

SEQ ID NO: 558671 - RNA, 18 nt, Homo sapiens
cuucucuccacaguguug

SEQ ID NO: 558672 - RNA, 14 nt, Homo sapiens
cuucucuccagcug

SEQ ID NO: 558673 - RNA, 14 nt, Homo sapiens
cuucucuccuugcc

SEQ ID NO: 558674 - RNA, 14 nt, Homo sapiens
cuucucucuguucc

SEQ ID NO: 558675 - RNA, 20 nt, Homo sapiens
cuucucugcaguaaaacaca

SEQ ID NO: 558676 - RNA, 22 nt, Homo sapiens
cuucucuguugucaaacugaaa

SEQ ID NO: 558677 - RNA, 14 nt, Homo sapiens
cuucucuugacagu

SEQ ID NO: 558678 - RNA, 17 nt, Homo sapiens
cuucugaaaaaguaucc

SEQ ID NO: 558679 - RNA, 22 nt, Homo sapiens
cuucugacccaaagcaaaacau

SEQ ID NO: 558680 - RNA, 23 nt, Homo sapiens
cuucugaggcgcugcuuugucaa

SEQ ID NO: 558681 - RNA, 17 nt, Homo sapiens
cuucugcaacaucuuaa

SEQ ID NO: 558682 - RNA, 13 nt, Homo sapiens
cuucugcaguuag

SEQ ID NO: 558683 - RNA, 15 nt, Homo sapiens
cuucugccuguuaua

SEQ ID NO: 558684 - RNA, 21 nt, Homo sapiens
cuucugcuaauaccucuuacu

SEQ ID NO: 558685 - RNA, 15 nt, Homo sapiens
cuucugcucagcucu

SEQ ID NO: 558686 - RNA, 21 nt, Homo sapiens
cuucuggagaaaaaggugcca

SEQ ID NO: 558687 - RNA, 18 nt, Homo sapiens
cuucugggaacuuccuca

SEQ ID NO: 558688 - RNA, 16 nt, Homo sapiens
cuucuggggguggugg

SEQ ID NO: 558689 - RNA, 19 nt, Homo sapiens
cuucuggggucaggugcca

SEQ ID NO: 558690 - RNA, 16 nt, Homo sapiens
cuucugguugcuucag

SEQ ID NO: 558691 - RNA, 16 nt, Homo sapiens
cuucuguaaucaauau

SEQ ID NO: 558692 - RNA, 17 nt, Homo sapiens
cuucuguaguacuccuu

SEQ ID NO: 558693 - RNA, 13 nt, Homo sapiens
cuucugucuguca

SEQ ID NO: 558694 - RNA, 15 nt, Homo sapiens
cuucuguguagucaa

SEQ ID NO: 558695 - RNA, 15 nt, Homo sapiens
cuucugugugaccau

SEQ ID NO: 558696 - RNA, 15 nt, Homo sapiens
cuucuucagagauca

SEQ ID NO: 558697 - RNA, 14 nt, Homo sapiens
cuucuucauauucu

SEQ ID NO: 558698 - RNA, 13 nt, Homo sapiens
cuucuucauugca

SEQ ID NO: 558699 - RNA, 14 nt, Homo sapiens
cuucuuccagauuu

SEQ ID NO: 558700 - RNA, 16 nt, Homo sapiens
cuucuuccuuaauuca

SEQ ID NO: 558701 - RNA, 17 nt, Homo sapiens
cuucuugcagcuguuga

SEQ ID NO: 558702 - RNA, 13 nt, Homo sapiens
cuucuuguucccc

SEQ ID NO: 558703 - RNA, 19 nt, Homo sapiens
cuucuuuacuaacacuggc

SEQ ID NO: 558704 - RNA, 15 nt, Homo sapiens
cuucuuugcugcugc

SEQ ID NO: 558705 - RNA, 13 nt, Homo sapiens
cuucuuuucucau

SEQ ID NO: 558706 - RNA, 20 nt, Homo sapiens
cuucuuuuggcuuccaugau

SEQ ID NO: 558707 - RNA, 22 nt, Homo sapiens
cuugaaaacuugcuaagugaaa

SEQ ID NO: 558708 - RNA, 16 nt, Homo sapiens
cuugaaaagaaaacca

SEQ ID NO: 558709 - RNA, 21 nt, Homo sapiens
cuugaaaagcuaguguaccuc

SEQ ID NO: 558710 - RNA, 21 nt, Homo sapiens
cuugaaaauaguaauaccuga

SEQ ID NO: 558711 - RNA, 18 nt, Homo sapiens
cuugaaacaagcaacaga

SEQ ID NO: 558712 - RNA, 22 nt, Homo sapiens
cuugaaacaagcaacagaugga

SEQ ID NO: 558713 - RNA, 14 nt, Homo sapiens
cuugaaaccaaaga

SEQ ID NO: 558714 - RNA, 21 nt, Homo sapiens
cuugaaaggaagagcuaauaa

SEQ ID NO: 558715 - RNA, 14 nt, Homo sapiens
cuugaaaguuuucc

SEQ ID NO: 558716 - RNA, 18 nt, Homo sapiens
cuugaaaguuuucuaaac

SEQ ID NO: 558717 - RNA, 21 nt, Homo sapiens
cuugaaaguuuucuaaacuca

SEQ ID NO: 558718 - RNA, 16 nt, Homo sapiens
cuugaaauaccaguga

SEQ ID NO: 558719 - RNA, 15 nt, Homo sapiens
cuugaaauguagaau

SEQ ID NO: 558720 - RNA, 22 nt, Homo sapiens
cuugaaauuaguuuaccucauc

SEQ ID NO: 558721 - RNA, 16 nt, Homo sapiens
cuugaacauacuuggu

SEQ ID NO: 558722 - RNA, 13 nt, Homo sapiens
cuugaagaacuga

SEQ ID NO: 558723 - RNA, 13 nt, Homo sapiens
cuugaagcacuua

SEQ ID NO: 558724 - RNA, 11 nt, Homo sapiens
cuugaagccaa

SEQ ID NO: 558725 - RNA, 12 nt, Homo sapiens
cuugaagccaaa

SEQ ID NO: 558726 - RNA, 15 nt, Homo sapiens
cuugaagcuguggag

SEQ ID NO: 558727 - RNA, 22 nt, Homo sapiens
cuugaaggauggaugagucaga

SEQ ID NO: 558728 - RNA, 15 nt, Homo sapiens
cuugaagggcccaga

SEQ ID NO: 558729 - RNA, 22 nt, Homo sapiens
cuugaauacucugcccucuaga

SEQ ID NO: 558730 - RNA, 19 nt, Homo sapiens
cuugaauauguagcucauc

SEQ ID NO: 558731 - RNA, 15 nt, Homo sapiens
cuugaaugugucacu

SEQ ID NO: 558732 - RNA, 17 nt, Homo sapiens
cuugaauucauguuggu

SEQ ID NO: 558733 - RNA, 13 nt, Homo sapiens
cuugaauuucaaa

SEQ ID NO: 558734 - RNA, 23 nt, Homo sapiens
cuugaauuuuucuuccucuccac

SEQ ID NO: 558735 - RNA, 14 nt, Homo sapiens
cuugacauaccuac

SEQ ID NO: 558736 - RNA, 12 nt, Homo sapiens
cuugacauuccu

SEQ ID NO: 558737 - RNA, 20 nt, Homo sapiens
cuugaccacggcuguucccc

SEQ ID NO: 558738 - RNA, 18 nt, Homo sapiens
cuugacccccuugagggu

SEQ ID NO: 558739 - RNA, 13 nt, Homo sapiens
cuugaccucguga

SEQ ID NO: 558740 - RNA, 17 nt, Homo sapiens
cuugaccucgugaucca

SEQ ID NO: 558741 - RNA, 18 nt, Homo sapiens
cuugaccucgugauccac

SEQ ID NO: 558742 - RNA, 19 nt, Homo sapiens
cuugacuuccccacugcuc

SEQ ID NO: 558743 - RNA, 21 nt, Homo sapiens
cuugagcaaccuggcuaagau

SEQ ID NO: 558744 - RNA, 20 nt, Homo sapiens
cuugagccagccaggcccug

SEQ ID NO: 558745 - RNA, 14 nt, Homo sapiens
cuugagccaggugg

SEQ ID NO: 558746 - RNA, 13 nt, Homo sapiens
cuugagccuguga

SEQ ID NO: 558747 - RNA, 15 nt, Homo sapiens
cuugagcuucugggg

SEQ ID NO: 558748 - RNA, 18 nt, Homo sapiens
cuugaggaaaacaagcau

SEQ ID NO: 558749 - RNA, 20 nt, Homo sapiens
cuugaggggccccagcgucu

SEQ ID NO: 558750 - RNA, 20 nt, Homo sapiens
cuugagggugcuuguucccu

SEQ ID NO: 558751 - RNA, 15 nt, Homo sapiens
cuugaggugaaaugg

SEQ ID NO: 558752 - RNA, 12 nt, Homo sapiens
cuugagucagaa

SEQ ID NO: 558753 - RNA, 20 nt, Homo sapiens
cuugagucucuuuaccuaau

SEQ ID NO: 558754 - RNA, 17 nt, Homo sapiens
cuugaguuccucugcag

SEQ ID NO: 558755 - RNA, 20 nt, Homo sapiens
cuugaguuggaguacuauau

SEQ ID NO: 558756 - RNA, 14 nt, Homo sapiens
cuugauaaacuagg

SEQ ID NO: 558757 - RNA, 21 nt, Homo sapiens
cuugauaaauauauaugauca

SEQ ID NO: 558758 - RNA, 17 nt, Homo sapiens
cuugauaauacuugacc

SEQ ID NO: 558759 - RNA, 14 nt, Homo sapiens
cuugaucaauuccc

SEQ ID NO: 558760 - RNA, 18 nt, Homo sapiens
cuugaucaauucccuuga

SEQ ID NO: 558761 - RNA, 20 nt, Homo sapiens
cuugaucauuauaucauugg

SEQ ID NO: 558762 - RNA, 21 nt, Homo sapiens
cuugaucuuaacaaagccuuu

SEQ ID NO: 558763 - RNA, 14 nt, Homo sapiens
cuugaugacugcug

SEQ ID NO: 558764 - RNA, 20 nt, Homo sapiens
cuugaugccagagggccagc

SEQ ID NO: 558765 - RNA, 19 nt, Homo sapiens
cuugauguugcuuagucac

SEQ ID NO: 558766 - RNA, 20 nt, Homo sapiens
cuugauuagugccuucugcc

SEQ ID NO: 558767 - RNA, 18 nt, Homo sapiens
cuugcaaagcgacagauu

SEQ ID NO: 558768 - RNA, 22 nt, Homo sapiens
cuugcaaauaccuccucccuaa

SEQ ID NO: 558769 - RNA, 14 nt, Homo sapiens
cuugcaagccauaa

SEQ ID NO: 558770 - RNA, 15 nt, Homo sapiens
cuugcacacaggugu

SEQ ID NO: 558771 - RNA, 20 nt, Homo sapiens
cuugcaccacuuccguccca

SEQ ID NO: 558772 - RNA, 20 nt, Homo sapiens
cuugcaccccaaagcuuucc

SEQ ID NO: 558773 - RNA, 18 nt, Homo sapiens
cuugcacucuuuaacaca

SEQ ID NO: 558774 - RNA, 20 nt, Homo sapiens
cuugcagauaucugcaugug

SEQ ID NO: 558775 - RNA, 17 nt, Homo sapiens
cuugcagcuaguuuucu

SEQ ID NO: 558776 - RNA, 17 nt, Homo sapiens
cuugcaggagugacuca

SEQ ID NO: 558777 - RNA, 17 nt, Homo sapiens
cuugcaguuaaggguua

SEQ ID NO: 558778 - RNA, 18 nt, Homo sapiens
cuugcaguuaaggguuag

SEQ ID NO: 558779 - RNA, 10 nt, Homo sapiens
cuugcauaau

SEQ ID NO: 558780 - RNA, 13 nt, Homo sapiens
cuugcauacagag

SEQ ID NO: 558781 - RNA, 15 nt, Homo sapiens
cuugcauacagagac

SEQ ID NO: 558782 - RNA, 18 nt, Homo sapiens
cuugcauacagagacaga

SEQ ID NO: 558783 - RNA, 21 nt, Homo sapiens
cuugcaucuaaugaaaaacaa

SEQ ID NO: 558784 - RNA, 16 nt, Homo sapiens
cuugcauguacuugaa

SEQ ID NO: 558785 - RNA, 12 nt, Homo sapiens
cuugccagacau

SEQ ID NO: 558786 - RNA, 19 nt, Homo sapiens
cuugccagccucaggcuug

SEQ ID NO: 558787 - RNA, 16 nt, Homo sapiens
cuugccauccugaugg

SEQ ID NO: 558788 - RNA, 12 nt, Homo sapiens
cuugccaugcag

SEQ ID NO: 558789 - RNA, 14 nt, Homo sapiens
cuugcccucaagca

SEQ ID NO: 558790 - RNA, 21 nt, Homo sapiens
cuugccuaaauuuaaugcugc

SEQ ID NO: 558791 - RNA, 20 nt, Homo sapiens
cuugccuaaggugcguaguc

SEQ ID NO: 558792 - RNA, 20 nt, Homo sapiens
cuugccucaaguuccaugcu

SEQ ID NO: 558793 - RNA, 11 nt, Homo sapiens
gaauuccugua

SEQ ID NO: 558794 - RNA, 21 nt, Homo sapiens
gaauucuaaauaaauuuccca

SEQ ID NO: 558795 - RNA, 14 nt, Homo sapiens
gaauucuaagugaa

SEQ ID NO: 558796 - RNA, 16 nt, Homo sapiens
gaauucuagugcugcu

SEQ ID NO: 558797 - RNA, 16 nt, Homo sapiens
gaauucuggaaucaca

SEQ ID NO: 558798 - RNA, 14 nt, Homo sapiens
gaauucuucauccu

SEQ ID NO: 558799 - RNA, 16 nt, Homo sapiens
gaauucuucuguucuc

SEQ ID NO: 558800 - RNA, 14 nt, Homo sapiens
gaauucuuggggcu

SEQ ID NO: 558801 - RNA, 13 nt, Homo sapiens
gaauucuuugcau

SEQ ID NO: 558802 - RNA, 20 nt, Homo sapiens
gaauugaacgacuguauauu

SEQ ID NO: 558803 - RNA, 23 nt, Homo sapiens
gaauugaccccuuccuccagggg

SEQ ID NO: 558804 - RNA, 17 nt, Homo sapiens
gaauugcuuaccaaagg

SEQ ID NO: 558805 - RNA, 14 nt, Homo sapiens
gaauuggaaucaca

SEQ ID NO: 558806 - RNA, 19 nt, Homo sapiens
gaauuggcauaauuugucu

SEQ ID NO: 558807 - RNA, 14 nt, Homo sapiens
gaauuggugauucu

SEQ ID NO: 558808 - RNA, 17 nt, Homo sapiens
gaauuguggaguguuuu

SEQ ID NO: 558809 - RNA, 23 nt, Homo sapiens
gaauuguuuccuuauuugcacuu

SEQ ID NO: 558810 - RNA, 20 nt, Homo sapiens
gaauuguuuuuugcucuuuu

SEQ ID NO: 558811 - RNA, 18 nt, Homo sapiens
gaauuuagaaaaagucaa

SEQ ID NO: 558812 - RNA, 20 nt, Homo sapiens
gaauuuauuauuuaccguug

SEQ ID NO: 558813 - RNA, 17 nt, Homo sapiens
gaauuuauucaauuccu

SEQ ID NO: 558814 - RNA, 10 nt, Homo sapiens
gaauuuccac

SEQ ID NO: 558815 - RNA, 13 nt, Homo sapiens
gaauuucccacau

SEQ ID NO: 558816 - RNA, 11 nt, Homo sapiens
gaauuuccucu

SEQ ID NO: 558817 - RNA, 15 nt, Homo sapiens
gaauuuccucuauug

SEQ ID NO: 558818 - RNA, 16 nt, Homo sapiens
gaauuucuucagucca

SEQ ID NO: 558819 - RNA, 11 nt, Homo sapiens
gaauuugcacc

SEQ ID NO: 558820 - RNA, 14 nt, Homo sapiens
gaauuugguaaauu

SEQ ID NO: 558821 - RNA, 14 nt, Homo sapiens
gaauuuguguuugu

SEQ ID NO: 558822 - RNA, 13 nt, Homo sapiens
gaauuuguugcua

SEQ ID NO: 558823 - RNA, 19 nt, Homo sapiens
gaauuuucucuaacuucaa

SEQ ID NO: 558824 - RNA, 22 nt, Homo sapiens
gaauuuuguucucugggagaaa

SEQ ID NO: 558825 - RNA, 21 nt, Homo sapiens
gaauuuuuacuuagauacuaa

SEQ ID NO: 558826 - RNA, 20 nt, Homo sapiens
gaauuuuucuuccucuccac

SEQ ID NO: 558827 - RNA, 16 nt, Homo sapiens
gaauuuuucuuccuga

SEQ ID NO: 558828 - RNA, 14 nt, Homo sapiens
gaauuuuugaagug

SEQ ID NO: 558829 - RNA, 23 nt, Homo sapiens
gaauuuuuugagagaaugagaug

SEQ ID NO: 558830 - RNA, 21 nt, Homo sapiens
gacaaaaagcacuaguauaaa

SEQ ID NO: 558831 - RNA, 23 nt, Homo sapiens
gacaaaaaggugcagaaggcaau

SEQ ID NO: 558832 - RNA, 13 nt, Homo sapiens
gacaaaacacagc

SEQ ID NO: 558833 - RNA, 14 nt, Homo sapiens
gacaaaaccaaaac

SEQ ID NO: 558834 - RNA, 14 nt, Homo sapiens
gacaaaagaaacuu

SEQ ID NO: 558835 - RNA, 16 nt, Homo sapiens
gacaaaauauuuccca

SEQ ID NO: 558836 - RNA, 20 nt, Homo sapiens
gacaaaauuaauacauucua

SEQ ID NO: 558837 - RNA, 16 nt, Homo sapiens
gacaaaauucauuugc

SEQ ID NO: 558838 - RNA, 14 nt, Homo sapiens
gacaaaccagagca

SEQ ID NO: 558839 - RNA, 21 nt, Homo sapiens
gacaaaccagagcagagagca

SEQ ID NO: 558840 - RNA, 19 nt, Homo sapiens
gacaaaccauaacugacaa

SEQ ID NO: 558841 - RNA, 17 nt, Homo sapiens
gacaaagaaacccaagu

SEQ ID NO: 558842 - RNA, 21 nt, Homo sapiens
gacaaagaauuccaaagcaaa

SEQ ID NO: 558843 - RNA, 18 nt, Homo sapiens
gacaaagacaaauucugu

SEQ ID NO: 558844 - RNA, 17 nt, Homo sapiens
gacaaagagaaugagaa

SEQ ID NO: 558845 - RNA, 12 nt, Homo sapiens
gacaaagccaaa

SEQ ID NO: 558846 - RNA, 11 nt, Homo sapiens
gacaaagccau

SEQ ID NO: 558847 - RNA, 20 nt, Homo sapiens
gacaaagccuuaaaaugcau

SEQ ID NO: 558848 - RNA, 14 nt, Homo sapiens
gacaaagugacauu

SEQ ID NO: 558849 - RNA, 19 nt, Homo sapiens
gacaaauaucuuuuuugga

SEQ ID NO: 558850 - RNA, 20 nt, Homo sapiens
gacaacacagcaggacucca

SEQ ID NO: 558851 - RNA, 13 nt, Homo sapiens
gacaacacuggga

SEQ ID NO: 558852 - RNA, 13 nt, Homo sapiens
gacaacagacuga

SEQ ID NO: 558853 - RNA, 16 nt, Homo sapiens
gacaacagugcuuugu

SEQ ID NO: 558854 - RNA, 19 nt, Homo sapiens
gacaacauuauaacuguau

SEQ ID NO: 558855 - RNA, 12 nt, Homo sapiens
gacaacauuucu

SEQ ID NO: 558856 - RNA, 22 nt, Homo sapiens
gacaaccaacggccgacugccu

SEQ ID NO: 558857 - RNA, 11 nt, Homo sapiens
gacaacccagg

SEQ ID NO: 558858 - RNA, 16 nt, Homo sapiens
gacaaccuccauucua

SEQ ID NO: 558859 - RNA, 17 nt, Homo sapiens
gacaacucagaggccag

SEQ ID NO: 558860 - RNA, 15 nt, Homo sapiens
gacaacugugacugu

SEQ ID NO: 558861 - RNA, 15 nt, Homo sapiens
gacaacuuagcucag

SEQ ID NO: 558862 - RNA, 15 nt, Homo sapiens
gacaagaagacuguc

SEQ ID NO: 558863 - RNA, 18 nt, Homo sapiens
gacaagacaaaaccaaaa

SEQ ID NO: 558864 - RNA, 21 nt, Homo sapiens
gacaagauacauaugaggaca

SEQ ID NO: 558865 - RNA, 23 nt, Homo sapiens
gacaagcagucccuuaauauuga

SEQ ID NO: 558866 - RNA, 11 nt, Homo sapiens
gacaagccauc

SEQ ID NO: 558867 - RNA, 16 nt, Homo sapiens
gacaagccuaacuuca

SEQ ID NO: 558868 - RNA, 17 nt, Homo sapiens
gacaaggaaaaucuaua

SEQ ID NO: 558869 - RNA, 21 nt, Homo sapiens
gacaaggagugugaccacuga

SEQ ID NO: 558870 - RNA, 13 nt, Homo sapiens
gacaaggugcuaa

SEQ ID NO: 558871 - RNA, 22 nt, Homo sapiens
gacaaugcaaugaaacagauga

SEQ ID NO: 558872 - RNA, 12 nt, Homo sapiens
gacaaugccaau

SEQ ID NO: 558873 - RNA, 13 nt, Homo sapiens
gacaaugccaaua

SEQ ID NO: 558874 - RNA, 14 nt, Homo sapiens
gacaaugccaauag

SEQ ID NO: 558875 - RNA, 19 nt, Homo sapiens
gacaauuaucugugucaaa

SEQ ID NO: 558876 - RNA, 21 nt, Homo sapiens
gacaauuccuagauaaaaaga

SEQ ID NO: 558877 - RNA, 13 nt, Homo sapiens
gacacaaaacucc

SEQ ID NO: 558878 - RNA, 18 nt, Homo sapiens
gacacaaaacuccgcccc

SEQ ID NO: 558879 - RNA, 16 nt, Homo sapiens
gacacaccugaacaca

SEQ ID NO: 558880 - RNA, 12 nt, Homo sapiens
gacacacuguua

SEQ ID NO: 558881 - RNA, 13 nt, Homo sapiens
gacacagaaaaug

SEQ ID NO: 558882 - RNA, 15 nt, Homo sapiens
gacacagcaguauug

SEQ ID NO: 558883 - RNA, 16 nt, Homo sapiens
gacacagcagugguau

SEQ ID NO: 558884 - RNA, 12 nt, Homo sapiens
gacacaugccag

SEQ ID NO: 558885 - RNA, 19 nt, Homo sapiens
gacacaugccagggccaug

SEQ ID NO: 558886 - RNA, 18 nt, Homo sapiens
gacacauuagccuugaac

SEQ ID NO: 558887 - RNA, 15 nt, Homo sapiens
gacaccaccaaggcu

SEQ ID NO: 558888 - RNA, 15 nt, Homo sapiens
gacacccaacacuuu

SEQ ID NO: 558889 - RNA, 18 nt, Homo sapiens
gacaccccugcucuaccc

SEQ ID NO: 558890 - RNA, 23 nt, Homo sapiens
gacaccccugcucuacccaugag

SEQ ID NO: 558891 - RNA, 18 nt, Homo sapiens
gacaccuggacugagcca

SEQ ID NO: 558892 - RNA, 19 nt, Homo sapiens
gacaccuguacauucuucc

SEQ ID NO: 558893 - RNA, 20 nt, Homo sapiens
gacacgauugagaacugaca

SEQ ID NO: 558894 - RNA, 23 nt, Homo sapiens
gacacuaaaacaagaggacacaa

SEQ ID NO: 558895 - RNA, 15 nt, Homo sapiens
gacacuacauaucua

SEQ ID NO: 558896 - RNA, 15 nt, Homo sapiens
gacacuaucacucau

SEQ ID NO: 558897 - RNA, 22 nt, Homo sapiens
gacacuccaugagugucuguga

SEQ ID NO: 558898 - RNA, 20 nt, Homo sapiens
gacacucuagugacuuccug

SEQ ID NO: 558899 - RNA, 17 nt, Homo sapiens
gacacugacaaagucau

SEQ ID NO: 558900 - RNA, 17 nt, Homo sapiens
gacacugaugaguuuca

SEQ ID NO: 558901 - RNA, 17 nt, Homo sapiens
gacacuguuggggaccu

SEQ ID NO: 558902 - RNA, 17 nt, Homo sapiens
gacacuuuaauuaccaa

SEQ ID NO: 558903 - RNA, 19 nt, Homo sapiens
gacacuuuggaaguuugug

SEQ ID NO: 558904 - RNA, 22 nt, Homo sapiens
gacagaaaaaaaaaaaaaauca

SEQ ID NO: 558905 - RNA, 13 nt, Homo sapiens
gacagaaugucac

SEQ ID NO: 558906 - RNA, 18 nt, Homo sapiens
gacagacaacacugggaa

SEQ ID NO: 558907 - RNA, 13 nt, Homo sapiens
gacagacccagug

SEQ ID NO: 558908 - RNA, 15 nt, Homo sapiens
gacagacggaaauga

SEQ ID NO: 558909 - RNA, 19 nt, Homo sapiens
gacagagaaggcgcuuccc

SEQ ID NO: 558910 - RNA, 20 nt, Homo sapiens
gacagagacuugggggccau

SEQ ID NO: 558911 - RNA, 16 nt, Homo sapiens
gacagagauaccauuc

SEQ ID NO: 558912 - RNA, 16 nt, Homo sapiens
gacagagcgagacucc

SEQ ID NO: 558913 - RNA, 16 nt, Homo sapiens
gacagagugaauuuca

SEQ ID NO: 558914 - RNA, 19 nt, Homo sapiens
gacagaucaagcugugaga

SEQ ID NO: 558915 - RNA, 18 nt, Homo sapiens
gacagcaaggaacuguca

SEQ ID NO: 558916 - RNA, 15 nt, Homo sapiens
gacagcaccacugcu

SEQ ID NO: 558917 - RNA, 17 nt, Homo sapiens
gacagcagaagccucca

SEQ ID NO: 558918 - RNA, 19 nt, Homo sapiens
gacagcagauuccacagga

SEQ ID NO: 558919 - RNA, 19 nt, Homo sapiens
gacagcaucuuccucccuc

SEQ ID NO: 558920 - RNA, 20 nt, Homo sapiens
gacagcaugaaauguccucu

SEQ ID NO: 558921 - RNA, 12 nt, Homo sapiens
gacagcauuucc

SEQ ID NO: 558922 - RNA, 15 nt, Homo sapiens
gacagccaagcaccu

SEQ ID NO: 558923 - RNA, 17 nt, Homo sapiens
gacagcccuccuugacc

SEQ ID NO: 558924 - RNA, 18 nt, Homo sapiens
gacagcucuguaucugcc

SEQ ID NO: 558925 - RNA, 16 nt, Homo sapiens
gacagcugugcucuca

SEQ ID NO: 558926 - RNA, 16 nt, Homo sapiens
gacagcugugugacau

SEQ ID NO: 558927 - RNA, 14 nt, Homo sapiens
gacagcuucaugaa

SEQ ID NO: 558928 - RNA, 14 nt, Homo sapiens
gacagcuuccucac

SEQ ID NO: 558929 - RNA, 16 nt, Homo sapiens
gacaggaagcuggcag

SEQ ID NO: 558930 - RNA, 23 nt, Homo sapiens
gacaggcccaagagaugaagagu

SEQ ID NO: 558931 - RNA, 18 nt, Homo sapiens
gacaggcuccucugggga

SEQ ID NO: 558932 - RNA, 18 nt, Homo sapiens
gacagggccagugcaguu

SEQ ID NO: 558933 - RNA, 15 nt, Homo sapiens
gacaguaaaucucac

SEQ ID NO: 558934 - RNA, 12 nt, Homo sapiens
gacaguaccuga

SEQ ID NO: 558935 - RNA, 16 nt, Homo sapiens
gacaguauuaagggua

SEQ ID NO: 558936 - RNA, 13 nt, Homo sapiens
gacaguauuccau

SEQ ID NO: 558937 - RNA, 20 nt, Homo sapiens
gacaguccaaccuugagaau

SEQ ID NO: 558938 - RNA, 18 nt, Homo sapiens
gacagucuggccacuguc

SEQ ID NO: 558939 - RNA, 22 nt, Homo sapiens
gacagugaaauacauccuucaa

SEQ ID NO: 558940 - RNA, 10 nt, Homo sapiens
gacagugaau

SEQ ID NO: 558941 - RNA, 22 nt, Homo sapiens
gacagugacuguacaguuauca

SEQ ID NO: 558942 - RNA, 17 nt, Homo sapiens
gacagugagacuguggc

SEQ ID NO: 558943 - RNA, 18 nt, Homo sapiens
gacagugaggcaggagaa

SEQ ID NO: 558944 - RNA, 14 nt, Homo sapiens
gacagugcugcccu

SEQ ID NO: 558945 - RNA, 21 nt, Homo sapiens
gacaguggcaggggcuggaga

SEQ ID NO: 558946 - RNA, 18 nt, Homo sapiens
gacaguguagcacucuac

SEQ ID NO: 558947 - RNA, 16 nt, Homo sapiens
gacaguguuaucccaa

SEQ ID NO: 558948 - RNA, 17 nt, Homo sapiens
gacaguguuuucuggga

SEQ ID NO: 558949 - RNA, 13 nt, Homo sapiens
gagaaccucaggc

SEQ ID NO: 558950 - RNA, 17 nt, Homo sapiens
gagaacuccucauuccc

SEQ ID NO: 558951 - RNA, 16 nt, Homo sapiens
gagaacugacaaagga

SEQ ID NO: 558952 - RNA, 19 nt, Homo sapiens
gagaacuggacaguggcag

SEQ ID NO: 558953 - RNA, 17 nt, Homo sapiens
gagaacuugaaacagau

SEQ ID NO: 558954 - RNA, 22 nt, Homo sapiens
gagaagaaaaccucaaguaaua

SEQ ID NO: 558955 - RNA, 12 nt, Homo sapiens
gagaagaagcag

SEQ ID NO: 558956 - RNA, 20 nt, Homo sapiens
gagaagaauaucaaauaaua

SEQ ID NO: 558957 - RNA, 23 nt, Homo sapiens
gagaagaauuuucagaccccagc

SEQ ID NO: 558958 - RNA, 20 nt, Homo sapiens
gagaagagaugcugccauuu

SEQ ID NO: 558959 - RNA, 14 nt, Homo sapiens
gagaagcagugagc

SEQ ID NO: 558960 - RNA, 20 nt, Homo sapiens
gagaagccuucagcuccagg

SEQ ID NO: 558961 - RNA, 14 nt, Homo sapiens
gagaagcucaccca

SEQ ID NO: 558962 - RNA, 18 nt, Homo sapiens
gagaagcuguaggacugu

SEQ ID NO: 558963 - RNA, 12 nt, Homo sapiens
gagaagcuucua

SEQ ID NO: 558964 - RNA, 19 nt, Homo sapiens
gagaaggaaggagacucac

SEQ ID NO: 558965 - RNA, 18 nt, Homo sapiens
gagaaggacggugccaag

SEQ ID NO: 558966 - RNA, 16 nt, Homo sapiens
gagaaggaggggagca

SEQ ID NO: 558967 - RNA, 15 nt, Homo sapiens
gagaaggcacacaga

SEQ ID NO: 558968 - RNA, 22 nt, Homo sapiens
gagaaguacaaagguugcagug

SEQ ID NO: 558969 - RNA, 13 nt, Homo sapiens
gagaaguauacau

SEQ ID NO: 558970 - RNA, 21 nt, Homo sapiens
gagaaguccagcucuucgccc

SEQ ID NO: 558971 - RNA, 18 nt, Homo sapiens
gagaaguucccauuauua

SEQ ID NO: 558972 - RNA, 21 nt, Homo sapiens
gagaaguuucgagggguccuc

SEQ ID NO: 558973 - RNA, 21 nt, Homo sapiens
gagaauaaacuagacucugaa

SEQ ID NO: 558974 - RNA, 18 nt, Homo sapiens
gagaaucagaucauuuca

SEQ ID NO: 558975 - RNA, 14 nt, Homo sapiens
gagaauguguguag

SEQ ID NO: 558976 - RNA, 20 nt, Homo sapiens
gagaauguguuucaaaacca

SEQ ID NO: 558977 - RNA, 20 nt, Homo sapiens
gagaauguuagccaugacuu

SEQ ID NO: 558978 - RNA, 16 nt, Homo sapiens
gagaauguucaucucu

SEQ ID NO: 558979 - RNA, 17 nt, Homo sapiens
gagaauuauuccuuucc

SEQ ID NO: 558980 - RNA, 14 nt, Homo sapiens
gagaauuggcucaa

SEQ ID NO: 558981 - RNA, 12 nt, Homo sapiens
gagaauuguuga

SEQ ID NO: 558982 - RNA, 16 nt, Homo sapiens
gagaauuuaaacaaug

SEQ ID NO: 558983 - RNA, 23 nt, Homo sapiens
gagaauuuccaaaacuuuaauga

SEQ ID NO: 558984 - RNA, 14 nt, Homo sapiens
gagacaacagguaa

SEQ ID NO: 558985 - RNA, 17 nt, Homo sapiens
gagacaaugauaugcaa

SEQ ID NO: 558986 - RNA, 14 nt, Homo sapiens
gagacacaucuccu

SEQ ID NO: 558987 - RNA, 18 nt, Homo sapiens
gagcacucauuccuuccc

SEQ ID NO: 558988 - RNA, 19 nt, Homo sapiens
gagcacucucaccccaagc

SEQ ID NO: 558989 - RNA, 17 nt, Homo sapiens
gagcacuggagugcagg

SEQ ID NO: 558990 - RNA, 21 nt, Homo sapiens
gagcacuguuuauacacugug

SEQ ID NO: 558991 - RNA, 15 nt, Homo sapiens
gagcacuuguuuuaa

SEQ ID NO: 558992 - RNA, 20 nt, Homo sapiens
gagcagaaaguaagcauuuc

SEQ ID NO: 558993 - RNA, 15 nt, Homo sapiens
gagcagaugaugcca

SEQ ID NO: 558994 - RNA, 15 nt, Homo sapiens
gagcagcagccagca

SEQ ID NO: 558995 - RNA, 15 nt, Homo sapiens
gagcagccacaacca

SEQ ID NO: 558996 - RNA, 23 nt, Homo sapiens
gagcagccagcaaguaagcuagc

SEQ ID NO: 558997 - RNA, 19 nt, Homo sapiens
gagcagcuuuggaaacagg

SEQ ID NO: 558998 - RNA, 16 nt, Homo sapiens
gagcaggaacaaugac

SEQ ID NO: 558999 - RNA, 18 nt, Homo sapiens
gagcaggaggccaauaaa

SEQ ID NO: 559000 - RNA, 19 nt, Homo sapiens
gagcagggagaccaugccu

SEQ ID NO: 559001 - RNA, 18 nt, Homo sapiens
gagcaguaaaagucacau

SEQ ID NO: 559002 - RNA, 17 nt, Homo sapiens
gagcaguaucaugaagc

SEQ ID NO: 559003 - RNA, 17 nt, Homo sapiens
gagcaguggcuggucca

SEQ ID NO: 559004 - RNA, 14 nt, Homo sapiens
gagcagugucuucc

SEQ ID NO: 559005 - RNA, 23 nt, Homo sapiens
gagcaguuucauugugaucacug

SEQ ID NO: 559006 - RNA, 22 nt, Homo sapiens
gagcauaauaaauuauauuaaa

SEQ ID NO: 559007 - RNA, 19 nt, Homo sapiens
gagcaucucuugaggccag

SEQ ID NO: 559008 - RNA, 22 nt, Homo sapiens
gagcaucugcaacaaaaaguca

SEQ ID NO: 559009 - RNA, 18 nt, Homo sapiens
gagcaugacagccugcag

SEQ ID NO: 559010 - RNA, 18 nt, Homo sapiens
gagcaugggccuggccac

SEQ ID NO: 559011 - RNA, 15 nt, Homo sapiens
gagcauuaagcccaa

SEQ ID NO: 559012 - RNA, 14 nt, Homo sapiens
gagcauuugcaccu

SEQ ID NO: 559013 - RNA, 15 nt, Homo sapiens
gagccaaaaucucaa

SEQ ID NO: 559014 - RNA, 16 nt, Homo sapiens
gagccaaauucauccu

SEQ ID NO: 559015 - RNA, 13 nt, Homo sapiens
gagccaagcugca

SEQ ID NO: 559016 - RNA, 23 nt, Homo sapiens
gagccaaggagggagggucuucc

SEQ ID NO: 559017 - RNA, 20 nt, Homo sapiens
gagccaaguccagauuuaca

SEQ ID NO: 559018 - RNA, 23 nt, Homo sapiens
gagccacagcugugcaugcucag

SEQ ID NO: 559019 - RNA, 18 nt, Homo sapiens
gagccaccgcgcccggcc

SEQ ID NO: 559020 - RNA, 19 nt, Homo sapiens
gagccaccgcgcccggccu

SEQ ID NO: 559021 - RNA, 23 nt, Homo sapiens
gagccaccgcgcccuccugccca

SEQ ID NO: 559022 - RNA, 15 nt, Homo sapiens
gagccagcucccucu

SEQ ID NO: 559023 - RNA, 21 nt, Homo sapiens
gagccagcuuggggccaccaa

SEQ ID NO: 559024 - RNA, 16 nt, Homo sapiens
gagccagggcuguccu

SEQ ID NO: 559025 - RNA, 20 nt, Homo sapiens
gagccaguccuccacucgac

SEQ ID NO: 559026 - RNA, 20 nt, Homo sapiens
gagccauagcugaucauguc

SEQ ID NO: 559027 - RNA, 13 nt, Homo sapiens
gagccauaugaau

SEQ ID NO: 559028 - RNA, 21 nt, Homo sapiens
gagccauauguacauaaucua

SEQ ID NO: 559029 - RNA, 23 nt, Homo sapiens
gagccauauuaauugccuguuaa

SEQ ID NO: 559030 - RNA, 13 nt, Homo sapiens
gagccauccuccu

SEQ ID NO: 559031 - RNA, 18 nt, Homo sapiens
gagccaugacaagaacaa

SEQ ID NO: 559032 - RNA, 12 nt, Homo sapiens
gagccaugccag

SEQ ID NO: 559033 - RNA, 21 nt, Homo sapiens
gagcccagaucaccaccugaa

SEQ ID NO: 559034 - RNA, 20 nt, Homo sapiens
gagcccagucgagaccucac

SEQ ID NO: 559035 - RNA, 16 nt, Homo sapiens
gagcccauagccagcu

SEQ ID NO: 559036 - RNA, 15 nt, Homo sapiens
gagcccauccagucu

SEQ ID NO: 559037 - RNA, 18 nt, Homo sapiens
gagccccacgcuguugac

SEQ ID NO: 559038 - RNA, 17 nt, Homo sapiens
gagcccccaacacaggc

SEQ ID NO: 559039 - RNA, 16 nt, Homo sapiens
gagcccccaccacaaa

SEQ ID NO: 559040 - RNA, 18 nt, Homo sapiens
gagccccuacagcauugu

SEQ ID NO: 559041 - RNA, 14 nt, Homo sapiens
gagccccugacccc

SEQ ID NO: 559042 - RNA, 23 nt, Homo sapiens
gagccccuuggggguucagggaa

SEQ ID NO: 559043 - RNA, 19 nt, Homo sapiens
gagcccgcagcccagaccc

SEQ ID NO: 559044 - RNA, 19 nt, Homo sapiens
gagcccggcaacucuagua

SEQ ID NO: 559045 - RNA, 20 nt, Homo sapiens
gagcccuaaaaauccagacu

SEQ ID NO: 559046 - RNA, 21 nt, Homo sapiens
gagcccugaggaccucucagc

SEQ ID NO: 559047 - RNA, 21 nt, Homo sapiens
gagccgagaucacaccacugu

SEQ ID NO: 559048 - RNA, 16 nt, Homo sapiens
gagccgagauugcacc

SEQ ID NO: 559049 - RNA, 14 nt, Homo sapiens
gagccgcugugagc

SEQ ID NO: 559050 - RNA, 16 nt, Homo sapiens
gagccggcauccuugc

SEQ ID NO: 559051 - RNA, 20 nt, Homo sapiens
gagccggccgccuucucccc

SEQ ID NO: 559052 - RNA, 21 nt, Homo sapiens
gagccggcugccuaccagggg

SEQ ID NO: 559053 - RNA, 17 nt, Homo sapiens
gagccgggucugccucu

SEQ ID NO: 559054 - RNA, 21 nt, Homo sapiens
gagccgguccuugcugcaccu

SEQ ID NO: 559055 - RNA, 22 nt, Homo sapiens
gagccuacagaagggcagugac

SEQ ID NO: 559056 - RNA, 13 nt, Homo sapiens
gagccuaccuuca

SEQ ID NO: 559057 - RNA, 17 nt, Homo sapiens
gagccuagcuccugcca

SEQ ID NO: 559058 - RNA, 16 nt, Homo sapiens
gagccuccacugccuc

SEQ ID NO: 559059 - RNA, 17 nt, Homo sapiens
gagccuccacugccucu

SEQ ID NO: 559060 - RNA, 12 nt, Homo sapiens
gagccugaggca

SEQ ID NO: 559061 - RNA, 17 nt, Homo sapiens
gagccugcaaacucacu

SEQ ID NO: 559062 - RNA, 21 nt, Homo sapiens
gagccugccaagagguacugu

SEQ ID NO: 559063 - RNA, 18 nt, Homo sapiens
gagccugcccucacuccc

SEQ ID NO: 559064 - RNA, 19 nt, Homo sapiens
gagccuggaacugcaucag

SEQ ID NO: 559065 - RNA, 17 nt, Homo sapiens
gagccuggcuggcacag

SEQ ID NO: 559066 - RNA, 16 nt, Homo sapiens
gagccuuccacaguga

SEQ ID NO: 559067 - RNA, 14 nt, Homo sapiens
gagccuugcaugua

SEQ ID NO: 559068 - RNA, 13 nt, Homo sapiens
gauggguggcacc

SEQ ID NO: 559069 - RNA, 14 nt, Homo sapiens
gauggguggcacca

SEQ ID NO: 559070 - RNA, 15 nt, Homo sapiens
gaugguaaaccagau

SEQ ID NO: 559071 - RNA, 16 nt, Homo sapiens
gauggucucgaucucu

SEQ ID NO: 559072 - RNA, 14 nt, Homo sapiens
gauggugaccuggg

SEQ ID NO: 559073 - RNA, 12 nt, Homo sapiens
gauggugccugc

SEQ ID NO: 559074 - RNA, 21 nt, Homo sapiens
gaugguguguccagcacucga

SEQ ID NO: 559075 - RNA, 18 nt, Homo sapiens
gaugguucauaucaugaa

SEQ ID NO: 559076 - RNA, 14 nt, Homo sapiens
gaugguugcaauug

SEQ ID NO: 559077 - RNA, 13 nt, Homo sapiens
gauguaaugcauu

SEQ ID NO: 559078 - RNA, 22 nt, Homo sapiens
gauguaaugucccuuucagaga

SEQ ID NO: 559079 - RNA, 11 nt, Homo sapiens
gauguacaauu

SEQ ID NO: 559080 - RNA, 15 nt, Homo sapiens
gauguagucaguuag

SEQ ID NO: 559081 - RNA, 20 nt, Homo sapiens
gauguaugcacacacauaua

SEQ ID NO: 559082 - RNA, 20 nt, Homo sapiens
gauguaugugugaaacaaug

SEQ ID NO: 559083 - RNA, 15 nt, Homo sapiens
gauguauuguugcuu

SEQ ID NO: 559084 - RNA, 14 nt, Homo sapiens
gaugucaagcaaug

SEQ ID NO: 559085 - RNA, 13 nt, Homo sapiens
gaugucaucuucc

SEQ ID NO: 559086 - RNA, 17 nt, Homo sapiens
gaugucccugggccagg

SEQ ID NO: 559087 - RNA, 16 nt, Homo sapiens
gaugucuauguagcug

SEQ ID NO: 559088 - RNA, 15 nt, Homo sapiens
gaugucucacauccu

SEQ ID NO: 559089 - RNA, 17 nt, Homo sapiens
gaugucuccacuuucac

SEQ ID NO: 559090 - RNA, 22 nt, Homo sapiens
gaugugaauacucuucccacau

SEQ ID NO: 559091 - RNA, 22 nt, Homo sapiens
gaugugaauuauugacacugaa

SEQ ID NO: 559092 - RNA, 17 nt, Homo sapiens
gaugugagccaccgugc

SEQ ID NO: 559093 - RNA, 17 nt, Homo sapiens
gaugugcagauaucaca

SEQ ID NO: 559094 - RNA, 19 nt, Homo sapiens
gauguggagcuacugauga

SEQ ID NO: 559095 - RNA, 13 nt, Homo sapiens
gaugugggguccc

SEQ ID NO: 559096 - RNA, 16 nt, Homo sapiens
gauguguccucaggga

SEQ ID NO: 559097 - RNA, 15 nt, Homo sapiens
gaugugucuuaccag

SEQ ID NO: 559098 - RNA, 13 nt, Homo sapiens
gaugugucuucaa

SEQ ID NO: 559099 - RNA, 22 nt, Homo sapiens
gauguguuuugcacgucuugcu

SEQ ID NO: 559100 - RNA, 23 nt, Homo sapiens
gauguuaugcuccugcugaucca

SEQ ID NO: 559101 - RNA, 21 nt, Homo sapiens
gauguugaaauaugcauacua

SEQ ID NO: 559102 - RNA, 17 nt, Homo sapiens
gauguugagaauguuca

SEQ ID NO: 559103 - RNA, 12 nt, Homo sapiens
gauguugcucag

SEQ ID NO: 559104 - RNA, 16 nt, Homo sapiens
gauguugucuuggcuu

SEQ ID NO: 559105 - RNA, 15 nt, Homo sapiens
gauguuuaggauaag

SEQ ID NO: 559106 - RNA, 14 nt, Homo sapiens
gauguuuccugggu

SEQ ID NO: 559107 - RNA, 22 nt, Homo sapiens
gauguuucgaguaaacuugaaa

SEQ ID NO: 559108 - RNA, 22 nt, Homo sapiens
gauguuuuaaguuuaucuuuca

SEQ ID NO: 559109 - RNA, 16 nt, Homo sapiens
gauguuuuacgugcaa

SEQ ID NO: 559110 - RNA, 17 nt, Homo sapiens
gauguuuuacgugcaaa

SEQ ID NO: 559111 - RNA, 18 nt, Homo sapiens
gauguuuuacgugcaaac

SEQ ID NO: 559112 - RNA, 15 nt, Homo sapiens
gauuaaaaauaccuu

SEQ ID NO: 559113 - RNA, 17 nt, Homo sapiens
gauuaaaaucacucuca

SEQ ID NO: 559114 - RNA, 13 nt, Homo sapiens
gauuaacauauag

SEQ ID NO: 559115 - RNA, 14 nt, Homo sapiens
gauuaaccucugca

SEQ ID NO: 559116 - RNA, 23 nt, Homo sapiens
gauuaaccucugcacuacugaca

SEQ ID NO: 559117 - RNA, 15 nt, Homo sapiens
gauuaagaguugcca

SEQ ID NO: 559118 - RNA, 18 nt, Homo sapiens
gauuaagaguugccaaaa

SEQ ID NO: 559119 - RNA, 13 nt, Homo sapiens
gauuaagauuuua

SEQ ID NO: 559120 - RNA, 16 nt, Homo sapiens
gauuaauaagugaagg

SEQ ID NO: 559121 - RNA, 14 nt, Homo sapiens
gauuaauauuauua

SEQ ID NO: 559122 - RNA, 15 nt, Homo sapiens
gauuaauguuuugua

SEQ ID NO: 559123 - RNA, 16 nt, Homo sapiens
gauuacaggcaccugc

SEQ ID NO: 559124 - RNA, 19 nt, Homo sapiens
gauuacaggcaugagccac

SEQ ID NO: 559125 - RNA, 20 nt, Homo sapiens
gauuacaggugcgcacuacc

SEQ ID NO: 559126 - RNA, 16 nt, Homo sapiens
gauuaccgacacuguc

SEQ ID NO: 559127 - RNA, 23 nt, Homo sapiens
gauuacucuccauaucccuuccu

SEQ ID NO: 559128 - RNA, 21 nt, Homo sapiens
gauuacugccauucacuucau

SEQ ID NO: 559129 - RNA, 14 nt, Homo sapiens
gauuacugucaaua

SEQ ID NO: 559130 - RNA, 18 nt, Homo sapiens
gauuagcucuggaccagc

SEQ ID NO: 559131 - RNA, 11 nt, Homo sapiens
gauuagcugua

SEQ ID NO: 559132 - RNA, 12 nt, Homo sapiens
gauuagcuguaa

SEQ ID NO: 559133 - RNA, 19 nt, Homo sapiens
gauuaggucguuuuccaaa

SEQ ID NO: 559134 - RNA, 20 nt, Homo sapiens
gauuagguguucaggccagu

SEQ ID NO: 559135 - RNA, 16 nt, Homo sapiens
gauuaguacacacuug

SEQ ID NO: 559136 - RNA, 22 nt, Homo sapiens
gauuagugccuucugcccuccc

SEQ ID NO: 559137 - RNA, 22 nt, Homo sapiens
gauuauaaaaaauguaacauca

SEQ ID NO: 559138 - RNA, 13 nt, Homo sapiens
gauuauaaacuga

SEQ ID NO: 559139 - RNA, 14 nt, Homo sapiens
gauuauaaacugac

SEQ ID NO: 559140 - RNA, 20 nt, Homo sapiens
gauuaugaagugacucucac

SEQ ID NO: 559141 - RNA, 14 nt, Homo sapiens
gauuaugcuuucuu

SEQ ID NO: 559142 - RNA, 23 nt, Homo sapiens
gauuauucuuugaaaacagauga

SEQ ID NO: 559143 - RNA, 17 nt, Homo sapiens
gauuauuuaaaugggaa

SEQ ID NO: 559144 - RNA, 14 nt, Homo sapiens
gauuauuuaucaca

SEQ ID NO: 559145 - RNA, 15 nt, Homo sapiens
gauucacagucucau

SEQ ID NO: 559146 - RNA, 14 nt, Homo sapiens
gauucacaucucau

SEQ ID NO: 559147 - RNA, 11 nt, Homo sapiens
gauucaccucu

SEQ ID NO: 559148 - RNA, 23 nt, Homo sapiens
gauucagcauuauuccuccagga

SEQ ID NO: 559149 - RNA, 23 nt, Homo sapiens
gauucagcgaagucucaugggaa

SEQ ID NO: 559150 - RNA, 15 nt, Homo sapiens
gauucaggggucuga

SEQ ID NO: 559151 - RNA, 20 nt, Homo sapiens
gauucaggggucugaugaca

SEQ ID NO: 559152 - RNA, 13 nt, Homo sapiens
gauucauauugaa

SEQ ID NO: 559153 - RNA, 21 nt, Homo sapiens
gauucauauuuacuucuuaua

SEQ ID NO: 559154 - RNA, 19 nt, Homo sapiens
gauucaucucugguuuucu

SEQ ID NO: 559155 - RNA, 22 nt, Homo sapiens
gauucauuuuccuguucaguga

SEQ ID NO: 559156 - RNA, 17 nt, Homo sapiens
gauuccaaaaagcacau

SEQ ID NO: 559157 - RNA, 20 nt, Homo sapiens
gauuccagcccacauuggau

SEQ ID NO: 559158 - RNA, 18 nt, Homo sapiens
gauuccaggcgaugugca

SEQ ID NO: 559159 - RNA, 23 nt, Homo sapiens
gauuccaggcgaugugcaagugu

SEQ ID NO: 559160 - RNA, 15 nt, Homo sapiens
gauucccaccaaggu

SEQ ID NO: 559161 - RNA, 18 nt, Homo sapiens
gauuccuucaacuggcua

SEQ ID NO: 559162 - RNA, 14 nt, Homo sapiens
gauuccuuuggaaa

SEQ ID NO: 559163 - RNA, 20 nt, Homo sapiens
gauucgugacaacaugcgac

SEQ ID NO: 559164 - RNA, 15 nt, Homo sapiens
gauucuaaagcucaa

SEQ ID NO: 559165 - RNA, 14 nt, Homo sapiens
gauucuaaucucau

SEQ ID NO: 559166 - RNA, 17 nt, Homo sapiens
gauucuaaugucuucau

SEQ ID NO: 559167 - RNA, 22 nt, Homo sapiens
gauucuacucuugucauuuuua

SEQ ID NO: 559168 - RNA, 19 nt, Homo sapiens
gauucucccaaaguaccuu

SEQ ID NO: 559169 - RNA, 13 nt, Homo sapiens
gauucucuacugc

SEQ ID NO: 559170 - RNA, 22 nt, Homo sapiens
gauucucucaucuaacugauga

SEQ ID NO: 559171 - RNA, 17 nt, Homo sapiens
gauucucuccugauuau

SEQ ID NO: 559172 - RNA, 19 nt, Homo sapiens
gauucugccuuguuucaua

SEQ ID NO: 559173 - RNA, 19 nt, Homo sapiens
gauucuggguuugcccagu

SEQ ID NO: 559174 - RNA, 17 nt, Homo sapiens
gauucugguuccagggu

SEQ ID NO: 559175 - RNA, 22 nt, Homo sapiens
gauucuguaauagugaacauau

SEQ ID NO: 559176 - RNA, 18 nt, Homo sapiens
gauucugucuuauagggu

SEQ ID NO: 559177 - RNA, 23 nt, Homo sapiens
gauucugugaucuuuuaaagugu

SEQ ID NO: 559178 - RNA, 15 nt, Homo sapiens
gauucugugccucca

SEQ ID NO: 559179 - RNA, 15 nt, Homo sapiens
gauucuuaacuaaaa

SEQ ID NO: 559180 - RNA, 19 nt, Homo sapiens
gauucuuaauucucugcaa

SEQ ID NO: 559181 - RNA, 20 nt, Homo sapiens
gauucuucucuuaauuucau

SEQ ID NO: 559182 - RNA, 17 nt, Homo sapiens
gauucuuucccaauuca

SEQ ID NO: 559183 - RNA, 14 nt, Homo sapiens
gauugaaaagaccu

SEQ ID NO: 559184 - RNA, 16 nt, Homo sapiens
gauugaacaagagcuu

SEQ ID NO: 559185 - RNA, 16 nt, Homo sapiens
gauugaauuucacugu

SEQ ID NO: 559186 - RNA, 15 nt, Homo sapiens
gauugagaacugaca

SEQ ID NO: 559187 - RNA, 14 nt, Homo sapiens
gauugauugaugua

SEQ ID NO: 559188 - RNA, 15 nt, Homo sapiens
gauugcacagaauuu

SEQ ID NO: 559189 - RNA, 14 nt, Homo sapiens
gauugccacagcuc

SEQ ID NO: 559190 - RNA, 23 nt, Homo sapiens
gauugcccauccaucugcuuaca

SEQ ID NO: 559191 - RNA, 23 nt, Homo sapiens
gauugccucugaagccuauguau

SEQ ID NO: 559192 - RNA, 18 nt, Homo sapiens
gauugcuuaaaauagcaa

SEQ ID NO: 559193 - RNA, 19 nt, Homo sapiens
gauugcuuucuucuuaacc

SEQ ID NO: 559194 - RNA, 20 nt, Homo sapiens
gauuggauuauucauuuaaa

SEQ ID NO: 559195 - RNA, 17 nt, Homo sapiens
gauuggcuuaaagugaa

SEQ ID NO: 559196 - RNA, 22 nt, Homo sapiens
gauugggacgcacagugcaguu

SEQ ID NO: 559197 - RNA, 13 nt, Homo sapiens
gauugucuccuaa

SEQ ID NO: 559198 - RNA, 18 nt, Homo sapiens
gauugucuuacuguugca

SEQ ID NO: 559199 - RNA, 22 nt, Homo sapiens
gauuguuaggagugguucucau

SEQ ID NO: 559200 - RNA, 17 nt, Homo sapiens
gauuguugucaggccau

SEQ ID NO: 559201 - RNA, 18 nt, Homo sapiens
gauuguugucaggccaua

SEQ ID NO: 559202 - RNA, 20 nt, Homo sapiens
gauuguuuaaagaagcucuc

SEQ ID NO: 559203 - RNA, 15 nt, Homo sapiens
gauuguuuugccacu

SEQ ID NO: 559204 - RNA, 19 nt, Homo sapiens
gauuguuuuugcucaaggc

SEQ ID NO: 559205 - RNA, 17 nt, Homo sapiens
gauuuaaaaaaagaaca

SEQ ID NO: 559206 - RNA, 18 nt, Homo sapiens
gauuuaaaaaaagaacau

SEQ ID NO: 559207 - RNA, 17 nt, Homo sapiens
gauuuaaaauuguucua

SEQ ID NO: 559208 - RNA, 17 nt, Homo sapiens
gauuuaaagcacaugcc

SEQ ID NO: 559209 - RNA, 15 nt, Homo sapiens
gauuuaauaugcaaa

SEQ ID NO: 559210 - RNA, 17 nt, Homo sapiens
gauuuaauuuccagggu

SEQ ID NO: 559211 - RNA, 14 nt, Homo sapiens
gauuuacacuggga

SEQ ID NO: 559212 - RNA, 21 nt, Homo sapiens
gauuuagaagcaaagauuuca

SEQ ID NO: 559213 - RNA, 22 nt, Homo sapiens
gauuuaugaugcacuuauucaa

SEQ ID NO: 559214 - RNA, 21 nt, Homo sapiens
gauuuauuuuaauuguugaua

SEQ ID NO: 559215 - RNA, 23 nt, Homo sapiens
gauuucaccccacagacacuuac

SEQ ID NO: 559216 - RNA, 13 nt, Homo sapiens
gauuucagcacau

SEQ ID NO: 559217 - RNA, 20 nt, Homo sapiens
gauuucauagcgaguuuucu

SEQ ID NO: 559218 - RNA, 23 nt, Homo sapiens
gauuucaugccuggugcuuccaa

SEQ ID NO: 559219 - RNA, 13 nt, Homo sapiens
gauuucauuacau

SEQ ID NO: 559220 - RNA, 12 nt, Homo sapiens
gauuuccaggga

SEQ ID NO: 559221 - RNA, 13 nt, Homo sapiens
gauuuccagugag

SEQ ID NO: 559222 - RNA, 22 nt, Homo sapiens
gauuuccuacagaaauacugcu

SEQ ID NO: 559223 - RNA, 13 nt, Homo sapiens
gauuuccuuccaa

SEQ ID NO: 559224 - RNA, 21 nt, Homo sapiens
gauuuccuugacuucuuugag

SEQ ID NO: 559225 - RNA, 17 nt, Homo sapiens
gauuucuaaagcugaaa

SEQ ID NO: 559226 - RNA, 13 nt, Homo sapiens
gauuucucaaaaa

SEQ ID NO: 559227 - RNA, 14 nt, Homo sapiens
gauuucuccaggau

SEQ ID NO: 559228 - RNA, 11 nt, Homo sapiens
gauuucuggga

SEQ ID NO: 559229 - RNA, 21 nt, Homo sapiens
gauuucuuccagaaggcaaaa

SEQ ID NO: 559230 - RNA, 18 nt, Homo sapiens
gauuucuucgcugcucua

SEQ ID NO: 559231 - RNA, 22 nt, Homo sapiens
gauuucuuucuuugcaccaaag

SEQ ID NO: 559232 - RNA, 15 nt, Homo sapiens
gauuugaacuugcuc

SEQ ID NO: 559233 - RNA, 19 nt, Homo sapiens
gauuugaagaacaugugag

SEQ ID NO: 559234 - RNA, 20 nt, Homo sapiens
gauuugcaggugaacagccu

SEQ ID NO: 559235 - RNA, 14 nt, Homo sapiens
gauuugccauucaa

SEQ ID NO: 559236 - RNA, 15 nt, Homo sapiens
gauuugccauucaag

SEQ ID NO: 559237 - RNA, 12 nt, Homo sapiens
gauuugggaaaa

SEQ ID NO: 559238 - RNA, 23 nt, Homo sapiens
gauuugggcuacccuaaagggag

SEQ ID NO: 559239 - RNA, 15 nt, Homo sapiens
gauuuggggaccaaa

SEQ ID NO: 559240 - RNA, 13 nt, Homo sapiens
gauuuggggcuuu

SEQ ID NO: 559241 - RNA, 18 nt, Homo sapiens
gauuuggucacacucuca

SEQ ID NO: 559242 - RNA, 14 nt, Homo sapiens
gauuuguagcacug

SEQ ID NO: 559243 - RNA, 19 nt, Homo sapiens
gauuuguagcauaacugua

SEQ ID NO: 559244 - RNA, 12 nt, Homo sapiens
gauuuguugcca

SEQ ID NO: 559245 - RNA, 21 nt, Homo sapiens
gauuuguuuuuaaacuguaca

SEQ ID NO: 559246 - RNA, 18 nt, Homo sapiens
gauuuuaaaaagucuuca

SEQ ID NO: 559247 - RNA, 15 nt, Homo sapiens
gauuuuacaaguaua

SEQ ID NO: 559248 - RNA, 20 nt, Homo sapiens
gauuuugaaauuuuuauuaa

SEQ ID NO: 559249 - RNA, 18 nt, Homo sapiens
gauuuugaaucaagcaau

SEQ ID NO: 559250 - RNA, 17 nt, Homo sapiens
gauuuuguugaccucaa

SEQ ID NO: 559251 - RNA, 17 nt, Homo sapiens
gauuuuuagcuuuacaa

SEQ ID NO: 559252 - RNA, 21 nt, Homo sapiens
gauuuuuauaucuaacuuucc

SEQ ID NO: 559253 - RNA, 14 nt, Homo sapiens
gauuuuucucuuca

SEQ ID NO: 559254 - RNA, 16 nt, Homo sapiens
gauuuuucucuucauu

SEQ ID NO: 559255 - RNA, 20 nt, Homo sapiens
gauuuuuguuuuccacugug

SEQ ID NO: 559256 - RNA, 19 nt, Homo sapiens
gauuuuuuuaauagugcuu

SEQ ID NO: 559257 - RNA, 19 nt, Homo sapiens
gauuuuuuuguaaauauga

SEQ ID NO: 559258 - RNA, 13 nt, Homo sapiens
gcaaaaaaagccu

SEQ ID NO: 559259 - RNA, 16 nt, Homo sapiens
gcaaaaaacauacuua

SEQ ID NO: 559260 - RNA, 14 nt, Homo sapiens
gcaaaaaucuccca

SEQ ID NO: 559261 - RNA, 16 nt, Homo sapiens
gcaaaaccucauuuaa

SEQ ID NO: 559262 - RNA, 16 nt, Homo sapiens
gcaaaacuccaucuca

SEQ ID NO: 559263 - RNA, 23 nt, Homo sapiens
gcaaaacugccgcaagucugcag

SEQ ID NO: 559264 - RNA, 21 nt, Homo sapiens
gcaaaaggaucuuuguggcca

SEQ ID NO: 559265 - RNA, 16 nt, Homo sapiens
gcaaaaggccucuugu

SEQ ID NO: 559266 - RNA, 15 nt, Homo sapiens
gcaaaagucagucuu

SEQ ID NO: 559267 - RNA, 16 nt, Homo sapiens
gcaaaagucauuacac

SEQ ID NO: 559268 - RNA, 19 nt, Homo sapiens
gcaaaauacaugacauuua

SEQ ID NO: 559269 - RNA, 23 nt, Homo sapiens
gcaaaaucuguucuaacauguaa

SEQ ID NO: 559270 - RNA, 18 nt, Homo sapiens
gcaaaaugagacuuucua

SEQ ID NO: 559271 - RNA, 23 nt, Homo sapiens
gcaaaaugaguugugaugaauca

SEQ ID NO: 559272 - RNA, 22 nt, Homo sapiens
gcaaaaugucuuaaugcaaauu

SEQ ID NO: 559273 - RNA, 12 nt, Homo sapiens
gcaaaauugcaa

SEQ ID NO: 559274 - RNA, 21 nt, Homo sapiens
gcaaaauugucuaaaauguca

SEQ ID NO: 559275 - RNA, 17 nt, Homo sapiens
gcaaaauuuuacaguaa

SEQ ID NO: 559276 - RNA, 19 nt, Homo sapiens
gcaaaauuuuuuuaaucuu

SEQ ID NO: 559277 - RNA, 13 nt, Homo sapiens
gcaaacaggcagu

SEQ ID NO: 559278 - RNA, 23 nt, Homo sapiens
gcaaacauuucuaacucuauuaa

SEQ ID NO: 559279 - RNA, 14 nt, Homo sapiens
gcaaaccauuuuua

SEQ ID NO: 559280 - RNA, 19 nt, Homo sapiens
gcaaacuguuuugacaaau

SEQ ID NO: 559281 - RNA, 17 nt, Homo sapiens
gcaaacuuuguauuaau

SEQ ID NO: 559282 - RNA, 20 nt, Homo sapiens
gcaaagacaaaagaaacuua

SEQ ID NO: 559283 - RNA, 14 nt, Homo sapiens
gcaaagacaucaaa

SEQ ID NO: 559284 - RNA, 16 nt, Homo sapiens
gcaaagauuuuuggca

SEQ ID NO: 559285 - RNA, 11 nt, Homo sapiens
gcaaagccaaa

SEQ ID NO: 559286 - RNA, 14 nt, Homo sapiens
gcaaagcucaccau

SEQ ID NO: 559287 - RNA, 12 nt, Homo sapiens
gcaaaggaacua

SEQ ID NO: 559288 - RNA, 14 nt, Homo sapiens
gcaaagggaaccau

SEQ ID NO: 559289 - RNA, 21 nt, Homo sapiens
gcaaagggccugcccagacaa

SEQ ID NO: 559290 - RNA, 18 nt, Homo sapiens
gcaaagguggcucuccag

SEQ ID NO: 559291 - RNA, 22 nt, Homo sapiens
gcaaagugaaaguaacuguuaa

SEQ ID NO: 559292 - RNA, 23 nt, Homo sapiens
gcaaagugcaaggaccuaaaaca

SEQ ID NO: 559293 - RNA, 19 nt, Homo sapiens
gcaaauaaucacagauuag

SEQ ID NO: 559294 - RNA, 20 nt, Homo sapiens
gcaaauaucauacuguucaa

SEQ ID NO: 559295 - RNA, 21 nt, Homo sapiens
gcaaauaucauacuguucaau

SEQ ID NO: 559296 - RNA, 12 nt, Homo sapiens
gcaaaugaauca

SEQ ID NO: 559297 - RNA, 15 nt, Homo sapiens
gcaaaugcaaaaacu

SEQ ID NO: 559298 - RNA, 19 nt, Homo sapiens
gcaaauggcagaaccaaag

SEQ ID NO: 559299 - RNA, 15 nt, Homo sapiens
gcaaauuaacuguau

SEQ ID NO: 559300 - RNA, 19 nt, Homo sapiens
gcaaauuaguugguuugug

SEQ ID NO: 559301 - RNA, 13 nt, Homo sapiens
gcaaauugcaauc

SEQ ID NO: 559302 - RNA, 17 nt, Homo sapiens
gcaacaaaauguagaau

SEQ ID NO: 559303 - RNA, 18 nt, Homo sapiens
gcaacaagaccaccacuu

SEQ ID NO: 559304 - RNA, 15 nt, Homo sapiens
gcaacacagccacua

SEQ ID NO: 559305 - RNA, 17 nt, Homo sapiens
gcaacagacaagugacu

SEQ ID NO: 559306 - RNA, 14 nt, Homo sapiens
gcaacagacuugaa

SEQ ID NO: 559307 - RNA, 15 nt, Homo sapiens
gcaacagagcaagac

SEQ ID NO: 559308 - RNA, 21 nt, Homo sapiens
gcaacagagcaagacuccauc

SEQ ID NO: 559309 - RNA, 18 nt, Homo sapiens
gcaacagcaaacaggugc

SEQ ID NO: 559310 - RNA, 20 nt, Homo sapiens
gcaacaggaaggaaccagaa

SEQ ID NO: 559311 - RNA, 15 nt, Homo sapiens
gcaacaguaaucuau

SEQ ID NO: 559312 - RNA, 13 nt, Homo sapiens
gcaacauagcaaa

SEQ ID NO: 559313 - RNA, 18 nt, Homo sapiens
gcaacauucauagucuuu

SEQ ID NO: 559314 - RNA, 14 nt, Homo sapiens
gaccccacuggaga

SEQ ID NO: 559315 - RNA, 19 nt, Homo sapiens
gaccccacuuaugcugcug

SEQ ID NO: 559316 - RNA, 16 nt, Homo sapiens
gacccccccccaacuc

SEQ ID NO: 559317 - RNA, 19 nt, Homo sapiens
gacccccgcaaguuugcac

SEQ ID NO: 559318 - RNA, 15 nt, Homo sapiens
gaccccuauccugau

SEQ ID NO: 559319 - RNA, 15 nt, Homo sapiens
gaccccucccugcag

SEQ ID NO: 559320 - RNA, 15 nt, Homo sapiens
gaccccucuccucaa

SEQ ID NO: 559321 - RNA, 15 nt, Homo sapiens
gaccccugaccucac

SEQ ID NO: 559322 - RNA, 18 nt, Homo sapiens
gaccccugacucaucauu

SEQ ID NO: 559323 - RNA, 13 nt, Homo sapiens
gaccccuuccucc

SEQ ID NO: 559324 - RNA, 14 nt, Homo sapiens
gaccccuuccucca

SEQ ID NO: 559325 - RNA, 19 nt, Homo sapiens
gacccggagcuaacacugg

SEQ ID NO: 559326 - RNA, 13 nt, Homo sapiens
gacccucugggaa

SEQ ID NO: 559327 - RNA, 23 nt, Homo sapiens
gacccugaaaggaacacuggcuu

SEQ ID NO: 559328 - RNA, 16 nt, Homo sapiens
gacccugcaagaccac

SEQ ID NO: 559329 - RNA, 16 nt, Homo sapiens
gacccuguccggccca

SEQ ID NO: 559330 - RNA, 22 nt, Homo sapiens
gacccuucagguguuacuagaa

SEQ ID NO: 559331 - RNA, 19 nt, Homo sapiens
gacccuucccagcccucau

SEQ ID NO: 559332 - RNA, 22 nt, Homo sapiens
gacccuuugccuuucuucugcc

SEQ ID NO: 559333 - RNA, 17 nt, Homo sapiens
gaccggaguuaugacaa

SEQ ID NO: 559334 - RNA, 14 nt, Homo sapiens
gaccguacucucac

SEQ ID NO: 559335 - RNA, 22 nt, Homo sapiens
gaccguauacuuaaaaugacaa

SEQ ID NO: 559336 - RNA, 22 nt, Homo sapiens
gaccuaaauuauuuacugcaaa

SEQ ID NO: 559337 - RNA, 15 nt, Homo sapiens
gaccuaacauucgau

SEQ ID NO: 559338 - RNA, 20 nt, Homo sapiens
gaccuaaggauaugcauuaa

SEQ ID NO: 559339 - RNA, 20 nt, Homo sapiens
gaccuaagggacucccacaa

SEQ ID NO: 559340 - RNA, 19 nt, Homo sapiens
gaccuacuguucggacaaa

SEQ ID NO: 559341 - RNA, 16 nt, Homo sapiens
gaccuaguauaucagu

SEQ ID NO: 559342 - RNA, 23 nt, Homo sapiens
gaccuauuuccagaaauacaauu

SEQ ID NO: 559343 - RNA, 21 nt, Homo sapiens
gaccucaaaggugauugugcc

SEQ ID NO: 559344 - RNA, 20 nt, Homo sapiens
gaccucaagugauccaccca

SEQ ID NO: 559345 - RNA, 14 nt, Homo sapiens
gaccucagccugug

SEQ ID NO: 559346 - RNA, 22 nt, Homo sapiens
gaccucaggugauccacccacc

SEQ ID NO: 559347 - RNA, 15 nt, Homo sapiens
gaccucagugacuca

SEQ ID NO: 559348 - RNA, 11 nt, Homo sapiens
gcaaccacugc

SEQ ID NO: 559349 - RNA, 14 nt, Homo sapiens
gcaaccaggcagcu

SEQ ID NO: 559350 - RNA, 15 nt, Homo sapiens
gcaaccauauuugua

SEQ ID NO: 559351 - RNA, 17 nt, Homo sapiens
gcaaccauuauaaccuu

SEQ ID NO: 559352 - RNA, 17 nt, Homo sapiens
gcaaccuccacauguuc

SEQ ID NO: 559353 - RNA, 20 nt, Homo sapiens
gcaaccuccgccucucaggu

SEQ ID NO: 559354 - RNA, 19 nt, Homo sapiens
gcaaccuuuggaugcacuu

SEQ ID NO: 559355 - RNA, 22 nt, Homo sapiens
gcaacguagcuucuaccaugaa

SEQ ID NO: 559356 - RNA, 14 nt, Homo sapiens
gcaacuagggcuag

SEQ ID NO: 559357 - RNA, 13 nt, Homo sapiens
gcaacucaaagag

SEQ ID NO: 559358 - RNA, 23 nt, Homo sapiens
gcaacucaaagagguaacugagg

SEQ ID NO: 559359 - RNA, 21 nt, Homo sapiens
gcaacuccuccauuuuccucc

SEQ ID NO: 559360 - RNA, 20 nt, Homo sapiens
gcaacugaauaaauaccucu

SEQ ID NO: 559361 - RNA, 15 nt, Homo sapiens
gcaacugacuucauu

SEQ ID NO: 559362 - RNA, 23 nt, Homo sapiens
gcaacugggucugacaugaacac

SEQ ID NO: 559363 - RNA, 14 nt, Homo sapiens
gcaacuucaaggga

SEQ ID NO: 559364 - RNA, 15 nt, Homo sapiens
gcaacuugcuucuaa

SEQ ID NO: 559365 - RNA, 14 nt, Homo sapiens
gcaagaaacaguuu

SEQ ID NO: 559366 - RNA, 18 nt, Homo sapiens
gcaagaaaucagccauaa

SEQ ID NO: 559367 - RNA, 15 nt, Homo sapiens
gcaagaacagugggc

SEQ ID NO: 559368 - RNA, 17 nt, Homo sapiens
gcaagaaggagcucagu

SEQ ID NO: 559369 - RNA, 21 nt, Homo sapiens
gcaagaccaaaaugacaauga

SEQ ID NO: 559370 - RNA, 16 nt, Homo sapiens
gcaagacuccaucuca

SEQ ID NO: 559371 - RNA, 18 nt, Homo sapiens
gcaagagaggaugacaca

SEQ ID NO: 559372 - RNA, 22 nt, Homo sapiens
gcaagagaggaugacacaucaa

SEQ ID NO: 559373 - RNA, 19 nt, Homo sapiens
gcaagagcccccuugacac

SEQ ID NO: 559374 - RNA, 15 nt, Homo sapiens
gcaagagggggaccu

SEQ ID NO: 559375 - RNA, 16 nt, Homo sapiens
gcaagaguggacugaa

SEQ ID NO: 559376 - RNA, 15 nt, Homo sapiens
gcaagauaaacacuu

SEQ ID NO: 559377 - RNA, 14 nt, Homo sapiens
gcaagauacaacag

SEQ ID NO: 559378 - RNA, 23 nt, Homo sapiens
gcaagauacaacagcugccgacc

SEQ ID NO: 559379 - RNA, 22 nt, Homo sapiens
gcaagaugaaugcagauuacac

SEQ ID NO: 559380 - RNA, 18 nt, Homo sapiens
gcaagauuuaaauccuuu

SEQ ID NO: 559381 - RNA, 15 nt, Homo sapiens
gcaagauuucuuugu

SEQ ID NO: 559382 - RNA, 15 nt, Homo sapiens
gcaagcaacugagau

SEQ ID NO: 559383 - RNA, 16 nt, Homo sapiens
gcaagcaccuguuaau

SEQ ID NO: 559384 - RNA, 16 nt, Homo sapiens
gcaagcauuuuuccau

SEQ ID NO: 559385 - RNA, 11 nt, Homo sapiens
gcaagccagac

SEQ ID NO: 559386 - RNA, 11 nt, Homo sapiens
gcaagccauaa

SEQ ID NO: 559387 - RNA, 20 nt, Homo sapiens
gcaagcccguuaaauaauuc

SEQ ID NO: 559388 - RNA, 15 nt, Homo sapiens
gcaagcuauucaaug

SEQ ID NO: 559389 - RNA, 21 nt, Homo sapiens
gcaaggacggccuucaacuga

SEQ ID NO: 559390 - RNA, 23 nt, Homo sapiens
gcaaggauccugugcugcugucu

SEQ ID NO: 559391 - RNA, 18 nt, Homo sapiens
gcaaggccugguguuucu

SEQ ID NO: 559392 - RNA, 21 nt, Homo sapiens
gcaagguauuacacucuguaa

SEQ ID NO: 559393 - RNA, 11 nt, Homo sapiens
gcaaggugcau

SEQ ID NO: 559394 - RNA, 13 nt, Homo sapiens
gcaaggugcucac

SEQ ID NO: 559395 - RNA, 23 nt, Homo sapiens
gcaagguuuaggcugguggccca

SEQ ID NO: 559396 - RNA, 15 nt, Homo sapiens
gcaaguacaauguua

SEQ ID NO: 559397 - RNA, 14 nt, Homo sapiens
gcaaguaucauaau

SEQ ID NO: 559398 - RNA, 21 nt, Homo sapiens
gcaaguaugugagugugucca

SEQ ID NO: 559399 - RNA, 17 nt, Homo sapiens
gcaagugagacccuguc

SEQ ID NO: 559400 - RNA, 12 nt, Homo sapiens
gcaagugauauc

SEQ ID NO: 559401 - RNA, 16 nt, Homo sapiens
gcaaguguaugcacgu

SEQ ID NO: 559402 - RNA, 19 nt, Homo sapiens
gcaagugucugugugcaag

SEQ ID NO: 559403 - RNA, 13 nt, Homo sapiens
gcaagugugugca

SEQ ID NO: 559404 - RNA, 19 nt, Homo sapiens
gcaauaaacuccuacuaaa

SEQ ID NO: 559405 - RNA, 15 nt, Homo sapiens
gcaauaacucucuac

SEQ ID NO: 559406 - RNA, 19 nt, Homo sapiens
gcaauacaacuuuaccaua

SEQ ID NO: 559407 - RNA, 13 nt, Homo sapiens
gcaauacauuuca

SEQ ID NO: 559408 - RNA, 14 nt, Homo sapiens
gcaauaggacaaaa

SEQ ID NO: 559409 - RNA, 17 nt, Homo sapiens
gcaauauuaaugaagua

SEQ ID NO: 559410 - RNA, 16 nt, Homo sapiens
gcaaucacagcucacu

SEQ ID NO: 559411 - RNA, 16 nt, Homo sapiens
gcaaucacugaucuca

SEQ ID NO: 559412 - RNA, 18 nt, Homo sapiens
gcaaucaugagcaaguga

SEQ ID NO: 559413 - RNA, 16 nt, Homo sapiens
gcaauccuaagcaaaa

SEQ ID NO: 559414 - RNA, 16 nt, Homo sapiens
gcaaucucagaugcag

SEQ ID NO: 559415 - RNA, 17 nt, Homo sapiens
gcaaucuucuacuuuaa

SEQ ID NO: 559416 - RNA, 17 nt, Homo sapiens
gcaaucuuugccuuuau

SEQ ID NO: 559417 - RNA, 14 nt, Homo sapiens
gcaaugaaacagau

SEQ ID NO: 559418 - RNA, 21 nt, Homo sapiens
gcacuauaauguaagcucuac

SEQ ID NO: 559419 - RNA, 18 nt, Homo sapiens
gcacuaucacgagccuuu

SEQ ID NO: 559420 - RNA, 13 nt, Homo sapiens
gcacucacgcccu

SEQ ID NO: 559421 - RNA, 16 nt, Homo sapiens
gcacuccauggccacc

SEQ ID NO: 559422 - RNA, 13 nt, Homo sapiens
gcacuccuggaca

SEQ ID NO: 559423 - RNA, 14 nt, Homo sapiens
gcacucucacccca

SEQ ID NO: 559424 - RNA, 18 nt, Homo sapiens
gcacucucauguugcaua

SEQ ID NO: 559425 - RNA, 18 nt, Homo sapiens
gcacucuugaacugggcg

SEQ ID NO: 559426 - RNA, 17 nt, Homo sapiens
gcacugaaaccugagau

SEQ ID NO: 559427 - RNA, 23 nt, Homo sapiens
gcacugaaguggcccucccucag

SEQ ID NO: 559428 - RNA, 23 nt, Homo sapiens
gcacugagcccccccaacacugu

SEQ ID NO: 559429 - RNA, 18 nt, Homo sapiens
gcacugaggguggcacuc

SEQ ID NO: 559430 - RNA, 16 nt, Homo sapiens
gcacugcucaagaacu

SEQ ID NO: 559431 - RNA, 23 nt, Homo sapiens
gcacugcuccaagggacaggugg

SEQ ID NO: 559432 - RNA, 22 nt, Homo sapiens
gcacuggguugacuuucaggua

SEQ ID NO: 559433 - RNA, 21 nt, Homo sapiens
gcacuggugguuuuugcucuc

SEQ ID NO: 559434 - RNA, 20 nt, Homo sapiens
gcacugugaccgagaacuuu

SEQ ID NO: 559435 - RNA, 18 nt, Homo sapiens
gcacugugccccaaguuc

SEQ ID NO: 559436 - RNA, 21 nt, Homo sapiens
gcacuguggcucugcaugaca

SEQ ID NO: 559437 - RNA, 13 nt, Homo sapiens
gcacugugucauc

SEQ ID NO: 559438 - RNA, 12 nt, Homo sapiens
gcacuguucaau

SEQ ID NO: 559439 - RNA, 23 nt, Homo sapiens
gcacuuauaagaaagaucaaaga

SEQ ID NO: 559440 - RNA, 14 nt, Homo sapiens
gcacuucaccuuuu

SEQ ID NO: 559441 - RNA, 11 nt, Homo sapiens
gcacuuccuug

SEQ ID NO: 559442 - RNA, 20 nt, Homo sapiens
gcacuugcacgcccaugugu

SEQ ID NO: 559443 - RNA, 15 nt, Homo sapiens
gcacuugccuggaau

SEQ ID NO: 559444 - RNA, 22 nt, Homo sapiens
gcacuuuaacccucucuucccu

SEQ ID NO: 559445 - RNA, 19 nt, Homo sapiens
gcacuuuagaucacuugag

SEQ ID NO: 559446 - RNA, 21 nt, Homo sapiens
gcacuuucauccucaagcuca

SEQ ID NO: 559447 - RNA, 13 nt, Homo sapiens
gcacuuuccacuu

SEQ ID NO: 559448 - RNA, 13 nt, Homo sapiens
gcacuuuggacau

SEQ ID NO: 559449 - RNA, 20 nt, Homo sapiens
gcacuuuuuuuauaagcaaa

SEQ ID NO: 559450 - RNA, 12 nt, Homo sapiens
gcagaaagggaa

SEQ ID NO: 559451 - RNA, 19 nt, Homo sapiens
gcagaaauuuaaacucuga

SEQ ID NO: 559452 - RNA, 19 nt, Homo sapiens
gcagaaauuuaucuuucaa

SEQ ID NO: 559453 - RNA, 23 nt, Homo sapiens
gcagaaauuuaucuuucaaagag

SEQ ID NO: 559454 - RNA, 14 nt, Homo sapiens
gcagaacagcauca

SEQ ID NO: 559455 - RNA, 15 nt, Homo sapiens
gcagaacuccuccaa

SEQ ID NO: 559456 - RNA, 15 nt, Homo sapiens
gcagaacuuaaucug

SEQ ID NO: 559457 - RNA, 13 nt, Homo sapiens
gcagaacuugaag

SEQ ID NO: 559458 - RNA, 14 nt, Homo sapiens
gcagaagaaggcau

SEQ ID NO: 559459 - RNA, 20 nt, Homo sapiens
gcagaagcagcugcagcagc

SEQ ID NO: 559460 - RNA, 14 nt, Homo sapiens
gcagaagcagggua

SEQ ID NO: 559461 - RNA, 18 nt, Homo sapiens
gcagaagcuggaggcaca

SEQ ID NO: 559462 - RNA, 14 nt, Homo sapiens
gcagaagucccaag

SEQ ID NO: 559463 - RNA, 15 nt, Homo sapiens
gcagaagucccaaga

SEQ ID NO: 559464 - RNA, 19 nt, Homo sapiens
gcagaauagcaaggugcuc

SEQ ID NO: 559465 - RNA, 21 nt, Homo sapiens
gcagaaucuguuaccagagga

SEQ ID NO: 559466 - RNA, 18 nt, Homo sapiens
gcagaauucaaaagugau

SEQ ID NO: 559467 - RNA, 21 nt, Homo sapiens
gcagaauucaaaagugauuau

SEQ ID NO: 559468 - RNA, 15 nt, Homo sapiens
gcagacaugccuugg

SEQ ID NO: 559469 - RNA, 21 nt, Homo sapiens
gcagaccacugauaaaaccau

SEQ ID NO: 559470 - RNA, 16 nt, Homo sapiens
gcagaccccaggcaag

SEQ ID NO: 559471 - RNA, 14 nt, Homo sapiens
gcagaccuacagca

SEQ ID NO: 559472 - RNA, 19 nt, Homo sapiens
gcagacgggaaugccuagg

SEQ ID NO: 559473 - RNA, 14 nt, Homo sapiens
gccuuaaccagucu

SEQ ID NO: 559474 - RNA, 12 nt, Homo sapiens
gccuuaauacuu

SEQ ID NO: 559475 - RNA, 13 nt, Homo sapiens
gccuuacacugaa

SEQ ID NO: 559476 - RNA, 13 nt, Homo sapiens
gccuuacaucugg

SEQ ID NO: 559477 - RNA, 14 nt, Homo sapiens
gccuuaccaggaga

SEQ ID NO: 559478 - RNA, 22 nt, Homo sapiens
gccuuaccuccugcccaggaga

SEQ ID NO: 559479 - RNA, 12 nt, Homo sapiens
gccuuacuguac

SEQ ID NO: 559480 - RNA, 23 nt, Homo sapiens
gccuuagaaauguaaacugccau

SEQ ID NO: 559481 - RNA, 14 nt, Homo sapiens
gccuuaucuugcac

SEQ ID NO: 559482 - RNA, 23 nt, Homo sapiens
gccuuauuuuuguaugccuuuug

SEQ ID NO: 559483 - RNA, 12 nt, Homo sapiens
gccuucacccau

SEQ ID NO: 559484 - RNA, 19 nt, Homo sapiens
gccuucacgugucuguucc

SEQ ID NO: 559485 - RNA, 15 nt, Homo sapiens
gccuucacuuuacaa

SEQ ID NO: 559486 - RNA, 17 nt, Homo sapiens
gccuucagaaugcuccu

SEQ ID NO: 559487 - RNA, 19 nt, Homo sapiens
gccuucagaucuugguguu

SEQ ID NO: 559488 - RNA, 13 nt, Homo sapiens
gccuucaguuuau

SEQ ID NO: 559489 - RNA, 20 nt, Homo sapiens
gccuucaugaaucuuucaua

SEQ ID NO: 559490 - RNA, 19 nt, Homo sapiens
gccuuccaaaaccugcuuc

SEQ ID NO: 559491 - RNA, 15 nt, Homo sapiens
gccuuccacaauuca

SEQ ID NO: 559492 - RNA, 14 nt, Homo sapiens
gccuuccacaguga

SEQ ID NO: 559493 - RNA, 20 nt, Homo sapiens
gccuuccacagugaaugugu

SEQ ID NO: 559494 - RNA, 22 nt, Homo sapiens
gccuuccacgcugucuccagac

SEQ ID NO: 559495 - RNA, 16 nt, Homo sapiens
gccuuccucucucuac

SEQ ID NO: 559496 - RNA, 19 nt, Homo sapiens
gccuuccuuucuccaggac

SEQ ID NO: 559497 - RNA, 13 nt, Homo sapiens
gccuucugccaac

SEQ ID NO: 559498 - RNA, 13 nt, Homo sapiens
gccuucugggaac

SEQ ID NO: 559499 - RNA, 15 nt, Homo sapiens
gccuucuucacccag

SEQ ID NO: 559500 - RNA, 23 nt, Homo sapiens
gccuucuuggggauucaaaaaca

SEQ ID NO: 559501 - RNA, 12 nt, Homo sapiens
gccuugaccucc

SEQ ID NO: 559502 - RNA, 20 nt, Homo sapiens
gccuugagucaucuauucaa

SEQ ID NO: 559503 - RNA, 16 nt, Homo sapiens
gccuugaguuccaguu

SEQ ID NO: 559504 - RNA, 17 nt, Homo sapiens
gccuugauaauacuuga

SEQ ID NO: 559505 - RNA, 15 nt, Homo sapiens
gccuugaucagugac

SEQ ID NO: 559506 - RNA, 15 nt, Homo sapiens
gccuugcaguaggca

SEQ ID NO: 559507 - RNA, 16 nt, Homo sapiens
gccuuggcucguucuc

SEQ ID NO: 559508 - RNA, 21 nt, Homo sapiens
gccuugggaaggaaggcagug

SEQ ID NO: 559509 - RNA, 14 nt, Homo sapiens
gccuugggcugcuc

SEQ ID NO: 559510 - RNA, 12 nt, Homo sapiens
gccuugugucac

SEQ ID NO: 559511 - RNA, 17 nt, Homo sapiens
gccuugugucacuggcu

SEQ ID NO: 559512 - RNA, 18 nt, Homo sapiens
gccuuguuucaccuucca

SEQ ID NO: 559513 - RNA, 16 nt, Homo sapiens
gccuuguuucugauga

SEQ ID NO: 559514 - RNA, 16 nt, Homo sapiens
gccuuuaaaucuguga

SEQ ID NO: 559515 - RNA, 16 nt, Homo sapiens
gccuuuaagccaaaga

SEQ ID NO: 559516 - RNA, 16 nt, Homo sapiens
gccuuuagccuggacc

SEQ ID NO: 559517 - RNA, 18 nt, Homo sapiens
gccuuuaguccacggacc

SEQ ID NO: 559518 - RNA, 13 nt, Homo sapiens
gccuuuaucucaa

SEQ ID NO: 559519 - RNA, 13 nt, Homo sapiens
gccuuuaucuuga

SEQ ID NO: 559520 - RNA, 15 nt, Homo sapiens
gccuuuauggcugcu

SEQ ID NO: 559521 - RNA, 21 nt, Homo sapiens
gccuuuauuaaaaacugagug

SEQ ID NO: 559522 - RNA, 21 nt, Homo sapiens
gccuuuccagagaacugcaga

SEQ ID NO: 559523 - RNA, 13 nt, Homo sapiens
gccuuuccagggu

SEQ ID NO: 559524 - RNA, 13 nt, Homo sapiens
gccuuuuccaaau

SEQ ID NO: 559525 - RNA, 17 nt, Homo sapiens
gccuuuugcuacgugcc

SEQ ID NO: 559526 - RNA, 19 nt, Homo sapiens
gccuuuugugcaaagccaa

SEQ ID NO: 559527 - RNA, 13 nt, Homo sapiens
gccuuuuuguaua

SEQ ID NO: 559528 - RNA, 22 nt, Homo sapiens
gccuuuuuuuuaaggagcaaaa

SEQ ID NO: 559529 - RNA, 14 nt, Homo sapiens
gcgaccauguggcc

SEQ ID NO: 559530 - RNA, 21 nt, Homo sapiens
gcgacuuaaaaugauugaaaa

SEQ ID NO: 559531 - RNA, 21 nt, Homo sapiens
gcgagaaaccucccccaaugu

SEQ ID NO: 559532 - RNA, 14 nt, Homo sapiens
gcgagccugacucu

SEQ ID NO: 559533 - RNA, 18 nt, Homo sapiens
gcuagaggacuucuggca

SEQ ID NO: 559534 - RNA, 14 nt, Homo sapiens
gcuagaguccucac

SEQ ID NO: 559535 - RNA, 14 nt, Homo sapiens
gcuagagugcaaug

SEQ ID NO: 559536 - RNA, 20 nt, Homo sapiens
gcuagaguuuuaacuuuuaa

SEQ ID NO: 559537 - RNA, 15 nt, Homo sapiens
gcuagcaaauuugag

SEQ ID NO: 559538 - RNA, 18 nt, Homo sapiens
gcuagcaguaaaagauga

SEQ ID NO: 559539 - RNA, 23 nt, Homo sapiens
gcuagccaucuugaucuguguuu

SEQ ID NO: 559540 - RNA, 19 nt, Homo sapiens
gcuagcuucuuuugauacu

SEQ ID NO: 559541 - RNA, 12 nt, Homo sapiens
gcuaggccagag

SEQ ID NO: 559542 - RNA, 20 nt, Homo sapiens
gcuagggagacgccauguga

SEQ ID NO: 559543 - RNA, 14 nt, Homo sapiens
gcuagggagugguc

SEQ ID NO: 559544 - RNA, 16 nt, Homo sapiens
gcuagguaucauucaa

SEQ ID NO: 559545 - RNA, 21 nt, Homo sapiens
gcuagguggguugaaagccaa

SEQ ID NO: 559546 - RNA, 16 nt, Homo sapiens
gcuagguucagcuuuc

SEQ ID NO: 559547 - RNA, 20 nt, Homo sapiens
gcuagugacuugugucccau

SEQ ID NO: 559548 - RNA, 15 nt, Homo sapiens
gcuaguguaccuccu

SEQ ID NO: 559549 - RNA, 11 nt, Homo sapiens
gcuaguguuua

SEQ ID NO: 559550 - RNA, 16 nt, Homo sapiens
gcuaguuugaccucau

SEQ ID NO: 559551 - RNA, 14 nt, Homo sapiens
gcuauaacuaagca

SEQ ID NO: 559552 - RNA, 14 nt, Homo sapiens
gcuauaagugcuca

SEQ ID NO: 559553 - RNA, 23 nt, Homo sapiens
gcuauaagugcucaauagcuuga

SEQ ID NO: 559554 - RNA, 17 nt, Homo sapiens
gcuauaaguuuuagaau

SEQ ID NO: 559555 - RNA, 18 nt, Homo sapiens
gcuauaugccuuaagcca

SEQ ID NO: 559556 - RNA, 23 nt, Homo sapiens
gcuaucacguugaaccacgugaa

SEQ ID NO: 559557 - RNA, 17 nt, Homo sapiens
gcuaucgcaccacugug

SEQ ID NO: 559558 - RNA, 13 nt, Homo sapiens
gcuaugcauuuga

SEQ ID NO: 559559 - RNA, 20 nt, Homo sapiens
gcuaugcccggaccuccauc

SEQ ID NO: 559560 - RNA, 18 nt, Homo sapiens
gcuaugccuugcacacag

SEQ ID NO: 559561 - RNA, 17 nt, Homo sapiens
gcuaugcuaaaccuccu

SEQ ID NO: 559562 - RNA, 18 nt, Homo sapiens
gcuauguaaacaaaccac

SEQ ID NO: 559563 - RNA, 14 nt, Homo sapiens
gcuauguugcccaa

SEQ ID NO: 559564 - RNA, 21 nt, Homo sapiens
gcuauuacagugccacugcaa

SEQ ID NO: 559565 - RNA, 21 nt, Homo sapiens
gcuauuaggaaauucugauga

SEQ ID NO: 559566 - RNA, 20 nt, Homo sapiens
gcuauucccucaaaucugag

SEQ ID NO: 559567 - RNA, 16 nt, Homo sapiens
gcuauugucuguaaua

SEQ ID NO: 559568 - RNA, 21 nt, Homo sapiens
gcuauuuaauaucuggcacug

SEQ ID NO: 559569 - RNA, 18 nt, Homo sapiens
gcuauuuaucccuuuccu

SEQ ID NO: 559570 - RNA, 19 nt, Homo sapiens
gcuauuucaucugguuucu

SEQ ID NO: 559571 - RNA, 15 nt, Homo sapiens
gcuauuuccauucca

SEQ ID NO: 559572 - RNA, 19 nt, Homo sapiens
gcuauuuccucuaaugaag

SEQ ID NO: 559573 - RNA, 13 nt, Homo sapiens
gcuauuucugggu

SEQ ID NO: 559574 - RNA, 17 nt, Homo sapiens
gcuauuugagcaugcac

SEQ ID NO: 559575 - RNA, 14 nt, Homo sapiens
gcucaaaaccucca

SEQ ID NO: 559576 - RNA, 14 nt, Homo sapiens
gcucaacauugugu

SEQ ID NO: 559577 - RNA, 14 nt, Homo sapiens
gcucaaccauggcu

SEQ ID NO: 559578 - RNA, 18 nt, Homo sapiens
gcucaagaacacaugugc

SEQ ID NO: 559579 - RNA, 17 nt, Homo sapiens
gcucaagaggccacuua

SEQ ID NO: 559580 - RNA, 20 nt, Homo sapiens
gcucaagcaauccuccugcc

SEQ ID NO: 559581 - RNA, 13 nt, Homo sapiens
gcucaagugaucu

SEQ ID NO: 559582 - RNA, 23 nt, Homo sapiens
gcucaauauuccugaaugaaaua

SEQ ID NO: 559583 - RNA, 18 nt, Homo sapiens
gcucaauuuaauuuugca

SEQ ID NO: 559584 - RNA, 12 nt, Homo sapiens
gcucacaggaaa

SEQ ID NO: 559585 - RNA, 12 nt, Homo sapiens
gcucacagggau

SEQ ID NO: 559586 - RNA, 13 nt, Homo sapiens
gcucacaguacag

SEQ ID NO: 559587 - RNA, 15 nt, Homo sapiens
gcucacauccagccu

SEQ ID NO: 559588 - RNA, 20 nt, Homo sapiens
gcucacaugggacugggaua

SEQ ID NO: 559589 - RNA, 21 nt, Homo sapiens
gcucaccuuuagaacaggaga

SEQ ID NO: 559590 - RNA, 13 nt, Homo sapiens
gcucacucagcca

SEQ ID NO: 559591 - RNA, 20 nt, Homo sapiens
gcucacuguggugucugugu

SEQ ID NO: 559592 - RNA, 13 nt, Homo sapiens
gcucacuugccuu

SEQ ID NO: 559593 - RNA, 10 nt, Homo sapiens
gcucagagau

SEQ ID NO: 559594 - RNA, 21 nt, Homo sapiens
gcucagaggcgcacugugacc

SEQ ID NO: 559595 - RNA, 17 nt, Homo sapiens
gcucagauuguaauaug

SEQ ID NO: 559596 - RNA, 22 nt, Homo sapiens
gcucagcaaaagaugcuucuca

SEQ ID NO: 559597 - RNA, 14 nt, Homo sapiens
gcucagcacuuugg

SEQ ID NO: 559598 - RNA, 23 nt, Homo sapiens
gcucuuucagagaggucucaggu

SEQ ID NO: 559599 - RNA, 21 nt, Homo sapiens
gcucuuucaucucugcuugga

SEQ ID NO: 559600 - RNA, 15 nt, Homo sapiens
gcucuuuggggucag

SEQ ID NO: 559601 - RNA, 22 nt, Homo sapiens
gcugaaaaaucacauccuggcc

SEQ ID NO: 559602 - RNA, 17 nt, Homo sapiens
gcugaaaagagcuuugu

SEQ ID NO: 559603 - RNA, 15 nt, Homo sapiens
gcugaaacucauuug

SEQ ID NO: 559604 - RNA, 17 nt, Homo sapiens
gcugaaagaacauggac

SEQ ID NO: 559605 - RNA, 14 nt, Homo sapiens
gcugaacauugcau

SEQ ID NO: 559606 - RNA, 16 nt, Homo sapiens
gcugaacauugcauau

SEQ ID NO: 559607 - RNA, 22 nt, Homo sapiens
gcugaacgcguguguacacggg

SEQ ID NO: 559608 - RNA, 13 nt, Homo sapiens
gcugaacugagaa

SEQ ID NO: 559609 - RNA, 14 nt, Homo sapiens
gcugaagcagguuc

SEQ ID NO: 559610 - RNA, 16 nt, Homo sapiens
gcugaagcuggugcgc

SEQ ID NO: 559611 - RNA, 13 nt, Homo sapiens
gcugaagucauug

SEQ ID NO: 559612 - RNA, 14 nt, Homo sapiens
gcugaagugucaca

SEQ ID NO: 559613 - RNA, 15 nt, Homo sapiens
gcugaagugucacag

SEQ ID NO: 559614 - RNA, 19 nt, Homo sapiens
gcugacaguuuguggcauc

SEQ ID NO: 559615 - RNA, 18 nt, Homo sapiens
gcugacuguacuccuccc

SEQ ID NO: 559616 - RNA, 13 nt, Homo sapiens
gcugacuuuggga

SEQ ID NO: 559617 - RNA, 19 nt, Homo sapiens
gcugagaaaaguauucuca

SEQ ID NO: 559618 - RNA, 16 nt, Homo sapiens
gcugagaauguggaau

SEQ ID NO: 559619 - RNA, 16 nt, Homo sapiens
gcugagacugugcugu

SEQ ID NO: 559620 - RNA, 14 nt, Homo sapiens
gcugagaucgugcu

SEQ ID NO: 559621 - RNA, 15 nt, Homo sapiens
gcugagauuacucug

SEQ ID NO: 559622 - RNA, 20 nt, Homo sapiens
gcugagcaaucugacccuau

SEQ ID NO: 559623 - RNA, 16 nt, Homo sapiens
gcugagcugaacccau

SEQ ID NO: 559624 - RNA, 16 nt, Homo sapiens
gcugaggcaagagaau

SEQ ID NO: 559625 - RNA, 15 nt, Homo sapiens
gcugaggccuaugca

SEQ ID NO: 559626 - RNA, 16 nt, Homo sapiens
gcugaggccuaugcag

SEQ ID NO: 559627 - RNA, 20 nt, Homo sapiens
gcugaggccuaugcagacau

SEQ ID NO: 559628 - RNA, 15 nt, Homo sapiens
gcugaggggcaggga

SEQ ID NO: 559629 - RNA, 16 nt, Homo sapiens
gcugaggggcagggag

SEQ ID NO: 559630 - RNA, 22 nt, Homo sapiens
gcugagguuuagaugugcaacc

SEQ ID NO: 559631 - RNA, 15 nt, Homo sapiens
gcugagucagacugu

SEQ ID NO: 559632 - RNA, 18 nt, Homo sapiens
gcugagugaaugaacaaa

SEQ ID NO: 559633 - RNA, 12 nt, Homo sapiens
gcugagugcuga

SEQ ID NO: 559634 - RNA, 13 nt, Homo sapiens
gcugagugcugaa

SEQ ID NO: 559635 - RNA, 23 nt, Homo sapiens
gcugaguggccagccagugccau

SEQ ID NO: 559636 - RNA, 14 nt, Homo sapiens
gcugagugggagaa

SEQ ID NO: 559637 - RNA, 18 nt, Homo sapiens
gcugaguggucugacacc

SEQ ID NO: 559638 - RNA, 13 nt, Homo sapiens
gcugaguguccag

SEQ ID NO: 559639 - RNA, 22 nt, Homo sapiens
gcugaguguccagcacaccugc

SEQ ID NO: 559640 - RNA, 22 nt, Homo sapiens
gcugaguuucucuuggguauaa

SEQ ID NO: 559641 - RNA, 14 nt, Homo sapiens
gcugaucaguuuuu

SEQ ID NO: 559642 - RNA, 18 nt, Homo sapiens
gcugaugaggcuggugac

SEQ ID NO: 559643 - RNA, 15 nt, Homo sapiens
gcugauguuuacaau

SEQ ID NO: 559644 - RNA, 19 nt, Homo sapiens
gcugauucaaaccaaagcu

SEQ ID NO: 559645 - RNA, 20 nt, Homo sapiens
gcugauuuccaggccccuga

SEQ ID NO: 559646 - RNA, 16 nt, Homo sapiens
gcugcaaaaguucuca

SEQ ID NO: 559647 - RNA, 17 nt, Homo sapiens
gcugcaaagccuuucca

SEQ ID NO: 559648 - RNA, 21 nt, Homo sapiens
gcugcaaauagccuuccugac

SEQ ID NO: 559649 - RNA, 23 nt, Homo sapiens
gcugcaaauagccuuccugaccu

SEQ ID NO: 559650 - RNA, 16 nt, Homo sapiens
gcugcaagguacucug

SEQ ID NO: 559651 - RNA, 14 nt, Homo sapiens
gcugcacacagacg

SEQ ID NO: 559652 - RNA, 21 nt, Homo sapiens
gcugcacacagacggccuagg

SEQ ID NO: 559653 - RNA, 21 nt, Homo sapiens
gcugcacaucacaacauuuac

SEQ ID NO: 559654 - RNA, 15 nt, Homo sapiens
gcaugucgcacaaug

SEQ ID NO: 559655 - RNA, 21 nt, Homo sapiens
gcaugucucucugccaagauc

SEQ ID NO: 559656 - RNA, 21 nt, Homo sapiens
gcaugugcugugaccauuuau

SEQ ID NO: 559657 - RNA, 16 nt, Homo sapiens
gcauguggagacacuc

SEQ ID NO: 559658 - RNA, 15 nt, Homo sapiens
gcaugugugauuuca

SEQ ID NO: 559659 - RNA, 17 nt, Homo sapiens
gcauguuaagugccauu

SEQ ID NO: 559660 - RNA, 22 nt, Homo sapiens
gcauuaaaccugucuccacugu

SEQ ID NO: 559661 - RNA, 17 nt, Homo sapiens
gcauuacuauucacuga

SEQ ID NO: 559662 - RNA, 13 nt, Homo sapiens
gcauucaagugua

SEQ ID NO: 559663 - RNA, 20 nt, Homo sapiens
gcauuccagccccucugguc

SEQ ID NO: 559664 - RNA, 20 nt, Homo sapiens
gcauuccucaggaaggacau

SEQ ID NO: 559665 - RNA, 17 nt, Homo sapiens
gcauuccugaugaccaa

SEQ ID NO: 559666 - RNA, 17 nt, Homo sapiens
gcauuccuuuuucuuca

SEQ ID NO: 559667 - RNA, 16 nt, Homo sapiens
gcauucugccuaacag

SEQ ID NO: 559668 - RNA, 21 nt, Homo sapiens
gcauucuguggccagccaaaa

SEQ ID NO: 559669 - RNA, 20 nt, Homo sapiens
gcauucuuaacaaacucuuc

SEQ ID NO: 559670 - RNA, 21 nt, Homo sapiens
gcauucuuaacaaacucuuca

SEQ ID NO: 559671 - RNA, 19 nt, Homo sapiens
gcauucuucuuuuggcaau

SEQ ID NO: 559672 - RNA, 20 nt, Homo sapiens
gcauugaaaugcaaugucua

SEQ ID NO: 559673 - RNA, 21 nt, Homo sapiens
gcauugauaaucuucagguga

SEQ ID NO: 559674 - RNA, 15 nt, Homo sapiens
gcauugauccaggag

SEQ ID NO: 559675 - RNA, 14 nt, Homo sapiens
gcauugcagucaua

SEQ ID NO: 559676 - RNA, 14 nt, Homo sapiens
gcauugcuuuccac

SEQ ID NO: 559677 - RNA, 12 nt, Homo sapiens
gcauugucaaua

SEQ ID NO: 559678 - RNA, 16 nt, Homo sapiens
gcauuguuuugguaua

SEQ ID NO: 559679 - RNA, 16 nt, Homo sapiens
gcauuuagucuugcca

SEQ ID NO: 559680 - RNA, 17 nt, Homo sapiens
gcauuuaugaugcaguu

SEQ ID NO: 559681 - RNA, 18 nt, Homo sapiens
gcauuuaugaugcaguuu

SEQ ID NO: 559682 - RNA, 9 nt, Homo sapiens
gcauuucaa

SEQ ID NO: 559683 - RNA, 19 nt, Homo sapiens
gcauuuccaacaccacaga

SEQ ID NO: 559684 - RNA, 12 nt, Homo sapiens
gcauuucuugcg

SEQ ID NO: 559685 - RNA, 21 nt, Homo sapiens
gcauuugaagaggagaacaaa

SEQ ID NO: 559686 - RNA, 16 nt, Homo sapiens
gcauuugauuuugccc

SEQ ID NO: 559687 - RNA, 12 nt, Homo sapiens
gcauuugcuggu

SEQ ID NO: 559688 - RNA, 19 nt, Homo sapiens
gcauuuggugagagucaaa

SEQ ID NO: 559689 - RNA, 17 nt, Homo sapiens
gcauuuucaagcaguua

SEQ ID NO: 559690 - RNA, 15 nt, Homo sapiens
gcauuuuccucuugu

SEQ ID NO: 559691 - RNA, 18 nt, Homo sapiens
gcauuuuccuguuuacug

SEQ ID NO: 559692 - RNA, 18 nt, Homo sapiens
gcauuuucuucagaauua

SEQ ID NO: 559693 - RNA, 16 nt, Homo sapiens
gcauuuugcuauugua

SEQ ID NO: 559694 - RNA, 15 nt, Homo sapiens
gcauuuuucugggag

SEQ ID NO: 559695 - RNA, 24 nt, Homo sapiens
gccaaaaacaaaaaauagcuuuca

SEQ ID NO: 559696 - RNA, 10 nt, Homo sapiens
gccaaaaagg

SEQ ID NO: 559697 - RNA, 13 nt, Homo sapiens
gccaaaaauacag

SEQ ID NO: 559698 - RNA, 20 nt, Homo sapiens
gccaaaauaucauguucaau

SEQ ID NO: 559699 - RNA, 14 nt, Homo sapiens
gccaaaaugacuuu

SEQ ID NO: 559700 - RNA, 13 nt, Homo sapiens
gccaaaaugcucu

SEQ ID NO: 559701 - RNA, 18 nt, Homo sapiens
gccaaaggaugugauaua

SEQ ID NO: 559702 - RNA, 13 nt, Homo sapiens
gccaaagugccug

SEQ ID NO: 559703 - RNA, 14 nt, Homo sapiens
gccaaagugccugg

SEQ ID NO: 559704 - RNA, 15 nt, Homo sapiens
gccaaauaaaaucua

SEQ ID NO: 559705 - RNA, 18 nt, Homo sapiens
gccaacaccuucuuggcu

SEQ ID NO: 559706 - RNA, 16 nt, Homo sapiens
gccaacauacuuuaag

SEQ ID NO: 559707 - RNA, 23 nt, Homo sapiens
gccaacaucuggaucaauguaau

SEQ ID NO: 559708 - RNA, 15 nt, Homo sapiens
gccaaccagacaccu

SEQ ID NO: 559709 - RNA, 22 nt, Homo sapiens
gccaaccagcccgacagugcca

SEQ ID NO: 559710 - RNA, 17 nt, Homo sapiens
gccaaccggucacccag

SEQ ID NO: 559711 - RNA, 19 nt, Homo sapiens
gccaaccucuggagcaaug

SEQ ID NO: 559712 - RNA, 14 nt, Homo sapiens
gccaaccuggaaug

SEQ ID NO: 559713 - RNA, 19 nt, Homo sapiens
gccaaccuggaauggagac

SEQ ID NO: 559714 - RNA, 12 nt, Homo sapiens
gccaacuuuguu

SEQ ID NO: 559715 - RNA, 16 nt, Homo sapiens
gccaagaaacacugcc

SEQ ID NO: 559716 - RNA, 19 nt, Homo sapiens
gccaagaaacgucuucuaa

SEQ ID NO: 559717 - RNA, 19 nt, Homo sapiens
gccaagaauauugcaaaau

SEQ ID NO: 559718 - RNA, 13 nt, Homo sapiens
gccaagacuccuc

SEQ ID NO: 559719 - RNA, 16 nt, Homo sapiens
gggugacagugccuuc

SEQ ID NO: 559720 - RNA, 21 nt, Homo sapiens
gggugaccaccgauuccagcu

SEQ ID NO: 559721 - RNA, 11 nt, Homo sapiens
gggugagccag

SEQ ID NO: 559722 - RNA, 15 nt, Homo sapiens
gggugaggaggacaa

SEQ ID NO: 559723 - RNA, 15 nt, Homo sapiens
gggugaggcugccgu

SEQ ID NO: 559724 - RNA, 22 nt, Homo sapiens
gggugauuuuaugaucaguguu

SEQ ID NO: 559725 - RNA, 18 nt, Homo sapiens
gggugcaaagacucugag

SEQ ID NO: 559726 - RNA, 17 nt, Homo sapiens
gggugccgcgagccagg

SEQ ID NO: 559727 - RNA, 11 nt, Homo sapiens
gggugcuccug

SEQ ID NO: 559728 - RNA, 18 nt, Homo sapiens
ggguggcacucagucucu

SEQ ID NO: 559729 - RNA, 19 nt, Homo sapiens
ggguggcgcuggugcauuc

SEQ ID NO: 559730 - RNA, 22 nt, Homo sapiens
ggguggcugccagcccacugcc

SEQ ID NO: 559731 - RNA, 14 nt, Homo sapiens
gggugguacccucu

SEQ ID NO: 559732 - RNA, 11 nt, Homo sapiens
gggugugcuau

SEQ ID NO: 559733 - RNA, 14 nt, Homo sapiens
ggguguucagaggc

SEQ ID NO: 559734 - RNA, 16 nt, Homo sapiens
ggguuaauucauuugg

SEQ ID NO: 559735 - RNA, 14 nt, Homo sapiens
ggguuacuuucaca

SEQ ID NO: 559736 - RNA, 14 nt, Homo sapiens
ggguuagagccaag

SEQ ID NO: 559737 - RNA, 22 nt, Homo sapiens
ggguucaagcaauugucugccu

SEQ ID NO: 559738 - RNA, 14 nt, Homo sapiens
ggguucaugcuuaa

SEQ ID NO: 559739 - RNA, 23 nt, Homo sapiens
ggguucuggggcaucagccagcu

SEQ ID NO: 559740 - RNA, 21 nt, Homo sapiens
ggguucuuauuuugcauucca

SEQ ID NO: 559741 - RNA, 15 nt, Homo sapiens
ggguugagggaugcu

SEQ ID NO: 559742 - RNA, 21 nt, Homo sapiens
ggguuggcuguuccagacuca

SEQ ID NO: 559743 - RNA, 22 nt, Homo sapiens
ggguuuaauagacugagucaga

SEQ ID NO: 559744 - RNA, 20 nt, Homo sapiens
ggguuucaccauauugccca

SEQ ID NO: 559745 - RNA, 15 nt, Homo sapiens
ggguuugcucaugua

SEQ ID NO: 559746 - RNA, 19 nt, Homo sapiens
gguaaaaacagcagcucau

SEQ ID NO: 559747 - RNA, 17 nt, Homo sapiens
gguaaaaccccaucucu

SEQ ID NO: 559748 - RNA, 19 nt, Homo sapiens
gguaaaacucacugugauc

SEQ ID NO: 559749 - RNA, 22 nt, Homo sapiens
gguaaaaguucuuuuugcucua

SEQ ID NO: 559750 - RNA, 16 nt, Homo sapiens
gguaaagggacaguua

SEQ ID NO: 559751 - RNA, 16 nt, Homo sapiens
gguaaaugauguggug

SEQ ID NO: 559752 - RNA, 14 nt, Homo sapiens
gguaaaugguauga

SEQ ID NO: 559753 - RNA, 11 nt, Homo sapiens
gguaacaaagg

SEQ ID NO: 559754 - RNA, 15 nt, Homo sapiens
gguaacuaacugcuu

SEQ ID NO: 559755 - RNA, 18 nt, Homo sapiens
gguaauauaaaguguaau

SEQ ID NO: 559756 - RNA, 14 nt, Homo sapiens
gguaaucagcauua

SEQ ID NO: 559757 - RNA, 17 nt, Homo sapiens
gguaauucuagccuuuu

SEQ ID NO: 559758 - RNA, 17 nt, Homo sapiens
gguacacagauggcagu

SEQ ID NO: 559759 - RNA, 14 nt, Homo sapiens
gguacauauuucuu

SEQ ID NO: 559760 - RNA, 22 nt, Homo sapiens
gguacuauaaaagcuuucugcc

SEQ ID NO: 559761 - RNA, 23 nt, Homo sapiens
gguacuauaaaagcuuucugcca

SEQ ID NO: 559762 - RNA, 20 nt, Homo sapiens
gguacuauuuagauauaaca

SEQ ID NO: 559763 - RNA, 16 nt, Homo sapiens
gguacugaaagccuua

SEQ ID NO: 559764 - RNA, 20 nt, Homo sapiens
gguagaaaaggcuagguaca

SEQ ID NO: 559765 - RNA, 14 nt, Homo sapiens
gguagaaaggcagu

SEQ ID NO: 559766 - RNA, 19 nt, Homo sapiens
gguagacuuuuaauaucac

SEQ ID NO: 559767 - RNA, 20 nt, Homo sapiens
gguagaggcugggggcucca

SEQ ID NO: 559768 - RNA, 20 nt, Homo sapiens
gguagcagggggagugcugg

SEQ ID NO: 559769 - RNA, 11 nt, Homo sapiens
gguagcauuuu

SEQ ID NO: 559770 - RNA, 22 nt, Homo sapiens
gguagccagcacacagggcagu

SEQ ID NO: 559771 - RNA, 19 nt, Homo sapiens
gguaggggcagggaggcaa

SEQ ID NO: 559772 - RNA, 14 nt, Homo sapiens
gguaggucggcacu

SEQ ID NO: 559773 - RNA, 23 nt, Homo sapiens
gguaguaaauaugaaacuagggu

SEQ ID NO: 559774 - RNA, 17 nt, Homo sapiens
gguaguauuacaccacc

SEQ ID NO: 559775 - RNA, 15 nt, Homo sapiens
gguaguuguggcuuu

SEQ ID NO: 559776 - RNA, 23 nt, Homo sapiens
gguaguuuguuuuagaaccagcc

SEQ ID NO: 559777 - RNA, 20 nt, Homo sapiens
gguauaaugguugacugggu

SEQ ID NO: 559778 - RNA, 21 nt, Homo sapiens
gguauaaugguugacuggguu

SEQ ID NO: 559779 - RNA, 16 nt, Homo sapiens
gguauauacuuugaaa

SEQ ID NO: 559780 - RNA, 18 nt, Homo sapiens
gguaucaaaauaguuuag

SEQ ID NO: 559781 - RNA, 21 nt, Homo sapiens
gguaucaaaauuacauauacu

SEQ ID NO: 559782 - RNA, 17 nt, Homo sapiens
gguauccugggggaccc

SEQ ID NO: 559783 - RNA, 21 nt, Homo sapiens
gguaucucuggcaccacacua

SEQ ID NO: 559784 - RNA, 20 nt, Homo sapiens
gguaucuguuuaacauuucc

SEQ ID NO: 559785 - RNA, 14 nt, Homo sapiens
gguaucuucuuuag

SEQ ID NO: 559786 - RNA, 15 nt, Homo sapiens
gguaugaaagugccu

SEQ ID NO: 559787 - RNA, 22 nt, Homo sapiens
gguaugaaguaucuuugacaug

SEQ ID NO: 559788 - RNA, 11 nt, Homo sapiens
gguaugcauuu

SEQ ID NO: 559789 - RNA, 15 nt, Homo sapiens
gguauguaauggaac

SEQ ID NO: 559790 - RNA, 14 nt, Homo sapiens
gguauguuuuacca

SEQ ID NO: 559791 - RNA, 20 nt, Homo sapiens
gguauguuuuaccaucugca

SEQ ID NO: 559792 - RNA, 23 nt, Homo sapiens
gguauuaacuuuauacacuugga

SEQ ID NO: 559793 - RNA, 14 nt, Homo sapiens
gguauuauucuguu

SEQ ID NO: 559794 - RNA, 17 nt, Homo sapiens
gguauugucuacucuga

SEQ ID NO: 559795 - RNA, 18 nt, Homo sapiens
gguauugucuacucugaa

SEQ ID NO: 559796 - RNA, 19 nt, Homo sapiens
gguauuugcuuuguaacuc

SEQ ID NO: 559797 - RNA, 15 nt, Homo sapiens
gguauuuuuauagcc

SEQ ID NO: 559798 - RNA, 13 nt, Homo sapiens
ggucaaaauuugc

SEQ ID NO: 559799 - RNA, 16 nt, Homo sapiens
gguuagagccaagcug

SEQ ID NO: 559800 - RNA, 20 nt, Homo sapiens
gguuaggauuuaacagucau

SEQ ID NO: 559801 - RNA, 22 nt, Homo sapiens
gguuauggguacggcaaccaca

SEQ ID NO: 559802 - RNA, 20 nt, Homo sapiens
gguuaugugcauuauucaua

SEQ ID NO: 559803 - RNA, 14 nt, Homo sapiens
gguuauuucaauuc

SEQ ID NO: 559804 - RNA, 21 nt, Homo sapiens
gguucacacccuguuuuauaa

SEQ ID NO: 559805 - RNA, 15 nt, Homo sapiens
gguucagcugaagcu

SEQ ID NO: 559806 - RNA, 14 nt, Homo sapiens
gguucagugccuuc

SEQ ID NO: 559807 - RNA, 22 nt, Homo sapiens
gguuccagggucccucugugua

SEQ ID NO: 559808 - RNA, 14 nt, Homo sapiens
gguuccuccucucc

SEQ ID NO: 559809 - RNA, 20 nt, Homo sapiens
gguuccugugauacauuucu

SEQ ID NO: 559810 - RNA, 17 nt, Homo sapiens
gguuccuugguauucac

SEQ ID NO: 559811 - RNA, 15 nt, Homo sapiens
gguucgagacuccau

SEQ ID NO: 559812 - RNA, 21 nt, Homo sapiens
gguucuacugacccaacuggg

SEQ ID NO: 559813 - RNA, 19 nt, Homo sapiens
gguucucagguguugccaa

SEQ ID NO: 559814 - RNA, 15 nt, Homo sapiens
gguucucuacaggcc

SEQ ID NO: 559815 - RNA, 12 nt, Homo sapiens
gguucugcccug

SEQ ID NO: 559816 - RNA, 20 nt, Homo sapiens
gguucuucuuccugaagcug

SEQ ID NO: 559817 - RNA, 22 nt, Homo sapiens
gguugaaaaauggcaaagaauu

SEQ ID NO: 559818 - RNA, 15 nt, Homo sapiens
gguugaaauauuaac

SEQ ID NO: 559819 - RNA, 11 nt, Homo sapiens
gguugaacuau

SEQ ID NO: 559820 - RNA, 22 nt, Homo sapiens
gguugaagaaaggaaccuggga

SEQ ID NO: 559821 - RNA, 18 nt, Homo sapiens
gguugaucacacucuggg

SEQ ID NO: 559822 - RNA, 17 nt, Homo sapiens
gguugcagucacuguga

SEQ ID NO: 559823 - RNA, 18 nt, Homo sapiens
gguugcagugaaccuaga

SEQ ID NO: 559824 - RNA, 13 nt, Homo sapiens
gguugcagugagc

SEQ ID NO: 559825 - RNA, 12 nt, Homo sapiens
gguugccaugga

SEQ ID NO: 559826 - RNA, 19 nt, Homo sapiens
gguuggaugggagugggca

SEQ ID NO: 559827 - RNA, 18 nt, Homo sapiens
gguuggcugggcccagaa

SEQ ID NO: 559828 - RNA, 19 nt, Homo sapiens
gguugggcuggugcucaca

SEQ ID NO: 559829 - RNA, 16 nt, Homo sapiens
gguugucaccaagcua

SEQ ID NO: 559830 - RNA, 23 nt, Homo sapiens
gguuguggcaaaagccacauuac

SEQ ID NO: 559831 - RNA, 17 nt, Homo sapiens
gguuguuguuaaugaau

SEQ ID NO: 559832 - RNA, 14 nt, Homo sapiens
gguuuagaucaaau

SEQ ID NO: 559833 - RNA, 19 nt, Homo sapiens
gguuuauucccaaguaugc

SEQ ID NO: 559834 - RNA, 19 nt, Homo sapiens
gguuucauguuaguuaccu

SEQ ID NO: 559835 - RNA, 14 nt, Homo sapiens
gguuuccacugucu

SEQ ID NO: 559836 - RNA, 23 nt, Homo sapiens
gguuuccgaaggguuuugcuaca

SEQ ID NO: 559837 - RNA, 22 nt, Homo sapiens
gguuuccuuuuggaacauuucu

SEQ ID NO: 559838 - RNA, 19 nt, Homo sapiens
gguuugaaagaugcagugg

SEQ ID NO: 559839 - RNA, 22 nt, Homo sapiens
gguuugagaauguuuuuagcug

SEQ ID NO: 559840 - RNA, 21 nt, Homo sapiens
gguuugccaaaauucauuucu

SEQ ID NO: 559841 - RNA, 17 nt, Homo sapiens
gguuuggucaguuacaa

SEQ ID NO: 559842 - RNA, 20 nt, Homo sapiens
gguuuguccuggucaugcac

SEQ ID NO: 559843 - RNA, 21 nt, Homo sapiens
gguuuguccuggucaugcaca

SEQ ID NO: 559844 - RNA, 23 nt, Homo sapiens
gguuugucgggcaccagccagcg

SEQ ID NO: 559845 - RNA, 21 nt, Homo sapiens
gguuuucuuuuaagaaucaau

SEQ ID NO: 559846 - RNA, 20 nt, Homo sapiens
gguuuugcucccccuaccuu

SEQ ID NO: 559847 - RNA, 20 nt, Homo sapiens
gguuuugcuuuagagugcaa

SEQ ID NO: 559848 - RNA, 14 nt, Homo sapiens
guaaaaaaauauga

SEQ ID NO: 559849 - RNA, 22 nt, Homo sapiens
guaaaaaaguaugcuuguuaau

SEQ ID NO: 559850 - RNA, 15 nt, Homo sapiens
guaaaaacuguucuc

SEQ ID NO: 559851 - RNA, 17 nt, Homo sapiens
guaaaaagggggcugca

SEQ ID NO: 559852 - RNA, 15 nt, Homo sapiens
guaaaaaugcugcuc

SEQ ID NO: 559853 - RNA, 18 nt, Homo sapiens
guaaaaaugcugcucuca

SEQ ID NO: 559854 - RNA, 17 nt, Homo sapiens
guaaaacacuuauuccc

SEQ ID NO: 559855 - RNA, 12 nt, Homo sapiens
guaaaacagggc

SEQ ID NO: 559856 - RNA, 17 nt, Homo sapiens
guaaaacauuuguuucc

SEQ ID NO: 559857 - RNA, 16 nt, Homo sapiens
guaaaacuauauucuc

SEQ ID NO: 559858 - RNA, 15 nt, Homo sapiens
guaaaauaacaucag

SEQ ID NO: 559859 - RNA, 13 nt, Homo sapiens
guaaaauaaucca

SEQ ID NO: 559860 - RNA, 19 nt, Homo sapiens
guaaaauacuuuuacucug

SEQ ID NO: 559861 - RNA, 13 nt, Homo sapiens
guaaaauauuuau

SEQ ID NO: 559862 - RNA, 16 nt, Homo sapiens
guaaaauuguuccuga

SEQ ID NO: 559863 - RNA, 12 nt, Homo sapiens
guaaacaaacuc

SEQ ID NO: 559864 - RNA, 17 nt, Homo sapiens
guaaacauauaucuuac

SEQ ID NO: 559865 - RNA, 16 nt, Homo sapiens
guaaacauguguuuua

SEQ ID NO: 559866 - RNA, 13 nt, Homo sapiens
guaaacauuuuaa

SEQ ID NO: 559867 - RNA, 13 nt, Homo sapiens
guaaacugugcac

SEQ ID NO: 559868 - RNA, 20 nt, Homo sapiens
guaaacuuaacuguucuuug

SEQ ID NO: 559869 - RNA, 13 nt, Homo sapiens
guaaacuuuguca

SEQ ID NO: 559870 - RNA, 19 nt, Homo sapiens
guaaagaauuuagcuguau

SEQ ID NO: 559871 - RNA, 16 nt, Homo sapiens
guaaagccucauuuga

SEQ ID NO: 559872 - RNA, 15 nt, Homo sapiens
guaaagugauguuug

SEQ ID NO: 559873 - RNA, 15 nt, Homo sapiens
guaaauaaauacauu

SEQ ID NO: 559874 - RNA, 17 nt, Homo sapiens
guaaauaauuugcacug

SEQ ID NO: 559875 - RNA, 21 nt, Homo sapiens
guaaauacacauagcauguaa

SEQ ID NO: 559876 - RNA, 13 nt, Homo sapiens
guaaauacaggua

SEQ ID NO: 559877 - RNA, 16 nt, Homo sapiens
guaaauacaugcauau

SEQ ID NO: 559878 - RNA, 13 nt, Homo sapiens
guaaauacugcuu

SEQ ID NO: 559879 - RNA, 18 nt, Homo sapiens
guaaauacuguaaaugca

SEQ ID NO: 559880 - RNA, 15 nt, Homo sapiens
guaaauagaugacaa

SEQ ID NO: 559881 - RNA, 16 nt, Homo sapiens
guaaauagaugacaaa

SEQ ID NO: 559882 - RNA, 14 nt, Homo sapiens
guaauaaacucugu

SEQ ID NO: 559883 - RNA, 13 nt, Homo sapiens
guaauaacaaacg

SEQ ID NO: 559884 - RNA, 14 nt, Homo sapiens
guaauaacauuuua

SEQ ID NO: 559885 - RNA, 21 nt, Homo sapiens
guaauaacauuuuauacaauu

SEQ ID NO: 559886 - RNA, 13 nt, Homo sapiens
guaauaagcacuu

SEQ ID NO: 559887 - RNA, 13 nt, Homo sapiens
guaauaaguaaaa

SEQ ID NO: 559888 - RNA, 21 nt, Homo sapiens
guaauaauacagccaaagaua

SEQ ID NO: 559889 - RNA, 14 nt, Homo sapiens
guaauaaugugcaa

SEQ ID NO: 559890 - RNA, 13 nt, Homo sapiens
guaauacaaacua

SEQ ID NO: 559891 - RNA, 17 nt, Homo sapiens
guaauacaaacuauaua

SEQ ID NO: 559892 - RNA, 15 nt, Homo sapiens
guaauacaucaaaga

SEQ ID NO: 559893 - RNA, 21 nt, Homo sapiens
guaauacuggaauaauuugua

SEQ ID NO: 559894 - RNA, 20 nt, Homo sapiens
guaauacuuuacaaaccauu

SEQ ID NO: 559895 - RNA, 15 nt, Homo sapiens
guaauagccaaaaag

SEQ ID NO: 559896 - RNA, 18 nt, Homo sapiens
guaauagugaacauaugg

SEQ ID NO: 559897 - RNA, 16 nt, Homo sapiens
guaauaguucuauccu

SEQ ID NO: 559898 - RNA, 18 nt, Homo sapiens
guaauauaaugaugcugu

SEQ ID NO: 559899 - RNA, 22 nt, Homo sapiens
guaauauagugacuaugaacuu

SEQ ID NO: 559900 - RNA, 19 nt, Homo sapiens
guaauauaguuauugcaca

SEQ ID NO: 559901 - RNA, 15 nt, Homo sapiens
guaaucagauuuauu

SEQ ID NO: 559902 - RNA, 19 nt, Homo sapiens
guaauccaggcacagcuga

SEQ ID NO: 559903 - RNA, 18 nt, Homo sapiens
guaaucccagcuacucag

SEQ ID NO: 559904 - RNA, 16 nt, Homo sapiens
guaaucccagcuacuu

SEQ ID NO: 559905 - RNA, 20 nt, Homo sapiens
guaaucccagcuacuuggga

SEQ ID NO: 559906 - RNA, 15 nt, Homo sapiens
guaaucucagcacuu

SEQ ID NO: 559907 - RNA, 19 nt, Homo sapiens
guaaucuguauaauacuuu

SEQ ID NO: 559908 - RNA, 18 nt, Homo sapiens
guaaucuguguacaaaga

SEQ ID NO: 559909 - RNA, 16 nt, Homo sapiens
guaaucuuuauacugg

SEQ ID NO: 559910 - RNA, 18 nt, Homo sapiens
guaaugaaacaccuucuc

SEQ ID NO: 559911 - RNA, 14 nt, Homo sapiens
guaaugaaauggag

SEQ ID NO: 559912 - RNA, 13 nt, Homo sapiens
guaaugcaaaagg

SEQ ID NO: 559913 - RNA, 11 nt, Homo sapiens
guaauggagca

SEQ ID NO: 559914 - RNA, 15 nt, Homo sapiens
guaaugucaccaccu

SEQ ID NO: 559915 - RNA, 22 nt, Homo sapiens
guaauguuccugaaaauugcaa

SEQ ID NO: 559916 - RNA, 18 nt, Homo sapiens
guaauuaaaggaacagag

SEQ ID NO: 559917 - RNA, 17 nt, Homo sapiens
guaauuagcauggcccc

SEQ ID NO: 559918 - RNA, 18 nt, Homo sapiens
guaauuccuguuacuuua

SEQ ID NO: 559919 - RNA, 19 nt, Homo sapiens
guaauuccuguuacuuuac

SEQ ID NO: 559920 - RNA, 23 nt, Homo sapiens
guaauucuaaaugaauguuuaca

SEQ ID NO: 559921 - RNA, 18 nt, Homo sapiens
guaauucuagccuuuuaa

SEQ ID NO: 559922 - RNA, 18 nt, Homo sapiens
guaauugcauuucugcuc

SEQ ID NO: 559923 - RNA, 19 nt, Homo sapiens
guaauuggcccaagucauu

SEQ ID NO: 559924 - RNA, 15 nt, Homo sapiens
guaauuguaauucca

SEQ ID NO: 559925 - RNA, 23 nt, Homo sapiens
guaauuuaauggggucuguaaau

SEQ ID NO: 559926 - RNA, 19 nt, Homo sapiens
guaauuuauuaacuaauca

SEQ ID NO: 559927 - RNA, 20 nt, Homo sapiens
guaauuuuaguagagacagg

SEQ ID NO: 559928 - RNA, 19 nt, Homo sapiens
guaauuuuuuuuccuugcc

SEQ ID NO: 559929 - RNA, 16 nt, Homo sapiens
guacaacguguccuca

SEQ ID NO: 559930 - RNA, 11 nt, Homo sapiens
guacaauaaua

SEQ ID NO: 559931 - RNA, 23 nt, Homo sapiens
guacacauuccugcauucaugua

SEQ ID NO: 559932 - RNA, 21 nt, Homo sapiens
guacaccccaggacaguuuau

SEQ ID NO: 559933 - RNA, 16 nt, Homo sapiens
guacacugguauuuau

SEQ ID NO: 559934 - RNA, 21 nt, Homo sapiens
guacacuguuucaaacuuuac

SEQ ID NO: 559935 - RNA, 17 nt, Homo sapiens
guacagaauucugcuac

SEQ ID NO: 559936 - RNA, 21 nt, Homo sapiens
guacagacugcagacauucuc

SEQ ID NO: 559937 - RNA, 14 nt, Homo sapiens
guacagagcacauu

SEQ ID NO: 559938 - RNA, 13 nt, Homo sapiens
guacagaugaaug

SEQ ID NO: 559939 - RNA, 22 nt, Homo sapiens
guacagcagaagccccaagcaa

SEQ ID NO: 559940 - RNA, 19 nt, Homo sapiens
guacagcagggucuugcug

SEQ ID NO: 559941 - RNA, 16 nt, Homo sapiens
guacagcgggcugugc

SEQ ID NO: 559942 - RNA, 16 nt, Homo sapiens
guacaggaaugaaccu

SEQ ID NO: 559943 - RNA, 13 nt, Homo sapiens
guacaggggccau

SEQ ID NO: 559944 - RNA, 20 nt, Homo sapiens
guacaguauguuuuacaugu

SEQ ID NO: 559945 - RNA, 23 nt, Homo sapiens
guacagucuguaucaaacccacg

SEQ ID NO: 559946 - RNA, 22 nt, Homo sapiens
guacaucguuugcaaaugucag

SEQ ID NO: 559947 - RNA, 12 nt, Homo sapiens
guacaucuggcc

SEQ ID NO: 559948 - RNA, 23 nt, Homo sapiens
guacaugcuaugcugaagacauu

SEQ ID NO: 559949 - RNA, 22 nt, Homo sapiens
guacauggaauaacauguaauu

SEQ ID NO: 559950 - RNA, 10 nt, Homo sapiens
guacauguau

SEQ ID NO: 559951 - RNA, 14 nt, Homo sapiens
guacaugugugaaa

SEQ ID NO: 559952 - RNA, 18 nt, Homo sapiens
guacauucuagcugagaa

SEQ ID NO: 559953 - RNA, 23 nt, Homo sapiens
guacauugagguugugggccuuc

SEQ ID NO: 559954 - RNA, 17 nt, Homo sapiens
guacauugggagucugu

SEQ ID NO: 559955 - RNA, 19 nt, Homo sapiens
guacauuuaaaauugcuau

SEQ ID NO: 559956 - RNA, 17 nt, Homo sapiens
guacauuuaucacugaa

SEQ ID NO: 559957 - RNA, 9 nt, Homo sapiens
guaccaaaa

SEQ ID NO: 559958 - RNA, 15 nt, Homo sapiens
guaccacacauauug

SEQ ID NO: 559959 - RNA, 16 nt, Homo sapiens
guaccaccaugcacug

SEQ ID NO: 559960 - RNA, 19 nt, Homo sapiens
guaccaccaugcacuguaa

SEQ ID NO: 559961 - RNA, 17 nt, Homo sapiens
guaccacguggguccuc

SEQ ID NO: 559962 - RNA, 10 nt, Homo sapiens
guaccauuca

SEQ ID NO: 559963 - RNA, 15 nt, Homo sapiens
guaccccacugggcc

SEQ ID NO: 559964 - RNA, 16 nt, Homo sapiens
guacccccuuucccuu

SEQ ID NO: 559965 - RNA, 22 nt, Homo sapiens
guaccccuaaaaagauugccaa

SEQ ID NO: 559966 - RNA, 12 nt, Homo sapiens
gucuuccauaau

SEQ ID NO: 559967 - RNA, 13 nt, Homo sapiens
gucuucccuguau

SEQ ID NO: 559968 - RNA, 19 nt, Homo sapiens
gucuuccugacacuuuaau

SEQ ID NO: 559969 - RNA, 13 nt, Homo sapiens
gucuucuaaacuu

SEQ ID NO: 559970 - RNA, 19 nt, Homo sapiens
gucuucucccuacaccaag

SEQ ID NO: 559971 - RNA, 22 nt, Homo sapiens
gucuucuccuccaugaacauca

SEQ ID NO: 559972 - RNA, 17 nt, Homo sapiens
gucuucuggacaggcuc

SEQ ID NO: 559973 - RNA, 12 nt, Homo sapiens
gucuucuggcuc

SEQ ID NO: 559974 - RNA, 17 nt, Homo sapiens
gucuugacgggagcauu

SEQ ID NO: 559975 - RNA, 23 nt, Homo sapiens
gucuugauccuccaaugucuaau

SEQ ID NO: 559976 - RNA, 16 nt, Homo sapiens
gucuugaugacugcug

SEQ ID NO: 559977 - RNA, 20 nt, Homo sapiens
gucuugcaacuucaguuuua

SEQ ID NO: 559978 - RNA, 19 nt, Homo sapiens
gucuugcuauguugcccaa

SEQ ID NO: 559979 - RNA, 14 nt, Homo sapiens
gucuuguacuucug

SEQ ID NO: 559980 - RNA, 21 nt, Homo sapiens
gucuuguagcuagaacuucuc

SEQ ID NO: 559981 - RNA, 15 nt, Homo sapiens
gucuugugaaggcag

SEQ ID NO: 559982 - RNA, 17 nt, Homo sapiens
gucuuguugauuuccuc

SEQ ID NO: 559983 - RNA, 14 nt, Homo sapiens
gucuuucaguggaa

SEQ ID NO: 559984 - RNA, 20 nt, Homo sapiens
gucuuuccuaaggcugcaag

SEQ ID NO: 559985 - RNA, 14 nt, Homo sapiens
gucuuucuauccug

SEQ ID NO: 559986 - RNA, 14 nt, Homo sapiens
gucuuugcagagaa

SEQ ID NO: 559987 - RNA, 14 nt, Homo sapiens
gucuuuuaaacugg

SEQ ID NO: 559988 - RNA, 15 nt, Homo sapiens
gucuuuuagaagaua

SEQ ID NO: 559989 - RNA, 21 nt, Homo sapiens
gucuuuugagguaaguggaau

SEQ ID NO: 559990 - RNA, 17 nt, Homo sapiens
gucuuuuguaauaucaa

SEQ ID NO: 559991 - RNA, 17 nt, Homo sapiens
gucuuuuuacuacaaac

SEQ ID NO: 559992 - RNA, 22 nt, Homo sapiens
gucuuuuuccuacuccguuccu

SEQ ID NO: 559993 - RNA, 21 nt, Homo sapiens
gugaaaaaucuuaaguaccaa

SEQ ID NO: 559994 - RNA, 13 nt, Homo sapiens
gugaaaacaauau

SEQ ID NO: 559995 - RNA, 14 nt, Homo sapiens
gugaaaagcuccau

SEQ ID NO: 559996 - RNA, 21 nt, Homo sapiens
gugaaaccucaucucuacuaa

SEQ ID NO: 559997 - RNA, 13 nt, Homo sapiens
gugaaacuggcac

SEQ ID NO: 559998 - RNA, 13 nt, Homo sapiens
gugaaagcccagg

SEQ ID NO: 559999 - RNA, 16 nt, Homo sapiens
gugaaagugacucuca

SEQ ID NO: 560000 - RNA, 18 nt, Homo sapiens
gugaaaucaauguguaca

SEQ ID NO: 560001 - RNA, 20 nt, Homo sapiens
gugaaaugcuggcauuugca

SEQ ID NO: 560002 - RNA, 23 nt, Homo sapiens
gugaaauuuaaauaauagacaua

SEQ ID NO: 560003 - RNA, 14 nt, Homo sapiens
gugaacaaagcagc

SEQ ID NO: 560004 - RNA, 23 nt, Homo sapiens
gugaacacugugaccaggcuuuu

SEQ ID NO: 560005 - RNA, 20 nt, Homo sapiens
gugaacagcuugcugucacu

SEQ ID NO: 560006 - RNA, 22 nt, Homo sapiens
gugaacaguugcuguucuuaca

SEQ ID NO: 560007 - RNA, 21 nt, Homo sapiens
gugaacauccccucccaucau

SEQ ID NO: 560008 - RNA, 14 nt, Homo sapiens
gugaaccaucucag

SEQ ID NO: 560009 - RNA, 16 nt, Homo sapiens
gugaacggacacugaa

SEQ ID NO: 560010 - RNA, 12 nt, Homo sapiens
gugaacugggca

SEQ ID NO: 560011 - RNA, 20 nt, Homo sapiens
gugaagaaaccguauccaua

SEQ ID NO: 560012 - RNA, 13 nt, Homo sapiens
gugaagaccaaca

SEQ ID NO: 560013 - RNA, 20 nt, Homo sapiens
gugaagaugguuucaauuca

SEQ ID NO: 560014 - RNA, 17 nt, Homo sapiens
gugaagccaaagggacu

SEQ ID NO: 560015 - RNA, 14 nt, Homo sapiens
gugaagccucugag

SEQ ID NO: 560016 - RNA, 12 nt, Homo sapiens
gugaagggaugg

SEQ ID NO: 560017 - RNA, 20 nt, Homo sapiens
gugaaggugcaucuuucccu

SEQ ID NO: 560018 - RNA, 23 nt, Homo sapiens
gugaauaaaccaucaucuugcca

SEQ ID NO: 560019 - RNA, 18 nt, Homo sapiens
gugaauaugugguuucua

SEQ ID NO: 560020 - RNA, 13 nt, Homo sapiens
gugaaucuugucu

SEQ ID NO: 560021 - RNA, 15 nt, Homo sapiens
gugaaugcacugugu

SEQ ID NO: 560022 - RNA, 17 nt, Homo sapiens
gugaauuaaaguacuuu

SEQ ID NO: 560023 - RNA, 14 nt, Homo sapiens
gugaauuaacacag

SEQ ID NO: 560024 - RNA, 23 nt, Homo sapiens
gugaauuaagcccaauuaauucc

SEQ ID NO: 560025 - RNA, 23 nt, Homo sapiens
gugaauuuuucucuaacucagaa

SEQ ID NO: 560026 - RNA, 20 nt, Homo sapiens
gugacaaaaaauuaaagcau

SEQ ID NO: 560027 - RNA, 14 nt, Homo sapiens
gugacaaagccaga

SEQ ID NO: 560028 - RNA, 23 nt, Homo sapiens
gugacaagaauaauuuuggaaua

SEQ ID NO: 560029 - RNA, 16 nt, Homo sapiens
gugacacucuauaaga

SEQ ID NO: 560030 - RNA, 21 nt, Homo sapiens
gugacagacaggcucuuagca

SEQ ID NO: 560031 - RNA, 20 nt, Homo sapiens
gugacagacuccugaggaca

SEQ ID NO: 560032 - RNA, 16 nt, Homo sapiens
gugacagcugagcacc

SEQ ID NO: 560033 - RNA, 18 nt, Homo sapiens
gugacagcuuucugggau

SEQ ID NO: 560034 - RNA, 18 nt, Homo sapiens
gugacaugaacuacagac

SEQ ID NO: 560035 - RNA, 18 nt, Homo sapiens
gugacauuuauauauuga

SEQ ID NO: 560036 - RNA, 15 nt, Homo sapiens
gugacauuugggaga

SEQ ID NO: 560037 - RNA, 21 nt, Homo sapiens
gugacauuugggagacaugug

SEQ ID NO: 560038 - RNA, 23 nt, Homo sapiens
gugacauuugggagacaugugac

SEQ ID NO: 560039 - RNA, 14 nt, Homo sapiens
gugaccaacugugu

SEQ ID NO: 560040 - RNA, 11 nt, Homo sapiens
gugaccagcac

SEQ ID NO: 560041 - RNA, 17 nt, Homo sapiens
gugacccgugaaugugc

SEQ ID NO: 560042 - RNA, 12 nt, Homo sapiens
gugacccugaga

SEQ ID NO: 560043 - RNA, 17 nt, Homo sapiens
gugaccuaaccacuuag

SEQ ID NO: 560044 - RNA, 19 nt, Homo sapiens
gugaccuccccuuccagac

SEQ ID NO: 560045 - RNA, 15 nt, Homo sapiens
gugaccuccugugac

SEQ ID NO: 560046 - RNA, 14 nt, Homo sapiens
gugacuaugaacuu

SEQ ID NO: 560047 - RNA, 12 nt, Homo sapiens
gugacucucuug

SEQ ID NO: 560048 - RNA, 21 nt, Homo sapiens
gugacucuuuccuaaagccaa

SEQ ID NO: 560049 - RNA, 21 nt, Homo sapiens
gugacuucuccaggucucacg

SEQ ID NO: 560050 - RNA, 14 nt, Homo sapiens
gugagaaagcuaaa

SEQ ID NO: 560051 - RNA, 13 nt, Homo sapiens
gugagaacuucca

SEQ ID NO: 560052 - RNA, 16 nt, Homo sapiens
gugagacacugcacag

SEQ ID NO: 560053 - RNA, 17 nt, Homo sapiens
gugagacacugcacaga

SEQ ID NO: 560054 - RNA, 20 nt, Homo sapiens
gugagacuguggcucaaaaa

SEQ ID NO: 560055 - RNA, 20 nt, Homo sapiens
gugucugggagagccuggca

SEQ ID NO: 560056 - RNA, 14 nt, Homo sapiens
gugucugugcccuc

SEQ ID NO: 560057 - RNA, 15 nt, Homo sapiens
gugucuguuucagaa

SEQ ID NO: 560058 - RNA, 13 nt, Homo sapiens
gugucuucaggag

SEQ ID NO: 560059 - RNA, 22 nt, Homo sapiens
gugugaaacacacaauguggac

SEQ ID NO: 560060 - RNA, 14 nt, Homo sapiens
gugugaagugcaga

SEQ ID NO: 560061 - RNA, 22 nt, Homo sapiens
gugugacucgggagcugcacac

SEQ ID NO: 560062 - RNA, 21 nt, Homo sapiens
gugugacuuugggcaagccaa

SEQ ID NO: 560063 - RNA, 22 nt, Homo sapiens
gugugagaacuuccaacaagcc

SEQ ID NO: 560064 - RNA, 15 nt, Homo sapiens
gugugagugugugca

SEQ ID NO: 560065 - RNA, 21 nt, Homo sapiens
gugugaucuuaauauauuuga

SEQ ID NO: 560066 - RNA, 12 nt, Homo sapiens
gugugauuugcu

SEQ ID NO: 560067 - RNA, 16 nt, Homo sapiens
gugugcaaguguguau

SEQ ID NO: 560068 - RNA, 21 nt, Homo sapiens
gugugcacaugcgcacucuca

SEQ ID NO: 560069 - RNA, 16 nt, Homo sapiens
gugugcauguguguaa

SEQ ID NO: 560070 - RNA, 21 nt, Homo sapiens
gugugcaugugugugcucagg

SEQ ID NO: 560071 - RNA, 16 nt, Homo sapiens
gugugccacucagaga

SEQ ID NO: 560072 - RNA, 21 nt, Homo sapiens
gugugccuauagucgcagcua

SEQ ID NO: 560073 - RNA, 19 nt, Homo sapiens
gugugccugucuguuacac

SEQ ID NO: 560074 - RNA, 23 nt, Homo sapiens
gugugcuuauuuuaaauguuacu

SEQ ID NO: 560075 - RNA, 10 nt, Homo sapiens
gugugcuugu

SEQ ID NO: 560076 - RNA, 22 nt, Homo sapiens
guguggcccagggaagccaaaa

SEQ ID NO: 560077 - RNA, 15 nt, Homo sapiens
guguggccugccuuc

SEQ ID NO: 560078 - RNA, 22 nt, Homo sapiens
guguggcuucuaugagcccaga

SEQ ID NO: 560079 - RNA, 19 nt, Homo sapiens
gugugggggaagcaccaua

SEQ ID NO: 560080 - RNA, 14 nt, Homo sapiens
gugugguugcucac

SEQ ID NO: 560081 - RNA, 22 nt, Homo sapiens
gugugguugcucacagcuguaa

SEQ ID NO: 560082 - RNA, 22 nt, Homo sapiens
gugugguuuuugcaaaugcuuu

SEQ ID NO: 560083 - RNA, 23 nt, Homo sapiens
guguguaugugcgugugugcaag

SEQ ID NO: 560084 - RNA, 20 nt, Homo sapiens
guguguaugugugugcaugu

SEQ ID NO: 560085 - RNA, 17 nt, Homo sapiens
guguguauuuguauuaa

SEQ ID NO: 560086 - RNA, 13 nt, Homo sapiens
gugugucagcuga

SEQ ID NO: 560087 - RNA, 17 nt, Homo sapiens
gugugugacacugauga

SEQ ID NO: 560088 - RNA, 13 nt, Homo sapiens
gugugugcaugug

SEQ ID NO: 560089 - RNA, 15 nt, Homo sapiens
gugugugccacaccc

SEQ ID NO: 560090 - RNA, 17 nt, Homo sapiens
guguguguauacaugcc

SEQ ID NO: 560091 - RNA, 13 nt, Homo sapiens
guguguguguaug

SEQ ID NO: 560092 - RNA, 22 nt, Homo sapiens
guguguuuucccaaagcacuuu

SEQ ID NO: 560093 - RNA, 22 nt, Homo sapiens
guguuaauagggauuuuuucag

SEQ ID NO: 560094 - RNA, 14 nt, Homo sapiens
guguuaucuuuuga

SEQ ID NO: 560095 - RNA, 14 nt, Homo sapiens
guguucagaggcag

SEQ ID NO: 560096 - RNA, 14 nt, Homo sapiens
guguuccauuugaa

SEQ ID NO: 560097 - RNA, 22 nt, Homo sapiens
guguucccgacauaacauugua

SEQ ID NO: 560098 - RNA, 17 nt, Homo sapiens
guguucugauuagaaau

SEQ ID NO: 560099 - RNA, 17 nt, Homo sapiens
guguugagcguuugcac

SEQ ID NO: 560100 - RNA, 22 nt, Homo sapiens
guguuguguuccuggcugauga

SEQ ID NO: 560101 - RNA, 22 nt, Homo sapiens
guguuucgcauuaagcacacac

SEQ ID NO: 560102 - RNA, 21 nt, Homo sapiens
guguuuggaaauaaacugugc

SEQ ID NO: 560103 - RNA, 16 nt, Homo sapiens
guguuuggagcucuau

SEQ ID NO: 560104 - RNA, 12 nt, Homo sapiens
guguuugggaug

SEQ ID NO: 560105 - RNA, 19 nt, Homo sapiens
guguuugggaugaccagga

SEQ ID NO: 560106 - RNA, 20 nt, Homo sapiens
guguuugguucuggggcccc

SEQ ID NO: 560107 - RNA, 14 nt, Homo sapiens
guguuuguuggcaa

SEQ ID NO: 560108 - RNA, 18 nt, Homo sapiens
guguuuuaaaacauucac

SEQ ID NO: 560109 - RNA, 16 nt, Homo sapiens
guguuuucaccauuca

SEQ ID NO: 560110 - RNA, 12 nt, Homo sapiens
guguuuugccau

SEQ ID NO: 560111 - RNA, 23 nt, Homo sapiens
guguuuuuaaagaaaagcauuca

SEQ ID NO: 560112 - RNA, 17 nt, Homo sapiens
guguuuuuaacauguca

SEQ ID NO: 560113 - RNA, 20 nt, Homo sapiens
guuaaaaaaaagaauaaagg

SEQ ID NO: 560114 - RNA, 19 nt, Homo sapiens
guuaaaaaagaaaucuguu

SEQ ID NO: 560115 - RNA, 22 nt, Homo sapiens
guuaaaaauaaaaaacauauac

SEQ ID NO: 560116 - RNA, 19 nt, Homo sapiens
guuaaacuguuagcacugu

SEQ ID NO: 560117 - RNA, 14 nt, Homo sapiens
guuaaauauuguca

SEQ ID NO: 560118 - RNA, 23 nt, Homo sapiens
guuaaccuuuuuguaaauacugc

SEQ ID NO: 560119 - RNA, 13 nt, Homo sapiens
guuaacuguguau

SEQ ID NO: 560120 - RNA, 19 nt, Homo sapiens
guuaacuuaauaguauuua

SEQ ID NO: 560121 - RNA, 19 nt, Homo sapiens
guuaagagaaugcuuugaa

SEQ ID NO: 560122 - RNA, 16 nt, Homo sapiens
guuaaggcaacauucc

SEQ ID NO: 560123 - RNA, 12 nt, Homo sapiens
guuaaguauuuu

SEQ ID NO: 560124 - RNA, 23 nt, Homo sapiens
guuaagugccauuacuacuguac

SEQ ID NO: 560125 - RNA, 17 nt, Homo sapiens
guuaauaaaccuuugca

SEQ ID NO: 560126 - RNA, 19 nt, Homo sapiens
guuaauaagugguaucuga

SEQ ID NO: 560127 - RNA, 18 nt, Homo sapiens
guuaauacuccagagaca

SEQ ID NO: 560128 - RNA, 14 nt, Homo sapiens
guuaauauacccca

SEQ ID NO: 560129 - RNA, 17 nt, Homo sapiens
guuaauauugugcaaac

SEQ ID NO: 560130 - RNA, 21 nt, Homo sapiens
guuaaucauccaucacuuccc

SEQ ID NO: 560131 - RNA, 15 nt, Homo sapiens
guuaauccacaucuu

SEQ ID NO: 560132 - RNA, 20 nt, Homo sapiens
guuaauucaccuauguuauu

SEQ ID NO: 560133 - RNA, 12 nt, Homo sapiens
guuaauugcagu

SEQ ID NO: 560134 - RNA, 13 nt, Homo sapiens
guuaauugcaguc

SEQ ID NO: 560135 - RNA, 21 nt, Homo sapiens
guuaauugggcaggugaaaag

SEQ ID NO: 560136 - RNA, 21 nt, Homo sapiens
guuaauuuuuugguacaaaaa

SEQ ID NO: 560137 - RNA, 18 nt, Homo sapiens
guuacaaaaagacaaaaa

SEQ ID NO: 560138 - RNA, 11 nt, Homo sapiens
guuacaaagac

SEQ ID NO: 560139 - RNA, 20 nt, Homo sapiens
guuacaaaguuauauucaca

SEQ ID NO: 560140 - RNA, 23 nt, Homo sapiens
guuacaaauuuuuuaauuuccaa

SEQ ID NO: 560141 - RNA, 18 nt, Homo sapiens
guuacacccuuucuugac

SEQ ID NO: 560142 - RNA, 21 nt, Homo sapiens
guuacagugaugcugugcuau

SEQ ID NO: 560143 - RNA, 13 nt, Homo sapiens
guuacaucuugua

SEQ ID NO: 560144 - RNA, 14 nt, Homo sapiens
guuacccacugcca

SEQ ID NO: 560145 - RNA, 19 nt, Homo sapiens
guuacccaggcuggucuca

SEQ ID NO: 560146 - RNA, 15 nt, Homo sapiens
guuaccuacuuugac

SEQ ID NO: 560147 - RNA, 17 nt, Homo sapiens
guugaaaggccucaaga

SEQ ID NO: 560148 - RNA, 19 nt, Homo sapiens
guugaacacaauugauacu

SEQ ID NO: 560149 - RNA, 21 nt, Homo sapiens
guugaagccaugucuacauga

SEQ ID NO: 560150 - RNA, 14 nt, Homo sapiens
guugaauaaaugaa

SEQ ID NO: 560151 - RNA, 16 nt, Homo sapiens
guugaauuucccacau

SEQ ID NO: 560152 - RNA, 22 nt, Homo sapiens
guugacacauaugaacacagac

SEQ ID NO: 560153 - RNA, 16 nt, Homo sapiens
guugaccacuccagag

SEQ ID NO: 560154 - RNA, 21 nt, Homo sapiens
guugacguuugcucauuuaag

SEQ ID NO: 560155 - RNA, 15 nt, Homo sapiens
guugagaaguuccca

SEQ ID NO: 560156 - RNA, 14 nt, Homo sapiens
guugagaauguuca

SEQ ID NO: 560157 - RNA, 21 nt, Homo sapiens
guugagcuguugccucagucc

SEQ ID NO: 560158 - RNA, 19 nt, Homo sapiens
guugaggccaggaguuuaa

SEQ ID NO: 560159 - RNA, 14 nt, Homo sapiens
guugaggugcaagg

SEQ ID NO: 560160 - RNA, 18 nt, Homo sapiens
guugagugcacugacugu

SEQ ID NO: 560161 - RNA, 20 nt, Homo sapiens
guugauaaauuccacuggac

SEQ ID NO: 560162 - RNA, 15 nt, Homo sapiens
guugaucccaagaca

SEQ ID NO: 560163 - RNA, 13 nt, Homo sapiens
guugauucuugcc

SEQ ID NO: 560164 - RNA, 23 nt, Homo sapiens
guugauuucagcaccuacagugu

SEQ ID NO: 560165 - RNA, 19 nt, Homo sapiens
guugcaacuuaaguauauu

SEQ ID NO: 560166 - RNA, 15 nt, Homo sapiens
guugcaauugauccu

SEQ ID NO: 560167 - RNA, 16 nt, Homo sapiens
guugcagucuaaccca

SEQ ID NO: 560168 - RNA, 14 nt, Homo sapiens
guugcauauccaaa

SEQ ID NO: 560169 - RNA, 13 nt, Homo sapiens
guugcaucauguu

SEQ ID NO: 560170 - RNA, 20 nt, Homo sapiens
guugccaauuuuuguuuucc

SEQ ID NO: 560171 - RNA, 19 nt, Homo sapiens
guugccaccccaacccaau

SEQ ID NO: 560172 - RNA, 17 nt, Homo sapiens
guugcccagcacugucu

SEQ ID NO: 560173 - RNA, 23 nt, Homo sapiens
guugcccaggcuagagugcaaug

SEQ ID NO: 560174 - RNA, 13 nt, Homo sapiens
guugcccuaauaa

SEQ ID NO: 560175 - RNA, 15 nt, Homo sapiens
guugccucucuugcc

SEQ ID NO: 560176 - RNA, 16 nt, Homo sapiens
guugcgcgccugcucc

SEQ ID NO: 560177 - RNA, 18 nt, Homo sapiens
guugcuagucuaguuucc

SEQ ID NO: 560178 - RNA, 17 nt, Homo sapiens
guugcuauuuguauuuc

SEQ ID NO: 560179 - RNA, 11 nt, Homo sapiens
guugcucugac

SEQ ID NO: 560180 - RNA, 20 nt, Homo sapiens
guugcugcuugugaucucac

SEQ ID NO: 560181 - RNA, 15 nt, Homo sapiens
guugcuggacuguca

SEQ ID NO: 560182 - RNA, 14 nt, Homo sapiens
guugcuguuucaca

SEQ ID NO: 560183 - RNA, 18 nt, Homo sapiens
guuggaaaacacuuucau

SEQ ID NO: 560184 - RNA, 13 nt, Homo sapiens
guuggaacauccu

SEQ ID NO: 560185 - RNA, 21 nt, Homo sapiens
guuggaacugcauucuuuuaa

SEQ ID NO: 560186 - RNA, 22 nt, Homo sapiens
guuggaacuuacauacaugggg

SEQ ID NO: 560187 - RNA, 10 nt, Homo sapiens
guuggaagag

SEQ ID NO: 560188 - RNA, 13 nt, Homo sapiens
guuggaagcuugu

SEQ ID NO: 560189 - RNA, 14 nt, Homo sapiens
guuggaaucacugu

SEQ ID NO: 560190 - RNA, 12 nt, Homo sapiens
guuggacagccc

SEQ ID NO: 560191 - RNA, 18 nt, Homo sapiens
guuggaccagagugaugu

SEQ ID NO: 560192 - RNA, 18 nt, Homo sapiens
guuggacccgcucuggac

SEQ ID NO: 560193 - RNA, 15 nt, Homo sapiens
guuggagagcagcag

SEQ ID NO: 560194 - RNA, 13 nt, Homo sapiens
guuggaguauuua

SEQ ID NO: 560195 - RNA, 18 nt, Homo sapiens
guuggccugcacuggugu

SEQ ID NO: 560196 - RNA, 23 nt, Homo sapiens
guugggauaaggaaacacuucua

SEQ ID NO: 560197 - RNA, 13 nt, Homo sapiens
guuggugcugcuu

SEQ ID NO: 560198 - RNA, 18 nt, Homo sapiens
guuguaaccugcugugau

SEQ ID NO: 560199 - RNA, 13 nt, Homo sapiens
guuguaaguaaua

SEQ ID NO: 560200 - RNA, 17 nt, Homo sapiens
guuguaauaaaacuuau

SEQ ID NO: 560201 - RNA, 14 nt, Homo sapiens
guuguaaugcugca

SEQ ID NO: 560202 - RNA, 20 nt, Homo sapiens
guuguagcagguuucacuau

SEQ ID NO: 560203 - RNA, 14 nt, Homo sapiens
guuguagcauuuaa

SEQ ID NO: 560204 - RNA, 19 nt, Homo sapiens
guuguaucaaagugugaua

SEQ ID NO: 560205 - RNA, 16 nt, Homo sapiens
guuguauuaacaaaag

SEQ ID NO: 560206 - RNA, 14 nt, Homo sapiens
guugucauugcugu

SEQ ID NO: 560207 - RNA, 16 nt, Homo sapiens
guugucccaucugccc

SEQ ID NO: 560208 - RNA, 14 nt, Homo sapiens
guuguccuugcccc

SEQ ID NO: 560209 - RNA, 20 nt, Homo sapiens
guugucuacaccaaugccca

SEQ ID NO: 560210 - RNA, 13 nt, Homo sapiens
guugugacugcca

SEQ ID NO: 560211 - RNA, 12 nt, Homo sapiens
guuguguaguca

SEQ ID NO: 560212 - RNA, 16 nt, Homo sapiens
guuguguugucacuaa

SEQ ID NO: 560213 - RNA, 17 nt, Homo sapiens
guuguuaauguacaaaa

SEQ ID NO: 560214 - RNA, 13 nt, Homo sapiens
guuguuaugccau

SEQ ID NO: 560215 - RNA, 19 nt, Homo sapiens
guuguucuaguaacaauac

SEQ ID NO: 560216 - RNA, 20 nt, Homo sapiens
guuguugauugacugcauga

SEQ ID NO: 560217 - RNA, 12 nt, Homo sapiens
guuguuggcaag

SEQ ID NO: 560218 - RNA, 21 nt, Homo sapiens
guuguuuauauacaguacaca

SEQ ID NO: 560219 - RNA, 20 nt, Homo sapiens
guuguuugguuagugacuga

SEQ ID NO: 560220 - RNA, 14 nt, Homo sapiens
guuguuuguuuaaa

SEQ ID NO: 560221 - RNA, 14 nt, Homo sapiens
guuuaaagucacau

SEQ ID NO: 560222 - RNA, 18 nt, Homo sapiens
guuuaaaugauacaguau

SEQ ID NO: 560223 - RNA, 15 nt, Homo sapiens
guuuaaaugccaaaa

SEQ ID NO: 560224 - RNA, 20 nt, Homo sapiens
guuuaaauucuaguguccau

SEQ ID NO: 560225 - RNA, 19 nt, Homo sapiens
guuuaagccagaguguauu

SEQ ID NO: 560226 - RNA, 20 nt, Homo sapiens
guuuaagcccagccaaguaa

SEQ ID NO: 560227 - RNA, 12 nt, Homo sapiens
guuuaaggccac

SEQ ID NO: 560228 - RNA, 14 nt, Homo sapiens
guuuacaacuugau

SEQ ID NO: 560229 - RNA, 19 nt, Homo sapiens
guuuaccuuguauacugua

SEQ ID NO: 560230 - RNA, 19 nt, Homo sapiens
guuuacuuaucuuaugcca

SEQ ID NO: 560231 - RNA, 16 nt, Homo sapiens
guuuacuucucuaaaa

SEQ ID NO: 560232 - RNA, 14 nt, Homo sapiens
guuuacuuugccaa

SEQ ID NO: 560233 - RNA, 13 nt, Homo sapiens
guuuagaucccau

SEQ ID NO: 560234 - RNA, 18 nt, Homo sapiens
guuuagccaaaggauaag

SEQ ID NO: 560235 - RNA, 17 nt, Homo sapiens
guuuaguugcagacuca

SEQ ID NO: 560236 - RNA, 17 nt, Homo sapiens
guuuauacacuguguaa

SEQ ID NO: 560237 - RNA, 15 nt, Homo sapiens
guuuauagaccagaa

SEQ ID NO: 560238 - RNA, 20 nt, Homo sapiens
guuuauccaaaucuugaauu

SEQ ID NO: 560239 - RNA, 13 nt, Homo sapiens
guuuauccucuug

SEQ ID NO: 560240 - RNA, 13 nt, Homo sapiens
guuuaucucugag

SEQ ID NO: 560241 - RNA, 12 nt, Homo sapiens
guuuaugaauga

SEQ ID NO: 560242 - RNA, 14 nt, Homo sapiens
guuuaugcuaccua

SEQ ID NO: 560243 - RNA, 19 nt, Homo sapiens
guuuauggccacauuuaau

SEQ ID NO: 560244 - RNA, 13 nt, Homo sapiens
guuuauucuucca

SEQ ID NO: 560245 - RNA, 18 nt, Homo sapiens
guuuuuauaccagcuuaa

SEQ ID NO: 560246 - RNA, 12 nt, Homo sapiens
guuuuuccucuu

SEQ ID NO: 560247 - RNA, 17 nt, Homo sapiens
guuuuucugaagacagu

SEQ ID NO: 560248 - RNA, 17 nt, Homo sapiens
guuuuugauaaaguaau

SEQ ID NO: 560249 - RNA, 17 nt, Homo sapiens
guuuuuggaguguuaug

SEQ ID NO: 560250 - RNA, 22 nt, Homo sapiens
guuuuugggggguuuucuugcc

SEQ ID NO: 560251 - RNA, 18 nt, Homo sapiens
guuuuugucuaugaauau

SEQ ID NO: 560252 - RNA, 17 nt, Homo sapiens
guuuuuguuuuuugcca

SEQ ID NO: 560253 - RNA, 18 nt, Homo sapiens
guuuuuguuuuuugccau

SEQ ID NO: 560254 - RNA, 19 nt, Homo sapiens
guuuuuuauuaugcauuau

SEQ ID NO: 560255 - RNA, 20 nt, Homo sapiens
guuuuuucaucauaacauaa

SEQ ID NO: 560256 - RNA, 13 nt, Homo sapiens
guuuuuucuccag

SEQ ID NO: 560257 - RNA, 23 nt, Homo sapiens
guuuuuuucccucuccuguccuu

SEQ ID NO: 560258 - RNA, 15 nt, Homo sapiens
guuuuuuuggucacu

SEQ ID NO: 560259 - RNA, 23 nt, Homo sapiens
guuuuuuuuuuccacuuagaaau

SEQ ID NO: 560260 - RNA, 22 nt, Homo sapiens
uaaaaaaaaaauccauuuuaca

SEQ ID NO: 560261 - RNA, 19 nt, Homo sapiens
uaaaaaaaaaauuacuucc

SEQ ID NO: 560262 - RNA, 19 nt, Homo sapiens
uaaaaaaaacaauuccaca

SEQ ID NO: 560263 - RNA, 23 nt, Homo sapiens
uaaaaaaaaugauaaggcucuga

SEQ ID NO: 560264 - RNA, 11 nt, Homo sapiens
uaaaaaaagca

SEQ ID NO: 560265 - RNA, 19 nt, Homo sapiens
uaaaaaaauaaaaaagauc

SEQ ID NO: 560266 - RNA, 16 nt, Homo sapiens
uaaaaaaauuacugug

SEQ ID NO: 560267 - RNA, 20 nt, Homo sapiens
uaaaaaagaguuuagucguc

SEQ ID NO: 560268 - RNA, 12 nt, Homo sapiens
uaaggccugaau

SEQ ID NO: 560269 - RNA, 14 nt, Homo sapiens
uaagggacaacauc

SEQ ID NO: 560270 - RNA, 15 nt, Homo sapiens
uaagggcuacuuaau

SEQ ID NO: 560271 - RNA, 21 nt, Homo sapiens
uaagggcuggucucugcugaa

SEQ ID NO: 560272 - RNA, 23 nt, Homo sapiens
uaaggggggcagggagugaugau

SEQ ID NO: 560273 - RNA, 14 nt, Homo sapiens
uaagggucucucau

SEQ ID NO: 560274 - RNA, 15 nt, Homo sapiens
uaagguaauguaggg

SEQ ID NO: 560275 - RNA, 17 nt, Homo sapiens
uaagguaauucauggca

SEQ ID NO: 560276 - RNA, 20 nt, Homo sapiens
uaagguauuucgaaacugcc

SEQ ID NO: 560277 - RNA, 20 nt, Homo sapiens
uaaggucacauugugccuuu

SEQ ID NO: 560278 - RNA, 13 nt, Homo sapiens
uaaggucccuggg

SEQ ID NO: 560279 - RNA, 19 nt, Homo sapiens
uaaggucugacaucagagg

SEQ ID NO: 560280 - RNA, 13 nt, Homo sapiens
uaaggugaaauuu

SEQ ID NO: 560281 - RNA, 16 nt, Homo sapiens
uaagguggguccagga

SEQ ID NO: 560282 - RNA, 15 nt, Homo sapiens
uaaguaacauaacua

SEQ ID NO: 560283 - RNA, 18 nt, Homo sapiens
uaaguaaguuugauuuca

SEQ ID NO: 560284 - RNA, 20 nt, Homo sapiens
uaaguaaucuuuuuacaguu

SEQ ID NO: 560285 - RNA, 21 nt, Homo sapiens
uaaguaaucuuuuuacaguug

SEQ ID NO: 560286 - RNA, 21 nt, Homo sapiens
uaaguaauugccacagcugua

SEQ ID NO: 560287 - RNA, 19 nt, Homo sapiens
uaaguacacaauaagcaaa

SEQ ID NO: 560288 - RNA, 13 nt, Homo sapiens
uaaguacauauag

SEQ ID NO: 560289 - RNA, 13 nt, Homo sapiens
uaaguacuaugua

SEQ ID NO: 560290 - RNA, 20 nt, Homo sapiens
uaaguacuauguaucaauga

SEQ ID NO: 560291 - RNA, 14 nt, Homo sapiens
uaaguacuuugcug

SEQ ID NO: 560292 - RNA, 22 nt, Homo sapiens
uaaguaggaugaaucauauuca

SEQ ID NO: 560293 - RNA, 20 nt, Homo sapiens
uaaguauuucagaugcuuua

SEQ ID NO: 560294 - RNA, 21 nt, Homo sapiens
uaaguauuucccagcacauga

SEQ ID NO: 560295 - RNA, 18 nt, Homo sapiens
uaaguauuuuccuaagca

SEQ ID NO: 560296 - RNA, 17 nt, Homo sapiens
uaagucaaccugccuga

SEQ ID NO: 560297 - RNA, 20 nt, Homo sapiens
uaagucaagaucaacauucc

SEQ ID NO: 560298 - RNA, 21 nt, Homo sapiens
uaagucaagaucaacauucca

SEQ ID NO: 560299 - RNA, 12 nt, Homo sapiens
uaagucagggaa

SEQ ID NO: 560300 - RNA, 15 nt, Homo sapiens
uaaguccaaauccaa

SEQ ID NO: 560301 - RNA, 19 nt, Homo sapiens
uaaguccuguauauguaug

SEQ ID NO: 560302 - RNA, 20 nt, Homo sapiens
uaagugauauaaaucagauu

SEQ ID NO: 560303 - RNA, 22 nt, Homo sapiens
uaagugaugagggccucugcau

SEQ ID NO: 560304 - RNA, 19 nt, Homo sapiens
uaagugaugugcugaauuu

SEQ ID NO: 560305 - RNA, 17 nt, Homo sapiens
uaagugcuaagugcuua

SEQ ID NO: 560306 - RNA, 19 nt, Homo sapiens
uaagugcuuuguaauggga

SEQ ID NO: 560307 - RNA, 22 nt, Homo sapiens
uaaguggcuuuuuaacaugaaa

SEQ ID NO: 560308 - RNA, 21 nt, Homo sapiens
uaagugggguagacugaggga

SEQ ID NO: 560309 - RNA, 23 nt, Homo sapiens
uaaguggggugggaaggggagca

SEQ ID NO: 560310 - RNA, 20 nt, Homo sapiens
uaagugggguugcaaccacu

SEQ ID NO: 560311 - RNA, 13 nt, Homo sapiens
uaaguguacaauu

SEQ ID NO: 560312 - RNA, 15 nt, Homo sapiens
uaaguguucucauga

SEQ ID NO: 560313 - RNA, 16 nt, Homo sapiens
uaaguucuuaugagga

SEQ ID NO: 560314 - RNA, 15 nt, Homo sapiens
uaaguugagaacuua

SEQ ID NO: 560315 - RNA, 23 nt, Homo sapiens
uaaguuguagaaauuaacaaaug

SEQ ID NO: 560316 - RNA, 15 nt, Homo sapiens
uaaguuugauuucau

SEQ ID NO: 560317 - RNA, 18 nt, Homo sapiens
uaaguuuuguguguauau

SEQ ID NO: 560318 - RNA, 18 nt, Homo sapiens
uaauaaaaauuauuacca

SEQ ID NO: 560319 - RNA, 20 nt, Homo sapiens
uaauaaaaauuguagcuuuu

SEQ ID NO: 560320 - RNA, 17 nt, Homo sapiens
uaauaaaaggaguucag

SEQ ID NO: 560321 - RNA, 22 nt, Homo sapiens
uaauaaaaguauucuuguuaga

SEQ ID NO: 560322 - RNA, 15 nt, Homo sapiens
uaauaaaccuccuuc

SEQ ID NO: 560323 - RNA, 13 nt, Homo sapiens
uaauaaacugugu

SEQ ID NO: 560324 - RNA, 17 nt, Homo sapiens
uaauaaagcauucuuua

SEQ ID NO: 560325 - RNA, 13 nt, Homo sapiens
uaauaaaggccac

SEQ ID NO: 560326 - RNA, 14 nt, Homo sapiens
uaauaaaguagcaa

SEQ ID NO: 560327 - RNA, 15 nt, Homo sapiens
uaauaaaguauauaa

SEQ ID NO: 560328 - RNA, 17 nt, Homo sapiens
uaauaaaugaaugucac

SEQ ID NO: 560329 - RNA, 19 nt, Homo sapiens
uaauaaauugacauaacca

SEQ ID NO: 560330 - RNA, 20 nt, Homo sapiens
uaauaaauugcuuacugaua

SEQ ID NO: 560331 - RNA, 20 nt, Homo sapiens
uaauaacaacagaucugcag

SEQ ID NO: 560332 - RNA, 12 nt, Homo sapiens
uaauaacuuauc

SEQ ID NO: 560333 - RNA, 20 nt, Homo sapiens
uaauaagauauuuaguaaua

SEQ ID NO: 560334 - RNA, 11 nt, Homo sapiens
uaauaagcaau

SEQ ID NO: 560335 - RNA, 19 nt, Homo sapiens
uaauaagcaaucaagguua

SEQ ID NO: 560336 - RNA, 14 nt, Homo sapiens
uaauaagcacuugc

SEQ ID NO: 560337 - RNA, 21 nt, Homo sapiens
uaauaauagaaaaauacucau

SEQ ID NO: 560338 - RNA, 17 nt, Homo sapiens
uaauaauaguaauuccu

SEQ ID NO: 560339 - RNA, 13 nt, Homo sapiens
uaauaauuauuca

SEQ ID NO: 560340 - RNA, 15 nt, Homo sapiens
uaauacaaacuaauu

SEQ ID NO: 560341 - RNA, 14 nt, Homo sapiens
uaauacaaacuaua

SEQ ID NO: 560342 - RNA, 23 nt, Homo sapiens
uaauacagaaucaacauuuaguc

SEQ ID NO: 560343 - RNA, 14 nt, Homo sapiens
uaauacagcagugu

SEQ ID NO: 560344 - RNA, 15 nt, Homo sapiens
uaauacagggcauuu

SEQ ID NO: 560345 - RNA, 21 nt, Homo sapiens
uaauacaguuuucuauucuug

SEQ ID NO: 560346 - RNA, 19 nt, Homo sapiens
uaauacauugaucaggcca

SEQ ID NO: 560347 - RNA, 14 nt, Homo sapiens
uaauacuacugugu

SEQ ID NO: 560348 - RNA, 22 nt, Homo sapiens
uaauacuccagagacagggaaa

SEQ ID NO: 560349 - RNA, 23 nt, Homo sapiens
uaauacugguauuuuuacuuaau

SEQ ID NO: 560350 - RNA, 22 nt, Homo sapiens
uaauacuuaaauaaacaugacc

SEQ ID NO: 560351 - RNA, 23 nt, Homo sapiens
uaauacuugaccucugugaccaa

SEQ ID NO: 560352 - RNA, 14 nt, Homo sapiens
uaauagaaagccag

SEQ ID NO: 560353 - RNA, 19 nt, Homo sapiens
uaauagacuuaauacaugc

SEQ ID NO: 560354 - RNA, 13 nt, Homo sapiens
uaauagacuucuc

SEQ ID NO: 560355 - RNA, 23 nt, Homo sapiens
uaauagagauuaaaaacaacaaa

SEQ ID NO: 560356 - RNA, 18 nt, Homo sapiens
uaauagaggcagugagac

SEQ ID NO: 560357 - RNA, 19 nt, Homo sapiens
uaauagauuguuuugccac

SEQ ID NO: 560358 - RNA, 23 nt, Homo sapiens
uaauagcugccuucaaggacugu

SEQ ID NO: 560359 - RNA, 11 nt, Homo sapiens
uaauagcuuuu

SEQ ID NO: 560360 - RNA, 19 nt, Homo sapiens
uaauagcuuuuauuguaua

SEQ ID NO: 560361 - RNA, 23 nt, Homo sapiens
uaauaggaauucaauuuggcaaa

SEQ ID NO: 560362 - RNA, 15 nt, Homo sapiens
uaauaguucagugua

SEQ ID NO: 560363 - RNA, 22 nt, Homo sapiens
uaauauaaaaagcuuccaugau

SEQ ID NO: 560364 - RNA, 12 nt, Homo sapiens
uaauauacuuua

SEQ ID NO: 560365 - RNA, 19 nt, Homo sapiens
uaauaucaaaugcaguaua

SEQ ID NO: 560366 - RNA, 15 nt, Homo sapiens
uaauaucaacucuga

SEQ ID NO: 560367 - RNA, 14 nt, Homo sapiens
uaauauccauauag

SEQ ID NO: 560368 - RNA, 13 nt, Homo sapiens
uaauaucuucaca

SEQ ID NO: 560369 - RNA, 22 nt, Homo sapiens
uaauaugaagcaggaucacaaa

SEQ ID NO: 560370 - RNA, 14 nt, Homo sapiens
uaauaugauucuag

SEQ ID NO: 560371 - RNA, 13 nt, Homo sapiens
uaauaugcugcaa

SEQ ID NO: 560372 - RNA, 14 nt, Homo sapiens
uaauaugcugccaa

SEQ ID NO: 560373 - RNA, 16 nt, Homo sapiens
uaauauguacuuugag

SEQ ID NO: 560374 - RNA, 16 nt, Homo sapiens
uaccauuuuacauuuc

SEQ ID NO: 560375 - RNA, 20 nt, Homo sapiens
uacccagagaauauauacau

SEQ ID NO: 560376 - RNA, 19 nt, Homo sapiens
uacccagcuucaaacuaua

SEQ ID NO: 560377 - RNA, 19 nt, Homo sapiens
uacccaggaccaagccaca

SEQ ID NO: 560378 - RNA, 19 nt, Homo sapiens
uacccauagcuuccaugag

SEQ ID NO: 560379 - RNA, 14 nt, Homo sapiens
uacccaugaagauu

SEQ ID NO: 560380 - RNA, 23 nt, Homo sapiens
uaccccaccacgauguggcccug

SEQ ID NO: 560381 - RNA, 13 nt, Homo sapiens
uaccccauacccc

SEQ ID NO: 560382 - RNA, 16 nt, Homo sapiens
uaccccccuaccacac

SEQ ID NO: 560383 - RNA, 21 nt, Homo sapiens
uaccccuggcuguacugcuca

SEQ ID NO: 560384 - RNA, 12 nt, Homo sapiens
uacccucccacc

SEQ ID NO: 560385 - RNA, 17 nt, Homo sapiens
uacccucgcaugacugu

SEQ ID NO: 560386 - RNA, 19 nt, Homo sapiens
guuaucuguguagcaagcu

SEQ ID NO: 560387 - RNA, 16 nt, Homo sapiens
guuaucuuagcuggau

SEQ ID NO: 560388 - RNA, 13 nt, Homo sapiens
guuaugaacaaag

SEQ ID NO: 560389 - RNA, 13 nt, Homo sapiens
guuaugacaguga

SEQ ID NO: 560390 - RNA, 21 nt, Homo sapiens
guuaugagaaauuagucacuu

SEQ ID NO: 560391 - RNA, 17 nt, Homo sapiens
guuaugauguaaucucu

SEQ ID NO: 560392 - RNA, 12 nt, Homo sapiens
guuaugccauga

SEQ ID NO: 560393 - RNA, 16 nt, Homo sapiens
guuaugugcaguacuu

SEQ ID NO: 560394 - RNA, 19 nt, Homo sapiens
guuauuaauuaauauucau

SEQ ID NO: 560395 - RNA, 19 nt, Homo sapiens
guuauuacagggcauucaa

SEQ ID NO: 560396 - RNA, 18 nt, Homo sapiens
guuauucuaguacuagaa

SEQ ID NO: 560397 - RNA, 16 nt, Homo sapiens
guuauugaaucuuaau

SEQ ID NO: 560398 - RNA, 16 nt, Homo sapiens
guuauugcacaaguuc

SEQ ID NO: 560399 - RNA, 14 nt, Homo sapiens
guuauugccucuac

SEQ ID NO: 560400 - RNA, 17 nt, Homo sapiens
guuauugccucuacuuu

SEQ ID NO: 560401 - RNA, 15 nt, Homo sapiens
guuauugugaaugau

SEQ ID NO: 560402 - RNA, 19 nt, Homo sapiens
guuauuguuguugccaaag

SEQ ID NO: 560403 - RNA, 15 nt, Homo sapiens
guuauuuacacuggu

SEQ ID NO: 560404 - RNA, 23 nt, Homo sapiens
guuauuuauuuccuuagugccag

SEQ ID NO: 560405 - RNA, 15 nt, Homo sapiens
guuauuuuaauuauc

SEQ ID NO: 560406 - RNA, 20 nt, Homo sapiens
guucaaaacauucauaggca

SEQ ID NO: 560407 - RNA, 17 nt, Homo sapiens
guucaaauccucaccau

SEQ ID NO: 560408 - RNA, 20 nt, Homo sapiens
guucaaaugcccuuccagug

SEQ ID NO: 560409 - RNA, 16 nt, Homo sapiens
guucaagaggcgugug

SEQ ID NO: 560410 - RNA, 15 nt, Homo sapiens
guucaauaaagcacu

SEQ ID NO: 560411 - RNA, 20 nt, Homo sapiens
guucaauaaagcacugagca

SEQ ID NO: 560412 - RNA, 20 nt, Homo sapiens
guucaaucucccgcugcugc

SEQ ID NO: 560413 - RNA, 18 nt, Homo sapiens
guucaaugcuagaacaac

SEQ ID NO: 560414 - RNA, 13 nt, Homo sapiens
guucaauguucca

SEQ ID NO: 560415 - RNA, 16 nt, Homo sapiens
guucacaaacugugaa

SEQ ID NO: 560416 - RNA, 15 nt, Homo sapiens
guucacaacagugaa

SEQ ID NO: 560417 - RNA, 16 nt, Homo sapiens
guucacucccaaccug

SEQ ID NO: 560418 - RNA, 14 nt, Homo sapiens
guucagaacacuuu

SEQ ID NO: 560419 - RNA, 14 nt, Homo sapiens
guucagaguggcuc

SEQ ID NO: 560420 - RNA, 14 nt, Homo sapiens
guucagaugugcau

SEQ ID NO: 560421 - RNA, 21 nt, Homo sapiens
guucagccuucguguggcucc

SEQ ID NO: 560422 - RNA, 12 nt, Homo sapiens
guucaggccagu

SEQ ID NO: 560423 - RNA, 16 nt, Homo sapiens
guucagggcugugauc

SEQ ID NO: 560424 - RNA, 20 nt, Homo sapiens
guucaguacucuacaauucc

SEQ ID NO: 560425 - RNA, 13 nt, Homo sapiens
guucaguucuguu

SEQ ID NO: 560426 - RNA, 17 nt, Homo sapiens
guucauauuaugaugcc

SEQ ID NO: 560427 - RNA, 21 nt, Homo sapiens
guucaucagacuccugugcaa

SEQ ID NO: 560428 - RNA, 23 nt, Homo sapiens
guucaucauccuaagcuauucag

SEQ ID NO: 560429 - RNA, 17 nt, Homo sapiens
guucauccaggcccaac

SEQ ID NO: 560430 - RNA, 19 nt, Homo sapiens
guucauggguuuaccacua

SEQ ID NO: 560431 - RNA, 19 nt, Homo sapiens
guucauuacuuuuucauau

SEQ ID NO: 560432 - RNA, 13 nt, Homo sapiens
guucauugcaaac

SEQ ID NO: 560433 - RNA, 16 nt, Homo sapiens
guucauugcacuuuga

SEQ ID NO: 560434 - RNA, 22 nt, Homo sapiens
guucauuggcaagaugaaauaa

SEQ ID NO: 560435 - RNA, 19 nt, Homo sapiens
guucauuucacacagugaa

SEQ ID NO: 560436 - RNA, 19 nt, Homo sapiens
guuccaagaaagauccacc

SEQ ID NO: 560437 - RNA, 16 nt, Homo sapiens
guuccacagaggacac

SEQ ID NO: 560438 - RNA, 20 nt, Homo sapiens
guuccaccuggggcuucccu

SEQ ID NO: 560439 - RNA, 12 nt, Homo sapiens
guuccagacuca

SEQ ID NO: 560440 - RNA, 15 nt, Homo sapiens
guuccagauguggau

SEQ ID NO: 560441 - RNA, 15 nt, Homo sapiens
guuccaguugcuuga

SEQ ID NO: 560442 - RNA, 13 nt, Homo sapiens
guuccaugcagcc

SEQ ID NO: 560443 - RNA, 23 nt, Homo sapiens
guuccauuuuuccucuguucaca

SEQ ID NO: 560444 - RNA, 20 nt, Homo sapiens
guucccauuuuugcuuagcu

SEQ ID NO: 560445 - RNA, 17 nt, Homo sapiens
guuccccacacagggca

SEQ ID NO: 560446 - RNA, 14 nt, Homo sapiens
guuccccacugaca

SEQ ID NO: 560447 - RNA, 20 nt, Homo sapiens
guuccccuaguucuacauga

SEQ ID NO: 560448 - RNA, 13 nt, Homo sapiens
guucccuccugcc

SEQ ID NO: 560449 - RNA, 13 nt, Homo sapiens
guucccuguucug

SEQ ID NO: 560450 - RNA, 15 nt, Homo sapiens
guucccuguucuucc

SEQ ID NO: 560451 - RNA, 19 nt, Homo sapiens
guucccuguucuuccucca

SEQ ID NO: 560452 - RNA, 21 nt, Homo sapiens
guuccgccucccggguucaca

SEQ ID NO: 560453 - RNA, 12 nt, Homo sapiens
guuccucaaaag

SEQ ID NO: 560454 - RNA, 17 nt, Homo sapiens
guuccucaagguccauu

SEQ ID NO: 560455 - RNA, 18 nt, Homo sapiens
guuccucucccuucccuu

SEQ ID NO: 560456 - RNA, 23 nt, Homo sapiens
guuccucuuuucuuucaagaacu

SEQ ID NO: 560457 - RNA, 21 nt, Homo sapiens
guuccuguucgguuccagaca

SEQ ID NO: 560458 - RNA, 20 nt, Homo sapiens
guuccuuacuuuacugccug

SEQ ID NO: 560459 - RNA, 17 nt, Homo sapiens
guuccuuggggggccaa

SEQ ID NO: 560460 - RNA, 16 nt, Homo sapiens
guucgagaccaaccug

SEQ ID NO: 560461 - RNA, 20 nt, Homo sapiens
guucgagaccagccuggcca

SEQ ID NO: 560462 - RNA, 20 nt, Homo sapiens
guucgcauggucacacacug

SEQ ID NO: 560463 - RNA, 13 nt, Homo sapiens
guucgcuuaucaa

SEQ ID NO: 560464 - RNA, 22 nt, Homo sapiens
guucuaagaaacccucugucau

SEQ ID NO: 560465 - RNA, 15 nt, Homo sapiens
guucuaaguucaugu

SEQ ID NO: 560466 - RNA, 13 nt, Homo sapiens
guucuacacugau

SEQ ID NO: 560467 - RNA, 18 nt, Homo sapiens
guucuaccaagaacugaa

SEQ ID NO: 560468 - RNA, 17 nt, Homo sapiens
guucuagacuuccccau

SEQ ID NO: 560469 - RNA, 21 nt, Homo sapiens
guucuaucaggggugcauucu

SEQ ID NO: 560470 - RNA, 13 nt, Homo sapiens
guucuaucccacc

SEQ ID NO: 560471 - RNA, 12 nt, Homo sapiens
guucuaugagaa

SEQ ID NO: 560472 - RNA, 20 nt, Homo sapiens
guucuauuuaacaacugggu

SEQ ID NO: 560473 - RNA, 17 nt, Homo sapiens
guucuauuuguauauau

SEQ ID NO: 560474 - RNA, 13 nt, Homo sapiens
guucucacuggga

SEQ ID NO: 560475 - RNA, 19 nt, Homo sapiens
guucucaggaccuguucaa

SEQ ID NO: 560476 - RNA, 20 nt, Homo sapiens
guucucagguguugccaaau

SEQ ID NO: 560477 - RNA, 19 nt, Homo sapiens
guucucaugaacuacccca

SEQ ID NO: 560478 - RNA, 13 nt, Homo sapiens
guucucauuugau

SEQ ID NO: 560479 - RNA, 20 nt, Homo sapiens
guucucauuuggucugccag

SEQ ID NO: 560480 - RNA, 21 nt, Homo sapiens
guucucauuuuuaucccauug

SEQ ID NO: 560481 - RNA, 23 nt, Homo sapiens
uacccugacacaagaaguucuug

SEQ ID NO: 560482 - RNA, 15 nt, Homo sapiens
uacccugaucuggac

SEQ ID NO: 560483 - RNA, 23 nt, Homo sapiens
uacccugcgcccaguccuuccac

SEQ ID NO: 560484 - RNA, 16 nt, Homo sapiens
uacccuucuuguccaa

SEQ ID NO: 560485 - RNA, 15 nt, Homo sapiens
uacccuuucauucag

SEQ ID NO: 560486 - RNA, 16 nt, Homo sapiens
uacccuuuggggagca

SEQ ID NO: 560487 - RNA, 21 nt, Homo sapiens
uaccgagccccugaacugcug

SEQ ID NO: 560488 - RNA, 16 nt, Homo sapiens
uaccuaacauuauuua

SEQ ID NO: 560489 - RNA, 15 nt, Homo sapiens
uaccuaauuguggau

SEQ ID NO: 560490 - RNA, 15 nt, Homo sapiens
uaccuaccacagugu

SEQ ID NO: 560491 - RNA, 21 nt, Homo sapiens
uaccuagagucaacucuggcc

SEQ ID NO: 560492 - RNA, 19 nt, Homo sapiens
uaccuagcuggcucuguga

SEQ ID NO: 560493 - RNA, 20 nt, Homo sapiens
uaccuaggcaacauggugaa

SEQ ID NO: 560494 - RNA, 14 nt, Homo sapiens
uaccuaguuugcac

SEQ ID NO: 560495 - RNA, 16 nt, Homo sapiens
uaccuaguuugcacua

SEQ ID NO: 560496 - RNA, 17 nt, Homo sapiens
uaccuauuucugaugau

SEQ ID NO: 560497 - RNA, 13 nt, Homo sapiens
uaccuauuugacu

SEQ ID NO: 560498 - RNA, 13 nt, Homo sapiens
uaccucaaccaau

SEQ ID NO: 560499 - RNA, 19 nt, Homo sapiens
uaccucacagagugcauug

SEQ ID NO: 560500 - RNA, 18 nt, Homo sapiens
uaccucacuaugcugcuu

SEQ ID NO: 560501 - RNA, 14 nt, Homo sapiens
uaccucacuggggu

SEQ ID NO: 560502 - RNA, 11 nt, Homo sapiens
uaccucagcuu

SEQ ID NO: 560503 - RNA, 19 nt, Homo sapiens
uaccucauccaugcacuuu

SEQ ID NO: 560504 - RNA, 20 nt, Homo sapiens
uaccucauccaugcacuuua

SEQ ID NO: 560505 - RNA, 19 nt, Homo sapiens
uaccucuaauaguccuguc

SEQ ID NO: 560506 - RNA, 15 nt, Homo sapiens
uaccucuauauacca

SEQ ID NO: 560507 - RNA, 19 nt, Homo sapiens
uaccucuauauaccaaagc

SEQ ID NO: 560508 - RNA, 18 nt, Homo sapiens
uaccucuucucucucagu

SEQ ID NO: 560509 - RNA, 17 nt, Homo sapiens
uaccugaaagacaguau

SEQ ID NO: 560510 - RNA, 14 nt, Homo sapiens
uaccugagagauuu

SEQ ID NO: 560511 - RNA, 19 nt, Homo sapiens
uaccugagauggaggaguc

SEQ ID NO: 560512 - RNA, 15 nt, Homo sapiens
uaccugaggccagga

SEQ ID NO: 560513 - RNA, 23 nt, Homo sapiens
uaccugauggaaguaaagccuca

SEQ ID NO: 560514 - RNA, 21 nt, Homo sapiens
uaccugcccccaauccaugaa

SEQ ID NO: 560515 - RNA, 14 nt, Homo sapiens
uaccuggaguuuaa

SEQ ID NO: 560516 - RNA, 20 nt, Homo sapiens
uaccuggauguucuuuuuac

SEQ ID NO: 560517 - RNA, 17 nt, Homo sapiens
uaccuggcaauucacaa

SEQ ID NO: 560518 - RNA, 20 nt, Homo sapiens
uaccuguggugauguugcca

SEQ ID NO: 560519 - RNA, 11 nt, Homo sapiens
uaccuguguac

SEQ ID NO: 560520 - RNA, 15 nt, Homo sapiens
uaccuguuauuuauc

SEQ ID NO: 560521 - RNA, 15 nt, Homo sapiens
uaccuguuccauugu

SEQ ID NO: 560522 - RNA, 18 nt, Homo sapiens
uaccuuaagagacacucc

SEQ ID NO: 560523 - RNA, 23 nt, Homo sapiens
uaccuuagauuagcucuggacca

SEQ ID NO: 560524 - RNA, 23 nt, Homo sapiens
uaccuucaugugauucacugccu

SEQ ID NO: 560525 - RNA, 19 nt, Homo sapiens
uaccuugcuuuugcuucua

SEQ ID NO: 560526 - RNA, 16 nt, Homo sapiens
uaccuuguagcagugu

SEQ ID NO: 560527 - RNA, 22 nt, Homo sapiens
uaccuuguggaugcuagugcug

SEQ ID NO: 560528 - RNA, 15 nt, Homo sapiens
uaccuuucagugcag

SEQ ID NO: 560529 - RNA, 15 nt, Homo sapiens
uaccuuuccugaugc

SEQ ID NO: 560530 - RNA, 16 nt, Homo sapiens
uaccuuucuagccuua

SEQ ID NO: 560531 - RNA, 16 nt, Homo sapiens
uaccuuuuauguagca

SEQ ID NO: 560532 - RNA, 14 nt, Homo sapiens
uaccuuuucagggc

SEQ ID NO: 560533 - RNA, 12 nt, Homo sapiens
uacgaaaagcca

SEQ ID NO: 560534 - RNA, 15 nt, Homo sapiens
uacgaaaagccagcu

SEQ ID NO: 560535 - RNA, 18 nt, Homo sapiens
uacgaaaaucccaugaga

SEQ ID NO: 560536 - RNA, 16 nt, Homo sapiens
uacgaagacaaagucc

SEQ ID NO: 560537 - RNA, 16 nt, Homo sapiens
uacgcaaaaacuuccu

SEQ ID NO: 560538 - RNA, 20 nt, Homo sapiens
uacgcagaacuaccaggugg

SEQ ID NO: 560539 - RNA, 13 nt, Homo sapiens
uacgccaggggaa

SEQ ID NO: 560540 - RNA, 15 nt, Homo sapiens
uacggagaaacucau

SEQ ID NO: 560541 - RNA, 19 nt, Homo sapiens
uacggcaaccacauguccc

SEQ ID NO: 560542 - RNA, 13 nt, Homo sapiens
uacggcuaccugg

SEQ ID NO: 560543 - RNA, 12 nt, Homo sapiens
uacgggccaguu

SEQ ID NO: 560544 - RNA, 15 nt, Homo sapiens
uacgggccaguuucu

SEQ ID NO: 560545 - RNA, 16 nt, Homo sapiens
uacgugaaaugcucaa

SEQ ID NO: 560546 - RNA, 11 nt, Homo sapiens
uacgugcauuu

SEQ ID NO: 560547 - RNA, 12 nt, Homo sapiens
uacgugccacuc

SEQ ID NO: 560548 - RNA, 22 nt, Homo sapiens
uacguuccuauugucauuaaag

SEQ ID NO: 560549 - RNA, 13 nt, Homo sapiens
uacguugugcauu

SEQ ID NO: 560550 - RNA, 19 nt, Homo sapiens
uacuaaacuucaccuacau

SEQ ID NO: 560551 - RNA, 18 nt, Homo sapiens
uacuaaaguuuuacagaa

SEQ ID NO: 560552 - RNA, 13 nt, Homo sapiens
uacuaaaugugca

SEQ ID NO: 560553 - RNA, 12 nt, Homo sapiens
uacuaaccugga

SEQ ID NO: 560554 - RNA, 23 nt, Homo sapiens
uacuaagauguucacuguggcau

SEQ ID NO: 560555 - RNA, 16 nt, Homo sapiens
uacuaagcauagcaaa

SEQ ID NO: 560556 - RNA, 16 nt, Homo sapiens
uacuaaggaaucuuuc

SEQ ID NO: 560557 - RNA, 15 nt, Homo sapiens
uacuaaggagcauga

SEQ ID NO: 560558 - RNA, 20 nt, Homo sapiens
uacuaaggaguaaucugugu

SEQ ID NO: 560559 - RNA, 21 nt, Homo sapiens
uacuaauuccacaccuuuuau

SEQ ID NO: 560560 - RNA, 15 nt, Homo sapiens
uacuacacugaggag

SEQ ID NO: 560561 - RNA, 17 nt, Homo sapiens
uacuacccgagcccagc

SEQ ID NO: 560562 - RNA, 16 nt, Homo sapiens
uacuaccuguaaugac

SEQ ID NO: 560563 - RNA, 13 nt, Homo sapiens
uacuaccuugaaa

SEQ ID NO: 560564 - RNA, 19 nt, Homo sapiens
uacuacggagaaacucauc

SEQ ID NO: 560565 - RNA, 11 nt, Homo sapiens
uacuagccucu

SEQ ID NO: 560566 - RNA, 21 nt, Homo sapiens
uacuagcuuuugaaauccaga

SEQ ID NO: 560567 - RNA, 15 nt, Homo sapiens
uacuagggaaguuga

SEQ ID NO: 560568 - RNA, 13 nt, Homo sapiens
uacuagugccauu

SEQ ID NO: 560569 - RNA, 18 nt, Homo sapiens
uacuaguucagacacuuu

SEQ ID NO: 560570 - RNA, 14 nt, Homo sapiens
uacuaguuuucaau

SEQ ID NO: 560571 - RNA, 22 nt, Homo sapiens
uacuauaaaagcuuucugccac

SEQ ID NO: 560572 - RNA, 16 nt, Homo sapiens
uacuauacagccauaa

SEQ ID NO: 560573 - RNA, 15 nt, Homo sapiens
uacuaucauaauuca

SEQ ID NO: 560574 - RNA, 16 nt, Homo sapiens
uacuaucauggcauau

SEQ ID NO: 560575 - RNA, 15 nt, Homo sapiens
uacuaucauucucag

SEQ ID NO: 560576 - RNA, 21 nt, Homo sapiens
uacuauccuguaaauauaucu

SEQ ID NO: 560577 - RNA, 17 nt, Homo sapiens
uacuauucccuuugacu

SEQ ID NO: 560578 - RNA, 18 nt, Homo sapiens
uacuauuuuuauacuuua

SEQ ID NO: 560579 - RNA, 12 nt, Homo sapiens
uacucaaaagag

SEQ ID NO: 560580 - RNA, 15 nt, Homo sapiens
uacucaacauuauua

SEQ ID NO: 560581 - RNA, 20 nt, Homo sapiens
uacucacacuaugugcaaaa

SEQ ID NO: 560582 - RNA, 17 nt, Homo sapiens
uacucagaauagcuguu

SEQ ID NO: 560583 - RNA, 14 nt, Homo sapiens
uacucagcauuuga

SEQ ID NO: 560584 - RNA, 19 nt, Homo sapiens
uacucaggaggcugaggca

SEQ ID NO: 560585 - RNA, 17 nt, Homo sapiens
uacucaggcaaggggca

SEQ ID NO: 560586 - RNA, 12 nt, Homo sapiens
uacucaucagag

SEQ ID NO: 560587 - RNA, 18 nt, Homo sapiens
uacucaucagagcagcua

SEQ ID NO: 560588 - RNA, 16 nt, Homo sapiens
uacucaugugcaauag

SEQ ID NO: 560589 - RNA, 17 nt, Homo sapiens
uacuccauauucuuccc

SEQ ID NO: 560590 - RNA, 15 nt, Homo sapiens
uacucccagcacuuu

SEQ ID NO: 560591 - RNA, 21 nt, Homo sapiens
uacucccccaccacucaggcc

SEQ ID NO: 560592 - RNA, 20 nt, Homo sapiens
uacucccucuucacuguggc

SEQ ID NO: 560593 - RNA, 12 nt, Homo sapiens
uagaaacacagu

SEQ ID NO: 560594 - RNA, 14 nt, Homo sapiens
uagaaacauuguaa

SEQ ID NO: 560595 - RNA, 15 nt, Homo sapiens
uagaaagaugacaaa

SEQ ID NO: 560596 - RNA, 16 nt, Homo sapiens
uagaaagauggggcau

SEQ ID NO: 560597 - RNA, 20 nt, Homo sapiens
uagaaagcauaacaaaaaga

SEQ ID NO: 560598 - RNA, 19 nt, Homo sapiens
uagaaagcauuuugggauc

SEQ ID NO: 560599 - RNA, 21 nt, Homo sapiens
uagaaagcuggcaacaugaag

SEQ ID NO: 560600 - RNA, 16 nt, Homo sapiens
uagaaaggucauccaa

SEQ ID NO: 560601 - RNA, 19 nt, Homo sapiens
uagaaaggucauccaaaga

SEQ ID NO: 560602 - RNA, 21 nt, Homo sapiens
uagaaauaagcccaacagaca

SEQ ID NO: 560603 - RNA, 19 nt, Homo sapiens
uagaaauauagccaaaaau

SEQ ID NO: 560604 - RNA, 22 nt, Homo sapiens
uagaaauaucuaaggucauuaa

SEQ ID NO: 560605 - RNA, 16 nt, Homo sapiens
uagaaaugagaccaca

SEQ ID NO: 560606 - RNA, 15 nt, Homo sapiens
uagaacaaagggcac

SEQ ID NO: 560607 - RNA, 17 nt, Homo sapiens
uagaacacacacacuua

SEQ ID NO: 560608 - RNA, 15 nt, Homo sapiens
uagaacacaguuugu

SEQ ID NO: 560609 - RNA, 16 nt, Homo sapiens
uagaacacugcauuag

SEQ ID NO: 560610 - RNA, 17 nt, Homo sapiens
uagaacaucccugggca

SEQ ID NO: 560611 - RNA, 17 nt, Homo sapiens
uagaaccuggagccacu

SEQ ID NO: 560612 - RNA, 17 nt, Homo sapiens
uagaacguaaccacgga

SEQ ID NO: 560613 - RNA, 14 nt, Homo sapiens
uagaacuacuuuga

SEQ ID NO: 560614 - RNA, 18 nt, Homo sapiens
uagaacuauuaaaacagc

SEQ ID NO: 560615 - RNA, 23 nt, Homo sapiens
uagaacucugggcugccauguga

SEQ ID NO: 560616 - RNA, 20 nt, Homo sapiens
uagaacuucaagaaguaaga

SEQ ID NO: 560617 - RNA, 17 nt, Homo sapiens
uagaacuucucuaagcc

SEQ ID NO: 560618 - RNA, 12 nt, Homo sapiens
uagaacuugcag

SEQ ID NO: 560619 - RNA, 15 nt, Homo sapiens
uagaacuuucugcuu

SEQ ID NO: 560620 - RNA, 16 nt, Homo sapiens
uagaagaagaggaaga

SEQ ID NO: 560621 - RNA, 15 nt, Homo sapiens
uagaagaagcccaua

SEQ ID NO: 560622 - RNA, 13 nt, Homo sapiens
uagaagacaauuu

SEQ ID NO: 560623 - RNA, 22 nt, Homo sapiens
uagaagacagacaucuguggaa

SEQ ID NO: 560624 - RNA, 18 nt, Homo sapiens
uagaagauuuuaugcugc

SEQ ID NO: 560625 - RNA, 14 nt, Homo sapiens
uagaagccaaggga

SEQ ID NO: 560626 - RNA, 22 nt, Homo sapiens
uagaagccacuauuacugggac

SEQ ID NO: 560627 - RNA, 15 nt, Homo sapiens
uagaagccaucugac

SEQ ID NO: 560628 - RNA, 17 nt, Homo sapiens
uagaagccaugggaccu

SEQ ID NO: 560629 - RNA, 21 nt, Homo sapiens
uagaagcuguaguagcccuuu

SEQ ID NO: 560630 - RNA, 24 nt, Homo sapiens
uagaaggauggcaucuccauguag

SEQ ID NO: 560631 - RNA, 17 nt, Homo sapiens
uagaaggccacauguca

SEQ ID NO: 560632 - RNA, 21 nt, Homo sapiens
uagaaguauaaggugcucuga

SEQ ID NO: 560633 - RNA, 19 nt, Homo sapiens
uagaagugugaagugcaga

SEQ ID NO: 560634 - RNA, 14 nt, Homo sapiens
uagaaguuacuuaa

SEQ ID NO: 560635 - RNA, 19 nt, Homo sapiens
uagaauaaaguuccuguca

SEQ ID NO: 560636 - RNA, 16 nt, Homo sapiens
uagaauaaauucccaa

SEQ ID NO: 560637 - RNA, 16 nt, Homo sapiens
uagaauaagaauuugc

SEQ ID NO: 560638 - RNA, 19 nt, Homo sapiens
uagaauaaugugggaagaa

SEQ ID NO: 560639 - RNA, 11 nt, Homo sapiens
uagaauaucua

SEQ ID NO: 560640 - RNA, 11 nt, Homo sapiens
uagaauaucuu

SEQ ID NO: 560641 - RNA, 20 nt, Homo sapiens
uagaauauuauguuccucaa

SEQ ID NO: 560642 - RNA, 23 nt, Homo sapiens
uagaauauuuauuaccucugaua

SEQ ID NO: 560643 - RNA, 21 nt, Homo sapiens
uagaauauuuuaagaauuuca

SEQ ID NO: 560644 - RNA, 13 nt, Homo sapiens
uagaaucuucuua

SEQ ID NO: 560645 - RNA, 13 nt, Homo sapiens
uagaaucuuuuaa

SEQ ID NO: 560646 - RNA, 21 nt, Homo sapiens
uagaaugagcacccauuccaa

SEQ ID NO: 560647 - RNA, 12 nt, Homo sapiens
uagaaugauaaa

SEQ ID NO: 560648 - RNA, 15 nt, Homo sapiens
uagaaugcaucucau

SEQ ID NO: 560649 - RNA, 15 nt, Homo sapiens
uagaaugggauguga

SEQ ID NO: 560650 - RNA, 12 nt, Homo sapiens
uagaaugugauu

SEQ ID NO: 560651 - RNA, 20 nt, Homo sapiens
uagaauguggauuugauuca

SEQ ID NO: 560652 - RNA, 18 nt, Homo sapiens
uagaauguuucauuugca

SEQ ID NO: 560653 - RNA, 17 nt, Homo sapiens
uagaauugacauugaaa

SEQ ID NO: 560654 - RNA, 16 nt, Homo sapiens
uagaauugaccaaaua

SEQ ID NO: 560655 - RNA, 12 nt, Homo sapiens
uagaauugcauu

SEQ ID NO: 560656 - RNA, 13 nt, Homo sapiens
uagaauuuauuca

SEQ ID NO: 560657 - RNA, 23 nt, Homo sapiens
uagaauuuuuugagagaaugaga

SEQ ID NO: 560658 - RNA, 16 nt, Homo sapiens
uagacaaucacuacaa

SEQ ID NO: 560659 - RNA, 13 nt, Homo sapiens
uagacaauuugca

SEQ ID NO: 560660 - RNA, 21 nt, Homo sapiens
uagacagaguugcuuaaugaa

SEQ ID NO: 560661 - RNA, 22 nt, Homo sapiens
uagacaguaugagucaaugugc

SEQ ID NO: 560662 - RNA, 15 nt, Homo sapiens
uagacaguauugcca

SEQ ID NO: 560663 - RNA, 18 nt, Homo sapiens
uagacaucaguauucugc

SEQ ID NO: 560664 - RNA, 17 nt, Homo sapiens
uagacaucugcuguuau

SEQ ID NO: 560665 - RNA, 19 nt, Homo sapiens
uagaccagaaagugugugu

SEQ ID NO: 560666 - RNA, 20 nt, Homo sapiens
uagaccagaaccagagcuca

SEQ ID NO: 560667 - RNA, 18 nt, Homo sapiens
uagacgccuuccagguca

SEQ ID NO: 560668 - RNA, 16 nt, Homo sapiens
uagacggugcucacuc

SEQ ID NO: 560669 - RNA, 15 nt, Homo sapiens
uagacuacucaauau

SEQ ID NO: 560670 - RNA, 15 nt, Homo sapiens
uagacugagguauaa

SEQ ID NO: 560671 - RNA, 17 nt, Homo sapiens
uagacuuaaacagcaga

SEQ ID NO: 560672 - RNA, 15 nt, Homo sapiens
uagacuuaaaucuca

SEQ ID NO: 560673 - RNA, 16 nt, Homo sapiens
uagacuuauugccaaa

SEQ ID NO: 560674 - RNA, 11 nt, Homo sapiens
uagacuugaaa

SEQ ID NO: 560675 - RNA, 23 nt, Homo sapiens
uagacuugaaaguuuuccaguau

SEQ ID NO: 560676 - RNA, 19 nt, Homo sapiens
uagacuuuugacacuuuua

SEQ ID NO: 560677 - RNA, 15 nt, Homo sapiens
uagacuuuugcuuua

SEQ ID NO: 560678 - RNA, 17 nt, Homo sapiens
uagagaaauuugccaau

SEQ ID NO: 560679 - RNA, 19 nt, Homo sapiens
uagagaacacgcguauuua

SEQ ID NO: 560680 - RNA, 18 nt, Homo sapiens
uagagaaggcugugagcc

SEQ ID NO: 560681 - RNA, 20 nt, Homo sapiens
uagagaaggcugugagccaa

SEQ ID NO: 560682 - RNA, 18 nt, Homo sapiens
uagagaauaccaguguua

SEQ ID NO: 560683 - RNA, 22 nt, Homo sapiens
uagagacaggguuucacugugu

SEQ ID NO: 560684 - RNA, 14 nt, Homo sapiens
uagagacuguagau

SEQ ID NO: 560685 - RNA, 17 nt, Homo sapiens
uagagacuuugugaaaa

SEQ ID NO: 560686 - RNA, 18 nt, Homo sapiens
uagagaggacaauacugg

SEQ ID NO: 560687 - RNA, 19 nt, Homo sapiens
uagagaggacaauacuggg

SEQ ID NO: 560688 - RNA, 18 nt, Homo sapiens
uagagaggggacuggggg

SEQ ID NO: 560689 - RNA, 15 nt, Homo sapiens
uagagaguuaugaac

SEQ ID NO: 560690 - RNA, 20 nt, Homo sapiens
uagagaucuauguacuguaa

SEQ ID NO: 560691 - RNA, 17 nt, Homo sapiens
uagagauggggguuuca

SEQ ID NO: 560692 - RNA, 16 nt, Homo sapiens
uagagaugggguuuca

SEQ ID NO: 560693 - RNA, 14 nt, Homo sapiens
uagagcacacugua

SEQ ID NO: 560694 - RNA, 21 nt, Homo sapiens
uagagcagccacaaccaaaaa

SEQ ID NO: 560695 - RNA, 21 nt, Homo sapiens
uagagccagcccauggcuuua

SEQ ID NO: 560696 - RNA, 15 nt, Homo sapiens
uagagcuagcugcca

SEQ ID NO: 560697 - RNA, 19 nt, Homo sapiens
uagagcucuacugccucaa

SEQ ID NO: 560698 - RNA, 19 nt, Homo sapiens
uagagcuuaaauugucaga

SEQ ID NO: 560699 - RNA, 14 nt, Homo sapiens
uagaggaaagggau

SEQ ID NO: 560700 - RNA, 17 nt, Homo sapiens
uagaggaagaccaaaaa

SEQ ID NO: 560701 - RNA, 21 nt, Homo sapiens
uagaggaaggagauagggaaa

SEQ ID NO: 560702 - RNA, 16 nt, Homo sapiens
uagaggagaaccugga

SEQ ID NO: 560703 - RNA, 20 nt, Homo sapiens
uagaggauauugggucucag

SEQ ID NO: 560704 - RNA, 18 nt, Homo sapiens
uagaggauguggcuguaa

SEQ ID NO: 560705 - RNA, 18 nt, Homo sapiens
uagaggcugggggcucca

SEQ ID NO: 560706 - RNA, 18 nt, Homo sapiens
uagagggccuugcuucuc

SEQ ID NO: 560707 - RNA, 21 nt, Homo sapiens
uagagguagguaggaucaucc

SEQ ID NO: 560708 - RNA, 14 nt, Homo sapiens
uagaguguagccua

SEQ ID NO: 560709 - RNA, 15 nt, Homo sapiens
uagaguguagcugua

SEQ ID NO: 560710 - RNA, 16 nt, Homo sapiens
uagagugucucagggu

SEQ ID NO: 560711 - RNA, 21 nt, Homo sapiens
uagaguguuuuaaaacauuca

SEQ ID NO: 560712 - RNA, 15 nt, Homo sapiens
uagaguuccauauau

SEQ ID NO: 560713 - RNA, 21 nt, Homo sapiens
uagaguuggauuaaauucugg

SEQ ID NO: 560714 - RNA, 17 nt, Homo sapiens
uagaguuuacaguuugu

SEQ ID NO: 560715 - RNA, 23 nt, Homo sapiens
uagauaaaagaaccgagcaauuu

SEQ ID NO: 560716 - RNA, 16 nt, Homo sapiens
uagauaaacucagaaa

SEQ ID NO: 560717 - RNA, 20 nt, Homo sapiens
uagauaaagauuucuaguag

SEQ ID NO: 560718 - RNA, 20 nt, Homo sapiens
uagauaaucucuccauuccc

SEQ ID NO: 560719 - RNA, 12 nt, Homo sapiens
uagauacuguau

SEQ ID NO: 560720 - RNA, 22 nt, Homo sapiens
uagauauaacacuauguuuauu

SEQ ID NO: 560721 - RNA, 15 nt, Homo sapiens
uagauauaugcucug

SEQ ID NO: 560722 - RNA, 23 nt, Homo sapiens
uagauauuaaaaguuaagcaaau

SEQ ID NO: 560723 - RNA, 18 nt, Homo sapiens
uagauccaaggcagggaa

SEQ ID NO: 560724 - RNA, 12 nt, Homo sapiens
uagaucuagaaa

SEQ ID NO: 560725 - RNA, 21 nt, Homo sapiens
uagaucuaguuuagaaaacau

SEQ ID NO: 560726 - RNA, 18 nt, Homo sapiens
uagaucugauggugagcu

SEQ ID NO: 560727 - RNA, 22 nt, Homo sapiens
uagaugacaaccuccauucuau

SEQ ID NO: 560728 - RNA, 11 nt, Homo sapiens
uagaugcauua

SEQ ID NO: 560729 - RNA, 15 nt, Homo sapiens
uagaugccaaaccac

SEQ ID NO: 560730 - RNA, 12 nt, Homo sapiens
uagaugccaggg

SEQ ID NO: 560731 - RNA, 21 nt, Homo sapiens
uagauggggagccucgggaaa

SEQ ID NO: 560732 - RNA, 14 nt, Homo sapiens
uagaugucuuuucc

SEQ ID NO: 560733 - RNA, 14 nt, Homo sapiens
uagaugugucuuac

SEQ ID NO: 560734 - RNA, 16 nt, Homo sapiens
uagaugugucuuacca

SEQ ID NO: 560735 - RNA, 20 nt, Homo sapiens
uagaugugucuuaccagauc

SEQ ID NO: 560736 - RNA, 18 nt, Homo sapiens
uagauguuauuaugcuaa

SEQ ID NO: 560737 - RNA, 17 nt, Homo sapiens
uagauguuucaacugug

SEQ ID NO: 560738 - RNA, 14 nt, Homo sapiens
uagauuaaacaaac

SEQ ID NO: 560739 - RNA, 15 nt, Homo sapiens
uagauuaaacaaaca

SEQ ID NO: 560740 - RNA, 16 nt, Homo sapiens
uagauuaccaugaaga

SEQ ID NO: 560741 - RNA, 17 nt, Homo sapiens
uagauuaguauuuucca

SEQ ID NO: 560742 - RNA, 17 nt, Homo sapiens
uagauuauuucauauac

SEQ ID NO: 560743 - RNA, 21 nt, Homo sapiens
uagauucuuaauucaugagga

SEQ ID NO: 560744 - RNA, 17 nt, Homo sapiens
uagauugcuaguuuauu

SEQ ID NO: 560745 - RNA, 19 nt, Homo sapiens
uagauugcuuucuucuuaa

SEQ ID NO: 560746 - RNA, 23 nt, Homo sapiens
uagauugcuuucuucuuaaccua

SEQ ID NO: 560747 - RNA, 23 nt, Homo sapiens
uagauuuaaagaauaugaaguuc

SEQ ID NO: 560748 - RNA, 18 nt, Homo sapiens
uagauuugaaaauuguau

SEQ ID NO: 560749 - RNA, 19 nt, Homo sapiens
uagauuuucuuuugccuuu

SEQ ID NO: 560750 - RNA, 21 nt, Homo sapiens
uagauuuuuucagacuuguca

SEQ ID NO: 560751 - RNA, 19 nt, Homo sapiens
uagauuuuuuuauuugaug

SEQ ID NO: 560752 - RNA, 23 nt, Homo sapiens
uagcaaaauuuggggaaauccau

SEQ ID NO: 560753 - RNA, 13 nt, Homo sapiens
uagcaaaugacau

SEQ ID NO: 560754 - RNA, 16 nt, Homo sapiens
uagcaaauuugaauuu

SEQ ID NO: 560755 - RNA, 13 nt, Homo sapiens
uagcaacuacagu

SEQ ID NO: 560756 - RNA, 19 nt, Homo sapiens
uagcaagauauugaucaaa

SEQ ID NO: 560757 - RNA, 14 nt, Homo sapiens
uagcaagugugcac

SEQ ID NO: 560758 - RNA, 22 nt, Homo sapiens
uagcaauaacauacaugagaua

SEQ ID NO: 560759 - RNA, 18 nt, Homo sapiens
uagcaauuaaacuuugua

SEQ ID NO: 560760 - RNA, 20 nt, Homo sapiens
uagcaauuagugauauagug

SEQ ID NO: 560761 - RNA, 23 nt, Homo sapiens
uagcaauugacagagaauaacuc

SEQ ID NO: 560762 - RNA, 18 nt, Homo sapiens
uagcacaauuugcacuaa

SEQ ID NO: 560763 - RNA, 12 nt, Homo sapiens
uagcacagagag

SEQ ID NO: 560764 - RNA, 18 nt, Homo sapiens
uagcaccguuugugacag

SEQ ID NO: 560765 - RNA, 19 nt, Homo sapiens
uagcagaguuaaaucucaa

SEQ ID NO: 560766 - RNA, 22 nt, Homo sapiens
uagcagcagggagggcuucugc

SEQ ID NO: 560767 - RNA, 20 nt, Homo sapiens
uagcagccuguacuagcuuu

SEQ ID NO: 560768 - RNA, 12 nt, Homo sapiens
uagcagcuauau

SEQ ID NO: 560769 - RNA, 18 nt, Homo sapiens
uagcaggcaaugcuguac

SEQ ID NO: 560770 - RNA, 15 nt, Homo sapiens
uagcagguuucacua

SEQ ID NO: 560771 - RNA, 18 nt, Homo sapiens
uagcauacgguaugauau

SEQ ID NO: 560772 - RNA, 22 nt, Homo sapiens
uagcaucagagguuugcuuccu

SEQ ID NO: 560773 - RNA, 14 nt, Homo sapiens
uagcaucccuggaa

SEQ ID NO: 560774 - RNA, 12 nt, Homo sapiens
uagcaucucagg

SEQ ID NO: 560775 - RNA, 17 nt, Homo sapiens
uagcaucuguaacagca

SEQ ID NO: 560776 - RNA, 19 nt, Homo sapiens
uagcaugaggccacugcug

SEQ ID NO: 560777 - RNA, 17 nt, Homo sapiens
uagcaugauguauuuaa

SEQ ID NO: 560778 - RNA, 16 nt, Homo sapiens
uagcauuaugcaauua

SEQ ID NO: 560779 - RNA, 13 nt, Homo sapiens
uagcauugcacuu

SEQ ID NO: 560780 - RNA, 20 nt, Homo sapiens
uagcauuguaaaagcauuuu

SEQ ID NO: 560781 - RNA, 21 nt, Homo sapiens
uagcauuugcuaacaggacca

SEQ ID NO: 560782 - RNA, 18 nt, Homo sapiens
uagcauuuuccuguuuac

SEQ ID NO: 560783 - RNA, 15 nt, Homo sapiens
uagcauuuuuauuca

SEQ ID NO: 560784 - RNA, 21 nt, Homo sapiens
uagccaacugcuaaugcaaau

SEQ ID NO: 560785 - RNA, 21 nt, Homo sapiens
uagccaaggauagaagcugca

SEQ ID NO: 560786 - RNA, 17 nt, Homo sapiens
uagccagauaguagaac

SEQ ID NO: 560787 - RNA, 21 nt, Homo sapiens
uagccagauuugucuuuuugu

SEQ ID NO: 560788 - RNA, 18 nt, Homo sapiens
uagccagcacacagggca

SEQ ID NO: 560789 - RNA, 17 nt, Homo sapiens
uagccagcauuccauau

SEQ ID NO: 560790 - RNA, 16 nt, Homo sapiens
uagccaggauccacaa

SEQ ID NO: 560791 - RNA, 16 nt, Homo sapiens
uagccaggauggucuc

SEQ ID NO: 560792 - RNA, 16 nt, Homo sapiens
uagccaucauaacuca

SEQ ID NO: 560793 - RNA, 23 nt, Homo sapiens
uagccaucccaugaacacacugu

SEQ ID NO: 560794 - RNA, 18 nt, Homo sapiens
uagccaucucucuacucc

SEQ ID NO: 560795 - RNA, 22 nt, Homo sapiens
uagccauuucuccaugggccac

SEQ ID NO: 560796 - RNA, 14 nt, Homo sapiens
uagcccaaaaccaa

SEQ ID NO: 560797 - RNA, 22 nt, Homo sapiens
uagcccauaaagucugagaaau

SEQ ID NO: 560798 - RNA, 23 nt, Homo sapiens
uagcccuaaaaugacaagccuuc

SEQ ID NO: 560799 - RNA, 13 nt, Homo sapiens
uagcccugcauuu

SEQ ID NO: 560800 - RNA, 17 nt, Homo sapiens
uagccgaccucagccuu

SEQ ID NO: 560801 - RNA, 18 nt, Homo sapiens
uagccgauaucagaauuu

SEQ ID NO: 560802 - RNA, 15 nt, Homo sapiens
uagccggguguggca

SEQ ID NO: 560803 - RNA, 20 nt, Homo sapiens
uagccuaauacaacauguag

SEQ ID NO: 560804 - RNA, 17 nt, Homo sapiens
uagccucgcucuuggca

SEQ ID NO: 560805 - RNA, 16 nt, Homo sapiens
uagccuuauccucuga

SEQ ID NO: 560806 - RNA, 16 nt, Homo sapiens
uagccuucuccccaac

SEQ ID NO: 560807 - RNA, 20 nt, Homo sapiens
uagccuuuaaaucauuuuua

SEQ ID NO: 560808 - RNA, 18 nt, Homo sapiens
uagcgagaagaugcucug

SEQ ID NO: 560809 - RNA, 20 nt, Homo sapiens
uagcgcugccgcaccccaga

SEQ ID NO: 560810 - RNA, 17 nt, Homo sapiens
uagcggucaauuugccu

SEQ ID NO: 560811 - RNA, 20 nt, Homo sapiens
uagcuacauucacacacuca

SEQ ID NO: 560812 - RNA, 16 nt, Homo sapiens
uagcuagcgugugcca

SEQ ID NO: 560813 - RNA, 18 nt, Homo sapiens
uagcuaguagcaaugugc

SEQ ID NO: 560814 - RNA, 23 nt, Homo sapiens
uagcuauauccauguacuguagu

SEQ ID NO: 560815 - RNA, 15 nt, Homo sapiens
uagcuauggaaucaa

SEQ ID NO: 560816 - RNA, 20 nt, Homo sapiens
uagcucaaauaggucaucau

SEQ ID NO: 560817 - RNA, 16 nt, Homo sapiens
uagcucaaucugcaaa

SEQ ID NO: 560818 - RNA, 18 nt, Homo sapiens
uagcucacugcagccuca

SEQ ID NO: 560819 - RNA, 14 nt, Homo sapiens
uagcucauccuuua

SEQ ID NO: 560820 - RNA, 14 nt, Homo sapiens
uagcuccuguuguc

SEQ ID NO: 560821 - RNA, 21 nt, Homo sapiens
uagcuccuuggagcaggcaaa

SEQ ID NO: 560822 - RNA, 23 nt, Homo sapiens
uagcucucccaacucuugcacag

SEQ ID NO: 560823 - RNA, 18 nt, Homo sapiens
ucaaguaauaggcauuuu

SEQ ID NO: 560824 - RNA, 20 nt, Homo sapiens
ucaaguaccaaaauguuaau

SEQ ID NO: 560825 - RNA, 20 nt, Homo sapiens
ucaagucaucuauaguugau

SEQ ID NO: 560826 - RNA, 17 nt, Homo sapiens
ucaagugcugugcaagg

SEQ ID NO: 560827 - RNA, 18 nt, Homo sapiens
ucaaguggagagaaauca

SEQ ID NO: 560828 - RNA, 14 nt, Homo sapiens
ucaagugguucucc

SEQ ID NO: 560829 - RNA, 20 nt, Homo sapiens
ucaaguguacaugugugaaa

SEQ ID NO: 560830 - RNA, 16 nt, Homo sapiens
ucaaguuaacaaggaa

SEQ ID NO: 560831 - RNA, 20 nt, Homo sapiens
ucaaguucagcccaccaucu

SEQ ID NO: 560832 - RNA, 13 nt, Homo sapiens
ucaaguucauuga

SEQ ID NO: 560833 - RNA, 20 nt, Homo sapiens
ucaaguucccaacugaguca

SEQ ID NO: 560834 - RNA, 16 nt, Homo sapiens
ucaaguugugccaaau

SEQ ID NO: 560835 - RNA, 20 nt, Homo sapiens
ucaaguugugcuuguuuaca

SEQ ID NO: 560836 - RNA, 23 nt, Homo sapiens
ucaaguuguuccuuaagucagaa

SEQ ID NO: 560837 - RNA, 17 nt, Homo sapiens
ucaauaaacaacagcug

SEQ ID NO: 560838 - RNA, 23 nt, Homo sapiens
ucaauaaaguuccccugugacac

SEQ ID NO: 560839 - RNA, 18 nt, Homo sapiens
ucaauaauauauuuucug

SEQ ID NO: 560840 - RNA, 17 nt, Homo sapiens
ucaauaauauuagcuua

SEQ ID NO: 560841 - RNA, 13 nt, Homo sapiens
ucaauacagugaa

SEQ ID NO: 560842 - RNA, 22 nt, Homo sapiens
ucaauacauagugcugcugugu

SEQ ID NO: 560843 - RNA, 19 nt, Homo sapiens
ucaauaccaauuacaugga

SEQ ID NO: 560844 - RNA, 16 nt, Homo sapiens
ucaauaccgcucagua

SEQ ID NO: 560845 - RNA, 18 nt, Homo sapiens
ucaauaccgcucaguauu

SEQ ID NO: 560846 - RNA, 13 nt, Homo sapiens
ucaauagcuugaa

SEQ ID NO: 560847 - RNA, 17 nt, Homo sapiens
ucaauauacauaauaca

SEQ ID NO: 560848 - RNA, 20 nt, Homo sapiens
ucaauauccaccccauccaa

SEQ ID NO: 560849 - RNA, 21 nt, Homo sapiens
ucaauauuuuuauaucaugca

SEQ ID NO: 560850 - RNA, 14 nt, Homo sapiens
ucaaucagccuuua

SEQ ID NO: 560851 - RNA, 19 nt, Homo sapiens
ucaaucagugcagugauac

SEQ ID NO: 560852 - RNA, 19 nt, Homo sapiens
ucaaucaucugugugaaaa

SEQ ID NO: 560853 - RNA, 12 nt, Homo sapiens
ucaauccagcua

SEQ ID NO: 560854 - RNA, 18 nt, Homo sapiens
ucaaucccagcuacucaa

SEQ ID NO: 560855 - RNA, 17 nt, Homo sapiens
ucaauccuaucacaguc

SEQ ID NO: 560856 - RNA, 21 nt, Homo sapiens
ucaauccugggcaaucagaca

SEQ ID NO: 560857 - RNA, 18 nt, Homo sapiens
ucaaucuaaggccuuccc

SEQ ID NO: 560858 - RNA, 11 nt, Homo sapiens
ucaaucucagc

SEQ ID NO: 560859 - RNA, 23 nt, Homo sapiens
ucaaucucagcuaacauuccaug

SEQ ID NO: 560860 - RNA, 23 nt, Homo sapiens
ucaaucuguccguucacaugugu

SEQ ID NO: 560861 - RNA, 14 nt, Homo sapiens
ucaaucuuugccua

SEQ ID NO: 560862 - RNA, 12 nt, Homo sapiens
ucaaugccagua

SEQ ID NO: 560863 - RNA, 23 nt, Homo sapiens
ucaaugccucacgagauuugcca

SEQ ID NO: 560864 - RNA, 16 nt, Homo sapiens
ucaauggaaagcugcu

SEQ ID NO: 560865 - RNA, 23 nt, Homo sapiens
ucaauggcuuguucaucauccag

SEQ ID NO: 560866 - RNA, 20 nt, Homo sapiens
ucaaugguugggacaauggc

SEQ ID NO: 560867 - RNA, 14 nt, Homo sapiens
ucaauguccaguga

SEQ ID NO: 560868 - RNA, 13 nt, Homo sapiens
ucaaugugcagug

SEQ ID NO: 560869 - RNA, 13 nt, Homo sapiens
ucaauguguacaa

SEQ ID NO: 560870 - RNA, 20 nt, Homo sapiens
ucaauguuuguucauuacuu

SEQ ID NO: 560871 - RNA, 16 nt, Homo sapiens
ucaauuauuacauuua

SEQ ID NO: 560872 - RNA, 15 nt, Homo sapiens
ucaauuccugugauu

SEQ ID NO: 560873 - RNA, 19 nt, Homo sapiens
ucaauucuuagaauaucua

SEQ ID NO: 560874 - RNA, 14 nt, Homo sapiens
ucaauuucuacuuc

SEQ ID NO: 560875 - RNA, 18 nt, Homo sapiens
ucaauuuugucuguacuc

SEQ ID NO: 560876 - RNA, 20 nt, Homo sapiens
ucaauuuugucuguacucau

SEQ ID NO: 560877 - RNA, 18 nt, Homo sapiens
ucaauuuuucccaguauu

SEQ ID NO: 560878 - RNA, 13 nt, Homo sapiens
ucacaaaaggcau

SEQ ID NO: 560879 - RNA, 17 nt, Homo sapiens
ucacaaaccaagccaug

SEQ ID NO: 560880 - RNA, 14 nt, Homo sapiens
ucacaaacugugaa

SEQ ID NO: 560881 - RNA, 22 nt, Homo sapiens
ucacaaaggcagagagucagac

SEQ ID NO: 560882 - RNA, 16 nt, Homo sapiens
ucacaaauccuucaaa

SEQ ID NO: 560883 - RNA, 15 nt, Homo sapiens
ucacaacagugaaaa

SEQ ID NO: 560884 - RNA, 15 nt, Homo sapiens
ucacaacauuccuca

SEQ ID NO: 560885 - RNA, 17 nt, Homo sapiens
ucacaacauuuacuuaa

SEQ ID NO: 560886 - RNA, 20 nt, Homo sapiens
ucacaaccaagaauguuaug

SEQ ID NO: 560887 - RNA, 18 nt, Homo sapiens
ucacaaccccugcuccag

SEQ ID NO: 560888 - RNA, 23 nt, Homo sapiens
ucacaagaacacacacauauaca

SEQ ID NO: 560889 - RNA, 18 nt, Homo sapiens
ucacaagaaucaccucaa

SEQ ID NO: 560890 - RNA, 13 nt, Homo sapiens
ucacaagaauuua

SEQ ID NO: 560891 - RNA, 18 nt, Homo sapiens
ucacaaggcaacugugag

SEQ ID NO: 560892 - RNA, 23 nt, Homo sapiens
ucacaaggcacaccagugcaagc

SEQ ID NO: 560893 - RNA, 21 nt, Homo sapiens
ucacaagugaaaaacauccag

SEQ ID NO: 560894 - RNA, 13 nt, Homo sapiens
ucacaaguucaau

SEQ ID NO: 560895 - RNA, 18 nt, Homo sapiens
ucacaauacucaaaagag

SEQ ID NO: 560896 - RNA, 21 nt, Homo sapiens
ucacaaucaucaucauucuca

SEQ ID NO: 560897 - RNA, 23 nt, Homo sapiens
ucacaauccuguggaucugggca

SEQ ID NO: 560898 - RNA, 23 nt, Homo sapiens
ucacaaucucuguuuguaugugg

SEQ ID NO: 560899 - RNA, 16 nt, Homo sapiens
ucacaauuaugugcaa

SEQ ID NO: 560900 - RNA, 19 nt, Homo sapiens
ucacaauuuacgaaaccaa

SEQ ID NO: 560901 - RNA, 20 nt, Homo sapiens
ucacaauuuacgaaaccaaa

SEQ ID NO: 560902 - RNA, 11 nt, Homo sapiens
ucacacacuga

SEQ ID NO: 560903 - RNA, 18 nt, Homo sapiens
ucacacagacacuaacga

SEQ ID NO: 560904 - RNA, 21 nt, Homo sapiens
ucacacagccaagccagucaa

SEQ ID NO: 560905 - RNA, 22 nt, Homo sapiens
ucacacauauucuuaaugacau

SEQ ID NO: 560906 - RNA, 13 nt, Homo sapiens
ucacaccacugua

SEQ ID NO: 560907 - RNA, 19 nt, Homo sapiens
ucacaccgcgucuggugac

SEQ ID NO: 560908 - RNA, 16 nt, Homo sapiens
ucacaccugggggaca

SEQ ID NO: 560909 - RNA, 13 nt, Homo sapiens
ucacacucucuug

SEQ ID NO: 560910 - RNA, 21 nt, Homo sapiens
ucacacugguucucaaugaaa

SEQ ID NO: 560911 - RNA, 19 nt, Homo sapiens
ucacagaacuauguacuuu

SEQ ID NO: 560912 - RNA, 18 nt, Homo sapiens
ucacagaagcacagcacc

SEQ ID NO: 560913 - RNA, 16 nt, Homo sapiens
ucacagaccucugcuu

SEQ ID NO: 560914 - RNA, 19 nt, Homo sapiens
ucacagacuggcaacaaga

SEQ ID NO: 560915 - RNA, 16 nt, Homo sapiens
ucacagaggucuuuca

SEQ ID NO: 560916 - RNA, 18 nt, Homo sapiens
ucacagaguagaaacuca

SEQ ID NO: 560917 - RNA, 16 nt, Homo sapiens
ucacagagugcauugu

SEQ ID NO: 560918 - RNA, 22 nt, Homo sapiens
ucacagcaaggauggagcugaa

SEQ ID NO: 560919 - RNA, 19 nt, Homo sapiens
ucacagcagugagacuggg

SEQ ID NO: 560920 - RNA, 20 nt, Homo sapiens
ucacagcccagaaccacaga

SEQ ID NO: 560921 - RNA, 14 nt, Homo sapiens
ucacagccucugaa

SEQ ID NO: 560922 - RNA, 14 nt, Homo sapiens
ucacagcucacugc

SEQ ID NO: 560923 - RNA, 12 nt, Homo sapiens
ucacagcugcuu

SEQ ID NO: 560924 - RNA, 22 nt, Homo sapiens
ucacagcugggaagacauuucu

SEQ ID NO: 560925 - RNA, 23 nt, Homo sapiens
ucacagcuguaaucccagcacuu

SEQ ID NO: 560926 - RNA, 17 nt, Homo sapiens
ucacaggagcaaucaca

SEQ ID NO: 560927 - RNA, 17 nt, Homo sapiens
ucacaggccccaggaaa

SEQ ID NO: 560928 - RNA, 17 nt, Homo sapiens
ucacagggguacagaaa

SEQ ID NO: 560929 - RNA, 22 nt, Homo sapiens
ucacagggguucccuucucuca

SEQ ID NO: 560930 - RNA, 23 nt, Homo sapiens
ucacaggugggaucggcacucag

SEQ ID NO: 560931 - RNA, 16 nt, Homo sapiens
ucacaggugugggaug

SEQ ID NO: 560932 - RNA, 17 nt, Homo sapiens
ucacagucaauggaucc

SEQ ID NO: 560933 - RNA, 20 nt, Homo sapiens
ucacaguccuggacuccugc

SEQ ID NO: 560934 - RNA, 14 nt, Homo sapiens
ucacagucuacuga

SEQ ID NO: 560935 - RNA, 19 nt, Homo sapiens
ucacaguguguuugugauu

SEQ ID NO: 560936 - RNA, 16 nt, Homo sapiens
ucacaguguugcccag

SEQ ID NO: 560937 - RNA, 19 nt, Homo sapiens
ucacaguuagguagcuuua

SEQ ID NO: 560938 - RNA, 16 nt, Homo sapiens
ucacauaagcucagaa

SEQ ID NO: 560939 - RNA, 14 nt, Homo sapiens
uaugagauugggua

SEQ ID NO: 560940 - RNA, 14 nt, Homo sapiens
uaugaggcauuugu

SEQ ID NO: 560941 - RNA, 23 nt, Homo sapiens
uaugaguaucuguauguauauau

SEQ ID NO: 560942 - RNA, 16 nt, Homo sapiens
uaugagugcgcagauc

SEQ ID NO: 560943 - RNA, 21 nt, Homo sapiens
uaugagugcugauucaaacca

SEQ ID NO: 560944 - RNA, 19 nt, Homo sapiens
uaugaguuuucuccuugau

SEQ ID NO: 560945 - RNA, 14 nt, Homo sapiens
uaugauacugaugc

SEQ ID NO: 560946 - RNA, 18 nt, Homo sapiens
uaugauauaacaugugua

SEQ ID NO: 560947 - RNA, 21 nt, Homo sapiens
uaugaucagguaacuuucgac

SEQ ID NO: 560948 - RNA, 15 nt, Homo sapiens
uaugaucuaauacaa

SEQ ID NO: 560949 - RNA, 12 nt, Homo sapiens
uaugaugcacuu

SEQ ID NO: 560950 - RNA, 15 nt, Homo sapiens
uaugaugcaguuuca

SEQ ID NO: 560951 - RNA, 17 nt, Homo sapiens
uaugauggucugcauua

SEQ ID NO: 560952 - RNA, 18 nt, Homo sapiens
uaugauguuagaagaaga

SEQ ID NO: 560953 - RNA, 18 nt, Homo sapiens
uaugauuuaagacuauga

SEQ ID NO: 560954 - RNA, 22 nt, Homo sapiens
uaugcaaaagucagcgugacaa

SEQ ID NO: 560955 - RNA, 20 nt, Homo sapiens
uaugcaaagaugaacccgag

SEQ ID NO: 560956 - RNA, 12 nt, Homo sapiens
uaugcaaaucag

SEQ ID NO: 560957 - RNA, 19 nt, Homo sapiens
uaugcaacucaucuucaca

SEQ ID NO: 560958 - RNA, 17 nt, Homo sapiens
uaugcaagggucccuua

SEQ ID NO: 560959 - RNA, 16 nt, Homo sapiens
uaugcaagugcaaaag

SEQ ID NO: 560960 - RNA, 16 nt, Homo sapiens
uaugcacacacauaua

SEQ ID NO: 560961 - RNA, 12 nt, Homo sapiens
uaugcacuucaa

SEQ ID NO: 560962 - RNA, 21 nt, Homo sapiens
uaugcagaaggcuacauauac

SEQ ID NO: 560963 - RNA, 21 nt, Homo sapiens
uaugcagagguccacaacaca

SEQ ID NO: 560964 - RNA, 19 nt, Homo sapiens
uaugcagcuaucuggucaa

SEQ ID NO: 560965 - RNA, 17 nt, Homo sapiens
uaugcaguaugcuuaau

SEQ ID NO: 560966 - RNA, 22 nt, Homo sapiens
uaugcaugaaguaauaugcaca

SEQ ID NO: 560967 - RNA, 11 nt, Homo sapiens
uaugcauuuga

SEQ ID NO: 560968 - RNA, 21 nt, Homo sapiens
uaugcauuuucuucacagugc

SEQ ID NO: 560969 - RNA, 20 nt, Homo sapiens
uaugccacagaauuugcuaa

SEQ ID NO: 560970 - RNA, 18 nt, Homo sapiens
uaugccauagcaagauug

SEQ ID NO: 560971 - RNA, 15 nt, Homo sapiens
uaugccucuguauuu

SEQ ID NO: 560972 - RNA, 16 nt, Homo sapiens
uaugccuuaagccaau

SEQ ID NO: 560973 - RNA, 14 nt, Homo sapiens
uaugccuucacuuu

SEQ ID NO: 560974 - RNA, 13 nt, Homo sapiens
uaugccuucuuau

SEQ ID NO: 560975 - RNA, 20 nt, Homo sapiens
uaugccuuuaaaucugugau

SEQ ID NO: 560976 - RNA, 22 nt, Homo sapiens
uaugcucagggucaauuucuuu

SEQ ID NO: 560977 - RNA, 12 nt, Homo sapiens
uaugcucuguga

SEQ ID NO: 560978 - RNA, 17 nt, Homo sapiens
uaugcugcaacaaaaug

SEQ ID NO: 560979 - RNA, 19 nt, Homo sapiens
uaugcuuggcuaacuauau

SEQ ID NO: 560980 - RNA, 22 nt, Homo sapiens
uaugcuuuccuucuuugggaua

SEQ ID NO: 560981 - RNA, 15 nt, Homo sapiens
uauggaaaaaaccaa

SEQ ID NO: 560982 - RNA, 13 nt, Homo sapiens
uauggaaacauuu

SEQ ID NO: 560983 - RNA, 18 nt, Homo sapiens
uauggaaccuucccucca

SEQ ID NO: 560984 - RNA, 23 nt, Homo sapiens
uauggaagaguuaaaacauuucu

SEQ ID NO: 560985 - RNA, 23 nt, Homo sapiens
uauggaauuccucuacugcccag

SEQ ID NO: 560986 - RNA, 19 nt, Homo sapiens
uauggaauuuugcaaagau

SEQ ID NO: 560987 - RNA, 13 nt, Homo sapiens
uauggaggacugu

SEQ ID NO: 560988 - RNA, 18 nt, Homo sapiens
uauggaggggagggaucu

SEQ ID NO: 560989 - RNA, 23 nt, Homo sapiens
uauggagugccugcuguggaccc

SEQ ID NO: 560990 - RNA, 13 nt, Homo sapiens
uauggcacuggca

SEQ ID NO: 560991 - RNA, 14 nt, Homo sapiens
uauggccaauaacu

SEQ ID NO: 560992 - RNA, 20 nt, Homo sapiens
uauggccaauaacuuuucac

SEQ ID NO: 560993 - RNA, 15 nt, Homo sapiens
uauggcucaccuuau

SEQ ID NO: 560994 - RNA, 18 nt, Homo sapiens
uauggcuuuugugcauua

SEQ ID NO: 560995 - RNA, 13 nt, Homo sapiens
uaugggaacaauu

SEQ ID NO: 560996 - RNA, 14 nt, Homo sapiens
uaugggaagccaua

SEQ ID NO: 560997 - RNA, 19 nt, Homo sapiens
uaugggagcuuaacuuuau

SEQ ID NO: 560998 - RNA, 22 nt, Homo sapiens
uaugggggauggugagcuguga

SEQ ID NO: 560999 - RNA, 20 nt, Homo sapiens
uaugggggcacugaggacca

SEQ ID NO: 561000 - RNA, 20 nt, Homo sapiens
uaugguaaaaguuacuuauu

SEQ ID NO: 561001 - RNA, 14 nt, Homo sapiens
uaugguaaucuuua

SEQ ID NO: 561002 - RNA, 19 nt, Homo sapiens
uaugguagaaaaauuucac

SEQ ID NO: 561003 - RNA, 20 nt, Homo sapiens
uaugguuauuuaugcacugu

SEQ ID NO: 561004 - RNA, 14 nt, Homo sapiens
uaugguuguauaca

SEQ ID NO: 561005 - RNA, 22 nt, Homo sapiens
uauguaauggaacuuagccauu

SEQ ID NO: 561006 - RNA, 16 nt, Homo sapiens
uauguacuaagcagua

SEQ ID NO: 561007 - RNA, 16 nt, Homo sapiens
uauguacuucagugca

SEQ ID NO: 561008 - RNA, 18 nt, Homo sapiens
uauguagaagccuaggau

SEQ ID NO: 561009 - RNA, 16 nt, Homo sapiens
uauguagaugugcauu

SEQ ID NO: 561010 - RNA, 23 nt, Homo sapiens
uauguaguaauugacaugugcca

SEQ ID NO: 561011 - RNA, 17 nt, Homo sapiens
uauguauaucauucuac

SEQ ID NO: 561012 - RNA, 16 nt, Homo sapiens
uaugucaaagcuuuga

SEQ ID NO: 561013 - RNA, 13 nt, Homo sapiens
uaugucaaaugga

SEQ ID NO: 561014 - RNA, 20 nt, Homo sapiens
uaugucaggcaaagugcugc

SEQ ID NO: 561015 - RNA, 18 nt, Homo sapiens
uaugucauauuuugccac

SEQ ID NO: 561016 - RNA, 14 nt, Homo sapiens
uaugucucaugaug

SEQ ID NO: 561017 - RNA, 13 nt, Homo sapiens
uaugugacuguga

SEQ ID NO: 561018 - RNA, 14 nt, Homo sapiens
uaugugacuuaaag

SEQ ID NO: 561019 - RNA, 19 nt, Homo sapiens
uaugugacuuaaagucaga

SEQ ID NO: 561020 - RNA, 20 nt, Homo sapiens
uaugugaucauguguggaag

SEQ ID NO: 561021 - RNA, 14 nt, Homo sapiens
uaugugcaaguuua

SEQ ID NO: 561022 - RNA, 18 nt, Homo sapiens
uaugugcauuauucauaa

SEQ ID NO: 561023 - RNA, 14 nt, Homo sapiens
uaugugcauuucaa

SEQ ID NO: 561024 - RNA, 17 nt, Homo sapiens
uaugugcgucucucuuu

SEQ ID NO: 561025 - RNA, 19 nt, Homo sapiens
uaugugcgugugugcaagu

SEQ ID NO: 561026 - RNA, 16 nt, Homo sapiens
uaugugcugaacauug

SEQ ID NO: 561027 - RNA, 20 nt, Homo sapiens
uauguggacguaaucuccac

SEQ ID NO: 561028 - RNA, 17 nt, Homo sapiens
uaugugguuaucuguga

SEQ ID NO: 561029 - RNA, 14 nt, Homo sapiens
uauguuacaauuaa

SEQ ID NO: 561030 - RNA, 16 nt, Homo sapiens
uauguuaccuuuucau

SEQ ID NO: 561031 - RNA, 13 nt, Homo sapiens
uauguuauugcau

SEQ ID NO: 561032 - RNA, 15 nt, Homo sapiens
uauguucagcagugu

SEQ ID NO: 561033 - RNA, 19 nt, Homo sapiens
uauguucccccuguuucag

SEQ ID NO: 561034 - RNA, 12 nt, Homo sapiens
uauguugucaua

SEQ ID NO: 561035 - RNA, 22 nt, Homo sapiens
uauguuguguuuuuuuucauua

SEQ ID NO: 561036 - RNA, 21 nt, Homo sapiens
uauguuuggaauaaagucaac

SEQ ID NO: 561037 - RNA, 17 nt, Homo sapiens
uauguuuucuuucucac

SEQ ID NO: 561038 - RNA, 20 nt, Homo sapiens
uauguuuucuuucucaccca

SEQ ID NO: 561039 - RNA, 21 nt, Homo sapiens
uauuaaaaagccugcauucug

SEQ ID NO: 561040 - RNA, 18 nt, Homo sapiens
uauuaaaaauagauauau

SEQ ID NO: 561041 - RNA, 21 nt, Homo sapiens
uauuaaaauuuuuugauguca

SEQ ID NO: 561042 - RNA, 13 nt, Homo sapiens
uauuaaacaaagu

SEQ ID NO: 561043 - RNA, 21 nt, Homo sapiens
uauuaaacguguaaauugcac

SEQ ID NO: 561044 - RNA, 23 nt, Homo sapiens
uauuaaacguguaaauugcacag

SEQ ID NO: 561045 - RNA, 13 nt, Homo sapiens
uauuaaagcaaaa

SEQ ID NO: 561046 - RNA, 16 nt, Homo sapiens
uauuaacccuaccugu

SEQ ID NO: 561047 - RNA, 15 nt, Homo sapiens
uauuaacccucugag

SEQ ID NO: 561048 - RNA, 14 nt, Homo sapiens
uauuaacuucacag

SEQ ID NO: 561049 - RNA, 17 nt, Homo sapiens
uauuaacuuuaauucuc

SEQ ID NO: 561050 - RNA, 15 nt, Homo sapiens
uauuaagauguauaa

SEQ ID NO: 561051 - RNA, 15 nt, Homo sapiens
uauuaagauuuccaa

SEQ ID NO: 561052 - RNA, 23 nt, Homo sapiens
uauuaagauuuccaagugccaau

SEQ ID NO: 561053 - RNA, 13 nt, Homo sapiens
uauuaagcacuuu

SEQ ID NO: 561054 - RNA, 15 nt, Homo sapiens
uauuaagccacuuaa

SEQ ID NO: 561055 - RNA, 23 nt, Homo sapiens
uauuaaggaaauacuuugcauaa

SEQ ID NO: 561056 - RNA, 20 nt, Homo sapiens
uauuaaggaagacaauguga

SEQ ID NO: 561057 - RNA, 20 nt, Homo sapiens
uauuaaggccuuuuccacac

SEQ ID NO: 561058 - RNA, 18 nt, Homo sapiens
uauuaagguaacuacugc

SEQ ID NO: 561059 - RNA, 20 nt, Homo sapiens
uauuaagguuuucaaccgga

SEQ ID NO: 561060 - RNA, 23 nt, Homo sapiens
uauuaauaaagcauucuuuaaca

SEQ ID NO: 561061 - RNA, 13 nt, Homo sapiens
uccauuagucaau

SEQ ID NO: 561062 - RNA, 20 nt, Homo sapiens
uccauuccagucaaaucugg

SEQ ID NO: 561063 - RNA, 13 nt, Homo sapiens
uccauucucugag

SEQ ID NO: 561064 - RNA, 15 nt, Homo sapiens
uccauucucugaguc

SEQ ID NO: 561065 - RNA, 19 nt, Homo sapiens
uccauucuggaaacaccug

SEQ ID NO: 561066 - RNA, 22 nt, Homo sapiens
uccauuggaucuuuuacuuuaa

SEQ ID NO: 561067 - RNA, 17 nt, Homo sapiens
uccauugguucuuccuu

SEQ ID NO: 561068 - RNA, 20 nt, Homo sapiens
uccauuuaagacacauugac

SEQ ID NO: 561069 - RNA, 20 nt, Homo sapiens
uccauuucccacaucuuucc

SEQ ID NO: 561070 - RNA, 20 nt, Homo sapiens
uccauuuccccuccuuccca

SEQ ID NO: 561071 - RNA, 13 nt, Homo sapiens
uccauuugacaaa

SEQ ID NO: 561072 - RNA, 13 nt, Homo sapiens
uccauuuuacaca

SEQ ID NO: 561073 - RNA, 21 nt, Homo sapiens
uccauuuucuucucugugaag

SEQ ID NO: 561074 - RNA, 20 nt, Homo sapiens
uccauuuugugaauugugac

SEQ ID NO: 561075 - RNA, 22 nt, Homo sapiens
uccauuuuuuucuaauggaaug

SEQ ID NO: 561076 - RNA, 15 nt, Homo sapiens
ucccaaaccagacac

SEQ ID NO: 561077 - RNA, 14 nt, Homo sapiens
ucccaaagcacuuu

SEQ ID NO: 561078 - RNA, 14 nt, Homo sapiens
ucccaaagccagaa

SEQ ID NO: 561079 - RNA, 15 nt, Homo sapiens
ucccaaagccagaac

SEQ ID NO: 561080 - RNA, 19 nt, Homo sapiens
ucccaaagccagaaccaga

SEQ ID NO: 561081 - RNA, 15 nt, Homo sapiens
ucccaacacuuugag

SEQ ID NO: 561082 - RNA, 16 nt, Homo sapiens
ucccaacacuuugaga

SEQ ID NO: 561083 - RNA, 21 nt, Homo sapiens
ucccaacccauucacuacagg

SEQ ID NO: 561084 - RNA, 15 nt, Homo sapiens
ucccaaccccaggaa

SEQ ID NO: 561085 - RNA, 14 nt, Homo sapiens
ucccaacucuugca

SEQ ID NO: 561086 - RNA, 21 nt, Homo sapiens
ucccaacucuugcacagucac

SEQ ID NO: 561087 - RNA, 15 nt, Homo sapiens
ucccaagagcauaac

SEQ ID NO: 561088 - RNA, 15 nt, Homo sapiens
ucccaagaguauccu

SEQ ID NO: 561089 - RNA, 16 nt, Homo sapiens
ucccaagguccucuca

SEQ ID NO: 561090 - RNA, 20 nt, Homo sapiens
ucccaagguccucucaguuc

SEQ ID NO: 561091 - RNA, 19 nt, Homo sapiens
ucccaaguagcugcaacaa

SEQ ID NO: 561092 - RNA, 14 nt, Homo sapiens
ucccaaguaugccu

SEQ ID NO: 561093 - RNA, 22 nt, Homo sapiens
ucccaauaaaagugacucucag

SEQ ID NO: 561094 - RNA, 23 nt, Homo sapiens
ucccaauaacuaaugcuaagaaa

SEQ ID NO: 561095 - RNA, 21 nt, Homo sapiens
ucccaauccuuaucccaagcu

SEQ ID NO: 561096 - RNA, 20 nt, Homo sapiens
ucccaauuaagaaauuccau

SEQ ID NO: 561097 - RNA, 20 nt, Homo sapiens
ucccaauuagcuuggccuac

SEQ ID NO: 561098 - RNA, 21 nt, Homo sapiens
ucccacacuguccauucuucc

SEQ ID NO: 561099 - RNA, 13 nt, Homo sapiens
ucccacacugugc

SEQ ID NO: 561100 - RNA, 14 nt, Homo sapiens
ucccaccacaggca

SEQ ID NO: 561101 - RNA, 13 nt, Homo sapiens
ucccaccagagac

SEQ ID NO: 561102 - RNA, 16 nt, Homo sapiens
ucccaccauuccugcc

SEQ ID NO: 561103 - RNA, 14 nt, Homo sapiens
ucccacccaacagc

SEQ ID NO: 561104 - RNA, 23 nt, Homo sapiens
ucccacccacacagcugcccuag

SEQ ID NO: 561105 - RNA, 17 nt, Homo sapiens
ucccacccccaucucuc

SEQ ID NO: 561106 - RNA, 18 nt, Homo sapiens
ucccacccccaucucucc

SEQ ID NO: 561107 - RNA, 21 nt, Homo sapiens
ucccaccuagugccccagacu

SEQ ID NO: 561108 - RNA, 23 nt, Homo sapiens
ucccaccuccauuugcaauugac

SEQ ID NO: 561109 - RNA, 14 nt, Homo sapiens
ucccacgaggaauc

SEQ ID NO: 561110 - RNA, 15 nt, Homo sapiens
ucccacggugcccaa

SEQ ID NO: 561111 - RNA, 17 nt, Homo sapiens
ucccacuaaagugucaa

SEQ ID NO: 561112 - RNA, 19 nt, Homo sapiens
ucccacuauuuauuacuga

SEQ ID NO: 561113 - RNA, 11 nt, Homo sapiens
ucccacuccag

SEQ ID NO: 561114 - RNA, 16 nt, Homo sapiens
ucccacucuucuugca

SEQ ID NO: 561115 - RNA, 12 nt, Homo sapiens
ucccacuggaag

SEQ ID NO: 561116 - RNA, 19 nt, Homo sapiens
ucccacuuccuccuaccug

SEQ ID NO: 561117 - RNA, 22 nt, Homo sapiens
ucccacuuggaggccuuucauc

SEQ ID NO: 561118 - RNA, 23 nt, Homo sapiens
ucccagaaaaacuggcucugauu

SEQ ID NO: 561119 - RNA, 14 nt, Homo sapiens
ucccagaaacucca

SEQ ID NO: 561120 - RNA, 23 nt, Homo sapiens
ucccagaaauuagaaaccuuaau

SEQ ID NO: 561121 - RNA, 13 nt, Homo sapiens
ucccagacacugg

SEQ ID NO: 561122 - RNA, 13 nt, Homo sapiens
ucccagagcaccu

SEQ ID NO: 561123 - RNA, 21 nt, Homo sapiens
ucccagaggagccaccaguuc

SEQ ID NO: 561124 - RNA, 16 nt, Homo sapiens
ucccagagucaucuga

SEQ ID NO: 561125 - RNA, 16 nt, Homo sapiens
ucccagauacacuaaa

SEQ ID NO: 561126 - RNA, 21 nt, Homo sapiens
ucccagauguuggaccaacac

SEQ ID NO: 561127 - RNA, 17 nt, Homo sapiens
ucccagcagcccaagcu

SEQ ID NO: 561128 - RNA, 17 nt, Homo sapiens
ucccagccacaguguua

SEQ ID NO: 561129 - RNA, 20 nt, Homo sapiens
ucccagccccggcaagccac

SEQ ID NO: 561130 - RNA, 19 nt, Homo sapiens
ucccagccugguuugcaaa

SEQ ID NO: 561131 - RNA, 22 nt, Homo sapiens
ucccagcuacucagguggcuaa

SEQ ID NO: 561132 - RNA, 16 nt, Homo sapiens
ucccagcuacucggga

SEQ ID NO: 561133 - RNA, 14 nt, Homo sapiens
ucccagcugcacuu

SEQ ID NO: 561134 - RNA, 18 nt, Homo sapiens
ucccaggaaagaagcauu

SEQ ID NO: 561135 - RNA, 22 nt, Homo sapiens
ucccaggagcagcggggcagug

SEQ ID NO: 561136 - RNA, 21 nt, Homo sapiens
ucccaggccaggcuuuguugc

SEQ ID NO: 561137 - RNA, 21 nt, Homo sapiens
ucccaggcugcuggagugcag

SEQ ID NO: 561138 - RNA, 22 nt, Homo sapiens
ucccaggcugcuggagugcagu

SEQ ID NO: 561139 - RNA, 19 nt, Homo sapiens
ucccaggcuggagugcagu

SEQ ID NO: 561140 - RNA, 20 nt, Homo sapiens
ucccaggcuggagugcagug

SEQ ID NO: 561141 - RNA, 21 nt, Homo sapiens
ucccaggggagccagcugcuu

SEQ ID NO: 561142 - RNA, 12 nt, Homo sapiens
ucccagucccau

SEQ ID NO: 561143 - RNA, 17 nt, Homo sapiens
ucccagugggugaugcu

SEQ ID NO: 561144 - RNA, 11 nt, Homo sapiens
ucccagugugu

SEQ ID NO: 561145 - RNA, 16 nt, Homo sapiens
ucccaucaauucuuag

SEQ ID NO: 561146 - RNA, 17 nt, Homo sapiens
ucccaucaauucuuaga

SEQ ID NO: 561147 - RNA, 15 nt, Homo sapiens
ucccaucacuucccu

SEQ ID NO: 561148 - RNA, 15 nt, Homo sapiens
ucccauccagugucu

SEQ ID NO: 561149 - RNA, 23 nt, Homo sapiens
ucccauccuggggcagcacuccc

SEQ ID NO: 561150 - RNA, 15 nt, Homo sapiens
ucccaucuuuacucc

SEQ ID NO: 561151 - RNA, 16 nt, Homo sapiens
ucccaugaccccaaag

SEQ ID NO: 561152 - RNA, 23 nt, Homo sapiens
ucccaugacuccuggaucuaugu

SEQ ID NO: 561153 - RNA, 15 nt, Homo sapiens
ucccaugacugcacc

SEQ ID NO: 561154 - RNA, 15 nt, Homo sapiens
ucccauggaaccacu

SEQ ID NO: 561155 - RNA, 16 nt, Homo sapiens
ucccauggacacucca

SEQ ID NO: 561156 - RNA, 22 nt, Homo sapiens
ucccauggguuguguguuuauu

SEQ ID NO: 561157 - RNA, 18 nt, Homo sapiens
ucccauguuagcuacaca

SEQ ID NO: 561158 - RNA, 18 nt, Homo sapiens
ucccauguugcaugccua

SEQ ID NO: 561159 - RNA, 14 nt, Homo sapiens
ucccauuacuuuga

SEQ ID NO: 561160 - RNA, 22 nt, Homo sapiens
ucccauuacuuugauaucugau

SEQ ID NO: 561161 - RNA, 23 nt, Homo sapiens
ucccauuauuauuucuguucuua

SEQ ID NO: 561162 - RNA, 15 nt, Homo sapiens
ucccauucuugcaug

SEQ ID NO: 561163 - RNA, 18 nt, Homo sapiens
ucccauuucuugcuagcu

SEQ ID NO: 561164 - RNA, 22 nt, Homo sapiens
ucccauuuuugcuuagcucaau

SEQ ID NO: 561165 - RNA, 23 nt, Homo sapiens
uccccaaacauuaaucaccaaag

SEQ ID NO: 561166 - RNA, 15 nt, Homo sapiens
uccccaaaccauaaa

SEQ ID NO: 561167 - RNA, 16 nt, Homo sapiens
uccccaaacccagaaa

SEQ ID NO: 561168 - RNA, 18 nt, Homo sapiens
ugagcccgguaagagcaa

SEQ ID NO: 561169 - RNA, 17 nt, Homo sapiens
ugagccgugaacugugc

SEQ ID NO: 561170 - RNA, 16 nt, Homo sapiens
ugagccuacgcugaag

SEQ ID NO: 561171 - RNA, 21 nt, Homo sapiens
ugagccucguguccagacuca

SEQ ID NO: 561172 - RNA, 14 nt, Homo sapiens
ugagccugcaucuu

SEQ ID NO: 561173 - RNA, 20 nt, Homo sapiens
ugagccuugcauguacuuga

SEQ ID NO: 561174 - RNA, 20 nt, Homo sapiens
ugagcgcuguggacuguccu

SEQ ID NO: 561175 - RNA, 14 nt, Homo sapiens
ugagcuaaucuuca

SEQ ID NO: 561176 - RNA, 13 nt, Homo sapiens
ugagcuacaguag

SEQ ID NO: 561177 - RNA, 20 nt, Homo sapiens
ugagcuacuucaaauguggu

SEQ ID NO: 561178 - RNA, 15 nt, Homo sapiens
ugagcugagugcuga

SEQ ID NO: 561179 - RNA, 21 nt, Homo sapiens
ugagcuggaguucagcaguga

SEQ ID NO: 561180 - RNA, 12 nt, Homo sapiens
ugagcugugaug

SEQ ID NO: 561181 - RNA, 14 nt, Homo sapiens
ugagcuucaguaua

SEQ ID NO: 561182 - RNA, 19 nt, Homo sapiens
ugagcuuuccauguugcug

SEQ ID NO: 561183 - RNA, 16 nt, Homo sapiens
ugaggaaaagacugug

SEQ ID NO: 561184 - RNA, 14 nt, Homo sapiens
ugaggaacauucaa

SEQ ID NO: 561185 - RNA, 24 nt, Homo sapiens
ugaggaacccugaucucucagccc

SEQ ID NO: 561186 - RNA, 20 nt, Homo sapiens
ugaggaacucacauacugac

SEQ ID NO: 561187 - RNA, 12 nt, Homo sapiens
ugaggaacuguc

SEQ ID NO: 561188 - RNA, 14 nt, Homo sapiens
ugaggaacugucuc

SEQ ID NO: 561189 - RNA, 17 nt, Homo sapiens
ugaggaauauuugcaag

SEQ ID NO: 561190 - RNA, 18 nt, Homo sapiens
ugaggaauguacuuuuaa

SEQ ID NO: 561191 - RNA, 14 nt, Homo sapiens
ugaggaauguauau

SEQ ID NO: 561192 - RNA, 15 nt, Homo sapiens
ugaggaccacuccug

SEQ ID NO: 561193 - RNA, 23 nt, Homo sapiens
ugaggacuuaaaauauuccugca

SEQ ID NO: 561194 - RNA, 15 nt, Homo sapiens
ugaggagccucccag

SEQ ID NO: 561195 - RNA, 17 nt, Homo sapiens
ugaggagcugcacugau

SEQ ID NO: 561196 - RNA, 13 nt, Homo sapiens
ugaggaggacaag

SEQ ID NO: 561197 - RNA, 23 nt, Homo sapiens
ugaggauacgacaguacacuguc

SEQ ID NO: 561198 - RNA, 12 nt, Homo sapiens
ugaggauuucaa

SEQ ID NO: 561199 - RNA, 13 nt, Homo sapiens
ugaggauuucaag

SEQ ID NO: 561200 - RNA, 19 nt, Homo sapiens
ugaggcaaauuaacuguau

SEQ ID NO: 561201 - RNA, 20 nt, Homo sapiens
ugaggcaaauuaacuguaug

SEQ ID NO: 561202 - RNA, 13 nt, Homo sapiens
ugaggcaggagaa

SEQ ID NO: 561203 - RNA, 22 nt, Homo sapiens
ugaggcaggagaaucucuugaa

SEQ ID NO: 561204 - RNA, 20 nt, Homo sapiens
ugaggcaggcaaucacuuga

SEQ ID NO: 561205 - RNA, 14 nt, Homo sapiens
ugaggcaugauuua

SEQ ID NO: 561206 - RNA, 21 nt, Homo sapiens
ugaggccacccagaggcagca

SEQ ID NO: 561207 - RNA, 17 nt, Homo sapiens
ugaggccagaccaugga

SEQ ID NO: 561208 - RNA, 16 nt, Homo sapiens
ugaggccaucucagga

SEQ ID NO: 561209 - RNA, 17 nt, Homo sapiens
ugaggccaucucaggag

SEQ ID NO: 561210 - RNA, 20 nt, Homo sapiens
ugaggcccauucuucacucu

SEQ ID NO: 561211 - RNA, 21 nt, Homo sapiens
ugaggcccugagcauucuugg

SEQ ID NO: 561212 - RNA, 16 nt, Homo sapiens
ugaggcccugcccaau

SEQ ID NO: 561213 - RNA, 14 nt, Homo sapiens
ugaggcccugugau

SEQ ID NO: 561214 - RNA, 15 nt, Homo sapiens
ugaggcccugugaua

SEQ ID NO: 561215 - RNA, 18 nt, Homo sapiens
ugaggccuggacuuuccu

SEQ ID NO: 561216 - RNA, 11 nt, Homo sapiens
ugaggccugug

SEQ ID NO: 561217 - RNA, 16 nt, Homo sapiens
ugaggcggagaauugc

SEQ ID NO: 561218 - RNA, 22 nt, Homo sapiens
ugaggcugcgagagaaagggag

SEQ ID NO: 561219 - RNA, 12 nt, Homo sapiens
ugaggcuucuaa

SEQ ID NO: 561220 - RNA, 16 nt, Homo sapiens
ugagggaaaaugagua

SEQ ID NO: 561221 - RNA, 23 nt, Homo sapiens
ugagggaauccauugaacuggaa

SEQ ID NO: 561222 - RNA, 11 nt, Homo sapiens
ugagggacaau

SEQ ID NO: 561223 - RNA, 13 nt, Homo sapiens
ugagggacaaugc

SEQ ID NO: 561224 - RNA, 21 nt, Homo sapiens
ugagggaggaagaaggcagug

SEQ ID NO: 561225 - RNA, 15 nt, Homo sapiens
ugagggcagcacugg

SEQ ID NO: 561226 - RNA, 15 nt, Homo sapiens
ugagggcaguucuga

SEQ ID NO: 561227 - RNA, 22 nt, Homo sapiens
ugagggcaguucugaguguuua

SEQ ID NO: 561228 - RNA, 15 nt, Homo sapiens
ugagggccagugaug

SEQ ID NO: 561229 - RNA, 20 nt, Homo sapiens
ugagggccagugaugauguu

SEQ ID NO: 561230 - RNA, 17 nt, Homo sapiens
ugaggggaggcaccucc

SEQ ID NO: 561231 - RNA, 11 nt, Homo sapiens
ugaggggcccc

SEQ ID NO: 561232 - RNA, 16 nt, Homo sapiens
ugaggggcuaccagga

SEQ ID NO: 561233 - RNA, 16 nt, Homo sapiens
ugaggggcuccuggaa

SEQ ID NO: 561234 - RNA, 13 nt, Homo sapiens
ugaggggcuguga

SEQ ID NO: 561235 - RNA, 14 nt, Homo sapiens
ugaggggcugugac

SEQ ID NO: 561236 - RNA, 12 nt, Homo sapiens
ugaggggugcug

SEQ ID NO: 561237 - RNA, 22 nt, Homo sapiens
ugagggguuaccucccucgccc

SEQ ID NO: 561238 - RNA, 19 nt, Homo sapiens
ugaggguaucugacaaugc

SEQ ID NO: 561239 - RNA, 11 nt, Homo sapiens
ugagggucccc

SEQ ID NO: 561240 - RNA, 16 nt, Homo sapiens
ugaggguuugugcuac

SEQ ID NO: 561241 - RNA, 16 nt, Homo sapiens
ugagguauaaagacaa

SEQ ID NO: 561242 - RNA, 19 nt, Homo sapiens
ugagguauaaagacaagua

SEQ ID NO: 561243 - RNA, 12 nt, Homo sapiens
ugaggucccuuc

SEQ ID NO: 561244 - RNA, 20 nt, Homo sapiens
ugaggugaaauucaguuaua

SEQ ID NO: 561245 - RNA, 14 nt, Homo sapiens
ugaggugaauuuca

SEQ ID NO: 561246 - RNA, 22 nt, Homo sapiens
ugaggugcaaggaguguaaaau

SEQ ID NO: 561247 - RNA, 22 nt, Homo sapiens
ugagguuaaguuucucuucacc

SEQ ID NO: 561248 - RNA, 22 nt, Homo sapiens
ugagguugggguguacuaguua

SEQ ID NO: 561249 - RNA, 19 nt, Homo sapiens
ugagguuucccccugucuc

SEQ ID NO: 561250 - RNA, 16 nt, Homo sapiens
ugagguuuugaaagaa

SEQ ID NO: 561251 - RNA, 19 nt, Homo sapiens
ugaguaaacugagacuuaa

SEQ ID NO: 561252 - RNA, 16 nt, Homo sapiens
ugaguaaucauacuca

SEQ ID NO: 561253 - RNA, 18 nt, Homo sapiens
ugaguaauuguauuguca

SEQ ID NO: 561254 - RNA, 17 nt, Homo sapiens
ugaguacauauuguggu

SEQ ID NO: 561255 - RNA, 23 nt, Homo sapiens
ugaguagcucuccugacuuuuaa

SEQ ID NO: 561256 - RNA, 22 nt, Homo sapiens
ugaguagcugggacuacaggug

SEQ ID NO: 561257 - RNA, 17 nt, Homo sapiens
ugaguagggacucaggg

SEQ ID NO: 561258 - RNA, 18 nt, Homo sapiens
ugaguagggacucagggc

SEQ ID NO: 561259 - RNA, 14 nt, Homo sapiens
ugaguaucacuuua

SEQ ID NO: 561260 - RNA, 19 nt, Homo sapiens
ugaguaucacuuuaacuca

SEQ ID NO: 561261 - RNA, 15 nt, Homo sapiens
ugaguaugaacuuga

SEQ ID NO: 561262 - RNA, 16 nt, Homo sapiens
ugagucaaaagccugg

SEQ ID NO: 561263 - RNA, 15 nt, Homo sapiens
ugagucagcaccuug

SEQ ID NO: 561264 - RNA, 16 nt, Homo sapiens
ugagucagugccauga

SEQ ID NO: 561265 - RNA, 12 nt, Homo sapiens
ugaguccaggcc

SEQ ID NO: 561266 - RNA, 17 nt, Homo sapiens
ugaguccuaggacuuaa

SEQ ID NO: 561267 - RNA, 19 nt, Homo sapiens
ugagucuauguucaaagac

SEQ ID NO: 561268 - RNA, 14 nt, Homo sapiens
ugagucuccuuuag

SEQ ID NO: 561269 - RNA, 14 nt, Homo sapiens
ugagugcagccaaa

SEQ ID NO: 561270 - RNA, 20 nt, Homo sapiens
ugaguggccagccagugcca

SEQ ID NO: 561271 - RNA, 22 nt, Homo sapiens
ugaguggccagccagugccauu

SEQ ID NO: 561272 - RNA, 15 nt, Homo sapiens
ugaguggccugcuaa

SEQ ID NO: 561273 - RNA, 13 nt, Homo sapiens
ugaguggugccaa

SEQ ID NO: 561274 - RNA, 22 nt, Homo sapiens
ugagugguguguguuaucagau

SEQ ID NO: 561275 - RNA, 23 nt, Homo sapiens
ugagugguguguguuaucagaua

SEQ ID NO: 561276 - RNA, 17 nt, Homo sapiens
ugaguguugcucucuag

SEQ ID NO: 561277 - RNA, 15 nt, Homo sapiens
ugaguuaaauuauac

SEQ ID NO: 561278 - RNA, 17 nt, Homo sapiens
ugaguuagaggagaaaa

SEQ ID NO: 561279 - RNA, 16 nt, Homo sapiens
ugaguucgaggacuac

SEQ ID NO: 561280 - RNA, 18 nt, Homo sapiens
ugaguuucuuaacccuuu

SEQ ID NO: 561281 - RNA, 14 nt, Homo sapiens
ugaguuugccucag

SEQ ID NO: 561282 - RNA, 19 nt, Homo sapiens
ugaguuugggauuguggua

SEQ ID NO: 561283 - RNA, 16 nt, Homo sapiens
ugaguuuuguguuugu

SEQ ID NO: 561284 - RNA, 12 nt, Homo sapiens
ugauaaaacugg

SEQ ID NO: 561285 - RNA, 18 nt, Homo sapiens
ugauaaaagagaagccaa

SEQ ID NO: 561286 - RNA, 16 nt, Homo sapiens
ugauaaaagauggcca

SEQ ID NO: 561287 - RNA, 13 nt, Homo sapiens
ugauaaacauuaa

SEQ ID NO: 561288 - RNA, 15 nt, Homo sapiens
ugauaaagcacagcu

SEQ ID NO: 561289 - RNA, 18 nt, Homo sapiens
ugauaaagcaguauuugg

SEQ ID NO: 561290 - RNA, 21 nt, Homo sapiens
ugauaaaguaauucauacaaa

SEQ ID NO: 561291 - RNA, 17 nt, Homo sapiens
ugauaaaugauagacaa

SEQ ID NO: 561292 - RNA, 22 nt, Homo sapiens
aaaauguacccgagcacauaga

SEQ ID NO: 561293 - RNA, 23 nt, Homo sapiens
aaaauguacucagcuaucagcuc

SEQ ID NO: 561294 - RNA, 23 nt, Homo sapiens
aaaauguagcaugauguauuuaa

SEQ ID NO: 561295 - RNA, 15 nt, Homo sapiens
aaaauguaugaccac

SEQ ID NO: 561296 - RNA, 19 nt, Homo sapiens
aaaauguaugaccacuggg

SEQ ID NO: 561297 - RNA, 14 nt, Homo sapiens
aaaauguaugucug

SEQ ID NO: 561298 - RNA, 13 nt, Homo sapiens
aaaauguccauga

SEQ ID NO: 561299 - RNA, 22 nt, Homo sapiens
aaaauguguuccauugccauag

SEQ ID NO: 561300 - RNA, 12 nt, Homo sapiens
aaaauguucaca

SEQ ID NO: 561301 - RNA, 23 nt, Homo sapiens
aaaauguuuaaauucucuuucac

SEQ ID NO: 561302 - RNA, 19 nt, Homo sapiens
aaaauguuucuacagauau

SEQ ID NO: 561303 - RNA, 22 nt, Homo sapiens
aaaauguuuugaaaagaacaaa

SEQ ID NO: 561304 - RNA, 16 nt, Homo sapiens
aaaauuaaaaccaauu

SEQ ID NO: 561305 - RNA, 13 nt, Homo sapiens
aaaauuacauaua

SEQ ID NO: 561306 - RNA, 14 nt, Homo sapiens
aaaauuaugaccau

SEQ ID NO: 561307 - RNA, 12 nt, Homo sapiens
aaaauuaugcaa

SEQ ID NO: 561308 - RNA, 14 nt, Homo sapiens
aaaauuaugcaaau

SEQ ID NO: 561309 - RNA, 14 nt, Homo sapiens
aaaauuaugccaua

SEQ ID NO: 561310 - RNA, 19 nt, Homo sapiens
aaaauuauguuugccacuu

SEQ ID NO: 561311 - RNA, 18 nt, Homo sapiens
aaaauuauuugcauaaca

SEQ ID NO: 561312 - RNA, 13 nt, Homo sapiens
aaaauuauuugcu

SEQ ID NO: 561313 - RNA, 17 nt, Homo sapiens
aaaauucagagaguuag

SEQ ID NO: 561314 - RNA, 13 nt, Homo sapiens
aaaauucauuucu

SEQ ID NO: 561315 - RNA, 17 nt, Homo sapiens
aaaauuccaaauucaug

SEQ ID NO: 561316 - RNA, 18 nt, Homo sapiens
aaaauucccuaaagacua

SEQ ID NO: 561317 - RNA, 15 nt, Homo sapiens
aaaauugacuuagau

SEQ ID NO: 561318 - RNA, 15 nt, Homo sapiens
aaaauuguagcuuuu

SEQ ID NO: 561319 - RNA, 20 nt, Homo sapiens
aaaauuuaaaggguguacuu

SEQ ID NO: 561320 - RNA, 15 nt, Homo sapiens
aaaauuugcugccaa

SEQ ID NO: 561321 - RNA, 16 nt, Homo sapiens
aaaauuuuuacauuca

SEQ ID NO: 561322 - RNA, 22 nt, Homo sapiens
aaacaaaaaaaccucuaugcaa

SEQ ID NO: 561323 - RNA, 16 nt, Homo sapiens
aaacaaaaaacugccu

SEQ ID NO: 561324 - RNA, 17 nt, Homo sapiens
aaacaaaaggguguaua

SEQ ID NO: 561325 - RNA, 13 nt, Homo sapiens
aaacaaacuucca

SEQ ID NO: 561326 - RNA, 15 nt, Homo sapiens
aaacaaaguuuuaaa

SEQ ID NO: 561327 - RNA, 13 nt, Homo sapiens
aaacaaauaugca

SEQ ID NO: 561328 - RNA, 17 nt, Homo sapiens
aaacaaauguauuucaa

SEQ ID NO: 561329 - RNA, 13 nt, Homo sapiens
aaacaaauucauu

SEQ ID NO: 561330 - RNA, 14 nt, Homo sapiens
aaacaacaaaaacc

SEQ ID NO: 561331 - RNA, 13 nt, Homo sapiens
aaacaacauuuau

SEQ ID NO: 561332 - RNA, 21 nt, Homo sapiens
aaacaaccauuuuuuguucug

SEQ ID NO: 561333 - RNA, 15 nt, Homo sapiens
aaacaacuaccuccu

SEQ ID NO: 561334 - RNA, 12 nt, Homo sapiens
aaacaacucuuu

SEQ ID NO: 561335 - RNA, 18 nt, Homo sapiens
aaacaacuuccucccuua

SEQ ID NO: 561336 - RNA, 17 nt, Homo sapiens
aaacaacuuggcauuuc

SEQ ID NO: 561337 - RNA, 20 nt, Homo sapiens
aaacaagaaaucugacaaua

SEQ ID NO: 561338 - RNA, 19 nt, Homo sapiens
aaacaagacugccucccuc

SEQ ID NO: 561339 - RNA, 16 nt, Homo sapiens
aaacaagcaacagaug

SEQ ID NO: 561340 - RNA, 14 nt, Homo sapiens
aaacaagccaaaga

SEQ ID NO: 561341 - RNA, 13 nt, Homo sapiens
aaacaagccuuaa

SEQ ID NO: 561342 - RNA, 14 nt, Homo sapiens
aaacaaggaagcca

SEQ ID NO: 561343 - RNA, 14 nt, Homo sapiens
aaacaaguauuugu

SEQ ID NO: 561344 - RNA, 15 nt, Homo sapiens
aaacaauaugcuccu

SEQ ID NO: 561345 - RNA, 18 nt, Homo sapiens
aaacaaugaaaacucuuu

SEQ ID NO: 561346 - RNA, 15 nt, Homo sapiens
aaacaaugaaauauu

SEQ ID NO: 561347 - RNA, 12 nt, Homo sapiens
aaacaauuccac

SEQ ID NO: 561348 - RNA, 15 nt, Homo sapiens
aaacaauucugugac

SEQ ID NO: 561349 - RNA, 20 nt, Homo sapiens
aaacaauuggcaaacuuugu

SEQ ID NO: 561350 - RNA, 19 nt, Homo sapiens
aaacacacauugcagcuuc

SEQ ID NO: 561351 - RNA, 19 nt, Homo sapiens
aaacacacuguauuuuaca

SEQ ID NO: 561352 - RNA, 14 nt, Homo sapiens
aaacacacuucuua

SEQ ID NO: 561353 - RNA, 17 nt, Homo sapiens
aaacacagagcuauaaa

SEQ ID NO: 561354 - RNA, 13 nt, Homo sapiens
aaacacauauuca

SEQ ID NO: 561355 - RNA, 20 nt, Homo sapiens
aaacacccuuucaucucaga

SEQ ID NO: 561356 - RNA, 21 nt, Homo sapiens
aaacaccggcagaaaacggag

SEQ ID NO: 561357 - RNA, 14 nt, Homo sapiens
aaacaccuccucau

SEQ ID NO: 561358 - RNA, 15 nt, Homo sapiens
aaacacuauuuccaa

SEQ ID NO: 561359 - RNA, 22 nt, Homo sapiens
aaacacuauuuccaaaagcaca

SEQ ID NO: 561360 - RNA, 13 nt, Homo sapiens
aaacacuguggaa

SEQ ID NO: 561361 - RNA, 20 nt, Homo sapiens
aaacacuucugcuuucacuu

SEQ ID NO: 561362 - RNA, 23 nt, Homo sapiens
aaacagaacugcagucagcauga

SEQ ID NO: 561363 - RNA, 19 nt, Homo sapiens
aaacagauggcacuuugaa

SEQ ID NO: 561364 - RNA, 20 nt, Homo sapiens
aaacagauucugauucccuu

SEQ ID NO: 561365 - RNA, 22 nt, Homo sapiens
aaacagccucuuuuugauacug

SEQ ID NO: 561366 - RNA, 12 nt, Homo sapiens
aaacaggccagg

SEQ ID NO: 561367 - RNA, 21 nt, Homo sapiens
aaacagggcugccuucuggcc

SEQ ID NO: 561368 - RNA, 13 nt, Homo sapiens
aaacagugcuguu

SEQ ID NO: 561369 - RNA, 19 nt, Homo sapiens
aaacauaaagagaacucug

SEQ ID NO: 561370 - RNA, 18 nt, Homo sapiens
aaacauaaggcacauugu

SEQ ID NO: 561371 - RNA, 18 nt, Homo sapiens
aaacauaauaccaccauu

SEQ ID NO: 561372 - RNA, 16 nt, Homo sapiens
aaacauauucaaagca

SEQ ID NO: 561373 - RNA, 11 nt, Homo sapiens
aaacaucucaa

SEQ ID NO: 561374 - RNA, 20 nt, Homo sapiens
aaacaucuccccucucaccu

SEQ ID NO: 561375 - RNA, 21 nt, Homo sapiens
aaacaugagcauccccagcca

SEQ ID NO: 561376 - RNA, 20 nt, Homo sapiens
aaacaugcugaaaacuacac

SEQ ID NO: 561377 - RNA, 20 nt, Homo sapiens
aaacaugguggguccauggg

SEQ ID NO: 561378 - RNA, 12 nt, Homo sapiens
aaacauguucuc

SEQ ID NO: 561379 - RNA, 19 nt, Homo sapiens
aaacauguuuaaauagccu

SEQ ID NO: 561380 - RNA, 19 nt, Homo sapiens
aaacauucacacagggcuc

SEQ ID NO: 561381 - RNA, 12 nt, Homo sapiens
aaacauugaaga

SEQ ID NO: 561382 - RNA, 21 nt, Homo sapiens
aaacauugaaguaaugaauuu

SEQ ID NO: 561383 - RNA, 14 nt, Homo sapiens
aaacauugccuuug

SEQ ID NO: 561384 - RNA, 23 nt, Homo sapiens
aaacauugccuuugaauguuaau

SEQ ID NO: 561385 - RNA, 11 nt, Homo sapiens
aaacauuucaa

SEQ ID NO: 561386 - RNA, 22 nt, Homo sapiens
aaacauuucaaugucagccuuu

SEQ ID NO: 561387 - RNA, 19 nt, Homo sapiens
aaacauuuuucacaucucu

SEQ ID NO: 561388 - RNA, 11 nt, Homo sapiens
aaaccaaaaaa

SEQ ID NO: 561389 - RNA, 16 nt, Homo sapiens
aaaccaaaagaauuug

SEQ ID NO: 561390 - RNA, 22 nt, Homo sapiens
aaaccaaacccagccacugcca

SEQ ID NO: 561391 - RNA, 18 nt, Homo sapiens
aaaccaaagagggcuucc

SEQ ID NO: 561392 - RNA, 21 nt, Homo sapiens
aaaccaaaguaaccuuuugca

SEQ ID NO: 561393 - RNA, 19 nt, Homo sapiens
aaaccaagauuaugugacu

SEQ ID NO: 561394 - RNA, 13 nt, Homo sapiens
aaaccaagccaug

SEQ ID NO: 561395 - RNA, 17 nt, Homo sapiens
aaaccaaggacugagca

SEQ ID NO: 561396 - RNA, 16 nt, Homo sapiens
aaaccaauagcuuuaa

SEQ ID NO: 561397 - RNA, 15 nt, Homo sapiens
aaaccaauucaccaa

SEQ ID NO: 561398 - RNA, 17 nt, Homo sapiens
aaaccaccgugaaccag

SEQ ID NO: 561399 - RNA, 18 nt, Homo sapiens
aaaccaccuaguucuccc

SEQ ID NO: 561400 - RNA, 15 nt, Homo sapiens
aaaccagaaaagcaa

SEQ ID NO: 561401 - RNA, 21 nt, Homo sapiens
aaaccagaagaagugugagaa

SEQ ID NO: 561402 - RNA, 21 nt, Homo sapiens
aaaccaggauuuccuugacuu

SEQ ID NO: 561403 - RNA, 21 nt, Homo sapiens
aaaccauaaaacccuauacaa

SEQ ID NO: 561404 - RNA, 22 nt, Homo sapiens
aaaccauaaaacccuauacaag

SEQ ID NO: 561405 - RNA, 14 nt, Homo sapiens
aaaccauaacugac

SEQ ID NO: 561406 - RNA, 22 nt, Homo sapiens
aaaccaucaaguugugccaaau

SEQ ID NO: 561407 - RNA, 13 nt, Homo sapiens
aaaccaugacaaa

SEQ ID NO: 561408 - RNA, 17 nt, Homo sapiens
aaaccauguauucccuu

SEQ ID NO: 561409 - RNA, 15 nt, Homo sapiens
aaaccauuaccugua

SEQ ID NO: 561410 - RNA, 20 nt, Homo sapiens
aaaccauucuagguguuuca

SEQ ID NO: 561411 - RNA, 14 nt, Homo sapiens
aaaccauucuuucc

SEQ ID NO: 561412 - RNA, 14 nt, Homo sapiens
aaacccaaaacagu

SEQ ID NO: 561413 - RNA, 18 nt, Homo sapiens
aaacccaaaacaguaaaa

SEQ ID NO: 561414 - RNA, 23 nt, Homo sapiens
aaacccaagugccuucagaggau

SEQ ID NO: 561415 - RNA, 19 nt, Homo sapiens
aagaauuuuugaagugacu

SEQ ID NO: 561416 - RNA, 16 nt, Homo sapiens
aagacaaaaccaaaac

SEQ ID NO: 561417 - RNA, 14 nt, Homo sapiens
aagacaaacuccug

SEQ ID NO: 561418 - RNA, 18 nt, Homo sapiens
aagacaacagcauaacua

SEQ ID NO: 561419 - RNA, 13 nt, Homo sapiens
aagacacagugac

SEQ ID NO: 561420 - RNA, 21 nt, Homo sapiens
aagacacauugacuccuuucc

SEQ ID NO: 561421 - RNA, 17 nt, Homo sapiens
aagacaccguucauuca

SEQ ID NO: 561422 - RNA, 12 nt, Homo sapiens
aagacacuguga

SEQ ID NO: 561423 - RNA, 21 nt, Homo sapiens
aagacacuuuugaugacgauu

SEQ ID NO: 561424 - RNA, 18 nt, Homo sapiens
aagacagaaaagugccug

SEQ ID NO: 561425 - RNA, 21 nt, Homo sapiens
aagacauaaacccaguugcca

SEQ ID NO: 561426 - RNA, 13 nt, Homo sapiens
aagacaucugccu

SEQ ID NO: 561427 - RNA, 22 nt, Homo sapiens
aagacaucuguggccaacaauc

SEQ ID NO: 561428 - RNA, 18 nt, Homo sapiens
aagacauggaauuaccuu

SEQ ID NO: 561429 - RNA, 16 nt, Homo sapiens
aagacauuucugcaca

SEQ ID NO: 561430 - RNA, 14 nt, Homo sapiens
aagaccaaagcaga

SEQ ID NO: 561431 - RNA, 22 nt, Homo sapiens
aagaccaagacuuuugucugau

SEQ ID NO: 561432 - RNA, 14 nt, Homo sapiens
aagaccaauauuca

SEQ ID NO: 561433 - RNA, 13 nt, Homo sapiens
aagaccagacugu

SEQ ID NO: 561434 - RNA, 15 nt, Homo sapiens
aagaccagcuuugca

SEQ ID NO: 561435 - RNA, 19 nt, Homo sapiens
aagacccaacaggugcuga

SEQ ID NO: 561436 - RNA, 16 nt, Homo sapiens
aagacccccagcacuu

SEQ ID NO: 561437 - RNA, 13 nt, Homo sapiens
aagacccugccau

SEQ ID NO: 561438 - RNA, 18 nt, Homo sapiens
aagaccuauaaaucauua

SEQ ID NO: 561439 - RNA, 22 nt, Homo sapiens
aagaccucgagcagaugaugcc

SEQ ID NO: 561440 - RNA, 22 nt, Homo sapiens
aagacgucucuuuuugguaaua

SEQ ID NO: 561441 - RNA, 14 nt, Homo sapiens
aagacuaaacuggu

SEQ ID NO: 561442 - RNA, 13 nt, Homo sapiens
aagacuacugaau

SEQ ID NO: 561443 - RNA, 22 nt, Homo sapiens
aagacucaggagucugccacuu

SEQ ID NO: 561444 - RNA, 19 nt, Homo sapiens
aagacucaguaugcuuucc

SEQ ID NO: 561445 - RNA, 15 nt, Homo sapiens
aagacucugaacaau

SEQ ID NO: 561446 - RNA, 17 nt, Homo sapiens
aagacucugaccagaga

SEQ ID NO: 561447 - RNA, 17 nt, Homo sapiens
aagacucuugaagacaa

SEQ ID NO: 561448 - RNA, 22 nt, Homo sapiens
aagacuggaagcuaauuugcau

SEQ ID NO: 561449 - RNA, 19 nt, Homo sapiens
aagacugucagcuuccaaa

SEQ ID NO: 561450 - RNA, 23 nt, Homo sapiens
aagacuguuaaaugaaaccagaa

SEQ ID NO: 561451 - RNA, 14 nt, Homo sapiens
aagacuuaacuggu

SEQ ID NO: 561452 - RNA, 15 nt, Homo sapiens
aagacuuaacugguu

SEQ ID NO: 561453 - RNA, 21 nt, Homo sapiens
aagacuuaagcccagugcacu

SEQ ID NO: 561454 - RNA, 22 nt, Homo sapiens
aagacuucaguauguugucaaa

SEQ ID NO: 561455 - RNA, 14 nt, Homo sapiens
aagacuucuugggu

SEQ ID NO: 561456 - RNA, 11 nt, Homo sapiens
aagacuugaga

SEQ ID NO: 561457 - RNA, 18 nt, Homo sapiens
aagacuuggguugaucuc

SEQ ID NO: 561458 - RNA, 23 nt, Homo sapiens
aagacuuuuuuuuaacacuuugg

SEQ ID NO: 561459 - RNA, 19 nt, Homo sapiens
aagagaaaaaauauuuucc

SEQ ID NO: 561460 - RNA, 21 nt, Homo sapiens
aagagaaaaagcagaggccaa

SEQ ID NO: 561461 - RNA, 18 nt, Homo sapiens
aagagaaccgagcaaaga

SEQ ID NO: 561462 - RNA, 22 nt, Homo sapiens
aagagaagcccagcucugggaa

SEQ ID NO: 561463 - RNA, 14 nt, Homo sapiens
aagagaaguuguaa

SEQ ID NO: 561464 - RNA, 22 nt, Homo sapiens
aagagaaugaacuguggaauuu

SEQ ID NO: 561465 - RNA, 18 nt, Homo sapiens
aagagacaagaucuugaa

SEQ ID NO: 561466 - RNA, 19 nt, Homo sapiens
aagagacagaacuguccac

SEQ ID NO: 561467 - RNA, 19 nt, Homo sapiens
aagagacuggagcaucuga

SEQ ID NO: 561468 - RNA, 21 nt, Homo sapiens
aagagagaaagaaguaggcau

SEQ ID NO: 561469 - RNA, 21 nt, Homo sapiens
aagagagaacaacuacuguga

SEQ ID NO: 561470 - RNA, 21 nt, Homo sapiens
aagagagaucuugauccacag

SEQ ID NO: 561471 - RNA, 21 nt, Homo sapiens
aagagaggaaugccuguguga

SEQ ID NO: 561472 - RNA, 22 nt, Homo sapiens
aagagaggcgucugcugucuca

SEQ ID NO: 561473 - RNA, 18 nt, Homo sapiens
aagagagggacaggcacu

SEQ ID NO: 561474 - RNA, 16 nt, Homo sapiens
aagagaguaaacagac

SEQ ID NO: 561475 - RNA, 17 nt, Homo sapiens
aagagagucgcaucuca

SEQ ID NO: 561476 - RNA, 16 nt, Homo sapiens
aagagauaacuguaaa

SEQ ID NO: 561477 - RNA, 19 nt, Homo sapiens
aagagauagagaccaucuu

SEQ ID NO: 561478 - RNA, 23 nt, Homo sapiens
aagagaucuuucuuuccaaaaca

SEQ ID NO: 561479 - RNA, 23 nt, Homo sapiens
aagagaugcacuauauguuuaca

SEQ ID NO: 561480 - RNA, 13 nt, Homo sapiens
aagagcaacaauc

SEQ ID NO: 561481 - RNA, 22 nt, Homo sapiens
aagagcaggacuccaggcccaa

SEQ ID NO: 561482 - RNA, 16 nt, Homo sapiens
aagagcaucaggcuca

SEQ ID NO: 561483 - RNA, 19 nt, Homo sapiens
aagagccauauaaguuuga

SEQ ID NO: 561484 - RNA, 15 nt, Homo sapiens
aagagccauucacuc

SEQ ID NO: 561485 - RNA, 22 nt, Homo sapiens
aagagcccccuugacaccgggg

SEQ ID NO: 561486 - RNA, 22 nt, Homo sapiens
aagagcuaaguucuaaguucau

SEQ ID NO: 561487 - RNA, 19 nt, Homo sapiens
aagagcuauggcccagaaa

SEQ ID NO: 561488 - RNA, 14 nt, Homo sapiens
aagagcuggaugca

SEQ ID NO: 561489 - RNA, 12 nt, Homo sapiens
aagagcuuugua

SEQ ID NO: 561490 - RNA, 21 nt, Homo sapiens
aagaggaaugugcaacauucu

SEQ ID NO: 561491 - RNA, 14 nt, Homo sapiens
aagaggauacaaau

SEQ ID NO: 561492 - RNA, 19 nt, Homo sapiens
aagaggcaccacuaaaaga

SEQ ID NO: 561493 - RNA, 13 nt, Homo sapiens
aagaggccuguuu

SEQ ID NO: 561494 - RNA, 18 nt, Homo sapiens
aagaggcugccccucuca

SEQ ID NO: 561495 - RNA, 21 nt, Homo sapiens
aagaggcugccccucucacca

SEQ ID NO: 561496 - RNA, 17 nt, Homo sapiens
aagaggcugcugagaaa

SEQ ID NO: 561497 - RNA, 12 nt, Homo sapiens
aagagggaacaa

SEQ ID NO: 561498 - RNA, 16 nt, Homo sapiens
aagagggcccagccca

SEQ ID NO: 561499 - RNA, 21 nt, Homo sapiens
aagagggcuuccucuagaagc

SEQ ID NO: 561500 - RNA, 12 nt, Homo sapiens
aagaggggaaaa

SEQ ID NO: 561501 - RNA, 13 nt, Homo sapiens
aagagggggaccu

SEQ ID NO: 561502 - RNA, 16 nt, Homo sapiens
aagagguaacugaggu

SEQ ID NO: 561503 - RNA, 18 nt, Homo sapiens
aagagguggguggugggc

SEQ ID NO: 561504 - RNA, 22 nt, Homo sapiens
aagaguacagaagcuuuagcaa

SEQ ID NO: 561505 - RNA, 16 nt, Homo sapiens
aagaguaugagucuuc

SEQ ID NO: 561506 - RNA, 22 nt, Homo sapiens
aagaguauuuuaagaagacaua

SEQ ID NO: 561507 - RNA, 18 nt, Homo sapiens
aagagucgggacuugaaa

SEQ ID NO: 561508 - RNA, 19 nt, Homo sapiens
aagagugaggacugacuca

SEQ ID NO: 561509 - RNA, 18 nt, Homo sapiens
aagagugauauacuccag

SEQ ID NO: 561510 - RNA, 16 nt, Homo sapiens
aagagugauugcagcu

SEQ ID NO: 561511 - RNA, 14 nt, Homo sapiens
aagaguggaaccaa

SEQ ID NO: 561512 - RNA, 22 nt, Homo sapiens
aagaguggguuucacaagugaa

SEQ ID NO: 561513 - RNA, 11 nt, Homo sapiens
aagaguggucu

SEQ ID NO: 561514 - RNA, 16 nt, Homo sapiens
aagaguguuucuucca

SEQ ID NO: 561515 - RNA, 18 nt, Homo sapiens
aagaguuaaaacauuucu

SEQ ID NO: 561516 - RNA, 21 nt, Homo sapiens
aagaguucuuaaggauuguga

SEQ ID NO: 561517 - RNA, 21 nt, Homo sapiens
aagaguugagauuuugcaauc

SEQ ID NO: 561518 - RNA, 17 nt, Homo sapiens
aagaguugccaaaauac

SEQ ID NO: 561519 - RNA, 18 nt, Homo sapiens
aagaguuucuccuuuuga

SEQ ID NO: 561520 - RNA, 19 nt, Homo sapiens
aagauaaaauauccucagg

SEQ ID NO: 561521 - RNA, 13 nt, Homo sapiens
aagauaaacacaa

SEQ ID NO: 561522 - RNA, 18 nt, Homo sapiens
aagauaaaccaguugaau

SEQ ID NO: 561523 - RNA, 16 nt, Homo sapiens
aagauaacuuacugua

SEQ ID NO: 561524 - RNA, 12 nt, Homo sapiens
aagauaagaguu

SEQ ID NO: 561525 - RNA, 22 nt, Homo sapiens
aagauaaucucucagcuuuuaa

SEQ ID NO: 561526 - RNA, 13 nt, Homo sapiens
aagauaauguugc

SEQ ID NO: 561527 - RNA, 15 nt, Homo sapiens
aagauaauuuacuua

SEQ ID NO: 561528 - RNA, 15 nt, Homo sapiens
aagauacaaguuuca

SEQ ID NO: 561529 - RNA, 22 nt, Homo sapiens
aagauagaugcacuuaugcagu

SEQ ID NO: 561530 - RNA, 17 nt, Homo sapiens
aagauagcuucacccca

SEQ ID NO: 561531 - RNA, 16 nt, Homo sapiens
aagauaggaguucucu

SEQ ID NO: 561532 - RNA, 21 nt, Homo sapiens
aagauagggaacacucauccc

SEQ ID NO: 561533 - RNA, 19 nt, Homo sapiens
aagauagguuugagggcau

SEQ ID NO: 561534 - RNA, 15 nt, Homo sapiens
aagauaguaacugua

SEQ ID NO: 561535 - RNA, 20 nt, Homo sapiens
aagauaguuacaaaauacaa

SEQ ID NO: 561536 - RNA, 22 nt, Homo sapiens
aagggagagaacaaaagcuaua

SEQ ID NO: 561537 - RNA, 14 nt, Homo sapiens
aagggagaguucuu

SEQ ID NO: 561538 - RNA, 21 nt, Homo sapiens
aagggaggggcuguguuucca

SEQ ID NO: 561539 - RNA, 17 nt, Homo sapiens
aagggagggucccugug

SEQ ID NO: 561540 - RNA, 16 nt, Homo sapiens
aagggagguggcaaga

SEQ ID NO: 561541 - RNA, 19 nt, Homo sapiens
aagggcaaggaguuuauua

SEQ ID NO: 561542 - RNA, 23 nt, Homo sapiens
aagggcacaaacugcagcuguga

SEQ ID NO: 561543 - RNA, 12 nt, Homo sapiens
aagggcagagaa

SEQ ID NO: 561544 - RNA, 14 nt, Homo sapiens
aagggcaucaucua

SEQ ID NO: 561545 - RNA, 12 nt, Homo sapiens
aagggccauuua

SEQ ID NO: 561546 - RNA, 17 nt, Homo sapiens
aagggcccaaugaauua

SEQ ID NO: 561547 - RNA, 17 nt, Homo sapiens
aagggcccuuucaucuu

SEQ ID NO: 561548 - RNA, 21 nt, Homo sapiens
aagggccugcccagacaagau

SEQ ID NO: 561549 - RNA, 14 nt, Homo sapiens
aagggcuacuuaau

SEQ ID NO: 561550 - RNA, 17 nt, Homo sapiens
aagggcugaguguccag

SEQ ID NO: 561551 - RNA, 18 nt, Homo sapiens
aagggcuucugcacccuc

SEQ ID NO: 561552 - RNA, 17 nt, Homo sapiens
aaggggagauacucucc

SEQ ID NO: 561553 - RNA, 20 nt, Homo sapiens
aaggggagccaaaaucucaa

SEQ ID NO: 561554 - RNA, 18 nt, Homo sapiens
aaggggcccaaauucuuu

SEQ ID NO: 561555 - RNA, 14 nt, Homo sapiens
aagggggaaaaagu

SEQ ID NO: 561556 - RNA, 20 nt, Homo sapiens
aagggggcggggacugcugg

SEQ ID NO: 561557 - RNA, 16 nt, Homo sapiens
aaggggggucucuggc

SEQ ID NO: 561558 - RNA, 18 nt, Homo sapiens
aaggggguagaaguaguu

SEQ ID NO: 561559 - RNA, 22 nt, Homo sapiens
aaggguaccuugaacacugggg

SEQ ID NO: 561560 - RNA, 13 nt, Homo sapiens
aaggguacugaaa

SEQ ID NO: 561561 - RNA, 23 nt, Homo sapiens
aaggguaggauguugcuucugaa

SEQ ID NO: 561562 - RNA, 18 nt, Homo sapiens
aaggguggaaaaaugccc

SEQ ID NO: 561563 - RNA, 16 nt, Homo sapiens
aagguaacuacugcua

SEQ ID NO: 561564 - RNA, 13 nt, Homo sapiens
aagguacauauuu

SEQ ID NO: 561565 - RNA, 20 nt, Homo sapiens
aagguaccuaucaguuugua

SEQ ID NO: 561566 - RNA, 18 nt, Homo sapiens
aagguacuauauuugcua

SEQ ID NO: 561567 - RNA, 17 nt, Homo sapiens
aagguaguaacuuucca

SEQ ID NO: 561568 - RNA, 17 nt, Homo sapiens
aagguauauugugaacc

SEQ ID NO: 561569 - RNA, 23 nt, Homo sapiens
aagguaugcauuuuauacaugua

SEQ ID NO: 561570 - RNA, 17 nt, Homo sapiens
aagguaugugucagcca

SEQ ID NO: 561571 - RNA, 15 nt, Homo sapiens
aagguauugugcauc

SEQ ID NO: 561572 - RNA, 19 nt, Homo sapiens
aagguauuuugaauaccau

SEQ ID NO: 561573 - RNA, 18 nt, Homo sapiens
aaggucaagggaaaaccc

SEQ ID NO: 561574 - RNA, 20 nt, Homo sapiens
aaggucaauuucaguguaug

SEQ ID NO: 561575 - RNA, 17 nt, Homo sapiens
aaggucagcccguuuca

SEQ ID NO: 561576 - RNA, 13 nt, Homo sapiens
aaggucccugggg

SEQ ID NO: 561577 - RNA, 17 nt, Homo sapiens
aaggucccuuguuucca

SEQ ID NO: 561578 - RNA, 18 nt, Homo sapiens
aagguccucugucaguca

SEQ ID NO: 561579 - RNA, 17 nt, Homo sapiens
aaggucuaagaagucau

SEQ ID NO: 561580 - RNA, 21 nt, Homo sapiens
aaggucugaaauccagcaucu

SEQ ID NO: 561581 - RNA, 21 nt, Homo sapiens
aaggucugcucugcuccugaa

SEQ ID NO: 561582 - RNA, 18 nt, Homo sapiens
aaggugaaacgacucaaa

SEQ ID NO: 561583 - RNA, 14 nt, Homo sapiens
aaggugaggggaug

SEQ ID NO: 561584 - RNA, 14 nt, Homo sapiens
aaggugagugcuug

SEQ ID NO: 561585 - RNA, 20 nt, Homo sapiens
aaggugccacuccagugccc

SEQ ID NO: 561586 - RNA, 12 nt, Homo sapiens
aaggugccacuu

SEQ ID NO: 561587 - RNA, 19 nt, Homo sapiens
aaggugugagacugggaag

SEQ ID NO: 561588 - RNA, 17 nt, Homo sapiens
aagguguuuccauuucu

SEQ ID NO: 561589 - RNA, 14 nt, Homo sapiens
aagguuaaauuuca

SEQ ID NO: 561590 - RNA, 22 nt, Homo sapiens
aagguuaagcagccugccauau

SEQ ID NO: 561591 - RNA, 14 nt, Homo sapiens
aagguuacuggaua

SEQ ID NO: 561592 - RNA, 21 nt, Homo sapiens
aagguuaguaucaucagauag

SEQ ID NO: 561593 - RNA, 19 nt, Homo sapiens
aagguuaugaaacauauca

SEQ ID NO: 561594 - RNA, 16 nt, Homo sapiens
aagguuccaacuguau

SEQ ID NO: 561595 - RNA, 16 nt, Homo sapiens
aagguucccaagacaa

SEQ ID NO: 561596 - RNA, 20 nt, Homo sapiens
aagguucgacuagugauagu

SEQ ID NO: 561597 - RNA, 20 nt, Homo sapiens
aagguucucagguguugcca

SEQ ID NO: 561598 - RNA, 18 nt, Homo sapiens
aagguugcagugcugagc

SEQ ID NO: 561599 - RNA, 21 nt, Homo sapiens
aagguuggcaacauuguacaa

SEQ ID NO: 561600 - RNA, 13 nt, Homo sapiens
aaguaaaaaucca

SEQ ID NO: 561601 - RNA, 21 nt, Homo sapiens
aaguaaaauugaagcaacuac

SEQ ID NO: 561602 - RNA, 19 nt, Homo sapiens
aaguaaaggccucaucucc

SEQ ID NO: 561603 - RNA, 22 nt, Homo sapiens
aaguaacauuaacucaguggaa

SEQ ID NO: 561604 - RNA, 14 nt, Homo sapiens
aaguaacauuugcc

SEQ ID NO: 561605 - RNA, 19 nt, Homo sapiens
aaguaacugugguuuacua

SEQ ID NO: 561606 - RNA, 23 nt, Homo sapiens
aaguaacuucugacuuacuguca

SEQ ID NO: 561607 - RNA, 15 nt, Homo sapiens
aaguaagcauuucca

SEQ ID NO: 561608 - RNA, 18 nt, Homo sapiens
aaguaauaaugugcaaau

SEQ ID NO: 561609 - RNA, 20 nt, Homo sapiens
aaguaauaaugugcaaaucu

SEQ ID NO: 561610 - RNA, 19 nt, Homo sapiens
aaguaauauaaugaugcug

SEQ ID NO: 561611 - RNA, 18 nt, Homo sapiens
aaguaauccaccugccuc

SEQ ID NO: 561612 - RNA, 14 nt, Homo sapiens
aaguaaugcuucaa

SEQ ID NO: 561613 - RNA, 20 nt, Homo sapiens
aaguaauugccuacaauaaa

SEQ ID NO: 561614 - RNA, 14 nt, Homo sapiens
aaguaauugugaaa

SEQ ID NO: 561615 - RNA, 23 nt, Homo sapiens
aaguacaagagcuuaacagugug

SEQ ID NO: 561616 - RNA, 19 nt, Homo sapiens
aaguacagaauuugaauua

SEQ ID NO: 561617 - RNA, 11 nt, Homo sapiens
aaguacaucuc

SEQ ID NO: 561618 - RNA, 12 nt, Homo sapiens
aaguacauguau

SEQ ID NO: 561619 - RNA, 17 nt, Homo sapiens
aaguacauuaaaacacu

SEQ ID NO: 561620 - RNA, 11 nt, Homo sapiens
aaguaccacac

SEQ ID NO: 561621 - RNA, 14 nt, Homo sapiens
aaguaccacacaua

SEQ ID NO: 561622 - RNA, 14 nt, Homo sapiens
aaguaccacacuga

SEQ ID NO: 561623 - RNA, 18 nt, Homo sapiens
aaguacccucuuuuacca

SEQ ID NO: 561624 - RNA, 20 nt, Homo sapiens
aaguaccuauauugauuuaa

SEQ ID NO: 561625 - RNA, 22 nt, Homo sapiens
aaguaccuuauucuacaucauu

SEQ ID NO: 561626 - RNA, 21 nt, Homo sapiens
aaguacuuuucuguucaucac

SEQ ID NO: 561627 - RNA, 23 nt, Homo sapiens
aaguacuuuucuguucaucacca

SEQ ID NO: 561628 - RNA, 14 nt, Homo sapiens
aaguagaauccuaa

SEQ ID NO: 561629 - RNA, 16 nt, Homo sapiens
aaguagaauccuaaau

SEQ ID NO: 561630 - RNA, 23 nt, Homo sapiens
aaguagaccucuuuuucuuacca

SEQ ID NO: 561631 - RNA, 17 nt, Homo sapiens
aaguagacuugguguga

SEQ ID NO: 561632 - RNA, 18 nt, Homo sapiens
aaguagaucuuuucuuga

SEQ ID NO: 561633 - RNA, 19 nt, Homo sapiens
aaguagaucuuuucuugac

SEQ ID NO: 561634 - RNA, 17 nt, Homo sapiens
aaguagcacccuggauu

SEQ ID NO: 561635 - RNA, 20 nt, Homo sapiens
aaguagcaucccaucccaac

SEQ ID NO: 561636 - RNA, 20 nt, Homo sapiens
aaguagccucuuucauccca

SEQ ID NO: 561637 - RNA, 22 nt, Homo sapiens
aaguagcuuuccacauuuguca

SEQ ID NO: 561638 - RNA, 17 nt, Homo sapiens
aaguagggauuaauauu

SEQ ID NO: 561639 - RNA, 19 nt, Homo sapiens
aaguagggauuaauauuua

SEQ ID NO: 561640 - RNA, 19 nt, Homo sapiens
aaguaggugugacuugaac

SEQ ID NO: 561641 - RNA, 21 nt, Homo sapiens
aaguaggugugacuugaacua

SEQ ID NO: 561642 - RNA, 18 nt, Homo sapiens
aaguagguuuacauucau

SEQ ID NO: 561643 - RNA, 14 nt, Homo sapiens
aaguagucauggau

SEQ ID NO: 561644 - RNA, 19 nt, Homo sapiens
aaguauauaauccugugaa

SEQ ID NO: 561645 - RNA, 19 nt, Homo sapiens
aaguauauacugaagugug

SEQ ID NO: 561646 - RNA, 16 nt, Homo sapiens
aaguauauugugaguu

SEQ ID NO: 561647 - RNA, 18 nt, Homo sapiens
aaguauccagucauugua

SEQ ID NO: 561648 - RNA, 14 nt, Homo sapiens
aaguauuacaacca

SEQ ID NO: 561649 - RNA, 21 nt, Homo sapiens
aaguauuauucaaaccaauuu

SEQ ID NO: 561650 - RNA, 16 nt, Homo sapiens
aaguauucuccauccu

SEQ ID NO: 561651 - RNA, 15 nt, Homo sapiens
aaguauuucugugga

SEQ ID NO: 561652 - RNA, 22 nt, Homo sapiens
aaguauuugcuuaaaauuguga

SEQ ID NO: 561653 - RNA, 23 nt, Homo sapiens
aaguauuuuuuaauccuaccuca

SEQ ID NO: 561654 - RNA, 15 nt, Homo sapiens
aagucaacaaacugc

SEQ ID NO: 561655 - RNA, 14 nt, Homo sapiens
aagucaacacucuu

SEQ ID NO: 561656 - RNA, 14 nt, Homo sapiens
aagucaacaguaaa

SEQ ID NO: 561657 - RNA, 22 nt, Homo sapiens
aaguugacuuauaguacaugau

SEQ ID NO: 561658 - RNA, 19 nt, Homo sapiens
aaguugauuagaaagacca

SEQ ID NO: 561659 - RNA, 17 nt, Homo sapiens
aaguugcugaugaacuc

SEQ ID NO: 561660 - RNA, 20 nt, Homo sapiens
aaguugcugcugugaaucug

SEQ ID NO: 561661 - RNA, 18 nt, Homo sapiens
aaguugcugcuugugauc

SEQ ID NO: 561662 - RNA, 23 nt, Homo sapiens
aaguugcugggauuacaggugug

SEQ ID NO: 561663 - RNA, 21 nt, Homo sapiens
aaguuguaaaguauguauuau

SEQ ID NO: 561664 - RNA, 16 nt, Homo sapiens
aaguuguggauaucag

SEQ ID NO: 561665 - RNA, 20 nt, Homo sapiens
aaguuguugacugugauuag

SEQ ID NO: 561666 - RNA, 20 nt, Homo sapiens
aaguuguugcuauacauguu

SEQ ID NO: 561667 - RNA, 14 nt, Homo sapiens
aaguuuaucuuuca

SEQ ID NO: 561668 - RNA, 15 nt, Homo sapiens
aaguuucaaugugau

SEQ ID NO: 561669 - RNA, 18 nt, Homo sapiens
aaguuucaggauacaugu

SEQ ID NO: 561670 - RNA, 18 nt, Homo sapiens
aaguuucugauaccacug

SEQ ID NO: 561671 - RNA, 16 nt, Homo sapiens
aaguuucuuaaggaaa

SEQ ID NO: 561672 - RNA, 23 nt, Homo sapiens
aaguuucuuaaggaaaugguggc

SEQ ID NO: 561673 - RNA, 12 nt, Homo sapiens
aaguuugcuauu

SEQ ID NO: 561674 - RNA, 16 nt, Homo sapiens
aaguuuggaagcacug

SEQ ID NO: 561675 - RNA, 21 nt, Homo sapiens
aaguuugucacuaaacucuca

SEQ ID NO: 561676 - RNA, 14 nt, Homo sapiens
aaguuuuacauugu

SEQ ID NO: 561677 - RNA, 21 nt, Homo sapiens
aaguuuuacuaaauacuuuaa

SEQ ID NO: 561678 - RNA, 16 nt, Homo sapiens
aaguuuuucacuuugg

SEQ ID NO: 561679 - RNA, 24 nt, Homo sapiens
aauaaaaaaaaaccuagugcugau

SEQ ID NO: 561680 - RNA, 18 nt, Homo sapiens
aauaaaaaaguaacaagg

SEQ ID NO: 561681 - RNA, 15 nt, Homo sapiens
aauaaaaacccugua

SEQ ID NO: 561682 - RNA, 18 nt, Homo sapiens
aauaaaaacccuguaugg

SEQ ID NO: 561683 - RNA, 16 nt, Homo sapiens
aauaaaaagugaacuu

SEQ ID NO: 561684 - RNA, 15 nt, Homo sapiens
aauaaaaaguucaga

SEQ ID NO: 561685 - RNA, 14 nt, Homo sapiens
aauaaaaaugcacg

SEQ ID NO: 561686 - RNA, 15 nt, Homo sapiens
aauaaaaaugucuca

SEQ ID NO: 561687 - RNA, 23 nt, Homo sapiens
aauaaaaauguucuuacacaagg

SEQ ID NO: 561688 - RNA, 19 nt, Homo sapiens
aauaaaaauuguagcuuuu

SEQ ID NO: 561689 - RNA, 11 nt, Homo sapiens
aauaaaacaca

SEQ ID NO: 561690 - RNA, 19 nt, Homo sapiens
aauaaaagaucuugaauag

SEQ ID NO: 561691 - RNA, 13 nt, Homo sapiens
aauaaaagcacaa

SEQ ID NO: 561692 - RNA, 16 nt, Homo sapiens
aauaaaaguuuacaga

SEQ ID NO: 561693 - RNA, 16 nt, Homo sapiens
aauaaaauccuaagac

SEQ ID NO: 561694 - RNA, 20 nt, Homo sapiens
aauaaaaugauuuguggaaa

SEQ ID NO: 561695 - RNA, 23 nt, Homo sapiens
aauaaaaugucuucucccaccag

SEQ ID NO: 561696 - RNA, 15 nt, Homo sapiens
aauaaaauguguaca

SEQ ID NO: 561697 - RNA, 14 nt, Homo sapiens
aauaaaauuaacaa

SEQ ID NO: 561698 - RNA, 18 nt, Homo sapiens
aauaaaauucaacaaaca

SEQ ID NO: 561699 - RNA, 20 nt, Homo sapiens
aauaaacacacuauggcaug

SEQ ID NO: 561700 - RNA, 13 nt, Homo sapiens
aauaaacaucagu

SEQ ID NO: 561701 - RNA, 12 nt, Homo sapiens
aauaaaccuccu

SEQ ID NO: 561702 - RNA, 21 nt, Homo sapiens
aauaaacgagauguuugccaa

SEQ ID NO: 561703 - RNA, 13 nt, Homo sapiens
aauaaacuacucu

SEQ ID NO: 561704 - RNA, 16 nt, Homo sapiens
aauaaacuccuacuaa

SEQ ID NO: 561705 - RNA, 21 nt, Homo sapiens
aauaaagaaugccauuucuca

SEQ ID NO: 561706 - RNA, 12 nt, Homo sapiens
aauaaagacagg

SEQ ID NO: 561707 - RNA, 14 nt, Homo sapiens
aauaaagcuugcaa

SEQ ID NO: 561708 - RNA, 13 nt, Homo sapiens
aauaaaggcagcu

SEQ ID NO: 561709 - RNA, 14 nt, Homo sapiens
aauaaaggcagcug

SEQ ID NO: 561710 - RNA, 23 nt, Homo sapiens
aauaaaguaccacacauauugca

SEQ ID NO: 561711 - RNA, 15 nt, Homo sapiens
aauaaaguaccauua

SEQ ID NO: 561712 - RNA, 17 nt, Homo sapiens
aauaaaguauagguuua

SEQ ID NO: 561713 - RNA, 15 nt, Homo sapiens
aauaaaguauuccac

SEQ ID NO: 561714 - RNA, 13 nt, Homo sapiens
aauaaaguggaaa

SEQ ID NO: 561715 - RNA, 16 nt, Homo sapiens
aauaaaguguaacaau

SEQ ID NO: 561716 - RNA, 16 nt, Homo sapiens
aauaaaguuccuguca

SEQ ID NO: 561717 - RNA, 14 nt, Homo sapiens
aauaaauaaucauc

SEQ ID NO: 561718 - RNA, 15 nt, Homo sapiens
aauaaauaaucugua

SEQ ID NO: 561719 - RNA, 14 nt, Homo sapiens
aauaaauaucugua

SEQ ID NO: 561720 - RNA, 16 nt, Homo sapiens
aauaaaucuaggaugu

SEQ ID NO: 561721 - RNA, 22 nt, Homo sapiens
aauaaaugacaagugagacaaa

SEQ ID NO: 561722 - RNA, 23 nt, Homo sapiens
aauaaauggaaagacauccugug

SEQ ID NO: 561723 - RNA, 20 nt, Homo sapiens
aauaaauggccagugcugcu

SEQ ID NO: 561724 - RNA, 16 nt, Homo sapiens
aauaaauuaaacaugc

SEQ ID NO: 561725 - RNA, 18 nt, Homo sapiens
aauaaauucccaacuucu

SEQ ID NO: 561726 - RNA, 15 nt, Homo sapiens
aauaaauuccuacaa

SEQ ID NO: 561727 - RNA, 14 nt, Homo sapiens
aauaaauugcuccu

SEQ ID NO: 561728 - RNA, 21 nt, Homo sapiens
aauaaauugcuuacugauauu

SEQ ID NO: 561729 - RNA, 16 nt, Homo sapiens
aauaaauuguguuucc

SEQ ID NO: 561730 - RNA, 19 nt, Homo sapiens
aauaacaacagaucugcag

SEQ ID NO: 561731 - RNA, 14 nt, Homo sapiens
aauaacaaucacaa

SEQ ID NO: 561732 - RNA, 14 nt, Homo sapiens
aauaacacagagag

SEQ ID NO: 561733 - RNA, 16 nt, Homo sapiens
aauaacaucaacaaca

SEQ ID NO: 561734 - RNA, 23 nt, Homo sapiens
aauaacauuuaaauuccacagau

SEQ ID NO: 561735 - RNA, 13 nt, Homo sapiens
aauaaccaauccu

SEQ ID NO: 561736 - RNA, 13 nt, Homo sapiens
aauaaccucuggc

SEQ ID NO: 561737 - RNA, 20 nt, Homo sapiens
aauaaccuuuauaugauaua

SEQ ID NO: 561738 - RNA, 17 nt, Homo sapiens
aauaacuauuuuuccuc

SEQ ID NO: 561739 - RNA, 21 nt, Homo sapiens
aauaacuuuucaccaaugagc

SEQ ID NO: 561740 - RNA, 13 nt, Homo sapiens
aauaagagcaguc

SEQ ID NO: 561741 - RNA, 15 nt, Homo sapiens
aauaagauauuuagu

SEQ ID NO: 561742 - RNA, 18 nt, Homo sapiens
aauaagcaaucaagguua

SEQ ID NO: 561743 - RNA, 18 nt, Homo sapiens
aauaagcccagugcugcu

SEQ ID NO: 561744 - RNA, 24 nt, Homo sapiens
aauaagcuaaacgcaaugucauuu

SEQ ID NO: 561745 - RNA, 18 nt, Homo sapiens
aauaaggagggacaugau

SEQ ID NO: 561746 - RNA, 14 nt, Homo sapiens
aauaaggcacaaaa

SEQ ID NO: 561747 - RNA, 15 nt, Homo sapiens
aauaagguacaagaa

SEQ ID NO: 561748 - RNA, 21 nt, Homo sapiens
aauaaguauauaauccuguga

SEQ ID NO: 561749 - RNA, 17 nt, Homo sapiens
aauaaguuuucagugga

SEQ ID NO: 561750 - RNA, 16 nt, Homo sapiens
aauaauaaaaugcaaa

SEQ ID NO: 561751 - RNA, 17 nt, Homo sapiens
aauaauaacaaucacaa

SEQ ID NO: 561752 - RNA, 18 nt, Homo sapiens
aauaauaacaaucacaaa

SEQ ID NO: 561753 - RNA, 18 nt, Homo sapiens
aauaauaagcuacuugcc

SEQ ID NO: 561754 - RNA, 19 nt, Homo sapiens
aauaauacaccagagauaa

SEQ ID NO: 561755 - RNA, 14 nt, Homo sapiens
aauaauacacuaau

SEQ ID NO: 561756 - RNA, 20 nt, Homo sapiens
aauaauacaguaucucaggg

SEQ ID NO: 561757 - RNA, 13 nt, Homo sapiens
aauaauaccuuau

SEQ ID NO: 561758 - RNA, 18 nt, Homo sapiens
aauaauacugaccuaccu

SEQ ID NO: 561759 - RNA, 13 nt, Homo sapiens
aauaauaucccac

SEQ ID NO: 561760 - RNA, 12 nt, Homo sapiens
aauaauaugcau

SEQ ID NO: 561761 - RNA, 14 nt, Homo sapiens
aauaauauuagcuu

SEQ ID NO: 561762 - RNA, 16 nt, Homo sapiens
aauaaucaucuaagac

SEQ ID NO: 561763 - RNA, 17 nt, Homo sapiens
aauaaucauucuggaua

SEQ ID NO: 561764 - RNA, 23 nt, Homo sapiens
aauaaucgacuuuuuaaauguga

SEQ ID NO: 561765 - RNA, 19 nt, Homo sapiens
aauaaucucuuuauucuaa

SEQ ID NO: 561766 - RNA, 13 nt, Homo sapiens
aauaaucuuauua

SEQ ID NO: 561767 - RNA, 14 nt, Homo sapiens
aauaaucuuggcaa

SEQ ID NO: 561768 - RNA, 18 nt, Homo sapiens
aauaaugaaggugccauu

SEQ ID NO: 561769 - RNA, 18 nt, Homo sapiens
aauaaugacaaaugcccu

SEQ ID NO: 561770 - RNA, 14 nt, Homo sapiens
aauaaugacaugua

SEQ ID NO: 561771 - RNA, 18 nt, Homo sapiens
aauaaugaguaguguaaa

SEQ ID NO: 561772 - RNA, 22 nt, Homo sapiens
aauaaugaguuagaacuauuaa

SEQ ID NO: 561773 - RNA, 19 nt, Homo sapiens
aauaauguccuuucauuug

SEQ ID NO: 561774 - RNA, 23 nt, Homo sapiens
aauaaugugaaugcuauguucug

SEQ ID NO: 561775 - RNA, 12 nt, Homo sapiens
aauaaugugcaa

SEQ ID NO: 561776 - RNA, 21 nt, Homo sapiens
aauaauuaaccaccaauccaa

SEQ ID NO: 561777 - RNA, 15 nt, Homo sapiens
aauaauuaccaauau

SEQ ID NO: 561778 - RNA, 22 nt, Homo sapiens
aauaauuaccaauaucuugcca

SEQ ID NO: 561779 - RNA, 16 nt, Homo sapiens
aaugacuuacuuuccu

SEQ ID NO: 561780 - RNA, 23 nt, Homo sapiens
aaugacuuggguuuaacaagcug

SEQ ID NO: 561781 - RNA, 14 nt, Homo sapiens
aaugagacugacca

SEQ ID NO: 561782 - RNA, 16 nt, Homo sapiens
aaugagacuugcucuc

SEQ ID NO: 561783 - RNA, 19 nt, Homo sapiens
aaugagaguuccuucucac

SEQ ID NO: 561784 - RNA, 16 nt, Homo sapiens
aaugagccaucacuag

SEQ ID NO: 561785 - RNA, 14 nt, Homo sapiens
aaugagccaugaga

SEQ ID NO: 561786 - RNA, 17 nt, Homo sapiens
aaugagccgagaucacg

SEQ ID NO: 561787 - RNA, 15 nt, Homo sapiens
aaugagccuggcaag

SEQ ID NO: 561788 - RNA, 17 nt, Homo sapiens
aaugagcuguaucugua

SEQ ID NO: 561789 - RNA, 23 nt, Homo sapiens
aaugaggugagggggguucuccu

SEQ ID NO: 561790 - RNA, 14 nt, Homo sapiens
aaugaguaacaucu

SEQ ID NO: 561791 - RNA, 20 nt, Homo sapiens
aaugaguuaugaguuauuca

SEQ ID NO: 561792 - RNA, 13 nt, Homo sapiens
aaugauacaguau

SEQ ID NO: 561793 - RNA, 20 nt, Homo sapiens
aaugauaugcaagugcaaaa

SEQ ID NO: 561794 - RNA, 16 nt, Homo sapiens
aaugaucauaagucua

SEQ ID NO: 561795 - RNA, 20 nt, Homo sapiens
aaugauccguuccauugcaa

SEQ ID NO: 561796 - RNA, 13 nt, Homo sapiens
aaugauccugcca

SEQ ID NO: 561797 - RNA, 18 nt, Homo sapiens
aaugaugaagaccaaaga

SEQ ID NO: 561798 - RNA, 16 nt, Homo sapiens
aaugaugaagcuuccu

SEQ ID NO: 561799 - RNA, 16 nt, Homo sapiens
aaugaugagguaauaa

SEQ ID NO: 561800 - RNA, 13 nt, Homo sapiens
aaugaugaucuuc

SEQ ID NO: 561801 - RNA, 13 nt, Homo sapiens
aaugaugcuauga

SEQ ID NO: 561802 - RNA, 15 nt, Homo sapiens
aaugaugcugucuga

SEQ ID NO: 561803 - RNA, 16 nt, Homo sapiens
aaugaugcugucugaa

SEQ ID NO: 561804 - RNA, 21 nt, Homo sapiens
aaugauguugauaauuucagg

SEQ ID NO: 561805 - RNA, 14 nt, Homo sapiens
aaugauguuuuccu

SEQ ID NO: 561806 - RNA, 23 nt, Homo sapiens
aaugauuaacaguuaugugguca

SEQ ID NO: 561807 - RNA, 15 nt, Homo sapiens
aaugauuaaucaaag

SEQ ID NO: 561808 - RNA, 14 nt, Homo sapiens
aaugauuauauuca

SEQ ID NO: 561809 - RNA, 15 nt, Homo sapiens
aaugauucauguuau

SEQ ID NO: 561810 - RNA, 17 nt, Homo sapiens
aaugauucauguuauau

SEQ ID NO: 561811 - RNA, 15 nt, Homo sapiens
aaugauuuagaauuu

SEQ ID NO: 561812 - RNA, 23 nt, Homo sapiens
aaugauuucaugcuaucucugug

SEQ ID NO: 561813 - RNA, 15 nt, Homo sapiens
aaugauuugggaaaa

SEQ ID NO: 561814 - RNA, 13 nt, Homo sapiens
aaugcaaaaaucu

SEQ ID NO: 561815 - RNA, 20 nt, Homo sapiens
aaugcaaacucaccgcucca

SEQ ID NO: 561816 - RNA, 17 nt, Homo sapiens
aaugcaaauuucuauaa

SEQ ID NO: 561817 - RNA, 11 nt, Homo sapiens
aaugcaacuuc

SEQ ID NO: 561818 - RNA, 18 nt, Homo sapiens
aaugcaauaacucuggga

SEQ ID NO: 561819 - RNA, 18 nt, Homo sapiens
aaugcacaaaacuuugau

SEQ ID NO: 561820 - RNA, 17 nt, Homo sapiens
aaugcacaguacuguuu

SEQ ID NO: 561821 - RNA, 18 nt, Homo sapiens
aaugcacauagcuaucaa

SEQ ID NO: 561822 - RNA, 18 nt, Homo sapiens
aaugcacauuucagaaau

SEQ ID NO: 561823 - RNA, 14 nt, Homo sapiens
aaugcaccaagaaa

SEQ ID NO: 561824 - RNA, 20 nt, Homo sapiens
aaugcacuguauugcuccuc

SEQ ID NO: 561825 - RNA, 13 nt, Homo sapiens
aaugcaguccuga

SEQ ID NO: 561826 - RNA, 16 nt, Homo sapiens
aaugcaugaacaaguu

SEQ ID NO: 561827 - RNA, 12 nt, Homo sapiens
aaugcauucccu

SEQ ID NO: 561828 - RNA, 14 nt, Homo sapiens
aaugcauugcuaaa

SEQ ID NO: 561829 - RNA, 13 nt, Homo sapiens
aaugccacaaaac

SEQ ID NO: 561830 - RNA, 23 nt, Homo sapiens
aaugccacaaaacugacaguaaa

SEQ ID NO: 561831 - RNA, 23 nt, Homo sapiens
aaugccagcauaaauccauccau

SEQ ID NO: 561832 - RNA, 14 nt, Homo sapiens
aaugcccagugacc

SEQ ID NO: 561833 - RNA, 23 nt, Homo sapiens
aaugcccagugaccagucacuga

SEQ ID NO: 561834 - RNA, 16 nt, Homo sapiens
aaugccucaaugugac

SEQ ID NO: 561835 - RNA, 13 nt, Homo sapiens
aaugccugugaag

SEQ ID NO: 561836 - RNA, 19 nt, Homo sapiens
aaugccugugaagcaguca

SEQ ID NO: 561837 - RNA, 22 nt, Homo sapiens
aaugcggaccaaacuacuucau

SEQ ID NO: 561838 - RNA, 14 nt, Homo sapiens
aaugcucaaucuca

SEQ ID NO: 561839 - RNA, 19 nt, Homo sapiens
aaugcucagaccagcucuu

SEQ ID NO: 561840 - RNA, 13 nt, Homo sapiens
aaugcucaugucc

SEQ ID NO: 561841 - RNA, 13 nt, Homo sapiens
aaugcugagguua

SEQ ID NO: 561842 - RNA, 17 nt, Homo sapiens
aaugcugagguuaugaa

SEQ ID NO: 561843 - RNA, 18 nt, Homo sapiens
aaugcugaugaaaacugu

SEQ ID NO: 561844 - RNA, 15 nt, Homo sapiens
aaugcugcuacuuaa

SEQ ID NO: 561845 - RNA, 21 nt, Homo sapiens
aaugcugcuuccauuugacaa

SEQ ID NO: 561846 - RNA, 14 nt, Homo sapiens
aaugcuggacugga

SEQ ID NO: 561847 - RNA, 12 nt, Homo sapiens
aaugcugggaaa

SEQ ID NO: 561848 - RNA, 21 nt, Homo sapiens
aaugcugguuuuucaguuuuc

SEQ ID NO: 561849 - RNA, 18 nt, Homo sapiens
aaugcugucccuauacac

SEQ ID NO: 561850 - RNA, 21 nt, Homo sapiens
aaugcugugugaugcaccugc

SEQ ID NO: 561851 - RNA, 23 nt, Homo sapiens
aaugcugugugaugcaccugcag

SEQ ID NO: 561852 - RNA, 16 nt, Homo sapiens
aaugcuguguugggua

SEQ ID NO: 561853 - RNA, 16 nt, Homo sapiens
aaugcuuagaaauuca

SEQ ID NO: 561854 - RNA, 15 nt, Homo sapiens
aaugcuuagacucuu

SEQ ID NO: 561855 - RNA, 22 nt, Homo sapiens
aaugcuucagauauuauugcuu

SEQ ID NO: 561856 - RNA, 17 nt, Homo sapiens
aaugcuucauaugagga

SEQ ID NO: 561857 - RNA, 13 nt, Homo sapiens
aaugcuuccaagc

SEQ ID NO: 561858 - RNA, 20 nt, Homo sapiens
aaugcuuuaacagcugauaa

SEQ ID NO: 561859 - RNA, 15 nt, Homo sapiens
aauggaaacauuuac

SEQ ID NO: 561860 - RNA, 12 nt, Homo sapiens
aauggaaaccaa

SEQ ID NO: 561861 - RNA, 12 nt, Homo sapiens
aauggaaaguug

SEQ ID NO: 561862 - RNA, 21 nt, Homo sapiens
aauggaagaaauggcuaugaa

SEQ ID NO: 561863 - RNA, 20 nt, Homo sapiens
aauggacauugagauacuau

SEQ ID NO: 561864 - RNA, 17 nt, Homo sapiens
aauggacuaaaacauuu

SEQ ID NO: 561865 - RNA, 22 nt, Homo sapiens
aauggagaauuaaaaauaccaa

SEQ ID NO: 561866 - RNA, 12 nt, Homo sapiens
aauggagcucag

SEQ ID NO: 561867 - RNA, 17 nt, Homo sapiens
aauggagcucaguaaca

SEQ ID NO: 561868 - RNA, 22 nt, Homo sapiens
aauggaggaacuuuccaaacac

SEQ ID NO: 561869 - RNA, 20 nt, Homo sapiens
aauggaggcagagaccucca

SEQ ID NO: 561870 - RNA, 16 nt, Homo sapiens
aauggcagaaccaaag

SEQ ID NO: 561871 - RNA, 19 nt, Homo sapiens
aauggcaguuuuaaucuua

SEQ ID NO: 561872 - RNA, 15 nt, Homo sapiens
aauggcaugcugaaa

SEQ ID NO: 561873 - RNA, 18 nt, Homo sapiens
aauggcccaggucucuca

SEQ ID NO: 561874 - RNA, 16 nt, Homo sapiens
aauggcgcgaucucag

SEQ ID NO: 561875 - RNA, 16 nt, Homo sapiens
aauggcuaacugauga

SEQ ID NO: 561876 - RNA, 21 nt, Homo sapiens
aauggcuacacucaucugacu

SEQ ID NO: 561877 - RNA, 20 nt, Homo sapiens
aauggcucaugaccuggaaa

SEQ ID NO: 561878 - RNA, 21 nt, Homo sapiens
aauggcuuuaugcuaguuuga

SEQ ID NO: 561879 - RNA, 22 nt, Homo sapiens
aaugggacaaaauaaauuguga

SEQ ID NO: 561880 - RNA, 15 nt, Homo sapiens
aaugggacucugaga

SEQ ID NO: 561881 - RNA, 15 nt, Homo sapiens
aaugggcucuuccaa

SEQ ID NO: 561882 - RNA, 15 nt, Homo sapiens
aauggguuacuugau

SEQ ID NO: 561883 - RNA, 17 nt, Homo sapiens
aauggucucuaccuaau

SEQ ID NO: 561884 - RNA, 22 nt, Homo sapiens
aauggugcaaauccuacugaau

SEQ ID NO: 561885 - RNA, 16 nt, Homo sapiens
aaugguggucuucucc

SEQ ID NO: 561886 - RNA, 20 nt, Homo sapiens
aaugguggucuucuccacca

SEQ ID NO: 561887 - RNA, 18 nt, Homo sapiens
aaugguguaauuuugucc

SEQ ID NO: 561888 - RNA, 20 nt, Homo sapiens
aauggugugaucucggcuca

SEQ ID NO: 561889 - RNA, 15 nt, Homo sapiens
aaugguuccauucuc

SEQ ID NO: 561890 - RNA, 21 nt, Homo sapiens
aaugguuucaaguuauucaaa

SEQ ID NO: 561891 - RNA, 16 nt, Homo sapiens
aaugguuuccucugga

SEQ ID NO: 561892 - RNA, 19 nt, Homo sapiens
aaugguuuguaaaauccac

SEQ ID NO: 561893 - RNA, 18 nt, Homo sapiens
aauguaaaaauccuuuug

SEQ ID NO: 561894 - RNA, 23 nt, Homo sapiens
aauguaaaacccaaaacaguaaa

SEQ ID NO: 561895 - RNA, 15 nt, Homo sapiens
aauguaaagaacuua

SEQ ID NO: 561896 - RNA, 14 nt, Homo sapiens
aauguaaagccagc

SEQ ID NO: 561897 - RNA, 15 nt, Homo sapiens
aauguaaagugcaau

SEQ ID NO: 561898 - RNA, 15 nt, Homo sapiens
aauguaaauacucau

SEQ ID NO: 561899 - RNA, 14 nt, Homo sapiens
aauguaaauguuau

SEQ ID NO: 561900 - RNA, 16 nt, Homo sapiens
aauguaaauuuacuga

SEQ ID NO: 561901 - RNA, 22 nt, Homo sapiens
aauuaguuuaccucauccaugc

SEQ ID NO: 561902 - RNA, 22 nt, Homo sapiens
aauuaguuuauauuacucucau

SEQ ID NO: 561903 - RNA, 15 nt, Homo sapiens
aauuauaacccagaa

SEQ ID NO: 561904 - RNA, 20 nt, Homo sapiens
aauuauaagcauacaacugg

SEQ ID NO: 561905 - RNA, 17 nt, Homo sapiens
aauuauaaucuguggau

SEQ ID NO: 561906 - RNA, 21 nt, Homo sapiens
aauuauacaucacagcagugc

SEQ ID NO: 561907 - RNA, 16 nt, Homo sapiens
aauuauacuacuuugu

SEQ ID NO: 561908 - RNA, 21 nt, Homo sapiens
aauuauacuguagcugaugaa

SEQ ID NO: 561909 - RNA, 20 nt, Homo sapiens
aauuauagaguaucacuccc

SEQ ID NO: 561910 - RNA, 14 nt, Homo sapiens
aauuaucaagcuuu

SEQ ID NO: 561911 - RNA, 21 nt, Homo sapiens
aauuaucaucuuuugaucuuu

SEQ ID NO: 561912 - RNA, 21 nt, Homo sapiens
aauuauccauuacgugcauuu

SEQ ID NO: 561913 - RNA, 13 nt, Homo sapiens
aauuaugaccaug

SEQ ID NO: 561914 - RNA, 23 nt, Homo sapiens
aauuaugaguuugcccucuuucc

SEQ ID NO: 561915 - RNA, 13 nt, Homo sapiens
aauuaugcuucca

SEQ ID NO: 561916 - RNA, 14 nt, Homo sapiens
aauuauggcauuuu

SEQ ID NO: 561917 - RNA, 20 nt, Homo sapiens
aauuauguaauauauuguac

SEQ ID NO: 561918 - RNA, 15 nt, Homo sapiens
aauuauguaaugcaa

SEQ ID NO: 561919 - RNA, 18 nt, Homo sapiens
aauuaugugaaaugcuua

SEQ ID NO: 561920 - RNA, 22 nt, Homo sapiens
aauuauuauauacauacugcau

SEQ ID NO: 561921 - RNA, 14 nt, Homo sapiens
aauuauuauauuga

SEQ ID NO: 561922 - RNA, 21 nt, Homo sapiens
aauuauuauuaucacauuuac

SEQ ID NO: 561923 - RNA, 21 nt, Homo sapiens
aauuauuauuuauauauguau

SEQ ID NO: 561924 - RNA, 22 nt, Homo sapiens
aauuauuccuuuccuagacuaa

SEQ ID NO: 561925 - RNA, 20 nt, Homo sapiens
aauuauugacacugaacuua

SEQ ID NO: 561926 - RNA, 15 nt, Homo sapiens
aauuauuuaugaacu

SEQ ID NO: 561927 - RNA, 22 nt, Homo sapiens
aauuauuugcauaacaauuccu

SEQ ID NO: 561928 - RNA, 19 nt, Homo sapiens
aauuauuuuuucuaugaac

SEQ ID NO: 561929 - RNA, 13 nt, Homo sapiens
aauucaaacuggg

SEQ ID NO: 561930 - RNA, 15 nt, Homo sapiens
aauucaaauaaucca

SEQ ID NO: 561931 - RNA, 14 nt, Homo sapiens
aauucaagccuuag

SEQ ID NO: 561932 - RNA, 23 nt, Homo sapiens
aauucaaugacagggaugccaac

SEQ ID NO: 561933 - RNA, 22 nt, Homo sapiens
aauucaaugccgcaacauauag

SEQ ID NO: 561934 - RNA, 14 nt, Homo sapiens
aauucacacaaaga

SEQ ID NO: 561935 - RNA, 22 nt, Homo sapiens
aauucacaugaugcacuucaaa

SEQ ID NO: 561936 - RNA, 13 nt, Homo sapiens
aauucacucccac

SEQ ID NO: 561937 - RNA, 22 nt, Homo sapiens
aauucagaagaccccugacuca

SEQ ID NO: 561938 - RNA, 15 nt, Homo sapiens
aauucagaugcuguu

SEQ ID NO: 561939 - RNA, 18 nt, Homo sapiens
aauucaguaacaaagguu

SEQ ID NO: 561940 - RNA, 20 nt, Homo sapiens
aauucauaaagaaaugcaag

SEQ ID NO: 561941 - RNA, 17 nt, Homo sapiens
aauucauccucuuacca

SEQ ID NO: 561942 - RNA, 23 nt, Homo sapiens
aauucauucucugugguauccaa

SEQ ID NO: 561943 - RNA, 21 nt, Homo sapiens
aauucauugagcaguuagcuc

SEQ ID NO: 561944 - RNA, 23 nt, Homo sapiens
aauucauuguguuaccuguagau

SEQ ID NO: 561945 - RNA, 16 nt, Homo sapiens
aauucauuugacuuug

SEQ ID NO: 561946 - RNA, 20 nt, Homo sapiens
aauucauuuucaucacuggg

SEQ ID NO: 561947 - RNA, 19 nt, Homo sapiens
aauucauuuuuuaaauucc

SEQ ID NO: 561948 - RNA, 11 nt, Homo sapiens
aauuccaaagc

SEQ ID NO: 561949 - RNA, 14 nt, Homo sapiens
aauuccaaagcaaa

SEQ ID NO: 561950 - RNA, 22 nt, Homo sapiens
aauuccacacuauucucugccu

SEQ ID NO: 561951 - RNA, 13 nt, Homo sapiens
aauucccuugaau

SEQ ID NO: 561952 - RNA, 13 nt, Homo sapiens
aauuccgcauuua

SEQ ID NO: 561953 - RNA, 21 nt, Homo sapiens
aauuccuacaacuuaauggaa

SEQ ID NO: 561954 - RNA, 12 nt, Homo sapiens
aauuccuaguca

SEQ ID NO: 561955 - RNA, 14 nt, Homo sapiens
aauuccuaucucau

SEQ ID NO: 561956 - RNA, 20 nt, Homo sapiens
aauuccugauggaaaaugca

SEQ ID NO: 561957 - RNA, 18 nt, Homo sapiens
aauuccuguagcaucuuc

SEQ ID NO: 561958 - RNA, 15 nt, Homo sapiens
aauuccuguauucua

SEQ ID NO: 561959 - RNA, 13 nt, Homo sapiens
aauuccugugauu

SEQ ID NO: 561960 - RNA, 20 nt, Homo sapiens
aauuccuguuacuuuacaga

SEQ ID NO: 561961 - RNA, 22 nt, Homo sapiens
aauuccuuagcuuagaccucag

SEQ ID NO: 561962 - RNA, 15 nt, Homo sapiens
aauucgcugcaaccu

SEQ ID NO: 561963 - RNA, 23 nt, Homo sapiens
aauucuaaauaaauuucccaguu

SEQ ID NO: 561964 - RNA, 21 nt, Homo sapiens
aauucuaaguuauuuacuuuu

SEQ ID NO: 561965 - RNA, 17 nt, Homo sapiens
aauucuaggcaucccag

SEQ ID NO: 561966 - RNA, 12 nt, Homo sapiens
aauucuauuaca

SEQ ID NO: 561967 - RNA, 17 nt, Homo sapiens
aauucuauucugaucuu

SEQ ID NO: 561968 - RNA, 16 nt, Homo sapiens
aauucucaaccuacca

SEQ ID NO: 561969 - RNA, 19 nt, Homo sapiens
aauucucuuuggucauuga

SEQ ID NO: 561970 - RNA, 19 nt, Homo sapiens
aauucugccuugguucugg

SEQ ID NO: 561971 - RNA, 15 nt, Homo sapiens
aauucugcucagaua

SEQ ID NO: 561972 - RNA, 23 nt, Homo sapiens
aauucugguauacauugaauuca

SEQ ID NO: 561973 - RNA, 23 nt, Homo sapiens
aauucugucccugucccugcccc

SEQ ID NO: 561974 - RNA, 20 nt, Homo sapiens
aauucugugacauacauauu

SEQ ID NO: 561975 - RNA, 17 nt, Homo sapiens
aauucuuacauguuuuc

SEQ ID NO: 561976 - RNA, 14 nt, Homo sapiens
aauucuuacuguag

SEQ ID NO: 561977 - RNA, 16 nt, Homo sapiens
aauucuuagucaagga

SEQ ID NO: 561978 - RNA, 22 nt, Homo sapiens
aauucuuauuuuuuaaaaagcu

SEQ ID NO: 561979 - RNA, 18 nt, Homo sapiens
aauucuuccuuagacuua

SEQ ID NO: 561980 - RNA, 14 nt, Homo sapiens
aauucuucugucaa

SEQ ID NO: 561981 - RNA, 19 nt, Homo sapiens
aauucuuguagaugcauua

SEQ ID NO: 561982 - RNA, 15 nt, Homo sapiens
aauucuuucacuuga

SEQ ID NO: 561983 - RNA, 15 nt, Homo sapiens
aauucuuucaguggc

SEQ ID NO: 561984 - RNA, 17 nt, Homo sapiens
aauugaaacacagaguu

SEQ ID NO: 561985 - RNA, 16 nt, Homo sapiens
aauugaacuaaaucca

SEQ ID NO: 561986 - RNA, 14 nt, Homo sapiens
aauugaacuaacaa

SEQ ID NO: 561987 - RNA, 20 nt, Homo sapiens
aauugaagcaacuacaacuu

SEQ ID NO: 561988 - RNA, 17 nt, Homo sapiens
aauugacaaugauuuau

SEQ ID NO: 561989 - RNA, 21 nt, Homo sapiens
aauugacagaucaagcuguga

SEQ ID NO: 561990 - RNA, 23 nt, Homo sapiens
aauugaccauacaauuucauccu

SEQ ID NO: 561991 - RNA, 21 nt, Homo sapiens
aauugaccuuuagguauuaca

SEQ ID NO: 561992 - RNA, 21 nt, Homo sapiens
aauugaccuuuugacuuaaag

SEQ ID NO: 561993 - RNA, 20 nt, Homo sapiens
aauugacuuauacucuugag

SEQ ID NO: 561994 - RNA, 14 nt, Homo sapiens
aauugaugaugcag

SEQ ID NO: 561995 - RNA, 23 nt, Homo sapiens
aauugauguugcuggacugucau

SEQ ID NO: 561996 - RNA, 21 nt, Homo sapiens
aauugauguuuuacgugcaaa

SEQ ID NO: 561997 - RNA, 17 nt, Homo sapiens
aauugauuucuucucau

SEQ ID NO: 561998 - RNA, 20 nt, Homo sapiens
aauugauuuuccuuugugca

SEQ ID NO: 561999 - RNA, 22 nt, Homo sapiens
aauugauuuuccuuugugcaug

SEQ ID NO: 562000 - RNA, 16 nt, Homo sapiens
aauugcaaaucuugaa

SEQ ID NO: 562001 - RNA, 23 nt, Homo sapiens
aauugcacacagaugugaaauga

SEQ ID NO: 562002 - RNA, 14 nt, Homo sapiens
aauugcaggucucu

SEQ ID NO: 562003 - RNA, 16 nt, Homo sapiens
aauugcaugaaacuag

SEQ ID NO: 562004 - RNA, 12 nt, Homo sapiens
aauugcauuuaa

SEQ ID NO: 562005 - RNA, 20 nt, Homo sapiens
aauugccuauaauacuugca

SEQ ID NO: 562006 - RNA, 10 nt, Homo sapiens
aauugcucaa

SEQ ID NO: 562007 - RNA, 12 nt, Homo sapiens
aauugcugaaag

SEQ ID NO: 562008 - RNA, 16 nt, Homo sapiens
aauugcuucaagcauu

SEQ ID NO: 562009 - RNA, 22 nt, Homo sapiens
aauugcuucuguguagucaaua

SEQ ID NO: 562010 - RNA, 17 nt, Homo sapiens
aauuggagaagauuuau

SEQ ID NO: 562011 - RNA, 19 nt, Homo sapiens
aauuggccaugucgccaaa

SEQ ID NO: 562012 - RNA, 22 nt, Homo sapiens
aauuggcucuagucacuggcau

SEQ ID NO: 562013 - RNA, 15 nt, Homo sapiens
aauugggaguccagg

SEQ ID NO: 562014 - RNA, 20 nt, Homo sapiens
aauugggaguccaggcacag

SEQ ID NO: 562015 - RNA, 24 nt, Homo sapiens
aauugggauaaacaucacaugaga

SEQ ID NO: 562016 - RNA, 18 nt, Homo sapiens
aauuggugcuauuugaag

SEQ ID NO: 562017 - RNA, 17 nt, Homo sapiens
aauugguguauaucaug

SEQ ID NO: 562018 - RNA, 18 nt, Homo sapiens
aauugguuuuaugcauug

SEQ ID NO: 562019 - RNA, 21 nt, Homo sapiens
aauuguaccuauuucugauga

SEQ ID NO: 562020 - RNA, 13 nt, Homo sapiens
aauuguagcacau

SEQ ID NO: 562021 - RNA, 13 nt, Homo sapiens
aauuguagugcaa

SEQ ID NO: 562022 - RNA, 16 nt, Homo sapiens
accccuuguugcacug

SEQ ID NO: 562023 - RNA, 18 nt, Homo sapiens
accccuuguugcacugcc

SEQ ID NO: 562024 - RNA, 22 nt, Homo sapiens
accccuuucuaguucaaugccu

SEQ ID NO: 562025 - RNA, 14 nt, Homo sapiens
acccgacaugugua

SEQ ID NO: 562026 - RNA, 15 nt, Homo sapiens
acccgacauguguac

SEQ ID NO: 562027 - RNA, 21 nt, Homo sapiens
acccgaccggugcaugaugcu

SEQ ID NO: 562028 - RNA, 19 nt, Homo sapiens
acccgagcccagcuacauu

SEQ ID NO: 562029 - RNA, 17 nt, Homo sapiens
acccgcccgagggaugg

SEQ ID NO: 562030 - RNA, 20 nt, Homo sapiens
acccgccuagcugcugucac

SEQ ID NO: 562031 - RNA, 16 nt, Homo sapiens
acccgcuccuacagcu

SEQ ID NO: 562032 - RNA, 16 nt, Homo sapiens
acccggagagugcucc

SEQ ID NO: 562033 - RNA, 22 nt, Homo sapiens
acccgguccugcccuuccugaa

SEQ ID NO: 562034 - RNA, 21 nt, Homo sapiens
acccguggagaugggaugcuu

SEQ ID NO: 562035 - RNA, 16 nt, Homo sapiens
acccuaaacauccaua

SEQ ID NO: 562036 - RNA, 22 nt, Homo sapiens
acccuaacacaguauaucccaa

SEQ ID NO: 562037 - RNA, 13 nt, Homo sapiens
acccuaccagcuc

SEQ ID NO: 562038 - RNA, 20 nt, Homo sapiens
acccuacuucuuuugcucuu

SEQ ID NO: 562039 - RNA, 12 nt, Homo sapiens
acccuacuuugc

SEQ ID NO: 562040 - RNA, 13 nt, Homo sapiens
acccuagcaaaag

SEQ ID NO: 562041 - RNA, 20 nt, Homo sapiens
acccuagccaaugucuccuc

SEQ ID NO: 562042 - RNA, 20 nt, Homo sapiens
acccuagccuugcuuguuaa

SEQ ID NO: 562043 - RNA, 15 nt, Homo sapiens
acccuagcuguguca

SEQ ID NO: 562044 - RNA, 16 nt, Homo sapiens
acccuagggauuugca

SEQ ID NO: 562045 - RNA, 21 nt, Homo sapiens
acccuagggauuugcacuaaa

SEQ ID NO: 562046 - RNA, 21 nt, Homo sapiens
acccuaugugggugggaccac

SEQ ID NO: 562047 - RNA, 20 nt, Homo sapiens
acccuauucuauccaucucc

SEQ ID NO: 562048 - RNA, 21 nt, Homo sapiens
acccuauuuagaaauggauuu

SEQ ID NO: 562049 - RNA, 20 nt, Homo sapiens
acccucacccccuccuggca

SEQ ID NO: 562050 - RNA, 15 nt, Homo sapiens
acccucagcacuguu

SEQ ID NO: 562051 - RNA, 16 nt, Homo sapiens
acccucaucacuagga

SEQ ID NO: 562052 - RNA, 21 nt, Homo sapiens
acccuccacaaagcaaaggca

SEQ ID NO: 562053 - RNA, 20 nt, Homo sapiens
acccuccagaauccugaugg

SEQ ID NO: 562054 - RNA, 22 nt, Homo sapiens
acccuccagagacaacagguaa

SEQ ID NO: 562055 - RNA, 16 nt, Homo sapiens
acccucccacucccau

SEQ ID NO: 562056 - RNA, 22 nt, Homo sapiens
acccucccaugcgggugcacac

SEQ ID NO: 562057 - RNA, 19 nt, Homo sapiens
acccucccccgccacuccu

SEQ ID NO: 562058 - RNA, 16 nt, Homo sapiens
acccuccccugaggau

SEQ ID NO: 562059 - RNA, 21 nt, Homo sapiens
acccucccuccacuccucuca

SEQ ID NO: 562060 - RNA, 19 nt, Homo sapiens
acccuccucacagaccucu

SEQ ID NO: 562061 - RNA, 17 nt, Homo sapiens
acccuccuccacuccac

SEQ ID NO: 562062 - RNA, 16 nt, Homo sapiens
acccucgcaugacugu

SEQ ID NO: 562063 - RNA, 20 nt, Homo sapiens
acccucgcaugacuguuaca

SEQ ID NO: 562064 - RNA, 16 nt, Homo sapiens
acccucuaagggaccu

SEQ ID NO: 562065 - RNA, 13 nt, Homo sapiens
acccucucagcuc

SEQ ID NO: 562066 - RNA, 16 nt, Homo sapiens
acccucuuccugugau

SEQ ID NO: 562067 - RNA, 13 nt, Homo sapiens
acccugaaccuau

SEQ ID NO: 562068 - RNA, 14 nt, Homo sapiens
acccugaaccuaug

SEQ ID NO: 562069 - RNA, 17 nt, Homo sapiens
acccugaaccuaugugu

SEQ ID NO: 562070 - RNA, 18 nt, Homo sapiens
acccugaagaaauccugg

SEQ ID NO: 562071 - RNA, 23 nt, Homo sapiens
acccugaagcuuaggacuaccag

SEQ ID NO: 562072 - RNA, 21 nt, Homo sapiens
acccugaaugguuccaugccu

SEQ ID NO: 562073 - RNA, 18 nt, Homo sapiens
acccugaccauugcccua

SEQ ID NO: 562074 - RNA, 19 nt, Homo sapiens
acccugagcagaauacugg

SEQ ID NO: 562075 - RNA, 24 nt, Homo sapiens
acccugcaaaauuugaugccagga

SEQ ID NO: 562076 - RNA, 18 nt, Homo sapiens
acccugcaagaccacgga

SEQ ID NO: 562077 - RNA, 14 nt, Homo sapiens
acccugcaaucacu

SEQ ID NO: 562078 - RNA, 17 nt, Homo sapiens
acccugcaggacuugcc

SEQ ID NO: 562079 - RNA, 15 nt, Homo sapiens
acccugccagugcca

SEQ ID NO: 562080 - RNA, 16 nt, Homo sapiens
acccugcccaccaaga

SEQ ID NO: 562081 - RNA, 16 nt, Homo sapiens
acccugccgucaccac

SEQ ID NO: 562082 - RNA, 22 nt, Homo sapiens
acccugcgcccaguccuuccac

SEQ ID NO: 562083 - RNA, 21 nt, Homo sapiens
acccugcugaacacagugucu

SEQ ID NO: 562084 - RNA, 15 nt, Homo sapiens
acccugcugaccucc

SEQ ID NO: 562085 - RNA, 16 nt, Homo sapiens
acccugcugaccuccc

SEQ ID NO: 562086 - RNA, 17 nt, Homo sapiens
acccuggaccauuccag

SEQ ID NO: 562087 - RNA, 21 nt, Homo sapiens
acccuggagcccauccagucu

SEQ ID NO: 562088 - RNA, 21 nt, Homo sapiens
acccugggagccaguccucca

SEQ ID NO: 562089 - RNA, 19 nt, Homo sapiens
acccugggcuuccugagcc

SEQ ID NO: 562090 - RNA, 19 nt, Homo sapiens
acccuguagguucuugaua

SEQ ID NO: 562091 - RNA, 21 nt, Homo sapiens
acccuguccggcccagugcca

SEQ ID NO: 562092 - RNA, 19 nt, Homo sapiens
acccugucuaaaaaacaua

SEQ ID NO: 562093 - RNA, 20 nt, Homo sapiens
acccugucucuacuaaaaau

SEQ ID NO: 562094 - RNA, 15 nt, Homo sapiens
acccugucugagaug

SEQ ID NO: 562095 - RNA, 23 nt, Homo sapiens
acccugugacccucucacuuugg

SEQ ID NO: 562096 - RNA, 16 nt, Homo sapiens
acccugugcagaaccu

SEQ ID NO: 562097 - RNA, 13 nt, Homo sapiens
acccugugcucaa

SEQ ID NO: 562098 - RNA, 17 nt, Homo sapiens
acccuucagaccccagu

SEQ ID NO: 562099 - RNA, 19 nt, Homo sapiens
acccuuccccacugcacac

SEQ ID NO: 562100 - RNA, 13 nt, Homo sapiens
acccuucugggca

SEQ ID NO: 562101 - RNA, 13 nt, Homo sapiens
acccuugaaccaa

SEQ ID NO: 562102 - RNA, 20 nt, Homo sapiens
acccuuggcacaggugucca

SEQ ID NO: 562103 - RNA, 15 nt, Homo sapiens
acccuuuagugcuuu

SEQ ID NO: 562104 - RNA, 19 nt, Homo sapiens
acccuuuuuugaaccaaca

SEQ ID NO: 562105 - RNA, 15 nt, Homo sapiens
accgaaaucccucag

SEQ ID NO: 562106 - RNA, 14 nt, Homo sapiens
accgacuagccagg

SEQ ID NO: 562107 - RNA, 19 nt, Homo sapiens
accgagccccugaacugcu

SEQ ID NO: 562108 - RNA, 16 nt, Homo sapiens
accgaggcgaugccac

SEQ ID NO: 562109 - RNA, 21 nt, Homo sapiens
accgagucucuucuccacugg

SEQ ID NO: 562110 - RNA, 18 nt, Homo sapiens
accgagucuugcucuguu

SEQ ID NO: 562111 - RNA, 13 nt, Homo sapiens
accgauggccaug

SEQ ID NO: 562112 - RNA, 14 nt, Homo sapiens
accgaugguccuca

SEQ ID NO: 562113 - RNA, 14 nt, Homo sapiens
accgcgacguugca

SEQ ID NO: 562114 - RNA, 14 nt, Homo sapiens
accgcucaguauuu

SEQ ID NO: 562115 - RNA, 18 nt, Homo sapiens
accgcugauaagcauuga

SEQ ID NO: 562116 - RNA, 15 nt, Homo sapiens
accgcuguccuggca

SEQ ID NO: 562117 - RNA, 23 nt, Homo sapiens
accgcuucugccuuuucacugug

SEQ ID NO: 562118 - RNA, 19 nt, Homo sapiens
accggagaaccccaggacg

SEQ ID NO: 562119 - RNA, 14 nt, Homo sapiens
accgguccagcugg

SEQ ID NO: 562120 - RNA, 18 nt, Homo sapiens
accgguuugcuacauucu

SEQ ID NO: 562121 - RNA, 20 nt, Homo sapiens
accguauuucagccaugaua

SEQ ID NO: 562122 - RNA, 20 nt, Homo sapiens
accguccucagcaguccaca

SEQ ID NO: 562123 - RNA, 18 nt, Homo sapiens
accgugagugacauagcc

SEQ ID NO: 562124 - RNA, 22 nt, Homo sapiens
accgugauggagaggacagagc

SEQ ID NO: 562125 - RNA, 20 nt, Homo sapiens
accgugccugaucugcacau

SEQ ID NO: 562126 - RNA, 14 nt, Homo sapiens
accguggaccuucc

SEQ ID NO: 562127 - RNA, 18 nt, Homo sapiens
accguggggaaggggugc

SEQ ID NO: 562128 - RNA, 14 nt, Homo sapiens
accguguacaauac

SEQ ID NO: 562129 - RNA, 15 nt, Homo sapiens
accgugucaccuacg

SEQ ID NO: 562130 - RNA, 22 nt, Homo sapiens
accuaaaaacauuuacugacca

SEQ ID NO: 562131 - RNA, 23 nt, Homo sapiens
accuaaaaggaaaucucacccca

SEQ ID NO: 562132 - RNA, 13 nt, Homo sapiens
accuaaacugagc

SEQ ID NO: 562133 - RNA, 14 nt, Homo sapiens
accuaaccacuuag

SEQ ID NO: 562134 - RNA, 15 nt, Homo sapiens
accuaaggauaugca

SEQ ID NO: 562135 - RNA, 19 nt, Homo sapiens
accuaagucucugugaauu

SEQ ID NO: 562136 - RNA, 23 nt, Homo sapiens
accuaagucucugugaauugaaa

SEQ ID NO: 562137 - RNA, 20 nt, Homo sapiens
accuaauggucucuaccuaa

SEQ ID NO: 562138 - RNA, 21 nt, Homo sapiens
accuacacaggagucuucaga

SEQ ID NO: 562139 - RNA, 16 nt, Homo sapiens
accuacagacuaagaa

SEQ ID NO: 562140 - RNA, 13 nt, Homo sapiens
accuacaguguac

SEQ ID NO: 562141 - RNA, 14 nt, Homo sapiens
accuacaguguaca

SEQ ID NO: 562142 - RNA, 12 nt, Homo sapiens
accuaccaaaau

SEQ ID NO: 562143 - RNA, 21 nt, Homo sapiens
acuaauuuuuaugaugcaaau

SEQ ID NO: 562144 - RNA, 15 nt, Homo sapiens
acuacaaaauuggaa

SEQ ID NO: 562145 - RNA, 15 nt, Homo sapiens
acuacaaacuucaaa

SEQ ID NO: 562146 - RNA, 15 nt, Homo sapiens
acuacaacagaauuu

SEQ ID NO: 562147 - RNA, 14 nt, Homo sapiens
acuacaaugauggu

SEQ ID NO: 562148 - RNA, 13 nt, Homo sapiens
acuacacuccagc

SEQ ID NO: 562149 - RNA, 17 nt, Homo sapiens
acuacagaguacgugaa

SEQ ID NO: 562150 - RNA, 16 nt, Homo sapiens
acuacaguaacuguga

SEQ ID NO: 562151 - RNA, 22 nt, Homo sapiens
acuacaguaacugugacugaug

SEQ ID NO: 562152 - RNA, 16 nt, Homo sapiens
acuacauaucuaaagc

SEQ ID NO: 562153 - RNA, 15 nt, Homo sapiens
acuacauauuguaaa

SEQ ID NO: 562154 - RNA, 15 nt, Homo sapiens
acuacaucuaguuaa

SEQ ID NO: 562155 - RNA, 22 nt, Homo sapiens
acuacauuaccuguucuugccu

SEQ ID NO: 562156 - RNA, 17 nt, Homo sapiens
acuacauuucuacuaug

SEQ ID NO: 562157 - RNA, 21 nt, Homo sapiens
acuaccccaaaguuugcucaa

SEQ ID NO: 562158 - RNA, 22 nt, Homo sapiens
acuacccgagcccagcuacauu

SEQ ID NO: 562159 - RNA, 15 nt, Homo sapiens
acuacgcuugcucau

SEQ ID NO: 562160 - RNA, 21 nt, Homo sapiens
acuacgggcugcucuacugcu

SEQ ID NO: 562161 - RNA, 14 nt, Homo sapiens
acuacuauauugau

SEQ ID NO: 562162 - RNA, 15 nt, Homo sapiens
acuacugacaugugg

SEQ ID NO: 562163 - RNA, 21 nt, Homo sapiens
acuacugacauguggggccag

SEQ ID NO: 562164 - RNA, 14 nt, Homo sapiens
acuacugugaucag

SEQ ID NO: 562165 - RNA, 22 nt, Homo sapiens
acuacuuaaaaugauucucuac

SEQ ID NO: 562166 - RNA, 21 nt, Homo sapiens
acuacuuuaauaaagaauuaa

SEQ ID NO: 562167 - RNA, 15 nt, Homo sapiens
acuacuuuuugguca

SEQ ID NO: 562168 - RNA, 17 nt, Homo sapiens
acuagaagcaacuagga

SEQ ID NO: 562169 - RNA, 14 nt, Homo sapiens
acuagaaggcuucu

SEQ ID NO: 562170 - RNA, 16 nt, Homo sapiens
acuagaagggccaguc

SEQ ID NO: 562171 - RNA, 15 nt, Homo sapiens
acuagaauagugcau

SEQ ID NO: 562172 - RNA, 20 nt, Homo sapiens
acuagacuacucaauauuaa

SEQ ID NO: 562173 - RNA, 16 nt, Homo sapiens
acuagagucugaacag

SEQ ID NO: 562174 - RNA, 14 nt, Homo sapiens
acuagaugacugua

SEQ ID NO: 562175 - RNA, 14 nt, Homo sapiens
acuagauuacauuc

SEQ ID NO: 562176 - RNA, 17 nt, Homo sapiens
acuagauucuugucaca

SEQ ID NO: 562177 - RNA, 14 nt, Homo sapiens
acuagcauacuuaa

SEQ ID NO: 562178 - RNA, 16 nt, Homo sapiens
acuagccacugagaag

SEQ ID NO: 562179 - RNA, 16 nt, Homo sapiens
acuagccagacacucu

SEQ ID NO: 562180 - RNA, 21 nt, Homo sapiens
acuagccaggaaguacuucca

SEQ ID NO: 562181 - RNA, 14 nt, Homo sapiens
acuagcuuuugcca

SEQ ID NO: 562182 - RNA, 21 nt, Homo sapiens
acuagcuuuugccaguauuau

SEQ ID NO: 562183 - RNA, 14 nt, Homo sapiens
acuaggaaauucca

SEQ ID NO: 562184 - RNA, 15 nt, Homo sapiens
acuaggacucugagg

SEQ ID NO: 562185 - RNA, 14 nt, Homo sapiens
acuaggcacugugg

SEQ ID NO: 562186 - RNA, 20 nt, Homo sapiens
acuaggccauuagcccuuca

SEQ ID NO: 562187 - RNA, 13 nt, Homo sapiens
acuaggccuucag

SEQ ID NO: 562188 - RNA, 15 nt, Homo sapiens
acuagggaucccuca

SEQ ID NO: 562189 - RNA, 18 nt, Homo sapiens
acuagggcacaucuggau

SEQ ID NO: 562190 - RNA, 14 nt, Homo sapiens
acuaguagauuucu

SEQ ID NO: 562191 - RNA, 19 nt, Homo sapiens
acuagugacacauuguaca

SEQ ID NO: 562192 - RNA, 16 nt, Homo sapiens
acuagugacagcuugu

SEQ ID NO: 562193 - RNA, 16 nt, Homo sapiens
acuagugcaauuccaa

SEQ ID NO: 562194 - RNA, 12 nt, Homo sapiens
acuagugccauu

SEQ ID NO: 562195 - RNA, 16 nt, Homo sapiens
acuauaaaagcuuucu

SEQ ID NO: 562196 - RNA, 12 nt, Homo sapiens
acuauaaguaau

SEQ ID NO: 562197 - RNA, 20 nt, Homo sapiens
acuauaaucucuugaauuug

SEQ ID NO: 562198 - RNA, 18 nt, Homo sapiens
acuauaauguaagcucua

SEQ ID NO: 562199 - RNA, 14 nt, Homo sapiens
acuauacacuuaau

SEQ ID NO: 562200 - RNA, 16 nt, Homo sapiens
acuauacccgggacca

SEQ ID NO: 562201 - RNA, 20 nt, Homo sapiens
acuauagaaugcaacuccau

SEQ ID NO: 562202 - RNA, 16 nt, Homo sapiens
acuauauguacagcuc

SEQ ID NO: 562203 - RNA, 14 nt, Homo sapiens
acuauauuugcuag

SEQ ID NO: 562204 - RNA, 18 nt, Homo sapiens
acuaucaaacugaagcca

SEQ ID NO: 562205 - RNA, 17 nt, Homo sapiens
acuaucauucucagugg

SEQ ID NO: 562206 - RNA, 15 nt, Homo sapiens
acuaucccaaucaaa

SEQ ID NO: 562207 - RNA, 22 nt, Homo sapiens
acuaucccaaucaaagaauuac

SEQ ID NO: 562208 - RNA, 14 nt, Homo sapiens
acuauccuacccca

SEQ ID NO: 562209 - RNA, 15 nt, Homo sapiens
acuaugaucacagug

SEQ ID NO: 562210 - RNA, 23 nt, Homo sapiens
acuaugauuuaauuugaaauaug

SEQ ID NO: 562211 - RNA, 22 nt, Homo sapiens
acuaugcccaaccuauccuguu

SEQ ID NO: 562212 - RNA, 19 nt, Homo sapiens
acuauggagugcaccaaag

SEQ ID NO: 562213 - RNA, 20 nt, Homo sapiens
acuauggagugcaccaaaga

SEQ ID NO: 562214 - RNA, 21 nt, Homo sapiens
acuauggauguguucucuagg

SEQ ID NO: 562215 - RNA, 17 nt, Homo sapiens
acuaugugccaguuccu

SEQ ID NO: 562216 - RNA, 21 nt, Homo sapiens
acuauguuaaugaguauguaa

SEQ ID NO: 562217 - RNA, 16 nt, Homo sapiens
acuauuaaaacagcca

SEQ ID NO: 562218 - RNA, 15 nt, Homo sapiens
acuauuaccaugaga

SEQ ID NO: 562219 - RNA, 16 nt, Homo sapiens
acuauucacugaugca

SEQ ID NO: 562220 - RNA, 17 nt, Homo sapiens
acuauucacugaugcag

SEQ ID NO: 562221 - RNA, 20 nt, Homo sapiens
acuauugaaaucaagcuuau

SEQ ID NO: 562222 - RNA, 18 nt, Homo sapiens
acuauugaaguugcagau

SEQ ID NO: 562223 - RNA, 20 nt, Homo sapiens
acuauuuaaaauaagcacac

SEQ ID NO: 562224 - RNA, 17 nt, Homo sapiens
acuauuuaugaaggcaa

SEQ ID NO: 562225 - RNA, 14 nt, Homo sapiens
acuauuuccaccuc

SEQ ID NO: 562226 - RNA, 15 nt, Homo sapiens
acuauuuugugcucc

SEQ ID NO: 562227 - RNA, 17 nt, Homo sapiens
acucaaaacacccaaaa

SEQ ID NO: 562228 - RNA, 17 nt, Homo sapiens
acucaaaacucuugaaa

SEQ ID NO: 562229 - RNA, 19 nt, Homo sapiens
acucaaaagcccacgucag

SEQ ID NO: 562230 - RNA, 14 nt, Homo sapiens
acucaaacugccuu

SEQ ID NO: 562231 - RNA, 18 nt, Homo sapiens
acucaaauuggugaacag

SEQ ID NO: 562232 - RNA, 12 nt, Homo sapiens
acucaacauguu

SEQ ID NO: 562233 - RNA, 19 nt, Homo sapiens
acucaacccauuguuguca

SEQ ID NO: 562234 - RNA, 21 nt, Homo sapiens
acucaagaagcacaccuacag

SEQ ID NO: 562235 - RNA, 15 nt, Homo sapiens
acucaagaaggaauu

SEQ ID NO: 562236 - RNA, 16 nt, Homo sapiens
acucaagaguucagug

SEQ ID NO: 562237 - RNA, 15 nt, Homo sapiens
acucaagcucaaaag

SEQ ID NO: 562238 - RNA, 16 nt, Homo sapiens
acucaaggcuugaguc

SEQ ID NO: 562239 - RNA, 19 nt, Homo sapiens
acucaaggucacacaguga

SEQ ID NO: 562240 - RNA, 17 nt, Homo sapiens
acucaaucuccagggcu

SEQ ID NO: 562241 - RNA, 20 nt, Homo sapiens
acucacaagaagaccagacu

SEQ ID NO: 562242 - RNA, 22 nt, Homo sapiens
acucacaccuguaaucccagca

SEQ ID NO: 562243 - RNA, 21 nt, Homo sapiens
acucacacggacacucaaaag

SEQ ID NO: 562244 - RNA, 15 nt, Homo sapiens
acucacagucucuuu

SEQ ID NO: 562245 - RNA, 20 nt, Homo sapiens
acucaccagccccacugcca

SEQ ID NO: 562246 - RNA, 23 nt, Homo sapiens
acucaccaguguccccuccacug

SEQ ID NO: 562247 - RNA, 12 nt, Homo sapiens
acucaccaucug

SEQ ID NO: 562248 - RNA, 12 nt, Homo sapiens
acucacccaagc

SEQ ID NO: 562249 - RNA, 12 nt, Homo sapiens
acucaccucccc

SEQ ID NO: 562250 - RNA, 22 nt, Homo sapiens
acucaccuucuagucuuggcca

SEQ ID NO: 562251 - RNA, 17 nt, Homo sapiens
acucacucauuccuuca

SEQ ID NO: 562252 - RNA, 22 nt, Homo sapiens
acucacugaggccaucagggcc

SEQ ID NO: 562253 - RNA, 19 nt, Homo sapiens
acucacugauucucuacau

SEQ ID NO: 562254 - RNA, 16 nt, Homo sapiens
acucacugcugugagu

SEQ ID NO: 562255 - RNA, 19 nt, Homo sapiens
acucacuucaaugugucau

SEQ ID NO: 562256 - RNA, 15 nt, Homo sapiens
acucacuuccagugc

SEQ ID NO: 562257 - RNA, 15 nt, Homo sapiens
acucagaaagccaac

SEQ ID NO: 562258 - RNA, 21 nt, Homo sapiens
acucagaaagccaacaugugg

SEQ ID NO: 562259 - RNA, 15 nt, Homo sapiens
acucagacauuccaa

SEQ ID NO: 562260 - RNA, 20 nt, Homo sapiens
acucagagaugaacaucuaa

SEQ ID NO: 562261 - RNA, 12 nt, Homo sapiens
acucagcacaag

SEQ ID NO: 562262 - RNA, 16 nt, Homo sapiens
acucagcaguugacau

SEQ ID NO: 562263 - RNA, 19 nt, Homo sapiens
acucagccggcagccagau

SEQ ID NO: 562264 - RNA, 21 nt, Homo sapiens
acucagccucauucagcaugg

SEQ ID NO: 562265 - RNA, 17 nt, Homo sapiens
acugugccucaggccag

SEQ ID NO: 562266 - RNA, 14 nt, Homo sapiens
acugugcuccucac

SEQ ID NO: 562267 - RNA, 14 nt, Homo sapiens
acugugcuuggcca

SEQ ID NO: 562268 - RNA, 24 nt, Homo sapiens
acuguggaaaugccaaaccaagca

SEQ ID NO: 562269 - RNA, 12 nt, Homo sapiens
acuguggaauau

SEQ ID NO: 562270 - RNA, 18 nt, Homo sapiens
acuguggcuagugacaaa

SEQ ID NO: 562271 - RNA, 20 nt, Homo sapiens
acuguggcugcuagcacuug

SEQ ID NO: 562272 - RNA, 17 nt, Homo sapiens
acugugguacugaugga

SEQ ID NO: 562273 - RNA, 16 nt, Homo sapiens
acuguguaaaccacau

SEQ ID NO: 562274 - RNA, 15 nt, Homo sapiens
acuguguaacuuucu

SEQ ID NO: 562275 - RNA, 16 nt, Homo sapiens
acuguguauuccaaga

SEQ ID NO: 562276 - RNA, 17 nt, Homo sapiens
acugugugagauuguga

SEQ ID NO: 562277 - RNA, 16 nt, Homo sapiens
acuguguggacuguga

SEQ ID NO: 562278 - RNA, 20 nt, Homo sapiens
acuguuagucauuugcugag

SEQ ID NO: 562279 - RNA, 16 nt, Homo sapiens
acuguucacucacucu

SEQ ID NO: 562280 - RNA, 15 nt, Homo sapiens
acuguugaguucuga

SEQ ID NO: 562281 - RNA, 17 nt, Homo sapiens
acuguugcuuuagucac

SEQ ID NO: 562282 - RNA, 18 nt, Homo sapiens
acuguugcuuugggagac

SEQ ID NO: 562283 - RNA, 13 nt, Homo sapiens
acuguuggcucuc

SEQ ID NO: 562284 - RNA, 16 nt, Homo sapiens
acuguugucaaaaagu

SEQ ID NO: 562285 - RNA, 19 nt, Homo sapiens
acuguuuaagcccagccaa

SEQ ID NO: 562286 - RNA, 13 nt, Homo sapiens
acuguuuuccuua

SEQ ID NO: 562287 - RNA, 18 nt, Homo sapiens
acuguuuugggccuccau

SEQ ID NO: 562288 - RNA, 16 nt, Homo sapiens
acuguuuuuaaguaac

SEQ ID NO: 562289 - RNA, 23 nt, Homo sapiens
acuuaaaaaaaaauaggcccuuu

SEQ ID NO: 562290 - RNA, 18 nt, Homo sapiens
acuuaaaaaaagcacaug

SEQ ID NO: 562291 - RNA, 22 nt, Homo sapiens
acuuaaaaaauacuugcaugaa

SEQ ID NO: 562292 - RNA, 15 nt, Homo sapiens
acuuaaaauaucucu

SEQ ID NO: 562293 - RNA, 14 nt, Homo sapiens
acuuaaacuuccac

SEQ ID NO: 562294 - RNA, 14 nt, Homo sapiens
acuuaaacuugcau

SEQ ID NO: 562295 - RNA, 13 nt, Homo sapiens
acuuaaagcaaaa

SEQ ID NO: 562296 - RNA, 19 nt, Homo sapiens
acuuaaagcccgccugaca

SEQ ID NO: 562297 - RNA, 13 nt, Homo sapiens
acuuaacauucug

SEQ ID NO: 562298 - RNA, 13 nt, Homo sapiens
acuuaacuaugag

SEQ ID NO: 562299 - RNA, 19 nt, Homo sapiens
acuuaagaguggcauauaa

SEQ ID NO: 562300 - RNA, 19 nt, Homo sapiens
acuuaagcccagugcacug

SEQ ID NO: 562301 - RNA, 20 nt, Homo sapiens
acuuaagcccagugcacuga

SEQ ID NO: 562302 - RNA, 17 nt, Homo sapiens
acuuaagucuuccuuaa

SEQ ID NO: 562303 - RNA, 18 nt, Homo sapiens
acuuaagucuuccuuaaa

SEQ ID NO: 562304 - RNA, 23 nt, Homo sapiens
acuuaauacucaaaugaguaaca

SEQ ID NO: 562305 - RNA, 13 nt, Homo sapiens
acuuaaucucaca

SEQ ID NO: 562306 - RNA, 17 nt, Homo sapiens
acuuaaucucacauuca

SEQ ID NO: 562307 - RNA, 13 nt, Homo sapiens
acuuaaugcacag

SEQ ID NO: 562308 - RNA, 17 nt, Homo sapiens
acuuaauguaauucagg

SEQ ID NO: 562309 - RNA, 18 nt, Homo sapiens
acuuaauguaauucagga

SEQ ID NO: 562310 - RNA, 21 nt, Homo sapiens
acuuaauguuugguaacuuuu

SEQ ID NO: 562311 - RNA, 22 nt, Homo sapiens
acuuacaauaccauggguuauu

SEQ ID NO: 562312 - RNA, 13 nt, Homo sapiens
acuuacacuguau

SEQ ID NO: 562313 - RNA, 15 nt, Homo sapiens
acuuacagaucuauc

SEQ ID NO: 562314 - RNA, 15 nt, Homo sapiens
acuuacaucaugugu

SEQ ID NO: 562315 - RNA, 18 nt, Homo sapiens
acuuacauuuacaaacug

SEQ ID NO: 562316 - RNA, 18 nt, Homo sapiens
acuuaccccgagaccuca

SEQ ID NO: 562317 - RNA, 18 nt, Homo sapiens
acuuaccuagauuuacag

SEQ ID NO: 562318 - RNA, 17 nt, Homo sapiens
acuuacuguagccucag

SEQ ID NO: 562319 - RNA, 16 nt, Homo sapiens
acuuacuuaguguuau

SEQ ID NO: 562320 - RNA, 14 nt, Homo sapiens
acuuacuuuacuca

SEQ ID NO: 562321 - RNA, 17 nt, Homo sapiens
acuuagaagaaaucauu

SEQ ID NO: 562322 - RNA, 23 nt, Homo sapiens
acuuagaucaucagucaccgaag

SEQ ID NO: 562323 - RNA, 17 nt, Homo sapiens
acuuagcaugucccuac

SEQ ID NO: 562324 - RNA, 18 nt, Homo sapiens
acuuagcgucaagacauu

SEQ ID NO: 562325 - RNA, 22 nt, Homo sapiens
acuuagcucaggugccuuacau

SEQ ID NO: 562326 - RNA, 21 nt, Homo sapiens
acuuagguggcaagcugugac

SEQ ID NO: 562327 - RNA, 22 nt, Homo sapiens
acuuagucucuaaagaguuuau

SEQ ID NO: 562328 - RNA, 16 nt, Homo sapiens
acuuaguugcguuaca

SEQ ID NO: 562329 - RNA, 18 nt, Homo sapiens
acuuauagcgcugaccaa

SEQ ID NO: 562330 - RNA, 15 nt, Homo sapiens
acuuauaguacauga

SEQ ID NO: 562331 - RNA, 18 nt, Homo sapiens
acuuauauugaagacaau

SEQ ID NO: 562332 - RNA, 23 nt, Homo sapiens
acuuauauugaagacaauuugau

SEQ ID NO: 562333 - RNA, 21 nt, Homo sapiens
acuuauauuuaaaacuugccu

SEQ ID NO: 562334 - RNA, 14 nt, Homo sapiens
acuuaucacaugga

SEQ ID NO: 562335 - RNA, 13 nt, Homo sapiens
acuuaugcugcug

SEQ ID NO: 562336 - RNA, 21 nt, Homo sapiens
acuuauuaugaggcuauuaaa

SEQ ID NO: 562337 - RNA, 13 nt, Homo sapiens
acuuauugccaaa

SEQ ID NO: 562338 - RNA, 15 nt, Homo sapiens
acuuauugccaaaaa

SEQ ID NO: 562339 - RNA, 23 nt, Homo sapiens
acuuauuuaugaauugucuaaag

SEQ ID NO: 562340 - RNA, 11 nt, Homo sapiens
acuucaaagag

SEQ ID NO: 562341 - RNA, 14 nt, Homo sapiens
acuucaaaguuaau

SEQ ID NO: 562342 - RNA, 19 nt, Homo sapiens
acuucaaaugugguauaca

SEQ ID NO: 562343 - RNA, 19 nt, Homo sapiens
acuucaauccauguaggaa

SEQ ID NO: 562344 - RNA, 14 nt, Homo sapiens
acuucaauuuacuu

SEQ ID NO: 562345 - RNA, 14 nt, Homo sapiens
acuucacaauguau

SEQ ID NO: 562346 - RNA, 14 nt, Homo sapiens
acuucacacacagg

SEQ ID NO: 562347 - RNA, 23 nt, Homo sapiens
acuucacccgaguuccucugggu

SEQ ID NO: 562348 - RNA, 13 nt, Homo sapiens
acuucaccuuucc

SEQ ID NO: 562349 - RNA, 18 nt, Homo sapiens
acuucacuaaugaucaca

SEQ ID NO: 562350 - RNA, 18 nt, Homo sapiens
acuucagagcacacuuau

SEQ ID NO: 562351 - RNA, 12 nt, Homo sapiens
acuucagggauc

SEQ ID NO: 562352 - RNA, 17 nt, Homo sapiens
acuucaggggcacuuca

SEQ ID NO: 562353 - RNA, 23 nt, Homo sapiens
acuucagguggagagcacuagaa

SEQ ID NO: 562354 - RNA, 12 nt, Homo sapiens
acuucagucuuc

SEQ ID NO: 562355 - RNA, 18 nt, Homo sapiens
acuucaguugcuuugcag

SEQ ID NO: 562356 - RNA, 22 nt, Homo sapiens
acuucaguuuuauuuuugccaa

SEQ ID NO: 562357 - RNA, 19 nt, Homo sapiens
acuucaugaaauccugggu

SEQ ID NO: 562358 - RNA, 15 nt, Homo sapiens
acuucauuugacaca

SEQ ID NO: 562359 - RNA, 13 nt, Homo sapiens
acuuccacauuau

SEQ ID NO: 562360 - RNA, 22 nt, Homo sapiens
acuuccacauuauacauuugau

SEQ ID NO: 562361 - RNA, 13 nt, Homo sapiens
acuuccacuuugu

SEQ ID NO: 562362 - RNA, 14 nt, Homo sapiens
acuuccccacaggc

SEQ ID NO: 562363 - RNA, 15 nt, Homo sapiens
acuuccccugggaug

SEQ ID NO: 562364 - RNA, 23 nt, Homo sapiens
acuuccccugggaugcugaccca

SEQ ID NO: 562365 - RNA, 17 nt, Homo sapiens
acuuccccugggcaaga

SEQ ID NO: 562366 - RNA, 17 nt, Homo sapiens
acuucccugggccucaa

SEQ ID NO: 562367 - RNA, 14 nt, Homo sapiens
acuuccuacuguag

SEQ ID NO: 562368 - RNA, 23 nt, Homo sapiens
acuuccucagucuggugcuccag

SEQ ID NO: 562369 - RNA, 20 nt, Homo sapiens
acuuccuccacaguccccca

SEQ ID NO: 562370 - RNA, 14 nt, Homo sapiens
acuuccucugccau

SEQ ID NO: 562371 - RNA, 16 nt, Homo sapiens
acuuccuguccagaga

SEQ ID NO: 562372 - RNA, 17 nt, Homo sapiens
acuuccuguguacucuu

SEQ ID NO: 562373 - RNA, 14 nt, Homo sapiens
acuuccuugcucuc

SEQ ID NO: 562374 - RNA, 21 nt, Homo sapiens
acuuccuuuuaacugccaaga

SEQ ID NO: 562375 - RNA, 20 nt, Homo sapiens
acuucgcuaaccaacuguuc

SEQ ID NO: 562376 - RNA, 16 nt, Homo sapiens
acuucgggcuguguaa

SEQ ID NO: 562377 - RNA, 21 nt, Homo sapiens
acuucgucuucgcccucugaa

SEQ ID NO: 562378 - RNA, 18 nt, Homo sapiens
acuucuacauccaaugua

SEQ ID NO: 562379 - RNA, 14 nt, Homo sapiens
acuucuagacucac

SEQ ID NO: 562380 - RNA, 23 nt, Homo sapiens
acuucuagacucaccuguucuca

SEQ ID NO: 562381 - RNA, 16 nt, Homo sapiens
acuucuccaggucuca

SEQ ID NO: 562382 - RNA, 18 nt, Homo sapiens
acuucucuauuaucucaa

SEQ ID NO: 562383 - RNA, 16 nt, Homo sapiens
acuucucucaggaucc

SEQ ID NO: 562384 - RNA, 18 nt, Homo sapiens
acuucucucuaaggagaa

SEQ ID NO: 562385 - RNA, 23 nt, Homo sapiens
acuucucugcugccucuguggaa

SEQ ID NO: 562386 - RNA, 20 nt, Homo sapiens
acuucucugggucccggggu

SEQ ID NO: 562387 - RNA, 21 nt, Homo sapiens
agaagcagaagggcagaagau

SEQ ID NO: 562388 - RNA, 16 nt, Homo sapiens
agaagcauacaacuuu

SEQ ID NO: 562389 - RNA, 17 nt, Homo sapiens
agaagccaagcgcucau

SEQ ID NO: 562390 - RNA, 12 nt, Homo sapiens
agaagccaagga

SEQ ID NO: 562391 - RNA, 20 nt, Homo sapiens
agaagcccagguuacaaaga

SEQ ID NO: 562392 - RNA, 14 nt, Homo sapiens
agaagcccauauca

SEQ ID NO: 562393 - RNA, 12 nt, Homo sapiens
agaagcccugau

SEQ ID NO: 562394 - RNA, 20 nt, Homo sapiens
agaagccugaugcugacauu

SEQ ID NO: 562395 - RNA, 19 nt, Homo sapiens
agaagcgcggcuaacuuau

SEQ ID NO: 562396 - RNA, 23 nt, Homo sapiens
agaagcuaaauccuuuacuguua

SEQ ID NO: 562397 - RNA, 13 nt, Homo sapiens
agaagcucacaaa

SEQ ID NO: 562398 - RNA, 23 nt, Homo sapiens
agaagcugcauguuaagugccau

SEQ ID NO: 562399 - RNA, 13 nt, Homo sapiens
agaaggaaaaaug

SEQ ID NO: 562400 - RNA, 16 nt, Homo sapiens
agaaggaaucuucuca

SEQ ID NO: 562401 - RNA, 19 nt, Homo sapiens
agaaggacauuuuacugca

SEQ ID NO: 562402 - RNA, 16 nt, Homo sapiens
agaaggaggggagcag

SEQ ID NO: 562403 - RNA, 22 nt, Homo sapiens
agaaggauggcauuuuuugcaa

SEQ ID NO: 562404 - RNA, 13 nt, Homo sapiens
agaaggcaaaaag

SEQ ID NO: 562405 - RNA, 14 nt, Homo sapiens
agaaggcagugucc

SEQ ID NO: 562406 - RNA, 18 nt, Homo sapiens
agaagggaauccuccucc

SEQ ID NO: 562407 - RNA, 19 nt, Homo sapiens
agaaggggaagcacucgug

SEQ ID NO: 562408 - RNA, 20 nt, Homo sapiens
agaaggggagaagucagcua

SEQ ID NO: 562409 - RNA, 19 nt, Homo sapiens
agaaggggaggacacuggu

SEQ ID NO: 562410 - RNA, 22 nt, Homo sapiens
agaaggguaccuugaacacugg

SEQ ID NO: 562411 - RNA, 13 nt, Homo sapiens
agaaggugccacu

SEQ ID NO: 562412 - RNA, 15 nt, Homo sapiens
agaagguuaccaaga

SEQ ID NO: 562413 - RNA, 19 nt, Homo sapiens
agaagguucacccagcacc

SEQ ID NO: 562414 - RNA, 14 nt, Homo sapiens
agaagguuccuuga

SEQ ID NO: 562415 - RNA, 16 nt, Homo sapiens
agaagguugugaugaa

SEQ ID NO: 562416 - RNA, 19 nt, Homo sapiens
agaagguugugaugaagaa

SEQ ID NO: 562417 - RNA, 20 nt, Homo sapiens
agaagguuucuggagcagug

SEQ ID NO: 562418 - RNA, 21 nt, Homo sapiens
agaaguaagccucaucaucag

SEQ ID NO: 562419 - RNA, 14 nt, Homo sapiens
agaaguaccagacu

SEQ ID NO: 562420 - RNA, 18 nt, Homo sapiens
agaaguagcuaguagcaa

SEQ ID NO: 562421 - RNA, 13 nt, Homo sapiens
agaaguagcuuca

SEQ ID NO: 562422 - RNA, 19 nt, Homo sapiens
agaagucauauguugucuu

SEQ ID NO: 562423 - RNA, 22 nt, Homo sapiens
agaagucccaagacccuaguga

SEQ ID NO: 562424 - RNA, 14 nt, Homo sapiens
agaagucuccucaa

SEQ ID NO: 562425 - RNA, 21 nt, Homo sapiens
agaagucuggcuuugcucuau

SEQ ID NO: 562426 - RNA, 18 nt, Homo sapiens
agaagugugaagugcaga

SEQ ID NO: 562427 - RNA, 23 nt, Homo sapiens
agaaguguggggauuuucacuga

SEQ ID NO: 562428 - RNA, 18 nt, Homo sapiens
agaaguuaauccacaucu

SEQ ID NO: 562429 - RNA, 14 nt, Homo sapiens
agaaguuauuuucc

SEQ ID NO: 562430 - RNA, 22 nt, Homo sapiens
agaaguuccuagugauggcuua

SEQ ID NO: 562431 - RNA, 22 nt, Homo sapiens
agaaguucuuguucuucaggag

SEQ ID NO: 562432 - RNA, 19 nt, Homo sapiens
agaaguuguuugaggcaaa

SEQ ID NO: 562433 - RNA, 18 nt, Homo sapiens
agaaguuuguagccaggu

SEQ ID NO: 562434 - RNA, 20 nt, Homo sapiens
agaauaaaauuccuaucuca

SEQ ID NO: 562435 - RNA, 20 nt, Homo sapiens
agaauaaacauuuuuugauc

SEQ ID NO: 562436 - RNA, 19 nt, Homo sapiens
agaauaaaguuccugucau

SEQ ID NO: 562437 - RNA, 20 nt, Homo sapiens
agaauaaaguuccugucauu

SEQ ID NO: 562438 - RNA, 13 nt, Homo sapiens
agaauaagaauuu

SEQ ID NO: 562439 - RNA, 13 nt, Homo sapiens
agaauacacagga

SEQ ID NO: 562440 - RNA, 15 nt, Homo sapiens
agaauacuugcacuc

SEQ ID NO: 562441 - RNA, 17 nt, Homo sapiens
agaauacuuugcuucau

SEQ ID NO: 562442 - RNA, 14 nt, Homo sapiens
agaauagcacaaac

SEQ ID NO: 562443 - RNA, 14 nt, Homo sapiens
agaauagcuuugaa

SEQ ID NO: 562444 - RNA, 18 nt, Homo sapiens
agaauaggaaaacauugc

SEQ ID NO: 562445 - RNA, 18 nt, Homo sapiens
agaauauaauacuguauu

SEQ ID NO: 562446 - RNA, 19 nt, Homo sapiens
agaauaucuguaaugguac

SEQ ID NO: 562447 - RNA, 13 nt, Homo sapiens
agaauaugaaguu

SEQ ID NO: 562448 - RNA, 13 nt, Homo sapiens
agaauaugacuuu

SEQ ID NO: 562449 - RNA, 19 nt, Homo sapiens
agaauauuauguuccucaa

SEQ ID NO: 562450 - RNA, 19 nt, Homo sapiens
agaauauuuauuaccucug

SEQ ID NO: 562451 - RNA, 20 nt, Homo sapiens
agaauauuuuaaguauugca

SEQ ID NO: 562452 - RNA, 16 nt, Homo sapiens
agaaucacgauuucau

SEQ ID NO: 562453 - RNA, 23 nt, Homo sapiens
agaaucagcauuuagucuugcca

SEQ ID NO: 562454 - RNA, 13 nt, Homo sapiens
agaaucagccugg

SEQ ID NO: 562455 - RNA, 13 nt, Homo sapiens
agaaucagucuug

SEQ ID NO: 562456 - RNA, 13 nt, Homo sapiens
agaaucauaugau

SEQ ID NO: 562457 - RNA, 11 nt, Homo sapiens
agaaucaucuu

SEQ ID NO: 562458 - RNA, 11 nt, Homo sapiens
agaauccaaac

SEQ ID NO: 562459 - RNA, 23 nt, Homo sapiens
agaauccauccaaaguucccuau

SEQ ID NO: 562460 - RNA, 20 nt, Homo sapiens
agaaucccuuugcaccugag

SEQ ID NO: 562461 - RNA, 16 nt, Homo sapiens
agaauccgaagggaau

SEQ ID NO: 562462 - RNA, 16 nt, Homo sapiens
agaaucgcuagacuaa

SEQ ID NO: 562463 - RNA, 17 nt, Homo sapiens
agaaucuagaaaaucag

SEQ ID NO: 562464 - RNA, 15 nt, Homo sapiens
agaaucuauaguuca

SEQ ID NO: 562465 - RNA, 17 nt, Homo sapiens
agaaucugcagcuaacu

SEQ ID NO: 562466 - RNA, 21 nt, Homo sapiens
agaaucugcagcuaacuuauu

SEQ ID NO: 562467 - RNA, 18 nt, Homo sapiens
agaaucuguuaccagagg

SEQ ID NO: 562468 - RNA, 19 nt, Homo sapiens
agaaugaaauguaugugcu

SEQ ID NO: 562469 - RNA, 20 nt, Homo sapiens
agaaugaaauguaugugcuc

SEQ ID NO: 562470 - RNA, 15 nt, Homo sapiens
agaaugaacacuccc

SEQ ID NO: 562471 - RNA, 20 nt, Homo sapiens
agaaugacuccaccuucuca

SEQ ID NO: 562472 - RNA, 14 nt, Homo sapiens
agaaugagaagaca

SEQ ID NO: 562473 - RNA, 18 nt, Homo sapiens
agaaugagcuuacaaagu

SEQ ID NO: 562474 - RNA, 14 nt, Homo sapiens
agaaugaguuauga

SEQ ID NO: 562475 - RNA, 15 nt, Homo sapiens
agaaugaugcuauga

SEQ ID NO: 562476 - RNA, 16 nt, Homo sapiens
agaaugauuaaucaaa

SEQ ID NO: 562477 - RNA, 17 nt, Homo sapiens
agaaugcagcugaagac

SEQ ID NO: 562478 - RNA, 18 nt, Homo sapiens
agaaugcauuccagaaca

SEQ ID NO: 562479 - RNA, 14 nt, Homo sapiens
agaaugcuauuuca

SEQ ID NO: 562480 - RNA, 11 nt, Homo sapiens
agaaugcucuu

SEQ ID NO: 562481 - RNA, 16 nt, Homo sapiens
agaauggaauaagcag

SEQ ID NO: 562482 - RNA, 12 nt, Homo sapiens
agaauggagcug

SEQ ID NO: 562483 - RNA, 21 nt, Homo sapiens
agaauggaggggacuccaaag

SEQ ID NO: 562484 - RNA, 18 nt, Homo sapiens
agaaugggauuggcaagu

SEQ ID NO: 562485 - RNA, 21 nt, Homo sapiens
agaauggugcucuuaucuuuc

SEQ ID NO: 562486 - RNA, 15 nt, Homo sapiens
agaauguaacuccag

SEQ ID NO: 562487 - RNA, 13 nt, Homo sapiens
agaaugugauucc

SEQ ID NO: 562488 - RNA, 18 nt, Homo sapiens
agaaugugggauauuucc

SEQ ID NO: 562489 - RNA, 15 nt, Homo sapiens
agaauguugcuuucu

SEQ ID NO: 562490 - RNA, 14 nt, Homo sapiens
agaauguuguacuu

SEQ ID NO: 562491 - RNA, 16 nt, Homo sapiens
agaauuacaguacaca

SEQ ID NO: 562492 - RNA, 23 nt, Homo sapiens
agaauuacuuguguuacuugcca

SEQ ID NO: 562493 - RNA, 21 nt, Homo sapiens
agaauuauaauuaguuccuca

SEQ ID NO: 562494 - RNA, 21 nt, Homo sapiens
agaauucaaaagugauuaucu

SEQ ID NO: 562495 - RNA, 19 nt, Homo sapiens
agaauucacagaaccuacu

SEQ ID NO: 562496 - RNA, 12 nt, Homo sapiens
agaauucaguau

SEQ ID NO: 562497 - RNA, 17 nt, Homo sapiens
agaauucccugaucuaa

SEQ ID NO: 562498 - RNA, 17 nt, Homo sapiens
agaauuccugaagccag

SEQ ID NO: 562499 - RNA, 23 nt, Homo sapiens
agaauuccuuuucuaacucuccc

SEQ ID NO: 562500 - RNA, 21 nt, Homo sapiens
agaauucuucauccuaaauua

SEQ ID NO: 562501 - RNA, 18 nt, Homo sapiens
agaauugaguaucacuuu

SEQ ID NO: 562502 - RNA, 17 nt, Homo sapiens
agaauuggccaucuuaa

SEQ ID NO: 562503 - RNA, 13 nt, Homo sapiens
agaauuguaucau

SEQ ID NO: 562504 - RNA, 14 nt, Homo sapiens
agaauuguaucuca

SEQ ID NO: 562505 - RNA, 21 nt, Homo sapiens
agaauuuaaaacgcaugugca

SEQ ID NO: 562506 - RNA, 21 nt, Homo sapiens
agaauuuauucaauuccucug

SEQ ID NO: 562507 - RNA, 18 nt, Homo sapiens
agaauuucacaagcuauu

SEQ ID NO: 562508 - RNA, 11 nt, Homo sapiens
agaauuugcac

SEQ ID NO: 562509 - RNA, 23 nt, Homo sapiens
agcuguacccuugagaccuggaa

SEQ ID NO: 562510 - RNA, 23 nt, Homo sapiens
agcuguagaccaccuaauaucaa

SEQ ID NO: 562511 - RNA, 14 nt, Homo sapiens
agcuguaucuugau

SEQ ID NO: 562512 - RNA, 17 nt, Homo sapiens
agcugucagaacacucc

SEQ ID NO: 562513 - RNA, 14 nt, Homo sapiens
agcugucccauggg

SEQ ID NO: 562514 - RNA, 19 nt, Homo sapiens
agcugucccucacuguuga

SEQ ID NO: 562515 - RNA, 23 nt, Homo sapiens
agcuguccugcagcaaacacucc

SEQ ID NO: 562516 - RNA, 19 nt, Homo sapiens
agcugucgacuucaugaca

SEQ ID NO: 562517 - RNA, 12 nt, Homo sapiens
agcugucugcuc

SEQ ID NO: 562518 - RNA, 13 nt, Homo sapiens
agcugucugcuca

SEQ ID NO: 562519 - RNA, 14 nt, Homo sapiens
agcugucugugaau

SEQ ID NO: 562520 - RNA, 16 nt, Homo sapiens
agcugugacuucucca

SEQ ID NO: 562521 - RNA, 15 nt, Homo sapiens
agcugugcaggcaug

SEQ ID NO: 562522 - RNA, 16 nt, Homo sapiens
agcugugcaggcaugg

SEQ ID NO: 562523 - RNA, 15 nt, Homo sapiens
agcuguggcuucuag

SEQ ID NO: 562524 - RNA, 12 nt, Homo sapiens
agcuguucaaac

SEQ ID NO: 562525 - RNA, 14 nt, Homo sapiens
agcuguucuggacu

SEQ ID NO: 562526 - RNA, 11 nt, Homo sapiens
agcuguugcua

SEQ ID NO: 562527 - RNA, 17 nt, Homo sapiens
agcuguuuauggccuca

SEQ ID NO: 562528 - RNA, 16 nt, Homo sapiens
agcuguuuucccugac

SEQ ID NO: 562529 - RNA, 22 nt, Homo sapiens
agcuuaaaguaucuaccuggaa

SEQ ID NO: 562530 - RNA, 16 nt, Homo sapiens
agcuuaaauugucaga

SEQ ID NO: 562531 - RNA, 15 nt, Homo sapiens
agcuuaaguguaaau

SEQ ID NO: 562532 - RNA, 13 nt, Homo sapiens
agcuuacaacauu

SEQ ID NO: 562533 - RNA, 18 nt, Homo sapiens
agcuuacacagguuucag

SEQ ID NO: 562534 - RNA, 20 nt, Homo sapiens
agcuuacacugaggacugug

SEQ ID NO: 562535 - RNA, 17 nt, Homo sapiens
agcuuacagaaugggag

SEQ ID NO: 562536 - RNA, 20 nt, Homo sapiens
agcuuacuggcaaacaugaa

SEQ ID NO: 562537 - RNA, 16 nt, Homo sapiens
agcuuagcauaucuga

SEQ ID NO: 562538 - RNA, 22 nt, Homo sapiens
agcuuagccaaugugggagcag

SEQ ID NO: 562539 - RNA, 12 nt, Homo sapiens
agcuuaucucag

SEQ ID NO: 562540 - RNA, 14 nt, Homo sapiens
agcuuaugucagac

SEQ ID NO: 562541 - RNA, 14 nt, Homo sapiens
agcuucaaacugca

SEQ ID NO: 562542 - RNA, 14 nt, Homo sapiens
agcuucacaguacc

SEQ ID NO: 562543 - RNA, 21 nt, Homo sapiens
agcuucagaaguuuggcaaua

SEQ ID NO: 562544 - RNA, 22 nt, Homo sapiens
agcuucaggagggaaccagcuu

SEQ ID NO: 562545 - RNA, 13 nt, Homo sapiens
agcuucaucuuug

SEQ ID NO: 562546 - RNA, 20 nt, Homo sapiens
agcuuccaacccgaggcaau

SEQ ID NO: 562547 - RNA, 14 nt, Homo sapiens
agcuuccaccucau

SEQ ID NO: 562548 - RNA, 18 nt, Homo sapiens
agcuuccuggcucugggg

SEQ ID NO: 562549 - RNA, 22 nt, Homo sapiens
agcuuccuucugggacuggaca

SEQ ID NO: 562550 - RNA, 16 nt, Homo sapiens
agcuucggcauuugau

SEQ ID NO: 562551 - RNA, 22 nt, Homo sapiens
agcuucucuacagacuccaaaa

SEQ ID NO: 562552 - RNA, 23 nt, Homo sapiens
agcuucucuacagacuccaaaag

SEQ ID NO: 562553 - RNA, 18 nt, Homo sapiens
agcuucugggaccauaag

SEQ ID NO: 562554 - RNA, 16 nt, Homo sapiens
agcuucuucacaggca

SEQ ID NO: 562555 - RNA, 14 nt, Homo sapiens
agcuugaagcccaa

SEQ ID NO: 562556 - RNA, 21 nt, Homo sapiens
agcuugaauucauguuggucu

SEQ ID NO: 562557 - RNA, 16 nt, Homo sapiens
agcuugccuaauggcu

SEQ ID NO: 562558 - RNA, 17 nt, Homo sapiens
agcuugcucuucagugg

SEQ ID NO: 562559 - RNA, 23 nt, Homo sapiens
agcuugcucuucagugggagaaa

SEQ ID NO: 562560 - RNA, 14 nt, Homo sapiens
agcuuggagggaug

SEQ ID NO: 562561 - RNA, 15 nt, Homo sapiens
agcuuggagggaugg

SEQ ID NO: 562562 - RNA, 23 nt, Homo sapiens
agcuuggauggagacuccaugag

SEQ ID NO: 562563 - RNA, 14 nt, Homo sapiens
agcuuggcaugacc

SEQ ID NO: 562564 - RNA, 19 nt, Homo sapiens
agcuugggcaacagagcaa

SEQ ID NO: 562565 - RNA, 22 nt, Homo sapiens
agcuugggucagguucuugccu

SEQ ID NO: 562566 - RNA, 21 nt, Homo sapiens
agcuuggguccaccaugcaga

SEQ ID NO: 562567 - RNA, 20 nt, Homo sapiens
agcuugucugaucguucaaa

SEQ ID NO: 562568 - RNA, 21 nt, Homo sapiens
agcuuuaaacucagggacaga

SEQ ID NO: 562569 - RNA, 15 nt, Homo sapiens
agcuuuacauauucc

SEQ ID NO: 562570 - RNA, 13 nt, Homo sapiens
agcuuuacgcuca

SEQ ID NO: 562571 - RNA, 17 nt, Homo sapiens
agcuuuacgcucaucac

SEQ ID NO: 562572 - RNA, 14 nt, Homo sapiens
agcuuuacuucuuu

SEQ ID NO: 562573 - RNA, 20 nt, Homo sapiens
agcuuuaggcagagccauaa

SEQ ID NO: 562574 - RNA, 22 nt, Homo sapiens
agcuuucagagccagugaagga

SEQ ID NO: 562575 - RNA, 16 nt, Homo sapiens
agcuuuccugacaaua

SEQ ID NO: 562576 - RNA, 13 nt, Homo sapiens
agcuuucucaggg

SEQ ID NO: 562577 - RNA, 16 nt, Homo sapiens
agcuuucuccuucaga

SEQ ID NO: 562578 - RNA, 22 nt, Homo sapiens
agcuuucucucagaaaugcugu

SEQ ID NO: 562579 - RNA, 13 nt, Homo sapiens
agcuuucugccau

SEQ ID NO: 562580 - RNA, 13 nt, Homo sapiens
agcuuugcucagc

SEQ ID NO: 562581 - RNA, 12 nt, Homo sapiens
agcuuugcucuu

SEQ ID NO: 562582 - RNA, 12 nt, Homo sapiens
agcuuugucacu

SEQ ID NO: 562583 - RNA, 18 nt, Homo sapiens
agcuuuuaaaaauguccu

SEQ ID NO: 562584 - RNA, 21 nt, Homo sapiens
agcuuuucccaggagaccauu

SEQ ID NO: 562585 - RNA, 22 nt, Homo sapiens
agcuuuucuuuuuuaauuucca

SEQ ID NO: 562586 - RNA, 23 nt, Homo sapiens
agcuuuucuuuuuuaauuuccag

SEQ ID NO: 562587 - RNA, 18 nt, Homo sapiens
agcuuuugaaauccagaa

SEQ ID NO: 562588 - RNA, 18 nt, Homo sapiens
aggaaaaaaagcaaaaag

SEQ ID NO: 562589 - RNA, 15 nt, Homo sapiens
aggaaaaacaaacua

SEQ ID NO: 562590 - RNA, 19 nt, Homo sapiens
aggaaaaacacaagcaaaa

SEQ ID NO: 562591 - RNA, 17 nt, Homo sapiens
aggaaaaacaugagcau

SEQ ID NO: 562592 - RNA, 20 nt, Homo sapiens
aggaaaaacaugagcauccc

SEQ ID NO: 562593 - RNA, 15 nt, Homo sapiens
aggaaaaauaaucaa

SEQ ID NO: 562594 - RNA, 15 nt, Homo sapiens
aggaaaaauguguaa

SEQ ID NO: 562595 - RNA, 13 nt, Homo sapiens
aggaaaacacagc

SEQ ID NO: 562596 - RNA, 14 nt, Homo sapiens
aggaaaagcaagaa

SEQ ID NO: 562597 - RNA, 20 nt, Homo sapiens
aggaaaagcggacaucagcu

SEQ ID NO: 562598 - RNA, 13 nt, Homo sapiens
aggaaaaggcccc

SEQ ID NO: 562599 - RNA, 14 nt, Homo sapiens
aggaaaagucccaa

SEQ ID NO: 562600 - RNA, 14 nt, Homo sapiens
aggaaaagugcaag

SEQ ID NO: 562601 - RNA, 17 nt, Homo sapiens
aggaaaaucugcacugu

SEQ ID NO: 562602 - RNA, 19 nt, Homo sapiens
aggaaaauguauccagagg

SEQ ID NO: 562603 - RNA, 14 nt, Homo sapiens
aggaaaauugcacu

SEQ ID NO: 562604 - RNA, 13 nt, Homo sapiens
aggaaacaaccau

SEQ ID NO: 562605 - RNA, 14 nt, Homo sapiens
aggaaacacuucua

SEQ ID NO: 562606 - RNA, 12 nt, Homo sapiens
aggaaacauuca

SEQ ID NO: 562607 - RNA, 16 nt, Homo sapiens
aggaaaccacaaccuu

SEQ ID NO: 562608 - RNA, 16 nt, Homo sapiens
aggaaacgcuaccucu

SEQ ID NO: 562609 - RNA, 15 nt, Homo sapiens
aggaaacucaucucc

SEQ ID NO: 562610 - RNA, 22 nt, Homo sapiens
aggaaacucaucuccuuccuga

SEQ ID NO: 562611 - RNA, 22 nt, Homo sapiens
aggaaaggccccaaucuugccc

SEQ ID NO: 562612 - RNA, 18 nt, Homo sapiens
aggaaaggggcgagcacc

SEQ ID NO: 562613 - RNA, 21 nt, Homo sapiens
aggaaaggggcgagcacccac

SEQ ID NO: 562614 - RNA, 22 nt, Homo sapiens
aggaaagucacccaaacacuuc

SEQ ID NO: 562615 - RNA, 15 nt, Homo sapiens
aggaaauaaaguaua

SEQ ID NO: 562616 - RNA, 23 nt, Homo sapiens
aggaaauagggaauccaauggaa

SEQ ID NO: 562617 - RNA, 11 nt, Homo sapiens
aggaaauccaa

SEQ ID NO: 562618 - RNA, 22 nt, Homo sapiens
aggaaauucuugaaaauauaag

SEQ ID NO: 562619 - RNA, 15 nt, Homo sapiens
aggaacaacagcauc

SEQ ID NO: 562620 - RNA, 17 nt, Homo sapiens
aggaacaauaaaauguc

SEQ ID NO: 562621 - RNA, 13 nt, Homo sapiens
aggaacacugcac

SEQ ID NO: 562622 - RNA, 24 nt, Homo sapiens
aggaacagaccugaggcuuaucuu

SEQ ID NO: 562623 - RNA, 13 nt, Homo sapiens
aggaacauuccuu

SEQ ID NO: 562624 - RNA, 20 nt, Homo sapiens
aggaacauuccuuagucuca

SEQ ID NO: 562625 - RNA, 15 nt, Homo sapiens
aggaaccacaauguu

SEQ ID NO: 562626 - RNA, 17 nt, Homo sapiens
aggaaccaggaggacaa

SEQ ID NO: 562627 - RNA, 20 nt, Homo sapiens
aggaacccuccuccugucaa

SEQ ID NO: 562628 - RNA, 22 nt, Homo sapiens
aggaacccugaucucucagccc

SEQ ID NO: 562629 - RNA, 20 nt, Homo sapiens
aggaaccuccuccacaccag

SEQ ID NO: 562630 - RNA, 19 nt, Homo sapiens
aggaacuguuauaauuuau

SEQ ID NO: 562631 - RNA, 18 nt, Homo sapiens
aggcugccccucucacca

SEQ ID NO: 562632 - RNA, 18 nt, Homo sapiens
aggcugcccugaacaaaa

SEQ ID NO: 562633 - RNA, 13 nt, Homo sapiens
aggcugcccugag

SEQ ID NO: 562634 - RNA, 19 nt, Homo sapiens
aggcugcgacugaugaagg

SEQ ID NO: 562635 - RNA, 18 nt, Homo sapiens
aggcugcuagaggugcuc

SEQ ID NO: 562636 - RNA, 18 nt, Homo sapiens
aggcugcuggacacgucg

SEQ ID NO: 562637 - RNA, 18 nt, Homo sapiens
aggcugcuggagugcagu

SEQ ID NO: 562638 - RNA, 15 nt, Homo sapiens
aggcuggaaaugguu

SEQ ID NO: 562639 - RNA, 16 nt, Homo sapiens
aggcuggaaaugguuu

SEQ ID NO: 562640 - RNA, 15 nt, Homo sapiens
aggcuggacugcaau

SEQ ID NO: 562641 - RNA, 20 nt, Homo sapiens
aggcuggaggacaguggcac

SEQ ID NO: 562642 - RNA, 14 nt, Homo sapiens
aggcuggagugcaa

SEQ ID NO: 562643 - RNA, 15 nt, Homo sapiens
aggcuggagugcaau

SEQ ID NO: 562644 - RNA, 20 nt, Homo sapiens
aggcuggagugcagugccac

SEQ ID NO: 562645 - RNA, 20 nt, Homo sapiens
aggcuggagugcaguggcau

SEQ ID NO: 562646 - RNA, 17 nt, Homo sapiens
aggcuggauccuagccu

SEQ ID NO: 562647 - RNA, 18 nt, Homo sapiens
aggcuggcaccaugguga

SEQ ID NO: 562648 - RNA, 15 nt, Homo sapiens
aggcuggccagucca

SEQ ID NO: 562649 - RNA, 18 nt, Homo sapiens
aggcuggcuccagaugca

SEQ ID NO: 562650 - RNA, 15 nt, Homo sapiens
aggcugggaggaaca

SEQ ID NO: 562651 - RNA, 15 nt, Homo sapiens
aggcugggcagcaca

SEQ ID NO: 562652 - RNA, 12 nt, Homo sapiens
aggcugggccau

SEQ ID NO: 562653 - RNA, 18 nt, Homo sapiens
aggcugggccauguccaa

SEQ ID NO: 562654 - RNA, 23 nt, Homo sapiens
aggcugggccauguccaaagagg

SEQ ID NO: 562655 - RNA, 14 nt, Homo sapiens
aggcugggccgcaa

SEQ ID NO: 562656 - RNA, 19 nt, Homo sapiens
aggcuggggaggccagugu

SEQ ID NO: 562657 - RNA, 12 nt, Homo sapiens
aggcuggucucg

SEQ ID NO: 562658 - RNA, 19 nt, Homo sapiens
aggcuguauauucaagccu

SEQ ID NO: 562659 - RNA, 12 nt, Homo sapiens
aggcugucacag

SEQ ID NO: 562660 - RNA, 21 nt, Homo sapiens
aggcugugagccaaggaggga

SEQ ID NO: 562661 - RNA, 19 nt, Homo sapiens
aggcuguggcaucagggua

SEQ ID NO: 562662 - RNA, 16 nt, Homo sapiens
aggcugugggccucaa

SEQ ID NO: 562663 - RNA, 24 nt, Homo sapiens
aggcugugggguggagcacuggac

SEQ ID NO: 562664 - RNA, 11 nt, Homo sapiens
aggcugugucu

SEQ ID NO: 562665 - RNA, 15 nt, Homo sapiens
aggcuguuccuugaa

SEQ ID NO: 562666 - RNA, 21 nt, Homo sapiens
aggcuguucucgaacuccuga

SEQ ID NO: 562667 - RNA, 18 nt, Homo sapiens
aggcuuaaucacaccguc

SEQ ID NO: 562668 - RNA, 18 nt, Homo sapiens
aggcuucuauuaccuauu

SEQ ID NO: 562669 - RNA, 18 nt, Homo sapiens
aggcuucuccgcccauuc

SEQ ID NO: 562670 - RNA, 14 nt, Homo sapiens
aggcuucucuccac

SEQ ID NO: 562671 - RNA, 12 nt, Homo sapiens
aggcuucuucag

SEQ ID NO: 562672 - RNA, 15 nt, Homo sapiens
aggcuuuacagugua

SEQ ID NO: 562673 - RNA, 16 nt, Homo sapiens
aggcuuuaucucaggg

SEQ ID NO: 562674 - RNA, 20 nt, Homo sapiens
aggcuuuggguggcucacua

SEQ ID NO: 562675 - RNA, 13 nt, Homo sapiens
agggaaaaaccag

SEQ ID NO: 562676 - RNA, 16 nt, Homo sapiens
agggaaacacagcagc

SEQ ID NO: 562677 - RNA, 19 nt, Homo sapiens
agggaaacuggcugagggg

SEQ ID NO: 562678 - RNA, 16 nt, Homo sapiens
agggaaaggggugcuu

SEQ ID NO: 562679 - RNA, 22 nt, Homo sapiens
agggaaauuuuggggggaacau

SEQ ID NO: 562680 - RNA, 18 nt, Homo sapiens
agggaaccuguuagucuc

SEQ ID NO: 562681 - RNA, 18 nt, Homo sapiens
agggaacugaaucacuua

SEQ ID NO: 562682 - RNA, 20 nt, Homo sapiens
agggaagaaaaagcaagugu

SEQ ID NO: 562683 - RNA, 18 nt, Homo sapiens
agggaagaagcauacaac

SEQ ID NO: 562684 - RNA, 16 nt, Homo sapiens
agggaagaggggugca

SEQ ID NO: 562685 - RNA, 20 nt, Homo sapiens
agggaagagugcauuuuccc

SEQ ID NO: 562686 - RNA, 13 nt, Homo sapiens
agggaagcaggga

SEQ ID NO: 562687 - RNA, 18 nt, Homo sapiens
agggaagccccacuugaa

SEQ ID NO: 562688 - RNA, 23 nt, Homo sapiens
agggaagcgucgccccaguggca

SEQ ID NO: 562689 - RNA, 19 nt, Homo sapiens
agggaaguaguccuuggca

SEQ ID NO: 562690 - RNA, 20 nt, Homo sapiens
agggaaguaguccuuggcau

SEQ ID NO: 562691 - RNA, 15 nt, Homo sapiens
agggaaguccuggga

SEQ ID NO: 562692 - RNA, 21 nt, Homo sapiens
agggaaguucaggcucugaga

SEQ ID NO: 562693 - RNA, 13 nt, Homo sapiens
agggaauccuccu

SEQ ID NO: 562694 - RNA, 17 nt, Homo sapiens
agggaaugcagcaggaa

SEQ ID NO: 562695 - RNA, 13 nt, Homo sapiens
agggaaugcauua

SEQ ID NO: 562696 - RNA, 18 nt, Homo sapiens
agggaccaaggaccccuc

SEQ ID NO: 562697 - RNA, 14 nt, Homo sapiens
agggacccaaagca

SEQ ID NO: 562698 - RNA, 14 nt, Homo sapiens
agggacccaugagu

SEQ ID NO: 562699 - RNA, 16 nt, Homo sapiens
agggaccuagaagcuu

SEQ ID NO: 562700 - RNA, 13 nt, Homo sapiens
agggaccugcuca

SEQ ID NO: 562701 - RNA, 23 nt, Homo sapiens
agggacuucacgaaguguugcau

SEQ ID NO: 562702 - RNA, 12 nt, Homo sapiens
agggacuugccu

SEQ ID NO: 562703 - RNA, 20 nt, Homo sapiens
agggagaacuugaaacagau

SEQ ID NO: 562704 - RNA, 15 nt, Homo sapiens
agggagaaggcaggu

SEQ ID NO: 562705 - RNA, 14 nt, Homo sapiens
agggagaccaugcc

SEQ ID NO: 562706 - RNA, 21 nt, Homo sapiens
agggagagacuaaccuugagu

SEQ ID NO: 562707 - RNA, 14 nt, Homo sapiens
agggagagccagcu

SEQ ID NO: 562708 - RNA, 15 nt, Homo sapiens
agggagaggccauga

SEQ ID NO: 562709 - RNA, 14 nt, Homo sapiens
agggagagguggca

SEQ ID NO: 562710 - RNA, 21 nt, Homo sapiens
agggagaguuggggaaggcaa

SEQ ID NO: 562711 - RNA, 18 nt, Homo sapiens
agggagaugaguugcagu

SEQ ID NO: 562712 - RNA, 21 nt, Homo sapiens
agggagcaacucuccacucca

SEQ ID NO: 562713 - RNA, 14 nt, Homo sapiens
agggagcacugggu

SEQ ID NO: 562714 - RNA, 16 nt, Homo sapiens
agggagcagaugcaau

SEQ ID NO: 562715 - RNA, 14 nt, Homo sapiens
agggagccauggaa

SEQ ID NO: 562716 - RNA, 19 nt, Homo sapiens
agggagccgcaccuuguca

SEQ ID NO: 562717 - RNA, 18 nt, Homo sapiens
agggagcucugaugagca

SEQ ID NO: 562718 - RNA, 13 nt, Homo sapiens
agggagcuugcca

SEQ ID NO: 562719 - RNA, 16 nt, Homo sapiens
agggaggggcuggggc

SEQ ID NO: 562720 - RNA, 21 nt, Homo sapiens
agggaggugaauacucuugaa

SEQ ID NO: 562721 - RNA, 18 nt, Homo sapiens
agggagugcacauaucca

SEQ ID NO: 562722 - RNA, 12 nt, Homo sapiens
agggaucacugg

SEQ ID NO: 562723 - RNA, 14 nt, Homo sapiens
agggaucacuggcu

SEQ ID NO: 562724 - RNA, 17 nt, Homo sapiens
agggauccguacauuca

SEQ ID NO: 562725 - RNA, 19 nt, Homo sapiens
agggaucuugcauucccag

SEQ ID NO: 562726 - RNA, 18 nt, Homo sapiens
agggaugagauacuuaug

SEQ ID NO: 562727 - RNA, 16 nt, Homo sapiens
agggauggagaaagaa

SEQ ID NO: 562728 - RNA, 22 nt, Homo sapiens
agggauggagaaagaaguggag

SEQ ID NO: 562729 - RNA, 16 nt, Homo sapiens
agggauuccccuaacc

SEQ ID NO: 562730 - RNA, 19 nt, Homo sapiens
agggauugaggaguugccu

SEQ ID NO: 562731 - RNA, 14 nt, Homo sapiens
agggcaacagauca

SEQ ID NO: 562732 - RNA, 19 nt, Homo sapiens
agggcacuaaacucagauu

SEQ ID NO: 562733 - RNA, 12 nt, Homo sapiens
agggcacuucag

SEQ ID NO: 562734 - RNA, 18 nt, Homo sapiens
agggcagacaugccuugg

SEQ ID NO: 562735 - RNA, 15 nt, Homo sapiens
agggcagagaauggc

SEQ ID NO: 562736 - RNA, 15 nt, Homo sapiens
agggcagagccaugg

SEQ ID NO: 562737 - RNA, 16 nt, Homo sapiens
agggcagaguagccag

SEQ ID NO: 562738 - RNA, 13 nt, Homo sapiens
agggcagcuguga

SEQ ID NO: 562739 - RNA, 14 nt, Homo sapiens
agggcagcugugau

SEQ ID NO: 562740 - RNA, 16 nt, Homo sapiens
agggcaggaccaaugg

SEQ ID NO: 562741 - RNA, 15 nt, Homo sapiens
agggcaggcugaggu

SEQ ID NO: 562742 - RNA, 16 nt, Homo sapiens
agggcagggcucugau

SEQ ID NO: 562743 - RNA, 18 nt, Homo sapiens
agggcaguaccugggaaa

SEQ ID NO: 562744 - RNA, 15 nt, Homo sapiens
agggcagucugcuca

SEQ ID NO: 562745 - RNA, 15 nt, Homo sapiens
agggcagugcccuuu

SEQ ID NO: 562746 - RNA, 22 nt, Homo sapiens
agggcaguuuugaggcaugacu

SEQ ID NO: 562747 - RNA, 15 nt, Homo sapiens
agggcauguguaugu

SEQ ID NO: 562748 - RNA, 21 nt, Homo sapiens
agggcauguguaugugucugc

SEQ ID NO: 562749 - RNA, 23 nt, Homo sapiens
agggcauuugugggucugugugg

SEQ ID NO: 562750 - RNA, 18 nt, Homo sapiens
agggccaagcaccuagcc

SEQ ID NO: 562751 - RNA, 15 nt, Homo sapiens
agggccacagcccug

SEQ ID NO: 562752 - RNA, 12 nt, Homo sapiens
agggccaggugc

SEQ ID NO: 562753 - RNA, 16 nt, Homo sapiens
agggccagugaugaug

SEQ ID NO: 562754 - RNA, 14 nt, Homo sapiens
aguccugguuggga

SEQ ID NO: 562755 - RNA, 12 nt, Homo sapiens
aguccuguugaa

SEQ ID NO: 562756 - RNA, 20 nt, Homo sapiens
aguccuguugaagacuuccu

SEQ ID NO: 562757 - RNA, 19 nt, Homo sapiens
aguccuguuugcagggaag

SEQ ID NO: 562758 - RNA, 13 nt, Homo sapiens
aguccuuauguua

SEQ ID NO: 562759 - RNA, 21 nt, Homo sapiens
aguccuucaccucacugaaaa

SEQ ID NO: 562760 - RNA, 19 nt, Homo sapiens
aguccuugggguuaagucu

SEQ ID NO: 562761 - RNA, 15 nt, Homo sapiens
agucgagaagccagg

SEQ ID NO: 562762 - RNA, 14 nt, Homo sapiens
agucgagaccucac

SEQ ID NO: 562763 - RNA, 18 nt, Homo sapiens
agucgagauugcacugcu

SEQ ID NO: 562764 - RNA, 23 nt, Homo sapiens
agucgauuauuuccaguguucua

SEQ ID NO: 562765 - RNA, 19 nt, Homo sapiens
agucgcaucucagugcagg

SEQ ID NO: 562766 - RNA, 15 nt, Homo sapiens
agucgcugugccaca

SEQ ID NO: 562767 - RNA, 23 nt, Homo sapiens
agucggauacccuggagcaagac

SEQ ID NO: 562768 - RNA, 19 nt, Homo sapiens
agucggcuuguucuugcag

SEQ ID NO: 562769 - RNA, 14 nt, Homo sapiens
agucgggacuugaa

SEQ ID NO: 562770 - RNA, 17 nt, Homo sapiens
agucguggaaucaaauc

SEQ ID NO: 562771 - RNA, 12 nt, Homo sapiens
agucuaaaccaa

SEQ ID NO: 562772 - RNA, 13 nt, Homo sapiens
agucuaacauauu

SEQ ID NO: 562773 - RNA, 22 nt, Homo sapiens
agucuaaccugcgucauuucag

SEQ ID NO: 562774 - RNA, 19 nt, Homo sapiens
agucuaccccugcuaagga

SEQ ID NO: 562775 - RNA, 14 nt, Homo sapiens
agucuacuucuuaa

SEQ ID NO: 562776 - RNA, 18 nt, Homo sapiens
agucuagaagcagcagcu

SEQ ID NO: 562777 - RNA, 12 nt, Homo sapiens
agucuccagugg

SEQ ID NO: 562778 - RNA, 14 nt, Homo sapiens
agucuccaugaaga

SEQ ID NO: 562779 - RNA, 15 nt, Homo sapiens
agucucccacuaaaa

SEQ ID NO: 562780 - RNA, 14 nt, Homo sapiens
agucucccagaugu

SEQ ID NO: 562781 - RNA, 15 nt, Homo sapiens
agucuccccacucca

SEQ ID NO: 562782 - RNA, 16 nt, Homo sapiens
agucuccuagacacuc

SEQ ID NO: 562783 - RNA, 21 nt, Homo sapiens
agucuccucacucugucccug

SEQ ID NO: 562784 - RNA, 21 nt, Homo sapiens
agucucugguagccugcagaa

SEQ ID NO: 562785 - RNA, 21 nt, Homo sapiens
agucucugucguggagccauu

SEQ ID NO: 562786 - RNA, 21 nt, Homo sapiens
agucucugugcuuugacucac

SEQ ID NO: 562787 - RNA, 21 nt, Homo sapiens
agucucuuacaaaagcuuuga

SEQ ID NO: 562788 - RNA, 22 nt, Homo sapiens
agucucuuuaaucuucaguuuu

SEQ ID NO: 562789 - RNA, 17 nt, Homo sapiens
agucugaacguggaauu

SEQ ID NO: 562790 - RNA, 21 nt, Homo sapiens
agucugacccuuacagccucu

SEQ ID NO: 562791 - RNA, 17 nt, Homo sapiens
agucugcagaguucucc

SEQ ID NO: 562792 - RNA, 10 nt, Homo sapiens
agucugcucc

SEQ ID NO: 562793 - RNA, 15 nt, Homo sapiens
agucuggaaagugau

SEQ ID NO: 562794 - RNA, 12 nt, Homo sapiens
agucuggcaaca

SEQ ID NO: 562795 - RNA, 19 nt, Homo sapiens
agucuggccacugucaagg

SEQ ID NO: 562796 - RNA, 21 nt, Homo sapiens
agucugggauguagaacuuca

SEQ ID NO: 562797 - RNA, 14 nt, Homo sapiens
agucuguaaaauac

SEQ ID NO: 562798 - RNA, 19 nt, Homo sapiens
agucuguaaaauacaugua

SEQ ID NO: 562799 - RNA, 12 nt, Homo sapiens
agucugucacac

SEQ ID NO: 562800 - RNA, 15 nt, Homo sapiens
agucuguucacugca

SEQ ID NO: 562801 - RNA, 15 nt, Homo sapiens
agucuuccaguuuaa

SEQ ID NO: 562802 - RNA, 20 nt, Homo sapiens
agucuucucauagcauuaac

SEQ ID NO: 562803 - RNA, 20 nt, Homo sapiens
agucuugaugacauuucacu

SEQ ID NO: 562804 - RNA, 19 nt, Homo sapiens
agucuugcaacagugccau

SEQ ID NO: 562805 - RNA, 18 nt, Homo sapiens
agucuugcucuguugccc

SEQ ID NO: 562806 - RNA, 22 nt, Homo sapiens
agucuuggguggcgcuggugca

SEQ ID NO: 562807 - RNA, 15 nt, Homo sapiens
agucuuggugcuauc

SEQ ID NO: 562808 - RNA, 22 nt, Homo sapiens
agucuuguagcuagaacuucuc

SEQ ID NO: 562809 - RNA, 14 nt, Homo sapiens
agucuugugccaaa

SEQ ID NO: 562810 - RNA, 22 nt, Homo sapiens
agucuugugccaaaccuacuag

SEQ ID NO: 562811 - RNA, 13 nt, Homo sapiens
agucuuuccuuag

SEQ ID NO: 562812 - RNA, 14 nt, Homo sapiens
agucuuugcucagu

SEQ ID NO: 562813 - RNA, 19 nt, Homo sapiens
agucuuugguaaauggcaa

SEQ ID NO: 562814 - RNA, 17 nt, Homo sapiens
agucuuuucaacaaaug

SEQ ID NO: 562815 - RNA, 22 nt, Homo sapiens
agucuuuuguucgcauggucac

SEQ ID NO: 562816 - RNA, 20 nt, Homo sapiens
agugaaaauuuuuacauuca

SEQ ID NO: 562817 - RNA, 13 nt, Homo sapiens
agugaaaccauga

SEQ ID NO: 562818 - RNA, 15 nt, Homo sapiens
agugaaaccaugacu

SEQ ID NO: 562819 - RNA, 18 nt, Homo sapiens
agugaaaccccaucucua

SEQ ID NO: 562820 - RNA, 18 nt, Homo sapiens
agugaaagagaguaccau

SEQ ID NO: 562821 - RNA, 18 nt, Homo sapiens
agugaaauuauacagaua

SEQ ID NO: 562822 - RNA, 17 nt, Homo sapiens
agugaacacucaguggc

SEQ ID NO: 562823 - RNA, 23 nt, Homo sapiens
agugaacauauggaaaguauuag

SEQ ID NO: 562824 - RNA, 13 nt, Homo sapiens
agugaaccaaaga

SEQ ID NO: 562825 - RNA, 15 nt, Homo sapiens
agugaagaacacuac

SEQ ID NO: 562826 - RNA, 18 nt, Homo sapiens
agugaagcagcacuguga

SEQ ID NO: 562827 - RNA, 19 nt, Homo sapiens
agugaagcugguggaacau

SEQ ID NO: 562828 - RNA, 13 nt, Homo sapiens
agugaaucugauu

SEQ ID NO: 562829 - RNA, 21 nt, Homo sapiens
agugaauugacccauguuccc

SEQ ID NO: 562830 - RNA, 14 nt, Homo sapiens
agugacacagcagc

SEQ ID NO: 562831 - RNA, 20 nt, Homo sapiens
agugacaguugcagcccuug

SEQ ID NO: 562832 - RNA, 19 nt, Homo sapiens
agugacauaauauauucua

SEQ ID NO: 562833 - RNA, 22 nt, Homo sapiens
agugacauaauuguccaguuau

SEQ ID NO: 562834 - RNA, 16 nt, Homo sapiens
agugacaugugcugga

SEQ ID NO: 562835 - RNA, 15 nt, Homo sapiens
agugacauguuuaca

SEQ ID NO: 562836 - RNA, 21 nt, Homo sapiens
agugaccaaaggugugcccug

SEQ ID NO: 562837 - RNA, 16 nt, Homo sapiens
agugaccccugaccuc

SEQ ID NO: 562838 - RNA, 16 nt, Homo sapiens
agugaccccuucccug

SEQ ID NO: 562839 - RNA, 15 nt, Homo sapiens
agugacccucagcug

SEQ ID NO: 562840 - RNA, 20 nt, Homo sapiens
agugaccgggcacuggcacu

SEQ ID NO: 562841 - RNA, 22 nt, Homo sapiens
agugacuaugaacuucucucag

SEQ ID NO: 562842 - RNA, 22 nt, Homo sapiens
agugacugggcaggcagcagaa

SEQ ID NO: 562843 - RNA, 16 nt, Homo sapiens
agugacuguacaguua

SEQ ID NO: 562844 - RNA, 16 nt, Homo sapiens
agugacuuccugguga

SEQ ID NO: 562845 - RNA, 15 nt, Homo sapiens
agugacuucugagau

SEQ ID NO: 562846 - RNA, 22 nt, Homo sapiens
agugacuugugucccaugaucc

SEQ ID NO: 562847 - RNA, 19 nt, Homo sapiens
agugacuuugagcugagug

SEQ ID NO: 562848 - RNA, 18 nt, Homo sapiens
agugagacuccgucacaa

SEQ ID NO: 562849 - RNA, 19 nt, Homo sapiens
agugagcaagggggcccaa

SEQ ID NO: 562850 - RNA, 22 nt, Homo sapiens
agugagcacucacgcccuaagc

SEQ ID NO: 562851 - RNA, 15 nt, Homo sapiens
agugagccaagauca

SEQ ID NO: 562852 - RNA, 12 nt, Homo sapiens
agugagccauga

SEQ ID NO: 562853 - RNA, 22 nt, Homo sapiens
agugagccccuccccagccagc

SEQ ID NO: 562854 - RNA, 22 nt, Homo sapiens
agugagccugaauuuuguugcu

SEQ ID NO: 562855 - RNA, 18 nt, Homo sapiens
agugagcguagcagcuca

SEQ ID NO: 562856 - RNA, 15 nt, Homo sapiens
agugaggaaagccuc

SEQ ID NO: 562857 - RNA, 19 nt, Homo sapiens
agugaggaacccugaucuc

SEQ ID NO: 562858 - RNA, 23 nt, Homo sapiens
agugaggaacccugaucucucag

SEQ ID NO: 562859 - RNA, 21 nt, Homo sapiens
agugaggacucggccacugug

SEQ ID NO: 562860 - RNA, 18 nt, Homo sapiens
agugaggcaggagaagaa

SEQ ID NO: 562861 - RNA, 21 nt, Homo sapiens
agugaggcugcacccacccag

SEQ ID NO: 562862 - RNA, 23 nt, Homo sapiens
agugagggaaggauguuuagcag

SEQ ID NO: 562863 - RNA, 16 nt, Homo sapiens
agugagggcucacuca

SEQ ID NO: 562864 - RNA, 22 nt, Homo sapiens
agugagggucuucuuacaugca

SEQ ID NO: 562865 - RNA, 22 nt, Homo sapiens
agugagguucuuguaccacuuc

SEQ ID NO: 562866 - RNA, 13 nt, Homo sapiens
agugaguccaggc

SEQ ID NO: 562867 - RNA, 19 nt, Homo sapiens
agugagugaucacugguau

SEQ ID NO: 562868 - RNA, 17 nt, Homo sapiens
agugagugugugugcuu

SEQ ID NO: 562869 - RNA, 17 nt, Homo sapiens
agugauaacucugagca

SEQ ID NO: 562870 - RNA, 19 nt, Homo sapiens
agugauacauguacuccag

SEQ ID NO: 562871 - RNA, 17 nt, Homo sapiens
agugauacucacguuug

SEQ ID NO: 562872 - RNA, 14 nt, Homo sapiens
agugauaugcauuu

SEQ ID NO: 562873 - RNA, 19 nt, Homo sapiens
agugaucaaacuacauauu

SEQ ID NO: 562874 - RNA, 15 nt, Homo sapiens
agugaucaccugcca

SEQ ID NO: 562875 - RNA, 21 nt, Homo sapiens
agugggggcggggaagggugc

SEQ ID NO: 562876 - RNA, 12 nt, Homo sapiens
agugggugguga

SEQ ID NO: 562877 - RNA, 19 nt, Homo sapiens
agugggugguggaucuguc

SEQ ID NO: 562878 - RNA, 19 nt, Homo sapiens
agugguauagaguacugca

SEQ ID NO: 562879 - RNA, 15 nt, Homo sapiens
agugguauccuguga

SEQ ID NO: 562880 - RNA, 18 nt, Homo sapiens
aguggucccagaaccuau

SEQ ID NO: 562881 - RNA, 12 nt, Homo sapiens
aguggucuucaa

SEQ ID NO: 562882 - RNA, 13 nt, Homo sapiens
aguggugccaaac

SEQ ID NO: 562883 - RNA, 21 nt, Homo sapiens
aguggugcccuggaacacucc

SEQ ID NO: 562884 - RNA, 19 nt, Homo sapiens
aguggugucugugaagggu

SEQ ID NO: 562885 - RNA, 20 nt, Homo sapiens
aguggugugaucucggcuca

SEQ ID NO: 562886 - RNA, 21 nt, Homo sapiens
agugguguguguuaucagaua

SEQ ID NO: 562887 - RNA, 13 nt, Homo sapiens
agugguuacccag

SEQ ID NO: 562888 - RNA, 19 nt, Homo sapiens
agugguucaagcacacugg

SEQ ID NO: 562889 - RNA, 22 nt, Homo sapiens
agugguucaagcacacuggaau

SEQ ID NO: 562890 - RNA, 22 nt, Homo sapiens
agugguucuauguccauucuca

SEQ ID NO: 562891 - RNA, 23 nt, Homo sapiens
agugguucucauuuggucugcca

SEQ ID NO: 562892 - RNA, 21 nt, Homo sapiens
agugguuguccccguaccacc

SEQ ID NO: 562893 - RNA, 22 nt, Homo sapiens
agugguuguccccguaccacca

SEQ ID NO: 562894 - RNA, 14 nt, Homo sapiens
agugguuguugcca

SEQ ID NO: 562895 - RNA, 15 nt, Homo sapiens
aguguaaacaccaua

SEQ ID NO: 562896 - RNA, 15 nt, Homo sapiens
aguguaaguucacaa

SEQ ID NO: 562897 - RNA, 18 nt, Homo sapiens
aguguaauugagaaggaa

SEQ ID NO: 562898 - RNA, 16 nt, Homo sapiens
aguguacagaguggaa

SEQ ID NO: 562899 - RNA, 20 nt, Homo sapiens
aguguacauaugugcuggaa

SEQ ID NO: 562900 - RNA, 12 nt, Homo sapiens
aguguacaugga

SEQ ID NO: 562901 - RNA, 14 nt, Homo sapiens
aguguacucuauaa

SEQ ID NO: 562902 - RNA, 15 nt, Homo sapiens
aguguagacuguggc

SEQ ID NO: 562903 - RNA, 16 nt, Homo sapiens
aguguagccuugcccg

SEQ ID NO: 562904 - RNA, 20 nt, Homo sapiens
aguguagcuaccuacaugcu

SEQ ID NO: 562905 - RNA, 14 nt, Homo sapiens
aguguauuaaucuc

SEQ ID NO: 562906 - RNA, 16 nt, Homo sapiens
agugucacugaugaac

SEQ ID NO: 562907 - RNA, 17 nt, Homo sapiens
agugucacuggauguca

SEQ ID NO: 562908 - RNA, 21 nt, Homo sapiens
agugucacuuaccuagauuua

SEQ ID NO: 562909 - RNA, 12 nt, Homo sapiens
aguguccaggcu

SEQ ID NO: 562910 - RNA, 19 nt, Homo sapiens
aguguccccuccacuguca

SEQ ID NO: 562911 - RNA, 20 nt, Homo sapiens
aguguccccuccacugucac

SEQ ID NO: 562912 - RNA, 21 nt, Homo sapiens
aguguccccuccacugucaca

SEQ ID NO: 562913 - RNA, 20 nt, Homo sapiens
aguguccccuuauacagugg

SEQ ID NO: 562914 - RNA, 17 nt, Homo sapiens
aguguccuaagugcuaa

SEQ ID NO: 562915 - RNA, 22 nt, Homo sapiens
agugucguuuucauaacuugcu

SEQ ID NO: 562916 - RNA, 19 nt, Homo sapiens
agugucugugccauggauu

SEQ ID NO: 562917 - RNA, 21 nt, Homo sapiens
agugucuguuccuggcaucua

SEQ ID NO: 562918 - RNA, 15 nt, Homo sapiens
agugucuuuugacau

SEQ ID NO: 562919 - RNA, 21 nt, Homo sapiens
agugugaacaaaagaugcucu

SEQ ID NO: 562920 - RNA, 15 nt, Homo sapiens
agugugaagugcaga

SEQ ID NO: 562921 - RNA, 14 nt, Homo sapiens
agugugacuucccu

SEQ ID NO: 562922 - RNA, 14 nt, Homo sapiens
agugugagcagggc

SEQ ID NO: 562923 - RNA, 19 nt, Homo sapiens
agugugauauacaaagugu

SEQ ID NO: 562924 - RNA, 12 nt, Homo sapiens
agugugauccca

SEQ ID NO: 562925 - RNA, 14 nt, Homo sapiens
agugugaucccaag

SEQ ID NO: 562926 - RNA, 19 nt, Homo sapiens
agugugccccucuguaaca

SEQ ID NO: 562927 - RNA, 17 nt, Homo sapiens
aguguggacaugagcag

SEQ ID NO: 562928 - RNA, 23 nt, Homo sapiens
aguguggccacgugggcaaacag

SEQ ID NO: 562929 - RNA, 12 nt, Homo sapiens
aguguggcccag

SEQ ID NO: 562930 - RNA, 16 nt, Homo sapiens
aguguggcugaggcca

SEQ ID NO: 562931 - RNA, 14 nt, Homo sapiens
aguguggcuucuau

SEQ ID NO: 562932 - RNA, 16 nt, Homo sapiens
agugugggggguccuu

SEQ ID NO: 562933 - RNA, 16 nt, Homo sapiens
agugugucugcugagu

SEQ ID NO: 562934 - RNA, 13 nt, Homo sapiens
agugugugcaagu

SEQ ID NO: 562935 - RNA, 15 nt, Homo sapiens
agugugugcacaugu

SEQ ID NO: 562936 - RNA, 18 nt, Homo sapiens
agugugugugugcaugug

SEQ ID NO: 562937 - RNA, 20 nt, Homo sapiens
aguguuaagcguucagugau

SEQ ID NO: 562938 - RNA, 13 nt, Homo sapiens
aguguucuacacc

SEQ ID NO: 562939 - RNA, 15 nt, Homo sapiens
aguguucugcuccug

SEQ ID NO: 562940 - RNA, 22 nt, Homo sapiens
aguguugcccaggcuggucuca

SEQ ID NO: 562941 - RNA, 15 nt, Homo sapiens
aguguugcucucuag

SEQ ID NO: 562942 - RNA, 21 nt, Homo sapiens
aguguuggaaaaugugcaaua

SEQ ID NO: 562943 - RNA, 18 nt, Homo sapiens
aguguugggcaugugauc

SEQ ID NO: 562944 - RNA, 20 nt, Homo sapiens
aguguuguucccucccucaa

SEQ ID NO: 562945 - RNA, 12 nt, Homo sapiens
aguguuuaucuu

SEQ ID NO: 562946 - RNA, 13 nt, Homo sapiens
aguguuugucaua

SEQ ID NO: 562947 - RNA, 21 nt, Homo sapiens
aguguuuuggacuccaucucu

SEQ ID NO: 562948 - RNA, 20 nt, Homo sapiens
aguguuuuuuagauacagag

SEQ ID NO: 562949 - RNA, 21 nt, Homo sapiens
aguuaaaacacauaucaaaug

SEQ ID NO: 562950 - RNA, 18 nt, Homo sapiens
aguuaaaaguguugauua

SEQ ID NO: 562951 - RNA, 20 nt, Homo sapiens
aguuaaagugaauaaccacu

SEQ ID NO: 562952 - RNA, 12 nt, Homo sapiens
aguuaagcaaau

SEQ ID NO: 562953 - RNA, 16 nt, Homo sapiens
aguuaagcaacaucua

SEQ ID NO: 562954 - RNA, 12 nt, Homo sapiens
aguuaagggaug

SEQ ID NO: 562955 - RNA, 16 nt, Homo sapiens
aguuaauaacagcucc

SEQ ID NO: 562956 - RNA, 15 nt, Homo sapiens
aguuaauauagucac

SEQ ID NO: 562957 - RNA, 16 nt, Homo sapiens
aguuaaugagccauca

SEQ ID NO: 562958 - RNA, 13 nt, Homo sapiens
aguuaauucaccu

SEQ ID NO: 562959 - RNA, 13 nt, Homo sapiens
aguuaauucucac

SEQ ID NO: 562960 - RNA, 17 nt, Homo sapiens
aguuaauucucaccauu

SEQ ID NO: 562961 - RNA, 13 nt, Homo sapiens
aguuacaaaaacc

SEQ ID NO: 562962 - RNA, 15 nt, Homo sapiens
aguuacaaccugaag

SEQ ID NO: 562963 - RNA, 18 nt, Homo sapiens
aguuaccaaacauuacaa

SEQ ID NO: 562964 - RNA, 19 nt, Homo sapiens
aguuaccacauuacucugc

SEQ ID NO: 562965 - RNA, 21 nt, Homo sapiens
aguuaccuacaagaacaauga

SEQ ID NO: 562966 - RNA, 23 nt, Homo sapiens
aguuaccuuauaguuacugugua

SEQ ID NO: 562967 - RNA, 23 nt, Homo sapiens
aguuacggagggaggacaucaua

SEQ ID NO: 562968 - RNA, 16 nt, Homo sapiens
aguuacuaccugucaa

SEQ ID NO: 562969 - RNA, 22 nt, Homo sapiens
aguuacugaaggugauggaggu

SEQ ID NO: 562970 - RNA, 17 nt, Homo sapiens
aguuacugccgguuuga

SEQ ID NO: 562971 - RNA, 23 nt, Homo sapiens
aguuacugcugcacuuucacuaa

SEQ ID NO: 562972 - RNA, 15 nt, Homo sapiens
aguuacuguccuguu

SEQ ID NO: 562973 - RNA, 15 nt, Homo sapiens
aguuacugugguaug

SEQ ID NO: 562974 - RNA, 13 nt, Homo sapiens
aguuacugugguc

SEQ ID NO: 562975 - RNA, 19 nt, Homo sapiens
aguuacuuuuuuacacuga

SEQ ID NO: 562976 - RNA, 16 nt, Homo sapiens
aguuagcucauuugag

SEQ ID NO: 562977 - RNA, 20 nt, Homo sapiens
aguuaggcuauucacaacca

SEQ ID NO: 562978 - RNA, 19 nt, Homo sapiens
aguuagguuaauaaaucaa

SEQ ID NO: 562979 - RNA, 16 nt, Homo sapiens
aguuagucaauccugu

SEQ ID NO: 562980 - RNA, 22 nt, Homo sapiens
aguuagucaauccugucauaua

SEQ ID NO: 562981 - RNA, 17 nt, Homo sapiens
aguuaguuuguauauau

SEQ ID NO: 562982 - RNA, 22 nt, Homo sapiens
aguuauaaaucaaugucacuua

SEQ ID NO: 562983 - RNA, 17 nt, Homo sapiens
aguuauaauaacugaac

SEQ ID NO: 562984 - RNA, 21 nt, Homo sapiens
aguuauaggaacaauucucuu

SEQ ID NO: 562985 - RNA, 16 nt, Homo sapiens
aguuaucuuugaauau

SEQ ID NO: 562986 - RNA, 15 nt, Homo sapiens
aguuaugacaagcuu

SEQ ID NO: 562987 - RNA, 20 nt, Homo sapiens
aguuaugccucugacagucc

SEQ ID NO: 562988 - RNA, 21 nt, Homo sapiens
aguuauugaugagagggaaaa

SEQ ID NO: 562989 - RNA, 12 nt, Homo sapiens
aguuauugcaca

SEQ ID NO: 562990 - RNA, 17 nt, Homo sapiens
aguuauuuacuuuuacc

SEQ ID NO: 562991 - RNA, 21 nt, Homo sapiens
aguucaaagagucugucuuga

SEQ ID NO: 562992 - RNA, 23 nt, Homo sapiens
aguucaaaugaugaagaccaaag

SEQ ID NO: 562993 - RNA, 16 nt, Homo sapiens
aguucaauacagugaa

SEQ ID NO: 562994 - RNA, 20 nt, Homo sapiens
aguucaaucucccgcugcug

SEQ ID NO: 562995 - RNA, 17 nt, Homo sapiens
aguucacauacaaauca

SEQ ID NO: 562996 - RNA, 17 nt, Homo sapiens
aguucaccugcacuuaa

SEQ ID NO: 562997 - RNA, 13 nt, Homo sapiens
augaaaacauuca

SEQ ID NO: 562998 - RNA, 21 nt, Homo sapiens
augaaaagcacagccucagaa

SEQ ID NO: 562999 - RNA, 23 nt, Homo sapiens
augaaaaggauauuaucuaccug

SEQ ID NO: 563000 - RNA, 15 nt, Homo sapiens
augaaaauacaucuu

SEQ ID NO: 563001 - RNA, 19 nt, Homo sapiens
augaaaaucuccaucucaa

SEQ ID NO: 563002 - RNA, 16 nt, Homo sapiens
augaaaaugaauagcu

SEQ ID NO: 563003 - RNA, 14 nt, Homo sapiens
augaaaaugaauau

SEQ ID NO: 563004 - RNA, 17 nt, Homo sapiens
augaaaaugaaucuuca

SEQ ID NO: 563005 - RNA, 13 nt, Homo sapiens
augaaaaugcagu

SEQ ID NO: 563006 - RNA, 21 nt, Homo sapiens
augaaaauuuauuuuuaguga

SEQ ID NO: 563007 - RNA, 20 nt, Homo sapiens
augaaacaccuucucuggag

SEQ ID NO: 563008 - RNA, 14 nt, Homo sapiens
augaaacauguucu

SEQ ID NO: 563009 - RNA, 21 nt, Homo sapiens
augaaaccuguacauaugugu

SEQ ID NO: 563010 - RNA, 12 nt, Homo sapiens
augaaacuaaga

SEQ ID NO: 563011 - RNA, 17 nt, Homo sapiens
augaaacugcacauugg

SEQ ID NO: 563012 - RNA, 14 nt, Homo sapiens
augaaagugccugc

SEQ ID NO: 563013 - RNA, 16 nt, Homo sapiens
augaaaguggacaagg

SEQ ID NO: 563014 - RNA, 14 nt, Homo sapiens
augaaaguuuugca

SEQ ID NO: 563015 - RNA, 22 nt, Homo sapiens
augaaauaaaagcacacugcuu

SEQ ID NO: 563016 - RNA, 21 nt, Homo sapiens
augaaauacuccagcaccugu

SEQ ID NO: 563017 - RNA, 15 nt, Homo sapiens
augaaauccagugag

SEQ ID NO: 563018 - RNA, 19 nt, Homo sapiens
augaaauggaggaucucua

SEQ ID NO: 563019 - RNA, 17 nt, Homo sapiens
augaaauuauaaucugu

SEQ ID NO: 563020 - RNA, 20 nt, Homo sapiens
augaaauuauaaucugugga

SEQ ID NO: 563021 - RNA, 13 nt, Homo sapiens
augaaauugccaa

SEQ ID NO: 563022 - RNA, 21 nt, Homo sapiens
augaacaaacuaugaucacag

SEQ ID NO: 563023 - RNA, 21 nt, Homo sapiens
augaacaauuaugaacaucca

SEQ ID NO: 563024 - RNA, 16 nt, Homo sapiens
augaacacuacagaua

SEQ ID NO: 563025 - RNA, 20 nt, Homo sapiens
augaacacuuauaagugaag

SEQ ID NO: 563026 - RNA, 19 nt, Homo sapiens
augaacagacacuuuucaa

SEQ ID NO: 563027 - RNA, 16 nt, Homo sapiens
augaacauauucauga

SEQ ID NO: 563028 - RNA, 17 nt, Homo sapiens
augaacauauuguugaa

SEQ ID NO: 563029 - RNA, 14 nt, Homo sapiens
augaacccaaaaag

SEQ ID NO: 563030 - RNA, 23 nt, Homo sapiens
augaaccugacaaaaacaagcaa

SEQ ID NO: 563031 - RNA, 20 nt, Homo sapiens
augaaccugcccugcuccca

SEQ ID NO: 563032 - RNA, 22 nt, Homo sapiens
augaacuaacugacagcuucau

SEQ ID NO: 563033 - RNA, 20 nt, Homo sapiens
augaacuaguuuaaugugga

SEQ ID NO: 563034 - RNA, 19 nt, Homo sapiens
augaacucuugaagucaca

SEQ ID NO: 563035 - RNA, 12 nt, Homo sapiens
augaacuuucuc

SEQ ID NO: 563036 - RNA, 20 nt, Homo sapiens
augaagaaucacgauuucau

SEQ ID NO: 563037 - RNA, 14 nt, Homo sapiens
augaagaccaaaga

SEQ ID NO: 563038 - RNA, 21 nt, Homo sapiens
augaagaugucuaauaguuau

SEQ ID NO: 563039 - RNA, 15 nt, Homo sapiens
augaagcacugagca

SEQ ID NO: 563040 - RNA, 13 nt, Homo sapiens
augaagcagauuu

SEQ ID NO: 563041 - RNA, 13 nt, Homo sapiens
augaagcaugcua

SEQ ID NO: 563042 - RNA, 20 nt, Homo sapiens
augaagcgaaacacagagaa

SEQ ID NO: 563043 - RNA, 23 nt, Homo sapiens
augaagcguugccauugaacuca

SEQ ID NO: 563044 - RNA, 20 nt, Homo sapiens
augaagcuaccucaaacuuc

SEQ ID NO: 563045 - RNA, 13 nt, Homo sapiens
augaaggaaucau

SEQ ID NO: 563046 - RNA, 16 nt, Homo sapiens
augaagggaagugcau

SEQ ID NO: 563047 - RNA, 21 nt, Homo sapiens
augaagggacccuuugggggu

SEQ ID NO: 563048 - RNA, 22 nt, Homo sapiens
augaaggggcucuucaucugcc

SEQ ID NO: 563049 - RNA, 21 nt, Homo sapiens
augaagguggaacaagcacag

SEQ ID NO: 563050 - RNA, 22 nt, Homo sapiens
augaagguggagggucucuagu

SEQ ID NO: 563051 - RNA, 22 nt, Homo sapiens
augaaguacagcagaagcccca

SEQ ID NO: 563052 - RNA, 17 nt, Homo sapiens
augaaguuugcuauucu

SEQ ID NO: 563053 - RNA, 18 nt, Homo sapiens
augaaguuuugauuuauu

SEQ ID NO: 563054 - RNA, 17 nt, Homo sapiens
augaauaaacugaauau

SEQ ID NO: 563055 - RNA, 18 nt, Homo sapiens
augaauaugaucccuaau

SEQ ID NO: 563056 - RNA, 20 nt, Homo sapiens
augaauauuuuguaacuauu

SEQ ID NO: 563057 - RNA, 17 nt, Homo sapiens
augaaucaguuuuggaa

SEQ ID NO: 563058 - RNA, 20 nt, Homo sapiens
augaaucauauucauaugca

SEQ ID NO: 563059 - RNA, 19 nt, Homo sapiens
augaaugaggucccaggca

SEQ ID NO: 563060 - RNA, 15 nt, Homo sapiens
augaauguaugugca

SEQ ID NO: 563061 - RNA, 23 nt, Homo sapiens
augaauuauaacuagacaucugc

SEQ ID NO: 563062 - RNA, 15 nt, Homo sapiens
augaauuauccugua

SEQ ID NO: 563063 - RNA, 23 nt, Homo sapiens
augaauucgaugcguauucugug

SEQ ID NO: 563064 - RNA, 11 nt, Homo sapiens
augaauucuua

SEQ ID NO: 563065 - RNA, 13 nt, Homo sapiens
augaauugucuaa

SEQ ID NO: 563066 - RNA, 12 nt, Homo sapiens
augacaaaaagc

SEQ ID NO: 563067 - RNA, 19 nt, Homo sapiens
augacaaaaaggugcagaa

SEQ ID NO: 563068 - RNA, 18 nt, Homo sapiens
augacaaacacacaucca

SEQ ID NO: 563069 - RNA, 12 nt, Homo sapiens
augacaaaccau

SEQ ID NO: 563070 - RNA, 13 nt, Homo sapiens
augacaaagccau

SEQ ID NO: 563071 - RNA, 21 nt, Homo sapiens
augacaaauguauuaaugcua

SEQ ID NO: 563072 - RNA, 20 nt, Homo sapiens
augacaaugugaaaccauca

SEQ ID NO: 563073 - RNA, 13 nt, Homo sapiens
augacacaguugg

SEQ ID NO: 563074 - RNA, 12 nt, Homo sapiens
augacacuacuu

SEQ ID NO: 563075 - RNA, 22 nt, Homo sapiens
augacagcuggcuagcauuccu

SEQ ID NO: 563076 - RNA, 17 nt, Homo sapiens
augacagggaugccaac

SEQ ID NO: 563077 - RNA, 21 nt, Homo sapiens
augacaguauuauacgcuggc

SEQ ID NO: 563078 - RNA, 15 nt, Homo sapiens
augacaguauuccau

SEQ ID NO: 563079 - RNA, 18 nt, Homo sapiens
augacauaugacuugauc

SEQ ID NO: 563080 - RNA, 16 nt, Homo sapiens
augacaucaaaaugag

SEQ ID NO: 563081 - RNA, 20 nt, Homo sapiens
augacaucacuuguacaaaa

SEQ ID NO: 563082 - RNA, 19 nt, Homo sapiens
augacaucagcaauacaga

SEQ ID NO: 563083 - RNA, 14 nt, Homo sapiens
augacauccagaaa

SEQ ID NO: 563084 - RNA, 14 nt, Homo sapiens
augacaucucaggg

SEQ ID NO: 563085 - RNA, 14 nt, Homo sapiens
augacaucuucaaa

SEQ ID NO: 563086 - RNA, 15 nt, Homo sapiens
augacauuuauucaa

SEQ ID NO: 563087 - RNA, 21 nt, Homo sapiens
augacauuucacugaugcuuc

SEQ ID NO: 563088 - RNA, 15 nt, Homo sapiens
augacauuucaucug

SEQ ID NO: 563089 - RNA, 16 nt, Homo sapiens
augaccacauccugaa

SEQ ID NO: 563090 - RNA, 11 nt, Homo sapiens
augaccacugc

SEQ ID NO: 563091 - RNA, 21 nt, Homo sapiens
augaccaguuguuauuuacag

SEQ ID NO: 563092 - RNA, 23 nt, Homo sapiens
augaccaguuguuauuuacagcu

SEQ ID NO: 563093 - RNA, 15 nt, Homo sapiens
augacccaaagacca

SEQ ID NO: 563094 - RNA, 16 nt, Homo sapiens
augacccaaagaccaa

SEQ ID NO: 563095 - RNA, 19 nt, Homo sapiens
augaccccagaaacugaac

SEQ ID NO: 563096 - RNA, 23 nt, Homo sapiens
augacccccaaccaaguggcucc

SEQ ID NO: 563097 - RNA, 15 nt, Homo sapiens
augaccguguacaau

SEQ ID NO: 563098 - RNA, 18 nt, Homo sapiens
augaccuguauuuugcca

SEQ ID NO: 563099 - RNA, 19 nt, Homo sapiens
augaccuugggguacaauu

SEQ ID NO: 563100 - RNA, 23 nt, Homo sapiens
augacgccugauggugcugcuca

SEQ ID NO: 563101 - RNA, 22 nt, Homo sapiens
augacguccucucaacucucuu

SEQ ID NO: 563102 - RNA, 14 nt, Homo sapiens
augacuacuuuuuc

SEQ ID NO: 563103 - RNA, 10 nt, Homo sapiens
augacuaugc

SEQ ID NO: 563104 - RNA, 14 nt, Homo sapiens
augacucaaggcca

SEQ ID NO: 563105 - RNA, 13 nt, Homo sapiens
augacucacauga

SEQ ID NO: 563106 - RNA, 14 nt, Homo sapiens
augacucucuccaa

SEQ ID NO: 563107 - RNA, 11 nt, Homo sapiens
augacugagaa

SEQ ID NO: 563108 - RNA, 12 nt, Homo sapiens
augacugauuac

SEQ ID NO: 563109 - RNA, 13 nt, Homo sapiens
augacugcacaug

SEQ ID NO: 563110 - RNA, 16 nt, Homo sapiens
augacugcuuaacucc

SEQ ID NO: 563111 - RNA, 11 nt, Homo sapiens
augacuggugg

SEQ ID NO: 563112 - RNA, 11 nt, Homo sapiens
augacugugaa

SEQ ID NO: 563113 - RNA, 17 nt, Homo sapiens
augacuuaccuguucag

SEQ ID NO: 563114 - RNA, 14 nt, Homo sapiens
augacuuacuguac

SEQ ID NO: 563115 - RNA, 13 nt, Homo sapiens
augacuuacuuuc

SEQ ID NO: 563116 - RNA, 21 nt, Homo sapiens
augacuucagugaaauuuuca

SEQ ID NO: 563117 - RNA, 13 nt, Homo sapiens
augacuucaucaa

SEQ ID NO: 563118 - RNA, 18 nt, Homo sapiens
augacuucccugcuccaa

SEQ ID NO: 563119 - RNA, 14 nt, Homo sapiens
augucaaagcuuug

SEQ ID NO: 563120 - RNA, 16 nt, Homo sapiens
augucaaccagugagg

SEQ ID NO: 563121 - RNA, 18 nt, Homo sapiens
augucacaaccucucuga

SEQ ID NO: 563122 - RNA, 15 nt, Homo sapiens
augucacagauuccu

SEQ ID NO: 563123 - RNA, 22 nt, Homo sapiens
augucacagggccaacuugagg

SEQ ID NO: 563124 - RNA, 19 nt, Homo sapiens
augucacuucccugcuuaa

SEQ ID NO: 563125 - RNA, 20 nt, Homo sapiens
augucacuucccugcuuaaa

SEQ ID NO: 563126 - RNA, 17 nt, Homo sapiens
augucagaaacaaugac

SEQ ID NO: 563127 - RNA, 21 nt, Homo sapiens
augucaggaaacauucaguga

SEQ ID NO: 563128 - RNA, 15 nt, Homo sapiens
augucaggccagccu

SEQ ID NO: 563129 - RNA, 15 nt, Homo sapiens
augucaggguucugc

SEQ ID NO: 563130 - RNA, 13 nt, Homo sapiens
augucaguuacaa

SEQ ID NO: 563131 - RNA, 23 nt, Homo sapiens
augucaguucugauauggaagca

SEQ ID NO: 563132 - RNA, 15 nt, Homo sapiens
augucauaaagugag

SEQ ID NO: 563133 - RNA, 14 nt, Homo sapiens
augucauagccaaa

SEQ ID NO: 563134 - RNA, 20 nt, Homo sapiens
augucauagguaagaaacac

SEQ ID NO: 563135 - RNA, 16 nt, Homo sapiens
augucauguacuuccu

SEQ ID NO: 563136 - RNA, 12 nt, Homo sapiens
augucauuuagu

SEQ ID NO: 563137 - RNA, 20 nt, Homo sapiens
augucauuuugguacuuugg

SEQ ID NO: 563138 - RNA, 20 nt, Homo sapiens
augucauuuuuaauguaucu

SEQ ID NO: 563139 - RNA, 12 nt, Homo sapiens
auguccaaagag

SEQ ID NO: 563140 - RNA, 15 nt, Homo sapiens
auguccaaguccaac

SEQ ID NO: 563141 - RNA, 16 nt, Homo sapiens
auguccaccaugaacu

SEQ ID NO: 563142 - RNA, 22 nt, Homo sapiens
auguccagaagaauauucagga

SEQ ID NO: 563143 - RNA, 13 nt, Homo sapiens
auguccauggugg

SEQ ID NO: 563144 - RNA, 23 nt, Homo sapiens
augucccuugcugugagcaagaa

SEQ ID NO: 563145 - RNA, 15 nt, Homo sapiens
auguccuacuaucac

SEQ ID NO: 563146 - RNA, 10 nt, Homo sapiens
auguccugca

SEQ ID NO: 563147 - RNA, 20 nt, Homo sapiens
auguccuuuccaucugucca

SEQ ID NO: 563148 - RNA, 17 nt, Homo sapiens
auguccuuuuaugauuu

SEQ ID NO: 563149 - RNA, 14 nt, Homo sapiens
augucggucuugca

SEQ ID NO: 563150 - RNA, 22 nt, Homo sapiens
augucuaauaaaauauaaucua

SEQ ID NO: 563151 - RNA, 17 nt, Homo sapiens
augucuauaaucccagc

SEQ ID NO: 563152 - RNA, 15 nt, Homo sapiens
augucuauguagcug

SEQ ID NO: 563153 - RNA, 20 nt, Homo sapiens
augucuccuggacucagggu

SEQ ID NO: 563154 - RNA, 21 nt, Homo sapiens
augucucuuuggcgaccuccu

SEQ ID NO: 563155 - RNA, 15 nt, Homo sapiens
augucugauaaugau

SEQ ID NO: 563156 - RNA, 17 nt, Homo sapiens
augucugauaaugauuu

SEQ ID NO: 563157 - RNA, 15 nt, Homo sapiens
augucugcagguuuc

SEQ ID NO: 563158 - RNA, 22 nt, Homo sapiens
augucuggggcagaaacacuca

SEQ ID NO: 563159 - RNA, 18 nt, Homo sapiens
augucuguagcuccucaa

SEQ ID NO: 563160 - RNA, 21 nt, Homo sapiens
augucuguuaccuuguuaaua

SEQ ID NO: 563161 - RNA, 19 nt, Homo sapiens
augucuuaaaugcucauaa

SEQ ID NO: 563162 - RNA, 16 nt, Homo sapiens
augucuuaaugcaaau

SEQ ID NO: 563163 - RNA, 12 nt, Homo sapiens
augucuucccac

SEQ ID NO: 563164 - RNA, 16 nt, Homo sapiens
augugaaaacaucuca

SEQ ID NO: 563165 - RNA, 16 nt, Homo sapiens
augugaaagacaauaa

SEQ ID NO: 563166 - RNA, 18 nt, Homo sapiens
augugaaaggaacauuuu

SEQ ID NO: 563167 - RNA, 23 nt, Homo sapiens
augugaagagggagaagcaugaa

SEQ ID NO: 563168 - RNA, 18 nt, Homo sapiens
augugaauuauugacacu

SEQ ID NO: 563169 - RNA, 19 nt, Homo sapiens
augugacaaagggccagca

SEQ ID NO: 563170 - RNA, 19 nt, Homo sapiens
augugacaguguucaguaa

SEQ ID NO: 563171 - RNA, 19 nt, Homo sapiens
augugacauuauaugcacu

SEQ ID NO: 563172 - RNA, 13 nt, Homo sapiens
augugacuacuga

SEQ ID NO: 563173 - RNA, 15 nt, Homo sapiens
augugacuggcagua

SEQ ID NO: 563174 - RNA, 16 nt, Homo sapiens
augugagaaaugucua

SEQ ID NO: 563175 - RNA, 20 nt, Homo sapiens
augugagagauucugugauc

SEQ ID NO: 563176 - RNA, 14 nt, Homo sapiens
augugauacaaauu

SEQ ID NO: 563177 - RNA, 21 nt, Homo sapiens
augugaucauaugaggaccuu

SEQ ID NO: 563178 - RNA, 15 nt, Homo sapiens
augugcaaaucugac

SEQ ID NO: 563179 - RNA, 15 nt, Homo sapiens
augugcaaccacugc

SEQ ID NO: 563180 - RNA, 17 nt, Homo sapiens
augugcaaccacugcuu

SEQ ID NO: 563181 - RNA, 10 nt, Homo sapiens
augugcaaua

SEQ ID NO: 563182 - RNA, 11 nt, Homo sapiens
augugcaauaa

SEQ ID NO: 563183 - RNA, 15 nt, Homo sapiens
augugcagcuauuua

SEQ ID NO: 563184 - RNA, 11 nt, Homo sapiens
augugccaagg

SEQ ID NO: 563185 - RNA, 14 nt, Homo sapiens
augugccaguuccu

SEQ ID NO: 563186 - RNA, 17 nt, Homo sapiens
augugccgaaugugcag

SEQ ID NO: 563187 - RNA, 22 nt, Homo sapiens
augugcgcgcgugcaugugugc

SEQ ID NO: 563188 - RNA, 19 nt, Homo sapiens
augugcuauacacacacac

SEQ ID NO: 563189 - RNA, 16 nt, Homo sapiens
augugcucaugcauug

SEQ ID NO: 563190 - RNA, 22 nt, Homo sapiens
augugcugaaugguuuucaaaa

SEQ ID NO: 563191 - RNA, 21 nt, Homo sapiens
augugcuggugaacacuguga

SEQ ID NO: 563192 - RNA, 17 nt, Homo sapiens
augugcugucaaaacaa

SEQ ID NO: 563193 - RNA, 16 nt, Homo sapiens
auguggauaacuuuac

SEQ ID NO: 563194 - RNA, 17 nt, Homo sapiens
auguggauuugauucau

SEQ ID NO: 563195 - RNA, 14 nt, Homo sapiens
auguggcauguuca

SEQ ID NO: 563196 - RNA, 16 nt, Homo sapiens
auguggccacaaucca

SEQ ID NO: 563197 - RNA, 17 nt, Homo sapiens
auguggccugcauguac

SEQ ID NO: 563198 - RNA, 20 nt, Homo sapiens
augugggccaaguccacugu

SEQ ID NO: 563199 - RNA, 20 nt, Homo sapiens
augugggguccccaucaucc

SEQ ID NO: 563200 - RNA, 14 nt, Homo sapiens
augugggucuucca

SEQ ID NO: 563201 - RNA, 20 nt, Homo sapiens
auguggguggcuucuaguuu

SEQ ID NO: 563202 - RNA, 16 nt, Homo sapiens
augugggugggaccac

SEQ ID NO: 563203 - RNA, 18 nt, Homo sapiens
augugggugggaccacag

SEQ ID NO: 563204 - RNA, 20 nt, Homo sapiens
augugggugucagucaggga

SEQ ID NO: 563205 - RNA, 15 nt, Homo sapiens
augugguacuugagg

SEQ ID NO: 563206 - RNA, 17 nt, Homo sapiens
augugguauacaauucu

SEQ ID NO: 563207 - RNA, 21 nt, Homo sapiens
auguggucuaagguucagccu

SEQ ID NO: 563208 - RNA, 13 nt, Homo sapiens
auguggucuuaug

SEQ ID NO: 563209 - RNA, 17 nt, Homo sapiens
augugguuacuuccuac

SEQ ID NO: 563210 - RNA, 16 nt, Homo sapiens
augugguuaucuguga

SEQ ID NO: 563211 - RNA, 16 nt, Homo sapiens
augugguugcuuaauu

SEQ ID NO: 563212 - RNA, 14 nt, Homo sapiens
auguguauaaacug

SEQ ID NO: 563213 - RNA, 15 nt, Homo sapiens
auguguaugauacua

SEQ ID NO: 563214 - RNA, 11 nt, Homo sapiens
auguguauuau

SEQ ID NO: 563215 - RNA, 21 nt, Homo sapiens
auguguauuuuucaaggcauu

SEQ ID NO: 563216 - RNA, 21 nt, Homo sapiens
augugucacuacucacagucu

SEQ ID NO: 563217 - RNA, 22 nt, Homo sapiens
augugucccagccacaguguua

SEQ ID NO: 563218 - RNA, 14 nt, Homo sapiens
augugugauuucac

SEQ ID NO: 563219 - RNA, 23 nt, Homo sapiens
augugugccuccuagagugcagg

SEQ ID NO: 563220 - RNA, 16 nt, Homo sapiens
augugugcgagugugu

SEQ ID NO: 563221 - RNA, 23 nt, Homo sapiens
auguguguagauacuuccugccc

SEQ ID NO: 563222 - RNA, 12 nt, Homo sapiens
augugugugcaa

SEQ ID NO: 563223 - RNA, 17 nt, Homo sapiens
augugugugcaagugug

SEQ ID NO: 563224 - RNA, 19 nt, Homo sapiens
auguguguguauguuugca

SEQ ID NO: 563225 - RNA, 14 nt, Homo sapiens
auguguuaaaauac

SEQ ID NO: 563226 - RNA, 16 nt, Homo sapiens
auguguuagcacugau

SEQ ID NO: 563227 - RNA, 18 nt, Homo sapiens
auguguuauuacuuccuc

SEQ ID NO: 563228 - RNA, 19 nt, Homo sapiens
auguguuauuugucacaaa

SEQ ID NO: 563229 - RNA, 20 nt, Homo sapiens
auguguuauuugucacaaau

SEQ ID NO: 563230 - RNA, 15 nt, Homo sapiens
auguguucucuaggc

SEQ ID NO: 563231 - RNA, 13 nt, Homo sapiens
auguguuuauuuc

SEQ ID NO: 563232 - RNA, 17 nt, Homo sapiens
auguuaaagaugcacag

SEQ ID NO: 563233 - RNA, 13 nt, Homo sapiens
auguuaacacuca

SEQ ID NO: 563234 - RNA, 16 nt, Homo sapiens
auguuaaccaauguau

SEQ ID NO: 563235 - RNA, 14 nt, Homo sapiens
auguuaagacuuga

SEQ ID NO: 563236 - RNA, 22 nt, Homo sapiens
auguuaagacuugacaguggaa

SEQ ID NO: 563237 - RNA, 22 nt, Homo sapiens
auguuaagauaacuuacuguau

SEQ ID NO: 563238 - RNA, 20 nt, Homo sapiens
auguuaagcauggauuuucc

SEQ ID NO: 563239 - RNA, 18 nt, Homo sapiens
auguuaagcucuuuauga

SEQ ID NO: 563240 - RNA, 21 nt, Homo sapiens
auguuaauggggacccuccaa

SEQ ID NO: 563241 - RNA, 22 nt, Homo sapiens
auucgcaauagacaaagugaag

SEQ ID NO: 563242 - RNA, 21 nt, Homo sapiens
auucgcccuccucccugucau

SEQ ID NO: 563243 - RNA, 22 nt, Homo sapiens
auucgcccuccucccugucaua

SEQ ID NO: 563244 - RNA, 21 nt, Homo sapiens
auucgcugcaaccuguugaua

SEQ ID NO: 563245 - RNA, 15 nt, Homo sapiens
auucggauuugccau

SEQ ID NO: 563246 - RNA, 22 nt, Homo sapiens
auucggcucccuggagccagac

SEQ ID NO: 563247 - RNA, 18 nt, Homo sapiens
auucgggugugagucuuu

SEQ ID NO: 563248 - RNA, 16 nt, Homo sapiens
auucuaaaggcuugau

SEQ ID NO: 563249 - RNA, 20 nt, Homo sapiens
auucuaaaugaauguuuaca

SEQ ID NO: 563250 - RNA, 14 nt, Homo sapiens
auucuaagcccuuu

SEQ ID NO: 563251 - RNA, 19 nt, Homo sapiens
auucuaagcccuuugccau

SEQ ID NO: 563252 - RNA, 17 nt, Homo sapiens
auucuaaguuauuuacu

SEQ ID NO: 563253 - RNA, 17 nt, Homo sapiens
auucuaauaacugcuua

SEQ ID NO: 563254 - RNA, 19 nt, Homo sapiens
auucuaaugguagucagau

SEQ ID NO: 563255 - RNA, 16 nt, Homo sapiens
auucuaaugucuucau

SEQ ID NO: 563256 - RNA, 19 nt, Homo sapiens
auucuacuaugcauuaaau

SEQ ID NO: 563257 - RNA, 13 nt, Homo sapiens
auucuacuggaaa

SEQ ID NO: 563258 - RNA, 18 nt, Homo sapiens
auucuacuucagcuuugg

SEQ ID NO: 563259 - RNA, 15 nt, Homo sapiens
auucuagagccagcu

SEQ ID NO: 563260 - RNA, 16 nt, Homo sapiens
auucuagagccagcug

SEQ ID NO: 563261 - RNA, 15 nt, Homo sapiens
auucuagauuaccau

SEQ ID NO: 563262 - RNA, 18 nt, Homo sapiens
auucuaguacauaauuga

SEQ ID NO: 563263 - RNA, 13 nt, Homo sapiens
auucuaguacuug

SEQ ID NO: 563264 - RNA, 16 nt, Homo sapiens
auucuaguuuugucaa

SEQ ID NO: 563265 - RNA, 21 nt, Homo sapiens
auucuauuacauuuucaguga

SEQ ID NO: 563266 - RNA, 17 nt, Homo sapiens
auucuauuuauauguac

SEQ ID NO: 563267 - RNA, 16 nt, Homo sapiens
auucucaaaauuccua

SEQ ID NO: 563268 - RNA, 16 nt, Homo sapiens
auucucaaagcaggaa

SEQ ID NO: 563269 - RNA, 13 nt, Homo sapiens
auucucaauacuu

SEQ ID NO: 563270 - RNA, 14 nt, Homo sapiens
auucucaccaggaa

SEQ ID NO: 563271 - RNA, 12 nt, Homo sapiens
auucucagggcu

SEQ ID NO: 563272 - RNA, 21 nt, Homo sapiens
auucucagggcuggagccugg

SEQ ID NO: 563273 - RNA, 15 nt, Homo sapiens
auucucaucacucaa

SEQ ID NO: 563274 - RNA, 18 nt, Homo sapiens
auucucaucaguccauug

SEQ ID NO: 563275 - RNA, 24 nt, Homo sapiens
auucucauuaaaagaauaucuggc

SEQ ID NO: 563276 - RNA, 13 nt, Homo sapiens
auucucauucuca

SEQ ID NO: 563277 - RNA, 12 nt, Homo sapiens
auucuccacagc

SEQ ID NO: 563278 - RNA, 21 nt, Homo sapiens
auucucccaaaguaccuugaa

SEQ ID NO: 563279 - RNA, 12 nt, Homo sapiens
auucucccugga

SEQ ID NO: 563280 - RNA, 18 nt, Homo sapiens
auucucuacaugcucuuu

SEQ ID NO: 563281 - RNA, 21 nt, Homo sapiens
auucucucaucuaacugauga

SEQ ID NO: 563282 - RNA, 14 nt, Homo sapiens
auucucuccuguac

SEQ ID NO: 563283 - RNA, 19 nt, Homo sapiens
auucucuccuguaccucuu

SEQ ID NO: 563284 - RNA, 17 nt, Homo sapiens
auucucugucucaucca

SEQ ID NO: 563285 - RNA, 19 nt, Homo sapiens
auucucuugacguuuacau

SEQ ID NO: 563286 - RNA, 20 nt, Homo sapiens
auucucuuugugaggacaaa

SEQ ID NO: 563287 - RNA, 17 nt, Homo sapiens
auucugaaucaagcaca

SEQ ID NO: 563288 - RNA, 16 nt, Homo sapiens
auucugaaucucaaga

SEQ ID NO: 563289 - RNA, 20 nt, Homo sapiens
auucugacauaaaauuccac

SEQ ID NO: 563290 - RNA, 15 nt, Homo sapiens
auucugaccauuuca

SEQ ID NO: 563291 - RNA, 18 nt, Homo sapiens
auucugaggaagucuuau

SEQ ID NO: 563292 - RNA, 15 nt, Homo sapiens
auucugaggcaggua

SEQ ID NO: 563293 - RNA, 18 nt, Homo sapiens
auucugaggccugaguga

SEQ ID NO: 563294 - RNA, 17 nt, Homo sapiens
auucugauaaugcucac

SEQ ID NO: 563295 - RNA, 19 nt, Homo sapiens
auucugauauguauccauc

SEQ ID NO: 563296 - RNA, 14 nt, Homo sapiens
auucugaugagcaa

SEQ ID NO: 563297 - RNA, 19 nt, Homo sapiens
auucugauguuacugagau

SEQ ID NO: 563298 - RNA, 18 nt, Homo sapiens
auucugauucgaaugaca

SEQ ID NO: 563299 - RNA, 14 nt, Homo sapiens
auucugcaauggca

SEQ ID NO: 563300 - RNA, 23 nt, Homo sapiens
auucugcaguaaaucuuuuacaa

SEQ ID NO: 563301 - RNA, 15 nt, Homo sapiens
auucugcauugcuag

SEQ ID NO: 563302 - RNA, 20 nt, Homo sapiens
auucugcuaccucacugggg

SEQ ID NO: 563303 - RNA, 22 nt, Homo sapiens
auucuggaaaagcaaaacugua

SEQ ID NO: 563304 - RNA, 17 nt, Homo sapiens
auucuggaucugacccu

SEQ ID NO: 563305 - RNA, 21 nt, Homo sapiens
auucuggcauaauuuuuacag

SEQ ID NO: 563306 - RNA, 13 nt, Homo sapiens
auucugguaggga

SEQ ID NO: 563307 - RNA, 15 nt, Homo sapiens
auucuguacuuguau

SEQ ID NO: 563308 - RNA, 20 nt, Homo sapiens
auucugucccaaucuuacca

SEQ ID NO: 563309 - RNA, 21 nt, Homo sapiens
auucugugccuccaggaccag

SEQ ID NO: 563310 - RNA, 18 nt, Homo sapiens
auucuguuuuuaaugcua

SEQ ID NO: 563311 - RNA, 22 nt, Homo sapiens
auucuuaaaauauauuucagau

SEQ ID NO: 563312 - RNA, 13 nt, Homo sapiens
auucuuaaugaca

SEQ ID NO: 563313 - RNA, 20 nt, Homo sapiens
auucuuagaauaucuaagaa

SEQ ID NO: 563314 - RNA, 19 nt, Homo sapiens
auucuuaugauuacuauca

SEQ ID NO: 563315 - RNA, 14 nt, Homo sapiens
auucuucaaccagu

SEQ ID NO: 563316 - RNA, 14 nt, Homo sapiens
auucuucacuugcu

SEQ ID NO: 563317 - RNA, 20 nt, Homo sapiens
auucuucagauacaaacugc

SEQ ID NO: 563318 - RNA, 15 nt, Homo sapiens
auucuuccaaaggau

SEQ ID NO: 563319 - RNA, 15 nt, Homo sapiens
auucuucucacaucc

SEQ ID NO: 563320 - RNA, 14 nt, Homo sapiens
auucuucucucuca

SEQ ID NO: 563321 - RNA, 18 nt, Homo sapiens
auucuucugagcacuguu

SEQ ID NO: 563322 - RNA, 21 nt, Homo sapiens
auucuucuuugguggagauaa

SEQ ID NO: 563323 - RNA, 20 nt, Homo sapiens
auucuugagggacaaugcca

SEQ ID NO: 563324 - RNA, 20 nt, Homo sapiens
auucuugccuuguaccucaa

SEQ ID NO: 563325 - RNA, 16 nt, Homo sapiens
auucuuggaccaugcc

SEQ ID NO: 563326 - RNA, 17 nt, Homo sapiens
auucuuguagaugcauu

SEQ ID NO: 563327 - RNA, 15 nt, Homo sapiens
auucuugucacaaua

SEQ ID NO: 563328 - RNA, 21 nt, Homo sapiens
auucuuguccacauucuacuu

SEQ ID NO: 563329 - RNA, 17 nt, Homo sapiens
auucuuuaccucagguu

SEQ ID NO: 563330 - RNA, 17 nt, Homo sapiens
auucuuucuaaacuaca

SEQ ID NO: 563331 - RNA, 20 nt, Homo sapiens
auucuuugaaaacagaugac

SEQ ID NO: 563332 - RNA, 14 nt, Homo sapiens
auucuuugcaagau

SEQ ID NO: 563333 - RNA, 19 nt, Homo sapiens
auucuuuguauaugcauuc

SEQ ID NO: 563334 - RNA, 16 nt, Homo sapiens
auucuuuuaaugccac

SEQ ID NO: 563335 - RNA, 20 nt, Homo sapiens
auucuuuucuuuuccauuua

SEQ ID NO: 563336 - RNA, 15 nt, Homo sapiens
auucuuuuuuaugca

SEQ ID NO: 563337 - RNA, 17 nt, Homo sapiens
auucuuuuuucuauuca

SEQ ID NO: 563338 - RNA, 18 nt, Homo sapiens
auucuuuuuucuauucaa

SEQ ID NO: 563339 - RNA, 19 nt, Homo sapiens
auucuuuuuuuuuugucua

SEQ ID NO: 563340 - RNA, 14 nt, Homo sapiens
auugaaaacacuua

SEQ ID NO: 563341 - RNA, 20 nt, Homo sapiens
auugaaaauaaugcuguucu

SEQ ID NO: 563342 - RNA, 14 nt, Homo sapiens
auugaaaauaugau

SEQ ID NO: 563343 - RNA, 13 nt, Homo sapiens
auugaaacucucu

SEQ ID NO: 563344 - RNA, 17 nt, Homo sapiens
auugaaagcuuuuguua

SEQ ID NO: 563345 - RNA, 19 nt, Homo sapiens
auugaaauguuugcauaaa

SEQ ID NO: 563346 - RNA, 17 nt, Homo sapiens
auugaacagcugugagc

SEQ ID NO: 563347 - RNA, 21 nt, Homo sapiens
auugaacuuuuguacugaauu

SEQ ID NO: 563348 - RNA, 12 nt, Homo sapiens
auugaagcaacu

SEQ ID NO: 563349 - RNA, 12 nt, Homo sapiens
auugaagcagau

SEQ ID NO: 563350 - RNA, 12 nt, Homo sapiens
auugaagccaau

SEQ ID NO: 563351 - RNA, 17 nt, Homo sapiens
auugaaguccuccagac

SEQ ID NO: 563352 - RNA, 13 nt, Homo sapiens
auugaaguguucu

SEQ ID NO: 563353 - RNA, 14 nt, Homo sapiens
auugaauaggauca

SEQ ID NO: 563354 - RNA, 14 nt, Homo sapiens
auugacaacugcac

SEQ ID NO: 563355 - RNA, 22 nt, Homo sapiens
auugacaacugcacaugaaagu

SEQ ID NO: 563356 - RNA, 22 nt, Homo sapiens
auugacagcuucaacagaaagg

SEQ ID NO: 563357 - RNA, 21 nt, Homo sapiens
auugacaucucuuuugagcua

SEQ ID NO: 563358 - RNA, 22 nt, Homo sapiens
auugaccaagaacugcauggac

SEQ ID NO: 563359 - RNA, 16 nt, Homo sapiens
auugacccauguuccc

SEQ ID NO: 563360 - RNA, 17 nt, Homo sapiens
auugacccuagccagag

SEQ ID NO: 563361 - RNA, 22 nt, Homo sapiens
auugaccgcgacuaauuucaaa

SEQ ID NO: 563362 - RNA, 20 nt, Homo sapiens
auugaccuauuuccagaaau

SEQ ID NO: 563363 - RNA, 21 nt, Homo sapiens
auuuguauauauuuuauaugu

SEQ ID NO: 563364 - RNA, 15 nt, Homo sapiens
auuuguauuaugcug

SEQ ID NO: 563365 - RNA, 22 nt, Homo sapiens
auuuguauucaugaacuuggcu

SEQ ID NO: 563366 - RNA, 14 nt, Homo sapiens
auuugucaauuuau

SEQ ID NO: 563367 - RNA, 23 nt, Homo sapiens
auuugucacaaauaaacauaaua

SEQ ID NO: 563368 - RNA, 23 nt, Homo sapiens
auuugucaggacaagggcucaga

SEQ ID NO: 563369 - RNA, 23 nt, Homo sapiens
auuugucauaauuuuuccucuuu

SEQ ID NO: 563370 - RNA, 17 nt, Homo sapiens
auuugucauucauucaa

SEQ ID NO: 563371 - RNA, 13 nt, Homo sapiens
auuuguccaauug

SEQ ID NO: 563372 - RNA, 14 nt, Homo sapiens
auuugucuucauga

SEQ ID NO: 563373 - RNA, 20 nt, Homo sapiens
auuugugaaaagaguaugua

SEQ ID NO: 563374 - RNA, 19 nt, Homo sapiens
auuugugucaaugggcaau

SEQ ID NO: 563375 - RNA, 19 nt, Homo sapiens
auuuguuaaaauuaucaau

SEQ ID NO: 563376 - RNA, 16 nt, Homo sapiens
auuuguuauacuucaa

SEQ ID NO: 563377 - RNA, 17 nt, Homo sapiens
auuuguuccuggaguuu

SEQ ID NO: 563378 - RNA, 23 nt, Homo sapiens
auuuguuuaaacaaucuuucaug

SEQ ID NO: 563379 - RNA, 16 nt, Homo sapiens
auuuguuuaaagaaua

SEQ ID NO: 563380 - RNA, 13 nt, Homo sapiens
auuuguuuuuacc

SEQ ID NO: 563381 - RNA, 18 nt, Homo sapiens
auuuuaaaaauaaauuca

SEQ ID NO: 563382 - RNA, 19 nt, Homo sapiens
auuuuaaaaauaaauucaa

SEQ ID NO: 563383 - RNA, 23 nt, Homo sapiens
auuuuaaaaauaaauucaaauua

SEQ ID NO: 563384 - RNA, 21 nt, Homo sapiens
auuuuaaaggcagagaaguuc

SEQ ID NO: 563385 - RNA, 16 nt, Homo sapiens
auuuuaagaaagagaa

SEQ ID NO: 563386 - RNA, 14 nt, Homo sapiens
auuuuaaggacugc

SEQ ID NO: 563387 - RNA, 16 nt, Homo sapiens
auuuuaaggauaugau

SEQ ID NO: 563388 - RNA, 19 nt, Homo sapiens
auuuuaaguaacauaacua

SEQ ID NO: 563389 - RNA, 15 nt, Homo sapiens
auuuuaauacauuga

SEQ ID NO: 563390 - RNA, 23 nt, Homo sapiens
auuuuaauagggaauauaucucu

SEQ ID NO: 563391 - RNA, 21 nt, Homo sapiens
auuuuaaugaagaaaguggaa

SEQ ID NO: 563392 - RNA, 17 nt, Homo sapiens
auuuuaauuacugcuau

SEQ ID NO: 563393 - RNA, 13 nt, Homo sapiens
auuuuaauuaucu

SEQ ID NO: 563394 - RNA, 14 nt, Homo sapiens
auuuuaauuaucuu

SEQ ID NO: 563395 - RNA, 16 nt, Homo sapiens
auuuuacaagggcaua

SEQ ID NO: 563396 - RNA, 23 nt, Homo sapiens
auuuuacaauuuuuuaucaugca

SEQ ID NO: 563397 - RNA, 13 nt, Homo sapiens
auuuuacauuucu

SEQ ID NO: 563398 - RNA, 13 nt, Homo sapiens
auuuuacuaaaaa

SEQ ID NO: 563399 - RNA, 16 nt, Homo sapiens
auuuuacugaucucuu

SEQ ID NO: 563400 - RNA, 19 nt, Homo sapiens
auuuuacuuuaacagucua

SEQ ID NO: 563401 - RNA, 20 nt, Homo sapiens
auuuuagaauaaauucccaa

SEQ ID NO: 563402 - RNA, 21 nt, Homo sapiens
auuuuagauguuauuaugcua

SEQ ID NO: 563403 - RNA, 12 nt, Homo sapiens
auuuuagcuuca

SEQ ID NO: 563404 - RNA, 23 nt, Homo sapiens
auuuuaguauucauucugcauug

SEQ ID NO: 563405 - RNA, 18 nt, Homo sapiens
auuuuaguuuuaauucca

SEQ ID NO: 563406 - RNA, 18 nt, Homo sapiens
auuuuauaacagaauuaa

SEQ ID NO: 563407 - RNA, 22 nt, Homo sapiens
auuuuauagaugggcaacuggc

SEQ ID NO: 563408 - RNA, 12 nt, Homo sapiens
auuuuauaggug

SEQ ID NO: 563409 - RNA, 22 nt, Homo sapiens
auuuuauaugcuuacugauaua

SEQ ID NO: 563410 - RNA, 19 nt, Homo sapiens
auuuuaucuaaauuacagu

SEQ ID NO: 563411 - RNA, 18 nt, Homo sapiens
auuuuaucuugaaacuga

SEQ ID NO: 563412 - RNA, 13 nt, Homo sapiens
auuuuaugaacau

SEQ ID NO: 563413 - RNA, 17 nt, Homo sapiens
auuuuaugagacagggu

SEQ ID NO: 563414 - RNA, 16 nt, Homo sapiens
auuuuaugaucuuggc

SEQ ID NO: 563415 - RNA, 14 nt, Homo sapiens
auuuucaaguuuac

SEQ ID NO: 563416 - RNA, 12 nt, Homo sapiens
auuuucacauau

SEQ ID NO: 563417 - RNA, 13 nt, Homo sapiens
auuuucaguuaca

SEQ ID NO: 563418 - RNA, 16 nt, Homo sapiens
auuuucaguuauaugu

SEQ ID NO: 563419 - RNA, 13 nt, Homo sapiens
auuuucaucacug

SEQ ID NO: 563420 - RNA, 23 nt, Homo sapiens
auuuucauccuauaagcuuaaau

SEQ ID NO: 563421 - RNA, 22 nt, Homo sapiens
auuuuccccccacucuccccac

SEQ ID NO: 563422 - RNA, 13 nt, Homo sapiens
auuuucccuaccc

SEQ ID NO: 563423 - RNA, 15 nt, Homo sapiens
auuuuccuuggcaau

SEQ ID NO: 563424 - RNA, 18 nt, Homo sapiens
auuuucuaagaaccaaaa

SEQ ID NO: 563425 - RNA, 19 nt, Homo sapiens
auuuucuaauguugacuuu

SEQ ID NO: 563426 - RNA, 14 nt, Homo sapiens
auuuucugauguau

SEQ ID NO: 563427 - RNA, 12 nt, Homo sapiens
auuuucugucag

SEQ ID NO: 563428 - RNA, 23 nt, Homo sapiens
auuuucugucagaugagaacaaa

SEQ ID NO: 563429 - RNA, 23 nt, Homo sapiens
auuuucuucacagugcagcuugc

SEQ ID NO: 563430 - RNA, 20 nt, Homo sapiens
auuuucuucucugugaagua

SEQ ID NO: 563431 - RNA, 20 nt, Homo sapiens
auuuucuuguuuaacauaua

SEQ ID NO: 563432 - RNA, 20 nt, Homo sapiens
auuuucuuuacaauuucacu

SEQ ID NO: 563433 - RNA, 16 nt, Homo sapiens
auuuucuuucacuuaa

SEQ ID NO: 563434 - RNA, 21 nt, Homo sapiens
auuuucuuucucuacuuugag

SEQ ID NO: 563435 - RNA, 14 nt, Homo sapiens
auuuucuuuuccau

SEQ ID NO: 563436 - RNA, 15 nt, Homo sapiens
auuuugaagugcugu

SEQ ID NO: 563437 - RNA, 12 nt, Homo sapiens
auuuugacuuaa

SEQ ID NO: 563438 - RNA, 23 nt, Homo sapiens
auuuugaguaaauauuuguuacu

SEQ ID NO: 563439 - RNA, 14 nt, Homo sapiens
auuuugaguauucc

SEQ ID NO: 563440 - RNA, 16 nt, Homo sapiens
auuuugcaaucugugu

SEQ ID NO: 563441 - RNA, 15 nt, Homo sapiens
auuuugcagaaggaa

SEQ ID NO: 563442 - RNA, 16 nt, Homo sapiens
auuuugcaucugaccc

SEQ ID NO: 563443 - RNA, 19 nt, Homo sapiens
auuuugccacugccuuuca

SEQ ID NO: 563444 - RNA, 23 nt, Homo sapiens
auuuugcccucuccuuagcucuu

SEQ ID NO: 563445 - RNA, 17 nt, Homo sapiens
auuuugcugagaugaag

SEQ ID NO: 563446 - RNA, 18 nt, Homo sapiens
auuuugcuugcugaagga

SEQ ID NO: 563447 - RNA, 12 nt, Homo sapiens
auuuuggagcuu

SEQ ID NO: 563448 - RNA, 23 nt, Homo sapiens
auuuugggggguaaucagcauua

SEQ ID NO: 563449 - RNA, 18 nt, Homo sapiens
auuuugggguaagacuuu

SEQ ID NO: 563450 - RNA, 19 nt, Homo sapiens
auuuugggguuguguuguc

SEQ ID NO: 563451 - RNA, 13 nt, Homo sapiens
auuuugguacuuu

SEQ ID NO: 563452 - RNA, 13 nt, Homo sapiens
auuuuguaacuuu

SEQ ID NO: 563453 - RNA, 19 nt, Homo sapiens
auuuuguaagaaggcaaua

SEQ ID NO: 563454 - RNA, 18 nt, Homo sapiens
auuuuguaauaauaaaga

SEQ ID NO: 563455 - RNA, 17 nt, Homo sapiens
auuuuguauccaaggau

SEQ ID NO: 563456 - RNA, 19 nt, Homo sapiens
auuuuguauucuuuuccaa

SEQ ID NO: 563457 - RNA, 15 nt, Homo sapiens
auuuugugacauucc

SEQ ID NO: 563458 - RNA, 16 nt, Homo sapiens
auuuuguggucauuaa

SEQ ID NO: 563459 - RNA, 17 nt, Homo sapiens
auuuuguguaagaaaua

SEQ ID NO: 563460 - RNA, 20 nt, Homo sapiens
auuuuguguucaguacaauu

SEQ ID NO: 563461 - RNA, 16 nt, Homo sapiens
auuuuguucugcaaau

SEQ ID NO: 563462 - RNA, 19 nt, Homo sapiens
auuuuguucuuaauuguga

SEQ ID NO: 563463 - RNA, 21 nt, Homo sapiens
auuuuguuuuugucuuaaaaa

SEQ ID NO: 563464 - RNA, 13 nt, Homo sapiens
auuuuuaaacuug

SEQ ID NO: 563465 - RNA, 23 nt, Homo sapiens
auuuuuaaaggcauuagagucaa

SEQ ID NO: 563466 - RNA, 14 nt, Homo sapiens
auuuuuaauggaaa

SEQ ID NO: 563467 - RNA, 21 nt, Homo sapiens
auuuuuaauguuuguacacaa

SEQ ID NO: 563468 - RNA, 19 nt, Homo sapiens
auuuuuacaguucucccaa

SEQ ID NO: 563469 - RNA, 17 nt, Homo sapiens
auuuuuagacucaucaa

SEQ ID NO: 563470 - RNA, 15 nt, Homo sapiens
auuuuuagcuuuuca

SEQ ID NO: 563471 - RNA, 21 nt, Homo sapiens
auuuuuauaaaaaugagugcu

SEQ ID NO: 563472 - RNA, 16 nt, Homo sapiens
auuuuuauacuuucag

SEQ ID NO: 563473 - RNA, 15 nt, Homo sapiens
auuuuucaaggcauu

SEQ ID NO: 563474 - RNA, 21 nt, Homo sapiens
auuuuucaaugggaagacuca

SEQ ID NO: 563475 - RNA, 20 nt, Homo sapiens
auuuuucacuguacauuaua

SEQ ID NO: 563476 - RNA, 18 nt, Homo sapiens
auuuuucagauauaaaag

SEQ ID NO: 563477 - RNA, 23 nt, Homo sapiens
auuuuuccuaugcuauugacaau

SEQ ID NO: 563478 - RNA, 13 nt, Homo sapiens
auuuuucuaucaa

SEQ ID NO: 563479 - RNA, 16 nt, Homo sapiens
auuuuucucuaacuca

SEQ ID NO: 563480 - RNA, 14 nt, Homo sapiens
auuuuucuguuacc

SEQ ID NO: 563481 - RNA, 15 nt, Homo sapiens
auuuuugaaggcaua

SEQ ID NO: 563482 - RNA, 16 nt, Homo sapiens
auuuuugauaucucaa

SEQ ID NO: 563483 - RNA, 12 nt, Homo sapiens
auuuuugccaaa

SEQ ID NO: 563484 - RNA, 17 nt, Homo sapiens
auuuuugccaaggcaaa

SEQ ID NO: 563485 - RNA, 16 nt, Homo sapiens
cacucagggagcauuu

SEQ ID NO: 563486 - RNA, 14 nt, Homo sapiens
cacucaggugaaaa

SEQ ID NO: 563487 - RNA, 15 nt, Homo sapiens
cacucagguucuuca

SEQ ID NO: 563488 - RNA, 18 nt, Homo sapiens
cacucagguucuucaggg

SEQ ID NO: 563489 - RNA, 17 nt, Homo sapiens
cacucagugcagcaaua

SEQ ID NO: 563490 - RNA, 22 nt, Homo sapiens
cacucaguggcccauggcauuu

SEQ ID NO: 563491 - RNA, 16 nt, Homo sapiens
cacucaugaagcauac

SEQ ID NO: 563492 - RNA, 15 nt, Homo sapiens
cacuccacagaguga

SEQ ID NO: 563493 - RNA, 23 nt, Homo sapiens
cacuccacccuguuaguuuugua

SEQ ID NO: 563494 - RNA, 14 nt, Homo sapiens
cacuccacuggccu

SEQ ID NO: 563495 - RNA, 16 nt, Homo sapiens
cacuccagcgcugagu

SEQ ID NO: 563496 - RNA, 11 nt, Homo sapiens
cacuccagugc

SEQ ID NO: 563497 - RNA, 15 nt, Homo sapiens
cacuccagugcccau

SEQ ID NO: 563498 - RNA, 23 nt, Homo sapiens
cacucccuaauuuaugugcuaua

SEQ ID NO: 563499 - RNA, 14 nt, Homo sapiens
cacucccugccuac

SEQ ID NO: 563500 - RNA, 20 nt, Homo sapiens
cacucccuguuuuaauucaa

SEQ ID NO: 563501 - RNA, 23 nt, Homo sapiens
cacuccgagaggugggccagucu

SEQ ID NO: 563502 - RNA, 18 nt, Homo sapiens
cacuccuccuacuguauu

SEQ ID NO: 563503 - RNA, 18 nt, Homo sapiens
cacuccuggccucacauu

SEQ ID NO: 563504 - RNA, 13 nt, Homo sapiens
cacuccuucagga

SEQ ID NO: 563505 - RNA, 14 nt, Homo sapiens
cacuccuucucuca

SEQ ID NO: 563506 - RNA, 15 nt, Homo sapiens
cacuccuuuuuugca

SEQ ID NO: 563507 - RNA, 14 nt, Homo sapiens
cacucuaaacugca

SEQ ID NO: 563508 - RNA, 16 nt, Homo sapiens
cacucuaagucaugua

SEQ ID NO: 563509 - RNA, 13 nt, Homo sapiens
cacucuacccuau

SEQ ID NO: 563510 - RNA, 19 nt, Homo sapiens
cacucuacccuauacaacu

SEQ ID NO: 563511 - RNA, 22 nt, Homo sapiens
cacucuaccugaaccugcacac

SEQ ID NO: 563512 - RNA, 19 nt, Homo sapiens
cacucuauaagauuccaaa

SEQ ID NO: 563513 - RNA, 13 nt, Homo sapiens
cacucucaugucc

SEQ ID NO: 563514 - RNA, 23 nt, Homo sapiens
cacucuccaaacagucaccauac

SEQ ID NO: 563515 - RNA, 20 nt, Homo sapiens
cacucucccaccuccuggug

SEQ ID NO: 563516 - RNA, 14 nt, Homo sapiens
cacucugaaacuga

SEQ ID NO: 563517 - RNA, 14 nt, Homo sapiens
cacucuggagcauu

SEQ ID NO: 563518 - RNA, 16 nt, Homo sapiens
cacucuggagcauuuc

SEQ ID NO: 563519 - RNA, 10 nt, Homo sapiens
cacucuggau

SEQ ID NO: 563520 - RNA, 23 nt, Homo sapiens
cacucuguaucuaugcaaagcac

SEQ ID NO: 563521 - RNA, 12 nt, Homo sapiens
cacucugucauc

SEQ ID NO: 563522 - RNA, 23 nt, Homo sapiens
cacucuuauucccaaacuacaga

SEQ ID NO: 563523 - RNA, 20 nt, Homo sapiens
cacugaaaaaauacuaccua

SEQ ID NO: 563524 - RNA, 22 nt, Homo sapiens
cacugaaaaaucuaagugauau

SEQ ID NO: 563525 - RNA, 14 nt, Homo sapiens
cacugaaaauguca

SEQ ID NO: 563526 - RNA, 21 nt, Homo sapiens
cacugaaacugguugaagggu

SEQ ID NO: 563527 - RNA, 13 nt, Homo sapiens
cacugacuguaug

SEQ ID NO: 563528 - RNA, 14 nt, Homo sapiens
cacugacugugaaa

SEQ ID NO: 563529 - RNA, 15 nt, Homo sapiens
cacugaggacugugg

SEQ ID NO: 563530 - RNA, 13 nt, Homo sapiens
cacugagggccac

SEQ ID NO: 563531 - RNA, 15 nt, Homo sapiens
cacugauaaaaccau

SEQ ID NO: 563532 - RNA, 20 nt, Homo sapiens
cacugaucacccaaugcauc

SEQ ID NO: 563533 - RNA, 18 nt, Homo sapiens
cacugauggaaaauacca

SEQ ID NO: 563534 - RNA, 23 nt, Homo sapiens
cacugauuccuuuaugaugacug

SEQ ID NO: 563535 - RNA, 16 nt, Homo sapiens
cacugcaagcucugcc

SEQ ID NO: 563536 - RNA, 18 nt, Homo sapiens
cacugcaauccugucuuu

SEQ ID NO: 563537 - RNA, 13 nt, Homo sapiens
cacugcacuccag

SEQ ID NO: 563538 - RNA, 14 nt, Homo sapiens
cacugcacugucug

SEQ ID NO: 563539 - RNA, 18 nt, Homo sapiens
cacugcacugucugagaa

SEQ ID NO: 563540 - RNA, 13 nt, Homo sapiens
cacugcauacaau

SEQ ID NO: 563541 - RNA, 13 nt, Homo sapiens
cacugccaagagc

SEQ ID NO: 563542 - RNA, 16 nt, Homo sapiens
cacugcccaccaaagg

SEQ ID NO: 563543 - RNA, 18 nt, Homo sapiens
cacugcccccugcugcca

SEQ ID NO: 563544 - RNA, 23 nt, Homo sapiens
cacugcccucuuguggugcauug

SEQ ID NO: 563545 - RNA, 15 nt, Homo sapiens
cacugccugaaagac

SEQ ID NO: 563546 - RNA, 18 nt, Homo sapiens
cacugccugucccagaga

SEQ ID NO: 563547 - RNA, 20 nt, Homo sapiens
cacugccuuagccucuugga

SEQ ID NO: 563548 - RNA, 20 nt, Homo sapiens
cacugcuaugccauuucuuc

SEQ ID NO: 563549 - RNA, 13 nt, Homo sapiens
cacugcucaagaa

SEQ ID NO: 563550 - RNA, 12 nt, Homo sapiens
cacugcucccua

SEQ ID NO: 563551 - RNA, 16 nt, Homo sapiens
cacugcugccucuuga

SEQ ID NO: 563552 - RNA, 13 nt, Homo sapiens
cacugcuguccac

SEQ ID NO: 563553 - RNA, 24 nt, Homo sapiens
cacugcuuaacuucacauauugau

SEQ ID NO: 563554 - RNA, 23 nt, Homo sapiens
cacugcuugaggaaaacaagcau

SEQ ID NO: 563555 - RNA, 17 nt, Homo sapiens
cacuggaaaaguguaau

SEQ ID NO: 563556 - RNA, 19 nt, Homo sapiens
cacuggaacauuccagugg

SEQ ID NO: 563557 - RNA, 16 nt, Homo sapiens
cacuggacaacacuga

SEQ ID NO: 563558 - RNA, 20 nt, Homo sapiens
cacuggacuccggggcccca

SEQ ID NO: 563559 - RNA, 19 nt, Homo sapiens
cacuggagguugaagccaa

SEQ ID NO: 563560 - RNA, 18 nt, Homo sapiens
cacuggcagcaucuucac

SEQ ID NO: 563561 - RNA, 18 nt, Homo sapiens
cacuggcaucucacuuua

SEQ ID NO: 563562 - RNA, 17 nt, Homo sapiens
cacuggcguuacugcuu

SEQ ID NO: 563563 - RNA, 23 nt, Homo sapiens
cacuggcugggaguccuuaccuc

SEQ ID NO: 563564 - RNA, 13 nt, Homo sapiens
cacuggcuugaag

SEQ ID NO: 563565 - RNA, 15 nt, Homo sapiens
cacugggaguguccu

SEQ ID NO: 563566 - RNA, 17 nt, Homo sapiens
cacugggccagcccugc

SEQ ID NO: 563567 - RNA, 22 nt, Homo sapiens
cacuggggaaacauaacuccau

SEQ ID NO: 563568 - RNA, 22 nt, Homo sapiens
cacuggggaagagaaaagccca

SEQ ID NO: 563569 - RNA, 20 nt, Homo sapiens
cacuggggggcucucaggga

SEQ ID NO: 563570 - RNA, 18 nt, Homo sapiens
cacuggguacccaaguga

SEQ ID NO: 563571 - RNA, 17 nt, Homo sapiens
cacugggugaccagcug

SEQ ID NO: 563572 - RNA, 15 nt, Homo sapiens
cacuggucugucuuu

SEQ ID NO: 563573 - RNA, 17 nt, Homo sapiens
cacugguuuacacuuua

SEQ ID NO: 563574 - RNA, 16 nt, Homo sapiens
cacugguuuuacacag

SEQ ID NO: 563575 - RNA, 18 nt, Homo sapiens
cacuguaagacucauucc

SEQ ID NO: 563576 - RNA, 13 nt, Homo sapiens
cacuguacuugua

SEQ ID NO: 563577 - RNA, 16 nt, Homo sapiens
cacuguauugcuccuc

SEQ ID NO: 563578 - RNA, 23 nt, Homo sapiens
cacuguccaugaagcacugagca

SEQ ID NO: 563579 - RNA, 19 nt, Homo sapiens
cacugucccccguuugccu

SEQ ID NO: 563580 - RNA, 22 nt, Homo sapiens
cacuguccugggcgcccuggaa

SEQ ID NO: 563581 - RNA, 16 nt, Homo sapiens
cacugucugacuuuag

SEQ ID NO: 563582 - RNA, 13 nt, Homo sapiens
cacugucuuucaa

SEQ ID NO: 563583 - RNA, 23 nt, Homo sapiens
cacugugagugaaaauuuuuaca

SEQ ID NO: 563584 - RNA, 20 nt, Homo sapiens
cacuguggcauugucuguaa

SEQ ID NO: 563585 - RNA, 23 nt, Homo sapiens
cacugugggaaggccagcugccc

SEQ ID NO: 563586 - RNA, 16 nt, Homo sapiens
cacuguguaaccaggu

SEQ ID NO: 563587 - RNA, 19 nt, Homo sapiens
cacuguguacaccucugga

SEQ ID NO: 563588 - RNA, 20 nt, Homo sapiens
cacugugugccuucugccaa

SEQ ID NO: 563589 - RNA, 23 nt, Homo sapiens
cacuguuacuuucguacauuggc

SEQ ID NO: 563590 - RNA, 10 nt, Homo sapiens
cacuguucaa

SEQ ID NO: 563591 - RNA, 18 nt, Homo sapiens
cacuguucuuguauugua

SEQ ID NO: 563592 - RNA, 16 nt, Homo sapiens
cacuguugauguaucu

SEQ ID NO: 563593 - RNA, 18 nt, Homo sapiens
cacuguuguacacagucu

SEQ ID NO: 563594 - RNA, 20 nt, Homo sapiens
cacuuaacuccuuuuccacu

SEQ ID NO: 563595 - RNA, 15 nt, Homo sapiens
cacuuaaggaccuuu

SEQ ID NO: 563596 - RNA, 12 nt, Homo sapiens
cacuuaauagca

SEQ ID NO: 563597 - RNA, 16 nt, Homo sapiens
cacuuaaugauacaug

SEQ ID NO: 563598 - RNA, 13 nt, Homo sapiens
cacuuacagaauu

SEQ ID NO: 563599 - RNA, 15 nt, Homo sapiens
cacuuacagaauuau

SEQ ID NO: 563600 - RNA, 20 nt, Homo sapiens
cacuuacagcucuggccaca

SEQ ID NO: 563601 - RNA, 20 nt, Homo sapiens
cacuuacugacuuugcauuu

SEQ ID NO: 563602 - RNA, 17 nt, Homo sapiens
cacuuacugcaaaggcu

SEQ ID NO: 563603 - RNA, 18 nt, Homo sapiens
cacuuagcuaucagaaga

SEQ ID NO: 563604 - RNA, 15 nt, Homo sapiens
cacuuagugaucauu

SEQ ID NO: 563605 - RNA, 17 nt, Homo sapiens
cacuuauacccaugaac

SEQ ID NO: 563606 - RNA, 16 nt, Homo sapiens
cacuuauguuauacaa

SEQ ID NO: 563607 - RNA, 19 nt, Homo sapiens
cagauguacgacuugcaua

SEQ ID NO: 563608 - RNA, 23 nt, Homo sapiens
cagauguauuaaaaaaagauuug

SEQ ID NO: 563609 - RNA, 16 nt, Homo sapiens
cagaugugaaaacauc

SEQ ID NO: 563610 - RNA, 21 nt, Homo sapiens
cagaugugaaaacaucucaau

SEQ ID NO: 563611 - RNA, 11 nt, Homo sapiens
cagauguuaaa

SEQ ID NO: 563612 - RNA, 19 nt, Homo sapiens
cagauguuuacagacugug

SEQ ID NO: 563613 - RNA, 14 nt, Homo sapiens
cagauuaaacccuu

SEQ ID NO: 563614 - RNA, 20 nt, Homo sapiens
cagauuaagaguugccaaaa

SEQ ID NO: 563615 - RNA, 17 nt, Homo sapiens
cagauuagagccuguaa

SEQ ID NO: 563616 - RNA, 16 nt, Homo sapiens
cagauuauuuaaaugg

SEQ ID NO: 563617 - RNA, 11 nt, Homo sapiens
cagauuccaca

SEQ ID NO: 563618 - RNA, 19 nt, Homo sapiens
cagauuccaccuagagcua

SEQ ID NO: 563619 - RNA, 11 nt, Homo sapiens
cagauucugaa

SEQ ID NO: 563620 - RNA, 15 nt, Homo sapiens
cagauucuucagcuu

SEQ ID NO: 563621 - RNA, 18 nt, Homo sapiens
cagauucuucucucucaa

SEQ ID NO: 563622 - RNA, 17 nt, Homo sapiens
cagauugaacaagagcu

SEQ ID NO: 563623 - RNA, 17 nt, Homo sapiens
cagauuguuaucuauca

SEQ ID NO: 563624 - RNA, 16 nt, Homo sapiens
cagauuuaaaaaaaga

SEQ ID NO: 563625 - RNA, 18 nt, Homo sapiens
cagauuuaaaaaaagaac

SEQ ID NO: 563626 - RNA, 16 nt, Homo sapiens
cagauuucagaucaua

SEQ ID NO: 563627 - RNA, 18 nt, Homo sapiens
cagauuuggaugcacuca

SEQ ID NO: 563628 - RNA, 23 nt, Homo sapiens
cagauuuguaugguuccaaagac

SEQ ID NO: 563629 - RNA, 20 nt, Homo sapiens
cagauuuuaccuauccacaa

SEQ ID NO: 563630 - RNA, 16 nt, Homo sapiens
cagauuuucaugcaaa

SEQ ID NO: 563631 - RNA, 18 nt, Homo sapiens
cagauuuucuaagaacca

SEQ ID NO: 563632 - RNA, 20 nt, Homo sapiens
cagauuuucuaagaaccaaa

SEQ ID NO: 563633 - RNA, 22 nt, Homo sapiens
cagauuuucuaagaaccaaaaa

SEQ ID NO: 563634 - RNA, 22 nt, Homo sapiens
cagcaaaaaucucccagugaca

SEQ ID NO: 563635 - RNA, 18 nt, Homo sapiens
cagcaaaacuccaucuca

SEQ ID NO: 563636 - RNA, 13 nt, Homo sapiens
cagcaaaagacca

SEQ ID NO: 563637 - RNA, 14 nt, Homo sapiens
cagcaaaagaccaa

SEQ ID NO: 563638 - RNA, 22 nt, Homo sapiens
cagcaaacaggugcuaauuugu

SEQ ID NO: 563639 - RNA, 18 nt, Homo sapiens
cagcaaacccugauguga

SEQ ID NO: 563640 - RNA, 14 nt, Homo sapiens
cagcaaaucacgac

SEQ ID NO: 563641 - RNA, 18 nt, Homo sapiens
cagcaacaagacugccag

SEQ ID NO: 563642 - RNA, 19 nt, Homo sapiens
cagcaacuucuucuccauc

SEQ ID NO: 563643 - RNA, 17 nt, Homo sapiens
cagcaaggaaagcucac

SEQ ID NO: 563644 - RNA, 23 nt, Homo sapiens
cagcaaguacgcaagaaauugga

SEQ ID NO: 563645 - RNA, 23 nt, Homo sapiens
cagcaaugaauugugccuagugg

SEQ ID NO: 563646 - RNA, 16 nt, Homo sapiens
cagcaaugacaucuca

SEQ ID NO: 563647 - RNA, 20 nt, Homo sapiens
cagcaaugacaucucagggg

SEQ ID NO: 563648 - RNA, 17 nt, Homo sapiens
cagcaaugccauuucag

SEQ ID NO: 563649 - RNA, 21 nt, Homo sapiens
cagcacagaugaggagcagcu

SEQ ID NO: 563650 - RNA, 16 nt, Homo sapiens
cagcacagucacccau

SEQ ID NO: 563651 - RNA, 16 nt, Homo sapiens
cagcacagugccugac

SEQ ID NO: 563652 - RNA, 12 nt, Homo sapiens
cagcaccacagu

SEQ ID NO: 563653 - RNA, 15 nt, Homo sapiens
cagcaccucucagga

SEQ ID NO: 563654 - RNA, 16 nt, Homo sapiens
cagcaccucucaggau

SEQ ID NO: 563655 - RNA, 20 nt, Homo sapiens
cagcaccugccccggcagug

SEQ ID NO: 563656 - RNA, 20 nt, Homo sapiens
cagcaccuguggcugacgaa

SEQ ID NO: 563657 - RNA, 22 nt, Homo sapiens
cagcaccuguggcugacgaauu

SEQ ID NO: 563658 - RNA, 20 nt, Homo sapiens
cagcaccuucuuucuggacu

SEQ ID NO: 563659 - RNA, 15 nt, Homo sapiens
cagcaccuuucucug

SEQ ID NO: 563660 - RNA, 21 nt, Homo sapiens
cagcacuaaagcaguggacac

SEQ ID NO: 563661 - RNA, 10 nt, Homo sapiens
cagcacuaac

SEQ ID NO: 563662 - RNA, 15 nt, Homo sapiens
cagcacuacucugug

SEQ ID NO: 563663 - RNA, 19 nt, Homo sapiens
cagcacucacgcaccggag

SEQ ID NO: 563664 - RNA, 13 nt, Homo sapiens
cagcacuccugua

SEQ ID NO: 563665 - RNA, 20 nt, Homo sapiens
cagcacucugaaacugagaa

SEQ ID NO: 563666 - RNA, 17 nt, Homo sapiens
cagcacucuuaucuaca

SEQ ID NO: 563667 - RNA, 19 nt, Homo sapiens
cagcacucuuaucuacaua

SEQ ID NO: 563668 - RNA, 13 nt, Homo sapiens
cagcacugacaau

SEQ ID NO: 563669 - RNA, 12 nt, Homo sapiens
cagcacugcccc

SEQ ID NO: 563670 - RNA, 12 nt, Homo sapiens
cagcacuggaag

SEQ ID NO: 563671 - RNA, 22 nt, Homo sapiens
cagcacugggaaccuagcuaca

SEQ ID NO: 563672 - RNA, 17 nt, Homo sapiens
cagcacuggugaacuga

SEQ ID NO: 563673 - RNA, 20 nt, Homo sapiens
cagcacuggugaacugagcu

SEQ ID NO: 563674 - RNA, 21 nt, Homo sapiens
cagcacuuuggacauggcuca

SEQ ID NO: 563675 - RNA, 22 nt, Homo sapiens
cagcagaaaggagaacuaucca

SEQ ID NO: 563676 - RNA, 20 nt, Homo sapiens
cagcagaaagguuaguauca

SEQ ID NO: 563677 - RNA, 24 nt, Homo sapiens
cagcagaaagguuaguaucaucag

SEQ ID NO: 563678 - RNA, 20 nt, Homo sapiens
cagcagaagauuuucaagaa

SEQ ID NO: 563679 - RNA, 21 nt, Homo sapiens
cagcagaagccuccaagcaca

SEQ ID NO: 563680 - RNA, 14 nt, Homo sapiens
cagcagacuaugaa

SEQ ID NO: 563681 - RNA, 13 nt, Homo sapiens
cagcagacugacc

SEQ ID NO: 563682 - RNA, 23 nt, Homo sapiens
cagcagagaagcuguaggacugu

SEQ ID NO: 563683 - RNA, 15 nt, Homo sapiens
cagcagagcauucag

SEQ ID NO: 563684 - RNA, 13 nt, Homo sapiens
cagcagagcccac

SEQ ID NO: 563685 - RNA, 16 nt, Homo sapiens
cagcagcccaagcuua

SEQ ID NO: 563686 - RNA, 21 nt, Homo sapiens
cagcagcucaggcacacuucu

SEQ ID NO: 563687 - RNA, 12 nt, Homo sapiens
cagcagcugaac

SEQ ID NO: 563688 - RNA, 15 nt, Homo sapiens
cagcaggaagccuuc

SEQ ID NO: 563689 - RNA, 18 nt, Homo sapiens
cagcaggaccugugcuuu

SEQ ID NO: 563690 - RNA, 16 nt, Homo sapiens
cagcaggcccagcaug

SEQ ID NO: 563691 - RNA, 16 nt, Homo sapiens
cagcagggaugcccug

SEQ ID NO: 563692 - RNA, 21 nt, Homo sapiens
cagcagggucuugcuguaacu

SEQ ID NO: 563693 - RNA, 11 nt, Homo sapiens
cagcaguauug

SEQ ID NO: 563694 - RNA, 17 nt, Homo sapiens
cagcagucuaguucuuu

SEQ ID NO: 563695 - RNA, 14 nt, Homo sapiens
cagcagugaaugcu

SEQ ID NO: 563696 - RNA, 23 nt, Homo sapiens
cagcagugaguaaucaauacaga

SEQ ID NO: 563697 - RNA, 15 nt, Homo sapiens
cagcagugaucucag

SEQ ID NO: 563698 - RNA, 15 nt, Homo sapiens
cagcagugccuugug

SEQ ID NO: 563699 - RNA, 18 nt, Homo sapiens
cagcagugccuugugcaa

SEQ ID NO: 563700 - RNA, 13 nt, Homo sapiens
cagcauacgucag

SEQ ID NO: 563701 - RNA, 22 nt, Homo sapiens
cagcauaguacuggcacaaaaa

SEQ ID NO: 563702 - RNA, 21 nt, Homo sapiens
cagcaugaaaaugcaguuucu

SEQ ID NO: 563703 - RNA, 22 nt, Homo sapiens
cagcaugaggacagaccacaga

SEQ ID NO: 563704 - RNA, 13 nt, Homo sapiens
cagcaugccccuu

SEQ ID NO: 563705 - RNA, 21 nt, Homo sapiens
cagcauggguccuugaugcca

SEQ ID NO: 563706 - RNA, 18 nt, Homo sapiens
cagcauguacggauuuuc

SEQ ID NO: 563707 - RNA, 17 nt, Homo sapiens
cagcauucucacuccua

SEQ ID NO: 563708 - RNA, 11 nt, Homo sapiens
cagcauugcag

SEQ ID NO: 563709 - RNA, 14 nt, Homo sapiens
cagcauugccuagg

SEQ ID NO: 563710 - RNA, 12 nt, Homo sapiens
cagcauuugacc

SEQ ID NO: 563711 - RNA, 14 nt, Homo sapiens
cagcauuuguccuu

SEQ ID NO: 563712 - RNA, 19 nt, Homo sapiens
cagcauuuuagaaacuaca

SEQ ID NO: 563713 - RNA, 18 nt, Homo sapiens
cagccaaacugucuuugu

SEQ ID NO: 563714 - RNA, 16 nt, Homo sapiens
cagccaaaugcaggga

SEQ ID NO: 563715 - RNA, 14 nt, Homo sapiens
cagccaacauguga

SEQ ID NO: 563716 - RNA, 20 nt, Homo sapiens
cagccaagccagucaaggau

SEQ ID NO: 563717 - RNA, 18 nt, Homo sapiens
cagccacagguacagagc

SEQ ID NO: 563718 - RNA, 12 nt, Homo sapiens
cagccacagugu

SEQ ID NO: 563719 - RNA, 17 nt, Homo sapiens
cagccacaguguuaugc

SEQ ID NO: 563720 - RNA, 16 nt, Homo sapiens
cagccaccacaucccu

SEQ ID NO: 563721 - RNA, 21 nt, Homo sapiens
cagccaccacccacaaucaca

SEQ ID NO: 563722 - RNA, 22 nt, Homo sapiens
cagccaccagggaguggccauu

SEQ ID NO: 563723 - RNA, 20 nt, Homo sapiens
cagccaccauccuauugcaa

SEQ ID NO: 563724 - RNA, 14 nt, Homo sapiens
cagccacccaagcc

SEQ ID NO: 563725 - RNA, 16 nt, Homo sapiens
cagccaccccugagau

SEQ ID NO: 563726 - RNA, 22 nt, Homo sapiens
cagccaccguuucuuccugcca

SEQ ID NO: 563727 - RNA, 19 nt, Homo sapiens
cagccaccucccucugcca

SEQ ID NO: 563728 - RNA, 15 nt, Homo sapiens
cagccacgacugcca

SEQ ID NO: 563729 - RNA, 14 nt, Homo sapiens
cagggggaaggugg

SEQ ID NO: 563730 - RNA, 23 nt, Homo sapiens
cagggggaaguucagaaggugug

SEQ ID NO: 563731 - RNA, 15 nt, Homo sapiens
cagggggccagcugg

SEQ ID NO: 563732 - RNA, 16 nt, Homo sapiens
cagggguacauucuag

SEQ ID NO: 563733 - RNA, 17 nt, Homo sapiens
cagggguccacugugag

SEQ ID NO: 563734 - RNA, 19 nt, Homo sapiens
caggguaggggagcauucu

SEQ ID NO: 563735 - RNA, 14 nt, Homo sapiens
caggguagugcagg

SEQ ID NO: 563736 - RNA, 19 nt, Homo sapiens
caggguaucccagaccccu

SEQ ID NO: 563737 - RNA, 21 nt, Homo sapiens
cagggucucacucuguugccc

SEQ ID NO: 563738 - RNA, 12 nt, Homo sapiens
cagggucugcuc

SEQ ID NO: 563739 - RNA, 16 nt, Homo sapiens
cagggucuugcuguaa

SEQ ID NO: 563740 - RNA, 15 nt, Homo sapiens
cagggugcagcccaa

SEQ ID NO: 563741 - RNA, 19 nt, Homo sapiens
caggguggcugugguccua

SEQ ID NO: 563742 - RNA, 22 nt, Homo sapiens
caggguggggggugacagugcc

SEQ ID NO: 563743 - RNA, 20 nt, Homo sapiens
caggguugaucacacucugg

SEQ ID NO: 563744 - RNA, 23 nt, Homo sapiens
caggguuuacccagugggacaga

SEQ ID NO: 563745 - RNA, 20 nt, Homo sapiens
caggguuucaccauguugcc

SEQ ID NO: 563746 - RNA, 21 nt, Homo sapiens
caggguuucaccauguuggcc

SEQ ID NO: 563747 - RNA, 16 nt, Homo sapiens
cagguaaaacagggcc

SEQ ID NO: 563748 - RNA, 20 nt, Homo sapiens
cagguacagaaaacauguuu

SEQ ID NO: 563749 - RNA, 23 nt, Homo sapiens
cagguacaguaggauaagccacu

SEQ ID NO: 563750 - RNA, 20 nt, Homo sapiens
cagguaccaucuuguauaca

SEQ ID NO: 563751 - RNA, 19 nt, Homo sapiens
cagguagcugggauuacag

SEQ ID NO: 563752 - RNA, 16 nt, Homo sapiens
cagguaguacugggaa

SEQ ID NO: 563753 - RNA, 19 nt, Homo sapiens
caggucauuauuuuuuaca

SEQ ID NO: 563754 - RNA, 13 nt, Homo sapiens
cagguccauuuag

SEQ ID NO: 563755 - RNA, 21 nt, Homo sapiens
cagguccgugggccguaucug

SEQ ID NO: 563756 - RNA, 19 nt, Homo sapiens
cagguccucuacuuaauga

SEQ ID NO: 563757 - RNA, 14 nt, Homo sapiens
caggucuagacuuu

SEQ ID NO: 563758 - RNA, 20 nt, Homo sapiens
caggucuuccugcuuuccau

SEQ ID NO: 563759 - RNA, 14 nt, Homo sapiens
caggucuugacuca

SEQ ID NO: 563760 - RNA, 22 nt, Homo sapiens
caggucuugacucauggcagcu

SEQ ID NO: 563761 - RNA, 20 nt, Homo sapiens
caggucuuuccuaaggcugc

SEQ ID NO: 563762 - RNA, 15 nt, Homo sapiens
caggugaaaauccau

SEQ ID NO: 563763 - RNA, 13 nt, Homo sapiens
caggugaguguga

SEQ ID NO: 563764 - RNA, 16 nt, Homo sapiens
caggugauccacccac

SEQ ID NO: 563765 - RNA, 22 nt, Homo sapiens
caggugauccacccaccuuggc

SEQ ID NO: 563766 - RNA, 17 nt, Homo sapiens
caggugauccaccugcc

SEQ ID NO: 563767 - RNA, 13 nt, Homo sapiens
caggugcacacau

SEQ ID NO: 563768 - RNA, 14 nt, Homo sapiens
caggugcauagcaa

SEQ ID NO: 563769 - RNA, 22 nt, Homo sapiens
caggugccuccaggugugcacg

SEQ ID NO: 563770 - RNA, 23 nt, Homo sapiens
caggugccuuguccucagggcua

SEQ ID NO: 563771 - RNA, 20 nt, Homo sapiens
caggugcgcgccaccgugcc

SEQ ID NO: 563772 - RNA, 19 nt, Homo sapiens
caggugcuacaacauguga

SEQ ID NO: 563773 - RNA, 15 nt, Homo sapiens
caggugcuuguucug

SEQ ID NO: 563774 - RNA, 16 nt, Homo sapiens
cagguggcaucucuaa

SEQ ID NO: 563775 - RNA, 22 nt, Homo sapiens
cagguggccccaguucaaucuc

SEQ ID NO: 563776 - RNA, 15 nt, Homo sapiens
caggugggaaauggu

SEQ ID NO: 563777 - RNA, 17 nt, Homo sapiens
caggugggacuuagcag

SEQ ID NO: 563778 - RNA, 14 nt, Homo sapiens
cagguggugcaaau

SEQ ID NO: 563779 - RNA, 15 nt, Homo sapiens
caggugguggcacug

SEQ ID NO: 563780 - RNA, 15 nt, Homo sapiens
caggugucauaugac

SEQ ID NO: 563781 - RNA, 16 nt, Homo sapiens
caggugucuagacugc

SEQ ID NO: 563782 - RNA, 19 nt, Homo sapiens
caggugugagccaccgugc

SEQ ID NO: 563783 - RNA, 14 nt, Homo sapiens
caggugugccuguu

SEQ ID NO: 563784 - RNA, 20 nt, Homo sapiens
cagguguuacuguaauuccu

SEQ ID NO: 563785 - RNA, 14 nt, Homo sapiens
cagguguugccaaa

SEQ ID NO: 563786 - RNA, 17 nt, Homo sapiens
cagguuauaacaguguu

SEQ ID NO: 563787 - RNA, 16 nt, Homo sapiens
cagguuauacuccucc

SEQ ID NO: 563788 - RNA, 14 nt, Homo sapiens
cagguucacuuugg

SEQ ID NO: 563789 - RNA, 15 nt, Homo sapiens
cagguucccccagca

SEQ ID NO: 563790 - RNA, 21 nt, Homo sapiens
cagguucuucagggccagucc

SEQ ID NO: 563791 - RNA, 13 nt, Homo sapiens
cagguucuugccu

SEQ ID NO: 563792 - RNA, 17 nt, Homo sapiens
cagguuuaacauuugcc

SEQ ID NO: 563793 - RNA, 15 nt, Homo sapiens
caguaaaaauggaaa

SEQ ID NO: 563794 - RNA, 22 nt, Homo sapiens
caguaaaaauggaaacuauauu

SEQ ID NO: 563795 - RNA, 16 nt, Homo sapiens
caguaaaauacuauuc

SEQ ID NO: 563796 - RNA, 20 nt, Homo sapiens
caguaaaauacuauucucau

SEQ ID NO: 563797 - RNA, 13 nt, Homo sapiens
caguaaacgggaa

SEQ ID NO: 563798 - RNA, 19 nt, Homo sapiens
caguaaacgggaacaugcc

SEQ ID NO: 563799 - RNA, 21 nt, Homo sapiens
caguaaacuuuggcuuauaaa

SEQ ID NO: 563800 - RNA, 18 nt, Homo sapiens
caguaaauaacuggaaaa

SEQ ID NO: 563801 - RNA, 18 nt, Homo sapiens
caguaaauccucauuuga

SEQ ID NO: 563802 - RNA, 19 nt, Homo sapiens
caguaaauguacaacugca

SEQ ID NO: 563803 - RNA, 21 nt, Homo sapiens
caguaacauuuuucucagugc

SEQ ID NO: 563804 - RNA, 15 nt, Homo sapiens
caguaaccaugcccg

SEQ ID NO: 563805 - RNA, 10 nt, Homo sapiens
caguaacuga

SEQ ID NO: 563806 - RNA, 16 nt, Homo sapiens
caguaacugugacuga

SEQ ID NO: 563807 - RNA, 12 nt, Homo sapiens
caguaagccaag

SEQ ID NO: 563808 - RNA, 17 nt, Homo sapiens
caguaagcuaucuucaa

SEQ ID NO: 563809 - RNA, 20 nt, Homo sapiens
caguaagcugcucuauugua

SEQ ID NO: 563810 - RNA, 16 nt, Homo sapiens
caguaaucccauuucc

SEQ ID NO: 563811 - RNA, 16 nt, Homo sapiens
caguaaucugagcagu

SEQ ID NO: 563812 - RNA, 14 nt, Homo sapiens
caguaauguuccuc

SEQ ID NO: 563813 - RNA, 22 nt, Homo sapiens
caguaauuccuguuacuuuaca

SEQ ID NO: 563814 - RNA, 19 nt, Homo sapiens
caguacaacccauaaucau

SEQ ID NO: 563815 - RNA, 16 nt, Homo sapiens
caguacacucuggcca

SEQ ID NO: 563816 - RNA, 14 nt, Homo sapiens
caguacagaaggca

SEQ ID NO: 563817 - RNA, 16 nt, Homo sapiens
caguacaggacauaua

SEQ ID NO: 563818 - RNA, 22 nt, Homo sapiens
caguacccacucuggagcauuu

SEQ ID NO: 563819 - RNA, 18 nt, Homo sapiens
caguacccucucagcucc

SEQ ID NO: 563820 - RNA, 17 nt, Homo sapiens
caguacuuccugcagua

SEQ ID NO: 563821 - RNA, 17 nt, Homo sapiens
caguacuuuauuguaca

SEQ ID NO: 563822 - RNA, 14 nt, Homo sapiens
caguagaagcucac

SEQ ID NO: 563823 - RNA, 17 nt, Homo sapiens
caguagaagcucacaaa

SEQ ID NO: 563824 - RNA, 15 nt, Homo sapiens
caguagagcucuacu

SEQ ID NO: 563825 - RNA, 16 nt, Homo sapiens
caguagagucaucucc

SEQ ID NO: 563826 - RNA, 15 nt, Homo sapiens
caguagcacaaguua

SEQ ID NO: 563827 - RNA, 14 nt, Homo sapiens
caguagcauuugcu

SEQ ID NO: 563828 - RNA, 20 nt, Homo sapiens
caguagggaggucagugcuu

SEQ ID NO: 563829 - RNA, 15 nt, Homo sapiens
caguauaauuguguu

SEQ ID NO: 563830 - RNA, 17 nt, Homo sapiens
caguaucccacauccaa

SEQ ID NO: 563831 - RNA, 12 nt, Homo sapiens
caguaucugauc

SEQ ID NO: 563832 - RNA, 22 nt, Homo sapiens
caguaugagucaaugugcagug

SEQ ID NO: 563833 - RNA, 18 nt, Homo sapiens
caguauuagaugcacuua

SEQ ID NO: 563834 - RNA, 18 nt, Homo sapiens
caguauuaucuaaaugaa

SEQ ID NO: 563835 - RNA, 13 nt, Homo sapiens
caguauucucaga

SEQ ID NO: 563836 - RNA, 23 nt, Homo sapiens
caguauuuagaagccaacuauga

SEQ ID NO: 563837 - RNA, 18 nt, Homo sapiens
caguauuuuccagccuua

SEQ ID NO: 563838 - RNA, 17 nt, Homo sapiens
cagucaaggugauauau

SEQ ID NO: 563839 - RNA, 19 nt, Homo sapiens
cagucacaacagagugaaa

SEQ ID NO: 563840 - RNA, 21 nt, Homo sapiens
cagucaccuucugggcaaggg

SEQ ID NO: 563841 - RNA, 16 nt, Homo sapiens
cagucacugacaguua

SEQ ID NO: 563842 - RNA, 15 nt, Homo sapiens
cagucacugacucaa

SEQ ID NO: 563843 - RNA, 14 nt, Homo sapiens
cagucacuguggug

SEQ ID NO: 563844 - RNA, 21 nt, Homo sapiens
cagucagaguccagugcucug

SEQ ID NO: 563845 - RNA, 16 nt, Homo sapiens
cagucaggguucacuu

SEQ ID NO: 563846 - RNA, 21 nt, Homo sapiens
cagucauaacuaaauaaagcu

SEQ ID NO: 563847 - RNA, 14 nt, Homo sapiens
cagucauguaugca

SEQ ID NO: 563848 - RNA, 20 nt, Homo sapiens
cagucauuauuagcuuuuau

SEQ ID NO: 563849 - RNA, 13 nt, Homo sapiens
caguccaaauggc

SEQ ID NO: 563850 - RNA, 22 nt, Homo sapiens
caguccaaccagaaacaccccu

SEQ ID NO: 563851 - RNA, 19 nt, Homo sapiens
caucugccuuaaaaccaaa

SEQ ID NO: 563852 - RNA, 14 nt, Homo sapiens
caucugcugugguc

SEQ ID NO: 563853 - RNA, 15 nt, Homo sapiens
caucuggaaucugga

SEQ ID NO: 563854 - RNA, 22 nt, Homo sapiens
caucuggggcaccugcuuccac

SEQ ID NO: 563855 - RNA, 16 nt, Homo sapiens
caucugguaucaucuu

SEQ ID NO: 563856 - RNA, 21 nt, Homo sapiens
caucuggucuuguuuccagga

SEQ ID NO: 563857 - RNA, 14 nt, Homo sapiens
caucuguccagagg

SEQ ID NO: 563858 - RNA, 13 nt, Homo sapiens
caucugucugucu

SEQ ID NO: 563859 - RNA, 18 nt, Homo sapiens
caucugucuucagcacau

SEQ ID NO: 563860 - RNA, 14 nt, Homo sapiens
caucugugccagag

SEQ ID NO: 563861 - RNA, 11 nt, Homo sapiens
caucuguggag

SEQ ID NO: 563862 - RNA, 15 nt, Homo sapiens
caucuguguaaagug

SEQ ID NO: 563863 - RNA, 20 nt, Homo sapiens
caucuguuguucugugguca

SEQ ID NO: 563864 - RNA, 12 nt, Homo sapiens
caucuuaaacua

SEQ ID NO: 563865 - RNA, 14 nt, Homo sapiens
caucuuaccucuca

SEQ ID NO: 563866 - RNA, 15 nt, Homo sapiens
caucuuagaccucca

SEQ ID NO: 563867 - RNA, 15 nt, Homo sapiens
caucuucacuacaaa

SEQ ID NO: 563868 - RNA, 20 nt, Homo sapiens
caucuucacucuucacuuga

SEQ ID NO: 563869 - RNA, 15 nt, Homo sapiens
caucuuccaccucac

SEQ ID NO: 563870 - RNA, 13 nt, Homo sapiens
caucuucuagaau

SEQ ID NO: 563871 - RNA, 14 nt, Homo sapiens
caucuucuggaguc

SEQ ID NO: 563872 - RNA, 16 nt, Homo sapiens
caucuugcaagcaaau

SEQ ID NO: 563873 - RNA, 14 nt, Homo sapiens
caucuugcuaccag

SEQ ID NO: 563874 - RNA, 19 nt, Homo sapiens
caucuuguaggaucuacuu

SEQ ID NO: 563875 - RNA, 23 nt, Homo sapiens
caucuugugguaacuugcugcuu

SEQ ID NO: 563876 - RNA, 14 nt, Homo sapiens
caucuuuaacacag

SEQ ID NO: 563877 - RNA, 21 nt, Homo sapiens
caucuuuaucaugaagcacau

SEQ ID NO: 563878 - RNA, 12 nt, Homo sapiens
caucuuucacau

SEQ ID NO: 563879 - RNA, 20 nt, Homo sapiens
caucuuuccugcccugccuu

SEQ ID NO: 563880 - RNA, 14 nt, Homo sapiens
caucuuuggcugag

SEQ ID NO: 563881 - RNA, 23 nt, Homo sapiens
caucuuuguggcgggagugcuca

SEQ ID NO: 563882 - RNA, 16 nt, Homo sapiens
caucuuuguugauguu

SEQ ID NO: 563883 - RNA, 15 nt, Homo sapiens
caugaaaaacacggc

SEQ ID NO: 563884 - RNA, 14 nt, Homo sapiens
caugaaaacacuug

SEQ ID NO: 563885 - RNA, 15 nt, Homo sapiens
caugaaaaugacauu

SEQ ID NO: 563886 - RNA, 19 nt, Homo sapiens
caugaaaauuuuaaaaaua

SEQ ID NO: 563887 - RNA, 19 nt, Homo sapiens
caugaaaccaaaaagagac

SEQ ID NO: 563888 - RNA, 19 nt, Homo sapiens
caugaaaguggacaaggag

SEQ ID NO: 563889 - RNA, 22 nt, Homo sapiens
caugaaaugucuggucugucca

SEQ ID NO: 563890 - RNA, 22 nt, Homo sapiens
caugaacaucauggacugagcu

SEQ ID NO: 563891 - RNA, 22 nt, Homo sapiens
caugaacaucuuuaggagacua

SEQ ID NO: 563892 - RNA, 20 nt, Homo sapiens
caugaagaauguuucuggaa

SEQ ID NO: 563893 - RNA, 16 nt, Homo sapiens
caugaagauucuuucc

SEQ ID NO: 563894 - RNA, 19 nt, Homo sapiens
caugaagcacaucaauuac

SEQ ID NO: 563895 - RNA, 15 nt, Homo sapiens
caugaaggaugccaa

SEQ ID NO: 563896 - RNA, 17 nt, Homo sapiens
caugaaggcagagccau

SEQ ID NO: 563897 - RNA, 21 nt, Homo sapiens
caugaagggagggucccugug

SEQ ID NO: 563898 - RNA, 10 nt, Homo sapiens
caugaaggug

SEQ ID NO: 563899 - RNA, 19 nt, Homo sapiens
caugaaguaauaugcacac

SEQ ID NO: 563900 - RNA, 16 nt, Homo sapiens
caugaauaacauuuaa

SEQ ID NO: 563901 - RNA, 22 nt, Homo sapiens
caugaauaacauuuaaauucca

SEQ ID NO: 563902 - RNA, 21 nt, Homo sapiens
caugaauauaaaugggaaauc

SEQ ID NO: 563903 - RNA, 16 nt, Homo sapiens
caugaauuaguucucc

SEQ ID NO: 563904 - RNA, 17 nt, Homo sapiens
caugaauuaguucuccu

SEQ ID NO: 563905 - RNA, 13 nt, Homo sapiens
caugacauaugac

SEQ ID NO: 563906 - RNA, 15 nt, Homo sapiens
caugaccacauagaa

SEQ ID NO: 563907 - RNA, 21 nt, Homo sapiens
caugaccacugggccugcuag

SEQ ID NO: 563908 - RNA, 18 nt, Homo sapiens
caugaccagaaacaggga

SEQ ID NO: 563909 - RNA, 23 nt, Homo sapiens
caugacccuuguggcacagaugc

SEQ ID NO: 563910 - RNA, 18 nt, Homo sapiens
caugaccugugaccagca

SEQ ID NO: 563911 - RNA, 15 nt, Homo sapiens
caugacguaguauua

SEQ ID NO: 563912 - RNA, 15 nt, Homo sapiens
caugacguguuucuu

SEQ ID NO: 563913 - RNA, 21 nt, Homo sapiens
caugacucggggguggggaaa

SEQ ID NO: 563914 - RNA, 20 nt, Homo sapiens
caugacucguauaugucuca

SEQ ID NO: 563915 - RNA, 20 nt, Homo sapiens
caugacugcauuuuacugua

SEQ ID NO: 563916 - RNA, 20 nt, Homo sapiens
caugacuuauuaugcauaaa

SEQ ID NO: 563917 - RNA, 18 nt, Homo sapiens
caugacuuuauauggaug

SEQ ID NO: 563918 - RNA, 14 nt, Homo sapiens
caugagaaagggag

SEQ ID NO: 563919 - RNA, 19 nt, Homo sapiens
caugagaccacuguuauca

SEQ ID NO: 563920 - RNA, 14 nt, Homo sapiens
caugagccacugca

SEQ ID NO: 563921 - RNA, 17 nt, Homo sapiens
caugaggacagaccaca

SEQ ID NO: 563922 - RNA, 20 nt, Homo sapiens
caugaggagggaaaagagug

SEQ ID NO: 563923 - RNA, 17 nt, Homo sapiens
caugagguacagcagaa

SEQ ID NO: 563924 - RNA, 19 nt, Homo sapiens
caugaguccaugagucuaa

SEQ ID NO: 563925 - RNA, 15 nt, Homo sapiens
caugaguccuugaaa

SEQ ID NO: 563926 - RNA, 15 nt, Homo sapiens
caugaucauagcuca

SEQ ID NO: 563927 - RNA, 22 nt, Homo sapiens
caugaucgcuuucuacacugua

SEQ ID NO: 563928 - RNA, 19 nt, Homo sapiens
caugaucuuguuacuguga

SEQ ID NO: 563929 - RNA, 14 nt, Homo sapiens
caugaugagaguuu

SEQ ID NO: 563930 - RNA, 13 nt, Homo sapiens
caugaugcugccc

SEQ ID NO: 563931 - RNA, 20 nt, Homo sapiens
caugauggccuuacacugaa

SEQ ID NO: 563932 - RNA, 17 nt, Homo sapiens
caugauguauuguugcu

SEQ ID NO: 563933 - RNA, 18 nt, Homo sapiens
caugauguauuguugcuu

SEQ ID NO: 563934 - RNA, 23 nt, Homo sapiens
caugaugugaagaguuucacaaa

SEQ ID NO: 563935 - RNA, 19 nt, Homo sapiens
caugauguuaaccagaaua

SEQ ID NO: 563936 - RNA, 16 nt, Homo sapiens
caugauuagauugcaa

SEQ ID NO: 563937 - RNA, 17 nt, Homo sapiens
caugauuagauugcaaa

SEQ ID NO: 563938 - RNA, 14 nt, Homo sapiens
caugauucuuuaau

SEQ ID NO: 563939 - RNA, 22 nt, Homo sapiens
caugauuucauuucaacuguuu

SEQ ID NO: 563940 - RNA, 17 nt, Homo sapiens
caugauuuccuugaaug

SEQ ID NO: 563941 - RNA, 10 nt, Homo sapiens
caugcaaaau

SEQ ID NO: 563942 - RNA, 15 nt, Homo sapiens
caugcaaaauauguu

SEQ ID NO: 563943 - RNA, 19 nt, Homo sapiens
caugcaaggggaaaaucuc

SEQ ID NO: 563944 - RNA, 16 nt, Homo sapiens
caugcaaugccaaaua

SEQ ID NO: 563945 - RNA, 11 nt, Homo sapiens
caugcacacac

SEQ ID NO: 563946 - RNA, 22 nt, Homo sapiens
caugcacacacacacaucucau

SEQ ID NO: 563947 - RNA, 12 nt, Homo sapiens
caugcacugagg

SEQ ID NO: 563948 - RNA, 13 nt, Homo sapiens
caugcacugaugu

SEQ ID NO: 563949 - RNA, 15 nt, Homo sapiens
caugcagaacaccaa

SEQ ID NO: 563950 - RNA, 22 nt, Homo sapiens
caugcagcggccugagcaguac

SEQ ID NO: 563951 - RNA, 23 nt, Homo sapiens
caugcaggcccuuugaagccuca

SEQ ID NO: 563952 - RNA, 15 nt, Homo sapiens
caugcauacuuuauu

SEQ ID NO: 563953 - RNA, 18 nt, Homo sapiens
caugcauguccuguaaag

SEQ ID NO: 563954 - RNA, 11 nt, Homo sapiens
caugcauuuga

SEQ ID NO: 563955 - RNA, 18 nt, Homo sapiens
caugccagacccacugaa

SEQ ID NO: 563956 - RNA, 14 nt, Homo sapiens
caugcccaugauga

SEQ ID NO: 563957 - RNA, 18 nt, Homo sapiens
caugccccuggaccagua

SEQ ID NO: 563958 - RNA, 15 nt, Homo sapiens
caugcccuccaugug

SEQ ID NO: 563959 - RNA, 22 nt, Homo sapiens
caugcccucccaggacccucca

SEQ ID NO: 563960 - RNA, 17 nt, Homo sapiens
caugcccuguaccugug

SEQ ID NO: 563961 - RNA, 14 nt, Homo sapiens
caugcccugugcaa

SEQ ID NO: 563962 - RNA, 15 nt, Homo sapiens
caugcccugugcaac

SEQ ID NO: 563963 - RNA, 16 nt, Homo sapiens
caugcccugugcaacc

SEQ ID NO: 563964 - RNA, 18 nt, Homo sapiens
caugccgacgcuugcacg

SEQ ID NO: 563965 - RNA, 23 nt, Homo sapiens
caugccucccugggccaccuccu

SEQ ID NO: 563966 - RNA, 16 nt, Homo sapiens
caugccuccucaggag

SEQ ID NO: 563967 - RNA, 15 nt, Homo sapiens
caugccugcaccugc

SEQ ID NO: 563968 - RNA, 17 nt, Homo sapiens
caugccuguagucccag

SEQ ID NO: 563969 - RNA, 15 nt, Homo sapiens
caugcgcacucucau

SEQ ID NO: 563970 - RNA, 15 nt, Homo sapiens
caugcgggugcacac

SEQ ID NO: 563971 - RNA, 17 nt, Homo sapiens
caugcgucgcaaacucu

SEQ ID NO: 563972 - RNA, 21 nt, Homo sapiens
caugcgugccgccugcuccuc

SEQ ID NO: 563973 - RNA, 15 nt, Homo sapiens
cccauccccaccagc

SEQ ID NO: 563974 - RNA, 16 nt, Homo sapiens
cccauccccaccagcu

SEQ ID NO: 563975 - RNA, 24 nt, Homo sapiens
cccauccccuuccuaaauauccaa

SEQ ID NO: 563976 - RNA, 19 nt, Homo sapiens
cccauccccuuuacuauca

SEQ ID NO: 563977 - RNA, 21 nt, Homo sapiens
cccaucggguaagaugcuccu

SEQ ID NO: 563978 - RNA, 19 nt, Homo sapiens
cccaucgguaggcaaagga

SEQ ID NO: 563979 - RNA, 19 nt, Homo sapiens
cccaucgucucggccuuca

SEQ ID NO: 563980 - RNA, 22 nt, Homo sapiens
cccaucgucucggccuucacaa

SEQ ID NO: 563981 - RNA, 12 nt, Homo sapiens
cccaucuaugag

SEQ ID NO: 563982 - RNA, 16 nt, Homo sapiens
cccaucuuuacaaaga

SEQ ID NO: 563983 - RNA, 16 nt, Homo sapiens
cccaugaacacacugu

SEQ ID NO: 563984 - RNA, 23 nt, Homo sapiens
cccaugccuggucccaagacagu

SEQ ID NO: 563985 - RNA, 22 nt, Homo sapiens
cccaugcuuuguaggugucuca

SEQ ID NO: 563986 - RNA, 15 nt, Homo sapiens
cccauggacacucca

SEQ ID NO: 563987 - RNA, 16 nt, Homo sapiens
cccauggacacuccag

SEQ ID NO: 563988 - RNA, 21 nt, Homo sapiens
cccaugggcucccacugcagc

SEQ ID NO: 563989 - RNA, 18 nt, Homo sapiens
cccauggggagacaguug

SEQ ID NO: 563990 - RNA, 13 nt, Homo sapiens
cccaugguggccu

SEQ ID NO: 563991 - RNA, 21 nt, Homo sapiens
cccaugucacugcagauugag

SEQ ID NO: 563992 - RNA, 23 nt, Homo sapiens
cccaugucagauugaauguauuu

SEQ ID NO: 563993 - RNA, 18 nt, Homo sapiens
cccauguccucagcauuu

SEQ ID NO: 563994 - RNA, 17 nt, Homo sapiens
cccauuaaaaugaauuu

SEQ ID NO: 563995 - RNA, 14 nt, Homo sapiens
cccauuacuuugau

SEQ ID NO: 563996 - RNA, 16 nt, Homo sapiens
cccauuagaaugugau

SEQ ID NO: 563997 - RNA, 17 nt, Homo sapiens
cccauuauuauuucugu

SEQ ID NO: 563998 - RNA, 15 nt, Homo sapiens
cccauucuacacaga

SEQ ID NO: 563999 - RNA, 21 nt, Homo sapiens
cccauucucccucucaaggca

SEQ ID NO: 564000 - RNA, 16 nt, Homo sapiens
cccauucuucacucuu

SEQ ID NO: 564001 - RNA, 12 nt, Homo sapiens
cccauucuugca

SEQ ID NO: 564002 - RNA, 22 nt, Homo sapiens
cccauugcaaacauuauuccaa

SEQ ID NO: 564003 - RNA, 17 nt, Homo sapiens
cccauuggugaccugcg

SEQ ID NO: 564004 - RNA, 16 nt, Homo sapiens
cccauugguguuguca

SEQ ID NO: 564005 - RNA, 17 nt, Homo sapiens
cccauuucaauuccugu

SEQ ID NO: 564006 - RNA, 15 nt, Homo sapiens
cccauuucacccaug

SEQ ID NO: 564007 - RNA, 16 nt, Homo sapiens
cccauuugucccagac

SEQ ID NO: 564008 - RNA, 20 nt, Homo sapiens
cccauuugugccagaggaau

SEQ ID NO: 564009 - RNA, 22 nt, Homo sapiens
ccccaaaguaccacacugaguu

SEQ ID NO: 564010 - RNA, 23 nt, Homo sapiens
ccccaacaucucccucccacauu

SEQ ID NO: 564011 - RNA, 16 nt, Homo sapiens
ccccaagacacuuccc

SEQ ID NO: 564012 - RNA, 21 nt, Homo sapiens
ccccaagaggggcgggcucag

SEQ ID NO: 564013 - RNA, 23 nt, Homo sapiens
ccccaaggccuuuccuacaugcc

SEQ ID NO: 564014 - RNA, 19 nt, Homo sapiens
ccccaagguccccccacag

SEQ ID NO: 564015 - RNA, 14 nt, Homo sapiens
ccccaauccaugaa

SEQ ID NO: 564016 - RNA, 16 nt, Homo sapiens
ccccaauuacagggug

SEQ ID NO: 564017 - RNA, 22 nt, Homo sapiens
ccccaauuacagggugacucac

SEQ ID NO: 564018 - RNA, 18 nt, Homo sapiens
ccccaauuucggauuuuu

SEQ ID NO: 564019 - RNA, 15 nt, Homo sapiens
ccccacaaugccaga

SEQ ID NO: 564020 - RNA, 13 nt, Homo sapiens
ccccacaccccag

SEQ ID NO: 564021 - RNA, 21 nt, Homo sapiens
ccccacaggcuggcgcucggc

SEQ ID NO: 564022 - RNA, 14 nt, Homo sapiens
ccccaccaguguag

SEQ ID NO: 564023 - RNA, 21 nt, Homo sapiens
ccccacccacccucugguccu

SEQ ID NO: 564024 - RNA, 19 nt, Homo sapiens
ccccacccccugggcagau

SEQ ID NO: 564025 - RNA, 11 nt, Homo sapiens
ccccaccuacu

SEQ ID NO: 564026 - RNA, 21 nt, Homo sapiens
ccccacuccucuccaccagac

SEQ ID NO: 564027 - RNA, 11 nt, Homo sapiens
ccccacugaca

SEQ ID NO: 564028 - RNA, 17 nt, Homo sapiens
ccccacuucccacuugc

SEQ ID NO: 564029 - RNA, 19 nt, Homo sapiens
ccccagaaaaaggccgggu

SEQ ID NO: 564030 - RNA, 16 nt, Homo sapiens
ccccagaaacagugug

SEQ ID NO: 564031 - RNA, 19 nt, Homo sapiens
ccccagauacauggugaug

SEQ ID NO: 564032 - RNA, 17 nt, Homo sapiens
ccccagcaagagcacaa

SEQ ID NO: 564033 - RNA, 12 nt, Homo sapiens
ccccagcacuug

SEQ ID NO: 564034 - RNA, 14 nt, Homo sapiens
ccccagcauuccag

SEQ ID NO: 564035 - RNA, 17 nt, Homo sapiens
ccccagcauuuccagag

SEQ ID NO: 564036 - RNA, 14 nt, Homo sapiens
ccccagccauccag

SEQ ID NO: 564037 - RNA, 16 nt, Homo sapiens
ccccagcccuccuuau

SEQ ID NO: 564038 - RNA, 15 nt, Homo sapiens
ccccagcccugugga

SEQ ID NO: 564039 - RNA, 19 nt, Homo sapiens
ccccagccugccuuugcca

SEQ ID NO: 564040 - RNA, 23 nt, Homo sapiens
ccccagccugcucccuagccaga

SEQ ID NO: 564041 - RNA, 23 nt, Homo sapiens
ccccagccuggccagacaagaag

SEQ ID NO: 564042 - RNA, 21 nt, Homo sapiens
ccccagcgucugcagggugac

SEQ ID NO: 564043 - RNA, 12 nt, Homo sapiens
ccccagcucaau

SEQ ID NO: 564044 - RNA, 22 nt, Homo sapiens
ccccagcucuggcuuccagaaa

SEQ ID NO: 564045 - RNA, 16 nt, Homo sapiens
ccccaggacucuggca

SEQ ID NO: 564046 - RNA, 16 nt, Homo sapiens
ccccaguaggacaaac

SEQ ID NO: 564047 - RNA, 19 nt, Homo sapiens
ccccaguuuggggugccaa

SEQ ID NO: 564048 - RNA, 21 nt, Homo sapiens
ccccaucaucccagcugcucc

SEQ ID NO: 564049 - RNA, 15 nt, Homo sapiens
ccccauccagccaga

SEQ ID NO: 564050 - RNA, 21 nt, Homo sapiens
ccccauccuucuccaccaaag

SEQ ID NO: 564051 - RNA, 19 nt, Homo sapiens
ccccaucuugaucuuugag

SEQ ID NO: 564052 - RNA, 21 nt, Homo sapiens
ccccaugggaucuugagggac

SEQ ID NO: 564053 - RNA, 23 nt, Homo sapiens
ccccauguaucucaguaccccau

SEQ ID NO: 564054 - RNA, 15 nt, Homo sapiens
ccccauuccugggaa

SEQ ID NO: 564055 - RNA, 11 nt, Homo sapiens
ccccauuucag

SEQ ID NO: 564056 - RNA, 20 nt, Homo sapiens
ccccauuucaggugugagau

SEQ ID NO: 564057 - RNA, 20 nt, Homo sapiens
ccccauuuccccgauguccc

SEQ ID NO: 564058 - RNA, 15 nt, Homo sapiens
cccccaagccugggc

SEQ ID NO: 564059 - RNA, 21 nt, Homo sapiens
cccccaaugacacccaugcca

SEQ ID NO: 564060 - RNA, 13 nt, Homo sapiens
cccccaccaugca

SEQ ID NO: 564061 - RNA, 16 nt, Homo sapiens
cccccacccaccucca

SEQ ID NO: 564062 - RNA, 20 nt, Homo sapiens
cccccagaacauacacugug

SEQ ID NO: 564063 - RNA, 21 nt, Homo sapiens
cccccagccugccuuugccac

SEQ ID NO: 564064 - RNA, 18 nt, Homo sapiens
cccccagccuuguuucug

SEQ ID NO: 564065 - RNA, 14 nt, Homo sapiens
cccccagcgucagu

SEQ ID NO: 564066 - RNA, 20 nt, Homo sapiens
cccccaggcuggagugcagu

SEQ ID NO: 564067 - RNA, 19 nt, Homo sapiens
cccccaugggcuguguccu

SEQ ID NO: 564068 - RNA, 12 nt, Homo sapiens
cccccauuagaa

SEQ ID NO: 564069 - RNA, 18 nt, Homo sapiens
cccccauucacuuuguca

SEQ ID NO: 564070 - RNA, 17 nt, Homo sapiens
ccccccaacacugugcc

SEQ ID NO: 564071 - RNA, 12 nt, Homo sapiens
cccccccggagc

SEQ ID NO: 564072 - RNA, 17 nt, Homo sapiens
cccccgagccccagucu

SEQ ID NO: 564073 - RNA, 18 nt, Homo sapiens
cccccgcggguucuagac

SEQ ID NO: 564074 - RNA, 14 nt, Homo sapiens
cccccugccagucu

SEQ ID NO: 564075 - RNA, 15 nt, Homo sapiens
cccccugccagugcc

SEQ ID NO: 564076 - RNA, 14 nt, Homo sapiens
cccccuggagagaa

SEQ ID NO: 564077 - RNA, 19 nt, Homo sapiens
cccccuguagacuagugcc

SEQ ID NO: 564078 - RNA, 12 nt, Homo sapiens
cccccugugcag

SEQ ID NO: 564079 - RNA, 12 nt, Homo sapiens
cccccuugaggg

SEQ ID NO: 564080 - RNA, 20 nt, Homo sapiens
cccccuugccuccgugccca

SEQ ID NO: 564081 - RNA, 20 nt, Homo sapiens
cccccuuuagcgggacucag

SEQ ID NO: 564082 - RNA, 16 nt, Homo sapiens
ccccgacacacggggc

SEQ ID NO: 564083 - RNA, 21 nt, Homo sapiens
ccccgacacccagcccagcuu

SEQ ID NO: 564084 - RNA, 20 nt, Homo sapiens
ccccgaccccccuaccccau

SEQ ID NO: 564085 - RNA, 13 nt, Homo sapiens
ccccgccuccagu

SEQ ID NO: 564086 - RNA, 12 nt, Homo sapiens
ccccggcccacc

SEQ ID NO: 564087 - RNA, 12 nt, Homo sapiens
ccccggggacuc

SEQ ID NO: 564088 - RNA, 12 nt, Homo sapiens
ccccguagcucc

SEQ ID NO: 564089 - RNA, 21 nt, Homo sapiens
ccccuagaauaaucucauccc

SEQ ID NO: 564090 - RNA, 18 nt, Homo sapiens
ccccucaacaccucugca

SEQ ID NO: 564091 - RNA, 16 nt, Homo sapiens
ccccucagaugaucuc

SEQ ID NO: 564092 - RNA, 20 nt, Homo sapiens
ccccucauucagagacugcc

SEQ ID NO: 564093 - RNA, 20 nt, Homo sapiens
ccccucauuguuuauuaaca

SEQ ID NO: 564094 - RNA, 13 nt, Homo sapiens
ccccuccaaaacc

SEQ ID NO: 564095 - RNA, 18 nt, Homo sapiens
ccuaaugugaucauauga

SEQ ID NO: 564096 - RNA, 16 nt, Homo sapiens
ccuaauguguuuagau

SEQ ID NO: 564097 - RNA, 23 nt, Homo sapiens
ccuaauucacacaaagacuccuu

SEQ ID NO: 564098 - RNA, 16 nt, Homo sapiens
ccuaauuuaugugcua

SEQ ID NO: 564099 - RNA, 23 nt, Homo sapiens
ccuacaaggcuggcagugacaga

SEQ ID NO: 564100 - RNA, 23 nt, Homo sapiens
ccuacaauguuguauuuguuauu

SEQ ID NO: 564101 - RNA, 19 nt, Homo sapiens
ccuacagaacuucagaaag

SEQ ID NO: 564102 - RNA, 21 nt, Homo sapiens
ccuacagaagggcagugacuc

SEQ ID NO: 564103 - RNA, 12 nt, Homo sapiens
ccuacagaauuu

SEQ ID NO: 564104 - RNA, 12 nt, Homo sapiens
ccuacagccagc

SEQ ID NO: 564105 - RNA, 12 nt, Homo sapiens
ccuacauguauu

SEQ ID NO: 564106 - RNA, 21 nt, Homo sapiens
ccuacauguauugcacauugu

SEQ ID NO: 564107 - RNA, 13 nt, Homo sapiens
ccuacauuaucuc

SEQ ID NO: 564108 - RNA, 15 nt, Homo sapiens
ccuaccaaaauggaa

SEQ ID NO: 564109 - RNA, 23 nt, Homo sapiens
ccuaccaguuggccaugaugucu

SEQ ID NO: 564110 - RNA, 15 nt, Homo sapiens
ccuacccacuggucu

SEQ ID NO: 564111 - RNA, 20 nt, Homo sapiens
ccuacccauacuuuguacaa

SEQ ID NO: 564112 - RNA, 15 nt, Homo sapiens
ccuacccuuggcagu

SEQ ID NO: 564113 - RNA, 19 nt, Homo sapiens
ccuacccuuggugccuaau

SEQ ID NO: 564114 - RNA, 21 nt, Homo sapiens
ccuaccucacagagugcauug

SEQ ID NO: 564115 - RNA, 14 nt, Homo sapiens
ccuacggagucagc

SEQ ID NO: 564116 - RNA, 15 nt, Homo sapiens
ccuacguauccugca

SEQ ID NO: 564117 - RNA, 16 nt, Homo sapiens
ccuacguauccugcag

SEQ ID NO: 564118 - RNA, 17 nt, Homo sapiens
ccuacguucucuuuaaa

SEQ ID NO: 564119 - RNA, 18 nt, Homo sapiens
ccuacugagcauuugcac

SEQ ID NO: 564120 - RNA, 16 nt, Homo sapiens
ccuacuugauaauauu

SEQ ID NO: 564121 - RNA, 19 nt, Homo sapiens
ccuagaaagccauauucca

SEQ ID NO: 564122 - RNA, 13 nt, Homo sapiens
ccuagaaauaucu

SEQ ID NO: 564123 - RNA, 17 nt, Homo sapiens
ccuagaauaaucucauc

SEQ ID NO: 564124 - RNA, 23 nt, Homo sapiens
ccuagaccagcagacagagccag

SEQ ID NO: 564125 - RNA, 13 nt, Homo sapiens
ccuagacuugaaa

SEQ ID NO: 564126 - RNA, 22 nt, Homo sapiens
ccuagacuuugggaucaaauaa

SEQ ID NO: 564127 - RNA, 18 nt, Homo sapiens
ccuagagaaggcugugag

SEQ ID NO: 564128 - RNA, 15 nt, Homo sapiens
ccuagagcacacugu

SEQ ID NO: 564129 - RNA, 13 nt, Homo sapiens
ccuagagcacucu

SEQ ID NO: 564130 - RNA, 22 nt, Homo sapiens
ccuagagcacucucaccccaag

SEQ ID NO: 564131 - RNA, 15 nt, Homo sapiens
ccuagagcuagaugu

SEQ ID NO: 564132 - RNA, 23 nt, Homo sapiens
ccuagagcuccaguucuuuauaa

SEQ ID NO: 564133 - RNA, 23 nt, Homo sapiens
ccuagagucuuaaagcauuucag

SEQ ID NO: 564134 - RNA, 16 nt, Homo sapiens
ccuagauagcuauuaa

SEQ ID NO: 564135 - RNA, 22 nt, Homo sapiens
ccuagauuagguagacuuugcu

SEQ ID NO: 564136 - RNA, 13 nt, Homo sapiens
ccuagcaaaagug

SEQ ID NO: 564137 - RNA, 13 nt, Homo sapiens
ccuagcaacauau

SEQ ID NO: 564138 - RNA, 20 nt, Homo sapiens
ccuagcagaggaaaguguaa

SEQ ID NO: 564139 - RNA, 23 nt, Homo sapiens
ccuagcagcaccguucugugcac

SEQ ID NO: 564140 - RNA, 17 nt, Homo sapiens
ccuagcagccucaaaac

SEQ ID NO: 564141 - RNA, 17 nt, Homo sapiens
ccuagcaggcuguucca

SEQ ID NO: 564142 - RNA, 16 nt, Homo sapiens
ccuagccagaggcucu

SEQ ID NO: 564143 - RNA, 16 nt, Homo sapiens
ccuagcccuucucuca

SEQ ID NO: 564144 - RNA, 17 nt, Homo sapiens
ccuagcucuuacacaua

SEQ ID NO: 564145 - RNA, 21 nt, Homo sapiens
ccuaggaauucccagcccaaa

SEQ ID NO: 564146 - RNA, 21 nt, Homo sapiens
ccuaggacagccuuguuccuc

SEQ ID NO: 564147 - RNA, 21 nt, Homo sapiens
ccuaggacuuaaaauuagucu

SEQ ID NO: 564148 - RNA, 20 nt, Homo sapiens
ccuaggauacccagaugcca

SEQ ID NO: 564149 - RNA, 15 nt, Homo sapiens
ccuaggcauuugcug

SEQ ID NO: 564150 - RNA, 15 nt, Homo sapiens
ccuaggcgcuguucu

SEQ ID NO: 564151 - RNA, 17 nt, Homo sapiens
ccuagggauauaauucu

SEQ ID NO: 564152 - RNA, 14 nt, Homo sapiens
ccuaguagaacuca

SEQ ID NO: 564153 - RNA, 12 nt, Homo sapiens
ccuagugccuuc

SEQ ID NO: 564154 - RNA, 17 nt, Homo sapiens
ccuaguggaugacuguu

SEQ ID NO: 564155 - RNA, 21 nt, Homo sapiens
ccuaguuguucagcauggcau

SEQ ID NO: 564156 - RNA, 18 nt, Homo sapiens
ccuaguuucccccuauga

SEQ ID NO: 564157 - RNA, 18 nt, Homo sapiens
ccuaguuucccugaagga

SEQ ID NO: 564158 - RNA, 15 nt, Homo sapiens
ccuauacauccacag

SEQ ID NO: 564159 - RNA, 13 nt, Homo sapiens
ccuauacauuaua

SEQ ID NO: 564160 - RNA, 19 nt, Homo sapiens
ccuauagucgcagcuacua

SEQ ID NO: 564161 - RNA, 13 nt, Homo sapiens
ccuauauguagcu

SEQ ID NO: 564162 - RNA, 17 nt, Homo sapiens
ccuauauguagcuuuau

SEQ ID NO: 564163 - RNA, 20 nt, Homo sapiens
ccuaucagaguugcugcaaa

SEQ ID NO: 564164 - RNA, 19 nt, Homo sapiens
ccuaucccagagaccuuga

SEQ ID NO: 564165 - RNA, 18 nt, Homo sapiens
ccuauccccauucucugc

SEQ ID NO: 564166 - RNA, 23 nt, Homo sapiens
ccuaucuaacccucccauggcac

SEQ ID NO: 564167 - RNA, 10 nt, Homo sapiens
ccuaucucau

SEQ ID NO: 564168 - RNA, 17 nt, Homo sapiens
ccuaucuggggagcucc

SEQ ID NO: 564169 - RNA, 15 nt, Homo sapiens
ccuaugcagaggucc

SEQ ID NO: 564170 - RNA, 16 nt, Homo sapiens
ccuaugcagaggucca

SEQ ID NO: 564171 - RNA, 15 nt, Homo sapiens
ccuauggacaacuua

SEQ ID NO: 564172 - RNA, 22 nt, Homo sapiens
ccuauguacuuaauccuuuaac

SEQ ID NO: 564173 - RNA, 21 nt, Homo sapiens
ccuauuagggaguuaugcaaa

SEQ ID NO: 564174 - RNA, 16 nt, Homo sapiens
ccuauucuguugccaa

SEQ ID NO: 564175 - RNA, 13 nt, Homo sapiens
ccuauucuuucua

SEQ ID NO: 564176 - RNA, 17 nt, Homo sapiens
ccuauuguucacuuuau

SEQ ID NO: 564177 - RNA, 13 nt, Homo sapiens
ccuauuuccccac

SEQ ID NO: 564178 - RNA, 17 nt, Homo sapiens
ccuauuuuucaauggga

SEQ ID NO: 564179 - RNA, 20 nt, Homo sapiens
ccucaaaaaauugcacauag

SEQ ID NO: 564180 - RNA, 22 nt, Homo sapiens
ccucaaaacgggucaguauuaa

SEQ ID NO: 564181 - RNA, 17 nt, Homo sapiens
ccucaaaccacuugccu

SEQ ID NO: 564182 - RNA, 20 nt, Homo sapiens
ccucaaacucuggggcucaa

SEQ ID NO: 564183 - RNA, 13 nt, Homo sapiens
ccucaaacugcac

SEQ ID NO: 564184 - RNA, 18 nt, Homo sapiens
ccucaaaugacccaaaga

SEQ ID NO: 564185 - RNA, 13 nt, Homo sapiens
ccucaaaugucag

SEQ ID NO: 564186 - RNA, 21 nt, Homo sapiens
ccucaacaagaagaauuugaa

SEQ ID NO: 564187 - RNA, 20 nt, Homo sapiens
ccucaacaucacacaguaua

SEQ ID NO: 564188 - RNA, 16 nt, Homo sapiens
ccucaacccaagggga

SEQ ID NO: 564189 - RNA, 17 nt, Homo sapiens
ccucaacugaaggggug

SEQ ID NO: 564190 - RNA, 11 nt, Homo sapiens
ccucaagaaga

SEQ ID NO: 564191 - RNA, 19 nt, Homo sapiens
ccucaagguguucucugua

SEQ ID NO: 564192 - RNA, 20 nt, Homo sapiens
ccucaagguguucucuguag

SEQ ID NO: 564193 - RNA, 17 nt, Homo sapiens
ccucaauccuaucacag

SEQ ID NO: 564194 - RNA, 24 nt, Homo sapiens
ccucaauggccuuuugcuacgugc

SEQ ID NO: 564195 - RNA, 15 nt, Homo sapiens
ccucaauguccccaa

SEQ ID NO: 564196 - RNA, 23 nt, Homo sapiens
ccucacacacacagcugggcaaa

SEQ ID NO: 564197 - RNA, 23 nt, Homo sapiens
ccucacauuuggaugauugucau

SEQ ID NO: 564198 - RNA, 23 nt, Homo sapiens
ccucacccuuuaccuuccucagg

SEQ ID NO: 564199 - RNA, 22 nt, Homo sapiens
ccucaccucccgaagccaccau

SEQ ID NO: 564200 - RNA, 22 nt, Homo sapiens
ccucacuccuguuacuuaccua

SEQ ID NO: 564201 - RNA, 17 nt, Homo sapiens
ccucacugccguccuca

SEQ ID NO: 564202 - RNA, 14 nt, Homo sapiens
ccucacuugcauca

SEQ ID NO: 564203 - RNA, 24 nt, Homo sapiens
ccucacuuguccuccugauccuga

SEQ ID NO: 564204 - RNA, 11 nt, Homo sapiens
ccucacuuuag

SEQ ID NO: 564205 - RNA, 19 nt, Homo sapiens
ccucacuuuauuacaagau

SEQ ID NO: 564206 - RNA, 13 nt, Homo sapiens
ccucagacauccc

SEQ ID NO: 564207 - RNA, 23 nt, Homo sapiens
ccucagacgagacccaagggcag

SEQ ID NO: 564208 - RNA, 16 nt, Homo sapiens
ccucagaggacaguuu

SEQ ID NO: 564209 - RNA, 11 nt, Homo sapiens
ccucagaugau

SEQ ID NO: 564210 - RNA, 13 nt, Homo sapiens
ccucagauuucca

SEQ ID NO: 564211 - RNA, 12 nt, Homo sapiens
ccucagcacugu

SEQ ID NO: 564212 - RNA, 14 nt, Homo sapiens
ccucagccaugagg

SEQ ID NO: 564213 - RNA, 23 nt, Homo sapiens
ccucagcccgccaagguagccau

SEQ ID NO: 564214 - RNA, 17 nt, Homo sapiens
ccucagccucccaaagu

SEQ ID NO: 564215 - RNA, 14 nt, Homo sapiens
ccucagccuccuga

SEQ ID NO: 564216 - RNA, 17 nt, Homo sapiens
ccucagccuccugggua

SEQ ID NO: 564217 - RNA, 22 nt, Homo sapiens
ccuggcauucuuguacagugua

SEQ ID NO: 564218 - RNA, 20 nt, Homo sapiens
ccuggccaacaugaugaaac

SEQ ID NO: 564219 - RNA, 18 nt, Homo sapiens
ccuggccaacauggcaaa

SEQ ID NO: 564220 - RNA, 21 nt, Homo sapiens
ccuggccaccagccauccucc

SEQ ID NO: 564221 - RNA, 18 nt, Homo sapiens
ccuggccaggauaauaua

SEQ ID NO: 564222 - RNA, 22 nt, Homo sapiens
ccuggccaugcugucccugcac

SEQ ID NO: 564223 - RNA, 20 nt, Homo sapiens
ccuggcccacugcaucguuu

SEQ ID NO: 564224 - RNA, 18 nt, Homo sapiens
ccuggcccauaaugugaa

SEQ ID NO: 564225 - RNA, 14 nt, Homo sapiens
ccuggcccaucuca

SEQ ID NO: 564226 - RNA, 14 nt, Homo sapiens
ccuggccucacugg

SEQ ID NO: 564227 - RNA, 19 nt, Homo sapiens
ccuggcuaacacggugaaa

SEQ ID NO: 564228 - RNA, 17 nt, Homo sapiens
ccuggcuccuugcagca

SEQ ID NO: 564229 - RNA, 21 nt, Homo sapiens
ccuggcucgcagggugcagga

SEQ ID NO: 564230 - RNA, 16 nt, Homo sapiens
ccuggcucugcuucca

SEQ ID NO: 564231 - RNA, 16 nt, Homo sapiens
ccuggcuggugacaga

SEQ ID NO: 564232 - RNA, 16 nt, Homo sapiens
ccuggcuuuuacuuua

SEQ ID NO: 564233 - RNA, 17 nt, Homo sapiens
ccugggaaaggacccac

SEQ ID NO: 564234 - RNA, 19 nt, Homo sapiens
ccugggagaaccucaggcu

SEQ ID NO: 564235 - RNA, 19 nt, Homo sapiens
ccugggagaccagggacca

SEQ ID NO: 564236 - RNA, 23 nt, Homo sapiens
ccugggagagaaguuugaagcac

SEQ ID NO: 564237 - RNA, 16 nt, Homo sapiens
ccugggaucuggcaca

SEQ ID NO: 564238 - RNA, 22 nt, Homo sapiens
ccugggcagccguuuuccucau

SEQ ID NO: 564239 - RNA, 14 nt, Homo sapiens
ccugggcauggugg

SEQ ID NO: 564240 - RNA, 15 nt, Homo sapiens
ccugggcccuugugc

SEQ ID NO: 564241 - RNA, 16 nt, Homo sapiens
ccugggccuccugaca

SEQ ID NO: 564242 - RNA, 17 nt, Homo sapiens
ccugggcugucugucac

SEQ ID NO: 564243 - RNA, 21 nt, Homo sapiens
ccuggggacuccucaaaccac

SEQ ID NO: 564244 - RNA, 20 nt, Homo sapiens
ccuggggcaggucacuuuac

SEQ ID NO: 564245 - RNA, 22 nt, Homo sapiens
ccuggggcggugugugugccau

SEQ ID NO: 564246 - RNA, 22 nt, Homo sapiens
ccugggggcaggccagggcagu

SEQ ID NO: 564247 - RNA, 18 nt, Homo sapiens
ccugggggcagugacugg

SEQ ID NO: 564248 - RNA, 12 nt, Homo sapiens
ccugggggccug

SEQ ID NO: 564249 - RNA, 20 nt, Homo sapiens
ccuggggguggcaggcacac

SEQ ID NO: 564250 - RNA, 20 nt, Homo sapiens
ccugggguguccuacaguga

SEQ ID NO: 564251 - RNA, 19 nt, Homo sapiens
ccugggguucuuuuugcca

SEQ ID NO: 564252 - RNA, 17 nt, Homo sapiens
ccuggguaacuagggaa

SEQ ID NO: 564253 - RNA, 16 nt, Homo sapiens
ccugggugacagagug

SEQ ID NO: 564254 - RNA, 18 nt, Homo sapiens
ccugggugacagagugag

SEQ ID NO: 564255 - RNA, 17 nt, Homo sapiens
ccuggguggggcugcuc

SEQ ID NO: 564256 - RNA, 16 nt, Homo sapiens
ccugguacacucugau

SEQ ID NO: 564257 - RNA, 16 nt, Homo sapiens
ccugguauauccaaaa

SEQ ID NO: 564258 - RNA, 19 nt, Homo sapiens
ccuggucaacauggugaaa

SEQ ID NO: 564259 - RNA, 12 nt, Homo sapiens
ccuggucaccaa

SEQ ID NO: 564260 - RNA, 11 nt, Homo sapiens
ccuggucaguc

SEQ ID NO: 564261 - RNA, 13 nt, Homo sapiens
ccugguccaugau

SEQ ID NO: 564262 - RNA, 18 nt, Homo sapiens
ccuggucccuuggagaca

SEQ ID NO: 564263 - RNA, 21 nt, Homo sapiens
ccugguccuggacaccuccca

SEQ ID NO: 564264 - RNA, 20 nt, Homo sapiens
ccugguccuuccacugugca

SEQ ID NO: 564265 - RNA, 19 nt, Homo sapiens
ccuggucucuucaccacug

SEQ ID NO: 564266 - RNA, 19 nt, Homo sapiens
ccuggugcccugagacaga

SEQ ID NO: 564267 - RNA, 15 nt, Homo sapiens
ccugguuugcaaaga

SEQ ID NO: 564268 - RNA, 21 nt, Homo sapiens
ccuguaaacuuuaucacuuaa

SEQ ID NO: 564269 - RNA, 12 nt, Homo sapiens
ccuguaaauaua

SEQ ID NO: 564270 - RNA, 18 nt, Homo sapiens
ccuguaaucccagcacuu

SEQ ID NO: 564271 - RNA, 23 nt, Homo sapiens
ccuguaaucccagcacuuuggga

SEQ ID NO: 564272 - RNA, 20 nt, Homo sapiens
ccuguaaucccagcuacucg

SEQ ID NO: 564273 - RNA, 20 nt, Homo sapiens
ccuguaaucccagcuacuug

SEQ ID NO: 564274 - RNA, 20 nt, Homo sapiens
ccuguaauuaaacuaguuua

SEQ ID NO: 564275 - RNA, 23 nt, Homo sapiens
ccuguagcaaccuucugcauuca

SEQ ID NO: 564276 - RNA, 18 nt, Homo sapiens
ccuguagccccagugaca

SEQ ID NO: 564277 - RNA, 22 nt, Homo sapiens
ccuguagccuucuguaggaauu

SEQ ID NO: 564278 - RNA, 21 nt, Homo sapiens
ccuguaguacaagauuaucuu

SEQ ID NO: 564279 - RNA, 13 nt, Homo sapiens
ccuguagucccag

SEQ ID NO: 564280 - RNA, 22 nt, Homo sapiens
ccuguagucccagcuacuugag

SEQ ID NO: 564281 - RNA, 15 nt, Homo sapiens
ccuguauacuuuucc

SEQ ID NO: 564282 - RNA, 14 nt, Homo sapiens
ccuguauauuccau

SEQ ID NO: 564283 - RNA, 15 nt, Homo sapiens
ccuguauggcacugg

SEQ ID NO: 564284 - RNA, 20 nt, Homo sapiens
ccuguauucuacagcagaua

SEQ ID NO: 564285 - RNA, 19 nt, Homo sapiens
ccuguauuuaacaaaaagu

SEQ ID NO: 564286 - RNA, 14 nt, Homo sapiens
ccugucaaauauca

SEQ ID NO: 564287 - RNA, 16 nt, Homo sapiens
ccugucacugagcaca

SEQ ID NO: 564288 - RNA, 13 nt, Homo sapiens
ccugucauauaau

SEQ ID NO: 564289 - RNA, 15 nt, Homo sapiens
ccugucaugugccuu

SEQ ID NO: 564290 - RNA, 15 nt, Homo sapiens
ccuguccaugccccu

SEQ ID NO: 564291 - RNA, 14 nt, Homo sapiens
ccugucccaugcag

SEQ ID NO: 564292 - RNA, 19 nt, Homo sapiens
ccugucccauggacacucc

SEQ ID NO: 564293 - RNA, 16 nt, Homo sapiens
ccuguccccacccucc

SEQ ID NO: 564294 - RNA, 15 nt, Homo sapiens
ccuguccuaucacuc

SEQ ID NO: 564295 - RNA, 20 nt, Homo sapiens
ccuguccugcagucccacac

SEQ ID NO: 564296 - RNA, 14 nt, Homo sapiens
ccugucgugccagu

SEQ ID NO: 564297 - RNA, 23 nt, Homo sapiens
ccugucuaaagccuuaacuaaga

SEQ ID NO: 564298 - RNA, 16 nt, Homo sapiens
ccugucuccacugugc

SEQ ID NO: 564299 - RNA, 18 nt, Homo sapiens
ccugucugaaggacacuu

SEQ ID NO: 564300 - RNA, 20 nt, Homo sapiens
ccugucuugaguagacuugg

SEQ ID NO: 564301 - RNA, 13 nt, Homo sapiens
ccugugaaugcca

SEQ ID NO: 564302 - RNA, 14 nt, Homo sapiens
ccugugaaugccac

SEQ ID NO: 564303 - RNA, 17 nt, Homo sapiens
ccugugaccagcacugu

SEQ ID NO: 564304 - RNA, 21 nt, Homo sapiens
ccugugacccucucacuuugg

SEQ ID NO: 564305 - RNA, 22 nt, Homo sapiens
ccugugacgcacagcacuccug

SEQ ID NO: 564306 - RNA, 16 nt, Homo sapiens
ccugugacugucucac

SEQ ID NO: 564307 - RNA, 16 nt, Homo sapiens
ccugugagcagggauu

SEQ ID NO: 564308 - RNA, 13 nt, Homo sapiens
ccugugagggagu

SEQ ID NO: 564309 - RNA, 22 nt, Homo sapiens
ccugugcccacccgucuucaau

SEQ ID NO: 564310 - RNA, 12 nt, Homo sapiens
ccugugccccag

SEQ ID NO: 564311 - RNA, 11 nt, Homo sapiens
ccugugccugg

SEQ ID NO: 564312 - RNA, 17 nt, Homo sapiens
ccugugcuacaauucau

SEQ ID NO: 564313 - RNA, 22 nt, Homo sapiens
ccugugcugaauguggacucaa

SEQ ID NO: 564314 - RNA, 18 nt, Homo sapiens
ccugugcuggaccagcug

SEQ ID NO: 564315 - RNA, 23 nt, Homo sapiens
ccuguggagaugagucagugcca

SEQ ID NO: 564316 - RNA, 14 nt, Homo sapiens
ccuguggagcucag

SEQ ID NO: 564317 - RNA, 21 nt, Homo sapiens
ccuguggcucaggggagcaag

SEQ ID NO: 564318 - RNA, 15 nt, Homo sapiens
ccuguggugaagugu

SEQ ID NO: 564319 - RNA, 22 nt, Homo sapiens
ccuguguaaaacuauauucuca

SEQ ID NO: 564320 - RNA, 14 nt, Homo sapiens
ccuguguacuuccc

SEQ ID NO: 564321 - RNA, 17 nt, Homo sapiens
ccuguguccagcagcug

SEQ ID NO: 564322 - RNA, 18 nt, Homo sapiens
ccugugucugcuguagaa

SEQ ID NO: 564323 - RNA, 21 nt, Homo sapiens
ccugugugauugacagcuuug

SEQ ID NO: 564324 - RNA, 20 nt, Homo sapiens
ccuguguguccaaaacugcc

SEQ ID NO: 564325 - RNA, 21 nt, Homo sapiens
ccuguguguccaaaacugccu

SEQ ID NO: 564326 - RNA, 21 nt, Homo sapiens
ccugugugugugugugcugau

SEQ ID NO: 564327 - RNA, 19 nt, Homo sapiens
ccuguguuaucugugguuu

SEQ ID NO: 564328 - RNA, 20 nt, Homo sapiens
ccuguuaaaauguacacugg

SEQ ID NO: 564329 - RNA, 22 nt, Homo sapiens
ccuguuacuugaaauaccagug

SEQ ID NO: 564330 - RNA, 23 nt, Homo sapiens
ccuguuacuugaaauaccaguga

SEQ ID NO: 564331 - RNA, 15 nt, Homo sapiens
ccuguuagacguccu

SEQ ID NO: 564332 - RNA, 16 nt, Homo sapiens
ccuguucuaugccuuu

SEQ ID NO: 564333 - RNA, 15 nt, Homo sapiens
ccuguugucaagaau

SEQ ID NO: 564334 - RNA, 22 nt, Homo sapiens
ccuguugucaagaauagcauug

SEQ ID NO: 564335 - RNA, 21 nt, Homo sapiens
ccuguuucuccacaacagccu

SEQ ID NO: 564336 - RNA, 17 nt, Homo sapiens
ccuguuugaaaguaaaa

SEQ ID NO: 564337 - RNA, 14 nt, Homo sapiens
ccuguuuguacugu

SEQ ID NO: 564338 - RNA, 18 nt, Homo sapiens
cgcucccagguuccccca

SEQ ID NO: 564339 - RNA, 15 nt, Homo sapiens
cgcuccccucuggaa

SEQ ID NO: 564340 - RNA, 20 nt, Homo sapiens
cgcuccucccugcuccucau

SEQ ID NO: 564341 - RNA, 13 nt, Homo sapiens
cgcucgcugccau

SEQ ID NO: 564342 - RNA, 17 nt, Homo sapiens
cgcucggcccggagcag

SEQ ID NO: 564343 - RNA, 12 nt, Homo sapiens
cgcucucaagac

SEQ ID NO: 564344 - RNA, 22 nt, Homo sapiens
cgcucugccauucaacucggaa

SEQ ID NO: 564345 - RNA, 16 nt, Homo sapiens
cgcugaagauggcauc

SEQ ID NO: 564346 - RNA, 19 nt, Homo sapiens
cgcugaagcgccuccccca

SEQ ID NO: 564347 - RNA, 21 nt, Homo sapiens
cgcugagugggagaaggcagu

SEQ ID NO: 564348 - RNA, 22 nt, Homo sapiens
cgcugcacacagacggccuagg

SEQ ID NO: 564349 - RNA, 13 nt, Homo sapiens
cgcugcaggaaac

SEQ ID NO: 564350 - RNA, 20 nt, Homo sapiens
cgcugcugugcucuggggau

SEQ ID NO: 564351 - RNA, 21 nt, Homo sapiens
cgcuggcuuuccagcuuagaa

SEQ ID NO: 564352 - RNA, 14 nt, Homo sapiens
cgcugggugguacc

SEQ ID NO: 564353 - RNA, 22 nt, Homo sapiens
cgcugucgugacuacacagagu

SEQ ID NO: 564354 - RNA, 16 nt, Homo sapiens
cgcuguguagggacca

SEQ ID NO: 564355 - RNA, 13 nt, Homo sapiens
cgcuguucuugcu

SEQ ID NO: 564356 - RNA, 19 nt, Homo sapiens
cgcuucugccuuuucacug

SEQ ID NO: 564357 - RNA, 23 nt, Homo sapiens
cgcuugaaccugggaaguggagg

SEQ ID NO: 564358 - RNA, 22 nt, Homo sapiens
cgcuugcaccacuuccguccca

SEQ ID NO: 564359 - RNA, 12 nt, Homo sapiens
cggaacugccuu

SEQ ID NO: 564360 - RNA, 21 nt, Homo sapiens
cggaagaacccucaggucaca

SEQ ID NO: 564361 - RNA, 18 nt, Homo sapiens
cggaagcccuugccugaa

SEQ ID NO: 564362 - RNA, 20 nt, Homo sapiens
cggaagcuggugaaagcucg

SEQ ID NO: 564363 - RNA, 23 nt, Homo sapiens
cggaagcugucgacuucaugaca

SEQ ID NO: 564364 - RNA, 18 nt, Homo sapiens
cggaaggucccucagaca

SEQ ID NO: 564365 - RNA, 17 nt, Homo sapiens
cggaagugaccacagaa

SEQ ID NO: 564366 - RNA, 18 nt, Homo sapiens
cggaagugaccacagaag

SEQ ID NO: 564367 - RNA, 12 nt, Homo sapiens
cggaaugcauug

SEQ ID NO: 564368 - RNA, 21 nt, Homo sapiens
cggacaagacccccagcacuu

SEQ ID NO: 564369 - RNA, 13 nt, Homo sapiens
cggaccuaccucc

SEQ ID NO: 564370 - RNA, 21 nt, Homo sapiens
cggacucacuauggccagaaa

SEQ ID NO: 564371 - RNA, 19 nt, Homo sapiens
cggacugaggugccugcuc

SEQ ID NO: 564372 - RNA, 21 nt, Homo sapiens
cggagacuuucaaacauauau

SEQ ID NO: 564373 - RNA, 18 nt, Homo sapiens
cggagccccugaaagccu

SEQ ID NO: 564374 - RNA, 12 nt, Homo sapiens
cggagcugccag

SEQ ID NO: 564375 - RNA, 12 nt, Homo sapiens
cggagcuuucaa

SEQ ID NO: 564376 - RNA, 23 nt, Homo sapiens
cggaggaggcuggugacaggcca

SEQ ID NO: 564377 - RNA, 14 nt, Homo sapiens
cggaggccagagag

SEQ ID NO: 564378 - RNA, 20 nt, Homo sapiens
cggaggccuucccacuccua

SEQ ID NO: 564379 - RNA, 19 nt, Homo sapiens
cggagggaggacaucauaa

SEQ ID NO: 564380 - RNA, 17 nt, Homo sapiens
cggaggucucuguaaaa

SEQ ID NO: 564381 - RNA, 21 nt, Homo sapiens
cggaguucugcccaugggaag

SEQ ID NO: 564382 - RNA, 12 nt, Homo sapiens
cggauggugcau

SEQ ID NO: 564383 - RNA, 14 nt, Homo sapiens
cggcacacacugug

SEQ ID NO: 564384 - RNA, 15 nt, Homo sapiens
cggcagcauggagcu

SEQ ID NO: 564385 - RNA, 14 nt, Homo sapiens
cggcagucaugcug

SEQ ID NO: 564386 - RNA, 15 nt, Homo sapiens
cggccagaagaucua

SEQ ID NO: 564387 - RNA, 16 nt, Homo sapiens
cggccagccaugucug

SEQ ID NO: 564388 - RNA, 17 nt, Homo sapiens
cggcccagaaguuuccc

SEQ ID NO: 564389 - RNA, 18 nt, Homo sapiens
cggccccucccccugaga

SEQ ID NO: 564390 - RNA, 13 nt, Homo sapiens
cggcccuccccca

SEQ ID NO: 564391 - RNA, 12 nt, Homo sapiens
cggccucagugc

SEQ ID NO: 564392 - RNA, 21 nt, Homo sapiens
cggcuccuccuuaugacucca

SEQ ID NO: 564393 - RNA, 16 nt, Homo sapiens
cggcucgauuucucca

SEQ ID NO: 564394 - RNA, 18 nt, Homo sapiens
cggcugaggccugagcga

SEQ ID NO: 564395 - RNA, 18 nt, Homo sapiens
cggcugccgacuccccca

SEQ ID NO: 564396 - RNA, 22 nt, Homo sapiens
cggcuguuccccucacccaaaa

SEQ ID NO: 564397 - RNA, 15 nt, Homo sapiens
cggcuucaaguggca

SEQ ID NO: 564398 - RNA, 19 nt, Homo sapiens
cggcuuccuacagccagca

SEQ ID NO: 564399 - RNA, 13 nt, Homo sapiens
cggcuugaucaca

SEQ ID NO: 564400 - RNA, 13 nt, Homo sapiens
cgggaacaguguu

SEQ ID NO: 564401 - RNA, 15 nt, Homo sapiens
cgggacacagaauua

SEQ ID NO: 564402 - RNA, 21 nt, Homo sapiens
cgggagaagaaguuugaccau

SEQ ID NO: 564403 - RNA, 20 nt, Homo sapiens
cgggagcugcggaagcccag

SEQ ID NO: 564404 - RNA, 21 nt, Homo sapiens
cgggaugguucuucuccaguu

SEQ ID NO: 564405 - RNA, 20 nt, Homo sapiens
cgggcagggccccugacccu

SEQ ID NO: 564406 - RNA, 22 nt, Homo sapiens
cgggcaggggucagagcacucc

SEQ ID NO: 564407 - RNA, 15 nt, Homo sapiens
cgggcugcucuacug

SEQ ID NO: 564408 - RNA, 19 nt, Homo sapiens
cggggccacgugugcugug

SEQ ID NO: 564409 - RNA, 15 nt, Homo sapiens
cggggccagcacuuc

SEQ ID NO: 564410 - RNA, 16 nt, Homo sapiens
cggggggcauagcucu

SEQ ID NO: 564411 - RNA, 12 nt, Homo sapiens
cggggugcuccu

SEQ ID NO: 564412 - RNA, 13 nt, Homo sapiens
cggggugcuccug

SEQ ID NO: 564413 - RNA, 15 nt, Homo sapiens
cggguccccuugaaa

SEQ ID NO: 564414 - RNA, 22 nt, Homo sapiens
cgggucucaacuuuaagauaga

SEQ ID NO: 564415 - RNA, 15 nt, Homo sapiens
cggugcaugaugcug

SEQ ID NO: 564416 - RNA, 14 nt, Homo sapiens
cgguggcccugacu

SEQ ID NO: 564417 - RNA, 17 nt, Homo sapiens
cgguggcugccccggcc

SEQ ID NO: 564418 - RNA, 16 nt, Homo sapiens
cggugugcaccaacau

SEQ ID NO: 564419 - RNA, 19 nt, Homo sapiens
cggugugugugccauguca

SEQ ID NO: 564420 - RNA, 14 nt, Homo sapiens
cgguguuuugccau

SEQ ID NO: 564421 - RNA, 15 nt, Homo sapiens
cgguuaccucugcau

SEQ ID NO: 564422 - RNA, 17 nt, Homo sapiens
cgguuaccucugcaugg

SEQ ID NO: 564423 - RNA, 12 nt, Homo sapiens
cgguucccugaa

SEQ ID NO: 564424 - RNA, 18 nt, Homo sapiens
cgguugcagucacuguga

SEQ ID NO: 564425 - RNA, 22 nt, Homo sapiens
cgguuuuuuauuuucuuuacaa

SEQ ID NO: 564426 - RNA, 23 nt, Homo sapiens
cguaacagauuuuguuggcauag

SEQ ID NO: 564427 - RNA, 22 nt, Homo sapiens
cguaacccauuaaaaugaauuu

SEQ ID NO: 564428 - RNA, 14 nt, Homo sapiens
cguaauuuugccaa

SEQ ID NO: 564429 - RNA, 16 nt, Homo sapiens
cguacaucugcaauau

SEQ ID NO: 564430 - RNA, 14 nt, Homo sapiens
cguacucucacaug

SEQ ID NO: 564431 - RNA, 19 nt, Homo sapiens
cguacugauucuaaugggg

SEQ ID NO: 564432 - RNA, 13 nt, Homo sapiens
cguacuguaacug

SEQ ID NO: 564433 - RNA, 14 nt, Homo sapiens
cguacuuguaauau

SEQ ID NO: 564434 - RNA, 13 nt, Homo sapiens
cguagccaucucu

SEQ ID NO: 564435 - RNA, 18 nt, Homo sapiens
cguagcuuucccaaauaa

SEQ ID NO: 564436 - RNA, 18 nt, Homo sapiens
cguaguauuaugauugca

SEQ ID NO: 564437 - RNA, 16 nt, Homo sapiens
cguauaccuuauuaac

SEQ ID NO: 564438 - RNA, 12 nt, Homo sapiens
cguaucugucac

SEQ ID NO: 564439 - RNA, 13 nt, Homo sapiens
cgucaagacauuu

SEQ ID NO: 564440 - RNA, 15 nt, Homo sapiens
cgucacgcucccuga

SEQ ID NO: 564441 - RNA, 18 nt, Homo sapiens
cgucacugcccaccaaag

SEQ ID NO: 564442 - RNA, 15 nt, Homo sapiens
cgucagcugcucccu

SEQ ID NO: 564443 - RNA, 15 nt, Homo sapiens
cgucaggccuaccuc

SEQ ID NO: 564444 - RNA, 20 nt, Homo sapiens
cgucaguccaagucuucuca

SEQ ID NO: 564445 - RNA, 15 nt, Homo sapiens
cgucagugcucagaa

SEQ ID NO: 564446 - RNA, 22 nt, Homo sapiens
cgucauuucagcucuugcuuca

SEQ ID NO: 564447 - RNA, 14 nt, Homo sapiens
cguccauggcacca

SEQ ID NO: 564448 - RNA, 22 nt, Homo sapiens
cgucccaggccacccccaugga

SEQ ID NO: 564449 - RNA, 21 nt, Homo sapiens
cgucccauccagcuaccacca

SEQ ID NO: 564450 - RNA, 12 nt, Homo sapiens
cgucccuaccuc

SEQ ID NO: 564451 - RNA, 13 nt, Homo sapiens
cgucccuaccucc

SEQ ID NO: 564452 - RNA, 20 nt, Homo sapiens
cguccgcgcgccagcacaga

SEQ ID NO: 564453 - RNA, 21 nt, Homo sapiens
cguccgcgcgccagcacagaa

SEQ ID NO: 564454 - RNA, 19 nt, Homo sapiens
cguccucagcaguccacaa

SEQ ID NO: 564455 - RNA, 18 nt, Homo sapiens
cguccuccguccauauca

SEQ ID NO: 564456 - RNA, 12 nt, Homo sapiens
cguccuggucaa

SEQ ID NO: 564457 - RNA, 19 nt, Homo sapiens
cguccugucacugauggaa

SEQ ID NO: 564458 - RNA, 13 nt, Homo sapiens
cguccuuccucuc

SEQ ID NO: 564459 - RNA, 23 nt, Homo sapiens
cgucgaggggcucucagcucagc

SEQ ID NO: 564460 - RNA, 10 nt, Homo sapiens
cucuugcccu

SEQ ID NO: 564461 - RNA, 16 nt, Homo sapiens
cucuuggauaccagcu

SEQ ID NO: 564462 - RNA, 14 nt, Homo sapiens
cucuuggcauuuuc

SEQ ID NO: 564463 - RNA, 15 nt, Homo sapiens
cucuuggccugauca

SEQ ID NO: 564464 - RNA, 15 nt, Homo sapiens
cucuuggcugacccc

SEQ ID NO: 564465 - RNA, 14 nt, Homo sapiens
cucuuggcuucuca

SEQ ID NO: 564466 - RNA, 21 nt, Homo sapiens
cucuugggaacugaacucacu

SEQ ID NO: 564467 - RNA, 13 nt, Homo sapiens
cucuuggguucaa

SEQ ID NO: 564468 - RNA, 22 nt, Homo sapiens
cucuuggugugauugcacagaa

SEQ ID NO: 564469 - RNA, 18 nt, Homo sapiens
cucuuguauaugaugauc

SEQ ID NO: 564470 - RNA, 17 nt, Homo sapiens
cucuugucccuuggcac

SEQ ID NO: 564471 - RNA, 16 nt, Homo sapiens
cucuuguccuagcuug

SEQ ID NO: 564472 - RNA, 22 nt, Homo sapiens
cucuugugacgugcacugugaa

SEQ ID NO: 564473 - RNA, 19 nt, Homo sapiens
cucuugugguaccuaguca

SEQ ID NO: 564474 - RNA, 16 nt, Homo sapiens
cucuuuaacacauucu

SEQ ID NO: 564475 - RNA, 17 nt, Homo sapiens
cucuuuaacacauucuu

SEQ ID NO: 564476 - RNA, 12 nt, Homo sapiens
cucuuuaacuuc

SEQ ID NO: 564477 - RNA, 13 nt, Homo sapiens
cucuuuaugacug

SEQ ID NO: 564478 - RNA, 16 nt, Homo sapiens
cucuuuccuauuucag

SEQ ID NO: 564479 - RNA, 15 nt, Homo sapiens
cucuuuccuugcuca

SEQ ID NO: 564480 - RNA, 17 nt, Homo sapiens
cucuuucuacaugacug

SEQ ID NO: 564481 - RNA, 18 nt, Homo sapiens
cucuuucuacaugacugg

SEQ ID NO: 564482 - RNA, 15 nt, Homo sapiens
cucuuucuacucuga

SEQ ID NO: 564483 - RNA, 14 nt, Homo sapiens
cucuuucucuauua

SEQ ID NO: 564484 - RNA, 23 nt, Homo sapiens
cucuuugugauaauucucaguag

SEQ ID NO: 564485 - RNA, 21 nt, Homo sapiens
cucuuuguguaauagaucuga

SEQ ID NO: 564486 - RNA, 20 nt, Homo sapiens
cucuuuucccucucuaggcc

SEQ ID NO: 564487 - RNA, 23 nt, Homo sapiens
cucuuuucuuucccucucauggu

SEQ ID NO: 564488 - RNA, 16 nt, Homo sapiens
cucuuuuuuucuuguc

SEQ ID NO: 564489 - RNA, 15 nt, Homo sapiens
cugaaaaacauucca

SEQ ID NO: 564490 - RNA, 14 nt, Homo sapiens
cugaaaaaugcaaa

SEQ ID NO: 564491 - RNA, 14 nt, Homo sapiens
cugaaaaaugucag

SEQ ID NO: 564492 - RNA, 19 nt, Homo sapiens
cugaaaacacugugcacau

SEQ ID NO: 564493 - RNA, 13 nt, Homo sapiens
cugaaaacuacac

SEQ ID NO: 564494 - RNA, 15 nt, Homo sapiens
cugaaaacuacacaa

SEQ ID NO: 564495 - RNA, 19 nt, Homo sapiens
cugaaaagacucaguguuc

SEQ ID NO: 564496 - RNA, 22 nt, Homo sapiens
cugaaaagauacugaugcauug

SEQ ID NO: 564497 - RNA, 17 nt, Homo sapiens
cugaaaauuuaucaugu

SEQ ID NO: 564498 - RNA, 12 nt, Homo sapiens
cugaaacacugg

SEQ ID NO: 564499 - RNA, 14 nt, Homo sapiens
cugaaacaucucaa

SEQ ID NO: 564500 - RNA, 21 nt, Homo sapiens
cugaaacccgcccucaggggc

SEQ ID NO: 564501 - RNA, 21 nt, Homo sapiens
cugaaacucauagacacugau

SEQ ID NO: 564502 - RNA, 12 nt, Homo sapiens
cugaaacugcag

SEQ ID NO: 564503 - RNA, 21 nt, Homo sapiens
cugaaagaacauggacuugua

SEQ ID NO: 564504 - RNA, 12 nt, Homo sapiens
cugaaagacaga

SEQ ID NO: 564505 - RNA, 19 nt, Homo sapiens
cugaaagacagaaugucac

SEQ ID NO: 564506 - RNA, 16 nt, Homo sapiens
cugaaagauacagggg

SEQ ID NO: 564507 - RNA, 12 nt, Homo sapiens
cugaaagccaca

SEQ ID NO: 564508 - RNA, 20 nt, Homo sapiens
cugaaaggagacauugcucu

SEQ ID NO: 564509 - RNA, 15 nt, Homo sapiens
cugaaaggaugugga

SEQ ID NO: 564510 - RNA, 16 nt, Homo sapiens
cugaaagggcacuuaa

SEQ ID NO: 564511 - RNA, 15 nt, Homo sapiens
cugaaaguaauauaa

SEQ ID NO: 564512 - RNA, 13 nt, Homo sapiens
cugaaaguacaaa

SEQ ID NO: 564513 - RNA, 12 nt, Homo sapiens
cugaaagugaaa

SEQ ID NO: 564514 - RNA, 21 nt, Homo sapiens
cugaaagugaaaguccagaaa

SEQ ID NO: 564515 - RNA, 14 nt, Homo sapiens
cugaaaguggugcu

SEQ ID NO: 564516 - RNA, 19 nt, Homo sapiens
cugaaauaaaaugauaaac

SEQ ID NO: 564517 - RNA, 22 nt, Homo sapiens
cugaaaugcuugaaaccagaau

SEQ ID NO: 564518 - RNA, 13 nt, Homo sapiens
cugaaaugucagu

SEQ ID NO: 564519 - RNA, 18 nt, Homo sapiens
cugaaauuaaaguaugca

SEQ ID NO: 564520 - RNA, 23 nt, Homo sapiens
cugaaauuuaucuuuucuucuau

SEQ ID NO: 564521 - RNA, 23 nt, Homo sapiens
cugaaauuuuaauugaacuaaca

SEQ ID NO: 564522 - RNA, 22 nt, Homo sapiens
cugaacaaaauguaaagccagc

SEQ ID NO: 564523 - RNA, 18 nt, Homo sapiens
cugaacacaucgugauga

SEQ ID NO: 564524 - RNA, 12 nt, Homo sapiens
cugaacaugccu

SEQ ID NO: 564525 - RNA, 17 nt, Homo sapiens
cugaacauguacacugg

SEQ ID NO: 564526 - RNA, 14 nt, Homo sapiens
cugaacauugcaua

SEQ ID NO: 564527 - RNA, 17 nt, Homo sapiens
cugaaccaagauguaaa

SEQ ID NO: 564528 - RNA, 18 nt, Homo sapiens
cugaaccauguggauaac

SEQ ID NO: 564529 - RNA, 15 nt, Homo sapiens
cugaacccauuuuga

SEQ ID NO: 564530 - RNA, 17 nt, Homo sapiens
cugaacccuaaggugag

SEQ ID NO: 564531 - RNA, 15 nt, Homo sapiens
cugaacccugugcug

SEQ ID NO: 564532 - RNA, 18 nt, Homo sapiens
cugaacgcguguguacac

SEQ ID NO: 564533 - RNA, 15 nt, Homo sapiens
cugaacuacuaaagu

SEQ ID NO: 564534 - RNA, 16 nt, Homo sapiens
cugaacugcaacacug

SEQ ID NO: 564535 - RNA, 22 nt, Homo sapiens
cugaacuugccuuaaacacuca

SEQ ID NO: 564536 - RNA, 21 nt, Homo sapiens
cugaacuuugcaaagaccuuc

SEQ ID NO: 564537 - RNA, 21 nt, Homo sapiens
cugaagaaaccuucagauuug

SEQ ID NO: 564538 - RNA, 22 nt, Homo sapiens
cugaagaacaguaacugccauc

SEQ ID NO: 564539 - RNA, 21 nt, Homo sapiens
cugaagaagaucccagaggau

SEQ ID NO: 564540 - RNA, 22 nt, Homo sapiens
cugaagagaccuuggcugcuca

SEQ ID NO: 564541 - RNA, 13 nt, Homo sapiens
cugaagagccuga

SEQ ID NO: 564542 - RNA, 14 nt, Homo sapiens
cugaagagguugaa

SEQ ID NO: 564543 - RNA, 17 nt, Homo sapiens
cugaagaucaagccagu

SEQ ID NO: 564544 - RNA, 13 nt, Homo sapiens
cugaagaugucaa

SEQ ID NO: 564545 - RNA, 20 nt, Homo sapiens
cugaagauugcgguuuacag

SEQ ID NO: 564546 - RNA, 20 nt, Homo sapiens
cugaagcccagcgacacaga

SEQ ID NO: 564547 - RNA, 17 nt, Homo sapiens
cugaagccuggauucca

SEQ ID NO: 564548 - RNA, 19 nt, Homo sapiens
cugaagcgagcccucagga

SEQ ID NO: 564549 - RNA, 16 nt, Homo sapiens
cugaagcugaaaugca

SEQ ID NO: 564550 - RNA, 19 nt, Homo sapiens
cugaagcuucaaaaagcca

SEQ ID NO: 564551 - RNA, 21 nt, Homo sapiens
cugaagcuucaaaaagccacu

SEQ ID NO: 564552 - RNA, 19 nt, Homo sapiens
cugaaggacacuuccugcc

SEQ ID NO: 564553 - RNA, 19 nt, Homo sapiens
cugaaggagccccauuccu

SEQ ID NO: 564554 - RNA, 20 nt, Homo sapiens
cugaaggcagucauaucaaa

SEQ ID NO: 564555 - RNA, 19 nt, Homo sapiens
cugaaggcugaaagacagg

SEQ ID NO: 564556 - RNA, 22 nt, Homo sapiens
cugaagggaacuagagguguua

SEQ ID NO: 564557 - RNA, 21 nt, Homo sapiens
cugaagggaaggcaaaggcag

SEQ ID NO: 564558 - RNA, 15 nt, Homo sapiens
cugaagggcauacaa

SEQ ID NO: 564559 - RNA, 17 nt, Homo sapiens
cugaagggcaucaugca

SEQ ID NO: 564560 - RNA, 20 nt, Homo sapiens
cugaagggcaucaugcaucu

SEQ ID NO: 564561 - RNA, 17 nt, Homo sapiens
cugaaggggaggucaca

SEQ ID NO: 564562 - RNA, 18 nt, Homo sapiens
cugaaggggcacaccacu

SEQ ID NO: 564563 - RNA, 12 nt, Homo sapiens
cugaagguccag

SEQ ID NO: 564564 - RNA, 20 nt, Homo sapiens
cugaaguacuuaaacuucca

SEQ ID NO: 564565 - RNA, 21 nt, Homo sapiens
cugaaguacuuaaacuuccac

SEQ ID NO: 564566 - RNA, 12 nt, Homo sapiens
cugaagugcuua

SEQ ID NO: 564567 - RNA, 16 nt, Homo sapiens
cugaagugucacagcc

SEQ ID NO: 564568 - RNA, 20 nt, Homo sapiens
cugaaguguggcugcaucuu

SEQ ID NO: 564569 - RNA, 23 nt, Homo sapiens
cugaaguuggccaccuugcuuga

SEQ ID NO: 564570 - RNA, 15 nt, Homo sapiens
cugaauaaacaggaa

SEQ ID NO: 564571 - RNA, 17 nt, Homo sapiens
cugaauaaaugauuaaa

SEQ ID NO: 564572 - RNA, 23 nt, Homo sapiens
cugaauagcagaagguugcaccu

SEQ ID NO: 564573 - RNA, 13 nt, Homo sapiens
cugaauauauaaa

SEQ ID NO: 564574 - RNA, 13 nt, Homo sapiens
cugaaucacuuaa

SEQ ID NO: 564575 - RNA, 16 nt, Homo sapiens
cugaaucagcaugaaa

SEQ ID NO: 564576 - RNA, 19 nt, Homo sapiens
cugaaucagcuggacauac

SEQ ID NO: 564577 - RNA, 23 nt, Homo sapiens
cugaaucuggaccccaucuguga

SEQ ID NO: 564578 - RNA, 20 nt, Homo sapiens
cugaaucuucaagaccaaag

SEQ ID NO: 564579 - RNA, 20 nt, Homo sapiens
cugaaugccucaaugugacc

SEQ ID NO: 564580 - RNA, 13 nt, Homo sapiens
cugaaugcuccau

SEQ ID NO: 564581 - RNA, 23 nt, Homo sapiens
cugaaugcugcuuccauuugaca

SEQ ID NO: 564582 - RNA, 23 nt, Homo sapiens
cuggaagauauaacauucaguuc

SEQ ID NO: 564583 - RNA, 22 nt, Homo sapiens
cuggaagccaccucaccaagga

SEQ ID NO: 564584 - RNA, 15 nt, Homo sapiens
cuggaagcugauuca

SEQ ID NO: 564585 - RNA, 14 nt, Homo sapiens
cuggaagcuuucau

SEQ ID NO: 564586 - RNA, 21 nt, Homo sapiens
cuggaagggcagaguagccag

SEQ ID NO: 564587 - RNA, 15 nt, Homo sapiens
cuggaaggggccacg

SEQ ID NO: 564588 - RNA, 18 nt, Homo sapiens
cuggaagggguccagccu

SEQ ID NO: 564589 - RNA, 23 nt, Homo sapiens
cuggaaggucaauuucaguguau

SEQ ID NO: 564590 - RNA, 15 nt, Homo sapiens
cuggaaggugccacu

SEQ ID NO: 564591 - RNA, 20 nt, Homo sapiens
cuggaaggugccacuccagu

SEQ ID NO: 564592 - RNA, 18 nt, Homo sapiens
cuggaagucaucucauuc

SEQ ID NO: 564593 - RNA, 22 nt, Homo sapiens
cuggaauaaacagugagcauau

SEQ ID NO: 564594 - RNA, 20 nt, Homo sapiens
cuggaauauaaaacagucau

SEQ ID NO: 564595 - RNA, 23 nt, Homo sapiens
cuggaaucacaaaccaagccaug

SEQ ID NO: 564596 - RNA, 21 nt, Homo sapiens
cuggaaugaagaccaugccua

SEQ ID NO: 564597 - RNA, 22 nt, Homo sapiens
cuggaaugaagaccaugccuag

SEQ ID NO: 564598 - RNA, 17 nt, Homo sapiens
cuggaauguacaguauu

SEQ ID NO: 564599 - RNA, 19 nt, Homo sapiens
cuggaauuaaaacaaaaca

SEQ ID NO: 564600 - RNA, 16 nt, Homo sapiens
cuggaauuacaaaacu

SEQ ID NO: 564601 - RNA, 13 nt, Homo sapiens
cuggaauugauau

SEQ ID NO: 564602 - RNA, 17 nt, Homo sapiens
cuggaauugauauugaa

SEQ ID NO: 564603 - RNA, 14 nt, Homo sapiens
cuggaauuuaccuc

SEQ ID NO: 564604 - RNA, 14 nt, Homo sapiens
cuggacaacacuga

SEQ ID NO: 564605 - RNA, 15 nt, Homo sapiens
cuggacaacacugau

SEQ ID NO: 564606 - RNA, 23 nt, Homo sapiens
cuggacacacuguuacacgugcc

SEQ ID NO: 564607 - RNA, 20 nt, Homo sapiens
cuggacagaugaauaccuuu

SEQ ID NO: 564608 - RNA, 22 nt, Homo sapiens
cuggacaggcucugcuucucca

SEQ ID NO: 564609 - RNA, 12 nt, Homo sapiens
cuggaccagcug

SEQ ID NO: 564610 - RNA, 14 nt, Homo sapiens
cuggaccauuccag

SEQ ID NO: 564611 - RNA, 13 nt, Homo sapiens
cuggaccauuuga

SEQ ID NO: 564612 - RNA, 21 nt, Homo sapiens
cuggaccugcccugggccaca

SEQ ID NO: 564613 - RNA, 22 nt, Homo sapiens
cuggacggcaggcucacugcca

SEQ ID NO: 564614 - RNA, 19 nt, Homo sapiens
cuggacuccggaggacuga

SEQ ID NO: 564615 - RNA, 13 nt, Homo sapiens
cuggacucuggac

SEQ ID NO: 564616 - RNA, 12 nt, Homo sapiens
cuggacugggag

SEQ ID NO: 564617 - RNA, 14 nt, Homo sapiens
cuggacuucuuagu

SEQ ID NO: 564618 - RNA, 13 nt, Homo sapiens
cuggacuugaaug

SEQ ID NO: 564619 - RNA, 22 nt, Homo sapiens
cuggacuuuccuguugucuaca

SEQ ID NO: 564620 - RNA, 14 nt, Homo sapiens
cuggagaaagacuu

SEQ ID NO: 564621 - RNA, 19 nt, Homo sapiens
cuggagacggggcaucucc

SEQ ID NO: 564622 - RNA, 21 nt, Homo sapiens
cuggagaggaagccaguggag

SEQ ID NO: 564623 - RNA, 22 nt, Homo sapiens
cuggagagguuaaggugcaaua

SEQ ID NO: 564624 - RNA, 13 nt, Homo sapiens
cuggagaguaauc

SEQ ID NO: 564625 - RNA, 23 nt, Homo sapiens
cuggagauaacagccucuugccc

SEQ ID NO: 564626 - RNA, 20 nt, Homo sapiens
cuggagauggacaacucaau

SEQ ID NO: 564627 - RNA, 16 nt, Homo sapiens
cuggagcaagugcuca

SEQ ID NO: 564628 - RNA, 17 nt, Homo sapiens
cuggagcaucugacuca

SEQ ID NO: 564629 - RNA, 18 nt, Homo sapiens
cuggagcaucugacucac

SEQ ID NO: 564630 - RNA, 21 nt, Homo sapiens
cuggagccaucucuuccucau

SEQ ID NO: 564631 - RNA, 15 nt, Homo sapiens
cuggagcccacagcg

SEQ ID NO: 564632 - RNA, 22 nt, Homo sapiens
cuggagcccccagcagaggcag

SEQ ID NO: 564633 - RNA, 19 nt, Homo sapiens
cuggagccuccacugccuc

SEQ ID NO: 564634 - RNA, 14 nt, Homo sapiens
cuggagccugcaga

SEQ ID NO: 564635 - RNA, 14 nt, Homo sapiens
cuggagccuuugaa

SEQ ID NO: 564636 - RNA, 12 nt, Homo sapiens
cuggaggaacuu

SEQ ID NO: 564637 - RNA, 18 nt, Homo sapiens
cuggaggaaucacugggg

SEQ ID NO: 564638 - RNA, 14 nt, Homo sapiens
cuggaggcugacac

SEQ ID NO: 564639 - RNA, 20 nt, Homo sapiens
cuggagggagaacccaaaga

SEQ ID NO: 564640 - RNA, 21 nt, Homo sapiens
cuggagggaggcugggcgggu

SEQ ID NO: 564641 - RNA, 14 nt, Homo sapiens
cuggagggcacuuc

SEQ ID NO: 564642 - RNA, 19 nt, Homo sapiens
cuggaggggcuguccuccu

SEQ ID NO: 564643 - RNA, 23 nt, Homo sapiens
cuggaggguaacuggggggccac

SEQ ID NO: 564644 - RNA, 16 nt, Homo sapiens
cuggaggucacauuca

SEQ ID NO: 564645 - RNA, 14 nt, Homo sapiens
cuggaggugcugcu

SEQ ID NO: 564646 - RNA, 13 nt, Homo sapiens
cuggagucgggac

SEQ ID NO: 564647 - RNA, 21 nt, Homo sapiens
cuggagucgggacuaacccag

SEQ ID NO: 564648 - RNA, 20 nt, Homo sapiens
cuggagucuccugaggacac

SEQ ID NO: 564649 - RNA, 20 nt, Homo sapiens
cuggagugcaauggugugau

SEQ ID NO: 564650 - RNA, 12 nt, Homo sapiens
cuggagugcagu

SEQ ID NO: 564651 - RNA, 17 nt, Homo sapiens
cuggagugcaguggcau

SEQ ID NO: 564652 - RNA, 19 nt, Homo sapiens
cuggagugcaguggcgcau

SEQ ID NO: 564653 - RNA, 13 nt, Homo sapiens
cuggagugcaguu

SEQ ID NO: 564654 - RNA, 14 nt, Homo sapiens
cuggauacugcaaa

SEQ ID NO: 564655 - RNA, 13 nt, Homo sapiens
cuggauccaucag

SEQ ID NO: 564656 - RNA, 15 nt, Homo sapiens
cuggaucuaccagca

SEQ ID NO: 564657 - RNA, 20 nt, Homo sapiens
cuggaucucuuaagacagca

SEQ ID NO: 564658 - RNA, 19 nt, Homo sapiens
cuggaucuugggaccucca

SEQ ID NO: 564659 - RNA, 19 nt, Homo sapiens
cuggaugagacuuccaaac

SEQ ID NO: 564660 - RNA, 20 nt, Homo sapiens
cuggaugucaaacaguaaua

SEQ ID NO: 564661 - RNA, 21 nt, Homo sapiens
cuggaugucugggugaccuca

SEQ ID NO: 564662 - RNA, 23 nt, Homo sapiens
cuggauuauguuauacaaggcaa

SEQ ID NO: 564663 - RNA, 15 nt, Homo sapiens
cuggauucacucacu

SEQ ID NO: 564664 - RNA, 13 nt, Homo sapiens
cuggauucauucu

SEQ ID NO: 564665 - RNA, 16 nt, Homo sapiens
cuggauuccuuuggaa

SEQ ID NO: 564666 - RNA, 20 nt, Homo sapiens
cuggauuuauaguaugugac

SEQ ID NO: 564667 - RNA, 19 nt, Homo sapiens
cuggauuugcaggugaaca

SEQ ID NO: 564668 - RNA, 14 nt, Homo sapiens
cuggcaacacagag

SEQ ID NO: 564669 - RNA, 16 nt, Homo sapiens
cuggcaagcagggaaa

SEQ ID NO: 564670 - RNA, 21 nt, Homo sapiens
cuggcaauucacaaauagcca

SEQ ID NO: 564671 - RNA, 14 nt, Homo sapiens
cuggcacagaggua

SEQ ID NO: 564672 - RNA, 15 nt, Homo sapiens
cuggcacuacaggca

SEQ ID NO: 564673 - RNA, 19 nt, Homo sapiens
cuggcacugaauuaaucau

SEQ ID NO: 564674 - RNA, 18 nt, Homo sapiens
cuggcacuuagcccaaga

SEQ ID NO: 564675 - RNA, 19 nt, Homo sapiens
cuggcagccgugccuucag

SEQ ID NO: 564676 - RNA, 12 nt, Homo sapiens
cuggcaguacug

SEQ ID NO: 564677 - RNA, 18 nt, Homo sapiens
cuggcauaucuggucaga

SEQ ID NO: 564678 - RNA, 16 nt, Homo sapiens
cuggcaucucacuuua

SEQ ID NO: 564679 - RNA, 17 nt, Homo sapiens
cuggcaucucacuuuau

SEQ ID NO: 564680 - RNA, 14 nt, Homo sapiens
cuggcauuaagggc

SEQ ID NO: 564681 - RNA, 19 nt, Homo sapiens
cuggccaaauaugcacuuu

SEQ ID NO: 564682 - RNA, 19 nt, Homo sapiens
cuggccacaguuguuugau

SEQ ID NO: 564683 - RNA, 16 nt, Homo sapiens
cuggccaccugaggug

SEQ ID NO: 564684 - RNA, 18 nt, Homo sapiens
cuggccacugaaaagcuu

SEQ ID NO: 564685 - RNA, 16 nt, Homo sapiens
cuggccagcacccucu

SEQ ID NO: 564686 - RNA, 23 nt, Homo sapiens
cuggccaggauaauauauuugca

SEQ ID NO: 564687 - RNA, 23 nt, Homo sapiens
cuggccauguggcccuccagugu

SEQ ID NO: 564688 - RNA, 16 nt, Homo sapiens
cuggcccacugagcca

SEQ ID NO: 564689 - RNA, 14 nt, Homo sapiens
cuggcccagccaaa

SEQ ID NO: 564690 - RNA, 17 nt, Homo sapiens
cuggccccggccuuuau

SEQ ID NO: 564691 - RNA, 20 nt, Homo sapiens
cuggccccgggcucuggcca

SEQ ID NO: 564692 - RNA, 13 nt, Homo sapiens
cuggccccugugc

SEQ ID NO: 564693 - RNA, 23 nt, Homo sapiens
cuggcccuguccuggcaucagua

SEQ ID NO: 564694 - RNA, 20 nt, Homo sapiens
cuggcccuucagucugcucc

SEQ ID NO: 564695 - RNA, 21 nt, Homo sapiens
cuggcccuugcuuaccucuca

SEQ ID NO: 564696 - RNA, 16 nt, Homo sapiens
cuggcccuuggggaga

SEQ ID NO: 564697 - RNA, 19 nt, Homo sapiens
cuggccuccuaugccucau

SEQ ID NO: 564698 - RNA, 15 nt, Homo sapiens
cuggccucugugauu

SEQ ID NO: 564699 - RNA, 20 nt, Homo sapiens
cuggccucugugauuacaua

SEQ ID NO: 564700 - RNA, 16 nt, Homo sapiens
cuggccuggcacauca

SEQ ID NO: 564701 - RNA, 20 nt, Homo sapiens
cuggccuggcaguugaacag

SEQ ID NO: 564702 - RNA, 15 nt, Homo sapiens
cuggccuuucacuuu

SEQ ID NO: 564703 - RNA, 23 nt, Homo sapiens
cugucaccacccugcucauccac

SEQ ID NO: 564704 - RNA, 18 nt, Homo sapiens
cugucaccaugacuuccu

SEQ ID NO: 564705 - RNA, 17 nt, Homo sapiens
cugucacccagcuccuc

SEQ ID NO: 564706 - RNA, 22 nt, Homo sapiens
cugucacccauauggucccugg

SEQ ID NO: 564707 - RNA, 20 nt, Homo sapiens
cugucacguggcuucaucag

SEQ ID NO: 564708 - RNA, 21 nt, Homo sapiens
cugucacguucuccacacggg

SEQ ID NO: 564709 - RNA, 18 nt, Homo sapiens
cugucacuacacacuaaa

SEQ ID NO: 564710 - RNA, 21 nt, Homo sapiens
cugucacuggcagagcacagc

SEQ ID NO: 564711 - RNA, 13 nt, Homo sapiens
cugucagccugac

SEQ ID NO: 564712 - RNA, 18 nt, Homo sapiens
cugucaggaaguaaaaua

SEQ ID NO: 564713 - RNA, 15 nt, Homo sapiens
cugucagucacagcc

SEQ ID NO: 564714 - RNA, 15 nt, Homo sapiens
cugucauaugcagaa

SEQ ID NO: 564715 - RNA, 20 nt, Homo sapiens
cugucauccucaggaaccaa

SEQ ID NO: 564716 - RNA, 24 nt, Homo sapiens
cugucaugaaaucagcaagagagg

SEQ ID NO: 564717 - RNA, 15 nt, Homo sapiens
cugucauuuccucua

SEQ ID NO: 564718 - RNA, 21 nt, Homo sapiens
cugucauuuuucuagcauuuu

SEQ ID NO: 564719 - RNA, 14 nt, Homo sapiens
cuguccacacccag

SEQ ID NO: 564720 - RNA, 12 nt, Homo sapiens
cuguccagagag

SEQ ID NO: 564721 - RNA, 18 nt, Homo sapiens
cuguccagcuuauagucu

SEQ ID NO: 564722 - RNA, 14 nt, Homo sapiens
cuguccaugaagca

SEQ ID NO: 564723 - RNA, 13 nt, Homo sapiens
cugucccagagag

SEQ ID NO: 564724 - RNA, 19 nt, Homo sapiens
cuguccccaagacacuucc

SEQ ID NO: 564725 - RNA, 22 nt, Homo sapiens
cuguccccacagcuucucuaca

SEQ ID NO: 564726 - RNA, 16 nt, Homo sapiens
cugucccccagcaucg

SEQ ID NO: 564727 - RNA, 19 nt, Homo sapiens
cugucccucaaaugaccca

SEQ ID NO: 564728 - RNA, 19 nt, Homo sapiens
cuguccguaguaucagaga

SEQ ID NO: 564729 - RNA, 22 nt, Homo sapiens
cuguccguucacauguguggua

SEQ ID NO: 564730 - RNA, 12 nt, Homo sapiens
cuguccuaagca

SEQ ID NO: 564731 - RNA, 18 nt, Homo sapiens
cuguccucccgagcuccu

SEQ ID NO: 564732 - RNA, 15 nt, Homo sapiens
cuguccucuuuguga

SEQ ID NO: 564733 - RNA, 17 nt, Homo sapiens
cuguccugcagucccac

SEQ ID NO: 564734 - RNA, 21 nt, Homo sapiens
cuguccuucugaagugugucc

SEQ ID NO: 564735 - RNA, 17 nt, Homo sapiens
cuguccuuuaugauccc

SEQ ID NO: 564736 - RNA, 17 nt, Homo sapiens
cuguccuuucuugcaga

SEQ ID NO: 564737 - RNA, 20 nt, Homo sapiens
cugucgcaugagaacauuaa

SEQ ID NO: 564738 - RNA, 15 nt, Homo sapiens
cugucgucuuagcaa

SEQ ID NO: 564739 - RNA, 21 nt, Homo sapiens
cugucgugacuacacagaguu

SEQ ID NO: 564740 - RNA, 15 nt, Homo sapiens
cugucuaauuugcac

SEQ ID NO: 564741 - RNA, 16 nt, Homo sapiens
cugucuacccagugcu

SEQ ID NO: 564742 - RNA, 14 nt, Homo sapiens
cugucucagagaua

SEQ ID NO: 564743 - RNA, 14 nt, Homo sapiens
cugucucagccucc

SEQ ID NO: 564744 - RNA, 13 nt, Homo sapiens
cugucuccagggc

SEQ ID NO: 564745 - RNA, 17 nt, Homo sapiens
cugucuccuuucucagc

SEQ ID NO: 564746 - RNA, 22 nt, Homo sapiens
cugucucuccuaccugucuucu

SEQ ID NO: 564747 - RNA, 22 nt, Homo sapiens
cugucucuggcauuuguuuccu

SEQ ID NO: 564748 - RNA, 21 nt, Homo sapiens
cugucucuguguuugaaguuu

SEQ ID NO: 564749 - RNA, 23 nt, Homo sapiens
cugucugaguaagcccucaggag

SEQ ID NO: 564750 - RNA, 17 nt, Homo sapiens
cugucugcacagagggu

SEQ ID NO: 564751 - RNA, 15 nt, Homo sapiens
cugucugcccugaac

SEQ ID NO: 564752 - RNA, 16 nt, Homo sapiens
cugucuggugccccua

SEQ ID NO: 564753 - RNA, 16 nt, Homo sapiens
cugucuggugccccuu

SEQ ID NO: 564754 - RNA, 19 nt, Homo sapiens
cugucugucaccagcuauc

SEQ ID NO: 564755 - RNA, 21 nt, Homo sapiens
cugucugugaauauccagaaa

SEQ ID NO: 564756 - RNA, 12 nt, Homo sapiens
cugucugugcca

SEQ ID NO: 564757 - RNA, 15 nt, Homo sapiens
cugucugugccaugg

SEQ ID NO: 564758 - RNA, 18 nt, Homo sapiens
cugucuguggggugguuc

SEQ ID NO: 564759 - RNA, 16 nt, Homo sapiens
cugucuguuugccaca

SEQ ID NO: 564760 - RNA, 23 nt, Homo sapiens
cugucuuagagugggaccaacuu

SEQ ID NO: 564761 - RNA, 16 nt, Homo sapiens
cugucuuccacuguac

SEQ ID NO: 564762 - RNA, 10 nt, Homo sapiens
cugucuuccc

SEQ ID NO: 564763 - RNA, 20 nt, Homo sapiens
cugucuucccaaacccaguc

SEQ ID NO: 564764 - RNA, 13 nt, Homo sapiens
cugucuuccucaa

SEQ ID NO: 564765 - RNA, 18 nt, Homo sapiens
cugucuucuccuaauucu

SEQ ID NO: 564766 - RNA, 16 nt, Homo sapiens
cugucuugaugacugc

SEQ ID NO: 564767 - RNA, 16 nt, Homo sapiens
cugucuugccagauua

SEQ ID NO: 564768 - RNA, 17 nt, Homo sapiens
cugucuugccagauuac

SEQ ID NO: 564769 - RNA, 14 nt, Homo sapiens
cugucuuuaauucu

SEQ ID NO: 564770 - RNA, 18 nt, Homo sapiens
cugucuuugcagggcaca

SEQ ID NO: 564771 - RNA, 22 nt, Homo sapiens
cugucuuuggauaauaggaauu

SEQ ID NO: 564772 - RNA, 17 nt, Homo sapiens
cugucuuugucaccacg

SEQ ID NO: 564773 - RNA, 17 nt, Homo sapiens
cugucuuuuauuuaaca

SEQ ID NO: 564774 - RNA, 21 nt, Homo sapiens
cugugaaaugcuggcauuugc

SEQ ID NO: 564775 - RNA, 16 nt, Homo sapiens
cugugaacccacugaa

SEQ ID NO: 564776 - RNA, 22 nt, Homo sapiens
cugugaauggaggcagagaccu

SEQ ID NO: 564777 - RNA, 16 nt, Homo sapiens
cugugaauuaagccca

SEQ ID NO: 564778 - RNA, 22 nt, Homo sapiens
cugugacauacauauuaucuca

SEQ ID NO: 564779 - RNA, 20 nt, Homo sapiens
cugugacccucucacuuugg

SEQ ID NO: 564780 - RNA, 16 nt, Homo sapiens
cugugacuagaaccau

SEQ ID NO: 564781 - RNA, 22 nt, Homo sapiens
cugugacucgagucacacucaa

SEQ ID NO: 564782 - RNA, 20 nt, Homo sapiens
cugugacuuucaaggacauu

SEQ ID NO: 564783 - RNA, 16 nt, Homo sapiens
cugugagaggugacac

SEQ ID NO: 564784 - RNA, 15 nt, Homo sapiens
cugugagcagggauu

SEQ ID NO: 564785 - RNA, 13 nt, Homo sapiens
cugugaguguaag

SEQ ID NO: 564786 - RNA, 14 nt, Homo sapiens
cugugauacauuuc

SEQ ID NO: 564787 - RNA, 22 nt, Homo sapiens
cugugaugacuugccauuaaaa

SEQ ID NO: 564788 - RNA, 20 nt, Homo sapiens
cugugauuaaagcaguaaua

SEQ ID NO: 564789 - RNA, 17 nt, Homo sapiens
cugugauuagaucacau

SEQ ID NO: 564790 - RNA, 21 nt, Homo sapiens
cugugauucccuccugcuacu

SEQ ID NO: 564791 - RNA, 18 nt, Homo sapiens
cugugauuuaucuuucaa

SEQ ID NO: 564792 - RNA, 16 nt, Homo sapiens
cugugauuuaugccaa

SEQ ID NO: 564793 - RNA, 14 nt, Homo sapiens
cugugcaaagggaa

SEQ ID NO: 564794 - RNA, 20 nt, Homo sapiens
cugugcauacuuucccucau

SEQ ID NO: 564795 - RNA, 16 nt, Homo sapiens
cugugcaucaguggga

SEQ ID NO: 564796 - RNA, 10 nt, Homo sapiens
cugugccaac

SEQ ID NO: 564797 - RNA, 17 nt, Homo sapiens
cugugccacaaugcagu

SEQ ID NO: 564798 - RNA, 21 nt, Homo sapiens
cugugccagacauugcucuca

SEQ ID NO: 564799 - RNA, 23 nt, Homo sapiens
cugugcccagcacagugccugac

SEQ ID NO: 564800 - RNA, 17 nt, Homo sapiens
cugugccccagcagugc

SEQ ID NO: 564801 - RNA, 22 nt, Homo sapiens
cugugccccagcagugccuugu

SEQ ID NO: 564802 - RNA, 22 nt, Homo sapiens
cugugcccccagccucagccca

SEQ ID NO: 564803 - RNA, 23 nt, Homo sapiens
cugugcccccagccucagcccaa

SEQ ID NO: 564804 - RNA, 19 nt, Homo sapiens
cugugcccuagaugcacgu

SEQ ID NO: 564805 - RNA, 14 nt, Homo sapiens
cugugccgugucca

SEQ ID NO: 564806 - RNA, 10 nt, Homo sapiens
cugugccuga

SEQ ID NO: 564807 - RNA, 22 nt, Homo sapiens
cugugccugggcccugggcuga

SEQ ID NO: 564808 - RNA, 17 nt, Homo sapiens
cugugcgccuuguagaa

SEQ ID NO: 564809 - RNA, 15 nt, Homo sapiens
cugugcuaguuuuac

SEQ ID NO: 564810 - RNA, 15 nt, Homo sapiens
cugugcucacuaccu

SEQ ID NO: 564811 - RNA, 16 nt, Homo sapiens
cugugcuggccaugga

SEQ ID NO: 564812 - RNA, 19 nt, Homo sapiens
cugugcugggggaaugagc

SEQ ID NO: 564813 - RNA, 18 nt, Homo sapiens
cugugcuucgacuacugc

SEQ ID NO: 564814 - RNA, 22 nt, Homo sapiens
cugugcuucuauuucuuggaau

SEQ ID NO: 564815 - RNA, 15 nt, Homo sapiens
cugugcuugcuuaga

SEQ ID NO: 564816 - RNA, 15 nt, Homo sapiens
cugugcuuugacuca

SEQ ID NO: 564817 - RNA, 13 nt, Homo sapiens
cugugcuuuucag

SEQ ID NO: 564818 - RNA, 14 nt, Homo sapiens
cuguggaacauaaa

SEQ ID NO: 564819 - RNA, 18 nt, Homo sapiens
cuguggaaggccgaggca

SEQ ID NO: 564820 - RNA, 23 nt, Homo sapiens
cuguggaauauaaauagcugaaa

SEQ ID NO: 564821 - RNA, 16 nt, Homo sapiens
cuguggaauucaguga

SEQ ID NO: 564822 - RNA, 22 nt, Homo sapiens
cuguggagaaauaaaaauaccu

SEQ ID NO: 564823 - RNA, 13 nt, Homo sapiens
cuguggagccauc

SEQ ID NO: 564824 - RNA, 15 nt, Homo sapiens
cuuaugaaaaucaua

SEQ ID NO: 564825 - RNA, 18 nt, Homo sapiens
cuuaugacuugcuacuuu

SEQ ID NO: 564826 - RNA, 17 nt, Homo sapiens
cuuaugagauacuuugc

SEQ ID NO: 564827 - RNA, 16 nt, Homo sapiens
cuuaugauacuugagg

SEQ ID NO: 564828 - RNA, 19 nt, Homo sapiens
cuuaugauuuuauuacaga

SEQ ID NO: 564829 - RNA, 16 nt, Homo sapiens
cuuaugccauauacaa

SEQ ID NO: 564830 - RNA, 16 nt, Homo sapiens
cuuauggcuucacuua

SEQ ID NO: 564831 - RNA, 17 nt, Homo sapiens
cuuauguguuacauuau

SEQ ID NO: 564832 - RNA, 12 nt, Homo sapiens
cuuauguuauac

SEQ ID NO: 564833 - RNA, 14 nt, Homo sapiens
cuuauguuauacaa

SEQ ID NO: 564834 - RNA, 22 nt, Homo sapiens
cuuauguugcacaaugagaaaa

SEQ ID NO: 564835 - RNA, 22 nt, Homo sapiens
cuuauuagggagaaaauucaau

SEQ ID NO: 564836 - RNA, 20 nt, Homo sapiens
cuuauucucuguaggccaaa

SEQ ID NO: 564837 - RNA, 15 nt, Homo sapiens
cuuauugaacauucu

SEQ ID NO: 564838 - RNA, 13 nt, Homo sapiens
cuuauugauccca

SEQ ID NO: 564839 - RNA, 21 nt, Homo sapiens
cuuauuggccacugggucuca

SEQ ID NO: 564840 - RNA, 14 nt, Homo sapiens
cuuauuguaccucu

SEQ ID NO: 564841 - RNA, 16 nt, Homo sapiens
cuuauuuaacuuaaca

SEQ ID NO: 564842 - RNA, 16 nt, Homo sapiens
cuuauuuaaugaaaga

SEQ ID NO: 564843 - RNA, 15 nt, Homo sapiens
cuuauuuauaccuca

SEQ ID NO: 564844 - RNA, 17 nt, Homo sapiens
cuuauuuugcauuccag

SEQ ID NO: 564845 - RNA, 22 nt, Homo sapiens
cuuauuuugucuuauucuuaag

SEQ ID NO: 564846 - RNA, 21 nt, Homo sapiens
cuuauuuugugaacuauauca

SEQ ID NO: 564847 - RNA, 16 nt, Homo sapiens
cuuauuuuuagccaua

SEQ ID NO: 564848 - RNA, 23 nt, Homo sapiens
cuucaaaagcuuuuuacucaaag

SEQ ID NO: 564849 - RNA, 18 nt, Homo sapiens
cuucaaaauaaguguaau

SEQ ID NO: 564850 - RNA, 15 nt, Homo sapiens
cuucaaaauauugag

SEQ ID NO: 564851 - RNA, 13 nt, Homo sapiens
cuucaaacuuuag

SEQ ID NO: 564852 - RNA, 15 nt, Homo sapiens
cuucaaagcugaaua

SEQ ID NO: 564853 - RNA, 22 nt, Homo sapiens
cuucaaagugugugugugcagg

SEQ ID NO: 564854 - RNA, 14 nt, Homo sapiens
cuucaaaucagaag

SEQ ID NO: 564855 - RNA, 14 nt, Homo sapiens
cuucaacaugacau

SEQ ID NO: 564856 - RNA, 16 nt, Homo sapiens
cuucaagaacucuggg

SEQ ID NO: 564857 - RNA, 21 nt, Homo sapiens
cuucaagacgacagcucugua

SEQ ID NO: 564858 - RNA, 23 nt, Homo sapiens
cuucaagccuagcccuucucuca

SEQ ID NO: 564859 - RNA, 20 nt, Homo sapiens
cuucaaggauauacugcagc

SEQ ID NO: 564860 - RNA, 22 nt, Homo sapiens
cuucaaggcccauaucugugaa

SEQ ID NO: 564861 - RNA, 16 nt, Homo sapiens
cuucaaggcccucaga

SEQ ID NO: 564862 - RNA, 20 nt, Homo sapiens
cuucaagggacaaguauuaa

SEQ ID NO: 564863 - RNA, 21 nt, Homo sapiens
cuucaaguauaacaacuuuga

SEQ ID NO: 564864 - RNA, 21 nt, Homo sapiens
cuucaagucccaucauagaaa

SEQ ID NO: 564865 - RNA, 18 nt, Homo sapiens
cuucaaucggcuuguggg

SEQ ID NO: 564866 - RNA, 21 nt, Homo sapiens
cuucaaugcaaaguacaugua

SEQ ID NO: 564867 - RNA, 18 nt, Homo sapiens
cuucaaugggcucuucca

SEQ ID NO: 564868 - RNA, 22 nt, Homo sapiens
cuucaaugggcucuuccaacaa

SEQ ID NO: 564869 - RNA, 19 nt, Homo sapiens
cuucaauuaaaauuacaaa

SEQ ID NO: 564870 - RNA, 15 nt, Homo sapiens
cuucacaaucuguca

SEQ ID NO: 564871 - RNA, 15 nt, Homo sapiens
cuucacagauuguuc

SEQ ID NO: 564872 - RNA, 22 nt, Homo sapiens
cuucacaggcagugcaugugaa

SEQ ID NO: 564873 - RNA, 20 nt, Homo sapiens
cuucacaguagagccagcuu

SEQ ID NO: 564874 - RNA, 23 nt, Homo sapiens
cuucacauaggaagggaucugag

SEQ ID NO: 564875 - RNA, 19 nt, Homo sapiens
cuucacaucucccccauag

SEQ ID NO: 564876 - RNA, 14 nt, Homo sapiens
cuucacaucuguca

SEQ ID NO: 564877 - RNA, 19 nt, Homo sapiens
cuucacauuuguaugugug

SEQ ID NO: 564878 - RNA, 15 nt, Homo sapiens
cuucacccugaaugg

SEQ ID NO: 564879 - RNA, 13 nt, Homo sapiens
cuucaccuuuuga

SEQ ID NO: 564880 - RNA, 12 nt, Homo sapiens
cuucacuacuuu

SEQ ID NO: 564881 - RNA, 20 nt, Homo sapiens
cuucacuagaguucuuugaa

SEQ ID NO: 564882 - RNA, 19 nt, Homo sapiens
cuucacuccccuaucccau

SEQ ID NO: 564883 - RNA, 11 nt, Homo sapiens
cuucacugaag

SEQ ID NO: 564884 - RNA, 20 nt, Homo sapiens
cuucacugccaugauagcug

SEQ ID NO: 564885 - RNA, 17 nt, Homo sapiens
cuucacugcugugacuu

SEQ ID NO: 564886 - RNA, 9 nt, Homo sapiens
cuucacuuc

SEQ ID NO: 564887 - RNA, 21 nt, Homo sapiens
cuucacuucaguugcuuugca

SEQ ID NO: 564888 - RNA, 14 nt, Homo sapiens
cuucagaacugccc

SEQ ID NO: 564889 - RNA, 18 nt, Homo sapiens
cuucagaacugcccuugc

SEQ ID NO: 564890 - RNA, 16 nt, Homo sapiens
cuucagaauagaaacu

SEQ ID NO: 564891 - RNA, 17 nt, Homo sapiens
cuucagaccaucaguua

SEQ ID NO: 564892 - RNA, 18 nt, Homo sapiens
cuucagacugaacaugua

SEQ ID NO: 564893 - RNA, 21 nt, Homo sapiens
cuucagaggauaaauaucaau

SEQ ID NO: 564894 - RNA, 18 nt, Homo sapiens
cuucagagggaaacucag

SEQ ID NO: 564895 - RNA, 21 nt, Homo sapiens
cuucagauauaagacuuuccc

SEQ ID NO: 564896 - RNA, 13 nt, Homo sapiens
cuucagaucugag

SEQ ID NO: 564897 - RNA, 16 nt, Homo sapiens
cuucagauuaaacccu

SEQ ID NO: 564898 - RNA, 16 nt, Homo sapiens
cuucagcacaggaauu

SEQ ID NO: 564899 - RNA, 13 nt, Homo sapiens
cuucagcagucaa

SEQ ID NO: 564900 - RNA, 16 nt, Homo sapiens
cuucagccaaacacaa

SEQ ID NO: 564901 - RNA, 13 nt, Homo sapiens
cuucagccauagu

SEQ ID NO: 564902 - RNA, 19 nt, Homo sapiens
cuucagccaucaacaagag

SEQ ID NO: 564903 - RNA, 17 nt, Homo sapiens
cuucagcccccaccagg

SEQ ID NO: 564904 - RNA, 16 nt, Homo sapiens
cuucagcccuggccaa

SEQ ID NO: 564905 - RNA, 21 nt, Homo sapiens
cuucagccuagccgaccucag

SEQ ID NO: 564906 - RNA, 22 nt, Homo sapiens
cuucagccuagccgaccucagc

SEQ ID NO: 564907 - RNA, 18 nt, Homo sapiens
cuucagccuuaauggaag

SEQ ID NO: 564908 - RNA, 17 nt, Homo sapiens
cuucagcuguacauacu

SEQ ID NO: 564909 - RNA, 19 nt, Homo sapiens
cuucagcuguacauacuca

SEQ ID NO: 564910 - RNA, 19 nt, Homo sapiens
cuucaggaaggacauggac

SEQ ID NO: 564911 - RNA, 17 nt, Homo sapiens
cuucagggaacugcaua

SEQ ID NO: 564912 - RNA, 19 nt, Homo sapiens
cuucagguaacacuacaga

SEQ ID NO: 564913 - RNA, 21 nt, Homo sapiens
cuucaguaaaugugauucacc

SEQ ID NO: 564914 - RNA, 19 nt, Homo sapiens
cuucaguaggaacaagcug

SEQ ID NO: 564915 - RNA, 16 nt, Homo sapiens
cuucaguauguuguca

SEQ ID NO: 564916 - RNA, 17 nt, Homo sapiens
cuucagucuugguaaaa

SEQ ID NO: 564917 - RNA, 18 nt, Homo sapiens
cuucagugaaauuuucag

SEQ ID NO: 564918 - RNA, 22 nt, Homo sapiens
cuucagugcaaauuguaucuua

SEQ ID NO: 564919 - RNA, 16 nt, Homo sapiens
cuucagugggagaaaa

SEQ ID NO: 564920 - RNA, 15 nt, Homo sapiens
cuucagugugguaca

SEQ ID NO: 564921 - RNA, 17 nt, Homo sapiens
cuucaguuucacagaaa

SEQ ID NO: 564922 - RNA, 23 nt, Homo sapiens
cuucauacuggcaggagggugag

SEQ ID NO: 564923 - RNA, 17 nt, Homo sapiens
cuucauagaaaccucuc

SEQ ID NO: 564924 - RNA, 14 nt, Homo sapiens
cuucauagcaaugu

SEQ ID NO: 564925 - RNA, 23 nt, Homo sapiens
cuucauccccuuuggcuaccuga

SEQ ID NO: 564926 - RNA, 22 nt, Homo sapiens
cuucauccucugagugugacca

SEQ ID NO: 564927 - RNA, 11 nt, Homo sapiens
cuucaucucau

SEQ ID NO: 564928 - RNA, 19 nt, Homo sapiens
cuucaucuucacugcaauu

SEQ ID NO: 564929 - RNA, 16 nt, Homo sapiens
cuucaugaagcagauu

SEQ ID NO: 564930 - RNA, 21 nt, Homo sapiens
cuucauguggcucagugccuu

SEQ ID NO: 564931 - RNA, 22 nt, Homo sapiens
cuucaugugguucagugccuuc

SEQ ID NO: 564932 - RNA, 22 nt, Homo sapiens
cuucauuagcuuugggugccuu

SEQ ID NO: 564933 - RNA, 23 nt, Homo sapiens
cuucauuccaaucuauugcuuca

SEQ ID NO: 564934 - RNA, 20 nt, Homo sapiens
cuucauucuccuuguuguug

SEQ ID NO: 564935 - RNA, 15 nt, Homo sapiens
cuucauucuuugcag

SEQ ID NO: 564936 - RNA, 12 nt, Homo sapiens
cuucauuucagg

SEQ ID NO: 564937 - RNA, 22 nt, Homo sapiens
cuucauuucaggaagacugaca

SEQ ID NO: 564938 - RNA, 14 nt, Homo sapiens
cuucauuucucugc

SEQ ID NO: 564939 - RNA, 14 nt, Homo sapiens
cuucauuugcaauu

SEQ ID NO: 564940 - RNA, 16 nt, Homo sapiens
cuuccaaaaccugcuu

SEQ ID NO: 564941 - RNA, 19 nt, Homo sapiens
cuuccaaacagaacuaugg

SEQ ID NO: 564942 - RNA, 20 nt, Homo sapiens
cuuccaaacauuaaugcaau

SEQ ID NO: 564943 - RNA, 14 nt, Homo sapiens
cuuccaaacucuuc

SEQ ID NO: 564944 - RNA, 23 nt, Homo sapiens
cuuccaaauccuggaaggacaca

SEQ ID NO: 564945 - RNA, 20 nt, Homo sapiens
gaagauguuucaaaaaaucu

SEQ ID NO: 564946 - RNA, 18 nt, Homo sapiens
gaagauucuccugugcua

SEQ ID NO: 564947 - RNA, 24 nt, Homo sapiens
gaagauuuuaugcugcuguuuaca

SEQ ID NO: 564948 - RNA, 15 nt, Homo sapiens
gaagcaaagacaaaa

SEQ ID NO: 564949 - RNA, 20 nt, Homo sapiens
gaagcaaagauuucaguaga

SEQ ID NO: 564950 - RNA, 17 nt, Homo sapiens
gaagcaacuaggaaaau

SEQ ID NO: 564951 - RNA, 21 nt, Homo sapiens
gaagcaauaaagcucuucccu

SEQ ID NO: 564952 - RNA, 18 nt, Homo sapiens
gaagcacagaguggcuug

SEQ ID NO: 564953 - RNA, 16 nt, Homo sapiens
gaagcaccccaugcca

SEQ ID NO: 564954 - RNA, 19 nt, Homo sapiens
gaagcacuacaccuugccu

SEQ ID NO: 564955 - RNA, 13 nt, Homo sapiens
gaagcaggaccua

SEQ ID NO: 564956 - RNA, 17 nt, Homo sapiens
gaagcaggguacccuuu

SEQ ID NO: 564957 - RNA, 18 nt, Homo sapiens
gaagcaggguacccuuug

SEQ ID NO: 564958 - RNA, 22 nt, Homo sapiens
gaagcaggugcuacaacaugug

SEQ ID NO: 564959 - RNA, 13 nt, Homo sapiens
gaagcaguauuuu

SEQ ID NO: 564960 - RNA, 12 nt, Homo sapiens
gaagcauaguga

SEQ ID NO: 564961 - RNA, 22 nt, Homo sapiens
gaagccaaaguuuucaaacugc

SEQ ID NO: 564962 - RNA, 14 nt, Homo sapiens
gaagccacaaagac

SEQ ID NO: 564963 - RNA, 16 nt, Homo sapiens
gaagccacuuggccca

SEQ ID NO: 564964 - RNA, 20 nt, Homo sapiens
gaagccauagggggcugcac

SEQ ID NO: 564965 - RNA, 21 nt, Homo sapiens
gaagcccuccaaaagcacuua

SEQ ID NO: 564966 - RNA, 23 nt, Homo sapiens
gaagcccugauguguccucaggg

SEQ ID NO: 564967 - RNA, 15 nt, Homo sapiens
gaagccggcggccca

SEQ ID NO: 564968 - RNA, 16 nt, Homo sapiens
gaagccucuggcuaga

SEQ ID NO: 564969 - RNA, 22 nt, Homo sapiens
gaagccuguccucaccgucucg

SEQ ID NO: 564970 - RNA, 15 nt, Homo sapiens
gaagccuuaagccau

SEQ ID NO: 564971 - RNA, 18 nt, Homo sapiens
gaagcgaaacacagagaa

SEQ ID NO: 564972 - RNA, 14 nt, Homo sapiens
gaagcgcuucugca

SEQ ID NO: 564973 - RNA, 21 nt, Homo sapiens
gaagcguugccauugaacuca

SEQ ID NO: 564974 - RNA, 13 nt, Homo sapiens
gaagcuccacugu

SEQ ID NO: 564975 - RNA, 14 nt, Homo sapiens
gaagcuccacuguc

SEQ ID NO: 564976 - RNA, 15 nt, Homo sapiens
gaagcuccacuguca

SEQ ID NO: 564977 - RNA, 15 nt, Homo sapiens
gaagcucccaggaac

SEQ ID NO: 564978 - RNA, 22 nt, Homo sapiens
gaagcuccggcagaagcagcug

SEQ ID NO: 564979 - RNA, 21 nt, Homo sapiens
gaagcuccugggggaugcucu

SEQ ID NO: 564980 - RNA, 20 nt, Homo sapiens
gaagcucucccuuguuuacu

SEQ ID NO: 564981 - RNA, 19 nt, Homo sapiens
gaagcugcaggcuuugcca

SEQ ID NO: 564982 - RNA, 17 nt, Homo sapiens
gaagcuggagugcugcu

SEQ ID NO: 564983 - RNA, 16 nt, Homo sapiens
gaagcugggcucuuuu

SEQ ID NO: 564984 - RNA, 14 nt, Homo sapiens
gaagcugucaggcu

SEQ ID NO: 564985 - RNA, 12 nt, Homo sapiens
gaagcugugaaa

SEQ ID NO: 564986 - RNA, 21 nt, Homo sapiens
gaagcuguguccuugcaccug

SEQ ID NO: 564987 - RNA, 22 nt, Homo sapiens
gaagcuguguccuugcaccugc

SEQ ID NO: 564988 - RNA, 10 nt, Homo sapiens
gaagcuuuag

SEQ ID NO: 564989 - RNA, 15 nt, Homo sapiens
gaaggaaaacaugcu

SEQ ID NO: 564990 - RNA, 22 nt, Homo sapiens
gaaggaacagcaauggugucag

SEQ ID NO: 564991 - RNA, 13 nt, Homo sapiens
gaaggaaggcagu

SEQ ID NO: 564992 - RNA, 18 nt, Homo sapiens
gaaggaauagccagagag

SEQ ID NO: 564993 - RNA, 14 nt, Homo sapiens
gaaggacacaguga

SEQ ID NO: 564994 - RNA, 15 nt, Homo sapiens
gaaggacacagugau

SEQ ID NO: 564995 - RNA, 13 nt, Homo sapiens
gaaggacauuuua

SEQ ID NO: 564996 - RNA, 16 nt, Homo sapiens
gaaggacggugccaag

SEQ ID NO: 564997 - RNA, 12 nt, Homo sapiens
gaaggacuauca

SEQ ID NO: 564998 - RNA, 18 nt, Homo sapiens
gaaggacuugacugggga

SEQ ID NO: 564999 - RNA, 21 nt, Homo sapiens
gaaggagaguccccugaaggu

SEQ ID NO: 565000 - RNA, 15 nt, Homo sapiens
gaaggagagugcuug

SEQ ID NO: 565001 - RNA, 15 nt, Homo sapiens
gaaggagcaguguga

SEQ ID NO: 565002 - RNA, 22 nt, Homo sapiens
gaaggaggcuuaggacuuucca

SEQ ID NO: 565003 - RNA, 22 nt, Homo sapiens
gaaggaguuucacccugaccau

SEQ ID NO: 565004 - RNA, 15 nt, Homo sapiens
gaaggauaaaagccc

SEQ ID NO: 565005 - RNA, 16 nt, Homo sapiens
gaaggauaaagccacu

SEQ ID NO: 565006 - RNA, 13 nt, Homo sapiens
gaaggaucaucug

SEQ ID NO: 565007 - RNA, 13 nt, Homo sapiens
gaaggcaaaaaga

SEQ ID NO: 565008 - RNA, 20 nt, Homo sapiens
gaaggcagagguugcaguga

SEQ ID NO: 565009 - RNA, 11 nt, Homo sapiens
gaaggcagcug

SEQ ID NO: 565010 - RNA, 15 nt, Homo sapiens
gaaggccacauguca

SEQ ID NO: 565011 - RNA, 10 nt, Homo sapiens
gaaggccagc

SEQ ID NO: 565012 - RNA, 14 nt, Homo sapiens
gaaggccagcugaa

SEQ ID NO: 565013 - RNA, 10 nt, Homo sapiens
gaaggccauu

SEQ ID NO: 565014 - RNA, 15 nt, Homo sapiens
gaaggccccagagag

SEQ ID NO: 565015 - RNA, 14 nt, Homo sapiens
gaaggccuucagga

SEQ ID NO: 565016 - RNA, 18 nt, Homo sapiens
gaaggcuaaaaagcaaca

SEQ ID NO: 565017 - RNA, 17 nt, Homo sapiens
gaaggcugugagccaag

SEQ ID NO: 565018 - RNA, 23 nt, Homo sapiens
gaaggcuuaagaacugcuucaug

SEQ ID NO: 565019 - RNA, 14 nt, Homo sapiens
gaaggcuucacucu

SEQ ID NO: 565020 - RNA, 15 nt, Homo sapiens
gaagggaauugcuca

SEQ ID NO: 565021 - RNA, 17 nt, Homo sapiens
gaagggaauugcucaga

SEQ ID NO: 565022 - RNA, 16 nt, Homo sapiens
gaagggcagugacucg

SEQ ID NO: 565023 - RNA, 17 nt, Homo sapiens
gaagggcgagugaaucu

SEQ ID NO: 565024 - RNA, 17 nt, Homo sapiens
gaagggcguucuaggua

SEQ ID NO: 565025 - RNA, 17 nt, Homo sapiens
gaagggcugaguggucu

SEQ ID NO: 565026 - RNA, 16 nt, Homo sapiens
gaagggggacacucca

SEQ ID NO: 565027 - RNA, 20 nt, Homo sapiens
gaaggggguggggaagaaga

SEQ ID NO: 565028 - RNA, 12 nt, Homo sapiens
gaaggguggaug

SEQ ID NO: 565029 - RNA, 15 nt, Homo sapiens
gaaggucccucagac

SEQ ID NO: 565030 - RNA, 22 nt, Homo sapiens
gaaggucucaggagaagggaua

SEQ ID NO: 565031 - RNA, 21 nt, Homo sapiens
gaaggucugucauaggacucu

SEQ ID NO: 565032 - RNA, 12 nt, Homo sapiens
gaaggugccacu

SEQ ID NO: 565033 - RNA, 12 nt, Homo sapiens
gaaggugccugg

SEQ ID NO: 565034 - RNA, 18 nt, Homo sapiens
gaagguggggauugccca

SEQ ID NO: 565035 - RNA, 13 nt, Homo sapiens
gaagguuaaguca

SEQ ID NO: 565036 - RNA, 18 nt, Homo sapiens
gaagguucccaaggacau

SEQ ID NO: 565037 - RNA, 20 nt, Homo sapiens
gaagguucuacgccagggga

SEQ ID NO: 565038 - RNA, 19 nt, Homo sapiens
gaagguucuucaugaucca

SEQ ID NO: 565039 - RNA, 13 nt, Homo sapiens
gaagguugcucua

SEQ ID NO: 565040 - RNA, 14 nt, Homo sapiens
gaaguaaaacaugc

SEQ ID NO: 565041 - RNA, 16 nt, Homo sapiens
gaaguacuccuauugc

SEQ ID NO: 565042 - RNA, 18 nt, Homo sapiens
gaaguagaauuuguccaa

SEQ ID NO: 565043 - RNA, 20 nt, Homo sapiens
gaaguagacucauucuucac

SEQ ID NO: 565044 - RNA, 21 nt, Homo sapiens
gaaguagacucauucuucaca

SEQ ID NO: 565045 - RNA, 15 nt, Homo sapiens
gaaguagcagugucu

SEQ ID NO: 565046 - RNA, 21 nt, Homo sapiens
gaaguagcucuggugaccuug

SEQ ID NO: 565047 - RNA, 22 nt, Homo sapiens
gaaguaggaggaaacaguucuc

SEQ ID NO: 565048 - RNA, 14 nt, Homo sapiens
gaaguaggcauaua

SEQ ID NO: 565049 - RNA, 13 nt, Homo sapiens
gaaguagguguga

SEQ ID NO: 565050 - RNA, 20 nt, Homo sapiens
gaaguaggugugacuugaac

SEQ ID NO: 565051 - RNA, 14 nt, Homo sapiens
gaaguaugagggaa

SEQ ID NO: 565052 - RNA, 15 nt, Homo sapiens
gaaguaugagggaaa

SEQ ID NO: 565053 - RNA, 22 nt, Homo sapiens
gaaguaugagggaaaaugagua

SEQ ID NO: 565054 - RNA, 18 nt, Homo sapiens
gaaguaugagugcugauu

SEQ ID NO: 565055 - RNA, 20 nt, Homo sapiens
gaaguaugagugcugauuca

SEQ ID NO: 565056 - RNA, 20 nt, Homo sapiens
gaagucagagagggugacaa

SEQ ID NO: 565057 - RNA, 21 nt, Homo sapiens
gaagucaucagcuuugugcca

SEQ ID NO: 565058 - RNA, 13 nt, Homo sapiens
gaagucaucucau

SEQ ID NO: 565059 - RNA, 21 nt, Homo sapiens
gaagucaucucauuccacugu

SEQ ID NO: 565060 - RNA, 22 nt, Homo sapiens
gaagucaucuccuucaaauacu

SEQ ID NO: 565061 - RNA, 19 nt, Homo sapiens
gaaguccccucuacuuuaa

SEQ ID NO: 565062 - RNA, 15 nt, Homo sapiens
gaaguccuucaguga

SEQ ID NO: 565063 - RNA, 17 nt, Homo sapiens
gaagucuaagagugaag

SEQ ID NO: 565064 - RNA, 15 nt, Homo sapiens
gaagucuccaugaag

SEQ ID NO: 565065 - RNA, 17 nt, Homo sapiens
gaagucucccuuggaaa

SEQ ID NO: 565066 - RNA, 18 nt, Homo sapiens
gaagucucuuuuucuucc

SEQ ID NO: 565067 - RNA, 12 nt, Homo sapiens
gaagucuuccau

SEQ ID NO: 565068 - RNA, 18 nt, Homo sapiens
gaccaacuguguuguauu

SEQ ID NO: 565069 - RNA, 14 nt, Homo sapiens
gaccaacuuccugu

SEQ ID NO: 565070 - RNA, 22 nt, Homo sapiens
gaccaauaaccaugcccaagaa

SEQ ID NO: 565071 - RNA, 13 nt, Homo sapiens
gaccaauauucaa

SEQ ID NO: 565072 - RNA, 22 nt, Homo sapiens
gaccaauucaacccuuugcccc

SEQ ID NO: 565073 - RNA, 19 nt, Homo sapiens
gaccaauugugcugccauu

SEQ ID NO: 565074 - RNA, 18 nt, Homo sapiens
gaccacagaagacccgcu

SEQ ID NO: 565075 - RNA, 22 nt, Homo sapiens
gaccacagacgggcacacagac

SEQ ID NO: 565076 - RNA, 19 nt, Homo sapiens
gaccacagcaucauuuugc

SEQ ID NO: 565077 - RNA, 19 nt, Homo sapiens
gaccacauaagaaggcaau

SEQ ID NO: 565078 - RNA, 19 nt, Homo sapiens
gaccacauagaacaugugu

SEQ ID NO: 565079 - RNA, 15 nt, Homo sapiens
gaccaccuaauauca

SEQ ID NO: 565080 - RNA, 21 nt, Homo sapiens
gaccaccuagucuguaacucu

SEQ ID NO: 565081 - RNA, 22 nt, Homo sapiens
gaccacucugucuuguguuucc

SEQ ID NO: 565082 - RNA, 11 nt, Homo sapiens
gaccacugucu

SEQ ID NO: 565083 - RNA, 17 nt, Homo sapiens
gaccacuuccaggggaa

SEQ ID NO: 565084 - RNA, 22 nt, Homo sapiens
gaccacuuuuuguaauacuuuu

SEQ ID NO: 565085 - RNA, 14 nt, Homo sapiens
gaccagcccggcca

SEQ ID NO: 565086 - RNA, 21 nt, Homo sapiens
gaccagccugggcaacauacc

SEQ ID NO: 565087 - RNA, 18 nt, Homo sapiens
gaccagcuuugcagugac

SEQ ID NO: 565088 - RNA, 22 nt, Homo sapiens
gaccaggccaagacucaagccu

SEQ ID NO: 565089 - RNA, 13 nt, Homo sapiens
gaccagggaccac

SEQ ID NO: 565090 - RNA, 16 nt, Homo sapiens
gaccaguaggacucaa

SEQ ID NO: 565091 - RNA, 20 nt, Homo sapiens
gaccagucccgucgugcagu

SEQ ID NO: 565092 - RNA, 21 nt, Homo sapiens
gaccagucccgucgugcaguc

SEQ ID NO: 565093 - RNA, 14 nt, Homo sapiens
gaccagugccuugg

SEQ ID NO: 565094 - RNA, 17 nt, Homo sapiens
gaccagugccuuggcca

SEQ ID NO: 565095 - RNA, 20 nt, Homo sapiens
gaccaguugggagcacugga

SEQ ID NO: 565096 - RNA, 20 nt, Homo sapiens
gaccauaaacguuguguuca

SEQ ID NO: 565097 - RNA, 18 nt, Homo sapiens
gaccaucacaucccuuca

SEQ ID NO: 565098 - RNA, 22 nt, Homo sapiens
gaccaucgcugccugccagcuu

SEQ ID NO: 565099 - RNA, 17 nt, Homo sapiens
gaccaugaaacauugua

SEQ ID NO: 565100 - RNA, 13 nt, Homo sapiens
gaccaugccagac

SEQ ID NO: 565101 - RNA, 23 nt, Homo sapiens
gaccaugguuuuggcucucccac

SEQ ID NO: 565102 - RNA, 16 nt, Homo sapiens
gaccauguuuccucuc

SEQ ID NO: 565103 - RNA, 12 nt, Homo sapiens
gaccauucugcc

SEQ ID NO: 565104 - RNA, 16 nt, Homo sapiens
gacccaaaacacagga

SEQ ID NO: 565105 - RNA, 14 nt, Homo sapiens
gacccaaagcaaaa

SEQ ID NO: 565106 - RNA, 17 nt, Homo sapiens
gacccaacagcagugau

SEQ ID NO: 565107 - RNA, 14 nt, Homo sapiens
gacccaaucugccu

SEQ ID NO: 565108 - RNA, 20 nt, Homo sapiens
gacccacacuuccaugagaa

SEQ ID NO: 565109 - RNA, 22 nt, Homo sapiens
gacccagaauauccaaauaagc

SEQ ID NO: 565110 - RNA, 13 nt, Homo sapiens
gacccagccugaa

SEQ ID NO: 565111 - RNA, 12 nt, Homo sapiens
gacccaggaaag

SEQ ID NO: 565112 - RNA, 23 nt, Homo sapiens
gacccaggaaaggcaggauugaa

SEQ ID NO: 565113 - RNA, 16 nt, Homo sapiens
gacccagggaugacau

SEQ ID NO: 565114 - RNA, 16 nt, Homo sapiens
gacccagggccugacu

SEQ ID NO: 565115 - RNA, 15 nt, Homo sapiens
gacccagucccacac

SEQ ID NO: 565116 - RNA, 18 nt, Homo sapiens
gacccagucccacacugu

SEQ ID NO: 565117 - RNA, 14 nt, Homo sapiens
gaccccagacugua

SEQ ID NO: 565118 - RNA, 17 nt, Homo sapiens
gaccccagccauccagg

SEQ ID NO: 565119 - RNA, 14 nt, Homo sapiens
gaccccaugucucc

SEQ ID NO: 565120 - RNA, 23 nt, Homo sapiens
gacccccagcacuuggggguuca

SEQ ID NO: 565121 - RNA, 17 nt, Homo sapiens
gaccccccuauugcugc

SEQ ID NO: 565122 - RNA, 22 nt, Homo sapiens
gacccccgcccccugcccuccc

SEQ ID NO: 565123 - RNA, 13 nt, Homo sapiens
gaccccucuaccu

SEQ ID NO: 565124 - RNA, 18 nt, Homo sapiens
gaccccugaauucaauga

SEQ ID NO: 565125 - RNA, 14 nt, Homo sapiens
gaccccuguccagg

SEQ ID NO: 565126 - RNA, 18 nt, Homo sapiens
gaccccugucucccaaaa

SEQ ID NO: 565127 - RNA, 14 nt, Homo sapiens
gacccgcucuccau

SEQ ID NO: 565128 - RNA, 15 nt, Homo sapiens
gacccguccauucuu

SEQ ID NO: 565129 - RNA, 16 nt, Homo sapiens
gacccuagccagagaa

SEQ ID NO: 565130 - RNA, 15 nt, Homo sapiens
gacccuagcucuuuc

SEQ ID NO: 565131 - RNA, 14 nt, Homo sapiens
gacccuagugaaaa

SEQ ID NO: 565132 - RNA, 21 nt, Homo sapiens
gacccuccuccacuccaccuc

SEQ ID NO: 565133 - RNA, 17 nt, Homo sapiens
gacccugagaaggcaaa

SEQ ID NO: 565134 - RNA, 20 nt, Homo sapiens
gacccugagcagaauacugg

SEQ ID NO: 565135 - RNA, 15 nt, Homo sapiens
gacccugaggcccug

SEQ ID NO: 565136 - RNA, 17 nt, Homo sapiens
gacccugauacaggcau

SEQ ID NO: 565137 - RNA, 15 nt, Homo sapiens
gacccugcaagacca

SEQ ID NO: 565138 - RNA, 19 nt, Homo sapiens
gacccugccacagccagag

SEQ ID NO: 565139 - RNA, 15 nt, Homo sapiens
gacccuggaccauuc

SEQ ID NO: 565140 - RNA, 17 nt, Homo sapiens
gacccuggggcaggggu

SEQ ID NO: 565141 - RNA, 17 nt, Homo sapiens
gacccugucuucugggc

SEQ ID NO: 565142 - RNA, 18 nt, Homo sapiens
gacccuguucccugucua

SEQ ID NO: 565143 - RNA, 18 nt, Homo sapiens
gacccuucagggccagaa

SEQ ID NO: 565144 - RNA, 18 nt, Homo sapiens
gacccuugauuuugcccc

SEQ ID NO: 565145 - RNA, 16 nt, Homo sapiens
gacccuuggcuaugaa

SEQ ID NO: 565146 - RNA, 12 nt, Homo sapiens
gacccuuuucau

SEQ ID NO: 565147 - RNA, 16 nt, Homo sapiens
gaccguuugcuauauu

SEQ ID NO: 565148 - RNA, 23 nt, Homo sapiens
gaccuaacauucgaucucauuca

SEQ ID NO: 565149 - RNA, 21 nt, Homo sapiens
gaccuagaccaguuugcauga

SEQ ID NO: 565150 - RNA, 15 nt, Homo sapiens
gaccuaggauuucau

SEQ ID NO: 565151 - RNA, 18 nt, Homo sapiens
gaccuaguagaguguaau

SEQ ID NO: 565152 - RNA, 16 nt, Homo sapiens
gaccucaccuagaaau

SEQ ID NO: 565153 - RNA, 11 nt, Homo sapiens
gaccucaggug

SEQ ID NO: 565154 - RNA, 14 nt, Homo sapiens
gaccucaggugauc

SEQ ID NO: 565155 - RNA, 20 nt, Homo sapiens
gaccuccagggagccuagaa

SEQ ID NO: 565156 - RNA, 21 nt, Homo sapiens
gaccuccccugaggcucaggg

SEQ ID NO: 565157 - RNA, 19 nt, Homo sapiens
gaccugacaagcacugcua

SEQ ID NO: 565158 - RNA, 19 nt, Homo sapiens
gaccugcagcgggcaaaga

SEQ ID NO: 565159 - RNA, 22 nt, Homo sapiens
gaccugcaggcagagacugaaa

SEQ ID NO: 565160 - RNA, 13 nt, Homo sapiens
gaccugcccuccc

SEQ ID NO: 565161 - RNA, 23 nt, Homo sapiens
gaccugcggcaguauguacuuca

SEQ ID NO: 565162 - RNA, 22 nt, Homo sapiens
gaccuggagcgccacacacugc

SEQ ID NO: 565163 - RNA, 16 nt, Homo sapiens
gaccuggcuggugaca

SEQ ID NO: 565164 - RNA, 19 nt, Homo sapiens
gaccugggggagccgacca

SEQ ID NO: 565165 - RNA, 17 nt, Homo sapiens
gaccuguaaucauauaa

SEQ ID NO: 565166 - RNA, 17 nt, Homo sapiens
gaccuguccaggugagu

SEQ ID NO: 565167 - RNA, 13 nt, Homo sapiens
gaccuuaaaugca

SEQ ID NO: 565168 - RNA, 14 nt, Homo sapiens
gaccuuaaaugcaa

SEQ ID NO: 565169 - RNA, 18 nt, Homo sapiens
gaccuuaagacacuguga

SEQ ID NO: 565170 - RNA, 18 nt, Homo sapiens
gaccuuaugagaaacugc

SEQ ID NO: 565171 - RNA, 23 nt, Homo sapiens
gaccuuauuaaagguaugcauuu

SEQ ID NO: 565172 - RNA, 15 nt, Homo sapiens
gaccuucagagccag

SEQ ID NO: 565173 - RNA, 18 nt, Homo sapiens
gaccuuccaaggacauau

SEQ ID NO: 565174 - RNA, 14 nt, Homo sapiens
gaccuuccugccac

SEQ ID NO: 565175 - RNA, 19 nt, Homo sapiens
gaccuuccugccaccaguc

SEQ ID NO: 565176 - RNA, 23 nt, Homo sapiens
gaccuuccugccaccagucacug

SEQ ID NO: 565177 - RNA, 18 nt, Homo sapiens
gaccuugacagagcagcu

SEQ ID NO: 565178 - RNA, 15 nt, Homo sapiens
gaccuugcugccaca

SEQ ID NO: 565179 - RNA, 22 nt, Homo sapiens
gaccuuggagcgagucugcccc

SEQ ID NO: 565180 - RNA, 20 nt, Homo sapiens
gaccuugggggaagacuuua

SEQ ID NO: 565181 - RNA, 21 nt, Homo sapiens
gaccuugggggaagacuuuaa

SEQ ID NO: 565182 - RNA, 13 nt, Homo sapiens
gacgacagaugcu

SEQ ID NO: 565183 - RNA, 20 nt, Homo sapiens
gacgagaugacgguguuauu

SEQ ID NO: 565184 - RNA, 19 nt, Homo sapiens
gacgaggggugucuugggc

SEQ ID NO: 565185 - RNA, 18 nt, Homo sapiens
gacgcacagcacuccugu

SEQ ID NO: 565186 - RNA, 17 nt, Homo sapiens
gacgcaucucaaaacag

SEQ ID NO: 565187 - RNA, 23 nt, Homo sapiens
gacggacguugguucugcacuaa

SEQ ID NO: 565188 - RNA, 19 nt, Homo sapiens
gacggagagauauaaaggu

SEQ ID NO: 565189 - RNA, 19 nt, Homo sapiens
gaggaagcagaggucuuca

SEQ ID NO: 565190 - RNA, 20 nt, Homo sapiens
gaggaagcaguuggggcccu

SEQ ID NO: 565191 - RNA, 16 nt, Homo sapiens
gaggaaggcucuguca

SEQ ID NO: 565192 - RNA, 16 nt, Homo sapiens
gaggaaguuuugucua

SEQ ID NO: 565193 - RNA, 14 nt, Homo sapiens
gaggaauccucaga

SEQ ID NO: 565194 - RNA, 13 nt, Homo sapiens
gaggaaugcuccc

SEQ ID NO: 565195 - RNA, 17 nt, Homo sapiens
gaggaauucagcucagc

SEQ ID NO: 565196 - RNA, 21 nt, Homo sapiens
gaggaauuuacuuucuucacc

SEQ ID NO: 565197 - RNA, 14 nt, Homo sapiens
gaggacacaauggc

SEQ ID NO: 565198 - RNA, 12 nt, Homo sapiens
gaggacacagau

SEQ ID NO: 565199 - RNA, 14 nt, Homo sapiens
gaggacccuggaaa

SEQ ID NO: 565200 - RNA, 22 nt, Homo sapiens
gaggacgcacgcucgcugccau

SEQ ID NO: 565201 - RNA, 21 nt, Homo sapiens
gaggacggcccugccugccuc

SEQ ID NO: 565202 - RNA, 18 nt, Homo sapiens
gaggacucaccacugccc

SEQ ID NO: 565203 - RNA, 17 nt, Homo sapiens
gaggacugagacuggca

SEQ ID NO: 565204 - RNA, 19 nt, Homo sapiens
gaggacuugugucucugug

SEQ ID NO: 565205 - RNA, 12 nt, Homo sapiens
gaggagaacaaa

SEQ ID NO: 565206 - RNA, 16 nt, Homo sapiens
gaggagacccuggaau

SEQ ID NO: 565207 - RNA, 21 nt, Homo sapiens
gaggagaugaccagugccuug

SEQ ID NO: 565208 - RNA, 14 nt, Homo sapiens
gaggagauggccau

SEQ ID NO: 565209 - RNA, 15 nt, Homo sapiens
gaggagcaagggugg

SEQ ID NO: 565210 - RNA, 15 nt, Homo sapiens
gaggaggugacaaac

SEQ ID NO: 565211 - RNA, 15 nt, Homo sapiens
gaggagguuucugca

SEQ ID NO: 565212 - RNA, 12 nt, Homo sapiens
gaggagugcagc

SEQ ID NO: 565213 - RNA, 21 nt, Homo sapiens
gaggauacgacaguacacugu

SEQ ID NO: 565214 - RNA, 12 nt, Homo sapiens
gaggaucauuug

SEQ ID NO: 565215 - RNA, 15 nt, Homo sapiens
gaggaugacagugac

SEQ ID NO: 565216 - RNA, 18 nt, Homo sapiens
gaggauggccuggauuca

SEQ ID NO: 565217 - RNA, 24 nt, Homo sapiens
gaggcaagauacaacagcugccga

SEQ ID NO: 565218 - RNA, 22 nt, Homo sapiens
gaggcaagguugggcuggugcu

SEQ ID NO: 565219 - RNA, 19 nt, Homo sapiens
gaggcaaugugggaucuca

SEQ ID NO: 565220 - RNA, 21 nt, Homo sapiens
gaggcaccugcuggaaaccac

SEQ ID NO: 565221 - RNA, 22 nt, Homo sapiens
gaggcagcaccaccacacaguc

SEQ ID NO: 565222 - RNA, 16 nt, Homo sapiens
gaggcaggagaaucac

SEQ ID NO: 565223 - RNA, 21 nt, Homo sapiens
gaggcaggagaauggugugaa

SEQ ID NO: 565224 - RNA, 20 nt, Homo sapiens
gaggcaggagacuggcguga

SEQ ID NO: 565225 - RNA, 20 nt, Homo sapiens
gaggcaggaggaucacuuga

SEQ ID NO: 565226 - RNA, 15 nt, Homo sapiens
gaggcaggaggauug

SEQ ID NO: 565227 - RNA, 19 nt, Homo sapiens
gaggcaggcaaucacuuga

SEQ ID NO: 565228 - RNA, 20 nt, Homo sapiens
gaggcaggggacaagggagg

SEQ ID NO: 565229 - RNA, 16 nt, Homo sapiens
gaggcagguauuagaa

SEQ ID NO: 565230 - RNA, 23 nt, Homo sapiens
gaggcagugugguuauguuccca

SEQ ID NO: 565231 - RNA, 17 nt, Homo sapiens
gaggcauacacacagca

SEQ ID NO: 565232 - RNA, 11 nt, Homo sapiens
gaggcaucuga

SEQ ID NO: 565233 - RNA, 13 nt, Homo sapiens
gaggcauuauuug

SEQ ID NO: 565234 - RNA, 10 nt, Homo sapiens
gaggcauuuc

SEQ ID NO: 565235 - RNA, 23 nt, Homo sapiens
gaggccaguguugugggcuuccu

SEQ ID NO: 565236 - RNA, 20 nt, Homo sapiens
gaggcccaaccuccuauaua

SEQ ID NO: 565237 - RNA, 17 nt, Homo sapiens
gaggcccaggcugggaa

SEQ ID NO: 565238 - RNA, 21 nt, Homo sapiens
gaggcccccuggugugucuga

SEQ ID NO: 565239 - RNA, 19 nt, Homo sapiens
gaggcccugagacagggau

SEQ ID NO: 565240 - RNA, 18 nt, Homo sapiens
gaggccgaggcgggugga

SEQ ID NO: 565241 - RNA, 21 nt, Homo sapiens
gaggccucaggugcuguccau

SEQ ID NO: 565242 - RNA, 20 nt, Homo sapiens
gaggccugcccucagggauc

SEQ ID NO: 565243 - RNA, 16 nt, Homo sapiens
gaggccuuuuuugcca

SEQ ID NO: 565244 - RNA, 17 nt, Homo sapiens
gaggccuuuuuugccag

SEQ ID NO: 565245 - RNA, 14 nt, Homo sapiens
gaggcgcggaguga

SEQ ID NO: 565246 - RNA, 18 nt, Homo sapiens
gaggcgcguuugugcaua

SEQ ID NO: 565247 - RNA, 19 nt, Homo sapiens
gaggcggagaauugcuuga

SEQ ID NO: 565248 - RNA, 20 nt, Homo sapiens
gaggcggagguugcaaugag

SEQ ID NO: 565249 - RNA, 21 nt, Homo sapiens
gaggcggaucaucuaauucuc

SEQ ID NO: 565250 - RNA, 15 nt, Homo sapiens
gaggcggauuucccu

SEQ ID NO: 565251 - RNA, 19 nt, Homo sapiens
gaggcgggcagaucaccag

SEQ ID NO: 565252 - RNA, 23 nt, Homo sapiens
gaggcuaucuaauuuuacacucu

SEQ ID NO: 565253 - RNA, 21 nt, Homo sapiens
gaggcucuaauguacaauaaa

SEQ ID NO: 565254 - RNA, 20 nt, Homo sapiens
gaggcugacacagccacugc

SEQ ID NO: 565255 - RNA, 16 nt, Homo sapiens
gaggcugcagaaggcc

SEQ ID NO: 565256 - RNA, 18 nt, Homo sapiens
gaggcugccccucucacc

SEQ ID NO: 565257 - RNA, 20 nt, Homo sapiens
gaggcugccccucucaccaa

SEQ ID NO: 565258 - RNA, 18 nt, Homo sapiens
gaggcugcccugaggggc

SEQ ID NO: 565259 - RNA, 19 nt, Homo sapiens
gaggcuggaccacacagga

SEQ ID NO: 565260 - RNA, 15 nt, Homo sapiens
gaggcuggugacagg

SEQ ID NO: 565261 - RNA, 18 nt, Homo sapiens
gaggcuggugacaggcca

SEQ ID NO: 565262 - RNA, 22 nt, Homo sapiens
gaggcuucuccuucuccuuccc

SEQ ID NO: 565263 - RNA, 20 nt, Homo sapiens
gaggcuucugauacguguau

SEQ ID NO: 565264 - RNA, 15 nt, Homo sapiens
gaggcuuuaaaaaga

SEQ ID NO: 565265 - RNA, 18 nt, Homo sapiens
gagggaaaagauugacug

SEQ ID NO: 565266 - RNA, 20 nt, Homo sapiens
gagggaaaguaaauauuuca

SEQ ID NO: 565267 - RNA, 17 nt, Homo sapiens
gagggaacagugcccaa

SEQ ID NO: 565268 - RNA, 18 nt, Homo sapiens
gagggaauccauugaacu

SEQ ID NO: 565269 - RNA, 15 nt, Homo sapiens
gagggacacaugccc

SEQ ID NO: 565270 - RNA, 17 nt, Homo sapiens
gagggacaggcacucca

SEQ ID NO: 565271 - RNA, 15 nt, Homo sapiens
gagggacguggugcc

SEQ ID NO: 565272 - RNA, 21 nt, Homo sapiens
gagggagaacccaaagagaca

SEQ ID NO: 565273 - RNA, 20 nt, Homo sapiens
gagggaguggguuaaacaca

SEQ ID NO: 565274 - RNA, 22 nt, Homo sapiens
gagggauaaccccaggcacugu

SEQ ID NO: 565275 - RNA, 18 nt, Homo sapiens
gagggauuuuaaaguaaa

SEQ ID NO: 565276 - RNA, 20 nt, Homo sapiens
gagggcaaucuuugccuuua

SEQ ID NO: 565277 - RNA, 16 nt, Homo sapiens
gagggcagacuggggc

SEQ ID NO: 565278 - RNA, 16 nt, Homo sapiens
gagggcucagggcagu

SEQ ID NO: 565279 - RNA, 23 nt, Homo sapiens
gaggggaaacgcaaaaccugcag

SEQ ID NO: 565280 - RNA, 20 nt, Homo sapiens
gaggggagagagaaccacca

SEQ ID NO: 565281 - RNA, 11 nt, Homo sapiens
gaggggccagc

SEQ ID NO: 565282 - RNA, 18 nt, Homo sapiens
gaggggcccucaggccau

SEQ ID NO: 565283 - RNA, 17 nt, Homo sapiens
gaggggcucucagcuca

SEQ ID NO: 565284 - RNA, 17 nt, Homo sapiens
gagggggaguagccaag

SEQ ID NO: 565285 - RNA, 19 nt, Homo sapiens
gaggggugcagaggcugug

SEQ ID NO: 565286 - RNA, 16 nt, Homo sapiens
gagggguguaccuaaa

SEQ ID NO: 565287 - RNA, 23 nt, Homo sapiens
gagggguucuucuggggugcuaa

SEQ ID NO: 565288 - RNA, 19 nt, Homo sapiens
gaggguaaauaaaccacug

SEQ ID NO: 565289 - RNA, 23 nt, Homo sapiens
gaggguauuuguggaaacuguca

SEQ ID NO: 565290 - RNA, 12 nt, Homo sapiens
gagggugacugu

SEQ ID NO: 565291 - RNA, 18 nt, Homo sapiens
gaggguggcaagggaugu

SEQ ID NO: 565292 - RNA, 14 nt, Homo sapiens
gagggugggccagc

SEQ ID NO: 565293 - RNA, 18 nt, Homo sapiens
gagggugggguaaccaaa

SEQ ID NO: 565294 - RNA, 15 nt, Homo sapiens
gaggguuuugcucuu

SEQ ID NO: 565295 - RNA, 21 nt, Homo sapiens
gagguaaaagugugagcagug

SEQ ID NO: 565296 - RNA, 22 nt, Homo sapiens
gagguaccagcaauauguaaau

SEQ ID NO: 565297 - RNA, 22 nt, Homo sapiens
gagguagaggggaaggaaaucu

SEQ ID NO: 565298 - RNA, 13 nt, Homo sapiens
gaggucacuggaa

SEQ ID NO: 565299 - RNA, 23 nt, Homo sapiens
gaggucauuaaaauuacauugag

SEQ ID NO: 565300 - RNA, 23 nt, Homo sapiens
gagguccccucgucccauccagc

SEQ ID NO: 565301 - RNA, 16 nt, Homo sapiens
gaggucucuugaggga

SEQ ID NO: 565302 - RNA, 18 nt, Homo sapiens
gaggucuuuugacaugug

SEQ ID NO: 565303 - RNA, 13 nt, Homo sapiens
gaggugaauuuca

SEQ ID NO: 565304 - RNA, 20 nt, Homo sapiens
gagguggagauugcagugag

SEQ ID NO: 565305 - RNA, 19 nt, Homo sapiens
gagguggagguugcaguga

SEQ ID NO: 565306 - RNA, 20 nt, Homo sapiens
gagguggagguugcagugag

SEQ ID NO: 565307 - RNA, 20 nt, Homo sapiens
gagguggauuuggagaccga

SEQ ID NO: 565308 - RNA, 19 nt, Homo sapiens
gagguggcggccugcugcu

SEQ ID NO: 565309 - RNA, 14 nt, Homo sapiens
gagguguacaggua

SEQ ID NO: 565310 - RNA, 18 nt, Homo sapiens
gauggaaaaaagccuuca

SEQ ID NO: 565311 - RNA, 15 nt, Homo sapiens
gauggaaaauaccag

SEQ ID NO: 565312 - RNA, 16 nt, Homo sapiens
gauggaaacucuuuaa

SEQ ID NO: 565313 - RNA, 16 nt, Homo sapiens
gauggaacaugcccac

SEQ ID NO: 565314 - RNA, 18 nt, Homo sapiens
gauggaacaugcccacaa

SEQ ID NO: 565315 - RNA, 18 nt, Homo sapiens
gauggaaguugcagugag

SEQ ID NO: 565316 - RNA, 22 nt, Homo sapiens
gauggaauauuccccuaucucu

SEQ ID NO: 565317 - RNA, 23 nt, Homo sapiens
gauggaaugaccagccuguccaa

SEQ ID NO: 565318 - RNA, 21 nt, Homo sapiens
gauggaauuauuguaccauuu

SEQ ID NO: 565319 - RNA, 19 nt, Homo sapiens
gauggaccagugguuucca

SEQ ID NO: 565320 - RNA, 19 nt, Homo sapiens
gauggacccucagucuucu

SEQ ID NO: 565321 - RNA, 22 nt, Homo sapiens
gauggacucugaaaaacauucc

SEQ ID NO: 565322 - RNA, 23 nt, Homo sapiens
gauggagcagucuccugcccucu

SEQ ID NO: 565323 - RNA, 19 nt, Homo sapiens
gauggaggggugguccuga

SEQ ID NO: 565324 - RNA, 23 nt, Homo sapiens
gauggaggggugguccugacuca

SEQ ID NO: 565325 - RNA, 19 nt, Homo sapiens
gauggaggucacacuggua

SEQ ID NO: 565326 - RNA, 18 nt, Homo sapiens
gauggagguucucagagc

SEQ ID NO: 565327 - RNA, 20 nt, Homo sapiens
gauggagucuugcucuguca

SEQ ID NO: 565328 - RNA, 21 nt, Homo sapiens
gauggaugucuucuagcugca

SEQ ID NO: 565329 - RNA, 24 nt, Homo sapiens
gauggauuaacauauagccuuugu

SEQ ID NO: 565330 - RNA, 20 nt, Homo sapiens
gauggcagauucccacugcc

SEQ ID NO: 565331 - RNA, 23 nt, Homo sapiens
gauggccacccgcccacagccag

SEQ ID NO: 565332 - RNA, 20 nt, Homo sapiens
gauggccccuccacugggga

SEQ ID NO: 565333 - RNA, 17 nt, Homo sapiens
gauggcgaccaccaaag

SEQ ID NO: 565334 - RNA, 22 nt, Homo sapiens
gauggcuaugccuugcacacag

SEQ ID NO: 565335 - RNA, 14 nt, Homo sapiens
gauggcucguggga

SEQ ID NO: 565336 - RNA, 17 nt, Homo sapiens
gauggcucgugggaugu

SEQ ID NO: 565337 - RNA, 19 nt, Homo sapiens
gauggcuggaaggggucca

SEQ ID NO: 565338 - RNA, 14 nt, Homo sapiens
gaugggagugggca

SEQ ID NO: 565339 - RNA, 14 nt, Homo sapiens
gauggggcaucggu

SEQ ID NO: 565340 - RNA, 14 nt, Homo sapiens
gauggguccagggg

SEQ ID NO: 565341 - RNA, 21 nt, Homo sapiens
gauggucacacaccagcacuu

SEQ ID NO: 565342 - RNA, 13 nt, Homo sapiens
gaugguccacugu

SEQ ID NO: 565343 - RNA, 16 nt, Homo sapiens
gaugguccgugcccag

SEQ ID NO: 565344 - RNA, 17 nt, Homo sapiens
gaugguccgugcccagg

SEQ ID NO: 565345 - RNA, 17 nt, Homo sapiens
gauggucucgaucuccu

SEQ ID NO: 565346 - RNA, 17 nt, Homo sapiens
gauggucucgaucucuu

SEQ ID NO: 565347 - RNA, 14 nt, Homo sapiens
gauggugacccaga

SEQ ID NO: 565348 - RNA, 21 nt, Homo sapiens
gaugguggccgcccacccgcc

SEQ ID NO: 565349 - RNA, 21 nt, Homo sapiens
gauguaaucucucugcagcug

SEQ ID NO: 565350 - RNA, 19 nt, Homo sapiens
gauguacaaaacaguuuga

SEQ ID NO: 565351 - RNA, 13 nt, Homo sapiens
gauguacaauuaa

SEQ ID NO: 565352 - RNA, 19 nt, Homo sapiens
gauguaccaggcucucgca

SEQ ID NO: 565353 - RNA, 17 nt, Homo sapiens
gauguagaacuucaaga

SEQ ID NO: 565354 - RNA, 18 nt, Homo sapiens
gauguaggguaaggugcc

SEQ ID NO: 565355 - RNA, 19 nt, Homo sapiens
gauguaggguaaggugccu

SEQ ID NO: 565356 - RNA, 20 nt, Homo sapiens
gauguaucccugccccgugg

SEQ ID NO: 565357 - RNA, 17 nt, Homo sapiens
gauguaugaaggcuuuu

SEQ ID NO: 565358 - RNA, 15 nt, Homo sapiens
gauguauguguaaua

SEQ ID NO: 565359 - RNA, 17 nt, Homo sapiens
gauguauuuuucuugcu

SEQ ID NO: 565360 - RNA, 13 nt, Homo sapiens
gaugucagaauuu

SEQ ID NO: 565361 - RNA, 18 nt, Homo sapiens
gauguccccaaaguacca

SEQ ID NO: 565362 - RNA, 18 nt, Homo sapiens
gaugucccccacugcuaa

SEQ ID NO: 565363 - RNA, 17 nt, Homo sapiens
gaugucggucuugcaaa

SEQ ID NO: 565364 - RNA, 23 nt, Homo sapiens
gaugucucacauccucugucuau

SEQ ID NO: 565365 - RNA, 17 nt, Homo sapiens
gaugucugggugaccuc

SEQ ID NO: 565366 - RNA, 13 nt, Homo sapiens
gaugugaagccaa

SEQ ID NO: 565367 - RNA, 20 nt, Homo sapiens
gaugugaagcucacacugau

SEQ ID NO: 565368 - RNA, 19 nt, Homo sapiens
gaugugaauuauugacacu

SEQ ID NO: 565369 - RNA, 14 nt, Homo sapiens
gaugugagccaccg

SEQ ID NO: 565370 - RNA, 17 nt, Homo sapiens
gaugugaucauagcuca

SEQ ID NO: 565371 - RNA, 17 nt, Homo sapiens
gauguuacaucacagug

SEQ ID NO: 565372 - RNA, 16 nt, Homo sapiens
gauguuacuagccucu

SEQ ID NO: 565373 - RNA, 21 nt, Homo sapiens
gauguuagccugcaaacaaca

SEQ ID NO: 565374 - RNA, 18 nt, Homo sapiens
gauguuccagugaggaac

SEQ ID NO: 565375 - RNA, 21 nt, Homo sapiens
gauguuuaacaaaucuaaucu

SEQ ID NO: 565376 - RNA, 15 nt, Homo sapiens
gauguuucaaaaaau

SEQ ID NO: 565377 - RNA, 18 nt, Homo sapiens
gauguuuccagacuuccu

SEQ ID NO: 565378 - RNA, 19 nt, Homo sapiens
gauguuuccagacuuccuu

SEQ ID NO: 565379 - RNA, 19 nt, Homo sapiens
gauguuucuggaauugaua

SEQ ID NO: 565380 - RNA, 18 nt, Homo sapiens
gauguuuucccuuaacuu

SEQ ID NO: 565381 - RNA, 20 nt, Homo sapiens
gauguuuuuaaaaguuucaa

SEQ ID NO: 565382 - RNA, 20 nt, Homo sapiens
gauuaaaaaaucucccaaag

SEQ ID NO: 565383 - RNA, 21 nt, Homo sapiens
gauuaaaaccaaaagaauuug

SEQ ID NO: 565384 - RNA, 18 nt, Homo sapiens
gauuaaaaucucuugauu

SEQ ID NO: 565385 - RNA, 23 nt, Homo sapiens
gauuaaacgugcagacuaugcaa

SEQ ID NO: 565386 - RNA, 15 nt, Homo sapiens
gauuaaauacauaug

SEQ ID NO: 565387 - RNA, 14 nt, Homo sapiens
gauuaagaaugcca

SEQ ID NO: 565388 - RNA, 18 nt, Homo sapiens
gauuaagugguuacuuug

SEQ ID NO: 565389 - RNA, 14 nt, Homo sapiens
gauuaauguuuuca

SEQ ID NO: 565390 - RNA, 12 nt, Homo sapiens
gauuacagaucu

SEQ ID NO: 565391 - RNA, 21 nt, Homo sapiens
gauuacaggcaugagccaccg

SEQ ID NO: 565392 - RNA, 17 nt, Homo sapiens
gauuacaggcauguguc

SEQ ID NO: 565393 - RNA, 21 nt, Homo sapiens
gauuacaggcgugagccaccg

SEQ ID NO: 565394 - RNA, 23 nt, Homo sapiens
gauuaccgacacugucacuugac

SEQ ID NO: 565395 - RNA, 20 nt, Homo sapiens
gauuacuauugcaaaaggga

SEQ ID NO: 565396 - RNA, 16 nt, Homo sapiens
gauuacucuccauauc

SEQ ID NO: 565397 - RNA, 16 nt, Homo sapiens
gauuagguagacuuug

SEQ ID NO: 565398 - RNA, 21 nt, Homo sapiens
gauuagguagacuuugcuuag

SEQ ID NO: 565399 - RNA, 18 nt, Homo sapiens
gauuaguaaaagugcuuu

SEQ ID NO: 565400 - RNA, 20 nt, Homo sapiens
gauuagucucuucuguguga

SEQ ID NO: 565401 - RNA, 18 nt, Homo sapiens
gauuagugucucaugugg

SEQ ID NO: 565402 - RNA, 12 nt, Homo sapiens
gauuauauucac

SEQ ID NO: 565403 - RNA, 19 nt, Homo sapiens
gauuaugugacuugcaaua

SEQ ID NO: 565404 - RNA, 19 nt, Homo sapiens
gauuauuagaaucaaacau

SEQ ID NO: 565405 - RNA, 22 nt, Homo sapiens
gauuauuagccagguaauguga

SEQ ID NO: 565406 - RNA, 20 nt, Homo sapiens
gauuauuauguuuauuacaa

SEQ ID NO: 565407 - RNA, 13 nt, Homo sapiens
gauuauucagugu

SEQ ID NO: 565408 - RNA, 21 nt, Homo sapiens
gauuauuggaaauuuguuaua

SEQ ID NO: 565409 - RNA, 19 nt, Homo sapiens
gauuauuuguguguucuaa

SEQ ID NO: 565410 - RNA, 15 nt, Homo sapiens
gauucaaauugcugc

SEQ ID NO: 565411 - RNA, 16 nt, Homo sapiens
gauucaaauugcugcu

SEQ ID NO: 565412 - RNA, 17 nt, Homo sapiens
gauucaagccauuccaa

SEQ ID NO: 565413 - RNA, 16 nt, Homo sapiens
gauucaauauuaugaa

SEQ ID NO: 565414 - RNA, 20 nt, Homo sapiens
gauucacaucucauuuuucc

SEQ ID NO: 565415 - RNA, 14 nt, Homo sapiens
gauucaccaaaaua

SEQ ID NO: 565416 - RNA, 18 nt, Homo sapiens
gauucaccucuuccucug

SEQ ID NO: 565417 - RNA, 21 nt, Homo sapiens
gauucacgcccucuuguuucc

SEQ ID NO: 565418 - RNA, 20 nt, Homo sapiens
gauucacugcauggcuccca

SEQ ID NO: 565419 - RNA, 20 nt, Homo sapiens
gauucagaaaauguucuguu

SEQ ID NO: 565420 - RNA, 21 nt, Homo sapiens
gauucagaucgaaauuggacu

SEQ ID NO: 565421 - RNA, 21 nt, Homo sapiens
gauucaggggcuuugggccca

SEQ ID NO: 565422 - RNA, 14 nt, Homo sapiens
gauucaguguuaaa

SEQ ID NO: 565423 - RNA, 17 nt, Homo sapiens
gauucaguuuugcuuau

SEQ ID NO: 565424 - RNA, 22 nt, Homo sapiens
gauucauaaaguaaugaugaaa

SEQ ID NO: 565425 - RNA, 15 nt, Homo sapiens
gauucauaagacacu

SEQ ID NO: 565426 - RNA, 23 nt, Homo sapiens
gauucauuauuuuuccacuuugu

SEQ ID NO: 565427 - RNA, 12 nt, Homo sapiens
gauuccagagag

SEQ ID NO: 565428 - RNA, 21 nt, Homo sapiens
gauuccagucuucucuuugaa

SEQ ID NO: 565429 - RNA, 12 nt, Homo sapiens
gauuccauucca

SEQ ID NO: 565430 - RNA, 20 nt, Homo sapiens
gcuaaaccaaggacugagca

SEQ ID NO: 565431 - RNA, 18 nt, Homo sapiens
gcuaaaccaccauuuuau

SEQ ID NO: 565432 - RNA, 11 nt, Homo sapiens
gcuaaagcaac

SEQ ID NO: 565433 - RNA, 18 nt, Homo sapiens
gcuaaaggaagugaaucu

SEQ ID NO: 565434 - RNA, 23 nt, Homo sapiens
gcuaaauaaauggguguauauaa

SEQ ID NO: 565435 - RNA, 13 nt, Homo sapiens
gcuaaauauuuac

SEQ ID NO: 565436 - RNA, 17 nt, Homo sapiens
gcuaaaugcacugaccc

SEQ ID NO: 565437 - RNA, 16 nt, Homo sapiens
gcuaaauucuauguua

SEQ ID NO: 565438 - RNA, 18 nt, Homo sapiens
gcuaacagaaauuaauuu

SEQ ID NO: 565439 - RNA, 11 nt, Homo sapiens
gcuaacaucuu

SEQ ID NO: 565440 - RNA, 20 nt, Homo sapiens
gcuaacccccuucuacugag

SEQ ID NO: 565441 - RNA, 17 nt, Homo sapiens
gcuaaccucucugaacu

SEQ ID NO: 565442 - RNA, 20 nt, Homo sapiens
gcuaacuauauuugcuuuuu

SEQ ID NO: 565443 - RNA, 20 nt, Homo sapiens
gcuaacugcuugaacccaga

SEQ ID NO: 565444 - RNA, 20 nt, Homo sapiens
gcuaacuuaguaagugcuuu

SEQ ID NO: 565445 - RNA, 14 nt, Homo sapiens
gcuaagcacuuuau

SEQ ID NO: 565446 - RNA, 21 nt, Homo sapiens
gcuaaggggaucggacaugaa

SEQ ID NO: 565447 - RNA, 20 nt, Homo sapiens
gcuaaguauuucccagcaca

SEQ ID NO: 565448 - RNA, 13 nt, Homo sapiens
gcuaagugaaaga

SEQ ID NO: 565449 - RNA, 19 nt, Homo sapiens
gcuaauaaacuguauuaaa

SEQ ID NO: 565450 - RNA, 18 nt, Homo sapiens
gcuaauaaauguugccau

SEQ ID NO: 565451 - RNA, 20 nt, Homo sapiens
gcuaauaagaagugccaagu

SEQ ID NO: 565452 - RNA, 14 nt, Homo sapiens
gcuaauaagugcuu

SEQ ID NO: 565453 - RNA, 15 nt, Homo sapiens
gcuaauaagugcuuu

SEQ ID NO: 565454 - RNA, 17 nt, Homo sapiens
gcuaauccaauuauuau

SEQ ID NO: 565455 - RNA, 19 nt, Homo sapiens
gcuaaucuucuuaugcaau

SEQ ID NO: 565456 - RNA, 13 nt, Homo sapiens
gcuaaucuugucc

SEQ ID NO: 565457 - RNA, 18 nt, Homo sapiens
gcuaauguaggacuguau

SEQ ID NO: 565458 - RNA, 13 nt, Homo sapiens
gcuaaugucacaa

SEQ ID NO: 565459 - RNA, 12 nt, Homo sapiens
gcuaauguuucc

SEQ ID NO: 565460 - RNA, 18 nt, Homo sapiens
gcuaauuagaaauauucu

SEQ ID NO: 565461 - RNA, 15 nt, Homo sapiens
gcuaauugugcacau

SEQ ID NO: 565462 - RNA, 19 nt, Homo sapiens
gcuacagaagaaacugggg

SEQ ID NO: 565463 - RNA, 18 nt, Homo sapiens
gcuacaggagcauaccac

SEQ ID NO: 565464 - RNA, 21 nt, Homo sapiens
gcuacauacuccaacugaaau

SEQ ID NO: 565465 - RNA, 16 nt, Homo sapiens
gcuacauauaugcaau

SEQ ID NO: 565466 - RNA, 17 nt, Homo sapiens
gcuacauuccucagcug

SEQ ID NO: 565467 - RNA, 17 nt, Homo sapiens
gcuacccaugacuuuau

SEQ ID NO: 565468 - RNA, 19 nt, Homo sapiens
gcuaccccucaaacugcac

SEQ ID NO: 565469 - RNA, 10 nt, Homo sapiens
gcuaccuccc

SEQ ID NO: 565470 - RNA, 22 nt, Homo sapiens
gcuacgcuccagcugauccaga

SEQ ID NO: 565471 - RNA, 21 nt, Homo sapiens
gcuacucaggaggcugaggca

SEQ ID NO: 565472 - RNA, 14 nt, Homo sapiens
gcuacuggcagcuc

SEQ ID NO: 565473 - RNA, 17 nt, Homo sapiens
gcuacugucucacugaa

SEQ ID NO: 565474 - RNA, 21 nt, Homo sapiens
gcuagaaggccacaugucacc

SEQ ID NO: 565475 - RNA, 17 nt, Homo sapiens
gcuagaagugugaagug

SEQ ID NO: 565476 - RNA, 21 nt, Homo sapiens
gcuagaagugugaagugcaga

SEQ ID NO: 565477 - RNA, 22 nt, Homo sapiens
gcuagacaagcuuguccaugua

SEQ ID NO: 565478 - RNA, 18 nt, Homo sapiens
gcuagaucuaguucucaa

SEQ ID NO: 565479 - RNA, 20 nt, Homo sapiens
gcuagcaccauggcaugcgc

SEQ ID NO: 565480 - RNA, 17 nt, Homo sapiens
gcuaggaaaagaaauca

SEQ ID NO: 565481 - RNA, 15 nt, Homo sapiens
gcuaggaacuuggga

SEQ ID NO: 565482 - RNA, 15 nt, Homo sapiens
gcuaggaugugcauu

SEQ ID NO: 565483 - RNA, 22 nt, Homo sapiens
gcuaggcgcuggggagacugau

SEQ ID NO: 565484 - RNA, 15 nt, Homo sapiens
gcuagggaguggucu

SEQ ID NO: 565485 - RNA, 20 nt, Homo sapiens
gcuagugaaguggccucuug

SEQ ID NO: 565486 - RNA, 12 nt, Homo sapiens
gcuagugcugua

SEQ ID NO: 565487 - RNA, 19 nt, Homo sapiens
gcuaguguaccuccucuca

SEQ ID NO: 565488 - RNA, 14 nt, Homo sapiens
gcuauaaagcagua

SEQ ID NO: 565489 - RNA, 13 nt, Homo sapiens
gcuauaagugcuc

SEQ ID NO: 565490 - RNA, 15 nt, Homo sapiens
gcuauaauaaagaag

SEQ ID NO: 565491 - RNA, 18 nt, Homo sapiens
gcuauaauaaagaagugu

SEQ ID NO: 565492 - RNA, 18 nt, Homo sapiens
gcuauagaaugagugcag

SEQ ID NO: 565493 - RNA, 14 nt, Homo sapiens
gcuauagcuacagg

SEQ ID NO: 565494 - RNA, 15 nt, Homo sapiens
gcuauagcucaggac

SEQ ID NO: 565495 - RNA, 13 nt, Homo sapiens
gcuauauugcacu

SEQ ID NO: 565496 - RNA, 16 nt, Homo sapiens
gcuaucacacaguggg

SEQ ID NO: 565497 - RNA, 19 nt, Homo sapiens
gcuaucacuguacuuguag

SEQ ID NO: 565498 - RNA, 15 nt, Homo sapiens
gcuauccacagcuua

SEQ ID NO: 565499 - RNA, 15 nt, Homo sapiens
gcuaucccacuguau

SEQ ID NO: 565500 - RNA, 22 nt, Homo sapiens
gcuaugaaaacagcuaucucac

SEQ ID NO: 565501 - RNA, 11 nt, Homo sapiens
gcuaugaauga

SEQ ID NO: 565502 - RNA, 21 nt, Homo sapiens
gcuauggaggguccuccucca

SEQ ID NO: 565503 - RNA, 14 nt, Homo sapiens
gcuauggugagaug

SEQ ID NO: 565504 - RNA, 16 nt, Homo sapiens
gcuauuaagaaaauca

SEQ ID NO: 565505 - RNA, 18 nt, Homo sapiens
gcuauuaagaaaaucaca

SEQ ID NO: 565506 - RNA, 19 nt, Homo sapiens
gcuauuaagaaaaucacau

SEQ ID NO: 565507 - RNA, 16 nt, Homo sapiens
gcuauuauuucugguu

SEQ ID NO: 565508 - RNA, 19 nt, Homo sapiens
gcuauuggcccagcuuuua

SEQ ID NO: 565509 - RNA, 22 nt, Homo sapiens
gcuauuuuauuuguauucauga

SEQ ID NO: 565510 - RNA, 19 nt, Homo sapiens
gcuauuuugugaagccaug

SEQ ID NO: 565511 - RNA, 21 nt, Homo sapiens
gcucaaaaccuccaaggaccu

SEQ ID NO: 565512 - RNA, 20 nt, Homo sapiens
gcucaaagcccuuccuaccu

SEQ ID NO: 565513 - RNA, 12 nt, Homo sapiens
gcucaacaucuc

SEQ ID NO: 565514 - RNA, 12 nt, Homo sapiens
gcucaagaacua

SEQ ID NO: 565515 - RNA, 16 nt, Homo sapiens
gcucaauacaauguga

SEQ ID NO: 565516 - RNA, 23 nt, Homo sapiens
gcucaauagcuugaagcccaaga

SEQ ID NO: 565517 - RNA, 24 nt, Homo sapiens
gcucaaucucagcuaacauuccau

SEQ ID NO: 565518 - RNA, 20 nt, Homo sapiens
gcucacgccuguaaucccag

SEQ ID NO: 565519 - RNA, 23 nt, Homo sapiens
gcucacuacugaacacaugugua

SEQ ID NO: 565520 - RNA, 13 nt, Homo sapiens
gcucacugcugau

SEQ ID NO: 565521 - RNA, 17 nt, Homo sapiens
gcucacuugcucaaaac

SEQ ID NO: 565522 - RNA, 15 nt, Homo sapiens
gcucagaaaggaaau

SEQ ID NO: 565523 - RNA, 14 nt, Homo sapiens
gcucagaccagcuc

SEQ ID NO: 565524 - RNA, 18 nt, Homo sapiens
gcucagagcuuugucacu

SEQ ID NO: 565525 - RNA, 19 nt, Homo sapiens
gcucagagugacccucagc

SEQ ID NO: 565526 - RNA, 18 nt, Homo sapiens
gcucagauuguaauaugu

SEQ ID NO: 565527 - RNA, 14 nt, Homo sapiens
gcucagcagccagu

SEQ ID NO: 565528 - RNA, 20 nt, Homo sapiens
gcucagcccaccccccucau

SEQ ID NO: 565529 - RNA, 19 nt, Homo sapiens
gcucagcccugacuggugc

SEQ ID NO: 565530 - RNA, 21 nt, Homo sapiens
gcucagccucccgaguagcug

SEQ ID NO: 565531 - RNA, 21 nt, Homo sapiens
gcucagcuucuuccuaggucc

SEQ ID NO: 565532 - RNA, 22 nt, Homo sapiens
gcucaggaggcuuggaaagcau

SEQ ID NO: 565533 - RNA, 21 nt, Homo sapiens
gcucaggccacauaauuggac

SEQ ID NO: 565534 - RNA, 18 nt, Homo sapiens
gcucagggaaaagcagcu

SEQ ID NO: 565535 - RNA, 20 nt, Homo sapiens
gcucaggggcguguggcuca

SEQ ID NO: 565536 - RNA, 16 nt, Homo sapiens
gcucaggugguugugg

SEQ ID NO: 565537 - RNA, 21 nt, Homo sapiens
gcucagguuuugagaagccau

SEQ ID NO: 565538 - RNA, 23 nt, Homo sapiens
gcucaguaaacgggaacaugccc

SEQ ID NO: 565539 - RNA, 16 nt, Homo sapiens
gcucaguaauuccugu

SEQ ID NO: 565540 - RNA, 15 nt, Homo sapiens
gcucagucucaggag

SEQ ID NO: 565541 - RNA, 20 nt, Homo sapiens
gcucauaagcaauaccagca

SEQ ID NO: 565542 - RNA, 16 nt, Homo sapiens
gcucauagaucagcaa

SEQ ID NO: 565543 - RNA, 13 nt, Homo sapiens
gcucaucacugga

SEQ ID NO: 565544 - RNA, 15 nt, Homo sapiens
gcucaucauauucca

SEQ ID NO: 565545 - RNA, 15 nt, Homo sapiens
gcucaucugcaaaag

SEQ ID NO: 565546 - RNA, 14 nt, Homo sapiens
gcucaugccccuug

SEQ ID NO: 565547 - RNA, 22 nt, Homo sapiens
gcucauuuugcaauuuuaucag

SEQ ID NO: 565548 - RNA, 13 nt, Homo sapiens
gcuccaagacuuu

SEQ ID NO: 565549 - RNA, 18 nt, Homo sapiens
gcuccaagggacaggugg

SEQ ID NO: 565550 - RNA, 13 nt, Homo sapiens
gcuccacugggau

SEQ ID NO: 565551 - RNA, 13 nt, Homo sapiens
gcuccacugucac

SEQ ID NO: 565552 - RNA, 15 nt, Homo sapiens
gcuugcaugcuugca

SEQ ID NO: 565553 - RNA, 11 nt, Homo sapiens
gcuugccaaau

SEQ ID NO: 565554 - RNA, 24 nt, Homo sapiens
gcuugcccagggugcagugugagu

SEQ ID NO: 565555 - RNA, 16 nt, Homo sapiens
gcuuggaccacuuaca

SEQ ID NO: 565556 - RNA, 19 nt, Homo sapiens
gcuuggcccuuuccuucca

SEQ ID NO: 565557 - RNA, 17 nt, Homo sapiens
gcuugggacauggcaca

SEQ ID NO: 565558 - RNA, 19 nt, Homo sapiens
gcuuggggccaccaaagcu

SEQ ID NO: 565559 - RNA, 14 nt, Homo sapiens
gcuuguacuaagcc

SEQ ID NO: 565560 - RNA, 14 nt, Homo sapiens
gcuugugguuuguu

SEQ ID NO: 565561 - RNA, 22 nt, Homo sapiens
gcuuguuguuuuuaaguccugu

SEQ ID NO: 565562 - RNA, 20 nt, Homo sapiens
gcuuguuuacagcacuacuc

SEQ ID NO: 565563 - RNA, 21 nt, Homo sapiens
gcuuguuuacagcacuacucu

SEQ ID NO: 565564 - RNA, 23 nt, Homo sapiens
gcuuguuuacagcacuacucugu

SEQ ID NO: 565565 - RNA, 19 nt, Homo sapiens
gcuuuaaaaugucugugua

SEQ ID NO: 565566 - RNA, 19 nt, Homo sapiens
gcuuuacaguuacaguuga

SEQ ID NO: 565567 - RNA, 16 nt, Homo sapiens
gcuuuacuguuucuca

SEQ ID NO: 565568 - RNA, 14 nt, Homo sapiens
gcuuuagcacagga

SEQ ID NO: 565569 - RNA, 13 nt, Homo sapiens
gcuuuagggcaau

SEQ ID NO: 565570 - RNA, 12 nt, Homo sapiens
gcuuuagucacu

SEQ ID NO: 565571 - RNA, 17 nt, Homo sapiens
gcuuuauauauggacau

SEQ ID NO: 565572 - RNA, 20 nt, Homo sapiens
gcuuuauuccagaaugcugu

SEQ ID NO: 565573 - RNA, 20 nt, Homo sapiens
gcuuuauuuuuuaaguauuu

SEQ ID NO: 565574 - RNA, 21 nt, Homo sapiens
gcuuucaagugccuuucugca

SEQ ID NO: 565575 - RNA, 18 nt, Homo sapiens
gcuuucacauuguacuua

SEQ ID NO: 565576 - RNA, 15 nt, Homo sapiens
gcuuucagcacucac

SEQ ID NO: 565577 - RNA, 17 nt, Homo sapiens
gcuuucauguuauuaaa

SEQ ID NO: 565578 - RNA, 13 nt, Homo sapiens
gcuuuccaagcuu

SEQ ID NO: 565579 - RNA, 20 nt, Homo sapiens
gcuuuccacauuugucacag

SEQ ID NO: 565580 - RNA, 22 nt, Homo sapiens
gcuuuccuuguuagaaugcaag

SEQ ID NO: 565581 - RNA, 18 nt, Homo sapiens
gcuuucuaaaguuaccug

SEQ ID NO: 565582 - RNA, 15 nt, Homo sapiens
gcuuucuccauugua

SEQ ID NO: 565583 - RNA, 22 nt, Homo sapiens
gcuuucuuuaaaguucuucuaa

SEQ ID NO: 565584 - RNA, 19 nt, Homo sapiens
gcuuucuuuuuaguucucu

SEQ ID NO: 565585 - RNA, 16 nt, Homo sapiens
gcuuugaaaaacaguu

SEQ ID NO: 565586 - RNA, 22 nt, Homo sapiens
gcuuugagagcaacgucacugg

SEQ ID NO: 565587 - RNA, 22 nt, Homo sapiens
gcuuugcaaaaugagacuuucu

SEQ ID NO: 565588 - RNA, 23 nt, Homo sapiens
gcuuugcaccccuuuccucccca

SEQ ID NO: 565589 - RNA, 13 nt, Homo sapiens
gcuuugcaggcuc

SEQ ID NO: 565590 - RNA, 12 nt, Homo sapiens
gcuuugcccauu

SEQ ID NO: 565591 - RNA, 14 nt, Homo sapiens
gcuuugccuauuga

SEQ ID NO: 565592 - RNA, 16 nt, Homo sapiens
gcuuuggauuugacau

SEQ ID NO: 565593 - RNA, 17 nt, Homo sapiens
gcuuuggguggcucacu

SEQ ID NO: 565594 - RNA, 19 nt, Homo sapiens
gcuuugguuaauacaucuu

SEQ ID NO: 565595 - RNA, 17 nt, Homo sapiens
gcuuuguaugacaguga

SEQ ID NO: 565596 - RNA, 12 nt, Homo sapiens
gcuuugugauuc

SEQ ID NO: 565597 - RNA, 14 nt, Homo sapiens
gcuuugugcuuguc

SEQ ID NO: 565598 - RNA, 17 nt, Homo sapiens
gcuuugugucaucacaa

SEQ ID NO: 565599 - RNA, 23 nt, Homo sapiens
gcuuuguugaaugaagcagagaa

SEQ ID NO: 565600 - RNA, 14 nt, Homo sapiens
gcuuuguugcugga

SEQ ID NO: 565601 - RNA, 19 nt, Homo sapiens
gcuuuuaagaaacacaggg

SEQ ID NO: 565602 - RNA, 15 nt, Homo sapiens
gcuuuuaauucucau

SEQ ID NO: 565603 - RNA, 15 nt, Homo sapiens
gcuuuuaccaugccc

SEQ ID NO: 565604 - RNA, 19 nt, Homo sapiens
gcuuuucaaacugcaguuu

SEQ ID NO: 565605 - RNA, 15 nt, Homo sapiens
gcuuuucacuacuuu

SEQ ID NO: 565606 - RNA, 17 nt, Homo sapiens
gcuuuucagugauacuc

SEQ ID NO: 565607 - RNA, 18 nt, Homo sapiens
gcuuuucagugauacuca

SEQ ID NO: 565608 - RNA, 14 nt, Homo sapiens
gcuuuuccucccuu

SEQ ID NO: 565609 - RNA, 19 nt, Homo sapiens
gcuuuucuuuuuuaauuuc

SEQ ID NO: 565610 - RNA, 16 nt, Homo sapiens
gcuuuuuccuuuucau

SEQ ID NO: 565611 - RNA, 15 nt, Homo sapiens
gcuuuuugcuucuug

SEQ ID NO: 565612 - RNA, 21 nt, Homo sapiens
gcuuuuugggaccaucacuga

SEQ ID NO: 565613 - RNA, 23 nt, Homo sapiens
gcuuuuugggaccaucacugaga

SEQ ID NO: 565614 - RNA, 18 nt, Homo sapiens
gcuuuuuguucagaauua

SEQ ID NO: 565615 - RNA, 19 nt, Homo sapiens
ggaaaaaaagacugaugaa

SEQ ID NO: 565616 - RNA, 18 nt, Homo sapiens
ggaaaaacaaaugccaua

SEQ ID NO: 565617 - RNA, 15 nt, Homo sapiens
ggaaaacaagcauuc

SEQ ID NO: 565618 - RNA, 17 nt, Homo sapiens
ggaaaacagaguauuuc

SEQ ID NO: 565619 - RNA, 16 nt, Homo sapiens
ggaaaacagggugcua

SEQ ID NO: 565620 - RNA, 21 nt, Homo sapiens
ggaaaacaugcugcucuggug

SEQ ID NO: 565621 - RNA, 12 nt, Homo sapiens
ggaaaacuacug

SEQ ID NO: 565622 - RNA, 13 nt, Homo sapiens
ggaaaacuacuga

SEQ ID NO: 565623 - RNA, 22 nt, Homo sapiens
ggaaaacuguguugccacagua

SEQ ID NO: 565624 - RNA, 17 nt, Homo sapiens
ggaaaagaaaccugggg

SEQ ID NO: 565625 - RNA, 17 nt, Homo sapiens
ggaaaagaaauugcaug

SEQ ID NO: 565626 - RNA, 21 nt, Homo sapiens
ggaaaagaaauugcaugcagu

SEQ ID NO: 565627 - RNA, 21 nt, Homo sapiens
ggaaaagagcgcaucaggccu

SEQ ID NO: 565628 - RNA, 13 nt, Homo sapiens
ggaaaagcaaaac

SEQ ID NO: 565629 - RNA, 21 nt, Homo sapiens
ggaaaagcauuuuucaauaua

SEQ ID NO: 565630 - RNA, 20 nt, Homo sapiens
ggaaaaggggugaccuagua

SEQ ID NO: 565631 - RNA, 13 nt, Homo sapiens
ggaaaagguuguu

SEQ ID NO: 565632 - RNA, 16 nt, Homo sapiens
ggaaaaguuagucaau

SEQ ID NO: 565633 - RNA, 19 nt, Homo sapiens
ggaaaaguuagucaauccu

SEQ ID NO: 565634 - RNA, 20 nt, Homo sapiens
ggaaaauacgaaaaucccau

SEQ ID NO: 565635 - RNA, 14 nt, Homo sapiens
ggaaaaucucagca

SEQ ID NO: 565636 - RNA, 20 nt, Homo sapiens
ggaaaaucuuuauaugcagu

SEQ ID NO: 565637 - RNA, 20 nt, Homo sapiens
ggaaaaugcaaugucuuaaa

SEQ ID NO: 565638 - RNA, 18 nt, Homo sapiens
ggaaaauguccuguggug

SEQ ID NO: 565639 - RNA, 22 nt, Homo sapiens
ggaaaaugugcaauaugugaug

SEQ ID NO: 565640 - RNA, 19 nt, Homo sapiens
ggaaacaaccaugucauuu

SEQ ID NO: 565641 - RNA, 18 nt, Homo sapiens
ggaaacagcaugaauaaa

SEQ ID NO: 565642 - RNA, 19 nt, Homo sapiens
ggaaaccaagucaggccag

SEQ ID NO: 565643 - RNA, 21 nt, Homo sapiens
ggaaaccaguuuggugauaua

SEQ ID NO: 565644 - RNA, 16 nt, Homo sapiens
ggaaaccgcugccuuu

SEQ ID NO: 565645 - RNA, 22 nt, Homo sapiens
ggaaacggucacgagacccaga

SEQ ID NO: 565646 - RNA, 22 nt, Homo sapiens
ggaaacucaaaucgaauaggga

SEQ ID NO: 565647 - RNA, 22 nt, Homo sapiens
ggaaacugcucccaucauuccu

SEQ ID NO: 565648 - RNA, 20 nt, Homo sapiens
ggaaacuguaugaaugucug

SEQ ID NO: 565649 - RNA, 22 nt, Homo sapiens
ggaaacuugaaaggucugagga

SEQ ID NO: 565650 - RNA, 17 nt, Homo sapiens
ggaaagaaaaagcaaua

SEQ ID NO: 565651 - RNA, 16 nt, Homo sapiens
ggaaagaaaugcccau

SEQ ID NO: 565652 - RNA, 23 nt, Homo sapiens
ggaaagaggcucuggacagcaga

SEQ ID NO: 565653 - RNA, 16 nt, Homo sapiens
ggaaagcauaugcagc

SEQ ID NO: 565654 - RNA, 20 nt, Homo sapiens
ggaaagcauaugcagccaac

SEQ ID NO: 565655 - RNA, 16 nt, Homo sapiens
ggaaagcaucaccuca

SEQ ID NO: 565656 - RNA, 16 nt, Homo sapiens
ggaaaggagaguacuu

SEQ ID NO: 565657 - RNA, 21 nt, Homo sapiens
ggaaaggauuuuaccaaagca

SEQ ID NO: 565658 - RNA, 15 nt, Homo sapiens
ggaaaggcagaugua

SEQ ID NO: 565659 - RNA, 18 nt, Homo sapiens
ggaaaggccacccuagaa

SEQ ID NO: 565660 - RNA, 23 nt, Homo sapiens
ggaaaggccccaaucuugcccac

SEQ ID NO: 565661 - RNA, 18 nt, Homo sapiens
ggaaaguaaauauuucag

SEQ ID NO: 565662 - RNA, 22 nt, Homo sapiens
ggaaaguaaauauuucaggcau

SEQ ID NO: 565663 - RNA, 23 nt, Homo sapiens
ggaaaguaaauauuucaggcaua

SEQ ID NO: 565664 - RNA, 21 nt, Homo sapiens
ggaaauauuaagaaagacuau

SEQ ID NO: 565665 - RNA, 22 nt, Homo sapiens
ggaaauauuugucuucucaggc

SEQ ID NO: 565666 - RNA, 21 nt, Homo sapiens
ggaaauauuuugugauggugu

SEQ ID NO: 565667 - RNA, 12 nt, Homo sapiens
ggaaaucuccuc

SEQ ID NO: 565668 - RNA, 22 nt, Homo sapiens
ggaaaucugccaugagcacaaa

SEQ ID NO: 565669 - RNA, 12 nt, Homo sapiens
ggaaaucugccu

SEQ ID NO: 565670 - RNA, 17 nt, Homo sapiens
ggaaaugagaacauucc

SEQ ID NO: 565671 - RNA, 15 nt, Homo sapiens
ggaaaugcugacuuu

SEQ ID NO: 565672 - RNA, 18 nt, Homo sapiens
ggaaaugguggugcuuua

SEQ ID NO: 565673 - RNA, 22 nt, Homo sapiens
ggauuagguguucaggccagua

SEQ ID NO: 565674 - RNA, 13 nt, Homo sapiens
ggauuaugaagug

SEQ ID NO: 565675 - RNA, 21 nt, Homo sapiens
ggauuaugaagugacucucac

SEQ ID NO: 565676 - RNA, 14 nt, Homo sapiens
ggauuauucauuua

SEQ ID NO: 565677 - RNA, 22 nt, Homo sapiens
ggauuauuuuaaauacaaaagg

SEQ ID NO: 565678 - RNA, 17 nt, Homo sapiens
ggauugaagcccuccaa

SEQ ID NO: 565679 - RNA, 19 nt, Homo sapiens
ggauugacuuugcugucaa

SEQ ID NO: 565680 - RNA, 18 nt, Homo sapiens
ggauuggccaaacaucag

SEQ ID NO: 565681 - RNA, 19 nt, Homo sapiens
ggauuggcuauaacauguc

SEQ ID NO: 565682 - RNA, 23 nt, Homo sapiens
ggauuuaucccccgcaaagacau

SEQ ID NO: 565683 - RNA, 15 nt, Homo sapiens
ggauuuauucugcca

SEQ ID NO: 565684 - RNA, 14 nt, Homo sapiens
ggauuugcagguga

SEQ ID NO: 565685 - RNA, 17 nt, Homo sapiens
ggauuugccugugccac

SEQ ID NO: 565686 - RNA, 14 nt, Homo sapiens
ggauuuggggacca

SEQ ID NO: 565687 - RNA, 21 nt, Homo sapiens
ggcaaaaacuguacuguguuu

SEQ ID NO: 565688 - RNA, 14 nt, Homo sapiens
ggcaaacaggcagu

SEQ ID NO: 565689 - RNA, 24 nt, Homo sapiens
ggcaaagaaaaugaaaugcauauu

SEQ ID NO: 565690 - RNA, 22 nt, Homo sapiens
ggcaaagauuuuuggcacuuug

SEQ ID NO: 565691 - RNA, 19 nt, Homo sapiens
ggcaaagguggcucuccag

SEQ ID NO: 565692 - RNA, 20 nt, Homo sapiens
ggcaaaguacuugucauaga

SEQ ID NO: 565693 - RNA, 14 nt, Homo sapiens
ggcaaagugcugua

SEQ ID NO: 565694 - RNA, 18 nt, Homo sapiens
ggcaaaucagaugcagcu

SEQ ID NO: 565695 - RNA, 12 nt, Homo sapiens
ggcaaaugaauu

SEQ ID NO: 565696 - RNA, 13 nt, Homo sapiens
ggcaaaugaauuu

SEQ ID NO: 565697 - RNA, 18 nt, Homo sapiens
ggcaaauggcugagaugg

SEQ ID NO: 565698 - RNA, 20 nt, Homo sapiens
ggcaacacugcuguccacau

SEQ ID NO: 565699 - RNA, 17 nt, Homo sapiens
ggcaacagauugaaaag

SEQ ID NO: 565700 - RNA, 20 nt, Homo sapiens
ggcaacaguacuucaaacag

SEQ ID NO: 565701 - RNA, 17 nt, Homo sapiens
ggcaacgacgguuucaa

SEQ ID NO: 565702 - RNA, 22 nt, Homo sapiens
ggcaaggacggccuucaacuga

SEQ ID NO: 565703 - RNA, 22 nt, Homo sapiens
ggcaagucaccugcagcccaug

SEQ ID NO: 565704 - RNA, 15 nt, Homo sapiens
ggcaaucuugccuuc

SEQ ID NO: 565705 - RNA, 17 nt, Homo sapiens
ggcaaucuuugccuuua

SEQ ID NO: 565706 - RNA, 19 nt, Homo sapiens
ggcaaucuuugccuuuauc

SEQ ID NO: 565707 - RNA, 13 nt, Homo sapiens
ggcaaugcaaaag

SEQ ID NO: 565708 - RNA, 17 nt, Homo sapiens
ggcaaugccaucagccc

SEQ ID NO: 565709 - RNA, 19 nt, Homo sapiens
ggcaauuuaacaaugucug

SEQ ID NO: 565710 - RNA, 21 nt, Homo sapiens
ggcacaagguugguugcuaag

SEQ ID NO: 565711 - RNA, 12 nt, Homo sapiens
ggcacacagcua

SEQ ID NO: 565712 - RNA, 19 nt, Homo sapiens
ggcacacgccucccacugg

SEQ ID NO: 565713 - RNA, 14 nt, Homo sapiens
ggcacacucccucu

SEQ ID NO: 565714 - RNA, 13 nt, Homo sapiens
ggcacaguggacu

SEQ ID NO: 565715 - RNA, 22 nt, Homo sapiens
ggcacauacaccucgucaagag

SEQ ID NO: 565716 - RNA, 12 nt, Homo sapiens
ggcacaucugcu

SEQ ID NO: 565717 - RNA, 23 nt, Homo sapiens
ggcacauucuuaaauauuuccau

SEQ ID NO: 565718 - RNA, 9 nt, Homo sapiens
ggcacauug

SEQ ID NO: 565719 - RNA, 19 nt, Homo sapiens
ggcaccauggugacugcca

SEQ ID NO: 565720 - RNA, 14 nt, Homo sapiens
ggcacccacccugg

SEQ ID NO: 565721 - RNA, 23 nt, Homo sapiens
ggcacgaggccaggcagauccca

SEQ ID NO: 565722 - RNA, 17 nt, Homo sapiens
ggcacuaaaccacuucu

SEQ ID NO: 565723 - RNA, 19 nt, Homo sapiens
ggcacuauuuauuuacaaa

SEQ ID NO: 565724 - RNA, 13 nt, Homo sapiens
ggcacucaggggg

SEQ ID NO: 565725 - RNA, 22 nt, Homo sapiens
ggcacuggcauugucccugugc

SEQ ID NO: 565726 - RNA, 22 nt, Homo sapiens
ggcagaagaauugaacccagga

SEQ ID NO: 565727 - RNA, 15 nt, Homo sapiens
ggcagaaugaaucua

SEQ ID NO: 565728 - RNA, 17 nt, Homo sapiens
ggcagacuacacaggau

SEQ ID NO: 565729 - RNA, 17 nt, Homo sapiens
ggcagacucgggaccaa

SEQ ID NO: 565730 - RNA, 23 nt, Homo sapiens
ggcagagcucugggaagugaagu

SEQ ID NO: 565731 - RNA, 16 nt, Homo sapiens
ggcagagguuacaggu

SEQ ID NO: 565732 - RNA, 20 nt, Homo sapiens
ggcagagguugcaguguggu

SEQ ID NO: 565733 - RNA, 15 nt, Homo sapiens
ggcagaucacuggag

SEQ ID NO: 565734 - RNA, 12 nt, Homo sapiens
ggcagauuugag

SEQ ID NO: 565735 - RNA, 13 nt, Homo sapiens
ggcagcacaggaa

SEQ ID NO: 565736 - RNA, 15 nt, Homo sapiens
ggcagcacagugugu

SEQ ID NO: 565737 - RNA, 19 nt, Homo sapiens
ggcagcaccaccacacagu

SEQ ID NO: 565738 - RNA, 23 nt, Homo sapiens
ggcagcagagcauucagacucca

SEQ ID NO: 565739 - RNA, 22 nt, Homo sapiens
ggcagcaggggcugcugugaug

SEQ ID NO: 565740 - RNA, 16 nt, Homo sapiens
ggcagccauagugcau

SEQ ID NO: 565741 - RNA, 23 nt, Homo sapiens
ggcagccugaacacucaguugca

SEQ ID NO: 565742 - RNA, 14 nt, Homo sapiens
ggcagcgccaagug

SEQ ID NO: 565743 - RNA, 22 nt, Homo sapiens
ggcagcugccucugcucccucu

SEQ ID NO: 565744 - RNA, 15 nt, Homo sapiens
ggcagcuucacucga

SEQ ID NO: 565745 - RNA, 20 nt, Homo sapiens
ggcaggaaaauuguuugaac

SEQ ID NO: 565746 - RNA, 14 nt, Homo sapiens
ggcaggaaagccac

SEQ ID NO: 565747 - RNA, 22 nt, Homo sapiens
ggcaggacaaauugcgcccauu

SEQ ID NO: 565748 - RNA, 16 nt, Homo sapiens
ggcaggagaauggugu

SEQ ID NO: 565749 - RNA, 23 nt, Homo sapiens
ggcaggaggcuuuggguggcuca

SEQ ID NO: 565750 - RNA, 15 nt, Homo sapiens
ggcaggcacuguggc

SEQ ID NO: 565751 - RNA, 18 nt, Homo sapiens
ggcaggcugggccauguc

SEQ ID NO: 565752 - RNA, 17 nt, Homo sapiens
ggcagggcccacgugua

SEQ ID NO: 565753 - RNA, 15 nt, Homo sapiens
ggcagggcugugcuu

SEQ ID NO: 565754 - RNA, 13 nt, Homo sapiens
ggcaggggcccac

SEQ ID NO: 565755 - RNA, 19 nt, Homo sapiens
ggcaggguucuccaagggc

SEQ ID NO: 565756 - RNA, 23 nt, Homo sapiens
ggcagguaggucggcacuuggac

SEQ ID NO: 565757 - RNA, 15 nt, Homo sapiens
ggcagguccacagag

SEQ ID NO: 565758 - RNA, 12 nt, Homo sapiens
ggcaggugcaga

SEQ ID NO: 565759 - RNA, 11 nt, Homo sapiens
ggcaguacugu

SEQ ID NO: 565760 - RNA, 21 nt, Homo sapiens
ggcaguagacuauaagcagaa

SEQ ID NO: 565761 - RNA, 23 nt, Homo sapiens
ggcaguaugugauggacugggga

SEQ ID NO: 565762 - RNA, 23 nt, Homo sapiens
ggcagucaccacccagcccuucc

SEQ ID NO: 565763 - RNA, 16 nt, Homo sapiens
ggcaguccaggccucu

SEQ ID NO: 565764 - RNA, 19 nt, Homo sapiens
ggcagucucugcccaaaca

SEQ ID NO: 565765 - RNA, 23 nt, Homo sapiens
ggcagugacagaacuaagaugau

SEQ ID NO: 565766 - RNA, 22 nt, Homo sapiens
ggcaguggcccuccaccuuguu

SEQ ID NO: 565767 - RNA, 11 nt, Homo sapiens
ggcagugucac

SEQ ID NO: 565768 - RNA, 17 nt, Homo sapiens
ggcaguuuaaagcacaa

SEQ ID NO: 565769 - RNA, 14 nt, Homo sapiens
ggcauaaauuacag

SEQ ID NO: 565770 - RNA, 16 nt, Homo sapiens
ggcauaauagucaauu

SEQ ID NO: 565771 - RNA, 11 nt, Homo sapiens
ggcauaugcac

SEQ ID NO: 565772 - RNA, 22 nt, Homo sapiens
ggcaucaaacagggcaaagugu

SEQ ID NO: 565773 - RNA, 13 nt, Homo sapiens
ggcaucaauauac

SEQ ID NO: 565774 - RNA, 18 nt, Homo sapiens
ggcaucaguagcaucugu

SEQ ID NO: 565775 - RNA, 16 nt, Homo sapiens
ggcaucggcagcugaa

SEQ ID NO: 565776 - RNA, 15 nt, Homo sapiens
ggcaucucacuuuau

SEQ ID NO: 565777 - RNA, 20 nt, Homo sapiens
ggcaucucacuuuaugauag

SEQ ID NO: 565778 - RNA, 12 nt, Homo sapiens
ggcaucuugcca

SEQ ID NO: 565779 - RNA, 16 nt, Homo sapiens
ggcaucuugcuggcua

SEQ ID NO: 565780 - RNA, 22 nt, Homo sapiens
ggcaugaugaucugccucucaa

SEQ ID NO: 565781 - RNA, 13 nt, Homo sapiens
ggcaugcuuuauu

SEQ ID NO: 565782 - RNA, 14 nt, Homo sapiens
ggcaugguggccca

SEQ ID NO: 565783 - RNA, 12 nt, Homo sapiens
ggcauguaugca

SEQ ID NO: 565784 - RNA, 14 nt, Homo sapiens
ggcaugugagauga

SEQ ID NO: 565785 - RNA, 23 nt, Homo sapiens
ggcaugugcggcugaacugagaa

SEQ ID NO: 565786 - RNA, 10 nt, Homo sapiens
ggcauuauua

SEQ ID NO: 565787 - RNA, 20 nt, Homo sapiens
ggcauugucuguaaugacaa

SEQ ID NO: 565788 - RNA, 17 nt, Homo sapiens
ggcauuuaacuccucau

SEQ ID NO: 565789 - RNA, 13 nt, Homo sapiens
ggcauuugcagga

SEQ ID NO: 565790 - RNA, 17 nt, Homo sapiens
ggcauuuguuuccucau

SEQ ID NO: 565791 - RNA, 15 nt, Homo sapiens
ggccaaagaaggcag

SEQ ID NO: 565792 - RNA, 22 nt, Homo sapiens
ggccaaauaugcacuuucccua

SEQ ID NO: 565793 - RNA, 14 nt, Homo sapiens
ggccaacaugucag

SEQ ID NO: 565794 - RNA, 16 nt, Homo sapiens
ggccaacaugucagaa

SEQ ID NO: 565795 - RNA, 22 nt, Homo sapiens
gggcugucuuugcagggcacag

SEQ ID NO: 565796 - RNA, 18 nt, Homo sapiens
gggcuguguugacugcug

SEQ ID NO: 565797 - RNA, 20 nt, Homo sapiens
gggcuuaguauuucucagga

SEQ ID NO: 565798 - RNA, 22 nt, Homo sapiens
gggcuugcuauaguguccaggc

SEQ ID NO: 565799 - RNA, 16 nt, Homo sapiens
gggcuuucuggggccu

SEQ ID NO: 565800 - RNA, 16 nt, Homo sapiens
gggcuuugugucauca

SEQ ID NO: 565801 - RNA, 15 nt, Homo sapiens
ggggaaaacgggcag

SEQ ID NO: 565802 - RNA, 22 nt, Homo sapiens
ggggaaaaucucagcaaugauu

SEQ ID NO: 565803 - RNA, 20 nt, Homo sapiens
ggggaagcggcccuaaggga

SEQ ID NO: 565804 - RNA, 13 nt, Homo sapiens
ggggaagggugca

SEQ ID NO: 565805 - RNA, 22 nt, Homo sapiens
ggggacagcuuccucacacccc

SEQ ID NO: 565806 - RNA, 17 nt, Homo sapiens
ggggacccuccaaagga

SEQ ID NO: 565807 - RNA, 17 nt, Homo sapiens
ggggacucagggaccgg

SEQ ID NO: 565808 - RNA, 15 nt, Homo sapiens
ggggacugucuuuca

SEQ ID NO: 565809 - RNA, 17 nt, Homo sapiens
ggggagacuucuuggcu

SEQ ID NO: 565810 - RNA, 18 nt, Homo sapiens
ggggaggagccucuggcu

SEQ ID NO: 565811 - RNA, 14 nt, Homo sapiens
ggggaggccaagug

SEQ ID NO: 565812 - RNA, 13 nt, Homo sapiens
ggggagugugagu

SEQ ID NO: 565813 - RNA, 20 nt, Homo sapiens
ggggagugugugugggguuu

SEQ ID NO: 565814 - RNA, 21 nt, Homo sapiens
ggggauaauguccccacuccc

SEQ ID NO: 565815 - RNA, 17 nt, Homo sapiens
ggggaugccuugguuuu

SEQ ID NO: 565816 - RNA, 16 nt, Homo sapiens
ggggauggacaccccc

SEQ ID NO: 565817 - RNA, 14 nt, Homo sapiens
ggggaugugacaug

SEQ ID NO: 565818 - RNA, 13 nt, Homo sapiens
ggggcagugugag

SEQ ID NO: 565819 - RNA, 13 nt, Homo sapiens
ggggccaccuccu

SEQ ID NO: 565820 - RNA, 16 nt, Homo sapiens
ggggccacguggaugg

SEQ ID NO: 565821 - RNA, 19 nt, Homo sapiens
ggggccacgugugcugugg

SEQ ID NO: 565822 - RNA, 22 nt, Homo sapiens
ggggcccaaauucuuucagugg

SEQ ID NO: 565823 - RNA, 21 nt, Homo sapiens
ggggccccagcgucugcaggg

SEQ ID NO: 565824 - RNA, 18 nt, Homo sapiens
ggggccuugggugagugg

SEQ ID NO: 565825 - RNA, 19 nt, Homo sapiens
ggggcggcaugaacccucu

SEQ ID NO: 565826 - RNA, 17 nt, Homo sapiens
ggggcggggggcgggga

SEQ ID NO: 565827 - RNA, 21 nt, Homo sapiens
ggggcuagaaaucuguugcua

SEQ ID NO: 565828 - RNA, 18 nt, Homo sapiens
ggggcuccagcaccuucu

SEQ ID NO: 565829 - RNA, 21 nt, Homo sapiens
ggggcugacuucaauccaugu

SEQ ID NO: 565830 - RNA, 22 nt, Homo sapiens
ggggcuggccucuggcucucau

SEQ ID NO: 565831 - RNA, 20 nt, Homo sapiens
ggggcuggguaagagcacag

SEQ ID NO: 565832 - RNA, 13 nt, Homo sapiens
gggggacagacag

SEQ ID NO: 565833 - RNA, 17 nt, Homo sapiens
gggggccuggccuugca

SEQ ID NO: 565834 - RNA, 15 nt, Homo sapiens
gggggcuccacccca

SEQ ID NO: 565835 - RNA, 22 nt, Homo sapiens
gggggcuggguaagagcacagg

SEQ ID NO: 565836 - RNA, 23 nt, Homo sapiens
gggggucccagugggaggggcag

SEQ ID NO: 565837 - RNA, 15 nt, Homo sapiens
ggggguucuguuuca

SEQ ID NO: 565838 - RNA, 18 nt, Homo sapiens
gggguauaaaacuuuccu

SEQ ID NO: 565839 - RNA, 11 nt, Homo sapiens
ggggucucaga

SEQ ID NO: 565840 - RNA, 14 nt, Homo sapiens
ggggucugagcaug

SEQ ID NO: 565841 - RNA, 15 nt, Homo sapiens
gggguggaggggugu

SEQ ID NO: 565842 - RNA, 12 nt, Homo sapiens
ggggugggccac

SEQ ID NO: 565843 - RNA, 13 nt, Homo sapiens
gggguuucaccug

SEQ ID NO: 565844 - RNA, 19 nt, Homo sapiens
ggguaaccaaauguuggcc

SEQ ID NO: 565845 - RNA, 21 nt, Homo sapiens
ggguaagaugcuccugguggc

SEQ ID NO: 565846 - RNA, 16 nt, Homo sapiens
ggguaccaaugcugca

SEQ ID NO: 565847 - RNA, 13 nt, Homo sapiens
ggguagaccuuga

SEQ ID NO: 565848 - RNA, 13 nt, Homo sapiens
ggguagaucucaa

SEQ ID NO: 565849 - RNA, 22 nt, Homo sapiens
ggguaggaaagaggaagcaaau

SEQ ID NO: 565850 - RNA, 20 nt, Homo sapiens
ggguaggcugucugugccau

SEQ ID NO: 565851 - RNA, 21 nt, Homo sapiens
ggguaucccagaccccucuca

SEQ ID NO: 565852 - RNA, 18 nt, Homo sapiens
ggguaugggaagccauau

SEQ ID NO: 565853 - RNA, 12 nt, Homo sapiens
gggucaaaguac

SEQ ID NO: 565854 - RNA, 21 nt, Homo sapiens
gggucacgcuugccuggucac

SEQ ID NO: 565855 - RNA, 12 nt, Homo sapiens
ggguccaccaug

SEQ ID NO: 565856 - RNA, 20 nt, Homo sapiens
ggguccacccagcaaagagu

SEQ ID NO: 565857 - RNA, 15 nt, Homo sapiens
ggguccccaccuggg

SEQ ID NO: 565858 - RNA, 20 nt, Homo sapiens
gggucccucggagcugccag

SEQ ID NO: 565859 - RNA, 20 nt, Homo sapiens
ggguccucuagcccacuccc

SEQ ID NO: 565860 - RNA, 18 nt, Homo sapiens
ggguccucuggggccuuc

SEQ ID NO: 565861 - RNA, 17 nt, Homo sapiens
ggguccugccgguggga

SEQ ID NO: 565862 - RNA, 21 nt, Homo sapiens
gggucgaggauucugugccuc

SEQ ID NO: 565863 - RNA, 14 nt, Homo sapiens
gggucggagucugu

SEQ ID NO: 565864 - RNA, 18 nt, Homo sapiens
gggucgucuuuguguaug

SEQ ID NO: 565865 - RNA, 20 nt, Homo sapiens
gggucucgcuuuguugccca

SEQ ID NO: 565866 - RNA, 19 nt, Homo sapiens
gggucucguuuuguugcca

SEQ ID NO: 565867 - RNA, 16 nt, Homo sapiens
gggucucuagugcugu

SEQ ID NO: 565868 - RNA, 11 nt, Homo sapiens
gggucucucau

SEQ ID NO: 565869 - RNA, 14 nt, Homo sapiens
gggucucuugccca

SEQ ID NO: 565870 - RNA, 20 nt, Homo sapiens
gggucuuguuucacauuugu

SEQ ID NO: 565871 - RNA, 19 nt, Homo sapiens
gggugacagagcaagugag

SEQ ID NO: 565872 - RNA, 22 nt, Homo sapiens
gggugagagucuggguccaggc

SEQ ID NO: 565873 - RNA, 13 nt, Homo sapiens
gggugagugcaag

SEQ ID NO: 565874 - RNA, 20 nt, Homo sapiens
gggugauuacauaaucugua

SEQ ID NO: 565875 - RNA, 13 nt, Homo sapiens
gggugcagucccc

SEQ ID NO: 565876 - RNA, 20 nt, Homo sapiens
gggugcccucugcucaggcc

SEQ ID NO: 565877 - RNA, 16 nt, Homo sapiens
gggugcgguggcucac

SEQ ID NO: 565878 - RNA, 18 nt, Homo sapiens
gggugcucugaaucugua

SEQ ID NO: 565879 - RNA, 17 nt, Homo sapiens
ggguggagcaugggccu

SEQ ID NO: 565880 - RNA, 18 nt, Homo sapiens
ggguggcaggugaccuuc

SEQ ID NO: 565881 - RNA, 21 nt, Homo sapiens
ggguggcccuugcaguucagc

SEQ ID NO: 565882 - RNA, 11 nt, Homo sapiens
gggugggagag

SEQ ID NO: 565883 - RNA, 18 nt, Homo sapiens
ggguggggggugacagug

SEQ ID NO: 565884 - RNA, 13 nt, Homo sapiens
gggugggggugga

SEQ ID NO: 565885 - RNA, 16 nt, Homo sapiens
gggugggguacuggag

SEQ ID NO: 565886 - RNA, 18 nt, Homo sapiens
ggguggugagaaccggag

SEQ ID NO: 565887 - RNA, 13 nt, Homo sapiens
ggguguguguagc

SEQ ID NO: 565888 - RNA, 11 nt, Homo sapiens
ggguguugcua

SEQ ID NO: 565889 - RNA, 22 nt, Homo sapiens
ggguuaaagcagacagucacac

SEQ ID NO: 565890 - RNA, 14 nt, Homo sapiens
ggguuaagucuccu

SEQ ID NO: 565891 - RNA, 16 nt, Homo sapiens
ggguuacaaacugcaa

SEQ ID NO: 565892 - RNA, 14 nt, Homo sapiens
ggguucaagugauu

SEQ ID NO: 565893 - RNA, 16 nt, Homo sapiens
ggguucacaccauucu

SEQ ID NO: 565894 - RNA, 23 nt, Homo sapiens
ggguucauuauuggaauuaaccu

SEQ ID NO: 565895 - RNA, 20 nt, Homo sapiens
ggguucguggaaagggugcu

SEQ ID NO: 565896 - RNA, 16 nt, Homo sapiens
ggguucugauauugcc

SEQ ID NO: 565897 - RNA, 21 nt, Homo sapiens
ggguucuugagccagccaggc

SEQ ID NO: 565898 - RNA, 13 nt, Homo sapiens
ggguugcgucuca

SEQ ID NO: 565899 - RNA, 18 nt, Homo sapiens
ggguuucaccauguuggc

SEQ ID NO: 565900 - RNA, 19 nt, Homo sapiens
ggguuuggaccacaucucu

SEQ ID NO: 565901 - RNA, 15 nt, Homo sapiens
ggguuuguacauuuu

SEQ ID NO: 565902 - RNA, 22 nt, Homo sapiens
ggguuuugcuuuagagugcaag

SEQ ID NO: 565903 - RNA, 23 nt, Homo sapiens
ggguuuuuaaucuuugugacagg

SEQ ID NO: 565904 - RNA, 17 nt, Homo sapiens
gguaaaaaguggcugcg

SEQ ID NO: 565905 - RNA, 14 nt, Homo sapiens
gguaaauguuaccu

SEQ ID NO: 565906 - RNA, 20 nt, Homo sapiens
gguaacaaagggcagcucag

SEQ ID NO: 565907 - RNA, 23 nt, Homo sapiens
gguaacuuuuuuuuaaagcucau

SEQ ID NO: 565908 - RNA, 17 nt, Homo sapiens
gguaagaugacucugag

SEQ ID NO: 565909 - RNA, 14 nt, Homo sapiens
gguaagcaccagga

SEQ ID NO: 565910 - RNA, 16 nt, Homo sapiens
gguaaguugagauguu

SEQ ID NO: 565911 - RNA, 12 nt, Homo sapiens
gguaauauaccu

SEQ ID NO: 565912 - RNA, 18 nt, Homo sapiens
gguaauuaguaacaugug

SEQ ID NO: 565913 - RNA, 18 nt, Homo sapiens
gguaauucuauugggaua

SEQ ID NO: 565914 - RNA, 11 nt, Homo sapiens
gguacacuggu

SEQ ID NO: 565915 - RNA, 20 nt, Homo sapiens
gguaccaauucagugucugu

SEQ ID NO: 565916 - RNA, 16 nt, Homo sapiens
gguacccagccaucug

SEQ ID NO: 565917 - RNA, 17 nt, Homo sapiens
guuaaagguucacaggg

SEQ ID NO: 565918 - RNA, 20 nt, Homo sapiens
guuaaauagaguauaugcac

SEQ ID NO: 565919 - RNA, 17 nt, Homo sapiens
guuaaauuuuacaugac

SEQ ID NO: 565920 - RNA, 17 nt, Homo sapiens
guuaacacucaugaagc

SEQ ID NO: 565921 - RNA, 11 nt, Homo sapiens
guuaacaucau

SEQ ID NO: 565922 - RNA, 18 nt, Homo sapiens
guuaaccccauguccuca

SEQ ID NO: 565923 - RNA, 19 nt, Homo sapiens
guuaaccucagugucauuu

SEQ ID NO: 565924 - RNA, 14 nt, Homo sapiens
guuaacuacauauu

SEQ ID NO: 565925 - RNA, 14 nt, Homo sapiens
guuaacugagcuac

SEQ ID NO: 565926 - RNA, 11 nt, Homo sapiens
guuaacuuaau

SEQ ID NO: 565927 - RNA, 17 nt, Homo sapiens
guuaagaacaucaaaac

SEQ ID NO: 565928 - RNA, 12 nt, Homo sapiens
guuaagugcagg

SEQ ID NO: 565929 - RNA, 21 nt, Homo sapiens
guuaaguuucucuucaccccu

SEQ ID NO: 565930 - RNA, 16 nt, Homo sapiens
guuaauaccagcuuaa

SEQ ID NO: 565931 - RNA, 14 nt, Homo sapiens
guuaaucuccucag

SEQ ID NO: 565932 - RNA, 13 nt, Homo sapiens
guuaaugccacaa

SEQ ID NO: 565933 - RNA, 15 nt, Homo sapiens
guuaaugucagugac

SEQ ID NO: 565934 - RNA, 21 nt, Homo sapiens
guuaaugugauggauggcaca

SEQ ID NO: 565935 - RNA, 18 nt, Homo sapiens
guuaauuacaacugcuau

SEQ ID NO: 565936 - RNA, 19 nt, Homo sapiens
guuaauuauuuugacaaau

SEQ ID NO: 565937 - RNA, 16 nt, Homo sapiens
guuaauucagcacuga

SEQ ID NO: 565938 - RNA, 19 nt, Homo sapiens
guuaauuuugaagugcugu

SEQ ID NO: 565939 - RNA, 20 nt, Homo sapiens
guuaauuuuuccaacuacua

SEQ ID NO: 565940 - RNA, 21 nt, Homo sapiens
guuacaaaguaauuucuuuga

SEQ ID NO: 565941 - RNA, 12 nt, Homo sapiens
guuacacuggag

SEQ ID NO: 565942 - RNA, 16 nt, Homo sapiens
guuacagguggggcau

SEQ ID NO: 565943 - RNA, 22 nt, Homo sapiens
guuacaguuugagacuuccaaa

SEQ ID NO: 565944 - RNA, 14 nt, Homo sapiens
guuacauaagauaa

SEQ ID NO: 565945 - RNA, 22 nt, Homo sapiens
guuacauaagauaaaugugcug

SEQ ID NO: 565946 - RNA, 16 nt, Homo sapiens
guuacaucacaguguu

SEQ ID NO: 565947 - RNA, 19 nt, Homo sapiens
guuaccacagcaacugacc

SEQ ID NO: 565948 - RNA, 17 nt, Homo sapiens
guuaccacauuacucug

SEQ ID NO: 565949 - RNA, 15 nt, Homo sapiens
guuaccaccaugcuc

SEQ ID NO: 565950 - RNA, 13 nt, Homo sapiens
guuaccacuacuu

SEQ ID NO: 565951 - RNA, 21 nt, Homo sapiens
guuaccauaagucugauucuc

SEQ ID NO: 565952 - RNA, 17 nt, Homo sapiens
guuaccaugucacugug

SEQ ID NO: 565953 - RNA, 19 nt, Homo sapiens
guuaccguucaccaguugc

SEQ ID NO: 565954 - RNA, 22 nt, Homo sapiens
guuaccucugaguuguguucca

SEQ ID NO: 565955 - RNA, 21 nt, Homo sapiens
guuaccugaaaacacugugca

SEQ ID NO: 565956 - RNA, 22 nt, Homo sapiens
guuaccugaaaacacugugcac

SEQ ID NO: 565957 - RNA, 13 nt, Homo sapiens
guuaccuuuucau

SEQ ID NO: 565958 - RNA, 22 nt, Homo sapiens
guuacuauuuucuacaauuaau

SEQ ID NO: 565959 - RNA, 15 nt, Homo sapiens
guuacugaaggugau

SEQ ID NO: 565960 - RNA, 15 nt, Homo sapiens
guuacugauguucaa

SEQ ID NO: 565961 - RNA, 17 nt, Homo sapiens
guuacugcuuugcaaag

SEQ ID NO: 565962 - RNA, 24 nt, Homo sapiens
guuacuggcuucucuugagucaca

SEQ ID NO: 565963 - RNA, 19 nt, Homo sapiens
guuacuguggccaguauuu

SEQ ID NO: 565964 - RNA, 20 nt, Homo sapiens
guuacuguggccaguauuuu

SEQ ID NO: 565965 - RNA, 16 nt, Homo sapiens
guuacuguggucacuu

SEQ ID NO: 565966 - RNA, 21 nt, Homo sapiens
guuacuuuugacccaugugca

SEQ ID NO: 565967 - RNA, 20 nt, Homo sapiens
guuacuuuuucuuguauuca

SEQ ID NO: 565968 - RNA, 21 nt, Homo sapiens
guuacuuuuucuuguauucau

SEQ ID NO: 565969 - RNA, 19 nt, Homo sapiens
guuacuuuuuuacacugau

SEQ ID NO: 565970 - RNA, 21 nt, Homo sapiens
guuagaaaaauagcugugaac

SEQ ID NO: 565971 - RNA, 21 nt, Homo sapiens
guuagaaaauggacacugugc

SEQ ID NO: 565972 - RNA, 13 nt, Homo sapiens
guuagaccacuuu

SEQ ID NO: 565973 - RNA, 18 nt, Homo sapiens
guuagagcugagcacuuu

SEQ ID NO: 565974 - RNA, 14 nt, Homo sapiens
guuagaugaggcac

SEQ ID NO: 565975 - RNA, 16 nt, Homo sapiens
guuagcacuguugaug

SEQ ID NO: 565976 - RNA, 13 nt, Homo sapiens
guuagcagcacgu

SEQ ID NO: 565977 - RNA, 15 nt, Homo sapiens
guuagccugcaaaca

SEQ ID NO: 565978 - RNA, 13 nt, Homo sapiens
guuaggaguuaau

SEQ ID NO: 565979 - RNA, 13 nt, Homo sapiens
guuaggcauuaau

SEQ ID NO: 565980 - RNA, 21 nt, Homo sapiens
guuagggagaugaguugcagu

SEQ ID NO: 565981 - RNA, 20 nt, Homo sapiens
guuaggggaauggagggaau

SEQ ID NO: 565982 - RNA, 18 nt, Homo sapiens
guuagucaauccugucau

SEQ ID NO: 565983 - RNA, 21 nt, Homo sapiens
guuagucaauccugucauaua

SEQ ID NO: 565984 - RNA, 20 nt, Homo sapiens
guuagucuccccaccucuuc

SEQ ID NO: 565985 - RNA, 15 nt, Homo sapiens
guuagugacugaugu

SEQ ID NO: 565986 - RNA, 17 nt, Homo sapiens
guuagugagggccucaa

SEQ ID NO: 565987 - RNA, 22 nt, Homo sapiens
guuauaaaucaaugucacuuaa

SEQ ID NO: 565988 - RNA, 23 nt, Homo sapiens
guuauaaaucaaugucacuuaaa

SEQ ID NO: 565989 - RNA, 19 nt, Homo sapiens
guuauaacucugcacuacu

SEQ ID NO: 565990 - RNA, 19 nt, Homo sapiens
guuauacuuauuuguauau

SEQ ID NO: 565991 - RNA, 18 nt, Homo sapiens
guuauauuuaaugcauua

SEQ ID NO: 565992 - RNA, 18 nt, Homo sapiens
guuaucaaaaaguauuau

SEQ ID NO: 565993 - RNA, 18 nt, Homo sapiens
guuaucaggcgucccaua

SEQ ID NO: 565994 - RNA, 21 nt, Homo sapiens
guuaucaguaagaaaaagaag

SEQ ID NO: 565995 - RNA, 16 nt, Homo sapiens
guuaucauuaucauca

SEQ ID NO: 565996 - RNA, 15 nt, Homo sapiens
guuaugacuauguaa

SEQ ID NO: 565997 - RNA, 19 nt, Homo sapiens
guuauguacaaacuaguuu

SEQ ID NO: 565998 - RNA, 19 nt, Homo sapiens
guuaugugcaaguuuauca

SEQ ID NO: 565999 - RNA, 24 nt, Homo sapiens
guuauuauuaccagcauuuguccu

SEQ ID NO: 566000 - RNA, 14 nt, Homo sapiens
guuauuauuuacug

SEQ ID NO: 566001 - RNA, 21 nt, Homo sapiens
guuauucauuuggugacugug

SEQ ID NO: 566002 - RNA, 13 nt, Homo sapiens
guuauucucuuca

SEQ ID NO: 566003 - RNA, 19 nt, Homo sapiens
guuauugcuggugcaaaga

SEQ ID NO: 566004 - RNA, 16 nt, Homo sapiens
guuauuggaaggcaag

SEQ ID NO: 566005 - RNA, 18 nt, Homo sapiens
guuauuuaaugagucagu

SEQ ID NO: 566006 - RNA, 19 nt, Homo sapiens
guuauuuagggaacugcuu

SEQ ID NO: 566007 - RNA, 21 nt, Homo sapiens
guuauuuagggaacugcuuga

SEQ ID NO: 566008 - RNA, 15 nt, Homo sapiens
guuauuuauaguguu

SEQ ID NO: 566009 - RNA, 15 nt, Homo sapiens
guuauuuaugcacug

SEQ ID NO: 566010 - RNA, 19 nt, Homo sapiens
guuauuuaugccucuguau

SEQ ID NO: 566011 - RNA, 19 nt, Homo sapiens
guuauuucucugauuugca

SEQ ID NO: 566012 - RNA, 22 nt, Homo sapiens
guuauuugaaaauuugauuuug

SEQ ID NO: 566013 - RNA, 21 nt, Homo sapiens
guuauuuuugcuuguuucuga

SEQ ID NO: 566014 - RNA, 22 nt, Homo sapiens
guucaaagacugugaacagcuu

SEQ ID NO: 566015 - RNA, 12 nt, Homo sapiens
guucaaagccag

SEQ ID NO: 566016 - RNA, 16 nt, Homo sapiens
guucaaaguguauauu

SEQ ID NO: 566017 - RNA, 20 nt, Homo sapiens
guucaacuuggugacacucu

SEQ ID NO: 566018 - RNA, 15 nt, Homo sapiens
guucaagaccagccu

SEQ ID NO: 566019 - RNA, 23 nt, Homo sapiens
guucaagcaauccuccuaccuca

SEQ ID NO: 566020 - RNA, 16 nt, Homo sapiens
guucacaaacuaccuc

SEQ ID NO: 566021 - RNA, 22 nt, Homo sapiens
guucacaccagagaaccaggcu

SEQ ID NO: 566022 - RNA, 21 nt, Homo sapiens
guucaccuccaagcauuucau

SEQ ID NO: 566023 - RNA, 11 nt, Homo sapiens
guucacuccca

SEQ ID NO: 566024 - RNA, 17 nt, Homo sapiens
guucacucuacuuagca

SEQ ID NO: 566025 - RNA, 21 nt, Homo sapiens
guucacugcuccuugcugcau

SEQ ID NO: 566026 - RNA, 15 nt, Homo sapiens
guucagaaagcaaua

SEQ ID NO: 566027 - RNA, 13 nt, Homo sapiens
guucagaaggugu

SEQ ID NO: 566028 - RNA, 15 nt, Homo sapiens
guucagacacagcuc

SEQ ID NO: 566029 - RNA, 17 nt, Homo sapiens
guucagaggcagcacca

SEQ ID NO: 566030 - RNA, 24 nt, Homo sapiens
guucagcacugucccuugccucaa

SEQ ID NO: 566031 - RNA, 12 nt, Homo sapiens
guucagcagaac

SEQ ID NO: 566032 - RNA, 21 nt, Homo sapiens
guucagcuccuuccaccacaa

SEQ ID NO: 566033 - RNA, 14 nt, Homo sapiens
guucagcugcccca

SEQ ID NO: 566034 - RNA, 22 nt, Homo sapiens
guucaguagagaauucauguga

SEQ ID NO: 566035 - RNA, 17 nt, Homo sapiens
guucagucccagggaaa

SEQ ID NO: 566036 - RNA, 20 nt, Homo sapiens
guucagugagguucuugggu

SEQ ID NO: 566037 - RNA, 19 nt, Homo sapiens
guucauagcaacauuauuu

SEQ ID NO: 566038 - RNA, 16 nt, Homo sapiens
uaaaacuauauucuca

SEQ ID NO: 566039 - RNA, 18 nt, Homo sapiens
uaaaacucacugugauca

SEQ ID NO: 566040 - RNA, 20 nt, Homo sapiens
uaaaacucacugugaucaau

SEQ ID NO: 566041 - RNA, 12 nt, Homo sapiens
uaaaacugaugu

SEQ ID NO: 566042 - RNA, 17 nt, Homo sapiens
uaaaacugauguuacua

SEQ ID NO: 566043 - RNA, 23 nt, Homo sapiens
uaaaacugccuuucugguggcuu

SEQ ID NO: 566044 - RNA, 19 nt, Homo sapiens
uaaaacuggcaucugacac

SEQ ID NO: 566045 - RNA, 15 nt, Homo sapiens
uaaaacuguguaaac

SEQ ID NO: 566046 - RNA, 16 nt, Homo sapiens
uaaaacuuaugcuagu

SEQ ID NO: 566047 - RNA, 18 nt, Homo sapiens
uaaaacuuuauguacugc

SEQ ID NO: 566048 - RNA, 18 nt, Homo sapiens
uaaaagaaaauccauuau

SEQ ID NO: 566049 - RNA, 16 nt, Homo sapiens
uaaaagaaaucuucau

SEQ ID NO: 566050 - RNA, 19 nt, Homo sapiens
uaaaagaaauguugcguaa

SEQ ID NO: 566051 - RNA, 23 nt, Homo sapiens
uaaaagaaccgagcaauuuucug

SEQ ID NO: 566052 - RNA, 15 nt, Homo sapiens
uaaaagacacagaac

SEQ ID NO: 566053 - RNA, 19 nt, Homo sapiens
uaaaagagaucugggcauu

SEQ ID NO: 566054 - RNA, 20 nt, Homo sapiens
uaaaagaguuaacaucccau

SEQ ID NO: 566055 - RNA, 18 nt, Homo sapiens
uaaaagauaaauuuguug

SEQ ID NO: 566056 - RNA, 17 nt, Homo sapiens
uaaaagcacaaguacuu

SEQ ID NO: 566057 - RNA, 13 nt, Homo sapiens
uaaaagcaugaaa

SEQ ID NO: 566058 - RNA, 19 nt, Homo sapiens
uaaaagcauuuuguaauaa

SEQ ID NO: 566059 - RNA, 18 nt, Homo sapiens
uaaaagccuaccuaagca

SEQ ID NO: 566060 - RNA, 19 nt, Homo sapiens
uaaaagcuauggugagaug

SEQ ID NO: 566061 - RNA, 18 nt, Homo sapiens
uaaaagcucagaugacau

SEQ ID NO: 566062 - RNA, 15 nt, Homo sapiens
uaaaaggggcccaag

SEQ ID NO: 566063 - RNA, 19 nt, Homo sapiens
uaaaagguagagucuuaca

SEQ ID NO: 566064 - RNA, 24 nt, Homo sapiens
uaaaagguauacuuuaguagacau

SEQ ID NO: 566065 - RNA, 22 nt, Homo sapiens
uaaaagguuaaauauugucaua

SEQ ID NO: 566066 - RNA, 19 nt, Homo sapiens
uaaaaguaaauucauguaa

SEQ ID NO: 566067 - RNA, 23 nt, Homo sapiens
uaaaaguacauguuaaacuuacu

SEQ ID NO: 566068 - RNA, 12 nt, Homo sapiens
uaaaaguaccac

SEQ ID NO: 566069 - RNA, 14 nt, Homo sapiens
uaaaagucuaccug

SEQ ID NO: 566070 - RNA, 13 nt, Homo sapiens
uaaaagugcuuuc

SEQ ID NO: 566071 - RNA, 16 nt, Homo sapiens
uaaaauaaaacacauu

SEQ ID NO: 566072 - RNA, 17 nt, Homo sapiens
uaaaauaaaaugcagac

SEQ ID NO: 566073 - RNA, 13 nt, Homo sapiens
uaaaauaaacuag

SEQ ID NO: 566074 - RNA, 15 nt, Homo sapiens
uaaaauaaagcuacc

SEQ ID NO: 566075 - RNA, 23 nt, Homo sapiens
uaaaauaaagcuaccauuuuaca

SEQ ID NO: 566076 - RNA, 17 nt, Homo sapiens
uaaaauaagaaugauuu

SEQ ID NO: 566077 - RNA, 20 nt, Homo sapiens
uaaaauaaggauaauaauca

SEQ ID NO: 566078 - RNA, 14 nt, Homo sapiens
uaaaauaauaacaa

SEQ ID NO: 566079 - RNA, 17 nt, Homo sapiens
uaaaauacaaacccaug

SEQ ID NO: 566080 - RNA, 18 nt, Homo sapiens
uaaaauacaagacugcca

SEQ ID NO: 566081 - RNA, 16 nt, Homo sapiens
uaaaauacauguaccu

SEQ ID NO: 566082 - RNA, 18 nt, Homo sapiens
uaaaauacuauucucauu

SEQ ID NO: 566083 - RNA, 20 nt, Homo sapiens
uaaaauacuuuuacucugcc

SEQ ID NO: 566084 - RNA, 21 nt, Homo sapiens
uaaaauacuuuuacucugccu

SEQ ID NO: 566085 - RNA, 24 nt, Homo sapiens
uaaaauacuuuuacucugccuaca

SEQ ID NO: 566086 - RNA, 19 nt, Homo sapiens
uaaaauagcauacugugua

SEQ ID NO: 566087 - RNA, 15 nt, Homo sapiens
uaaaauaguaugaaa

SEQ ID NO: 566088 - RNA, 14 nt, Homo sapiens
uaaaauauaaucua

SEQ ID NO: 566089 - RNA, 19 nt, Homo sapiens
uaaaauauaaucucuauaa

SEQ ID NO: 566090 - RNA, 19 nt, Homo sapiens
uaaaauauagcuguacaaa

SEQ ID NO: 566091 - RNA, 22 nt, Homo sapiens
uaaaauauuuaucugauuaagu

SEQ ID NO: 566092 - RNA, 18 nt, Homo sapiens
uaaaauauuugaaugaaa

SEQ ID NO: 566093 - RNA, 22 nt, Homo sapiens
uaaaauauuuuguaaugcugca

SEQ ID NO: 566094 - RNA, 24 nt, Homo sapiens
uaaaauccaauauuguaauccuag

SEQ ID NO: 566095 - RNA, 17 nt, Homo sapiens
uaaaaucuaaaauuuca

SEQ ID NO: 566096 - RNA, 21 nt, Homo sapiens
uaaaaucuaguuuuggcaaga

SEQ ID NO: 566097 - RNA, 12 nt, Homo sapiens
uaaaaucucuaa

SEQ ID NO: 566098 - RNA, 13 nt, Homo sapiens
uaaaaucugugaa

SEQ ID NO: 566099 - RNA, 16 nt, Homo sapiens
uaaaaucuguuaccau

SEQ ID NO: 566100 - RNA, 21 nt, Homo sapiens
uaaaaucuuucugauaaugca

SEQ ID NO: 566101 - RNA, 15 nt, Homo sapiens
uaaaaugaacaucuc

SEQ ID NO: 566102 - RNA, 17 nt, Homo sapiens
uaaaaugacaaagccau

SEQ ID NO: 566103 - RNA, 18 nt, Homo sapiens
uaaaaugacaagcacuau

SEQ ID NO: 566104 - RNA, 15 nt, Homo sapiens
uaaaaugacagaucc

SEQ ID NO: 566105 - RNA, 12 nt, Homo sapiens
uaaaaugaggcu

SEQ ID NO: 566106 - RNA, 21 nt, Homo sapiens
uaaaaugauuguaguaaucug

SEQ ID NO: 566107 - RNA, 18 nt, Homo sapiens
uaaaaugcagauucauag

SEQ ID NO: 566108 - RNA, 11 nt, Homo sapiens
uaaaauggagg

SEQ ID NO: 566109 - RNA, 15 nt, Homo sapiens
uaaaauggaugccuu

SEQ ID NO: 566110 - RNA, 17 nt, Homo sapiens
uaaaauggaugccuuga

SEQ ID NO: 566111 - RNA, 18 nt, Homo sapiens
uaaaauggaugccuugaa

SEQ ID NO: 566112 - RNA, 16 nt, Homo sapiens
uaaaaugggaagacug

SEQ ID NO: 566113 - RNA, 21 nt, Homo sapiens
uaaaaugguguuuucauguaa

SEQ ID NO: 566114 - RNA, 18 nt, Homo sapiens
uaaaaugguuaugugcau

SEQ ID NO: 566115 - RNA, 17 nt, Homo sapiens
uaaaauguacucagcua

SEQ ID NO: 566116 - RNA, 19 nt, Homo sapiens
uaaaauguaugaccacugg

SEQ ID NO: 566117 - RNA, 23 nt, Homo sapiens
uaaaauguauuauguccugugag

SEQ ID NO: 566118 - RNA, 23 nt, Homo sapiens
uaaaaugugaggaagaacuacag

SEQ ID NO: 566119 - RNA, 18 nt, Homo sapiens
uaaaaugugucuugcugu

SEQ ID NO: 566120 - RNA, 14 nt, Homo sapiens
uaaaauguuauuau

SEQ ID NO: 566121 - RNA, 18 nt, Homo sapiens
uaaaauuaaaaguuugaa

SEQ ID NO: 566122 - RNA, 14 nt, Homo sapiens
uaaaauuaagcaca

SEQ ID NO: 566123 - RNA, 14 nt, Homo sapiens
uaaaauuacauucu

SEQ ID NO: 566124 - RNA, 15 nt, Homo sapiens
uaaaauuaccagaca

SEQ ID NO: 566125 - RNA, 12 nt, Homo sapiens
uaaaauucauuu

SEQ ID NO: 566126 - RNA, 16 nt, Homo sapiens
uaaaauuccuaucuca

SEQ ID NO: 566127 - RNA, 19 nt, Homo sapiens
uaaaauugaagcaacuaca

SEQ ID NO: 566128 - RNA, 21 nt, Homo sapiens
uaaaauugauuuuucucuuca

SEQ ID NO: 566129 - RNA, 14 nt, Homo sapiens
uaaaauugcacuuu

SEQ ID NO: 566130 - RNA, 12 nt, Homo sapiens
uaaaauugcuau

SEQ ID NO: 566131 - RNA, 23 nt, Homo sapiens
uaaaauugcuucuuuaccaagga

SEQ ID NO: 566132 - RNA, 21 nt, Homo sapiens
uaaaauugggcuugugauuuc

SEQ ID NO: 566133 - RNA, 11 nt, Homo sapiens
uaaaauuguga

SEQ ID NO: 566134 - RNA, 15 nt, Homo sapiens
uaaaauuucuaagag

SEQ ID NO: 566135 - RNA, 15 nt, Homo sapiens
uaaaauuugugcugg

SEQ ID NO: 566136 - RNA, 21 nt, Homo sapiens
uaaaauuuuucuuaagacaga

SEQ ID NO: 566137 - RNA, 14 nt, Homo sapiens
uaaacaaacaaaca

SEQ ID NO: 566138 - RNA, 12 nt, Homo sapiens
uaaacaaaccac

SEQ ID NO: 566139 - RNA, 17 nt, Homo sapiens
uaaacaaaggaauuaug

SEQ ID NO: 566140 - RNA, 20 nt, Homo sapiens
uaaacaagggucaauucaaa

SEQ ID NO: 566141 - RNA, 15 nt, Homo sapiens
uaaacaauaguucac

SEQ ID NO: 566142 - RNA, 19 nt, Homo sapiens
uaaacacaaauuucauuuc

SEQ ID NO: 566143 - RNA, 22 nt, Homo sapiens
uaaacacauagauucaccugua

SEQ ID NO: 566144 - RNA, 19 nt, Homo sapiens
uaaacacauguucugugcc

SEQ ID NO: 566145 - RNA, 15 nt, Homo sapiens
uaaacaccuccucau

SEQ ID NO: 566146 - RNA, 22 nt, Homo sapiens
uaaacacuccacaguguuuaua

SEQ ID NO: 566147 - RNA, 21 nt, Homo sapiens
uaaacagaagcagcaaaugaa

SEQ ID NO: 566148 - RNA, 22 nt, Homo sapiens
uaaacagacagcuuacagaaug

SEQ ID NO: 566149 - RNA, 21 nt, Homo sapiens
uaaacagauuugauugugagg

SEQ ID NO: 566150 - RNA, 23 nt, Homo sapiens
uaaacagcugguccuccacuuug

SEQ ID NO: 566151 - RNA, 18 nt, Homo sapiens
uaaacaggagacagguca

SEQ ID NO: 566152 - RNA, 11 nt, Homo sapiens
uaaacagugcc

SEQ ID NO: 566153 - RNA, 20 nt, Homo sapiens
uaaacauauccaaguuugaa

SEQ ID NO: 566154 - RNA, 21 nt, Homo sapiens
uaaacauccuucaagaacucu

SEQ ID NO: 566155 - RNA, 19 nt, Homo sapiens
uaaacaucuuuguugaugu

SEQ ID NO: 566156 - RNA, 15 nt, Homo sapiens
uaaacaugcuguuac

SEQ ID NO: 566157 - RNA, 13 nt, Homo sapiens
uaaacauguguuu

SEQ ID NO: 566158 - RNA, 23 nt, Homo sapiens
uaaacauuccuguugaugggaaa

SEQ ID NO: 566159 - RNA, 21 nt, Homo sapiens
uaacagauggaaaaacugagg

SEQ ID NO: 566160 - RNA, 21 nt, Homo sapiens
uaacagcggcaggguguccca

SEQ ID NO: 566161 - RNA, 13 nt, Homo sapiens
uaacagcugggga

SEQ ID NO: 566162 - RNA, 20 nt, Homo sapiens
uaacagggagaaguagcuag

SEQ ID NO: 566163 - RNA, 21 nt, Homo sapiens
uaacagguuuguuugugcuuu

SEQ ID NO: 566164 - RNA, 17 nt, Homo sapiens
uaacaguaguccuuuga

SEQ ID NO: 566165 - RNA, 13 nt, Homo sapiens
uaacagucuaaaa

SEQ ID NO: 566166 - RNA, 19 nt, Homo sapiens
uaacaguucacuuuuuaca

SEQ ID NO: 566167 - RNA, 20 nt, Homo sapiens
uaacaguugugaugacuaug

SEQ ID NO: 566168 - RNA, 16 nt, Homo sapiens
uaacauaccuaagaag

SEQ ID NO: 566169 - RNA, 15 nt, Homo sapiens
uaacauaugauacug

SEQ ID NO: 566170 - RNA, 17 nt, Homo sapiens
uaacauauucaaugcaa

SEQ ID NO: 566171 - RNA, 20 nt, Homo sapiens
uaacaucaacaacacagcaa

SEQ ID NO: 566172 - RNA, 22 nt, Homo sapiens
uaacaucgugggucacuacagg

SEQ ID NO: 566173 - RNA, 13 nt, Homo sapiens
uaacaucuugaau

SEQ ID NO: 566174 - RNA, 19 nt, Homo sapiens
uaacaugaagcaaacuaac

SEQ ID NO: 566175 - RNA, 19 nt, Homo sapiens
uaacaugcccuguucagcu

SEQ ID NO: 566176 - RNA, 12 nt, Homo sapiens
uaacaugcuuua

SEQ ID NO: 566177 - RNA, 19 nt, Homo sapiens
uaacauggacugcuucauc

SEQ ID NO: 566178 - RNA, 20 nt, Homo sapiens
uaacauguaauuaaguacua

SEQ ID NO: 566179 - RNA, 15 nt, Homo sapiens
uaacaugugaaaaga

SEQ ID NO: 566180 - RNA, 13 nt, Homo sapiens
uaacauguguaug

SEQ ID NO: 566181 - RNA, 17 nt, Homo sapiens
uaacauuaucuaguuca

SEQ ID NO: 566182 - RNA, 15 nt, Homo sapiens
uaacauucaguuccc

SEQ ID NO: 566183 - RNA, 17 nt, Homo sapiens
uaacauuccauguuuca

SEQ ID NO: 566184 - RNA, 18 nt, Homo sapiens
uaacauuuaaauuccaca

SEQ ID NO: 566185 - RNA, 19 nt, Homo sapiens
uaacauuuaaauuccacag

SEQ ID NO: 566186 - RNA, 20 nt, Homo sapiens
uaacauuuaaauuccacaga

SEQ ID NO: 566187 - RNA, 14 nt, Homo sapiens
uaaccacagugaaa

SEQ ID NO: 566188 - RNA, 24 nt, Homo sapiens
uaaccagcccgucuucucucucug

SEQ ID NO: 566189 - RNA, 16 nt, Homo sapiens
uaaccaguauuuuugc

SEQ ID NO: 566190 - RNA, 14 nt, Homo sapiens
uaaccaguucuguc

SEQ ID NO: 566191 - RNA, 17 nt, Homo sapiens
uaaccauuacauguuua

SEQ ID NO: 566192 - RNA, 15 nt, Homo sapiens
uaaccauucaaauga

SEQ ID NO: 566193 - RNA, 19 nt, Homo sapiens
uaaccauuuuccuuuggac

SEQ ID NO: 566194 - RNA, 21 nt, Homo sapiens
uaacccaagacaugacauucu

SEQ ID NO: 566195 - RNA, 23 nt, Homo sapiens
uaacccaugaaggauaaaagccc

SEQ ID NO: 566196 - RNA, 17 nt, Homo sapiens
uaaccccaggcacuguu

SEQ ID NO: 566197 - RNA, 19 nt, Homo sapiens
uaacccccaaauacucuga

SEQ ID NO: 566198 - RNA, 21 nt, Homo sapiens
uaaccccgggaugcaagguag

SEQ ID NO: 566199 - RNA, 20 nt, Homo sapiens
uaacccgcucaucacuggau

SEQ ID NO: 566200 - RNA, 15 nt, Homo sapiens
uaacccucacccaca

SEQ ID NO: 566201 - RNA, 15 nt, Homo sapiens
uaacccucucuuccc

SEQ ID NO: 566202 - RNA, 15 nt, Homo sapiens
uaaccuagauguuua

SEQ ID NO: 566203 - RNA, 17 nt, Homo sapiens
uaaccucaaagugacua

SEQ ID NO: 566204 - RNA, 14 nt, Homo sapiens
uaaccucaguguca

SEQ ID NO: 566205 - RNA, 16 nt, Homo sapiens
uaaccucuucaccuua

SEQ ID NO: 566206 - RNA, 22 nt, Homo sapiens
uaaccugccaacauacuuuaag

SEQ ID NO: 566207 - RNA, 13 nt, Homo sapiens
uaaccugcuggau

SEQ ID NO: 566208 - RNA, 21 nt, Homo sapiens
uaaccuucuggcuuccuucuc

SEQ ID NO: 566209 - RNA, 17 nt, Homo sapiens
uaaccuugaaugcugcc

SEQ ID NO: 566210 - RNA, 15 nt, Homo sapiens
uaaccuuuacacucc

SEQ ID NO: 566211 - RNA, 16 nt, Homo sapiens
uaaccuuugcuaugua

SEQ ID NO: 566212 - RNA, 12 nt, Homo sapiens
uaacgacaauuu

SEQ ID NO: 566213 - RNA, 19 nt, Homo sapiens
uaacgacuucuccaucucc

SEQ ID NO: 566214 - RNA, 14 nt, Homo sapiens
uaacgcgucuuccu

SEQ ID NO: 566215 - RNA, 11 nt, Homo sapiens
uaacgcugaac

SEQ ID NO: 566216 - RNA, 14 nt, Homo sapiens
uaacggaccaaagc

SEQ ID NO: 566217 - RNA, 19 nt, Homo sapiens
uaacguggggcuaggacac

SEQ ID NO: 566218 - RNA, 15 nt, Homo sapiens
uaacguucugcugcu

SEQ ID NO: 566219 - RNA, 17 nt, Homo sapiens
uaacguucugcugcuug

SEQ ID NO: 566220 - RNA, 17 nt, Homo sapiens
uaacuaauacuacugug

SEQ ID NO: 566221 - RNA, 15 nt, Homo sapiens
uaacuacaucugccu

SEQ ID NO: 566222 - RNA, 12 nt, Homo sapiens
uaacuacugugu

SEQ ID NO: 566223 - RNA, 19 nt, Homo sapiens
uaacuacuuuuuauacucc

SEQ ID NO: 566224 - RNA, 18 nt, Homo sapiens
uaacuagaaaucugccaa

SEQ ID NO: 566225 - RNA, 19 nt, Homo sapiens
uaacuagaaaucugccaau

SEQ ID NO: 566226 - RNA, 17 nt, Homo sapiens
uaacuagaauuuauuca

SEQ ID NO: 566227 - RNA, 14 nt, Homo sapiens
uaacuauaaucucu

SEQ ID NO: 566228 - RNA, 14 nt, Homo sapiens
uaacuauacuugau

SEQ ID NO: 566229 - RNA, 14 nt, Homo sapiens
uaacuauauuugcu

SEQ ID NO: 566230 - RNA, 14 nt, Homo sapiens
uaacuauuucuuca

SEQ ID NO: 566231 - RNA, 20 nt, Homo sapiens
uaacucaccagccccacugc

SEQ ID NO: 566232 - RNA, 22 nt, Homo sapiens
uaacucaccagccccacugcca

SEQ ID NO: 566233 - RNA, 23 nt, Homo sapiens
uaacucaccagccccacugccag

SEQ ID NO: 566234 - RNA, 21 nt, Homo sapiens
uaacucacugccuaggaggcu

SEQ ID NO: 566235 - RNA, 23 nt, Homo sapiens
uaacucagaaacaucaguuacuc

SEQ ID NO: 566236 - RNA, 15 nt, Homo sapiens
uaacucagaauuauu

SEQ ID NO: 566237 - RNA, 19 nt, Homo sapiens
uaacuccuagcugacucag

SEQ ID NO: 566238 - RNA, 15 nt, Homo sapiens
uaacucggauuccag

SEQ ID NO: 566239 - RNA, 14 nt, Homo sapiens
uaacucucuacagg

SEQ ID NO: 566240 - RNA, 15 nt, Homo sapiens
uaacucugcccaccc

SEQ ID NO: 566241 - RNA, 18 nt, Homo sapiens
uaacucuguauuacagcu

SEQ ID NO: 566242 - RNA, 22 nt, Homo sapiens
uaacugaaccauuccaacuuca

SEQ ID NO: 566243 - RNA, 16 nt, Homo sapiens
uaacugacaacuugaa

SEQ ID NO: 566244 - RNA, 20 nt, Homo sapiens
uaacugacaagccaucuuga

SEQ ID NO: 566245 - RNA, 14 nt, Homo sapiens
uaacugcauugaga

SEQ ID NO: 566246 - RNA, 19 nt, Homo sapiens
uaacugcuucuuggagcuu

SEQ ID NO: 566247 - RNA, 15 nt, Homo sapiens
uaacuggcaguuuuc

SEQ ID NO: 566248 - RNA, 15 nt, Homo sapiens
uaacuggggauauaa

SEQ ID NO: 566249 - RNA, 14 nt, Homo sapiens
uaacuggggggcca

SEQ ID NO: 566250 - RNA, 15 nt, Homo sapiens
uaacuggggggccac

SEQ ID NO: 566251 - RNA, 20 nt, Homo sapiens
uaacuguagcucaaguuuaa

SEQ ID NO: 566252 - RNA, 20 nt, Homo sapiens
uaacuguaugggagcuuaac

SEQ ID NO: 566253 - RNA, 23 nt, Homo sapiens
uaacuguauuucaguauuuucca

SEQ ID NO: 566254 - RNA, 19 nt, Homo sapiens
uaacugugacugaugacuu

SEQ ID NO: 566255 - RNA, 20 nt, Homo sapiens
uaacuguucaaacucaggcc

SEQ ID NO: 566256 - RNA, 13 nt, Homo sapiens
uaacuuacauuug

SEQ ID NO: 566257 - RNA, 13 nt, Homo sapiens
uaacuuacuguau

SEQ ID NO: 566258 - RNA, 14 nt, Homo sapiens
uaacuuauauugaa

SEQ ID NO: 566259 - RNA, 19 nt, Homo sapiens
uaacuuauauugaagacaa

SEQ ID NO: 566260 - RNA, 21 nt, Homo sapiens
uaacuuauauugaagacaauu

SEQ ID NO: 566261 - RNA, 20 nt, Homo sapiens
uaacuuauuuuaaauaugcc

SEQ ID NO: 566262 - RNA, 14 nt, Homo sapiens
uaacuucacauuaa

SEQ ID NO: 566263 - RNA, 13 nt, Homo sapiens
uaacuuccugcug

SEQ ID NO: 566264 - RNA, 15 nt, Homo sapiens
uaacuugcaaaaagu

SEQ ID NO: 566265 - RNA, 13 nt, Homo sapiens
uaacuugcugcuu

SEQ ID NO: 566266 - RNA, 16 nt, Homo sapiens
uaacuuguaaaccaca

SEQ ID NO: 566267 - RNA, 16 nt, Homo sapiens
uaacuuguauauucca

SEQ ID NO: 566268 - RNA, 22 nt, Homo sapiens
uaacuuguuugguaguuagcca

SEQ ID NO: 566269 - RNA, 13 nt, Homo sapiens
uaacuuuaccaug

SEQ ID NO: 566270 - RNA, 15 nt, Homo sapiens
uaacuuuauguguaa

SEQ ID NO: 566271 - RNA, 17 nt, Homo sapiens
uaacuuuauugcauaua

SEQ ID NO: 566272 - RNA, 16 nt, Homo sapiens
uaacuuugaaccauaa

SEQ ID NO: 566273 - RNA, 16 nt, Homo sapiens
uaacuuuuaaugguga

SEQ ID NO: 566274 - RNA, 20 nt, Homo sapiens
uaacuuuucaaugacauuuu

SEQ ID NO: 566275 - RNA, 16 nt, Homo sapiens
uaacuuuuugcacuau

SEQ ID NO: 566276 - RNA, 18 nt, Homo sapiens
uaagaaaaaaacuugucu

SEQ ID NO: 566277 - RNA, 19 nt, Homo sapiens
uaagaaaaaggaugcacag

SEQ ID NO: 566278 - RNA, 12 nt, Homo sapiens
uaagaaaaucau

SEQ ID NO: 566279 - RNA, 16 nt, Homo sapiens
uaagaaacacugacuc

SEQ ID NO: 566280 - RNA, 22 nt, Homo sapiens
uaagaaagaacauuuugccuga

SEQ ID NO: 566281 - RNA, 14 nt, Homo sapiens
uaaugauacuuaac

SEQ ID NO: 566282 - RNA, 12 nt, Homo sapiens
uaaugaugcugu

SEQ ID NO: 566283 - RNA, 17 nt, Homo sapiens
uaaugaugcugucugaa

SEQ ID NO: 566284 - RNA, 15 nt, Homo sapiens
uaaugcaagcaaagu

SEQ ID NO: 566285 - RNA, 14 nt, Homo sapiens
uaaugcacaucugc

SEQ ID NO: 566286 - RNA, 19 nt, Homo sapiens
uaaugcagacucuucuuaa

SEQ ID NO: 566287 - RNA, 10 nt, Homo sapiens
uaaugcugug

SEQ ID NO: 566288 - RNA, 13 nt, Homo sapiens
uaaugcuuuuuga

SEQ ID NO: 566289 - RNA, 20 nt, Homo sapiens
uaauggagaggaaaccagau

SEQ ID NO: 566290 - RNA, 21 nt, Homo sapiens
uaauggcaucaauauacauaa

SEQ ID NO: 566291 - RNA, 16 nt, Homo sapiens
uaauggcuaguacugu

SEQ ID NO: 566292 - RNA, 14 nt, Homo sapiens
uaauguaagcucua

SEQ ID NO: 566293 - RNA, 12 nt, Homo sapiens
uaauguacaaaa

SEQ ID NO: 566294 - RNA, 14 nt, Homo sapiens
uaauguacaauaaa

SEQ ID NO: 566295 - RNA, 23 nt, Homo sapiens
uaauguacaauaaagcaaugugg

SEQ ID NO: 566296 - RNA, 22 nt, Homo sapiens
uaaugucauagguaagaaacac

SEQ ID NO: 566297 - RNA, 14 nt, Homo sapiens
uaaugucucacugu

SEQ ID NO: 566298 - RNA, 19 nt, Homo sapiens
uaaugugaggaacucacau

SEQ ID NO: 566299 - RNA, 23 nt, Homo sapiens
uaauguggccuuggcauuucuuc

SEQ ID NO: 566300 - RNA, 17 nt, Homo sapiens
uaauguuacaacaacua

SEQ ID NO: 566301 - RNA, 14 nt, Homo sapiens
uaauguuacugauc

SEQ ID NO: 566302 - RNA, 16 nt, Homo sapiens
uaauguugcuggauca

SEQ ID NO: 566303 - RNA, 23 nt, Homo sapiens
uaauguuggacagacacuguugc

SEQ ID NO: 566304 - RNA, 22 nt, Homo sapiens
uaauguuguaauucaugccagg

SEQ ID NO: 566305 - RNA, 18 nt, Homo sapiens
uaauuaaaagcaaaucau

SEQ ID NO: 566306 - RNA, 12 nt, Homo sapiens
uaauuaauuuca

SEQ ID NO: 566307 - RNA, 17 nt, Homo sapiens
uaauuagagaacuggag

SEQ ID NO: 566308 - RNA, 13 nt, Homo sapiens
uaauuagcugugc

SEQ ID NO: 566309 - RNA, 17 nt, Homo sapiens
uaauuagggguugcuaa

SEQ ID NO: 566310 - RNA, 17 nt, Homo sapiens
uaauuaguuaacaguuu

SEQ ID NO: 566311 - RNA, 13 nt, Homo sapiens
uaauuaguuccag

SEQ ID NO: 566312 - RNA, 16 nt, Homo sapiens
uaauuauaaauaucau

SEQ ID NO: 566313 - RNA, 20 nt, Homo sapiens
uaauuaucgggaacaguguu

SEQ ID NO: 566314 - RNA, 20 nt, Homo sapiens
uaauuaugaguuugcuuaug

SEQ ID NO: 566315 - RNA, 19 nt, Homo sapiens
uaauuauuauuuccagugu

SEQ ID NO: 566316 - RNA, 14 nt, Homo sapiens
uaauucagcacuga

SEQ ID NO: 566317 - RNA, 13 nt, Homo sapiens
uaauucagcacuu

SEQ ID NO: 566318 - RNA, 16 nt, Homo sapiens
uaauucagguauguaa

SEQ ID NO: 566319 - RNA, 14 nt, Homo sapiens
uaauucaguacaac

SEQ ID NO: 566320 - RNA, 13 nt, Homo sapiens
uaauucauggcau

SEQ ID NO: 566321 - RNA, 16 nt, Homo sapiens
uaauucauggcauuga

SEQ ID NO: 566322 - RNA, 15 nt, Homo sapiens
uaauucauugugauu

SEQ ID NO: 566323 - RNA, 14 nt, Homo sapiens
uaauuccaauauga

SEQ ID NO: 566324 - RNA, 15 nt, Homo sapiens
uaauucuaaguuauu

SEQ ID NO: 566325 - RNA, 14 nt, Homo sapiens
uaauucucuuucaa

SEQ ID NO: 566326 - RNA, 13 nt, Homo sapiens
uaauucuuguaga

SEQ ID NO: 566327 - RNA, 17 nt, Homo sapiens
uaauugaccuacuuugg

SEQ ID NO: 566328 - RNA, 17 nt, Homo sapiens
uaauugcuguucugcug

SEQ ID NO: 566329 - RNA, 18 nt, Homo sapiens
uaauuggaagaaauuccu

SEQ ID NO: 566330 - RNA, 12 nt, Homo sapiens
uaauugguucuu

SEQ ID NO: 566331 - RNA, 15 nt, Homo sapiens
uaauuguaaucugaa

SEQ ID NO: 566332 - RNA, 14 nt, Homo sapiens
uaauuguagcacau

SEQ ID NO: 566333 - RNA, 21 nt, Homo sapiens
uaauuguagcacauuaccaau

SEQ ID NO: 566334 - RNA, 19 nt, Homo sapiens
uaauuguuuaaaaugccuc

SEQ ID NO: 566335 - RNA, 19 nt, Homo sapiens
uaauuuaaacaaauuuaga

SEQ ID NO: 566336 - RNA, 14 nt, Homo sapiens
uaauuuaaagcuua

SEQ ID NO: 566337 - RNA, 14 nt, Homo sapiens
uaauuuaaugcaug

SEQ ID NO: 566338 - RNA, 17 nt, Homo sapiens
uaauuuagaacugucaa

SEQ ID NO: 566339 - RNA, 15 nt, Homo sapiens
uaauuuagacuugga

SEQ ID NO: 566340 - RNA, 22 nt, Homo sapiens
uaauuuaguggauggaauauca

SEQ ID NO: 566341 - RNA, 14 nt, Homo sapiens
uaauuuaguuccac

SEQ ID NO: 566342 - RNA, 21 nt, Homo sapiens
uaauuuaucuugucucugggc

SEQ ID NO: 566343 - RNA, 13 nt, Homo sapiens
uaauuuaugcaag

SEQ ID NO: 566344 - RNA, 15 nt, Homo sapiens
uaauuuaugugcuau

SEQ ID NO: 566345 - RNA, 15 nt, Homo sapiens
uaauuuauuaaucua

SEQ ID NO: 566346 - RNA, 20 nt, Homo sapiens
uaauuuauuauacaccuuag

SEQ ID NO: 566347 - RNA, 21 nt, Homo sapiens
uaauuuauuuaauauacuuua

SEQ ID NO: 566348 - RNA, 18 nt, Homo sapiens
uaauuucaugggacuaaa

SEQ ID NO: 566349 - RNA, 17 nt, Homo sapiens
uaauuuccuggugugaa

SEQ ID NO: 566350 - RNA, 17 nt, Homo sapiens
uaauuuccuuuuugaca

SEQ ID NO: 566351 - RNA, 22 nt, Homo sapiens
uaauuuccuuuuugacacugaa

SEQ ID NO: 566352 - RNA, 22 nt, Homo sapiens
uaauuucgccuuaaacucugga

SEQ ID NO: 566353 - RNA, 21 nt, Homo sapiens
uaauuucugaaaugugcagcu

SEQ ID NO: 566354 - RNA, 13 nt, Homo sapiens
uaauuugaugaaa

SEQ ID NO: 566355 - RNA, 19 nt, Homo sapiens
uaauuugcauugugucaga

SEQ ID NO: 566356 - RNA, 16 nt, Homo sapiens
uaauuugugaauuugc

SEQ ID NO: 566357 - RNA, 18 nt, Homo sapiens
uaauuugugaauuugcaa

SEQ ID NO: 566358 - RNA, 12 nt, Homo sapiens
uaauuugugugg

SEQ ID NO: 566359 - RNA, 20 nt, Homo sapiens
uaauuuuaaccaguucuguc

SEQ ID NO: 566360 - RNA, 18 nt, Homo sapiens
uaauuuuguaauguauca

SEQ ID NO: 566361 - RNA, 14 nt, Homo sapiens
uaauuuuguuguuu

SEQ ID NO: 566362 - RNA, 14 nt, Homo sapiens
uaauuuuuacaugg

SEQ ID NO: 566363 - RNA, 22 nt, Homo sapiens
uacaaaaaauuagcugggcaug

SEQ ID NO: 566364 - RNA, 17 nt, Homo sapiens
uacaaaacaaucucuca

SEQ ID NO: 566365 - RNA, 11 nt, Homo sapiens
uacaaaacugc

SEQ ID NO: 566366 - RNA, 20 nt, Homo sapiens
uacaaaacugcuuugugcau

SEQ ID NO: 566367 - RNA, 14 nt, Homo sapiens
uacaaaaggcauuu

SEQ ID NO: 566368 - RNA, 20 nt, Homo sapiens
uacaaaagugaaccaucuca

SEQ ID NO: 566369 - RNA, 21 nt, Homo sapiens
uacaaacauaaggcacauugu

SEQ ID NO: 566370 - RNA, 23 nt, Homo sapiens
uacaaaccauuuuguuauugacu

SEQ ID NO: 566371 - RNA, 16 nt, Homo sapiens
uacaaacuucaaagag

SEQ ID NO: 566372 - RNA, 13 nt, Homo sapiens
uacaaagaaauaa

SEQ ID NO: 566373 - RNA, 16 nt, Homo sapiens
uacaaagauuaguuuc

SEQ ID NO: 566374 - RNA, 19 nt, Homo sapiens
uacaaaucaaagauuuguc

SEQ ID NO: 566375 - RNA, 13 nt, Homo sapiens
uacaaaucaucca

SEQ ID NO: 566376 - RNA, 19 nt, Homo sapiens
uacaaauuuaugcauuuca

SEQ ID NO: 566377 - RNA, 16 nt, Homo sapiens
uacaacacugagccau

SEQ ID NO: 566378 - RNA, 17 nt, Homo sapiens
uacaacagugcauuuac

SEQ ID NO: 566379 - RNA, 12 nt, Homo sapiens
uacaacauguag

SEQ ID NO: 566380 - RNA, 15 nt, Homo sapiens
uacaaccaauuccaa

SEQ ID NO: 566381 - RNA, 18 nt, Homo sapiens
uacaacugccucgaaaca

SEQ ID NO: 566382 - RNA, 17 nt, Homo sapiens
uacaacuucaagugcau

SEQ ID NO: 566383 - RNA, 21 nt, Homo sapiens
uacaagaacaaugacaccaca

SEQ ID NO: 566384 - RNA, 15 nt, Homo sapiens
uacaagaaguuuauu

SEQ ID NO: 566385 - RNA, 14 nt, Homo sapiens
uacaagacacagug

SEQ ID NO: 566386 - RNA, 20 nt, Homo sapiens
uacaagcuuaaagcuugauu

SEQ ID NO: 566387 - RNA, 17 nt, Homo sapiens
uacaagggcugagauuc

SEQ ID NO: 566388 - RNA, 21 nt, Homo sapiens
uacaaggguaaaauguuacca

SEQ ID NO: 566389 - RNA, 19 nt, Homo sapiens
uacaagucagcuccagcuu

SEQ ID NO: 566390 - RNA, 14 nt, Homo sapiens
uacaaguuugcuaa

SEQ ID NO: 566391 - RNA, 22 nt, Homo sapiens
uacaauaaaaccuuugccacuu

SEQ ID NO: 566392 - RNA, 21 nt, Homo sapiens
uacaauaaagcaaugugguag

SEQ ID NO: 566393 - RNA, 23 nt, Homo sapiens
uacaauacauauaucuacacaua

SEQ ID NO: 566394 - RNA, 18 nt, Homo sapiens
uacaauagacauugcaaa

SEQ ID NO: 566395 - RNA, 20 nt, Homo sapiens
uacaauauuaaguccaaauc

SEQ ID NO: 566396 - RNA, 19 nt, Homo sapiens
uacaaucagccacauucua

SEQ ID NO: 566397 - RNA, 14 nt, Homo sapiens
uacaaucucaaauu

SEQ ID NO: 566398 - RNA, 18 nt, Homo sapiens
uacaaucucaaauucuca

SEQ ID NO: 566399 - RNA, 13 nt, Homo sapiens
uacaauguacaau

SEQ ID NO: 566400 - RNA, 14 nt, Homo sapiens
uacaauguacaauu

SEQ ID NO: 566401 - RNA, 14 nt, Homo sapiens
uacaauguuaaccc

SEQ ID NO: 566402 - RNA, 16 nt, Homo sapiens
uacaauguucauccca

SEQ ID NO: 566403 - RNA, 17 nt, Homo sapiens
uacaauugcacugcugu

SEQ ID NO: 566404 - RNA, 14 nt, Homo sapiens
uauucugggggccc

SEQ ID NO: 566405 - RNA, 17 nt, Homo sapiens
uauucugguuacugugg

SEQ ID NO: 566406 - RNA, 19 nt, Homo sapiens
uauucugucuggcauuaca

SEQ ID NO: 566407 - RNA, 19 nt, Homo sapiens
uauucuguuugcguacuug

SEQ ID NO: 566408 - RNA, 12 nt, Homo sapiens
uauucuugucaa

SEQ ID NO: 566409 - RNA, 14 nt, Homo sapiens
uauucuugucaaaa

SEQ ID NO: 566410 - RNA, 15 nt, Homo sapiens
uauucuugugcuuuu

SEQ ID NO: 566411 - RNA, 17 nt, Homo sapiens
uauucuuucuaaacuac

SEQ ID NO: 566412 - RNA, 19 nt, Homo sapiens
uauucuuucuaaacuacaa

SEQ ID NO: 566413 - RNA, 15 nt, Homo sapiens
uauucuuuguuuccu

SEQ ID NO: 566414 - RNA, 19 nt, Homo sapiens
uauugaaagccaacaacuc

SEQ ID NO: 566415 - RNA, 20 nt, Homo sapiens
uauugaaaggggacaccugu

SEQ ID NO: 566416 - RNA, 16 nt, Homo sapiens
uauugaaugguggugg

SEQ ID NO: 566417 - RNA, 18 nt, Homo sapiens
uauugacaauaauuucag

SEQ ID NO: 566418 - RNA, 18 nt, Homo sapiens
uauugacccucuaugaua

SEQ ID NO: 566419 - RNA, 18 nt, Homo sapiens
uauugacgcauauuuaac

SEQ ID NO: 566420 - RNA, 15 nt, Homo sapiens
uauugacuucaauga

SEQ ID NO: 566421 - RNA, 23 nt, Homo sapiens
uauugagccuugcauguacuuga

SEQ ID NO: 566422 - RNA, 22 nt, Homo sapiens
uauugaggccaagaauauugca

SEQ ID NO: 566423 - RNA, 11 nt, Homo sapiens
uauugauccca

SEQ ID NO: 566424 - RNA, 21 nt, Homo sapiens
uauugcaucuggguagcugua

SEQ ID NO: 566425 - RNA, 21 nt, Homo sapiens
uauugccgccagaagauccaa

SEQ ID NO: 566426 - RNA, 16 nt, Homo sapiens
uauugccucuacuuug

SEQ ID NO: 566427 - RNA, 14 nt, Homo sapiens
uauugcgcugcuac

SEQ ID NO: 566428 - RNA, 14 nt, Homo sapiens
uauugcuucaccau

SEQ ID NO: 566429 - RNA, 17 nt, Homo sapiens
uauugcuucaccauggc

SEQ ID NO: 566430 - RNA, 19 nt, Homo sapiens
uauuggaaagugauuuuau

SEQ ID NO: 566431 - RNA, 13 nt, Homo sapiens
uauuggaagacuu

SEQ ID NO: 566432 - RNA, 19 nt, Homo sapiens
uauuggacugauaaucucu

SEQ ID NO: 566433 - RNA, 13 nt, Homo sapiens
uauuggagcacau

SEQ ID NO: 566434 - RNA, 22 nt, Homo sapiens
uauuggcgcaccaagaucucca

SEQ ID NO: 566435 - RNA, 14 nt, Homo sapiens
uauugguaaauucu

SEQ ID NO: 566436 - RNA, 14 nt, Homo sapiens
uauugguuggugug

SEQ ID NO: 566437 - RNA, 15 nt, Homo sapiens
uauuguaaauacugg

SEQ ID NO: 566438 - RNA, 14 nt, Homo sapiens
uauuguacauaaaa

SEQ ID NO: 566439 - RNA, 14 nt, Homo sapiens
uauuguagcucaau

SEQ ID NO: 566440 - RNA, 14 nt, Homo sapiens
uauuguaguucaua

SEQ ID NO: 566441 - RNA, 16 nt, Homo sapiens
uauuguauaaagcauu

SEQ ID NO: 566442 - RNA, 16 nt, Homo sapiens
uauugugccaauaugu

SEQ ID NO: 566443 - RNA, 22 nt, Homo sapiens
uauuuaaaaaaaaagucagaga

SEQ ID NO: 566444 - RNA, 22 nt, Homo sapiens
uauuuaaagaagaaacgucuau

SEQ ID NO: 566445 - RNA, 15 nt, Homo sapiens
uauuuaaagcuuuca

SEQ ID NO: 566446 - RNA, 20 nt, Homo sapiens
uauuuaaauuguuuuggacg

SEQ ID NO: 566447 - RNA, 18 nt, Homo sapiens
uauuuaacaaaaagugcu

SEQ ID NO: 566448 - RNA, 23 nt, Homo sapiens
uauuuaagaaaaguguuuucaca

SEQ ID NO: 566449 - RNA, 17 nt, Homo sapiens
uauuuaauuaaaucuca

SEQ ID NO: 566450 - RNA, 20 nt, Homo sapiens
uauuuacauaaagacugugc

SEQ ID NO: 566451 - RNA, 12 nt, Homo sapiens
uauuuaccugaa

SEQ ID NO: 566452 - RNA, 14 nt, Homo sapiens
uauuuacucauagu

SEQ ID NO: 566453 - RNA, 18 nt, Homo sapiens
uauuuagacucaucuuac

SEQ ID NO: 566454 - RNA, 20 nt, Homo sapiens
uauuuagauauaacacuaug

SEQ ID NO: 566455 - RNA, 15 nt, Homo sapiens
uauuuagugaacuac

SEQ ID NO: 566456 - RNA, 13 nt, Homo sapiens
uauuuauaacuca

SEQ ID NO: 566457 - RNA, 15 nt, Homo sapiens
uauuuauagucacaa

SEQ ID NO: 566458 - RNA, 14 nt, Homo sapiens
uauuuauauuucaa

SEQ ID NO: 566459 - RNA, 17 nt, Homo sapiens
uauuuaucaauuuuucc

SEQ ID NO: 566460 - RNA, 15 nt, Homo sapiens
uauuuaucacauagc

SEQ ID NO: 566461 - RNA, 20 nt, Homo sapiens
uauuuauccaaaauguguau

SEQ ID NO: 566462 - RNA, 13 nt, Homo sapiens
uauuuaugaaggc

SEQ ID NO: 566463 - RNA, 21 nt, Homo sapiens
uauuuaugagaaaguucucau

SEQ ID NO: 566464 - RNA, 23 nt, Homo sapiens
uauuuaugcaacucaucuucaca

SEQ ID NO: 566465 - RNA, 12 nt, Homo sapiens
uauuuaugcaag

SEQ ID NO: 566466 - RNA, 21 nt, Homo sapiens
uauuuaugcacugugggaugu

SEQ ID NO: 566467 - RNA, 13 nt, Homo sapiens
uauuuauucacug

SEQ ID NO: 566468 - RNA, 13 nt, Homo sapiens
uauuuauuuucag

SEQ ID NO: 566469 - RNA, 19 nt, Homo sapiens
uauuuauuuuuugccauuu

SEQ ID NO: 566470 - RNA, 12 nt, Homo sapiens
uauuucaggcau

SEQ ID NO: 566471 - RNA, 12 nt, Homo sapiens
uauuucagugac

SEQ ID NO: 566472 - RNA, 14 nt, Homo sapiens
uauuucaucugguu

SEQ ID NO: 566473 - RNA, 17 nt, Homo sapiens
uauuucauuccaguuug

SEQ ID NO: 566474 - RNA, 12 nt, Homo sapiens
uauuuccacuga

SEQ ID NO: 566475 - RNA, 15 nt, Homo sapiens
uauuuccacuugccc

SEQ ID NO: 566476 - RNA, 19 nt, Homo sapiens
uauuucccucuacugagua

SEQ ID NO: 566477 - RNA, 22 nt, Homo sapiens
uauuuccuaaaaucacaggaca

SEQ ID NO: 566478 - RNA, 17 nt, Homo sapiens
uauuuccucugugcaaa

SEQ ID NO: 566479 - RNA, 22 nt, Homo sapiens
uauuuccuuaaauguuuugcca

SEQ ID NO: 566480 - RNA, 23 nt, Homo sapiens
uauuuccuuaaauguuuugccag

SEQ ID NO: 566481 - RNA, 16 nt, Homo sapiens
uauuucuauuccuuau

SEQ ID NO: 566482 - RNA, 12 nt, Homo sapiens
uauuucucugau

SEQ ID NO: 566483 - RNA, 14 nt, Homo sapiens
uauuucugauacug

SEQ ID NO: 566484 - RNA, 12 nt, Homo sapiens
uauuucugauga

SEQ ID NO: 566485 - RNA, 18 nt, Homo sapiens
uauuucuguauuuggcua

SEQ ID NO: 566486 - RNA, 18 nt, Homo sapiens
uauuucuuaauuuggaua

SEQ ID NO: 566487 - RNA, 23 nt, Homo sapiens
uauuucuugaagaauaaauucua

SEQ ID NO: 566488 - RNA, 13 nt, Homo sapiens
uauuugaacacuu

SEQ ID NO: 566489 - RNA, 18 nt, Homo sapiens
uauuugaccggaucuaca

SEQ ID NO: 566490 - RNA, 17 nt, Homo sapiens
uauuugcaagacauaga

SEQ ID NO: 566491 - RNA, 19 nt, Homo sapiens
uauuugcaguucaccugca

SEQ ID NO: 566492 - RNA, 19 nt, Homo sapiens
uauuugcauguuaccuccu

SEQ ID NO: 566493 - RNA, 22 nt, Homo sapiens
uauuugcuaccacagcaacuau

SEQ ID NO: 566494 - RNA, 14 nt, Homo sapiens
uauuuggaaccuug

SEQ ID NO: 566495 - RNA, 22 nt, Homo sapiens
uauuugggggaacuggacacaa

SEQ ID NO: 566496 - RNA, 13 nt, Homo sapiens
uauuugguacugu

SEQ ID NO: 566497 - RNA, 12 nt, Homo sapiens
uauuugucacaa

SEQ ID NO: 566498 - RNA, 11 nt, Homo sapiens
uauuugucauu

SEQ ID NO: 566499 - RNA, 23 nt, Homo sapiens
uauuugucuguaaaaaauggagc

SEQ ID NO: 566500 - RNA, 15 nt, Homo sapiens
uauuugugacaaaaa

SEQ ID NO: 566501 - RNA, 18 nt, Homo sapiens
uauuuguggaaacuguca

SEQ ID NO: 566502 - RNA, 20 nt, Homo sapiens
uauuuguuuuaauaccacag

SEQ ID NO: 566503 - RNA, 20 nt, Homo sapiens
uauuuuaaaguaaaagucua

SEQ ID NO: 566504 - RNA, 17 nt, Homo sapiens
uauuuuacugaucucuu

SEQ ID NO: 566505 - RNA, 22 nt, Homo sapiens
uauuuuagacacuucccugcau

SEQ ID NO: 566506 - RNA, 21 nt, Homo sapiens
uauuuuaggcacuguucaaua

SEQ ID NO: 566507 - RNA, 23 nt, Homo sapiens
uauuuuauauaauaaaguauucc

SEQ ID NO: 566508 - RNA, 13 nt, Homo sapiens
uauuuuaucucaa

SEQ ID NO: 566509 - RNA, 17 nt, Homo sapiens
uauuuuaucuucuuucc

SEQ ID NO: 566510 - RNA, 18 nt, Homo sapiens
uauuuuaugaucuuggcu

SEQ ID NO: 566511 - RNA, 23 nt, Homo sapiens
uauuuuauguaaacccucaaggg

SEQ ID NO: 566512 - RNA, 20 nt, Homo sapiens
uauuuuauucccuuucacaa

SEQ ID NO: 566513 - RNA, 17 nt, Homo sapiens
uauuuuauucugaagga

SEQ ID NO: 566514 - RNA, 17 nt, Homo sapiens
uauuuuauuuagacaag

SEQ ID NO: 566515 - RNA, 12 nt, Homo sapiens
uauuuucauaga

SEQ ID NO: 566516 - RNA, 17 nt, Homo sapiens
uauuuucuacagugguu

SEQ ID NO: 566517 - RNA, 22 nt, Homo sapiens
uauuuucuucuccaguggucau

SEQ ID NO: 566518 - RNA, 14 nt, Homo sapiens
uauuuucuuuauca

SEQ ID NO: 566519 - RNA, 16 nt, Homo sapiens
uauuuugguugcugau

SEQ ID NO: 566520 - RNA, 17 nt, Homo sapiens
uauuuuguaaugcugca

SEQ ID NO: 566521 - RNA, 23 nt, Homo sapiens
uauuuuguauauuuguaaacuac

SEQ ID NO: 566522 - RNA, 14 nt, Homo sapiens
uauuuuguguccuc

SEQ ID NO: 566523 - RNA, 16 nt, Homo sapiens
uauuuuguuacaaaaa

SEQ ID NO: 566524 - RNA, 16 nt, Homo sapiens
uauuuuuaaacaaaga

SEQ ID NO: 566525 - RNA, 18 nt, Homo sapiens
uauuuuugagacugucag

SEQ ID NO: 566526 - RNA, 22 nt, Homo sapiens
uauuuuuggguuuggccaggga

SEQ ID NO: 566527 - RNA, 18 nt, Homo sapiens
ucaccuacauuaucucac

SEQ ID NO: 566528 - RNA, 14 nt, Homo sapiens
ucaccuacuccaga

SEQ ID NO: 566529 - RNA, 17 nt, Homo sapiens
ucaccuagaacgugcau

SEQ ID NO: 566530 - RNA, 16 nt, Homo sapiens
ucaccucaaccuccgc

SEQ ID NO: 566531 - RNA, 18 nt, Homo sapiens
ucaccucacacuccucca

SEQ ID NO: 566532 - RNA, 15 nt, Homo sapiens
ucaccucagcugaua

SEQ ID NO: 566533 - RNA, 15 nt, Homo sapiens
ucaccucauucugaa

SEQ ID NO: 566534 - RNA, 18 nt, Homo sapiens
ucaccuccaagcauuuca

SEQ ID NO: 566535 - RNA, 19 nt, Homo sapiens
ucaccuccaagcauuucau

SEQ ID NO: 566536 - RNA, 18 nt, Homo sapiens
ucaccucccgaagccacc

SEQ ID NO: 566537 - RNA, 16 nt, Homo sapiens
ucaccucugaggacag

SEQ ID NO: 566538 - RNA, 17 nt, Homo sapiens
ucaccugaggucaggag

SEQ ID NO: 566539 - RNA, 15 nt, Homo sapiens
ucaccuuagugcaac

SEQ ID NO: 566540 - RNA, 12 nt, Homo sapiens
ucaccuuauuca

SEQ ID NO: 566541 - RNA, 17 nt, Homo sapiens
ucaccuuuucuguggcu

SEQ ID NO: 566542 - RNA, 19 nt, Homo sapiens
ucacgaaguuuguucauca

SEQ ID NO: 566543 - RNA, 14 nt, Homo sapiens
ucacgacucuuccu

SEQ ID NO: 566544 - RNA, 14 nt, Homo sapiens
ucacgagccuuugu

SEQ ID NO: 566545 - RNA, 16 nt, Homo sapiens
ucacgcaggcugaguc

SEQ ID NO: 566546 - RNA, 18 nt, Homo sapiens
ucacgcuugccuggucac

SEQ ID NO: 566547 - RNA, 21 nt, Homo sapiens
ucacgcuuucaugaccacugg

SEQ ID NO: 566548 - RNA, 18 nt, Homo sapiens
ucacggaccacucgaggc

SEQ ID NO: 566549 - RNA, 15 nt, Homo sapiens
ucacggaccccaugu

SEQ ID NO: 566550 - RNA, 23 nt, Homo sapiens
ucacggaccccauguuggaucuu

SEQ ID NO: 566551 - RNA, 18 nt, Homo sapiens
ucacggcugcgcacugug

SEQ ID NO: 566552 - RNA, 19 nt, Homo sapiens
ucacggcugcgcacugugu

SEQ ID NO: 566553 - RNA, 16 nt, Homo sapiens
ucacgggaacucucca

SEQ ID NO: 566554 - RNA, 16 nt, Homo sapiens
ucacguaaagcuagaa

SEQ ID NO: 566555 - RNA, 16 nt, Homo sapiens
ucacgucagugcucag

SEQ ID NO: 566556 - RNA, 17 nt, Homo sapiens
ucacguggaaaugucuc

SEQ ID NO: 566557 - RNA, 21 nt, Homo sapiens
ucacguuuggugcuucucaga

SEQ ID NO: 566558 - RNA, 23 nt, Homo sapiens
ucacuaaauaaacacgauuuuau

SEQ ID NO: 566559 - RNA, 14 nt, Homo sapiens
ucacuaaauguaaa

SEQ ID NO: 566560 - RNA, 16 nt, Homo sapiens
ucacuaaggacuuaaa

SEQ ID NO: 566561 - RNA, 15 nt, Homo sapiens
ucacuaauacacagu

SEQ ID NO: 566562 - RNA, 14 nt, Homo sapiens
ucacuaauacuaau

SEQ ID NO: 566563 - RNA, 20 nt, Homo sapiens
ucacuacugaacacaugugu

SEQ ID NO: 566564 - RNA, 18 nt, Homo sapiens
ucacuacuuuaauaaaga

SEQ ID NO: 566565 - RNA, 22 nt, Homo sapiens
ucacuagagacaaaucuuuaag

SEQ ID NO: 566566 - RNA, 17 nt, Homo sapiens
ucacuauauaagucaca

SEQ ID NO: 566567 - RNA, 16 nt, Homo sapiens
ucacuauguuacaugu

SEQ ID NO: 566568 - RNA, 12 nt, Homo sapiens
ucacuauugaaa

SEQ ID NO: 566569 - RNA, 21 nt, Homo sapiens
ucacucaaccauaacacuuga

SEQ ID NO: 566570 - RNA, 20 nt, Homo sapiens
ucacucaauuucucugagga

SEQ ID NO: 566571 - RNA, 22 nt, Homo sapiens
ucacucaauuucucugaggaca

SEQ ID NO: 566572 - RNA, 16 nt, Homo sapiens
ucacucacucacucca

SEQ ID NO: 566573 - RNA, 18 nt, Homo sapiens
ucacucagccccuacccc

SEQ ID NO: 566574 - RNA, 23 nt, Homo sapiens
ucacucaucaauggggccaguca

SEQ ID NO: 566575 - RNA, 21 nt, Homo sapiens
ucacucauuaaugaaucacau

SEQ ID NO: 566576 - RNA, 22 nt, Homo sapiens
ucacucauucccauguugucaa

SEQ ID NO: 566577 - RNA, 14 nt, Homo sapiens
ucacucccagucca

SEQ ID NO: 566578 - RNA, 16 nt, Homo sapiens
ucacucccauaagcua

SEQ ID NO: 566579 - RNA, 18 nt, Homo sapiens
ucacuccccacaucccau

SEQ ID NO: 566580 - RNA, 17 nt, Homo sapiens
ucacucucaccuuccaa

SEQ ID NO: 566581 - RNA, 18 nt, Homo sapiens
ucacucuguaguuacugu

SEQ ID NO: 566582 - RNA, 12 nt, Homo sapiens
ucacucugucag

SEQ ID NO: 566583 - RNA, 18 nt, Homo sapiens
ucacugaaaacaucugga

SEQ ID NO: 566584 - RNA, 20 nt, Homo sapiens
ucacugaaaacaucuggaag

SEQ ID NO: 566585 - RNA, 18 nt, Homo sapiens
ucacugaacaaacuaaag

SEQ ID NO: 566586 - RNA, 14 nt, Homo sapiens
ucacugaaccacug

SEQ ID NO: 566587 - RNA, 11 nt, Homo sapiens
ucacugagcuc

SEQ ID NO: 566588 - RNA, 17 nt, Homo sapiens
ucacugauauuuuaguc

SEQ ID NO: 566589 - RNA, 23 nt, Homo sapiens
ucacugaugggaaaacugccaau

SEQ ID NO: 566590 - RNA, 12 nt, Homo sapiens
ucacugcaauuu

SEQ ID NO: 566591 - RNA, 14 nt, Homo sapiens
ucacugcauccuca

SEQ ID NO: 566592 - RNA, 17 nt, Homo sapiens
ucacugcccaccaaagg

SEQ ID NO: 566593 - RNA, 14 nt, Homo sapiens
ucacugcucuucag

SEQ ID NO: 566594 - RNA, 12 nt, Homo sapiens
ucacugcugauc

SEQ ID NO: 566595 - RNA, 20 nt, Homo sapiens
ucacugcugcaaauacugua

SEQ ID NO: 566596 - RNA, 22 nt, Homo sapiens
ucacugcugcaaauacuguaua

SEQ ID NO: 566597 - RNA, 16 nt, Homo sapiens
ucacugcuuaacuuca

SEQ ID NO: 566598 - RNA, 16 nt, Homo sapiens
ucacugcuuguugaca

SEQ ID NO: 566599 - RNA, 24 nt, Homo sapiens
ucacuggccccuacuuuguggcaa

SEQ ID NO: 566600 - RNA, 18 nt, Homo sapiens
ucacuggggcaugagauu

SEQ ID NO: 566601 - RNA, 17 nt, Homo sapiens
ucacugguccaccuccu

SEQ ID NO: 566602 - RNA, 14 nt, Homo sapiens
ucacuguacuugua

SEQ ID NO: 566603 - RNA, 22 nt, Homo sapiens
ucacugucuauuuaagugcaau

SEQ ID NO: 566604 - RNA, 15 nt, Homo sapiens
ucacuguguaaccag

SEQ ID NO: 566605 - RNA, 17 nt, Homo sapiens
ucacuguguuacugcuu

SEQ ID NO: 566606 - RNA, 23 nt, Homo sapiens
ucacuuaaagcccgccugacaga

SEQ ID NO: 566607 - RNA, 15 nt, Homo sapiens
ucacuuaauccuuug

SEQ ID NO: 566608 - RNA, 15 nt, Homo sapiens
ucacuucaauccuca

SEQ ID NO: 566609 - RNA, 16 nt, Homo sapiens
ucacuucacuguucuc

SEQ ID NO: 566610 - RNA, 13 nt, Homo sapiens
ucacuucaguugc

SEQ ID NO: 566611 - RNA, 15 nt, Homo sapiens
ucacuucauagcuca

SEQ ID NO: 566612 - RNA, 18 nt, Homo sapiens
ucacuucccuacauggag

SEQ ID NO: 566613 - RNA, 12 nt, Homo sapiens
ucacuucuggga

SEQ ID NO: 566614 - RNA, 16 nt, Homo sapiens
ucacuugaaccgggga

SEQ ID NO: 566615 - RNA, 15 nt, Homo sapiens
ucacuugcucuuuga

SEQ ID NO: 566616 - RNA, 18 nt, Homo sapiens
ucacuugcuuuugaauug

SEQ ID NO: 566617 - RNA, 20 nt, Homo sapiens
ucacuuggaagauuuguaua

SEQ ID NO: 566618 - RNA, 13 nt, Homo sapiens
ucacuuguacaaa

SEQ ID NO: 566619 - RNA, 17 nt, Homo sapiens
ucacuuuaacucaggag

SEQ ID NO: 566620 - RNA, 19 nt, Homo sapiens
ucacuuuggauaugaucuu

SEQ ID NO: 566621 - RNA, 15 nt, Homo sapiens
ucacuuuuauugaua

SEQ ID NO: 566622 - RNA, 19 nt, Homo sapiens
ucacuuuuuacagugcuau

SEQ ID NO: 566623 - RNA, 19 nt, Homo sapiens
ucacuuuuuacauauaguu

SEQ ID NO: 566624 - RNA, 20 nt, Homo sapiens
ucagaaaaagcuagcacuaa

SEQ ID NO: 566625 - RNA, 21 nt, Homo sapiens
ucagaaaaaguuucuuaagga

SEQ ID NO: 566626 - RNA, 23 nt, Homo sapiens
ucagaaacccggcuuccugugcu

SEQ ID NO: 566627 - RNA, 15 nt, Homo sapiens
ucagaaagauaagcc

SEQ ID NO: 566628 - RNA, 13 nt, Homo sapiens
ucagaaagccaac

SEQ ID NO: 566629 - RNA, 13 nt, Homo sapiens
ucagaaagggauu

SEQ ID NO: 566630 - RNA, 17 nt, Homo sapiens
ucagaaagucaccagga

SEQ ID NO: 566631 - RNA, 14 nt, Homo sapiens
ucagaaaugcuguc

SEQ ID NO: 566632 - RNA, 16 nt, Homo sapiens
ucagaacaacuugcua

SEQ ID NO: 566633 - RNA, 22 nt, Homo sapiens
ucagaacagcugaaacauuccg

SEQ ID NO: 566634 - RNA, 13 nt, Homo sapiens
ucagaacaugaaa

SEQ ID NO: 566635 - RNA, 15 nt, Homo sapiens
ucagaaccacuccug

SEQ ID NO: 566636 - RNA, 17 nt, Homo sapiens
ucagaaccuugucccag

SEQ ID NO: 566637 - RNA, 13 nt, Homo sapiens
ucagaagccugag

SEQ ID NO: 566638 - RNA, 18 nt, Homo sapiens
ucagaaggccccagagag

SEQ ID NO: 566639 - RNA, 17 nt, Homo sapiens
ucagaagguaucaguua

SEQ ID NO: 566640 - RNA, 22 nt, Homo sapiens
ucagaagguaucaguuauauga

SEQ ID NO: 566641 - RNA, 13 nt, Homo sapiens
ucagaagugauuu

SEQ ID NO: 566642 - RNA, 19 nt, Homo sapiens
ucagaaguuaguuuguaua

SEQ ID NO: 566643 - RNA, 20 nt, Homo sapiens
ucagaaguuaguuuguauau

SEQ ID NO: 566644 - RNA, 19 nt, Homo sapiens
ucagaaguuucucagcucc

SEQ ID NO: 566645 - RNA, 15 nt, Homo sapiens
ucagaauaaggcagg

SEQ ID NO: 566646 - RNA, 13 nt, Homo sapiens
ucagaauagccac

SEQ ID NO: 566647 - RNA, 21 nt, Homo sapiens
ucagaauaggaaaacauugca

SEQ ID NO: 566648 - RNA, 21 nt, Homo sapiens
ucagaauauugucugccuuaa

SEQ ID NO: 566649 - RNA, 16 nt, Homo sapiens
ucaugugugcauguga

SEQ ID NO: 566650 - RNA, 21 nt, Homo sapiens
ucauguuguugaggcugucac

SEQ ID NO: 566651 - RNA, 22 nt, Homo sapiens
ucauguuguugaggcugucaca

SEQ ID NO: 566652 - RNA, 21 nt, Homo sapiens
ucauuaacaacucauucugau

SEQ ID NO: 566653 - RNA, 14 nt, Homo sapiens
ucauuaaugcacau

SEQ ID NO: 566654 - RNA, 12 nt, Homo sapiens
ucauuacagcuu

SEQ ID NO: 566655 - RNA, 22 nt, Homo sapiens
ucauuacuguuccagauuccua

SEQ ID NO: 566656 - RNA, 23 nt, Homo sapiens
ucauuagagcuuaaauugucaga

SEQ ID NO: 566657 - RNA, 20 nt, Homo sapiens
ucauuagcaguugcucacau

SEQ ID NO: 566658 - RNA, 19 nt, Homo sapiens
ucauuaggcaaaguacaaa

SEQ ID NO: 566659 - RNA, 17 nt, Homo sapiens
ucauuagggaaaugcaa

SEQ ID NO: 566660 - RNA, 22 nt, Homo sapiens
ucauuagggaaaugcaagucaa

SEQ ID NO: 566661 - RNA, 15 nt, Homo sapiens
ucauuaugauuucau

SEQ ID NO: 566662 - RNA, 13 nt, Homo sapiens
ucauuauguauga

SEQ ID NO: 566663 - RNA, 13 nt, Homo sapiens
ucauuauuggaau

SEQ ID NO: 566664 - RNA, 15 nt, Homo sapiens
ucauuauuugcagag

SEQ ID NO: 566665 - RNA, 22 nt, Homo sapiens
ucauuauuuuuuacaauggcca

SEQ ID NO: 566666 - RNA, 16 nt, Homo sapiens
ucauucaauauugaca

SEQ ID NO: 566667 - RNA, 14 nt, Homo sapiens
ucauucagccuuua

SEQ ID NO: 566668 - RNA, 13 nt, Homo sapiens
ucauucauccuga

SEQ ID NO: 566669 - RNA, 19 nt, Homo sapiens
ucauucccuagaucuuucu

SEQ ID NO: 566670 - RNA, 17 nt, Homo sapiens
ucauucccucucaucuc

SEQ ID NO: 566671 - RNA, 20 nt, Homo sapiens
ucauuccuaacacagcaugu

SEQ ID NO: 566672 - RNA, 18 nt, Homo sapiens
ucauuccuuagauaccuu

SEQ ID NO: 566673 - RNA, 15 nt, Homo sapiens
ucauucuaaaccaaa

SEQ ID NO: 566674 - RNA, 13 nt, Homo sapiens
ucauucuacugaa

SEQ ID NO: 566675 - RNA, 21 nt, Homo sapiens
ucauucuacugaacaguccau

SEQ ID NO: 566676 - RNA, 18 nt, Homo sapiens
ucauucucgaaaaaagag

SEQ ID NO: 566677 - RNA, 16 nt, Homo sapiens
ucauucugaaccuuau

SEQ ID NO: 566678 - RNA, 15 nt, Homo sapiens
ucauucugauccuca

SEQ ID NO: 566679 - RNA, 16 nt, Homo sapiens
ucauucugcuacuuca

SEQ ID NO: 566680 - RNA, 22 nt, Homo sapiens
ucauucuuacaauugcacugcu

SEQ ID NO: 566681 - RNA, 22 nt, Homo sapiens
ucauucuucuugggcuuugcua

SEQ ID NO: 566682 - RNA, 22 nt, Homo sapiens
ucauucuuuuauacucagcuuu

SEQ ID NO: 566683 - RNA, 14 nt, Homo sapiens
ucauugaagcuuug

SEQ ID NO: 566684 - RNA, 14 nt, Homo sapiens
ucauugacuaucaa

SEQ ID NO: 566685 - RNA, 16 nt, Homo sapiens
ucauugagaaacuggg

SEQ ID NO: 566686 - RNA, 23 nt, Homo sapiens
ucauugaugagcaagacauacuu

SEQ ID NO: 566687 - RNA, 14 nt, Homo sapiens
ucauugauugaaua

SEQ ID NO: 566688 - RNA, 22 nt, Homo sapiens
ucauugcaccuaucucagccau

SEQ ID NO: 566689 - RNA, 15 nt, Homo sapiens
ucauugcacuuugau

SEQ ID NO: 566690 - RNA, 15 nt, Homo sapiens
ucauugccuuuccag

SEQ ID NO: 566691 - RNA, 21 nt, Homo sapiens
ucauugcgauuuaucuugcuu

SEQ ID NO: 566692 - RNA, 12 nt, Homo sapiens
ucauugcuaaaa

SEQ ID NO: 566693 - RNA, 17 nt, Homo sapiens
ucauugcugagccucug

SEQ ID NO: 566694 - RNA, 16 nt, Homo sapiens
ucauugcuguaccaca

SEQ ID NO: 566695 - RNA, 17 nt, Homo sapiens
ucauuggccuucuuaaa

SEQ ID NO: 566696 - RNA, 18 nt, Homo sapiens
ucauugggaagauucucu

SEQ ID NO: 566697 - RNA, 17 nt, Homo sapiens
ucauuguaaacaaacuc

SEQ ID NO: 566698 - RNA, 18 nt, Homo sapiens
ucauugucuuauaugcuu

SEQ ID NO: 566699 - RNA, 22 nt, Homo sapiens
ucauugucuuguuauguacaaa

SEQ ID NO: 566700 - RNA, 17 nt, Homo sapiens
ucauuguuaaccacagc

SEQ ID NO: 566701 - RNA, 20 nt, Homo sapiens
ucauuguuuauuaacaaauu

SEQ ID NO: 566702 - RNA, 12 nt, Homo sapiens
ucauuuagcuuu

SEQ ID NO: 566703 - RNA, 13 nt, Homo sapiens
ucauuuagcuuuu

SEQ ID NO: 566704 - RNA, 17 nt, Homo sapiens
ucauuucaaauacaucu

SEQ ID NO: 566705 - RNA, 13 nt, Homo sapiens
ucauuucagccaa

SEQ ID NO: 566706 - RNA, 14 nt, Homo sapiens
ucauuucauuucag

SEQ ID NO: 566707 - RNA, 21 nt, Homo sapiens
ucauuuccaaaccaucagcug

SEQ ID NO: 566708 - RNA, 18 nt, Homo sapiens
ucauuuccaaacuugaaa

SEQ ID NO: 566709 - RNA, 13 nt, Homo sapiens
ucauuucuggaaa

SEQ ID NO: 566710 - RNA, 18 nt, Homo sapiens
ucauuucuuccucugcau

SEQ ID NO: 566711 - RNA, 12 nt, Homo sapiens
ucauuugaacaa

SEQ ID NO: 566712 - RNA, 13 nt, Homo sapiens
ucauuugaacaac

SEQ ID NO: 566713 - RNA, 23 nt, Homo sapiens
ucauuuuaacuuuaucacauuau

SEQ ID NO: 566714 - RNA, 17 nt, Homo sapiens
ucauuuuauaugucaaa

SEQ ID NO: 566715 - RNA, 23 nt, Homo sapiens
ucauuuugagcugaaaugcugca

SEQ ID NO: 566716 - RNA, 16 nt, Homo sapiens
ucauuuugcauucaaa

SEQ ID NO: 566717 - RNA, 22 nt, Homo sapiens
ucauuuuuaaccucuagaguca

SEQ ID NO: 566718 - RNA, 17 nt, Homo sapiens
ucauuuuuaagacugua

SEQ ID NO: 566719 - RNA, 15 nt, Homo sapiens
ucauuuuucuccuca

SEQ ID NO: 566720 - RNA, 21 nt, Homo sapiens
ucauuuuuuuuuuaucagagu

SEQ ID NO: 566721 - RNA, 15 nt, Homo sapiens
uccaaaaacagcagg

SEQ ID NO: 566722 - RNA, 14 nt, Homo sapiens
uccaaaaagcacau

SEQ ID NO: 566723 - RNA, 21 nt, Homo sapiens
uccaaaaauagcccugcaaaa

SEQ ID NO: 566724 - RNA, 13 nt, Homo sapiens
uccaaaacauuuc

SEQ ID NO: 566725 - RNA, 13 nt, Homo sapiens
uccaaaagacaaa

SEQ ID NO: 566726 - RNA, 22 nt, Homo sapiens
uccaaaagcacuuacggauucu

SEQ ID NO: 566727 - RNA, 13 nt, Homo sapiens
uccaaaaggcccu

SEQ ID NO: 566728 - RNA, 14 nt, Homo sapiens
uccaaacagugugu

SEQ ID NO: 566729 - RNA, 23 nt, Homo sapiens
uccaaacaguguguuggugcuuu

SEQ ID NO: 566730 - RNA, 18 nt, Homo sapiens
uccaaacauuaaugcaau

SEQ ID NO: 566731 - RNA, 15 nt, Homo sapiens
uccaaaccaguuuau

SEQ ID NO: 566732 - RNA, 18 nt, Homo sapiens
uccaaaccaucagcugcu

SEQ ID NO: 566733 - RNA, 23 nt, Homo sapiens
uccaaaccccaggguagccaugg

SEQ ID NO: 566734 - RNA, 22 nt, Homo sapiens
uccaaaccugucuuggggccac

SEQ ID NO: 566735 - RNA, 15 nt, Homo sapiens
uccaaagaacuugau

SEQ ID NO: 566736 - RNA, 21 nt, Homo sapiens
uccaaagagaagggcacugua

SEQ ID NO: 566737 - RNA, 16 nt, Homo sapiens
uccaaagagccuucag

SEQ ID NO: 566738 - RNA, 22 nt, Homo sapiens
uccaaagaggcugccccucuca

SEQ ID NO: 566739 - RNA, 13 nt, Homo sapiens
uccaaagucagau

SEQ ID NO: 566740 - RNA, 21 nt, Homo sapiens
uccaaaguucccacuccuuca

SEQ ID NO: 566741 - RNA, 11 nt, Homo sapiens
uccaaauaaca

SEQ ID NO: 566742 - RNA, 18 nt, Homo sapiens
uccaaaucugccuagaaa

SEQ ID NO: 566743 - RNA, 13 nt, Homo sapiens
uccaaaugccaac

SEQ ID NO: 566744 - RNA, 19 nt, Homo sapiens
uccaaauggcuuugcagaa

SEQ ID NO: 566745 - RNA, 15 nt, Homo sapiens
uccaaauguccucca

SEQ ID NO: 566746 - RNA, 17 nt, Homo sapiens
uccaaauguggccucca

SEQ ID NO: 566747 - RNA, 23 nt, Homo sapiens
uccaaauuuggcucacuugccuu

SEQ ID NO: 566748 - RNA, 19 nt, Homo sapiens
uccaacaacgacacauuca

SEQ ID NO: 566749 - RNA, 21 nt, Homo sapiens
uccaacaccaagcacagcagc

SEQ ID NO: 566750 - RNA, 16 nt, Homo sapiens
uccaacacugcugcuc

SEQ ID NO: 566751 - RNA, 18 nt, Homo sapiens
uccaacagccagugugug

SEQ ID NO: 566752 - RNA, 19 nt, Homo sapiens
uccaacauuucucacugaa

SEQ ID NO: 566753 - RNA, 17 nt, Homo sapiens
uccaaccaagaggauuu

SEQ ID NO: 566754 - RNA, 17 nt, Homo sapiens
uccaaccaggagcugau

SEQ ID NO: 566755 - RNA, 21 nt, Homo sapiens
uccaaccaggaguaccuggac

SEQ ID NO: 566756 - RNA, 21 nt, Homo sapiens
uccaaccccccaccugccauu

SEQ ID NO: 566757 - RNA, 17 nt, Homo sapiens
uccaacccgaggcaaua

SEQ ID NO: 566758 - RNA, 18 nt, Homo sapiens
uccaacccgccggucuca

SEQ ID NO: 566759 - RNA, 18 nt, Homo sapiens
uccaacccugccgucacc

SEQ ID NO: 566760 - RNA, 15 nt, Homo sapiens
uccaacuccaggaua

SEQ ID NO: 566761 - RNA, 17 nt, Homo sapiens
uccaacuguacuuuuaa

SEQ ID NO: 566762 - RNA, 12 nt, Homo sapiens
uccaacuguaua

SEQ ID NO: 566763 - RNA, 14 nt, Homo sapiens
uccaagacugaaga

SEQ ID NO: 566764 - RNA, 20 nt, Homo sapiens
uccaagcaaaaacaaauggg

SEQ ID NO: 566765 - RNA, 20 nt, Homo sapiens
uccaagcagaguguuuuauu

SEQ ID NO: 566766 - RNA, 18 nt, Homo sapiens
uccaagcauuucaugaaa

SEQ ID NO: 566767 - RNA, 21 nt, Homo sapiens
uccaagccuuauuuugaguaa

SEQ ID NO: 566768 - RNA, 12 nt, Homo sapiens
uccaagcugugu

SEQ ID NO: 566769 - RNA, 13 nt, Homo sapiens
uccaagcuguguu

SEQ ID NO: 566770 - RNA, 21 nt, Homo sapiens
uccaaggaugggaaucaggca

SEQ ID NO: 566771 - RNA, 20 nt, Homo sapiens
uccgaggcuccccgccucca

SEQ ID NO: 566772 - RNA, 15 nt, Homo sapiens
uccgaucaacauuua

SEQ ID NO: 566773 - RNA, 16 nt, Homo sapiens
uccgcacuuuccacuu

SEQ ID NO: 566774 - RNA, 21 nt, Homo sapiens
uccgcagaccugcugugauga

SEQ ID NO: 566775 - RNA, 14 nt, Homo sapiens
uccgcccugccacu

SEQ ID NO: 566776 - RNA, 18 nt, Homo sapiens
uccgcggccugcaccgac

SEQ ID NO: 566777 - RNA, 21 nt, Homo sapiens
uccggaagcugucgacuucau

SEQ ID NO: 566778 - RNA, 17 nt, Homo sapiens
uccggcccacagguuuc

SEQ ID NO: 566779 - RNA, 17 nt, Homo sapiens
uccggccugcgucucca

SEQ ID NO: 566780 - RNA, 16 nt, Homo sapiens
uccggcgggauguuga

SEQ ID NO: 566781 - RNA, 16 nt, Homo sapiens
uccgggaaaacagcua

SEQ ID NO: 566782 - RNA, 22 nt, Homo sapiens
uccgggagcggcuguugggcug

SEQ ID NO: 566783 - RNA, 17 nt, Homo sapiens
uccgguuuagucaucca

SEQ ID NO: 566784 - RNA, 18 nt, Homo sapiens
uccgguuugccauguugc

SEQ ID NO: 566785 - RNA, 20 nt, Homo sapiens
uccguaaacauauaucuuac

SEQ ID NO: 566786 - RNA, 12 nt, Homo sapiens
uccguacauuca

SEQ ID NO: 566787 - RNA, 17 nt, Homo sapiens
uccgucugucucgaugc

SEQ ID NO: 566788 - RNA, 13 nt, Homo sapiens
uccgugccuccac

SEQ ID NO: 566789 - RNA, 15 nt, Homo sapiens
uccguucaauaagca

SEQ ID NO: 566790 - RNA, 22 nt, Homo sapiens
uccuaaacccaaugacuucccu

SEQ ID NO: 566791 - RNA, 21 nt, Homo sapiens
uccuaaacucucuagcuuaag

SEQ ID NO: 566792 - RNA, 16 nt, Homo sapiens
uccuaaaugcagugaa

SEQ ID NO: 566793 - RNA, 20 nt, Homo sapiens
uccuaacaaguagcacccug

SEQ ID NO: 566794 - RNA, 14 nt, Homo sapiens
uccuaacuagaauu

SEQ ID NO: 566795 - RNA, 13 nt, Homo sapiens
uccuaagcaccug

SEQ ID NO: 566796 - RNA, 23 nt, Homo sapiens
uccuaagccuguugcugaaguca

SEQ ID NO: 566797 - RNA, 16 nt, Homo sapiens
uccuaaggacacacua

SEQ ID NO: 566798 - RNA, 21 nt, Homo sapiens
uccuaauaauaucccacuggg

SEQ ID NO: 566799 - RNA, 18 nt, Homo sapiens
uccuaauauuuuguucug

SEQ ID NO: 566800 - RNA, 21 nt, Homo sapiens
uccuacaagacacagugacca

SEQ ID NO: 566801 - RNA, 16 nt, Homo sapiens
uccuacacuugagaug

SEQ ID NO: 566802 - RNA, 19 nt, Homo sapiens
uccuacagcuaacccucac

SEQ ID NO: 566803 - RNA, 16 nt, Homo sapiens
uccuacagggccacaa

SEQ ID NO: 566804 - RNA, 20 nt, Homo sapiens
uccuacagugacucccuggg

SEQ ID NO: 566805 - RNA, 21 nt, Homo sapiens
uccuaccccuuccuguccugc

SEQ ID NO: 566806 - RNA, 12 nt, Homo sapiens
uccuaccucagc

SEQ ID NO: 566807 - RNA, 16 nt, Homo sapiens
uccuaccucuggugau

SEQ ID NO: 566808 - RNA, 15 nt, Homo sapiens
uccuacguauccugc

SEQ ID NO: 566809 - RNA, 15 nt, Homo sapiens
uccuacucacuuaaa

SEQ ID NO: 566810 - RNA, 11 nt, Homo sapiens
uccuacugaug

SEQ ID NO: 566811 - RNA, 16 nt, Homo sapiens
uccuacugauguuccu

SEQ ID NO: 566812 - RNA, 21 nt, Homo sapiens
uccuacuuagggaagaaaaag

SEQ ID NO: 566813 - RNA, 20 nt, Homo sapiens
uccuacuucucuuguaaaac

SEQ ID NO: 566814 - RNA, 21 nt, Homo sapiens
uccuacuuuacauaugcuuua

SEQ ID NO: 566815 - RNA, 13 nt, Homo sapiens
uccuacuuucucc

SEQ ID NO: 566816 - RNA, 14 nt, Homo sapiens
uccuagacuugaaa

SEQ ID NO: 566817 - RNA, 19 nt, Homo sapiens
uccuagaggugggcagcug

SEQ ID NO: 566818 - RNA, 13 nt, Homo sapiens
uccuagagugcag

SEQ ID NO: 566819 - RNA, 14 nt, Homo sapiens
uccuagagugcagg

SEQ ID NO: 566820 - RNA, 16 nt, Homo sapiens
uccuagguccucugag

SEQ ID NO: 566821 - RNA, 22 nt, Homo sapiens
uccuaguguuucuuuguggucu

SEQ ID NO: 566822 - RNA, 20 nt, Homo sapiens
uccuauaaucugucaaaaca

SEQ ID NO: 566823 - RNA, 14 nt, Homo sapiens
uccuauaccuuacu

SEQ ID NO: 566824 - RNA, 20 nt, Homo sapiens
uccuauaucuguuuguauau

SEQ ID NO: 566825 - RNA, 23 nt, Homo sapiens
uccuaucacugauaguguccaaa

SEQ ID NO: 566826 - RNA, 21 nt, Homo sapiens
uccuaugcccagguaccaccc

SEQ ID NO: 566827 - RNA, 13 nt, Homo sapiens
uccuaugcuauug

SEQ ID NO: 566828 - RNA, 16 nt, Homo sapiens
uccuaugcuauugaca

SEQ ID NO: 566829 - RNA, 19 nt, Homo sapiens
uccuauucccugucacuac

SEQ ID NO: 566830 - RNA, 18 nt, Homo sapiens
uccuauucuguugccaau

SEQ ID NO: 566831 - RNA, 13 nt, Homo sapiens
uccuauugucauu

SEQ ID NO: 566832 - RNA, 16 nt, Homo sapiens
uccuauugucauuaaa

SEQ ID NO: 566833 - RNA, 19 nt, Homo sapiens
uccucaaaccacuugccug

SEQ ID NO: 566834 - RNA, 22 nt, Homo sapiens
uccucaaauuuuuugacuuuuu

SEQ ID NO: 566835 - RNA, 22 nt, Homo sapiens
uccucacacacccugaggucag

SEQ ID NO: 566836 - RNA, 13 nt, Homo sapiens
uccucacagugaa

SEQ ID NO: 566837 - RNA, 18 nt, Homo sapiens
uccucacaguugccaugu

SEQ ID NO: 566838 - RNA, 19 nt, Homo sapiens
uccucacauacccacacau

SEQ ID NO: 566839 - RNA, 16 nt, Homo sapiens
uccucacccagaucag

SEQ ID NO: 566840 - RNA, 22 nt, Homo sapiens
uccucacccugccggguagcug

SEQ ID NO: 566841 - RNA, 15 nt, Homo sapiens
uccucagacaacagc

SEQ ID NO: 566842 - RNA, 19 nt, Homo sapiens
uccucagacaacagccucu

SEQ ID NO: 566843 - RNA, 19 nt, Homo sapiens
uccucagagcaggggccag

SEQ ID NO: 566844 - RNA, 19 nt, Homo sapiens
uccucagguaguacuggga

SEQ ID NO: 566845 - RNA, 20 nt, Homo sapiens
uccucagguaguacugggaa

SEQ ID NO: 566846 - RNA, 19 nt, Homo sapiens
uccucaguuuacaucuugu

SEQ ID NO: 566847 - RNA, 19 nt, Homo sapiens
uccucaucuuuaaaaugaa

SEQ ID NO: 566848 - RNA, 22 nt, Homo sapiens
uccucaugcuuagaaaguucca

SEQ ID NO: 566849 - RNA, 21 nt, Homo sapiens
uccucauuagcauuuugcuaa

SEQ ID NO: 566850 - RNA, 13 nt, Homo sapiens
uccucauuccuga

SEQ ID NO: 566851 - RNA, 20 nt, Homo sapiens
uccucauugccuccuguucu

SEQ ID NO: 566852 - RNA, 23 nt, Homo sapiens
uccuccaagaauuugacuuggaa

SEQ ID NO: 566853 - RNA, 22 nt, Homo sapiens
uccuccacagucccccacccac

SEQ ID NO: 566854 - RNA, 13 nt, Homo sapiens
uccuccacuccac

SEQ ID NO: 566855 - RNA, 18 nt, Homo sapiens
uccuccacuccaccucca

SEQ ID NO: 566856 - RNA, 13 nt, Homo sapiens
uccuccacugacu

SEQ ID NO: 566857 - RNA, 20 nt, Homo sapiens
uccuccagaagccucuggcu

SEQ ID NO: 566858 - RNA, 14 nt, Homo sapiens
uccuccagaccauu

SEQ ID NO: 566859 - RNA, 13 nt, Homo sapiens
uccuccaggguga

SEQ ID NO: 566860 - RNA, 13 nt, Homo sapiens
uccuccaucccaa

SEQ ID NO: 566861 - RNA, 19 nt, Homo sapiens
uccucccacagaccugcag

SEQ ID NO: 566862 - RNA, 14 nt, Homo sapiens
uccucccagugaga

SEQ ID NO: 566863 - RNA, 18 nt, Homo sapiens
uccuccccacacuccacu

SEQ ID NO: 566864 - RNA, 13 nt, Homo sapiens
uccuccccauaca

SEQ ID NO: 566865 - RNA, 17 nt, Homo sapiens
uccucccccagcuaucu

SEQ ID NO: 566866 - RNA, 17 nt, Homo sapiens
uccuccccuauugcgcu

SEQ ID NO: 566867 - RNA, 15 nt, Homo sapiens
uccucccucauucca

SEQ ID NO: 566868 - RNA, 23 nt, Homo sapiens
uccucccucccagcugcacuuua

SEQ ID NO: 566869 - RNA, 20 nt, Homo sapiens
uccucccuuccuuuucccug

SEQ ID NO: 566870 - RNA, 19 nt, Homo sapiens
uccuccguguggacugugc

SEQ ID NO: 566871 - RNA, 12 nt, Homo sapiens
uccuccuaccug

SEQ ID NO: 566872 - RNA, 15 nt, Homo sapiens
uccuccugaccucaa

SEQ ID NO: 566873 - RNA, 12 nt, Homo sapiens
uccuccugaugg

SEQ ID NO: 566874 - RNA, 17 nt, Homo sapiens
uccuccugcagacaccu

SEQ ID NO: 566875 - RNA, 20 nt, Homo sapiens
uccuccugcagacaccugga

SEQ ID NO: 566876 - RNA, 14 nt, Homo sapiens
uccuccugcugcag

SEQ ID NO: 566877 - RNA, 23 nt, Homo sapiens
uccuccuuaugacuccauucaaa

SEQ ID NO: 566878 - RNA, 22 nt, Homo sapiens
uccuccuuuaccuuucagugca

SEQ ID NO: 566879 - RNA, 23 nt, Homo sapiens
uccucgggaaacacacaagcaac

SEQ ID NO: 566880 - RNA, 15 nt, Homo sapiens
uccucgguucaaggu

SEQ ID NO: 566881 - RNA, 13 nt, Homo sapiens
uccucguagccau

SEQ ID NO: 566882 - RNA, 22 nt, Homo sapiens
uccucguugggccgcucugauu

SEQ ID NO: 566883 - RNA, 17 nt, Homo sapiens
uccucuacuguuuaaca

SEQ ID NO: 566884 - RNA, 13 nt, Homo sapiens
uccucucaucccc

SEQ ID NO: 566885 - RNA, 14 nt, Homo sapiens
uccucucucuacca

SEQ ID NO: 566886 - RNA, 17 nt, Homo sapiens
uccucucuuaaaugcaa

SEQ ID NO: 566887 - RNA, 16 nt, Homo sapiens
uccucugaggcacuca

SEQ ID NO: 566888 - RNA, 15 nt, Homo sapiens
uccucugaucuccau

SEQ ID NO: 566889 - RNA, 10 nt, Homo sapiens
uccucugcau

SEQ ID NO: 566890 - RNA, 21 nt, Homo sapiens
uccucugggcagcgcuaucua

SEQ ID NO: 566891 - RNA, 19 nt, Homo sapiens
uccucuguccaggcacugc

SEQ ID NO: 566892 - RNA, 17 nt, Homo sapiens
uccucugugcaaaggga

SEQ ID NO: 566893 - RNA, 18 nt, Homo sapiens
ugaacuacagacuaaaga

SEQ ID NO: 566894 - RNA, 19 nt, Homo sapiens
ugaacuacauaacuuccua

SEQ ID NO: 566895 - RNA, 18 nt, Homo sapiens
ugaacuagggaagcucag

SEQ ID NO: 566896 - RNA, 17 nt, Homo sapiens
ugaacuccaccgaccaa

SEQ ID NO: 566897 - RNA, 21 nt, Homo sapiens
ugaacucugguggcacaggag

SEQ ID NO: 566898 - RNA, 18 nt, Homo sapiens
ugaacucuucaaucucuu

SEQ ID NO: 566899 - RNA, 22 nt, Homo sapiens
ugaacucuuucuggccugccuu

SEQ ID NO: 566900 - RNA, 17 nt, Homo sapiens
ugaacugaaguuucaca

SEQ ID NO: 566901 - RNA, 18 nt, Homo sapiens
ugaacugacaaugaaggg

SEQ ID NO: 566902 - RNA, 15 nt, Homo sapiens
ugaacugcaacacug

SEQ ID NO: 566903 - RNA, 16 nt, Homo sapiens
ugaacugcaacacugg

SEQ ID NO: 566904 - RNA, 11 nt, Homo sapiens
ugaacugcugu

SEQ ID NO: 566905 - RNA, 15 nt, Homo sapiens
ugaacugggcauuuc

SEQ ID NO: 566906 - RNA, 13 nt, Homo sapiens
ugaacugugcaua

SEQ ID NO: 566907 - RNA, 21 nt, Homo sapiens
ugaacuguggugccacaugac

SEQ ID NO: 566908 - RNA, 17 nt, Homo sapiens
ugaacuugcauugugau

SEQ ID NO: 566909 - RNA, 21 nt, Homo sapiens
ugaacuuggaaagaaaugccc

SEQ ID NO: 566910 - RNA, 24 nt, Homo sapiens
ugaacuuggaaagaaaugcccauc

SEQ ID NO: 566911 - RNA, 16 nt, Homo sapiens
ugaacuuucacauagc

SEQ ID NO: 566912 - RNA, 13 nt, Homo sapiens
ugaagaaaagggg

SEQ ID NO: 566913 - RNA, 17 nt, Homo sapiens
ugaagaaaaguauugca

SEQ ID NO: 566914 - RNA, 19 nt, Homo sapiens
ugaagaacacagcaugugc

SEQ ID NO: 566915 - RNA, 21 nt, Homo sapiens
ugaagaacaggcuuggcaaag

SEQ ID NO: 566916 - RNA, 12 nt, Homo sapiens
ugaagaacugac

SEQ ID NO: 566917 - RNA, 19 nt, Homo sapiens
ugaagaagaguuucuccuu

SEQ ID NO: 566918 - RNA, 20 nt, Homo sapiens
ugaagaagaugagccuugca

SEQ ID NO: 566919 - RNA, 12 nt, Homo sapiens
ugaagaaguagu

SEQ ID NO: 566920 - RNA, 16 nt, Homo sapiens
ugaagaaucuacuuaa

SEQ ID NO: 566921 - RNA, 17 nt, Homo sapiens
ugaagacacagccuccc

SEQ ID NO: 566922 - RNA, 11 nt, Homo sapiens
ugaagacauaa

SEQ ID NO: 566923 - RNA, 15 nt, Homo sapiens
ugaagacauguuuca

SEQ ID NO: 566924 - RNA, 14 nt, Homo sapiens
ugaagaccaugccu

SEQ ID NO: 566925 - RNA, 18 nt, Homo sapiens
ugaagacgagcauccccc

SEQ ID NO: 566926 - RNA, 13 nt, Homo sapiens
ugaagacuaugaa

SEQ ID NO: 566927 - RNA, 14 nt, Homo sapiens
ugaagacugcacag

SEQ ID NO: 566928 - RNA, 23 nt, Homo sapiens
ugaagagagggacaggcacucca

SEQ ID NO: 566929 - RNA, 22 nt, Homo sapiens
ugaagagauuucaacaagaaua

SEQ ID NO: 566930 - RNA, 14 nt, Homo sapiens
ugaagagcaaaggg

SEQ ID NO: 566931 - RNA, 21 nt, Homo sapiens
ugaagaggagauuggccagug

SEQ ID NO: 566932 - RNA, 23 nt, Homo sapiens
ugaagaggagauuggccagugag

SEQ ID NO: 566933 - RNA, 22 nt, Homo sapiens
ugaagaggccaaaggaaugucc

SEQ ID NO: 566934 - RNA, 22 nt, Homo sapiens
ugaagaggcugcuucucuacag

SEQ ID NO: 566935 - RNA, 18 nt, Homo sapiens
ugaagaggguugguauaa

SEQ ID NO: 566936 - RNA, 22 nt, Homo sapiens
ugaagaguccgugguugcccua

SEQ ID NO: 566937 - RNA, 21 nt, Homo sapiens
ugaagaguuuacugaagcaaa

SEQ ID NO: 566938 - RNA, 21 nt, Homo sapiens
ugaagauaguaacuguagaug

SEQ ID NO: 566939 - RNA, 23 nt, Homo sapiens
ugaagaucaagccaguucuccuu

SEQ ID NO: 566940 - RNA, 23 nt, Homo sapiens
ugaagaugauaccugaagcuguc

SEQ ID NO: 566941 - RNA, 17 nt, Homo sapiens
ugaagauggacauuuua

SEQ ID NO: 566942 - RNA, 23 nt, Homo sapiens
ugaagauguuucaaaaaaucuga

SEQ ID NO: 566943 - RNA, 13 nt, Homo sapiens
ugaagcacugagc

SEQ ID NO: 566944 - RNA, 11 nt, Homo sapiens
ugaagcacugu

SEQ ID NO: 566945 - RNA, 17 nt, Homo sapiens
ugaagcagcacugugag

SEQ ID NO: 566946 - RNA, 15 nt, Homo sapiens
ugaagcagguuccca

SEQ ID NO: 566947 - RNA, 13 nt, Homo sapiens
ugaagccaaagaa

SEQ ID NO: 566948 - RNA, 15 nt, Homo sapiens
ugaagccaaagggac

SEQ ID NO: 566949 - RNA, 11 nt, Homo sapiens
ugaagccacag

SEQ ID NO: 566950 - RNA, 13 nt, Homo sapiens
ugaagccacagca

SEQ ID NO: 566951 - RNA, 14 nt, Homo sapiens
ugaagccagaucca

SEQ ID NO: 566952 - RNA, 16 nt, Homo sapiens
ugaagccauguagcca

SEQ ID NO: 566953 - RNA, 16 nt, Homo sapiens
ugaagccaugucuaca

SEQ ID NO: 566954 - RNA, 15 nt, Homo sapiens
ugaagcccucugucu

SEQ ID NO: 566955 - RNA, 22 nt, Homo sapiens
ugaagcguugccauugaacuca

SEQ ID NO: 566956 - RNA, 21 nt, Homo sapiens
ugaagcuuaggacuaccagcc

SEQ ID NO: 566957 - RNA, 23 nt, Homo sapiens
ugaaggaaaguguaugaguugca

SEQ ID NO: 566958 - RNA, 15 nt, Homo sapiens
ugaaggaacauuccu

SEQ ID NO: 566959 - RNA, 22 nt, Homo sapiens
ugaaggaagagaagacauuugc

SEQ ID NO: 566960 - RNA, 18 nt, Homo sapiens
ugaaggagauagauuugu

SEQ ID NO: 566961 - RNA, 16 nt, Homo sapiens
ugaaggagcagcauug

SEQ ID NO: 566962 - RNA, 17 nt, Homo sapiens
ugaaggaugugggccca

SEQ ID NO: 566963 - RNA, 21 nt, Homo sapiens
ugaaggcaaaaacuguacugu

SEQ ID NO: 566964 - RNA, 14 nt, Homo sapiens
ugaaggcccaagag

SEQ ID NO: 566965 - RNA, 23 nt, Homo sapiens
ugaagggaagugcaucugucagc

SEQ ID NO: 566966 - RNA, 16 nt, Homo sapiens
ugaagggagggucccu

SEQ ID NO: 566967 - RNA, 15 nt, Homo sapiens
ugaaggggaggucac

SEQ ID NO: 566968 - RNA, 16 nt, Homo sapiens
ugaaggguaaagaagu

SEQ ID NO: 566969 - RNA, 12 nt, Homo sapiens
ugaaggugaccu

SEQ ID NO: 566970 - RNA, 14 nt, Homo sapiens
ugaaggugaccucu

SEQ ID NO: 566971 - RNA, 18 nt, Homo sapiens
ugaaggugauucaccaaa

SEQ ID NO: 566972 - RNA, 16 nt, Homo sapiens
ugaaguaaaauugagu

SEQ ID NO: 566973 - RNA, 23 nt, Homo sapiens
ugaaguaaugaauuuuuaugaua

SEQ ID NO: 566974 - RNA, 18 nt, Homo sapiens
ugaaguacaaacaugaaa

SEQ ID NO: 566975 - RNA, 16 nt, Homo sapiens
ugaaguaggugugacu

SEQ ID NO: 566976 - RNA, 14 nt, Homo sapiens
ugaagucaaauguc

SEQ ID NO: 566977 - RNA, 18 nt, Homo sapiens
ugaagucagccacacugg

SEQ ID NO: 566978 - RNA, 22 nt, Homo sapiens
ugaaguccuucaccucacugaa

SEQ ID NO: 566979 - RNA, 23 nt, Homo sapiens
ugaagucucuuuuucuuccucuc

SEQ ID NO: 566980 - RNA, 15 nt, Homo sapiens
ugaagucuucccuca

SEQ ID NO: 566981 - RNA, 14 nt, Homo sapiens
ugaagugaaucuga

SEQ ID NO: 566982 - RNA, 15 nt, Homo sapiens
ugaagugcgugaaug

SEQ ID NO: 566983 - RNA, 20 nt, Homo sapiens
ugaaguggucugaauucugg

SEQ ID NO: 566984 - RNA, 15 nt, Homo sapiens
ugaagugguuucuaa

SEQ ID NO: 566985 - RNA, 23 nt, Homo sapiens
ugaaguuaacccugucugagaug

SEQ ID NO: 566986 - RNA, 22 nt, Homo sapiens
ugaaguucagugauaacucuga

SEQ ID NO: 566987 - RNA, 16 nt, Homo sapiens
ugaaguuuaauugacu

SEQ ID NO: 566988 - RNA, 18 nt, Homo sapiens
ugaaguuuaauugacuua

SEQ ID NO: 566989 - RNA, 15 nt, Homo sapiens
ugaaguuucacauga

SEQ ID NO: 566990 - RNA, 15 nt, Homo sapiens
ugaauaaaaacccug

SEQ ID NO: 566991 - RNA, 17 nt, Homo sapiens
ugaauaaaaacccugua

SEQ ID NO: 566992 - RNA, 22 nt, Homo sapiens
ugaauaaaccaucaucuugcca

SEQ ID NO: 566993 - RNA, 15 nt, Homo sapiens
ugaauaaaguguaag

SEQ ID NO: 566994 - RNA, 15 nt, Homo sapiens
ugaauaaauguguug

SEQ ID NO: 566995 - RNA, 16 nt, Homo sapiens
ugaauaauacaguauc

SEQ ID NO: 566996 - RNA, 13 nt, Homo sapiens
ugaauacacagua

SEQ ID NO: 566997 - RNA, 20 nt, Homo sapiens
ugaauacauuuccaaaaugg

SEQ ID NO: 566998 - RNA, 20 nt, Homo sapiens
ugaauacucugcccucuaga

SEQ ID NO: 566999 - RNA, 22 nt, Homo sapiens
ugaauagaaguuuuccugauaa

SEQ ID NO: 567000 - RNA, 15 nt, Homo sapiens
ugaauagauggaauu

SEQ ID NO: 567001 - RNA, 12 nt, Homo sapiens
ugaauagcacag

SEQ ID NO: 567002 - RNA, 23 nt, Homo sapiens
ugaauagccaggccugaccucaa

SEQ ID NO: 567003 - RNA, 23 nt, Homo sapiens
ugaauagccuggccaccagccau

SEQ ID NO: 567004 - RNA, 18 nt, Homo sapiens
ugaauagggaaguaacau

SEQ ID NO: 567005 - RNA, 15 nt, Homo sapiens
ugaauaguugcuuaa

SEQ ID NO: 567006 - RNA, 23 nt, Homo sapiens
ugaauauaaauguuuuacucaga

SEQ ID NO: 567007 - RNA, 11 nt, Homo sapiens
ugaauaucauu

SEQ ID NO: 567008 - RNA, 14 nt, Homo sapiens
ugaauauccagaaa

SEQ ID NO: 567009 - RNA, 22 nt, Homo sapiens
ugaauaucugccccaguaguca

SEQ ID NO: 567010 - RNA, 20 nt, Homo sapiens
ugaauauggaacauaugcac

SEQ ID NO: 567011 - RNA, 13 nt, Homo sapiens
ugaauauguagcu

SEQ ID NO: 567012 - RNA, 22 nt, Homo sapiens
ugaauauuccuggacuuacaaa

SEQ ID NO: 567013 - RNA, 17 nt, Homo sapiens
ugaauauugccauuaug

SEQ ID NO: 567014 - RNA, 18 nt, Homo sapiens
ugaaucaagcacacugua

SEQ ID NO: 567015 - RNA, 19 nt, Homo sapiens
ugaaucaaggaaagccagg

SEQ ID NO: 567016 - RNA, 12 nt, Homo sapiens
ugaaucaaugaa

SEQ ID NO: 567017 - RNA, 18 nt, Homo sapiens
ugaaucaguuuuggaauc

SEQ ID NO: 567018 - RNA, 19 nt, Homo sapiens
ugaaucauauucauaugca

SEQ ID NO: 567019 - RNA, 18 nt, Homo sapiens
ugaauccaaacuaaucca

SEQ ID NO: 567020 - RNA, 15 nt, Homo sapiens
ugaauccaagccuug

SEQ ID NO: 567021 - RNA, 15 nt, Homo sapiens
ugaauccuuugccug

SEQ ID NO: 567022 - RNA, 17 nt, Homo sapiens
ugaaucuaacacauuuc

SEQ ID NO: 567023 - RNA, 12 nt, Homo sapiens
ugaaucuucaca

SEQ ID NO: 567024 - RNA, 16 nt, Homo sapiens
ugaaugaacaaaugaa

SEQ ID NO: 567025 - RNA, 14 nt, Homo sapiens
ugaaugaugccuuu

SEQ ID NO: 567026 - RNA, 12 nt, Homo sapiens
ugaaugaugcuu

SEQ ID NO: 567027 - RNA, 15 nt, Homo sapiens
ugaaugcaaaccaua

SEQ ID NO: 567028 - RNA, 14 nt, Homo sapiens
ugaaugcagggaca

SEQ ID NO: 567029 - RNA, 20 nt, Homo sapiens
ugaaugccguggauugcacg

SEQ ID NO: 567030 - RNA, 15 nt, Homo sapiens
ugaaugccucccuca

SEQ ID NO: 567031 - RNA, 23 nt, Homo sapiens
ugaaugccucccucaaaggaccu

SEQ ID NO: 567032 - RNA, 16 nt, Homo sapiens
ugaaugcuauguucug

SEQ ID NO: 567033 - RNA, 14 nt, Homo sapiens
ugaaugcuccauua

SEQ ID NO: 567034 - RNA, 13 nt, Homo sapiens
ugaaugcugccag

SEQ ID NO: 567035 - RNA, 20 nt, Homo sapiens
ugaaugcugcuuccauuuga

SEQ ID NO: 567036 - RNA, 12 nt, Homo sapiens
ugaaugcuuccu

SEQ ID NO: 567037 - RNA, 21 nt, Homo sapiens
ugaauggaggcagagaccucc

SEQ ID NO: 567038 - RNA, 16 nt, Homo sapiens
ugaaugguuccaugcc

SEQ ID NO: 567039 - RNA, 14 nt, Homo sapiens
ugaauguaaugaga

SEQ ID NO: 567040 - RNA, 16 nt, Homo sapiens
ugaauguagcuuccac

SEQ ID NO: 567041 - RNA, 21 nt, Homo sapiens
ugaauguauguaauguguggu

SEQ ID NO: 567042 - RNA, 15 nt, Homo sapiens
ugaauguaugugcac

SEQ ID NO: 567043 - RNA, 22 nt, Homo sapiens
ugaauguauuuugguugcugau

SEQ ID NO: 567044 - RNA, 21 nt, Homo sapiens
ugaaugucacauuugaauucu

SEQ ID NO: 567045 - RNA, 20 nt, Homo sapiens
ugaaugucccaacccagaca

SEQ ID NO: 567046 - RNA, 19 nt, Homo sapiens
ugaaugugccuaauggaga

SEQ ID NO: 567047 - RNA, 15 nt, Homo sapiens
ugaauguggacucaa

SEQ ID NO: 567048 - RNA, 21 nt, Homo sapiens
ugaauguguccacaguugaga

SEQ ID NO: 567049 - RNA, 13 nt, Homo sapiens
ugaauuacccuuu

SEQ ID NO: 567050 - RNA, 21 nt, Homo sapiens
ugaauuauaacuagacaucug

SEQ ID NO: 567051 - RNA, 16 nt, Homo sapiens
ugaauuaugcuuccac

SEQ ID NO: 567052 - RNA, 18 nt, Homo sapiens
ugaauuauugacacugaa

SEQ ID NO: 567053 - RNA, 15 nt, Homo sapiens
ugaauucauaucgcc

SEQ ID NO: 567054 - RNA, 14 nt, Homo sapiens
ugaauucuggaauc

SEQ ID NO: 567055 - RNA, 15 nt, Homo sapiens
ugaauugaaauguuc

SEQ ID NO: 567056 - RNA, 17 nt, Homo sapiens
ugaauugggaucugauu

SEQ ID NO: 567057 - RNA, 23 nt, Homo sapiens
ugaauuguuaauucacagaauag

SEQ ID NO: 567058 - RNA, 19 nt, Homo sapiens
ugaauuguuacaucaugcu

SEQ ID NO: 567059 - RNA, 14 nt, Homo sapiens
ugaauuucaguaaa

SEQ ID NO: 567060 - RNA, 21 nt, Homo sapiens
ugaauuuggccugcacuaauu

SEQ ID NO: 567061 - RNA, 17 nt, Homo sapiens
ugaauuuucaaguaauu

SEQ ID NO: 567062 - RNA, 21 nt, Homo sapiens
ugaauuuucaaguaauuguga

SEQ ID NO: 567063 - RNA, 14 nt, Homo sapiens
ugaauuuuguugcu

SEQ ID NO: 567064 - RNA, 19 nt, Homo sapiens
ugacaaaaaauuaaagcau

SEQ ID NO: 567065 - RNA, 21 nt, Homo sapiens
ugacaaaaaauuaaagcauuu

SEQ ID NO: 567066 - RNA, 13 nt, Homo sapiens
ugacaaacauauc

SEQ ID NO: 567067 - RNA, 17 nt, Homo sapiens
ugacaaaccauaacuga

SEQ ID NO: 567068 - RNA, 15 nt, Homo sapiens
ugacaaaccauuucc

SEQ ID NO: 567069 - RNA, 12 nt, Homo sapiens
ugacaaagccau

SEQ ID NO: 567070 - RNA, 22 nt, Homo sapiens
ugacaaauauuuuagaagcuaa

SEQ ID NO: 567071 - RNA, 13 nt, Homo sapiens
ugacaacacaaau

SEQ ID NO: 567072 - RNA, 14 nt, Homo sapiens
ugacaacaguuuua

SEQ ID NO: 567073 - RNA, 12 nt, Homo sapiens
ugacaacuguga

SEQ ID NO: 567074 - RNA, 17 nt, Homo sapiens
ugacaacugugacugua

SEQ ID NO: 567075 - RNA, 22 nt, Homo sapiens
ugacaacugugacuguacccaa

SEQ ID NO: 567076 - RNA, 13 nt, Homo sapiens
ugacaagaacaaa

SEQ ID NO: 567077 - RNA, 18 nt, Homo sapiens
ugacaagaacaaagccac

SEQ ID NO: 567078 - RNA, 14 nt, Homo sapiens
ugacaagcacugcu

SEQ ID NO: 567079 - RNA, 16 nt, Homo sapiens
ugacaagccuucuuaa

SEQ ID NO: 567080 - RNA, 22 nt, Homo sapiens
ugacaaggggcaguggugguuu

SEQ ID NO: 567081 - RNA, 20 nt, Homo sapiens
ugacaagguucccaagacaa

SEQ ID NO: 567082 - RNA, 16 nt, Homo sapiens
ugacaauauacuucac

SEQ ID NO: 567083 - RNA, 14 nt, Homo sapiens
ugacaaucaacucu

SEQ ID NO: 567084 - RNA, 23 nt, Homo sapiens
ugacaaucaacucuaauagugcu

SEQ ID NO: 567085 - RNA, 14 nt, Homo sapiens
ugacaaucugccuu

SEQ ID NO: 567086 - RNA, 16 nt, Homo sapiens
ugacaauguugcauuu

SEQ ID NO: 567087 - RNA, 20 nt, Homo sapiens
ugacaauuacucagguuuga

SEQ ID NO: 567088 - RNA, 15 nt, Homo sapiens
ugacacaagcacuuu

SEQ ID NO: 567089 - RNA, 18 nt, Homo sapiens
ugacacaaguggaccuua

SEQ ID NO: 567090 - RNA, 21 nt, Homo sapiens
ugacacacaaaucccauuaaa

SEQ ID NO: 567091 - RNA, 21 nt, Homo sapiens
ugacacaccccuaaguacaag

SEQ ID NO: 567092 - RNA, 11 nt, Homo sapiens
ugacacagcca

SEQ ID NO: 567093 - RNA, 13 nt, Homo sapiens
ugacacagucuug

SEQ ID NO: 567094 - RNA, 17 nt, Homo sapiens
ugacacauugcugauau

SEQ ID NO: 567095 - RNA, 19 nt, Homo sapiens
ugacacccaugccagagag

SEQ ID NO: 567096 - RNA, 18 nt, Homo sapiens
ugacaccggggggcuccc

SEQ ID NO: 567097 - RNA, 20 nt, Homo sapiens
ugacaccgucccucagugau

SEQ ID NO: 567098 - RNA, 21 nt, Homo sapiens
ugacaccgucccucagugaua

SEQ ID NO: 567099 - RNA, 20 nt, Homo sapiens
ugacaccgugggucauuaca

SEQ ID NO: 567100 - RNA, 20 nt, Homo sapiens
ugacaccuagauuauagucu

SEQ ID NO: 567101 - RNA, 15 nt, Homo sapiens
ugacaccugcugaga

SEQ ID NO: 567102 - RNA, 16 nt, Homo sapiens
ugacaccuggugcuuu

SEQ ID NO: 567103 - RNA, 11 nt, Homo sapiens
ugacacgcagc

SEQ ID NO: 567104 - RNA, 12 nt, Homo sapiens
ugacacuauuca

SEQ ID NO: 567105 - RNA, 18 nt, Homo sapiens
ugacacuuuaauuaccaa

SEQ ID NO: 567106 - RNA, 17 nt, Homo sapiens
ugacacuuugccagaaa

SEQ ID NO: 567107 - RNA, 19 nt, Homo sapiens
ugacagacaggcucuuagc

SEQ ID NO: 567108 - RNA, 19 nt, Homo sapiens
ugacagaguucacuauaaa

SEQ ID NO: 567109 - RNA, 20 nt, Homo sapiens
ugacagaucaagcugugaga

SEQ ID NO: 567110 - RNA, 12 nt, Homo sapiens
ugacagccuccc

SEQ ID NO: 567111 - RNA, 13 nt, Homo sapiens
ugacagccuuccc

SEQ ID NO: 567112 - RNA, 22 nt, Homo sapiens
ugacagcugaccuuugucaucu

SEQ ID NO: 567113 - RNA, 20 nt, Homo sapiens
ugacagcuucaugaaacugu

SEQ ID NO: 567114 - RNA, 13 nt, Homo sapiens
ugacagcuuuauc

SEQ ID NO: 567115 - RNA, 14 nt, Homo sapiens
ugacaggugaugcu

SEQ ID NO: 567116 - RNA, 16 nt, Homo sapiens
ugacaguaaaucucac

SEQ ID NO: 567117 - RNA, 21 nt, Homo sapiens
ugacagucauaaauacuguca

SEQ ID NO: 567118 - RNA, 16 nt, Homo sapiens
ugacagucuugugcuu

SEQ ID NO: 567119 - RNA, 23 nt, Homo sapiens
ugacagugaagcagcacugugag

SEQ ID NO: 567120 - RNA, 14 nt, Homo sapiens
ugacagugccucuu

SEQ ID NO: 567121 - RNA, 17 nt, Homo sapiens
ugacagugccugggaau

SEQ ID NO: 567122 - RNA, 18 nt, Homo sapiens
ugacaguggucccagaac

SEQ ID NO: 567123 - RNA, 12 nt, Homo sapiens
ugacaguuuaca

SEQ ID NO: 567124 - RNA, 13 nt, Homo sapiens
ugacauaaccaac

SEQ ID NO: 567125 - RNA, 16 nt, Homo sapiens
ugacauaauaauagca

SEQ ID NO: 567126 - RNA, 21 nt, Homo sapiens
ugacauaccuaccaguauuau

SEQ ID NO: 567127 - RNA, 18 nt, Homo sapiens
ugacauauaucuauuaca

SEQ ID NO: 567128 - RNA, 22 nt, Homo sapiens
ugacauaugcuaacccccaaau

SEQ ID NO: 567129 - RNA, 19 nt, Homo sapiens
ugacauauguagaugugcu

SEQ ID NO: 567130 - RNA, 14 nt, Homo sapiens
ugacaucacuugua

SEQ ID NO: 567131 - RNA, 18 nt, Homo sapiens
ugacaucagcaauacaga

SEQ ID NO: 567132 - RNA, 17 nt, Homo sapiens
ugacauccaaaucuagc

SEQ ID NO: 567133 - RNA, 18 nt, Homo sapiens
ugacaucucaguucacug

SEQ ID NO: 567134 - RNA, 17 nt, Homo sapiens
ugacaugauauagucag

SEQ ID NO: 567135 - RNA, 16 nt, Homo sapiens
ugacauguaagaaaau

SEQ ID NO: 567136 - RNA, 15 nt, Homo sapiens
ugacauuacaauccu

SEQ ID NO: 567137 - RNA, 16 nt, Homo sapiens
ugacauuacaauccug

SEQ ID NO: 567138 - RNA, 17 nt, Homo sapiens
ugaucaagaaugcaaua

SEQ ID NO: 567139 - RNA, 22 nt, Homo sapiens
ugaucacacaguguuagugcug

SEQ ID NO: 567140 - RNA, 12 nt, Homo sapiens
ugaucacaguga

SEQ ID NO: 567141 - RNA, 14 nt, Homo sapiens
ugaucacauucuuc

SEQ ID NO: 567142 - RNA, 17 nt, Homo sapiens
ugaucacauucuuucca

SEQ ID NO: 567143 - RNA, 16 nt, Homo sapiens
ugaucaccugccaaau

SEQ ID NO: 567144 - RNA, 16 nt, Homo sapiens
ugaucagcaucuguga

SEQ ID NO: 567145 - RNA, 18 nt, Homo sapiens
ugaucagcaucugugaug

SEQ ID NO: 567146 - RNA, 15 nt, Homo sapiens
ugaucagguaacuuu

SEQ ID NO: 567147 - RNA, 17 nt, Homo sapiens
ugaucagugggccucca

SEQ ID NO: 567148 - RNA, 15 nt, Homo sapiens
ugaucauccaggccu

SEQ ID NO: 567149 - RNA, 21 nt, Homo sapiens
ugaucauguguggaaguuauu

SEQ ID NO: 567150 - RNA, 23 nt, Homo sapiens
ugauccacuuugggggaggagaa

SEQ ID NO: 567151 - RNA, 15 nt, Homo sapiens
ugaucccaauccuua

SEQ ID NO: 567152 - RNA, 12 nt, Homo sapiens
ugaucccagaaa

SEQ ID NO: 567153 - RNA, 16 nt, Homo sapiens
ugauccguuccauugc

SEQ ID NO: 567154 - RNA, 19 nt, Homo sapiens
ugauccuaggcauuugcug

SEQ ID NO: 567155 - RNA, 22 nt, Homo sapiens
ugauccugacacauucugagua

SEQ ID NO: 567156 - RNA, 17 nt, Homo sapiens
ugauccuuccaccucag

SEQ ID NO: 567157 - RNA, 16 nt, Homo sapiens
ugauccuugcugauaa

SEQ ID NO: 567158 - RNA, 15 nt, Homo sapiens
ugaucgcuuucuaca

SEQ ID NO: 567159 - RNA, 23 nt, Homo sapiens
ugaucggagccuccucucucaaa

SEQ ID NO: 567160 - RNA, 21 nt, Homo sapiens
ugaucuagugcaguaaaggga

SEQ ID NO: 567161 - RNA, 13 nt, Homo sapiens
ugaucuauacaaa

SEQ ID NO: 567162 - RNA, 20 nt, Homo sapiens
ugaucuccauaaacaugaaa

SEQ ID NO: 567163 - RNA, 19 nt, Homo sapiens
ugaucucggaugaccaaac

SEQ ID NO: 567164 - RNA, 22 nt, Homo sapiens
ugaucucggcucacugcaaauc

SEQ ID NO: 567165 - RNA, 13 nt, Homo sapiens
ugaucucugggag

SEQ ID NO: 567166 - RNA, 19 nt, Homo sapiens
ugaucucuuagaagccaug

SEQ ID NO: 567167 - RNA, 23 nt, Homo sapiens
ugaucucuucuuuuggcuuccau

SEQ ID NO: 567168 - RNA, 19 nt, Homo sapiens
ugaucugggagagucucac

SEQ ID NO: 567169 - RNA, 14 nt, Homo sapiens
ugaucuguacuuug

SEQ ID NO: 567170 - RNA, 12 nt, Homo sapiens
ugaucugugaua

SEQ ID NO: 567171 - RNA, 19 nt, Homo sapiens
ugaucuuaacaaagccuuu

SEQ ID NO: 567172 - RNA, 20 nt, Homo sapiens
ugaucuucccacaccagccu

SEQ ID NO: 567173 - RNA, 12 nt, Homo sapiens
ugaucuugagca

SEQ ID NO: 567174 - RNA, 18 nt, Homo sapiens
ugaucuuucuuuucccaa

SEQ ID NO: 567175 - RNA, 19 nt, Homo sapiens
ugaucuuuuaggccaagga

SEQ ID NO: 567176 - RNA, 21 nt, Homo sapiens
ugaugaaaacuaaggauuuuu

SEQ ID NO: 567177 - RNA, 15 nt, Homo sapiens
ugaugaaacauucau

SEQ ID NO: 567178 - RNA, 14 nt, Homo sapiens
ugaugaacuaguga

SEQ ID NO: 567179 - RNA, 20 nt, Homo sapiens
ugaugaacuguggugccaca

SEQ ID NO: 567180 - RNA, 16 nt, Homo sapiens
ugaugaaucaacaaga

SEQ ID NO: 567181 - RNA, 18 nt, Homo sapiens
ugaugacccuuuucauga

SEQ ID NO: 567182 - RNA, 15 nt, Homo sapiens
ugaugacgacgacaa

SEQ ID NO: 567183 - RNA, 18 nt, Homo sapiens
ugaugacugcuuaacucc

SEQ ID NO: 567184 - RNA, 19 nt, Homo sapiens
ugaugagaauuguauguca

SEQ ID NO: 567185 - RNA, 18 nt, Homo sapiens
ugaugagcauuuguuuga

SEQ ID NO: 567186 - RNA, 23 nt, Homo sapiens
ugaugaggccucuuggaccucug

SEQ ID NO: 567187 - RNA, 23 nt, Homo sapiens
ugaugagucgguccucuuuccag

SEQ ID NO: 567188 - RNA, 16 nt, Homo sapiens
ugaugauaacacuuaa

SEQ ID NO: 567189 - RNA, 17 nt, Homo sapiens
ugaugaugaugaugacu

SEQ ID NO: 567190 - RNA, 13 nt, Homo sapiens
ugaugaugucucu

SEQ ID NO: 567191 - RNA, 13 nt, Homo sapiens
ugaugauuuugca

SEQ ID NO: 567192 - RNA, 11 nt, Homo sapiens
ugaugcagcuu

SEQ ID NO: 567193 - RNA, 23 nt, Homo sapiens
ugaugccauuacagaaccaaauc

SEQ ID NO: 567194 - RNA, 18 nt, Homo sapiens
ugaugccccuuccccaag

SEQ ID NO: 567195 - RNA, 21 nt, Homo sapiens
ugaugcccugcugaccaugca

SEQ ID NO: 567196 - RNA, 12 nt, Homo sapiens
ugaugcuagcca

SEQ ID NO: 567197 - RNA, 13 nt, Homo sapiens
ugaugcuaugaaa

SEQ ID NO: 567198 - RNA, 16 nt, Homo sapiens
ugaugcuauuuaugca

SEQ ID NO: 567199 - RNA, 17 nt, Homo sapiens
ugaugcuauuuaugcaa

SEQ ID NO: 567200 - RNA, 14 nt, Homo sapiens
ugaugcugugcuau

SEQ ID NO: 567201 - RNA, 23 nt, Homo sapiens
ugaugcuucuaucaggucccauc

SEQ ID NO: 567202 - RNA, 13 nt, Homo sapiens
ugauggaaauauu

SEQ ID NO: 567203 - RNA, 18 nt, Homo sapiens
ugauggagaggacagagc

SEQ ID NO: 567204 - RNA, 16 nt, Homo sapiens
ugauggagaugcaguc

SEQ ID NO: 567205 - RNA, 12 nt, Homo sapiens
ugauggaggaac

SEQ ID NO: 567206 - RNA, 17 nt, Homo sapiens
ugauggagucagguuug

SEQ ID NO: 567207 - RNA, 21 nt, Homo sapiens
ugauggcaccacugcacucca

SEQ ID NO: 567208 - RNA, 18 nt, Homo sapiens
ugauggcuaugccuugca

SEQ ID NO: 567209 - RNA, 15 nt, Homo sapiens
ugaugggacaucaaa

SEQ ID NO: 567210 - RNA, 22 nt, Homo sapiens
ugaugguauaaacaggagacag

SEQ ID NO: 567211 - RNA, 14 nt, Homo sapiens
ugaugguugcaaaa

SEQ ID NO: 567212 - RNA, 17 nt, Homo sapiens
ugauguagauuacugaa

SEQ ID NO: 567213 - RNA, 20 nt, Homo sapiens
ugaugucagaauagcuucca

SEQ ID NO: 567214 - RNA, 16 nt, Homo sapiens
ugaugucuccacuuuc

SEQ ID NO: 567215 - RNA, 22 nt, Homo sapiens
ugaugucuucuggugucauggu

SEQ ID NO: 567216 - RNA, 15 nt, Homo sapiens
ugaugugaaacauua

SEQ ID NO: 567217 - RNA, 19 nt, Homo sapiens
ugauguuccaccugccaca

SEQ ID NO: 567218 - RNA, 21 nt, Homo sapiens
ugauguuuugguguauuguca

SEQ ID NO: 567219 - RNA, 23 nt, Homo sapiens
ugauuaaaacacacauaaaccaa

SEQ ID NO: 567220 - RNA, 16 nt, Homo sapiens
ugauuaaagugcucac

SEQ ID NO: 567221 - RNA, 14 nt, Homo sapiens
ugauuaaaugacac

SEQ ID NO: 567222 - RNA, 13 nt, Homo sapiens
ugauuaacuuauu

SEQ ID NO: 567223 - RNA, 14 nt, Homo sapiens
ugauuaauguuucu

SEQ ID NO: 567224 - RNA, 14 nt, Homo sapiens
ugauuagacagaac

SEQ ID NO: 567225 - RNA, 15 nt, Homo sapiens
ugauuagacagaaca

SEQ ID NO: 567226 - RNA, 22 nt, Homo sapiens
ugauuagagugcaaaagugaga

SEQ ID NO: 567227 - RNA, 15 nt, Homo sapiens
ugauuaggaagcauu

SEQ ID NO: 567228 - RNA, 14 nt, Homo sapiens
ugauuauauucaca

SEQ ID NO: 567229 - RNA, 13 nt, Homo sapiens
ugauuauucaaca

SEQ ID NO: 567230 - RNA, 21 nt, Homo sapiens
ugauucaaaccaaagcugccu

SEQ ID NO: 567231 - RNA, 20 nt, Homo sapiens
ugauucaagccauuccaaag

SEQ ID NO: 567232 - RNA, 16 nt, Homo sapiens
ugauucacagucucau

SEQ ID NO: 567233 - RNA, 20 nt, Homo sapiens
ugauucacauccucucaagu

SEQ ID NO: 567234 - RNA, 17 nt, Homo sapiens
ugauucaccucuuccuc

SEQ ID NO: 567235 - RNA, 22 nt, Homo sapiens
ugauucaggggucugaugacac

SEQ ID NO: 567236 - RNA, 19 nt, Homo sapiens
ugauucauaguaacuucuu

SEQ ID NO: 567237 - RNA, 16 nt, Homo sapiens
ugauuccgcagcucag

SEQ ID NO: 567238 - RNA, 20 nt, Homo sapiens
ugauucgcccaaagccagac

SEQ ID NO: 567239 - RNA, 14 nt, Homo sapiens
ugauucuccugccu

SEQ ID NO: 567240 - RNA, 13 nt, Homo sapiens
ugauucucucucc

SEQ ID NO: 567241 - RNA, 22 nt, Homo sapiens
ugauucuuaacacagccuuccu

SEQ ID NO: 567242 - RNA, 12 nt, Homo sapiens
ugauucuugccu

SEQ ID NO: 567243 - RNA, 19 nt, Homo sapiens
ugauugaaaauaguaaaug

SEQ ID NO: 567244 - RNA, 15 nt, Homo sapiens
ugauugaaccagcuc

SEQ ID NO: 567245 - RNA, 16 nt, Homo sapiens
ugauugaaccagcuca

SEQ ID NO: 567246 - RNA, 20 nt, Homo sapiens
ugauugaaucugauuggaca

SEQ ID NO: 567247 - RNA, 18 nt, Homo sapiens
ugauugacagaacccuuu

SEQ ID NO: 567248 - RNA, 18 nt, Homo sapiens
ugauugaucacacagugu

SEQ ID NO: 567249 - RNA, 17 nt, Homo sapiens
ugauugcuuugcugcac

SEQ ID NO: 567250 - RNA, 17 nt, Homo sapiens
ugauuggaccaggccau

SEQ ID NO: 567251 - RNA, 23 nt, Homo sapiens
ugauuggaccaggccauucugcc

SEQ ID NO: 567252 - RNA, 12 nt, Homo sapiens
ugauuuacauaa

SEQ ID NO: 567253 - RNA, 23 nt, Homo sapiens
ugauuuagugaauggcauuugcu

SEQ ID NO: 567254 - RNA, 18 nt, Homo sapiens
ugauuucacaacagauca

SEQ ID NO: 567255 - RNA, 15 nt, Homo sapiens
ugauuucagcacauu

SEQ ID NO: 567256 - RNA, 15 nt, Homo sapiens
ugauuucauuuagau

SEQ ID NO: 567257 - RNA, 14 nt, Homo sapiens
ugauuucuucucau

SEQ ID NO: 567258 - RNA, 18 nt, Homo sapiens
ugauuugaaaaguauuau

SEQ ID NO: 567259 - RNA, 19 nt, Homo sapiens
ugauuuggaagagaggcac

SEQ ID NO: 567260 - RNA, 17 nt, Homo sapiens
ugcccaacccuauccca

SEQ ID NO: 567261 - RNA, 21 nt, Homo sapiens
ugcccaacugccugccuuagg

SEQ ID NO: 567262 - RNA, 18 nt, Homo sapiens
ugcccaauccauccugcu

SEQ ID NO: 567263 - RNA, 17 nt, Homo sapiens
ugcccacaacuugucac

SEQ ID NO: 567264 - RNA, 23 nt, Homo sapiens
ugcccacaacuugucacccaaag

SEQ ID NO: 567265 - RNA, 13 nt, Homo sapiens
ugcccacagcagg

SEQ ID NO: 567266 - RNA, 13 nt, Homo sapiens
ugcccacaggccg

SEQ ID NO: 567267 - RNA, 20 nt, Homo sapiens
ugcccacaggugcgggacca

SEQ ID NO: 567268 - RNA, 22 nt, Homo sapiens
ugcccacauuaagcacugugga

SEQ ID NO: 567269 - RNA, 22 nt, Homo sapiens
ugcccacccccgggauccugcc

SEQ ID NO: 567270 - RNA, 23 nt, Homo sapiens
ugcccaccuccuuccagcacuga

SEQ ID NO: 567271 - RNA, 15 nt, Homo sapiens
ugcccacgcagagga

SEQ ID NO: 567272 - RNA, 19 nt, Homo sapiens
ugcccacggcaacugccuu

SEQ ID NO: 567273 - RNA, 18 nt, Homo sapiens
ugcccacggucugagcua

SEQ ID NO: 567274 - RNA, 18 nt, Homo sapiens
ugcccacucgggucugca

SEQ ID NO: 567275 - RNA, 20 nt, Homo sapiens
ugcccacucuccauccuccc

SEQ ID NO: 567276 - RNA, 13 nt, Homo sapiens
ugcccacuggaga

SEQ ID NO: 567277 - RNA, 23 nt, Homo sapiens
ugcccagaauaaguuauugcagu

SEQ ID NO: 567278 - RNA, 13 nt, Homo sapiens
ugcccagacaaga

SEQ ID NO: 567279 - RNA, 15 nt, Homo sapiens
ugcccagaucaacag

SEQ ID NO: 567280 - RNA, 17 nt, Homo sapiens
ugcccagcacagugccu

SEQ ID NO: 567281 - RNA, 12 nt, Homo sapiens
ugcccagccaau

SEQ ID NO: 567282 - RNA, 22 nt, Homo sapiens
ugcccagcuucaauaauuacca

SEQ ID NO: 567283 - RNA, 17 nt, Homo sapiens
ugcccaggacugcauug

SEQ ID NO: 567284 - RNA, 14 nt, Homo sapiens
ugcccaggagacag

SEQ ID NO: 567285 - RNA, 19 nt, Homo sapiens
ugcccaggcuagagugcaa

SEQ ID NO: 567286 - RNA, 20 nt, Homo sapiens
ugcccaggcuggaguacaau

SEQ ID NO: 567287 - RNA, 20 nt, Homo sapiens
ugcccaggcuggagugcaau

SEQ ID NO: 567288 - RNA, 21 nt, Homo sapiens
ugcccaggcuggagugcaaug

SEQ ID NO: 567289 - RNA, 16 nt, Homo sapiens
ugcccaucagccauuu

SEQ ID NO: 567290 - RNA, 15 nt, Homo sapiens
ugcccauugucuuau

SEQ ID NO: 567291 - RNA, 20 nt, Homo sapiens
ugccccaaacaaauaugcaa

SEQ ID NO: 567292 - RNA, 18 nt, Homo sapiens
ugccccacauguggccau

SEQ ID NO: 567293 - RNA, 12 nt, Homo sapiens
ugccccaccugc

SEQ ID NO: 567294 - RNA, 18 nt, Homo sapiens
ugccccagcagugccuug

SEQ ID NO: 567295 - RNA, 18 nt, Homo sapiens
ugccccaggacucuggca

SEQ ID NO: 567296 - RNA, 17 nt, Homo sapiens
ugcccccaauccaugaa

SEQ ID NO: 567297 - RNA, 21 nt, Homo sapiens
ugcccccaggcagccaccagu

SEQ ID NO: 567298 - RNA, 18 nt, Homo sapiens
ugcccccauccagccacg

SEQ ID NO: 567299 - RNA, 14 nt, Homo sapiens
ugcccccauuucac

SEQ ID NO: 567300 - RNA, 23 nt, Homo sapiens
ugccccccagucuccccacucca

SEQ ID NO: 567301 - RNA, 18 nt, Homo sapiens
ugcccccucccacccugc

SEQ ID NO: 567302 - RNA, 18 nt, Homo sapiens
ugcccccucccccacugc

SEQ ID NO: 567303 - RNA, 14 nt, Homo sapiens
ugccccgcacugug

SEQ ID NO: 567304 - RNA, 17 nt, Homo sapiens
ugccccggaccuaccuc

SEQ ID NO: 567305 - RNA, 19 nt, Homo sapiens
ugccccggaccuaccuccc

SEQ ID NO: 567306 - RNA, 16 nt, Homo sapiens
ugccccguuucuugcc

SEQ ID NO: 567307 - RNA, 17 nt, Homo sapiens
ugccccuacugcaaaug

SEQ ID NO: 567308 - RNA, 16 nt, Homo sapiens
ugccccuagcuuuaua

SEQ ID NO: 567309 - RNA, 19 nt, Homo sapiens
ugccccucgcacacagggc

SEQ ID NO: 567310 - RNA, 21 nt, Homo sapiens
ugccccucggccccagcacau

SEQ ID NO: 567311 - RNA, 12 nt, Homo sapiens
ugccccugccuu

SEQ ID NO: 567312 - RNA, 13 nt, Homo sapiens
ugccccuugaaag

SEQ ID NO: 567313 - RNA, 19 nt, Homo sapiens
ugccccuuuauaaauccaa

SEQ ID NO: 567314 - RNA, 14 nt, Homo sapiens
ugcccgaaaagcau

SEQ ID NO: 567315 - RNA, 22 nt, Homo sapiens
ugcccgccgccccuccacccau

SEQ ID NO: 567316 - RNA, 21 nt, Homo sapiens
ugcccgcugccugcacuggaa

SEQ ID NO: 567317 - RNA, 20 nt, Homo sapiens
ugcccggugguuugccaugu

SEQ ID NO: 567318 - RNA, 19 nt, Homo sapiens
ugcccuaggauacccagau

SEQ ID NO: 567319 - RNA, 16 nt, Homo sapiens
ugcccucaccaccaca

SEQ ID NO: 567320 - RNA, 19 nt, Homo sapiens
ugcccucauuacugggccu

SEQ ID NO: 567321 - RNA, 22 nt, Homo sapiens
ugcccucccauguugcaugccu

SEQ ID NO: 567322 - RNA, 15 nt, Homo sapiens
ugcccucuaccugac

SEQ ID NO: 567323 - RNA, 23 nt, Homo sapiens
ugcccucuccccaccccuuccaa

SEQ ID NO: 567324 - RNA, 13 nt, Homo sapiens
ugcccucucugaa

SEQ ID NO: 567325 - RNA, 23 nt, Homo sapiens
ugcccucugacuaguagauuucu

SEQ ID NO: 567326 - RNA, 15 nt, Homo sapiens
ugcccugaacccacu

SEQ ID NO: 567327 - RNA, 20 nt, Homo sapiens
ugcccugagaagcugcucca

SEQ ID NO: 567328 - RNA, 17 nt, Homo sapiens
ugcccugcccaugggag

SEQ ID NO: 567329 - RNA, 24 nt, Homo sapiens
ugcccuggagggaggcucuucagu

SEQ ID NO: 567330 - RNA, 18 nt, Homo sapiens
ugcccugggccaaaacca

SEQ ID NO: 567331 - RNA, 19 nt, Homo sapiens
ugcccugggccaaaaccaa

SEQ ID NO: 567332 - RNA, 17 nt, Homo sapiens
ugcccugugcaugccau

SEQ ID NO: 567333 - RNA, 16 nt, Homo sapiens
ugcccuguguacuucc

SEQ ID NO: 567334 - RNA, 17 nt, Homo sapiens
ugcccuuccccuuccca

SEQ ID NO: 567335 - RNA, 17 nt, Homo sapiens
ugcccuuguuccagcuu

SEQ ID NO: 567336 - RNA, 14 nt, Homo sapiens
ugcccuuuggccaa

SEQ ID NO: 567337 - RNA, 19 nt, Homo sapiens
ugccgaaaacaggagcaaa

SEQ ID NO: 567338 - RNA, 18 nt, Homo sapiens
ugccgaacauuaggaauu

SEQ ID NO: 567339 - RNA, 14 nt, Homo sapiens
ugccgaaugugcag

SEQ ID NO: 567340 - RNA, 22 nt, Homo sapiens
ugccgcaugcucccuccucucc

SEQ ID NO: 567341 - RNA, 12 nt, Homo sapiens
ugccgcauuugg

SEQ ID NO: 567342 - RNA, 22 nt, Homo sapiens
ugccggaggaaaagcagcucaa

SEQ ID NO: 567343 - RNA, 17 nt, Homo sapiens
ugccguauaggauguca

SEQ ID NO: 567344 - RNA, 16 nt, Homo sapiens
ugccgucuucacuucc

SEQ ID NO: 567345 - RNA, 22 nt, Homo sapiens
ugccguguccaagggccgugcc

SEQ ID NO: 567346 - RNA, 16 nt, Homo sapiens
ugccguuuaaaccacu

SEQ ID NO: 567347 - RNA, 13 nt, Homo sapiens
ugccuaaauauaa

SEQ ID NO: 567348 - RNA, 16 nt, Homo sapiens
ugccuaaauauaauua

SEQ ID NO: 567349 - RNA, 15 nt, Homo sapiens
ugccuaauggcaaaa

SEQ ID NO: 567350 - RNA, 12 nt, Homo sapiens
ugccuaccccag

SEQ ID NO: 567351 - RNA, 12 nt, Homo sapiens
ugccuaccucuu

SEQ ID NO: 567352 - RNA, 14 nt, Homo sapiens
ugccuacuccaaaa

SEQ ID NO: 567353 - RNA, 15 nt, Homo sapiens
ugccuagaaauaucu

SEQ ID NO: 567354 - RNA, 22 nt, Homo sapiens
ugccuaguaagggaacuaugga

SEQ ID NO: 567355 - RNA, 22 nt, Homo sapiens
ugccuaucuuuaaacauuucaa

SEQ ID NO: 567356 - RNA, 17 nt, Homo sapiens
ugccuaugaaauuucaa

SEQ ID NO: 567357 - RNA, 18 nt, Homo sapiens
ugccuauuuguguggaca

SEQ ID NO: 567358 - RNA, 15 nt, Homo sapiens
ugccucaaugccagu

SEQ ID NO: 567359 - RNA, 17 nt, Homo sapiens
ugccucaaugugaccag

SEQ ID NO: 567360 - RNA, 18 nt, Homo sapiens
ugccucagccucccgagu

SEQ ID NO: 567361 - RNA, 16 nt, Homo sapiens
ugccucagccuuccaa

SEQ ID NO: 567362 - RNA, 12 nt, Homo sapiens
ugccucaguaua

SEQ ID NO: 567363 - RNA, 18 nt, Homo sapiens
ugccucauuucuuccucu

SEQ ID NO: 567364 - RNA, 22 nt, Homo sapiens
ugccucauuucuuccucugcau

SEQ ID NO: 567365 - RNA, 18 nt, Homo sapiens
ugccucccaagguccucu

SEQ ID NO: 567366 - RNA, 22 nt, Homo sapiens
ugccucccaagguccucucagu

SEQ ID NO: 567367 - RNA, 16 nt, Homo sapiens
ugccucccacuucacu

SEQ ID NO: 567368 - RNA, 22 nt, Homo sapiens
ugccucccccgccuccagucau

SEQ ID NO: 567369 - RNA, 22 nt, Homo sapiens
ugccucccuggcagcacaggaa

SEQ ID NO: 567370 - RNA, 23 nt, Homo sapiens
ugccucccuggcagcacaggaaa

SEQ ID NO: 567371 - RNA, 15 nt, Homo sapiens
ugccuccucaucagu

SEQ ID NO: 567372 - RNA, 19 nt, Homo sapiens
ugccuccucuccuccucag

SEQ ID NO: 567373 - RNA, 16 nt, Homo sapiens
ugccuccugccugccc

SEQ ID NO: 567374 - RNA, 14 nt, Homo sapiens
ugccucuccccaaa

SEQ ID NO: 567375 - RNA, 21 nt, Homo sapiens
ugccucugacagcagccugug

SEQ ID NO: 567376 - RNA, 21 nt, Homo sapiens
ugccucugaguuuugaugcug

SEQ ID NO: 567377 - RNA, 16 nt, Homo sapiens
ugccugaacuccagag

SEQ ID NO: 567378 - RNA, 14 nt, Homo sapiens
ugccugagggucac

SEQ ID NO: 567379 - RNA, 19 nt, Homo sapiens
ugccugauccuccaacagc

SEQ ID NO: 567380 - RNA, 20 nt, Homo sapiens
ugccugauccuccaacagcu

SEQ ID NO: 567381 - RNA, 19 nt, Homo sapiens
ugucuagguuaaagcuaaa

SEQ ID NO: 567382 - RNA, 14 nt, Homo sapiens
ugucuaguuucuag

SEQ ID NO: 567383 - RNA, 21 nt, Homo sapiens
ugucucaaaggagcuuucuca

SEQ ID NO: 567384 - RNA, 13 nt, Homo sapiens
ugucucacagccc

SEQ ID NO: 567385 - RNA, 22 nt, Homo sapiens
ugucucacuuuuuacccagaac

SEQ ID NO: 567386 - RNA, 21 nt, Homo sapiens
ugucuccacccguguccagca

SEQ ID NO: 567387 - RNA, 13 nt, Homo sapiens
ugucuccacugug

SEQ ID NO: 567388 - RNA, 14 nt, Homo sapiens
ugucuccacugugc

SEQ ID NO: 567389 - RNA, 14 nt, Homo sapiens
ugucucccaaaaau

SEQ ID NO: 567390 - RNA, 21 nt, Homo sapiens
ugucuccuccccuucccccac

SEQ ID NO: 567391 - RNA, 19 nt, Homo sapiens
ugucuccuuucugacuguc

SEQ ID NO: 567392 - RNA, 19 nt, Homo sapiens
ugucucgcgcgacugagaa

SEQ ID NO: 567393 - RNA, 16 nt, Homo sapiens
ugucucuacuaaaaau

SEQ ID NO: 567394 - RNA, 20 nt, Homo sapiens
ugucucuacuaaaaaugcaa

SEQ ID NO: 567395 - RNA, 18 nt, Homo sapiens
ugucucucacugcauuug

SEQ ID NO: 567396 - RNA, 21 nt, Homo sapiens
ugucucuuagaaauacuugug

SEQ ID NO: 567397 - RNA, 17 nt, Homo sapiens
ugucucuuuccacuuug

SEQ ID NO: 567398 - RNA, 16 nt, Homo sapiens
ugucugaacauagaaa

SEQ ID NO: 567399 - RNA, 22 nt, Homo sapiens
ugucugagaugcagccagcauu

SEQ ID NO: 567400 - RNA, 23 nt, Homo sapiens
ugucugaggaguaaguguacaau

SEQ ID NO: 567401 - RNA, 14 nt, Homo sapiens
ugucugcacccagg

SEQ ID NO: 567402 - RNA, 22 nt, Homo sapiens
ugucugcccugaacccacugcu

SEQ ID NO: 567403 - RNA, 16 nt, Homo sapiens
ugucuggcguucucaa

SEQ ID NO: 567404 - RNA, 17 nt, Homo sapiens
ugucuggugcacauaau

SEQ ID NO: 567405 - RNA, 17 nt, Homo sapiens
ugucugucaccagcuau

SEQ ID NO: 567406 - RNA, 17 nt, Homo sapiens
ugucugucuagugucug

SEQ ID NO: 567407 - RNA, 21 nt, Homo sapiens
ugucugugaguaccuggucau

SEQ ID NO: 567408 - RNA, 19 nt, Homo sapiens
ugucuguggcaaaaguuua

SEQ ID NO: 567409 - RNA, 13 nt, Homo sapiens
ugucugugugcaa

SEQ ID NO: 567410 - RNA, 15 nt, Homo sapiens
ugucugugugcaagu

SEQ ID NO: 567411 - RNA, 23 nt, Homo sapiens
ugucuguguuccaaccacugaau

SEQ ID NO: 567412 - RNA, 15 nt, Homo sapiens
ugucuguugcuugua

SEQ ID NO: 567413 - RNA, 22 nt, Homo sapiens
ugucuguuuuuguaacuuaaaa

SEQ ID NO: 567414 - RNA, 14 nt, Homo sapiens
ugucuuaaaaccag

SEQ ID NO: 567415 - RNA, 19 nt, Homo sapiens
ugucuuaauuuucuuucac

SEQ ID NO: 567416 - RNA, 22 nt, Homo sapiens
ugucuuacagagaaaagacaua

SEQ ID NO: 567417 - RNA, 18 nt, Homo sapiens
ugucuuaguugaugagug

SEQ ID NO: 567418 - RNA, 20 nt, Homo sapiens
ugucuuauggucuugauccu

SEQ ID NO: 567419 - RNA, 15 nt, Homo sapiens
ugucuuccaagguag

SEQ ID NO: 567420 - RNA, 12 nt, Homo sapiens
ugucuuccauaa

SEQ ID NO: 567421 - RNA, 21 nt, Homo sapiens
ugucuuggcauuaaaccacau

SEQ ID NO: 567422 - RNA, 14 nt, Homo sapiens
ugucuuggggccac

SEQ ID NO: 567423 - RNA, 22 nt, Homo sapiens
ugucuugucauacaaauuuaua

SEQ ID NO: 567424 - RNA, 18 nt, Homo sapiens
ugucuuguguuuccacag

SEQ ID NO: 567425 - RNA, 15 nt, Homo sapiens
ugucuuucacuggaa

SEQ ID NO: 567426 - RNA, 21 nt, Homo sapiens
ugucuuucugagcacacuuua

SEQ ID NO: 567427 - RNA, 11 nt, Homo sapiens
ugucuuugaau

SEQ ID NO: 567428 - RNA, 23 nt, Homo sapiens
ugucuuugucaccacguggggcu

SEQ ID NO: 567429 - RNA, 15 nt, Homo sapiens
ugucuuuuguucucu

SEQ ID NO: 567430 - RNA, 17 nt, Homo sapiens
ugugaaacuggcacuga

SEQ ID NO: 567431 - RNA, 23 nt, Homo sapiens
ugugaaagaaccaaaagagauca

SEQ ID NO: 567432 - RNA, 21 nt, Homo sapiens
ugugaaaggaagcuccacugu

SEQ ID NO: 567433 - RNA, 23 nt, Homo sapiens
ugugaaaggaagcuccacuguca

SEQ ID NO: 567434 - RNA, 15 nt, Homo sapiens
ugugaaaggaagugu

SEQ ID NO: 567435 - RNA, 21 nt, Homo sapiens
ugugaaaggguacuacagcuu

SEQ ID NO: 567436 - RNA, 12 nt, Homo sapiens
ugugaaagucag

SEQ ID NO: 567437 - RNA, 20 nt, Homo sapiens
ugugaaauucacaguaauau

SEQ ID NO: 567438 - RNA, 12 nt, Homo sapiens
ugugaacaaguc

SEQ ID NO: 567439 - RNA, 17 nt, Homo sapiens
ugugaacaagucccugu

SEQ ID NO: 567440 - RNA, 18 nt, Homo sapiens
ugugaacugggcauuuca

SEQ ID NO: 567441 - RNA, 14 nt, Homo sapiens
ugugaagaaagggu

SEQ ID NO: 567442 - RNA, 17 nt, Homo sapiens
ugugaagaaaggguguu

SEQ ID NO: 567443 - RNA, 12 nt, Homo sapiens
ugugaagccaaa

SEQ ID NO: 567444 - RNA, 13 nt, Homo sapiens
ugugaagugcaga

SEQ ID NO: 567445 - RNA, 16 nt, Homo sapiens
ugugaagugcagauga

SEQ ID NO: 567446 - RNA, 23 nt, Homo sapiens
ugugaauagccuggccaccagcc

SEQ ID NO: 567447 - RNA, 16 nt, Homo sapiens
ugugaauuaacacagu

SEQ ID NO: 567448 - RNA, 17 nt, Homo sapiens
ugugaauuaggcuguaa

SEQ ID NO: 567449 - RNA, 19 nt, Homo sapiens
ugugaauuaggcuguaacu

SEQ ID NO: 567450 - RNA, 13 nt, Homo sapiens
ugugaauucaaua

SEQ ID NO: 567451 - RNA, 12 nt, Homo sapiens
ugugacauacau

SEQ ID NO: 567452 - RNA, 13 nt, Homo sapiens
ugugacauacaua

SEQ ID NO: 567453 - RNA, 19 nt, Homo sapiens
ugugacauugauuugcucu

SEQ ID NO: 567454 - RNA, 18 nt, Homo sapiens
ugugaccaaaaguuacau

SEQ ID NO: 567455 - RNA, 21 nt, Homo sapiens
ugugaccaaugucuugaugca

SEQ ID NO: 567456 - RNA, 23 nt, Homo sapiens
ugugaccacugaagcaccacagg

SEQ ID NO: 567457 - RNA, 22 nt, Homo sapiens
ugugaccccuccccagugccuc

SEQ ID NO: 567458 - RNA, 12 nt, Homo sapiens
ugugacuacuga

SEQ ID NO: 567459 - RNA, 20 nt, Homo sapiens
ugugacucgggagcugcaca

SEQ ID NO: 567460 - RNA, 16 nt, Homo sapiens
ugugacuuauucccug

SEQ ID NO: 567461 - RNA, 15 nt, Homo sapiens
ugugacuucacugua

SEQ ID NO: 567462 - RNA, 22 nt, Homo sapiens
ugugacuugaacuagauugcau

SEQ ID NO: 567463 - RNA, 18 nt, Homo sapiens
ugugacuuucaaggacau

SEQ ID NO: 567464 - RNA, 15 nt, Homo sapiens
ugugagagauucugu

SEQ ID NO: 567465 - RNA, 15 nt, Homo sapiens
ugugagauccuucac

SEQ ID NO: 567466 - RNA, 22 nt, Homo sapiens
ugugagauguaacccaccuuga

SEQ ID NO: 567467 - RNA, 12 nt, Homo sapiens
ugugagcaagaa

SEQ ID NO: 567468 - RNA, 18 nt, Homo sapiens
ugugagccucuuuguaau

SEQ ID NO: 567469 - RNA, 17 nt, Homo sapiens
ugugagggacaugcuca

SEQ ID NO: 567470 - RNA, 23 nt, Homo sapiens
ugugaguggcauuugucagggau

SEQ ID NO: 567471 - RNA, 20 nt, Homo sapiens
ugugauauauaaguguacau

SEQ ID NO: 567472 - RNA, 16 nt, Homo sapiens
ugugauauccuaggag

SEQ ID NO: 567473 - RNA, 20 nt, Homo sapiens
ugugauguaccaguuugucc

SEQ ID NO: 567474 - RNA, 15 nt, Homo sapiens
ugugauuacaaggcu

SEQ ID NO: 567475 - RNA, 17 nt, Homo sapiens
ugugauuagacagaaca

SEQ ID NO: 567476 - RNA, 15 nt, Homo sapiens
ugugauucacugccu

SEQ ID NO: 567477 - RNA, 14 nt, Homo sapiens
ugugauucugccuu

SEQ ID NO: 567478 - RNA, 23 nt, Homo sapiens
ugugauugaaggugauaagggaa

SEQ ID NO: 567479 - RNA, 17 nt, Homo sapiens
ugugauugucuuugaau

SEQ ID NO: 567480 - RNA, 12 nt, Homo sapiens
ugugauuuagaa

SEQ ID NO: 567481 - RNA, 17 nt, Homo sapiens
ugugauuuccuaaacau

SEQ ID NO: 567482 - RNA, 23 nt, Homo sapiens
ugugauuuccuaauaugaucuaa

SEQ ID NO: 567483 - RNA, 21 nt, Homo sapiens
ugugauuugguugcacuuuag

SEQ ID NO: 567484 - RNA, 20 nt, Homo sapiens
ugugcaacuggccagccaau

SEQ ID NO: 567485 - RNA, 20 nt, Homo sapiens
ugugcaaguguguaugugcg

SEQ ID NO: 567486 - RNA, 9 nt, Homo sapiens
ugugcaaua

SEQ ID NO: 567487 - RNA, 15 nt, Homo sapiens
ugugcacacauauac

SEQ ID NO: 567488 - RNA, 16 nt, Homo sapiens
ugugcaccaauuauca

SEQ ID NO: 567489 - RNA, 16 nt, Homo sapiens
ugugcacgagugggaa

SEQ ID NO: 567490 - RNA, 23 nt, Homo sapiens
ugugcacuuucuucucuuuccca

SEQ ID NO: 567491 - RNA, 15 nt, Homo sapiens
ugugcauauguuaaa

SEQ ID NO: 567492 - RNA, 16 nt, Homo sapiens
ugugcaucaaccagga

SEQ ID NO: 567493 - RNA, 15 nt, Homo sapiens
ugugcaucaguggga

SEQ ID NO: 567494 - RNA, 20 nt, Homo sapiens
ugugcaugaaaaggauuccu

SEQ ID NO: 567495 - RNA, 22 nt, Homo sapiens
ugugcauggaggcccuccugug

SEQ ID NO: 567496 - RNA, 21 nt, Homo sapiens
ugugcauguauguauacaguu

SEQ ID NO: 567497 - RNA, 18 nt, Homo sapiens
ugugcaugugugugcuca

SEQ ID NO: 567498 - RNA, 23 nt, Homo sapiens
ugugcauuaucuagauacuguau

SEQ ID NO: 567499 - RNA, 14 nt, Homo sapiens
ugugccacacagug

SEQ ID NO: 567500 - RNA, 17 nt, Homo sapiens
ugugccaccaacauaaa

SEQ ID NO: 567501 - RNA, 13 nt, Homo sapiens
ugugccaccaagc

SEQ ID NO: 567502 - RNA, 9 nt, Homo sapiens
uuaacuuug

SEQ ID NO: 567503 - RNA, 17 nt, Homo sapiens
uuaacuuugaaccauaa

SEQ ID NO: 567504 - RNA, 13 nt, Homo sapiens
uuaacuuuuggaa

SEQ ID NO: 567505 - RNA, 19 nt, Homo sapiens
uuaacuuuuuuucuucuac

SEQ ID NO: 567506 - RNA, 14 nt, Homo sapiens
uuaagaaacacagg

SEQ ID NO: 567507 - RNA, 15 nt, Homo sapiens
uuaagaaacacaggg

SEQ ID NO: 567508 - RNA, 13 nt, Homo sapiens
uuaagaagacaua

SEQ ID NO: 567509 - RNA, 15 nt, Homo sapiens
uuaagaagacauacu

SEQ ID NO: 567510 - RNA, 21 nt, Homo sapiens
uuaagaagucuauaaugcaau

SEQ ID NO: 567511 - RNA, 22 nt, Homo sapiens
uuaagaauugaguaauggugua

SEQ ID NO: 567512 - RNA, 14 nt, Homo sapiens
uuaagaauuucaca

SEQ ID NO: 567513 - RNA, 18 nt, Homo sapiens
uuaagaauuuuuuccuaa

SEQ ID NO: 567514 - RNA, 13 nt, Homo sapiens
uuaagacagugua

SEQ ID NO: 567515 - RNA, 22 nt, Homo sapiens
uuaagagaauauuuuaaguauu

SEQ ID NO: 567516 - RNA, 14 nt, Homo sapiens
uuaagagacacucc

SEQ ID NO: 567517 - RNA, 16 nt, Homo sapiens
uuaagagaccaggucu

SEQ ID NO: 567518 - RNA, 20 nt, Homo sapiens
uuaagagcuugaucugugau

SEQ ID NO: 567519 - RNA, 15 nt, Homo sapiens
uuaagaguuacuuaa

SEQ ID NO: 567520 - RNA, 13 nt, Homo sapiens
uuaagcacacaca

SEQ ID NO: 567521 - RNA, 12 nt, Homo sapiens
uuaagcauuguu

SEQ ID NO: 567522 - RNA, 18 nt, Homo sapiens
uuaagcauuuugaaacaa

SEQ ID NO: 567523 - RNA, 15 nt, Homo sapiens
uuaagccagcacuca

SEQ ID NO: 567524 - RNA, 18 nt, Homo sapiens
uuaagccuaaaugccuua

SEQ ID NO: 567525 - RNA, 18 nt, Homo sapiens
uuaagcuccagacauaca

SEQ ID NO: 567526 - RNA, 14 nt, Homo sapiens
uuaagcugauccug

SEQ ID NO: 567527 - RNA, 21 nt, Homo sapiens
uuaagcuuccgccgucucaac

SEQ ID NO: 567528 - RNA, 20 nt, Homo sapiens
uuaagcuuuuuuuuuuugaa

SEQ ID NO: 567529 - RNA, 17 nt, Homo sapiens
uuaaggaacaucucugc

SEQ ID NO: 567530 - RNA, 19 nt, Homo sapiens
uuaaggaugcuuguacaua

SEQ ID NO: 567531 - RNA, 18 nt, Homo sapiens
uuaagguaacuacugcua

SEQ ID NO: 567532 - RNA, 21 nt, Homo sapiens
uuaagguuuuacuuuucugaa

SEQ ID NO: 567533 - RNA, 22 nt, Homo sapiens
uuaaguaacauaacuaguggcu

SEQ ID NO: 567534 - RNA, 22 nt, Homo sapiens
uuaaguaaucuuuuuacaguug

SEQ ID NO: 567535 - RNA, 13 nt, Homo sapiens
uuaaguacccgag

SEQ ID NO: 567536 - RNA, 22 nt, Homo sapiens
uuaaguagaaaaguugcagaug

SEQ ID NO: 567537 - RNA, 14 nt, Homo sapiens
uuaagucaaagaag

SEQ ID NO: 567538 - RNA, 18 nt, Homo sapiens
uuaaguccuacuuuacau

SEQ ID NO: 567539 - RNA, 20 nt, Homo sapiens
uuaagugacuauagaaugca

SEQ ID NO: 567540 - RNA, 12 nt, Homo sapiens
uuaagugauuau

SEQ ID NO: 567541 - RNA, 12 nt, Homo sapiens
uuaagugccuuu

SEQ ID NO: 567542 - RNA, 13 nt, Homo sapiens
uuaagugcugcag

SEQ ID NO: 567543 - RNA, 17 nt, Homo sapiens
uuaagugcuucacauuu

SEQ ID NO: 567544 - RNA, 13 nt, Homo sapiens
uuaaguggcagaa

SEQ ID NO: 567545 - RNA, 23 nt, Homo sapiens
uuaaguguaacuggcaguuuucc

SEQ ID NO: 567546 - RNA, 13 nt, Homo sapiens
uuaagugugcuua

SEQ ID NO: 567547 - RNA, 20 nt, Homo sapiens
uuaaguuauugauguuuuaa

SEQ ID NO: 567548 - RNA, 15 nt, Homo sapiens
uuaaguucacaaccu

SEQ ID NO: 567549 - RNA, 21 nt, Homo sapiens
uuaauaaaagaacaugcuuga

SEQ ID NO: 567550 - RNA, 12 nt, Homo sapiens
uuaauaaacaug

SEQ ID NO: 567551 - RNA, 17 nt, Homo sapiens
uuaauaaagaauuaaca

SEQ ID NO: 567552 - RNA, 13 nt, Homo sapiens
uuaauaaauaugu

SEQ ID NO: 567553 - RNA, 11 nt, Homo sapiens
uuaauaacaua

SEQ ID NO: 567554 - RNA, 15 nt, Homo sapiens
uuaauaaccugccag

SEQ ID NO: 567555 - RNA, 20 nt, Homo sapiens
uuaauaaccugccaguccca

SEQ ID NO: 567556 - RNA, 21 nt, Homo sapiens
uuaauaacuuguccuauguca

SEQ ID NO: 567557 - RNA, 12 nt, Homo sapiens
uuaauaagugaa

SEQ ID NO: 567558 - RNA, 13 nt, Homo sapiens
uuaauacagaauc

SEQ ID NO: 567559 - RNA, 21 nt, Homo sapiens
uuaauacagugagcucuagca

SEQ ID NO: 567560 - RNA, 13 nt, Homo sapiens
uuaauaccaaagu

SEQ ID NO: 567561 - RNA, 13 nt, Homo sapiens
uuaauacuugauu

SEQ ID NO: 567562 - RNA, 20 nt, Homo sapiens
uuaauagcaacagagcacuu

SEQ ID NO: 567563 - RNA, 13 nt, Homo sapiens
uuaauagcacuaa

SEQ ID NO: 567564 - RNA, 18 nt, Homo sapiens
uuaauaggaaaaacggaa

SEQ ID NO: 567565 - RNA, 18 nt, Homo sapiens
uuaauagggaauauaucu

SEQ ID NO: 567566 - RNA, 14 nt, Homo sapiens
uuaauaucugaggu

SEQ ID NO: 567567 - RNA, 17 nt, Homo sapiens
uuaauaugauucuagua

SEQ ID NO: 567568 - RNA, 23 nt, Homo sapiens
uuaauauguuaaccucaguguca

SEQ ID NO: 567569 - RNA, 13 nt, Homo sapiens
uuaauauuccaau

SEQ ID NO: 567570 - RNA, 20 nt, Homo sapiens
uuaauauuuuccuaguagau

SEQ ID NO: 567571 - RNA, 20 nt, Homo sapiens
uuaaucacaccguccuccac

SEQ ID NO: 567572 - RNA, 13 nt, Homo sapiens
uuaaucacuacug

SEQ ID NO: 567573 - RNA, 19 nt, Homo sapiens
uuaaucacuauuguuccag

SEQ ID NO: 567574 - RNA, 13 nt, Homo sapiens
uuaaucagcauua

SEQ ID NO: 567575 - RNA, 23 nt, Homo sapiens
uuaaucauuuccccauaacucaa

SEQ ID NO: 567576 - RNA, 12 nt, Homo sapiens
uuaauccagcuu

SEQ ID NO: 567577 - RNA, 22 nt, Homo sapiens
uuaauccccaucauuacuggua

SEQ ID NO: 567578 - RNA, 21 nt, Homo sapiens
uuaaucucugcugaaacucag

SEQ ID NO: 567579 - RNA, 19 nt, Homo sapiens
uuaaucucuuaauauugag

SEQ ID NO: 567580 - RNA, 14 nt, Homo sapiens
uuaaucugcaccuu

SEQ ID NO: 567581 - RNA, 20 nt, Homo sapiens
uuaaucuuucuuuaccugag

SEQ ID NO: 567582 - RNA, 20 nt, Homo sapiens
uuaaugaacaaauggccuuu

SEQ ID NO: 567583 - RNA, 18 nt, Homo sapiens
uuaaugaacuaacugaca

SEQ ID NO: 567584 - RNA, 18 nt, Homo sapiens
uuaaugaagaaaguggaa

SEQ ID NO: 567585 - RNA, 18 nt, Homo sapiens
uuaaugaauaucaggcua

SEQ ID NO: 567586 - RNA, 17 nt, Homo sapiens
uuaaugagccaucacua

SEQ ID NO: 567587 - RNA, 17 nt, Homo sapiens
uuaaugagucagucaau

SEQ ID NO: 567588 - RNA, 22 nt, Homo sapiens
uuaaugauaaacucagaucuga

SEQ ID NO: 567589 - RNA, 14 nt, Homo sapiens
uuaaugauacaugu

SEQ ID NO: 567590 - RNA, 14 nt, Homo sapiens
uuaaugaugguguu

SEQ ID NO: 567591 - RNA, 22 nt, Homo sapiens
uuaaugcagagcuagaggacuu

SEQ ID NO: 567592 - RNA, 19 nt, Homo sapiens
uuaaugccacaaaacugac

SEQ ID NO: 567593 - RNA, 20 nt, Homo sapiens
uuaaugccugcuuuuuggaa

SEQ ID NO: 567594 - RNA, 19 nt, Homo sapiens
uuaaugcugucuuugugga

SEQ ID NO: 567595 - RNA, 12 nt, Homo sapiens
uuaaugcuugua

SEQ ID NO: 567596 - RNA, 16 nt, Homo sapiens
uuaauggggaggacaa

SEQ ID NO: 567597 - RNA, 11 nt, Homo sapiens
uuaauguaauc

SEQ ID NO: 567598 - RNA, 14 nt, Homo sapiens
uuaauguauucccu

SEQ ID NO: 567599 - RNA, 14 nt, Homo sapiens
uuaaugucagugac

SEQ ID NO: 567600 - RNA, 18 nt, Homo sapiens
uuaaugugacaguguuca

SEQ ID NO: 567601 - RNA, 12 nt, Homo sapiens
uuaauguucaca

SEQ ID NO: 567602 - RNA, 19 nt, Homo sapiens
uuaauguuuagauuuuuca

SEQ ID NO: 567603 - RNA, 21 nt, Homo sapiens
uuaauguuuauuaauguuuac

SEQ ID NO: 567604 - RNA, 15 nt, Homo sapiens
uuaauguuuuuaccc

SEQ ID NO: 567605 - RNA, 18 nt, Homo sapiens
uuaauuaauggaaucuuc

SEQ ID NO: 567606 - RNA, 17 nt, Homo sapiens
uuaauuacaacugcuau

SEQ ID NO: 567607 - RNA, 14 nt, Homo sapiens
uuaauuacauacag

SEQ ID NO: 567608 - RNA, 18 nt, Homo sapiens
uuaauuagggguugcuaa

SEQ ID NO: 567609 - RNA, 20 nt, Homo sapiens
uuaauucucauuuguucuca

SEQ ID NO: 567610 - RNA, 15 nt, Homo sapiens
uuaauucucugcaac

SEQ ID NO: 567611 - RNA, 19 nt, Homo sapiens
uuaauucucuuucaaagcu

SEQ ID NO: 567612 - RNA, 15 nt, Homo sapiens
uuaauucuucaccug

SEQ ID NO: 567613 - RNA, 14 nt, Homo sapiens
uuaauugcauuuaa

SEQ ID NO: 567614 - RNA, 23 nt, Homo sapiens
uuaauuguauaagucaagcacau

SEQ ID NO: 567615 - RNA, 21 nt, Homo sapiens
uuaauuguuuaaaaaccgaau

SEQ ID NO: 567616 - RNA, 11 nt, Homo sapiens
uuaauuuccag

SEQ ID NO: 567617 - RNA, 18 nt, Homo sapiens
uuaauuugugaauuugca

SEQ ID NO: 567618 - RNA, 17 nt, Homo sapiens
uuaauuuuaacugccaa

SEQ ID NO: 567619 - RNA, 19 nt, Homo sapiens
uuaauuuuaguuucaugag

SEQ ID NO: 567620 - RNA, 17 nt, Homo sapiens
uuaauuuuauugcaaag

SEQ ID NO: 567621 - RNA, 15 nt, Homo sapiens
uuaauuuugauucag

SEQ ID NO: 567622 - RNA, 20 nt, Homo sapiens
uuaauuuuuuuuacuauaaa

SEQ ID NO: 567623 - RNA, 17 nt, Homo sapiens
uuacaaaaaaauacaaa

SEQ ID NO: 567624 - RNA, 18 nt, Homo sapiens
uuacaaaaaaauacaaaa

SEQ ID NO: 567625 - RNA, 20 nt, Homo sapiens
uucagccuagccgaccucag

SEQ ID NO: 567626 - RNA, 21 nt, Homo sapiens
uucagccuagccgaccucagc

SEQ ID NO: 567627 - RNA, 15 nt, Homo sapiens
uucagccugaggcug

SEQ ID NO: 567628 - RNA, 17 nt, Homo sapiens
uucagccuuaauggaag

SEQ ID NO: 567629 - RNA, 19 nt, Homo sapiens
uucagccuuugucaauaaa

SEQ ID NO: 567630 - RNA, 15 nt, Homo sapiens
uucagcgaagucuca

SEQ ID NO: 567631 - RNA, 19 nt, Homo sapiens
uucagcuccuuccaccaca

SEQ ID NO: 567632 - RNA, 13 nt, Homo sapiens
uucagcucuacag

SEQ ID NO: 567633 - RNA, 22 nt, Homo sapiens
uucagcuguacauacucaguaa

SEQ ID NO: 567634 - RNA, 22 nt, Homo sapiens
uucagcuguacuucgucuucua

SEQ ID NO: 567635 - RNA, 21 nt, Homo sapiens
uucaggaacguugccacacca

SEQ ID NO: 567636 - RNA, 13 nt, Homo sapiens
uucaggacucugc

SEQ ID NO: 567637 - RNA, 17 nt, Homo sapiens
uucaggaggucaucuga

SEQ ID NO: 567638 - RNA, 18 nt, Homo sapiens
uucaggcaacgcacaaaa

SEQ ID NO: 567639 - RNA, 17 nt, Homo sapiens
uucaggcagcacaucaa

SEQ ID NO: 567640 - RNA, 18 nt, Homo sapiens
uucaggcagccaguguga

SEQ ID NO: 567641 - RNA, 20 nt, Homo sapiens
uucagggaagaagcauacaa

SEQ ID NO: 567642 - RNA, 15 nt, Homo sapiens
uucagggagcucgca

SEQ ID NO: 567643 - RNA, 14 nt, Homo sapiens
uucagggauucccu

SEQ ID NO: 567644 - RNA, 18 nt, Homo sapiens
uucagggcagggcucuga

SEQ ID NO: 567645 - RNA, 13 nt, Homo sapiens
uucagggccaguc

SEQ ID NO: 567646 - RNA, 13 nt, Homo sapiens
uucaggguuuuau

SEQ ID NO: 567647 - RNA, 20 nt, Homo sapiens
uucaggugcuuuugauguga

SEQ ID NO: 567648 - RNA, 14 nt, Homo sapiens
uucagguguuacag

SEQ ID NO: 567649 - RNA, 14 nt, Homo sapiens
uucaguagaauuac

SEQ ID NO: 567650 - RNA, 15 nt, Homo sapiens
uucaguauacugugu

SEQ ID NO: 567651 - RNA, 13 nt, Homo sapiens
uucaguaugcaaa

SEQ ID NO: 567652 - RNA, 21 nt, Homo sapiens
uucaguauguugucaaagaga

SEQ ID NO: 567653 - RNA, 14 nt, Homo sapiens
uucaguccuaagaa

SEQ ID NO: 567654 - RNA, 14 nt, Homo sapiens
uucagucugugaaa

SEQ ID NO: 567655 - RNA, 15 nt, Homo sapiens
uucagugauacucac

SEQ ID NO: 567656 - RNA, 19 nt, Homo sapiens
uucagugcaccugccucag

SEQ ID NO: 567657 - RNA, 17 nt, Homo sapiens
uucaguggacccugugg

SEQ ID NO: 567658 - RNA, 22 nt, Homo sapiens
uucaguguacauggaauaacau

SEQ ID NO: 567659 - RNA, 13 nt, Homo sapiens
uucagugugcaua

SEQ ID NO: 567660 - RNA, 21 nt, Homo sapiens
uucaguucagauaauuggcaa

SEQ ID NO: 567661 - RNA, 19 nt, Homo sapiens
uucaguugaucacuggcaa

SEQ ID NO: 567662 - RNA, 16 nt, Homo sapiens
uucaguuguuuugcau

SEQ ID NO: 567663 - RNA, 15 nt, Homo sapiens
uucaguuuauuucca

SEQ ID NO: 567664 - RNA, 17 nt, Homo sapiens
uucaguuuauuuccacu

SEQ ID NO: 567665 - RNA, 14 nt, Homo sapiens
uucaguuuugcuua

SEQ ID NO: 567666 - RNA, 20 nt, Homo sapiens
uucauaaaaaauaauggugu

SEQ ID NO: 567667 - RNA, 17 nt, Homo sapiens
uucauaaggccugcccu

SEQ ID NO: 567668 - RNA, 21 nt, Homo sapiens
uucauaagguaauucauggca

SEQ ID NO: 567669 - RNA, 19 nt, Homo sapiens
uucauaguaagaauucugg

SEQ ID NO: 567670 - RNA, 13 nt, Homo sapiens
uucauagugcuca

SEQ ID NO: 567671 - RNA, 20 nt, Homo sapiens
uucauauguaccauguacau

SEQ ID NO: 567672 - RNA, 22 nt, Homo sapiens
uucaucagcugugugcauuuca

SEQ ID NO: 567673 - RNA, 19 nt, Homo sapiens
uucaucuacccugcugacc

SEQ ID NO: 567674 - RNA, 11 nt, Homo sapiens
uucaucucaug

SEQ ID NO: 567675 - RNA, 18 nt, Homo sapiens
uucaucucucuaccucca

SEQ ID NO: 567676 - RNA, 19 nt, Homo sapiens
uucaucugaaacccacaga

SEQ ID NO: 567677 - RNA, 13 nt, Homo sapiens
uucaucugggaca

SEQ ID NO: 567678 - RNA, 15 nt, Homo sapiens
uucaugaaacugucc

SEQ ID NO: 567679 - RNA, 23 nt, Homo sapiens
uucaugaaacuguccaccaagau

SEQ ID NO: 567680 - RNA, 20 nt, Homo sapiens
uucaugaaugugcuggugaa

SEQ ID NO: 567681 - RNA, 22 nt, Homo sapiens
uucaugacgaagacgccaaaaa

SEQ ID NO: 567682 - RNA, 17 nt, Homo sapiens
uucaugagcuugaacaa

SEQ ID NO: 567683 - RNA, 16 nt, Homo sapiens
uucaugcauuugcacu

SEQ ID NO: 567684 - RNA, 14 nt, Homo sapiens
uucaugcuugacau

SEQ ID NO: 567685 - RNA, 19 nt, Homo sapiens
uucaugggacuaaaugaac

SEQ ID NO: 567686 - RNA, 22 nt, Homo sapiens
uucauggugauugucauguaag

SEQ ID NO: 567687 - RNA, 12 nt, Homo sapiens
uucauguaaaac

SEQ ID NO: 567688 - RNA, 19 nt, Homo sapiens
uucauguaauagcaaugca

SEQ ID NO: 567689 - RNA, 22 nt, Homo sapiens
uucaugugaaucccuuuaggau

SEQ ID NO: 567690 - RNA, 18 nt, Homo sapiens
uucaugugcugccugcaa

SEQ ID NO: 567691 - RNA, 21 nt, Homo sapiens
uucauguggcucagugccuuc

SEQ ID NO: 567692 - RNA, 23 nt, Homo sapiens
uucauguggcucagugccuuccu

SEQ ID NO: 567693 - RNA, 20 nt, Homo sapiens
uucaugugguucagugccuu

SEQ ID NO: 567694 - RNA, 16 nt, Homo sapiens
uucauguucacuguga

SEQ ID NO: 567695 - RNA, 14 nt, Homo sapiens
uucauuaaugauga

SEQ ID NO: 567696 - RNA, 17 nt, Homo sapiens
uucauuagcugcucuga

SEQ ID NO: 567697 - RNA, 13 nt, Homo sapiens
uucauuaucacau

SEQ ID NO: 567698 - RNA, 21 nt, Homo sapiens
uucauucaggcaacgcacaaa

SEQ ID NO: 567699 - RNA, 16 nt, Homo sapiens
uucauucugcaaguau

SEQ ID NO: 567700 - RNA, 14 nt, Homo sapiens
uucauucuuugcag

SEQ ID NO: 567701 - RNA, 16 nt, Homo sapiens
uucauugagaaacugg

SEQ ID NO: 567702 - RNA, 13 nt, Homo sapiens
uucauugaugacc

SEQ ID NO: 567703 - RNA, 16 nt, Homo sapiens
uucauuuaguaauuaa

SEQ ID NO: 567704 - RNA, 14 nt, Homo sapiens
uucauuuauaucgc

SEQ ID NO: 567705 - RNA, 13 nt, Homo sapiens
uucauuucaggaa

SEQ ID NO: 567706 - RNA, 13 nt, Homo sapiens
uucauuuguauug

SEQ ID NO: 567707 - RNA, 15 nt, Homo sapiens
uuccaaacacauaca

SEQ ID NO: 567708 - RNA, 13 nt, Homo sapiens
uuccaaagccaga

SEQ ID NO: 567709 - RNA, 14 nt, Homo sapiens
uuccaaauauguau

SEQ ID NO: 567710 - RNA, 15 nt, Homo sapiens
uuccaacaccacaga

SEQ ID NO: 567711 - RNA, 15 nt, Homo sapiens
uuccaauaaagcagc

SEQ ID NO: 567712 - RNA, 14 nt, Homo sapiens
uuccaaucaugaaa

SEQ ID NO: 567713 - RNA, 20 nt, Homo sapiens
uuccaauuugacaaaaccca

SEQ ID NO: 567714 - RNA, 17 nt, Homo sapiens
uuccaauuuuguugcau

SEQ ID NO: 567715 - RNA, 13 nt, Homo sapiens
uuccacacuauuc

SEQ ID NO: 567716 - RNA, 15 nt, Homo sapiens
uuccacagaggacac

SEQ ID NO: 567717 - RNA, 18 nt, Homo sapiens
uuccaccuagagcuagau

SEQ ID NO: 567718 - RNA, 14 nt, Homo sapiens
uuccaccucaccuc

SEQ ID NO: 567719 - RNA, 14 nt, Homo sapiens
uuccaccugccaca

SEQ ID NO: 567720 - RNA, 23 nt, Homo sapiens
uuccacguguuuuauuccuguau

SEQ ID NO: 567721 - RNA, 14 nt, Homo sapiens
uuccacuacugcua

SEQ ID NO: 567722 - RNA, 20 nt, Homo sapiens
uuccacucccuuugccagug

SEQ ID NO: 567723 - RNA, 18 nt, Homo sapiens
uuccacucgaugaugcuu

SEQ ID NO: 567724 - RNA, 11 nt, Homo sapiens
uuccacugaaa

SEQ ID NO: 567725 - RNA, 19 nt, Homo sapiens
uuccacugccuccugugac

SEQ ID NO: 567726 - RNA, 12 nt, Homo sapiens
uuccacugcugc

SEQ ID NO: 567727 - RNA, 20 nt, Homo sapiens
uuccacugucuuucaaugac

SEQ ID NO: 567728 - RNA, 22 nt, Homo sapiens
uuccagaaacuuuaagaacaaa

SEQ ID NO: 567729 - RNA, 23 nt, Homo sapiens
uuccagaagaagagaagcugcug

SEQ ID NO: 567730 - RNA, 14 nt, Homo sapiens
uuccagaaggucac

SEQ ID NO: 567731 - RNA, 19 nt, Homo sapiens
uuccagaaugguauggaau

SEQ ID NO: 567732 - RNA, 14 nt, Homo sapiens
uuccagacuuugaa

SEQ ID NO: 567733 - RNA, 15 nt, Homo sapiens
uuccagacuuugaaa

SEQ ID NO: 567734 - RNA, 14 nt, Homo sapiens
uuccagagcugaga

SEQ ID NO: 567735 - RNA, 14 nt, Homo sapiens
uuccagaguaugca

SEQ ID NO: 567736 - RNA, 12 nt, Homo sapiens
uuccagauagca

SEQ ID NO: 567737 - RNA, 16 nt, Homo sapiens
uuccagaucacugcca

SEQ ID NO: 567738 - RNA, 21 nt, Homo sapiens
uuccagcaaaauggaagcaaa

SEQ ID NO: 567739 - RNA, 21 nt, Homo sapiens
uuccagcagcugcaccccagc

SEQ ID NO: 567740 - RNA, 22 nt, Homo sapiens
uuccagcuuagaaugcaucuca

SEQ ID NO: 567741 - RNA, 23 nt, Homo sapiens
uuccagcuuagaaugcaucucau

SEQ ID NO: 567742 - RNA, 19 nt, Homo sapiens
uuccaggaaaaucugcacu

SEQ ID NO: 567743 - RNA, 15 nt, Homo sapiens
uuccaggagacauau

SEQ ID NO: 567744 - RNA, 22 nt, Homo sapiens
uuccaggagcauagaagccaca

SEQ ID NO: 567745 - RNA, 19 nt, Homo sapiens
uuccaggcgaugugcaagu

SEQ ID NO: 567746 - RNA, 21 nt, Homo sapiens
uuccaggcgaugugcaagugu

SEQ ID NO: 567747 - RNA, 12 nt, Homo sapiens
uucuauuuaaca

SEQ ID NO: 567748 - RNA, 23 nt, Homo sapiens
uucuauuuaaugcuuccagggau

SEQ ID NO: 567749 - RNA, 23 nt, Homo sapiens
uucucaaaugcacaucucauggc

SEQ ID NO: 567750 - RNA, 22 nt, Homo sapiens
uucucaagcugagauugagcag

SEQ ID NO: 567751 - RNA, 19 nt, Homo sapiens
uucucacaaugucccuuca

SEQ ID NO: 567752 - RNA, 22 nt, Homo sapiens
uucucacacacaacuguccaua

SEQ ID NO: 567753 - RNA, 20 nt, Homo sapiens
uucucacuccuaccugguaa

SEQ ID NO: 567754 - RNA, 17 nt, Homo sapiens
uucucagccacaaaaua

SEQ ID NO: 567755 - RNA, 17 nt, Homo sapiens
uucucagguguugccaa

SEQ ID NO: 567756 - RNA, 23 nt, Homo sapiens
uucucagugggacucugauccca

SEQ ID NO: 567757 - RNA, 14 nt, Homo sapiens
uucucaguggugca

SEQ ID NO: 567758 - RNA, 20 nt, Homo sapiens
uucucaucacucaaccuuau

SEQ ID NO: 567759 - RNA, 21 nt, Homo sapiens
uucucaucaguaguucacaua

SEQ ID NO: 567760 - RNA, 23 nt, Homo sapiens
uucucaucaguaguucacauaca

SEQ ID NO: 567761 - RNA, 21 nt, Homo sapiens
uucucaucauauuguauguaa

SEQ ID NO: 567762 - RNA, 18 nt, Homo sapiens
uucucaugaacuacccca

SEQ ID NO: 567763 - RNA, 13 nt, Homo sapiens
uucucaugaucca

SEQ ID NO: 567764 - RNA, 17 nt, Homo sapiens
uucucauucguggcaug

SEQ ID NO: 567765 - RNA, 14 nt, Homo sapiens
uucucauuucucag

SEQ ID NO: 567766 - RNA, 17 nt, Homo sapiens
uucuccaagaaacugaa

SEQ ID NO: 567767 - RNA, 14 nt, Homo sapiens
uucuccacaaagua

SEQ ID NO: 567768 - RNA, 13 nt, Homo sapiens
uucuccacagugu

SEQ ID NO: 567769 - RNA, 14 nt, Homo sapiens
uucuccacugcuug

SEQ ID NO: 567770 - RNA, 23 nt, Homo sapiens
uucuccagacccaccacaccgca

SEQ ID NO: 567771 - RNA, 21 nt, Homo sapiens
uucuccagggguuuacaguga

SEQ ID NO: 567772 - RNA, 23 nt, Homo sapiens
uucucccacaugaggccaucuca

SEQ ID NO: 567773 - RNA, 17 nt, Homo sapiens
uucucccaccaccucac

SEQ ID NO: 567774 - RNA, 17 nt, Homo sapiens
uucucccagcacacggc

SEQ ID NO: 567775 - RNA, 23 nt, Homo sapiens
uucucccagggagugagcagcua

SEQ ID NO: 567776 - RNA, 13 nt, Homo sapiens
uucucccauuucc

SEQ ID NO: 567777 - RNA, 15 nt, Homo sapiens
uucuccccucuccca

SEQ ID NO: 567778 - RNA, 18 nt, Homo sapiens
uucuccccuuccuggaca

SEQ ID NO: 567779 - RNA, 14 nt, Homo sapiens
uucucccugggaag

SEQ ID NO: 567780 - RNA, 15 nt, Homo sapiens
uucuccucacuguau

SEQ ID NO: 567781 - RNA, 13 nt, Homo sapiens
uucuccuccaugg

SEQ ID NO: 567782 - RNA, 23 nt, Homo sapiens
uucuccucccuguuaucugcuag

SEQ ID NO: 567783 - RNA, 14 nt, Homo sapiens
uucuccuugaauau

SEQ ID NO: 567784 - RNA, 18 nt, Homo sapiens
uucuccuuuuacuucacu

SEQ ID NO: 567785 - RNA, 15 nt, Homo sapiens
uucuccuuuugaacu

SEQ ID NO: 567786 - RNA, 16 nt, Homo sapiens
uucuccuuuugaccaa

SEQ ID NO: 567787 - RNA, 19 nt, Homo sapiens
uucuccuuuugaccaaaua

SEQ ID NO: 567788 - RNA, 23 nt, Homo sapiens
uucucuaaaauaacuaguacaaa

SEQ ID NO: 567789 - RNA, 16 nt, Homo sapiens
uucucuaacucagaaa

SEQ ID NO: 567790 - RNA, 16 nt, Homo sapiens
uucucuauacucaggu

SEQ ID NO: 567791 - RNA, 20 nt, Homo sapiens
uucucucacaguguacucua

SEQ ID NO: 567792 - RNA, 13 nt, Homo sapiens
uucucucagaaau

SEQ ID NO: 567793 - RNA, 16 nt, Homo sapiens
uucucuccugugugcu

SEQ ID NO: 567794 - RNA, 15 nt, Homo sapiens
uucucucuccagggu

SEQ ID NO: 567795 - RNA, 15 nt, Homo sapiens
uucucucuguucccu

SEQ ID NO: 567796 - RNA, 18 nt, Homo sapiens
uucucucuuauuccacuu

SEQ ID NO: 567797 - RNA, 12 nt, Homo sapiens
uucucugccuca

SEQ ID NO: 567798 - RNA, 19 nt, Homo sapiens
uucucugguaauauugacu

SEQ ID NO: 567799 - RNA, 15 nt, Homo sapiens
uucucugguuucacc

SEQ ID NO: 567800 - RNA, 18 nt, Homo sapiens
uucucugucucuguggaa

SEQ ID NO: 567801 - RNA, 17 nt, Homo sapiens
uucucuuaaucacuacu

SEQ ID NO: 567802 - RNA, 23 nt, Homo sapiens
uucucuuagggucgcugcauaaa

SEQ ID NO: 567803 - RNA, 20 nt, Homo sapiens
uucucuuaguuauugcugaa

SEQ ID NO: 567804 - RNA, 15 nt, Homo sapiens
uucucuucccaguga

SEQ ID NO: 567805 - RNA, 17 nt, Homo sapiens
uucucuugacagucuga

SEQ ID NO: 567806 - RNA, 16 nt, Homo sapiens
uucucuuuaaugccua

SEQ ID NO: 567807 - RNA, 16 nt, Homo sapiens
uucucuuucucuccuu

SEQ ID NO: 567808 - RNA, 17 nt, Homo sapiens
uucucuuucuuuuacug

SEQ ID NO: 567809 - RNA, 22 nt, Homo sapiens
uucucuuugauuauuugcaugu

SEQ ID NO: 567810 - RNA, 21 nt, Homo sapiens
uucugaaauaaacuucacuga

SEQ ID NO: 567811 - RNA, 14 nt, Homo sapiens
uucugaagaucaau

SEQ ID NO: 567812 - RNA, 14 nt, Homo sapiens
uucugaagugggaa

SEQ ID NO: 567813 - RNA, 19 nt, Homo sapiens
uucugaauacaaagugaug

SEQ ID NO: 567814 - RNA, 15 nt, Homo sapiens
uucugaauuguccuu

SEQ ID NO: 567815 - RNA, 13 nt, Homo sapiens
uucugacaucagc

SEQ ID NO: 567816 - RNA, 23 nt, Homo sapiens
uucugacgucagcgcaccaaaac

SEQ ID NO: 567817 - RNA, 14 nt, Homo sapiens
uucugacuuacugu

SEQ ID NO: 567818 - RNA, 13 nt, Homo sapiens
uucugagcuguau

SEQ ID NO: 567819 - RNA, 19 nt, Homo sapiens
uucugaggccugagugauc

SEQ ID NO: 567820 - RNA, 18 nt, Homo sapiens
uucugagggaaagugcau

SEQ ID NO: 567821 - RNA, 13 nt, Homo sapiens
uucugaggggugu

SEQ ID NO: 567822 - RNA, 16 nt, Homo sapiens
uucugauaaaguuccu

SEQ ID NO: 567823 - RNA, 19 nt, Homo sapiens
uucugauacguguaugaga

SEQ ID NO: 567824 - RNA, 17 nt, Homo sapiens
uucugauauguauccau

SEQ ID NO: 567825 - RNA, 22 nt, Homo sapiens
uucugaugacaguguuauccca

SEQ ID NO: 567826 - RNA, 19 nt, Homo sapiens
uucugauggccagcaaaug

SEQ ID NO: 567827 - RNA, 22 nt, Homo sapiens
uucugauuugucccuaugcaua

SEQ ID NO: 567828 - RNA, 12 nt, Homo sapiens
uucugcagaaau

SEQ ID NO: 567829 - RNA, 22 nt, Homo sapiens
uucugcagaaauuugcaacuca

SEQ ID NO: 567830 - RNA, 19 nt, Homo sapiens
uucugcagaacuccuccaa

SEQ ID NO: 567831 - RNA, 15 nt, Homo sapiens
uucugcccaugggaa

SEQ ID NO: 567832 - RNA, 22 nt, Homo sapiens
uucugccugcuccaucgcgcca

SEQ ID NO: 567833 - RNA, 19 nt, Homo sapiens
uucugccuucucaugaucc

SEQ ID NO: 567834 - RNA, 21 nt, Homo sapiens
uucugcuaaauaucaccuagc

SEQ ID NO: 567835 - RNA, 16 nt, Homo sapiens
uucugcuagagcagac

SEQ ID NO: 567836 - RNA, 14 nt, Homo sapiens
uucugcucugccau

SEQ ID NO: 567837 - RNA, 18 nt, Homo sapiens
uucugcuguggucuauaa

SEQ ID NO: 567838 - RNA, 17 nt, Homo sapiens
uucuggaagucaucuca

SEQ ID NO: 567839 - RNA, 24 nt, Homo sapiens
uucuggacugcacacuuccaccau

SEQ ID NO: 567840 - RNA, 16 nt, Homo sapiens
uucuggagguuuccaa

SEQ ID NO: 567841 - RNA, 14 nt, Homo sapiens
uucuggauaccauu

SEQ ID NO: 567842 - RNA, 18 nt, Homo sapiens
uucuggauuugcagguga

SEQ ID NO: 567843 - RNA, 16 nt, Homo sapiens
uucugggaacuuccuc

SEQ ID NO: 567844 - RNA, 18 nt, Homo sapiens
uucugggcaaucaguguu

SEQ ID NO: 567845 - RNA, 17 nt, Homo sapiens
uucugggcuucaucugg

SEQ ID NO: 567846 - RNA, 20 nt, Homo sapiens
uucugggugcgagugugaga

SEQ ID NO: 567847 - RNA, 15 nt, Homo sapiens
uucuggguuugccca

SEQ ID NO: 567848 - RNA, 18 nt, Homo sapiens
uucugguagcauauucau

SEQ ID NO: 567849 - RNA, 18 nt, Homo sapiens
uucugguauucacagaaa

SEQ ID NO: 567850 - RNA, 14 nt, Homo sapiens
uucugguuggugua

SEQ ID NO: 567851 - RNA, 18 nt, Homo sapiens
uucugguuguuaugugau

SEQ ID NO: 567852 - RNA, 13 nt, Homo sapiens
uucuguaccaguu

SEQ ID NO: 567853 - RNA, 23 nt, Homo sapiens
uucuguagauguugucuuggcuu

SEQ ID NO: 567854 - RNA, 21 nt, Homo sapiens
uucuguagcucaguucccaga

SEQ ID NO: 567855 - RNA, 22 nt, Homo sapiens
uucuguagcuuguucccugucu

SEQ ID NO: 567856 - RNA, 14 nt, Homo sapiens
uucuguaugcauca

SEQ ID NO: 567857 - RNA, 16 nt, Homo sapiens
uucugucaaaugcagu

SEQ ID NO: 567858 - RNA, 23 nt, Homo sapiens
uucugucaagcuuacuacaguga

SEQ ID NO: 567859 - RNA, 18 nt, Homo sapiens
uucuguccccucuuccua

SEQ ID NO: 567860 - RNA, 12 nt, Homo sapiens
uucuguccugua

SEQ ID NO: 567861 - RNA, 21 nt, Homo sapiens
uucuguccuguaacuguuaca

SEQ ID NO: 567862 - RNA, 16 nt, Homo sapiens
uucugucuggagugac

SEQ ID NO: 567863 - RNA, 21 nt, Homo sapiens
uucugucugugucuucaggag

SEQ ID NO: 567864 - RNA, 16 nt, Homo sapiens
uucugugaaauauaau

SEQ ID NO: 567865 - RNA, 24 nt, Homo sapiens
uucugugaucuuuuaaaguguuac

SEQ ID NO: 567866 - RNA, 23 nt, Homo sapiens
uucugugauuaggugaagggaug

SEQ ID NO: 567867 - RNA, 18 nt, Homo sapiens
uucuguggaccacugcau

SEQ ID NO: 567868 - RNA, 13 nt, Homo sapiens
uuuugccagagaa

SEQ ID NO: 567869 - RNA, 12 nt, Homo sapiens
uuuugcucugcc

SEQ ID NO: 567870 - RNA, 22 nt, Homo sapiens
uuuugcugucuuucucuaaaua

SEQ ID NO: 567871 - RNA, 13 nt, Homo sapiens
uuuugcuuuccaa

SEQ ID NO: 567872 - RNA, 16 nt, Homo sapiens
uuuuggaauuaugucu

SEQ ID NO: 567873 - RNA, 19 nt, Homo sapiens
uuuuggcccaaucucugcc

SEQ ID NO: 567874 - RNA, 12 nt, Homo sapiens
uuuuggcuucug

SEQ ID NO: 567875 - RNA, 12 nt, Homo sapiens
uuuugguaucua

SEQ ID NO: 567876 - RNA, 18 nt, Homo sapiens
uuuugguuccacaaucuc

SEQ ID NO: 567877 - RNA, 20 nt, Homo sapiens
uuuugguuuaaaaaguuuca

SEQ ID NO: 567878 - RNA, 21 nt, Homo sapiens
uuuuguaaauauucuugucca

SEQ ID NO: 567879 - RNA, 9 nt, Homo sapiens
uuuuguaca

SEQ ID NO: 567880 - RNA, 11 nt, Homo sapiens
uuuuguacuuu

SEQ ID NO: 567881 - RNA, 20 nt, Homo sapiens
uuuuguauuguuuucugaca

SEQ ID NO: 567882 - RNA, 18 nt, Homo sapiens
uuuugucuagaccuauua

SEQ ID NO: 567883 - RNA, 12 nt, Homo sapiens
uuuuguguccuc

SEQ ID NO: 567884 - RNA, 16 nt, Homo sapiens
uuuuguguuuugguua

SEQ ID NO: 567885 - RNA, 20 nt, Homo sapiens
uuuuguuacaaaaagacaaa

SEQ ID NO: 567886 - RNA, 19 nt, Homo sapiens
uuuuguucucaacuucaaa

SEQ ID NO: 567887 - RNA, 19 nt, Homo sapiens
uuuuguugaaauagcuuua

SEQ ID NO: 567888 - RNA, 16 nt, Homo sapiens
uuuuguugacauuagu

SEQ ID NO: 567889 - RNA, 16 nt, Homo sapiens
uuuuuaaaaaaguaag

SEQ ID NO: 567890 - RNA, 20 nt, Homo sapiens
uuuuuaaaagguagagucuu

SEQ ID NO: 567891 - RNA, 21 nt, Homo sapiens
uuuuuaaaauauauugcugca

SEQ ID NO: 567892 - RNA, 18 nt, Homo sapiens
uuuuuaaacaaagacagc

SEQ ID NO: 567893 - RNA, 13 nt, Homo sapiens
uuuuuaacuuuga

SEQ ID NO: 567894 - RNA, 14 nt, Homo sapiens
uuuuuaagcucaaa

SEQ ID NO: 567895 - RNA, 19 nt, Homo sapiens
uuuuuaagugcugcauuua

SEQ ID NO: 567896 - RNA, 18 nt, Homo sapiens
uuuuuaauauaaagccug

SEQ ID NO: 567897 - RNA, 13 nt, Homo sapiens
uuuuuaauggaaa

SEQ ID NO: 567898 - RNA, 21 nt, Homo sapiens
uuuuuaauggcaauaggacau

SEQ ID NO: 567899 - RNA, 14 nt, Homo sapiens
uuuuuaauuaacca

SEQ ID NO: 567900 - RNA, 13 nt, Homo sapiens
uuuuuaauuggcc

SEQ ID NO: 567901 - RNA, 12 nt, Homo sapiens
uuuuuacuauua

SEQ ID NO: 567902 - RNA, 15 nt, Homo sapiens
uuuuuacugcucuga

SEQ ID NO: 567903 - RNA, 22 nt, Homo sapiens
uuuuuauaaaaaugagugcuua

SEQ ID NO: 567904 - RNA, 18 nt, Homo sapiens
uuuuuauaaauaucaugc

SEQ ID NO: 567905 - RNA, 13 nt, Homo sapiens
uuuuuauacugua

SEQ ID NO: 567906 - RNA, 13 nt, Homo sapiens
uuuuuaugugcag

SEQ ID NO: 567907 - RNA, 14 nt, Homo sapiens
uuuuucaaagcaau

SEQ ID NO: 567908 - RNA, 14 nt, Homo sapiens
uuuuucaagagcuc

SEQ ID NO: 567909 - RNA, 15 nt, Homo sapiens
uuuuucauucauccc

SEQ ID NO: 567910 - RNA, 13 nt, Homo sapiens
uuuuucauuguau

SEQ ID NO: 567911 - RNA, 20 nt, Homo sapiens
uuuuuccaauuuuguugcau

SEQ ID NO: 567912 - RNA, 21 nt, Homo sapiens
uuuuucccaaguacccugaga

SEQ ID NO: 567913 - RNA, 22 nt, Homo sapiens
uuuuuccccugcuccccugaga

SEQ ID NO: 567914 - RNA, 14 nt, Homo sapiens
uuuuuccucugcau

SEQ ID NO: 567915 - RNA, 23 nt, Homo sapiens
uuuuuccugcauguucugugacu

SEQ ID NO: 567916 - RNA, 11 nt, Homo sapiens
uuuuucugggg

SEQ ID NO: 567917 - RNA, 20 nt, Homo sapiens
uuuuucugggucucccacuu

SEQ ID NO: 567918 - RNA, 14 nt, Homo sapiens
uuuuugaaagucag

SEQ ID NO: 567919 - RNA, 15 nt, Homo sapiens
uuuuugagaaagcaa

SEQ ID NO: 567920 - RNA, 17 nt, Homo sapiens
uuuuugcaaaugcuuua

SEQ ID NO: 567921 - RNA, 12 nt, Homo sapiens
uuuuugccaaaa

SEQ ID NO: 567922 - RNA, 15 nt, Homo sapiens
uuuuugccagacucu

SEQ ID NO: 567923 - RNA, 11 nt, Homo sapiens
uuuuugccauu

SEQ ID NO: 567924 - RNA, 18 nt, Homo sapiens
uuuuugcugcugccucuu

SEQ ID NO: 567925 - RNA, 23 nt, Homo sapiens
uuuuuggaauuaugucugcugaa

SEQ ID NO: 567926 - RNA, 15 nt, Homo sapiens
uuuuuggucaugaaa

SEQ ID NO: 567927 - RNA, 21 nt, Homo sapiens
uuuuuguacuuuucugguucc

SEQ ID NO: 567928 - RNA, 18 nt, Homo sapiens
uuuuuguucaaagccagc

SEQ ID NO: 567929 - RNA, 13 nt, Homo sapiens
uuuuuucaccaau

SEQ ID NO: 567930 - RNA, 15 nt, Homo sapiens
uuuuuugauccacuu

SEQ ID NO: 567931 - RNA, 21 nt, Homo sapiens
uuuuuuguauagaccaaagca

SEQ ID NO: 567932 - RNA, 13 nt, Homo sapiens
uuuuuuugcugcu

SEQ ID NO: 567933 - RNA, 18 nt, Homo sapiens
aaagccaaacucugccag

SEQ ID NO: 567934 - RNA, 15 nt, Homo sapiens
aaagccaacagucaa

SEQ ID NO: 567935 - RNA, 14 nt, Homo sapiens
aaagccacaaggcu

SEQ ID NO: 567936 - RNA, 22 nt, Homo sapiens
aaagccacaaugagaaugaugc

SEQ ID NO: 567937 - RNA, 15 nt, Homo sapiens
aaagccaccacauuu

SEQ ID NO: 567938 - RNA, 19 nt, Homo sapiens
aaagccacuguaugauucu

SEQ ID NO: 567939 - RNA, 19 nt, Homo sapiens
aaagccagggucucucccu

SEQ ID NO: 567940 - RNA, 17 nt, Homo sapiens
aaagccauaacuugaaa

SEQ ID NO: 567941 - RNA, 23 nt, Homo sapiens
aaagccauauuccagcagugaaa

SEQ ID NO: 567942 - RNA, 16 nt, Homo sapiens
aaagccaucucagguu

SEQ ID NO: 567943 - RNA, 18 nt, Homo sapiens
aaagcccaaccuccugac

SEQ ID NO: 567944 - RNA, 21 nt, Homo sapiens
aaagcccacgucaggaccaca

SEQ ID NO: 567945 - RNA, 14 nt, Homo sapiens
aaagcccagcuuga

SEQ ID NO: 567946 - RNA, 16 nt, Homo sapiens
aaagcccauugccauu

SEQ ID NO: 567947 - RNA, 13 nt, Homo sapiens
aaagcccuuccau

SEQ ID NO: 567948 - RNA, 20 nt, Homo sapiens
aaagccucacguauuucaca

SEQ ID NO: 567949 - RNA, 17 nt, Homo sapiens
aaagccucagccauuca

SEQ ID NO: 567950 - RNA, 21 nt, Homo sapiens
aaagccucagccauucacugc

SEQ ID NO: 567951 - RNA, 24 nt, Homo sapiens
aaagccuccaaggguuucgacugg

SEQ ID NO: 567952 - RNA, 20 nt, Homo sapiens
aaagcggggcuucaucugca

SEQ ID NO: 567953 - RNA, 16 nt, Homo sapiens
aaagcuaaaauaaaga

SEQ ID NO: 567954 - RNA, 19 nt, Homo sapiens
aaagcuaaauguacauguu

SEQ ID NO: 567955 - RNA, 15 nt, Homo sapiens
aaagcuaaauuccac

SEQ ID NO: 567956 - RNA, 17 nt, Homo sapiens
aaagcuaacaucuuuac

SEQ ID NO: 567957 - RNA, 12 nt, Homo sapiens
aaagcuaccugu

SEQ ID NO: 567958 - RNA, 19 nt, Homo sapiens
aaagcuagauaugccuuaa

SEQ ID NO: 567959 - RNA, 20 nt, Homo sapiens
aaagcuagcacuaacucgug

SEQ ID NO: 567960 - RNA, 17 nt, Homo sapiens
aaagcucaaaguaugca

SEQ ID NO: 567961 - RNA, 18 nt, Homo sapiens
aaagcucaccaucuucac

SEQ ID NO: 567962 - RNA, 17 nt, Homo sapiens
aaagcucacugcugauc

SEQ ID NO: 567963 - RNA, 22 nt, Homo sapiens
aaagcucaugcauuucaagcag

SEQ ID NO: 567964 - RNA, 14 nt, Homo sapiens
aaagcugaaaagca

SEQ ID NO: 567965 - RNA, 16 nt, Homo sapiens
aaagcugauagccaga

SEQ ID NO: 567966 - RNA, 21 nt, Homo sapiens
aaagcugccugugccaugccc

SEQ ID NO: 567967 - RNA, 22 nt, Homo sapiens
aaagcugccugugccaugccca

SEQ ID NO: 567968 - RNA, 14 nt, Homo sapiens
aaagcuuacuguuu

SEQ ID NO: 567969 - RNA, 11 nt, Homo sapiens
aaagcuucccc

SEQ ID NO: 567970 - RNA, 18 nt, Homo sapiens
aaagcuucuaucccagga

SEQ ID NO: 567971 - RNA, 21 nt, Homo sapiens
aaagcuucucagccuuccuag

SEQ ID NO: 567972 - RNA, 20 nt, Homo sapiens
aaagcuuuauacaguugaau

SEQ ID NO: 567973 - RNA, 12 nt, Homo sapiens
aaagcuuucaac

SEQ ID NO: 567974 - RNA, 18 nt, Homo sapiens
aaagcuuuggcugagacc

SEQ ID NO: 567975 - RNA, 17 nt, Homo sapiens
aaaggaaaaauaaucaa

SEQ ID NO: 567976 - RNA, 16 nt, Homo sapiens
aaaggaaaaggucuga

SEQ ID NO: 567977 - RNA, 19 nt, Homo sapiens
aaaggaaaauaguaauguu

SEQ ID NO: 567978 - RNA, 15 nt, Homo sapiens
aaaggaaaccaagug

SEQ ID NO: 567979 - RNA, 14 nt, Homo sapiens
aaaggaaacuugaa

SEQ ID NO: 567980 - RNA, 22 nt, Homo sapiens
aaaggaaagauuugccaauuga

SEQ ID NO: 567981 - RNA, 21 nt, Homo sapiens
aaaggaacucuagaagaccaa

SEQ ID NO: 567982 - RNA, 15 nt, Homo sapiens
aaaggaacugcaaua

SEQ ID NO: 567983 - RNA, 13 nt, Homo sapiens
aaaggaagacaga

SEQ ID NO: 567984 - RNA, 16 nt, Homo sapiens
aaaggaagacuugaag

SEQ ID NO: 567985 - RNA, 18 nt, Homo sapiens
aaaggaagccuugcucau

SEQ ID NO: 567986 - RNA, 21 nt, Homo sapiens
aaaggaagcuccacugucacc

SEQ ID NO: 567987 - RNA, 17 nt, Homo sapiens
aaaggaauacauugcaa

SEQ ID NO: 567988 - RNA, 24 nt, Homo sapiens
aaaggaaugaaagagagcucuaac

SEQ ID NO: 567989 - RNA, 19 nt, Homo sapiens
aaaggacagaguaugaaca

SEQ ID NO: 567990 - RNA, 22 nt, Homo sapiens
aaaggacucugcuucaguccac

SEQ ID NO: 567991 - RNA, 18 nt, Homo sapiens
aaaggagaacuauccaaa

SEQ ID NO: 567992 - RNA, 23 nt, Homo sapiens
aaaggaugcuuacuccacuucgc

SEQ ID NO: 567993 - RNA, 15 nt, Homo sapiens
aaaggauuuuaccaa

SEQ ID NO: 567994 - RNA, 22 nt, Homo sapiens
aaaggcagauuaaaagcacaag

SEQ ID NO: 567995 - RNA, 15 nt, Homo sapiens
aaaggcagcccucac

SEQ ID NO: 567996 - RNA, 13 nt, Homo sapiens
aaaggcagcugcc

SEQ ID NO: 567997 - RNA, 15 nt, Homo sapiens
aaaggcccuuuucag

SEQ ID NO: 567998 - RNA, 14 nt, Homo sapiens
aaaggcugcuguga

SEQ ID NO: 567999 - RNA, 17 nt, Homo sapiens
aaagggaagccauuccg

SEQ ID NO: 568000 - RNA, 15 nt, Homo sapiens
aaagggaccagggga

SEQ ID NO: 568001 - RNA, 9 nt, Homo sapiens
aaagggaug

SEQ ID NO: 568002 - RNA, 12 nt, Homo sapiens
aaagggcacuua

SEQ ID NO: 568003 - RNA, 17 nt, Homo sapiens
aaagggcugaaagccau

SEQ ID NO: 568004 - RNA, 22 nt, Homo sapiens
aaagggcuugaggugaauuuca

SEQ ID NO: 568005 - RNA, 17 nt, Homo sapiens
aaaggggguaugugaua

SEQ ID NO: 568006 - RNA, 16 nt, Homo sapiens
aaagggucuuaugaaa

SEQ ID NO: 568007 - RNA, 20 nt, Homo sapiens
aaagggucuuaugaaacaau

SEQ ID NO: 568008 - RNA, 16 nt, Homo sapiens
aaagggugacuuacau

SEQ ID NO: 568009 - RNA, 14 nt, Homo sapiens
aaagguaacaaagg

SEQ ID NO: 568010 - RNA, 20 nt, Homo sapiens
aaagguaacuaacugcuuca

SEQ ID NO: 568011 - RNA, 14 nt, Homo sapiens
aaaggucagacuga

SEQ ID NO: 568012 - RNA, 17 nt, Homo sapiens
aaagguccuugccuccu

SEQ ID NO: 568013 - RNA, 22 nt, Homo sapiens
aaaggugaauguugagggcccu

SEQ ID NO: 568014 - RNA, 13 nt, Homo sapiens
aaaggugacuggg

SEQ ID NO: 568015 - RNA, 16 nt, Homo sapiens
aaagguucacucucaa

SEQ ID NO: 568016 - RNA, 22 nt, Homo sapiens
aaagguucuaaggggaccuaca

SEQ ID NO: 568017 - RNA, 14 nt, Homo sapiens
aaagguuggccuua

SEQ ID NO: 568018 - RNA, 18 nt, Homo sapiens
aaagguuuaugaaaaaga

SEQ ID NO: 568019 - RNA, 20 nt, Homo sapiens
aaaguaaaauagauggugua

SEQ ID NO: 568020 - RNA, 20 nt, Homo sapiens
aaaguaaaggccucaucucc

SEQ ID NO: 568021 - RNA, 16 nt, Homo sapiens
aaaguaagacaucuca

SEQ ID NO: 568022 - RNA, 13 nt, Homo sapiens
aaaguaaugacuu

SEQ ID NO: 568023 - RNA, 16 nt, Homo sapiens
aaaguaaugcuucaau

SEQ ID NO: 568024 - RNA, 20 nt, Homo sapiens
aaaguaauuucuuugaucug

SEQ ID NO: 568025 - RNA, 22 nt, Homo sapiens
aaaguaauuucuuugaucugga

SEQ ID NO: 568026 - RNA, 17 nt, Homo sapiens
aaaguaccacacugagu

SEQ ID NO: 568027 - RNA, 18 nt, Homo sapiens
aaaguacccugugcucaa

SEQ ID NO: 568028 - RNA, 16 nt, Homo sapiens
aaaguaccuugaacuc

SEQ ID NO: 568029 - RNA, 13 nt, Homo sapiens
aaaguacuuuaau

SEQ ID NO: 568030 - RNA, 17 nt, Homo sapiens
aaaguagaaaaagauuc

SEQ ID NO: 568031 - RNA, 18 nt, Homo sapiens
aaaguagaauaagccuuc

SEQ ID NO: 568032 - RNA, 20 nt, Homo sapiens
aaaguagaauaagccuucaa

SEQ ID NO: 568033 - RNA, 15 nt, Homo sapiens
aaaguaguccuguga

SEQ ID NO: 568034 - RNA, 12 nt, Homo sapiens
aaaguauuguaa

SEQ ID NO: 568035 - RNA, 15 nt, Homo sapiens
aaagucacccaaaca

SEQ ID NO: 568036 - RNA, 22 nt, Homo sapiens
aaagucacggcugcgcacugug

SEQ ID NO: 568037 - RNA, 12 nt, Homo sapiens
aaagucagagac

SEQ ID NO: 568038 - RNA, 17 nt, Homo sapiens
aaagucagaucuggucu

SEQ ID NO: 568039 - RNA, 15 nt, Homo sapiens
cuaaauaaugcaaac

SEQ ID NO: 568040 - RNA, 20 nt, Homo sapiens
cuaaauaauguuaucugugu

SEQ ID NO: 568041 - RNA, 22 nt, Homo sapiens
cuaaauaguucuaucaggaaaa

SEQ ID NO: 568042 - RNA, 14 nt, Homo sapiens
cuaaauaucuguca

SEQ ID NO: 568043 - RNA, 11 nt, Homo sapiens
cuaaauaugau

SEQ ID NO: 568044 - RNA, 16 nt, Homo sapiens
cuaaauaugugacuga

SEQ ID NO: 568045 - RNA, 23 nt, Homo sapiens
cuaaauaugugacugacaauaaa

SEQ ID NO: 568046 - RNA, 12 nt, Homo sapiens
cuaaaucccucc

SEQ ID NO: 568047 - RNA, 11 nt, Homo sapiens
cuaaaugaagu

SEQ ID NO: 568048 - RNA, 22 nt, Homo sapiens
cuaaaugaaugagccaaaauga

SEQ ID NO: 568049 - RNA, 16 nt, Homo sapiens
cuaaaugagauacacu

SEQ ID NO: 568050 - RNA, 15 nt, Homo sapiens
cuaaaugcacugacc

SEQ ID NO: 568051 - RNA, 20 nt, Homo sapiens
cuaaaugcagacaacaccuu

SEQ ID NO: 568052 - RNA, 23 nt, Homo sapiens
cuaaaugcagacaacaccuuccu

SEQ ID NO: 568053 - RNA, 12 nt, Homo sapiens
cuaaauguauuc

SEQ ID NO: 568054 - RNA, 16 nt, Homo sapiens
cuaaaugucagcuguu

SEQ ID NO: 568055 - RNA, 18 nt, Homo sapiens
cuaaauuacagugcaguu

SEQ ID NO: 568056 - RNA, 12 nt, Homo sapiens
cuaacacaaaau

SEQ ID NO: 568057 - RNA, 20 nt, Homo sapiens
cuaacagaucagaacaugaa

SEQ ID NO: 568058 - RNA, 21 nt, Homo sapiens
cuaacagcaacagcaagaaau

SEQ ID NO: 568059 - RNA, 22 nt, Homo sapiens
cuaacagcccuccucugcacuc

SEQ ID NO: 568060 - RNA, 18 nt, Homo sapiens
cuaacagucuagugcaaa

SEQ ID NO: 568061 - RNA, 22 nt, Homo sapiens
cuaacaucuuuacguacuguaa

SEQ ID NO: 568062 - RNA, 20 nt, Homo sapiens
cuaacauguaauugcagaua

SEQ ID NO: 568063 - RNA, 23 nt, Homo sapiens
cuaaccacuuagcaugugugauu

SEQ ID NO: 568064 - RNA, 19 nt, Homo sapiens
cuaaccaguaccucuguau

SEQ ID NO: 568065 - RNA, 14 nt, Homo sapiens
cuaacccccaaaua

SEQ ID NO: 568066 - RNA, 16 nt, Homo sapiens
cuaaccccuuccagau

SEQ ID NO: 568067 - RNA, 16 nt, Homo sapiens
cuaaccuaucuaugaa

SEQ ID NO: 568068 - RNA, 13 nt, Homo sapiens
cuaaccugugacc

SEQ ID NO: 568069 - RNA, 15 nt, Homo sapiens
cuaacuauauuugcu

SEQ ID NO: 568070 - RNA, 22 nt, Homo sapiens
cuaacuuuguauccguucaaua

SEQ ID NO: 568071 - RNA, 20 nt, Homo sapiens
cuaagaagcgagcacugacc

SEQ ID NO: 568072 - RNA, 15 nt, Homo sapiens
cuaagagugaaguag

SEQ ID NO: 568073 - RNA, 15 nt, Homo sapiens
cuaagauacuccaua

SEQ ID NO: 568074 - RNA, 17 nt, Homo sapiens
cuaagaugaaauugcca

SEQ ID NO: 568075 - RNA, 18 nt, Homo sapiens
cuaagcaaaaagaacaaa

SEQ ID NO: 568076 - RNA, 15 nt, Homo sapiens
cuaagcagaccacug

SEQ ID NO: 568077 - RNA, 17 nt, Homo sapiens
cuaagcagaccacugau

SEQ ID NO: 568078 - RNA, 14 nt, Homo sapiens
cuaagcaguggcau

SEQ ID NO: 568079 - RNA, 14 nt, Homo sapiens
cuaagcaugugucc

SEQ ID NO: 568080 - RNA, 21 nt, Homo sapiens
cuaagccacucuuccaaaggc

SEQ ID NO: 568081 - RNA, 16 nt, Homo sapiens
cuaagccuguugcuga

SEQ ID NO: 568082 - RNA, 11 nt, Homo sapiens
cuaagccuuuc

SEQ ID NO: 568083 - RNA, 22 nt, Homo sapiens
cuaagcgaauguguacaaagug

SEQ ID NO: 568084 - RNA, 23 nt, Homo sapiens
cuaagcgaauguguacaaagugu

SEQ ID NO: 568085 - RNA, 16 nt, Homo sapiens
cuaagcgcacauucau

SEQ ID NO: 568086 - RNA, 20 nt, Homo sapiens
cuaaggaagauuacucagua

SEQ ID NO: 568087 - RNA, 15 nt, Homo sapiens
cuaaggaggggaaaa

SEQ ID NO: 568088 - RNA, 16 nt, Homo sapiens
cuaagggguacuccuc

SEQ ID NO: 568089 - RNA, 18 nt, Homo sapiens
cuaagguuuagauaaaua

SEQ ID NO: 568090 - RNA, 23 nt, Homo sapiens
cuaaguaauuuagaagauauuau

SEQ ID NO: 568091 - RNA, 13 nt, Homo sapiens
cuaaguauauuaa

SEQ ID NO: 568092 - RNA, 22 nt, Homo sapiens
cuaagucacccagagcacagga

SEQ ID NO: 568093 - RNA, 21 nt, Homo sapiens
cuaagucaggcccugaucuag

SEQ ID NO: 568094 - RNA, 17 nt, Homo sapiens
cuaaguccaguguuucu

SEQ ID NO: 568095 - RNA, 20 nt, Homo sapiens
cuaagugggagaaggacuau

SEQ ID NO: 568096 - RNA, 23 nt, Homo sapiens
cuaauaaaauuaaguuguaucau

SEQ ID NO: 568097 - RNA, 17 nt, Homo sapiens
cuaauaaauaaucaucc

SEQ ID NO: 568098 - RNA, 16 nt, Homo sapiens
cuaauacaacauguag

SEQ ID NO: 568099 - RNA, 19 nt, Homo sapiens
cuaauacagcaacaauuua

SEQ ID NO: 568100 - RNA, 16 nt, Homo sapiens
cuaauaguuuuucacu

SEQ ID NO: 568101 - RNA, 20 nt, Homo sapiens
cuaauauuuuguucugcaaa

SEQ ID NO: 568102 - RNA, 22 nt, Homo sapiens
cuaauauuuuguucugcaaauu

SEQ ID NO: 568103 - RNA, 18 nt, Homo sapiens
cuaaucacaugugcugca

SEQ ID NO: 568104 - RNA, 23 nt, Homo sapiens
cuaaucaguccuuauuaucccag

SEQ ID NO: 568105 - RNA, 21 nt, Homo sapiens
cuaaucccgugccccuuuccu

SEQ ID NO: 568106 - RNA, 17 nt, Homo sapiens
cuaaugaacucuuucaa

SEQ ID NO: 568107 - RNA, 16 nt, Homo sapiens
cuaaugcucaccuuua

SEQ ID NO: 568108 - RNA, 13 nt, Homo sapiens
cuaaugcuuuaag

SEQ ID NO: 568109 - RNA, 19 nt, Homo sapiens
cuaauggggacacagauca

SEQ ID NO: 568110 - RNA, 12 nt, Homo sapiens
cuaaugguguug

SEQ ID NO: 568111 - RNA, 21 nt, Homo sapiens
cuaauguacaauaaagcaaug

SEQ ID NO: 568112 - RNA, 22 nt, Homo sapiens
cuaauguacaauaaagcaaugu

SEQ ID NO: 568113 - RNA, 16 nt, Homo sapiens
cuaauguaggacugua

SEQ ID NO: 568114 - RNA, 18 nt, Homo sapiens
cuaauguaggacuguaua

SEQ ID NO: 568115 - RNA, 11 nt, Homo sapiens
cuaauguauua

SEQ ID NO: 568116 - RNA, 15 nt, Homo sapiens
cuaaugucagaguag

SEQ ID NO: 568117 - RNA, 22 nt, Homo sapiens
cuaaugugcagggauauugccu

SEQ ID NO: 568118 - RNA, 13 nt, Homo sapiens
cuaaugugcauua

SEQ ID NO: 568119 - RNA, 22 nt, Homo sapiens
cuaaugugcauuaaaacaaauc

SEQ ID NO: 568120 - RNA, 13 nt, Homo sapiens
cuaauuaaacaca

SEQ ID NO: 568121 - RNA, 23 nt, Homo sapiens
cuaauuaaucuggaauaugcaac

SEQ ID NO: 568122 - RNA, 22 nt, Homo sapiens
cuaauuagaaaucaacuugugg

SEQ ID NO: 568123 - RNA, 14 nt, Homo sapiens
cuaauuauuuacuc

SEQ ID NO: 568124 - RNA, 20 nt, Homo sapiens
cuaauucacaggcaaaccaa

SEQ ID NO: 568125 - RNA, 20 nt, Homo sapiens
cuaauucuuguagaugcauu

SEQ ID NO: 568126 - RNA, 17 nt, Homo sapiens
cuaauugagaccacagg

SEQ ID NO: 568127 - RNA, 18 nt, Homo sapiens
cuaauuggccucuuuaag

SEQ ID NO: 568128 - RNA, 17 nt, Homo sapiens
cuaauuuaaguacauuu

SEQ ID NO: 568129 - RNA, 21 nt, Homo sapiens
cuaauuuauccugaaauuuca

SEQ ID NO: 568130 - RNA, 21 nt, Homo sapiens
cuaauuuccucugacauguaa

SEQ ID NO: 568131 - RNA, 18 nt, Homo sapiens
cuaauuuuuuauccuuuu

SEQ ID NO: 568132 - RNA, 15 nt, Homo sapiens
cuacaaaaaacaaca

SEQ ID NO: 568133 - RNA, 14 nt, Homo sapiens
cuacaaaggccaug

SEQ ID NO: 568134 - RNA, 21 nt, Homo sapiens
cuacaaauuuaugcauuucau

SEQ ID NO: 568135 - RNA, 21 nt, Homo sapiens
cuacaacaaauacuacaggcc

SEQ ID NO: 568136 - RNA, 18 nt, Homo sapiens
cuacaaccaauuuacacu

SEQ ID NO: 568137 - RNA, 20 nt, Homo sapiens
cuacaacuuuuccuaaggca

SEQ ID NO: 568138 - RNA, 17 nt, Homo sapiens
cuacaaggcuacaguaa

SEQ ID NO: 568139 - RNA, 19 nt, Homo sapiens
cuacaaggcuggcagugac

SEQ ID NO: 568140 - RNA, 22 nt, Homo sapiens
cuacaauuaauaguuugucuau

SEQ ID NO: 568141 - RNA, 14 nt, Homo sapiens
cuacaauuugccau

SEQ ID NO: 568142 - RNA, 14 nt, Homo sapiens
cuacacacagauga

SEQ ID NO: 568143 - RNA, 15 nt, Homo sapiens
cuacacauacagaaa

SEQ ID NO: 568144 - RNA, 15 nt, Homo sapiens
cuacacccagcaaua

SEQ ID NO: 568145 - RNA, 15 nt, Homo sapiens
cuacagaaauugaaa

SEQ ID NO: 568146 - RNA, 16 nt, Homo sapiens
cuacagacuccaaaag

SEQ ID NO: 568147 - RNA, 17 nt, Homo sapiens
cuacagacuccaaaagg

SEQ ID NO: 568148 - RNA, 20 nt, Homo sapiens
cuacagacuccaaaaggccc

SEQ ID NO: 568149 - RNA, 19 nt, Homo sapiens
cuacagauauuaauguuaa

SEQ ID NO: 568150 - RNA, 20 nt, Homo sapiens
cuacaggaagcaccccaugc

SEQ ID NO: 568151 - RNA, 19 nt, Homo sapiens
cuacaggacugguacucaa

SEQ ID NO: 568152 - RNA, 23 nt, Homo sapiens
cuacagggcgagacucugucuca

SEQ ID NO: 568153 - RNA, 15 nt, Homo sapiens
cuacaguaacuguga

SEQ ID NO: 568154 - RNA, 19 nt, Homo sapiens
cuacaguaacugugacuga

SEQ ID NO: 568155 - RNA, 16 nt, Homo sapiens
cuacaguacaaucagc

SEQ ID NO: 568156 - RNA, 20 nt, Homo sapiens
cuacagugccaacuccucac

SEQ ID NO: 568157 - RNA, 12 nt, Homo sapiens
cuacaguuauua

SEQ ID NO: 568158 - RNA, 15 nt, Homo sapiens
cuacaguuguaauaa

SEQ ID NO: 568159 - RNA, 14 nt, Homo sapiens
cuacauauaugcaa

SEQ ID NO: 568160 - RNA, 13 nt, Homo sapiens
gcugccacagcaa

SEQ ID NO: 568161 - RNA, 20 nt, Homo sapiens
gcugccagaugauuguucaa

SEQ ID NO: 568162 - RNA, 18 nt, Homo sapiens
gcugccagcucuguauca

SEQ ID NO: 568163 - RNA, 20 nt, Homo sapiens
gcugccauauuguagcucaa

SEQ ID NO: 568164 - RNA, 12 nt, Homo sapiens
gcugccaucacc

SEQ ID NO: 568165 - RNA, 20 nt, Homo sapiens
gcugccaugccacugccagg

SEQ ID NO: 568166 - RNA, 15 nt, Homo sapiens
gcugccccaccugcc

SEQ ID NO: 568167 - RNA, 16 nt, Homo sapiens
gcugccccaccugccg

SEQ ID NO: 568168 - RNA, 18 nt, Homo sapiens
gcugcccuagcugacccc

SEQ ID NO: 568169 - RNA, 14 nt, Homo sapiens
gcugccuaguggga

SEQ ID NO: 568170 - RNA, 15 nt, Homo sapiens
gcugccucacuuccu

SEQ ID NO: 568171 - RNA, 21 nt, Homo sapiens
gcugccugcaaugcagggcau

SEQ ID NO: 568172 - RNA, 15 nt, Homo sapiens
gcugccugcacugga

SEQ ID NO: 568173 - RNA, 14 nt, Homo sapiens
gcugccugccuugg

SEQ ID NO: 568174 - RNA, 17 nt, Homo sapiens
gcugccugcugugcugg

SEQ ID NO: 568175 - RNA, 14 nt, Homo sapiens
gcugccuggcacag

SEQ ID NO: 568176 - RNA, 17 nt, Homo sapiens
gcugccuggcacagacc

SEQ ID NO: 568177 - RNA, 15 nt, Homo sapiens
gcugccuggggccca

SEQ ID NO: 568178 - RNA, 20 nt, Homo sapiens
gcugccugguauauccaaaa

SEQ ID NO: 568179 - RNA, 23 nt, Homo sapiens
gcugccuucccuagcuuuagacc

SEQ ID NO: 568180 - RNA, 22 nt, Homo sapiens
gcugccuuguuucaccuuccau

SEQ ID NO: 568181 - RNA, 21 nt, Homo sapiens
gcugccuuuggaaguccagag

SEQ ID NO: 568182 - RNA, 20 nt, Homo sapiens
gcugcggggggcaccagagg

SEQ ID NO: 568183 - RNA, 15 nt, Homo sapiens
gcugcgucugcaaag

SEQ ID NO: 568184 - RNA, 18 nt, Homo sapiens
gcugcguugacuacugcu

SEQ ID NO: 568185 - RNA, 15 nt, Homo sapiens
gcugcuaaaggacag

SEQ ID NO: 568186 - RNA, 18 nt, Homo sapiens
gcugcuacuacuccugua

SEQ ID NO: 568187 - RNA, 13 nt, Homo sapiens
gcugcuccagugc

SEQ ID NO: 568188 - RNA, 16 nt, Homo sapiens
gcugcuccagugcagg

SEQ ID NO: 568189 - RNA, 13 nt, Homo sapiens
gcugcucucaggc

SEQ ID NO: 568190 - RNA, 14 nt, Homo sapiens
gcugcucugugguc

SEQ ID NO: 568191 - RNA, 13 nt, Homo sapiens
gcugcucuuccca

SEQ ID NO: 568192 - RNA, 15 nt, Homo sapiens
gcugcugccuggcca

SEQ ID NO: 568193 - RNA, 11 nt, Homo sapiens
gcugcugcuac

SEQ ID NO: 568194 - RNA, 12 nt, Homo sapiens
gcugcugcugcc

SEQ ID NO: 568195 - RNA, 16 nt, Homo sapiens
gcugcuggagugcagu

SEQ ID NO: 568196 - RNA, 14 nt, Homo sapiens
gcugcugugcacau

SEQ ID NO: 568197 - RNA, 12 nt, Homo sapiens
gcugcuuuccag

SEQ ID NO: 568198 - RNA, 14 nt, Homo sapiens
gcugcuuuguucaa

SEQ ID NO: 568199 - RNA, 12 nt, Homo sapiens
gcuggaaccugc

SEQ ID NO: 568200 - RNA, 23 nt, Homo sapiens
gcuggaauuacaaaacucagaga

SEQ ID NO: 568201 - RNA, 16 nt, Homo sapiens
gcuggaauuucugcug

SEQ ID NO: 568202 - RNA, 18 nt, Homo sapiens
gcuggacuucuaccugcc

SEQ ID NO: 568203 - RNA, 17 nt, Homo sapiens
gcuggagagaacccaga

SEQ ID NO: 568204 - RNA, 23 nt, Homo sapiens
gcuggagagagauucuguugcau

SEQ ID NO: 568205 - RNA, 22 nt, Homo sapiens
gcuggagcggggaucugaugaa

SEQ ID NO: 568206 - RNA, 17 nt, Homo sapiens
gcuggaggaaguggggu

SEQ ID NO: 568207 - RNA, 21 nt, Homo sapiens
gcuggagguugagcucuucuu

SEQ ID NO: 568208 - RNA, 15 nt, Homo sapiens
gcuggaguccagugc

SEQ ID NO: 568209 - RNA, 17 nt, Homo sapiens
gcuggagucgggacuaa

SEQ ID NO: 568210 - RNA, 19 nt, Homo sapiens
gcuggagugcaguggugca

SEQ ID NO: 568211 - RNA, 20 nt, Homo sapiens
gcuggagugcaguggugcaa

SEQ ID NO: 568212 - RNA, 16 nt, Homo sapiens
gcuggcaagcagggaa

SEQ ID NO: 568213 - RNA, 21 nt, Homo sapiens
gcuggcaccuuaguugcauga

SEQ ID NO: 568214 - RNA, 13 nt, Homo sapiens
gcuggcagugaca

SEQ ID NO: 568215 - RNA, 15 nt, Homo sapiens
gcuggcaucaagagg

SEQ ID NO: 568216 - RNA, 21 nt, Homo sapiens
gcuggccaugaaucucugccu

SEQ ID NO: 568217 - RNA, 17 nt, Homo sapiens
gcuggccccuucugggg

SEQ ID NO: 568218 - RNA, 21 nt, Homo sapiens
gcuggccuccuaugccucauc

SEQ ID NO: 568219 - RNA, 19 nt, Homo sapiens
gcuggccucucuagcacaa

SEQ ID NO: 568220 - RNA, 18 nt, Homo sapiens
gcuggcuagcauuccuca

SEQ ID NO: 568221 - RNA, 16 nt, Homo sapiens
gcuggcucccagggug

SEQ ID NO: 568222 - RNA, 20 nt, Homo sapiens
gcuggcuggaaaaaggugaa

SEQ ID NO: 568223 - RNA, 22 nt, Homo sapiens
gcuggcuggaaaaaggugaaug

SEQ ID NO: 568224 - RNA, 23 nt, Homo sapiens
gcugggaacaugacccagccuga

SEQ ID NO: 568225 - RNA, 22 nt, Homo sapiens
gcugggaagacgccugagcuca

SEQ ID NO: 568226 - RNA, 14 nt, Homo sapiens
gcugggacugagaa

SEQ ID NO: 568227 - RNA, 13 nt, Homo sapiens
gcugggagacaca

SEQ ID NO: 568228 - RNA, 18 nt, Homo sapiens
gcugggaguccuuaccuc

SEQ ID NO: 568229 - RNA, 13 nt, Homo sapiens
gcugggauuacag

SEQ ID NO: 568230 - RNA, 18 nt, Homo sapiens
gcugggauuacaggcgcc

SEQ ID NO: 568231 - RNA, 16 nt, Homo sapiens
gcugggauugugggca

SEQ ID NO: 568232 - RNA, 22 nt, Homo sapiens
gcugggcgugcuagagguugca

SEQ ID NO: 568233 - RNA, 22 nt, Homo sapiens
gcugggcugucucucccuucca

SEQ ID NO: 568234 - RNA, 13 nt, Homo sapiens
gcuggggaaauca

SEQ ID NO: 568235 - RNA, 21 nt, Homo sapiens
gcuggggcuucaccagucugu

SEQ ID NO: 568236 - RNA, 23 nt, Homo sapiens
gcugggucaggcagggugcagua

SEQ ID NO: 568237 - RNA, 22 nt, Homo sapiens
gcugggucuucaaggaucuccu

SEQ ID NO: 568238 - RNA, 14 nt, Homo sapiens
gcugggugugacca

SEQ ID NO: 568239 - RNA, 15 nt, Homo sapiens
gcuggguuauucaga

SEQ ID NO: 568240 - RNA, 18 nt, Homo sapiens
gcugguaacaguggcugc

SEQ ID NO: 568241 - RNA, 13 nt, Homo sapiens
gcuggucuucaau

SEQ ID NO: 568242 - RNA, 19 nt, Homo sapiens
gcugguugaaaaauggcaa

SEQ ID NO: 568243 - RNA, 21 nt, Homo sapiens
gcuguaaaaauguuacgugaa

SEQ ID NO: 568244 - RNA, 20 nt, Homo sapiens
gcuguaaccgauaugcacuu

SEQ ID NO: 568245 - RNA, 20 nt, Homo sapiens
gcuguaacguggcacuggua

SEQ ID NO: 568246 - RNA, 14 nt, Homo sapiens
gcuguaacuacuuu

SEQ ID NO: 568247 - RNA, 18 nt, Homo sapiens
gcuguaaucccagcacuu

SEQ ID NO: 568248 - RNA, 21 nt, Homo sapiens
gcuguacccagagaguccugu

SEQ ID NO: 568249 - RNA, 22 nt, Homo sapiens
gcuguagcucccgagcuacucu

SEQ ID NO: 568250 - RNA, 13 nt, Homo sapiens
gcuguauauucaa

SEQ ID NO: 568251 - RNA, 16 nt, Homo sapiens
gcuguauguaaacugu

SEQ ID NO: 568252 - RNA, 14 nt, Homo sapiens
gcugucacuuccca

SEQ ID NO: 568253 - RNA, 20 nt, Homo sapiens
gcugucaguaugacauuuca

SEQ ID NO: 568254 - RNA, 13 nt, Homo sapiens
gcuguccacauga

SEQ ID NO: 568255 - RNA, 18 nt, Homo sapiens
gcuguccagguucugucu

SEQ ID NO: 568256 - RNA, 22 nt, Homo sapiens
gcugucccucauggagaccuca

SEQ ID NO: 568257 - RNA, 15 nt, Homo sapiens
gcugucccugcacug

SEQ ID NO: 568258 - RNA, 22 nt, Homo sapiens
gcuguccugaaccgacugaccc

SEQ ID NO: 568259 - RNA, 16 nt, Homo sapiens
gcugucgacuucauga

SEQ ID NO: 568260 - RNA, 15 nt, Homo sapiens
gcugucuacuggaca

SEQ ID NO: 568261 - RNA, 23 nt, Homo sapiens
ccccuucccuguccuugcccuuu

SEQ ID NO: 568262 - RNA, 15 nt, Homo sapiens
ccccuuccuggacac

SEQ ID NO: 568263 - RNA, 16 nt, Homo sapiens
ccccuuguugcacugc

SEQ ID NO: 568264 - RNA, 17 nt, Homo sapiens
ccccuuuggcacuggau

SEQ ID NO: 568265 - RNA, 16 nt, Homo sapiens
ccccuuuucugcauuu

SEQ ID NO: 568266 - RNA, 16 nt, Homo sapiens
cccgacagugccaucc

SEQ ID NO: 568267 - RNA, 15 nt, Homo sapiens
cccgacugccugucu

SEQ ID NO: 568268 - RNA, 19 nt, Homo sapiens
cccgagcugggggccauga

SEQ ID NO: 568269 - RNA, 16 nt, Homo sapiens
cccgaugcaggggaug

SEQ ID NO: 568270 - RNA, 18 nt, Homo sapiens
cccgaugcugcuauggaa

SEQ ID NO: 568271 - RNA, 16 nt, Homo sapiens
cccgcaggguccaaag

SEQ ID NO: 568272 - RNA, 18 nt, Homo sapiens
cccgcaguugugccaaag

SEQ ID NO: 568273 - RNA, 22 nt, Homo sapiens
cccgccgccugguacucaagcc

SEQ ID NO: 568274 - RNA, 14 nt, Homo sapiens
cccgcggguucuag

SEQ ID NO: 568275 - RNA, 17 nt, Homo sapiens
cccggagaaacugaggu

SEQ ID NO: 568276 - RNA, 14 nt, Homo sapiens
cccggcacuuccga

SEQ ID NO: 568277 - RNA, 14 nt, Homo sapiens
cccgggcugccugg

SEQ ID NO: 568278 - RNA, 16 nt, Homo sapiens
cccggggccagcacuu

SEQ ID NO: 568279 - RNA, 15 nt, Homo sapiens
cccguacuagguugg

SEQ ID NO: 568280 - RNA, 14 nt, Homo sapiens
cccgucauguuccu

SEQ ID NO: 568281 - RNA, 20 nt, Homo sapiens
cccgucauguuccucaaaag

SEQ ID NO: 568282 - RNA, 13 nt, Homo sapiens
cgcgauucaggac

SEQ ID NO: 568283 - RNA, 20 nt, Homo sapiens
cgcgcaccuguaaucccagc

SEQ ID NO: 568284 - RNA, 13 nt, Homo sapiens
cgcgcaccuguag

SEQ ID NO: 568285 - RNA, 12 nt, Homo sapiens
cgcgcucgccca

SEQ ID NO: 568286 - RNA, 18 nt, Homo sapiens
cgcgggaggcaccagcuc

SEQ ID NO: 568287 - RNA, 20 nt, Homo sapiens
cgcguggcauccugugaccg

SEQ ID NO: 568288 - RNA, 19 nt, Homo sapiens
cgcuaaagggaccaucugc

SEQ ID NO: 568289 - RNA, 19 nt, Homo sapiens
cgcuacccaccuccaggga

SEQ ID NO: 568290 - RNA, 15 nt, Homo sapiens
cgcuagcauuuccca

SEQ ID NO: 568291 - RNA, 14 nt, Homo sapiens
cgcuccacagagau

SEQ ID NO: 568292 - RNA, 15 nt, Homo sapiens
cgcuccacagagaua

SEQ ID NO: 568293 - RNA, 15 nt, Homo sapiens
cgcuccaguaucucc

SEQ ID NO: 568294 - RNA, 13 nt, Homo sapiens
cgcucccuuucag

SEQ ID NO: 568295 - RNA, 22 nt, Homo sapiens
cgcuccuuugugugugugucag

SEQ ID NO: 568296 - RNA, 17 nt, Homo sapiens
cgcucgaugacugugaa

SEQ ID NO: 568297 - RNA, 14 nt, Homo sapiens
cgcucgcugccauc

SEQ ID NO: 568298 - RNA, 13 nt, Homo sapiens
cgcugacucuggg

SEQ ID NO: 568299 - RNA, 22 nt, Homo sapiens
cgcugagcgaggagaugcuccu

SEQ ID NO: 568300 - RNA, 22 nt, Homo sapiens
cgcugagcgucacggccaagug

SEQ ID NO: 568301 - RNA, 18 nt, Homo sapiens
cgcugugucagcauagaa

SEQ ID NO: 568302 - RNA, 13 nt, Homo sapiens
cgcuuauguuaau

SEQ ID NO: 568303 - RNA, 22 nt, Homo sapiens
cgcuucuccaaugcucuggagu

SEQ ID NO: 568304 - RNA, 12 nt, Homo sapiens
cgcuucuugccu

SEQ ID NO: 568305 - RNA, 14 nt, Homo sapiens
cggaaacaggugug

SEQ ID NO: 568306 - RNA, 14 nt, Homo sapiens
cggaacauguaaaa

SEQ ID NO: 568307 - RNA, 16 nt, Homo sapiens
cggacagccaggagcu

SEQ ID NO: 568308 - RNA, 23 nt, Homo sapiens
cggacaugaaaggacccugugag

SEQ ID NO: 568309 - RNA, 15 nt, Homo sapiens
cggacgccaccugcg

SEQ ID NO: 568310 - RNA, 19 nt, Homo sapiens
cggacucaccaacuugcca

SEQ ID NO: 568311 - RNA, 17 nt, Homo sapiens
cggacugucaguucucu

SEQ ID NO: 568312 - RNA, 20 nt, Homo sapiens
cggagaaacgggugagcuga

SEQ ID NO: 568313 - RNA, 15 nt, Homo sapiens
cggagauuuugaaca

SEQ ID NO: 568314 - RNA, 11 nt, Homo sapiens
cggaggucucu

SEQ ID NO: 568315 - RNA, 16 nt, Homo sapiens
cggagguugcagugag

SEQ ID NO: 568316 - RNA, 18 nt, Homo sapiens
cggagucuguaaaaccag

SEQ ID NO: 568317 - RNA, 17 nt, Homo sapiens
cggagucuugcucuguu

SEQ ID NO: 568318 - RNA, 18 nt, Homo sapiens
cggaguggacaccgcuca

SEQ ID NO: 568319 - RNA, 15 nt, Homo sapiens
cggauacacacucga

SEQ ID NO: 568320 - RNA, 22 nt, Homo sapiens
cggauugcucuggagcagccaa

SEQ ID NO: 568321 - RNA, 13 nt, Homo sapiens
cggcaacaucucu

SEQ ID NO: 568322 - RNA, 14 nt, Homo sapiens
cggcaacaucucug

SEQ ID NO: 568323 - RNA, 15 nt, Homo sapiens
cggcaaccacauguc

SEQ ID NO: 568324 - RNA, 17 nt, Homo sapiens
cggcaagcgagcacagu

SEQ ID NO: 568325 - RNA, 19 nt, Homo sapiens
cggcaaugcccugugcaug

SEQ ID NO: 568326 - RNA, 15 nt, Homo sapiens
cggcagcauucucca

SEQ ID NO: 568327 - RNA, 18 nt, Homo sapiens
cggcagccccccccucaa

SEQ ID NO: 568328 - RNA, 21 nt, Homo sapiens
cggcagggugucccaggagcc

SEQ ID NO: 568329 - RNA, 19 nt, Homo sapiens
cggccacauuugguucuaa

SEQ ID NO: 568330 - RNA, 18 nt, Homo sapiens
cggccacucuaccugaac

SEQ ID NO: 568331 - RNA, 19 nt, Homo sapiens
cggccaggcuggagugcag

SEQ ID NO: 568332 - RNA, 23 nt, Homo sapiens
cggccagguugugucccaaaauc

SEQ ID NO: 568333 - RNA, 19 nt, Homo sapiens
cggccuugaagacagagca

SEQ ID NO: 568334 - RNA, 23 nt, Homo sapiens
cggcgcaugccugcaaucccagc

SEQ ID NO: 568335 - RNA, 21 nt, Homo sapiens
cggcgccacagaccccggguc

SEQ ID NO: 568336 - RNA, 20 nt, Homo sapiens
cggcggcucugagcaggggc

SEQ ID NO: 568337 - RNA, 14 nt, Homo sapiens
cggcuacucuggaa

SEQ ID NO: 568338 - RNA, 15 nt, Homo sapiens
cggcuacucuggaau

SEQ ID NO: 568339 - RNA, 14 nt, Homo sapiens
cggcucacugcaaa

SEQ ID NO: 568340 - RNA, 17 nt, Homo sapiens
cggcucucaccaguggc

SEQ ID NO: 568341 - RNA, 22 nt, Homo sapiens
cggcugccuagcccucccccca

SEQ ID NO: 568342 - RNA, 18 nt, Homo sapiens
cggcugcggggggcacca

SEQ ID NO: 568343 - RNA, 13 nt, Homo sapiens
cggcuguggagca

SEQ ID NO: 568344 - RNA, 22 nt, Homo sapiens
cggcuguugauacgauugucug

SEQ ID NO: 568345 - RNA, 21 nt, Homo sapiens
cgggaagcaagaugugaaaga

SEQ ID NO: 568346 - RNA, 21 nt, Homo sapiens
cgggaagcgaugaauuuggag

SEQ ID NO: 568347 - RNA, 18 nt, Homo sapiens
cgggaccaauacuacuga

SEQ ID NO: 568348 - RNA, 20 nt, Homo sapiens
cgggagaccccuuguugcac

SEQ ID NO: 568349 - RNA, 20 nt, Homo sapiens
cgggagacugacacgaagcc

SEQ ID NO: 568350 - RNA, 13 nt, Homo sapiens
cgggagcacugcg

SEQ ID NO: 568351 - RNA, 17 nt, Homo sapiens
cgggagccuaggaccac

SEQ ID NO: 568352 - RNA, 22 nt, Homo sapiens
cgggaggguuccgccacuccag

SEQ ID NO: 568353 - RNA, 16 nt, Homo sapiens
cgggauccagcucauc

SEQ ID NO: 568354 - RNA, 21 nt, Homo sapiens
cgggcaccaacuccauguuug

SEQ ID NO: 568355 - RNA, 21 nt, Homo sapiens
cgggcaggguguggggccaug

SEQ ID NO: 568356 - RNA, 21 nt, Homo sapiens
cgggccuggagaacuagagaa

SEQ ID NO: 568357 - RNA, 19 nt, Homo sapiens
cgggcgucaggggugcaca

SEQ ID NO: 568358 - RNA, 18 nt, Homo sapiens
cgggcuccagccaucuca

SEQ ID NO: 568359 - RNA, 20 nt, Homo sapiens
cgggcucccuccucuggcag

SEQ ID NO: 568360 - RNA, 16 nt, Homo sapiens
cgggcuuaccagguga

SEQ ID NO: 568361 - RNA, 14 nt, Homo sapiens
cggggacccuguga

SEQ ID NO: 568362 - RNA, 20 nt, Homo sapiens
cggggaggcuccugccugag

SEQ ID NO: 568363 - RNA, 18 nt, Homo sapiens
cggggccagcacuuccau

SEQ ID NO: 568364 - RNA, 13 nt, Homo sapiens
cggggcccaggac

SEQ ID NO: 568365 - RNA, 18 nt, Homo sapiens
cgggggaccccuuugccc

SEQ ID NO: 568366 - RNA, 13 nt, Homo sapiens
cgggggccugcaa

SEQ ID NO: 568367 - RNA, 23 nt, Homo sapiens
cgggguauucccacucaccagcc

SEQ ID NO: 568368 - RNA, 23 nt, Homo sapiens
cgggucacccugugacccucuca

SEQ ID NO: 568369 - RNA, 11 nt, Homo sapiens
cgggucacugc

SEQ ID NO: 568370 - RNA, 21 nt, Homo sapiens
cggguccccaaaccuguuccc

SEQ ID NO: 568371 - RNA, 18 nt, Homo sapiens
cgggucuauggggagaaa

SEQ ID NO: 568372 - RNA, 17 nt, Homo sapiens
cgggucucaacuuuaag

SEQ ID NO: 568373 - RNA, 20 nt, Homo sapiens
cgggugguccgggaagugag

SEQ ID NO: 568374 - RNA, 12 nt, Homo sapiens
cgggugugcuau

SEQ ID NO: 568375 - RNA, 13 nt, Homo sapiens
cggguguguacac

SEQ ID NO: 568376 - RNA, 22 nt, Homo sapiens
cgguacuaguucagacacuuug

SEQ ID NO: 568377 - RNA, 22 nt, Homo sapiens
cggucauuugaaugagaccugg

SEQ ID NO: 568378 - RNA, 11 nt, Homo sapiens
cgguccagcug

SEQ ID NO: 568379 - RNA, 14 nt, Homo sapiens
cggucccacacugg

SEQ ID NO: 568380 - RNA, 17 nt, Homo sapiens
cggucccacacugguga

SEQ ID NO: 568381 - RNA, 20 nt, Homo sapiens
cggucccaguuuuguugccc

SEQ ID NO: 568382 - RNA, 16 nt, Homo sapiens
cggucccugucccucu

SEQ ID NO: 568383 - RNA, 16 nt, Homo sapiens
cggucucauuucuucu

SEQ ID NO: 568384 - RNA, 12 nt, Homo sapiens
cggucuugcaaa

SEQ ID NO: 568385 - RNA, 22 nt, Homo sapiens
cggugaaaccccgucucuacua

SEQ ID NO: 568386 - RNA, 20 nt, Homo sapiens
cggugacacaggucagggcu

SEQ ID NO: 568387 - RNA, 22 nt, Homo sapiens
cggugcucuggaagaccugaaa

SEQ ID NO: 568388 - RNA, 14 nt, Homo sapiens
cgguggccacagcg

SEQ ID NO: 568389 - RNA, 21 nt, Homo sapiens
cgguggggcguagacuugaca

SEQ ID NO: 568390 - RNA, 22 nt, Homo sapiens
cgguguucugucccagugcggu

SEQ ID NO: 568391 - RNA, 22 nt, Homo sapiens
cgguuggaaauagaaauuucca

SEQ ID NO: 568392 - RNA, 15 nt, Homo sapiens
cgguuuggaguaauc

SEQ ID NO: 568393 - RNA, 16 nt, Homo sapiens
cgguuugucaguucuu

SEQ ID NO: 568394 - RNA, 19 nt, Homo sapiens
cgguuuuauaaaagccuug

SEQ ID NO: 568395 - RNA, 13 nt, Homo sapiens
cguaaagauuugg

SEQ ID NO: 568396 - RNA, 16 nt, Homo sapiens
cguaagggaucuuccu

SEQ ID NO: 568397 - RNA, 18 nt, Homo sapiens
cguaccaccaugcacugu

SEQ ID NO: 568398 - RNA, 20 nt, Homo sapiens
cguagacugauggaacagaa

SEQ ID NO: 568399 - RNA, 11 nt, Homo sapiens
cguagccucag

SEQ ID NO: 568400 - RNA, 19 nt, Homo sapiens
cguagcuccauauuggaca

SEQ ID NO: 568401 - RNA, 14 nt, Homo sapiens
cguaguucccugaa

SEQ ID NO: 568402 - RNA, 16 nt, Homo sapiens
cguauaaugcuuucug

SEQ ID NO: 568403 - RNA, 19 nt, Homo sapiens
cauuuugcaaaauuuccag

SEQ ID NO: 568404 - RNA, 22 nt, Homo sapiens
cauuuuggaaguuuucaggacu

SEQ ID NO: 568405 - RNA, 21 nt, Homo sapiens
cauuuuguaaguugaagcaaa

SEQ ID NO: 568406 - RNA, 14 nt, Homo sapiens
cauuuuguaauaau

SEQ ID NO: 568407 - RNA, 20 nt, Homo sapiens
cauuuuguuaaaaucuacuu

SEQ ID NO: 568408 - RNA, 21 nt, Homo sapiens
cauuuuuaacagcaugcugcu

SEQ ID NO: 568409 - RNA, 21 nt, Homo sapiens
cauuuuuaagauagaacacaa

SEQ ID NO: 568410 - RNA, 23 nt, Homo sapiens
cauuuuuaccuuguggaugcuag

SEQ ID NO: 568411 - RNA, 22 nt, Homo sapiens
cauuuuuagagaaguaaaacau

SEQ ID NO: 568412 - RNA, 21 nt, Homo sapiens
cauuuuuauaaaaaugagugc

SEQ ID NO: 568413 - RNA, 16 nt, Homo sapiens
cauuuuuuagucugua

SEQ ID NO: 568414 - RNA, 23 nt, Homo sapiens
ccaaaaaaaaauacaugcuaaga

SEQ ID NO: 568415 - RNA, 16 nt, Homo sapiens
ccaaaaagagacugau

SEQ ID NO: 568416 - RNA, 20 nt, Homo sapiens
ccaaaaagagacugaucauc

SEQ ID NO: 568417 - RNA, 16 nt, Homo sapiens
ccaaaaauugccaagu

SEQ ID NO: 568418 - RNA, 18 nt, Homo sapiens
ccaaaacaaacaaacaga

SEQ ID NO: 568419 - RNA, 12 nt, Homo sapiens
ccaaaacacagg

SEQ ID NO: 568420 - RNA, 20 nt, Homo sapiens
ccaaaacauauucaaagcag

SEQ ID NO: 568421 - RNA, 14 nt, Homo sapiens
ccaaaacauccacu

SEQ ID NO: 568422 - RNA, 13 nt, Homo sapiens
ccaaaacauuucu

SEQ ID NO: 568423 - RNA, 16 nt, Homo sapiens
ccaaaacuaguucaaa

SEQ ID NO: 568424 - RNA, 22 nt, Homo sapiens
ccaaaagacagucgagaagcca

SEQ ID NO: 568425 - RNA, 22 nt, Homo sapiens
ccaaaagggccauguuucaaga

SEQ ID NO: 568426 - RNA, 14 nt, Homo sapiens
ccaaaauacagcua

SEQ ID NO: 568427 - RNA, 18 nt, Homo sapiens
ccaaaauauuaacauucu

SEQ ID NO: 568428 - RNA, 18 nt, Homo sapiens
ccaaaauauuuuuugcaa

SEQ ID NO: 568429 - RNA, 17 nt, Homo sapiens
ccaaaauuaccaaaaau

SEQ ID NO: 568430 - RNA, 20 nt, Homo sapiens
ccaaaauuaccaaaaaucuu

SEQ ID NO: 568431 - RNA, 17 nt, Homo sapiens
ccaaacagaacuaugga

SEQ ID NO: 568432 - RNA, 17 nt, Homo sapiens
ccaaacauccuacaaga

SEQ ID NO: 568433 - RNA, 14 nt, Homo sapiens
ccaaacauuacaaa

SEQ ID NO: 568434 - RNA, 23 nt, Homo sapiens
ccaaaccaauucaccaacacagu

SEQ ID NO: 568435 - RNA, 13 nt, Homo sapiens
ccaaacgcuuauu

SEQ ID NO: 568436 - RNA, 22 nt, Homo sapiens
ccaaacggaagacuacagcaug

SEQ ID NO: 568437 - RNA, 14 nt, Homo sapiens
ccaaacucugccag

SEQ ID NO: 568438 - RNA, 15 nt, Homo sapiens
ccaaacucugccagc

SEQ ID NO: 568439 - RNA, 21 nt, Homo sapiens
gaaaaguuaacacaaguacua

SEQ ID NO: 568440 - RNA, 22 nt, Homo sapiens
gaaaaguuagucaauccuguca

SEQ ID NO: 568441 - RNA, 23 nt, Homo sapiens
gaaaaguuagucaauccugucau

SEQ ID NO: 568442 - RNA, 19 nt, Homo sapiens
gaaaaguuauuagugguuu

SEQ ID NO: 568443 - RNA, 14 nt, Homo sapiens
gaaaaguucaggga

SEQ ID NO: 568444 - RNA, 18 nt, Homo sapiens
gaaaaguugggcuuucac

SEQ ID NO: 568445 - RNA, 14 nt, Homo sapiens
gaaaauaaacugac

SEQ ID NO: 568446 - RNA, 13 nt, Homo sapiens
gaaaauaaagugu

SEQ ID NO: 568447 - RNA, 14 nt, Homo sapiens
gaaaauaacaaagc

SEQ ID NO: 568448 - RNA, 14 nt, Homo sapiens
gaaaauaauuugag

SEQ ID NO: 568449 - RNA, 18 nt, Homo sapiens
gaaaauacauaagaccau

SEQ ID NO: 568450 - RNA, 13 nt, Homo sapiens
gaaaauacaucuu

SEQ ID NO: 568451 - RNA, 18 nt, Homo sapiens
gaaaauaguucccuuugc

SEQ ID NO: 568452 - RNA, 14 nt, Homo sapiens
gaaaauaguuugca

SEQ ID NO: 568453 - RNA, 12 nt, Homo sapiens
gaaaauaugccu

SEQ ID NO: 568454 - RNA, 16 nt, Homo sapiens
gaaaauauggguugca

SEQ ID NO: 568455 - RNA, 12 nt, Homo sapiens
gaaaauauuuca

SEQ ID NO: 568456 - RNA, 18 nt, Homo sapiens
gaaaaucacuugccaaaa

SEQ ID NO: 568457 - RNA, 12 nt, Homo sapiens
gaaaauccagaa

SEQ ID NO: 568458 - RNA, 19 nt, Homo sapiens
gaaaauccccaacuaugca

SEQ ID NO: 568459 - RNA, 18 nt, Homo sapiens
gaaaaucucagcaaugau

SEQ ID NO: 568460 - RNA, 23 nt, Homo sapiens
gaaaaucuucauggaauucacaa

SEQ ID NO: 568461 - RNA, 20 nt, Homo sapiens
gaaaaucuuuaggcuuucaa

SEQ ID NO: 568462 - RNA, 22 nt, Homo sapiens
gaaaaucuuuauaugcaguaua

SEQ ID NO: 568463 - RNA, 16 nt, Homo sapiens
gaaaaugaaucuucac

SEQ ID NO: 568464 - RNA, 17 nt, Homo sapiens
gaaaaugaaucuucaca

SEQ ID NO: 568465 - RNA, 15 nt, Homo sapiens
gaaaaugacucuggg

SEQ ID NO: 568466 - RNA, 13 nt, Homo sapiens
gaaaaugcaaaag

SEQ ID NO: 568467 - RNA, 17 nt, Homo sapiens
gaaaaugccaugaaaau

SEQ ID NO: 568468 - RNA, 19 nt, Homo sapiens
gaaaaugcuauccagcaga

SEQ ID NO: 568469 - RNA, 18 nt, Homo sapiens
gaaaauggagccaugaca

SEQ ID NO: 568470 - RNA, 15 nt, Homo sapiens
gaaaauggcuuucuc

SEQ ID NO: 568471 - RNA, 11 nt, Homo sapiens
gaaaaugucag

SEQ ID NO: 568472 - RNA, 15 nt, Homo sapiens
gaaaaugugacccag

SEQ ID NO: 568473 - RNA, 14 nt, Homo sapiens
gaaaaugugcaaua

SEQ ID NO: 568474 - RNA, 20 nt, Homo sapiens
gaaaauguuacggcaucaca

SEQ ID NO: 568475 - RNA, 16 nt, Homo sapiens
gaaaauuaauccucac

SEQ ID NO: 568476 - RNA, 20 nt, Homo sapiens
gaaaauuagacugugauuca

SEQ ID NO: 568477 - RNA, 14 nt, Homo sapiens
gaaaauuauaucuc

SEQ ID NO: 568478 - RNA, 20 nt, Homo sapiens
gaaaauucaaaaaguguuua

SEQ ID NO: 568479 - RNA, 21 nt, Homo sapiens
gaaaauucuguagguucugug

SEQ ID NO: 568480 - RNA, 16 nt, Homo sapiens
gaaaauugaaugcaaa

SEQ ID NO: 568481 - RNA, 16 nt, Homo sapiens
gaaaauugcaauacau

SEQ ID NO: 568482 - RNA, 15 nt, Homo sapiens
gaaacaaacauggau

SEQ ID NO: 568483 - RNA, 17 nt, Homo sapiens
gaaacaaaucucaaagu

SEQ ID NO: 568484 - RNA, 23 nt, Homo sapiens
gaaacaaauguguauaaacugcu

SEQ ID NO: 568485 - RNA, 14 nt, Homo sapiens
gaaacaacagggga

SEQ ID NO: 568486 - RNA, 13 nt, Homo sapiens
gaaacaacucuuu

SEQ ID NO: 568487 - RNA, 20 nt, Homo sapiens
gaaacacacaagcaacaaac

SEQ ID NO: 568488 - RNA, 14 nt, Homo sapiens
gaaacacacgugcu

SEQ ID NO: 568489 - RNA, 17 nt, Homo sapiens
gaaacacaugccaguuu

SEQ ID NO: 568490 - RNA, 18 nt, Homo sapiens
gaaacacguaucccaccu

SEQ ID NO: 568491 - RNA, 17 nt, Homo sapiens
gaaacacugcugcccuc

SEQ ID NO: 568492 - RNA, 11 nt, Homo sapiens
gaaacacugga

SEQ ID NO: 568493 - RNA, 16 nt, Homo sapiens
gaaacacugugcaaag

SEQ ID NO: 568494 - RNA, 19 nt, Homo sapiens
gaaacaguugguaacuuuu

SEQ ID NO: 568495 - RNA, 16 nt, Homo sapiens
gaaacaugaagcauaa

SEQ ID NO: 568496 - RNA, 22 nt, Homo sapiens
gaaacaugcaagauacaggaaa

SEQ ID NO: 568497 - RNA, 18 nt, Homo sapiens
gaaacaugccagaaggaa

SEQ ID NO: 568498 - RNA, 16 nt, Homo sapiens
gaaacauuagugaaaa

SEQ ID NO: 568499 - RNA, 10 nt, Homo sapiens
gaaacauuca

SEQ ID NO: 568500 - RNA, 23 nt, Homo sapiens
gaaacauucauuuuuaccuugug

SEQ ID NO: 568501 - RNA, 16 nt, Homo sapiens
gaaacauuccgaagag

SEQ ID NO: 568502 - RNA, 12 nt, Homo sapiens
gaaacauuucag

SEQ ID NO: 568503 - RNA, 23 nt, Homo sapiens
gaaacauuucagaagguaucagu

SEQ ID NO: 568504 - RNA, 18 nt, Homo sapiens
gaaacauuuccuuugaac

SEQ ID NO: 568505 - RNA, 17 nt, Homo sapiens
gaaacauuucugacacc

SEQ ID NO: 568506 - RNA, 18 nt, Homo sapiens
gaaacauuuuauacugua

SEQ ID NO: 568507 - RNA, 13 nt, Homo sapiens
gaaaccacaaccu

SEQ ID NO: 568508 - RNA, 18 nt, Homo sapiens
gaaaccagaaaagcaaua

SEQ ID NO: 568509 - RNA, 10 nt, Homo sapiens
gaaaccagag

SEQ ID NO: 568510 - RNA, 16 nt, Homo sapiens
gaaaccagagccuuuc

SEQ ID NO: 568511 - RNA, 23 nt, Homo sapiens
gaaaccccaucucuacuaaaaau

SEQ ID NO: 568512 - RNA, 14 nt, Homo sapiens
gaaaccccgucucu

SEQ ID NO: 568513 - RNA, 18 nt, Homo sapiens
gaaaccuacaagauuucc

SEQ ID NO: 568514 - RNA, 19 nt, Homo sapiens
gaaaccucugggucaucuc

SEQ ID NO: 568515 - RNA, 18 nt, Homo sapiens
gaaaccugcccugccuga

SEQ ID NO: 568516 - RNA, 11 nt, Homo sapiens
gaaaccuuuac

SEQ ID NO: 568517 - RNA, 14 nt, Homo sapiens
gaaacgccuugcac

SEQ ID NO: 568518 - RNA, 22 nt, Homo sapiens
gaaacggucacgagacccagag

SEQ ID NO: 568519 - RNA, 21 nt, Homo sapiens
gaaacguggauacagagccac

SEQ ID NO: 568520 - RNA, 22 nt, Homo sapiens
gaaacuaagagacaguucucug

SEQ ID NO: 568521 - RNA, 15 nt, Homo sapiens
gaaacuacauuucua

SEQ ID NO: 568522 - RNA, 21 nt, Homo sapiens
gaaacuaccaggugugccugg

SEQ ID NO: 568523 - RNA, 20 nt, Homo sapiens
gaaacuacugccuuuagaaa

SEQ ID NO: 568524 - RNA, 18 nt, Homo sapiens
gaaacuauaaguaauucu

SEQ ID NO: 568525 - RNA, 16 nt, Homo sapiens
gaacgucuccuagcca

SEQ ID NO: 568526 - RNA, 23 nt, Homo sapiens
gaacguguauguaccuaggauau

SEQ ID NO: 568527 - RNA, 19 nt, Homo sapiens
gaacuaacuuacuguccac

SEQ ID NO: 568528 - RNA, 20 nt, Homo sapiens
gaacuacagguguuugacuu

SEQ ID NO: 568529 - RNA, 17 nt, Homo sapiens
gaacuacauuaguacac

SEQ ID NO: 568530 - RNA, 17 nt, Homo sapiens
gaacuaccaucugaugu

SEQ ID NO: 568531 - RNA, 17 nt, Homo sapiens
gaacuaccccacaacac

SEQ ID NO: 568532 - RNA, 17 nt, Homo sapiens
gaacuacuuuuggugcu

SEQ ID NO: 568533 - RNA, 19 nt, Homo sapiens
gaacuacuuuuggugcuua

SEQ ID NO: 568534 - RNA, 16 nt, Homo sapiens
gaacuaggguaaggug

SEQ ID NO: 568535 - RNA, 14 nt, Homo sapiens
gaacucacuggggc

SEQ ID NO: 568536 - RNA, 22 nt, Homo sapiens
gaacucagagaugaacaucuaa

SEQ ID NO: 568537 - RNA, 22 nt, Homo sapiens
gaacuccacaugcuggugcaua

SEQ ID NO: 568538 - RNA, 20 nt, Homo sapiens
gaacuccaccgaccaacugc

SEQ ID NO: 568539 - RNA, 12 nt, Homo sapiens
gaacuccaggau

SEQ ID NO: 568540 - RNA, 23 nt, Homo sapiens
gaacuccaucauucauccaggac

SEQ ID NO: 568541 - RNA, 14 nt, Homo sapiens
gaacuccugaccuc

SEQ ID NO: 568542 - RNA, 14 nt, Homo sapiens
gaacucucuccacc

SEQ ID NO: 568543 - RNA, 19 nt, Homo sapiens
gaacucuuaggcacaucaa

SEQ ID NO: 568544 - RNA, 17 nt, Homo sapiens
gaacucuugacuuccug

SEQ ID NO: 568545 - RNA, 18 nt, Homo sapiens
gaacugaaguuucacaug

SEQ ID NO: 568546 - RNA, 16 nt, Homo sapiens
gaacugaaucacuuaa

SEQ ID NO: 568547 - RNA, 22 nt, Homo sapiens
gaacugacaggcagccuggaca

SEQ ID NO: 568548 - RNA, 16 nt, Homo sapiens
gaacugaucauguuua

SEQ ID NO: 568549 - RNA, 14 nt, Homo sapiens
gaacugcaacacug

SEQ ID NO: 568550 - RNA, 16 nt, Homo sapiens
gaacuggcaauugucu

SEQ ID NO: 568551 - RNA, 15 nt, Homo sapiens
gaacuguagggccag

SEQ ID NO: 568552 - RNA, 16 nt, Homo sapiens
gaacuguagggccagg

SEQ ID NO: 568553 - RNA, 16 nt, Homo sapiens
gaacugucagccucag

SEQ ID NO: 568554 - RNA, 12 nt, Homo sapiens
gaacugugccac

SEQ ID NO: 568555 - RNA, 15 nt, Homo sapiens
gaacuuaacacuccc

SEQ ID NO: 568556 - RNA, 17 nt, Homo sapiens
gaacuuaaccuugcaaa

SEQ ID NO: 568557 - RNA, 17 nt, Homo sapiens
gaacuuagauguuaaau

SEQ ID NO: 568558 - RNA, 13 nt, Homo sapiens
gaacuuccaacaa

SEQ ID NO: 568559 - RNA, 17 nt, Homo sapiens
gaacuugaacugauuca

SEQ ID NO: 568560 - RNA, 12 nt, Homo sapiens
gaacuugcacaa

SEQ ID NO: 568561 - RNA, 13 nt, Homo sapiens
gaacuugcacaaa

SEQ ID NO: 568562 - RNA, 22 nt, Homo sapiens
gaacuugcgaguccaaggccag

SEQ ID NO: 568563 - RNA, 18 nt, Homo sapiens
gaacuuggcacacucucc

SEQ ID NO: 568564 - RNA, 24 nt, Homo sapiens
gaacuuuaagcaacaagaccacca

SEQ ID NO: 568565 - RNA, 19 nt, Homo sapiens
gaacuuuagugaaacauaa

SEQ ID NO: 568566 - RNA, 21 nt, Homo sapiens
gaacuuuagugaaacauaaua

SEQ ID NO: 568567 - RNA, 19 nt, Homo sapiens
gaagaaaaaguacaaugaa

SEQ ID NO: 568568 - RNA, 22 nt, Homo sapiens
gaagaaaacaguacagaaggca

SEQ ID NO: 568569 - RNA, 20 nt, Homo sapiens
gaagaaaagcaugcauauca

SEQ ID NO: 568570 - RNA, 16 nt, Homo sapiens
gaagaaaagcugccau

SEQ ID NO: 568571 - RNA, 13 nt, Homo sapiens
gaagaaacacuuu

SEQ ID NO: 568572 - RNA, 14 nt, Homo sapiens
gaagaaacuggggc

SEQ ID NO: 568573 - RNA, 20 nt, Homo sapiens
gaagaaacuuugccucaaga

SEQ ID NO: 568574 - RNA, 20 nt, Homo sapiens
gaagaaagagcaacaaucca

SEQ ID NO: 568575 - RNA, 19 nt, Homo sapiens
gaagaaauuccaggaaaau

SEQ ID NO: 568576 - RNA, 15 nt, Homo sapiens
gaagaaauucuguca

SEQ ID NO: 568577 - RNA, 22 nt, Homo sapiens
gaagaacacagcaugugccaag

SEQ ID NO: 568578 - RNA, 13 nt, Homo sapiens
gaagaacauagaa

SEQ ID NO: 568579 - RNA, 17 nt, Homo sapiens
gaagaacauccaaggag

SEQ ID NO: 568580 - RNA, 18 nt, Homo sapiens
gaagaaccaaauaccuca

SEQ ID NO: 568581 - RNA, 13 nt, Homo sapiens
gaagaacuacagc

SEQ ID NO: 568582 - RNA, 19 nt, Homo sapiens
gaagaagaucaacgccuca

SEQ ID NO: 568583 - RNA, 23 nt, Homo sapiens
gaagaauaggcggggcacggugg

SEQ ID NO: 568584 - RNA, 23 nt, Homo sapiens
gaagaaugaucagcaucugugau

SEQ ID NO: 568585 - RNA, 17 nt, Homo sapiens
gaagacaaugacuuacu

SEQ ID NO: 568586 - RNA, 11 nt, Homo sapiens
gaagaccagcu

SEQ ID NO: 568587 - RNA, 23 nt, Homo sapiens
gaagaccaugccuaggaacauuu

SEQ ID NO: 568588 - RNA, 23 nt, Homo sapiens
gaagaccuccacauuaaguggcu

SEQ ID NO: 568589 - RNA, 16 nt, Homo sapiens
gaagacgccaaaaaca

SEQ ID NO: 568590 - RNA, 18 nt, Homo sapiens
gaagacguggacuccucu

SEQ ID NO: 568591 - RNA, 16 nt, Homo sapiens
gaagacuagaggccag

SEQ ID NO: 568592 - RNA, 20 nt, Homo sapiens
gaagacuccaguaugaaaau

SEQ ID NO: 568593 - RNA, 12 nt, Homo sapiens
gaagacuguggc

SEQ ID NO: 568594 - RNA, 18 nt, Homo sapiens
gaagacuugaagcacaga

SEQ ID NO: 568595 - RNA, 17 nt, Homo sapiens
gaagagaaagcacgugu

SEQ ID NO: 568596 - RNA, 16 nt, Homo sapiens
gaagagaagcugcuga

SEQ ID NO: 568597 - RNA, 23 nt, Homo sapiens
gaagagaauauuagcuuuacugu

SEQ ID NO: 568598 - RNA, 14 nt, Homo sapiens
gaagagacaggcac

SEQ ID NO: 568599 - RNA, 20 nt, Homo sapiens
gaagagaccuuggcugcuca

SEQ ID NO: 568600 - RNA, 17 nt, Homo sapiens
gaagagagagacccuca

SEQ ID NO: 568601 - RNA, 18 nt, Homo sapiens
gaagagauccuucuguaa

SEQ ID NO: 568602 - RNA, 16 nt, Homo sapiens
gaagagcgcaguguuu

SEQ ID NO: 568603 - RNA, 21 nt, Homo sapiens
gaagagcgcaguguuuugcaa

SEQ ID NO: 568604 - RNA, 15 nt, Homo sapiens
gaagaggaaagggag

SEQ ID NO: 568605 - RNA, 15 nt, Homo sapiens
gaagaggagaacaaa

SEQ ID NO: 568606 - RNA, 20 nt, Homo sapiens
gaagagggagaagcaugaaa

SEQ ID NO: 568607 - RNA, 14 nt, Homo sapiens
gaagauaaacacaa

SEQ ID NO: 568608 - RNA, 14 nt, Homo sapiens
gaagauaauuugca

SEQ ID NO: 568609 - RNA, 23 nt, Homo sapiens
gaagauacagagaugcaaugaua

SEQ ID NO: 568610 - RNA, 17 nt, Homo sapiens
gaagauagaacaaugcu

SEQ ID NO: 568611 - RNA, 23 nt, Homo sapiens
gaagaugacgaguaacuccccuc

SEQ ID NO: 568612 - RNA, 23 nt, Homo sapiens
gaagaugagccuugcagauaucu

SEQ ID NO: 568613 - RNA, 15 nt, Homo sapiens
gaagauggacauuuu

SEQ ID NO: 568614 - RNA, 16 nt, Homo sapiens
gaagauguguaaacag

SEQ ID NO: 568615 - RNA, 17 nt, Homo sapiens
gaagauuauaugaaguu

SEQ ID NO: 568616 - RNA, 23 nt, Homo sapiens
gaagauuguuggugaauuuucaa

SEQ ID NO: 568617 - RNA, 20 nt, Homo sapiens
gaagcaaaagaaacgugaga

SEQ ID NO: 568618 - RNA, 18 nt, Homo sapiens
gaagcaaacuaagccccc

SEQ ID NO: 568619 - RNA, 23 nt, Homo sapiens
gaagcaaagacaaaagaaacuua

SEQ ID NO: 568620 - RNA, 10 nt, Homo sapiens
gaagcaaagg

SEQ ID NO: 568621 - RNA, 23 nt, Homo sapiens
gaagcaaaucagaaacuugugaa

SEQ ID NO: 568622 - RNA, 14 nt, Homo sapiens
gaagcaaucuuuga

SEQ ID NO: 568623 - RNA, 16 nt, Homo sapiens
gaagcacauguguauu

SEQ ID NO: 568624 - RNA, 15 nt, Homo sapiens
gaagcagacuuuuca

SEQ ID NO: 568625 - RNA, 15 nt, Homo sapiens
gaagcagcugcagca

SEQ ID NO: 568626 - RNA, 23 nt, Homo sapiens
gaagcagggaauuccugggguaa

SEQ ID NO: 568627 - RNA, 17 nt, Homo sapiens
gaagcagucuugcucug

SEQ ID NO: 568628 - RNA, 15 nt, Homo sapiens
gaagcagugccuucc

SEQ ID NO: 568629 - RNA, 18 nt, Homo sapiens
gaagcauuugauuuucaa

SEQ ID NO: 568630 - RNA, 22 nt, Homo sapiens
gaagcauuuguauuuuguguga

SEQ ID NO: 568631 - RNA, 12 nt, Homo sapiens
gaagccaaagaa

SEQ ID NO: 568632 - RNA, 22 nt, Homo sapiens
gaagccaagucagcuuugccuu

SEQ ID NO: 568633 - RNA, 20 nt, Homo sapiens
gaagccaauaaaccuuccuu

SEQ ID NO: 568634 - RNA, 20 nt, Homo sapiens
gaagccagaaggugcagggg

SEQ ID NO: 568635 - RNA, 13 nt, Homo sapiens
gaagccauauuca

SEQ ID NO: 568636 - RNA, 19 nt, Homo sapiens
gaagccauauucacaccuc

SEQ ID NO: 568637 - RNA, 18 nt, Homo sapiens
gaagcccagcucugggaa

SEQ ID NO: 568638 - RNA, 14 nt, Homo sapiens
gaagcccauaucac

SEQ ID NO: 568639 - RNA, 16 nt, Homo sapiens
gaagcccaugucuucu

SEQ ID NO: 568640 - RNA, 18 nt, Homo sapiens
gaagcccccagcccuaau

SEQ ID NO: 568641 - RNA, 23 nt, Homo sapiens
gaagcccuugccugaaagcaaga

SEQ ID NO: 568642 - RNA, 20 nt, Homo sapiens
gaagccggaggguguuuaug

SEQ ID NO: 568643 - RNA, 21 nt, Homo sapiens
gaagccggcagggaagggccu

SEQ ID NO: 568644 - RNA, 17 nt, Homo sapiens
gaagccugaugcugaca

SEQ ID NO: 568645 - RNA, 19 nt, Homo sapiens
gaagccuggacucuaagcu

SEQ ID NO: 568646 - RNA, 23 nt, Homo sapiens
gauacacagauauauacacacag

SEQ ID NO: 568647 - RNA, 15 nt, Homo sapiens
gauacagaacucuuu

SEQ ID NO: 568648 - RNA, 12 nt, Homo sapiens
gauacauuucau

SEQ ID NO: 568649 - RNA, 22 nt, Homo sapiens
gauacauuucugaaugggcaau

SEQ ID NO: 568650 - RNA, 14 nt, Homo sapiens
gauaccacugcacu

SEQ ID NO: 568651 - RNA, 15 nt, Homo sapiens
gauaccacugcacug

SEQ ID NO: 568652 - RNA, 21 nt, Homo sapiens
gauacccauagcuuccaugag

SEQ ID NO: 568653 - RNA, 14 nt, Homo sapiens
gauaccuccaaccc

SEQ ID NO: 568654 - RNA, 22 nt, Homo sapiens
gauaccuguaguggaacuaaaa

SEQ ID NO: 568655 - RNA, 20 nt, Homo sapiens
gauacuaauaggugugugag

SEQ ID NO: 568656 - RNA, 23 nt, Homo sapiens
gauacuaauaggugugugaggcu

SEQ ID NO: 568657 - RNA, 19 nt, Homo sapiens
gauacugaguaaauccaug

SEQ ID NO: 568658 - RNA, 20 nt, Homo sapiens
gauacugcaaaggcuugugg

SEQ ID NO: 568659 - RNA, 19 nt, Homo sapiens
gauacugcgacuuucugcc

SEQ ID NO: 568660 - RNA, 11 nt, Homo sapiens
gauacuggaaa

SEQ ID NO: 568661 - RNA, 17 nt, Homo sapiens
gauacuugccaaaauga

SEQ ID NO: 568662 - RNA, 17 nt, Homo sapiens
gauacuuuccugaaugu

SEQ ID NO: 568663 - RNA, 18 nt, Homo sapiens
gauagaacaaugcuauaa

SEQ ID NO: 568664 - RNA, 20 nt, Homo sapiens
gauagaacaaugcuauaaua

SEQ ID NO: 568665 - RNA, 16 nt, Homo sapiens
gauagaaugauguuuu

SEQ ID NO: 568666 - RNA, 13 nt, Homo sapiens
gauagacacugga

SEQ ID NO: 568667 - RNA, 22 nt, Homo sapiens
gauagacuuauugccaaaaaca

SEQ ID NO: 568668 - RNA, 22 nt, Homo sapiens
gauagagaauguuccagacauu

SEQ ID NO: 568669 - RNA, 16 nt, Homo sapiens
gauagaggaaagggau

SEQ ID NO: 568670 - RNA, 20 nt, Homo sapiens
gauagauauaugcucugcau

SEQ ID NO: 568671 - RNA, 15 nt, Homo sapiens
gauagaucuguguuu

SEQ ID NO: 568672 - RNA, 20 nt, Homo sapiens
gauagaugcagguccauucu

SEQ ID NO: 568673 - RNA, 23 nt, Homo sapiens
gauagcccaggagcaacagccua

SEQ ID NO: 568674 - RNA, 11 nt, Homo sapiens
gauagcugucc

SEQ ID NO: 568675 - RNA, 18 nt, Homo sapiens
gauagcuuggagggaugg

SEQ ID NO: 568676 - RNA, 12 nt, Homo sapiens
gauagcuuuauu

SEQ ID NO: 568677 - RNA, 18 nt, Homo sapiens
gauaggaccuugggccaa

SEQ ID NO: 568678 - RNA, 15 nt, Homo sapiens
gauagggaacacuca

SEQ ID NO: 568679 - RNA, 15 nt, Homo sapiens
gauagggaacugggg

SEQ ID NO: 568680 - RNA, 22 nt, Homo sapiens
gauagugggcaccccacugcaa

SEQ ID NO: 568681 - RNA, 16 nt, Homo sapiens
gauaguuaaaagacug

SEQ ID NO: 568682 - RNA, 13 nt, Homo sapiens
gauaguucccaaa

SEQ ID NO: 568683 - RNA, 16 nt, Homo sapiens
gauaguucuauaagaa

SEQ ID NO: 568684 - RNA, 12 nt, Homo sapiens
gauaguuuaccu

SEQ ID NO: 568685 - RNA, 20 nt, Homo sapiens
gauauaacacuauguuuauu

SEQ ID NO: 568686 - RNA, 22 nt, Homo sapiens
gauauauaaguguacauaugug

SEQ ID NO: 568687 - RNA, 16 nt, Homo sapiens
gauauauacacaggau

SEQ ID NO: 568688 - RNA, 15 nt, Homo sapiens
gauauauaccacuuu

SEQ ID NO: 568689 - RNA, 17 nt, Homo sapiens
gauauauaccacuuucc

SEQ ID NO: 568690 - RNA, 16 nt, Homo sapiens
gauauauaggcuauuu

SEQ ID NO: 568691 - RNA, 22 nt, Homo sapiens
gauaucauuuuaaaaacuuuau

SEQ ID NO: 568692 - RNA, 14 nt, Homo sapiens
gauauccaugccac

SEQ ID NO: 568693 - RNA, 16 nt, Homo sapiens
gauaucccuuacucca

SEQ ID NO: 568694 - RNA, 19 nt, Homo sapiens
gauaucccuuacuccagag

SEQ ID NO: 568695 - RNA, 12 nt, Homo sapiens
gauaucuacugu

SEQ ID NO: 568696 - RNA, 12 nt, Homo sapiens
gauaucuuggcu

SEQ ID NO: 568697 - RNA, 17 nt, Homo sapiens
gauaucuuugcugcuuu

SEQ ID NO: 568698 - RNA, 19 nt, Homo sapiens
gauaugacccacacugcca

SEQ ID NO: 568699 - RNA, 17 nt, Homo sapiens
gauaugcaagugcaaaa

SEQ ID NO: 568700 - RNA, 14 nt, Homo sapiens
gauaugcacuugaa

SEQ ID NO: 568701 - RNA, 23 nt, Homo sapiens
gauaugcacuugaaaugauggua

SEQ ID NO: 568702 - RNA, 14 nt, Homo sapiens
gauaugcaguaugc

SEQ ID NO: 568703 - RNA, 14 nt, Homo sapiens
gauauggcaggacu

SEQ ID NO: 568704 - RNA, 13 nt, Homo sapiens
gauauguggugua

SEQ ID NO: 568705 - RNA, 20 nt, Homo sapiens
gauauguugaauuaacauaa

SEQ ID NO: 568706 - RNA, 22 nt, Homo sapiens
gauauuauacaggaaagcaaua

SEQ ID NO: 568707 - RNA, 18 nt, Homo sapiens
gauauucaggcuacucau

SEQ ID NO: 568708 - RNA, 21 nt, Homo sapiens
gauauucauuggcagcucaaa

SEQ ID NO: 568709 - RNA, 13 nt, Homo sapiens
gauauugaugaua

SEQ ID NO: 568710 - RNA, 18 nt, Homo sapiens
gauguggccugcauguac

SEQ ID NO: 568711 - RNA, 16 nt, Homo sapiens
gauguggucaauggaa

SEQ ID NO: 568712 - RNA, 14 nt, Homo sapiens
gaugugucuuacca

SEQ ID NO: 568713 - RNA, 16 nt, Homo sapiens
gaugugucuuaccaga

SEQ ID NO: 568714 - RNA, 19 nt, Homo sapiens
gaugugucuucaaugucaa

SEQ ID NO: 568715 - RNA, 14 nt, Homo sapiens
gaugugugaggcac

SEQ ID NO: 568716 - RNA, 14 nt, Homo sapiens
gauguuacugagau

SEQ ID NO: 568717 - RNA, 22 nt, Homo sapiens
gauguuagcagacccagcuuag

SEQ ID NO: 568718 - RNA, 16 nt, Homo sapiens
gauguuagccugcaaa

SEQ ID NO: 568719 - RNA, 15 nt, Homo sapiens
gauguucacuguggc

SEQ ID NO: 568720 - RNA, 19 nt, Homo sapiens
gauguucgcucgugcagua

SEQ ID NO: 568721 - RNA, 20 nt, Homo sapiens
gauguucugacccugcuuca

SEQ ID NO: 568722 - RNA, 18 nt, Homo sapiens
gauguugcuuuugcaccu

SEQ ID NO: 568723 - RNA, 14 nt, Homo sapiens
gauguuuccagacu

SEQ ID NO: 568724 - RNA, 19 nt, Homo sapiens
gauguuugaccuucagagc

SEQ ID NO: 568725 - RNA, 12 nt, Homo sapiens
gauguuugccau

SEQ ID NO: 568726 - RNA, 20 nt, Homo sapiens
gauuaaacaaacaaacaauu

SEQ ID NO: 568727 - RNA, 22 nt, Homo sapiens
gauuaagauauucagaaguaua

SEQ ID NO: 568728 - RNA, 19 nt, Homo sapiens
gauuacaggcgugagccac

SEQ ID NO: 568729 - RNA, 19 nt, Homo sapiens
gauuacauagaucagccau

SEQ ID NO: 568730 - RNA, 16 nt, Homo sapiens
gauuacuguuuacuga

SEQ ID NO: 568731 - RNA, 12 nt, Homo sapiens
gauuagacugga

SEQ ID NO: 568732 - RNA, 20 nt, Homo sapiens
gauuagcucuggaccagccu

SEQ ID NO: 568733 - RNA, 21 nt, Homo sapiens
gauuaguugaaaggccucaag

SEQ ID NO: 568734 - RNA, 16 nt, Homo sapiens
gauuauauagcacaua

SEQ ID NO: 568735 - RNA, 16 nt, Homo sapiens
gauuaugaagugacuc

SEQ ID NO: 568736 - RNA, 22 nt, Homo sapiens
gauuaugaagugacucucacaa

SEQ ID NO: 568737 - RNA, 12 nt, Homo sapiens
gauuauucugau

SEQ ID NO: 568738 - RNA, 15 nt, Homo sapiens
gauuauuuccagugu

SEQ ID NO: 568739 - RNA, 22 nt, Homo sapiens
gauucaaaguguuguguuccug

SEQ ID NO: 568740 - RNA, 20 nt, Homo sapiens
gauucaacacuuaagucuca

SEQ ID NO: 568741 - RNA, 18 nt, Homo sapiens
gauucaauauuaugaauu

SEQ ID NO: 568742 - RNA, 23 nt, Homo sapiens
gauucaccaaaauagucuucuca

SEQ ID NO: 568743 - RNA, 23 nt, Homo sapiens
gauucaccucuucuuucccuccu

SEQ ID NO: 568744 - RNA, 17 nt, Homo sapiens
gauucagaauguguuau

SEQ ID NO: 568745 - RNA, 12 nt, Homo sapiens
gauucagcaaaa

SEQ ID NO: 568746 - RNA, 21 nt, Homo sapiens
gauucagccaaaugcagggag

SEQ ID NO: 568747 - RNA, 14 nt, Homo sapiens
gauucaggggcuuu

SEQ ID NO: 568748 - RNA, 21 nt, Homo sapiens
gauucauaaaguaaugaugaa

SEQ ID NO: 568749 - RNA, 14 nt, Homo sapiens
gauucaugccaauu

SEQ ID NO: 568750 - RNA, 19 nt, Homo sapiens
gauuccaaaaagcacauau

SEQ ID NO: 568751 - RNA, 14 nt, Homo sapiens
gauuccacuaucuc

SEQ ID NO: 568752 - RNA, 19 nt, Homo sapiens
gauuccagcagugaaugcu

SEQ ID NO: 568753 - RNA, 19 nt, Homo sapiens
gauuccaggcgaugugcaa

SEQ ID NO: 568754 - RNA, 22 nt, Homo sapiens
gauuccagucuucucuuugaag

SEQ ID NO: 568755 - RNA, 19 nt, Homo sapiens
gauuccaguuuagugcuug

SEQ ID NO: 568756 - RNA, 13 nt, Homo sapiens
gauucccagagac

SEQ ID NO: 568757 - RNA, 20 nt, Homo sapiens
gauucccgggcuuaccaggu

SEQ ID NO: 568758 - RNA, 16 nt, Homo sapiens
gauuccucuugccucu

SEQ ID NO: 568759 - RNA, 18 nt, Homo sapiens
gauuccuggcagagccau

SEQ ID NO: 568760 - RNA, 19 nt, Homo sapiens
gauuccugguuugacucag

SEQ ID NO: 568761 - RNA, 17 nt, Homo sapiens
gauuccuuuauggcaaa

SEQ ID NO: 568762 - RNA, 22 nt, Homo sapiens
gauucgaaacuccauugaguca

SEQ ID NO: 568763 - RNA, 14 nt, Homo sapiens
gauucgaaugacac

SEQ ID NO: 568764 - RNA, 23 nt, Homo sapiens
gauucgcccuccucccugucaua

SEQ ID NO: 568765 - RNA, 18 nt, Homo sapiens
gauucuaaugucuucauu

SEQ ID NO: 568766 - RNA, 17 nt, Homo sapiens
gauucuauuuaauugaa

SEQ ID NO: 568767 - RNA, 22 nt, Homo sapiens
gauucuauuuauuaugcuuuau

SEQ ID NO: 568768 - RNA, 20 nt, Homo sapiens
gauucucuacaugcucuuuu

SEQ ID NO: 568769 - RNA, 23 nt, Homo sapiens
gauucucuuuaaaaaagacugaa

SEQ ID NO: 568770 - RNA, 18 nt, Homo sapiens
gauucugagccauucaca

SEQ ID NO: 568771 - RNA, 14 nt, Homo sapiens
gauucuguugcaua

SEQ ID NO: 568772 - RNA, 23 nt, Homo sapiens
gauucuuauuaguuccccaaaua

SEQ ID NO: 568773 - RNA, 18 nt, Homo sapiens
gauucuuuccauuaugau

SEQ ID NO: 568774 - RNA, 22 nt, Homo sapiens
gauucuuuuuuucugucaguaa

SEQ ID NO: 568775 - RNA, 12 nt, Homo sapiens
gauugaacucca

SEQ ID NO: 568776 - RNA, 14 nt, Homo sapiens
gauugagcucucug

SEQ ID NO: 568777 - RNA, 12 nt, Homo sapiens
ccagagccaugc

SEQ ID NO: 568778 - RNA, 15 nt, Homo sapiens
ccagagccaugccag

SEQ ID NO: 568779 - RNA, 22 nt, Homo sapiens
ccagagcggaaggagggagcuc

SEQ ID NO: 568780 - RNA, 17 nt, Homo sapiens
ccagagcgguaucucug

SEQ ID NO: 568781 - RNA, 18 nt, Homo sapiens
ccagagcguguagugaau

SEQ ID NO: 568782 - RNA, 19 nt, Homo sapiens
ccagagcugagauggcaua

SEQ ID NO: 568783 - RNA, 16 nt, Homo sapiens
ccagaggaacaagcau

SEQ ID NO: 568784 - RNA, 19 nt, Homo sapiens
ccagaggaaguuaagggag

SEQ ID NO: 568785 - RNA, 23 nt, Homo sapiens
ccagaggaauugauugucagcca

SEQ ID NO: 568786 - RNA, 14 nt, Homo sapiens
ccagaggacaaagc

SEQ ID NO: 568787 - RNA, 23 nt, Homo sapiens
ccagaggcagccucugcacuccc

SEQ ID NO: 568788 - RNA, 18 nt, Homo sapiens
ccagaggcccuggcuccu

SEQ ID NO: 568789 - RNA, 18 nt, Homo sapiens
ccagaggcucuaauguac

SEQ ID NO: 568790 - RNA, 19 nt, Homo sapiens
ccagaggcuggaccacaca

SEQ ID NO: 568791 - RNA, 18 nt, Homo sapiens
ccagaggcuuaaucacac

SEQ ID NO: 568792 - RNA, 22 nt, Homo sapiens
ccagagguauuccucucuuaaa

SEQ ID NO: 568793 - RNA, 22 nt, Homo sapiens
ccagagucuaggcuaagcacuu

SEQ ID NO: 568794 - RNA, 16 nt, Homo sapiens
ccagaguggagucuga

SEQ ID NO: 568795 - RNA, 16 nt, Homo sapiens
ccagaguugcaaagau

SEQ ID NO: 568796 - RNA, 18 nt, Homo sapiens
ccagauaacucucuuucc

SEQ ID NO: 568797 - RNA, 12 nt, Homo sapiens
ccagauaccagc

SEQ ID NO: 568798 - RNA, 13 nt, Homo sapiens
ccagauaccagcc

SEQ ID NO: 568799 - RNA, 15 nt, Homo sapiens
ccagaucaccaccug

SEQ ID NO: 568800 - RNA, 17 nt, Homo sapiens
ccagaucacugccacac

SEQ ID NO: 568801 - RNA, 22 nt, Homo sapiens
ccagaucacugccacacucucc

SEQ ID NO: 568802 - RNA, 17 nt, Homo sapiens
ccagaucagacuuuaau

SEQ ID NO: 568803 - RNA, 23 nt, Homo sapiens
ccagaucagauucuucucuuaau

SEQ ID NO: 568804 - RNA, 16 nt, Homo sapiens
ccagauccagacugua

SEQ ID NO: 568805 - RNA, 17 nt, Homo sapiens
ccagaucgcaccacugc

SEQ ID NO: 568806 - RNA, 19 nt, Homo sapiens
ccagaucgcaccacugcac

SEQ ID NO: 568807 - RNA, 22 nt, Homo sapiens
ccagaugaacauuucaaauuga

SEQ ID NO: 568808 - RNA, 18 nt, Homo sapiens
ccagaugaucccagucac

SEQ ID NO: 568809 - RNA, 16 nt, Homo sapiens
ccagaugcagggcagu

SEQ ID NO: 568810 - RNA, 18 nt, Homo sapiens
ccagauggaacacuggaa

SEQ ID NO: 568811 - RNA, 15 nt, Homo sapiens
ccagauggacuccag

SEQ ID NO: 568812 - RNA, 15 nt, Homo sapiens
ccagauggccccucc

SEQ ID NO: 568813 - RNA, 19 nt, Homo sapiens
ccagaugugaaaacaucuc

SEQ ID NO: 568814 - RNA, 20 nt, Homo sapiens
ccagaugugaaaacaucuca

SEQ ID NO: 568815 - RNA, 17 nt, Homo sapiens
ccagauguuaugcuccu

SEQ ID NO: 568816 - RNA, 16 nt, Homo sapiens
ccagauguuggaccaa

SEQ ID NO: 568817 - RNA, 20 nt, Homo sapiens
ccagauguuuacagacugug

SEQ ID NO: 568818 - RNA, 18 nt, Homo sapiens
ccagauguuuccagacuu

SEQ ID NO: 568819 - RNA, 21 nt, Homo sapiens
ccagauuagagccuguaaacu

SEQ ID NO: 568820 - RNA, 16 nt, Homo sapiens
ccagauucuaccacac

SEQ ID NO: 568821 - RNA, 22 nt, Homo sapiens
ccagauugacgacaagugcuga

SEQ ID NO: 568822 - RNA, 23 nt, Homo sapiens
ccagauugacgacaagugcugaa

SEQ ID NO: 568823 - RNA, 14 nt, Homo sapiens
ccagauugcucugc

SEQ ID NO: 568824 - RNA, 20 nt, Homo sapiens
ccagauuguggggugcagcu

SEQ ID NO: 568825 - RNA, 15 nt, Homo sapiens
ccagauuuacacugg

SEQ ID NO: 568826 - RNA, 15 nt, Homo sapiens
ccagauuuccuuuca

SEQ ID NO: 568827 - RNA, 22 nt, Homo sapiens
ccagcaaaagagcuauugccaa

SEQ ID NO: 568828 - RNA, 22 nt, Homo sapiens
ccagcaaaauggaagcaaagac

SEQ ID NO: 568829 - RNA, 14 nt, Homo sapiens
ccagcaagucccag

SEQ ID NO: 568830 - RNA, 17 nt, Homo sapiens
ccagcaaugacaucuca

SEQ ID NO: 568831 - RNA, 15 nt, Homo sapiens
gcaaaaaaauuauuu

SEQ ID NO: 568832 - RNA, 14 nt, Homo sapiens
gcaaaaaauacuuu

SEQ ID NO: 568833 - RNA, 22 nt, Homo sapiens
gcaaaaacauguaugugcauuu

SEQ ID NO: 568834 - RNA, 15 nt, Homo sapiens
gcaaaaagaacaaag

SEQ ID NO: 568835 - RNA, 19 nt, Homo sapiens
gcaaaaagcaaaaucauuu

SEQ ID NO: 568836 - RNA, 16 nt, Homo sapiens
gcaaaaaguagacuug

SEQ ID NO: 568837 - RNA, 19 nt, Homo sapiens
gcaaaaauggauauuauua

SEQ ID NO: 568838 - RNA, 20 nt, Homo sapiens
gcaaaacaaauucaaauaau

SEQ ID NO: 568839 - RNA, 19 nt, Homo sapiens
gcaaaaccacuagaacucu

SEQ ID NO: 568840 - RNA, 21 nt, Homo sapiens
gcaaaacucuacuuaauccaa

SEQ ID NO: 568841 - RNA, 15 nt, Homo sapiens
gcaaaacuuaggcau

SEQ ID NO: 568842 - RNA, 19 nt, Homo sapiens
gcaaaacuuaggcaugcac

SEQ ID NO: 568843 - RNA, 17 nt, Homo sapiens
gcaaaagaaacuaucaa

SEQ ID NO: 568844 - RNA, 16 nt, Homo sapiens
gcaaaagaaagaacca

SEQ ID NO: 568845 - RNA, 15 nt, Homo sapiens
gcaaaagagcuacuc

SEQ ID NO: 568846 - RNA, 22 nt, Homo sapiens
gcaaaaggaucuuuguggccaa

SEQ ID NO: 568847 - RNA, 14 nt, Homo sapiens
gcaaaaggcagcuc

SEQ ID NO: 568848 - RNA, 13 nt, Homo sapiens
gcaaaaguucuca

SEQ ID NO: 568849 - RNA, 17 nt, Homo sapiens
gcaaaaucaacaugacu

SEQ ID NO: 568850 - RNA, 20 nt, Homo sapiens
gcaaaaucuggaucuuggga

SEQ ID NO: 568851 - RNA, 18 nt, Homo sapiens
gcaaaaucuguucuaaca

SEQ ID NO: 568852 - RNA, 21 nt, Homo sapiens
gcaaaauggaagcaaagacaa

SEQ ID NO: 568853 - RNA, 20 nt, Homo sapiens
gcaaaaugguccuguggcug

SEQ ID NO: 568854 - RNA, 21 nt, Homo sapiens
gcaaaauuauguuugccacuu

SEQ ID NO: 568855 - RNA, 20 nt, Homo sapiens
gcaaaauuugaugccaggac

SEQ ID NO: 568856 - RNA, 21 nt, Homo sapiens
gcaaacacaagaaaucaaaau

SEQ ID NO: 568857 - RNA, 17 nt, Homo sapiens
gcaaacaguucuuggac

SEQ ID NO: 568858 - RNA, 12 nt, Homo sapiens
gcaaaccuuccu

SEQ ID NO: 568859 - RNA, 15 nt, Homo sapiens
gcaaaccuuccuggg

SEQ ID NO: 568860 - RNA, 14 nt, Homo sapiens
gcaaacugcuuuau

SEQ ID NO: 568861 - RNA, 19 nt, Homo sapiens
gcaaagacugcaguaucca

SEQ ID NO: 568862 - RNA, 23 nt, Homo sapiens
gcaaagaugaacccgaggcugag

SEQ ID NO: 568863 - RNA, 22 nt, Homo sapiens
gcaaagauuuuuggcacuuugu

SEQ ID NO: 568864 - RNA, 18 nt, Homo sapiens
gcaaagccuuuccagaaa

SEQ ID NO: 568865 - RNA, 18 nt, Homo sapiens
gcaaaggaaauaccaguu

SEQ ID NO: 568866 - RNA, 21 nt, Homo sapiens
gcaaaggggacagcuguguga

SEQ ID NO: 568867 - RNA, 17 nt, Homo sapiens
gcaaagguaauaauaca

SEQ ID NO: 568868 - RNA, 15 nt, Homo sapiens
gcaaaggugccucau

SEQ ID NO: 568869 - RNA, 14 nt, Homo sapiens
gcaaaguacaugua

SEQ ID NO: 568870 - RNA, 13 nt, Homo sapiens
gcaaaguacuugu

SEQ ID NO: 568871 - RNA, 15 nt, Homo sapiens
gcaaaguaguacuuc

SEQ ID NO: 568872 - RNA, 20 nt, Homo sapiens
gcaaaguaucccuacuguaa

SEQ ID NO: 568873 - RNA, 20 nt, Homo sapiens
gcaaaguauuguaaauuaua

SEQ ID NO: 568874 - RNA, 15 nt, Homo sapiens
gcaaaguccagcuca

SEQ ID NO: 568875 - RNA, 23 nt, Homo sapiens
gcaaagugcugcuggaaguagaa

SEQ ID NO: 568876 - RNA, 15 nt, Homo sapiens
gcaaauaaaccacuu

SEQ ID NO: 568877 - RNA, 16 nt, Homo sapiens
gcaaauaaaccacuuu

SEQ ID NO: 568878 - RNA, 16 nt, Homo sapiens
gcaaauaaaugccuuc

SEQ ID NO: 568879 - RNA, 21 nt, Homo sapiens
gcaaauagccuuccugaccuc

SEQ ID NO: 568880 - RNA, 19 nt, Homo sapiens
gcaaauaucauacuguuca

SEQ ID NO: 568881 - RNA, 18 nt, Homo sapiens
gcaaauauuauccagcaa

SEQ ID NO: 568882 - RNA, 16 nt, Homo sapiens
gcaaauauugucauaa

SEQ ID NO: 568883 - RNA, 14 nt, Homo sapiens
gcaaaucacuucaa

SEQ ID NO: 568884 - RNA, 14 nt, Homo sapiens
gcaaaucaucugca

SEQ ID NO: 568885 - RNA, 22 nt, Homo sapiens
gcaaauccugucggucuccagu

SEQ ID NO: 568886 - RNA, 16 nt, Homo sapiens
gcaaaucgugccuugu

SEQ ID NO: 568887 - RNA, 23 nt, Homo sapiens
gcaaaucuuucuguaaacagaau

SEQ ID NO: 568888 - RNA, 16 nt, Homo sapiens
gcaaaugcauggcaaa

SEQ ID NO: 568889 - RNA, 17 nt, Homo sapiens
gcaaaugcauggcaaau

SEQ ID NO: 568890 - RNA, 22 nt, Homo sapiens
gcaaaugcuacauauaugcaau

SEQ ID NO: 568891 - RNA, 23 nt, Homo sapiens
gcaaaugcuguauucuucuuugg

SEQ ID NO: 568892 - RNA, 14 nt, Homo sapiens
gcaaaugucuucca

SEQ ID NO: 568893 - RNA, 17 nt, Homo sapiens
gcaaaugucuuccaggu

SEQ ID NO: 568894 - RNA, 21 nt, Homo sapiens
gcaaauguguacgugcaugcu

SEQ ID NO: 568895 - RNA, 18 nt, Homo sapiens
gcaaauguuucugcagua

SEQ ID NO: 568896 - RNA, 20 nt, Homo sapiens
gcaaauuaaaacauauuuca

SEQ ID NO: 568897 - RNA, 16 nt, Homo sapiens
gcaaauuaacuaauuu

SEQ ID NO: 568898 - RNA, 20 nt, Homo sapiens
gcaaauuaguugguuugugu

SEQ ID NO: 568899 - RNA, 16 nt, Homo sapiens
ccagcuuguaggagcu

SEQ ID NO: 568900 - RNA, 14 nt, Homo sapiens
ccagcuuugcagug

SEQ ID NO: 568901 - RNA, 18 nt, Homo sapiens
ccagcuuuggcugcugaa

SEQ ID NO: 568902 - RNA, 22 nt, Homo sapiens
ccagcuuuuagaaaaugcaguc

SEQ ID NO: 568903 - RNA, 21 nt, Homo sapiens
ccaggaaaaaauaaaaggggg

SEQ ID NO: 568904 - RNA, 21 nt, Homo sapiens
ccaggaaaagcccucaucuuc

SEQ ID NO: 568905 - RNA, 20 nt, Homo sapiens
ccaggaaacaugaagcauaa

SEQ ID NO: 568906 - RNA, 17 nt, Homo sapiens
ccaggaaagaagcauuu

SEQ ID NO: 568907 - RNA, 14 nt, Homo sapiens
ccaggaaaggccca

SEQ ID NO: 568908 - RNA, 21 nt, Homo sapiens
ccaggaacugccugggccaug

SEQ ID NO: 568909 - RNA, 15 nt, Homo sapiens
ccaggaaggcagcug

SEQ ID NO: 568910 - RNA, 11 nt, Homo sapiens
ccaggacacca

SEQ ID NO: 568911 - RNA, 23 nt, Homo sapiens
ccaggacaccacuagguggugcu

SEQ ID NO: 568912 - RNA, 15 nt, Homo sapiens
ccaggaccaagccac

SEQ ID NO: 568913 - RNA, 17 nt, Homo sapiens
ccaggaccaggggccca

SEQ ID NO: 568914 - RNA, 18 nt, Homo sapiens
ccaggaccccuguccagg

SEQ ID NO: 568915 - RNA, 22 nt, Homo sapiens
ccaggacgcuucugaaugcugc

SEQ ID NO: 568916 - RNA, 17 nt, Homo sapiens
ccaggacucuggcacuu

SEQ ID NO: 568917 - RNA, 14 nt, Homo sapiens
ccaggacuguguuu

SEQ ID NO: 568918 - RNA, 14 nt, Homo sapiens
ccaggagaaggggg

SEQ ID NO: 568919 - RNA, 15 nt, Homo sapiens
ccaggagacauauau

SEQ ID NO: 568920 - RNA, 14 nt, Homo sapiens
ccaggagagacaga

SEQ ID NO: 568921 - RNA, 16 nt, Homo sapiens
ccaggagcagcagcca

SEQ ID NO: 568922 - RNA, 18 nt, Homo sapiens
ccaggagcaggcacgggu

SEQ ID NO: 568923 - RNA, 22 nt, Homo sapiens
ccaggaggauugccuuuaauau

SEQ ID NO: 568924 - RNA, 14 nt, Homo sapiens
ccaggaggggccug

SEQ ID NO: 568925 - RNA, 22 nt, Homo sapiens
ccaggagguggaggcugcagug

SEQ ID NO: 568926 - RNA, 22 nt, Homo sapiens
ccaggaguaccuggaccugucc

SEQ ID NO: 568927 - RNA, 18 nt, Homo sapiens
ccaggauaaggagacuga

SEQ ID NO: 568928 - RNA, 13 nt, Homo sapiens
ccaggaugcuaaa

SEQ ID NO: 568929 - RNA, 18 nt, Homo sapiens
ccaggauuuuaauuucag

SEQ ID NO: 568930 - RNA, 16 nt, Homo sapiens
ccaggcacugcccuuu

SEQ ID NO: 568931 - RNA, 14 nt, Homo sapiens
ccaggcacugcugc

SEQ ID NO: 568932 - RNA, 13 nt, Homo sapiens
ccaggcagccuca

SEQ ID NO: 568933 - RNA, 20 nt, Homo sapiens
ccaggcaggcugugcgcuga

SEQ ID NO: 568934 - RNA, 17 nt, Homo sapiens
ccaggccagagggcagu

SEQ ID NO: 568935 - RNA, 18 nt, Homo sapiens
ccaggccucacuggcuca

SEQ ID NO: 568936 - RNA, 16 nt, Homo sapiens
ccaggccugaccucaa

SEQ ID NO: 568937 - RNA, 16 nt, Homo sapiens
ccaggcgaugugcaag

SEQ ID NO: 568938 - RNA, 22 nt, Homo sapiens
ccaggcuacaaucuucauuuaa

SEQ ID NO: 568939 - RNA, 20 nt, Homo sapiens
ccaggcucucgcacaccucu

SEQ ID NO: 568940 - RNA, 13 nt, Homo sapiens
ccaggcucucugc

SEQ ID NO: 568941 - RNA, 19 nt, Homo sapiens
ccaggcugaccacagcaca

SEQ ID NO: 568942 - RNA, 20 nt, Homo sapiens
ccaggcugccugugugcaug

SEQ ID NO: 568943 - RNA, 20 nt, Homo sapiens
ccaggcugcuggagugcagu

SEQ ID NO: 568944 - RNA, 15 nt, Homo sapiens
ccaggcuggagauaa

SEQ ID NO: 568945 - RNA, 17 nt, Homo sapiens
ccaggcuggaguacagu

SEQ ID NO: 568946 - RNA, 17 nt, Homo sapiens
ccaggcuggagugcaau

SEQ ID NO: 568947 - RNA, 19 nt, Homo sapiens
ccaggcuggagugcaaugg

SEQ ID NO: 568948 - RNA, 23 nt, Homo sapiens
ccaggcuggagugcaguggugca

SEQ ID NO: 568949 - RNA, 12 nt, Homo sapiens
ccaggcuguagg

SEQ ID NO: 568950 - RNA, 14 nt, Homo sapiens
ccaggcuugccuca

SEQ ID NO: 568951 - RNA, 16 nt, Homo sapiens
ccaggcuugccucaag

SEQ ID NO: 568952 - RNA, 17 nt, Homo sapiens
ccaggcuuucaauguuu

SEQ ID NO: 568953 - RNA, 14 nt, Homo sapiens
ccagggaaacaaag

SEQ ID NO: 568954 - RNA, 12 nt, Homo sapiens
ccagggagaccc

SEQ ID NO: 568955 - RNA, 17 nt, Homo sapiens
ccagggaggagucagua

SEQ ID NO: 568956 - RNA, 15 nt, Homo sapiens
ccagggaugacaugu

SEQ ID NO: 568957 - RNA, 18 nt, Homo sapiens
ccagggaugacauguccc

SEQ ID NO: 568958 - RNA, 15 nt, Homo sapiens
ccagggcauguguau

SEQ ID NO: 568959 - RNA, 20 nt, Homo sapiens
ccaggggcuucccacuuugg

SEQ ID NO: 568960 - RNA, 22 nt, Homo sapiens
ccagggugacagagugagacca

SEQ ID NO: 568961 - RNA, 15 nt, Homo sapiens
ccagguaccacccuu

SEQ ID NO: 568962 - RNA, 19 nt, Homo sapiens
ccaggucaggaugcacauu

SEQ ID NO: 568963 - RNA, 15 nt, Homo sapiens
ccaggucucacgggc

SEQ ID NO: 568964 - RNA, 16 nt, Homo sapiens
ccaggucuugacucau

SEQ ID NO: 568965 - RNA, 13 nt, Homo sapiens
ccaggugcaaaag

SEQ ID NO: 568966 - RNA, 12 nt, Homo sapiens
ccaggugcaauu

SEQ ID NO: 568967 - RNA, 14 nt, Homo sapiens
ccaggugggugugg

SEQ ID NO: 568968 - RNA, 18 nt, Homo sapiens
ccaggugggugugggaca

SEQ ID NO: 568969 - RNA, 13 nt, Homo sapiens
ccaggugguuggg

SEQ ID NO: 568970 - RNA, 13 nt, Homo sapiens
ccagguucacuuu

SEQ ID NO: 568971 - RNA, 22 nt, Homo sapiens
ccagguugcugugggugcagcu

SEQ ID NO: 568972 - RNA, 23 nt, Homo sapiens
ccaguaauggaaugaagguaaua

SEQ ID NO: 568973 - RNA, 16 nt, Homo sapiens
ccaguaauugguccga

SEQ ID NO: 568974 - RNA, 13 nt, Homo sapiens
ccaguacauuuaa

SEQ ID NO: 568975 - RNA, 12 nt, Homo sapiens
ccaguacuggga

SEQ ID NO: 568976 - RNA, 19 nt, Homo sapiens
ccaguacuugucauaugua

SEQ ID NO: 568977 - RNA, 14 nt, Homo sapiens
ccaguaggacaaac

SEQ ID NO: 568978 - RNA, 14 nt, Homo sapiens
ccaguauggugaaa

SEQ ID NO: 568979 - RNA, 14 nt, Homo sapiens
ccaguauuaugcau

SEQ ID NO: 568980 - RNA, 20 nt, Homo sapiens
ccaguauugaaaacuucaaa

SEQ ID NO: 568981 - RNA, 23 nt, Homo sapiens
ccaguccaaauggcuauuauaaa

SEQ ID NO: 568982 - RNA, 17 nt, Homo sapiens
ccaguccaagaccccaa

SEQ ID NO: 568983 - RNA, 15 nt, Homo sapiens
ccaguccauuuccaa

SEQ ID NO: 568984 - RNA, 21 nt, Homo sapiens
ccaguccccgaggagcugggc

SEQ ID NO: 568985 - RNA, 15 nt, Homo sapiens
ccaguccugguuggg

SEQ ID NO: 568986 - RNA, 20 nt, Homo sapiens
ccaguccuguuugcagggaa

SEQ ID NO: 568987 - RNA, 15 nt, Homo sapiens
ccagucgagaccuca

SEQ ID NO: 568988 - RNA, 18 nt, Homo sapiens
ccagucggccccaucucu

SEQ ID NO: 568989 - RNA, 20 nt, Homo sapiens
ccagucucagagaccagcac

SEQ ID NO: 568990 - RNA, 22 nt, Homo sapiens
ccagucucagagaccagcacuc

SEQ ID NO: 568991 - RNA, 16 nt, Homo sapiens
ccagucucaucuccug

SEQ ID NO: 568992 - RNA, 16 nt, Homo sapiens
ccagucucucaaguga

SEQ ID NO: 568993 - RNA, 13 nt, Homo sapiens
ccagucucuggca

SEQ ID NO: 568994 - RNA, 17 nt, Homo sapiens
ccagucuggaaaacaga

SEQ ID NO: 568995 - RNA, 23 nt, Homo sapiens
ccagucuggaaaacagaaaccau

SEQ ID NO: 568996 - RNA, 21 nt, Homo sapiens
ccagucuuccugacacuuuaa

SEQ ID NO: 568997 - RNA, 23 nt, Homo sapiens
ccagucuuuucuggcaaauaaca

SEQ ID NO: 568998 - RNA, 13 nt, Homo sapiens
ccagugaaccaaa

SEQ ID NO: 568999 - RNA, 18 nt, Homo sapiens
ccagugaaucuguuucag

SEQ ID NO: 569000 - RNA, 13 nt, Homo sapiens
ccagugacacuuc

SEQ ID NO: 569001 - RNA, 15 nt, Homo sapiens
ccagugaccagucac

SEQ ID NO: 569002 - RNA, 20 nt, Homo sapiens
ccagugaccccugaccucac

SEQ ID NO: 569003 - RNA, 11 nt, Homo sapiens
ccagugaugau

SEQ ID NO: 569004 - RNA, 12 nt, Homo sapiens
ccagugaugaug

SEQ ID NO: 569005 - RNA, 14 nt, Homo sapiens
ccagugcaacagca

SEQ ID NO: 569006 - RNA, 15 nt, Homo sapiens
ccagugcacugaaag

SEQ ID NO: 569007 - RNA, 12 nt, Homo sapiens
ccagugccauuc

SEQ ID NO: 569008 - RNA, 20 nt, Homo sapiens
ccagugccauuccacuccac

SEQ ID NO: 569009 - RNA, 12 nt, Homo sapiens
ccagugcccauc

SEQ ID NO: 569010 - RNA, 22 nt, Homo sapiens
ccaguggaacagcgggagaccu

SEQ ID NO: 569011 - RNA, 21 nt, Homo sapiens
ccaguggaauuccaacuugaa

SEQ ID NO: 569012 - RNA, 19 nt, Homo sapiens
ccaguggcagacaaacaga

SEQ ID NO: 569013 - RNA, 20 nt, Homo sapiens
ccagugggaacugugcaaag

SEQ ID NO: 569014 - RNA, 18 nt, Homo sapiens
ccagugggcugaugcugg

SEQ ID NO: 569015 - RNA, 15 nt, Homo sapiens
ccaguguacagugaa

SEQ ID NO: 569016 - RNA, 16 nt, Homo sapiens
ccaguguggaaccacu

SEQ ID NO: 569017 - RNA, 22 nt, Homo sapiens
ccaguguggaguggguaaucca

SEQ ID NO: 569018 - RNA, 18 nt, Homo sapiens
ccagugugggcuugacca

SEQ ID NO: 569019 - RNA, 18 nt, Homo sapiens
ccaguguuccugaagcug

SEQ ID NO: 569020 - RNA, 19 nt, Homo sapiens
ccaguguucuaugaacaac

SEQ ID NO: 569021 - RNA, 12 nt, Homo sapiens
ccaguguucucc

SEQ ID NO: 569022 - RNA, 16 nt, Homo sapiens
ccaguguuguggauuu

SEQ ID NO: 569023 - RNA, 20 nt, Homo sapiens
gcaaauuucuauaaauuuaa

SEQ ID NO: 569024 - RNA, 19 nt, Homo sapiens
gcaaauuuucagcauuaag

SEQ ID NO: 569025 - RNA, 22 nt, Homo sapiens
gcaacaagaccaccacuucgaa

SEQ ID NO: 569026 - RNA, 15 nt, Homo sapiens
gcaacaagacugcca

SEQ ID NO: 569027 - RNA, 13 nt, Homo sapiens
gcaacaaugacuu

SEQ ID NO: 569028 - RNA, 16 nt, Homo sapiens
gcaacacugcaggaca

SEQ ID NO: 569029 - RNA, 18 nt, Homo sapiens
gcaacacugcuguccaca

SEQ ID NO: 569030 - RNA, 15 nt, Homo sapiens
gcaacagaagcaaaa

SEQ ID NO: 569031 - RNA, 19 nt, Homo sapiens
gcaacaggaggcauucugu

SEQ ID NO: 569032 - RNA, 16 nt, Homo sapiens
gcaacagguucaggug

SEQ ID NO: 569033 - RNA, 22 nt, Homo sapiens
gcaacaguacuucaaacagaac

SEQ ID NO: 569034 - RNA, 12 nt, Homo sapiens
gcaacaguuuuu

SEQ ID NO: 569035 - RNA, 16 nt, Homo sapiens
gcaacaucucugggaa

SEQ ID NO: 569036 - RNA, 13 nt, Homo sapiens
gcaaccacugcuu

SEQ ID NO: 569037 - RNA, 12 nt, Homo sapiens
gcaaccaggaac

SEQ ID NO: 569038 - RNA, 13 nt, Homo sapiens
gcaaccauauuug

SEQ ID NO: 569039 - RNA, 17 nt, Homo sapiens
gcaacccuaacaguaag

SEQ ID NO: 569040 - RNA, 16 nt, Homo sapiens
gcaacuaaggacaaau

SEQ ID NO: 569041 - RNA, 16 nt, Homo sapiens
gcaacuaggccuucag

SEQ ID NO: 569042 - RNA, 18 nt, Homo sapiens
gcaacuaggccuucagua

SEQ ID NO: 569043 - RNA, 20 nt, Homo sapiens
gcaacucuuuuaagugccuu

SEQ ID NO: 569044 - RNA, 13 nt, Homo sapiens
gcaacugaauaaa

SEQ ID NO: 569045 - RNA, 18 nt, Homo sapiens
gcaacuucuucuccaucc

SEQ ID NO: 569046 - RNA, 15 nt, Homo sapiens
gcaagaagcuguuac

SEQ ID NO: 569047 - RNA, 18 nt, Homo sapiens
gcaagaagucaaaguaaa

SEQ ID NO: 569048 - RNA, 17 nt, Homo sapiens
gcaagaauauugucccu

SEQ ID NO: 569049 - RNA, 15 nt, Homo sapiens
gcaagaccagucacu

SEQ ID NO: 569050 - RNA, 16 nt, Homo sapiens
gcaagaccagucacuc

SEQ ID NO: 569051 - RNA, 17 nt, Homo sapiens
gcaagacuccaucucaa

SEQ ID NO: 569052 - RNA, 18 nt, Homo sapiens
gcaagacuguugcucaaa

SEQ ID NO: 569053 - RNA, 14 nt, Homo sapiens
gcaagagggggacc

SEQ ID NO: 569054 - RNA, 13 nt, Homo sapiens
gcaagaugagcug

SEQ ID NO: 569055 - RNA, 14 nt, Homo sapiens
gcaagaugcaaaug

SEQ ID NO: 569056 - RNA, 18 nt, Homo sapiens
gcaagccugucugagacu

SEQ ID NO: 569057 - RNA, 23 nt, Homo sapiens
gcaaggaaacuauguaacaugua

SEQ ID NO: 569058 - RNA, 14 nt, Homo sapiens
gcaagggauaacuc

SEQ ID NO: 569059 - RNA, 15 nt, Homo sapiens
gcaagggcagugaag

SEQ ID NO: 569060 - RNA, 17 nt, Homo sapiens
gcaaggugcucuugaac

SEQ ID NO: 569061 - RNA, 16 nt, Homo sapiens
gcaagguuuggugcaa

SEQ ID NO: 569062 - RNA, 13 nt, Homo sapiens
gcaaguaacauua

SEQ ID NO: 569063 - RNA, 17 nt, Homo sapiens
gcaaguaaguuauagaa

SEQ ID NO: 569064 - RNA, 20 nt, Homo sapiens
gcaaguauguuuuagcaugu

SEQ ID NO: 569065 - RNA, 16 nt, Homo sapiens
gcaagucccugacucu

SEQ ID NO: 569066 - RNA, 18 nt, Homo sapiens
gcaagucggggccuggga

SEQ ID NO: 569067 - RNA, 15 nt, Homo sapiens
gcaagugaaagcaag

SEQ ID NO: 569068 - RNA, 19 nt, Homo sapiens
gcaaguguguaugugcgug

SEQ ID NO: 569069 - RNA, 17 nt, Homo sapiens
gcaagugugugcacaug

SEQ ID NO: 569070 - RNA, 21 nt, Homo sapiens
gcaagugugugcacaugugug

SEQ ID NO: 569071 - RNA, 17 nt, Homo sapiens
gcaaguguucacugcuc

SEQ ID NO: 569072 - RNA, 20 nt, Homo sapiens
gcaaguugaggacuucuugc

SEQ ID NO: 569073 - RNA, 19 nt, Homo sapiens
gcaaguuucaucagucaau

SEQ ID NO: 569074 - RNA, 18 nt, Homo sapiens
gcaaguuugacacaaacu

SEQ ID NO: 569075 - RNA, 14 nt, Homo sapiens
gcuaccucuucuau

SEQ ID NO: 569076 - RNA, 19 nt, Homo sapiens
gcuacuaccuagggcacuu

SEQ ID NO: 569077 - RNA, 22 nt, Homo sapiens
gcuacuaccuagggcacuuuaa

SEQ ID NO: 569078 - RNA, 18 nt, Homo sapiens
gcuacuauagguccagaa

SEQ ID NO: 569079 - RNA, 14 nt, Homo sapiens
gcuacuauauguca

SEQ ID NO: 569080 - RNA, 17 nt, Homo sapiens
gcuacucgauagccuga

SEQ ID NO: 569081 - RNA, 21 nt, Homo sapiens
gcuacucucuugccagcauuu

SEQ ID NO: 569082 - RNA, 21 nt, Homo sapiens
gcuacucuguuccuucacauc

SEQ ID NO: 569083 - RNA, 23 nt, Homo sapiens
gcuacugaugaaaucugcuagaa

SEQ ID NO: 569084 - RNA, 18 nt, Homo sapiens
gcuacuguaauuuuauau

SEQ ID NO: 569085 - RNA, 12 nt, Homo sapiens
gcuacugucauu

SEQ ID NO: 569086 - RNA, 13 nt, Homo sapiens
gcuacuugggagg

SEQ ID NO: 569087 - RNA, 21 nt, Homo sapiens
gcuacuuuauuuauacacugu

SEQ ID NO: 569088 - RNA, 20 nt, Homo sapiens
gcuagaaaaaaaaaacacuu

SEQ ID NO: 569089 - RNA, 13 nt, Homo sapiens
gcuagaaggccac

SEQ ID NO: 569090 - RNA, 18 nt, Homo sapiens
gcuagagaaggaccagaa

SEQ ID NO: 569091 - RNA, 14 nt, Homo sapiens
gcuagagggacaaa

SEQ ID NO: 569092 - RNA, 18 nt, Homo sapiens
gcuagaugugucuuacca

SEQ ID NO: 569093 - RNA, 19 nt, Homo sapiens
gcuagaugugucuuaccag

SEQ ID NO: 569094 - RNA, 16 nt, Homo sapiens
gcuagcgugugccagg

SEQ ID NO: 569095 - RNA, 21 nt, Homo sapiens
gcuaggacuccaaccucaggg

SEQ ID NO: 569096 - RNA, 22 nt, Homo sapiens
gcuaggacuccaaccucaggga

SEQ ID NO: 569097 - RNA, 16 nt, Homo sapiens
gcuaggugacauauac

SEQ ID NO: 569098 - RNA, 17 nt, Homo sapiens
gcuagguuaaaggccag

SEQ ID NO: 569099 - RNA, 15 nt, Homo sapiens
gcuagucugucaggg

SEQ ID NO: 569100 - RNA, 12 nt, Homo sapiens
gcuagugccuuu

SEQ ID NO: 569101 - RNA, 18 nt, Homo sapiens
gcuaguucguagcuuucc

SEQ ID NO: 569102 - RNA, 20 nt, Homo sapiens
gcuauagaaugagugcaggu

SEQ ID NO: 569103 - RNA, 13 nt, Homo sapiens
gcuauagcacaca

SEQ ID NO: 569104 - RNA, 15 nt, Homo sapiens
gcuauauccauguac

SEQ ID NO: 569105 - RNA, 17 nt, Homo sapiens
gcuauauccauguacug

SEQ ID NO: 569106 - RNA, 20 nt, Homo sapiens
gcuauaugccuuaagccaau

SEQ ID NO: 569107 - RNA, 23 nt, Homo sapiens
gcuauauuccuuuuucuaugaaa

SEQ ID NO: 569108 - RNA, 17 nt, Homo sapiens
gcuauccagcagaucau

SEQ ID NO: 569109 - RNA, 15 nt, Homo sapiens
gcuauccagugacuu

SEQ ID NO: 569110 - RNA, 22 nt, Homo sapiens
gcuauccguguugcagguucau

SEQ ID NO: 569111 - RNA, 17 nt, Homo sapiens
gcuaucuacuaccagaa

SEQ ID NO: 569112 - RNA, 15 nt, Homo sapiens
gcuaucuccuaacuu

SEQ ID NO: 569113 - RNA, 22 nt, Homo sapiens
gcuaugaaaaugagcccuggcu

SEQ ID NO: 569114 - RNA, 20 nt, Homo sapiens
gcuaugaucagaagacuuua

SEQ ID NO: 569115 - RNA, 23 nt, Homo sapiens
gcuaugcggaggaaagcaagugu

SEQ ID NO: 569116 - RNA, 15 nt, Homo sapiens
gcuaugguugccacc

SEQ ID NO: 569117 - RNA, 14 nt, Homo sapiens
gcuauguaaggguc

SEQ ID NO: 569118 - RNA, 15 nt, Homo sapiens
gcuauguccuaauaa

SEQ ID NO: 569119 - RNA, 19 nt, Homo sapiens
gcuauguucugucuuccca

SEQ ID NO: 569120 - RNA, 14 nt, Homo sapiens
gcuauuacugucca

SEQ ID NO: 569121 - RNA, 14 nt, Homo sapiens
gcuauuacugucug

SEQ ID NO: 569122 - RNA, 14 nt, Homo sapiens
gcuauucaccucag

SEQ ID NO: 569123 - RNA, 14 nt, Homo sapiens
gcuauuuaugcaag

SEQ ID NO: 569124 - RNA, 22 nt, Homo sapiens
gcuauuuccagagccagcucaa

SEQ ID NO: 569125 - RNA, 17 nt, Homo sapiens
gcuauuuggacucaggu

SEQ ID NO: 569126 - RNA, 15 nt, Homo sapiens
gcuauuuguauuucu

SEQ ID NO: 569127 - RNA, 22 nt, Homo sapiens
gcuauuuuuuauuuuacuuuua

SEQ ID NO: 569128 - RNA, 16 nt, Homo sapiens
gcucaagaacacaugu

SEQ ID NO: 569129 - RNA, 14 nt, Homo sapiens
gcucaagcccugaa

SEQ ID NO: 569130 - RNA, 12 nt, Homo sapiens
gcucaagcugac

SEQ ID NO: 569131 - RNA, 16 nt, Homo sapiens
gcucaauagcuugaag

SEQ ID NO: 569132 - RNA, 15 nt, Homo sapiens
gcucaauauuccuga

SEQ ID NO: 569133 - RNA, 21 nt, Homo sapiens
gcucaaucucagcuaacauuc

SEQ ID NO: 569134 - RNA, 22 nt, Homo sapiens
gcucaaucucagcuaacauucc

SEQ ID NO: 569135 - RNA, 19 nt, Homo sapiens
gcucaauucaagugacaca

SEQ ID NO: 569136 - RNA, 21 nt, Homo sapiens
gcucaauuuugucuguacuca

SEQ ID NO: 569137 - RNA, 13 nt, Homo sapiens
gcucacaccaaau

SEQ ID NO: 569138 - RNA, 18 nt, Homo sapiens
gcucacagauugagguaa

SEQ ID NO: 569139 - RNA, 21 nt, Homo sapiens
gcucacccaagcaaggccaaa

SEQ ID NO: 569140 - RNA, 17 nt, Homo sapiens
gcucaccgcccaucagg

SEQ ID NO: 569141 - RNA, 12 nt, Homo sapiens
gcucacgugugu

SEQ ID NO: 569142 - RNA, 12 nt, Homo sapiens
gcucacuacuga

SEQ ID NO: 569143 - RNA, 17 nt, Homo sapiens
gcucacugcagccucaa

SEQ ID NO: 569144 - RNA, 22 nt, Homo sapiens
gcucacuguccacaugugaacu

SEQ ID NO: 569145 - RNA, 22 nt, Homo sapiens
gcucacugugcuggggcacggc

SEQ ID NO: 569146 - RNA, 13 nt, Homo sapiens
gcucacuuuucau

SEQ ID NO: 569147 - RNA, 22 nt, Homo sapiens
gcucagaaauuuucugaucuca

SEQ ID NO: 569148 - RNA, 13 nt, Homo sapiens
gcucagaacccag

SEQ ID NO: 569149 - RNA, 15 nt, Homo sapiens
gcucagaauaaggca

SEQ ID NO: 569150 - RNA, 16 nt, Homo sapiens
gcucagacuugccagg

SEQ ID NO: 569151 - RNA, 23 nt, Homo sapiens
gcucagauuauuuaaaugggaau

SEQ ID NO: 569152 - RNA, 16 nt, Homo sapiens
gcucagcaaccuuuca

SEQ ID NO: 569153 - RNA, 19 nt, Homo sapiens
gcucaggcuuuuccaggaa

SEQ ID NO: 569154 - RNA, 19 nt, Homo sapiens
gcucagggaaaagcagcuc

SEQ ID NO: 569155 - RNA, 18 nt, Homo sapiens
gcucaggggacacuggcc

SEQ ID NO: 569156 - RNA, 16 nt, Homo sapiens
gcucagucuguucacu

SEQ ID NO: 569157 - RNA, 17 nt, Homo sapiens
gcucaguuggugcugcu

SEQ ID NO: 569158 - RNA, 17 nt, Homo sapiens
gcucauagaucagcaaa

SEQ ID NO: 569159 - RNA, 21 nt, Homo sapiens
gcucauaugcauguagucacu

SEQ ID NO: 569160 - RNA, 14 nt, Homo sapiens
gcucaucacuggau

SEQ ID NO: 569161 - RNA, 15 nt, Homo sapiens
gcucaucauucucug

SEQ ID NO: 569162 - RNA, 14 nt, Homo sapiens
gcucaugacacugu

SEQ ID NO: 569163 - RNA, 20 nt, Homo sapiens
gcucaugaccuggaaauaaa

SEQ ID NO: 569164 - RNA, 10 nt, Homo sapiens
gcucaugccc

SEQ ID NO: 569165 - RNA, 18 nt, Homo sapiens
gcucauguaccucugauu

SEQ ID NO: 569166 - RNA, 19 nt, Homo sapiens
gcucauugcuguaccacau

SEQ ID NO: 569167 - RNA, 16 nt, Homo sapiens
gcucauuuuugcuguu

SEQ ID NO: 569168 - RNA, 22 nt, Homo sapiens
gcuccacaccuccaaugcugcc

SEQ ID NO: 569169 - RNA, 23 nt, Homo sapiens
gcuccacgaagccuuaagccaua

SEQ ID NO: 569170 - RNA, 13 nt, Homo sapiens
gcuccacugaaca

SEQ ID NO: 569171 - RNA, 13 nt, Homo sapiens
gcuccagcaucca

SEQ ID NO: 569172 - RNA, 20 nt, Homo sapiens
guuuguggccucagaauuga

SEQ ID NO: 569173 - RNA, 19 nt, Homo sapiens
guuuguuauuuacacuggu

SEQ ID NO: 569174 - RNA, 22 nt, Homo sapiens
guuuguugaugugaaacauuau

SEQ ID NO: 569175 - RNA, 18 nt, Homo sapiens
guuuguugccccauuccu

SEQ ID NO: 569176 - RNA, 22 nt, Homo sapiens
guuuguugugauauagaacaaa

SEQ ID NO: 569177 - RNA, 11 nt, Homo sapiens
guuuguuguuu

SEQ ID NO: 569178 - RNA, 15 nt, Homo sapiens
guuuuaaacauuaau

SEQ ID NO: 569179 - RNA, 17 nt, Homo sapiens
guuuuaacaguucacuu

SEQ ID NO: 569180 - RNA, 20 nt, Homo sapiens
guuuuaagaaacuagcagau

SEQ ID NO: 569181 - RNA, 12 nt, Homo sapiens
guuuuaccagcu

SEQ ID NO: 569182 - RNA, 14 nt, Homo sapiens
guuuuaccagcucc

SEQ ID NO: 569183 - RNA, 12 nt, Homo sapiens
guuuuacccaga

SEQ ID NO: 569184 - RNA, 18 nt, Homo sapiens
guuuuacgucugggagaa

SEQ ID NO: 569185 - RNA, 10 nt, Homo sapiens
guuuuacuaa

SEQ ID NO: 569186 - RNA, 18 nt, Homo sapiens
guuuuagcacccccaugg

SEQ ID NO: 569187 - RNA, 17 nt, Homo sapiens
guuuuaggguacaguuu

SEQ ID NO: 569188 - RNA, 17 nt, Homo sapiens
guuuuauaaaagccuug

SEQ ID NO: 569189 - RNA, 15 nt, Homo sapiens
guuuuauaauuuaau

SEQ ID NO: 569190 - RNA, 15 nt, Homo sapiens
guuuuauauguugcu

SEQ ID NO: 569191 - RNA, 23 nt, Homo sapiens
guuuucaauaacaaagcacauaa

SEQ ID NO: 569192 - RNA, 21 nt, Homo sapiens
guuuucaauuuuaaacauauc

SEQ ID NO: 569193 - RNA, 13 nt, Homo sapiens
guuuucacacuga

SEQ ID NO: 569194 - RNA, 11 nt, Homo sapiens
guuuucagugu

SEQ ID NO: 569195 - RNA, 18 nt, Homo sapiens
guuuucauaauaccucac

SEQ ID NO: 569196 - RNA, 17 nt, Homo sapiens
guuuucauccuggccuc

SEQ ID NO: 569197 - RNA, 12 nt, Homo sapiens
guuuucauuugc

SEQ ID NO: 569198 - RNA, 12 nt, Homo sapiens
guuuucauuugu

SEQ ID NO: 569199 - RNA, 13 nt, Homo sapiens
guuuuccaaagag

SEQ ID NO: 569200 - RNA, 19 nt, Homo sapiens
guuuuccagucucuuguac

SEQ ID NO: 569201 - RNA, 18 nt, Homo sapiens
guuuuccccaaaccauaa

SEQ ID NO: 569202 - RNA, 17 nt, Homo sapiens
guuuuccuaaaugcagu

SEQ ID NO: 569203 - RNA, 19 nt, Homo sapiens
guuuucguuguuguuaaca

SEQ ID NO: 569204 - RNA, 12 nt, Homo sapiens
guuuucuccucu

SEQ ID NO: 569205 - RNA, 21 nt, Homo sapiens
guuuucugagcccgggcugcc

SEQ ID NO: 569206 - RNA, 20 nt, Homo sapiens
guuuucuguaaauaaccuau

SEQ ID NO: 569207 - RNA, 17 nt, Homo sapiens
guuuugaaaagaacaaa

SEQ ID NO: 569208 - RNA, 16 nt, Homo sapiens
guuuugaaaugcagaa

SEQ ID NO: 569209 - RNA, 20 nt, Homo sapiens
guuuugcauuuuuugaauau

SEQ ID NO: 569210 - RNA, 16 nt, Homo sapiens
guuuugcuacauucua

SEQ ID NO: 569211 - RNA, 18 nt, Homo sapiens
guuuuggagaguuugccu

SEQ ID NO: 569212 - RNA, 13 nt, Homo sapiens
guuuugggccaga

SEQ ID NO: 569213 - RNA, 19 nt, Homo sapiens
guuuuguuaauauacccca

SEQ ID NO: 569214 - RNA, 23 nt, Homo sapiens
guuuuguugagcaugacagccug

SEQ ID NO: 569215 - RNA, 15 nt, Homo sapiens
guuuuuacauucaau

SEQ ID NO: 569216 - RNA, 20 nt, Homo sapiens
guuuuuagauuaaacaaaca

SEQ ID NO: 569217 - RNA, 14 nt, Homo sapiens
guuuuuagcuggug

SEQ ID NO: 569218 - RNA, 20 nt, Homo sapiens
guuuuuauauuaauguacuu

SEQ ID NO: 569219 - RNA, 14 nt, Homo sapiens
guuuuucacuuugg

SEQ ID NO: 569220 - RNA, 14 nt, Homo sapiens
guuuuucagcaccc

SEQ ID NO: 569221 - RNA, 18 nt, Homo sapiens
guuuuuccacuacugcua

SEQ ID NO: 569222 - RNA, 13 nt, Homo sapiens
guuuuuccuccau

SEQ ID NO: 569223 - RNA, 12 nt, Homo sapiens
guuuuugccaaa

SEQ ID NO: 569224 - RNA, 14 nt, Homo sapiens
guuuuugcuguuaa

SEQ ID NO: 569225 - RNA, 17 nt, Homo sapiens
guuuuugcuuguuauau

SEQ ID NO: 569226 - RNA, 15 nt, Homo sapiens
guuuuugucuaugaa

SEQ ID NO: 569227 - RNA, 16 nt, Homo sapiens
guuuuuuaaauguaua

SEQ ID NO: 569228 - RNA, 16 nt, Homo sapiens
cuuaauaaauauuaca

SEQ ID NO: 569229 - RNA, 21 nt, Homo sapiens
cuuaauaaauauuacagugaa

SEQ ID NO: 569230 - RNA, 19 nt, Homo sapiens
cuuaauaacauacaaugac

SEQ ID NO: 569231 - RNA, 13 nt, Homo sapiens
cuuaauacugucc

SEQ ID NO: 569232 - RNA, 20 nt, Homo sapiens
cuuaauacuuuaugaugcua

SEQ ID NO: 569233 - RNA, 19 nt, Homo sapiens
cuuaauagcuguaguuuuc

SEQ ID NO: 569234 - RNA, 21 nt, Homo sapiens
cuuaauagcuguaguuuuccc

SEQ ID NO: 569235 - RNA, 14 nt, Homo sapiens
cuuaauaguauuua

SEQ ID NO: 569236 - RNA, 22 nt, Homo sapiens
cuuaauauaaauucacuuucau

SEQ ID NO: 569237 - RNA, 19 nt, Homo sapiens
cuuaauauuucuucaaaua

SEQ ID NO: 569238 - RNA, 20 nt, Homo sapiens
cuuaauccaauauuuugccu

SEQ ID NO: 569239 - RNA, 17 nt, Homo sapiens
cuuaaucuuauggggcc

SEQ ID NO: 569240 - RNA, 21 nt, Homo sapiens
cuuaaugauccguuccauugc

SEQ ID NO: 569241 - RNA, 13 nt, Homo sapiens
cuuaaugcaaauu

SEQ ID NO: 569242 - RNA, 15 nt, Homo sapiens
cuuaauguuuauucc

SEQ ID NO: 569243 - RNA, 16 nt, Homo sapiens
cuuaauucacucccac

SEQ ID NO: 569244 - RNA, 20 nt, Homo sapiens
cuuaauucuaagacuuuuga

SEQ ID NO: 569245 - RNA, 15 nt, Homo sapiens
cuuaauucucugcaa

SEQ ID NO: 569246 - RNA, 14 nt, Homo sapiens
cuuaauuuaaguca

SEQ ID NO: 569247 - RNA, 15 nt, Homo sapiens
cuuaauuuuaagugu

SEQ ID NO: 569248 - RNA, 16 nt, Homo sapiens
cuuaauuuuagggaca

SEQ ID NO: 569249 - RNA, 14 nt, Homo sapiens
cuuaauuuucagua

SEQ ID NO: 569250 - RNA, 21 nt, Homo sapiens
cuuacaacgccgagugcacug

SEQ ID NO: 569251 - RNA, 20 nt, Homo sapiens
cuuacacuuuaugcacaaaa

SEQ ID NO: 569252 - RNA, 20 nt, Homo sapiens
cuuacagaaaauauagccau

SEQ ID NO: 569253 - RNA, 16 nt, Homo sapiens
cuuacaucauguguug

SEQ ID NO: 569254 - RNA, 13 nt, Homo sapiens
cuuacauggcgcu

SEQ ID NO: 569255 - RNA, 20 nt, Homo sapiens
cuuacauuuacaaacugaag

SEQ ID NO: 569256 - RNA, 13 nt, Homo sapiens
cuuaccaacaucu

SEQ ID NO: 569257 - RNA, 21 nt, Homo sapiens
cuuaccagaucuaauauugac

SEQ ID NO: 569258 - RNA, 17 nt, Homo sapiens
cuuaccccgagaccuca

SEQ ID NO: 569259 - RNA, 22 nt, Homo sapiens
cuuacccugguaaucagcaaaa

SEQ ID NO: 569260 - RNA, 18 nt, Homo sapiens
cuuaccugaccucuugcu

SEQ ID NO: 569261 - RNA, 17 nt, Homo sapiens
cuuacuaaugugcccca

SEQ ID NO: 569262 - RNA, 11 nt, Homo sapiens
cuuacuccauc

SEQ ID NO: 569263 - RNA, 15 nt, Homo sapiens
cuuacuguacauaca

SEQ ID NO: 569264 - RNA, 18 nt, Homo sapiens
cuuacuguagccucagau

SEQ ID NO: 569265 - RNA, 14 nt, Homo sapiens
cuuacuguugcaua

SEQ ID NO: 569266 - RNA, 16 nt, Homo sapiens
cuuacuuuacugccug

SEQ ID NO: 569267 - RNA, 14 nt, Homo sapiens
cuuacuuugaguua

SEQ ID NO: 569268 - RNA, 14 nt, Homo sapiens
cuuagaaaaaccac

SEQ ID NO: 569269 - RNA, 20 nt, Homo sapiens
cuuagaaaauucaagcauuu

SEQ ID NO: 569270 - RNA, 18 nt, Homo sapiens
cuuagaaauucagcauuu

SEQ ID NO: 569271 - RNA, 17 nt, Homo sapiens
cuuagaagccaugggac

SEQ ID NO: 569272 - RNA, 13 nt, Homo sapiens
cuuagaauaucua

SEQ ID NO: 569273 - RNA, 18 nt, Homo sapiens
cuuagaauugaccaaaua

SEQ ID NO: 569274 - RNA, 23 nt, Homo sapiens
cuuagaauuuuggguauuguaau

SEQ ID NO: 569275 - RNA, 14 nt, Homo sapiens
cuuagacauaacaa

SEQ ID NO: 569276 - RNA, 15 nt, Homo sapiens
cuuagacgaagaagc

SEQ ID NO: 569277 - RNA, 15 nt, Homo sapiens
cuuagagaggacaau

SEQ ID NO: 569278 - RNA, 19 nt, Homo sapiens
cuuagagugcccagcagag

SEQ ID NO: 569279 - RNA, 17 nt, Homo sapiens
cuuagaguguagcugua

SEQ ID NO: 569280 - RNA, 14 nt, Homo sapiens
cuuagauauuaaaa

SEQ ID NO: 569281 - RNA, 15 nt, Homo sapiens
cuuagauucagggga

SEQ ID NO: 569282 - RNA, 13 nt, Homo sapiens
cuuagcacacuca

SEQ ID NO: 569283 - RNA, 14 nt, Homo sapiens
cuuagcaugcaguu

SEQ ID NO: 569284 - RNA, 11 nt, Homo sapiens
cuuagccauuu

SEQ ID NO: 569285 - RNA, 21 nt, Homo sapiens
cuuagccauuuuucaaagcaa

SEQ ID NO: 569286 - RNA, 23 nt, Homo sapiens
cuuagccauuuuucaaagcaauu

SEQ ID NO: 569287 - RNA, 16 nt, Homo sapiens
cuuagccccagacucu

SEQ ID NO: 569288 - RNA, 16 nt, Homo sapiens
cuuagcugucugcuca

SEQ ID NO: 569289 - RNA, 23 nt, Homo sapiens
cuuaggacuaccagccauacaaa

SEQ ID NO: 569290 - RNA, 20 nt, Homo sapiens
cuuaggacuuuccacuccug

SEQ ID NO: 569291 - RNA, 16 nt, Homo sapiens
cuuaggauggggcucc

SEQ ID NO: 569292 - RNA, 18 nt, Homo sapiens
cuuaggauucuguucccu

SEQ ID NO: 569293 - RNA, 16 nt, Homo sapiens
cuuaggcacugaggga

SEQ ID NO: 569294 - RNA, 18 nt, Homo sapiens
cuuaggcccuagcggcag

SEQ ID NO: 569295 - RNA, 10 nt, Homo sapiens
cuucauucua

SEQ ID NO: 569296 - RNA, 16 nt, Homo sapiens
cuucauugcaguuauu

SEQ ID NO: 569297 - RNA, 22 nt, Homo sapiens
cuucauuugacacaaagcuucu

SEQ ID NO: 569298 - RNA, 17 nt, Homo sapiens
cuucauuugcaauucau

SEQ ID NO: 569299 - RNA, 14 nt, Homo sapiens
cuucauuuguguca

SEQ ID NO: 569300 - RNA, 20 nt, Homo sapiens
cuucauuuuuaagacuguaa

SEQ ID NO: 569301 - RNA, 17 nt, Homo sapiens
cuuccaaauuuggcuca

SEQ ID NO: 569302 - RNA, 20 nt, Homo sapiens
cuuccaacccgccggucuca

SEQ ID NO: 569303 - RNA, 13 nt, Homo sapiens
cuuccaagacuga

SEQ ID NO: 569304 - RNA, 21 nt, Homo sapiens
cuuccaauuuacauacucugc

SEQ ID NO: 569305 - RNA, 13 nt, Homo sapiens
cuuccacaaagaa

SEQ ID NO: 569306 - RNA, 19 nt, Homo sapiens
cuuccacaauucacuagac

SEQ ID NO: 569307 - RNA, 20 nt, Homo sapiens
cuuccacaugggugcauuug

SEQ ID NO: 569308 - RNA, 15 nt, Homo sapiens
cuuccacccgucucu

SEQ ID NO: 569309 - RNA, 13 nt, Homo sapiens
cuuccacuuugag

SEQ ID NO: 569310 - RNA, 18 nt, Homo sapiens
cuuccagauugacgacaa

SEQ ID NO: 569311 - RNA, 14 nt, Homo sapiens
cuuccagauuuccu

SEQ ID NO: 569312 - RNA, 23 nt, Homo sapiens
cuuccagcaagcaaagugcuuug

SEQ ID NO: 569313 - RNA, 15 nt, Homo sapiens
cuuccagcacugacu

SEQ ID NO: 569314 - RNA, 15 nt, Homo sapiens
cuuccagccuccuuu

SEQ ID NO: 569315 - RNA, 20 nt, Homo sapiens
cuuccaggauggauguuggg

SEQ ID NO: 569316 - RNA, 20 nt, Homo sapiens
cuuccauaaugcuacugucu

SEQ ID NO: 569317 - RNA, 18 nt, Homo sapiens
cuuccauacacagaggag

SEQ ID NO: 569318 - RNA, 13 nt, Homo sapiens
cuuccaugucucc

SEQ ID NO: 569319 - RNA, 24 nt, Homo sapiens
cuuccauuaacuuagcauguguug

SEQ ID NO: 569320 - RNA, 12 nt, Homo sapiens
cuuccauuugcu

SEQ ID NO: 569321 - RNA, 16 nt, Homo sapiens
cuuccauuugugugug

SEQ ID NO: 569322 - RNA, 21 nt, Homo sapiens
cuuccauuugugugugugcaa

SEQ ID NO: 569323 - RNA, 20 nt, Homo sapiens
cuucccaaguagcugggauu

SEQ ID NO: 569324 - RNA, 21 nt, Homo sapiens
cuucccaccuacugcacuuuc

SEQ ID NO: 569325 - RNA, 20 nt, Homo sapiens
cuucccaccucacagugaug

SEQ ID NO: 569326 - RNA, 23 nt, Homo sapiens
cuucccauuguggcuccuaucug

SEQ ID NO: 569327 - RNA, 12 nt, Homo sapiens
cuucccauuucu

SEQ ID NO: 569328 - RNA, 15 nt, Homo sapiens
cuucccauuucucua

SEQ ID NO: 569329 - RNA, 18 nt, Homo sapiens
cuucccauuucucuacac

SEQ ID NO: 569330 - RNA, 17 nt, Homo sapiens
cuuccccaaacccagaa

SEQ ID NO: 569331 - RNA, 17 nt, Homo sapiens
cuuccccaagggccaaa

SEQ ID NO: 569332 - RNA, 20 nt, Homo sapiens
cuuccccaggcccaccauca

SEQ ID NO: 569333 - RNA, 15 nt, Homo sapiens
cuuccccagguccuu

SEQ ID NO: 569334 - RNA, 22 nt, Homo sapiens
cuucccccaagauugagcucuc

SEQ ID NO: 569335 - RNA, 16 nt, Homo sapiens
cuucccccacauuggg

SEQ ID NO: 569336 - RNA, 15 nt, Homo sapiens
cuucccccacuuccc

SEQ ID NO: 569337 - RNA, 14 nt, Homo sapiens
cuucccccugcaaa

SEQ ID NO: 569338 - RNA, 16 nt, Homo sapiens
cuuccccgaaucacac

SEQ ID NO: 569339 - RNA, 23 nt, Homo sapiens
cuuccccggggucuucuaccuca

SEQ ID NO: 569340 - RNA, 14 nt, Homo sapiens
cuuccccugggcaa

SEQ ID NO: 569341 - RNA, 16 nt, Homo sapiens
cuuccccuucuugcca

SEQ ID NO: 569342 - RNA, 13 nt, Homo sapiens
cuuccccuugccc

SEQ ID NO: 569343 - RNA, 22 nt, Homo sapiens
cuucccgccuuccaaaaccugc

SEQ ID NO: 569344 - RNA, 16 nt, Homo sapiens
cuucccucccuaucua

SEQ ID NO: 569345 - RNA, 19 nt, Homo sapiens
cuucccucgcaugucuccc

SEQ ID NO: 569346 - RNA, 12 nt, Homo sapiens
cuucccugauug

SEQ ID NO: 569347 - RNA, 18 nt, Homo sapiens
cuucccugcagagcuuug

SEQ ID NO: 569348 - RNA, 15 nt, Homo sapiens
cuucccugcauuaac

SEQ ID NO: 569349 - RNA, 18 nt, Homo sapiens
cuucccuguauuaccucc

SEQ ID NO: 569350 - RNA, 16 nt, Homo sapiens
cuucccuuaccucaaa

SEQ ID NO: 569351 - RNA, 22 nt, Homo sapiens
cuucccuugcuggaaaacccaa

SEQ ID NO: 569352 - RNA, 23 nt, Homo sapiens
cuuccgucucccccguguucccc

SEQ ID NO: 569353 - RNA, 16 nt, Homo sapiens
cuuccuacccuuccuc

SEQ ID NO: 569354 - RNA, 12 nt, Homo sapiens
uaaaauacucag

SEQ ID NO: 569355 - RNA, 12 nt, Homo sapiens
uaaaauagagua

SEQ ID NO: 569356 - RNA, 18 nt, Homo sapiens
uaaaauagcauacugugu

SEQ ID NO: 569357 - RNA, 14 nt, Homo sapiens
uaaaauaguuuaga

SEQ ID NO: 569358 - RNA, 17 nt, Homo sapiens
uaaaauauaagaucuga

SEQ ID NO: 569359 - RNA, 20 nt, Homo sapiens
uaaaauauccuguaacuaca

SEQ ID NO: 569360 - RNA, 14 nt, Homo sapiens
uaaaauauuaauaa

SEQ ID NO: 569361 - RNA, 14 nt, Homo sapiens
uaaaauauuacaca

SEQ ID NO: 569362 - RNA, 15 nt, Homo sapiens
uaaaauauuauugaa

SEQ ID NO: 569363 - RNA, 16 nt, Homo sapiens
uaaaauauuauuugau

SEQ ID NO: 569364 - RNA, 19 nt, Homo sapiens
uaaaauauuccugcauuug

SEQ ID NO: 569365 - RNA, 18 nt, Homo sapiens
uaaaauauuuaucugauu

SEQ ID NO: 569366 - RNA, 19 nt, Homo sapiens
uaaaauauuuaugagaaag

SEQ ID NO: 569367 - RNA, 14 nt, Homo sapiens
uaaaaucacuguca

SEQ ID NO: 569368 - RNA, 13 nt, Homo sapiens
uaaaaucacuuca

SEQ ID NO: 569369 - RNA, 18 nt, Homo sapiens
uaaaaucccaagucauuu

SEQ ID NO: 569370 - RNA, 16 nt, Homo sapiens
uaaaauccuaagacac

SEQ ID NO: 569371 - RNA, 23 nt, Homo sapiens
uaaaauccuaagacacaaaugca

SEQ ID NO: 569372 - RNA, 15 nt, Homo sapiens
uaaaaucuacuuuuc

SEQ ID NO: 569373 - RNA, 20 nt, Homo sapiens
uaaaaugaaauuacuacaaa

SEQ ID NO: 569374 - RNA, 18 nt, Homo sapiens
uaaaaugaacaucucuug

SEQ ID NO: 569375 - RNA, 22 nt, Homo sapiens
uaaaaugaaccugaucacuuuu

SEQ ID NO: 569376 - RNA, 21 nt, Homo sapiens
uaaaaugaaggaaaagcaugu

SEQ ID NO: 569377 - RNA, 18 nt, Homo sapiens
uaaaaugacaaagccauu

SEQ ID NO: 569378 - RNA, 14 nt, Homo sapiens
uaaaaugacagauc

SEQ ID NO: 569379 - RNA, 14 nt, Homo sapiens
uaaaaugacauuca

SEQ ID NO: 569380 - RNA, 22 nt, Homo sapiens
uaaaaugagaucguuguuuaca

SEQ ID NO: 569381 - RNA, 13 nt, Homo sapiens
uaaaaugcagugg

SEQ ID NO: 569382 - RNA, 14 nt, Homo sapiens
uaaaaugcauugaa

SEQ ID NO: 569383 - RNA, 15 nt, Homo sapiens
uaaaaugcauugaaa

SEQ ID NO: 569384 - RNA, 15 nt, Homo sapiens
uaaaauggcaccuuc

SEQ ID NO: 569385 - RNA, 20 nt, Homo sapiens
uaaaaugggaagacugagcu

SEQ ID NO: 569386 - RNA, 19 nt, Homo sapiens
uaaaauguacucagcuauc

SEQ ID NO: 569387 - RNA, 14 nt, Homo sapiens
uaaaauguauucaa

SEQ ID NO: 569388 - RNA, 21 nt, Homo sapiens
uaaaaugucuagcuugguggu

SEQ ID NO: 569389 - RNA, 20 nt, Homo sapiens
uaaaaugugaggaagaacua

SEQ ID NO: 569390 - RNA, 23 nt, Homo sapiens
uaaaaugugauuuuucuucaggu

SEQ ID NO: 569391 - RNA, 19 nt, Homo sapiens
uaaaauguuaccacuacuu

SEQ ID NO: 569392 - RNA, 12 nt, Homo sapiens
uaaaauguuuaa

SEQ ID NO: 569393 - RNA, 20 nt, Homo sapiens
uaaaauuaucaauaucuaau

SEQ ID NO: 569394 - RNA, 18 nt, Homo sapiens
uaaaauuaugccauagca

SEQ ID NO: 569395 - RNA, 14 nt, Homo sapiens
uaaaauuauucaaa

SEQ ID NO: 569396 - RNA, 13 nt, Homo sapiens
uaaaauuauuuca

SEQ ID NO: 569397 - RNA, 17 nt, Homo sapiens
uaaaauucagaugcugu

SEQ ID NO: 569398 - RNA, 17 nt, Homo sapiens
uaaaauuccuaucucau

SEQ ID NO: 569399 - RNA, 17 nt, Homo sapiens
uaaaauugaaaguaaua

SEQ ID NO: 569400 - RNA, 15 nt, Homo sapiens
uaaaauugcacuuuu

SEQ ID NO: 569401 - RNA, 17 nt, Homo sapiens
uaaaauugcaguuucau

SEQ ID NO: 569402 - RNA, 16 nt, Homo sapiens
uaaaauugcugugcuu

SEQ ID NO: 569403 - RNA, 14 nt, Homo sapiens
uaaaauuggcacca

SEQ ID NO: 569404 - RNA, 12 nt, Homo sapiens
uaaaauugugag

SEQ ID NO: 569405 - RNA, 15 nt, Homo sapiens
uaaaauuuggugcuu

SEQ ID NO: 569406 - RNA, 14 nt, Homo sapiens
uaaacaaagcagua

SEQ ID NO: 569407 - RNA, 14 nt, Homo sapiens
uaaacaaauaacaa

SEQ ID NO: 569408 - RNA, 17 nt, Homo sapiens
uaaacacaccggagaag

SEQ ID NO: 569409 - RNA, 22 nt, Homo sapiens
uaaacacauguucugugccugc

SEQ ID NO: 569410 - RNA, 14 nt, Homo sapiens
uaaacacccaugaa

SEQ ID NO: 569411 - RNA, 17 nt, Homo sapiens
uaaacacuguauuguaa

SEQ ID NO: 569412 - RNA, 12 nt, Homo sapiens
uaaacagaauaa

SEQ ID NO: 569413 - RNA, 17 nt, Homo sapiens
uaaacagauggcacuuu

SEQ ID NO: 569414 - RNA, 18 nt, Homo sapiens
uaaacagauggcacuuug

SEQ ID NO: 569415 - RNA, 19 nt, Homo sapiens
uaaacagauggcacuuuga

SEQ ID NO: 569416 - RNA, 19 nt, Homo sapiens
uaaacagguguuugccuua

SEQ ID NO: 569417 - RNA, 14 nt, Homo sapiens
uaaacauccuucaa

SEQ ID NO: 569418 - RNA, 12 nt, Homo sapiens
cuugauuccagu

SEQ ID NO: 569419 - RNA, 13 nt, Homo sapiens
cuugauuguacuu

SEQ ID NO: 569420 - RNA, 20 nt, Homo sapiens
cuugauuuagcacuauuuac

SEQ ID NO: 569421 - RNA, 14 nt, Homo sapiens
cuugauuucacugg

SEQ ID NO: 569422 - RNA, 22 nt, Homo sapiens
cuugauuuugcccccugaggga

SEQ ID NO: 569423 - RNA, 22 nt, Homo sapiens
cuugcaaaaaguagacuuggug

SEQ ID NO: 569424 - RNA, 17 nt, Homo sapiens
cuugcaacuaaggacaa

SEQ ID NO: 569425 - RNA, 21 nt, Homo sapiens
cuugcaacuaaggacaaauua

SEQ ID NO: 569426 - RNA, 13 nt, Homo sapiens
cuugcaagccaua

SEQ ID NO: 569427 - RNA, 14 nt, Homo sapiens
cuugcaaucuaauc

SEQ ID NO: 569428 - RNA, 18 nt, Homo sapiens
cuugcacacccacugccc

SEQ ID NO: 569429 - RNA, 15 nt, Homo sapiens
cuugcaccguccuca

SEQ ID NO: 569430 - RNA, 20 nt, Homo sapiens
cuugcacuccggagguagag

SEQ ID NO: 569431 - RNA, 13 nt, Homo sapiens
cuugcacuguuac

SEQ ID NO: 569432 - RNA, 18 nt, Homo sapiens
cuugcacuuguuauauua

SEQ ID NO: 569433 - RNA, 15 nt, Homo sapiens
cuugcagaacugcca

SEQ ID NO: 569434 - RNA, 16 nt, Homo sapiens
cuugcagaacugccau

SEQ ID NO: 569435 - RNA, 24 nt, Homo sapiens
cuugcauaggcucuuaagcagcau

SEQ ID NO: 569436 - RNA, 14 nt, Homo sapiens
cuugcaucacuuaa

SEQ ID NO: 569437 - RNA, 14 nt, Homo sapiens
cuugcauugcugga

SEQ ID NO: 569438 - RNA, 13 nt, Homo sapiens
cuugccacacccc

SEQ ID NO: 569439 - RNA, 14 nt, Homo sapiens
cuugccacccaaau

SEQ ID NO: 569440 - RNA, 18 nt, Homo sapiens
cuugccacccauucuucc

SEQ ID NO: 569441 - RNA, 14 nt, Homo sapiens
cuugccagauuacc

SEQ ID NO: 569442 - RNA, 21 nt, Homo sapiens
cuugccauuauuaacccauuu

SEQ ID NO: 569443 - RNA, 20 nt, Homo sapiens
cuugccauuuguagcuuugc

SEQ ID NO: 569444 - RNA, 17 nt, Homo sapiens
cuugcccagacuacagg

SEQ ID NO: 569445 - RNA, 16 nt, Homo sapiens
cuugcccugaccuccc

SEQ ID NO: 569446 - RNA, 11 nt, Homo sapiens
cuugccucuuc

SEQ ID NO: 569447 - RNA, 13 nt, Homo sapiens
cuugccuggucac

SEQ ID NO: 569448 - RNA, 21 nt, Homo sapiens
cuugccugugcuacaauucau

SEQ ID NO: 569449 - RNA, 16 nt, Homo sapiens
cuugcggaagccauag

SEQ ID NO: 569450 - RNA, 16 nt, Homo sapiens
cuugcguagaauugca

SEQ ID NO: 569451 - RNA, 22 nt, Homo sapiens
cuugcguggacagucaggguuc

SEQ ID NO: 569452 - RNA, 21 nt, Homo sapiens
cuugcuaaaagauuauagaag

SEQ ID NO: 569453 - RNA, 17 nt, Homo sapiens
cuugcuauguugcccaa

SEQ ID NO: 569454 - RNA, 21 nt, Homo sapiens
cuugcuauuugagcaugcaca

SEQ ID NO: 569455 - RNA, 22 nt, Homo sapiens
cuugcuauuugagcaugcacag

SEQ ID NO: 569456 - RNA, 16 nt, Homo sapiens
cuugcucacucacuca

SEQ ID NO: 569457 - RNA, 18 nt, Homo sapiens
cuugcucugcacccccau

SEQ ID NO: 569458 - RNA, 12 nt, Homo sapiens
cuugcucugcau

SEQ ID NO: 569459 - RNA, 17 nt, Homo sapiens
cuugcucuguuacccag

SEQ ID NO: 569460 - RNA, 20 nt, Homo sapiens
cuugcuggaaaacccaaagu

SEQ ID NO: 569461 - RNA, 15 nt, Homo sapiens
cuugcuuaccucuca

SEQ ID NO: 569462 - RNA, 14 nt, Homo sapiens
cuugcuucauucug

SEQ ID NO: 569463 - RNA, 14 nt, Homo sapiens
cuugcuuccugucu

SEQ ID NO: 569464 - RNA, 19 nt, Homo sapiens
cuugcuucuaaaugcccag

SEQ ID NO: 569465 - RNA, 18 nt, Homo sapiens
cuugcuucucuucuuucc

SEQ ID NO: 569466 - RNA, 23 nt, Homo sapiens
cuugcuuguugggauuccugacc

SEQ ID NO: 569467 - RNA, 22 nt, Homo sapiens
cuuggaaagcaucaccucaggc

SEQ ID NO: 569468 - RNA, 17 nt, Homo sapiens
cuuggaaagcugaugau

SEQ ID NO: 569469 - RNA, 23 nt, Homo sapiens
cuuggaaauagaaagaagccaua

SEQ ID NO: 569470 - RNA, 23 nt, Homo sapiens
cuuggaaaucagguagaccauau

SEQ ID NO: 569471 - RNA, 12 nt, Homo sapiens
cuuggaacauac

SEQ ID NO: 569472 - RNA, 14 nt, Homo sapiens
cuuggaacauggaa

SEQ ID NO: 569473 - RNA, 16 nt, Homo sapiens
cuuggaacauuggaau

SEQ ID NO: 569474 - RNA, 14 nt, Homo sapiens
cuuggaaggugaca

SEQ ID NO: 569475 - RNA, 16 nt, Homo sapiens
cuuggaccaugccaga

SEQ ID NO: 569476 - RNA, 13 nt, Homo sapiens
cuuggaccucagu

SEQ ID NO: 569477 - RNA, 19 nt, Homo sapiens
cuuggacuauuauaauuua

SEQ ID NO: 569478 - RNA, 21 nt, Homo sapiens
cuuggagaaugugagaagcca

SEQ ID NO: 569479 - RNA, 17 nt, Homo sapiens
cuuggagagcaaaggcc

SEQ ID NO: 569480 - RNA, 18 nt, Homo sapiens
cuuggagauuuaacaccc

SEQ ID NO: 569481 - RNA, 20 nt, Homo sapiens
uaaauggcauggaguauagu

SEQ ID NO: 569482 - RNA, 22 nt, Homo sapiens
uaaaugggaaaucaguguuuua

SEQ ID NO: 569483 - RNA, 15 nt, Homo sapiens
uaaaugggacuggag

SEQ ID NO: 569484 - RNA, 16 nt, Homo sapiens
uaaauggguagagaaa

SEQ ID NO: 569485 - RNA, 18 nt, Homo sapiens
uaaauguauacuauagua

SEQ ID NO: 569486 - RNA, 21 nt, Homo sapiens
uaaauguauacuauaguacca

SEQ ID NO: 569487 - RNA, 16 nt, Homo sapiens
uaaaugucacugccaa

SEQ ID NO: 569488 - RNA, 22 nt, Homo sapiens
uaaaugucuuguuucccagauu

SEQ ID NO: 569489 - RNA, 20 nt, Homo sapiens
uaaaugugacauugauuugc

SEQ ID NO: 569490 - RNA, 14 nt, Homo sapiens
uaaauguugcccua

SEQ ID NO: 569491 - RNA, 12 nt, Homo sapiens
uaaauguugcuu

SEQ ID NO: 569492 - RNA, 19 nt, Homo sapiens
uaaauguuuauacuguauu

SEQ ID NO: 569493 - RNA, 14 nt, Homo sapiens
uaaauuacagucau

SEQ ID NO: 569494 - RNA, 16 nt, Homo sapiens
uaaauuaccuugccaa

SEQ ID NO: 569495 - RNA, 20 nt, Homo sapiens
uaaauuacuuuuucauucuu

SEQ ID NO: 569496 - RNA, 14 nt, Homo sapiens
uaaauuaguauuua

SEQ ID NO: 569497 - RNA, 22 nt, Homo sapiens
uaaauuauacuggagaagucuu

SEQ ID NO: 569498 - RNA, 18 nt, Homo sapiens
uaaauuauaucugugaau

SEQ ID NO: 569499 - RNA, 18 nt, Homo sapiens
uaaauucaaauuauucua

SEQ ID NO: 569500 - RNA, 19 nt, Homo sapiens
uaaauucacaucucaagga

SEQ ID NO: 569501 - RNA, 17 nt, Homo sapiens
uaaauucagaacaagca

SEQ ID NO: 569502 - RNA, 22 nt, Homo sapiens
uaaauuccacacuaccacauua

SEQ ID NO: 569503 - RNA, 19 nt, Homo sapiens
uaaauuccacagauuauca

SEQ ID NO: 569504 - RNA, 18 nt, Homo sapiens
uaaauucccaacuucucu

SEQ ID NO: 569505 - RNA, 15 nt, Homo sapiens
uaaauucuaagccau

SEQ ID NO: 569506 - RNA, 13 nt, Homo sapiens
uaaauucuaccuc

SEQ ID NO: 569507 - RNA, 20 nt, Homo sapiens
uaaauugauagcagauauca

SEQ ID NO: 569508 - RNA, 15 nt, Homo sapiens
uaaauugauuuguua

SEQ ID NO: 569509 - RNA, 19 nt, Homo sapiens
uaaauugcuccuugacauu

SEQ ID NO: 569510 - RNA, 16 nt, Homo sapiens
uaaauuuaaagucuaa

SEQ ID NO: 569511 - RNA, 13 nt, Homo sapiens
uaaauuuauuuca

SEQ ID NO: 569512 - RNA, 21 nt, Homo sapiens
uaaauuuguaaacaaucuaau

SEQ ID NO: 569513 - RNA, 18 nt, Homo sapiens
uaaauuuuauaacagaau

SEQ ID NO: 569514 - RNA, 20 nt, Homo sapiens
uaaauuuuuuauaaaagugu

SEQ ID NO: 569515 - RNA, 23 nt, Homo sapiens
uaaauuuuuuugcaauccuuucc

SEQ ID NO: 569516 - RNA, 14 nt, Homo sapiens
uaacaacucuaguc

SEQ ID NO: 569517 - RNA, 15 nt, Homo sapiens
uaacaagaguuuuaa

SEQ ID NO: 569518 - RNA, 14 nt, Homo sapiens
uaacaagccagauu

SEQ ID NO: 569519 - RNA, 21 nt, Homo sapiens
uaacaagcugucuacuggaca

SEQ ID NO: 569520 - RNA, 20 nt, Homo sapiens
uaacaaguagcacccuggau

SEQ ID NO: 569521 - RNA, 19 nt, Homo sapiens
uaacaauucccaguacuau

SEQ ID NO: 569522 - RNA, 15 nt, Homo sapiens
uaacaauugucuuaa

SEQ ID NO: 569523 - RNA, 21 nt, Homo sapiens
uaacaauugucuuaaaaccag

SEQ ID NO: 569524 - RNA, 17 nt, Homo sapiens
uaacacaagccacagaa

SEQ ID NO: 569525 - RNA, 12 nt, Homo sapiens
uaacacacucca

SEQ ID NO: 569526 - RNA, 21 nt, Homo sapiens
uaacacagccguguguucaaa

SEQ ID NO: 569527 - RNA, 23 nt, Homo sapiens
uaacacauagcgccgugcuguaa

SEQ ID NO: 569528 - RNA, 19 nt, Homo sapiens
uaacaccaugauuaaccac

SEQ ID NO: 569529 - RNA, 20 nt, Homo sapiens
uaacaccgucccagggcucu

SEQ ID NO: 569530 - RNA, 21 nt, Homo sapiens
uaacacuauacucuaaaaugg

SEQ ID NO: 569531 - RNA, 12 nt, Homo sapiens
uaacacuuguca

SEQ ID NO: 569532 - RNA, 11 nt, Homo sapiens
uaacacuuugg

SEQ ID NO: 569533 - RNA, 16 nt, Homo sapiens
uaacagaaacuuucaa

SEQ ID NO: 569534 - RNA, 16 nt, Homo sapiens
uaacagaaauguacag

SEQ ID NO: 569535 - RNA, 10 nt, Homo sapiens
uaacagaauu

SEQ ID NO: 569536 - RNA, 20 nt, Homo sapiens
uaacagaggcaggaguggca

SEQ ID NO: 569537 - RNA, 17 nt, Homo sapiens
uaacagaguaucagauc

SEQ ID NO: 569538 - RNA, 20 nt, Homo sapiens
uaacagaguaucagaucuau

SEQ ID NO: 569539 - RNA, 19 nt, Homo sapiens
uaacagaucagaacaugaa

SEQ ID NO: 569540 - RNA, 18 nt, Homo sapiens
gaagucaccuuucugggc

SEQ ID NO: 569541 - RNA, 16 nt, Homo sapiens
gaagucacugcacagu

SEQ ID NO: 569542 - RNA, 21 nt, Homo sapiens
gaagucagaggagaugugguc

SEQ ID NO: 569543 - RNA, 16 nt, Homo sapiens
gaagucaucucauucc

SEQ ID NO: 569544 - RNA, 20 nt, Homo sapiens
gaagucaucucauuccacug

SEQ ID NO: 569545 - RNA, 13 nt, Homo sapiens
gaaguccagagcu

SEQ ID NO: 569546 - RNA, 18 nt, Homo sapiens
gaaguccccucuacuuua

SEQ ID NO: 569547 - RNA, 16 nt, Homo sapiens
gaaguccuccagacaa

SEQ ID NO: 569548 - RNA, 17 nt, Homo sapiens
gaaguccuucaccucac

SEQ ID NO: 569549 - RNA, 15 nt, Homo sapiens
gaagucuaacgcuga

SEQ ID NO: 569550 - RNA, 13 nt, Homo sapiens
gaagucuccucaa

SEQ ID NO: 569551 - RNA, 23 nt, Homo sapiens
gaagucuggcuuugcucuauuaa

SEQ ID NO: 569552 - RNA, 18 nt, Homo sapiens
gaagucuuagacuugaaa

SEQ ID NO: 569553 - RNA, 16 nt, Homo sapiens
gaagucuuccauagag

SEQ ID NO: 569554 - RNA, 21 nt, Homo sapiens
gaagugaccuggaaucaguga

SEQ ID NO: 569555 - RNA, 16 nt, Homo sapiens
gaagugagaaguucau

SEQ ID NO: 569556 - RNA, 22 nt, Homo sapiens
gaagugagcaaggugcucuuga

SEQ ID NO: 569557 - RNA, 17 nt, Homo sapiens
gaagugcagaagcacau

SEQ ID NO: 569558 - RNA, 19 nt, Homo sapiens
gaagugcuuuguaucagga

SEQ ID NO: 569559 - RNA, 22 nt, Homo sapiens
gaaguggaguugacucuggaag

SEQ ID NO: 569560 - RNA, 21 nt, Homo sapiens
gaaguggcuacugacuacccu

SEQ ID NO: 569561 - RNA, 16 nt, Homo sapiens
gaagugguucuauguc

SEQ ID NO: 569562 - RNA, 15 nt, Homo sapiens
gaagugucacagccu

SEQ ID NO: 569563 - RNA, 14 nt, Homo sapiens
gaaguuaaagggca

SEQ ID NO: 569564 - RNA, 20 nt, Homo sapiens
gaaguuaacaugaacucuug

SEQ ID NO: 569565 - RNA, 17 nt, Homo sapiens
gaaguugacuuauagua

SEQ ID NO: 569566 - RNA, 18 nt, Homo sapiens
gaaguugucuccuuccau

SEQ ID NO: 569567 - RNA, 21 nt, Homo sapiens
gaaguuguugcuauacauguu

SEQ ID NO: 569568 - RNA, 16 nt, Homo sapiens
gaaguuuaauugacuu

SEQ ID NO: 569569 - RNA, 15 nt, Homo sapiens
gaaguuuacaaucaa

SEQ ID NO: 569570 - RNA, 11 nt, Homo sapiens
gaaguuucauc

SEQ ID NO: 569571 - RNA, 18 nt, Homo sapiens
gaaguuugcuuuguacug

SEQ ID NO: 569572 - RNA, 14 nt, Homo sapiens
gaaguuuguguucu

SEQ ID NO: 569573 - RNA, 21 nt, Homo sapiens
gaauaaaaaauagacauguag

SEQ ID NO: 569574 - RNA, 15 nt, Homo sapiens
gaauaaaaacauuuc

SEQ ID NO: 569575 - RNA, 21 nt, Homo sapiens
gaauaaaaagguuggccuuag

SEQ ID NO: 569576 - RNA, 20 nt, Homo sapiens
gaauaaaaauauguacaagu

SEQ ID NO: 569577 - RNA, 13 nt, Homo sapiens
gaauaaaacacuc

SEQ ID NO: 569578 - RNA, 22 nt, Homo sapiens
gaauaaaacguuaguuaauccc

SEQ ID NO: 569579 - RNA, 22 nt, Homo sapiens
gaauaaaagaugauuucucaaa

SEQ ID NO: 569580 - RNA, 24 nt, Homo sapiens
gaauaaaagaugauuucucaaaaa

SEQ ID NO: 569581 - RNA, 15 nt, Homo sapiens
gaauaaaagugcaca

SEQ ID NO: 569582 - RNA, 13 nt, Homo sapiens
gaauaaaauauga

SEQ ID NO: 569583 - RNA, 19 nt, Homo sapiens
gaauaaaauugcacuuuua

SEQ ID NO: 569584 - RNA, 16 nt, Homo sapiens
gaauaaacaggaaaau

SEQ ID NO: 569585 - RNA, 22 nt, Homo sapiens
gaauaaacuagauuacauucag

SEQ ID NO: 569586 - RNA, 15 nt, Homo sapiens
gaauaaauaccucuu

SEQ ID NO: 569587 - RNA, 16 nt, Homo sapiens
gaauaaauucuaccuc

SEQ ID NO: 569588 - RNA, 17 nt, Homo sapiens
gaauaaauugcuccuug

SEQ ID NO: 569589 - RNA, 14 nt, Homo sapiens
gaauaaauuuggga

SEQ ID NO: 569590 - RNA, 21 nt, Homo sapiens
gaauaacauuuaaauuccaca

SEQ ID NO: 569591 - RNA, 15 nt, Homo sapiens
gaauaaccacuuaaa

SEQ ID NO: 569592 - RNA, 20 nt, Homo sapiens
gaauaacuguguuuccuacc

SEQ ID NO: 569593 - RNA, 23 nt, Homo sapiens
gaauaagcucuaguucuuaacaa

SEQ ID NO: 569594 - RNA, 12 nt, Homo sapiens
gaauaaggccuu

SEQ ID NO: 569595 - RNA, 15 nt, Homo sapiens
gaauaauauuguguc

SEQ ID NO: 569596 - RNA, 16 nt, Homo sapiens
gaauaaucagauuucu

SEQ ID NO: 569597 - RNA, 22 nt, Homo sapiens
gaauacaggaggcagacaauga

SEQ ID NO: 569598 - RNA, 23 nt, Homo sapiens
gaauacaggaggcagacaaugac

SEQ ID NO: 569599 - RNA, 14 nt, Homo sapiens
gaauacauugcaau

SEQ ID NO: 569600 - RNA, 14 nt, Homo sapiens
gaauacauuuccaa

SEQ ID NO: 569601 - RNA, 19 nt, Homo sapiens
gaauacccuauaagccaga

SEQ ID NO: 569602 - RNA, 18 nt, Homo sapiens
gaauacguucuccucuga

SEQ ID NO: 569603 - RNA, 19 nt, Homo sapiens
gaauacuauacagccauaa

SEQ ID NO: 569604 - RNA, 13 nt, Homo sapiens
gaauacuauguau

SEQ ID NO: 569605 - RNA, 20 nt, Homo sapiens
gaauacucugcccucuagag

SEQ ID NO: 569606 - RNA, 17 nt, Homo sapiens
gaauacucuucccacau

SEQ ID NO: 569607 - RNA, 13 nt, Homo sapiens
gaauacugugcau

SEQ ID NO: 569608 - RNA, 14 nt, Homo sapiens
gaauacugugcaua

SEQ ID NO: 569609 - RNA, 22 nt, Homo sapiens
gaauacuuaacucaauaauucu

SEQ ID NO: 569610 - RNA, 15 nt, Homo sapiens
gaauacuugaacucu

SEQ ID NO: 569611 - RNA, 17 nt, Homo sapiens
gaauacuugcacucuuu

SEQ ID NO: 569612 - RNA, 19 nt, Homo sapiens
gaauacuugcacucuuuaa

SEQ ID NO: 569613 - RNA, 15 nt, Homo sapiens
gaauagccuggccac

SEQ ID NO: 569614 - RNA, 17 nt, Homo sapiens
gaauagccuggccacca

SEQ ID NO: 569615 - RNA, 19 nt, Homo sapiens
gaauagcuuugaauguggc

SEQ ID NO: 569616 - RNA, 23 nt, Homo sapiens
gaauaggcacuuuaaaacacucu

SEQ ID NO: 569617 - RNA, 24 nt, Homo sapiens
gaauagucuuuugcaugucgcaca

SEQ ID NO: 569618 - RNA, 19 nt, Homo sapiens
gaauauaauacuguauuug

SEQ ID NO: 569619 - RNA, 17 nt, Homo sapiens
gaauauaguucugugua

SEQ ID NO: 569620 - RNA, 18 nt, Homo sapiens
gaauauaguucuguguag

SEQ ID NO: 569621 - RNA, 21 nt, Homo sapiens
gaauauaguucuguguagaga

SEQ ID NO: 569622 - RNA, 20 nt, Homo sapiens
gaauauauuauaaucuucca

SEQ ID NO: 569623 - RNA, 22 nt, Homo sapiens
gaauauauuugugugugugaua

SEQ ID NO: 569624 - RNA, 12 nt, Homo sapiens
uagagggacaaa

SEQ ID NO: 569625 - RNA, 16 nt, Homo sapiens
uagagggggucucaga

SEQ ID NO: 569626 - RNA, 18 nt, Homo sapiens
uagagucugaacagcugu

SEQ ID NO: 569627 - RNA, 17 nt, Homo sapiens
uagagugauuuugaaau

SEQ ID NO: 569628 - RNA, 19 nt, Homo sapiens
uagagugcucugacccugg

SEQ ID NO: 569629 - RNA, 15 nt, Homo sapiens
uagagugguuauuca

SEQ ID NO: 569630 - RNA, 23 nt, Homo sapiens
uagaguguaggugaaaugaauga

SEQ ID NO: 569631 - RNA, 16 nt, Homo sapiens
uagaguucacuguugu

SEQ ID NO: 569632 - RNA, 14 nt, Homo sapiens
uagaguugauacua

SEQ ID NO: 569633 - RNA, 17 nt, Homo sapiens
uagaguuuccacuaucc

SEQ ID NO: 569634 - RNA, 15 nt, Homo sapiens
uagauaaauuucaau

SEQ ID NO: 569635 - RNA, 23 nt, Homo sapiens
uagauaaccuguacuucaaguua

SEQ ID NO: 569636 - RNA, 22 nt, Homo sapiens
uagauaauaugaaaaucuccau

SEQ ID NO: 569637 - RNA, 15 nt, Homo sapiens
uagauauacauauca

SEQ ID NO: 569638 - RNA, 14 nt, Homo sapiens
uagauaucaugcaa

SEQ ID NO: 569639 - RNA, 15 nt, Homo sapiens
uagauaucaugcaaa

SEQ ID NO: 569640 - RNA, 13 nt, Homo sapiens
uagauaugccuua

SEQ ID NO: 569641 - RNA, 21 nt, Homo sapiens
uagauauugugaaguacauau

SEQ ID NO: 569642 - RNA, 22 nt, Homo sapiens
uagaucuaguucucaaucacug

SEQ ID NO: 569643 - RNA, 21 nt, Homo sapiens
uagaucucccauguguaggua

SEQ ID NO: 569644 - RNA, 16 nt, Homo sapiens
uagaucugaauaaagu

SEQ ID NO: 569645 - RNA, 17 nt, Homo sapiens
uagaugauaaaagagaa

SEQ ID NO: 569646 - RNA, 23 nt, Homo sapiens
uagaugauaaagagacagugaua

SEQ ID NO: 569647 - RNA, 18 nt, Homo sapiens
uagaugcacuuaugcagu

SEQ ID NO: 569648 - RNA, 23 nt, Homo sapiens
uagaugcacuuaugcaguaaauu

SEQ ID NO: 569649 - RNA, 12 nt, Homo sapiens
uagaugcaggag

SEQ ID NO: 569650 - RNA, 21 nt, Homo sapiens
uagaugcagguccauucugca

SEQ ID NO: 569651 - RNA, 18 nt, Homo sapiens
uagaugccagggcuggaa

SEQ ID NO: 569652 - RNA, 18 nt, Homo sapiens
uagaugugcaaccugugg

SEQ ID NO: 569653 - RNA, 12 nt, Homo sapiens
uagaugugcauu

SEQ ID NO: 569654 - RNA, 18 nt, Homo sapiens
uagauguggccuuugaau

SEQ ID NO: 569655 - RNA, 13 nt, Homo sapiens
uagaugugucuua

SEQ ID NO: 569656 - RNA, 17 nt, Homo sapiens
uagaugugucuuaccag

SEQ ID NO: 569657 - RNA, 22 nt, Homo sapiens
uagauuaagauuuuacuuuaac

SEQ ID NO: 569658 - RNA, 14 nt, Homo sapiens
uagauuacugaaaa

SEQ ID NO: 569659 - RNA, 13 nt, Homo sapiens
uagauuacugaug

SEQ ID NO: 569660 - RNA, 13 nt, Homo sapiens
uagauucagggga

SEQ ID NO: 569661 - RNA, 21 nt, Homo sapiens
uaggaaggcagcauuccauga

SEQ ID NO: 569662 - RNA, 18 nt, Homo sapiens
uaggaaggugugauguca

SEQ ID NO: 569663 - RNA, 16 nt, Homo sapiens
uaggaauaaauaaaaa

SEQ ID NO: 569664 - RNA, 23 nt, Homo sapiens
uaggaauaagcucuaguucuuaa

SEQ ID NO: 569665 - RNA, 12 nt, Homo sapiens
uaggaaucaccc

SEQ ID NO: 569666 - RNA, 17 nt, Homo sapiens
uaggaauuguuuauaca

SEQ ID NO: 569667 - RNA, 20 nt, Homo sapiens
uaggacuccaaccucaggga

SEQ ID NO: 569668 - RNA, 16 nt, Homo sapiens
uaggacucugaggcuc

SEQ ID NO: 569669 - RNA, 19 nt, Homo sapiens
uaggagaaaccagcuuuua

SEQ ID NO: 569670 - RNA, 20 nt, Homo sapiens
uaggagaaacuuagaggaaa

SEQ ID NO: 569671 - RNA, 18 nt, Homo sapiens
uaggagaagggucucaug

SEQ ID NO: 569672 - RNA, 20 nt, Homo sapiens
uaggagggcuggcaacuuag

SEQ ID NO: 569673 - RNA, 18 nt, Homo sapiens
uaggaguucucugaugca

SEQ ID NO: 569674 - RNA, 17 nt, Homo sapiens
uaggaguugaguacagu

SEQ ID NO: 569675 - RNA, 14 nt, Homo sapiens
uaggauaucuuggc

SEQ ID NO: 569676 - RNA, 13 nt, Homo sapiens
uaggaucaucucu

SEQ ID NO: 569677 - RNA, 14 nt, Homo sapiens
uaggaugacugcug

SEQ ID NO: 569678 - RNA, 12 nt, Homo sapiens
uaggaugugaug

SEQ ID NO: 569679 - RNA, 15 nt, Homo sapiens
uaggauguugcucag

SEQ ID NO: 569680 - RNA, 15 nt, Homo sapiens
uaggauuacuuagau

SEQ ID NO: 569681 - RNA, 17 nt, Homo sapiens
uaggauucuaaucucau

SEQ ID NO: 569682 - RNA, 19 nt, Homo sapiens
uaggcaccacagagaagac

SEQ ID NO: 569683 - RNA, 21 nt, Homo sapiens
uaggcagcaaaagaccaaauc

SEQ ID NO: 569684 - RNA, 18 nt, Homo sapiens
uaggcagcaucucagauc

SEQ ID NO: 569685 - RNA, 16 nt, Homo sapiens
uaggcauuaacacaaa

SEQ ID NO: 569686 - RNA, 15 nt, Homo sapiens
uaggcauuugcugaa

SEQ ID NO: 569687 - RNA, 14 nt, Homo sapiens
uaggccuaccugau

SEQ ID NO: 569688 - RNA, 23 nt, Homo sapiens
uaggcuacaauuuucucccagga

SEQ ID NO: 569689 - RNA, 14 nt, Homo sapiens
uaggcuagcuauuu

SEQ ID NO: 569690 - RNA, 22 nt, Homo sapiens
uaggcuccugccaguguggaac

SEQ ID NO: 569691 - RNA, 21 nt, Homo sapiens
uaggcucuuaugugugccuuu

SEQ ID NO: 569692 - RNA, 12 nt, Homo sapiens
uaggcuggccag

SEQ ID NO: 569693 - RNA, 15 nt, Homo sapiens
uagggaaguaacauu

SEQ ID NO: 569694 - RNA, 20 nt, Homo sapiens
uagggaaguaacauuugccu

SEQ ID NO: 569695 - RNA, 21 nt, Homo sapiens
uagggacugccaggcuguuuc

SEQ ID NO: 569696 - RNA, 14 nt, Homo sapiens
uagggagaaaccaa

SEQ ID NO: 569697 - RNA, 16 nt, Homo sapiens
uagggcaacaauacau

SEQ ID NO: 569698 - RNA, 19 nt, Homo sapiens
uagggcaauauugccaugg

SEQ ID NO: 569699 - RNA, 21 nt, Homo sapiens
uagggcacuuuaagucaguga

SEQ ID NO: 569700 - RNA, 21 nt, Homo sapiens
uagggcuguagacuuacuuuc

SEQ ID NO: 569701 - RNA, 16 nt, Homo sapiens
uaggggaacaucaccc

SEQ ID NO: 569702 - RNA, 22 nt, Homo sapiens
uagggggagcaaaucgugccuu

SEQ ID NO: 569703 - RNA, 17 nt, Homo sapiens
uaggguagugcuaagag

SEQ ID NO: 569704 - RNA, 19 nt, Homo sapiens
uagggucacuuugccauua

SEQ ID NO: 569705 - RNA, 15 nt, Homo sapiens
uaggguccaccagga

SEQ ID NO: 569706 - RNA, 22 nt, Homo sapiens
uaggguuacagagaccuaugua

SEQ ID NO: 569707 - RNA, 14 nt, Homo sapiens
uaggguuuaggaaa

SEQ ID NO: 569708 - RNA, 13 nt, Homo sapiens
uagguaaaaacug

SEQ ID NO: 569709 - RNA, 20 nt, Homo sapiens
uagguaaaauaaaagacuau

SEQ ID NO: 569710 - RNA, 17 nt, Homo sapiens
uagguaccaggugucag

SEQ ID NO: 569711 - RNA, 16 nt, Homo sapiens
uagguacgucaaagca

SEQ ID NO: 569712 - RNA, 15 nt, Homo sapiens
uagguagacuuugcu

SEQ ID NO: 569713 - RNA, 14 nt, Homo sapiens
uagguaucauucaa

SEQ ID NO: 569714 - RNA, 20 nt, Homo sapiens
uagguauugucuacucugaa

SEQ ID NO: 569715 - RNA, 17 nt, Homo sapiens
uagguccaagggccaua

SEQ ID NO: 569716 - RNA, 12 nt, Homo sapiens
uaggugagacag

SEQ ID NO: 569717 - RNA, 15 nt, Homo sapiens
uaggugcagcuccuc

SEQ ID NO: 569718 - RNA, 18 nt, Homo sapiens
uagguggagguugugcau

SEQ ID NO: 569719 - RNA, 16 nt, Homo sapiens
uagguggcaagcugug

SEQ ID NO: 569720 - RNA, 14 nt, Homo sapiens
uaggugucucauag

SEQ ID NO: 569721 - RNA, 20 nt, Homo sapiens
uaggugucucugggccugug

SEQ ID NO: 569722 - RNA, 15 nt, Homo sapiens
uagguguggcuguga

SEQ ID NO: 569723 - RNA, 16 nt, Homo sapiens
uagguuaauaaaucaa

SEQ ID NO: 569724 - RNA, 20 nt, Homo sapiens
uagguuaauaaaucaagcca

SEQ ID NO: 569725 - RNA, 14 nt, Homo sapiens
uagguuuacauuca

SEQ ID NO: 569726 - RNA, 20 nt, Homo sapiens
uagguuuacauucaucucau

SEQ ID NO: 569727 - RNA, 24 nt, Homo sapiens
uagguuucagcaacaagacugcca

SEQ ID NO: 569728 - RNA, 15 nt, Homo sapiens
uaguaaaagugcuuu

SEQ ID NO: 569729 - RNA, 14 nt, Homo sapiens
uaguaacaauacau

SEQ ID NO: 569730 - RNA, 16 nt, Homo sapiens
uaguaacuguagaugg

SEQ ID NO: 569731 - RNA, 16 nt, Homo sapiens
uaguaagaugcacuga

SEQ ID NO: 569732 - RNA, 20 nt, Homo sapiens
uaguaagggaacuauggaaa

SEQ ID NO: 569733 - RNA, 12 nt, Homo sapiens
uaguacacacuu

SEQ ID NO: 569734 - RNA, 17 nt, Homo sapiens
uaguaccuucaauacuu

SEQ ID NO: 569735 - RNA, 13 nt, Homo sapiens
uaguacugggaau

SEQ ID NO: 569736 - RNA, 20 nt, Homo sapiens
uaguacuuauguugcacaau

SEQ ID NO: 569737 - RNA, 12 nt, Homo sapiens
uaguacuugaaa

SEQ ID NO: 569738 - RNA, 20 nt, Homo sapiens
uaguagaaagacaucugccu

SEQ ID NO: 569739 - RNA, 16 nt, Homo sapiens
uaguagaaaugccaga

SEQ ID NO: 569740 - RNA, 13 nt, Homo sapiens
uaguagaacugga

SEQ ID NO: 569741 - RNA, 13 nt, Homo sapiens
uaguagcaaugug

SEQ ID NO: 569742 - RNA, 20 nt, Homo sapiens
uaguagcugggauuacaggc

SEQ ID NO: 569743 - RNA, 13 nt, Homo sapiens
uaguauacuuugu

SEQ ID NO: 569744 - RNA, 16 nt, Homo sapiens
uaguauauuuauacuc

SEQ ID NO: 569745 - RNA, 12 nt, Homo sapiens
uaguaucuguau

SEQ ID NO: 569746 - RNA, 21 nt, Homo sapiens
uaguauugcagccaaagaaua

SEQ ID NO: 569747 - RNA, 20 nt, Homo sapiens
uaguauugguguauguauga

SEQ ID NO: 569748 - RNA, 15 nt, Homo sapiens
uaguauuucucagga

SEQ ID NO: 569749 - RNA, 18 nt, Homo sapiens
gaauugugacucggcuag

SEQ ID NO: 569750 - RNA, 12 nt, Homo sapiens
gaauuguuacau

SEQ ID NO: 569751 - RNA, 21 nt, Homo sapiens
gaauuuaaaaaaacgagcaau

SEQ ID NO: 569752 - RNA, 16 nt, Homo sapiens
gaauuuaaacaaugca

SEQ ID NO: 569753 - RNA, 19 nt, Homo sapiens
gaauuuauugcacauuguu

SEQ ID NO: 569754 - RNA, 10 nt, Homo sapiens
gaauuucaca

SEQ ID NO: 569755 - RNA, 14 nt, Homo sapiens
gaauuucacaagcu

SEQ ID NO: 569756 - RNA, 17 nt, Homo sapiens
gaauuucacaagcuauu

SEQ ID NO: 569757 - RNA, 19 nt, Homo sapiens
gaauuucacaagcuauuuu

SEQ ID NO: 569758 - RNA, 13 nt, Homo sapiens
gaauuucuagaca

SEQ ID NO: 569759 - RNA, 17 nt, Homo sapiens
gaauuucugcugugguc

SEQ ID NO: 569760 - RNA, 18 nt, Homo sapiens
gaauuugaacagcucacc

SEQ ID NO: 569761 - RNA, 18 nt, Homo sapiens
gaauuugcacagugauau

SEQ ID NO: 569762 - RNA, 13 nt, Homo sapiens
gaauuuggaacaa

SEQ ID NO: 569763 - RNA, 17 nt, Homo sapiens
gaauuuggccugcacua

SEQ ID NO: 569764 - RNA, 22 nt, Homo sapiens
gaauuuguacuucuuauugcaa

SEQ ID NO: 569765 - RNA, 14 nt, Homo sapiens
gaauuuuaccauuc

SEQ ID NO: 569766 - RNA, 14 nt, Homo sapiens
gaauuuucuuccaa

SEQ ID NO: 569767 - RNA, 14 nt, Homo sapiens
gaauuuuguauauu

SEQ ID NO: 569768 - RNA, 18 nt, Homo sapiens
gaauuuuguuuguugaug

SEQ ID NO: 569769 - RNA, 20 nt, Homo sapiens
gaauuuuuacccaauuggau

SEQ ID NO: 569770 - RNA, 22 nt, Homo sapiens
gaauuuuuuuguaauaagcaau

SEQ ID NO: 569771 - RNA, 18 nt, Homo sapiens
gacaaaaaugaaauauau

SEQ ID NO: 569772 - RNA, 16 nt, Homo sapiens
gacaaaacccacuguu

SEQ ID NO: 569773 - RNA, 21 nt, Homo sapiens
gacaaaaggaaaggucucagc

SEQ ID NO: 569774 - RNA, 14 nt, Homo sapiens
gacaaacuccugaa

SEQ ID NO: 569775 - RNA, 23 nt, Homo sapiens
gacaaagagauugagguucucua

SEQ ID NO: 569776 - RNA, 19 nt, Homo sapiens
gacaaaggccacaggcagu

SEQ ID NO: 569777 - RNA, 22 nt, Homo sapiens
gacaaagugacauuccugaguc

SEQ ID NO: 569778 - RNA, 16 nt, Homo sapiens
gacaaagugagacucc

SEQ ID NO: 569779 - RNA, 15 nt, Homo sapiens
gacaaagugccucau

SEQ ID NO: 569780 - RNA, 19 nt, Homo sapiens
gacaaaguugaauguaaag

SEQ ID NO: 569781 - RNA, 16 nt, Homo sapiens
gacaaauaauaagcaa

SEQ ID NO: 569782 - RNA, 15 nt, Homo sapiens
gacaaaucuguuguu

SEQ ID NO: 569783 - RNA, 23 nt, Homo sapiens
gacaacaaaugggucccucaguc

SEQ ID NO: 569784 - RNA, 13 nt, Homo sapiens
uaugaugcacuua

SEQ ID NO: 569785 - RNA, 20 nt, Homo sapiens
uaugaugggcuucuguucuc

SEQ ID NO: 569786 - RNA, 23 nt, Homo sapiens
uaugauguaaucucucugcagcu

SEQ ID NO: 569787 - RNA, 18 nt, Homo sapiens
uaugauguguugugauag

SEQ ID NO: 569788 - RNA, 21 nt, Homo sapiens
uaugauuauuaacgaugucca

SEQ ID NO: 569789 - RNA, 20 nt, Homo sapiens
uaugauuuaagguacuuaaa

SEQ ID NO: 569790 - RNA, 17 nt, Homo sapiens
uaugcaaaccaggauuu

SEQ ID NO: 569791 - RNA, 13 nt, Homo sapiens
uaugcaaaccuca

SEQ ID NO: 569792 - RNA, 18 nt, Homo sapiens
uaugcaaaucagcuuuau

SEQ ID NO: 569793 - RNA, 14 nt, Homo sapiens
uaugcaaauggaga

SEQ ID NO: 569794 - RNA, 19 nt, Homo sapiens
uaugcaaccaguuuaucca

SEQ ID NO: 569795 - RNA, 23 nt, Homo sapiens
uaugcaaccuuuggaugcacuuu

SEQ ID NO: 569796 - RNA, 22 nt, Homo sapiens
uaugcaacucaucuucacagau

SEQ ID NO: 569797 - RNA, 14 nt, Homo sapiens
uaugcaagcagcuu

SEQ ID NO: 569798 - RNA, 15 nt, Homo sapiens
uaugcaaguuagggu

SEQ ID NO: 569799 - RNA, 12 nt, Homo sapiens
uaugcaaucuga

SEQ ID NO: 569800 - RNA, 17 nt, Homo sapiens
uaugcacacacauauau

SEQ ID NO: 569801 - RNA, 16 nt, Homo sapiens
uaugcacgugugcaca

SEQ ID NO: 569802 - RNA, 19 nt, Homo sapiens
uaugcagaauggcauuugc

SEQ ID NO: 569803 - RNA, 21 nt, Homo sapiens
uaugcagaauuugauucguau

SEQ ID NO: 569804 - RNA, 18 nt, Homo sapiens
uaugcagccaaccaagau

SEQ ID NO: 569805 - RNA, 22 nt, Homo sapiens
uaugcagccaaccaagaugcaa

SEQ ID NO: 569806 - RNA, 21 nt, Homo sapiens
uaugcaguaaauuaucuuggg

SEQ ID NO: 569807 - RNA, 12 nt, Homo sapiens
uaugcaguaugc

SEQ ID NO: 569808 - RNA, 16 nt, Homo sapiens
uaugcauaaagccaaa

SEQ ID NO: 569809 - RNA, 17 nt, Homo sapiens
uaugccaauaaaguuug

SEQ ID NO: 569810 - RNA, 21 nt, Homo sapiens
uaugccaccccaugugccuuu

SEQ ID NO: 569811 - RNA, 12 nt, Homo sapiens
uaugccauagca

SEQ ID NO: 569812 - RNA, 18 nt, Homo sapiens
uaugcccagguaccaccc

SEQ ID NO: 569813 - RNA, 18 nt, Homo sapiens
uaugcccugcagagcaau

SEQ ID NO: 569814 - RNA, 22 nt, Homo sapiens
uaugcccugcagagcaauaaca

SEQ ID NO: 569815 - RNA, 16 nt, Homo sapiens
uaugccucauacacau

SEQ ID NO: 569816 - RNA, 16 nt, Homo sapiens
uaugccugccucuuuc

SEQ ID NO: 569817 - RNA, 15 nt, Homo sapiens
uaugccuuaagccaa

SEQ ID NO: 569818 - RNA, 17 nt, Homo sapiens
uaugcgugugacagugu

SEQ ID NO: 569819 - RNA, 15 nt, Homo sapiens
uaugcuacccuuaau

SEQ ID NO: 569820 - RNA, 21 nt, Homo sapiens
uaugcugaucuuuuaaaauca

SEQ ID NO: 569821 - RNA, 21 nt, Homo sapiens
uaugcugcaacaaaauguaga

SEQ ID NO: 569822 - RNA, 16 nt, Homo sapiens
uaugcugcucauccaa

SEQ ID NO: 569823 - RNA, 16 nt, Homo sapiens
uaugcugcuguuuaca

SEQ ID NO: 569824 - RNA, 22 nt, Homo sapiens
uaugcuggacucuggaccauau

SEQ ID NO: 569825 - RNA, 22 nt, Homo sapiens
uaugcuggagauggacaacuca

SEQ ID NO: 569826 - RNA, 12 nt, Homo sapiens
uaugcuggccag

SEQ ID NO: 569827 - RNA, 16 nt, Homo sapiens
uaugcuggcuuuucac

SEQ ID NO: 569828 - RNA, 19 nt, Homo sapiens
uaugcuguauccacaaauc

SEQ ID NO: 569829 - RNA, 20 nt, Homo sapiens
uaugcuguauccacaaauca

SEQ ID NO: 569830 - RNA, 16 nt, Homo sapiens
uaugcuguaucugugc

SEQ ID NO: 569831 - RNA, 17 nt, Homo sapiens
uaugcuuacucuugcuu

SEQ ID NO: 569832 - RNA, 16 nt, Homo sapiens
uaugcuuacugauaua

SEQ ID NO: 569833 - RNA, 14 nt, Homo sapiens
uaugcuuauacacu

SEQ ID NO: 569834 - RNA, 13 nt, Homo sapiens
uaugcuugcuugg

SEQ ID NO: 569835 - RNA, 20 nt, Homo sapiens
uaugcuuucccugaggaaug

SEQ ID NO: 569836 - RNA, 18 nt, Homo sapiens
uaugcuuucuuuggccua

SEQ ID NO: 569837 - RNA, 19 nt, Homo sapiens
uaugcuuugaaugcaaaag

SEQ ID NO: 569838 - RNA, 23 nt, Homo sapiens
uauggaaaagggucuucuuggca

SEQ ID NO: 569839 - RNA, 15 nt, Homo sapiens
uauggaacauaugca

SEQ ID NO: 569840 - RNA, 16 nt, Homo sapiens
uauggaacucucucca

SEQ ID NO: 569841 - RNA, 16 nt, Homo sapiens
uauggaauauucauuu

SEQ ID NO: 569842 - RNA, 19 nt, Homo sapiens
uauggaauugauuugcauu

SEQ ID NO: 569843 - RNA, 20 nt, Homo sapiens
uauggacaguaaguccagua

SEQ ID NO: 569844 - RNA, 19 nt, Homo sapiens
uauggagaaacaaaauccu

SEQ ID NO: 569845 - RNA, 20 nt, Homo sapiens
uauggaguaccauguggcaa

SEQ ID NO: 569846 - RNA, 19 nt, Homo sapiens
uauggagugcaccaaagag

SEQ ID NO: 569847 - RNA, 15 nt, Homo sapiens
uauggcaugauuuau

SEQ ID NO: 569848 - RNA, 19 nt, Homo sapiens
uauggcuaauaccugucaa

SEQ ID NO: 569849 - RNA, 16 nt, Homo sapiens
uauggcuagacaggaa

SEQ ID NO: 569850 - RNA, 13 nt, Homo sapiens
uaugggaagccau

SEQ ID NO: 569851 - RNA, 15 nt, Homo sapiens
uaugggggcacugag

SEQ ID NO: 569852 - RNA, 14 nt, Homo sapiens
uaugguauuacaaa

SEQ ID NO: 569853 - RNA, 15 nt, Homo sapiens
uaugguuugccauua

SEQ ID NO: 569854 - RNA, 21 nt, Homo sapiens
uauguaaaaccaacaaaaaga

SEQ ID NO: 569855 - RNA, 23 nt, Homo sapiens
uauguaaaguagaauaagccuuc

SEQ ID NO: 569856 - RNA, 22 nt, Homo sapiens
uauguaaauguguuagcacuga

SEQ ID NO: 569857 - RNA, 21 nt, Homo sapiens
uauguaacagucaaauaucau

SEQ ID NO: 569858 - RNA, 16 nt, Homo sapiens
uauguaaguacuucca

SEQ ID NO: 569859 - RNA, 15 nt, Homo sapiens
uauguaauauauugu

SEQ ID NO: 569860 - RNA, 14 nt, Homo sapiens
uauguaaucucacc

SEQ ID NO: 569861 - RNA, 14 nt, Homo sapiens
uauguacaugagaa

SEQ ID NO: 569862 - RNA, 19 nt, Homo sapiens
uauguaccauguacaugaa

SEQ ID NO: 569863 - RNA, 22 nt, Homo sapiens
uauguagcaaaauacaugacau

SEQ ID NO: 569864 - RNA, 13 nt, Homo sapiens
uauguagcacuac

SEQ ID NO: 569865 - RNA, 14 nt, Homo sapiens
uauguagugcauuu

SEQ ID NO: 569866 - RNA, 23 nt, Homo sapiens
uauguauaaauuaauacagagua

SEQ ID NO: 569867 - RNA, 20 nt, Homo sapiens
uauguauacacacauauaca

SEQ ID NO: 569868 - RNA, 13 nt, Homo sapiens
uauguauauauac

SEQ ID NO: 569869 - RNA, 14 nt, Homo sapiens
uauguauaucauuc

SEQ ID NO: 569870 - RNA, 13 nt, Homo sapiens
uauguauggaaua

SEQ ID NO: 569871 - RNA, 22 nt, Homo sapiens
uauguauuaagccaaacaugag

SEQ ID NO: 569872 - RNA, 16 nt, Homo sapiens
uauguauuugcaguuc

SEQ ID NO: 569873 - RNA, 13 nt, Homo sapiens
uauguauuuucag

SEQ ID NO: 569874 - RNA, 13 nt, Homo sapiens
uaugucaacuuaa

SEQ ID NO: 569875 - RNA, 22 nt, Homo sapiens
uaugucaggcaaagugcugcug

SEQ ID NO: 569876 - RNA, 16 nt, Homo sapiens
uaugucaguuugcagu

SEQ ID NO: 569877 - RNA, 22 nt, Homo sapiens
uauguccauccauauauauuca

SEQ ID NO: 569878 - RNA, 14 nt, Homo sapiens
uauguccuaauaau

SEQ ID NO: 569879 - RNA, 21 nt, Homo sapiens
uaugucugccuucgaccacag

SEQ ID NO: 569880 - RNA, 14 nt, Homo sapiens
uaugugacugacaa

SEQ ID NO: 569881 - RNA, 10 nt, Homo sapiens
uaugugcaau

SEQ ID NO: 569882 - RNA, 11 nt, Homo sapiens
uaugugcauua

SEQ ID NO: 569883 - RNA, 16 nt, Homo sapiens
uaugugcgugugugca

SEQ ID NO: 569884 - RNA, 16 nt, Homo sapiens
uaugugcuauacacac

SEQ ID NO: 569885 - RNA, 14 nt, Homo sapiens
uauguggcuguauc

SEQ ID NO: 569886 - RNA, 20 nt, Homo sapiens
uaugugggugggaccacaga

SEQ ID NO: 569887 - RNA, 18 nt, Homo sapiens
uaugugugaggagcugcu

SEQ ID NO: 569888 - RNA, 18 nt, Homo sapiens
uauguuaauaacuugucc

SEQ ID NO: 569889 - RNA, 14 nt, Homo sapiens
uauguucaaagacu

SEQ ID NO: 569890 - RNA, 18 nt, Homo sapiens
uauguucaaagacuguga

SEQ ID NO: 569891 - RNA, 16 nt, Homo sapiens
gcacaguccagaccca

SEQ ID NO: 569892 - RNA, 13 nt, Homo sapiens
gcacagugcaguu

SEQ ID NO: 569893 - RNA, 20 nt, Homo sapiens
gcacauaacuggauuuugaa

SEQ ID NO: 569894 - RNA, 14 nt, Homo sapiens
gcacauaccuucau

SEQ ID NO: 569895 - RNA, 18 nt, Homo sapiens
gcacauagcuaucaagug

SEQ ID NO: 569896 - RNA, 15 nt, Homo sapiens
gcacaucaauuacaa

SEQ ID NO: 569897 - RNA, 21 nt, Homo sapiens
gcacaucaauuacaagcugua

SEQ ID NO: 569898 - RNA, 22 nt, Homo sapiens
gcacaucugcauuuucacccca

SEQ ID NO: 569899 - RNA, 15 nt, Homo sapiens
gcacaucuugucuaa

SEQ ID NO: 569900 - RNA, 16 nt, Homo sapiens
gcacaugccuacugcu

SEQ ID NO: 569901 - RNA, 20 nt, Homo sapiens
gcacaugugccacacaguga

SEQ ID NO: 569902 - RNA, 22 nt, Homo sapiens
gcacauugaaagagaaccaguu

SEQ ID NO: 569903 - RNA, 20 nt, Homo sapiens
gcacauugccuguucugcuu

SEQ ID NO: 569904 - RNA, 14 nt, Homo sapiens
gcacauuucaaaac

SEQ ID NO: 569905 - RNA, 23 nt, Homo sapiens
gcaccaaagacaucagucuccaa

SEQ ID NO: 569906 - RNA, 12 nt, Homo sapiens
gcagauacuuga

SEQ ID NO: 569907 - RNA, 19 nt, Homo sapiens
gcagauaucugcauguguc

SEQ ID NO: 569908 - RNA, 18 nt, Homo sapiens
gcagauccagagguuucu

SEQ ID NO: 569909 - RNA, 18 nt, Homo sapiens
gcagauccccacuguccu

SEQ ID NO: 569910 - RNA, 21 nt, Homo sapiens
gcagaucucaucucaugacag

SEQ ID NO: 569911 - RNA, 16 nt, Homo sapiens
gcagaucugugccugg

SEQ ID NO: 569912 - RNA, 15 nt, Homo sapiens
gcagaugaucaggga

SEQ ID NO: 569913 - RNA, 21 nt, Homo sapiens
gcagcaaaagaccaaaucuca

SEQ ID NO: 569914 - RNA, 20 nt, Homo sapiens
gcagcaccguucugugcaca

SEQ ID NO: 569915 - RNA, 23 nt, Homo sapiens
gcagcacucaaaccuggagcuga

SEQ ID NO: 569916 - RNA, 19 nt, Homo sapiens
gcagcacugcccaucagug

SEQ ID NO: 569917 - RNA, 20 nt, Homo sapiens
gcagcacugcccaucaguga

SEQ ID NO: 569918 - RNA, 12 nt, Homo sapiens
gcagcacuguga

SEQ ID NO: 569919 - RNA, 14 nt, Homo sapiens
gcagcagcuuucag

SEQ ID NO: 569920 - RNA, 15 nt, Homo sapiens
gcagcaggaaggccc

SEQ ID NO: 569921 - RNA, 22 nt, Homo sapiens
gcagcagggagggcuucugcca

SEQ ID NO: 569922 - RNA, 14 nt, Homo sapiens
gcagcagugccaua

SEQ ID NO: 569923 - RNA, 22 nt, Homo sapiens
gcagcaugcuugggcugaccca

SEQ ID NO: 569924 - RNA, 17 nt, Homo sapiens
gcagcauggucccugcc

SEQ ID NO: 569925 - RNA, 17 nt, Homo sapiens
gcagcauuccaugacca

SEQ ID NO: 569926 - RNA, 22 nt, Homo sapiens
gcagccaccagggaguggccau

SEQ ID NO: 569927 - RNA, 16 nt, Homo sapiens
gcagccaggacccgcc

SEQ ID NO: 569928 - RNA, 15 nt, Homo sapiens
gcagcccaaucugcc

SEQ ID NO: 569929 - RNA, 17 nt, Homo sapiens
gcagcccagccuaguca

SEQ ID NO: 569930 - RNA, 13 nt, Homo sapiens
gcagcccaugccc

SEQ ID NO: 569931 - RNA, 20 nt, Homo sapiens
gcagccccccccucaagggg

SEQ ID NO: 569932 - RNA, 19 nt, Homo sapiens
gcagcccuacaacaaccug

SEQ ID NO: 569933 - RNA, 16 nt, Homo sapiens
gcagccuccuccugac

SEQ ID NO: 569934 - RNA, 19 nt, Homo sapiens
gcagccugagcaacucuug

SEQ ID NO: 569935 - RNA, 13 nt, Homo sapiens
gcagccuuuccag

SEQ ID NO: 569936 - RNA, 20 nt, Homo sapiens
gcagcgccugccgccccggg

SEQ ID NO: 569937 - RNA, 16 nt, Homo sapiens
gcagcgcgcacacgca

SEQ ID NO: 569938 - RNA, 15 nt, Homo sapiens
gcagcgguaccccag

SEQ ID NO: 569939 - RNA, 18 nt, Homo sapiens
gcagcuaaaauaagcuca

SEQ ID NO: 569940 - RNA, 15 nt, Homo sapiens
gcagcuaacaauguc

SEQ ID NO: 569941 - RNA, 22 nt, Homo sapiens
gcagcuaccagguguucuacac

SEQ ID NO: 569942 - RNA, 13 nt, Homo sapiens
gcagcuacuggaa

SEQ ID NO: 569943 - RNA, 22 nt, Homo sapiens
gcagcuauuuuaagccaucuca

SEQ ID NO: 569944 - RNA, 23 nt, Homo sapiens
gcagcucccauuucaucagcaag

SEQ ID NO: 569945 - RNA, 23 nt, Homo sapiens
gcagcucuccccucagagugcaa

SEQ ID NO: 569946 - RNA, 23 nt, Homo sapiens
gcagcugcaccagcaggugccau

SEQ ID NO: 569947 - RNA, 15 nt, Homo sapiens
gcagcugccagagaa

SEQ ID NO: 569948 - RNA, 16 nt, Homo sapiens
gcagcuggaccaucuc

SEQ ID NO: 569949 - RNA, 22 nt, Homo sapiens
gcagcugugcugggugagcucu

SEQ ID NO: 569950 - RNA, 21 nt, Homo sapiens
gcagcuucaccagagcauuuc

SEQ ID NO: 569951 - RNA, 18 nt, Homo sapiens
gcaggaaagggagggaau

SEQ ID NO: 569952 - RNA, 21 nt, Homo sapiens
gcaggaaaguuuacccaugaa

SEQ ID NO: 569953 - RNA, 18 nt, Homo sapiens
gcaggaaaugaaaauguc

SEQ ID NO: 569954 - RNA, 22 nt, Homo sapiens
gcaggaacucccagcaacacaa

SEQ ID NO: 569955 - RNA, 21 nt, Homo sapiens
gcaggaacuugcacaaaauca

SEQ ID NO: 569956 - RNA, 18 nt, Homo sapiens
gcaggaagcauucagaga

SEQ ID NO: 569957 - RNA, 23 nt, Homo sapiens
gcaggaagcauucagagagcagc

SEQ ID NO: 569958 - RNA, 15 nt, Homo sapiens
gcaggaagggagaac

SEQ ID NO: 569959 - RNA, 12 nt, Homo sapiens
gcaggaccaagg

SEQ ID NO: 569960 - RNA, 18 nt, Homo sapiens
gcaggacuaaaugucuag

SEQ ID NO: 569961 - RNA, 17 nt, Homo sapiens
gcaggagaauugcuuga

SEQ ID NO: 569962 - RNA, 22 nt, Homo sapiens
gcaggaggcccuugucguggga

SEQ ID NO: 569963 - RNA, 14 nt, Homo sapiens
gcaggagguucugg

SEQ ID NO: 569964 - RNA, 14 nt, Homo sapiens
gcaggagugacuca

SEQ ID NO: 569965 - RNA, 13 nt, Homo sapiens
gcaggagugccag

SEQ ID NO: 569966 - RNA, 22 nt, Homo sapiens
gcaggauccgcugccaccacgu

SEQ ID NO: 569967 - RNA, 13 nt, Homo sapiens
gcaggaugcuaau

SEQ ID NO: 569968 - RNA, 24 nt, Homo sapiens
gcaggauucuguaauagugaacau

SEQ ID NO: 569969 - RNA, 23 nt, Homo sapiens
gcaggcaagugggauaaaggccc

SEQ ID NO: 569970 - RNA, 14 nt, Homo sapiens
gcaggcaggggcau

SEQ ID NO: 569971 - RNA, 16 nt, Homo sapiens
gcaggcccuguccuaa

SEQ ID NO: 569972 - RNA, 18 nt, Homo sapiens
gcaggccgacagucggug

SEQ ID NO: 569973 - RNA, 23 nt, Homo sapiens
gcaggccuccaacgccccugugg

SEQ ID NO: 569974 - RNA, 14 nt, Homo sapiens
gcaggccuccgucu

SEQ ID NO: 569975 - RNA, 15 nt, Homo sapiens
gcaggcguacagguu

SEQ ID NO: 569976 - RNA, 17 nt, Homo sapiens
gcaggcucagacucugg

SEQ ID NO: 569977 - RNA, 21 nt, Homo sapiens
gcaggcugggacggaccagca

SEQ ID NO: 569978 - RNA, 18 nt, Homo sapiens
gcaggcugggccaugucc

SEQ ID NO: 569979 - RNA, 21 nt, Homo sapiens
gcagggaagccccacuugaag

SEQ ID NO: 569980 - RNA, 14 nt, Homo sapiens
gcagggaaugcaau

SEQ ID NO: 569981 - RNA, 14 nt, Homo sapiens
gcagggacuugccu

SEQ ID NO: 569982 - RNA, 18 nt, Homo sapiens
gcagggagggcuguggug

SEQ ID NO: 569983 - RNA, 23 nt, Homo sapiens
gcagggauguuccuuaccaagga

SEQ ID NO: 569984 - RNA, 14 nt, Homo sapiens
gcagggcagccugu

SEQ ID NO: 569985 - RNA, 19 nt, Homo sapiens
gcagggcccacccauguca

SEQ ID NO: 569986 - RNA, 18 nt, Homo sapiens
gcagggcccagugacaag

SEQ ID NO: 569987 - RNA, 16 nt, Homo sapiens
gcagggccugauuuau

SEQ ID NO: 569988 - RNA, 11 nt, Homo sapiens
gcagggccuug

SEQ ID NO: 569989 - RNA, 13 nt, Homo sapiens
gcagggcucugau

SEQ ID NO: 569990 - RNA, 15 nt, Homo sapiens
gcagggcuggcacgu

SEQ ID NO: 569991 - RNA, 18 nt, Homo sapiens
gcagggcuggucuugggg

SEQ ID NO: 569992 - RNA, 21 nt, Homo sapiens
gcaggggagacaggagccuag

SEQ ID NO: 569993 - RNA, 14 nt, Homo sapiens
gcaggggaggggug

SEQ ID NO: 569994 - RNA, 16 nt, Homo sapiens
gcaggggccuggagau

SEQ ID NO: 569995 - RNA, 18 nt, Homo sapiens
gcagggggaaggcuugga

SEQ ID NO: 569996 - RNA, 20 nt, Homo sapiens
gcagggggugugucugcuca

SEQ ID NO: 569997 - RNA, 19 nt, Homo sapiens
gcagggguccuugguguga

SEQ ID NO: 569998 - RNA, 18 nt, Homo sapiens
gcaggguccaaaggccag

SEQ ID NO: 569999 - RNA, 21 nt, Homo sapiens
gcaggucacugucacugccga

SEQ ID NO: 570000 - RNA, 15 nt, Homo sapiens
gcaggucugcaaggg

SEQ ID NO: 570001 - RNA, 16 nt, Homo sapiens
gcaggugaugccauua

SEQ ID NO: 570002 - RNA, 16 nt, Homo sapiens
gcaggugcuacaacau

SEQ ID NO: 570003 - RNA, 16 nt, Homo sapiens
gcagguggcaucucua

SEQ ID NO: 570004 - RNA, 15 nt, Homo sapiens
gcagguguucugggc

SEQ ID NO: 570005 - RNA, 16 nt, Homo sapiens
gcagguucccaagcuc

SEQ ID NO: 570006 - RNA, 20 nt, Homo sapiens
gcagguuccuuaucugucac

SEQ ID NO: 570007 - RNA, 18 nt, Homo sapiens
gcaguaaaagaugaaguu

SEQ ID NO: 570008 - RNA, 14 nt, Homo sapiens
gcaguaauguuccu

SEQ ID NO: 570009 - RNA, 20 nt, Homo sapiens
gcaguagacuauaagcagaa

SEQ ID NO: 570010 - RNA, 18 nt, Homo sapiens
gcaguagccuucuucccu

SEQ ID NO: 570011 - RNA, 19 nt, Homo sapiens
gcaguaucaugaagccuaa

SEQ ID NO: 570012 - RNA, 19 nt, Homo sapiens
gcaguaucaugcccugugc

SEQ ID NO: 570013 - RNA, 23 nt, Homo sapiens
gcaguauccaauaggcauuugau

SEQ ID NO: 570014 - RNA, 17 nt, Homo sapiens
gcagucagcaugaaucc

SEQ ID NO: 570015 - RNA, 18 nt, Homo sapiens
ucaaaagccagaugugaa

SEQ ID NO: 570016 - RNA, 20 nt, Homo sapiens
ucaaaagccauaacuugaaa

SEQ ID NO: 570017 - RNA, 23 nt, Homo sapiens
ucaaaagcggggcuucaucugca

SEQ ID NO: 570018 - RNA, 20 nt, Homo sapiens
ucaaaagcugggaaccagca

SEQ ID NO: 570019 - RNA, 16 nt, Homo sapiens
ucaaaaggagaaauga

SEQ ID NO: 570020 - RNA, 17 nt, Homo sapiens
ucaaaagggccaaagaa

SEQ ID NO: 570021 - RNA, 12 nt, Homo sapiens
ucaaaaggugcc

SEQ ID NO: 570022 - RNA, 22 nt, Homo sapiens
ucaaaagguuaauaaaguaauu

SEQ ID NO: 570023 - RNA, 19 nt, Homo sapiens
ucaaaaguaaugcuucaau

SEQ ID NO: 570024 - RNA, 18 nt, Homo sapiens
ucaaaauaaaaagugaca

SEQ ID NO: 570025 - RNA, 19 nt, Homo sapiens
ucaaaauaagaaaauaacc

SEQ ID NO: 570026 - RNA, 20 nt, Homo sapiens
ucaaaauaaguguaauccac

SEQ ID NO: 570027 - RNA, 19 nt, Homo sapiens
uccccccuugaagcaauaa

SEQ ID NO: 570028 - RNA, 22 nt, Homo sapiens
ucccccuaaaccccugucccau

SEQ ID NO: 570029 - RNA, 17 nt, Homo sapiens
ucccccuaauauuaggg

SEQ ID NO: 570030 - RNA, 17 nt, Homo sapiens
ucccccuacccauaucc

SEQ ID NO: 570031 - RNA, 20 nt, Homo sapiens
gcucuggaccaacccuguuu

SEQ ID NO: 570032 - RNA, 20 nt, Homo sapiens
gcucuggauccugcacucua

SEQ ID NO: 570033 - RNA, 14 nt, Homo sapiens
gcucuggggguccc

SEQ ID NO: 570034 - RNA, 15 nt, Homo sapiens
gcucuguauuaaucc

SEQ ID NO: 570035 - RNA, 20 nt, Homo sapiens
gcucuuaaaaagacacuuau

SEQ ID NO: 570036 - RNA, 19 nt, Homo sapiens
gcucuucugugcccagggu

SEQ ID NO: 570037 - RNA, 11 nt, Homo sapiens
gcucuugcagu

SEQ ID NO: 570038 - RNA, 11 nt, Homo sapiens
gcucuugcccu

SEQ ID NO: 570039 - RNA, 17 nt, Homo sapiens
gcucuuguucuacugag

SEQ ID NO: 570040 - RNA, 17 nt, Homo sapiens
gcucuuuucaaugaaua

SEQ ID NO: 570041 - RNA, 16 nt, Homo sapiens
gcucuuuugugaugaa

SEQ ID NO: 570042 - RNA, 13 nt, Homo sapiens
gcugaaaacuaca

SEQ ID NO: 570043 - RNA, 13 nt, Homo sapiens
gcugaaagccaag

SEQ ID NO: 570044 - RNA, 17 nt, Homo sapiens
gcugaacaauaggcugu

SEQ ID NO: 570045 - RNA, 15 nt, Homo sapiens
gcugaacaugccugc

SEQ ID NO: 570046 - RNA, 17 nt, Homo sapiens
gcugaacugacaaugaa

SEQ ID NO: 570047 - RNA, 19 nt, Homo sapiens
gcugaagacauguuucaag

SEQ ID NO: 570048 - RNA, 16 nt, Homo sapiens
gcugaagaguuuacug

SEQ ID NO: 570049 - RNA, 23 nt, Homo sapiens
gcugaagugguugcauucuacua

SEQ ID NO: 570050 - RNA, 22 nt, Homo sapiens
gcugaauagcuacuauauguca

SEQ ID NO: 570051 - RNA, 22 nt, Homo sapiens
gcugaaugccuccuguggggaa

SEQ ID NO: 570052 - RNA, 16 nt, Homo sapiens
gcugaauuccuuuaca

SEQ ID NO: 570053 - RNA, 18 nt, Homo sapiens
gcugacacagccacugcg

SEQ ID NO: 570054 - RNA, 16 nt, Homo sapiens
gcugacaggugaugcu

SEQ ID NO: 570055 - RNA, 18 nt, Homo sapiens
gcugacaucuguguuuca

SEQ ID NO: 570056 - RNA, 23 nt, Homo sapiens
gcugacaugaagcuguuguguga

SEQ ID NO: 570057 - RNA, 23 nt, Homo sapiens
gcugaccaacgcacaacaggaaa

SEQ ID NO: 570058 - RNA, 20 nt, Homo sapiens
gcugaccacagcacagccaa

SEQ ID NO: 570059 - RNA, 23 nt, Homo sapiens
gcugaccaggcgcccgggaucca

SEQ ID NO: 570060 - RNA, 19 nt, Homo sapiens
gcugacccaagagaacuca

SEQ ID NO: 570061 - RNA, 21 nt, Homo sapiens
gcugaccuagaccaguuugca

SEQ ID NO: 570062 - RNA, 14 nt, Homo sapiens
gcugagaccagggu

SEQ ID NO: 570063 - RNA, 21 nt, Homo sapiens
gcugagauuacucugaaaaug

SEQ ID NO: 570064 - RNA, 14 nt, Homo sapiens
gcugagauuccugg

SEQ ID NO: 570065 - RNA, 17 nt, Homo sapiens
gcugagccuggucccac

SEQ ID NO: 570066 - RNA, 17 nt, Homo sapiens
gcugagcugaguggcca

SEQ ID NO: 570067 - RNA, 13 nt, Homo sapiens
gcugagcugugau

SEQ ID NO: 570068 - RNA, 16 nt, Homo sapiens
gcugaggccacacuca

SEQ ID NO: 570069 - RNA, 17 nt, Homo sapiens
gcugaggcccagugcau

SEQ ID NO: 570070 - RNA, 16 nt, Homo sapiens
gcugaggccucgaggg

SEQ ID NO: 570071 - RNA, 21 nt, Homo sapiens
gcugaggcugaggcacuggcg

SEQ ID NO: 570072 - RNA, 15 nt, Homo sapiens
gcugaggcuggcaca

SEQ ID NO: 570073 - RNA, 21 nt, Homo sapiens
gcugaggcuggcacaggacau

SEQ ID NO: 570074 - RNA, 18 nt, Homo sapiens
gcugagggccugcuggag

SEQ ID NO: 570075 - RNA, 23 nt, Homo sapiens
gcugagggugagugggugaauaa

SEQ ID NO: 570076 - RNA, 18 nt, Homo sapiens
gcugagguuccucugccu

SEQ ID NO: 570077 - RNA, 19 nt, Homo sapiens
gcugagguuugcacuuccu

SEQ ID NO: 570078 - RNA, 16 nt, Homo sapiens
gcugagucaccuccuc

SEQ ID NO: 570079 - RNA, 22 nt, Homo sapiens
gcugagucccuccaugcaaaag

SEQ ID NO: 570080 - RNA, 16 nt, Homo sapiens
gcugagugcaccacuu

SEQ ID NO: 570081 - RNA, 19 nt, Homo sapiens
gcugagugcaccacuucaa

SEQ ID NO: 570082 - RNA, 16 nt, Homo sapiens
gcugagugcagccaaa

SEQ ID NO: 570083 - RNA, 19 nt, Homo sapiens
gcugaguuccggggugcaa

SEQ ID NO: 570084 - RNA, 22 nt, Homo sapiens
gcugauccggcugcuccuccag

SEQ ID NO: 570085 - RNA, 19 nt, Homo sapiens
gcugaugaacuguggugcc

SEQ ID NO: 570086 - RNA, 18 nt, Homo sapiens
gcugauggguaguaccug

SEQ ID NO: 570087 - RNA, 22 nt, Homo sapiens
gcugauguuuauaaacugagag

SEQ ID NO: 570088 - RNA, 15 nt, Homo sapiens
gcugauuccagaaca

SEQ ID NO: 570089 - RNA, 16 nt, Homo sapiens
gcugauuucuagugua

SEQ ID NO: 570090 - RNA, 14 nt, Homo sapiens
gcugcacagcaaaa

SEQ ID NO: 570091 - RNA, 23 nt, Homo sapiens
gcugcacauugccuguucugcuu

SEQ ID NO: 570092 - RNA, 15 nt, Homo sapiens
gcugcaccacuucca

SEQ ID NO: 570093 - RNA, 21 nt, Homo sapiens
gcugcacucaagcuuggguga

SEQ ID NO: 570094 - RNA, 18 nt, Homo sapiens
gcugcacugaucacccaa

SEQ ID NO: 570095 - RNA, 21 nt, Homo sapiens
gcugcagagcagcagcaccuu

SEQ ID NO: 570096 - RNA, 23 nt, Homo sapiens
gcugcagcucccauuucaucagc

SEQ ID NO: 570097 - RNA, 17 nt, Homo sapiens
gcugcaggacuugagaa

SEQ ID NO: 570098 - RNA, 22 nt, Homo sapiens
gcugcaggccgugugucuguca

SEQ ID NO: 570099 - RNA, 19 nt, Homo sapiens
gcugcaggucaacagcuau

SEQ ID NO: 570100 - RNA, 22 nt, Homo sapiens
gcugcagguuccuuaucuguca

SEQ ID NO: 570101 - RNA, 15 nt, Homo sapiens
gcugcagucaucuac

SEQ ID NO: 570102 - RNA, 20 nt, Homo sapiens
gcugcagugacgugcaccug

SEQ ID NO: 570103 - RNA, 12 nt, Homo sapiens
gcugcauaguau

SEQ ID NO: 570104 - RNA, 10 nt, Homo sapiens
gcugcaucuc

SEQ ID NO: 570105 - RNA, 21 nt, Homo sapiens
gcugcaucuccccucagauuc

SEQ ID NO: 570106 - RNA, 12 nt, Homo sapiens
gcugcaugaccu

SEQ ID NO: 570107 - RNA, 14 nt, Homo sapiens
gcugccacaaccag

SEQ ID NO: 570108 - RNA, 21 nt, Homo sapiens
gcugccaccacgucugccagg

SEQ ID NO: 570109 - RNA, 14 nt, Homo sapiens
gcugccaccagccc

SEQ ID NO: 570110 - RNA, 19 nt, Homo sapiens
gcugccagaugauuguuca

SEQ ID NO: 570111 - RNA, 16 nt, Homo sapiens
gcugccagccacuuca

SEQ ID NO: 570112 - RNA, 20 nt, Homo sapiens
gcugccagugcuggucacua

SEQ ID NO: 570113 - RNA, 23 nt, Homo sapiens
gcugcccagcugcuccccugcca

SEQ ID NO: 570114 - RNA, 23 nt, Homo sapiens
gcugcccccuuccccagcccuua

SEQ ID NO: 570115 - RNA, 18 nt, Homo sapiens
gcugccccuacugcaaau

SEQ ID NO: 570116 - RNA, 19 nt, Homo sapiens
gcugccccuugcaagccau

SEQ ID NO: 570117 - RNA, 22 nt, Homo sapiens
gcugcccuggcccugaggugug

SEQ ID NO: 570118 - RNA, 12 nt, Homo sapiens
gcugccgugccc

SEQ ID NO: 570119 - RNA, 18 nt, Homo sapiens
gcugccgugccugugucc

SEQ ID NO: 570120 - RNA, 22 nt, Homo sapiens
gcugccucuugaaugcagggac

SEQ ID NO: 570121 - RNA, 14 nt, Homo sapiens
gcugccucuuggcu

SEQ ID NO: 570122 - RNA, 20 nt, Homo sapiens
gcugccucuuggcuucucag

SEQ ID NO: 570123 - RNA, 21 nt, Homo sapiens
gcugccugccccccagucucc

SEQ ID NO: 570124 - RNA, 19 nt, Homo sapiens
gcugccuuugaucacagga

SEQ ID NO: 570125 - RNA, 18 nt, Homo sapiens
gcugcgagagaaagggag

SEQ ID NO: 570126 - RNA, 13 nt, Homo sapiens
gcugcuaaugugu

SEQ ID NO: 570127 - RNA, 14 nt, Homo sapiens
gcugcuacugcccc

SEQ ID NO: 570128 - RNA, 18 nt, Homo sapiens
gcugcuauuucaucuggu

SEQ ID NO: 570129 - RNA, 19 nt, Homo sapiens
gcugcuccccaacaccugc

SEQ ID NO: 570130 - RNA, 21 nt, Homo sapiens
gcugcucggcuugaucacagc

SEQ ID NO: 570131 - RNA, 14 nt, Homo sapiens
gcugcucuacugcu

SEQ ID NO: 570132 - RNA, 14 nt, Homo sapiens
gcugcucuggaaaa

SEQ ID NO: 570133 - RNA, 19 nt, Homo sapiens
gcugcugcccauguuucaa

SEQ ID NO: 570134 - RNA, 15 nt, Homo sapiens
gcugcuggagugcag

SEQ ID NO: 570135 - RNA, 17 nt, Homo sapiens
gcugcugggauugggaa

SEQ ID NO: 570136 - RNA, 21 nt, Homo sapiens
gcugcuggggccucagacgag

SEQ ID NO: 570137 - RNA, 20 nt, Homo sapiens
gcugcuguagaugacuacuu

SEQ ID NO: 570138 - RNA, 12 nt, Homo sapiens
gcugcugugaac

SEQ ID NO: 570139 - RNA, 17 nt, Homo sapiens
gcugcuuagacauaaca

SEQ ID NO: 570140 - RNA, 19 nt, Homo sapiens
gcugcuuagacauaacaaa

SEQ ID NO: 570141 - RNA, 19 nt, Homo sapiens
gcugcuucugcaaaaaacu

SEQ ID NO: 570142 - RNA, 21 nt, Homo sapiens
gcugcuucuguguguggugag

SEQ ID NO: 570143 - RNA, 17 nt, Homo sapiens
gcugcuugagggcugau

SEQ ID NO: 570144 - RNA, 20 nt, Homo sapiens
gcugcuuucuuguugcugca

SEQ ID NO: 570145 - RNA, 21 nt, Homo sapiens
gcugcuuugagcuacaggaca

SEQ ID NO: 570146 - RNA, 17 nt, Homo sapiens
gcugcuuuguucaaugc

SEQ ID NO: 570147 - RNA, 13 nt, Homo sapiens
gcuggaacacugc

SEQ ID NO: 570148 - RNA, 15 nt, Homo sapiens
gcuggaacacugcug

SEQ ID NO: 570149 - RNA, 13 nt, Homo sapiens
gcuggaacccagg

SEQ ID NO: 570150 - RNA, 18 nt, Homo sapiens
gcuggaagucuccaugaa

SEQ ID NO: 570151 - RNA, 18 nt, Homo sapiens
gcuggacggggacugggg

SEQ ID NO: 570152 - RNA, 21 nt, Homo sapiens
gcuggacuacccacguucuca

SEQ ID NO: 570153 - RNA, 21 nt, Homo sapiens
ucccccucaauagaucuccag

SEQ ID NO: 570154 - RNA, 16 nt, Homo sapiens
ucccccugcaaaaaga

SEQ ID NO: 570155 - RNA, 14 nt, Homo sapiens
ucccccugcugcug

SEQ ID NO: 570156 - RNA, 15 nt, Homo sapiens
ucccccuucucccac

SEQ ID NO: 570157 - RNA, 19 nt, Homo sapiens
ucccccuuugugcacauuu

SEQ ID NO: 570158 - RNA, 22 nt, Homo sapiens
uccccgaaucacacagacaguu

SEQ ID NO: 570159 - RNA, 22 nt, Homo sapiens
uccccgagugccuagguuuugg

SEQ ID NO: 570160 - RNA, 21 nt, Homo sapiens
uccccgcagugugcacuaagg

SEQ ID NO: 570161 - RNA, 22 nt, Homo sapiens
uccccggggucuucuaccucag

SEQ ID NO: 570162 - RNA, 12 nt, Homo sapiens
uccccgucccug

SEQ ID NO: 570163 - RNA, 20 nt, Homo sapiens
uccccguuccaccccaagag

SEQ ID NO: 570164 - RNA, 14 nt, Homo sapiens
uccccuaaaccaaa

SEQ ID NO: 570165 - RNA, 17 nt, Homo sapiens
uccccuaaaccaaaaac

SEQ ID NO: 570166 - RNA, 23 nt, Homo sapiens
uccccuaaaccaaaaacugaaag

SEQ ID NO: 570167 - RNA, 11 nt, Homo sapiens
uccccuaauaa

SEQ ID NO: 570168 - RNA, 22 nt, Homo sapiens
uccccuaggcgcuguucuugcu

SEQ ID NO: 570169 - RNA, 14 nt, Homo sapiens
uccccucaccuccu

SEQ ID NO: 570170 - RNA, 19 nt, Homo sapiens
uccccucccuggcucccau

SEQ ID NO: 570171 - RNA, 22 nt, Homo sapiens
uccccucccuggcucccaugac

SEQ ID NO: 570172 - RNA, 23 nt, Homo sapiens
uccccuccgucugugacauggag

SEQ ID NO: 570173 - RNA, 15 nt, Homo sapiens
uccccuccucacagu

SEQ ID NO: 570174 - RNA, 16 nt, Homo sapiens
uccccuccucuugccu

SEQ ID NO: 570175 - RNA, 19 nt, Homo sapiens
uccccucucugcuccagac

SEQ ID NO: 570176 - RNA, 22 nt, Homo sapiens
uccccucuggaaucuuccccaa

SEQ ID NO: 570177 - RNA, 22 nt, Homo sapiens
uccccugacagggccagugcag

SEQ ID NO: 570178 - RNA, 16 nt, Homo sapiens
uccccugaccugugag

SEQ ID NO: 570179 - RNA, 15 nt, Homo sapiens
uccccuggacuggga

SEQ ID NO: 570180 - RNA, 16 nt, Homo sapiens
uccccuggacugggag

SEQ ID NO: 570181 - RNA, 21 nt, Homo sapiens
uccccuucccccaucccuacc

SEQ ID NO: 570182 - RNA, 18 nt, Homo sapiens
uccccuuccccugcugac

SEQ ID NO: 570183 - RNA, 16 nt, Homo sapiens
uccccuucuugccauu

SEQ ID NO: 570184 - RNA, 14 nt, Homo sapiens
uccccuugguucug

SEQ ID NO: 570185 - RNA, 13 nt, Homo sapiens
uccccuugucugc

SEQ ID NO: 570186 - RNA, 23 nt, Homo sapiens
uccccuuuacuaucauucucagu

SEQ ID NO: 570187 - RNA, 18 nt, Homo sapiens
uccccuuuguguagaaag

SEQ ID NO: 570188 - RNA, 19 nt, Homo sapiens
uccccuuuugccaaucuca

SEQ ID NO: 570189 - RNA, 23 nt, Homo sapiens
ucccgaaugaagcguugccauug

SEQ ID NO: 570190 - RNA, 13 nt, Homo sapiens
ucccgaccucagg

SEQ ID NO: 570191 - RNA, 21 nt, Homo sapiens
ucccgagcuacucucuugcca

SEQ ID NO: 570192 - RNA, 20 nt, Homo sapiens
ucccgaguagcugggauuac

SEQ ID NO: 570193 - RNA, 16 nt, Homo sapiens
ucccgaugcugcuaug

SEQ ID NO: 570194 - RNA, 17 nt, Homo sapiens
ucccgcuaugauggaag

SEQ ID NO: 570195 - RNA, 16 nt, Homo sapiens
ucccgggccucagggu

SEQ ID NO: 570196 - RNA, 19 nt, Homo sapiens
ucccgggcuuaccagguga

SEQ ID NO: 570197 - RNA, 17 nt, Homo sapiens
ucccggggccagcacuu

SEQ ID NO: 570198 - RNA, 18 nt, Homo sapiens
ucccggggcuccacugaa

SEQ ID NO: 570199 - RNA, 15 nt, Homo sapiens
ucccggggugcauuu

SEQ ID NO: 570200 - RNA, 15 nt, Homo sapiens
ucccgucccauaucc

SEQ ID NO: 570201 - RNA, 14 nt, Homo sapiens
ucccgucgugcagu

SEQ ID NO: 570202 - RNA, 23 nt, Homo sapiens
ucccguuucuuaaaaaacauaua

SEQ ID NO: 570203 - RNA, 20 nt, Homo sapiens
ucccuacauggaguauaugu

SEQ ID NO: 570204 - RNA, 21 nt, Homo sapiens
ucccuaccccauuugugguca

SEQ ID NO: 570205 - RNA, 12 nt, Homo sapiens
ucccuaccucag

SEQ ID NO: 570206 - RNA, 12 nt, Homo sapiens
ucccuaccuccu

SEQ ID NO: 570207 - RNA, 12 nt, Homo sapiens
ucccuacugcca

SEQ ID NO: 570208 - RNA, 13 nt, Homo sapiens
ucccuagccagag

SEQ ID NO: 570209 - RNA, 14 nt, Homo sapiens
ucccuagcccuucc

SEQ ID NO: 570210 - RNA, 15 nt, Homo sapiens
ucccuaggaaacuca

SEQ ID NO: 570211 - RNA, 20 nt, Homo sapiens
ucccuaguagcugggauuac

SEQ ID NO: 570212 - RNA, 15 nt, Homo sapiens
ucccucaaaugacag

SEQ ID NO: 570213 - RNA, 19 nt, Homo sapiens
ucccucaaaugacccaaag

SEQ ID NO: 570214 - RNA, 22 nt, Homo sapiens
ucccucaaaugcgcgugugcac

SEQ ID NO: 570215 - RNA, 13 nt, Homo sapiens
ucccucagcggag

SEQ ID NO: 570216 - RNA, 13 nt, Homo sapiens
ucccucagugaag

SEQ ID NO: 570217 - RNA, 18 nt, Homo sapiens
ucccucauccuuucaggu

SEQ ID NO: 570218 - RNA, 18 nt, Homo sapiens
ucccucaucugccagaaa

SEQ ID NO: 570219 - RNA, 20 nt, Homo sapiens
ucccucauggaagaugcaag

SEQ ID NO: 570220 - RNA, 23 nt, Homo sapiens
ucccucccagaggagccaccagu

SEQ ID NO: 570221 - RNA, 14 nt, Homo sapiens
ucccucccuaucua

SEQ ID NO: 570222 - RNA, 14 nt, Homo sapiens
ucccuccggccaua

SEQ ID NO: 570223 - RNA, 16 nt, Homo sapiens
ucccucggagcugcca

SEQ ID NO: 570224 - RNA, 14 nt, Homo sapiens
ucccucuaaugaga

SEQ ID NO: 570225 - RNA, 19 nt, Homo sapiens
ucccucuaauuuaucuugu

SEQ ID NO: 570226 - RNA, 15 nt, Homo sapiens
ucccucuacagguca

SEQ ID NO: 570227 - RNA, 13 nt, Homo sapiens
ucccucucaggug

SEQ ID NO: 570228 - RNA, 15 nt, Homo sapiens
ucccucuccaacugc

SEQ ID NO: 570229 - RNA, 12 nt, Homo sapiens
ucccucugaugu

SEQ ID NO: 570230 - RNA, 13 nt, Homo sapiens
ucccucuggauca

SEQ ID NO: 570231 - RNA, 14 nt, Homo sapiens
ucccucuggcccug

SEQ ID NO: 570232 - RNA, 16 nt, Homo sapiens
ucccucuuucuuccca

SEQ ID NO: 570233 - RNA, 17 nt, Homo sapiens
ucccugaaacaucucaa

SEQ ID NO: 570234 - RNA, 19 nt, Homo sapiens
ucccugacuuuucugugga

SEQ ID NO: 570235 - RNA, 19 nt, Homo sapiens
ucccugaggaaugaaaaag

SEQ ID NO: 570236 - RNA, 17 nt, Homo sapiens
ucccugaggauggguca

SEQ ID NO: 570237 - RNA, 16 nt, Homo sapiens
ucccugauggacccuc

SEQ ID NO: 570238 - RNA, 15 nt, Homo sapiens
ucccugcacagugac

SEQ ID NO: 570239 - RNA, 16 nt, Homo sapiens
ucccugcacagugacu

SEQ ID NO: 570240 - RNA, 14 nt, Homo sapiens
ucccugcagaccuc

SEQ ID NO: 570241 - RNA, 17 nt, Homo sapiens
ucccugccaccaggcac

SEQ ID NO: 570242 - RNA, 15 nt, Homo sapiens
ucccugccacugggc

SEQ ID NO: 570243 - RNA, 24 nt, Homo sapiens
ucccugccucucaucaacugaaug

SEQ ID NO: 570244 - RNA, 15 nt, Homo sapiens
ucccugcugugccau

SEQ ID NO: 570245 - RNA, 21 nt, Homo sapiens
ucccuggaucacgacgcugca

SEQ ID NO: 570246 - RNA, 15 nt, Homo sapiens
ucccuggccacugaa

SEQ ID NO: 570247 - RNA, 19 nt, Homo sapiens
ucccuggccacugaaaagc

SEQ ID NO: 570248 - RNA, 18 nt, Homo sapiens
ucccugggccaacagacc

SEQ ID NO: 570249 - RNA, 19 nt, Homo sapiens
ucccuggggaaaacuugca

SEQ ID NO: 570250 - RNA, 22 nt, Homo sapiens
ucccugggguggggauagggag

SEQ ID NO: 570251 - RNA, 14 nt, Homo sapiens
ucccuggucaccaa

SEQ ID NO: 570252 - RNA, 11 nt, Homo sapiens
ucccuguucuc

SEQ ID NO: 570253 - RNA, 13 nt, Homo sapiens
ucccuguucuggu

SEQ ID NO: 570254 - RNA, 14 nt, Homo sapiens
ucccuguugcugaa

SEQ ID NO: 570255 - RNA, 17 nt, Homo sapiens
ucccuguuuuaauucaa

SEQ ID NO: 570256 - RNA, 21 nt, Homo sapiens
ucccuuaaagauuuucugcuu

SEQ ID NO: 570257 - RNA, 18 nt, Homo sapiens
ucccuuaauaaaaauaua

SEQ ID NO: 570258 - RNA, 21 nt, Homo sapiens
ucccuucacuccccuauccca

SEQ ID NO: 570259 - RNA, 21 nt, Homo sapiens
ucccuuccuccauugcacaug

SEQ ID NO: 570260 - RNA, 17 nt, Homo sapiens
ucccuuccugaaggggg

SEQ ID NO: 570261 - RNA, 17 nt, Homo sapiens
ucccuugaggaaacaac

SEQ ID NO: 570262 - RNA, 20 nt, Homo sapiens
ucccuugaggaaacaacagc

SEQ ID NO: 570263 - RNA, 17 nt, Homo sapiens
ucccuugcucagugccu

SEQ ID NO: 570264 - RNA, 21 nt, Homo sapiens
ucccuugcuggaaaacccaaa

SEQ ID NO: 570265 - RNA, 15 nt, Homo sapiens
ucccuugcuguaugc

SEQ ID NO: 570266 - RNA, 19 nt, Homo sapiens
ucccuuggaaaucugccau

SEQ ID NO: 570267 - RNA, 16 nt, Homo sapiens
ucccuuggccucagaa

SEQ ID NO: 570268 - RNA, 21 nt, Homo sapiens
ucccuugggaagggcagggaa

SEQ ID NO: 570269 - RNA, 15 nt, Homo sapiens
ucccuugguggcaag

SEQ ID NO: 570270 - RNA, 22 nt, Homo sapiens
ucccuuuaccuucauaugugua

SEQ ID NO: 570271 - RNA, 19 nt, Homo sapiens
ucccuuuaugcagagccac

SEQ ID NO: 570272 - RNA, 18 nt, Homo sapiens
ucccuuuggagaugcuga

SEQ ID NO: 570273 - RNA, 15 nt, Homo sapiens
ucccuuuucuguucu

SEQ ID NO: 570274 - RNA, 20 nt, Homo sapiens
uccgacacauuuaccaaauu

SEQ ID NO: 570275 - RNA, 17 nt, Homo sapiens
uccgacgcugccucuca

SEQ ID NO: 570276 - RNA, 14 nt, Homo sapiens
gcuggagagcugcu

SEQ ID NO: 570277 - RNA, 18 nt, Homo sapiens
gcuggagauaguuucaaa

SEQ ID NO: 570278 - RNA, 21 nt, Homo sapiens
gcuggagcaaaagucauuaca

SEQ ID NO: 570279 - RNA, 14 nt, Homo sapiens
gcuggagcuuccaa

SEQ ID NO: 570280 - RNA, 17 nt, Homo sapiens
gcuggaggaugugggca

SEQ ID NO: 570281 - RNA, 21 nt, Homo sapiens
gcuggagggagaacccaaaga

SEQ ID NO: 570282 - RNA, 12 nt, Homo sapiens
gcuggagugcaa

SEQ ID NO: 570283 - RNA, 13 nt, Homo sapiens
gcuggagugcagu

SEQ ID NO: 570284 - RNA, 14 nt, Homo sapiens
gcuggagugcagua

SEQ ID NO: 570285 - RNA, 18 nt, Homo sapiens
gcuggagugcaguggugu

SEQ ID NO: 570286 - RNA, 20 nt, Homo sapiens
gcuggagugcagugguguga

SEQ ID NO: 570287 - RNA, 20 nt, Homo sapiens
gcuggaguguaguggcgcga

SEQ ID NO: 570288 - RNA, 17 nt, Homo sapiens
gcuggauaaaaugaggu

SEQ ID NO: 570289 - RNA, 22 nt, Homo sapiens
gcuggauuacaggcaugugcca

SEQ ID NO: 570290 - RNA, 13 nt, Homo sapiens
gcuggcaaccacu

SEQ ID NO: 570291 - RNA, 19 nt, Homo sapiens
gcuggcaccgccuucucua

SEQ ID NO: 570292 - RNA, 22 nt, Homo sapiens
gcuggcaccuuaguugcaugac

SEQ ID NO: 570293 - RNA, 16 nt, Homo sapiens
gcuggcagaaagggaa

SEQ ID NO: 570294 - RNA, 17 nt, Homo sapiens
gcuggcagaaagggaac

SEQ ID NO: 570295 - RNA, 14 nt, Homo sapiens
gcuggcaguacugu

SEQ ID NO: 570296 - RNA, 19 nt, Homo sapiens
gcuggcaugcagugcccuc

SEQ ID NO: 570297 - RNA, 18 nt, Homo sapiens
gcuggcauugaugggguu

SEQ ID NO: 570298 - RNA, 22 nt, Homo sapiens
gcuggccaaagagccuuuccaa

SEQ ID NO: 570299 - RNA, 15 nt, Homo sapiens
gcuggcccagccaaa

SEQ ID NO: 570300 - RNA, 15 nt, Homo sapiens
gcuggcccgugacag

SEQ ID NO: 570301 - RNA, 16 nt, Homo sapiens
gcuggcccgugacaga

SEQ ID NO: 570302 - RNA, 18 nt, Homo sapiens
gcuggccuccuaugccuc

SEQ ID NO: 570303 - RNA, 16 nt, Homo sapiens
gcuggccucucuagca

SEQ ID NO: 570304 - RNA, 17 nt, Homo sapiens
gcuggccucucugacau

SEQ ID NO: 570305 - RNA, 23 nt, Homo sapiens
gcuggccucucugacauaugcua

SEQ ID NO: 570306 - RNA, 18 nt, Homo sapiens
gcuggccucuggcucuca

SEQ ID NO: 570307 - RNA, 14 nt, Homo sapiens
gcuggcucugagaa

SEQ ID NO: 570308 - RNA, 13 nt, Homo sapiens
gcuggcugcagug

SEQ ID NO: 570309 - RNA, 14 nt, Homo sapiens
gcuggcugcaguga

SEQ ID NO: 570310 - RNA, 13 nt, Homo sapiens
gcuggcuugcagu

SEQ ID NO: 570311 - RNA, 20 nt, Homo sapiens
gcugggaaaaaaguuuugau

SEQ ID NO: 570312 - RNA, 11 nt, Homo sapiens
gcugggaacau

SEQ ID NO: 570313 - RNA, 14 nt, Homo sapiens
gcugggaaccagca

SEQ ID NO: 570314 - RNA, 16 nt, Homo sapiens
gcugggacguggcuca

SEQ ID NO: 570315 - RNA, 15 nt, Homo sapiens
gcugggacuggccag

SEQ ID NO: 570316 - RNA, 19 nt, Homo sapiens
gcugggacuucuuacccaa

SEQ ID NO: 570317 - RNA, 17 nt, Homo sapiens
gcugggacuuggauccc

SEQ ID NO: 570318 - RNA, 12 nt, Homo sapiens
gcugggagacaa

SEQ ID NO: 570319 - RNA, 17 nt, Homo sapiens
gcugggagcacuggugu

SEQ ID NO: 570320 - RNA, 20 nt, Homo sapiens
gcugggaggcaagaggggug

SEQ ID NO: 570321 - RNA, 16 nt, Homo sapiens
gcugggauuacaggug

SEQ ID NO: 570322 - RNA, 14 nt, Homo sapiens
gcugggcaccugac

SEQ ID NO: 570323 - RNA, 14 nt, Homo sapiens
gcugggcaggguga

SEQ ID NO: 570324 - RNA, 16 nt, Homo sapiens
gcugggccauguccaa

SEQ ID NO: 570325 - RNA, 15 nt, Homo sapiens
gcugggccccuucca

SEQ ID NO: 570326 - RNA, 16 nt, Homo sapiens
gcuggggacuggggaa

SEQ ID NO: 570327 - RNA, 19 nt, Homo sapiens
gcuggggaggagcuuuguu

SEQ ID NO: 570328 - RNA, 20 nt, Homo sapiens
gcuggggggauguucugccu

SEQ ID NO: 570329 - RNA, 18 nt, Homo sapiens
gcuggggugcacugggga

SEQ ID NO: 570330 - RNA, 19 nt, Homo sapiens
gcugggugagcucuuccag

SEQ ID NO: 570331 - RNA, 21 nt, Homo sapiens
gcuggucagagagaccucauc

SEQ ID NO: 570332 - RNA, 23 nt, Homo sapiens
gcuggucccggggccagcacuuc

SEQ ID NO: 570333 - RNA, 22 nt, Homo sapiens
gcuggucucaaacuccugaccu

SEQ ID NO: 570334 - RNA, 23 nt, Homo sapiens
gcuggugccccacagcuaccuga

SEQ ID NO: 570335 - RNA, 14 nt, Homo sapiens
gcugguggcaauaa

SEQ ID NO: 570336 - RNA, 20 nt, Homo sapiens
gcuggugggcaugugagaug

SEQ ID NO: 570337 - RNA, 18 nt, Homo sapiens
gcuggugggucugagcug

SEQ ID NO: 570338 - RNA, 22 nt, Homo sapiens
gcuguacaccccaggacaguuu

SEQ ID NO: 570339 - RNA, 14 nt, Homo sapiens
gcuguagaagaugg

SEQ ID NO: 570340 - RNA, 15 nt, Homo sapiens
gcuguagacaucugu

SEQ ID NO: 570341 - RNA, 13 nt, Homo sapiens
gcuguagauccca

SEQ ID NO: 570342 - RNA, 23 nt, Homo sapiens
gcuguaucaaacuagugcaugaa

SEQ ID NO: 570343 - RNA, 19 nt, Homo sapiens
gcuguauccagaagccagu

SEQ ID NO: 570344 - RNA, 19 nt, Homo sapiens
gcuguauuugcugccagac

SEQ ID NO: 570345 - RNA, 19 nt, Homo sapiens
gcugucaaaacuacugaca

SEQ ID NO: 570346 - RNA, 21 nt, Homo sapiens
gcugucaagggcagaaugaau

SEQ ID NO: 570347 - RNA, 21 nt, Homo sapiens
gcugucaucugugcacugccc

SEQ ID NO: 570348 - RNA, 23 nt, Homo sapiens
gcuguccccacagcuucucuaca

SEQ ID NO: 570349 - RNA, 16 nt, Homo sapiens
gcugucccgugcaugg

SEQ ID NO: 570350 - RNA, 17 nt, Homo sapiens
gcuguccugaucuguga

SEQ ID NO: 570351 - RNA, 14 nt, Homo sapiens
gcuguccugcagca

SEQ ID NO: 570352 - RNA, 20 nt, Homo sapiens
gcugucuauguggcuguauc

SEQ ID NO: 570353 - RNA, 16 nt, Homo sapiens
gcugucuugccccagu

SEQ ID NO: 570354 - RNA, 18 nt, Homo sapiens
gcugugaaagaaccaaaa

SEQ ID NO: 570355 - RNA, 16 nt, Homo sapiens
gcugugagacaguggg

SEQ ID NO: 570356 - RNA, 19 nt, Homo sapiens
gcugugaggccccuggaca

SEQ ID NO: 570357 - RNA, 22 nt, Homo sapiens
gcugugauuguacuguacauaa

SEQ ID NO: 570358 - RNA, 16 nt, Homo sapiens
gcugugcaucaguggg

SEQ ID NO: 570359 - RNA, 23 nt, Homo sapiens
gcugugccuggccuccgaugccu

SEQ ID NO: 570360 - RNA, 14 nt, Homo sapiens
gcuguggaagccag

SEQ ID NO: 570361 - RNA, 14 nt, Homo sapiens
gcuguggacuauua

SEQ ID NO: 570362 - RNA, 15 nt, Homo sapiens
gcuguggcccuggag

SEQ ID NO: 570363 - RNA, 23 nt, Homo sapiens
gcuguggccgucuccucccucag

SEQ ID NO: 570364 - RNA, 16 nt, Homo sapiens
gcugugggcugcauac

SEQ ID NO: 570365 - RNA, 20 nt, Homo sapiens
gcugugggguggagcacugg

SEQ ID NO: 570366 - RNA, 17 nt, Homo sapiens
gcuguguaagcucacau

SEQ ID NO: 570367 - RNA, 14 nt, Homo sapiens
gcugugucauucca

SEQ ID NO: 570368 - RNA, 19 nt, Homo sapiens
gcuguguugggugguugcc

SEQ ID NO: 570369 - RNA, 12 nt, Homo sapiens
gcuguuaaccaa

SEQ ID NO: 570370 - RNA, 13 nt, Homo sapiens
gcuguuauacugu

SEQ ID NO: 570371 - RNA, 14 nt, Homo sapiens
gcuguuccugagaa

SEQ ID NO: 570372 - RNA, 14 nt, Homo sapiens
gcuguucugcugaa

SEQ ID NO: 570373 - RNA, 15 nt, Homo sapiens
gcuguugacauauuu

SEQ ID NO: 570374 - RNA, 20 nt, Homo sapiens
gcuguugcaugggcuaauga

SEQ ID NO: 570375 - RNA, 18 nt, Homo sapiens
gcuguuguaaagaauugg

SEQ ID NO: 570376 - RNA, 15 nt, Homo sapiens
gcuguuguuccauug

SEQ ID NO: 570377 - RNA, 18 nt, Homo sapiens
gcuguuuccaggaaauua

SEQ ID NO: 570378 - RNA, 15 nt, Homo sapiens
gcuguuugacaccuc

SEQ ID NO: 570379 - RNA, 17 nt, Homo sapiens
gcuguuuguuccaggcu

SEQ ID NO: 570380 - RNA, 19 nt, Homo sapiens
gcuguuuguuccaggcuca

SEQ ID NO: 570381 - RNA, 14 nt, Homo sapiens
gcuguuuguuucau

SEQ ID NO: 570382 - RNA, 18 nt, Homo sapiens
gcuguuuuagcugaggga

SEQ ID NO: 570383 - RNA, 21 nt, Homo sapiens
gcuguuuucaauaaugugaau

SEQ ID NO: 570384 - RNA, 15 nt, Homo sapiens
gcuguuuucuucuau

SEQ ID NO: 570385 - RNA, 16 nt, Homo sapiens
gcuuaaaguugucacu

SEQ ID NO: 570386 - RNA, 16 nt, Homo sapiens
gcuuaaauugucagau

SEQ ID NO: 570387 - RNA, 21 nt, Homo sapiens
gcuuaaccuuuccaguuuaua

SEQ ID NO: 570388 - RNA, 22 nt, Homo sapiens
gcuuaagaacugcuucauguga

SEQ ID NO: 570389 - RNA, 23 nt, Homo sapiens
gcuuaagccacugccucucccuc

SEQ ID NO: 570390 - RNA, 22 nt, Homo sapiens
gcuuaauggcucaugaccugga

SEQ ID NO: 570391 - RNA, 14 nt, Homo sapiens
gcuuaaugggagcu

SEQ ID NO: 570392 - RNA, 11 nt, Homo sapiens
gcuuacaggaa

SEQ ID NO: 570393 - RNA, 18 nt, Homo sapiens
gcuuacauuuuuacaaua

SEQ ID NO: 570394 - RNA, 21 nt, Homo sapiens
gcuuaccauuaaaguucucaa

SEQ ID NO: 570395 - RNA, 15 nt, Homo sapiens
gcuuaccugaucuca

SEQ ID NO: 570396 - RNA, 15 nt, Homo sapiens
gcuuaccuucugcug

SEQ ID NO: 570397 - RNA, 14 nt, Homo sapiens
gcuuacuaaugugc

SEQ ID NO: 570398 - RNA, 20 nt, Homo sapiens
gcuuacuguugcuuuaguca

SEQ ID NO: 570399 - RNA, 16 nt, Homo sapiens
uccgagauccaccaga

SEQ ID NO: 570400 - RNA, 17 nt, Homo sapiens
uccgagauccaccagau

SEQ ID NO: 570401 - RNA, 19 nt, Homo sapiens
uccgcaggcagacuacaca

SEQ ID NO: 570402 - RNA, 14 nt, Homo sapiens
uccgccagaccuca

SEQ ID NO: 570403 - RNA, 22 nt, Homo sapiens
uccgcccccggauuugcucagg

SEQ ID NO: 570404 - RNA, 22 nt, Homo sapiens
uccgcugccaccacgucugcca

SEQ ID NO: 570405 - RNA, 17 nt, Homo sapiens
uccgcuuucucuugcug

SEQ ID NO: 570406 - RNA, 13 nt, Homo sapiens
uccggaauccuug

SEQ ID NO: 570407 - RNA, 17 nt, Homo sapiens
uccggaggcugaggcag

SEQ ID NO: 570408 - RNA, 20 nt, Homo sapiens
uccggagugagcaauggagu

SEQ ID NO: 570409 - RNA, 21 nt, Homo sapiens
uccggcaaugcccugugcaug

SEQ ID NO: 570410 - RNA, 20 nt, Homo sapiens
uccggcagaagcagcugcag

SEQ ID NO: 570411 - RNA, 19 nt, Homo sapiens
uccggccccuccugugacg

SEQ ID NO: 570412 - RNA, 13 nt, Homo sapiens
uccgggucacugc

SEQ ID NO: 570413 - RNA, 23 nt, Homo sapiens
uccggguggaaaagaaucccugc

SEQ ID NO: 570414 - RNA, 16 nt, Homo sapiens
uccguaguucccugaa

SEQ ID NO: 570415 - RNA, 20 nt, Homo sapiens
uccgucaguccaagucuucu

SEQ ID NO: 570416 - RNA, 12 nt, Homo sapiens
uccgucugaccc

SEQ ID NO: 570417 - RNA, 19 nt, Homo sapiens
uccgugccuccaccaccac

SEQ ID NO: 570418 - RNA, 12 nt, Homo sapiens
uccguguaaaau

SEQ ID NO: 570419 - RNA, 21 nt, Homo sapiens
uccgugugauugucuuugaau

SEQ ID NO: 570420 - RNA, 15 nt, Homo sapiens
uccguuaugccaccu

SEQ ID NO: 570421 - RNA, 19 nt, Homo sapiens
uccguuaugccaccuggag

SEQ ID NO: 570422 - RNA, 16 nt, Homo sapiens
uccguucaauaagcau

SEQ ID NO: 570423 - RNA, 15 nt, Homo sapiens
uccuaaaacaacaga

SEQ ID NO: 570424 - RNA, 23 nt, Homo sapiens
uccuaaaagagaucugggcauua

SEQ ID NO: 570425 - RNA, 15 nt, Homo sapiens
uccuaaacuuuccaa

SEQ ID NO: 570426 - RNA, 23 nt, Homo sapiens
uccuaaaguacuggagugaaaua

SEQ ID NO: 570427 - RNA, 16 nt, Homo sapiens
uccuaacugacaugca

SEQ ID NO: 570428 - RNA, 18 nt, Homo sapiens
uccuaagacacaaaugca

SEQ ID NO: 570429 - RNA, 12 nt, Homo sapiens
uccuaagcacuu

SEQ ID NO: 570430 - RNA, 16 nt, Homo sapiens
uccuaagcuauucagu

SEQ ID NO: 570431 - RNA, 21 nt, Homo sapiens
uccuaagcuucaaaucagaag

SEQ ID NO: 570432 - RNA, 21 nt, Homo sapiens
uccuaagucugucauccucug

SEQ ID NO: 570433 - RNA, 21 nt, Homo sapiens
uccuaaucugcugccagaauu

SEQ ID NO: 570434 - RNA, 14 nt, Homo sapiens
uccuaauuaccagu

SEQ ID NO: 570435 - RNA, 17 nt, Homo sapiens
uccuaauuccacagcug

SEQ ID NO: 570436 - RNA, 23 nt, Homo sapiens
uccuaauuccacagcugcucaau

SEQ ID NO: 570437 - RNA, 13 nt, Homo sapiens
uccuacaagacac

SEQ ID NO: 570438 - RNA, 17 nt, Homo sapiens
uccuacaagacacagug

SEQ ID NO: 570439 - RNA, 18 nt, Homo sapiens
uccuacaagacacaguga

SEQ ID NO: 570440 - RNA, 23 nt, Homo sapiens
uccuacacguuagauuugccgua

SEQ ID NO: 570441 - RNA, 17 nt, Homo sapiens
uccuaccaguugcccua

SEQ ID NO: 570442 - RNA, 14 nt, Homo sapiens
uccuacccacuggu

SEQ ID NO: 570443 - RNA, 22 nt, Homo sapiens
uccuacccacuggucugcuuaa

SEQ ID NO: 570444 - RNA, 19 nt, Homo sapiens
uccuacgauacgcuacuau

SEQ ID NO: 570445 - RNA, 18 nt, Homo sapiens
uccuacuaucacugaaca

SEQ ID NO: 570446 - RNA, 21 nt, Homo sapiens
uccuacugagcauuugcaccu

SEQ ID NO: 570447 - RNA, 21 nt, Homo sapiens
uccuagaagaaccaaauaccu

SEQ ID NO: 570448 - RNA, 15 nt, Homo sapiens
uccuagcaaccucca

SEQ ID NO: 570449 - RNA, 13 nt, Homo sapiens
uccuagcacuuug

SEQ ID NO: 570450 - RNA, 22 nt, Homo sapiens
uccuagccaggcuaucuggccu

SEQ ID NO: 570451 - RNA, 18 nt, Homo sapiens
uccuagcugugugaauac

SEQ ID NO: 570452 - RNA, 19 nt, Homo sapiens
uccuaggagagccaaccuc

SEQ ID NO: 570453 - RNA, 18 nt, Homo sapiens
uccuaggcauuugcugaa

SEQ ID NO: 570454 - RNA, 19 nt, Homo sapiens
uccuaggccacaccaucuc

SEQ ID NO: 570455 - RNA, 20 nt, Homo sapiens
uccuaggccacaccaucucc

SEQ ID NO: 570456 - RNA, 22 nt, Homo sapiens
uccuagggcacuucuaguuuca

SEQ ID NO: 570457 - RNA, 16 nt, Homo sapiens
uccuaguaauugccua

SEQ ID NO: 570458 - RNA, 18 nt, Homo sapiens
uccuaguggaugacuguu

SEQ ID NO: 570459 - RNA, 13 nt, Homo sapiens
uccuauaagcuua

SEQ ID NO: 570460 - RNA, 13 nt, Homo sapiens
uccuauaccuuac

SEQ ID NO: 570461 - RNA, 24 nt, Homo sapiens
uccuaucaccucgagaaguaauua

SEQ ID NO: 570462 - RNA, 22 nt, Homo sapiens
uccuaucuccagcggcccuguc

SEQ ID NO: 570463 - RNA, 18 nt, Homo sapiens
uccuaugcuauugacaau

SEQ ID NO: 570464 - RNA, 16 nt, Homo sapiens
uccuaugggaacaauu

SEQ ID NO: 570465 - RNA, 17 nt, Homo sapiens
uccuauucuauugcagu

SEQ ID NO: 570466 - RNA, 14 nt, Homo sapiens
uccuauucuguugc

SEQ ID NO: 570467 - RNA, 18 nt, Homo sapiens
uccuauuguucacuuuau

SEQ ID NO: 570468 - RNA, 22 nt, Homo sapiens
uccuauuuauaagagugccgua

SEQ ID NO: 570469 - RNA, 15 nt, Homo sapiens
uccucaaaacuggag

SEQ ID NO: 570470 - RNA, 18 nt, Homo sapiens
uccucaaaccacuugccu

SEQ ID NO: 570471 - RNA, 18 nt, Homo sapiens
uccucaaauaagucuucc

SEQ ID NO: 570472 - RNA, 19 nt, Homo sapiens
uccucaagacuuugauccu

SEQ ID NO: 570473 - RNA, 17 nt, Homo sapiens
uccucaagcagaccuac

SEQ ID NO: 570474 - RNA, 13 nt, Homo sapiens
uccucaagccugu

SEQ ID NO: 570475 - RNA, 14 nt, Homo sapiens
uccucaauccagcu

SEQ ID NO: 570476 - RNA, 12 nt, Homo sapiens
uccucacgugca

SEQ ID NO: 570477 - RNA, 16 nt, Homo sapiens
uccucacuguauccag

SEQ ID NO: 570478 - RNA, 15 nt, Homo sapiens
uccucagaacaugag

SEQ ID NO: 570479 - RNA, 20 nt, Homo sapiens
uccucagagcaggggccaga

SEQ ID NO: 570480 - RNA, 15 nt, Homo sapiens
uccucagauggggca

SEQ ID NO: 570481 - RNA, 22 nt, Homo sapiens
uccucagauugcugaaucccau

SEQ ID NO: 570482 - RNA, 21 nt, Homo sapiens
uccucagccaugggaaccuca

SEQ ID NO: 570483 - RNA, 23 nt, Homo sapiens
uccucagcccccaggccagguga

SEQ ID NO: 570484 - RNA, 22 nt, Homo sapiens
uccucagccucugcaacugcaa

SEQ ID NO: 570485 - RNA, 15 nt, Homo sapiens
uccucagcuuaucuc

SEQ ID NO: 570486 - RNA, 22 nt, Homo sapiens
uccucaggcacacagcuacucu

SEQ ID NO: 570487 - RNA, 21 nt, Homo sapiens
uccucaggguggggggugaca

SEQ ID NO: 570488 - RNA, 18 nt, Homo sapiens
uccucagguaacagucgu

SEQ ID NO: 570489 - RNA, 12 nt, Homo sapiens
uccucauguugc

SEQ ID NO: 570490 - RNA, 16 nt, Homo sapiens
uccuccaacaccaagc

SEQ ID NO: 570491 - RNA, 16 nt, Homo sapiens
uccuccacagugcugc

SEQ ID NO: 570492 - RNA, 17 nt, Homo sapiens
uccuccaccgucuuucu

SEQ ID NO: 570493 - RNA, 16 nt, Homo sapiens
uccuccacgccugucc

SEQ ID NO: 570494 - RNA, 16 nt, Homo sapiens
uccuccagcaccauag

SEQ ID NO: 570495 - RNA, 12 nt, Homo sapiens
uccuccaggcaa

SEQ ID NO: 570496 - RNA, 21 nt, Homo sapiens
uccuccaggguggcagcaaca

SEQ ID NO: 570497 - RNA, 20 nt, Homo sapiens
uccuccagggugugugcucg

SEQ ID NO: 570498 - RNA, 14 nt, Homo sapiens
uccuccaugggaga

SEQ ID NO: 570499 - RNA, 16 nt, Homo sapiens
uccucccacugucugc

SEQ ID NO: 570500 - RNA, 13 nt, Homo sapiens
uccucccagugag

SEQ ID NO: 570501 - RNA, 16 nt, Homo sapiens
uccuccccacacucca

SEQ ID NO: 570502 - RNA, 16 nt, Homo sapiens
uccucccugucauaga

SEQ ID NO: 570503 - RNA, 15 nt, Homo sapiens
uccucccuucugcua

SEQ ID NO: 570504 - RNA, 15 nt, Homo sapiens
uccuccuccaucacc

SEQ ID NO: 570505 - RNA, 18 nt, Homo sapiens
uccuccugauccugacac

SEQ ID NO: 570506 - RNA, 16 nt, Homo sapiens
uccuccuucccaggga

SEQ ID NO: 570507 - RNA, 14 nt, Homo sapiens
uccucgcagccucu

SEQ ID NO: 570508 - RNA, 16 nt, Homo sapiens
uccucgguacucccau

SEQ ID NO: 570509 - RNA, 19 nt, Homo sapiens
uccucuagcccacucccug

SEQ ID NO: 570510 - RNA, 21 nt, Homo sapiens
uccucuagcccacucccugcc

SEQ ID NO: 570511 - RNA, 19 nt, Homo sapiens
uccucuagcugugggggug

SEQ ID NO: 570512 - RNA, 14 nt, Homo sapiens
uccucuaguaguau

SEQ ID NO: 570513 - RNA, 19 nt, Homo sapiens
uccucuauuuaagauauau

SEQ ID NO: 570514 - RNA, 19 nt, Homo sapiens
uccucucaagcuagccaga

SEQ ID NO: 570515 - RNA, 14 nt, Homo sapiens
uccucuccuaccca

SEQ ID NO: 570516 - RNA, 15 nt, Homo sapiens
uccucucuuccucuu

SEQ ID NO: 570517 - RNA, 14 nt, Homo sapiens
uccucugaacaaaa

SEQ ID NO: 570518 - RNA, 11 nt, Homo sapiens
uccucugacau

SEQ ID NO: 570519 - RNA, 17 nt, Homo sapiens
uccucugcauuuacaca

SEQ ID NO: 570520 - RNA, 13 nt, Homo sapiens
uccucugccaugu

SEQ ID NO: 570521 - RNA, 23 nt, Homo sapiens
uccucugccucccauucugacca

SEQ ID NO: 570522 - RNA, 16 nt, Homo sapiens
gcuuacuuaugccaua

SEQ ID NO: 570523 - RNA, 13 nt, Homo sapiens
gcuuagacucuug

SEQ ID NO: 570524 - RNA, 15 nt, Homo sapiens
gcuuagagaggacaa

SEQ ID NO: 570525 - RNA, 15 nt, Homo sapiens
gcuuaggacuuucca

SEQ ID NO: 570526 - RNA, 18 nt, Homo sapiens
gcuuaggccucucugccu

SEQ ID NO: 570527 - RNA, 22 nt, Homo sapiens
gcuuaggccucucugccuggga

SEQ ID NO: 570528 - RNA, 23 nt, Homo sapiens
gcuuagggggagcccuggugcua

SEQ ID NO: 570529 - RNA, 23 nt, Homo sapiens
gcuuaguccaauuccuugcacau

SEQ ID NO: 570530 - RNA, 16 nt, Homo sapiens
gcuuaguuuguguguu

SEQ ID NO: 570531 - RNA, 14 nt, Homo sapiens
gcuuaugcauuuau

SEQ ID NO: 570532 - RNA, 17 nt, Homo sapiens
gcuuaugccugccucuu

SEQ ID NO: 570533 - RNA, 16 nt, Homo sapiens
gcuuauggauucauau

SEQ ID NO: 570534 - RNA, 22 nt, Homo sapiens
gcuuauggauucauauaggcca

SEQ ID NO: 570535 - RNA, 22 nt, Homo sapiens
gcuucaaauuauagaaacaaua

SEQ ID NO: 570536 - RNA, 21 nt, Homo sapiens
gcuucaaggauauacugcagc

SEQ ID NO: 570537 - RNA, 19 nt, Homo sapiens
gcuucaaggcccucagaga

SEQ ID NO: 570538 - RNA, 22 nt, Homo sapiens
gcuucaggaaggacauggacaa

SEQ ID NO: 570539 - RNA, 13 nt, Homo sapiens
gcuucagugccau

SEQ ID NO: 570540 - RNA, 14 nt, Homo sapiens
gcuucaguugcaua

SEQ ID NO: 570541 - RNA, 19 nt, Homo sapiens
gcuucaguugcauaucuua

SEQ ID NO: 570542 - RNA, 23 nt, Homo sapiens
gcuucauaaaugaagcagcuuua

SEQ ID NO: 570543 - RNA, 24 nt, Homo sapiens
gcuucaugugcugccugcaagcuu

SEQ ID NO: 570544 - RNA, 20 nt, Homo sapiens
gcuuccaacaaggacagccc

SEQ ID NO: 570545 - RNA, 16 nt, Homo sapiens
gcuuccagaaaacccc

SEQ ID NO: 570546 - RNA, 23 nt, Homo sapiens
gcuuccauccugucaccaugacu

SEQ ID NO: 570547 - RNA, 14 nt, Homo sapiens
gcuucccacuuugg

SEQ ID NO: 570548 - RNA, 23 nt, Homo sapiens
gcuucccggcgucccuaccuccu

SEQ ID NO: 570549 - RNA, 19 nt, Homo sapiens
gcuucccuaaucuaugguc

SEQ ID NO: 570550 - RNA, 23 nt, Homo sapiens
gcuuccgcccccggauuugcuca

SEQ ID NO: 570551 - RNA, 16 nt, Homo sapiens
gcuuccgccgucucaa

SEQ ID NO: 570552 - RNA, 17 nt, Homo sapiens
gcuuccgccgucucaac

SEQ ID NO: 570553 - RNA, 12 nt, Homo sapiens
gcuuccuaacug

SEQ ID NO: 570554 - RNA, 20 nt, Homo sapiens
gcuuccucaguaacauuucu

SEQ ID NO: 570555 - RNA, 19 nt, Homo sapiens
gcuuccucuagaagccaag

SEQ ID NO: 570556 - RNA, 14 nt, Homo sapiens
gcuuccugugacag

SEQ ID NO: 570557 - RNA, 20 nt, Homo sapiens
gcuuccuuagaacuucuaca

SEQ ID NO: 570558 - RNA, 12 nt, Homo sapiens
gcuucgcuggaa

SEQ ID NO: 570559 - RNA, 15 nt, Homo sapiens
gcuucggacaaaaua

SEQ ID NO: 570560 - RNA, 17 nt, Homo sapiens
gcuucuaucagguccca

SEQ ID NO: 570561 - RNA, 22 nt, Homo sapiens
gcuucucacugccaugccagcu

SEQ ID NO: 570562 - RNA, 15 nt, Homo sapiens
gcuucucagccccuu

SEQ ID NO: 570563 - RNA, 20 nt, Homo sapiens
gcuucucaucuaaauauuuc

SEQ ID NO: 570564 - RNA, 20 nt, Homo sapiens
gcuucuccaauucugcccaa

SEQ ID NO: 570565 - RNA, 15 nt, Homo sapiens
gcuucuccauggcca

SEQ ID NO: 570566 - RNA, 12 nt, Homo sapiens
gcuucuccuucu

SEQ ID NO: 570567 - RNA, 18 nt, Homo sapiens
gcuucucuacagacucca

SEQ ID NO: 570568 - RNA, 21 nt, Homo sapiens
gcuucucuacagacuccaaaa

SEQ ID NO: 570569 - RNA, 23 nt, Homo sapiens
gcuucucuacagacuccaaaagg

SEQ ID NO: 570570 - RNA, 14 nt, Homo sapiens
gcuucucuccucag

SEQ ID NO: 570571 - RNA, 21 nt, Homo sapiens
gcuucucuucuuuauugcacu

SEQ ID NO: 570572 - RNA, 22 nt, Homo sapiens
gcuucucuucuuuauugcacua

SEQ ID NO: 570573 - RNA, 14 nt, Homo sapiens
gcuucucuuucuaa

SEQ ID NO: 570574 - RNA, 19 nt, Homo sapiens
gcuucugauacguguauga

SEQ ID NO: 570575 - RNA, 14 nt, Homo sapiens
gcuucugauaugca

SEQ ID NO: 570576 - RNA, 21 nt, Homo sapiens
gcuucugcaccaacucaccug

SEQ ID NO: 570577 - RNA, 11 nt, Homo sapiens
gcuucugccau

SEQ ID NO: 570578 - RNA, 22 nt, Homo sapiens
gcuucuuaaaaacuguguauca

SEQ ID NO: 570579 - RNA, 17 nt, Homo sapiens
gcuucuucaucuuuaaa

SEQ ID NO: 570580 - RNA, 13 nt, Homo sapiens
gcuucuucugccc

SEQ ID NO: 570581 - RNA, 20 nt, Homo sapiens
gcuucuugccucugugcugu

SEQ ID NO: 570582 - RNA, 15 nt, Homo sapiens
gcuugacauaccuac

SEQ ID NO: 570583 - RNA, 13 nt, Homo sapiens
gcuugaccaaaga

SEQ ID NO: 570584 - RNA, 21 nt, Homo sapiens
gcuugagcaaccuggcuaaga

SEQ ID NO: 570585 - RNA, 13 nt, Homo sapiens
gcuugaguuauau

SEQ ID NO: 570586 - RNA, 20 nt, Homo sapiens
gcuugaucaauucccuugaa

SEQ ID NO: 570587 - RNA, 13 nt, Homo sapiens
gcuugaucacagc

SEQ ID NO: 570588 - RNA, 15 nt, Homo sapiens
gcuugaucugugauu

SEQ ID NO: 570589 - RNA, 16 nt, Homo sapiens
gcuugcaauguaguca

SEQ ID NO: 570590 - RNA, 16 nt, Homo sapiens
gcuugcaccacuuccg

SEQ ID NO: 570591 - RNA, 20 nt, Homo sapiens
gcuugcccagggugcagugu

SEQ ID NO: 570592 - RNA, 13 nt, Homo sapiens
gcuugcuggguac

SEQ ID NO: 570593 - RNA, 16 nt, Homo sapiens
gcuuggaguucucuau

SEQ ID NO: 570594 - RNA, 21 nt, Homo sapiens
gcuuggauggagacuccauga

SEQ ID NO: 570595 - RNA, 18 nt, Homo sapiens
gcuuggauuaaauacaua

SEQ ID NO: 570596 - RNA, 21 nt, Homo sapiens
gcuuggcaucugugugcgugg

SEQ ID NO: 570597 - RNA, 15 nt, Homo sapiens
gcuuggcaugaccuc

SEQ ID NO: 570598 - RNA, 23 nt, Homo sapiens
gcuuggcucccgaaugucgcauu

SEQ ID NO: 570599 - RNA, 16 nt, Homo sapiens
gcuugggcuuccauuu

SEQ ID NO: 570600 - RNA, 18 nt, Homo sapiens
gcuuggggcaacagauug

SEQ ID NO: 570601 - RNA, 16 nt, Homo sapiens
gcuugguggccuggga

SEQ ID NO: 570602 - RNA, 17 nt, Homo sapiens
gcuugguggccugggau

SEQ ID NO: 570603 - RNA, 13 nt, Homo sapiens
gcuuguaaucaag

SEQ ID NO: 570604 - RNA, 16 nt, Homo sapiens
gcuugucauuccagag

SEQ ID NO: 570605 - RNA, 19 nt, Homo sapiens
gcuuguccugcucucuuca

SEQ ID NO: 570606 - RNA, 16 nt, Homo sapiens
gcuuguuccacugcaa

SEQ ID NO: 570607 - RNA, 13 nt, Homo sapiens
gcuuguugcuguu

SEQ ID NO: 570608 - RNA, 21 nt, Homo sapiens
gcuuguugucuccacuuguau

SEQ ID NO: 570609 - RNA, 14 nt, Homo sapiens
gcuuuaaaaccaca

SEQ ID NO: 570610 - RNA, 22 nt, Homo sapiens
gcuuuaaguaaaaauccaaaaa

SEQ ID NO: 570611 - RNA, 19 nt, Homo sapiens
gcuuuacuuucuguguuga

SEQ ID NO: 570612 - RNA, 19 nt, Homo sapiens
gcuuuaggcagagccauaa

SEQ ID NO: 570613 - RNA, 14 nt, Homo sapiens
gcuuuaguggggaa

SEQ ID NO: 570614 - RNA, 21 nt, Homo sapiens
gcuuuauuuuuuaaguauuua

SEQ ID NO: 570615 - RNA, 20 nt, Homo sapiens
gcuuucaacauguacaggaa

SEQ ID NO: 570616 - RNA, 14 nt, Homo sapiens
gcuuucagagccag

SEQ ID NO: 570617 - RNA, 20 nt, Homo sapiens
gcuuucagguguuacagaaa

SEQ ID NO: 570618 - RNA, 19 nt, Homo sapiens
gcuuuccaauguagcucag

SEQ ID NO: 570619 - RNA, 17 nt, Homo sapiens
gcuuuccuuaguuuucu

SEQ ID NO: 570620 - RNA, 23 nt, Homo sapiens
gcuuucguguaaauuauguaaug

SEQ ID NO: 570621 - RNA, 21 nt, Homo sapiens
gcuuucuccauuguaaaccac

SEQ ID NO: 570622 - RNA, 22 nt, Homo sapiens
gcuuucucccucacccaaguuu

SEQ ID NO: 570623 - RNA, 13 nt, Homo sapiens
gcuuucucucaga

SEQ ID NO: 570624 - RNA, 20 nt, Homo sapiens
gcuuucucugccucugggca

SEQ ID NO: 570625 - RNA, 22 nt, Homo sapiens
gcuuucugccaucuagccagcc

SEQ ID NO: 570626 - RNA, 23 nt, Homo sapiens
gcuuucuguugauguuaacugag

SEQ ID NO: 570627 - RNA, 18 nt, Homo sapiens
gcuuucuucuuaaccuau

SEQ ID NO: 570628 - RNA, 15 nt, Homo sapiens
gcuuucuuguugcug

SEQ ID NO: 570629 - RNA, 13 nt, Homo sapiens
gcuuugacucacc

SEQ ID NO: 570630 - RNA, 19 nt, Homo sapiens
gcuuugacucaccuguuac

SEQ ID NO: 570631 - RNA, 23 nt, Homo sapiens
gcuuugccagagcgugcuuucaa

SEQ ID NO: 570632 - RNA, 15 nt, Homo sapiens
gcuuugccauuguga

SEQ ID NO: 570633 - RNA, 12 nt, Homo sapiens
gcuuugcucaaa

SEQ ID NO: 570634 - RNA, 17 nt, Homo sapiens
gcuuugcugcuaugaaa

SEQ ID NO: 570635 - RNA, 22 nt, Homo sapiens
uccuucccucucaugacuugca

SEQ ID NO: 570636 - RNA, 20 nt, Homo sapiens
uccuucccugcucuugcagu

SEQ ID NO: 570637 - RNA, 21 nt, Homo sapiens
uccuuccuaaacccaaugacu

SEQ ID NO: 570638 - RNA, 14 nt, Homo sapiens
uccuuccucccacc

SEQ ID NO: 570639 - RNA, 11 nt, Homo sapiens
uccuuccucuc

SEQ ID NO: 570640 - RNA, 20 nt, Homo sapiens
uccuuccuuaucacugacac

SEQ ID NO: 570641 - RNA, 14 nt, Homo sapiens
uccuuccuugacug

SEQ ID NO: 570642 - RNA, 19 nt, Homo sapiens
uccuucuacuguccuggcu

SEQ ID NO: 570643 - RNA, 15 nt, Homo sapiens
uccuucucacacaca

SEQ ID NO: 570644 - RNA, 20 nt, Homo sapiens
uccuucucacugccauggaa

SEQ ID NO: 570645 - RNA, 12 nt, Homo sapiens
gcuuuucagggu

SEQ ID NO: 570646 - RNA, 15 nt, Homo sapiens
gcuuuucauuucuca

SEQ ID NO: 570647 - RNA, 21 nt, Homo sapiens
gcuuuuccaagcugccacugg

SEQ ID NO: 570648 - RNA, 17 nt, Homo sapiens
gcuuuucuaacuaagag

SEQ ID NO: 570649 - RNA, 22 nt, Homo sapiens
gcuuuugccaguauuaugcaua

SEQ ID NO: 570650 - RNA, 16 nt, Homo sapiens
gcuuuugcuugcaaug

SEQ ID NO: 570651 - RNA, 16 nt, Homo sapiens
gcuuuuguuugcucuu

SEQ ID NO: 570652 - RNA, 18 nt, Homo sapiens
gcuuuuugccaucuguga

SEQ ID NO: 570653 - RNA, 21 nt, Homo sapiens
ggaaaaaaauaguaaagccaa

SEQ ID NO: 570654 - RNA, 20 nt, Homo sapiens
ggaaaaaaguuuugaugaaa

SEQ ID NO: 570655 - RNA, 19 nt, Homo sapiens
ggaaaaaauaaaagaucuu

SEQ ID NO: 570656 - RNA, 19 nt, Homo sapiens
ggaaaaacaaaugccauau

SEQ ID NO: 570657 - RNA, 19 nt, Homo sapiens
ggaaaaaccaauagcuuua

SEQ ID NO: 570658 - RNA, 22 nt, Homo sapiens
ggaaaaauaaucaaaagcuauu

SEQ ID NO: 570659 - RNA, 17 nt, Homo sapiens
ggaaaaauaauucuauu

SEQ ID NO: 570660 - RNA, 13 nt, Homo sapiens
ggaaaacacugcc

SEQ ID NO: 570661 - RNA, 15 nt, Homo sapiens
ggaaaacagaccugu

SEQ ID NO: 570662 - RNA, 22 nt, Homo sapiens
ggaaaagaagaaacuuugccuc

SEQ ID NO: 570663 - RNA, 19 nt, Homo sapiens
ggaaaagcaaaacuguagg

SEQ ID NO: 570664 - RNA, 13 nt, Homo sapiens
ggaaaagcaagaa

SEQ ID NO: 570665 - RNA, 16 nt, Homo sapiens
ggaaaagcauguuaug

SEQ ID NO: 570666 - RNA, 15 nt, Homo sapiens
ggaaaagccaucuca

SEQ ID NO: 570667 - RNA, 22 nt, Homo sapiens
ggaaaaguguaauagcauacau

SEQ ID NO: 570668 - RNA, 17 nt, Homo sapiens
ggaaaauaaacaucagu

SEQ ID NO: 570669 - RNA, 20 nt, Homo sapiens
ggaaaauaaauucagaucaa

SEQ ID NO: 570670 - RNA, 18 nt, Homo sapiens
ggaaaaucacuugccaaa

SEQ ID NO: 570671 - RNA, 18 nt, Homo sapiens
ggaaaauccacuaugaca

SEQ ID NO: 570672 - RNA, 12 nt, Homo sapiens
ggaaaaugacuc

SEQ ID NO: 570673 - RNA, 15 nt, Homo sapiens
ggaaaaugccaugaa

SEQ ID NO: 570674 - RNA, 19 nt, Homo sapiens
ggaaaauggagccaugaca

SEQ ID NO: 570675 - RNA, 21 nt, Homo sapiens
ggaaaauggagccaugacaag

SEQ ID NO: 570676 - RNA, 23 nt, Homo sapiens
ggaaacaauauaaccacaaagca

SEQ ID NO: 570677 - RNA, 20 nt, Homo sapiens
ggaaacauuuuauacuguac

SEQ ID NO: 570678 - RNA, 16 nt, Homo sapiens
ggaaaccgccuaguuu

SEQ ID NO: 570679 - RNA, 18 nt, Homo sapiens
ggaaaccugcccugccug

SEQ ID NO: 570680 - RNA, 17 nt, Homo sapiens
ggaaacucagaugucca

SEQ ID NO: 570681 - RNA, 15 nt, Homo sapiens
ggaaacugcucccau

SEQ ID NO: 570682 - RNA, 17 nt, Homo sapiens
ggaaagacggugcuaua

SEQ ID NO: 570683 - RNA, 22 nt, Homo sapiens
ggaaagaugguguggguguccu

SEQ ID NO: 570684 - RNA, 17 nt, Homo sapiens
ggaaagggauaguccaa

SEQ ID NO: 570685 - RNA, 17 nt, Homo sapiens
ggaaaguaaauauuuca

SEQ ID NO: 570686 - RNA, 12 nt, Homo sapiens
ggaaagugaaac

SEQ ID NO: 570687 - RNA, 12 nt, Homo sapiens
ggaaagugcaua

SEQ ID NO: 570688 - RNA, 16 nt, Homo sapiens
ggaaagugcauaugaa

SEQ ID NO: 570689 - RNA, 17 nt, Homo sapiens
ggaaaguguacacuauu

SEQ ID NO: 570690 - RNA, 22 nt, Homo sapiens
ggaaauaaaauuuaggaccaau

SEQ ID NO: 570691 - RNA, 14 nt, Homo sapiens
ggaaauaaagggau

SEQ ID NO: 570692 - RNA, 17 nt, Homo sapiens
ggaaauaacauugcacu

SEQ ID NO: 570693 - RNA, 13 nt, Homo sapiens
ggaaauacuuugc

SEQ ID NO: 570694 - RNA, 17 nt, Homo sapiens
ggaaauccccuuaugac

SEQ ID NO: 570695 - RNA, 17 nt, Homo sapiens
ggaaaugaguggccagc

SEQ ID NO: 570696 - RNA, 17 nt, Homo sapiens
ggaaaugguacugccca

SEQ ID NO: 570697 - RNA, 21 nt, Homo sapiens
ggaaauguaacuugaagcagc

SEQ ID NO: 570698 - RNA, 17 nt, Homo sapiens
ggaaauuguuuaugugu

SEQ ID NO: 570699 - RNA, 19 nt, Homo sapiens
ggaaauuguuuauguguua

SEQ ID NO: 570700 - RNA, 20 nt, Homo sapiens
ggaaauuuuucagacuuuaa

SEQ ID NO: 570701 - RNA, 19 nt, Homo sapiens
ggaacaagacagccuucac

SEQ ID NO: 570702 - RNA, 20 nt, Homo sapiens
ggaacaauaaaaugucuucu

SEQ ID NO: 570703 - RNA, 12 nt, Homo sapiens
ggaacaauccau

SEQ ID NO: 570704 - RNA, 13 nt, Homo sapiens
ggaacacacuugg

SEQ ID NO: 570705 - RNA, 15 nt, Homo sapiens
ggaacacaucuggcu

SEQ ID NO: 570706 - RNA, 13 nt, Homo sapiens
ggaacacuggugg

SEQ ID NO: 570707 - RNA, 18 nt, Homo sapiens
ggaacagaaggaugaaug

SEQ ID NO: 570708 - RNA, 13 nt, Homo sapiens
ggaacagaauguu

SEQ ID NO: 570709 - RNA, 11 nt, Homo sapiens
ggaacauuucu

SEQ ID NO: 570710 - RNA, 22 nt, Homo sapiens
ggaaccagggccucccuguuca

SEQ ID NO: 570711 - RNA, 20 nt, Homo sapiens
ggaacccuccuccugucaau

SEQ ID NO: 570712 - RNA, 17 nt, Homo sapiens
ggaaccuguccuaagga

SEQ ID NO: 570713 - RNA, 13 nt, Homo sapiens
ggaacuacuguac

SEQ ID NO: 570714 - RNA, 22 nt, Homo sapiens
ggaacuagagggauacacugaa

SEQ ID NO: 570715 - RNA, 12 nt, Homo sapiens
ggaacugugcaa

SEQ ID NO: 570716 - RNA, 21 nt, Homo sapiens
ggaagaaaaagcaaguguuca

SEQ ID NO: 570717 - RNA, 19 nt, Homo sapiens
ggaagaaaagcugccauuu

SEQ ID NO: 570718 - RNA, 17 nt, Homo sapiens
ggaagaaagaaugcaag

SEQ ID NO: 570719 - RNA, 18 nt, Homo sapiens
ggaagaaauggcuaugaa

SEQ ID NO: 570720 - RNA, 17 nt, Homo sapiens
ggaagaagauagaucca

SEQ ID NO: 570721 - RNA, 14 nt, Homo sapiens
ggaagaccaagaca

SEQ ID NO: 570722 - RNA, 20 nt, Homo sapiens
ggaagaccagcuuugcagug

SEQ ID NO: 570723 - RNA, 23 nt, Homo sapiens
ggaagacgcuuccuuccaggaca

SEQ ID NO: 570724 - RNA, 19 nt, Homo sapiens
ggaagacuagaggcuugca

SEQ ID NO: 570725 - RNA, 14 nt, Homo sapiens
ggaagagcaaggga

SEQ ID NO: 570726 - RNA, 16 nt, Homo sapiens
ggaagcacauguuuau

SEQ ID NO: 570727 - RNA, 20 nt, Homo sapiens
ggaagccaccucaccaagga

SEQ ID NO: 570728 - RNA, 21 nt, Homo sapiens
ggaagcccauccugaccagcu

SEQ ID NO: 570729 - RNA, 16 nt, Homo sapiens
ggaagccccacuugaa

SEQ ID NO: 570730 - RNA, 22 nt, Homo sapiens
ggaagcccugucuguuugccac

SEQ ID NO: 570731 - RNA, 16 nt, Homo sapiens
ggaagcccuugccuga

SEQ ID NO: 570732 - RNA, 20 nt, Homo sapiens
ggaagccggaggguguuuau

SEQ ID NO: 570733 - RNA, 21 nt, Homo sapiens
ggaagccggugucccuggaug

SEQ ID NO: 570734 - RNA, 21 nt, Homo sapiens
ggaagccuugcucauucuuga

SEQ ID NO: 570735 - RNA, 15 nt, Homo sapiens
ggaagcuccacuguc

SEQ ID NO: 570736 - RNA, 20 nt, Homo sapiens
ggaagcucccaccccacuca

SEQ ID NO: 570737 - RNA, 21 nt, Homo sapiens
ggaaggaacagcaaugguguc

SEQ ID NO: 570738 - RNA, 19 nt, Homo sapiens
ggaaggacuugacugggga

SEQ ID NO: 570739 - RNA, 22 nt, Homo sapiens
ggaaggagaggagaggggcaca

SEQ ID NO: 570740 - RNA, 21 nt, Homo sapiens
ggaaggcagaggcuggcacca

SEQ ID NO: 570741 - RNA, 19 nt, Homo sapiens
ggaaguaaccauuugcacu

SEQ ID NO: 570742 - RNA, 13 nt, Homo sapiens
ggaaguccaucug

SEQ ID NO: 570743 - RNA, 11 nt, Homo sapiens
ggaagucucca

SEQ ID NO: 570744 - RNA, 15 nt, Homo sapiens
ggaagucuccaugaa

SEQ ID NO: 570745 - RNA, 16 nt, Homo sapiens
ggaagugaggcccaag

SEQ ID NO: 570746 - RNA, 12 nt, Homo sapiens
ggaaguguuuau

SEQ ID NO: 570747 - RNA, 20 nt, Homo sapiens
ggaauaacaacuuucagugg

SEQ ID NO: 570748 - RNA, 14 nt, Homo sapiens
ggaauaaccuucca

SEQ ID NO: 570749 - RNA, 21 nt, Homo sapiens
ggaauaaccuuccauacauuu

SEQ ID NO: 570750 - RNA, 16 nt, Homo sapiens
ggaauaauuauuuauu

SEQ ID NO: 570751 - RNA, 19 nt, Homo sapiens
ggaauacuggccaugccug

SEQ ID NO: 570752 - RNA, 22 nt, Homo sapiens
ggaauacuucaccuuuccucuc

SEQ ID NO: 570753 - RNA, 16 nt, Homo sapiens
ggaauagugaauacuu

SEQ ID NO: 570754 - RNA, 14 nt, Homo sapiens
ggaauauacggaau

SEQ ID NO: 570755 - RNA, 23 nt, Homo sapiens
ggaauauauuugugugugugaua

SEQ ID NO: 570756 - RNA, 22 nt, Homo sapiens
ggaauauuugcaagacauagaa

SEQ ID NO: 570757 - RNA, 15 nt, Homo sapiens
ggugauauccucuca

SEQ ID NO: 570758 - RNA, 12 nt, Homo sapiens
ggugauaugcac

SEQ ID NO: 570759 - RNA, 23 nt, Homo sapiens
ggugauugucauguaaggcuuaa

SEQ ID NO: 570760 - RNA, 18 nt, Homo sapiens
ggugcagaccuuggggga

SEQ ID NO: 570761 - RNA, 15 nt, Homo sapiens
ggugcagcugucaca

SEQ ID NO: 570762 - RNA, 21 nt, Homo sapiens
ggugcagggagacaucugcac

SEQ ID NO: 570763 - RNA, 19 nt, Homo sapiens
ggugcaguaucaugcccug

SEQ ID NO: 570764 - RNA, 18 nt, Homo sapiens
ggugcaguugacagcagg

SEQ ID NO: 570765 - RNA, 13 nt, Homo sapiens
ggugcauagcaga

SEQ ID NO: 570766 - RNA, 16 nt, Homo sapiens
ggugccaaguuccacu

SEQ ID NO: 570767 - RNA, 21 nt, Homo sapiens
ggugcccagaacuucccugau

SEQ ID NO: 570768 - RNA, 18 nt, Homo sapiens
ggugcccuuugggguccc

SEQ ID NO: 570769 - RNA, 15 nt, Homo sapiens
ggugccucagagcag

SEQ ID NO: 570770 - RNA, 13 nt, Homo sapiens
ggugccucaggac

SEQ ID NO: 570771 - RNA, 15 nt, Homo sapiens
ggugcuauccauuuc

SEQ ID NO: 570772 - RNA, 22 nt, Homo sapiens
ggugcuaugucccaagagccau

SEQ ID NO: 570773 - RNA, 21 nt, Homo sapiens
ggugcuauuucuauuccuuau

SEQ ID NO: 570774 - RNA, 12 nt, Homo sapiens
ggugcucacucc

SEQ ID NO: 570775 - RNA, 12 nt, Homo sapiens
ggugcugagcuu

SEQ ID NO: 570776 - RNA, 20 nt, Homo sapiens
ggugcugcuuucuuguugcu

SEQ ID NO: 570777 - RNA, 21 nt, Homo sapiens
ggugcugcuuucuuguugcug

SEQ ID NO: 570778 - RNA, 23 nt, Homo sapiens
ggugcugcuuucuuguugcugca

SEQ ID NO: 570779 - RNA, 23 nt, Homo sapiens
ucuuuuuaaugcuguuaacuuaa

SEQ ID NO: 570780 - RNA, 13 nt, Homo sapiens
ucuuuuuugccaa

SEQ ID NO: 570781 - RNA, 17 nt, Homo sapiens
ucuuuuuuugagugaca

SEQ ID NO: 570782 - RNA, 17 nt, Homo sapiens
ugaaaaaaaaaacuauc

SEQ ID NO: 570783 - RNA, 18 nt, Homo sapiens
ugaaaaaaaaaacuauca

SEQ ID NO: 570784 - RNA, 20 nt, Homo sapiens
ugaaaaaaaauaaauugcuc

SEQ ID NO: 570785 - RNA, 17 nt, Homo sapiens
ugaaaaaaaguacaugu

SEQ ID NO: 570786 - RNA, 22 nt, Homo sapiens
ugaaaaaagguuguguagcugu

SEQ ID NO: 570787 - RNA, 23 nt, Homo sapiens
ugaaaaaagguuguguagcugug

SEQ ID NO: 570788 - RNA, 17 nt, Homo sapiens
ugaaaaacagaaagcau

SEQ ID NO: 570789 - RNA, 19 nt, Homo sapiens
ugaaaaacauuccaggaaa

SEQ ID NO: 570790 - RNA, 23 nt, Homo sapiens
ugaaaaagauuauuugugcauuu

SEQ ID NO: 570791 - RNA, 23 nt, Homo sapiens
ugaaaaaguagauugaguauaaa

SEQ ID NO: 570792 - RNA, 12 nt, Homo sapiens
ugaaaaauacuu

SEQ ID NO: 570793 - RNA, 16 nt, Homo sapiens
ugaaaaauauugcuaa

SEQ ID NO: 570794 - RNA, 17 nt, Homo sapiens
ugaaaaauggcaaagaa

SEQ ID NO: 570795 - RNA, 22 nt, Homo sapiens
ugaaaaaugguaauuguugcua

SEQ ID NO: 570796 - RNA, 22 nt, Homo sapiens
ugaaaaauucucagucaguaau

SEQ ID NO: 570797 - RNA, 13 nt, Homo sapiens
ugaaaacacauga

SEQ ID NO: 570798 - RNA, 22 nt, Homo sapiens
ugaaaacacaugagauugaauc

SEQ ID NO: 570799 - RNA, 12 nt, Homo sapiens
ugaaaacagcua

SEQ ID NO: 570800 - RNA, 21 nt, Homo sapiens
ugaaaacauauaaagcacuau

SEQ ID NO: 570801 - RNA, 20 nt, Homo sapiens
ugaaaacaucuggaagggga

SEQ ID NO: 570802 - RNA, 13 nt, Homo sapiens
ugaaaacugucaa

SEQ ID NO: 570803 - RNA, 17 nt, Homo sapiens
ugaaaacuuagccagag

SEQ ID NO: 570804 - RNA, 12 nt, Homo sapiens
ugaaaacuucaa

SEQ ID NO: 570805 - RNA, 13 nt, Homo sapiens
ugaaaacuuugua

SEQ ID NO: 570806 - RNA, 17 nt, Homo sapiens
ugaaaagaaaaagccac

SEQ ID NO: 570807 - RNA, 18 nt, Homo sapiens
ugaaaagaauagaagcua

SEQ ID NO: 570808 - RNA, 16 nt, Homo sapiens
ugaaaagaauuugaug

SEQ ID NO: 570809 - RNA, 20 nt, Homo sapiens
ugaaaagagaaugaugcuca

SEQ ID NO: 570810 - RNA, 22 nt, Homo sapiens
ugaaaagcacagccucagaaua

SEQ ID NO: 570811 - RNA, 16 nt, Homo sapiens
ugaaaagcuccaucaa

SEQ ID NO: 570812 - RNA, 15 nt, Homo sapiens
ugaaaagcuugucca

SEQ ID NO: 570813 - RNA, 22 nt, Homo sapiens
ugaaaaggauauuaucuaccug

SEQ ID NO: 570814 - RNA, 16 nt, Homo sapiens
ugaaaagggcacuccc

SEQ ID NO: 570815 - RNA, 15 nt, Homo sapiens
ugaaaagguugccug

SEQ ID NO: 570816 - RNA, 11 nt, Homo sapiens
ugaaaauaacu

SEQ ID NO: 570817 - RNA, 18 nt, Homo sapiens
ugaaaauaaugcuguucu

SEQ ID NO: 570818 - RNA, 15 nt, Homo sapiens
ugaaaauaugauguu

SEQ ID NO: 570819 - RNA, 23 nt, Homo sapiens
ugaaaauauuuguccaauugagu

SEQ ID NO: 570820 - RNA, 20 nt, Homo sapiens
ugaaaauauuuuguugccuu

SEQ ID NO: 570821 - RNA, 17 nt, Homo sapiens
ugaaaaucaucacucaa

SEQ ID NO: 570822 - RNA, 14 nt, Homo sapiens
ugaaaaugaaucuu

SEQ ID NO: 570823 - RNA, 16 nt, Homo sapiens
ugaaaaugaaucuuca

SEQ ID NO: 570824 - RNA, 13 nt, Homo sapiens
ugaaaaugacauu

SEQ ID NO: 570825 - RNA, 22 nt, Homo sapiens
ugaaaauuauuugaaaacauau

SEQ ID NO: 570826 - RNA, 23 nt, Homo sapiens
ugaaaauuuauuuuuagugauaa

SEQ ID NO: 570827 - RNA, 21 nt, Homo sapiens
ugaaacaagcaacagauggau

SEQ ID NO: 570828 - RNA, 15 nt, Homo sapiens
ugaaacacacaugga

SEQ ID NO: 570829 - RNA, 18 nt, Homo sapiens
ugaaacacacauggacau

SEQ ID NO: 570830 - RNA, 12 nt, Homo sapiens
ugaaacacugga

SEQ ID NO: 570831 - RNA, 13 nt, Homo sapiens
ugaaacaucucaa

SEQ ID NO: 570832 - RNA, 21 nt, Homo sapiens
ugaaacaugaacccaaaaaga

SEQ ID NO: 570833 - RNA, 11 nt, Homo sapiens
ugaaaccaaaa

SEQ ID NO: 570834 - RNA, 14 nt, Homo sapiens
ugaaaccaaaacau

SEQ ID NO: 570835 - RNA, 12 nt, Homo sapiens
ugaaaccaaaga

SEQ ID NO: 570836 - RNA, 22 nt, Homo sapiens
ugaaaccagaaggauauuuacu

SEQ ID NO: 570837 - RNA, 20 nt, Homo sapiens
ugaaaccauacagcuucaua

SEQ ID NO: 570838 - RNA, 15 nt, Homo sapiens
ugaaaccccaucucu

SEQ ID NO: 570839 - RNA, 20 nt, Homo sapiens
ugaaaccccaucucuacuaa

SEQ ID NO: 570840 - RNA, 17 nt, Homo sapiens
ugaaacccuugagcuca

SEQ ID NO: 570841 - RNA, 16 nt, Homo sapiens
ugaaaccuguacauau

SEQ ID NO: 570842 - RNA, 14 nt, Homo sapiens
ugaaacgccuugca

SEQ ID NO: 570843 - RNA, 13 nt, Homo sapiens
ugaaacguggaua

SEQ ID NO: 570844 - RNA, 11 nt, Homo sapiens
ugaaacuaaga

SEQ ID NO: 570845 - RNA, 20 nt, Homo sapiens
ugaaacuagaagagauuucu

SEQ ID NO: 570846 - RNA, 21 nt, Homo sapiens
ugaaacuauuaagcuucuuaa

SEQ ID NO: 570847 - RNA, 20 nt, Homo sapiens
ugaaacuauuuuaccugaac

SEQ ID NO: 570848 - RNA, 21 nt, Homo sapiens
ugaaacucauagacacugauc

SEQ ID NO: 570849 - RNA, 17 nt, Homo sapiens
ugaaacuccagaugcca

SEQ ID NO: 570850 - RNA, 18 nt, Homo sapiens
ugaaacuccagaugccac

SEQ ID NO: 570851 - RNA, 20 nt, Homo sapiens
ugaaacuccaucucuacuga

SEQ ID NO: 570852 - RNA, 18 nt, Homo sapiens
ugaaacuguccaccaaga

SEQ ID NO: 570853 - RNA, 22 nt, Homo sapiens
ugaaacuugggcacaugcucag

SEQ ID NO: 570854 - RNA, 13 nt, Homo sapiens
ugaaagaaaccac

SEQ ID NO: 570855 - RNA, 21 nt, Homo sapiens
ugaaagaaccaaaagagauca

SEQ ID NO: 570856 - RNA, 15 nt, Homo sapiens
ugaaagaaccagaga

SEQ ID NO: 570857 - RNA, 21 nt, Homo sapiens
ugaaagaagccaggugcaaaa

SEQ ID NO: 570858 - RNA, 22 nt, Homo sapiens
ugaaagaggggugggauccaca

SEQ ID NO: 570859 - RNA, 23 nt, Homo sapiens
ugaaagaucucugucacauccaa

SEQ ID NO: 570860 - RNA, 11 nt, Homo sapiens
ugaaagaucuu

SEQ ID NO: 570861 - RNA, 14 nt, Homo sapiens
ugaaagaucuucuu

SEQ ID NO: 570862 - RNA, 23 nt, Homo sapiens
ugaaagaucuucuuuaggaauaa

SEQ ID NO: 570863 - RNA, 11 nt, Homo sapiens
ugaaagccaug

SEQ ID NO: 570864 - RNA, 19 nt, Homo sapiens
ugaaagcccagggcuccag

SEQ ID NO: 570865 - RNA, 23 nt, Homo sapiens
ugaaaggaagcuccacugucacc

SEQ ID NO: 570866 - RNA, 20 nt, Homo sapiens
ugaaaggacaguuaaguauu

SEQ ID NO: 570867 - RNA, 21 nt, Homo sapiens
ugaaagggaaagucagcuuuc

SEQ ID NO: 570868 - RNA, 16 nt, Homo sapiens
ugaaaggggacaccug

SEQ ID NO: 570869 - RNA, 18 nt, Homo sapiens
ugaaaggggacaccugua

SEQ ID NO: 570870 - RNA, 19 nt, Homo sapiens
ugaaaggggacaccuguac

SEQ ID NO: 570871 - RNA, 16 nt, Homo sapiens
ugaaagguuaauucuc

SEQ ID NO: 570872 - RNA, 23 nt, Homo sapiens
ugaaaguagagcuagcugccacu

SEQ ID NO: 570873 - RNA, 17 nt, Homo sapiens
ugaaaguggacaaggag

SEQ ID NO: 570874 - RNA, 15 nt, Homo sapiens
ugaaaguuaacauua

SEQ ID NO: 570875 - RNA, 15 nt, Homo sapiens
ugaaaguuuucuaaa

SEQ ID NO: 570876 - RNA, 18 nt, Homo sapiens
ugaaaguuuugauuugaa

SEQ ID NO: 570877 - RNA, 22 nt, Homo sapiens
ugaaauaaaagcacacugcuua

SEQ ID NO: 570878 - RNA, 15 nt, Homo sapiens
ugaagcagucuugcu

SEQ ID NO: 570879 - RNA, 17 nt, Homo sapiens
ugaagcagucuugcucu

SEQ ID NO: 570880 - RNA, 12 nt, Homo sapiens
ugaagcauaauu

SEQ ID NO: 570881 - RNA, 19 nt, Homo sapiens
ugaagcauaauuuguuuaa

SEQ ID NO: 570882 - RNA, 13 nt, Homo sapiens
ugaagcauaguca

SEQ ID NO: 570883 - RNA, 20 nt, Homo sapiens
ugaagcaugcuuugcugcua

SEQ ID NO: 570884 - RNA, 12 nt, Homo sapiens
ugaagcauuaug

SEQ ID NO: 570885 - RNA, 15 nt, Homo sapiens
ugaagccagauccac

SEQ ID NO: 570886 - RNA, 21 nt, Homo sapiens
ugaagcccuccaaaagcacuu

SEQ ID NO: 570887 - RNA, 22 nt, Homo sapiens
ugaagcccuccaaaagcacuua

SEQ ID NO: 570888 - RNA, 11 nt, Homo sapiens
ugaagccuuug

SEQ ID NO: 570889 - RNA, 16 nt, Homo sapiens
ugaagcgaaacacaga

SEQ ID NO: 570890 - RNA, 16 nt, Homo sapiens
ugaagcuaauugugca

SEQ ID NO: 570891 - RNA, 14 nt, Homo sapiens
ugaagcugagcuuu

SEQ ID NO: 570892 - RNA, 20 nt, Homo sapiens
ugaagcugaggcucaggggu

SEQ ID NO: 570893 - RNA, 15 nt, Homo sapiens
ugaagcuucaugcac

SEQ ID NO: 570894 - RNA, 18 nt, Homo sapiens
ugaaggaacauuccuuag

SEQ ID NO: 570895 - RNA, 19 nt, Homo sapiens
ugaaggaccuaaauucgua

SEQ ID NO: 570896 - RNA, 16 nt, Homo sapiens
ugaaggagaaggugcc

SEQ ID NO: 570897 - RNA, 17 nt, Homo sapiens
ugaaggaggugagggau

SEQ ID NO: 570898 - RNA, 23 nt, Homo sapiens
ugaaggaggugagggaugugaau

SEQ ID NO: 570899 - RNA, 14 nt, Homo sapiens
ugaaggaucuugcc

SEQ ID NO: 570900 - RNA, 22 nt, Homo sapiens
ugaaggaugcggcaggugcucu

SEQ ID NO: 570901 - RNA, 22 nt, Homo sapiens
ugaaggcaguacuuauagaccu

SEQ ID NO: 570902 - RNA, 17 nt, Homo sapiens
ugaaggcauuugcagga

SEQ ID NO: 570903 - RNA, 20 nt, Homo sapiens
guaacagccaggaguguuaa

SEQ ID NO: 570904 - RNA, 16 nt, Homo sapiens
guaacauacauauucc

SEQ ID NO: 570905 - RNA, 14 nt, Homo sapiens
guaacaucagccau

SEQ ID NO: 570906 - RNA, 21 nt, Homo sapiens
guaacaugaggggacauuuug

SEQ ID NO: 570907 - RNA, 22 nt, Homo sapiens
guaacccgauuauuguguauua

SEQ ID NO: 570908 - RNA, 20 nt, Homo sapiens
guaacccgcucaucacugga

SEQ ID NO: 570909 - RNA, 21 nt, Homo sapiens
guaacccgcucaucacuggau

SEQ ID NO: 570910 - RNA, 17 nt, Homo sapiens
guaacccuggcacuuaa

SEQ ID NO: 570911 - RNA, 18 nt, Homo sapiens
guaaccuagugaauuucu

SEQ ID NO: 570912 - RNA, 17 nt, Homo sapiens
guaaccucaaacucugg

SEQ ID NO: 570913 - RNA, 18 nt, Homo sapiens
guaaccuggccacugucc

SEQ ID NO: 570914 - RNA, 19 nt, Homo sapiens
guaacgaaugguacuacaa

SEQ ID NO: 570915 - RNA, 11 nt, Homo sapiens
guaacuacugc

SEQ ID NO: 570916 - RNA, 14 nt, Homo sapiens
guaacuagugaaau

SEQ ID NO: 570917 - RNA, 19 nt, Homo sapiens
guaacuauuacaccaaaua

SEQ ID NO: 570918 - RNA, 21 nt, Homo sapiens
guaacucacauucucuuccca

SEQ ID NO: 570919 - RNA, 13 nt, Homo sapiens
guaacuccagcuc

SEQ ID NO: 570920 - RNA, 19 nt, Homo sapiens
guaacuccagcucugcucc

SEQ ID NO: 570921 - RNA, 13 nt, Homo sapiens
guaacuuacuuag

SEQ ID NO: 570922 - RNA, 16 nt, Homo sapiens
guaacuuuuugcacua

SEQ ID NO: 570923 - RNA, 14 nt, Homo sapiens
guaagaacugcucu

SEQ ID NO: 570924 - RNA, 14 nt, Homo sapiens
guaagacaggccag

SEQ ID NO: 570925 - RNA, 14 nt, Homo sapiens
guaagacauuugua

SEQ ID NO: 570926 - RNA, 17 nt, Homo sapiens
guaagagaacacaaucu

SEQ ID NO: 570927 - RNA, 18 nt, Homo sapiens
guaagagcuggugucuga

SEQ ID NO: 570928 - RNA, 22 nt, Homo sapiens
guaagaucguucucugccucac

SEQ ID NO: 570929 - RNA, 15 nt, Homo sapiens
guaagaugcacugaa

SEQ ID NO: 570930 - RNA, 22 nt, Homo sapiens
guaagcauuuccagccuaucua

SEQ ID NO: 570931 - RNA, 19 nt, Homo sapiens
guaagcauuugaguuugca

SEQ ID NO: 570932 - RNA, 21 nt, Homo sapiens
guaagccaaggucaugccacu

SEQ ID NO: 570933 - RNA, 22 nt, Homo sapiens
guaagccaaggucaugccacug

SEQ ID NO: 570934 - RNA, 15 nt, Homo sapiens
guaagccccugugac

SEQ ID NO: 570935 - RNA, 21 nt, Homo sapiens
guaaggacggacucacuucuc

SEQ ID NO: 570936 - RNA, 14 nt, Homo sapiens
guaaggagccuuuc

SEQ ID NO: 570937 - RNA, 17 nt, Homo sapiens
guaaggagccuuuccag

SEQ ID NO: 570938 - RNA, 22 nt, Homo sapiens
guaaggucuucuuguguccuga

SEQ ID NO: 570939 - RNA, 13 nt, Homo sapiens
guaaggugcaguu

SEQ ID NO: 570940 - RNA, 18 nt, Homo sapiens
guaaguaaacagauuuga

SEQ ID NO: 570941 - RNA, 14 nt, Homo sapiens
guaaguacuuccac

SEQ ID NO: 570942 - RNA, 12 nt, Homo sapiens
guaagugcugcu

SEQ ID NO: 570943 - RNA, 11 nt, Homo sapiens
guaagugcuuu

SEQ ID NO: 570944 - RNA, 23 nt, Homo sapiens
guaaguuauugaugagagggaaa

SEQ ID NO: 570945 - RNA, 16 nt, Homo sapiens
guaaguuccuacuagg

SEQ ID NO: 570946 - RNA, 23 nt, Homo sapiens
guaaguugaauggccugccuuga

SEQ ID NO: 570947 - RNA, 21 nt, Homo sapiens
guaauaauaaucccaaggcaa

SEQ ID NO: 570948 - RNA, 22 nt, Homo sapiens
guaauaauaaucccaaggcaaa

SEQ ID NO: 570949 - RNA, 16 nt, Homo sapiens
guaauaccugauugau

SEQ ID NO: 570950 - RNA, 17 nt, Homo sapiens
guaauagauguuugaua

SEQ ID NO: 570951 - RNA, 19 nt, Homo sapiens
guaauagauuguuuugcca

SEQ ID NO: 570952 - RNA, 18 nt, Homo sapiens
guaauaguccauggacaa

SEQ ID NO: 570953 - RNA, 18 nt, Homo sapiens
guaauauuuuacuuugag

SEQ ID NO: 570954 - RNA, 19 nt, Homo sapiens
guaaucauuuuaaauucca

SEQ ID NO: 570955 - RNA, 16 nt, Homo sapiens
guaauccuagcacuuu

SEQ ID NO: 570956 - RNA, 18 nt, Homo sapiens
guaauccuagcacuuugg

SEQ ID NO: 570957 - RNA, 14 nt, Homo sapiens
guaaucuaaguaua

SEQ ID NO: 570958 - RNA, 15 nt, Homo sapiens
guaaucuaaguauau

SEQ ID NO: 570959 - RNA, 16 nt, Homo sapiens
guaaucucagcacuuu

SEQ ID NO: 570960 - RNA, 13 nt, Homo sapiens
guaaucuguguac

SEQ ID NO: 570961 - RNA, 19 nt, Homo sapiens
guaaucuguguacaaagaa

SEQ ID NO: 570962 - RNA, 14 nt, Homo sapiens
guaaugaaacaaag

SEQ ID NO: 570963 - RNA, 23 nt, Homo sapiens
guaaugaaacaccuucucuggag

SEQ ID NO: 570964 - RNA, 15 nt, Homo sapiens
guaaugaccaugaaa

SEQ ID NO: 570965 - RNA, 18 nt, Homo sapiens
guaaugauauagccagaa

SEQ ID NO: 570966 - RNA, 15 nt, Homo sapiens
guaaugauguugaua

SEQ ID NO: 570967 - RNA, 11 nt, Homo sapiens
guaaugcugca

SEQ ID NO: 570968 - RNA, 14 nt, Homo sapiens
guaaugucacuguu

SEQ ID NO: 570969 - RNA, 14 nt, Homo sapiens
guaauguggucacc

SEQ ID NO: 570970 - RNA, 22 nt, Homo sapiens
guaauuacauauuugacucuuu

SEQ ID NO: 570971 - RNA, 21 nt, Homo sapiens
guaauuauguuuucaacacuu

SEQ ID NO: 570972 - RNA, 20 nt, Homo sapiens
guaauuuaaaaagugcuaua

SEQ ID NO: 570973 - RNA, 22 nt, Homo sapiens
guaauuuguuuaaaaaguaaua

SEQ ID NO: 570974 - RNA, 23 nt, Homo sapiens
guaauuuuuuuaucgucacugcu

SEQ ID NO: 570975 - RNA, 20 nt, Homo sapiens
guacaaacacaggauuugua

SEQ ID NO: 570976 - RNA, 17 nt, Homo sapiens
guacaaagguugcagug

SEQ ID NO: 570977 - RNA, 12 nt, Homo sapiens
guacaacccuga

SEQ ID NO: 570978 - RNA, 21 nt, Homo sapiens
guacaaggcccccacugccug

SEQ ID NO: 570979 - RNA, 20 nt, Homo sapiens
guacaaguauauaauauguc

SEQ ID NO: 570980 - RNA, 21 nt, Homo sapiens
guacaaguauauaauauguca

SEQ ID NO: 570981 - RNA, 24 nt, Homo sapiens
guacaauaaaaacauugccuuuga

SEQ ID NO: 570982 - RNA, 16 nt, Homo sapiens
guacaauaaagcaaug

SEQ ID NO: 570983 - RNA, 18 nt, Homo sapiens
guacaauaaagcaaugug

SEQ ID NO: 570984 - RNA, 19 nt, Homo sapiens
guacaauaaagcaaugugg

SEQ ID NO: 570985 - RNA, 21 nt, Homo sapiens
guacaauaaagcaauguggua

SEQ ID NO: 570986 - RNA, 16 nt, Homo sapiens
guacaauacaauguac

SEQ ID NO: 570987 - RNA, 19 nt, Homo sapiens
guacaaucaugaacagcuc

SEQ ID NO: 570988 - RNA, 17 nt, Homo sapiens
guacaauccacaauuca

SEQ ID NO: 570989 - RNA, 20 nt, Homo sapiens
guacaaugaacccccaugau

SEQ ID NO: 570990 - RNA, 19 nt, Homo sapiens
guacaaugguuuauuccca

SEQ ID NO: 570991 - RNA, 19 nt, Homo sapiens
guacacacugguacuuaga

SEQ ID NO: 570992 - RNA, 18 nt, Homo sapiens
guacagaaagcugccugg

SEQ ID NO: 570993 - RNA, 22 nt, Homo sapiens
guacagaauucugcuaccucac

SEQ ID NO: 570994 - RNA, 18 nt, Homo sapiens
guacaguagauuuuccaa

SEQ ID NO: 570995 - RNA, 21 nt, Homo sapiens
guacaguauguuuuacaugua

SEQ ID NO: 570996 - RNA, 23 nt, Homo sapiens
guacaguucugggguacauguua

SEQ ID NO: 570997 - RNA, 14 nt, Homo sapiens
guacauacuggccu

SEQ ID NO: 570998 - RNA, 17 nt, Homo sapiens
guacaucguuugcaaau

SEQ ID NO: 570999 - RNA, 12 nt, Homo sapiens
ugcugcuuuaau

SEQ ID NO: 571000 - RNA, 18 nt, Homo sapiens
ugcugcuuuaauucauaa

SEQ ID NO: 571001 - RNA, 17 nt, Homo sapiens
ugcuggaaccugcaaaa

SEQ ID NO: 571002 - RNA, 14 nt, Homo sapiens
ugcuggaccagcug

SEQ ID NO: 571003 - RNA, 13 nt, Homo sapiens
ugcuggacucugg

SEQ ID NO: 571004 - RNA, 20 nt, Homo sapiens
ugcuggagggaagaucuuga

SEQ ID NO: 571005 - RNA, 14 nt, Homo sapiens
ugcuggaggggcug

SEQ ID NO: 571006 - RNA, 14 nt, Homo sapiens
ugcuggauacugga

SEQ ID NO: 571007 - RNA, 17 nt, Homo sapiens
ugcuggaucacagcugc

SEQ ID NO: 571008 - RNA, 14 nt, Homo sapiens
ugcuggaucuugcc

SEQ ID NO: 571009 - RNA, 15 nt, Homo sapiens
ugcuggcaguacugu

SEQ ID NO: 571010 - RNA, 14 nt, Homo sapiens
ugcuggcauuugca

SEQ ID NO: 571011 - RNA, 19 nt, Homo sapiens
ugcuggcccauaaacaccc

SEQ ID NO: 571012 - RNA, 20 nt, Homo sapiens
ugcuggcgacacucagggca

SEQ ID NO: 571013 - RNA, 17 nt, Homo sapiens
ugcuggcuccaaacuuc

SEQ ID NO: 571014 - RNA, 22 nt, Homo sapiens
ugcuggcucugcuguccuugcc

SEQ ID NO: 571015 - RNA, 14 nt, Homo sapiens
ugcuggcugccuua

SEQ ID NO: 571016 - RNA, 12 nt, Homo sapiens
ugcuggcuucag

SEQ ID NO: 571017 - RNA, 14 nt, Homo sapiens
ugcuggcuuuucac

SEQ ID NO: 571018 - RNA, 23 nt, Homo sapiens
ugcugggaagacgccugagcuca

SEQ ID NO: 571019 - RNA, 23 nt, Homo sapiens
ugcugggacugagccagucccag

SEQ ID NO: 571020 - RNA, 21 nt, Homo sapiens
ugcugggagaggggguagcua

SEQ ID NO: 571021 - RNA, 17 nt, Homo sapiens
ugcugggauaacuggcc

SEQ ID NO: 571022 - RNA, 18 nt, Homo sapiens
ugcugggauuacaggcau

SEQ ID NO: 571023 - RNA, 23 nt, Homo sapiens
ugcugggauuacaggcgugaucc

SEQ ID NO: 571024 - RNA, 17 nt, Homo sapiens
ugcugggauuacaggug

SEQ ID NO: 571025 - RNA, 14 nt, Homo sapiens
ugcugggauuucca

SEQ ID NO: 571026 - RNA, 23 nt, Homo sapiens
ugcugggcccccagccuggccag

SEQ ID NO: 571027 - RNA, 18 nt, Homo sapiens
ugcugggggcaacuggcc

SEQ ID NO: 571028 - RNA, 18 nt, Homo sapiens
ugcugguagcugagggga

SEQ ID NO: 571029 - RNA, 15 nt, Homo sapiens
ugcuggucauggaau

SEQ ID NO: 571030 - RNA, 16 nt, Homo sapiens
ugcuggucuauuuuga

SEQ ID NO: 571031 - RNA, 18 nt, Homo sapiens
ugcuggugagaggugcaa

SEQ ID NO: 571032 - RNA, 20 nt, Homo sapiens
ugcugguguccugaccaccc

SEQ ID NO: 571033 - RNA, 17 nt, Homo sapiens
ugcuguaacucagacau

SEQ ID NO: 571034 - RNA, 23 nt, Homo sapiens
ugcuguagaaaaaaaaauucaca

SEQ ID NO: 571035 - RNA, 15 nt, Homo sapiens
ugcuguauuugcugc

SEQ ID NO: 571036 - RNA, 13 nt, Homo sapiens
ugcugucacuguu

SEQ ID NO: 571037 - RNA, 22 nt, Homo sapiens
ugcugucauuaguauuucacaa

SEQ ID NO: 571038 - RNA, 15 nt, Homo sapiens
ugcugucauuagucu

SEQ ID NO: 571039 - RNA, 17 nt, Homo sapiens
ugcuguccacaugaccu

SEQ ID NO: 571040 - RNA, 20 nt, Homo sapiens
ugcuguccacaugaccucca

SEQ ID NO: 571041 - RNA, 15 nt, Homo sapiens
ugcugucccugucag

SEQ ID NO: 571042 - RNA, 15 nt, Homo sapiens
ugcuguccugaucug

SEQ ID NO: 571043 - RNA, 22 nt, Homo sapiens
ugcugugaggcuguccuguaca

SEQ ID NO: 571044 - RNA, 17 nt, Homo sapiens
ugcugugccccaccacg

SEQ ID NO: 571045 - RNA, 19 nt, Homo sapiens
ugcugugccccaccacguc

SEQ ID NO: 571046 - RNA, 22 nt, Homo sapiens
ugcuguggccaggccugcagac

SEQ ID NO: 571047 - RNA, 16 nt, Homo sapiens
ugcugugucauuccaa

SEQ ID NO: 571048 - RNA, 22 nt, Homo sapiens
ugcuguguggacuucaucucaa

SEQ ID NO: 571049 - RNA, 17 nt, Homo sapiens
gucucagugcuauccua

SEQ ID NO: 571050 - RNA, 17 nt, Homo sapiens
gucucaucuucucucau

SEQ ID NO: 571051 - RNA, 18 nt, Homo sapiens
gucucaugugguccuccu

SEQ ID NO: 571052 - RNA, 16 nt, Homo sapiens
gucuccaccugagacc

SEQ ID NO: 571053 - RNA, 21 nt, Homo sapiens
gucuccacugugccuuugcaa

SEQ ID NO: 571054 - RNA, 17 nt, Homo sapiens
gucuccaugcucaccaa

SEQ ID NO: 571055 - RNA, 20 nt, Homo sapiens
gucucccgccccccacacuu

SEQ ID NO: 571056 - RNA, 20 nt, Homo sapiens
gucuccucucagagugacag

SEQ ID NO: 571057 - RNA, 18 nt, Homo sapiens
gucuccuggacucagggu

SEQ ID NO: 571058 - RNA, 13 nt, Homo sapiens
gucucgcuuuguu

SEQ ID NO: 571059 - RNA, 14 nt, Homo sapiens
gucucguggcaaca

SEQ ID NO: 571060 - RNA, 20 nt, Homo sapiens
gucucucggguucaagcaau

SEQ ID NO: 571061 - RNA, 21 nt, Homo sapiens
gucucucggguucaagcaauu

SEQ ID NO: 571062 - RNA, 16 nt, Homo sapiens
gucucucugccaagau

SEQ ID NO: 571063 - RNA, 19 nt, Homo sapiens
gucucucuucugcugucuc

SEQ ID NO: 571064 - RNA, 18 nt, Homo sapiens
gucucucuuuggcuggaa

SEQ ID NO: 571065 - RNA, 21 nt, Homo sapiens
gucucugccugcggcccagaa

SEQ ID NO: 571066 - RNA, 17 nt, Homo sapiens
gucucugcuccuacauc

SEQ ID NO: 571067 - RNA, 14 nt, Homo sapiens
gucucugucucuca

SEQ ID NO: 571068 - RNA, 21 nt, Homo sapiens
gucucuguugguccacugugu

SEQ ID NO: 571069 - RNA, 12 nt, Homo sapiens
gucucuucaucu

SEQ ID NO: 571070 - RNA, 16 nt, Homo sapiens
gucucuuccacaggaa

SEQ ID NO: 571071 - RNA, 22 nt, Homo sapiens
gucucuuccuuacccuuucugu

SEQ ID NO: 571072 - RNA, 23 nt, Homo sapiens
gucucuucuuuagaacagggaaa

SEQ ID NO: 571073 - RNA, 21 nt, Homo sapiens
gucugaaacccuugagcucaa

SEQ ID NO: 571074 - RNA, 21 nt, Homo sapiens
gucugaaagacagaaugucac

SEQ ID NO: 571075 - RNA, 13 nt, Homo sapiens
gucugaacaaagu

SEQ ID NO: 571076 - RNA, 19 nt, Homo sapiens
gucugaacucccgccacau

SEQ ID NO: 571077 - RNA, 15 nt, Homo sapiens
gucugaagugcuaau

SEQ ID NO: 571078 - RNA, 16 nt, Homo sapiens
gucugaauucuggaau

SEQ ID NO: 571079 - RNA, 18 nt, Homo sapiens
gucugagaauuuccaaaa

SEQ ID NO: 571080 - RNA, 22 nt, Homo sapiens
gucugagcuucaguauaaaaga

SEQ ID NO: 571081 - RNA, 21 nt, Homo sapiens
gucugaguaagcccucaggag

SEQ ID NO: 571082 - RNA, 16 nt, Homo sapiens
gucugaucguucaaag

SEQ ID NO: 571083 - RNA, 24 nt, Homo sapiens
gucugauucucuuuaacuguguga

SEQ ID NO: 571084 - RNA, 19 nt, Homo sapiens
gucugauuggcucacccaa

SEQ ID NO: 571085 - RNA, 14 nt, Homo sapiens
gucugcagaccauc

SEQ ID NO: 571086 - RNA, 19 nt, Homo sapiens
gucugccccacccucaaac

SEQ ID NO: 571087 - RNA, 16 nt, Homo sapiens
gucugcccuagggaga

SEQ ID NO: 571088 - RNA, 14 nt, Homo sapiens
gucugcuguagaaa

SEQ ID NO: 571089 - RNA, 17 nt, Homo sapiens
gucuggacugacagcau

SEQ ID NO: 571090 - RNA, 23 nt, Homo sapiens
gucuggagccccauccuguguua

SEQ ID NO: 571091 - RNA, 17 nt, Homo sapiens
gucuggcuguguugccc

SEQ ID NO: 571092 - RNA, 16 nt, Homo sapiens
gucugggagucacaca

SEQ ID NO: 571093 - RNA, 16 nt, Homo sapiens
gucugggcacagucag

SEQ ID NO: 571094 - RNA, 16 nt, Homo sapiens
gucugggcaccaccuc

SEQ ID NO: 571095 - RNA, 18 nt, Homo sapiens
gucugggcugggcaccug

SEQ ID NO: 571096 - RNA, 23 nt, Homo sapiens
gucuggggucuccuauacucuau

SEQ ID NO: 571097 - RNA, 19 nt, Homo sapiens
gucuguaaaaaauggagcu

SEQ ID NO: 571098 - RNA, 19 nt, Homo sapiens
gucuguaaaagagccuagu

SEQ ID NO: 571099 - RNA, 13 nt, Homo sapiens
gucuguagggagu

SEQ ID NO: 571100 - RNA, 15 nt, Homo sapiens
gucugucacaggcug

SEQ ID NO: 571101 - RNA, 14 nt, Homo sapiens
gucugucaccagcu

SEQ ID NO: 571102 - RNA, 18 nt, Homo sapiens
gucugugaauauccagaa

SEQ ID NO: 571103 - RNA, 15 nt, Homo sapiens
gucugugaguaccug

SEQ ID NO: 571104 - RNA, 15 nt, Homo sapiens
gucuguggacugcaa

SEQ ID NO: 571105 - RNA, 21 nt, Homo sapiens
gucuguguuuaauauuaccaa

SEQ ID NO: 571106 - RNA, 21 nt, Homo sapiens
gucuguuucaaugaccuguau

SEQ ID NO: 571107 - RNA, 20 nt, Homo sapiens
gucuguuuucuaaagccagg

SEQ ID NO: 571108 - RNA, 22 nt, Homo sapiens
gucuuaaaugagaaguacuugg

SEQ ID NO: 571109 - RNA, 14 nt, Homo sapiens
gucuuaaucguccu

SEQ ID NO: 571110 - RNA, 21 nt, Homo sapiens
gucuuaaucguccugcugcug

SEQ ID NO: 571111 - RNA, 15 nt, Homo sapiens
gucuuaauguacaca

SEQ ID NO: 571112 - RNA, 16 nt, Homo sapiens
gucuuacuccuggcuu

SEQ ID NO: 571113 - RNA, 15 nt, Homo sapiens
gucuuacuguugcau

SEQ ID NO: 571114 - RNA, 21 nt, Homo sapiens
gucuuacuguugcauaacuau

SEQ ID NO: 571115 - RNA, 23 nt, Homo sapiens
gucuuagacuugaaauacuacuu

SEQ ID NO: 571116 - RNA, 15 nt, Homo sapiens
gucuuagauguauau

SEQ ID NO: 571117 - RNA, 20 nt, Homo sapiens
gucuuaugaaacaauuugag

SEQ ID NO: 571118 - RNA, 14 nt, Homo sapiens
gucuucauuaucuu

SEQ ID NO: 571119 - RNA, 23 nt, Homo sapiens
gucuuccacaaaaaauacuuuau

SEQ ID NO: 571120 - RNA, 19 nt, Homo sapiens
uggacccccuggaagcuga

SEQ ID NO: 571121 - RNA, 19 nt, Homo sapiens
uggacccuggaccauucca

SEQ ID NO: 571122 - RNA, 22 nt, Homo sapiens
uggacccuuggccuccauuucu

SEQ ID NO: 571123 - RNA, 21 nt, Homo sapiens
uggaccugcccugggccacac

SEQ ID NO: 571124 - RNA, 15 nt, Homo sapiens
uggaccugccuccug

SEQ ID NO: 571125 - RNA, 17 nt, Homo sapiens
uggacgagaaggugcuu

SEQ ID NO: 571126 - RNA, 22 nt, Homo sapiens
uggacguacugguuuaaccucc

SEQ ID NO: 571127 - RNA, 13 nt, Homo sapiens
uggacgugcacug

SEQ ID NO: 571128 - RNA, 18 nt, Homo sapiens
uggacuaaaacauuuuga

SEQ ID NO: 571129 - RNA, 13 nt, Homo sapiens
uggacucaccucc

SEQ ID NO: 571130 - RNA, 20 nt, Homo sapiens
uggacuccggaggacugagc

SEQ ID NO: 571131 - RNA, 18 nt, Homo sapiens
uggacucuacacugugaa

SEQ ID NO: 571132 - RNA, 15 nt, Homo sapiens
uggacucucagggau

SEQ ID NO: 571133 - RNA, 13 nt, Homo sapiens
uggacugcaauga

SEQ ID NO: 571134 - RNA, 14 nt, Homo sapiens
uggacugcauuuaa

SEQ ID NO: 571135 - RNA, 20 nt, Homo sapiens
uggacuggcagacucaaggg

SEQ ID NO: 571136 - RNA, 21 nt, Homo sapiens
uggacuggggagcacaggugu

SEQ ID NO: 571137 - RNA, 22 nt, Homo sapiens
uggacugguaaguaacuguggu

SEQ ID NO: 571138 - RNA, 19 nt, Homo sapiens
uggacuggugugcucucuu

SEQ ID NO: 571139 - RNA, 18 nt, Homo sapiens
uggacugguugguuuugc

SEQ ID NO: 571140 - RNA, 16 nt, Homo sapiens
uggacuguaacugacu

SEQ ID NO: 571141 - RNA, 18 nt, Homo sapiens
uggacugugcuggugcau

SEQ ID NO: 571142 - RNA, 23 nt, Homo sapiens
uggacuguuuucaauaacaaagc

SEQ ID NO: 571143 - RNA, 21 nt, Homo sapiens
uggacuucacauaagcucaga

SEQ ID NO: 571144 - RNA, 13 nt, Homo sapiens
uggacuucucuga

SEQ ID NO: 571145 - RNA, 11 nt, Homo sapiens
uggacuucuua

SEQ ID NO: 571146 - RNA, 12 nt, Homo sapiens
uggacuucuuag

SEQ ID NO: 571147 - RNA, 16 nt, Homo sapiens
uggacuuuugaagucc

SEQ ID NO: 571148 - RNA, 16 nt, Homo sapiens
uggagaaagcacugac

SEQ ID NO: 571149 - RNA, 19 nt, Homo sapiens
uggagaaagggcagaggaa

SEQ ID NO: 571150 - RNA, 15 nt, Homo sapiens
uggagaaaguauuua

SEQ ID NO: 571151 - RNA, 16 nt, Homo sapiens
uggagaagacauucug

SEQ ID NO: 571152 - RNA, 17 nt, Homo sapiens
uggagaagucucagcua

SEQ ID NO: 571153 - RNA, 22 nt, Homo sapiens
uggagacaagggcaucaucuau

SEQ ID NO: 571154 - RNA, 17 nt, Homo sapiens
uggagacaaggugcuaa

SEQ ID NO: 571155 - RNA, 16 nt, Homo sapiens
uggagaccagccagag

SEQ ID NO: 571156 - RNA, 23 nt, Homo sapiens
uggagacccugcaaacagaacag

SEQ ID NO: 571157 - RNA, 22 nt, Homo sapiens
uggagacccugccacagccaga

SEQ ID NO: 571158 - RNA, 23 nt, Homo sapiens
uggagacccugccacagccagag

SEQ ID NO: 571159 - RNA, 19 nt, Homo sapiens
uggagacguggaaccucug

SEQ ID NO: 571160 - RNA, 18 nt, Homo sapiens
uggagacuaaagauugca

SEQ ID NO: 571161 - RNA, 15 nt, Homo sapiens
uggagagaagcugau

SEQ ID NO: 571162 - RNA, 20 nt, Homo sapiens
uggagagagauguuccucuu

SEQ ID NO: 571163 - RNA, 19 nt, Homo sapiens
uggagagcagcaggugcug

SEQ ID NO: 571164 - RNA, 12 nt, Homo sapiens
uggagagcugcu

SEQ ID NO: 571165 - RNA, 14 nt, Homo sapiens
uggagaggaaccca

SEQ ID NO: 571166 - RNA, 18 nt, Homo sapiens
uggagaggagaguggcag

SEQ ID NO: 571167 - RNA, 16 nt, Homo sapiens
uggagagggacuggca

SEQ ID NO: 571168 - RNA, 18 nt, Homo sapiens
uggagagggcagggucca

SEQ ID NO: 571169 - RNA, 21 nt, Homo sapiens
uggagaucagaaagugacauu

SEQ ID NO: 571170 - RNA, 18 nt, Homo sapiens
uggagaugaggugcucaa

SEQ ID NO: 571171 - RNA, 19 nt, Homo sapiens
uggagaugaggugcucaau

SEQ ID NO: 571172 - RNA, 21 nt, Homo sapiens
uggagauucaguuuucauuug

SEQ ID NO: 571173 - RNA, 19 nt, Homo sapiens
gugcaguggcgugaucucg

SEQ ID NO: 571174 - RNA, 17 nt, Homo sapiens
gugcaguugacagcagg

SEQ ID NO: 571175 - RNA, 21 nt, Homo sapiens
gugcaguuucuaagcauguag

SEQ ID NO: 571176 - RNA, 15 nt, Homo sapiens
gugcaguuuucagga

SEQ ID NO: 571177 - RNA, 14 nt, Homo sapiens
gugcauaucugccu

SEQ ID NO: 571178 - RNA, 13 nt, Homo sapiens
gugcaucugucag

SEQ ID NO: 571179 - RNA, 15 nt, Homo sapiens
gugcaugugugcgag

SEQ ID NO: 571180 - RNA, 14 nt, Homo sapiens
gugcauucuggcca

SEQ ID NO: 571181 - RNA, 22 nt, Homo sapiens
gugcauuggaagaccccaccca

SEQ ID NO: 571182 - RNA, 15 nt, Homo sapiens
gugcauuucuaggac

SEQ ID NO: 571183 - RNA, 23 nt, Homo sapiens
gugcauuuuuacuauuguuacau

SEQ ID NO: 571184 - RNA, 11 nt, Homo sapiens
gugccaaaaau

SEQ ID NO: 571185 - RNA, 23 nt, Homo sapiens
gugccaaagcuuuacuacugugg

SEQ ID NO: 571186 - RNA, 16 nt, Homo sapiens
gugccaaauuauucuc

SEQ ID NO: 571187 - RNA, 12 nt, Homo sapiens
gugccaccauca

SEQ ID NO: 571188 - RNA, 21 nt, Homo sapiens
gugccacccuccucccuccaa

SEQ ID NO: 571189 - RNA, 18 nt, Homo sapiens
gugccacuacacuccagc

SEQ ID NO: 571190 - RNA, 21 nt, Homo sapiens
gugccacugcccgagcuggug

SEQ ID NO: 571191 - RNA, 18 nt, Homo sapiens
gugccacuugacauuccu

SEQ ID NO: 571192 - RNA, 18 nt, Homo sapiens
gugccagauauaacuguc

SEQ ID NO: 571193 - RNA, 20 nt, Homo sapiens
gugccagcaaugacaucuca

SEQ ID NO: 571194 - RNA, 21 nt, Homo sapiens
gugccagcccugcauugcuga

SEQ ID NO: 571195 - RNA, 18 nt, Homo sapiens
gugccagcccuggcagac

SEQ ID NO: 571196 - RNA, 18 nt, Homo sapiens
gugccauuguacuccagc

SEQ ID NO: 571197 - RNA, 20 nt, Homo sapiens
gugcccaaguggguccaagu

SEQ ID NO: 571198 - RNA, 18 nt, Homo sapiens
gugcccaggaagagccau

SEQ ID NO: 571199 - RNA, 19 nt, Homo sapiens
gugcccaggaagagccauu

SEQ ID NO: 571200 - RNA, 18 nt, Homo sapiens
gugcccaggguuuugccc

SEQ ID NO: 571201 - RNA, 13 nt, Homo sapiens
gugcccaugugua

SEQ ID NO: 571202 - RNA, 22 nt, Homo sapiens
gugccccacagcuaccugagac

SEQ ID NO: 571203 - RNA, 19 nt, Homo sapiens
gugccccaugccuguccag

SEQ ID NO: 571204 - RNA, 15 nt, Homo sapiens
gugcccccaggagga

SEQ ID NO: 571205 - RNA, 17 nt, Homo sapiens
gugccccccuccuccag

SEQ ID NO: 571206 - RNA, 17 nt, Homo sapiens
gugccccuuuccuucac

SEQ ID NO: 571207 - RNA, 19 nt, Homo sapiens
gugcccuagaugcacgugg

SEQ ID NO: 571208 - RNA, 15 nt, Homo sapiens
gugcccucaccacca

SEQ ID NO: 571209 - RNA, 19 nt, Homo sapiens
gugcccugcaucccucucc

SEQ ID NO: 571210 - RNA, 15 nt, Homo sapiens
gugcccugguggaga

SEQ ID NO: 571211 - RNA, 13 nt, Homo sapiens
gugcccuugcccu

SEQ ID NO: 571212 - RNA, 17 nt, Homo sapiens
gugccgauguugaacuu

SEQ ID NO: 571213 - RNA, 14 nt, Homo sapiens
gugccgccugcucc

SEQ ID NO: 571214 - RNA, 18 nt, Homo sapiens
gugccguaacaacugugg

SEQ ID NO: 571215 - RNA, 18 nt, Homo sapiens
gugccuccccccagaccc

SEQ ID NO: 571216 - RNA, 19 nt, Homo sapiens
gugccuccucagaggacag

SEQ ID NO: 571217 - RNA, 14 nt, Homo sapiens
gugccucugcccaa

SEQ ID NO: 571218 - RNA, 22 nt, Homo sapiens
gugccugcucagcagccagucu

SEQ ID NO: 571219 - RNA, 16 nt, Homo sapiens
gugccugcuccuguac

SEQ ID NO: 571220 - RNA, 13 nt, Homo sapiens
gugccugcugcug

SEQ ID NO: 571221 - RNA, 15 nt, Homo sapiens
gugccuggacauuug

SEQ ID NO: 571222 - RNA, 16 nt, Homo sapiens
gugccuggccauguca

SEQ ID NO: 571223 - RNA, 23 nt, Homo sapiens
gugccugggggaguuuuccucua

SEQ ID NO: 571224 - RNA, 12 nt, Homo sapiens
gugccuucugcc

SEQ ID NO: 571225 - RNA, 16 nt, Homo sapiens
gugccuucugccaacg

SEQ ID NO: 571226 - RNA, 16 nt, Homo sapiens
gugccuuguccaggaa

SEQ ID NO: 571227 - RNA, 18 nt, Homo sapiens
gugccuuugaccaucucu

SEQ ID NO: 571228 - RNA, 13 nt, Homo sapiens
gugcgagggccac

SEQ ID NO: 571229 - RNA, 15 nt, Homo sapiens
gugcgcgcgugcaug

SEQ ID NO: 571230 - RNA, 13 nt, Homo sapiens
gugcggugcaaag

SEQ ID NO: 571231 - RNA, 23 nt, Homo sapiens
gugcgugcucccgaugcugcuau

SEQ ID NO: 571232 - RNA, 15 nt, Homo sapiens
gugcgugugugcaag

SEQ ID NO: 571233 - RNA, 16 nt, Homo sapiens
gugcgugugugcaagu

SEQ ID NO: 571234 - RNA, 15 nt, Homo sapiens
gugcuauacacacac

SEQ ID NO: 571235 - RNA, 18 nt, Homo sapiens
gugcuauaggcuggagaa

SEQ ID NO: 571236 - RNA, 20 nt, Homo sapiens
gugcuaucgcaccacugugu

SEQ ID NO: 571237 - RNA, 21 nt, Homo sapiens
gugcuauuaggaaauucugau

SEQ ID NO: 571238 - RNA, 12 nt, Homo sapiens
gugcucagagac

SEQ ID NO: 571239 - RNA, 14 nt, Homo sapiens
gugcucagccaaau

SEQ ID NO: 571240 - RNA, 14 nt, Homo sapiens
gugcuccaguucca

SEQ ID NO: 571241 - RNA, 17 nt, Homo sapiens
gugcuccucacuuccuc

SEQ ID NO: 571242 - RNA, 17 nt, Homo sapiens
uaaggacggacucacuu

SEQ ID NO: 571243 - RNA, 14 nt, Homo sapiens
uaaggaucucucag

SEQ ID NO: 571244 - RNA, 16 nt, Homo sapiens
uaaggaugucacaggg

SEQ ID NO: 571245 - RNA, 14 nt, Homo sapiens
uaaggauguugcca

SEQ ID NO: 571246 - RNA, 16 nt, Homo sapiens
uaaggcuuaggugcca

SEQ ID NO: 571247 - RNA, 16 nt, Homo sapiens
uaaggcuuuaguguau

SEQ ID NO: 571248 - RNA, 17 nt, Homo sapiens
uaaggcuuuuucuuccc

SEQ ID NO: 571249 - RNA, 13 nt, Homo sapiens
uaagggaccucaa

SEQ ID NO: 571250 - RNA, 18 nt, Homo sapiens
uaagggacucccacaaca

SEQ ID NO: 571251 - RNA, 23 nt, Homo sapiens
uaagggaguggccucauuucacu

SEQ ID NO: 571252 - RNA, 14 nt, Homo sapiens
uaagggcagugccc

SEQ ID NO: 571253 - RNA, 22 nt, Homo sapiens
uaaggggggcagggagugauga

SEQ ID NO: 571254 - RNA, 14 nt, Homo sapiens
uaagggguacuccu

SEQ ID NO: 571255 - RNA, 17 nt, Homo sapiens
uaagggugggugcucag

SEQ ID NO: 571256 - RNA, 13 nt, Homo sapiens
uaagguaaugguu

SEQ ID NO: 571257 - RNA, 13 nt, Homo sapiens
uaagguacuagca

SEQ ID NO: 571258 - RNA, 13 nt, Homo sapiens
uaagguacugaag

SEQ ID NO: 571259 - RNA, 21 nt, Homo sapiens
uaagguauuaucuugcaacuu

SEQ ID NO: 571260 - RNA, 16 nt, Homo sapiens
uaagguauugugcauc

SEQ ID NO: 571261 - RNA, 12 nt, Homo sapiens
uaaggugcuauc

SEQ ID NO: 571262 - RNA, 17 nt, Homo sapiens
uaagguuggagauguca

SEQ ID NO: 571263 - RNA, 22 nt, Homo sapiens
uaaguaaaauccccuucgcuga

SEQ ID NO: 571264 - RNA, 17 nt, Homo sapiens
uaaguaaauacaguaga

SEQ ID NO: 571265 - RNA, 23 nt, Homo sapiens
uaaguaccuuauucuacaucauu

SEQ ID NO: 571266 - RNA, 22 nt, Homo sapiens
uaaguacuauguaucaaugagu

SEQ ID NO: 571267 - RNA, 23 nt, Homo sapiens
uaaguacuauguaucaaugagua

SEQ ID NO: 571268 - RNA, 16 nt, Homo sapiens
uaaguagggauguuua

SEQ ID NO: 571269 - RNA, 13 nt, Homo sapiens
uaaguaucagagg

SEQ ID NO: 571270 - RNA, 14 nt, Homo sapiens
uaaguaucagggga

SEQ ID NO: 571271 - RNA, 19 nt, Homo sapiens
uaaguaucuugugcuucuu

SEQ ID NO: 571272 - RNA, 16 nt, Homo sapiens
uaaguauuuugaucac

SEQ ID NO: 571273 - RNA, 17 nt, Homo sapiens
uaaguauuuugaucacu

SEQ ID NO: 571274 - RNA, 14 nt, Homo sapiens
uaagucaagcacau

SEQ ID NO: 571275 - RNA, 22 nt, Homo sapiens
uaagucacauaggaaacuugaa

SEQ ID NO: 571276 - RNA, 22 nt, Homo sapiens
uaagucccuuuuaguuugauca

SEQ ID NO: 571277 - RNA, 23 nt, Homo sapiens
uaaguccucuagugaauguaggc

SEQ ID NO: 571278 - RNA, 13 nt, Homo sapiens
uaagucuaucugg

SEQ ID NO: 571279 - RNA, 15 nt, Homo sapiens
uaagucuuacauaaa

SEQ ID NO: 571280 - RNA, 17 nt, Homo sapiens
uaagugaauacauuaac

SEQ ID NO: 571281 - RNA, 19 nt, Homo sapiens
uaagugaauuuaugagauu

SEQ ID NO: 571282 - RNA, 11 nt, Homo sapiens
uaagugacaaa

SEQ ID NO: 571283 - RNA, 11 nt, Homo sapiens
uaagugauaua

SEQ ID NO: 571284 - RNA, 19 nt, Homo sapiens
uaagugcauuuguaauuca

SEQ ID NO: 571285 - RNA, 16 nt, Homo sapiens
uaagugccauuacuac

SEQ ID NO: 571286 - RNA, 11 nt, Homo sapiens
uaagugcugcu

SEQ ID NO: 571287 - RNA, 12 nt, Homo sapiens
uaagugcugcua

SEQ ID NO: 571288 - RNA, 20 nt, Homo sapiens
uaaguggacuggugucauaa

SEQ ID NO: 571289 - RNA, 15 nt, Homo sapiens
uaagugguuacuuug

SEQ ID NO: 571290 - RNA, 14 nt, Homo sapiens
uaagugugccaaau

SEQ ID NO: 571291 - RNA, 13 nt, Homo sapiens
uaaguguucucau

SEQ ID NO: 571292 - RNA, 15 nt, Homo sapiens
uaaguguuugucaua

SEQ ID NO: 571293 - RNA, 18 nt, Homo sapiens
uaaguuaaaacaaaggaa

SEQ ID NO: 571294 - RNA, 20 nt, Homo sapiens
uaaguuauuuacuuuuacca

SEQ ID NO: 571295 - RNA, 17 nt, Homo sapiens
uaaguuccacugagcuc

SEQ ID NO: 571296 - RNA, 18 nt, Homo sapiens
uaaguucuuugauuugua

SEQ ID NO: 571297 - RNA, 23 nt, Homo sapiens
uaaguugcugggauuacaggugu

SEQ ID NO: 571298 - RNA, 18 nt, Homo sapiens
uaaguugucgaacaguag

SEQ ID NO: 571299 - RNA, 14 nt, Homo sapiens
uaaguuuaucuuuc

SEQ ID NO: 571300 - RNA, 16 nt, Homo sapiens
uaaguuucucuucacc

SEQ ID NO: 571301 - RNA, 21 nt, Homo sapiens
uaaguuugaaggaaacaguua

SEQ ID NO: 571302 - RNA, 21 nt, Homo sapiens
uaaguuuugaaauaagaaagu

SEQ ID NO: 571303 - RNA, 21 nt, Homo sapiens
uaauaaaacaacaacaaaaac

SEQ ID NO: 571304 - RNA, 21 nt, Homo sapiens
uaauaaaagaguuaacauccc

SEQ ID NO: 571305 - RNA, 13 nt, Homo sapiens
uaauaaacauccu

SEQ ID NO: 571306 - RNA, 17 nt, Homo sapiens
uaauaaacauccuucaa

SEQ ID NO: 571307 - RNA, 13 nt, Homo sapiens
uaauaaagacagg

SEQ ID NO: 571308 - RNA, 23 nt, Homo sapiens
uaauaaagacauuuccuaccugc

SEQ ID NO: 571309 - RNA, 13 nt, Homo sapiens
uaauaaagcuuuu

SEQ ID NO: 571310 - RNA, 21 nt, Homo sapiens
uaauaaaggcccccacuucuc

SEQ ID NO: 571311 - RNA, 15 nt, Homo sapiens
uaauaaaucacuugc

SEQ ID NO: 571312 - RNA, 24 nt, Homo sapiens
uaauaaaucucuucuuugcugcag

SEQ ID NO: 571313 - RNA, 19 nt, Homo sapiens
uaauaaaucuguugccaag

SEQ ID NO: 571314 - RNA, 12 nt, Homo sapiens
uaauaacauaca

SEQ ID NO: 571315 - RNA, 14 nt, Homo sapiens
uaauaacuuaucua

SEQ ID NO: 571316 - RNA, 18 nt, Homo sapiens
uaauaagaagugccaagu

SEQ ID NO: 571317 - RNA, 18 nt, Homo sapiens
uguuaauauaccccaaau

SEQ ID NO: 571318 - RNA, 14 nt, Homo sapiens
uguuaauaucacuc

SEQ ID NO: 571319 - RNA, 19 nt, Homo sapiens
uguuaaugucauugcuaaa

SEQ ID NO: 571320 - RNA, 14 nt, Homo sapiens
uguuaaugucuuca

SEQ ID NO: 571321 - RNA, 18 nt, Homo sapiens
uguuaauucagcacugau

SEQ ID NO: 571322 - RNA, 20 nt, Homo sapiens
uguuacaaguuugcuaaaag

SEQ ID NO: 571323 - RNA, 13 nt, Homo sapiens
uguuacccacugc

SEQ ID NO: 571324 - RNA, 13 nt, Homo sapiens
uguuaccuacuuu

SEQ ID NO: 571325 - RNA, 22 nt, Homo sapiens
uguuaccuguagauucagguaa

SEQ ID NO: 571326 - RNA, 16 nt, Homo sapiens
uguuacuaaauccuuu

SEQ ID NO: 571327 - RNA, 22 nt, Homo sapiens
uguuacucucuuccacauguua

SEQ ID NO: 571328 - RNA, 15 nt, Homo sapiens
uguuacugccuauaa

SEQ ID NO: 571329 - RNA, 14 nt, Homo sapiens
uguuacuguaauuc

SEQ ID NO: 571330 - RNA, 11 nt, Homo sapiens
uguuacuguga

SEQ ID NO: 571331 - RNA, 21 nt, Homo sapiens
uguuacuugaaauaccaguga

SEQ ID NO: 571332 - RNA, 16 nt, Homo sapiens
uguuagaaugcaagca

SEQ ID NO: 571333 - RNA, 12 nt, Homo sapiens
uguuagccuuag

SEQ ID NO: 571334 - RNA, 20 nt, Homo sapiens
uguuagcguggguuagggga

SEQ ID NO: 571335 - RNA, 23 nt, Homo sapiens
uguuaguaaauaaaauuaacaaa

SEQ ID NO: 571336 - RNA, 13 nt, Homo sapiens
uguuaguaguuuc

SEQ ID NO: 571337 - RNA, 18 nt, Homo sapiens
uguuaguggaaaauggaa

SEQ ID NO: 571338 - RNA, 14 nt, Homo sapiens
uguuauaaagacac

SEQ ID NO: 571339 - RNA, 18 nt, Homo sapiens
uguuauaaagacacaugc

SEQ ID NO: 571340 - RNA, 21 nt, Homo sapiens
uguuauaacucugcacuacuc

SEQ ID NO: 571341 - RNA, 18 nt, Homo sapiens
uguuauagaacuucaugg

SEQ ID NO: 571342 - RNA, 17 nt, Homo sapiens
uguuauauaauuuagac

SEQ ID NO: 571343 - RNA, 19 nt, Homo sapiens
uguuauauagccaauauaa

SEQ ID NO: 571344 - RNA, 20 nt, Homo sapiens
uguuauauuuaaugcauuaa

SEQ ID NO: 571345 - RNA, 20 nt, Homo sapiens
uguuaucaccuaagcacuuc

SEQ ID NO: 571346 - RNA, 16 nt, Homo sapiens
uguuaucaguaagaaa

SEQ ID NO: 571347 - RNA, 20 nt, Homo sapiens
uguuaucuuauacuguacaa

SEQ ID NO: 571348 - RNA, 13 nt, Homo sapiens
uguuaugccauga

SEQ ID NO: 571349 - RNA, 17 nt, Homo sapiens
uguuauuacuguuccca

SEQ ID NO: 571350 - RNA, 19 nt, Homo sapiens
uguuauuauuaccagcauu

SEQ ID NO: 571351 - RNA, 15 nt, Homo sapiens
uguuauuauucuuga

SEQ ID NO: 571352 - RNA, 13 nt, Homo sapiens
uguuauuuaucaa

SEQ ID NO: 571353 - RNA, 17 nt, Homo sapiens
uguuauuuuucaaggaa

SEQ ID NO: 571354 - RNA, 12 nt, Homo sapiens
uguucaaaaagg

SEQ ID NO: 571355 - RNA, 17 nt, Homo sapiens
uguucaaacuacuguac

SEQ ID NO: 571356 - RNA, 14 nt, Homo sapiens
uguucaauuucagu

SEQ ID NO: 571357 - RNA, 16 nt, Homo sapiens
uguucacugaagguga

SEQ ID NO: 571358 - RNA, 18 nt, Homo sapiens
uguucacuuauugacuau

SEQ ID NO: 571359 - RNA, 21 nt, Homo sapiens
uguucagaguggcucacuggc

SEQ ID NO: 571360 - RNA, 12 nt, Homo sapiens
uguucagauuaa

SEQ ID NO: 571361 - RNA, 15 nt, Homo sapiens
uguucagggcuguga

SEQ ID NO: 571362 - RNA, 17 nt, Homo sapiens
uguucagggcugugauc

SEQ ID NO: 571363 - RNA, 14 nt, Homo sapiens
uguucaguacucua

SEQ ID NO: 571364 - RNA, 18 nt, Homo sapiens
uguucauauuuauugauu

SEQ ID NO: 571365 - RNA, 22 nt, Homo sapiens
uuaacaacucauucugauccuc

SEQ ID NO: 571366 - RNA, 14 nt, Homo sapiens
uuaacacaucucaa

SEQ ID NO: 571367 - RNA, 13 nt, Homo sapiens
uuaacaccuucau

SEQ ID NO: 571368 - RNA, 16 nt, Homo sapiens
uuaacagaucuuuacu

SEQ ID NO: 571369 - RNA, 15 nt, Homo sapiens
uuaacauaccuaaga

SEQ ID NO: 571370 - RNA, 11 nt, Homo sapiens
uuaacaugucg

SEQ ID NO: 571371 - RNA, 23 nt, Homo sapiens
uuaacauuaucuaguucauugaa

SEQ ID NO: 571372 - RNA, 14 nt, Homo sapiens
uuaacauucacagc

SEQ ID NO: 571373 - RNA, 18 nt, Homo sapiens
uuaaccaaucagaugaca

SEQ ID NO: 571374 - RNA, 18 nt, Homo sapiens
uuaaccccauguccucag

SEQ ID NO: 571375 - RNA, 19 nt, Homo sapiens
uuaacccuauuuuaccuag

SEQ ID NO: 571376 - RNA, 18 nt, Homo sapiens
uuaaccgcacaugcacac

SEQ ID NO: 571377 - RNA, 18 nt, Homo sapiens
uuaaccugccaacauacu

SEQ ID NO: 571378 - RNA, 18 nt, Homo sapiens
uuaaccuuccaagacuga

SEQ ID NO: 571379 - RNA, 16 nt, Homo sapiens
uuaaccuuugcuaugu

SEQ ID NO: 571380 - RNA, 15 nt, Homo sapiens
uuaacggugcuaaaa

SEQ ID NO: 571381 - RNA, 12 nt, Homo sapiens
uuaacucuagaa

SEQ ID NO: 571382 - RNA, 20 nt, Homo sapiens
uuaacugacuuaaguggcau

SEQ ID NO: 571383 - RNA, 17 nt, Homo sapiens
uuaacugagcuacuaga

SEQ ID NO: 571384 - RNA, 19 nt, Homo sapiens
uuaacuguauuucaguauu

SEQ ID NO: 571385 - RNA, 12 nt, Homo sapiens
uuaacugucacc

SEQ ID NO: 571386 - RNA, 17 nt, Homo sapiens
uuaacugugaaccugga

SEQ ID NO: 571387 - RNA, 17 nt, Homo sapiens
uuaacuuacacugauca

SEQ ID NO: 571388 - RNA, 18 nt, Homo sapiens
uuaacuuccaauuuacau

SEQ ID NO: 571389 - RNA, 21 nt, Homo sapiens
uuaacuuccaauuuacauacu

SEQ ID NO: 571390 - RNA, 16 nt, Homo sapiens
uuaacuuuaccaugcu

SEQ ID NO: 571391 - RNA, 15 nt, Homo sapiens
uuaacuuugaaaguu

SEQ ID NO: 571392 - RNA, 18 nt, Homo sapiens
uuaacuuuuaagguugaa

SEQ ID NO: 571393 - RNA, 15 nt, Homo sapiens
uuaacuuuuggaauc

SEQ ID NO: 571394 - RNA, 18 nt, Homo sapiens
uuaacuuuuguaccaaau

SEQ ID NO: 571395 - RNA, 15 nt, Homo sapiens
uuaagaaaaaagugu

SEQ ID NO: 571396 - RNA, 14 nt, Homo sapiens
uuaagaaacuagca

SEQ ID NO: 571397 - RNA, 15 nt, Homo sapiens
uuaagaaacuguuuc

SEQ ID NO: 571398 - RNA, 17 nt, Homo sapiens
uuaagaaauuucacaua

SEQ ID NO: 571399 - RNA, 19 nt, Homo sapiens
uuaagaacacuuuuaauaa

SEQ ID NO: 571400 - RNA, 12 nt, Homo sapiens
uuaagaacuuca

SEQ ID NO: 571401 - RNA, 16 nt, Homo sapiens
uuaagaagucuauaau

SEQ ID NO: 571402 - RNA, 18 nt, Homo sapiens
uuaagaauuucacaagcu

SEQ ID NO: 571403 - RNA, 13 nt, Homo sapiens
uuaagacagaguu

SEQ ID NO: 571404 - RNA, 17 nt, Homo sapiens
uuaagacaguguacaaa

SEQ ID NO: 571405 - RNA, 19 nt, Homo sapiens
uuaagacuaaaaguugcau

SEQ ID NO: 571406 - RNA, 17 nt, Homo sapiens
uuaagacugaaaauaua

SEQ ID NO: 571407 - RNA, 15 nt, Homo sapiens
uuaagagacacucca

SEQ ID NO: 571408 - RNA, 23 nt, Homo sapiens
uuaagagauacuugaugccaaaa

SEQ ID NO: 571409 - RNA, 19 nt, Homo sapiens
uuaagagaucccuuaagaa

SEQ ID NO: 571410 - RNA, 14 nt, Homo sapiens
uuaagagccauaua

SEQ ID NO: 571411 - RNA, 23 nt, Homo sapiens
uuaagaggacauaaugggguccu

SEQ ID NO: 571412 - RNA, 22 nt, Homo sapiens
uuaagagggaacuuagcagaga

SEQ ID NO: 571413 - RNA, 23 nt, Homo sapiens
uuaagaguccaacucacuuccag

SEQ ID NO: 571414 - RNA, 14 nt, Homo sapiens
uuaagagugaaguc

SEQ ID NO: 571415 - RNA, 13 nt, Homo sapiens
uuaagauaugcac

SEQ ID NO: 571416 - RNA, 19 nt, Homo sapiens
uuaagauccacaaaugaag

SEQ ID NO: 571417 - RNA, 23 nt, Homo sapiens
uuaagaucuuuaaacugcuuuau

SEQ ID NO: 571418 - RNA, 13 nt, Homo sapiens
uuaagcacuuuaa

SEQ ID NO: 571419 - RNA, 15 nt, Homo sapiens
uuaagccaucaggga

SEQ ID NO: 571420 - RNA, 21 nt, Homo sapiens
uuaagcuaggauguugcucag

SEQ ID NO: 571421 - RNA, 19 nt, Homo sapiens
uuaagcuauccacagcuua

SEQ ID NO: 571422 - RNA, 19 nt, Homo sapiens
uuaagcugaagaguuuacu

SEQ ID NO: 571423 - RNA, 14 nt, Homo sapiens
uuaagcugagccac

SEQ ID NO: 571424 - RNA, 19 nt, Homo sapiens
uuaagcugggauaaucaca

SEQ ID NO: 571425 - RNA, 18 nt, Homo sapiens
uuaagcuucuuaacugcc

SEQ ID NO: 571426 - RNA, 14 nt, Homo sapiens
uuaaggaaauggug

SEQ ID NO: 571427 - RNA, 15 nt, Homo sapiens
uuaaggauugugaua

SEQ ID NO: 571428 - RNA, 13 nt, Homo sapiens
uuaaggcaaaaaa

SEQ ID NO: 571429 - RNA, 13 nt, Homo sapiens
uuaagggggaaaa

SEQ ID NO: 571430 - RNA, 19 nt, Homo sapiens
uuaagguaacuacugcuaa

SEQ ID NO: 571431 - RNA, 13 nt, Homo sapiens
uuaagguacuuaa

SEQ ID NO: 571432 - RNA, 17 nt, Homo sapiens
uuaaguacaugugccag

SEQ ID NO: 571433 - RNA, 14 nt, Homo sapiens
uuaaguaccaaugg

SEQ ID NO: 571434 - RNA, 14 nt, Homo sapiens
uuaaguagggauaa

SEQ ID NO: 571435 - RNA, 17 nt, Homo sapiens
uuaagugagcagaacag

SEQ ID NO: 571436 - RNA, 12 nt, Homo sapiens
uuaagugccauu

SEQ ID NO: 571437 - RNA, 23 nt, Homo sapiens
uuaauaaaaaggaauacauugca

SEQ ID NO: 571438 - RNA, 21 nt, Homo sapiens
uuaauaaaaauuauuaccagu

SEQ ID NO: 571439 - RNA, 16 nt, Homo sapiens
uuaauaaaccuuugca

SEQ ID NO: 571440 - RNA, 19 nt, Homo sapiens
uuaauaaagaauuaacaga

SEQ ID NO: 571441 - RNA, 18 nt, Homo sapiens
uuaauaaagacgauuugu

SEQ ID NO: 571442 - RNA, 16 nt, Homo sapiens
uuaauaaauucagaua

SEQ ID NO: 571443 - RNA, 14 nt, Homo sapiens
uuaauacaugcaac

SEQ ID NO: 571444 - RNA, 16 nt, Homo sapiens
uuaauaccagcuuaaa

SEQ ID NO: 571445 - RNA, 21 nt, Homo sapiens
uacacacuguugucaaaaagu

SEQ ID NO: 571446 - RNA, 15 nt, Homo sapiens
uacacagaauauaau

SEQ ID NO: 571447 - RNA, 16 nt, Homo sapiens
uacacaggagucuuca

SEQ ID NO: 571448 - RNA, 14 nt, Homo sapiens
uacacauacauaca

SEQ ID NO: 571449 - RNA, 22 nt, Homo sapiens
uacacauccccagaauccauaa

SEQ ID NO: 571450 - RNA, 14 nt, Homo sapiens
uacaccaaugccca

SEQ ID NO: 571451 - RNA, 15 nt, Homo sapiens
uacaccacugcacuu

SEQ ID NO: 571452 - RNA, 15 nt, Homo sapiens
uacacccaccagagu

SEQ ID NO: 571453 - RNA, 19 nt, Homo sapiens
uacacccaguucugaauaa

SEQ ID NO: 571454 - RNA, 16 nt, Homo sapiens
uacaccgacuagccag

SEQ ID NO: 571455 - RNA, 17 nt, Homo sapiens
uacaccuuagucuuucc

SEQ ID NO: 571456 - RNA, 15 nt, Homo sapiens
uacacgcgugugcuc

SEQ ID NO: 571457 - RNA, 21 nt, Homo sapiens
uacacggaggucucuguaaaa

SEQ ID NO: 571458 - RNA, 21 nt, Homo sapiens
uacacuaaaaggugaccaaug

SEQ ID NO: 571459 - RNA, 16 nt, Homo sapiens
uacacuaaaguuacaa

SEQ ID NO: 571460 - RNA, 23 nt, Homo sapiens
uacacuacagaggggccagggga

SEQ ID NO: 571461 - RNA, 18 nt, Homo sapiens
uacacucaagcaugaaga

SEQ ID NO: 571462 - RNA, 12 nt, Homo sapiens
uacacucaggcu

SEQ ID NO: 571463 - RNA, 20 nt, Homo sapiens
uacacuccagccugagcaac

SEQ ID NO: 571464 - RNA, 23 nt, Homo sapiens
uacacucuugacuagugcaauuu

SEQ ID NO: 571465 - RNA, 21 nt, Homo sapiens
uacacugaucaauuucaacau

SEQ ID NO: 571466 - RNA, 15 nt, Homo sapiens
uacacuguauuacau

SEQ ID NO: 571467 - RNA, 16 nt, Homo sapiens
uacacugugaacucaa

SEQ ID NO: 571468 - RNA, 18 nt, Homo sapiens
uacacuucuuaccccagc

SEQ ID NO: 571469 - RNA, 20 nt, Homo sapiens
uacacuuggaugcagugcgu

SEQ ID NO: 571470 - RNA, 17 nt, Homo sapiens
uacacuugguguacugg

SEQ ID NO: 571471 - RNA, 16 nt, Homo sapiens
uacagaacuacuucuu

SEQ ID NO: 571472 - RNA, 14 nt, Homo sapiens
uacagaacucuuuc

SEQ ID NO: 571473 - RNA, 14 nt, Homo sapiens
uacagaagggcagu

SEQ ID NO: 571474 - RNA, 22 nt, Homo sapiens
uacagaaguccccucuacuuua

SEQ ID NO: 571475 - RNA, 23 nt, Homo sapiens
uacagaaucauugcuuaugacau

SEQ ID NO: 571476 - RNA, 15 nt, Homo sapiens
uacagaaugcauuaa

SEQ ID NO: 571477 - RNA, 19 nt, Homo sapiens
uacagaauggaaccaaaau

SEQ ID NO: 571478 - RNA, 13 nt, Homo sapiens
uacagacaagguu

SEQ ID NO: 571479 - RNA, 13 nt, Homo sapiens
uacagacagacau

SEQ ID NO: 571480 - RNA, 13 nt, Homo sapiens
uacagacauacau

SEQ ID NO: 571481 - RNA, 23 nt, Homo sapiens
uacagacauacauuuaugcacau

SEQ ID NO: 571482 - RNA, 13 nt, Homo sapiens
uacagacuagcag

SEQ ID NO: 571483 - RNA, 11 nt, Homo sapiens
uacagacucca

SEQ ID NO: 571484 - RNA, 13 nt, Homo sapiens
uacagacuccaaa

SEQ ID NO: 571485 - RNA, 15 nt, Homo sapiens
uacagacuccaaaag

SEQ ID NO: 571486 - RNA, 23 nt, Homo sapiens
uacagacugcagacauucucaaa

SEQ ID NO: 571487 - RNA, 16 nt, Homo sapiens
uacagagcaccuguag

SEQ ID NO: 571488 - RNA, 12 nt, Homo sapiens
aaugcacugugu

SEQ ID NO: 571489 - RNA, 13 nt, Homo sapiens
aaugcacuuggaa

SEQ ID NO: 571490 - RNA, 20 nt, Homo sapiens
aaugcagggacaaaugccac

SEQ ID NO: 571491 - RNA, 21 nt, Homo sapiens
aaugcaguacaggacauauau

SEQ ID NO: 571492 - RNA, 21 nt, Homo sapiens
aaugcauacuguugauacaaa

SEQ ID NO: 571493 - RNA, 19 nt, Homo sapiens
aaugcaucacguaccccac

SEQ ID NO: 571494 - RNA, 15 nt, Homo sapiens
aaugcaugucuuaaa

SEQ ID NO: 571495 - RNA, 23 nt, Homo sapiens
aaugcaugucuuaaaugcucaua

SEQ ID NO: 571496 - RNA, 14 nt, Homo sapiens
aaugcauuccagaa

SEQ ID NO: 571497 - RNA, 16 nt, Homo sapiens
aaugcauucccugaau

SEQ ID NO: 571498 - RNA, 19 nt, Homo sapiens
aaugcauuuggaaccaaag

SEQ ID NO: 571499 - RNA, 20 nt, Homo sapiens
aaugcauuuggaaccaaagu

SEQ ID NO: 571500 - RNA, 18 nt, Homo sapiens
aaugcauuuguaauucau

SEQ ID NO: 571501 - RNA, 19 nt, Homo sapiens
aaugcauuuuauucuuuaa

SEQ ID NO: 571502 - RNA, 15 nt, Homo sapiens
aaugccaaauugcag

SEQ ID NO: 571503 - RNA, 19 nt, Homo sapiens
aaugccacacggcucucac

SEQ ID NO: 571504 - RNA, 13 nt, Homo sapiens
aaugccaucagcc

SEQ ID NO: 571505 - RNA, 22 nt, Homo sapiens
aaugccaucagccccugggaac

SEQ ID NO: 571506 - RNA, 12 nt, Homo sapiens
aaugccaugaaa

SEQ ID NO: 571507 - RNA, 14 nt, Homo sapiens
aaugccaugaauua

SEQ ID NO: 571508 - RNA, 20 nt, Homo sapiens
aaugcccaguucacuucuuu

SEQ ID NO: 571509 - RNA, 18 nt, Homo sapiens
aaugcccauuuuugcuaa

SEQ ID NO: 571510 - RNA, 22 nt, Homo sapiens
aaugcccucaggggacuugaau

SEQ ID NO: 571511 - RNA, 14 nt, Homo sapiens
aaugcccugugcau

SEQ ID NO: 571512 - RNA, 17 nt, Homo sapiens
aaugcccuucuccuuau

SEQ ID NO: 571513 - RNA, 21 nt, Homo sapiens
aggcuuagagaagggcucuau

SEQ ID NO: 571514 - RNA, 15 nt, Homo sapiens
aggcuucacccugaa

SEQ ID NO: 571515 - RNA, 21 nt, Homo sapiens
aggcuucccccuuuacuauaa

SEQ ID NO: 571516 - RNA, 10 nt, Homo sapiens
aggcuuccug

SEQ ID NO: 571517 - RNA, 20 nt, Homo sapiens
aggcuugacagagucugccc

SEQ ID NO: 571518 - RNA, 15 nt, Homo sapiens
aggcuugcagucucc

SEQ ID NO: 571519 - RNA, 18 nt, Homo sapiens
aggcuuuaauaaaggcca

SEQ ID NO: 571520 - RNA, 23 nt, Homo sapiens
aggcuuucagaagcucuucuaaa

SEQ ID NO: 571521 - RNA, 11 nt, Homo sapiens
aggcuuucaug

SEQ ID NO: 571522 - RNA, 20 nt, Homo sapiens
aggcuuuccaauguagcuca

SEQ ID NO: 571523 - RNA, 16 nt, Homo sapiens
aggcuuucucuacuga

SEQ ID NO: 571524 - RNA, 20 nt, Homo sapiens
aggcuuuguacagagugcuu

SEQ ID NO: 571525 - RNA, 13 nt, Homo sapiens
agggaaaagcagc

SEQ ID NO: 571526 - RNA, 18 nt, Homo sapiens
agggaaaaggaguaggga

SEQ ID NO: 571527 - RNA, 22 nt, Homo sapiens
agggaaaaggaguagggaguuc

SEQ ID NO: 571528 - RNA, 15 nt, Homo sapiens
agggaaacacagcag

SEQ ID NO: 571529 - RNA, 13 nt, Homo sapiens
agggaaagugcau

SEQ ID NO: 571530 - RNA, 12 nt, Homo sapiens
agggaacacuca

SEQ ID NO: 571531 - RNA, 21 nt, Homo sapiens
agggaacagcagcagugccau

SEQ ID NO: 571532 - RNA, 21 nt, Homo sapiens
agggaaccugguacauccagu

SEQ ID NO: 571533 - RNA, 18 nt, Homo sapiens
agggaacuagagguguua

SEQ ID NO: 571534 - RNA, 19 nt, Homo sapiens
agggaacugaacauuccag

SEQ ID NO: 571535 - RNA, 23 nt, Homo sapiens
agggaagaacuauugugcucaga

SEQ ID NO: 571536 - RNA, 13 nt, Homo sapiens
agggaagccaaaa

SEQ ID NO: 571537 - RNA, 22 nt, Homo sapiens
agggaagcugucccucacuguu

SEQ ID NO: 571538 - RNA, 23 nt, Homo sapiens
agggaaggcuguuugagaaccau

SEQ ID NO: 571539 - RNA, 13 nt, Homo sapiens
agggaaguugucu

SEQ ID NO: 571540 - RNA, 14 nt, Homo sapiens
agggaauccagcuc

SEQ ID NO: 571541 - RNA, 13 nt, Homo sapiens
agggaaugcucag

SEQ ID NO: 571542 - RNA, 15 nt, Homo sapiens
agggacaaugccaau

SEQ ID NO: 571543 - RNA, 14 nt, Homo sapiens
agggacacuuucac

SEQ ID NO: 571544 - RNA, 16 nt, Homo sapiens
agggacagaugaaugc

SEQ ID NO: 571545 - RNA, 17 nt, Homo sapiens
agggacagcagauucca

SEQ ID NO: 571546 - RNA, 22 nt, Homo sapiens
agggacagcaugccccuuggcu

SEQ ID NO: 571547 - RNA, 16 nt, Homo sapiens
agggacaggcacucca

SEQ ID NO: 571548 - RNA, 20 nt, Homo sapiens
agggacaggcuccucugggg

SEQ ID NO: 571549 - RNA, 19 nt, Homo sapiens
agggacagggaaugcugag

SEQ ID NO: 571550 - RNA, 16 nt, Homo sapiens
agggacaggugggccu

SEQ ID NO: 571551 - RNA, 21 nt, Homo sapiens
agggacaugcccuguguggcu

SEQ ID NO: 571552 - RNA, 18 nt, Homo sapiens
agggaccaucugcugcag

SEQ ID NO: 571553 - RNA, 22 nt, Homo sapiens
agggaccaucugcugcaguuac

SEQ ID NO: 571554 - RNA, 14 nt, Homo sapiens
agggacccacuuca

SEQ ID NO: 571555 - RNA, 12 nt, Homo sapiens
agggacucccac

SEQ ID NO: 571556 - RNA, 18 nt, Homo sapiens
agggacuugaaguuguua

SEQ ID NO: 571557 - RNA, 17 nt, Homo sapiens
agggagaaaaagaaaca

SEQ ID NO: 571558 - RNA, 18 nt, Homo sapiens
agggagaaaggagaaauu

SEQ ID NO: 571559 - RNA, 15 nt, Homo sapiens
agggagaagcaugaa

SEQ ID NO: 571560 - RNA, 14 nt, Homo sapiens
agggagaagggaug

SEQ ID NO: 571561 - RNA, 15 nt, Homo sapiens
agggagagccaucac

SEQ ID NO: 571562 - RNA, 17 nt, Homo sapiens
agggagaggcucuggac

SEQ ID NO: 571563 - RNA, 20 nt, Homo sapiens
agggagcgaggucagaggag

SEQ ID NO: 571564 - RNA, 21 nt, Homo sapiens
agggaggaaucgaggaaccag

SEQ ID NO: 571565 - RNA, 20 nt, Homo sapiens
agggaggcaagcccuguuga

SEQ ID NO: 571566 - RNA, 21 nt, Homo sapiens
agggaggcaggggaggggugc

SEQ ID NO: 571567 - RNA, 15 nt, Homo sapiens
agggagggcuguggu

SEQ ID NO: 571568 - RNA, 23 nt, Homo sapiens
agggaggguguuuuggguggcau

SEQ ID NO: 571569 - RNA, 14 nt, Homo sapiens
agggaggucacugg

SEQ ID NO: 571570 - RNA, 12 nt, Homo sapiens
agggagugcaug

SEQ ID NO: 571571 - RNA, 17 nt, Homo sapiens
agggagugcuggcucac

SEQ ID NO: 571572 - RNA, 15 nt, Homo sapiens
agggaguuccaguca

SEQ ID NO: 571573 - RNA, 15 nt, Homo sapiens
agggauaauacugug

SEQ ID NO: 571574 - RNA, 18 nt, Homo sapiens
agggauaucuacuguggu

SEQ ID NO: 571575 - RNA, 15 nt, Homo sapiens
agggaucuguuugaa

SEQ ID NO: 571576 - RNA, 23 nt, Homo sapiens
agggaugccaacaccuucuuggc

SEQ ID NO: 571577 - RNA, 23 nt, Homo sapiens
agggauggcgaggccucucucag

SEQ ID NO: 571578 - RNA, 23 nt, Homo sapiens
agggauggggcagucucugccca

SEQ ID NO: 571579 - RNA, 13 nt, Homo sapiens
agggauguaucaa

SEQ ID NO: 571580 - RNA, 18 nt, Homo sapiens
agggaugugugagaauaa

SEQ ID NO: 571581 - RNA, 19 nt, Homo sapiens
agggauuugaggugagggu

SEQ ID NO: 571582 - RNA, 16 nt, Homo sapiens
agggauuuuagccucu

SEQ ID NO: 571583 - RNA, 23 nt, Homo sapiens
agggcaacaauacaugcugcuaa

SEQ ID NO: 571584 - RNA, 15 nt, Homo sapiens
agggcaacuguagaa

SEQ ID NO: 571585 - RNA, 23 nt, Homo sapiens
agggcaagaaauggcgucugcuc

SEQ ID NO: 571586 - RNA, 22 nt, Homo sapiens
agggcaagagggggaccugcca

SEQ ID NO: 571587 - RNA, 15 nt, Homo sapiens
agggcaagaucucag

SEQ ID NO: 571588 - RNA, 14 nt, Homo sapiens
agggcaaugccauc

SEQ ID NO: 571589 - RNA, 23 nt, Homo sapiens
agggcacaaacugcagcugugag

SEQ ID NO: 571590 - RNA, 11 nt, Homo sapiens
agggcacauua

SEQ ID NO: 571591 - RNA, 22 nt, Homo sapiens
agggcacccuaguucuaccuca

SEQ ID NO: 571592 - RNA, 17 nt, Homo sapiens
agggcacuuaauuugua

SEQ ID NO: 571593 - RNA, 22 nt, Homo sapiens
agggcagaauaaauaagcaaaa

SEQ ID NO: 571594 - RNA, 19 nt, Homo sapiens
agggcagaccacauugcuu

SEQ ID NO: 571595 - RNA, 14 nt, Homo sapiens
agggcagaggaaug

SEQ ID NO: 571596 - RNA, 22 nt, Homo sapiens
agggcaggucuggcggcuccau

SEQ ID NO: 571597 - RNA, 19 nt, Homo sapiens
agggcagugcccuuugaga

SEQ ID NO: 571598 - RNA, 20 nt, Homo sapiens
agggcaguucugaguguuua

SEQ ID NO: 571599 - RNA, 18 nt, Homo sapiens
agggcaucggcagcugaa

SEQ ID NO: 571600 - RNA, 18 nt, Homo sapiens
agggcaucuccugugcau

SEQ ID NO: 571601 - RNA, 17 nt, Homo sapiens
agggcauuuccaaguua

SEQ ID NO: 571602 - RNA, 19 nt, Homo sapiens
agggccaaagaaccaaaga

SEQ ID NO: 571603 - RNA, 13 nt, Homo sapiens
agggccaggugca

SEQ ID NO: 571604 - RNA, 10 nt, Homo sapiens
agggccaguc

SEQ ID NO: 571605 - RNA, 11 nt, Homo sapiens
agggccaguga

SEQ ID NO: 571606 - RNA, 23 nt, Homo sapiens
agggcccagcggucccugcagaa

SEQ ID NO: 571607 - RNA, 20 nt, Homo sapiens
agggcccccaucucaugccc

SEQ ID NO: 571608 - RNA, 14 nt, Homo sapiens
agggcccuaccuga

SEQ ID NO: 571609 - RNA, 14 nt, Homo sapiens
agggcccugcccug

SEQ ID NO: 571610 - RNA, 12 nt, Homo sapiens
aaugucaagcca

SEQ ID NO: 571611 - RNA, 19 nt, Homo sapiens
aaugucacaaccucucuga

SEQ ID NO: 571612 - RNA, 14 nt, Homo sapiens
aaugucacauucua

SEQ ID NO: 571613 - RNA, 14 nt, Homo sapiens
aaugucaccaccuu

SEQ ID NO: 571614 - RNA, 13 nt, Homo sapiens
aaugucacugcca

SEQ ID NO: 571615 - RNA, 14 nt, Homo sapiens
aaugucacugccaa

SEQ ID NO: 571616 - RNA, 12 nt, Homo sapiens
aaugucacugua

SEQ ID NO: 571617 - RNA, 12 nt, Homo sapiens
aaugucacuuaa

SEQ ID NO: 571618 - RNA, 16 nt, Homo sapiens
aaugucagaaaccagu

SEQ ID NO: 571619 - RNA, 19 nt, Homo sapiens
aaugucagaaaccaguuau

SEQ ID NO: 571620 - RNA, 13 nt, Homo sapiens
aaugucagccuuu

SEQ ID NO: 571621 - RNA, 17 nt, Homo sapiens
aaugucaggaacagaag

SEQ ID NO: 571622 - RNA, 14 nt, Homo sapiens
aaugucauugcuaa

SEQ ID NO: 571623 - RNA, 15 nt, Homo sapiens
aauguccaccaugaa

SEQ ID NO: 571624 - RNA, 12 nt, Homo sapiens
aauguccagcca

SEQ ID NO: 571625 - RNA, 18 nt, Homo sapiens
aaugucccaacccagaca

SEQ ID NO: 571626 - RNA, 22 nt, Homo sapiens
aaugucccuuucagagacagcu

SEQ ID NO: 571627 - RNA, 15 nt, Homo sapiens
aaugucuaaaaugga

SEQ ID NO: 571628 - RNA, 15 nt, Homo sapiens
aaugucuaccaacug

SEQ ID NO: 571629 - RNA, 22 nt, Homo sapiens
aaugucucaugucaaugaccau

SEQ ID NO: 571630 - RNA, 20 nt, Homo sapiens
aaugucucgggacuuggguc

SEQ ID NO: 571631 - RNA, 20 nt, Homo sapiens
aaugucucugcuccuacauc

SEQ ID NO: 571632 - RNA, 16 nt, Homo sapiens
aaugucuggucugucc

SEQ ID NO: 571633 - RNA, 18 nt, Homo sapiens
aaugucuggucuguccac

SEQ ID NO: 571634 - RNA, 17 nt, Homo sapiens
aaugucugugaauuuca

SEQ ID NO: 571635 - RNA, 13 nt, Homo sapiens
aaugucuguuuca

SEQ ID NO: 571636 - RNA, 21 nt, Homo sapiens
aaugucuuaaaaauauauuua

SEQ ID NO: 571637 - RNA, 20 nt, Homo sapiens
agggggagcaaaucgugccu

SEQ ID NO: 571638 - RNA, 21 nt, Homo sapiens
agggggaugccacuccucccu

SEQ ID NO: 571639 - RNA, 20 nt, Homo sapiens
agggggccaugaggccucag

SEQ ID NO: 571640 - RNA, 12 nt, Homo sapiens
agggggcccaaa

SEQ ID NO: 571641 - RNA, 23 nt, Homo sapiens
agggggccuugcggaagccauag

SEQ ID NO: 571642 - RNA, 20 nt, Homo sapiens
agggggcgcucaggacccag

SEQ ID NO: 571643 - RNA, 18 nt, Homo sapiens
aggggguaggagagcacu

SEQ ID NO: 571644 - RNA, 19 nt, Homo sapiens
aggggguaggagagcacug

SEQ ID NO: 571645 - RNA, 21 nt, Homo sapiens
agggggugcaaagacucugag

SEQ ID NO: 571646 - RNA, 13 nt, Homo sapiens
agggggugugcgu

SEQ ID NO: 571647 - RNA, 18 nt, Homo sapiens
agggggugugucugcuca

SEQ ID NO: 571648 - RNA, 20 nt, Homo sapiens
aggggguuacaaacugcaau

SEQ ID NO: 571649 - RNA, 12 nt, Homo sapiens
aggggguugugg

SEQ ID NO: 571650 - RNA, 13 nt, Homo sapiens
agggguacauucu

SEQ ID NO: 571651 - RNA, 21 nt, Homo sapiens
aggggucugaacgucuccuag

SEQ ID NO: 571652 - RNA, 19 nt, Homo sapiens
aggggugcugcagguggca

SEQ ID NO: 571653 - RNA, 22 nt, Homo sapiens
aggggugggagagccagcucuc

SEQ ID NO: 571654 - RNA, 20 nt, Homo sapiens
aggggugggauccacacuga

SEQ ID NO: 571655 - RNA, 22 nt, Homo sapiens
aggggugggauccacacugaga

SEQ ID NO: 571656 - RNA, 18 nt, Homo sapiens
aggguaagacaauaugaa

SEQ ID NO: 571657 - RNA, 20 nt, Homo sapiens
aggguacuuuaagacauacu

SEQ ID NO: 571658 - RNA, 17 nt, Homo sapiens
aggguagaagaggcaag

SEQ ID NO: 571659 - RNA, 22 nt, Homo sapiens
aggguaggcacgaagcaauuug

SEQ ID NO: 571660 - RNA, 15 nt, Homo sapiens
aggguagggcacaaa

SEQ ID NO: 571661 - RNA, 16 nt, Homo sapiens
aggguauauacaaauu

SEQ ID NO: 571662 - RNA, 23 nt, Homo sapiens
aggguauauuuuugauaccuuca

SEQ ID NO: 571663 - RNA, 16 nt, Homo sapiens
agggucaaaguacaga

SEQ ID NO: 571664 - RNA, 17 nt, Homo sapiens
agggucacgcuugccug

SEQ ID NO: 571665 - RNA, 21 nt, Homo sapiens
agggucacgcuugccugguca

SEQ ID NO: 571666 - RNA, 11 nt, Homo sapiens
agggucacugu

SEQ ID NO: 571667 - RNA, 14 nt, Homo sapiens
agggucaucugccc

SEQ ID NO: 571668 - RNA, 21 nt, Homo sapiens
agggucccauuucucacugag

SEQ ID NO: 571669 - RNA, 16 nt, Homo sapiens
agggucccucugugua

SEQ ID NO: 571670 - RNA, 20 nt, Homo sapiens
agggucccuuaaagauuuuc

SEQ ID NO: 571671 - RNA, 16 nt, Homo sapiens
aggguccgcaccagcu

SEQ ID NO: 571672 - RNA, 16 nt, Homo sapiens
aggguccugcccuccg

SEQ ID NO: 571673 - RNA, 14 nt, Homo sapiens
agggucgcugcaua

SEQ ID NO: 571674 - RNA, 16 nt, Homo sapiens
agggucuaagcaccuu

SEQ ID NO: 571675 - RNA, 22 nt, Homo sapiens
agggucucacucuguugcccag

SEQ ID NO: 571676 - RNA, 17 nt, Homo sapiens
agggucucuagugcugu

SEQ ID NO: 571677 - RNA, 22 nt, Homo sapiens
agggucucuugcccaucucucc

SEQ ID NO: 571678 - RNA, 18 nt, Homo sapiens
agggucucuuuguucaau

SEQ ID NO: 571679 - RNA, 23 nt, Homo sapiens
agggucugcucuuucucugccag

SEQ ID NO: 571680 - RNA, 23 nt, Homo sapiens
agggucuuaccucucugggaccu

SEQ ID NO: 571681 - RNA, 23 nt, Homo sapiens
agggucuucuuacaugcauuuga

SEQ ID NO: 571682 - RNA, 17 nt, Homo sapiens
agggucuuugcaagaau

SEQ ID NO: 571683 - RNA, 20 nt, Homo sapiens
agggucuuuucaucugggaa

SEQ ID NO: 571684 - RNA, 22 nt, Homo sapiens
agggugaagcuauuuaucugua

SEQ ID NO: 571685 - RNA, 16 nt, Homo sapiens
agggugacauggggaa

SEQ ID NO: 571686 - RNA, 16 nt, Homo sapiens
agggugaccacaccuu

SEQ ID NO: 571687 - RNA, 17 nt, Homo sapiens
agggugaggcugacaca

SEQ ID NO: 571688 - RNA, 21 nt, Homo sapiens
agggugcagcccaaucugcca

SEQ ID NO: 571689 - RNA, 19 nt, Homo sapiens
agggugcaguaucaugccc

SEQ ID NO: 571690 - RNA, 15 nt, Homo sapiens
agggugcccucugcu

SEQ ID NO: 571691 - RNA, 16 nt, Homo sapiens
agggugcuccuuguca

SEQ ID NO: 571692 - RNA, 22 nt, Homo sapiens
aggguggcacucaacucugagc

SEQ ID NO: 571693 - RNA, 16 nt, Homo sapiens
agggugggcagccuau

SEQ ID NO: 571694 - RNA, 23 nt, Homo sapiens
agggugggguaaccaaauguugg

SEQ ID NO: 571695 - RNA, 17 nt, Homo sapiens
aggguggucuugaucuc

SEQ ID NO: 571696 - RNA, 22 nt, Homo sapiens
agggugguggcgugcauaugua

SEQ ID NO: 571697 - RNA, 16 nt, Homo sapiens
aggguguaauggagca

SEQ ID NO: 571698 - RNA, 19 nt, Homo sapiens
aggguguaauggagcauca

SEQ ID NO: 571699 - RNA, 15 nt, Homo sapiens
agggugugugcuagc

SEQ ID NO: 571700 - RNA, 23 nt, Homo sapiens
aggguuaacccuucaucuuccug

SEQ ID NO: 571701 - RNA, 16 nt, Homo sapiens
aggguuaaggccugaa

SEQ ID NO: 571702 - RNA, 23 nt, Homo sapiens
aggguugcuucugagugguguuu

SEQ ID NO: 571703 - RNA, 23 nt, Homo sapiens
aggguuggguucaucugagcaag

SEQ ID NO: 571704 - RNA, 20 nt, Homo sapiens
aggguuucaccauguugccc

SEQ ID NO: 571705 - RNA, 17 nt, Homo sapiens
aggguuuguaauacuuu

SEQ ID NO: 571706 - RNA, 14 nt, Homo sapiens
agguaaaaacugga

SEQ ID NO: 571707 - RNA, 12 nt, Homo sapiens
agguaacaaagg

SEQ ID NO: 571708 - RNA, 15 nt, Homo sapiens
agguaacacuacaga

SEQ ID NO: 571709 - RNA, 14 nt, Homo sapiens
agguaacuacugcu

SEQ ID NO: 571710 - RNA, 21 nt, Homo sapiens
agguaauaauaaagguugagu

SEQ ID NO: 571711 - RNA, 15 nt, Homo sapiens
agguacaaguggcug

SEQ ID NO: 571712 - RNA, 16 nt, Homo sapiens
agguacagcagaaagg

SEQ ID NO: 571713 - RNA, 20 nt, Homo sapiens
agguagacuuuuaauaucac

SEQ ID NO: 571714 - RNA, 15 nt, Homo sapiens
agguagagucauuca

SEQ ID NO: 571715 - RNA, 20 nt, Homo sapiens
agguagugauuaacugugaa

SEQ ID NO: 571716 - RNA, 16 nt, Homo sapiens
agguaguuaagggaug

SEQ ID NO: 571717 - RNA, 21 nt, Homo sapiens
agguauaccuguugagacuga

SEQ ID NO: 571718 - RNA, 20 nt, Homo sapiens
agguauauaaauuuucccaa

SEQ ID NO: 571719 - RNA, 19 nt, Homo sapiens
agguaucuguuuaacauuu

SEQ ID NO: 571720 - RNA, 20 nt, Homo sapiens
agguauuacacaagccaaaa

SEQ ID NO: 571721 - RNA, 15 nt, Homo sapiens
agguauuacacucug

SEQ ID NO: 571722 - RNA, 16 nt, Homo sapiens
agguauuggggaacag

SEQ ID NO: 571723 - RNA, 20 nt, Homo sapiens
agguauuucuccaguuggga

SEQ ID NO: 571724 - RNA, 21 nt, Homo sapiens
aggucaaagcaaguuucauca

SEQ ID NO: 571725 - RNA, 20 nt, Homo sapiens
aggucacuuuaccucugugg

SEQ ID NO: 571726 - RNA, 21 nt, Homo sapiens
aggucagagcagagguggaaa

SEQ ID NO: 571727 - RNA, 15 nt, Homo sapiens
aggucaggaguucga

SEQ ID NO: 571728 - RNA, 23 nt, Homo sapiens
aggucaggaguucgagaccagcc

SEQ ID NO: 571729 - RNA, 21 nt, Homo sapiens
aggucaguaaugcugcaggaa

SEQ ID NO: 571730 - RNA, 11 nt, Homo sapiens
aggucaguggg

SEQ ID NO: 571731 - RNA, 23 nt, Homo sapiens
aauuaggaagugcagaagcacau

SEQ ID NO: 571732 - RNA, 21 nt, Homo sapiens
aauuaggagaggcagagauag

SEQ ID NO: 571733 - RNA, 15 nt, Homo sapiens
aauuaggcuguaacu

SEQ ID NO: 571734 - RNA, 16 nt, Homo sapiens
aauuagggaugcucaa

SEQ ID NO: 571735 - RNA, 13 nt, Homo sapiens
aauuagucacugc

SEQ ID NO: 571736 - RNA, 20 nt, Homo sapiens
aauuaguucagccauugugg

SEQ ID NO: 571737 - RNA, 19 nt, Homo sapiens
aauuaguuuauauuacucu

SEQ ID NO: 571738 - RNA, 21 nt, Homo sapiens
aauuauaagcauacaacugga

SEQ ID NO: 571739 - RNA, 14 nt, Homo sapiens
aauuauaaucucuu

SEQ ID NO: 571740 - RNA, 22 nt, Homo sapiens
aauuauacagauagaguuccau

SEQ ID NO: 571741 - RNA, 22 nt, Homo sapiens
aauuauacuguagcugaugaaa

SEQ ID NO: 571742 - RNA, 20 nt, Homo sapiens
aauuauagaaacaauacugu

SEQ ID NO: 571743 - RNA, 15 nt, Homo sapiens
aauuauaucacuuca

SEQ ID NO: 571744 - RNA, 21 nt, Homo sapiens
aauuauaucacuucacuguuc

SEQ ID NO: 571745 - RNA, 21 nt, Homo sapiens
aauuauauuaaagaaccaaaa

SEQ ID NO: 571746 - RNA, 19 nt, Homo sapiens
aauuauccauuacgugcau

SEQ ID NO: 571747 - RNA, 18 nt, Homo sapiens
aauuaucggaagcagugc

SEQ ID NO: 571748 - RNA, 14 nt, Homo sapiens
aauuaucuauagcu

SEQ ID NO: 571749 - RNA, 22 nt, Homo sapiens
aauuaugaaaacucaugaucaa

SEQ ID NO: 571750 - RNA, 12 nt, Homo sapiens
aauuaugcaaau

SEQ ID NO: 571751 - RNA, 12 nt, Homo sapiens
aauuaugccaua

SEQ ID NO: 571752 - RNA, 13 nt, Homo sapiens
aauuaugugcaaa

SEQ ID NO: 571753 - RNA, 13 nt, Homo sapiens
aauuauugcuuaa

SEQ ID NO: 571754 - RNA, 19 nt, Homo sapiens
aauuauuguagacaugccc

SEQ ID NO: 571755 - RNA, 21 nt, Homo sapiens
aauuauuuauuacuugugcac

SEQ ID NO: 571756 - RNA, 12 nt, Homo sapiens
aauuauuugacu

SEQ ID NO: 571757 - RNA, 17 nt, Homo sapiens
aauuauuuuucacucua

SEQ ID NO: 571758 - RNA, 14 nt, Homo sapiens
aauucaaacauauu

SEQ ID NO: 571759 - RNA, 23 nt, Homo sapiens
aggugagccugggcagcuucugu

SEQ ID NO: 571760 - RNA, 21 nt, Homo sapiens
aggugagugcuugucauggaa

SEQ ID NO: 571761 - RNA, 23 nt, Homo sapiens
aggugagugugagggcagcacug

SEQ ID NO: 571762 - RNA, 20 nt, Homo sapiens
aggugauccacccaccucag

SEQ ID NO: 571763 - RNA, 19 nt, Homo sapiens
aggugauccacccaccucg

SEQ ID NO: 571764 - RNA, 21 nt, Homo sapiens
aggugaugcucuggcuugccc

SEQ ID NO: 571765 - RNA, 14 nt, Homo sapiens
aggugcacugcuuu

SEQ ID NO: 571766 - RNA, 17 nt, Homo sapiens
aggugcagccccagggc

SEQ ID NO: 571767 - RNA, 14 nt, Homo sapiens
aggugccacuccag

SEQ ID NO: 571768 - RNA, 17 nt, Homo sapiens
aggugccacuccagugc

SEQ ID NO: 571769 - RNA, 19 nt, Homo sapiens
aggugccaucucaggagaa

SEQ ID NO: 571770 - RNA, 19 nt, Homo sapiens
aggugccucauagcauagc

SEQ ID NO: 571771 - RNA, 17 nt, Homo sapiens
aggugccugcucaggug

SEQ ID NO: 571772 - RNA, 20 nt, Homo sapiens
aggugccuggccaugucacc

SEQ ID NO: 571773 - RNA, 21 nt, Homo sapiens
aggugcgaaugacaguagcau

SEQ ID NO: 571774 - RNA, 21 nt, Homo sapiens
aggugcuauguucuuagugga

SEQ ID NO: 571775 - RNA, 15 nt, Homo sapiens
aggugcucauccuca

SEQ ID NO: 571776 - RNA, 16 nt, Homo sapiens
aggugcuuauucucaa

SEQ ID NO: 571777 - RNA, 14 nt, Homo sapiens
aggugcuuggcucu

SEQ ID NO: 571778 - RNA, 22 nt, Homo sapiens
agguggaaacuccugugucugu

SEQ ID NO: 571779 - RNA, 17 nt, Homo sapiens
agguggagacccugaga

SEQ ID NO: 571780 - RNA, 17 nt, Homo sapiens
agguggagguugugcau

SEQ ID NO: 571781 - RNA, 22 nt, Homo sapiens
agguggauuccgaguggugaca

SEQ ID NO: 571782 - RNA, 14 nt, Homo sapiens
agguggcaaaguac

SEQ ID NO: 571783 - RNA, 18 nt, Homo sapiens
agguggcagagugaaugu

SEQ ID NO: 571784 - RNA, 20 nt, Homo sapiens
agguggccacagugucacug

SEQ ID NO: 571785 - RNA, 15 nt, Homo sapiens
agguggccacuccag

SEQ ID NO: 571786 - RNA, 23 nt, Homo sapiens
agguggcccuuguuuacagugag

SEQ ID NO: 571787 - RNA, 16 nt, Homo sapiens
agguggccuccuggcc

SEQ ID NO: 571788 - RNA, 15 nt, Homo sapiens
aggugggaggaucac

SEQ ID NO: 571789 - RNA, 20 nt, Homo sapiens
aggugggaggauugcuugag

SEQ ID NO: 571790 - RNA, 16 nt, Homo sapiens
aggugggaggguggca

SEQ ID NO: 571791 - RNA, 20 nt, Homo sapiens
aggugggcagaucacuggag

SEQ ID NO: 571792 - RNA, 21 nt, Homo sapiens
aggugggcaugccacccucac

SEQ ID NO: 571793 - RNA, 14 nt, Homo sapiens
aggugggguuucac

SEQ ID NO: 571794 - RNA, 14 nt, Homo sapiens
agguggguccagga

SEQ ID NO: 571795 - RNA, 23 nt, Homo sapiens
agguggguccaggaaggcagcug

SEQ ID NO: 571796 - RNA, 12 nt, Homo sapiens
aggugggucuac

SEQ ID NO: 571797 - RNA, 20 nt, Homo sapiens
aggugggucuaccucaucuc

SEQ ID NO: 571798 - RNA, 12 nt, Homo sapiens
aggugggugcug

SEQ ID NO: 571799 - RNA, 13 nt, Homo sapiens
aggugggugcugc

SEQ ID NO: 571800 - RNA, 15 nt, Homo sapiens
agguggugaggcaau

SEQ ID NO: 571801 - RNA, 15 nt, Homo sapiens
aggugguucucuuca

SEQ ID NO: 571802 - RNA, 22 nt, Homo sapiens
aggugguuggguucugccuuua

SEQ ID NO: 571803 - RNA, 17 nt, Homo sapiens
agguguaacacuuguca

SEQ ID NO: 571804 - RNA, 16 nt, Homo sapiens
aggugucucuuucauc

SEQ ID NO: 571805 - RNA, 10 nt, Homo sapiens
aggugucuga

SEQ ID NO: 571806 - RNA, 15 nt, Homo sapiens
aggugucugccuuca

SEQ ID NO: 571807 - RNA, 15 nt, Homo sapiens
aggugugacuugaac

SEQ ID NO: 571808 - RNA, 20 nt, Homo sapiens
aggugugagccaccgugccc

SEQ ID NO: 571809 - RNA, 16 nt, Homo sapiens
aggugugagccacugc

SEQ ID NO: 571810 - RNA, 20 nt, Homo sapiens
aggugugcaccaccaugccc

SEQ ID NO: 571811 - RNA, 16 nt, Homo sapiens
aggugugcccuguaca

SEQ ID NO: 571812 - RNA, 14 nt, Homo sapiens
agguguggcuucaa

SEQ ID NO: 571813 - RNA, 23 nt, Homo sapiens
agguguggggacacagcagugag

SEQ ID NO: 571814 - RNA, 18 nt, Homo sapiens
agguguguccuugaacug

SEQ ID NO: 571815 - RNA, 16 nt, Homo sapiens
agguguuacuagaagg

SEQ ID NO: 571816 - RNA, 16 nt, Homo sapiens
agguguucaagaccag

SEQ ID NO: 571817 - RNA, 16 nt, Homo sapiens
agguguugccaaauau

SEQ ID NO: 571818 - RNA, 20 nt, Homo sapiens
agguuaaaaaaaaaagucac

SEQ ID NO: 571819 - RNA, 16 nt, Homo sapiens
agguuaaacugaagca

SEQ ID NO: 571820 - RNA, 19 nt, Homo sapiens
agguuaagcagccugccau

SEQ ID NO: 571821 - RNA, 12 nt, Homo sapiens
agguuagggcau

SEQ ID NO: 571822 - RNA, 15 nt, Homo sapiens
agguuauacuccucc

SEQ ID NO: 571823 - RNA, 18 nt, Homo sapiens
agguuauugcaauaaagu

SEQ ID NO: 571824 - RNA, 16 nt, Homo sapiens
agguucagcugaagcu

SEQ ID NO: 571825 - RNA, 17 nt, Homo sapiens
agguucaggaagaccac

SEQ ID NO: 571826 - RNA, 13 nt, Homo sapiens
agguucauggauu

SEQ ID NO: 571827 - RNA, 18 nt, Homo sapiens
agguucauggauuacuuc

SEQ ID NO: 571828 - RNA, 18 nt, Homo sapiens
agguuccacagaggacac

SEQ ID NO: 571829 - RNA, 13 nt, Homo sapiens
agguuccccagag

SEQ ID NO: 571830 - RNA, 18 nt, Homo sapiens
agguucggacuaacauuu

SEQ ID NO: 571831 - RNA, 19 nt, Homo sapiens
agguucucagguguugcca

SEQ ID NO: 571832 - RNA, 22 nt, Homo sapiens
agguucuucagaagucacacau

SEQ ID NO: 571833 - RNA, 22 nt, Homo sapiens
agguucuugaugucauguacuu

SEQ ID NO: 571834 - RNA, 13 nt, Homo sapiens
agguucuugccuu

SEQ ID NO: 571835 - RNA, 14 nt, Homo sapiens
agguucuuuccaug

SEQ ID NO: 571836 - RNA, 17 nt, Homo sapiens
agguugaaaagacaaua

SEQ ID NO: 571837 - RNA, 13 nt, Homo sapiens
agguugcagugag

SEQ ID NO: 571838 - RNA, 21 nt, Homo sapiens
agguugcagugagcugagauc

SEQ ID NO: 571839 - RNA, 16 nt, Homo sapiens
agguugccugaaaaau

SEQ ID NO: 571840 - RNA, 17 nt, Homo sapiens
agguuggauccaaggag

SEQ ID NO: 571841 - RNA, 16 nt, Homo sapiens
agguuggcaccccagc

SEQ ID NO: 571842 - RNA, 19 nt, Homo sapiens
agguugggcuggugcucac

SEQ ID NO: 571843 - RNA, 22 nt, Homo sapiens
agguuggugaauuucacaagcu

SEQ ID NO: 571844 - RNA, 21 nt, Homo sapiens
agguugucugaagucacugca

SEQ ID NO: 571845 - RNA, 23 nt, Homo sapiens
agguugucugaagucacugcaca

SEQ ID NO: 571846 - RNA, 17 nt, Homo sapiens
agguuguggagaaaaag

SEQ ID NO: 571847 - RNA, 16 nt, Homo sapiens
agguuuagaugugcaa

SEQ ID NO: 571848 - RNA, 20 nt, Homo sapiens
agguuuccucuuagguguua

SEQ ID NO: 571849 - RNA, 13 nt, Homo sapiens
agguuuccugccu

SEQ ID NO: 571850 - RNA, 21 nt, Homo sapiens
agguuuccuuuuggaacauuu

SEQ ID NO: 571851 - RNA, 13 nt, Homo sapiens
agguuucuauucg

SEQ ID NO: 571852 - RNA, 14 nt, Homo sapiens
agguuugcacuucc

SEQ ID NO: 571853 - RNA, 22 nt, Homo sapiens
acauuaucaucugaaaaucugg

SEQ ID NO: 571854 - RNA, 14 nt, Homo sapiens
acauuaugccuuaa

SEQ ID NO: 571855 - RNA, 15 nt, Homo sapiens
acauuauuagcacuu

SEQ ID NO: 571856 - RNA, 12 nt, Homo sapiens
acauuauuccaa

SEQ ID NO: 571857 - RNA, 14 nt, Homo sapiens
acauucacacaggg

SEQ ID NO: 571858 - RNA, 12 nt, Homo sapiens
acauucagaaaa

SEQ ID NO: 571859 - RNA, 13 nt, Homo sapiens
acauucagugaaa

SEQ ID NO: 571860 - RNA, 17 nt, Homo sapiens
acauuccaggaaaccau

SEQ ID NO: 571861 - RNA, 14 nt, Homo sapiens
acauucccacugcc

SEQ ID NO: 571862 - RNA, 21 nt, Homo sapiens
acauucccaugguggccucaa

SEQ ID NO: 571863 - RNA, 15 nt, Homo sapiens
acauuccccagagug

SEQ ID NO: 571864 - RNA, 12 nt, Homo sapiens
acauuccuugag

SEQ ID NO: 571865 - RNA, 20 nt, Homo sapiens
acauucuaaaggcuugauau

SEQ ID NO: 571866 - RNA, 15 nt, Homo sapiens
acauucuaauuugca

SEQ ID NO: 571867 - RNA, 19 nt, Homo sapiens
acauucuaugcuuacagaa

SEQ ID NO: 571868 - RNA, 14 nt, Homo sapiens
acauucucuuccca

SEQ ID NO: 571869 - RNA, 19 nt, Homo sapiens
acauucuggaaaagcaaaa

SEQ ID NO: 571870 - RNA, 18 nt, Homo sapiens
acauucuggaucugaccc

SEQ ID NO: 571871 - RNA, 14 nt, Homo sapiens
acauucuguuaauc

SEQ ID NO: 571872 - RNA, 19 nt, Homo sapiens
acauucuuaaauauuucca

SEQ ID NO: 571873 - RNA, 12 nt, Homo sapiens
acauucuuggcu

SEQ ID NO: 571874 - RNA, 22 nt, Homo sapiens
acauucuuuuucuguugaaacu

SEQ ID NO: 571875 - RNA, 20 nt, Homo sapiens
acauucuuuuuucuauucaa

SEQ ID NO: 571876 - RNA, 11 nt, Homo sapiens
acauugaacaa

SEQ ID NO: 571877 - RNA, 13 nt, Homo sapiens
acauugagguucc

SEQ ID NO: 571878 - RNA, 22 nt, Homo sapiens
acauugauuugcucuuacuaca

SEQ ID NO: 571879 - RNA, 19 nt, Homo sapiens
acauugccuucuggagcug

SEQ ID NO: 571880 - RNA, 16 nt, Homo sapiens
acauugcugauaugca

SEQ ID NO: 571881 - RNA, 16 nt, Homo sapiens
acauugcuugugccac

SEQ ID NO: 571882 - RNA, 20 nt, Homo sapiens
acauugcuugugccacaccc

SEQ ID NO: 571883 - RNA, 21 nt, Homo sapiens
acauuguccuguagcuuuaaa

SEQ ID NO: 571884 - RNA, 12 nt, Homo sapiens
acauugugccuu

SEQ ID NO: 571885 - RNA, 13 nt, Homo sapiens
acauugugcuugg

SEQ ID NO: 571886 - RNA, 23 nt, Homo sapiens
acauugugucagauuaccaguua

SEQ ID NO: 571887 - RNA, 22 nt, Homo sapiens
acauuuaauacagcagugucau

SEQ ID NO: 571888 - RNA, 13 nt, Homo sapiens
acauuuacaauaa

SEQ ID NO: 571889 - RNA, 14 nt, Homo sapiens
acauuuagaacuuu

SEQ ID NO: 571890 - RNA, 18 nt, Homo sapiens
acauuuagccaaucuuuc

SEQ ID NO: 571891 - RNA, 14 nt, Homo sapiens
acauuuaugaccua

SEQ ID NO: 571892 - RNA, 17 nt, Homo sapiens
acauuuccgcuguccgu

SEQ ID NO: 571893 - RNA, 15 nt, Homo sapiens
acauuucuaacucua

SEQ ID NO: 571894 - RNA, 17 nt, Homo sapiens
acauuucuaugccaaac

SEQ ID NO: 571895 - RNA, 14 nt, Homo sapiens
acauuucugacacc

SEQ ID NO: 571896 - RNA, 14 nt, Homo sapiens
acauuucugcacau

SEQ ID NO: 571897 - RNA, 23 nt, Homo sapiens
acauuugacuugaaccacaagug

SEQ ID NO: 571898 - RNA, 19 nt, Homo sapiens
acauuugauguacaugugu

SEQ ID NO: 571899 - RNA, 12 nt, Homo sapiens
acauuugccuua

SEQ ID NO: 571900 - RNA, 19 nt, Homo sapiens
acauuugcuccauccuccu

SEQ ID NO: 571901 - RNA, 22 nt, Homo sapiens
auacugaaaacuuuuaaggugg

SEQ ID NO: 571902 - RNA, 15 nt, Homo sapiens
auacugaaagaucuc

SEQ ID NO: 571903 - RNA, 17 nt, Homo sapiens
auacugaccuaccucaa

SEQ ID NO: 571904 - RNA, 13 nt, Homo sapiens
auacugagccugc

SEQ ID NO: 571905 - RNA, 17 nt, Homo sapiens
auacugagccugccaaa

SEQ ID NO: 571906 - RNA, 19 nt, Homo sapiens
auacugcaauuaaagugau

SEQ ID NO: 571907 - RNA, 17 nt, Homo sapiens
auacugccggucaccca

SEQ ID NO: 571908 - RNA, 19 nt, Homo sapiens
auacugcucaucauuccuu

SEQ ID NO: 571909 - RNA, 22 nt, Homo sapiens
auacugcuugaccguacucuca

SEQ ID NO: 571910 - RNA, 16 nt, Homo sapiens
auacuggacucaggaa

SEQ ID NO: 571911 - RNA, 17 nt, Homo sapiens
auacuggucucaggcca

SEQ ID NO: 571912 - RNA, 22 nt, Homo sapiens
auacuguaaaugcauuggaaua

SEQ ID NO: 571913 - RNA, 19 nt, Homo sapiens
auacuguaacauucaggaa

SEQ ID NO: 571914 - RNA, 14 nt, Homo sapiens
auacuguucacuca

SEQ ID NO: 571915 - RNA, 23 nt, Homo sapiens
auacuguugauacaaaccacugu

SEQ ID NO: 571916 - RNA, 18 nt, Homo sapiens
auacuuacuauaauuuga

SEQ ID NO: 571917 - RNA, 13 nt, Homo sapiens
auacuuagauuag

SEQ ID NO: 571918 - RNA, 21 nt, Homo sapiens
auacuucaugaaauccugggu

SEQ ID NO: 571919 - RNA, 21 nt, Homo sapiens
auacuugauaguuuggcuaua

SEQ ID NO: 571920 - RNA, 17 nt, Homo sapiens
auacuugcaguugugau

SEQ ID NO: 571921 - RNA, 15 nt, Homo sapiens
auacuuggaccucag

SEQ ID NO: 571922 - RNA, 19 nt, Homo sapiens
auacuuggaugcagcucuu

SEQ ID NO: 571923 - RNA, 16 nt, Homo sapiens
auacuuguauucccuu

SEQ ID NO: 571924 - RNA, 13 nt, Homo sapiens
auacuuuacaugg

SEQ ID NO: 571925 - RNA, 14 nt, Homo sapiens
auacuuucagucaa

SEQ ID NO: 571926 - RNA, 22 nt, Homo sapiens
auacuuugcagcacagcugaga

SEQ ID NO: 571927 - RNA, 15 nt, Homo sapiens
auacuuuugcugaug

SEQ ID NO: 571928 - RNA, 19 nt, Homo sapiens
auacuuuuggcuccucuag

SEQ ID NO: 571929 - RNA, 21 nt, Homo sapiens
auacuuuugugaacaaaaauu

SEQ ID NO: 571930 - RNA, 18 nt, Homo sapiens
auacuuuuuuucacaguu

SEQ ID NO: 571931 - RNA, 18 nt, Homo sapiens
auagaaacaauacuguuc

SEQ ID NO: 571932 - RNA, 15 nt, Homo sapiens
auagaaacuugcuua

SEQ ID NO: 571933 - RNA, 17 nt, Homo sapiens
auagaaacuugcuuauc

SEQ ID NO: 571934 - RNA, 13 nt, Homo sapiens
auagaaagcuaua

SEQ ID NO: 571935 - RNA, 16 nt, Homo sapiens
auagaaagcuguuuau

SEQ ID NO: 571936 - RNA, 23 nt, Homo sapiens
auagaaauguaaaaguacucuga

SEQ ID NO: 571937 - RNA, 15 nt, Homo sapiens
auagaacacaguuug

SEQ ID NO: 571938 - RNA, 13 nt, Homo sapiens
auagaacacugcc

SEQ ID NO: 571939 - RNA, 12 nt, Homo sapiens
auagaacaucca

SEQ ID NO: 571940 - RNA, 14 nt, Homo sapiens
auagaacauccaga

SEQ ID NO: 571941 - RNA, 19 nt, Homo sapiens
auagaagaugaaucauuga

SEQ ID NO: 571942 - RNA, 15 nt, Homo sapiens
auagaaguagcaaaa

SEQ ID NO: 571943 - RNA, 14 nt, Homo sapiens
auagaauacaugga

SEQ ID NO: 571944 - RNA, 21 nt, Homo sapiens
auagaaugagcacccauucca

SEQ ID NO: 571945 - RNA, 16 nt, Homo sapiens
auagaauuuccaauau

SEQ ID NO: 571946 - RNA, 17 nt, Homo sapiens
auagacacuugcuccca

SEQ ID NO: 571947 - RNA, 17 nt, Homo sapiens
auagacaucaguauucu

SEQ ID NO: 571948 - RNA, 23 nt, Homo sapiens
auagaccucucaauuucuggaaa

SEQ ID NO: 571949 - RNA, 22 nt, Homo sapiens
auagacuguaacuuccaaauaa

SEQ ID NO: 571950 - RNA, 15 nt, Homo sapiens
auagacuuaauacau

SEQ ID NO: 571951 - RNA, 15 nt, Homo sapiens
auagacuucucuuac

SEQ ID NO: 571952 - RNA, 23 nt, Homo sapiens
auagacuugcaccuuaugucaug

SEQ ID NO: 571953 - RNA, 19 nt, Homo sapiens
auagagaauuuagaaauga

SEQ ID NO: 571954 - RNA, 14 nt, Homo sapiens
auagaggcuagcuu

SEQ ID NO: 571955 - RNA, 12 nt, Homo sapiens
auagaggcuucu

SEQ ID NO: 571956 - RNA, 18 nt, Homo sapiens
auagaguaaauacaggua

SEQ ID NO: 571957 - RNA, 16 nt, Homo sapiens
auagagugucucaggg

SEQ ID NO: 571958 - RNA, 17 nt, Homo sapiens
auagagugucucagggu

SEQ ID NO: 571959 - RNA, 19 nt, Homo sapiens
auagauaaagcugauuugu

SEQ ID NO: 571960 - RNA, 20 nt, Homo sapiens
auagauauaugcucugcaug

SEQ ID NO: 571961 - RNA, 23 nt, Homo sapiens
auagaucagcaaaccggggccua

SEQ ID NO: 571962 - RNA, 20 nt, Homo sapiens
auagauccuaagccauaaaa

SEQ ID NO: 571963 - RNA, 12 nt, Homo sapiens
auagaugacaaa

SEQ ID NO: 571964 - RNA, 14 nt, Homo sapiens
auagaugguguaug

SEQ ID NO: 571965 - RNA, 16 nt, Homo sapiens
auagauuuaaagaaua

SEQ ID NO: 571966 - RNA, 19 nt, Homo sapiens
auagauuucuacacugagg

SEQ ID NO: 571967 - RNA, 20 nt, Homo sapiens
auagauuucuacacugaggu

SEQ ID NO: 571968 - RNA, 12 nt, Homo sapiens
auagcaagugaa

SEQ ID NO: 571969 - RNA, 14 nt, Homo sapiens
auagcaagugaaag

SEQ ID NO: 571970 - RNA, 15 nt, Homo sapiens
auagcaagugaaagc

SEQ ID NO: 571971 - RNA, 23 nt, Homo sapiens
auagcaccccuacucacauacac

SEQ ID NO: 571972 - RNA, 18 nt, Homo sapiens
auagcagaugguuuccac

SEQ ID NO: 571973 - RNA, 14 nt, Homo sapiens
auagcauacugugu

SEQ ID NO: 571974 - RNA, 13 nt, Homo sapiens
auagcaucucagg

SEQ ID NO: 571975 - RNA, 16 nt, Homo sapiens
auagcauuuguuuaag

SEQ ID NO: 571976 - RNA, 17 nt, Homo sapiens
accaaguuaucaucuca

SEQ ID NO: 571977 - RNA, 19 nt, Homo sapiens
accaauagcaucugugcca

SEQ ID NO: 571978 - RNA, 15 nt, Homo sapiens
accaaugagccuuag

SEQ ID NO: 571979 - RNA, 14 nt, Homo sapiens
accaaugccaaaaa

SEQ ID NO: 571980 - RNA, 19 nt, Homo sapiens
accaauggauuguggaaaa

SEQ ID NO: 571981 - RNA, 14 nt, Homo sapiens
accaauguccuugu

SEQ ID NO: 571982 - RNA, 21 nt, Homo sapiens
accaauguccuuguggucuuu

SEQ ID NO: 571983 - RNA, 13 nt, Homo sapiens
accaaugucuuga

SEQ ID NO: 571984 - RNA, 13 nt, Homo sapiens
accaauguucucu

SEQ ID NO: 571985 - RNA, 20 nt, Homo sapiens
accaauucuggacagacaga

SEQ ID NO: 571986 - RNA, 17 nt, Homo sapiens
accaauugugcugccau

SEQ ID NO: 571987 - RNA, 16 nt, Homo sapiens
accacaaaacuuuucu

SEQ ID NO: 571988 - RNA, 18 nt, Homo sapiens
accacaaggcuguugcau

SEQ ID NO: 571989 - RNA, 18 nt, Homo sapiens
accacaauaccacuauca

SEQ ID NO: 571990 - RNA, 15 nt, Homo sapiens
accacacauauugca

SEQ ID NO: 571991 - RNA, 17 nt, Homo sapiens
accacacuagaauucau

SEQ ID NO: 571992 - RNA, 15 nt, Homo sapiens
accacacuucuugaa

SEQ ID NO: 571993 - RNA, 22 nt, Homo sapiens
accacagaaaucacagucaaug

SEQ ID NO: 571994 - RNA, 18 nt, Homo sapiens
accacagagccucgggac

SEQ ID NO: 571995 - RNA, 21 nt, Homo sapiens
accacagagggcgugugcucg

SEQ ID NO: 571996 - RNA, 19 nt, Homo sapiens
accacagaugugucuggga

SEQ ID NO: 571997 - RNA, 18 nt, Homo sapiens
accacagauucagacuug

SEQ ID NO: 571998 - RNA, 11 nt, Homo sapiens
accacagcagc

SEQ ID NO: 571999 - RNA, 17 nt, Homo sapiens
accacagugaauccaga

SEQ ID NO: 572000 - RNA, 13 nt, Homo sapiens
accacagugucug

SEQ ID NO: 572001 - RNA, 16 nt, Homo sapiens
accacauagcaugagg

SEQ ID NO: 572002 - RNA, 17 nt, Homo sapiens
accacauccuccgucca

SEQ ID NO: 572003 - RNA, 14 nt, Homo sapiens
accacaucugccag

SEQ ID NO: 572004 - RNA, 19 nt, Homo sapiens
accacauguguuucugucu

SEQ ID NO: 572005 - RNA, 11 nt, Homo sapiens
accaccaaagu

SEQ ID NO: 572006 - RNA, 21 nt, Homo sapiens
accaccccaacaaaccaucca

SEQ ID NO: 572007 - RNA, 22 nt, Homo sapiens
accaccccccacccuccuccag

SEQ ID NO: 572008 - RNA, 16 nt, Homo sapiens
accaccccuuccuguc

SEQ ID NO: 572009 - RNA, 12 nt, Homo sapiens
accacccuagca

SEQ ID NO: 572010 - RNA, 19 nt, Homo sapiens
accaccgaaucccuagucc

SEQ ID NO: 572011 - RNA, 15 nt, Homo sapiens
accaccucaccaguu

SEQ ID NO: 572012 - RNA, 11 nt, Homo sapiens
accaccuccaa

SEQ ID NO: 572013 - RNA, 17 nt, Homo sapiens
accacgauucucccaaa

SEQ ID NO: 572014 - RNA, 19 nt, Homo sapiens
accacgcaugcucagugcc

SEQ ID NO: 572015 - RNA, 22 nt, Homo sapiens
accacgccucuugaccaggcug

SEQ ID NO: 572016 - RNA, 20 nt, Homo sapiens
accacggaggaugaugccag

SEQ ID NO: 572017 - RNA, 20 nt, Homo sapiens
accacguccucgaauucuca

SEQ ID NO: 572018 - RNA, 17 nt, Homo sapiens
accacuagaacucucca

SEQ ID NO: 572019 - RNA, 12 nt, Homo sapiens
accacucugucu

SEQ ID NO: 572020 - RNA, 21 nt, Homo sapiens
accacugacagcuagacaccu

SEQ ID NO: 572021 - RNA, 22 nt, Homo sapiens
accacugcccccugcugccaug

SEQ ID NO: 572022 - RNA, 11 nt, Homo sapiens
accacugccug

SEQ ID NO: 572023 - RNA, 20 nt, Homo sapiens
accacugcugauauuuucuc

SEQ ID NO: 572024 - RNA, 19 nt, Homo sapiens
accacuggccaccaggcug

SEQ ID NO: 572025 - RNA, 18 nt, Homo sapiens
auagugccagguggcuca

SEQ ID NO: 572026 - RNA, 16 nt, Homo sapiens
auaguggagagaacug

SEQ ID NO: 572027 - RNA, 20 nt, Homo sapiens
auagugggcaccccacugca

SEQ ID NO: 572028 - RNA, 19 nt, Homo sapiens
auagugucaccaauuccac

SEQ ID NO: 572029 - RNA, 22 nt, Homo sapiens
auagugucauccucacagugaa

SEQ ID NO: 572030 - RNA, 10 nt, Homo sapiens
auagugucuu

SEQ ID NO: 572031 - RNA, 16 nt, Homo sapiens
auaguguuaacuguca

SEQ ID NO: 572032 - RNA, 12 nt, Homo sapiens
auaguguugcuu

SEQ ID NO: 572033 - RNA, 16 nt, Homo sapiens
auaguguuggaaaaug

SEQ ID NO: 572034 - RNA, 14 nt, Homo sapiens
auaguuaagacaug

SEQ ID NO: 572035 - RNA, 21 nt, Homo sapiens
auaguuacugcugcacuuuca

SEQ ID NO: 572036 - RNA, 15 nt, Homo sapiens
auaguuaugccugua

SEQ ID NO: 572037 - RNA, 11 nt, Homo sapiens
auaguucuucu

SEQ ID NO: 572038 - RNA, 22 nt, Homo sapiens
auaguuuaggaaaaugagagga

SEQ ID NO: 572039 - RNA, 22 nt, Homo sapiens
auaguuuguuuuuaaacuaaua

SEQ ID NO: 572040 - RNA, 16 nt, Homo sapiens
auaguuuugaauccuu

SEQ ID NO: 572041 - RNA, 18 nt, Homo sapiens
auaguuuuguuuguuaga

SEQ ID NO: 572042 - RNA, 15 nt, Homo sapiens
auauaaaacagucau

SEQ ID NO: 572043 - RNA, 20 nt, Homo sapiens
auauaaaauguuuaaucucu

SEQ ID NO: 572044 - RNA, 13 nt, Homo sapiens
auauaaacauauu

SEQ ID NO: 572045 - RNA, 21 nt, Homo sapiens
auauaaagguggugggcaaaa

SEQ ID NO: 572046 - RNA, 14 nt, Homo sapiens
auauaaaucucaau

SEQ ID NO: 572047 - RNA, 21 nt, Homo sapiens
auauaaaugugauugcagcuu

SEQ ID NO: 572048 - RNA, 18 nt, Homo sapiens
auauaaauucuaagccau

SEQ ID NO: 572049 - RNA, 20 nt, Homo sapiens
auauaacaagugggugaaug

SEQ ID NO: 572050 - RNA, 12 nt, Homo sapiens
auauaacaugua

SEQ ID NO: 572051 - RNA, 16 nt, Homo sapiens
auauaacauguguaug

SEQ ID NO: 572052 - RNA, 18 nt, Homo sapiens
auauaacauucaguuccc

SEQ ID NO: 572053 - RNA, 13 nt, Homo sapiens
auauaagcucaau

SEQ ID NO: 572054 - RNA, 18 nt, Homo sapiens
auauaaggaaagcaauaa

SEQ ID NO: 572055 - RNA, 19 nt, Homo sapiens
auauaaguuuacaccuuua

SEQ ID NO: 572056 - RNA, 14 nt, Homo sapiens
auauaauacuguau

SEQ ID NO: 572057 - RNA, 15 nt, Homo sapiens
auauaauacuguauu

SEQ ID NO: 572058 - RNA, 20 nt, Homo sapiens
auauaauguauuuucagcuc

SEQ ID NO: 572059 - RNA, 16 nt, Homo sapiens
auauaauguugccagc

SEQ ID NO: 572060 - RNA, 19 nt, Homo sapiens
auauaauucccaagcuuuu

SEQ ID NO: 572061 - RNA, 16 nt, Homo sapiens
auauacaaaacuuuau

SEQ ID NO: 572062 - RNA, 10 nt, Homo sapiens
auauacaaau

SEQ ID NO: 572063 - RNA, 12 nt, Homo sapiens
auauacaaauag

SEQ ID NO: 572064 - RNA, 15 nt, Homo sapiens
auauacacacagugg

SEQ ID NO: 572065 - RNA, 22 nt, Homo sapiens
auauaccacucuuuaccuuuau

SEQ ID NO: 572066 - RNA, 17 nt, Homo sapiens
auauaccugguuuacuu

SEQ ID NO: 572067 - RNA, 21 nt, Homo sapiens
auauacuauuuucauucucuu

SEQ ID NO: 572068 - RNA, 22 nt, Homo sapiens
auauacucuucgauguacuugu

SEQ ID NO: 572069 - RNA, 22 nt, Homo sapiens
auauacugcuugucaucugcau

SEQ ID NO: 572070 - RNA, 20 nt, Homo sapiens
auauagagaauaaggcacaa

SEQ ID NO: 572071 - RNA, 21 nt, Homo sapiens
auauagauuguccuuuugcaa

SEQ ID NO: 572072 - RNA, 17 nt, Homo sapiens
auauagccaaaaauguc

SEQ ID NO: 572073 - RNA, 18 nt, Homo sapiens
auauagcuaggugacaua

SEQ ID NO: 572074 - RNA, 23 nt, Homo sapiens
auauaggccagaguugcaaagau

SEQ ID NO: 572075 - RNA, 23 nt, Homo sapiens
auauaggcuucucacggcgacca

SEQ ID NO: 572076 - RNA, 16 nt, Homo sapiens
auauagguugugcaaa

SEQ ID NO: 572077 - RNA, 12 nt, Homo sapiens
auauaguucugu

SEQ ID NO: 572078 - RNA, 13 nt, Homo sapiens
auauauaauacug

SEQ ID NO: 572079 - RNA, 21 nt, Homo sapiens
auauauacacauacauacaca

SEQ ID NO: 572080 - RNA, 13 nt, Homo sapiens
auauauacaggca

SEQ ID NO: 572081 - RNA, 13 nt, Homo sapiens
auauauauuacaa

SEQ ID NO: 572082 - RNA, 12 nt, Homo sapiens
auauauauucac

SEQ ID NO: 572083 - RNA, 12 nt, Homo sapiens
auauaugaccag

SEQ ID NO: 572084 - RNA, 23 nt, Homo sapiens
auauaugauauauaaaugugauu

SEQ ID NO: 572085 - RNA, 17 nt, Homo sapiens
auauaugcacuauguau

SEQ ID NO: 572086 - RNA, 16 nt, Homo sapiens
auauauggggggccaa

SEQ ID NO: 572087 - RNA, 20 nt, Homo sapiens
auauauguaucuacaauaca

SEQ ID NO: 572088 - RNA, 20 nt, Homo sapiens
auauauguguauacauacau

SEQ ID NO: 572089 - RNA, 20 nt, Homo sapiens
auauauguguuuuucacauu

SEQ ID NO: 572090 - RNA, 19 nt, Homo sapiens
auauauuauuuuacugcuu

SEQ ID NO: 572091 - RNA, 13 nt, Homo sapiens
auauauucaagag

SEQ ID NO: 572092 - RNA, 12 nt, Homo sapiens
auauauucccaa

SEQ ID NO: 572093 - RNA, 21 nt, Homo sapiens
auauauucugguuauaguucu

SEQ ID NO: 572094 - RNA, 13 nt, Homo sapiens
auauauuucacuu

SEQ ID NO: 572095 - RNA, 18 nt, Homo sapiens
auauauuuuucugagauu

SEQ ID NO: 572096 - RNA, 21 nt, Homo sapiens
auauauuuuugguugucaaua

SEQ ID NO: 572097 - RNA, 23 nt, Homo sapiens
auauauuuuugguugucaauauu

SEQ ID NO: 572098 - RNA, 21 nt, Homo sapiens
accaucuccagcuauuuacac

SEQ ID NO: 572099 - RNA, 13 nt, Homo sapiens
accaucugauuaa

SEQ ID NO: 572100 - RNA, 13 nt, Homo sapiens
accaucuuggcca

SEQ ID NO: 572101 - RNA, 23 nt, Homo sapiens
accaugaaacauuguagguauau

SEQ ID NO: 572102 - RNA, 22 nt, Homo sapiens
accaugaauacacuuacaguua

SEQ ID NO: 572103 - RNA, 14 nt, Homo sapiens
accaugacccuaca

SEQ ID NO: 572104 - RNA, 16 nt, Homo sapiens
accaugacgcacugcu

SEQ ID NO: 572105 - RNA, 14 nt, Homo sapiens
accaugacuuccuc

SEQ ID NO: 572106 - RNA, 16 nt, Homo sapiens
accaugacuuccucac

SEQ ID NO: 572107 - RNA, 21 nt, Homo sapiens
accaugagaccacuguuauca

SEQ ID NO: 572108 - RNA, 24 nt, Homo sapiens
accaugauuaaccacuucagcuga

SEQ ID NO: 572109 - RNA, 19 nt, Homo sapiens
accaugcaaaugucuucca

SEQ ID NO: 572110 - RNA, 18 nt, Homo sapiens
accaugcacuauauuugu

SEQ ID NO: 572111 - RNA, 20 nt, Homo sapiens
accaugccccugagcaaugu

SEQ ID NO: 572112 - RNA, 18 nt, Homo sapiens
accaugccuuccucagua

SEQ ID NO: 572113 - RNA, 14 nt, Homo sapiens
accauggacacuac

SEQ ID NO: 572114 - RNA, 23 nt, Homo sapiens
accauggggaagaaaucuggucu

SEQ ID NO: 572115 - RNA, 18 nt, Homo sapiens
accaugguuuuggcucuc

SEQ ID NO: 572116 - RNA, 21 nt, Homo sapiens
accauguaauggcaguuauau

SEQ ID NO: 572117 - RNA, 13 nt, Homo sapiens
accauguacauga

SEQ ID NO: 572118 - RNA, 14 nt, Homo sapiens
accaugucacugug

SEQ ID NO: 572119 - RNA, 13 nt, Homo sapiens
accaugugcaaua

SEQ ID NO: 572120 - RNA, 15 nt, Homo sapiens
accauuacauguuua

SEQ ID NO: 572121 - RNA, 13 nt, Homo sapiens
accauuaccaaaa

SEQ ID NO: 572122 - RNA, 19 nt, Homo sapiens
accauucagaucacugaau

SEQ ID NO: 572123 - RNA, 13 nt, Homo sapiens
accauucaggaca

SEQ ID NO: 572124 - RNA, 16 nt, Homo sapiens
accauuccaacuucaa

SEQ ID NO: 572125 - RNA, 19 nt, Homo sapiens
accauuccaggaaaacugg

SEQ ID NO: 572126 - RNA, 22 nt, Homo sapiens
accauuccugccuuuaagccaa

SEQ ID NO: 572127 - RNA, 17 nt, Homo sapiens
accauugaccucagcug

SEQ ID NO: 572128 - RNA, 19 nt, Homo sapiens
accauugaccucagcugca

SEQ ID NO: 572129 - RNA, 13 nt, Homo sapiens
accauugcccuag

SEQ ID NO: 572130 - RNA, 10 nt, Homo sapiens
accauuugca

SEQ ID NO: 572131 - RNA, 12 nt, Homo sapiens
accauuugcacu

SEQ ID NO: 572132 - RNA, 22 nt, Homo sapiens
accauuuuaguuuuaauuccau

SEQ ID NO: 572133 - RNA, 23 nt, Homo sapiens
acccaaaacacgcacacccugcc

SEQ ID NO: 572134 - RNA, 22 nt, Homo sapiens
acccaaaagaaacugacaugcc

SEQ ID NO: 572135 - RNA, 20 nt, Homo sapiens
acccaaacacuucugcuuuc

SEQ ID NO: 572136 - RNA, 20 nt, Homo sapiens
acccaaagccugucccagga

SEQ ID NO: 572137 - RNA, 14 nt, Homo sapiens
acccaaaguaucag

SEQ ID NO: 572138 - RNA, 13 nt, Homo sapiens
acccaaauuauaa

SEQ ID NO: 572139 - RNA, 13 nt, Homo sapiens
acccaacagcagu

SEQ ID NO: 572140 - RNA, 23 nt, Homo sapiens
acccaacagcagugaucucaggg

SEQ ID NO: 572141 - RNA, 22 nt, Homo sapiens
acccaaccugacuuccucugcc

SEQ ID NO: 572142 - RNA, 15 nt, Homo sapiens
acccaacuugccaaa

SEQ ID NO: 572143 - RNA, 15 nt, Homo sapiens
acccaagaagggcac

SEQ ID NO: 572144 - RNA, 22 nt, Homo sapiens
acccaagccugauccagccuuu

SEQ ID NO: 572145 - RNA, 19 nt, Homo sapiens
acccaagugccucaccucg

SEQ ID NO: 572146 - RNA, 20 nt, Homo sapiens
acccaagugccucaccucga

SEQ ID NO: 572147 - RNA, 22 nt, Homo sapiens
acccaauaaaacugauguuacu

SEQ ID NO: 572148 - RNA, 13 nt, Homo sapiens
acccaaucugccu

SEQ ID NO: 572149 - RNA, 19 nt, Homo sapiens
auaugccucauacacauaa

SEQ ID NO: 572150 - RNA, 14 nt, Homo sapiens
auaugcuccugccu

SEQ ID NO: 572151 - RNA, 14 nt, Homo sapiens
auaugcugccaaau

SEQ ID NO: 572152 - RNA, 17 nt, Homo sapiens
auaugcuguacaugaca

SEQ ID NO: 572153 - RNA, 22 nt, Homo sapiens
auaugcuuauacacuguuggug

SEQ ID NO: 572154 - RNA, 19 nt, Homo sapiens
auaugcuucacauagcaug

SEQ ID NO: 572155 - RNA, 18 nt, Homo sapiens
auaugcuuguaacuaaaa

SEQ ID NO: 572156 - RNA, 15 nt, Homo sapiens
auaugguagagcaau

SEQ ID NO: 572157 - RNA, 15 nt, Homo sapiens
auauguaaagcacau

SEQ ID NO: 572158 - RNA, 18 nt, Homo sapiens
auauguaaguacuuccac

SEQ ID NO: 572159 - RNA, 22 nt, Homo sapiens
auauguaauuucaaaauacauu

SEQ ID NO: 572160 - RNA, 14 nt, Homo sapiens
auauguacagcucu

SEQ ID NO: 572161 - RNA, 14 nt, Homo sapiens
auauguagauguau

SEQ ID NO: 572162 - RNA, 20 nt, Homo sapiens
auauguagcuuuauccuuag

SEQ ID NO: 572163 - RNA, 22 nt, Homo sapiens
auauguaggugucugcacccag

SEQ ID NO: 572164 - RNA, 14 nt, Homo sapiens
auauguauauacau

SEQ ID NO: 572165 - RNA, 18 nt, Homo sapiens
auauguauauacauauca

SEQ ID NO: 572166 - RNA, 12 nt, Homo sapiens
auauguauauau

SEQ ID NO: 572167 - RNA, 22 nt, Homo sapiens
auauguauauuuuaauagaauu

SEQ ID NO: 572168 - RNA, 23 nt, Homo sapiens
auauguaugcaccucaaggucau

SEQ ID NO: 572169 - RNA, 18 nt, Homo sapiens
auauguaugccugcaaua

SEQ ID NO: 572170 - RNA, 19 nt, Homo sapiens
auaugucacgaacuugaaa

SEQ ID NO: 572171 - RNA, 23 nt, Homo sapiens
auaugugggugucagucagggac

SEQ ID NO: 572172 - RNA, 16 nt, Homo sapiens
auauguuggaaaaaag

SEQ ID NO: 572173 - RNA, 16 nt, Homo sapiens
auauuaaaauagcaua

SEQ ID NO: 572174 - RNA, 23 nt, Homo sapiens
auauuaaaauagcauacugugua

SEQ ID NO: 572175 - RNA, 15 nt, Homo sapiens
auauuaacacgcugc

SEQ ID NO: 572176 - RNA, 21 nt, Homo sapiens
auauuaaggaagacaauguga

SEQ ID NO: 572177 - RNA, 17 nt, Homo sapiens
auauuaauaaucuuggc

SEQ ID NO: 572178 - RNA, 21 nt, Homo sapiens
auauuacuuguuuucacuuua

SEQ ID NO: 572179 - RNA, 15 nt, Homo sapiens
auauuagaucaaaua

SEQ ID NO: 572180 - RNA, 12 nt, Homo sapiens
auauuagcuuua

SEQ ID NO: 572181 - RNA, 22 nt, Homo sapiens
auauuaucacgcagaucacuaa

SEQ ID NO: 572182 - RNA, 21 nt, Homo sapiens
auauuaucuacaaacacugca

SEQ ID NO: 572183 - RNA, 15 nt, Homo sapiens
auauuauuccaaagu

SEQ ID NO: 572184 - RNA, 13 nt, Homo sapiens
auauuauugauuc

SEQ ID NO: 572185 - RNA, 18 nt, Homo sapiens
auauuauuguaaccaaua

SEQ ID NO: 572186 - RNA, 17 nt, Homo sapiens
auauucauuuccacucu

SEQ ID NO: 572187 - RNA, 18 nt, Homo sapiens
auauuccauccauauacu

SEQ ID NO: 572188 - RNA, 13 nt, Homo sapiens
auauuccugcauu

SEQ ID NO: 572189 - RNA, 20 nt, Homo sapiens
auauuccuuuuucuaugaaa

SEQ ID NO: 572190 - RNA, 18 nt, Homo sapiens
auauucuauuaacuuuaa

SEQ ID NO: 572191 - RNA, 16 nt, Homo sapiens
auauucuuaacagauc

SEQ ID NO: 572192 - RNA, 15 nt, Homo sapiens
auauucuucuaccac

SEQ ID NO: 572193 - RNA, 13 nt, Homo sapiens
auauucuugucaa

SEQ ID NO: 572194 - RNA, 23 nt, Homo sapiens
auauucuuguccacauucuacuu

SEQ ID NO: 572195 - RNA, 17 nt, Homo sapiens
auauucuuuccucaaaa

SEQ ID NO: 572196 - RNA, 17 nt, Homo sapiens
auauucuuugguuguga

SEQ ID NO: 572197 - RNA, 16 nt, Homo sapiens
auauugacuuguuaca

SEQ ID NO: 572198 - RNA, 21 nt, Homo sapiens
auauugagcagaauucauuca

SEQ ID NO: 572199 - RNA, 19 nt, Homo sapiens
auauugauaaaaccauaca

SEQ ID NO: 572200 - RNA, 12 nt, Homo sapiens
auauugcaaaau

SEQ ID NO: 572201 - RNA, 11 nt, Homo sapiens
auauugcuaaa

SEQ ID NO: 572202 - RNA, 16 nt, Homo sapiens
auauuguaaauacugg

SEQ ID NO: 572203 - RNA, 15 nt, Homo sapiens
auauuguacauaaaa

SEQ ID NO: 572204 - RNA, 21 nt, Homo sapiens
auauuguauacuaccauagug

SEQ ID NO: 572205 - RNA, 13 nt, Homo sapiens
auauuguccugcu

SEQ ID NO: 572206 - RNA, 22 nt, Homo sapiens
auauugucugaacggcugaaua

SEQ ID NO: 572207 - RNA, 12 nt, Homo sapiens
auauugugauuc

SEQ ID NO: 572208 - RNA, 13 nt, Homo sapiens
auauugugcaaac

SEQ ID NO: 572209 - RNA, 14 nt, Homo sapiens
auauugugcaauaa

SEQ ID NO: 572210 - RNA, 21 nt, Homo sapiens
auauuguugacaacugugacu

SEQ ID NO: 572211 - RNA, 12 nt, Homo sapiens
auauuguugccg

SEQ ID NO: 572212 - RNA, 16 nt, Homo sapiens
auauuguuuucagugu

SEQ ID NO: 572213 - RNA, 16 nt, Homo sapiens
auauuuaaaacaucau

SEQ ID NO: 572214 - RNA, 14 nt, Homo sapiens
auauuuaacaugua

SEQ ID NO: 572215 - RNA, 22 nt, Homo sapiens
auauuuaacuggugcacuuugu

SEQ ID NO: 572216 - RNA, 16 nt, Homo sapiens
auauuuaagugaagga

SEQ ID NO: 572217 - RNA, 15 nt, Homo sapiens
auauuuaauauguca

SEQ ID NO: 572218 - RNA, 18 nt, Homo sapiens
auauuuaauggcaaugca

SEQ ID NO: 572219 - RNA, 18 nt, Homo sapiens
auauuuaauuaaagcaca

SEQ ID NO: 572220 - RNA, 19 nt, Homo sapiens
aucacugccaucacaucac

SEQ ID NO: 572221 - RNA, 19 nt, Homo sapiens
aucacugcgccacugcucc

SEQ ID NO: 572222 - RNA, 16 nt, Homo sapiens
aucacuguacuuguag

SEQ ID NO: 572223 - RNA, 21 nt, Homo sapiens
aucacuguauagacaugcuac

SEQ ID NO: 572224 - RNA, 20 nt, Homo sapiens
aucacuuaaacuugcaucac

SEQ ID NO: 572225 - RNA, 18 nt, Homo sapiens
aucacuucacuguucucu

SEQ ID NO: 572226 - RNA, 17 nt, Homo sapiens
aucacuucuuccacugu

SEQ ID NO: 572227 - RNA, 17 nt, Homo sapiens
aucacuugcacuccgga

SEQ ID NO: 572228 - RNA, 14 nt, Homo sapiens
aucacuuuuuggaa

SEQ ID NO: 572229 - RNA, 15 nt, Homo sapiens
aucagaaggugacaa

SEQ ID NO: 572230 - RNA, 13 nt, Homo sapiens
aucagaauauuaa

SEQ ID NO: 572231 - RNA, 17 nt, Homo sapiens
aucagaaucauugaagu

SEQ ID NO: 572232 - RNA, 16 nt, Homo sapiens
aucagaccauaauguu

SEQ ID NO: 572233 - RNA, 24 nt, Homo sapiens
aucagaccugucuuccaaggagac

SEQ ID NO: 572234 - RNA, 13 nt, Homo sapiens
aucagacuaguga

SEQ ID NO: 572235 - RNA, 13 nt, Homo sapiens
aucagagaacuuu

SEQ ID NO: 572236 - RNA, 15 nt, Homo sapiens
aucagagacuaugua

SEQ ID NO: 572237 - RNA, 24 nt, Homo sapiens
aucagagagcugcccuucagcgau

SEQ ID NO: 572238 - RNA, 19 nt, Homo sapiens
aucagaggaaauucuuucc

SEQ ID NO: 572239 - RNA, 15 nt, Homo sapiens
aucagagggugacug

SEQ ID NO: 572240 - RNA, 21 nt, Homo sapiens
aucagauccgugcgugaagua

SEQ ID NO: 572241 - RNA, 13 nt, Homo sapiens
aucagaugaacuc

SEQ ID NO: 572242 - RNA, 12 nt, Homo sapiens
aucagauuuauu

SEQ ID NO: 572243 - RNA, 19 nt, Homo sapiens
aucagcacuuuaaccaaug

SEQ ID NO: 572244 - RNA, 17 nt, Homo sapiens
aucagcaggaaugcucu

SEQ ID NO: 572245 - RNA, 20 nt, Homo sapiens
aucagcaucucuucuucccu

SEQ ID NO: 572246 - RNA, 22 nt, Homo sapiens
aucagcaugaaaaugcaguuuc

SEQ ID NO: 572247 - RNA, 15 nt, Homo sapiens
aucagccacauucua

SEQ ID NO: 572248 - RNA, 14 nt, Homo sapiens
aucagccagucuca

SEQ ID NO: 572249 - RNA, 19 nt, Homo sapiens
aucagccccgcuccucccc

SEQ ID NO: 572250 - RNA, 16 nt, Homo sapiens
aucagccccugggaac

SEQ ID NO: 572251 - RNA, 23 nt, Homo sapiens
aucagcuauuuugugaagccaug

SEQ ID NO: 572252 - RNA, 14 nt, Homo sapiens
aucagcugcuacua

SEQ ID NO: 572253 - RNA, 13 nt, Homo sapiens
aucagcugcugac

SEQ ID NO: 572254 - RNA, 19 nt, Homo sapiens
aucagcuggacauacugcu

SEQ ID NO: 572255 - RNA, 20 nt, Homo sapiens
aucaggccuggcacgguggc

SEQ ID NO: 572256 - RNA, 19 nt, Homo sapiens
aucagggccuuucuccucc

SEQ ID NO: 572257 - RNA, 15 nt, Homo sapiens
aucaggggccagaga

SEQ ID NO: 572258 - RNA, 22 nt, Homo sapiens
aucagggguuagggugcaagaa

SEQ ID NO: 572259 - RNA, 22 nt, Homo sapiens
aucaggucauuauuuuuuacaa

SEQ ID NO: 572260 - RNA, 12 nt, Homo sapiens
aucaggucuccc

SEQ ID NO: 572261 - RNA, 18 nt, Homo sapiens
aucaguaaauaacuggaa

SEQ ID NO: 572262 - RNA, 23 nt, Homo sapiens
aucaguaguguacauuaccauau

SEQ ID NO: 572263 - RNA, 13 nt, Homo sapiens
aucagucaugugu

SEQ ID NO: 572264 - RNA, 18 nt, Homo sapiens
aucagucuccaacauguu

SEQ ID NO: 572265 - RNA, 20 nt, Homo sapiens
aucagugaagccaaagggac

SEQ ID NO: 572266 - RNA, 19 nt, Homo sapiens
aucagugaauaaaccauca

SEQ ID NO: 572267 - RNA, 14 nt, Homo sapiens
aucagugcagugau

SEQ ID NO: 572268 - RNA, 13 nt, Homo sapiens
aucagugcauuuu

SEQ ID NO: 572269 - RNA, 15 nt, Homo sapiens
aucaguguaugcgaa

SEQ ID NO: 572270 - RNA, 15 nt, Homo sapiens
aucaguguuaccguu

SEQ ID NO: 572271 - RNA, 14 nt, Homo sapiens
aucaguguuuuaga

SEQ ID NO: 572272 - RNA, 15 nt, Homo sapiens
aucaguuacuaagaa

SEQ ID NO: 572273 - RNA, 16 nt, Homo sapiens
aucaguuauaugauau

SEQ ID NO: 572274 - RNA, 20 nt, Homo sapiens
aucaguucccccaguaccuc

SEQ ID NO: 572275 - RNA, 16 nt, Homo sapiens
acccucagcacuguua

SEQ ID NO: 572276 - RNA, 18 nt, Homo sapiens
acccucaggucacaagag

SEQ ID NO: 572277 - RNA, 14 nt, Homo sapiens
acccucaggugccu

SEQ ID NO: 572278 - RNA, 14 nt, Homo sapiens
acccucauacacag

SEQ ID NO: 572279 - RNA, 14 nt, Homo sapiens
acccucccaaaaca

SEQ ID NO: 572280 - RNA, 19 nt, Homo sapiens
acccucccacucccaucuc

SEQ ID NO: 572281 - RNA, 19 nt, Homo sapiens
acccuccuaauagucauac

SEQ ID NO: 572282 - RNA, 18 nt, Homo sapiens
acccuccuuccacaugua

SEQ ID NO: 572283 - RNA, 19 nt, Homo sapiens
acccuccuuccacauguac

SEQ ID NO: 572284 - RNA, 20 nt, Homo sapiens
acccuccuugggacugaagg

SEQ ID NO: 572285 - RNA, 19 nt, Homo sapiens
acccucgcaugacuguuac

SEQ ID NO: 572286 - RNA, 18 nt, Homo sapiens
acccucgcccaacuccac

SEQ ID NO: 572287 - RNA, 14 nt, Homo sapiens
acccucggaaauca

SEQ ID NO: 572288 - RNA, 20 nt, Homo sapiens
acccucuaucccaauaggca

SEQ ID NO: 572289 - RNA, 13 nt, Homo sapiens
acccucuccagca

SEQ ID NO: 572290 - RNA, 17 nt, Homo sapiens
acccucuuccugugauc

SEQ ID NO: 572291 - RNA, 15 nt, Homo sapiens
acccucuuugcugca

SEQ ID NO: 572292 - RNA, 22 nt, Homo sapiens
acccugaucucucagccccaaa

SEQ ID NO: 572293 - RNA, 16 nt, Homo sapiens
acccugcaacuucuau

SEQ ID NO: 572294 - RNA, 15 nt, Homo sapiens
acccugcaagaccac

SEQ ID NO: 572295 - RNA, 20 nt, Homo sapiens
acccugccaggcugcuaaag

SEQ ID NO: 572296 - RNA, 16 nt, Homo sapiens
acccugccccuugcca

SEQ ID NO: 572297 - RNA, 17 nt, Homo sapiens
acccugccugcaccucc

SEQ ID NO: 572298 - RNA, 15 nt, Homo sapiens
acccugcgccuccag

SEQ ID NO: 572299 - RNA, 21 nt, Homo sapiens
acccugcucauccacucuacu

SEQ ID NO: 572300 - RNA, 19 nt, Homo sapiens
acccugcuucucccgggga

SEQ ID NO: 572301 - RNA, 18 nt, Homo sapiens
acccugcuuuuugcuucu

SEQ ID NO: 572302 - RNA, 15 nt, Homo sapiens
acccuggaguucuug

SEQ ID NO: 572303 - RNA, 14 nt, Homo sapiens
acccugggaccaca

SEQ ID NO: 572304 - RNA, 23 nt, Homo sapiens
acccugggcuguccagccuuaau

SEQ ID NO: 572305 - RNA, 20 nt, Homo sapiens
acccuggggauaguccuucc

SEQ ID NO: 572306 - RNA, 18 nt, Homo sapiens
acccuguccuuugcaauu

SEQ ID NO: 572307 - RNA, 18 nt, Homo sapiens
acccuguuuucagcuaaa

SEQ ID NO: 572308 - RNA, 17 nt, Homo sapiens
acccuuaucaccagcug

SEQ ID NO: 572309 - RNA, 13 nt, Homo sapiens
acccuucaacucc

SEQ ID NO: 572310 - RNA, 13 nt, Homo sapiens
acccuuccaucag

SEQ ID NO: 572311 - RNA, 20 nt, Homo sapiens
acccuucccgccucccucuc

SEQ ID NO: 572312 - RNA, 22 nt, Homo sapiens
acccuucccugcacuaaagcca

SEQ ID NO: 572313 - RNA, 21 nt, Homo sapiens
acccuugacaccugcugagaa

SEQ ID NO: 572314 - RNA, 15 nt, Homo sapiens
acccuugagcucaag

SEQ ID NO: 572315 - RNA, 15 nt, Homo sapiens
acccuugcugugaau

SEQ ID NO: 572316 - RNA, 19 nt, Homo sapiens
acccuuggagccaauggag

SEQ ID NO: 572317 - RNA, 11 nt, Homo sapiens
acccuuggcac

SEQ ID NO: 572318 - RNA, 22 nt, Homo sapiens
acccuuugccuuucuucugccc

SEQ ID NO: 572319 - RNA, 15 nt, Homo sapiens
acccuuugcugugag

SEQ ID NO: 572320 - RNA, 21 nt, Homo sapiens
acccuuuggccccacuuugaa

SEQ ID NO: 572321 - RNA, 12 nt, Homo sapiens
acccuuuuccau

SEQ ID NO: 572322 - RNA, 17 nt, Homo sapiens
accgagucuugcucugu

SEQ ID NO: 572323 - RNA, 12 nt, Homo sapiens
accgagugcaau

SEQ ID NO: 572324 - RNA, 13 nt, Homo sapiens
accgagugcaaug

SEQ ID NO: 572325 - RNA, 17 nt, Homo sapiens
accgcccaucaggguuc

SEQ ID NO: 572326 - RNA, 18 nt, Homo sapiens
accgccuggcccucugug

SEQ ID NO: 572327 - RNA, 18 nt, Homo sapiens
accgcgugauaaaacugg

SEQ ID NO: 572328 - RNA, 21 nt, Homo sapiens
accgcuuguggggacccaggc

SEQ ID NO: 572329 - RNA, 18 nt, Homo sapiens
accggcucucaccuggcc

SEQ ID NO: 572330 - RNA, 21 nt, Homo sapiens
accgggaggacagcugccugu

SEQ ID NO: 572331 - RNA, 15 nt, Homo sapiens
accgggcugggagcu

SEQ ID NO: 572332 - RNA, 21 nt, Homo sapiens
accggggaggcggagguugca

SEQ ID NO: 572333 - RNA, 16 nt, Homo sapiens
accgggguucaagcca

SEQ ID NO: 572334 - RNA, 21 nt, Homo sapiens
accgguggggcugguucugua

SEQ ID NO: 572335 - RNA, 14 nt, Homo sapiens
accgguuugcuaca

SEQ ID NO: 572336 - RNA, 15 nt, Homo sapiens
accguaaauguccau

SEQ ID NO: 572337 - RNA, 14 nt, Homo sapiens
accguacuguggaa

SEQ ID NO: 572338 - RNA, 14 nt, Homo sapiens
accguauacuuaaa

SEQ ID NO: 572339 - RNA, 19 nt, Homo sapiens
accguauccauaaagaccc

SEQ ID NO: 572340 - RNA, 13 nt, Homo sapiens
accguaucucagg

SEQ ID NO: 572341 - RNA, 17 nt, Homo sapiens
accgucacccaacauca

SEQ ID NO: 572342 - RNA, 15 nt, Homo sapiens
aagcagauacuugag

SEQ ID NO: 572343 - RNA, 21 nt, Homo sapiens
aagcagccacgaggugcaaca

SEQ ID NO: 572344 - RNA, 20 nt, Homo sapiens
aagcagcucacggaacugga

SEQ ID NO: 572345 - RNA, 12 nt, Homo sapiens
aagcagcugcag

SEQ ID NO: 572346 - RNA, 15 nt, Homo sapiens
aagcaggaaagggag

SEQ ID NO: 572347 - RNA, 21 nt, Homo sapiens
aagcaggcuugcccaguacau

SEQ ID NO: 572348 - RNA, 11 nt, Homo sapiens
aagcagggaaa

SEQ ID NO: 572349 - RNA, 16 nt, Homo sapiens
aagcagggaauuccug

SEQ ID NO: 572350 - RNA, 15 nt, Homo sapiens
aagcaggguacccuu

SEQ ID NO: 572351 - RNA, 13 nt, Homo sapiens
aagcaggugcuac

SEQ ID NO: 572352 - RNA, 22 nt, Homo sapiens
aagcaguagcauuugcuuccuc

SEQ ID NO: 572353 - RNA, 14 nt, Homo sapiens
aagcagucgugccu

SEQ ID NO: 572354 - RNA, 20 nt, Homo sapiens
aagcagucgugccugugucc

SEQ ID NO: 572355 - RNA, 16 nt, Homo sapiens
aagcagucucacugca

SEQ ID NO: 572356 - RNA, 15 nt, Homo sapiens
aagcagugcacauuu

SEQ ID NO: 572357 - RNA, 22 nt, Homo sapiens
aagcagugggguugggaccuca

SEQ ID NO: 572358 - RNA, 13 nt, Homo sapiens
aagcauacuucua

SEQ ID NO: 572359 - RNA, 14 nt, Homo sapiens
aagcauacuuugua

SEQ ID NO: 572360 - RNA, 16 nt, Homo sapiens
aagcaucauuucccca

SEQ ID NO: 572361 - RNA, 23 nt, Homo sapiens
aagcaucauuuccccaacagggc

SEQ ID NO: 572362 - RNA, 22 nt, Homo sapiens
aagcaucuagguuuuugauaau

SEQ ID NO: 572363 - RNA, 24 nt, Homo sapiens
aagcaucucagccuaccaugagaa

SEQ ID NO: 572364 - RNA, 15 nt, Homo sapiens
aagcaucuggcucua

SEQ ID NO: 572365 - RNA, 18 nt, Homo sapiens
aagcaugaaacauuucag

SEQ ID NO: 572366 - RNA, 22 nt, Homo sapiens
aagcaugaucuuguuacuguga

SEQ ID NO: 572367 - RNA, 13 nt, Homo sapiens
aagcauguagcca

SEQ ID NO: 572368 - RNA, 16 nt, Homo sapiens
aagcauguagccaguu

SEQ ID NO: 572369 - RNA, 14 nt, Homo sapiens
aagcaugucucucu

SEQ ID NO: 572370 - RNA, 18 nt, Homo sapiens
aagcaugucucugcuucc

SEQ ID NO: 572371 - RNA, 17 nt, Homo sapiens
aagcauuccugcucaag

SEQ ID NO: 572372 - RNA, 19 nt, Homo sapiens
aagcauucugagcugggcu

SEQ ID NO: 572373 - RNA, 11 nt, Homo sapiens
aagcauuguuu

SEQ ID NO: 572374 - RNA, 18 nt, Homo sapiens
aagcauuucuagcaguga

SEQ ID NO: 572375 - RNA, 21 nt, Homo sapiens
aagcauuugcaacagcuacag

SEQ ID NO: 572376 - RNA, 22 nt, Homo sapiens
aagcauuuggugccuauuugaa

SEQ ID NO: 572377 - RNA, 19 nt, Homo sapiens
aagcauuuuaaaugucagu

SEQ ID NO: 572378 - RNA, 23 nt, Homo sapiens
aagcauuuuaaaugucaguuaca

SEQ ID NO: 572379 - RNA, 19 nt, Homo sapiens
aagccaaagagccucccac

SEQ ID NO: 572380 - RNA, 15 nt, Homo sapiens
aagccaaauuuccag

SEQ ID NO: 572381 - RNA, 18 nt, Homo sapiens
aagccaacaacucugccu

SEQ ID NO: 572382 - RNA, 21 nt, Homo sapiens
aagccacaucuugcucugcau

SEQ ID NO: 572383 - RNA, 15 nt, Homo sapiens
aagccacucuguccc

SEQ ID NO: 572384 - RNA, 12 nt, Homo sapiens
aagccacugccu

SEQ ID NO: 572385 - RNA, 23 nt, Homo sapiens
aagccagaugugaaaacaucuca

SEQ ID NO: 572386 - RNA, 13 nt, Homo sapiens
aagccagcacuca

SEQ ID NO: 572387 - RNA, 19 nt, Homo sapiens
aagccaggacuauucccuu

SEQ ID NO: 572388 - RNA, 12 nt, Homo sapiens
aagccagggucu

SEQ ID NO: 572389 - RNA, 13 nt, Homo sapiens
aagccaguuuuca

SEQ ID NO: 572390 - RNA, 23 nt, Homo sapiens
aagccauaguggagagaacugaa

SEQ ID NO: 572391 - RNA, 14 nt, Homo sapiens
aagccauauuccag

SEQ ID NO: 572392 - RNA, 17 nt, Homo sapiens
aagccaugggaccuccu

SEQ ID NO: 572393 - RNA, 14 nt, Homo sapiens
aagccauuaugaua

SEQ ID NO: 572394 - RNA, 16 nt, Homo sapiens
aagccauuauucacua

SEQ ID NO: 572395 - RNA, 15 nt, Homo sapiens
aagccauuccaaagu

SEQ ID NO: 572396 - RNA, 18 nt, Homo sapiens
aagccauuucugucucca

SEQ ID NO: 572397 - RNA, 14 nt, Homo sapiens
aagcccaacugggg

SEQ ID NO: 572398 - RNA, 21 nt, Homo sapiens
aagcccaaguucaugcagcug

SEQ ID NO: 572399 - RNA, 21 nt, Homo sapiens
aagcccagcgguucacacagg

SEQ ID NO: 572400 - RNA, 22 nt, Homo sapiens
aagcccaggggccggccagugg

SEQ ID NO: 572401 - RNA, 12 nt, Homo sapiens
aagcccaguuca

SEQ ID NO: 572402 - RNA, 14 nt, Homo sapiens
aagcccaguucauc

SEQ ID NO: 572403 - RNA, 15 nt, Homo sapiens
aagccccacuugaag

SEQ ID NO: 572404 - RNA, 13 nt, Homo sapiens
aagccccgucucu

SEQ ID NO: 572405 - RNA, 21 nt, Homo sapiens
aagcccguuaaauaauucccu

SEQ ID NO: 572406 - RNA, 13 nt, Homo sapiens
aagcccuggcaac

SEQ ID NO: 572407 - RNA, 19 nt, Homo sapiens
aagcccugguaaaagggau

SEQ ID NO: 572408 - RNA, 13 nt, Homo sapiens
aagccgagcucuc

SEQ ID NO: 572409 - RNA, 23 nt, Homo sapiens
aagccuaccguauuucagccaug

SEQ ID NO: 572410 - RNA, 18 nt, Homo sapiens
aagccuagcccuucucuc

SEQ ID NO: 572411 - RNA, 20 nt, Homo sapiens
aagccuagcccuucucucau

SEQ ID NO: 572412 - RNA, 23 nt, Homo sapiens
aagccucagcuacccacuauccu

SEQ ID NO: 572413 - RNA, 16 nt, Homo sapiens
aagccucaucaucaga

SEQ ID NO: 572414 - RNA, 13 nt, Homo sapiens
aagccucauuuga

SEQ ID NO: 572415 - RNA, 12 nt, Homo sapiens
aagccuccgccu

SEQ ID NO: 572416 - RNA, 16 nt, Homo sapiens
aagccucgacugagcu

SEQ ID NO: 572417 - RNA, 21 nt, Homo sapiens
aagccucguuuugaugccauu

SEQ ID NO: 572418 - RNA, 18 nt, Homo sapiens
aagccucuccagcaauaa

SEQ ID NO: 572419 - RNA, 20 nt, Homo sapiens
aagccucucuggcacuuuga

SEQ ID NO: 572420 - RNA, 23 nt, Homo sapiens
aagccucugcgucuuuuuacuca

SEQ ID NO: 572421 - RNA, 22 nt, Homo sapiens
aagccucuggaaaacucaggau

SEQ ID NO: 572422 - RNA, 15 nt, Homo sapiens
aagccuggaagccau

SEQ ID NO: 572423 - RNA, 20 nt, Homo sapiens
aagccuggcccauaauguga

SEQ ID NO: 572424 - RNA, 16 nt, Homo sapiens
aagccugucccaggac

SEQ ID NO: 572425 - RNA, 19 nt, Homo sapiens
aagccugucccaggacuca

SEQ ID NO: 572426 - RNA, 21 nt, Homo sapiens
aagccuguccucaccgucucg

SEQ ID NO: 572427 - RNA, 18 nt, Homo sapiens
aagccugucucuuuccac

SEQ ID NO: 572428 - RNA, 23 nt, Homo sapiens
aagccugucucuuuccacuuugu

SEQ ID NO: 572429 - RNA, 18 nt, Homo sapiens
aagccugucugagacuca

SEQ ID NO: 572430 - RNA, 16 nt, Homo sapiens
aagccuuaagcaaauu

SEQ ID NO: 572431 - RNA, 12 nt, Homo sapiens
aagccuuaggga

SEQ ID NO: 572432 - RNA, 15 nt, Homo sapiens
aagccuuauuuuuca

SEQ ID NO: 572433 - RNA, 14 nt, Homo sapiens
aagccuuccuacac

SEQ ID NO: 572434 - RNA, 20 nt, Homo sapiens
aagcgauccuaucaccucag

SEQ ID NO: 572435 - RNA, 19 nt, Homo sapiens
aagcggaaaguuagugcuu

SEQ ID NO: 572436 - RNA, 15 nt, Homo sapiens
aagcguaauuuugcc

SEQ ID NO: 572437 - RNA, 17 nt, Homo sapiens
aagcguuaugugcagua

SEQ ID NO: 572438 - RNA, 18 nt, Homo sapiens
aagcuaaaauaaagaaau

SEQ ID NO: 572439 - RNA, 15 nt, Homo sapiens
aagcuaaaaugauuu

SEQ ID NO: 572440 - RNA, 16 nt, Homo sapiens
aagcuaacaucuuuac

SEQ ID NO: 572441 - RNA, 19 nt, Homo sapiens
aagcuaauaaaauucgcuu

SEQ ID NO: 572442 - RNA, 19 nt, Homo sapiens
aagcuaauacaauggucau

SEQ ID NO: 572443 - RNA, 14 nt, Homo sapiens
aagcuaaugucaca

SEQ ID NO: 572444 - RNA, 18 nt, Homo sapiens
aagcuaaugucacaauua

SEQ ID NO: 572445 - RNA, 17 nt, Homo sapiens
aagcuaauugugcacau

SEQ ID NO: 572446 - RNA, 22 nt, Homo sapiens
aagcuagauacuggaaaccuaa

SEQ ID NO: 572447 - RNA, 19 nt, Homo sapiens
aagcuagaugccccugcag

SEQ ID NO: 572448 - RNA, 16 nt, Homo sapiens
aagcuagcacuaacuc

SEQ ID NO: 572449 - RNA, 14 nt, Homo sapiens
aagcuaggucgugg

SEQ ID NO: 572450 - RNA, 17 nt, Homo sapiens
aagcuaguguaccuccu

SEQ ID NO: 572451 - RNA, 21 nt, Homo sapiens
aagcuaguguaccuccucuca

SEQ ID NO: 572452 - RNA, 18 nt, Homo sapiens
aagcuaguuaaugucagu

SEQ ID NO: 572453 - RNA, 20 nt, Homo sapiens
aagcuaucagcaauacucau

SEQ ID NO: 572454 - RNA, 13 nt, Homo sapiens
aagcucacaaaua

SEQ ID NO: 572455 - RNA, 16 nt, Homo sapiens
aagcucacugcugauc

SEQ ID NO: 572456 - RNA, 13 nt, Homo sapiens
aagcucagugaua

SEQ ID NO: 572457 - RNA, 15 nt, Homo sapiens
aagcucauaauggaa

SEQ ID NO: 572458 - RNA, 14 nt, Homo sapiens
aagcucaugcauuu

SEQ ID NO: 572459 - RNA, 17 nt, Homo sapiens
aagcucaugcauuucaa

SEQ ID NO: 572460 - RNA, 12 nt, Homo sapiens
aagcuccacugu

SEQ ID NO: 572461 - RNA, 14 nt, Homo sapiens
aagcuccacuguca

SEQ ID NO: 572462 - RNA, 15 nt, Homo sapiens
aagcuccaucaauga

SEQ ID NO: 572463 - RNA, 16 nt, Homo sapiens
aagcucccaccccacu

SEQ ID NO: 572464 - RNA, 14 nt, Homo sapiens
aaggccgggugaca

SEQ ID NO: 572465 - RNA, 17 nt, Homo sapiens
aaggccuuccacugugg

SEQ ID NO: 572466 - RNA, 20 nt, Homo sapiens
aaggcggguggaucacuuga

SEQ ID NO: 572467 - RNA, 19 nt, Homo sapiens
aaaacuacugauacuuuca

SEQ ID NO: 572468 - RNA, 13 nt, Homo sapiens
aaaacuagcauua

SEQ ID NO: 572469 - RNA, 16 nt, Homo sapiens
aaaacuauuugggaua

SEQ ID NO: 572470 - RNA, 12 nt, Homo sapiens
aaaacucaaaac

SEQ ID NO: 572471 - RNA, 14 nt, Homo sapiens
aaaacucacuguga

SEQ ID NO: 572472 - RNA, 22 nt, Homo sapiens
aaaacucccaauggauaaauca

SEQ ID NO: 572473 - RNA, 17 nt, Homo sapiens
aaaacuccccuuccuca

SEQ ID NO: 572474 - RNA, 17 nt, Homo sapiens
aaaacucucauuauuug

SEQ ID NO: 572475 - RNA, 20 nt, Homo sapiens
aaaacucuugauaugaccug

SEQ ID NO: 572476 - RNA, 15 nt, Homo sapiens
aaaacugaaccacaa

SEQ ID NO: 572477 - RNA, 17 nt, Homo sapiens
aaaacugauuuuuagcu

SEQ ID NO: 572478 - RNA, 13 nt, Homo sapiens
aaaacugccaaaa

SEQ ID NO: 572479 - RNA, 18 nt, Homo sapiens
aaaacugcugaacuugac

SEQ ID NO: 572480 - RNA, 16 nt, Homo sapiens
aaaacuggaagcacag

SEQ ID NO: 572481 - RNA, 19 nt, Homo sapiens
aaaacuucaguaaguacgu

SEQ ID NO: 572482 - RNA, 12 nt, Homo sapiens
aaaacuuccuag

SEQ ID NO: 572483 - RNA, 22 nt, Homo sapiens
aaaacuugauguguuaucucuu

SEQ ID NO: 572484 - RNA, 14 nt, Homo sapiens
aaaacuugcugccu

SEQ ID NO: 572485 - RNA, 23 nt, Homo sapiens
aaaacuugguuuguggugcacag

SEQ ID NO: 572486 - RNA, 18 nt, Homo sapiens
aaaacuuuggaaccagac

SEQ ID NO: 572487 - RNA, 17 nt, Homo sapiens
aaaagaaaacaccacua

SEQ ID NO: 572488 - RNA, 23 nt, Homo sapiens
aaaagaaaaucuuuaggcuuuca

SEQ ID NO: 572489 - RNA, 18 nt, Homo sapiens
aaaagaaacacgcacuua

SEQ ID NO: 572490 - RNA, 21 nt, Homo sapiens
aaaagaaagcaaacuuaagaa

SEQ ID NO: 572491 - RNA, 14 nt, Homo sapiens
aacuuacuuccaag

SEQ ID NO: 572492 - RNA, 24 nt, Homo sapiens
aacuuagaaggauggcaucuccau

SEQ ID NO: 572493 - RNA, 20 nt, Homo sapiens
aacuuagaucaucagucacc

SEQ ID NO: 572494 - RNA, 15 nt, Homo sapiens
aacuuagauguuaaa

SEQ ID NO: 572495 - RNA, 16 nt, Homo sapiens
aacuuaggcaugcaca

SEQ ID NO: 572496 - RNA, 13 nt, Homo sapiens
aacuuagugacaa

SEQ ID NO: 572497 - RNA, 17 nt, Homo sapiens
aacuuauaggugaauga

SEQ ID NO: 572498 - RNA, 15 nt, Homo sapiens
aacuuauucucugua

SEQ ID NO: 572499 - RNA, 12 nt, Homo sapiens
aacuucaaagag

SEQ ID NO: 572500 - RNA, 21 nt, Homo sapiens
aacuucaagggacaaguauua

SEQ ID NO: 572501 - RNA, 22 nt, Homo sapiens
aacuucaagggacaaguauuaa

SEQ ID NO: 572502 - RNA, 16 nt, Homo sapiens
aacuucagguggauga

SEQ ID NO: 572503 - RNA, 19 nt, Homo sapiens
aacuucagugugguacaag

SEQ ID NO: 572504 - RNA, 13 nt, Homo sapiens
aacuucauucuaa

SEQ ID NO: 572505 - RNA, 12 nt, Homo sapiens
aacuucauucuc

SEQ ID NO: 572506 - RNA, 19 nt, Homo sapiens
aacuuccacaagagugaau

SEQ ID NO: 572507 - RNA, 15 nt, Homo sapiens
aacuucccugauuga

SEQ ID NO: 572508 - RNA, 23 nt, Homo sapiens
aacuucccugauugaccugcucc

SEQ ID NO: 572509 - RNA, 11 nt, Homo sapiens
aacuuccucag

SEQ ID NO: 572510 - RNA, 18 nt, Homo sapiens
aacuucuccugaaugcau

SEQ ID NO: 572511 - RNA, 20 nt, Homo sapiens
aacuucuccuuagacacuuu

SEQ ID NO: 572512 - RNA, 12 nt, Homo sapiens
aacuucugccuc

SEQ ID NO: 572513 - RNA, 14 nt, Homo sapiens
aacuucugccucua

SEQ ID NO: 572514 - RNA, 18 nt, Homo sapiens
aacuucuugcuucuuucu

SEQ ID NO: 572515 - RNA, 19 nt, Homo sapiens
aacuucuuuccucuggaga

SEQ ID NO: 572516 - RNA, 18 nt, Homo sapiens
aacuugaaaccugggcau

SEQ ID NO: 572517 - RNA, 15 nt, Homo sapiens
aacuugaacugauuc

SEQ ID NO: 572518 - RNA, 18 nt, Homo sapiens
aacuugaaugugucaggu

SEQ ID NO: 572519 - RNA, 21 nt, Homo sapiens
aacuugauuuuuucaaaaaag

SEQ ID NO: 572520 - RNA, 19 nt, Homo sapiens
aacuugcaaugggcagcua

SEQ ID NO: 572521 - RNA, 17 nt, Homo sapiens
aacuugcacuuguuaua

SEQ ID NO: 572522 - RNA, 15 nt, Homo sapiens
aacuugcuacuuauc

SEQ ID NO: 572523 - RNA, 20 nt, Homo sapiens
aacuuggaaugcaagcugga

SEQ ID NO: 572524 - RNA, 18 nt, Homo sapiens
aacuuggcacacucucca

SEQ ID NO: 572525 - RNA, 18 nt, Homo sapiens
aacuuggguucuucucag

SEQ ID NO: 572526 - RNA, 21 nt, Homo sapiens
aacuuguggagagcuuauaca

SEQ ID NO: 572527 - RNA, 20 nt, Homo sapiens
aacuuuauaaggaaauguau

SEQ ID NO: 572528 - RNA, 16 nt, Homo sapiens
aacuuuaucauaugcu

SEQ ID NO: 572529 - RNA, 14 nt, Homo sapiens
aacuuucacuuuga

SEQ ID NO: 572530 - RNA, 22 nt, Homo sapiens
aacuuucagaggcaauagguaa

SEQ ID NO: 572531 - RNA, 15 nt, Homo sapiens
aacuuugaaccauaa

SEQ ID NO: 572532 - RNA, 14 nt, Homo sapiens
aacuuugacuuucu

SEQ ID NO: 572533 - RNA, 18 nt, Homo sapiens
aacuuugccagucuuuaa

SEQ ID NO: 572534 - RNA, 20 nt, Homo sapiens
aacuuuggaguccccucacc

SEQ ID NO: 572535 - RNA, 16 nt, Homo sapiens
aacuuuggcuuucaua

SEQ ID NO: 572536 - RNA, 17 nt, Homo sapiens
aacuuuguaguaugaua

SEQ ID NO: 572537 - RNA, 16 nt, Homo sapiens
aacuuuuauuacuggg

SEQ ID NO: 572538 - RNA, 16 nt, Homo sapiens
aacuuuucgacauauu

SEQ ID NO: 572539 - RNA, 20 nt, Homo sapiens
aacuuuugguaucuacuucu

SEQ ID NO: 572540 - RNA, 17 nt, Homo sapiens
aacuuuuuaauauguaa

SEQ ID NO: 572541 - RNA, 19 nt, Homo sapiens
aacuuuuugcaaggcauuu

SEQ ID NO: 572542 - RNA, 19 nt, Homo sapiens
aacuuuuuuugucuguuga

SEQ ID NO: 572543 - RNA, 15 nt, Homo sapiens
aagaaaaaaaccaua

SEQ ID NO: 572544 - RNA, 22 nt, Homo sapiens
aagaaaaaauucccucauuuaa

SEQ ID NO: 572545 - RNA, 21 nt, Homo sapiens
aagaaaaacaccgcuucugcc

SEQ ID NO: 572546 - RNA, 14 nt, Homo sapiens
aagaaaaauaucuu

SEQ ID NO: 572547 - RNA, 18 nt, Homo sapiens
aagaaaacaccacuaauu

SEQ ID NO: 572548 - RNA, 13 nt, Homo sapiens
aagaaaagcaauc

SEQ ID NO: 572549 - RNA, 17 nt, Homo sapiens
aagaaaagcauuuucag

SEQ ID NO: 572550 - RNA, 13 nt, Homo sapiens
aagaaaauauucu

SEQ ID NO: 572551 - RNA, 19 nt, Homo sapiens
aagaaaaucacauuuccag

SEQ ID NO: 572552 - RNA, 13 nt, Homo sapiens
aagaaaauguucu

SEQ ID NO: 572553 - RNA, 21 nt, Homo sapiens
aagaaaauuccuauaaggaag

SEQ ID NO: 572554 - RNA, 17 nt, Homo sapiens
aagaaacacccuuucau

SEQ ID NO: 572555 - RNA, 16 nt, Homo sapiens
aagaaacagcuuucaa

SEQ ID NO: 572556 - RNA, 16 nt, Homo sapiens
aagaaacaugugagua

SEQ ID NO: 572557 - RNA, 14 nt, Homo sapiens
aagaaacauuucag

SEQ ID NO: 572558 - RNA, 16 nt, Homo sapiens
aagaaacccucuguca

SEQ ID NO: 572559 - RNA, 17 nt, Homo sapiens
aagaaacuaaacagaaa

SEQ ID NO: 572560 - RNA, 13 nt, Homo sapiens
aagaaacuaucaa

SEQ ID NO: 572561 - RNA, 18 nt, Homo sapiens
aagaaagaagacaaacuu

SEQ ID NO: 572562 - RNA, 15 nt, Homo sapiens
aagaaagaucaaaga

SEQ ID NO: 572563 - RNA, 16 nt, Homo sapiens
aagaaagaugaaauaa

SEQ ID NO: 572564 - RNA, 15 nt, Homo sapiens
aagaaauaaugccuc

SEQ ID NO: 572565 - RNA, 14 nt, Homo sapiens
aagaaauacuguac

SEQ ID NO: 572566 - RNA, 20 nt, Homo sapiens
aagaaauagagccaacugau

SEQ ID NO: 572567 - RNA, 16 nt, Homo sapiens
aagaaaucaaaaucca

SEQ ID NO: 572568 - RNA, 23 nt, Homo sapiens
aagaaaucauuuagugacuuaau

SEQ ID NO: 572569 - RNA, 19 nt, Homo sapiens
aagaaauccaguuuguguu

SEQ ID NO: 572570 - RNA, 23 nt, Homo sapiens
aagaaaucuacuauaucccuuaa

SEQ ID NO: 572571 - RNA, 17 nt, Homo sapiens
aagaaaucuugcuucag

SEQ ID NO: 572572 - RNA, 19 nt, Homo sapiens
aagaaaucuugucuuacca

SEQ ID NO: 572573 - RNA, 21 nt, Homo sapiens
aagaaaugcaagggacccaga

SEQ ID NO: 572574 - RNA, 21 nt, Homo sapiens
aagaaauguuuuugcuguuaa

SEQ ID NO: 572575 - RNA, 22 nt, Homo sapiens
aagaaauuccauacuucucuca

SEQ ID NO: 572576 - RNA, 14 nt, Homo sapiens
aagaaauucuguca

SEQ ID NO: 572577 - RNA, 17 nt, Homo sapiens
aagaaauuuuaugaagu

SEQ ID NO: 572578 - RNA, 19 nt, Homo sapiens
aagaacacaugugcaguca

SEQ ID NO: 572579 - RNA, 21 nt, Homo sapiens
aagaacauuauucaucucucc

SEQ ID NO: 572580 - RNA, 11 nt, Homo sapiens
aagaaccaaaa

SEQ ID NO: 572581 - RNA, 12 nt, Homo sapiens
aagaaccaaaaa

SEQ ID NO: 572582 - RNA, 13 nt, Homo sapiens
aagaaccaaaaaa

SEQ ID NO: 572583 - RNA, 12 nt, Homo sapiens
aagaaccaaaga

SEQ ID NO: 572584 - RNA, 13 nt, Homo sapiens
aagaaccaaagaa

SEQ ID NO: 572585 - RNA, 16 nt, Homo sapiens
aagaaccagacugugu

SEQ ID NO: 572586 - RNA, 15 nt, Homo sapiens
aagaaccauugauuu

SEQ ID NO: 572587 - RNA, 21 nt, Homo sapiens
aagaacccaagugccucaccu

SEQ ID NO: 572588 - RNA, 20 nt, Homo sapiens
aagaaccgguuuccaaagac

SEQ ID NO: 572589 - RNA, 16 nt, Homo sapiens
aagaaccuugccugaa

SEQ ID NO: 572590 - RNA, 18 nt, Homo sapiens
aagaacucugggcugcua

SEQ ID NO: 572591 - RNA, 17 nt, Homo sapiens
aagaacugcuuucuuuc

SEQ ID NO: 572592 - RNA, 23 nt, Homo sapiens
aagaacuugggauaagaguguga

SEQ ID NO: 572593 - RNA, 14 nt, Homo sapiens
aagaagaaucucau

SEQ ID NO: 572594 - RNA, 12 nt, Homo sapiens
aagaagacauga

SEQ ID NO: 572595 - RNA, 12 nt, Homo sapiens
aagaagacauuu

SEQ ID NO: 572596 - RNA, 21 nt, Homo sapiens
aagaagacuguugccacuuaa

SEQ ID NO: 572597 - RNA, 15 nt, Homo sapiens
aagaagagacuggga

SEQ ID NO: 572598 - RNA, 22 nt, Homo sapiens
aagaagagcgagagaucaaaga

SEQ ID NO: 572599 - RNA, 16 nt, Homo sapiens
aagaagaguuucuccu

SEQ ID NO: 572600 - RNA, 20 nt, Homo sapiens
aagaagaguuucuccuuuug

SEQ ID NO: 572601 - RNA, 19 nt, Homo sapiens
aagaagcacugggugacca

SEQ ID NO: 572602 - RNA, 19 nt, Homo sapiens
aagaagcauacaacuuugg

SEQ ID NO: 572603 - RNA, 15 nt, Homo sapiens
aagaagccacagacc

SEQ ID NO: 572604 - RNA, 23 nt, Homo sapiens
aagaagccacccuccuugcagga

SEQ ID NO: 572605 - RNA, 21 nt, Homo sapiens
aagaagccauauaugaccaga

SEQ ID NO: 572606 - RNA, 17 nt, Homo sapiens
aagaagcccauaucaca

SEQ ID NO: 572607 - RNA, 18 nt, Homo sapiens
aagaagcguuaugugcag

SEQ ID NO: 572608 - RNA, 15 nt, Homo sapiens
aagaagcucucuccu

SEQ ID NO: 572609 - RNA, 23 nt, Homo sapiens
aagaagcugguggagcagagugu

SEQ ID NO: 572610 - RNA, 16 nt, Homo sapiens
aagaagcuuuaauauu

SEQ ID NO: 572611 - RNA, 15 nt, Homo sapiens
aagaagcuuuauuuc

SEQ ID NO: 572612 - RNA, 15 nt, Homo sapiens
aagaaggcaauauua

SEQ ID NO: 572613 - RNA, 17 nt, Homo sapiens
aaaaaauaaaguaccac

SEQ ID NO: 572614 - RNA, 12 nt, Homo sapiens
aaaaaauaccau

SEQ ID NO: 572615 - RNA, 12 nt, Homo sapiens
aaaaaauccauu

SEQ ID NO: 572616 - RNA, 21 nt, Homo sapiens
aaaaaaugauaaggcucugaa

SEQ ID NO: 572617 - RNA, 20 nt, Homo sapiens
aaaaaaugcugaacauugca

SEQ ID NO: 572618 - RNA, 14 nt, Homo sapiens
aaaaaauuaugaca

SEQ ID NO: 572619 - RNA, 19 nt, Homo sapiens
aaaaaauucacaugaugca

SEQ ID NO: 572620 - RNA, 11 nt, Homo sapiens
aaaaacaacca

SEQ ID NO: 572621 - RNA, 12 nt, Homo sapiens
aaaaacaaguuu

SEQ ID NO: 572622 - RNA, 21 nt, Homo sapiens
aaaaacagguauauacuuuga

SEQ ID NO: 572623 - RNA, 13 nt, Homo sapiens
aaaaacaucccaa

SEQ ID NO: 572624 - RNA, 21 nt, Homo sapiens
aaaaaccaucaaguugugcca

SEQ ID NO: 572625 - RNA, 17 nt, Homo sapiens
aaaaaccgaauaaaugu

SEQ ID NO: 572626 - RNA, 20 nt, Homo sapiens
aaaaaccuuuacaguuagca

SEQ ID NO: 572627 - RNA, 17 nt, Homo sapiens
aaaaacguaucuccuaa

SEQ ID NO: 572628 - RNA, 11 nt, Homo sapiens
aaaaacuaaaa

SEQ ID NO: 572629 - RNA, 13 nt, Homo sapiens
aaaaacucuucag

SEQ ID NO: 572630 - RNA, 20 nt, Homo sapiens
aaaaacugauugaaugauau

SEQ ID NO: 572631 - RNA, 18 nt, Homo sapiens
aaaaacugcuuacuuaug

SEQ ID NO: 572632 - RNA, 21 nt, Homo sapiens
aaaaacuuaccuacuggggac

SEQ ID NO: 572633 - RNA, 15 nt, Homo sapiens
aaaaacuuacuuugg

SEQ ID NO: 572634 - RNA, 17 nt, Homo sapiens
aaaaagaaaucuguuuc

SEQ ID NO: 572635 - RNA, 14 nt, Homo sapiens
aaaaagacagggcu

SEQ ID NO: 572636 - RNA, 19 nt, Homo sapiens
aaaaagaccuaugagcaca

SEQ ID NO: 572637 - RNA, 23 nt, Homo sapiens
aaaaagagacccacaauaaacuc

SEQ ID NO: 572638 - RNA, 14 nt, Homo sapiens
aaaaagauccaggg

SEQ ID NO: 572639 - RNA, 18 nt, Homo sapiens
aaaaagcaucuaucucau

SEQ ID NO: 572640 - RNA, 12 nt, Homo sapiens
aaaaagccaaaa

SEQ ID NO: 572641 - RNA, 13 nt, Homo sapiens
cauuugcacuauu

SEQ ID NO: 572642 - RNA, 14 nt, Homo sapiens
cauuugcucuuuca

SEQ ID NO: 572643 - RNA, 18 nt, Homo sapiens
cauuugcuuacuuugcau

SEQ ID NO: 572644 - RNA, 17 nt, Homo sapiens
cauuugcuuccucccaa

SEQ ID NO: 572645 - RNA, 17 nt, Homo sapiens
cauuugcuugcaaucua

SEQ ID NO: 572646 - RNA, 19 nt, Homo sapiens
cauuuggaaugaauacagc

SEQ ID NO: 572647 - RNA, 19 nt, Homo sapiens
cauuugggagacaugugac

SEQ ID NO: 572648 - RNA, 12 nt, Homo sapiens
cauuuguagcuu

SEQ ID NO: 572649 - RNA, 18 nt, Homo sapiens
cauuuguauauuguggau

SEQ ID NO: 572650 - RNA, 17 nt, Homo sapiens
cauuugucuuuguaaua

SEQ ID NO: 572651 - RNA, 22 nt, Homo sapiens
cauuuguggucacagccaugaa

SEQ ID NO: 572652 - RNA, 12 nt, Homo sapiens
cauuugugucaa

SEQ ID NO: 572653 - RNA, 12 nt, Homo sapiens
cauuuguuuaaa

SEQ ID NO: 572654 - RNA, 15 nt, Homo sapiens
cauuuguuuaaaaag

SEQ ID NO: 572655 - RNA, 19 nt, Homo sapiens
cauuuguuuccucaucuuu

SEQ ID NO: 572656 - RNA, 13 nt, Homo sapiens
cauuuguuuucac

SEQ ID NO: 572657 - RNA, 18 nt, Homo sapiens
cauuuuaaaagugccauu

SEQ ID NO: 572658 - RNA, 22 nt, Homo sapiens
cauuuuaaaagugccauuaaca

SEQ ID NO: 572659 - RNA, 21 nt, Homo sapiens
cauuuuaaaaugcuuggguac

SEQ ID NO: 572660 - RNA, 21 nt, Homo sapiens
cauuuuaaauuccacugaaaa

SEQ ID NO: 572661 - RNA, 19 nt, Homo sapiens
cauuuuaacaacugcucuu

SEQ ID NO: 572662 - RNA, 14 nt, Homo sapiens
cauuuuacacaaag

SEQ ID NO: 572663 - RNA, 16 nt, Homo sapiens
cauuuuacagaagcau

SEQ ID NO: 572664 - RNA, 22 nt, Homo sapiens
cauuuuaggaauaauaaauuca

SEQ ID NO: 572665 - RNA, 15 nt, Homo sapiens
cauuuuagugacugu

SEQ ID NO: 572666 - RNA, 20 nt, Homo sapiens
cauuuuauaagcuacauguu

SEQ ID NO: 572667 - RNA, 15 nt, Homo sapiens
cauuuuaucccaugg

SEQ ID NO: 572668 - RNA, 22 nt, Homo sapiens
cauuuuaucccauggaaccacu

SEQ ID NO: 572669 - RNA, 21 nt, Homo sapiens
cauuuuaugagaguuuggaau

SEQ ID NO: 572670 - RNA, 12 nt, Homo sapiens
cauuuucaauga

SEQ ID NO: 572671 - RNA, 19 nt, Homo sapiens
cauuuucagucuuguagug

SEQ ID NO: 572672 - RNA, 16 nt, Homo sapiens
cauuuucaucacuggg

SEQ ID NO: 572673 - RNA, 12 nt, Homo sapiens
cauuuuccuuag

SEQ ID NO: 572674 - RNA, 21 nt, Homo sapiens
cauuuuccuuaggaaaaacau

SEQ ID NO: 572675 - RNA, 15 nt, Homo sapiens
cauuuucucuaauau

SEQ ID NO: 572676 - RNA, 17 nt, Homo sapiens
cauuuucuucucuguga

SEQ ID NO: 572677 - RNA, 15 nt, Homo sapiens
cauuuucuuucaugg

SEQ ID NO: 572678 - RNA, 13 nt, Homo sapiens
cauuuugagcuga

SEQ ID NO: 572679 - RNA, 22 nt, Homo sapiens
cauuuugagcugaaaugcugca

SEQ ID NO: 572680 - RNA, 14 nt, Homo sapiens
cauuuugcaaaauu

SEQ ID NO: 572681 - RNA, 14 nt, Homo sapiens
cauuuugcauucaa

SEQ ID NO: 572682 - RNA, 21 nt, Homo sapiens
cauuuuggugugcaacccugu

SEQ ID NO: 572683 - RNA, 20 nt, Homo sapiens
cauuuugugaauacuaugua

SEQ ID NO: 572684 - RNA, 16 nt, Homo sapiens
cauuuuuaauguaucu

SEQ ID NO: 572685 - RNA, 16 nt, Homo sapiens
cauuuuucaaagcaau

SEQ ID NO: 572686 - RNA, 19 nt, Homo sapiens
cauuuuucccuauuuuccu

SEQ ID NO: 572687 - RNA, 18 nt, Homo sapiens
cauuuuucucuugccauu

SEQ ID NO: 572688 - RNA, 17 nt, Homo sapiens
cauuuuuuucacuggag

SEQ ID NO: 572689 - RNA, 22 nt, Homo sapiens
cauuuuuuucacuggaguuaca

SEQ ID NO: 572690 - RNA, 21 nt, Homo sapiens
cauuuuuuuuauauugccuua

SEQ ID NO: 572691 - RNA, 21 nt, Homo sapiens
cauuuuuuuucagcagacuau

SEQ ID NO: 572692 - RNA, 19 nt, Homo sapiens
cauuuuuuuuucaaucaac

SEQ ID NO: 572693 - RNA, 20 nt, Homo sapiens
cauuuuuuuuuuaucagagu

SEQ ID NO: 572694 - RNA, 13 nt, Homo sapiens
ccaaaaacuaaau

SEQ ID NO: 572695 - RNA, 19 nt, Homo sapiens
ccaaaaagagacugaucau

SEQ ID NO: 572696 - RNA, 16 nt, Homo sapiens
ccaaaaauacagccua

SEQ ID NO: 572697 - RNA, 21 nt, Homo sapiens
ccaaaaauaucuccuccaaug

SEQ ID NO: 572698 - RNA, 16 nt, Homo sapiens
ccaaaaauuacuuugg

SEQ ID NO: 572699 - RNA, 18 nt, Homo sapiens
ccaaaaccacagcccugu

SEQ ID NO: 572700 - RNA, 16 nt, Homo sapiens
ccaaaaccugcuuccu

SEQ ID NO: 572701 - RNA, 15 nt, Homo sapiens
ccaaaacuaauuucc

SEQ ID NO: 572702 - RNA, 15 nt, Homo sapiens
ccaaaacuaguucaa

SEQ ID NO: 572703 - RNA, 17 nt, Homo sapiens
ccaaaacuauccugauu

SEQ ID NO: 572704 - RNA, 15 nt, Homo sapiens
ccaaaagauacccaa

SEQ ID NO: 572705 - RNA, 12 nt, Homo sapiens
ccaaaagcacuu

SEQ ID NO: 572706 - RNA, 15 nt, Homo sapiens
ccaaaagcaguaaau

SEQ ID NO: 572707 - RNA, 14 nt, Homo sapiens
ccaaaaggcccuuu

SEQ ID NO: 572708 - RNA, 18 nt, Homo sapiens
ccaaaauaaaaccagcuc

SEQ ID NO: 572709 - RNA, 14 nt, Homo sapiens
ccaaaauacaaugu

SEQ ID NO: 572710 - RNA, 14 nt, Homo sapiens
ccaaaauauauauu

SEQ ID NO: 572711 - RNA, 19 nt, Homo sapiens
ccaaaauauuaacauucuu

SEQ ID NO: 572712 - RNA, 21 nt, Homo sapiens
ccaaaaucaggaaccacagau

SEQ ID NO: 572713 - RNA, 16 nt, Homo sapiens
ccaaaaucaugccauu

SEQ ID NO: 572714 - RNA, 12 nt, Homo sapiens
ccaaaaucucaa

SEQ ID NO: 572715 - RNA, 15 nt, Homo sapiens
ccaaaaugacuuuau

SEQ ID NO: 572716 - RNA, 16 nt, Homo sapiens
ccaaaaugacuuugaa

SEQ ID NO: 572717 - RNA, 22 nt, Homo sapiens
ccaaaaugggagaaaacgccag

SEQ ID NO: 572718 - RNA, 16 nt, Homo sapiens
ccaaaauguacuuaaa

SEQ ID NO: 572719 - RNA, 22 nt, Homo sapiens
ccaaacaaaacugaaccacaaa

SEQ ID NO: 572720 - RNA, 20 nt, Homo sapiens
ccaaacaacagucuucauuu

SEQ ID NO: 572721 - RNA, 17 nt, Homo sapiens
ccaaacaccagucaccu

SEQ ID NO: 572722 - RNA, 14 nt, Homo sapiens
ccaaaccaagcaaa

SEQ ID NO: 572723 - RNA, 16 nt, Homo sapiens
ccaaacccaccugcua

SEQ ID NO: 572724 - RNA, 18 nt, Homo sapiens
ccaaacccuuaacugaca

SEQ ID NO: 572725 - RNA, 18 nt, Homo sapiens
ccaaacgcuuauugugua

SEQ ID NO: 572726 - RNA, 14 nt, Homo sapiens
ccaaacugccucaa

SEQ ID NO: 572727 - RNA, 15 nt, Homo sapiens
ccaaacugucuuugu

SEQ ID NO: 572728 - RNA, 20 nt, Homo sapiens
ccaaagaaauggaaauugau

SEQ ID NO: 572729 - RNA, 16 nt, Homo sapiens
ccaaagaaccaaagaa

SEQ ID NO: 572730 - RNA, 21 nt, Homo sapiens
ccaaagagaagggcacuguaa

SEQ ID NO: 572731 - RNA, 13 nt, Homo sapiens
ccaaagagacugg

SEQ ID NO: 572732 - RNA, 22 nt, Homo sapiens
ccaaagagauauugauauugaa

SEQ ID NO: 572733 - RNA, 19 nt, Homo sapiens
ccaaagagggcuuccucua

SEQ ID NO: 572734 - RNA, 22 nt, Homo sapiens
ccaaagcacaugcuuagcuuau

SEQ ID NO: 572735 - RNA, 22 nt, Homo sapiens
ccaaagcaucaauacaaccagc

SEQ ID NO: 572736 - RNA, 18 nt, Homo sapiens
ccaaagccagaaccagau

SEQ ID NO: 572737 - RNA, 15 nt, Homo sapiens
ccaaagccagaccag

SEQ ID NO: 572738 - RNA, 22 nt, Homo sapiens
ccaaagcccugguaaaagggau

SEQ ID NO: 572739 - RNA, 18 nt, Homo sapiens
ccaaaggauaaguguccc

SEQ ID NO: 572740 - RNA, 10 nt, Homo sapiens
ccaaaggggc

SEQ ID NO: 572741 - RNA, 21 nt, Homo sapiens
ccaaagggugaagcuauuuau

SEQ ID NO: 572742 - RNA, 18 nt, Homo sapiens
ccaaaggucauccuuaau

SEQ ID NO: 572743 - RNA, 20 nt, Homo sapiens
ccaaaguaaauguccugcua

SEQ ID NO: 572744 - RNA, 18 nt, Homo sapiens
ccaaaguccucugcucca

SEQ ID NO: 572745 - RNA, 20 nt, Homo sapiens
ccaaaguccuuuuuuuccau

SEQ ID NO: 572746 - RNA, 13 nt, Homo sapiens
ccaaagugccugg

SEQ ID NO: 572747 - RNA, 14 nt, Homo sapiens
ccaaagugguauag

SEQ ID NO: 572748 - RNA, 18 nt, Homo sapiens
ccaaauaaaauguucccu

SEQ ID NO: 572749 - RNA, 23 nt, Homo sapiens
ccaaauaaacucuaaacauuaau

SEQ ID NO: 572750 - RNA, 17 nt, Homo sapiens
ccaaauaaaguaccauu

SEQ ID NO: 572751 - RNA, 14 nt, Homo sapiens
ccaaauaagauucc

SEQ ID NO: 572752 - RNA, 14 nt, Homo sapiens
ccaaauaauuucau

SEQ ID NO: 572753 - RNA, 12 nt, Homo sapiens
ccaaauaccuca

SEQ ID NO: 572754 - RNA, 22 nt, Homo sapiens
ccaaauaggagggagacugugg

SEQ ID NO: 572755 - RNA, 15 nt, Homo sapiens
ccaaauaugagaugc

SEQ ID NO: 572756 - RNA, 14 nt, Homo sapiens
ccaaaucaccacaa

SEQ ID NO: 572757 - RNA, 15 nt, Homo sapiens
ccaaaucagcugcua

SEQ ID NO: 572758 - RNA, 21 nt, Homo sapiens
ccaaauccaaggaaacaugca

SEQ ID NO: 572759 - RNA, 20 nt, Homo sapiens
ccaaaucugcauccuuuuca

SEQ ID NO: 572760 - RNA, 16 nt, Homo sapiens
ccaaaucuuguuauug

SEQ ID NO: 572761 - RNA, 12 nt, Homo sapiens
ccaaaugagauc

SEQ ID NO: 572762 - RNA, 14 nt, Homo sapiens
ccaaaugcagggag

SEQ ID NO: 572763 - RNA, 22 nt, Homo sapiens
ccaaaugcagggaggggaggca

SEQ ID NO: 572764 - RNA, 14 nt, Homo sapiens
aguuaauucaccua

SEQ ID NO: 572765 - RNA, 17 nt, Homo sapiens
aguuaauuuugaguaau

SEQ ID NO: 572766 - RNA, 16 nt, Homo sapiens
aguuacacagaaaugc

SEQ ID NO: 572767 - RNA, 21 nt, Homo sapiens
aguuacacagaaaugcugcug

SEQ ID NO: 572768 - RNA, 13 nt, Homo sapiens
aguuacacuaaaa

SEQ ID NO: 572769 - RNA, 18 nt, Homo sapiens
aguuacaguucugugguu

SEQ ID NO: 572770 - RNA, 12 nt, Homo sapiens
aguuacauauua

SEQ ID NO: 572771 - RNA, 17 nt, Homo sapiens
aguuaccagugccuuaa

SEQ ID NO: 572772 - RNA, 11 nt, Homo sapiens
aguuacuugaa

SEQ ID NO: 572773 - RNA, 12 nt, Homo sapiens
aguuacuugaau

SEQ ID NO: 572774 - RNA, 18 nt, Homo sapiens
aguuagaacuagauuuaa

SEQ ID NO: 572775 - RNA, 17 nt, Homo sapiens
aguuagaacuagccaaa

SEQ ID NO: 572776 - RNA, 20 nt, Homo sapiens
aguuagaauuauaucacuuc

SEQ ID NO: 572777 - RNA, 17 nt, Homo sapiens
aguuagaggagaaaaag

SEQ ID NO: 572778 - RNA, 15 nt, Homo sapiens
aguuagauuauugaa

SEQ ID NO: 572779 - RNA, 20 nt, Homo sapiens
aguuagcauaauacagaagu

SEQ ID NO: 572780 - RNA, 22 nt, Homo sapiens
aguuagguagcuuuagggcaau

SEQ ID NO: 572781 - RNA, 18 nt, Homo sapiens
aguuagucaauccuguca

SEQ ID NO: 572782 - RNA, 20 nt, Homo sapiens
aguuagucaauccugucaua

SEQ ID NO: 572783 - RNA, 13 nt, Homo sapiens
aguuagugccaua

SEQ ID NO: 572784 - RNA, 15 nt, Homo sapiens
aguuaguuccacuga

SEQ ID NO: 572785 - RNA, 22 nt, Homo sapiens
aguuauagaagagaaaugcugc

SEQ ID NO: 572786 - RNA, 23 nt, Homo sapiens
aguuauagaagagaaaugcugcu

SEQ ID NO: 572787 - RNA, 14 nt, Homo sapiens
aguuaucaguauuu

SEQ ID NO: 572788 - RNA, 18 nt, Homo sapiens
aguuaugauguaaucucu

SEQ ID NO: 572789 - RNA, 16 nt, Homo sapiens
aguuauuaaucuggac

SEQ ID NO: 572790 - RNA, 20 nt, Homo sapiens
aguuauuacauguaauuuga

SEQ ID NO: 572791 - RNA, 18 nt, Homo sapiens
aguuauugcuggugcaaa

SEQ ID NO: 572792 - RNA, 20 nt, Homo sapiens
aguuauuuacuuuuaccacu

SEQ ID NO: 572793 - RNA, 21 nt, Homo sapiens
aguucaaaaaacucuugauau

SEQ ID NO: 572794 - RNA, 15 nt, Homo sapiens
aguucacagacauac

SEQ ID NO: 572795 - RNA, 21 nt, Homo sapiens
aguucacauacaaaucaucca

SEQ ID NO: 572796 - RNA, 16 nt, Homo sapiens
aguucaccugcacuua

SEQ ID NO: 572797 - RNA, 22 nt, Homo sapiens
aguucacuuuuuacagugcuau

SEQ ID NO: 572798 - RNA, 16 nt, Homo sapiens
aguucagagucuucag

SEQ ID NO: 572799 - RNA, 23 nt, Homo sapiens
aguucagcugccccacaggugug

SEQ ID NO: 572800 - RNA, 13 nt, Homo sapiens
aguucagucugua

SEQ ID NO: 572801 - RNA, 17 nt, Homo sapiens
aguucaucaccauuucc

SEQ ID NO: 572802 - RNA, 18 nt, Homo sapiens
aguuccagaaacuuuaag

SEQ ID NO: 572803 - RNA, 22 nt, Homo sapiens
aguuccaugaauucuugauuuc

SEQ ID NO: 572804 - RNA, 15 nt, Homo sapiens
aguucccacccaagc

SEQ ID NO: 572805 - RNA, 22 nt, Homo sapiens
aguuccuauaccuuacugacac

SEQ ID NO: 572806 - RNA, 21 nt, Homo sapiens
aguuccucauuagcauuuugc

SEQ ID NO: 572807 - RNA, 13 nt, Homo sapiens
aguuccucugcag

SEQ ID NO: 572808 - RNA, 14 nt, Homo sapiens
aguuccucuggguu

SEQ ID NO: 572809 - RNA, 17 nt, Homo sapiens
aguuccuguaacaggug

SEQ ID NO: 572810 - RNA, 18 nt, Homo sapiens
aguuccuugaucuguaua

SEQ ID NO: 572811 - RNA, 22 nt, Homo sapiens
aguuccuuggagggacaugacu

SEQ ID NO: 572812 - RNA, 22 nt, Homo sapiens
aguucggaaaccguccugugua

SEQ ID NO: 572813 - RNA, 18 nt, Homo sapiens
aguucuaacaaaacaagu

SEQ ID NO: 572814 - RNA, 19 nt, Homo sapiens
aguucuaaccuccuaagca

SEQ ID NO: 572815 - RNA, 13 nt, Homo sapiens
aguucuaucagga

SEQ ID NO: 572816 - RNA, 13 nt, Homo sapiens
aguucucacuguu

SEQ ID NO: 572817 - RNA, 18 nt, Homo sapiens
aguucucuugcuuucaca

SEQ ID NO: 572818 - RNA, 19 nt, Homo sapiens
aguucugaauaacuugaag

SEQ ID NO: 572819 - RNA, 19 nt, Homo sapiens
aguucugagcaccguguca

SEQ ID NO: 572820 - RNA, 17 nt, Homo sapiens
aguucugccaggcaacu

SEQ ID NO: 572821 - RNA, 19 nt, Homo sapiens
aguucuucaccucuaucca

SEQ ID NO: 572822 - RNA, 21 nt, Homo sapiens
aguucuuuauaacaaaacagg

SEQ ID NO: 572823 - RNA, 22 nt, Homo sapiens
aguugaaacugcuauagccuaa

SEQ ID NO: 572824 - RNA, 19 nt, Homo sapiens
aguugaacacuagucugug

SEQ ID NO: 572825 - RNA, 18 nt, Homo sapiens
aguugaagcuaagauuua

SEQ ID NO: 572826 - RNA, 17 nt, Homo sapiens
aguugacugacugagca

SEQ ID NO: 572827 - RNA, 18 nt, Homo sapiens
aguugagagcaccuugca

SEQ ID NO: 572828 - RNA, 14 nt, Homo sapiens
aguugaggccagga

SEQ ID NO: 572829 - RNA, 13 nt, Homo sapiens
aguugaucugcuc

SEQ ID NO: 572830 - RNA, 14 nt, Homo sapiens
aguugauuuuacaa

SEQ ID NO: 572831 - RNA, 14 nt, Homo sapiens
aguugcaaguuuaa

SEQ ID NO: 572832 - RNA, 20 nt, Homo sapiens
aguugcaccauugcacucca

SEQ ID NO: 572833 - RNA, 19 nt, Homo sapiens
aguugcagccagggccagu

SEQ ID NO: 572834 - RNA, 20 nt, Homo sapiens
aguugcagccagggccagug

SEQ ID NO: 572835 - RNA, 11 nt, Homo sapiens
aguugcagcug

SEQ ID NO: 572836 - RNA, 17 nt, Homo sapiens
aguugcagugaauucau

SEQ ID NO: 572837 - RNA, 18 nt, Homo sapiens
aguugcagugagcagggu

SEQ ID NO: 572838 - RNA, 16 nt, Homo sapiens
aguugccaggcacuuu

SEQ ID NO: 572839 - RNA, 22 nt, Homo sapiens
aguugcuguucuuacaucugua

SEQ ID NO: 572840 - RNA, 13 nt, Homo sapiens
aguugcuuuucag

SEQ ID NO: 572841 - RNA, 16 nt, Homo sapiens
aguugcuuuucagcug

SEQ ID NO: 572842 - RNA, 23 nt, Homo sapiens
aguuggaaaaacaaaugccauau

SEQ ID NO: 572843 - RNA, 14 nt, Homo sapiens
aguuggacagcaaa

SEQ ID NO: 572844 - RNA, 14 nt, Homo sapiens
aguuggaguacuau

SEQ ID NO: 572845 - RNA, 14 nt, Homo sapiens
aguuggcucaggca

SEQ ID NO: 572846 - RNA, 18 nt, Homo sapiens
aguuggcuucuaagccaa

SEQ ID NO: 572847 - RNA, 23 nt, Homo sapiens
aguugggacccaaaacacaggaa

SEQ ID NO: 572848 - RNA, 16 nt, Homo sapiens
aguugggagcacugga

SEQ ID NO: 572849 - RNA, 21 nt, Homo sapiens
aguuggugacugggaaaguua

SEQ ID NO: 572850 - RNA, 12 nt, Homo sapiens
aguuggugcugc

SEQ ID NO: 572851 - RNA, 21 nt, Homo sapiens
aguuggugcuuuugagaacca

SEQ ID NO: 572852 - RNA, 21 nt, Homo sapiens
aguuguaacuuugccuucaca

SEQ ID NO: 572853 - RNA, 18 nt, Homo sapiens
aguuguaauaagucuucc

SEQ ID NO: 572854 - RNA, 13 nt, Homo sapiens
aguuguacuucug

SEQ ID NO: 572855 - RNA, 12 nt, Homo sapiens
aguuguaguguu

SEQ ID NO: 572856 - RNA, 15 nt, Homo sapiens
aguuguauccauuaa

SEQ ID NO: 572857 - RNA, 11 nt, Homo sapiens
aguuguauuag

SEQ ID NO: 572858 - RNA, 20 nt, Homo sapiens
aguugucagcuuugacuuua

SEQ ID NO: 572859 - RNA, 13 nt, Homo sapiens
aguuguguugaca

SEQ ID NO: 572860 - RNA, 13 nt, Homo sapiens
aguuguucagcau

SEQ ID NO: 572861 - RNA, 20 nt, Homo sapiens
aguuguucuaguaacaauac

SEQ ID NO: 572862 - RNA, 15 nt, Homo sapiens
aguuguucuguuaac

SEQ ID NO: 572863 - RNA, 22 nt, Homo sapiens
aguuguuuuaauaacuuaucua

SEQ ID NO: 572864 - RNA, 23 nt, Homo sapiens
aguuuaacauuagcuaaaacugc

SEQ ID NO: 572865 - RNA, 18 nt, Homo sapiens
aguuuaaguaauugccua

SEQ ID NO: 572866 - RNA, 19 nt, Homo sapiens
aguuuaauauuccaauacc

SEQ ID NO: 572867 - RNA, 18 nt, Homo sapiens
aguuuaaugccuagcaga

SEQ ID NO: 572868 - RNA, 16 nt, Homo sapiens
aguuuacaaucagcca

SEQ ID NO: 572869 - RNA, 19 nt, Homo sapiens
aguuuacauuguccuguag

SEQ ID NO: 572870 - RNA, 14 nt, Homo sapiens
aguuuaccuaugua

SEQ ID NO: 572871 - RNA, 19 nt, Homo sapiens
aguuuaccucauccaugca

SEQ ID NO: 572872 - RNA, 16 nt, Homo sapiens
aguuuacugaagcaaa

SEQ ID NO: 572873 - RNA, 14 nt, Homo sapiens
aguuuagugugaua

SEQ ID NO: 572874 - RNA, 16 nt, Homo sapiens
aguuuauacagaacuc

SEQ ID NO: 572875 - RNA, 23 nt, Homo sapiens
aguuuauagaccagaaccagagc

SEQ ID NO: 572876 - RNA, 15 nt, Homo sapiens
aguuuaugcuaccua

SEQ ID NO: 572877 - RNA, 15 nt, Homo sapiens
aguuuauugacaaua

SEQ ID NO: 572878 - RNA, 19 nt, Homo sapiens
aguuuauuggaaguguuca

SEQ ID NO: 572879 - RNA, 23 nt, Homo sapiens
aguuuauuuguugagagugugac

SEQ ID NO: 572880 - RNA, 17 nt, Homo sapiens
aguuucaaguaccaaaa

SEQ ID NO: 572881 - RNA, 15 nt, Homo sapiens
aguuucaaugugauu

SEQ ID NO: 572882 - RNA, 13 nt, Homo sapiens
aguuucaccacuc

SEQ ID NO: 572883 - RNA, 15 nt, Homo sapiens
aguuucaccacuccu

SEQ ID NO: 572884 - RNA, 17 nt, Homo sapiens
aguuucaccacuccucu

SEQ ID NO: 572885 - RNA, 18 nt, Homo sapiens
aguuucacuguacugcau

SEQ ID NO: 572886 - RNA, 16 nt, Homo sapiens
aguuucagagagucaa

SEQ ID NO: 572887 - RNA, 19 nt, Homo sapiens
ccaaaugcauggugcaguu

SEQ ID NO: 572888 - RNA, 17 nt, Homo sapiens
ccaaauguagcaggugu

SEQ ID NO: 572889 - RNA, 15 nt, Homo sapiens
ccaaauucauauaaa

SEQ ID NO: 572890 - RNA, 13 nt, Homo sapiens
ccaaauucauccu

SEQ ID NO: 572891 - RNA, 22 nt, Homo sapiens
ccaaauucucccuggaccccau

SEQ ID NO: 572892 - RNA, 15 nt, Homo sapiens
ccaaauugcuucuag

SEQ ID NO: 572893 - RNA, 17 nt, Homo sapiens
ccaaauuucauuucagc

SEQ ID NO: 572894 - RNA, 23 nt, Homo sapiens
ccaaauuuccaguuuaaguaauu

SEQ ID NO: 572895 - RNA, 16 nt, Homo sapiens
ccaaauuuguauuuaa

SEQ ID NO: 572896 - RNA, 13 nt, Homo sapiens
ccaacaaaccauc

SEQ ID NO: 572897 - RNA, 15 nt, Homo sapiens
ccaacaagccucaaa

SEQ ID NO: 572898 - RNA, 12 nt, Homo sapiens
ccaacaauguug

SEQ ID NO: 572899 - RNA, 22 nt, Homo sapiens
ccaacagaggggcagccaggac

SEQ ID NO: 572900 - RNA, 18 nt, Homo sapiens
ccaacagucaaaacagag

SEQ ID NO: 572901 - RNA, 21 nt, Homo sapiens
ccaacauaaaacaaaaccaag

SEQ ID NO: 572902 - RNA, 15 nt, Homo sapiens
ccaacauacuuuaag

SEQ ID NO: 572903 - RNA, 20 nt, Homo sapiens
ccaacauaugcccucagaaa

SEQ ID NO: 572904 - RNA, 15 nt, Homo sapiens
ccaacaugcacugau

SEQ ID NO: 572905 - RNA, 12 nt, Homo sapiens
ccaacaugguga

SEQ ID NO: 572906 - RNA, 21 nt, Homo sapiens
ccaaccacagcaucgggagca

SEQ ID NO: 572907 - RNA, 15 nt, Homo sapiens
ccaaccagacuuuga

SEQ ID NO: 572908 - RNA, 20 nt, Homo sapiens
ccaacccaauaaaacugaug

SEQ ID NO: 572909 - RNA, 17 nt, Homo sapiens
ccaaccccccaccugcc

SEQ ID NO: 572910 - RNA, 22 nt, Homo sapiens
ccaacccgucuggcccaccagg

SEQ ID NO: 572911 - RNA, 17 nt, Homo sapiens
ccaaccggucacccagg

SEQ ID NO: 572912 - RNA, 16 nt, Homo sapiens
ccaaccugaagacacc

SEQ ID NO: 572913 - RNA, 15 nt, Homo sapiens
ccaaccugcucauuu

SEQ ID NO: 572914 - RNA, 23 nt, Homo sapiens
ccaaccuuguuugaagcuguuau

SEQ ID NO: 572915 - RNA, 17 nt, Homo sapiens
ccaacgagcuguacaug

SEQ ID NO: 572916 - RNA, 15 nt, Homo sapiens
ccaacucacuuccag

SEQ ID NO: 572917 - RNA, 20 nt, Homo sapiens
ccaacuccgcccagccucuc

SEQ ID NO: 572918 - RNA, 12 nt, Homo sapiens
ccaacuccucac

SEQ ID NO: 572919 - RNA, 19 nt, Homo sapiens
ccaacugcaaaaaaagccu

SEQ ID NO: 572920 - RNA, 22 nt, Homo sapiens
ccaacuugagggcccagagcag

SEQ ID NO: 572921 - RNA, 17 nt, Homo sapiens
ccaacuugaugugaaaa

SEQ ID NO: 572922 - RNA, 20 nt, Homo sapiens
ccaacuugccacauguucua

SEQ ID NO: 572923 - RNA, 22 nt, Homo sapiens
ccaacuugguucugcuucaaua

SEQ ID NO: 572924 - RNA, 22 nt, Homo sapiens
ccaacuuuguggaugucuuccu

SEQ ID NO: 572925 - RNA, 21 nt, Homo sapiens
ccaacuuuuuguuacagauua

SEQ ID NO: 572926 - RNA, 16 nt, Homo sapiens
ccaagaaaauaucacu

SEQ ID NO: 572927 - RNA, 19 nt, Homo sapiens
ccaagaacugcauggaccu

SEQ ID NO: 572928 - RNA, 13 nt, Homo sapiens
ccaagaaggugag

SEQ ID NO: 572929 - RNA, 18 nt, Homo sapiens
ccaagaaggugagugcuu

SEQ ID NO: 572930 - RNA, 16 nt, Homo sapiens
ccaagaagugggugcc

SEQ ID NO: 572931 - RNA, 15 nt, Homo sapiens
ccaagaauauugcaa

SEQ ID NO: 572932 - RNA, 18 nt, Homo sapiens
ccaagaauauugcaaaau

SEQ ID NO: 572933 - RNA, 20 nt, Homo sapiens
ccaagaauguuaugugcaag

SEQ ID NO: 572934 - RNA, 13 nt, Homo sapiens
ccaagacaaauca

SEQ ID NO: 572935 - RNA, 15 nt, Homo sapiens
ccaagaccuggugug

SEQ ID NO: 572936 - RNA, 20 nt, Homo sapiens
ccaagacuuuugucugauca

SEQ ID NO: 572937 - RNA, 22 nt, Homo sapiens
ccaagagaacucgcgcucagua

SEQ ID NO: 572938 - RNA, 16 nt, Homo sapiens
ccaagagguacuguaa

SEQ ID NO: 572939 - RNA, 13 nt, Homo sapiens
ccaagaugaauua

SEQ ID NO: 572940 - RNA, 13 nt, Homo sapiens
ccaagcagacugu

SEQ ID NO: 572941 - RNA, 11 nt, Homo sapiens
ccaagcagcuu

SEQ ID NO: 572942 - RNA, 12 nt, Homo sapiens
ccaagcauuuca

SEQ ID NO: 572943 - RNA, 20 nt, Homo sapiens
ccaagcccaauacagccauu

SEQ ID NO: 572944 - RNA, 11 nt, Homo sapiens
ccaagcccagg

SEQ ID NO: 572945 - RNA, 14 nt, Homo sapiens
ccaagccuccacag

SEQ ID NO: 572946 - RNA, 14 nt, Homo sapiens
ccaagccugcugug

SEQ ID NO: 572947 - RNA, 19 nt, Homo sapiens
ccaagccuggcaagggaau

SEQ ID NO: 572948 - RNA, 22 nt, Homo sapiens
ccaagccugggcuugagcugca

SEQ ID NO: 572949 - RNA, 23 nt, Homo sapiens
ccaagcgcgguuacuauggccag

SEQ ID NO: 572950 - RNA, 23 nt, Homo sapiens
ccaagcguuucccagucuuagcc

SEQ ID NO: 572951 - RNA, 15 nt, Homo sapiens
ccaaggaaaccgccu

SEQ ID NO: 572952 - RNA, 19 nt, Homo sapiens
ccaaggaaacgcuaccucu

SEQ ID NO: 572953 - RNA, 16 nt, Homo sapiens
ccaaggaaacuugaau

SEQ ID NO: 572954 - RNA, 22 nt, Homo sapiens
ccaaggaauguguccaagacac

SEQ ID NO: 572955 - RNA, 22 nt, Homo sapiens
ccaaggaccucucucaaugcca

SEQ ID NO: 572956 - RNA, 14 nt, Homo sapiens
ccaaggagggugag

SEQ ID NO: 572957 - RNA, 19 nt, Homo sapiens
ccaaggagggugagugcaa

SEQ ID NO: 572958 - RNA, 18 nt, Homo sapiens
ccaaggauggaccacaca

SEQ ID NO: 572959 - RNA, 22 nt, Homo sapiens
ccaaggcagcucuucuggaguu

SEQ ID NO: 572960 - RNA, 15 nt, Homo sapiens
ccaagggaaaggggu

SEQ ID NO: 572961 - RNA, 13 nt, Homo sapiens
ccaagggacaggu

SEQ ID NO: 572962 - RNA, 21 nt, Homo sapiens
ccaagggcuucugcacccucc

SEQ ID NO: 572963 - RNA, 16 nt, Homo sapiens
ccaaggguaugggaag

SEQ ID NO: 572964 - RNA, 20 nt, Homo sapiens
ccaaggguaugggaagccau

SEQ ID NO: 572965 - RNA, 12 nt, Homo sapiens
ccaaggugggag

SEQ ID NO: 572966 - RNA, 17 nt, Homo sapiens
ccaagguuacucagcag

SEQ ID NO: 572967 - RNA, 12 nt, Homo sapiens
ccaaguaaaggu

SEQ ID NO: 572968 - RNA, 23 nt, Homo sapiens
ccaaguagcugggauuacaggca

SEQ ID NO: 572969 - RNA, 15 nt, Homo sapiens
ccaaguaugccuuaa

SEQ ID NO: 572970 - RNA, 16 nt, Homo sapiens
ccaaguaugccuuaag

SEQ ID NO: 572971 - RNA, 16 nt, Homo sapiens
ccaaguccagauuuac

SEQ ID NO: 572972 - RNA, 14 nt, Homo sapiens
ccaagugauaauuu

SEQ ID NO: 572973 - RNA, 16 nt, Homo sapiens
ccaagugauccuucca

SEQ ID NO: 572974 - RNA, 11 nt, Homo sapiens
ccaagugcaau

SEQ ID NO: 572975 - RNA, 11 nt, Homo sapiens
ccaagugugaa

SEQ ID NO: 572976 - RNA, 23 nt, Homo sapiens
ccaaguucuuagggcacaugaaa

SEQ ID NO: 572977 - RNA, 17 nt, Homo sapiens
ccaaguucuucaccucu

SEQ ID NO: 572978 - RNA, 15 nt, Homo sapiens
ccaauaaaaaguuca

SEQ ID NO: 572979 - RNA, 20 nt, Homo sapiens
ccaauaaaaaguucagaguu

SEQ ID NO: 572980 - RNA, 14 nt, Homo sapiens
ccaauaaaacugau

SEQ ID NO: 572981 - RNA, 13 nt, Homo sapiens
ccaauacuacuga

SEQ ID NO: 572982 - RNA, 14 nt, Homo sapiens
ccaauaugacucag

SEQ ID NO: 572983 - RNA, 15 nt, Homo sapiens
ccaaucaguuuauac

SEQ ID NO: 572984 - RNA, 21 nt, Homo sapiens
ccaauccauccugcucaggaa

SEQ ID NO: 572985 - RNA, 17 nt, Homo sapiens
ccaauccccagacucaa

SEQ ID NO: 572986 - RNA, 17 nt, Homo sapiens
ccaauccuggacaugaa

SEQ ID NO: 572987 - RNA, 18 nt, Homo sapiens
ccaaucucuuggugggga

SEQ ID NO: 572988 - RNA, 13 nt, Homo sapiens
ccaaucuuucuau

SEQ ID NO: 572989 - RNA, 19 nt, Homo sapiens
ccaaugacacccaugccag

SEQ ID NO: 572990 - RNA, 13 nt, Homo sapiens
ccaaugagcuccu

SEQ ID NO: 572991 - RNA, 22 nt, Homo sapiens
ccaaugaggucugaaauggagg

SEQ ID NO: 572992 - RNA, 13 nt, Homo sapiens
ccaaugaugguca

SEQ ID NO: 572993 - RNA, 14 nt, Homo sapiens
ccaaugauggucac

SEQ ID NO: 572994 - RNA, 12 nt, Homo sapiens
ccaaugccugug

SEQ ID NO: 572995 - RNA, 14 nt, Homo sapiens
ccaaugccugugaa

SEQ ID NO: 572996 - RNA, 18 nt, Homo sapiens
ccaaugccugugaagcag

SEQ ID NO: 572997 - RNA, 24 nt, Homo sapiens
ccaauggacaagcagugucuguca

SEQ ID NO: 572998 - RNA, 20 nt, Homo sapiens
ccaauuagacaaacagcauc

SEQ ID NO: 572999 - RNA, 23 nt, Homo sapiens
ccaauucugucccaaucuuacca

SEQ ID NO: 573000 - RNA, 18 nt, Homo sapiens
ccaauugugcugccauuu

SEQ ID NO: 573001 - RNA, 17 nt, Homo sapiens
ccaauugugguugugca

SEQ ID NO: 573002 - RNA, 14 nt, Homo sapiens
ccaauuuacauacu

SEQ ID NO: 573003 - RNA, 14 nt, Homo sapiens
ccaauuuacuuugu

SEQ ID NO: 573004 - RNA, 18 nt, Homo sapiens
ccaauuuuuuaagugaaa

SEQ ID NO: 573005 - RNA, 13 nt, Homo sapiens
ccacaaaacugac

SEQ ID NO: 573006 - RNA, 19 nt, Homo sapiens
ccacaaaacuucagugugg

SEQ ID NO: 573007 - RNA, 18 nt, Homo sapiens
ccacaaagcaaaggcagu

SEQ ID NO: 573008 - RNA, 17 nt, Homo sapiens
ccacaaaguaucuaaca

SEQ ID NO: 573009 - RNA, 19 nt, Homo sapiens
ccacaaaucaucuguaaca

SEQ ID NO: 573010 - RNA, 13 nt, Homo sapiens
ccacaaaugccac

SEQ ID NO: 573011 - RNA, 19 nt, Homo sapiens
aguuuccaaucccauagau

SEQ ID NO: 573012 - RNA, 17 nt, Homo sapiens
aguuuccauauguuaua

SEQ ID NO: 573013 - RNA, 18 nt, Homo sapiens
aguuuccuaugggaacaa

SEQ ID NO: 573014 - RNA, 16 nt, Homo sapiens
aguuuccucaucugca

SEQ ID NO: 573015 - RNA, 24 nt, Homo sapiens
aguuuccugcuauauuaacaucau

SEQ ID NO: 573016 - RNA, 21 nt, Homo sapiens
aguuucucagcucccaaggcu

SEQ ID NO: 573017 - RNA, 18 nt, Homo sapiens
aguuucugauaccacugc

SEQ ID NO: 573018 - RNA, 19 nt, Homo sapiens
aguuucuguaaaugacacu

SEQ ID NO: 573019 - RNA, 14 nt, Homo sapiens
aguuucuuuucaca

SEQ ID NO: 573020 - RNA, 22 nt, Homo sapiens
aguuugaacaaaaucuccucuu

SEQ ID NO: 573021 - RNA, 14 nt, Homo sapiens
aguuugagggagaa

SEQ ID NO: 573022 - RNA, 18 nt, Homo sapiens
aguuugauuauucagugu

SEQ ID NO: 573023 - RNA, 13 nt, Homo sapiens
aguuugauuucau

SEQ ID NO: 573024 - RNA, 11 nt, Homo sapiens
aguuugcaguu

SEQ ID NO: 573025 - RNA, 18 nt, Homo sapiens
aguuugcaguuaugcaga

SEQ ID NO: 573026 - RNA, 22 nt, Homo sapiens
aguuugccggauacaaacuggu

SEQ ID NO: 573027 - RNA, 15 nt, Homo sapiens
aguuuggaagcacug

SEQ ID NO: 573028 - RNA, 19 nt, Homo sapiens
aguuuggaaugaagaaauu

SEQ ID NO: 573029 - RNA, 21 nt, Homo sapiens
aguuuggaauuauuguagaca

SEQ ID NO: 573030 - RNA, 18 nt, Homo sapiens
aguuugggcuuguaccac

SEQ ID NO: 573031 - RNA, 21 nt, Homo sapiens
aguuuguagccagguacugca

SEQ ID NO: 573032 - RNA, 16 nt, Homo sapiens
aguuuguauauauuau

SEQ ID NO: 573033 - RNA, 18 nt, Homo sapiens
aguuugucauauacugcu

SEQ ID NO: 573034 - RNA, 15 nt, Homo sapiens
aguuuguccuacaau

SEQ ID NO: 573035 - RNA, 22 nt, Homo sapiens
aguuuguuuuuaaaaaaaucua

SEQ ID NO: 573036 - RNA, 23 nt, Homo sapiens
aguuuuaaaaaaaacaauuccac

SEQ ID NO: 573037 - RNA, 14 nt, Homo sapiens
aguuuuaaacuggu

SEQ ID NO: 573038 - RNA, 15 nt, Homo sapiens
aguuuuaaguccagc

SEQ ID NO: 573039 - RNA, 20 nt, Homo sapiens
aguuuuaauaagaacagauc

SEQ ID NO: 573040 - RNA, 22 nt, Homo sapiens
aguuuuaccucuucucucucag

SEQ ID NO: 573041 - RNA, 23 nt, Homo sapiens
aguuuuaggacaaacagcucagu

SEQ ID NO: 573042 - RNA, 20 nt, Homo sapiens
aguuuuauuuugggccuguu

SEQ ID NO: 573043 - RNA, 22 nt, Homo sapiens
aguuuucaggaugagaugacag

SEQ ID NO: 573044 - RNA, 18 nt, Homo sapiens
aguuuuccccuggccuca

SEQ ID NO: 573045 - RNA, 19 nt, Homo sapiens
aguuuuccuucuguuaaaa

SEQ ID NO: 573046 - RNA, 15 nt, Homo sapiens
aguuuugaagcuuua

SEQ ID NO: 573047 - RNA, 13 nt, Homo sapiens
aguuuugaugaaa

SEQ ID NO: 573048 - RNA, 15 nt, Homo sapiens
aguuuugcacuuuua

SEQ ID NO: 573049 - RNA, 16 nt, Homo sapiens
aguuuugccuuucuaa

SEQ ID NO: 573050 - RNA, 15 nt, Homo sapiens
aguuuuucacuuugg

SEQ ID NO: 573051 - RNA, 13 nt, Homo sapiens
aguuuuucagucu

SEQ ID NO: 573052 - RNA, 14 nt, Homo sapiens
aguuuuucugucaa

SEQ ID NO: 573053 - RNA, 23 nt, Homo sapiens
aguuuuuuuaauguguuugcaau

SEQ ID NO: 573054 - RNA, 16 nt, Homo sapiens
auaaaaaacauauaca

SEQ ID NO: 573055 - RNA, 14 nt, Homo sapiens
auaaaaaagcaaaa

SEQ ID NO: 573056 - RNA, 15 nt, Homo sapiens
auaaaaaagcaaaaa

SEQ ID NO: 573057 - RNA, 16 nt, Homo sapiens
auaaaaaagcaaaaac

SEQ ID NO: 573058 - RNA, 14 nt, Homo sapiens
auaaaaaauagaca

SEQ ID NO: 573059 - RNA, 20 nt, Homo sapiens
auaaaaaauuaugacaaugu

SEQ ID NO: 573060 - RNA, 15 nt, Homo sapiens
auaaaaacauuucuu

SEQ ID NO: 573061 - RNA, 19 nt, Homo sapiens
auaaaaagauaaucucagu

SEQ ID NO: 573062 - RNA, 17 nt, Homo sapiens
auaaaaagccucaguga

SEQ ID NO: 573063 - RNA, 20 nt, Homo sapiens
auaaaaaggaacaagacuga

SEQ ID NO: 573064 - RNA, 20 nt, Homo sapiens
auaaaaauaaaucaguucau

SEQ ID NO: 573065 - RNA, 15 nt, Homo sapiens
auaaaaauaccucuu

SEQ ID NO: 573066 - RNA, 21 nt, Homo sapiens
auaaaaauguuuugaggcuuu

SEQ ID NO: 573067 - RNA, 16 nt, Homo sapiens
auaaaacaaaaccaag

SEQ ID NO: 573068 - RNA, 16 nt, Homo sapiens
auaaaacacugcccuc

SEQ ID NO: 573069 - RNA, 21 nt, Homo sapiens
auaaaaccauuuuuugaacca

SEQ ID NO: 573070 - RNA, 22 nt, Homo sapiens
auaaaacgcaaagggcugaaag

SEQ ID NO: 573071 - RNA, 13 nt, Homo sapiens
auaaaacggugcu

SEQ ID NO: 573072 - RNA, 14 nt, Homo sapiens
auaaaacucuccuu

SEQ ID NO: 573073 - RNA, 13 nt, Homo sapiens
auaaaacuuuccu

SEQ ID NO: 573074 - RNA, 22 nt, Homo sapiens
auaaaagaaauaaaccaaagga

SEQ ID NO: 573075 - RNA, 21 nt, Homo sapiens
auaaaagaaccgagcaauuuu

SEQ ID NO: 573076 - RNA, 16 nt, Homo sapiens
auaaaagacuauucua

SEQ ID NO: 573077 - RNA, 23 nt, Homo sapiens
auaaaagagaagaugaggcauga

SEQ ID NO: 573078 - RNA, 19 nt, Homo sapiens
auaaaagaguuaacauccc

SEQ ID NO: 573079 - RNA, 18 nt, Homo sapiens
auaaaagaugauuucuca

SEQ ID NO: 573080 - RNA, 14 nt, Homo sapiens
auaaaagauuuaca

SEQ ID NO: 573081 - RNA, 19 nt, Homo sapiens
auaaaagauuuacauucca

SEQ ID NO: 573082 - RNA, 20 nt, Homo sapiens
auaaaagcuagauacuggaa

SEQ ID NO: 573083 - RNA, 21 nt, Homo sapiens
auaaaagcuaugacacgagaa

SEQ ID NO: 573084 - RNA, 20 nt, Homo sapiens
auaaaagcuauggugagaug

SEQ ID NO: 573085 - RNA, 21 nt, Homo sapiens
auaaaaguuaauaacagcucc

SEQ ID NO: 573086 - RNA, 17 nt, Homo sapiens
auaaaauauaaucuaau

SEQ ID NO: 573087 - RNA, 23 nt, Homo sapiens
auaaaauauuuuugaaaggcaug

SEQ ID NO: 573088 - RNA, 23 nt, Homo sapiens
auaaaauccuaagacacaaaugc

SEQ ID NO: 573089 - RNA, 13 nt, Homo sapiens
auaaaaugaacau

SEQ ID NO: 573090 - RNA, 22 nt, Homo sapiens
auaaaaugguguuuucauguaa

SEQ ID NO: 573091 - RNA, 16 nt, Homo sapiens
auaaaauguaugacca

SEQ ID NO: 573092 - RNA, 18 nt, Homo sapiens
auaaaaugucuucuccca

SEQ ID NO: 573093 - RNA, 13 nt, Homo sapiens
auaaaaugugauu

SEQ ID NO: 573094 - RNA, 14 nt, Homo sapiens
auaaaauguuucau

SEQ ID NO: 573095 - RNA, 14 nt, Homo sapiens
auaaaauuagcuug

SEQ ID NO: 573096 - RNA, 15 nt, Homo sapiens
auaaaauuaugccau

SEQ ID NO: 573097 - RNA, 20 nt, Homo sapiens
auaaaauuaugccauagcaa

SEQ ID NO: 573098 - RNA, 18 nt, Homo sapiens
auaaaauugaaaguaaua

SEQ ID NO: 573099 - RNA, 23 nt, Homo sapiens
auaaaauugcaguuucauguaug

SEQ ID NO: 573100 - RNA, 14 nt, Homo sapiens
ccaccuacacagga

SEQ ID NO: 573101 - RNA, 13 nt, Homo sapiens
ccaccuagacugu

SEQ ID NO: 573102 - RNA, 15 nt, Homo sapiens
ccaccuagagcuaga

SEQ ID NO: 573103 - RNA, 19 nt, Homo sapiens
ccaccuagagcuagaugug

SEQ ID NO: 573104 - RNA, 23 nt, Homo sapiens
ccaccuauauccagaaggggagc

SEQ ID NO: 573105 - RNA, 13 nt, Homo sapiens
ccaccucagggca

SEQ ID NO: 573106 - RNA, 18 nt, Homo sapiens
ccaccucccauuacuuug

SEQ ID NO: 573107 - RNA, 22 nt, Homo sapiens
ccaccucccugacccgucuaau

SEQ ID NO: 573108 - RNA, 19 nt, Homo sapiens
ccaccucggcacacacugu

SEQ ID NO: 573109 - RNA, 20 nt, Homo sapiens
ccaccucugccuuacaaaau

SEQ ID NO: 573110 - RNA, 22 nt, Homo sapiens
ccaccucugccuuacaaaauac

SEQ ID NO: 573111 - RNA, 18 nt, Homo sapiens
ccaccucuuucuauuuau

SEQ ID NO: 573112 - RNA, 17 nt, Homo sapiens
ccaccugggcauaucca

SEQ ID NO: 573113 - RNA, 18 nt, Homo sapiens
ccaccuggggcuggggau

SEQ ID NO: 573114 - RNA, 21 nt, Homo sapiens
ccaccugugcccucaccacca

SEQ ID NO: 573115 - RNA, 22 nt, Homo sapiens
ccaccuguuaaaauguacacug

SEQ ID NO: 573116 - RNA, 22 nt, Homo sapiens
ccaccuguuuucugaaacacac

SEQ ID NO: 573117 - RNA, 21 nt, Homo sapiens
ccaccuuggacccuggugacc

SEQ ID NO: 573118 - RNA, 14 nt, Homo sapiens
ccacgacugccaug

SEQ ID NO: 573119 - RNA, 13 nt, Homo sapiens
ccacgagggugcc

SEQ ID NO: 573120 - RNA, 23 nt, Homo sapiens
ccacgagguuaaagaagcugcau

SEQ ID NO: 573121 - RNA, 14 nt, Homo sapiens
ccacgcccugucua

SEQ ID NO: 573122 - RNA, 19 nt, Homo sapiens
ccacggaggaugaugccag

SEQ ID NO: 573123 - RNA, 17 nt, Homo sapiens
ccacggggucugcagca

SEQ ID NO: 573124 - RNA, 22 nt, Homo sapiens
ccacguccagcuggaaggguca

SEQ ID NO: 573125 - RNA, 24 nt, Homo sapiens
ccacgucuggccaggcacugccuu

SEQ ID NO: 573126 - RNA, 19 nt, Homo sapiens
ccacgugggcaaacaggca

SEQ ID NO: 573127 - RNA, 20 nt, Homo sapiens
ccacgugggcaaacaggcag

SEQ ID NO: 573128 - RNA, 21 nt, Homo sapiens
ccacgugggcaaacaggcagu

SEQ ID NO: 573129 - RNA, 13 nt, Homo sapiens
ccacguucaggga

SEQ ID NO: 573130 - RNA, 20 nt, Homo sapiens
ccacguugccucuacuuuau

SEQ ID NO: 573131 - RNA, 13 nt, Homo sapiens
ccacuaaaacaca

SEQ ID NO: 573132 - RNA, 21 nt, Homo sapiens
ccacuaccagccagccucaga

SEQ ID NO: 573133 - RNA, 14 nt, Homo sapiens
ccacuacugcagca

SEQ ID NO: 573134 - RNA, 22 nt, Homo sapiens
ccacuaggguccaccaggaguu

SEQ ID NO: 573135 - RNA, 23 nt, Homo sapiens
auaaaggcauuucaaagucucac

SEQ ID NO: 573136 - RNA, 18 nt, Homo sapiens
auaaaggcccccacuucu

SEQ ID NO: 573137 - RNA, 14 nt, Homo sapiens
auaaagucaaggac

SEQ ID NO: 573138 - RNA, 23 nt, Homo sapiens
auaaagucauccucucacugcaa

SEQ ID NO: 573139 - RNA, 18 nt, Homo sapiens
auaaaguguaaguucaca

SEQ ID NO: 573140 - RNA, 16 nt, Homo sapiens
auaaaguuacuugaau

SEQ ID NO: 573141 - RNA, 19 nt, Homo sapiens
auaaaguuccccugugaca

SEQ ID NO: 573142 - RNA, 15 nt, Homo sapiens
auaaaguuccuguca

SEQ ID NO: 573143 - RNA, 17 nt, Homo sapiens
auaaaguuggugacaga

SEQ ID NO: 573144 - RNA, 20 nt, Homo sapiens
auaaaguuuuugacuuccuu

SEQ ID NO: 573145 - RNA, 15 nt, Homo sapiens
auaaauaaaguuuca

SEQ ID NO: 573146 - RNA, 23 nt, Homo sapiens
auaaauacaugcacacacuugca

SEQ ID NO: 573147 - RNA, 13 nt, Homo sapiens
auaaauaccucuu

SEQ ID NO: 573148 - RNA, 14 nt, Homo sapiens
auaaauacguguca

SEQ ID NO: 573149 - RNA, 13 nt, Homo sapiens
auaaauacuguca

SEQ ID NO: 573150 - RNA, 14 nt, Homo sapiens
auaaauacugucaa

SEQ ID NO: 573151 - RNA, 17 nt, Homo sapiens
auaaauagcugaaaacu

SEQ ID NO: 573152 - RNA, 18 nt, Homo sapiens
auaaauauacucaaguuu

SEQ ID NO: 573153 - RNA, 17 nt, Homo sapiens
auaaauauagagaugug

SEQ ID NO: 573154 - RNA, 16 nt, Homo sapiens
auaaauauauauucac

SEQ ID NO: 573155 - RNA, 16 nt, Homo sapiens
auaaauauauauucua

SEQ ID NO: 573156 - RNA, 14 nt, Homo sapiens
auaaauaugucaga

SEQ ID NO: 573157 - RNA, 15 nt, Homo sapiens
auaaauaugucagau

SEQ ID NO: 573158 - RNA, 14 nt, Homo sapiens
auaaaucaauucau

SEQ ID NO: 573159 - RNA, 19 nt, Homo sapiens
auaaaucagccuaaauguc

SEQ ID NO: 573160 - RNA, 13 nt, Homo sapiens
auaaaucauaaaa

SEQ ID NO: 573161 - RNA, 22 nt, Homo sapiens
auaaauccucagguaguacugg

SEQ ID NO: 573162 - RNA, 19 nt, Homo sapiens
auaaaugacaagugagaca

SEQ ID NO: 573163 - RNA, 13 nt, Homo sapiens
auaaaugacuguu

SEQ ID NO: 573164 - RNA, 20 nt, Homo sapiens
auaaauguaaauauguacac

SEQ ID NO: 573165 - RNA, 23 nt, Homo sapiens
auaaauguaccagagagaguugu

SEQ ID NO: 573166 - RNA, 14 nt, Homo sapiens
auaaauguauucaa

SEQ ID NO: 573167 - RNA, 18 nt, Homo sapiens
auaaaugucacugccaac

SEQ ID NO: 573168 - RNA, 15 nt, Homo sapiens
auaaauguugccaug

SEQ ID NO: 573169 - RNA, 15 nt, Homo sapiens
auaaauucacuuuca

SEQ ID NO: 573170 - RNA, 18 nt, Homo sapiens
auaaauucagaacaagca

SEQ ID NO: 573171 - RNA, 21 nt, Homo sapiens
auaaauucagccaacauguga

SEQ ID NO: 573172 - RNA, 18 nt, Homo sapiens
auaaauuccuacaacuua

SEQ ID NO: 573173 - RNA, 22 nt, Homo sapiens
auaaauugaacuaaauccaaac

SEQ ID NO: 573174 - RNA, 24 nt, Homo sapiens
auaaauuuuuuugcaauccuuucc

SEQ ID NO: 573175 - RNA, 13 nt, Homo sapiens
auaacaacuuuca

SEQ ID NO: 573176 - RNA, 19 nt, Homo sapiens
auaacaagugggugaaugu

SEQ ID NO: 573177 - RNA, 12 nt, Homo sapiens
auaacacugucu

SEQ ID NO: 573178 - RNA, 19 nt, Homo sapiens
auaacacuguuggcacuua

SEQ ID NO: 573179 - RNA, 20 nt, Homo sapiens
auaacagaaagccuggguga

SEQ ID NO: 573180 - RNA, 13 nt, Homo sapiens
auaacagcauucu

SEQ ID NO: 573181 - RNA, 11 nt, Homo sapiens
auaacaguguu

SEQ ID NO: 573182 - RNA, 18 nt, Homo sapiens
auaacaguuacuccagua

SEQ ID NO: 573183 - RNA, 21 nt, Homo sapiens
auaacauuuaaauuccacaga

SEQ ID NO: 573184 - RNA, 17 nt, Homo sapiens
auaacauuuuauacaau

SEQ ID NO: 573185 - RNA, 15 nt, Homo sapiens
auaaccaaaaggagc

SEQ ID NO: 573186 - RNA, 18 nt, Homo sapiens
auaaccccaggcacuguu

SEQ ID NO: 573187 - RNA, 15 nt, Homo sapiens
auaacccccugccca

SEQ ID NO: 573188 - RNA, 22 nt, Homo sapiens
auaacccugccagugccagggu

SEQ ID NO: 573189 - RNA, 16 nt, Homo sapiens
auaaccuugugccuug

SEQ ID NO: 573190 - RNA, 14 nt, Homo sapiens
auaacgucugccuu

SEQ ID NO: 573191 - RNA, 22 nt, Homo sapiens
auaacuaggcguggacuuacua

SEQ ID NO: 573192 - RNA, 22 nt, Homo sapiens
auaacuauugauauaauuucca

SEQ ID NO: 573193 - RNA, 18 nt, Homo sapiens
auaacucugcacuacucc

SEQ ID NO: 573194 - RNA, 15 nt, Homo sapiens
auaacucuucuaaca

SEQ ID NO: 573195 - RNA, 16 nt, Homo sapiens
auaacugaacauccaa

SEQ ID NO: 573196 - RNA, 19 nt, Homo sapiens
auaacuggaaaacagaaca

SEQ ID NO: 573197 - RNA, 14 nt, Homo sapiens
auaacuguucucau

SEQ ID NO: 573198 - RNA, 21 nt, Homo sapiens
auaacuuaaaaaaaugacaga

SEQ ID NO: 573199 - RNA, 22 nt, Homo sapiens
auaacuuggccauguucuccau

SEQ ID NO: 573200 - RNA, 19 nt, Homo sapiens
auaacuuuauugcauauag

SEQ ID NO: 573201 - RNA, 18 nt, Homo sapiens
auaacuuuucaccaauga

SEQ ID NO: 573202 - RNA, 17 nt, Homo sapiens
auaagaaagcacuauua

SEQ ID NO: 573203 - RNA, 17 nt, Homo sapiens
auaagaacugugcagua

SEQ ID NO: 573204 - RNA, 18 nt, Homo sapiens
auaagaaucuauaguuca

SEQ ID NO: 573205 - RNA, 23 nt, Homo sapiens
auaagaaugguuuguaaaaucca

SEQ ID NO: 573206 - RNA, 15 nt, Homo sapiens
auaagaauugucucu

SEQ ID NO: 573207 - RNA, 15 nt, Homo sapiens
auaagacaaugacau

SEQ ID NO: 573208 - RNA, 14 nt, Homo sapiens
auaagaccacuaca

SEQ ID NO: 573209 - RNA, 18 nt, Homo sapiens
auaagagugccguaacaa

SEQ ID NO: 573210 - RNA, 22 nt, Homo sapiens
auaagaguugagauuuugcaau

SEQ ID NO: 573211 - RNA, 18 nt, Homo sapiens
auaagauauauaugugcu

SEQ ID NO: 573212 - RNA, 14 nt, Homo sapiens
auaagauuccaaaa

SEQ ID NO: 573213 - RNA, 22 nt, Homo sapiens
auaagauuccaaaaagcacaua

SEQ ID NO: 573214 - RNA, 14 nt, Homo sapiens
auaagcaagagaca

SEQ ID NO: 573215 - RNA, 18 nt, Homo sapiens
auaagcuaaagaggcuga

SEQ ID NO: 573216 - RNA, 13 nt, Homo sapiens
auaagcuacaugu

SEQ ID NO: 573217 - RNA, 19 nt, Homo sapiens
auaagcuacuagcaaaaua

SEQ ID NO: 573218 - RNA, 21 nt, Homo sapiens
auaagcucaauuuaauuuugc

SEQ ID NO: 573219 - RNA, 19 nt, Homo sapiens
auaagcuuucucucagaaa

SEQ ID NO: 573220 - RNA, 20 nt, Homo sapiens
auaagcuuucucucagaaau

SEQ ID NO: 573221 - RNA, 14 nt, Homo sapiens
cauucuaaaccaaa

SEQ ID NO: 573222 - RNA, 15 nt, Homo sapiens
cauucuaaaccaaaa

SEQ ID NO: 573223 - RNA, 17 nt, Homo sapiens
cauucuaguacuuggga

SEQ ID NO: 573224 - RNA, 15 nt, Homo sapiens
cauucuauagccaua

SEQ ID NO: 573225 - RNA, 17 nt, Homo sapiens
cauucuauuuuggguau

SEQ ID NO: 573226 - RNA, 19 nt, Homo sapiens
cauucucaccaacuuguag

SEQ ID NO: 573227 - RNA, 12 nt, Homo sapiens
cauucuccugcc

SEQ ID NO: 573228 - RNA, 15 nt, Homo sapiens
cauucuccugccuca

SEQ ID NO: 573229 - RNA, 16 nt, Homo sapiens
cauucuccugccucag

SEQ ID NO: 573230 - RNA, 15 nt, Homo sapiens
cauucucgcuucccu

SEQ ID NO: 573231 - RNA, 13 nt, Homo sapiens
cauucucugaguc

SEQ ID NO: 573232 - RNA, 14 nt, Homo sapiens
cauucugaccauuu

SEQ ID NO: 573233 - RNA, 17 nt, Homo sapiens
cauucugacucauaucc

SEQ ID NO: 573234 - RNA, 17 nt, Homo sapiens
cauucugcauugcuaga

SEQ ID NO: 573235 - RNA, 16 nt, Homo sapiens
cauucuggaucugacc

SEQ ID NO: 573236 - RNA, 19 nt, Homo sapiens
cauucuguggccagccaaa

SEQ ID NO: 573237 - RNA, 20 nt, Homo sapiens
cauucuguggccagccaaaa

SEQ ID NO: 573238 - RNA, 17 nt, Homo sapiens
cauucuguuagauacua

SEQ ID NO: 573239 - RNA, 21 nt, Homo sapiens
cauucuuaaauauuuccauca

SEQ ID NO: 573240 - RNA, 18 nt, Homo sapiens
cauucuuaacaaacucuu

SEQ ID NO: 573241 - RNA, 12 nt, Homo sapiens
cauucuucucac

SEQ ID NO: 573242 - RNA, 13 nt, Homo sapiens
cauucuucucaca

SEQ ID NO: 573243 - RNA, 19 nt, Homo sapiens
cauucuucugagcacuguu

SEQ ID NO: 573244 - RNA, 22 nt, Homo sapiens
cauucuuuauaaaauguauaaa

SEQ ID NO: 573245 - RNA, 19 nt, Homo sapiens
cauucuuuuaaaagacaag

SEQ ID NO: 573246 - RNA, 18 nt, Homo sapiens
cauucuuuuuucuauuca

SEQ ID NO: 573247 - RNA, 20 nt, Homo sapiens
cauugaaagagaaccaguuu

SEQ ID NO: 573248 - RNA, 18 nt, Homo sapiens
cauugaaauuuacuguga

SEQ ID NO: 573249 - RNA, 18 nt, Homo sapiens
cauugaacagcaaaguag

SEQ ID NO: 573250 - RNA, 18 nt, Homo sapiens
cauugagccaguggugcu

SEQ ID NO: 573251 - RNA, 14 nt, Homo sapiens
cauugagucccugc

SEQ ID NO: 573252 - RNA, 15 nt, Homo sapiens
cauugauacaaagua

SEQ ID NO: 573253 - RNA, 14 nt, Homo sapiens
cauugauacaugca

SEQ ID NO: 573254 - RNA, 20 nt, Homo sapiens
cauugaugacccucugaccc

SEQ ID NO: 573255 - RNA, 23 nt, Homo sapiens
cauugaugagcaagacauacuua

SEQ ID NO: 573256 - RNA, 15 nt, Homo sapiens
cauugauugcuaaau

SEQ ID NO: 573257 - RNA, 17 nt, Homo sapiens
cauugcaaacagaaggu

SEQ ID NO: 573258 - RNA, 13 nt, Homo sapiens
cauugcacuccag

SEQ ID NO: 573259 - RNA, 20 nt, Homo sapiens
cauugcacucuagccuggca

SEQ ID NO: 573260 - RNA, 24 nt, Homo sapiens
cauugcacucuagccuggcaacag

SEQ ID NO: 573261 - RNA, 14 nt, Homo sapiens
cauugcacuuugau

SEQ ID NO: 573262 - RNA, 15 nt, Homo sapiens
cauugcaguuuaaga

SEQ ID NO: 573263 - RNA, 20 nt, Homo sapiens
cauugccaauuagacaaaca

SEQ ID NO: 573264 - RNA, 19 nt, Homo sapiens
cauugcgauuuaucuugcu

SEQ ID NO: 573265 - RNA, 12 nt, Homo sapiens
cauugcugccaa

SEQ ID NO: 573266 - RNA, 17 nt, Homo sapiens
cauugcuggacuagcaa

SEQ ID NO: 573267 - RNA, 15 nt, Homo sapiens
cauugcuuuccacug

SEQ ID NO: 573268 - RNA, 17 nt, Homo sapiens
cauuggaauaaggcaug

SEQ ID NO: 573269 - RNA, 13 nt, Homo sapiens
cauuggagcauuu

SEQ ID NO: 573270 - RNA, 23 nt, Homo sapiens
cauuggcuauuuaaaacuuguaa

SEQ ID NO: 573271 - RNA, 20 nt, Homo sapiens
cauuggggauugaaaaucau

SEQ ID NO: 573272 - RNA, 20 nt, Homo sapiens
cauugggguuccgcacuuuc

SEQ ID NO: 573273 - RNA, 14 nt, Homo sapiens
cauuggguucaagg

SEQ ID NO: 573274 - RNA, 16 nt, Homo sapiens
cauuggguucaaggaa

SEQ ID NO: 573275 - RNA, 13 nt, Homo sapiens
cauuggugacuca

SEQ ID NO: 573276 - RNA, 16 nt, Homo sapiens
cauuggugacucacuu

SEQ ID NO: 573277 - RNA, 14 nt, Homo sapiens
cauuguaaaagcau

SEQ ID NO: 573278 - RNA, 21 nt, Homo sapiens
cauuguaaaguuuaugucacc

SEQ ID NO: 573279 - RNA, 14 nt, Homo sapiens
cauuguagccucaa

SEQ ID NO: 573280 - RNA, 22 nt, Homo sapiens
cauuguaugauguguugugaua

SEQ ID NO: 573281 - RNA, 20 nt, Homo sapiens
cauuguccauuacuugccag

SEQ ID NO: 573282 - RNA, 12 nt, Homo sapiens
cauugucccuga

SEQ ID NO: 573283 - RNA, 21 nt, Homo sapiens
cauugucccugaaugcuccau

SEQ ID NO: 573284 - RNA, 18 nt, Homo sapiens
cauuguggacuguaucca

SEQ ID NO: 573285 - RNA, 15 nt, Homo sapiens
cauuguuauaaagac

SEQ ID NO: 573286 - RNA, 18 nt, Homo sapiens
cauuguugucuucacuua

SEQ ID NO: 573287 - RNA, 19 nt, Homo sapiens
cauuguuuucuuuuacaga

SEQ ID NO: 573288 - RNA, 18 nt, Homo sapiens
cauuuaaaaaaaaucccu

SEQ ID NO: 573289 - RNA, 20 nt, Homo sapiens
cauuuaaaaaaaucacaaaa

SEQ ID NO: 573290 - RNA, 12 nt, Homo sapiens
cauuuaaaacau

SEQ ID NO: 573291 - RNA, 20 nt, Homo sapiens
cauuuaaaaggacugcugau

SEQ ID NO: 573292 - RNA, 22 nt, Homo sapiens
cauuuaaaauugcuauguuacu

SEQ ID NO: 573293 - RNA, 18 nt, Homo sapiens
cauuuaaagagauuuccc

SEQ ID NO: 573294 - RNA, 17 nt, Homo sapiens
cauuuaaauguguacaa

SEQ ID NO: 573295 - RNA, 14 nt, Homo sapiens
cauuuaaauuccac

SEQ ID NO: 573296 - RNA, 20 nt, Homo sapiens
cauuuaaauuccacagauua

SEQ ID NO: 573297 - RNA, 21 nt, Homo sapiens
cauuuaaauuccacagauuau

SEQ ID NO: 573298 - RNA, 22 nt, Homo sapiens
cauuuacagaaacgcauccagc

SEQ ID NO: 573299 - RNA, 11 nt, Homo sapiens
cauuuaccaaa

SEQ ID NO: 573300 - RNA, 19 nt, Homo sapiens
cauuuaccagcagcccugg

SEQ ID NO: 573301 - RNA, 21 nt, Homo sapiens
cauuuagaacuuuaagucuca

SEQ ID NO: 573302 - RNA, 22 nt, Homo sapiens
cauuuagaggacauucuggaaa

SEQ ID NO: 573303 - RNA, 22 nt, Homo sapiens
cauuuagcuuguuccacugcaa

SEQ ID NO: 573304 - RNA, 23 nt, Homo sapiens
cauuuagcuuguuccacugcaaa

SEQ ID NO: 573305 - RNA, 22 nt, Homo sapiens
cauuuaguuugauuauucagug

SEQ ID NO: 573306 - RNA, 16 nt, Homo sapiens
cauuuauagaugucag

SEQ ID NO: 573307 - RNA, 18 nt, Homo sapiens
cauuuaucuaaauaugga

SEQ ID NO: 573308 - RNA, 16 nt, Homo sapiens
cauuuaugaugcaguu

SEQ ID NO: 573309 - RNA, 15 nt, Homo sapiens
cauuucaaaguuugg

SEQ ID NO: 573310 - RNA, 15 nt, Homo sapiens
cauuucacacaguga

SEQ ID NO: 573311 - RNA, 21 nt, Homo sapiens
cauuucacagugcccaagagu

SEQ ID NO: 573312 - RNA, 12 nt, Homo sapiens
cauuucaucuca

SEQ ID NO: 573313 - RNA, 21 nt, Homo sapiens
cauuucaucucauuuaaggga

SEQ ID NO: 573314 - RNA, 13 nt, Homo sapiens
cauuucaucuggg

SEQ ID NO: 573315 - RNA, 22 nt, Homo sapiens
cauuucauuguaugauguguug

SEQ ID NO: 573316 - RNA, 17 nt, Homo sapiens
augagcuagugucuuau

SEQ ID NO: 573317 - RNA, 17 nt, Homo sapiens
augagcugacaucucag

SEQ ID NO: 573318 - RNA, 18 nt, Homo sapiens
augagcugacaucucagu

SEQ ID NO: 573319 - RNA, 22 nt, Homo sapiens
augagcuguggacuagcaauau

SEQ ID NO: 573320 - RNA, 21 nt, Homo sapiens
augaggaaaacuguagucucu

SEQ ID NO: 573321 - RNA, 17 nt, Homo sapiens
augaggaauauuugcaa

SEQ ID NO: 573322 - RNA, 19 nt, Homo sapiens
augaggacaagagggacaa

SEQ ID NO: 573323 - RNA, 13 nt, Homo sapiens
augaggacagagu

SEQ ID NO: 573324 - RNA, 19 nt, Homo sapiens
augaggauuauugauagua

SEQ ID NO: 573325 - RNA, 13 nt, Homo sapiens
augaggcauuugu

SEQ ID NO: 573326 - RNA, 18 nt, Homo sapiens
augagggccucguuuauu

SEQ ID NO: 573327 - RNA, 14 nt, Homo sapiens
augaggggccucag

SEQ ID NO: 573328 - RNA, 16 nt, Homo sapiens
augagggugacuguca

SEQ ID NO: 573329 - RNA, 13 nt, Homo sapiens
augaggucuuccc

SEQ ID NO: 573330 - RNA, 23 nt, Homo sapiens
augaggucuucccgcaaggccuc

SEQ ID NO: 573331 - RNA, 20 nt, Homo sapiens
augaggugguggaguggagu

SEQ ID NO: 573332 - RNA, 16 nt, Homo sapiens
augaguaacaggaaaa

SEQ ID NO: 573333 - RNA, 21 nt, Homo sapiens
augaguaacauuugcuguuuu

SEQ ID NO: 573334 - RNA, 17 nt, Homo sapiens
augaguaauacaucaaa

SEQ ID NO: 573335 - RNA, 21 nt, Homo sapiens
augaguagauaauuucagggu

SEQ ID NO: 573336 - RNA, 16 nt, Homo sapiens
augaguaguguggaau

SEQ ID NO: 573337 - RNA, 15 nt, Homo sapiens
augagucaaugugca

SEQ ID NO: 573338 - RNA, 13 nt, Homo sapiens
augagucagucaa

SEQ ID NO: 573339 - RNA, 14 nt, Homo sapiens
augaguccuugaaa

SEQ ID NO: 573340 - RNA, 21 nt, Homo sapiens
augagucuuuauuuuuuguua

SEQ ID NO: 573341 - RNA, 13 nt, Homo sapiens
augagugcuuaaa

SEQ ID NO: 573342 - RNA, 15 nt, Homo sapiens
augaguuucacugua

SEQ ID NO: 573343 - RNA, 20 nt, Homo sapiens
augaguuucacuguacugca

SEQ ID NO: 573344 - RNA, 22 nt, Homo sapiens
augaguuuuugauagcuuuauu

SEQ ID NO: 573345 - RNA, 19 nt, Homo sapiens
augauaaauguacagagua

SEQ ID NO: 573346 - RNA, 20 nt, Homo sapiens
augauaaauuaagcaugaaa

SEQ ID NO: 573347 - RNA, 16 nt, Homo sapiens
augauaaggcucugaa

SEQ ID NO: 573348 - RNA, 17 nt, Homo sapiens
augauaauaaaggcauu

SEQ ID NO: 573349 - RNA, 13 nt, Homo sapiens
augauacaguauu

SEQ ID NO: 573350 - RNA, 18 nt, Homo sapiens
augauacuguuucuugca

SEQ ID NO: 573351 - RNA, 16 nt, Homo sapiens
augauagaugacaaau

SEQ ID NO: 573352 - RNA, 18 nt, Homo sapiens
augauauuccccauuucc

SEQ ID NO: 573353 - RNA, 23 nt, Homo sapiens
augauauuuuaugcaaacaguuc

SEQ ID NO: 573354 - RNA, 20 nt, Homo sapiens
augaucaaaaccugugccag

SEQ ID NO: 573355 - RNA, 16 nt, Homo sapiens
augaucaaggugaaau

SEQ ID NO: 573356 - RNA, 19 nt, Homo sapiens
augaucagcaucugugaug

SEQ ID NO: 573357 - RNA, 17 nt, Homo sapiens
augaucagcuguuuguc

SEQ ID NO: 573358 - RNA, 20 nt, Homo sapiens
augaucagcuguuugucaua

SEQ ID NO: 573359 - RNA, 20 nt, Homo sapiens
augaucaguguuacugccua

SEQ ID NO: 573360 - RNA, 14 nt, Homo sapiens
augauccagaacag

SEQ ID NO: 573361 - RNA, 18 nt, Homo sapiens
augauccccaagugugaa

SEQ ID NO: 573362 - RNA, 16 nt, Homo sapiens
augaucccuaaugugu

SEQ ID NO: 573363 - RNA, 16 nt, Homo sapiens
augauccugccaaucu

SEQ ID NO: 573364 - RNA, 17 nt, Homo sapiens
augauccuugcugauaa

SEQ ID NO: 573365 - RNA, 23 nt, Homo sapiens
augauccuuuuuugucauuuuau

SEQ ID NO: 573366 - RNA, 17 nt, Homo sapiens
augaucuggauccacca

SEQ ID NO: 573367 - RNA, 20 nt, Homo sapiens
augaugaaaacuaaggauuu

SEQ ID NO: 573368 - RNA, 14 nt, Homo sapiens
augaugaaacauuc

SEQ ID NO: 573369 - RNA, 14 nt, Homo sapiens
augaugaagaccaa

SEQ ID NO: 573370 - RNA, 14 nt, Homo sapiens
augaugacuccucu

SEQ ID NO: 573371 - RNA, 15 nt, Homo sapiens
augaugagcauuuag

SEQ ID NO: 573372 - RNA, 12 nt, Homo sapiens
augaugaucugg

SEQ ID NO: 573373 - RNA, 15 nt, Homo sapiens
augaugauguggaag

SEQ ID NO: 573374 - RNA, 18 nt, Homo sapiens
augaugcgggacugcugg

SEQ ID NO: 573375 - RNA, 18 nt, Homo sapiens
augaugcuagccagcaaa

SEQ ID NO: 573376 - RNA, 13 nt, Homo sapiens
augaugcuaugaa

SEQ ID NO: 573377 - RNA, 22 nt, Homo sapiens
augauggaaaaaauacauugaa

SEQ ID NO: 573378 - RNA, 13 nt, Homo sapiens
augccgauuucau

SEQ ID NO: 573379 - RNA, 18 nt, Homo sapiens
augccuaaaaaguaucau

SEQ ID NO: 573380 - RNA, 18 nt, Homo sapiens
augccuacugaugucagu

SEQ ID NO: 573381 - RNA, 20 nt, Homo sapiens
augccuauguacucuacgcc

SEQ ID NO: 573382 - RNA, 23 nt, Homo sapiens
augccuauguacucuacgccaaa

SEQ ID NO: 573383 - RNA, 19 nt, Homo sapiens
augccucaccacacccagg

SEQ ID NO: 573384 - RNA, 20 nt, Homo sapiens
augccucacgagauuugcca

SEQ ID NO: 573385 - RNA, 16 nt, Homo sapiens
augccucuguauuuaa

SEQ ID NO: 573386 - RNA, 21 nt, Homo sapiens
augccugccccccucaucuca

SEQ ID NO: 573387 - RNA, 14 nt, Homo sapiens
augccugcuugaua

SEQ ID NO: 573388 - RNA, 18 nt, Homo sapiens
augccuguaacccuggca

SEQ ID NO: 573389 - RNA, 15 nt, Homo sapiens
augccuguaaucuca

SEQ ID NO: 573390 - RNA, 23 nt, Homo sapiens
augccuguaaucucagcacuuug

SEQ ID NO: 573391 - RNA, 15 nt, Homo sapiens
augccuuaagcagaa

SEQ ID NO: 573392 - RNA, 12 nt, Homo sapiens
augccuuacucu

SEQ ID NO: 573393 - RNA, 17 nt, Homo sapiens
augccuucacuuuacaa

SEQ ID NO: 573394 - RNA, 18 nt, Homo sapiens
augccuuuaaaucuguga

SEQ ID NO: 573395 - RNA, 22 nt, Homo sapiens
augccuuucuaguccuauucua

SEQ ID NO: 573396 - RNA, 22 nt, Homo sapiens
augccuuuucccaaaauguuga

SEQ ID NO: 573397 - RNA, 22 nt, Homo sapiens
augcgaaccacccaaaacacgc

SEQ ID NO: 573398 - RNA, 15 nt, Homo sapiens
augcgcagugccuug

SEQ ID NO: 573399 - RNA, 21 nt, Homo sapiens
augcggaccaaacuacuucau

SEQ ID NO: 573400 - RNA, 20 nt, Homo sapiens
augcgguagccagcacacag

SEQ ID NO: 573401 - RNA, 18 nt, Homo sapiens
augcguaaacgacacucu

SEQ ID NO: 573402 - RNA, 19 nt, Homo sapiens
augcguacguuuccugaga

SEQ ID NO: 573403 - RNA, 22 nt, Homo sapiens
augcgucugucguugugcuuuu

SEQ ID NO: 573404 - RNA, 20 nt, Homo sapiens
augcuaacaaagacaaaagu

SEQ ID NO: 573405 - RNA, 22 nt, Homo sapiens
augcuaccacugguacuuccuu

SEQ ID NO: 573406 - RNA, 22 nt, Homo sapiens
augcuagaaaggaagacagauu

SEQ ID NO: 573407 - RNA, 22 nt, Homo sapiens
augcuaguuugaccucauuugu

SEQ ID NO: 573408 - RNA, 16 nt, Homo sapiens
augcuauacuggaaau

SEQ ID NO: 573409 - RNA, 20 nt, Homo sapiens
augcucaaaaucuuuccaaa

SEQ ID NO: 573410 - RNA, 13 nt, Homo sapiens
augcucagaaagg

SEQ ID NO: 573411 - RNA, 18 nt, Homo sapiens
augcucaggcuacuauag

SEQ ID NO: 573412 - RNA, 14 nt, Homo sapiens
augcucagugccuu

SEQ ID NO: 573413 - RNA, 21 nt, Homo sapiens
augcucaguuggugcugcuuu

SEQ ID NO: 573414 - RNA, 20 nt, Homo sapiens
augcuccauuuuuaaccacu

SEQ ID NO: 573415 - RNA, 15 nt, Homo sapiens
augcucgugugauuu

SEQ ID NO: 573416 - RNA, 22 nt, Homo sapiens
augcucuauguuuguauuugga

SEQ ID NO: 573417 - RNA, 12 nt, Homo sapiens
augcucucucau

SEQ ID NO: 573418 - RNA, 17 nt, Homo sapiens
augcucugcauguuaca

SEQ ID NO: 573419 - RNA, 22 nt, Homo sapiens
augcucuggcuugccccaggac

SEQ ID NO: 573420 - RNA, 18 nt, Homo sapiens
augcucuuguucuguucc

SEQ ID NO: 573421 - RNA, 18 nt, Homo sapiens
augcugaaaacuacacaa

SEQ ID NO: 573422 - RNA, 23 nt, Homo sapiens
augcugaaaaucaaaguaaaaaa

SEQ ID NO: 573423 - RNA, 18 nt, Homo sapiens
augcugaacauugcauau

SEQ ID NO: 573424 - RNA, 16 nt, Homo sapiens
augcugaagacauuca

SEQ ID NO: 573425 - RNA, 16 nt, Homo sapiens
augcugaauacuccuc

SEQ ID NO: 573426 - RNA, 18 nt, Homo sapiens
augcugaauaucuguuca

SEQ ID NO: 573427 - RNA, 18 nt, Homo sapiens
augcugacagcucuucac

SEQ ID NO: 573428 - RNA, 20 nt, Homo sapiens
augcugacagcucuucacag

SEQ ID NO: 573429 - RNA, 14 nt, Homo sapiens
augcugacauucac

SEQ ID NO: 573430 - RNA, 13 nt, Homo sapiens
augcugacuguac

SEQ ID NO: 573431 - RNA, 17 nt, Homo sapiens
augcugagaagaucuga

SEQ ID NO: 573432 - RNA, 15 nt, Homo sapiens
augcugcuaauucaa

SEQ ID NO: 573433 - RNA, 11 nt, Homo sapiens
augcugcuaug

SEQ ID NO: 573434 - RNA, 23 nt, Homo sapiens
augcugcugagguuuugaaagaa

SEQ ID NO: 573435 - RNA, 14 nt, Homo sapiens
augcugcuugccuc

SEQ ID NO: 573436 - RNA, 19 nt, Homo sapiens
augcugcuuguuggcucca

SEQ ID NO: 573437 - RNA, 20 nt, Homo sapiens
augcuggaaccugcaaaaaa

SEQ ID NO: 573438 - RNA, 17 nt, Homo sapiens
augcugggcccucuuau

SEQ ID NO: 573439 - RNA, 20 nt, Homo sapiens
augcugggcucaucuucuag

SEQ ID NO: 573440 - RNA, 17 nt, Homo sapiens
augaacuggaccugcac

SEQ ID NO: 573441 - RNA, 17 nt, Homo sapiens
augaacuuaaaaugaaa

SEQ ID NO: 573442 - RNA, 20 nt, Homo sapiens
augaacuuuaaaaaagcaaa

SEQ ID NO: 573443 - RNA, 22 nt, Homo sapiens
augaagaacacagcaugugcca

SEQ ID NO: 573444 - RNA, 15 nt, Homo sapiens
augaagaagacaccu

SEQ ID NO: 573445 - RNA, 14 nt, Homo sapiens
augaagagcugucu

SEQ ID NO: 573446 - RNA, 15 nt, Homo sapiens
augaagaucauauac

SEQ ID NO: 573447 - RNA, 19 nt, Homo sapiens
augaagauggacauuuuag

SEQ ID NO: 573448 - RNA, 14 nt, Homo sapiens
augaagcacaucaa

SEQ ID NO: 573449 - RNA, 14 nt, Homo sapiens
augaagcacugagc

SEQ ID NO: 573450 - RNA, 12 nt, Homo sapiens
augaagccuuug

SEQ ID NO: 573451 - RNA, 20 nt, Homo sapiens
augaagcuaauugugcacau

SEQ ID NO: 573452 - RNA, 16 nt, Homo sapiens
augaaggcagagccau

SEQ ID NO: 573453 - RNA, 13 nt, Homo sapiens
augaagggaaauu

SEQ ID NO: 573454 - RNA, 22 nt, Homo sapiens
augaagguuuguuccuuuguua

SEQ ID NO: 573455 - RNA, 17 nt, Homo sapiens
augaagugacucucaca

SEQ ID NO: 573456 - RNA, 23 nt, Homo sapiens
augaagugcuuuguaucaggaaa

SEQ ID NO: 573457 - RNA, 21 nt, Homo sapiens
augaagugggcuccaguauua

SEQ ID NO: 573458 - RNA, 17 nt, Homo sapiens
augaaguucuaucuagu

SEQ ID NO: 573459 - RNA, 18 nt, Homo sapiens
augaauaaauuccuucaa

SEQ ID NO: 573460 - RNA, 21 nt, Homo sapiens
augaauaacauuuaaauucca

SEQ ID NO: 573461 - RNA, 12 nt, Homo sapiens
augaauaagcuu

SEQ ID NO: 573462 - RNA, 19 nt, Homo sapiens
augaauaagcuuucucuca

SEQ ID NO: 573463 - RNA, 19 nt, Homo sapiens
augaauacuuugcagcaca

SEQ ID NO: 573464 - RNA, 13 nt, Homo sapiens
augaauagccagg

SEQ ID NO: 573465 - RNA, 18 nt, Homo sapiens
augaauauauuaaucagc

SEQ ID NO: 573466 - RNA, 18 nt, Homo sapiens
augaauauuuuguaacua

SEQ ID NO: 573467 - RNA, 14 nt, Homo sapiens
augaaucaaagaca

SEQ ID NO: 573468 - RNA, 17 nt, Homo sapiens
augaaucaaagacaugg

SEQ ID NO: 573469 - RNA, 22 nt, Homo sapiens
augaaucaaucaauucauaucu

SEQ ID NO: 573470 - RNA, 14 nt, Homo sapiens
augaaucacaguau

SEQ ID NO: 573471 - RNA, 14 nt, Homo sapiens
augaaucauauuca

SEQ ID NO: 573472 - RNA, 18 nt, Homo sapiens
augaaucauugauugaau

SEQ ID NO: 573473 - RNA, 21 nt, Homo sapiens
augaaucuucacaaaacacuu

SEQ ID NO: 573474 - RNA, 12 nt, Homo sapiens
augaaugcacac

SEQ ID NO: 573475 - RNA, 13 nt, Homo sapiens
augaaugcagauu

SEQ ID NO: 573476 - RNA, 15 nt, Homo sapiens
augaaugcagauuac

SEQ ID NO: 573477 - RNA, 20 nt, Homo sapiens
augaaugccuaaauauaauu

SEQ ID NO: 573478 - RNA, 24 nt, Homo sapiens
augaaugcuuuuagugugugcaua

SEQ ID NO: 573479 - RNA, 16 nt, Homo sapiens
augaauguaugugcac

SEQ ID NO: 573480 - RNA, 22 nt, Homo sapiens
augaaugucacauuugaauucu

SEQ ID NO: 573481 - RNA, 23 nt, Homo sapiens
augaauguuuacacucuuuguaa

SEQ ID NO: 573482 - RNA, 23 nt, Homo sapiens
augaauucuuccucuccuuccca

SEQ ID NO: 573483 - RNA, 12 nt, Homo sapiens
augaauucuuga

SEQ ID NO: 573484 - RNA, 23 nt, Homo sapiens
augaauucuugauuuccuuucag

SEQ ID NO: 573485 - RNA, 19 nt, Homo sapiens
augaauugcauuuuacuuu

SEQ ID NO: 573486 - RNA, 16 nt, Homo sapiens
augaauuuaaggcaaa

SEQ ID NO: 573487 - RNA, 21 nt, Homo sapiens
augaauuuaucuuuaccaaaa

SEQ ID NO: 573488 - RNA, 21 nt, Homo sapiens
augaauuugagcaggucucau

SEQ ID NO: 573489 - RNA, 23 nt, Homo sapiens
augaauuugggauacuaaaguag

SEQ ID NO: 573490 - RNA, 19 nt, Homo sapiens
augaauuuuuuucaucuuc

SEQ ID NO: 573491 - RNA, 14 nt, Homo sapiens
augacaaagacuga

SEQ ID NO: 573492 - RNA, 16 nt, Homo sapiens
augacaaaggcacuga

SEQ ID NO: 573493 - RNA, 13 nt, Homo sapiens
augacaagcacua

SEQ ID NO: 573494 - RNA, 18 nt, Homo sapiens
augacaaugaugaugaua

SEQ ID NO: 573495 - RNA, 19 nt, Homo sapiens
augacaaugaugaugauaa

SEQ ID NO: 573496 - RNA, 19 nt, Homo sapiens
augacacaggcugacucau

SEQ ID NO: 573497 - RNA, 15 nt, Homo sapiens
augacaggcuguuca

SEQ ID NO: 573498 - RNA, 22 nt, Homo sapiens
augacagugaauauugcuuuua

SEQ ID NO: 573499 - RNA, 12 nt, Homo sapiens
augacagugcua

SEQ ID NO: 573500 - RNA, 15 nt, Homo sapiens
augacauauguagau

SEQ ID NO: 573501 - RNA, 15 nt, Homo sapiens
augacaucucagggg

SEQ ID NO: 573502 - RNA, 13 nt, Homo sapiens
augacauguuccu

SEQ ID NO: 573503 - RNA, 12 nt, Homo sapiens
augacauuucau

SEQ ID NO: 573504 - RNA, 17 nt, Homo sapiens
aucucauagguugccaa

SEQ ID NO: 573505 - RNA, 18 nt, Homo sapiens
aucucauccuuuccucua

SEQ ID NO: 573506 - RNA, 23 nt, Homo sapiens
aucucauucccagagucagagga

SEQ ID NO: 573507 - RNA, 22 nt, Homo sapiens
aucucauugcuuacaagccuaa

SEQ ID NO: 573508 - RNA, 17 nt, Homo sapiens
aucucauuuaagggaaa

SEQ ID NO: 573509 - RNA, 15 nt, Homo sapiens
aucuccaagaccaga

SEQ ID NO: 573510 - RNA, 18 nt, Homo sapiens
aucuccaagaccagagau

SEQ ID NO: 573511 - RNA, 12 nt, Homo sapiens
aucuccaaggac

SEQ ID NO: 573512 - RNA, 21 nt, Homo sapiens
aucuccacggucagauuugcu

SEQ ID NO: 573513 - RNA, 15 nt, Homo sapiens
aucuccacugauaag

SEQ ID NO: 573514 - RNA, 22 nt, Homo sapiens
aucuccagggaguccccucccc

SEQ ID NO: 573515 - RNA, 21 nt, Homo sapiens
aucuccaguuuauagaccaga

SEQ ID NO: 573516 - RNA, 17 nt, Homo sapiens
aucuccauauguuacac

SEQ ID NO: 573517 - RNA, 21 nt, Homo sapiens
aucuccccucagauuccaccu

SEQ ID NO: 573518 - RNA, 21 nt, Homo sapiens
aucuccugacagaaggugcca

SEQ ID NO: 573519 - RNA, 13 nt, Homo sapiens
aucuccugaguau

SEQ ID NO: 573520 - RNA, 20 nt, Homo sapiens
aucuccuggaggcugguucu

SEQ ID NO: 573521 - RNA, 15 nt, Homo sapiens
aucuccuguccauca

SEQ ID NO: 573522 - RNA, 15 nt, Homo sapiens
aucuccuuccagggc

SEQ ID NO: 573523 - RNA, 19 nt, Homo sapiens
aucucggcucacugcaaau

SEQ ID NO: 573524 - RNA, 14 nt, Homo sapiens
aucucguauaauau

SEQ ID NO: 573525 - RNA, 24 nt, Homo sapiens
aucucuaacauaugauacugaugc

SEQ ID NO: 573526 - RNA, 18 nt, Homo sapiens
aucucuaauacaguguga

SEQ ID NO: 573527 - RNA, 15 nt, Homo sapiens
aucucuacuaaaaau

SEQ ID NO: 573528 - RNA, 21 nt, Homo sapiens
aucucuacuaaaaauacaaaa

SEQ ID NO: 573529 - RNA, 19 nt, Homo sapiens
aucucuacugaaaauacaa

SEQ ID NO: 573530 - RNA, 19 nt, Homo sapiens
aucucuacugaaaguacaa

SEQ ID NO: 573531 - RNA, 16 nt, Homo sapiens
aucucuagaaagcucu

SEQ ID NO: 573532 - RNA, 14 nt, Homo sapiens
aucucucuaccucc

SEQ ID NO: 573533 - RNA, 13 nt, Homo sapiens
aucucucuacucc

SEQ ID NO: 573534 - RNA, 16 nt, Homo sapiens
aucucucuagugaugg

SEQ ID NO: 573535 - RNA, 22 nt, Homo sapiens
aucucuguucuguuuggcacuu

SEQ ID NO: 573536 - RNA, 15 nt, Homo sapiens
aucucuucacuaccc

SEQ ID NO: 573537 - RNA, 17 nt, Homo sapiens
aucucuucuuauacaga

SEQ ID NO: 573538 - RNA, 21 nt, Homo sapiens
aucucuucuuauacagauaaa

SEQ ID NO: 573539 - RNA, 16 nt, Homo sapiens
aucucuugcccuuccu

SEQ ID NO: 573540 - RNA, 17 nt, Homo sapiens
aucucuuugaucuacuu

SEQ ID NO: 573541 - RNA, 22 nt, Homo sapiens
aucucuuuuggucccauccucu

SEQ ID NO: 573542 - RNA, 17 nt, Homo sapiens
aucugaaacccacagau

SEQ ID NO: 573543 - RNA, 21 nt, Homo sapiens
aucugaacugcucuacuuuga

SEQ ID NO: 573544 - RNA, 17 nt, Homo sapiens
aucugaacuggaccagu

SEQ ID NO: 573545 - RNA, 18 nt, Homo sapiens
aucugaagaaacuuccca

SEQ ID NO: 573546 - RNA, 13 nt, Homo sapiens
aucugaccaaaac

SEQ ID NO: 573547 - RNA, 14 nt, Homo sapiens
aucugagaggcucu

SEQ ID NO: 573548 - RNA, 17 nt, Homo sapiens
aucugagagguaagaag

SEQ ID NO: 573549 - RNA, 15 nt, Homo sapiens
aucugagcaaugacu

SEQ ID NO: 573550 - RNA, 17 nt, Homo sapiens
aucugaguugccaagac

SEQ ID NO: 573551 - RNA, 11 nt, Homo sapiens
aucugaugaaa

SEQ ID NO: 573552 - RNA, 17 nt, Homo sapiens
aucugauguaacaaggu

SEQ ID NO: 573553 - RNA, 18 nt, Homo sapiens
aucugauuagaaguauaa

SEQ ID NO: 573554 - RNA, 21 nt, Homo sapiens
aucugcagggguuugccaaac

SEQ ID NO: 573555 - RNA, 18 nt, Homo sapiens
aucugcagugaugcaaua

SEQ ID NO: 573556 - RNA, 17 nt, Homo sapiens
aucugcaugucuacuca

SEQ ID NO: 573557 - RNA, 15 nt, Homo sapiens
aucugccuaugucau

SEQ ID NO: 573558 - RNA, 21 nt, Homo sapiens
aucugccuuaaaaccaaagag

SEQ ID NO: 573559 - RNA, 15 nt, Homo sapiens
aucugcgugacaaua

SEQ ID NO: 573560 - RNA, 23 nt, Homo sapiens
aucuggaagccaccucaccaagg

SEQ ID NO: 573561 - RNA, 22 nt, Homo sapiens
aucuggacagaacauuuauauc

SEQ ID NO: 573562 - RNA, 19 nt, Homo sapiens
aucuggcagacucauugca

SEQ ID NO: 573563 - RNA, 19 nt, Homo sapiens
aucuggcccucgacacuca

SEQ ID NO: 573564 - RNA, 14 nt, Homo sapiens
aucuguaacagcau

SEQ ID NO: 573565 - RNA, 16 nt, Homo sapiens
aucuguaacccuugaa

SEQ ID NO: 573566 - RNA, 21 nt, Homo sapiens
aucuguaagagcuugcuccag

SEQ ID NO: 573567 - RNA, 18 nt, Homo sapiens
aucuguauaauacuuugu

SEQ ID NO: 573568 - RNA, 16 nt, Homo sapiens
aucuguauauacaaua

SEQ ID NO: 573569 - RNA, 15 nt, Homo sapiens
aucugucaucucucu

SEQ ID NO: 573570 - RNA, 14 nt, Homo sapiens
aucuguccaaggaa

SEQ ID NO: 573571 - RNA, 14 nt, Homo sapiens
aucuguccacaucc

SEQ ID NO: 573572 - RNA, 16 nt, Homo sapiens
aucuguccacaucccc

SEQ ID NO: 573573 - RNA, 20 nt, Homo sapiens
aucuguccacauccccagag

SEQ ID NO: 573574 - RNA, 12 nt, Homo sapiens
aucugugccugg

SEQ ID NO: 573575 - RNA, 19 nt, Homo sapiens
aucuguucuaacauguaau

SEQ ID NO: 573576 - RNA, 21 nt, Homo sapiens
aucuguuguucuguggucaca

SEQ ID NO: 573577 - RNA, 12 nt, Homo sapiens
aucuguuuccaa

SEQ ID NO: 573578 - RNA, 20 nt, Homo sapiens
aucuguuugaucccuguuac

SEQ ID NO: 573579 - RNA, 21 nt, Homo sapiens
aucuguuugaucccuguuacc

SEQ ID NO: 573580 - RNA, 14 nt, Homo sapiens
aucuguuuuagaca

SEQ ID NO: 573581 - RNA, 14 nt, Homo sapiens
aucuuaaaugccag

SEQ ID NO: 573582 - RNA, 16 nt, Homo sapiens
aucuuaagauccacaa

SEQ ID NO: 573583 - RNA, 21 nt, Homo sapiens
aucuuaaucauuauccuucua

SEQ ID NO: 573584 - RNA, 12 nt, Homo sapiens
aucuuacugaaa

SEQ ID NO: 573585 - RNA, 13 nt, Homo sapiens
aucuuaguguuca

SEQ ID NO: 573586 - RNA, 18 nt, Homo sapiens
aucuuauacuguacaaua

SEQ ID NO: 573587 - RNA, 22 nt, Homo sapiens
aucuuaugcuauuauucuguaa

SEQ ID NO: 573588 - RNA, 23 nt, Homo sapiens
aucuuauuuugugaacuauauca

SEQ ID NO: 573589 - RNA, 22 nt, Homo sapiens
aucuucaaacauguacaaaauc

SEQ ID NO: 573590 - RNA, 19 nt, Homo sapiens
aucuucaaacuuucacuuu

SEQ ID NO: 573591 - RNA, 21 nt, Homo sapiens
aucuucaaacuuucacuuuga

SEQ ID NO: 573592 - RNA, 13 nt, Homo sapiens
aucuucaacagac

SEQ ID NO: 573593 - RNA, 16 nt, Homo sapiens
aucuucaagaccaaag

SEQ ID NO: 573594 - RNA, 21 nt, Homo sapiens
aucuucaauuuauuacugaaa

SEQ ID NO: 573595 - RNA, 13 nt, Homo sapiens
aucuucacugcaa

SEQ ID NO: 573596 - RNA, 13 nt, Homo sapiens
aucuucagauuaa

SEQ ID NO: 573597 - RNA, 17 nt, Homo sapiens
aucuuccaaaugcaauu

SEQ ID NO: 573598 - RNA, 15 nt, Homo sapiens
aucuuccccggaugu

SEQ ID NO: 573599 - RNA, 14 nt, Homo sapiens
aucuucuacuguau

SEQ ID NO: 573600 - RNA, 12 nt, Homo sapiens
aucuucuacuuu

SEQ ID NO: 573601 - RNA, 16 nt, Homo sapiens
aucuucucauuuugca

SEQ ID NO: 573602 - RNA, 14 nt, Homo sapiens
aucuucucccccac

SEQ ID NO: 573603 - RNA, 18 nt, Homo sapiens
aucuucucuuugacaauu

SEQ ID NO: 573604 - RNA, 22 nt, Homo sapiens
aucuucuuccagauuuccuuuc

SEQ ID NO: 573605 - RNA, 19 nt, Homo sapiens
aucuugaauguaguauuca

SEQ ID NO: 573606 - RNA, 22 nt, Homo sapiens
aucuugagccacagucacugga

SEQ ID NO: 573607 - RNA, 16 nt, Homo sapiens
aucuugaucuguguuu

SEQ ID NO: 573608 - RNA, 18 nt, Homo sapiens
aucuugaucuguguuuua

SEQ ID NO: 573609 - RNA, 18 nt, Homo sapiens
aucuugaugucuaugaua

SEQ ID NO: 573610 - RNA, 18 nt, Homo sapiens
aucuugccagccucaggc

SEQ ID NO: 573611 - RNA, 19 nt, Homo sapiens
aucuugcuaccaguauuua

SEQ ID NO: 573612 - RNA, 15 nt, Homo sapiens
aucuuggaacugcau

SEQ ID NO: 573613 - RNA, 18 nt, Homo sapiens
aucuuggacaaaucacau

SEQ ID NO: 573614 - RNA, 19 nt, Homo sapiens
aucuuggacugacauuuag

SEQ ID NO: 573615 - RNA, 18 nt, Homo sapiens
aucuuggauggugacauu

SEQ ID NO: 573616 - RNA, 18 nt, Homo sapiens
aucuuggcuuugccacac

SEQ ID NO: 573617 - RNA, 16 nt, Homo sapiens
aucuuguggggccagg

SEQ ID NO: 573618 - RNA, 22 nt, Homo sapiens
aucuugugguaacuugcugcuu

SEQ ID NO: 573619 - RNA, 16 nt, Homo sapiens
aucuuguuuacaauaa

SEQ ID NO: 573620 - RNA, 12 nt, Homo sapiens
aucuuguuucau

SEQ ID NO: 573621 - RNA, 14 nt, Homo sapiens
aucuuuaagaauag

SEQ ID NO: 573622 - RNA, 22 nt, Homo sapiens
aucuuuacucccaagacuucau

SEQ ID NO: 573623 - RNA, 17 nt, Homo sapiens
aucuuuagagaaguaua

SEQ ID NO: 573624 - RNA, 13 nt, Homo sapiens
aucuuuagggaau

SEQ ID NO: 573625 - RNA, 23 nt, Homo sapiens
aucuuuauacuggguuucaagaa

SEQ ID NO: 573626 - RNA, 24 nt, Homo sapiens
agacaagugacuguaucuguguag

SEQ ID NO: 573627 - RNA, 15 nt, Homo sapiens
agacaauaaaacacu

SEQ ID NO: 573628 - RNA, 12 nt, Homo sapiens
agacaaugacuu

SEQ ID NO: 573629 - RNA, 13 nt, Homo sapiens
agacaauuugcac

SEQ ID NO: 573630 - RNA, 23 nt, Homo sapiens
agacacaauauguaugcuuuuua

SEQ ID NO: 573631 - RNA, 19 nt, Homo sapiens
agacacaccccaacaugcc

SEQ ID NO: 573632 - RNA, 17 nt, Homo sapiens
agacacagaagccuuug

SEQ ID NO: 573633 - RNA, 14 nt, Homo sapiens
agacacagugacca

SEQ ID NO: 573634 - RNA, 22 nt, Homo sapiens
agacacaucuccuccauacuca

SEQ ID NO: 573635 - RNA, 18 nt, Homo sapiens
agacacauuggcuuugua

SEQ ID NO: 573636 - RNA, 18 nt, Homo sapiens
agacaccagccuagccug

SEQ ID NO: 573637 - RNA, 15 nt, Homo sapiens
agacaccaugugcaa

SEQ ID NO: 573638 - RNA, 17 nt, Homo sapiens
agacacuaaaugcagac

SEQ ID NO: 573639 - RNA, 18 nt, Homo sapiens
agacacucacagcaagga

SEQ ID NO: 573640 - RNA, 24 nt, Homo sapiens
agacacugaagaagucacugaaca

SEQ ID NO: 573641 - RNA, 17 nt, Homo sapiens
agacacugagcuucuga

SEQ ID NO: 573642 - RNA, 15 nt, Homo sapiens
agacacugaucuggc

SEQ ID NO: 573643 - RNA, 12 nt, Homo sapiens
agacacugcaca

SEQ ID NO: 573644 - RNA, 23 nt, Homo sapiens
agacacugccgacaucagcauug

SEQ ID NO: 573645 - RNA, 20 nt, Homo sapiens
agacacuggcguuacugcuu

SEQ ID NO: 573646 - RNA, 14 nt, Homo sapiens
agacacugugagag

SEQ ID NO: 573647 - RNA, 13 nt, Homo sapiens
agacacuguugca

SEQ ID NO: 573648 - RNA, 18 nt, Homo sapiens
agacacuucccugcauua

SEQ ID NO: 573649 - RNA, 19 nt, Homo sapiens
agacacuucccugcauuaa

SEQ ID NO: 573650 - RNA, 21 nt, Homo sapiens
agacacuuuggaaucuaacca

SEQ ID NO: 573651 - RNA, 17 nt, Homo sapiens
agacacuuuucaaaaga

SEQ ID NO: 573652 - RNA, 18 nt, Homo sapiens
agacagacuugagaacuu

SEQ ID NO: 573653 - RNA, 23 nt, Homo sapiens
agacagauaccuccaacccugcc

SEQ ID NO: 573654 - RNA, 20 nt, Homo sapiens
agacaggcaccccucccagc

SEQ ID NO: 573655 - RNA, 20 nt, Homo sapiens
agacaggccaugugagccac

SEQ ID NO: 573656 - RNA, 14 nt, Homo sapiens
agacagggucucau

SEQ ID NO: 573657 - RNA, 19 nt, Homo sapiens
agacaggguuucacugugu

SEQ ID NO: 573658 - RNA, 18 nt, Homo sapiens
agacaggguuuggcugug

SEQ ID NO: 573659 - RNA, 19 nt, Homo sapiens
agacaggucuagacuuucu

SEQ ID NO: 573660 - RNA, 21 nt, Homo sapiens
agacagucucacucuguugcc

SEQ ID NO: 573661 - RNA, 13 nt, Homo sapiens
agacagugcugcc

SEQ ID NO: 573662 - RNA, 13 nt, Homo sapiens
agacagugggaaa

SEQ ID NO: 573663 - RNA, 15 nt, Homo sapiens
agacagugggaaaua

SEQ ID NO: 573664 - RNA, 15 nt, Homo sapiens
agacaguucaagaaa

SEQ ID NO: 573665 - RNA, 20 nt, Homo sapiens
agacaguuuacuuugccaac

SEQ ID NO: 573666 - RNA, 16 nt, Homo sapiens
agacauaaauuacuuu

SEQ ID NO: 573667 - RNA, 18 nt, Homo sapiens
agacauacagagauauac

SEQ ID NO: 573668 - RNA, 20 nt, Homo sapiens
agacauacagcugccuaccu

SEQ ID NO: 573669 - RNA, 20 nt, Homo sapiens
agacauacauuuaugcacau

SEQ ID NO: 573670 - RNA, 11 nt, Homo sapiens
agacauacucc

SEQ ID NO: 573671 - RNA, 15 nt, Homo sapiens
agacauaucacucaa

SEQ ID NO: 573672 - RNA, 22 nt, Homo sapiens
agacaucagucuccaacauguu

SEQ ID NO: 573673 - RNA, 15 nt, Homo sapiens
agacauccugagcag

SEQ ID NO: 573674 - RNA, 12 nt, Homo sapiens
agacaucugccu

SEQ ID NO: 573675 - RNA, 19 nt, Homo sapiens
agacaucuuugcuuaugaa

SEQ ID NO: 573676 - RNA, 17 nt, Homo sapiens
agacaugccuuggugcc

SEQ ID NO: 573677 - RNA, 21 nt, Homo sapiens
agacauggaagagagagccau

SEQ ID NO: 573678 - RNA, 23 nt, Homo sapiens
agacauuacaauguguaauggaa

SEQ ID NO: 573679 - RNA, 18 nt, Homo sapiens
agacauucauugucccug

SEQ ID NO: 573680 - RNA, 20 nt, Homo sapiens
agacauuccugcgcauggug

SEQ ID NO: 573681 - RNA, 22 nt, Homo sapiens
agacauuccugcgcauggugca

SEQ ID NO: 573682 - RNA, 22 nt, Homo sapiens
agacauuuuaaaaaauggucac

SEQ ID NO: 573683 - RNA, 12 nt, Homo sapiens
agaaucuugacu

SEQ ID NO: 573684 - RNA, 21 nt, Homo sapiens
agaaucuuuuaaauacauucc

SEQ ID NO: 573685 - RNA, 18 nt, Homo sapiens
agaaugaaauguaugugc

SEQ ID NO: 573686 - RNA, 13 nt, Homo sapiens
agaaugaauuuau

SEQ ID NO: 573687 - RNA, 20 nt, Homo sapiens
agaaugagcacccauuccaa

SEQ ID NO: 573688 - RNA, 20 nt, Homo sapiens
agaaugcaagaguggacuga

SEQ ID NO: 573689 - RNA, 22 nt, Homo sapiens
agaaugcacaagaauggaucac

SEQ ID NO: 573690 - RNA, 12 nt, Homo sapiens
agaaugcaugua

SEQ ID NO: 573691 - RNA, 14 nt, Homo sapiens
agaaugcauucccu

SEQ ID NO: 573692 - RNA, 15 nt, Homo sapiens
agaaugccaggaaua

SEQ ID NO: 573693 - RNA, 12 nt, Homo sapiens
agaaugcucagg

SEQ ID NO: 573694 - RNA, 22 nt, Homo sapiens
agaaugcugcaggacuugagaa

SEQ ID NO: 573695 - RNA, 17 nt, Homo sapiens
agaauggaaaacagacu

SEQ ID NO: 573696 - RNA, 13 nt, Homo sapiens
agaauggaacuca

SEQ ID NO: 573697 - RNA, 11 nt, Homo sapiens
agaauggagcu

SEQ ID NO: 573698 - RNA, 12 nt, Homo sapiens
agaauggaucac

SEQ ID NO: 573699 - RNA, 10 nt, Homo sapiens
agaauggauu

SEQ ID NO: 573700 - RNA, 23 nt, Homo sapiens
agaauggcgccaccagcucugcc

SEQ ID NO: 573701 - RNA, 20 nt, Homo sapiens
agaaugggggcuuucgggga

SEQ ID NO: 573702 - RNA, 13 nt, Homo sapiens
agaauggugcugu

SEQ ID NO: 573703 - RNA, 20 nt, Homo sapiens
agaauguagucagacugaca

SEQ ID NO: 573704 - RNA, 17 nt, Homo sapiens
agaaugugauauuugaa

SEQ ID NO: 573705 - RNA, 21 nt, Homo sapiens
agaauguuccagacauucucg

SEQ ID NO: 573706 - RNA, 14 nt, Homo sapiens
agaauuaaaacuga

SEQ ID NO: 573707 - RNA, 18 nt, Homo sapiens
agaauuaagauacaaauu

SEQ ID NO: 573708 - RNA, 19 nt, Homo sapiens
agaauuacaguacacaucc

SEQ ID NO: 573709 - RNA, 13 nt, Homo sapiens
agaauuacuugug

SEQ ID NO: 573710 - RNA, 15 nt, Homo sapiens
agaauuauaacugua

SEQ ID NO: 573711 - RNA, 19 nt, Homo sapiens
agaauucacacaacuacuu

SEQ ID NO: 573712 - RNA, 23 nt, Homo sapiens
agaauucacuaggaggucaucaa

SEQ ID NO: 573713 - RNA, 15 nt, Homo sapiens
agaauuccaaagcaa

SEQ ID NO: 573714 - RNA, 19 nt, Homo sapiens
agaauuccugaagccagau

SEQ ID NO: 573715 - RNA, 19 nt, Homo sapiens
agaauucucucuucuggaa

SEQ ID NO: 573716 - RNA, 16 nt, Homo sapiens
agaauucuuacauguu

SEQ ID NO: 573717 - RNA, 23 nt, Homo sapiens
agaauugcuccugcaugcaacua

SEQ ID NO: 573718 - RNA, 16 nt, Homo sapiens
agaauuggaaucacau

SEQ ID NO: 573719 - RNA, 20 nt, Homo sapiens
agaauuggagcuguacgagu

SEQ ID NO: 573720 - RNA, 16 nt, Homo sapiens
agaauuggccaucuua

SEQ ID NO: 573721 - RNA, 16 nt, Homo sapiens
agaauuuagaaaugag

SEQ ID NO: 573722 - RNA, 12 nt, Homo sapiens
agaauuucacaa

SEQ ID NO: 573723 - RNA, 15 nt, Homo sapiens
agaauuucacaagcu

SEQ ID NO: 573724 - RNA, 19 nt, Homo sapiens
agaauuucugcuaaauauc

SEQ ID NO: 573725 - RNA, 20 nt, Homo sapiens
agaauuucuuugucauucaa

SEQ ID NO: 573726 - RNA, 13 nt, Homo sapiens
agaauuugcuaau

SEQ ID NO: 573727 - RNA, 23 nt, Homo sapiens
agaauuugguaaauuaguauuua

SEQ ID NO: 573728 - RNA, 14 nt, Homo sapiens
agacaaaaccaaaa

SEQ ID NO: 573729 - RNA, 16 nt, Homo sapiens
agacaaaauauuuccc

SEQ ID NO: 573730 - RNA, 19 nt, Homo sapiens
agacaaaaucuuaaaugcc

SEQ ID NO: 573731 - RNA, 18 nt, Homo sapiens
agacaaacaagggagaag

SEQ ID NO: 573732 - RNA, 20 nt, Homo sapiens
agacaaacuccugaaaugcc

SEQ ID NO: 573733 - RNA, 14 nt, Homo sapiens
agacaaagacucac

SEQ ID NO: 573734 - RNA, 17 nt, Homo sapiens
agacaaaguaauuccuc

SEQ ID NO: 573735 - RNA, 17 nt, Homo sapiens
agacaaagugaagccgc

SEQ ID NO: 573736 - RNA, 19 nt, Homo sapiens
agacaaauccuuucugccc

SEQ ID NO: 573737 - RNA, 15 nt, Homo sapiens
agacaacaccuuccu

SEQ ID NO: 573738 - RNA, 22 nt, Homo sapiens
agacaacuucuguuucuucucu

SEQ ID NO: 573739 - RNA, 13 nt, Homo sapiens
agacaagaacuau

SEQ ID NO: 573740 - RNA, 19 nt, Homo sapiens
agacaagaaugugcacucu

SEQ ID NO: 573741 - RNA, 14 nt, Homo sapiens
agacaagauuuaug

SEQ ID NO: 573742 - RNA, 17 nt, Homo sapiens
agacaagcaagugcaca

SEQ ID NO: 573743 - RNA, 14 nt, Homo sapiens
agacaagcacuauu

SEQ ID NO: 573744 - RNA, 16 nt, Homo sapiens
agacaagugacuguau

SEQ ID NO: 573745 - RNA, 17 nt, Homo sapiens
agacaagugacuguauc

SEQ ID NO: 573746 - RNA, 21 nt, Homo sapiens
agacaagugacuguaucugug

SEQ ID NO: 573747 - RNA, 12 nt, Homo sapiens
agaacucaaggc

SEQ ID NO: 573748 - RNA, 17 nt, Homo sapiens
agaacucgaugcacuga

SEQ ID NO: 573749 - RNA, 13 nt, Homo sapiens
agaacucuggucu

SEQ ID NO: 573750 - RNA, 21 nt, Homo sapiens
agaacucuugacuuccugcca

SEQ ID NO: 573751 - RNA, 15 nt, Homo sapiens
agaacugagggcucu

SEQ ID NO: 573752 - RNA, 23 nt, Homo sapiens
agaacugcacuuuuuuuacuucg

SEQ ID NO: 573753 - RNA, 15 nt, Homo sapiens
agaacugcagggccu

SEQ ID NO: 573754 - RNA, 23 nt, Homo sapiens
agaacugucuauuuucucaguca

SEQ ID NO: 573755 - RNA, 14 nt, Homo sapiens
agaacugucuguga

SEQ ID NO: 573756 - RNA, 14 nt, Homo sapiens
agaacugugccaca

SEQ ID NO: 573757 - RNA, 16 nt, Homo sapiens
agaacuguuuucucaa

SEQ ID NO: 573758 - RNA, 23 nt, Homo sapiens
agaacuucugaaaccucuggguc

SEQ ID NO: 573759 - RNA, 14 nt, Homo sapiens
agaacuugaaugug

SEQ ID NO: 573760 - RNA, 20 nt, Homo sapiens
agaacuuuaagucucaccca

SEQ ID NO: 573761 - RNA, 20 nt, Homo sapiens
agaacuuucugauucacagu

SEQ ID NO: 573762 - RNA, 17 nt, Homo sapiens
agaacuuuucgacauau

SEQ ID NO: 573763 - RNA, 24 nt, Homo sapiens
agaagaaacgucuauguguacaga

SEQ ID NO: 573764 - RNA, 19 nt, Homo sapiens
agaagaaacuggggcuccu

SEQ ID NO: 573765 - RNA, 22 nt, Homo sapiens
agaagaaacuuugccucaagac

SEQ ID NO: 573766 - RNA, 22 nt, Homo sapiens
agaagaacagcuguuccugugu

SEQ ID NO: 573767 - RNA, 17 nt, Homo sapiens
agaagaacauccaagga

SEQ ID NO: 573768 - RNA, 18 nt, Homo sapiens
agaagaagcccauaucac

SEQ ID NO: 573769 - RNA, 22 nt, Homo sapiens
agaagacaaacuuugcaucuca

SEQ ID NO: 573770 - RNA, 18 nt, Homo sapiens
agaagacaacauuucuca

SEQ ID NO: 573771 - RNA, 12 nt, Homo sapiens
agaagacauuuu

SEQ ID NO: 573772 - RNA, 21 nt, Homo sapiens
agaagaccccugacucaucau

SEQ ID NO: 573773 - RNA, 23 nt, Homo sapiens
agaagaccuucuagugagccugg

SEQ ID NO: 573774 - RNA, 18 nt, Homo sapiens
agaagacuauuugccaug

SEQ ID NO: 573775 - RNA, 13 nt, Homo sapiens
agaagacucugac

SEQ ID NO: 573776 - RNA, 15 nt, Homo sapiens
agaagacucugaccu

SEQ ID NO: 573777 - RNA, 14 nt, Homo sapiens
agaagagauuucuc

SEQ ID NO: 573778 - RNA, 16 nt, Homo sapiens
agaagaggcuggugcu

SEQ ID NO: 573779 - RNA, 21 nt, Homo sapiens
agaagagugaggacugacuca

SEQ ID NO: 573780 - RNA, 18 nt, Homo sapiens
agaagagugccacauuua

SEQ ID NO: 573781 - RNA, 23 nt, Homo sapiens
agaagaguuucuccuuuugacca

SEQ ID NO: 573782 - RNA, 16 nt, Homo sapiens
agaagauacacugcag

SEQ ID NO: 573783 - RNA, 13 nt, Homo sapiens
agaagaugaucag

SEQ ID NO: 573784 - RNA, 14 nt, Homo sapiens
agaagaugcucugg

SEQ ID NO: 573785 - RNA, 18 nt, Homo sapiens
agaagauggcccagcucc

SEQ ID NO: 573786 - RNA, 19 nt, Homo sapiens
agaagauuuuaugcugcug

SEQ ID NO: 573787 - RNA, 16 nt, Homo sapiens
agaagcacauaugaac

SEQ ID NO: 573788 - RNA, 13 nt, Homo sapiens
agaagcacuacac

SEQ ID NO: 573789 - RNA, 20 nt, Homo sapiens
agaagcacuuugauugaagu

SEQ ID NO: 573790 - RNA, 21 nt, Homo sapiens
agaagcaguggccuuauugca

SEQ ID NO: 573791 - RNA, 16 nt, Homo sapiens
agaagccaacuaugau

SEQ ID NO: 573792 - RNA, 19 nt, Homo sapiens
agaagccuccaagcacaga

SEQ ID NO: 573793 - RNA, 19 nt, Homo sapiens
agaagcggauuuccaggga

SEQ ID NO: 573794 - RNA, 18 nt, Homo sapiens
agaagcguuaugugcagu

SEQ ID NO: 573795 - RNA, 19 nt, Homo sapiens
agaagcguuaugugcagua

SEQ ID NO: 573796 - RNA, 18 nt, Homo sapiens
agaagcuaaagucaucca

SEQ ID NO: 573797 - RNA, 20 nt, Homo sapiens
agaagcuaauguaggacugu

SEQ ID NO: 573798 - RNA, 20 nt, Homo sapiens
agaagcugaggcuaguucca

SEQ ID NO: 573799 - RNA, 17 nt, Homo sapiens
agaagcuguaggacugu

SEQ ID NO: 573800 - RNA, 22 nt, Homo sapiens
agaagcuguguuagaacagcau

SEQ ID NO: 573801 - RNA, 14 nt, Homo sapiens
agaaggaguguaug

SEQ ID NO: 573802 - RNA, 23 nt, Homo sapiens
agaaggaguguaugagugugagu

SEQ ID NO: 573803 - RNA, 20 nt, Homo sapiens
agaaggauguacauuuccaa

SEQ ID NO: 573804 - RNA, 18 nt, Homo sapiens
agaaggcaguaguuuuca

SEQ ID NO: 573805 - RNA, 22 nt, Homo sapiens
agaaggcaugaaauugucuagc

SEQ ID NO: 573806 - RNA, 17 nt, Homo sapiens
agaaggccaagaaucaa

SEQ ID NO: 573807 - RNA, 14 nt, Homo sapiens
agaaaaguugggcu

SEQ ID NO: 573808 - RNA, 22 nt, Homo sapiens
agaaaaguugggcuuucacaaa

SEQ ID NO: 573809 - RNA, 15 nt, Homo sapiens
agaaaauacaauaaa

SEQ ID NO: 573810 - RNA, 19 nt, Homo sapiens
agaaaaucaaauauauaac

SEQ ID NO: 573811 - RNA, 20 nt, Homo sapiens
agaaaauccccaacuaugca

SEQ ID NO: 573812 - RNA, 16 nt, Homo sapiens
agaaaaugcagucauu

SEQ ID NO: 573813 - RNA, 13 nt, Homo sapiens
agaaaaugccuca

SEQ ID NO: 573814 - RNA, 22 nt, Homo sapiens
agaaaaugccucaauucacaua

SEQ ID NO: 573815 - RNA, 16 nt, Homo sapiens
agaaaauguguccuau

SEQ ID NO: 573816 - RNA, 16 nt, Homo sapiens
agaaaauuagacugug

SEQ ID NO: 573817 - RNA, 23 nt, Homo sapiens
agaaaauugcugugccucccaaa

SEQ ID NO: 573818 - RNA, 16 nt, Homo sapiens
agaaaauuggauguuu

SEQ ID NO: 573819 - RNA, 12 nt, Homo sapiens
agaaaauuuucc

SEQ ID NO: 573820 - RNA, 16 nt, Homo sapiens
agaaacaaacaucuaa

SEQ ID NO: 573821 - RNA, 20 nt, Homo sapiens
agaaacaaacuccauuacuc

SEQ ID NO: 573822 - RNA, 14 nt, Homo sapiens
agaaacaaaugaca

SEQ ID NO: 573823 - RNA, 17 nt, Homo sapiens
agaaacacguaucccac

SEQ ID NO: 573824 - RNA, 20 nt, Homo sapiens
agaaacagauaacaccaaac

SEQ ID NO: 573825 - RNA, 22 nt, Homo sapiens
agaaacagugggagcccugacc

SEQ ID NO: 573826 - RNA, 12 nt, Homo sapiens
agaaacaugcca

SEQ ID NO: 573827 - RNA, 20 nt, Homo sapiens
agaaaccaagagaaguuuug

SEQ ID NO: 573828 - RNA, 16 nt, Homo sapiens
agaaaccacaagcaaa

SEQ ID NO: 573829 - RNA, 20 nt, Homo sapiens
agaaacccaaauugggacaa

SEQ ID NO: 573830 - RNA, 18 nt, Homo sapiens
agaaacccuugcugcuuu

SEQ ID NO: 573831 - RNA, 19 nt, Homo sapiens
agaaacucaaaaauauuug

SEQ ID NO: 573832 - RNA, 16 nt, Homo sapiens
agaaacuccagacuug

SEQ ID NO: 573833 - RNA, 14 nt, Homo sapiens
agaaacuucccaag

SEQ ID NO: 573834 - RNA, 18 nt, Homo sapiens
agaaacuugugaagugga

SEQ ID NO: 573835 - RNA, 14 nt, Homo sapiens
agaaagaagccaua

SEQ ID NO: 573836 - RNA, 19 nt, Homo sapiens
agaaagaaguuauuuucca

SEQ ID NO: 573837 - RNA, 15 nt, Homo sapiens
agaaagaccaggcca

SEQ ID NO: 573838 - RNA, 14 nt, Homo sapiens
agaaagaugacaaa

SEQ ID NO: 573839 - RNA, 14 nt, Homo sapiens
agaaagcaaacuua

SEQ ID NO: 573840 - RNA, 16 nt, Homo sapiens
agaaagcaacaguuac

SEQ ID NO: 573841 - RNA, 15 nt, Homo sapiens
agaaagcacuacaau

SEQ ID NO: 573842 - RNA, 18 nt, Homo sapiens
agaaagcacuacaaucau

SEQ ID NO: 573843 - RNA, 14 nt, Homo sapiens
agaaagcuucuuca

SEQ ID NO: 573844 - RNA, 20 nt, Homo sapiens
agaaaggugugcuggucaug

SEQ ID NO: 573845 - RNA, 15 nt, Homo sapiens
agaaaguacaaacuu

SEQ ID NO: 573846 - RNA, 18 nt, Homo sapiens
agaaagugaagcaaauca

SEQ ID NO: 573847 - RNA, 18 nt, Homo sapiens
agaaagugacauuugcuu

SEQ ID NO: 573848 - RNA, 13 nt, Homo sapiens
agaaagugcugau

SEQ ID NO: 573849 - RNA, 16 nt, Homo sapiens
agaaaguuaaccccau

SEQ ID NO: 573850 - RNA, 22 nt, Homo sapiens
agaaaguugauauucaaccuca

SEQ ID NO: 573851 - RNA, 23 nt, Homo sapiens
agaaaguuuagaucugucccuua

SEQ ID NO: 573852 - RNA, 18 nt, Homo sapiens
agaaauaaaaauaccucu

SEQ ID NO: 573853 - RNA, 17 nt, Homo sapiens
agaaauaaaauaucucc

SEQ ID NO: 573854 - RNA, 14 nt, Homo sapiens
agaaauaauaugca

SEQ ID NO: 573855 - RNA, 14 nt, Homo sapiens
agaaauacagucuu

SEQ ID NO: 573856 - RNA, 19 nt, Homo sapiens
agaaauacccacuaacaaa

SEQ ID NO: 573857 - RNA, 20 nt, Homo sapiens
agaaauacucaugugcaaua

SEQ ID NO: 573858 - RNA, 16 nt, Homo sapiens
agaaauacugcucuga

SEQ ID NO: 573859 - RNA, 14 nt, Homo sapiens
agaaauagaauuau

SEQ ID NO: 573860 - RNA, 14 nt, Homo sapiens
agaaaucaggccuu

SEQ ID NO: 573861 - RNA, 23 nt, Homo sapiens
agaaaucauaguuuaaacugcau

SEQ ID NO: 573862 - RNA, 23 nt, Homo sapiens
agaaaucgagagugugcucuccc

SEQ ID NO: 573863 - RNA, 16 nt, Homo sapiens
agaaaucuaagcugug

SEQ ID NO: 573864 - RNA, 15 nt, Homo sapiens
agaaaucuagaauuu

SEQ ID NO: 573865 - RNA, 23 nt, Homo sapiens
agaaaucuugcuucagaccauca

SEQ ID NO: 573866 - RNA, 17 nt, Homo sapiens
acuuuaacccucucuuc

SEQ ID NO: 573867 - RNA, 18 nt, Homo sapiens
acuuuaacccucucuucc

SEQ ID NO: 573868 - RNA, 21 nt, Homo sapiens
acuuuaagaacaaacucugaa

SEQ ID NO: 573869 - RNA, 14 nt, Homo sapiens
acuuuaagauguuu

SEQ ID NO: 573870 - RNA, 13 nt, Homo sapiens
acuuuaagcacua

SEQ ID NO: 573871 - RNA, 13 nt, Homo sapiens
acuuuaagucuca

SEQ ID NO: 573872 - RNA, 18 nt, Homo sapiens
acuuuaagucucacccau

SEQ ID NO: 573873 - RNA, 13 nt, Homo sapiens
acuuuaaugaacu

SEQ ID NO: 573874 - RNA, 14 nt, Homo sapiens
acuuuaaugaacua

SEQ ID NO: 573875 - RNA, 15 nt, Homo sapiens
acuuuaaugaacuaa

SEQ ID NO: 573876 - RNA, 20 nt, Homo sapiens
acuuuaauuucucugcauca

SEQ ID NO: 573877 - RNA, 14 nt, Homo sapiens
acuuuacacaagaa

SEQ ID NO: 573878 - RNA, 17 nt, Homo sapiens
acuuuaccucuguggac

SEQ ID NO: 573879 - RNA, 17 nt, Homo sapiens
acuuuaccugaaagaca

SEQ ID NO: 573880 - RNA, 22 nt, Homo sapiens
acuuuaccugaaagacaguaug

SEQ ID NO: 573881 - RNA, 20 nt, Homo sapiens
acuuuagacuucccacuguu

SEQ ID NO: 573882 - RNA, 22 nt, Homo sapiens
acuuuagacuucccacuguucu

SEQ ID NO: 573883 - RNA, 13 nt, Homo sapiens
acuuuauagcucu

SEQ ID NO: 573884 - RNA, 21 nt, Homo sapiens
acuuuauauggcccugcacag

SEQ ID NO: 573885 - RNA, 21 nt, Homo sapiens
acuuuaucaaagagaaguuac

SEQ ID NO: 573886 - RNA, 13 nt, Homo sapiens
acuuuaucaauua

SEQ ID NO: 573887 - RNA, 21 nt, Homo sapiens
acuuuaucaauuaacugagua

SEQ ID NO: 573888 - RNA, 14 nt, Homo sapiens
acuuuaucacuuaa

SEQ ID NO: 573889 - RNA, 19 nt, Homo sapiens
acuuuaugccggaugugcu

SEQ ID NO: 573890 - RNA, 15 nt, Homo sapiens
acuuuauguacugcu

SEQ ID NO: 573891 - RNA, 23 nt, Homo sapiens
acuuuauuacaagaucuuuccaa

SEQ ID NO: 573892 - RNA, 12 nt, Homo sapiens
acuuuauucuug

SEQ ID NO: 573893 - RNA, 22 nt, Homo sapiens
acuuuauugcuuaauuucugcc

SEQ ID NO: 573894 - RNA, 17 nt, Homo sapiens
acuuuauuuauacacug

SEQ ID NO: 573895 - RNA, 17 nt, Homo sapiens
acuuuauuucugaucua

SEQ ID NO: 573896 - RNA, 19 nt, Homo sapiens
acuuucagucucucugaaa

SEQ ID NO: 573897 - RNA, 14 nt, Homo sapiens
acuuucauaccacu

SEQ ID NO: 573898 - RNA, 19 nt, Homo sapiens
acuuucauccucaagcuca

SEQ ID NO: 573899 - RNA, 17 nt, Homo sapiens
acuuucauuccuucaga

SEQ ID NO: 573900 - RNA, 15 nt, Homo sapiens
acuuuccaaacacca

SEQ ID NO: 573901 - RNA, 22 nt, Homo sapiens
acuuuccacuccuggcugagag

SEQ ID NO: 573902 - RNA, 20 nt, Homo sapiens
acuuuccccaauuacagggu

SEQ ID NO: 573903 - RNA, 20 nt, Homo sapiens
acuuucccguuuuauuccag

SEQ ID NO: 573904 - RNA, 22 nt, Homo sapiens
acuuuccuauuuucuuuuccau

SEQ ID NO: 573905 - RNA, 16 nt, Homo sapiens
acuuuccucaguugau

SEQ ID NO: 573906 - RNA, 16 nt, Homo sapiens
acuuuccugaaugugu

SEQ ID NO: 573907 - RNA, 17 nt, Homo sapiens
acuuuccugacuuacaa

SEQ ID NO: 573908 - RNA, 24 nt, Homo sapiens
acuuucuaauuagagagcaucugc

SEQ ID NO: 573909 - RNA, 17 nt, Homo sapiens
acuuucucaguuuucau

SEQ ID NO: 573910 - RNA, 12 nt, Homo sapiens
acuuucugauua

SEQ ID NO: 573911 - RNA, 22 nt, Homo sapiens
acuuucuguugccacaacccug

SEQ ID NO: 573912 - RNA, 22 nt, Homo sapiens
acuuucuuagcucaagagagag

SEQ ID NO: 573913 - RNA, 22 nt, Homo sapiens
acuuugaaggacaacagcaucu

SEQ ID NO: 573914 - RNA, 14 nt, Homo sapiens
acuuugacaguguu

SEQ ID NO: 573915 - RNA, 19 nt, Homo sapiens
acuuugagcacacuuuaca

SEQ ID NO: 573916 - RNA, 13 nt, Homo sapiens
acuuugagccugc

SEQ ID NO: 573917 - RNA, 15 nt, Homo sapiens
acuuugauaucugau

SEQ ID NO: 573918 - RNA, 16 nt, Homo sapiens
acuuugaucucugcuu

SEQ ID NO: 573919 - RNA, 17 nt, Homo sapiens
acuuugaucucugcuua

SEQ ID NO: 573920 - RNA, 14 nt, Homo sapiens
acuuugcacugaua

SEQ ID NO: 573921 - RNA, 23 nt, Homo sapiens
acuuugccauuaugcaaauggag

SEQ ID NO: 573922 - RNA, 12 nt, Homo sapiens
acuuugcucaaa

SEQ ID NO: 573923 - RNA, 16 nt, Homo sapiens
acuucaaaauauugag

SEQ ID NO: 573924 - RNA, 19 nt, Homo sapiens
acuucaagaucugaauuug

SEQ ID NO: 573925 - RNA, 13 nt, Homo sapiens
acuucaagugcau

SEQ ID NO: 573926 - RNA, 18 nt, Homo sapiens
acuucaaugggcucuucc

SEQ ID NO: 573927 - RNA, 19 nt, Homo sapiens
acuucaaugggcucuucca

SEQ ID NO: 573928 - RNA, 16 nt, Homo sapiens
acuucacaauguauau

SEQ ID NO: 573929 - RNA, 14 nt, Homo sapiens
acuucaccaaggaa

SEQ ID NO: 573930 - RNA, 20 nt, Homo sapiens
acuucaccuacauuaucuca

SEQ ID NO: 573931 - RNA, 20 nt, Homo sapiens
acuucacuaaugaucacauu

SEQ ID NO: 573932 - RNA, 21 nt, Homo sapiens
acuucacuaccaagcagcuca

SEQ ID NO: 573933 - RNA, 20 nt, Homo sapiens
acuucagaagcaaacaauau

SEQ ID NO: 573934 - RNA, 20 nt, Homo sapiens
acuucagagacuaucugauu

SEQ ID NO: 573935 - RNA, 12 nt, Homo sapiens
acuucagcagua

SEQ ID NO: 573936 - RNA, 15 nt, Homo sapiens
acuucagcugccuga

SEQ ID NO: 573937 - RNA, 16 nt, Homo sapiens
acuucagcugccugaa

SEQ ID NO: 573938 - RNA, 18 nt, Homo sapiens
acuucaguauguugucaa

SEQ ID NO: 573939 - RNA, 14 nt, Homo sapiens
acuucauaauccag

SEQ ID NO: 573940 - RNA, 18 nt, Homo sapiens
acuucauacuggcaggag

SEQ ID NO: 573941 - RNA, 17 nt, Homo sapiens
acuucauagaaaccucu

SEQ ID NO: 573942 - RNA, 17 nt, Homo sapiens
acuucauugucccucuu

SEQ ID NO: 573943 - RNA, 13 nt, Homo sapiens
acuuccacaagag

SEQ ID NO: 573944 - RNA, 18 nt, Homo sapiens
acuuccacaagagugaau

SEQ ID NO: 573945 - RNA, 19 nt, Homo sapiens
acuuccacaagagugaauu

SEQ ID NO: 573946 - RNA, 19 nt, Homo sapiens
acuuccaggggaaccugcc

SEQ ID NO: 573947 - RNA, 11 nt, Homo sapiens
acuuccagugg

SEQ ID NO: 573948 - RNA, 16 nt, Homo sapiens
acuuccauuaacuuag

SEQ ID NO: 573949 - RNA, 13 nt, Homo sapiens
acuuccauuugcu

SEQ ID NO: 573950 - RNA, 19 nt, Homo sapiens
acuuccccacugcucucug

SEQ ID NO: 573951 - RNA, 15 nt, Homo sapiens
acuuccccauuucag

SEQ ID NO: 573952 - RNA, 14 nt, Homo sapiens
acuuccccugggca

SEQ ID NO: 573953 - RNA, 14 nt, Homo sapiens
acuuccccuugucu

SEQ ID NO: 573954 - RNA, 14 nt, Homo sapiens
acuucccuggucac

SEQ ID NO: 573955 - RNA, 22 nt, Homo sapiens
acuuccucacauggucugcuua

SEQ ID NO: 573956 - RNA, 14 nt, Homo sapiens
acuuccucagucug

SEQ ID NO: 573957 - RNA, 22 nt, Homo sapiens
acuuccuggccucuucugggcu

SEQ ID NO: 573958 - RNA, 22 nt, Homo sapiens
acuuccuugcaggagugacuca

SEQ ID NO: 573959 - RNA, 24 nt, Homo sapiens
acuuccuugcaggagugacucaag

SEQ ID NO: 573960 - RNA, 21 nt, Homo sapiens
acuuccuugcccccauuucac

SEQ ID NO: 573961 - RNA, 18 nt, Homo sapiens
acuucgacucaggaucca

SEQ ID NO: 573962 - RNA, 13 nt, Homo sapiens
acuucgacuguga

SEQ ID NO: 573963 - RNA, 17 nt, Homo sapiens
acuucuaaaagcuaaag

SEQ ID NO: 573964 - RNA, 23 nt, Homo sapiens
acuucuaacuagaaaucugccaa

SEQ ID NO: 573965 - RNA, 14 nt, Homo sapiens
acuucuaccaggac

SEQ ID NO: 573966 - RNA, 12 nt, Homo sapiens
acuucucccacc

SEQ ID NO: 573967 - RNA, 22 nt, Homo sapiens
acuucucuaaaacccuguguuc

SEQ ID NO: 573968 - RNA, 19 nt, Homo sapiens
acuucucucagacuuacuu

SEQ ID NO: 573969 - RNA, 12 nt, Homo sapiens
acuucucugaaa

SEQ ID NO: 573970 - RNA, 13 nt, Homo sapiens
acuucucuuacau

SEQ ID NO: 573971 - RNA, 15 nt, Homo sapiens
acuucugcaggaucc

SEQ ID NO: 573972 - RNA, 15 nt, Homo sapiens
acuucugccuugagu

SEQ ID NO: 573973 - RNA, 22 nt, Homo sapiens
acuucugcuccauagacaucag

SEQ ID NO: 573974 - RNA, 15 nt, Homo sapiens
acuucuggaagucau

SEQ ID NO: 573975 - RNA, 19 nt, Homo sapiens
acuucuggaagucaucuca

SEQ ID NO: 573976 - RNA, 16 nt, Homo sapiens
acuucuggaugcccau

SEQ ID NO: 573977 - RNA, 16 nt, Homo sapiens
acuucuggcagggaag

SEQ ID NO: 573978 - RNA, 16 nt, Homo sapiens
acugccgccuacugga

SEQ ID NO: 573979 - RNA, 23 nt, Homo sapiens
acugccgccuacuggacgcugcc

SEQ ID NO: 573980 - RNA, 19 nt, Homo sapiens
acugccucgaaacacagaa

SEQ ID NO: 573981 - RNA, 20 nt, Homo sapiens
acugccucucccucuggucc

SEQ ID NO: 573982 - RNA, 13 nt, Homo sapiens
acugccugaauaa

SEQ ID NO: 573983 - RNA, 20 nt, Homo sapiens
acugccuucgcuucuugccu

SEQ ID NO: 573984 - RNA, 21 nt, Homo sapiens
acugccuuuagaaaauauaag

SEQ ID NO: 573985 - RNA, 13 nt, Homo sapiens
acugcgacuguga

SEQ ID NO: 573986 - RNA, 17 nt, Homo sapiens
acugcgaggacaucaaa

SEQ ID NO: 573987 - RNA, 14 nt, Homo sapiens
acugcgccacugcu

SEQ ID NO: 573988 - RNA, 19 nt, Homo sapiens
acugcgcguuuucaaagac

SEQ ID NO: 573989 - RNA, 15 nt, Homo sapiens
acugcuaaauccuca

SEQ ID NO: 573990 - RNA, 14 nt, Homo sapiens
acugcuaaaugcac

SEQ ID NO: 573991 - RNA, 20 nt, Homo sapiens
acugcuaauucuguauuuau

SEQ ID NO: 573992 - RNA, 22 nt, Homo sapiens
acugcuacagcaauuucuaauu

SEQ ID NO: 573993 - RNA, 13 nt, Homo sapiens
acugcucaagaac

SEQ ID NO: 573994 - RNA, 17 nt, Homo sapiens
acugcucaucauuccuu

SEQ ID NO: 573995 - RNA, 21 nt, Homo sapiens
acugcuccaagggacaggugg

SEQ ID NO: 573996 - RNA, 22 nt, Homo sapiens
acugcuccauuuauaaccccag

SEQ ID NO: 573997 - RNA, 19 nt, Homo sapiens
acugcucguggacugugcu

SEQ ID NO: 573998 - RNA, 13 nt, Homo sapiens
acugcucugagaa

SEQ ID NO: 573999 - RNA, 14 nt, Homo sapiens
acugcucugagaau

SEQ ID NO: 574000 - RNA, 17 nt, Homo sapiens
acugcugauauuuucuc

SEQ ID NO: 574001 - RNA, 16 nt, Homo sapiens
acugcugauucuugua

SEQ ID NO: 574002 - RNA, 22 nt, Homo sapiens
acugcugcccagccuccaagcu

SEQ ID NO: 574003 - RNA, 23 nt, Homo sapiens
acugcugccucuugaaugcaggg

SEQ ID NO: 574004 - RNA, 17 nt, Homo sapiens
acugcugcuccagugca

SEQ ID NO: 574005 - RNA, 18 nt, Homo sapiens
acugcuggaguccagugc

SEQ ID NO: 574006 - RNA, 12 nt, Homo sapiens
acugcugugaaa

SEQ ID NO: 574007 - RNA, 12 nt, Homo sapiens
acugcugugaau

SEQ ID NO: 574008 - RNA, 15 nt, Homo sapiens
acugcugugaaugug

SEQ ID NO: 574009 - RNA, 14 nt, Homo sapiens
acugcuugaggaaa

SEQ ID NO: 574010 - RNA, 19 nt, Homo sapiens
acugcuuuaaacugcauuu

SEQ ID NO: 574011 - RNA, 18 nt, Homo sapiens
acugcuuucuguuccaaa

SEQ ID NO: 574012 - RNA, 17 nt, Homo sapiens
acugcuuuucauuagca

SEQ ID NO: 574013 - RNA, 14 nt, Homo sapiens
acuggaaaacagaa

SEQ ID NO: 574014 - RNA, 21 nt, Homo sapiens
acuggaaaacagaacacuuau

SEQ ID NO: 574015 - RNA, 22 nt, Homo sapiens
acuggaaaaucuucuagcaugu

SEQ ID NO: 574016 - RNA, 19 nt, Homo sapiens
acuggaaauguagcacuua

SEQ ID NO: 574017 - RNA, 23 nt, Homo sapiens
acuggaaauuccaggaaccaaaa

SEQ ID NO: 574018 - RNA, 13 nt, Homo sapiens
acuggaacauucc

SEQ ID NO: 574019 - RNA, 14 nt, Homo sapiens
acuggaacggugaa

SEQ ID NO: 574020 - RNA, 16 nt, Homo sapiens
acuggaagacacuuca

SEQ ID NO: 574021 - RNA, 14 nt, Homo sapiens
acuggaagcacagc

SEQ ID NO: 574022 - RNA, 16 nt, Homo sapiens
acuggacaagauuucc

SEQ ID NO: 574023 - RNA, 17 nt, Homo sapiens
acuggaccccacuggcu

SEQ ID NO: 574024 - RNA, 15 nt, Homo sapiens
acuggacucaccucc

SEQ ID NO: 574025 - RNA, 19 nt, Homo sapiens
acuggagcaucugacucac

SEQ ID NO: 574026 - RNA, 16 nt, Homo sapiens
acuggagccaucucuu

SEQ ID NO: 574027 - RNA, 14 nt, Homo sapiens
acuggaggugggca

SEQ ID NO: 574028 - RNA, 19 nt, Homo sapiens
acuggaguucaguggugca

SEQ ID NO: 574029 - RNA, 21 nt, Homo sapiens
acuggaguuuuggacuggaua

SEQ ID NO: 574030 - RNA, 13 nt, Homo sapiens
acuggccaugccu

SEQ ID NO: 574031 - RNA, 14 nt, Homo sapiens
acuggccaugguga

SEQ ID NO: 574032 - RNA, 15 nt, Homo sapiens
acuggccucaaguga

SEQ ID NO: 574033 - RNA, 14 nt, Homo sapiens
acuggccucuguga

SEQ ID NO: 574034 - RNA, 16 nt, Homo sapiens
acuggccucugugauu

SEQ ID NO: 574035 - RNA, 15 nt, Homo sapiens
acuggcucucuccag

SEQ ID NO: 574036 - RNA, 22 nt, Homo sapiens
acugggaaccuagcuacacuga

SEQ ID NO: 574037 - RNA, 21 nt, Homo sapiens
acugggagaggugccagcaac

SEQ ID NO: 574038 - RNA, 18 nt, Homo sapiens
acugggagauacagccau

SEQ ID NO: 574039 - RNA, 16 nt, Homo sapiens
acugggcgucugacuc

SEQ ID NO: 574040 - RNA, 20 nt, Homo sapiens
acugggugaaucuggcagga

SEQ ID NO: 574041 - RNA, 12 nt, Homo sapiens
acugggugacca

SEQ ID NO: 574042 - RNA, 19 nt, Homo sapiens
acugggugaggauaacaca

SEQ ID NO: 574043 - RNA, 14 nt, Homo sapiens
acugguaaagccuc

SEQ ID NO: 574044 - RNA, 15 nt, Homo sapiens
acugguacucaagcc

SEQ ID NO: 574045 - RNA, 22 nt, Homo sapiens
acugguagaacguaaccacgga

SEQ ID NO: 574046 - RNA, 22 nt, Homo sapiens
acugguauguguggaugaugcu

SEQ ID NO: 574047 - RNA, 13 nt, Homo sapiens
acuggucagggca

SEQ ID NO: 574048 - RNA, 20 nt, Homo sapiens
acuggucccaagguguaaag

SEQ ID NO: 574049 - RNA, 17 nt, Homo sapiens
acuggucuccuugcuuc

SEQ ID NO: 574050 - RNA, 12 nt, Homo sapiens
accaaagcagaa

SEQ ID NO: 574051 - RNA, 17 nt, Homo sapiens
accaaagccaccacauu

SEQ ID NO: 574052 - RNA, 22 nt, Homo sapiens
accaaagccaccagacugacaa

SEQ ID NO: 574053 - RNA, 18 nt, Homo sapiens
accaaagcugcccacugu

SEQ ID NO: 574054 - RNA, 18 nt, Homo sapiens
accaaaggauagugcgau

SEQ ID NO: 574055 - RNA, 15 nt, Homo sapiens
accaaaggucaggga

SEQ ID NO: 574056 - RNA, 12 nt, Homo sapiens
accaaaggugaa

SEQ ID NO: 574057 - RNA, 21 nt, Homo sapiens
accaaaggugugcccuguaca

SEQ ID NO: 574058 - RNA, 16 nt, Homo sapiens
accaaagucacaaauc

SEQ ID NO: 574059 - RNA, 14 nt, Homo sapiens
accaaauaccucaa

SEQ ID NO: 574060 - RNA, 22 nt, Homo sapiens
accaaaucauccugaaucugau

SEQ ID NO: 574061 - RNA, 18 nt, Homo sapiens
accaaaucguggcacgua

SEQ ID NO: 574062 - RNA, 13 nt, Homo sapiens
accaaaugugcuu

SEQ ID NO: 574063 - RNA, 13 nt, Homo sapiens
accaaauuuguau

SEQ ID NO: 574064 - RNA, 19 nt, Homo sapiens
accaaccccgcggcccaga

SEQ ID NO: 574065 - RNA, 18 nt, Homo sapiens
accaacccuguuuccuga

SEQ ID NO: 574066 - RNA, 19 nt, Homo sapiens
accaacccuguuuccugag

SEQ ID NO: 574067 - RNA, 22 nt, Homo sapiens
accaaccuagccaacaugguga

SEQ ID NO: 574068 - RNA, 16 nt, Homo sapiens
accaacgcacaacagg

SEQ ID NO: 574069 - RNA, 22 nt, Homo sapiens
accaacuaaaacccccaauaaa

SEQ ID NO: 574070 - RNA, 23 nt, Homo sapiens
accaacuacuaccuguaaugaca

SEQ ID NO: 574071 - RNA, 22 nt, Homo sapiens
accaacugaaguggcuaaagag

SEQ ID NO: 574072 - RNA, 11 nt, Homo sapiens
accaacugugu

SEQ ID NO: 574073 - RNA, 19 nt, Homo sapiens
accaagaaagcucacugua

SEQ ID NO: 574074 - RNA, 21 nt, Homo sapiens
accaagaauguuaugugcaag

SEQ ID NO: 574075 - RNA, 23 nt, Homo sapiens
accaagaauucuccaaaacaauu

SEQ ID NO: 574076 - RNA, 21 nt, Homo sapiens
accaagauuaugugacuugca

SEQ ID NO: 574077 - RNA, 22 nt, Homo sapiens
accaagauuaugugacuugcaa

SEQ ID NO: 574078 - RNA, 19 nt, Homo sapiens
accaagcauuccugcucaa

SEQ ID NO: 574079 - RNA, 23 nt, Homo sapiens
accaagcguuucccagucuuagc

SEQ ID NO: 574080 - RNA, 23 nt, Homo sapiens
accaaggcaaggcaggugccucc

SEQ ID NO: 574081 - RNA, 14 nt, Homo sapiens
accaaggcagccuc

SEQ ID NO: 574082 - RNA, 21 nt, Homo sapiens
accaaggccucggcagaacuc

SEQ ID NO: 574083 - RNA, 15 nt, Homo sapiens
accaagugcugucuu

SEQ ID NO: 574084 - RNA, 15 nt, Homo sapiens
accaaguggcuccca

SEQ ID NO: 574085 - RNA, 23 nt, Homo sapiens
accaaguuauaaaucaaugucac

SEQ ID NO: 574086 - RNA, 18 nt, Homo sapiens
accaaguuaucaucucac

SEQ ID NO: 574087 - RNA, 19 nt, Homo sapiens
accaaguuaucaucucacc

SEQ ID NO: 574088 - RNA, 19 nt, Homo sapiens
accaauagggcugagcucu

SEQ ID NO: 574089 - RNA, 16 nt, Homo sapiens
accaauaugcauuuau

SEQ ID NO: 574090 - RNA, 13 nt, Homo sapiens
accaauauucaaa

SEQ ID NO: 574091 - RNA, 17 nt, Homo sapiens
accaauauuucuucaca

SEQ ID NO: 574092 - RNA, 22 nt, Homo sapiens
accaauauuucuucacaaagga

SEQ ID NO: 574093 - RNA, 16 nt, Homo sapiens
accaaugagccuuagu

SEQ ID NO: 574094 - RNA, 17 nt, Homo sapiens
accaaugcugaugaccu

SEQ ID NO: 574095 - RNA, 18 nt, Homo sapiens
accaauuccaaguuuuaa

SEQ ID NO: 574096 - RNA, 17 nt, Homo sapiens
accaauugacucucaca

SEQ ID NO: 574097 - RNA, 18 nt, Homo sapiens
accaauuucuuccuucca

SEQ ID NO: 574098 - RNA, 15 nt, Homo sapiens
accaauuuuuuacag

SEQ ID NO: 574099 - RNA, 14 nt, Homo sapiens
accacaaacaauuc

SEQ ID NO: 574100 - RNA, 18 nt, Homo sapiens
accacaaacggagccccu

SEQ ID NO: 574101 - RNA, 22 nt, Homo sapiens
accacaaagcacaguuugaaca

SEQ ID NO: 574102 - RNA, 15 nt, Homo sapiens
accacaaccuugcag

SEQ ID NO: 574103 - RNA, 11 nt, Homo sapiens
accacaauuca

SEQ ID NO: 574104 - RNA, 13 nt, Homo sapiens
accacacauauug

SEQ ID NO: 574105 - RNA, 16 nt, Homo sapiens
accacaccucccugaa

SEQ ID NO: 574106 - RNA, 20 nt, Homo sapiens
accacaccuggcccuugcaa

SEQ ID NO: 574107 - RNA, 16 nt, Homo sapiens
accacagaaagcacuc

SEQ ID NO: 574108 - RNA, 21 nt, Homo sapiens
accacagaaaucacagucaau

SEQ ID NO: 574109 - RNA, 16 nt, Homo sapiens
accacagacgggcaca

SEQ ID NO: 574110 - RNA, 12 nt, Homo sapiens
accacagacugu

SEQ ID NO: 574111 - RNA, 22 nt, Homo sapiens
accacagugaauccagaccaac

SEQ ID NO: 574112 - RNA, 15 nt, Homo sapiens
accacagugucugua

SEQ ID NO: 574113 - RNA, 16 nt, Homo sapiens
accacauccugaaaag

SEQ ID NO: 574114 - RNA, 13 nt, Homo sapiens
accacaucugcca

SEQ ID NO: 574115 - RNA, 15 nt, Homo sapiens
accaccaccaucacc

SEQ ID NO: 574116 - RNA, 17 nt, Homo sapiens
accacccccuguucccu

SEQ ID NO: 574117 - RNA, 16 nt, Homo sapiens
accacccuagucccuu

SEQ ID NO: 574118 - RNA, 22 nt, Homo sapiens
accacccuuucacaagcaacag

SEQ ID NO: 574119 - RNA, 19 nt, Homo sapiens
accaccucccucaccaaca

SEQ ID NO: 574120 - RNA, 20 nt, Homo sapiens
accaccuucccagcucuccc

SEQ ID NO: 574121 - RNA, 13 nt, Homo sapiens
accacgacuggcc

SEQ ID NO: 574122 - RNA, 18 nt, Homo sapiens
accacgacuggccagggc

SEQ ID NO: 574123 - RNA, 20 nt, Homo sapiens
accacgaggaaaagaacaaa

SEQ ID NO: 574124 - RNA, 20 nt, Homo sapiens
accacgccgcccuccauccg

SEQ ID NO: 574125 - RNA, 23 nt, Homo sapiens
accacggggccgacauugucucc

SEQ ID NO: 574126 - RNA, 15 nt, Homo sapiens
accacuaacuccuga

SEQ ID NO: 574127 - RNA, 21 nt, Homo sapiens
accacuaagaauucaaacugg

SEQ ID NO: 574128 - RNA, 21 nt, Homo sapiens
accacuacaugcagcccaugc

SEQ ID NO: 574129 - RNA, 18 nt, Homo sapiens
accacuagaacucuccau

SEQ ID NO: 574130 - RNA, 15 nt, Homo sapiens
accacucccaccaca

SEQ ID NO: 574131 - RNA, 20 nt, Homo sapiens
accacucgaggccugcaaac

SEQ ID NO: 574132 - RNA, 11 nt, Homo sapiens
accacugacag

SEQ ID NO: 574133 - RNA, 15 nt, Homo sapiens
accacugacagcuag

SEQ ID NO: 574134 - RNA, 17 nt, Homo sapiens
accacugauaaaaccau

SEQ ID NO: 574135 - RNA, 11 nt, Homo sapiens
accacugcacu

SEQ ID NO: 574136 - RNA, 20 nt, Homo sapiens
accacugcccuggagguggc

SEQ ID NO: 574137 - RNA, 13 nt, Homo sapiens
aauacaacaugua

SEQ ID NO: 574138 - RNA, 15 nt, Homo sapiens
aauacaacauugcca

SEQ ID NO: 574139 - RNA, 15 nt, Homo sapiens
aauacaagccuaugc

SEQ ID NO: 574140 - RNA, 15 nt, Homo sapiens
aauacaaguaauauu

SEQ ID NO: 574141 - RNA, 12 nt, Homo sapiens
aauacaauguga

SEQ ID NO: 574142 - RNA, 13 nt, Homo sapiens
aauacaauguuau

SEQ ID NO: 574143 - RNA, 22 nt, Homo sapiens
aauacacaguauucagagucuc

SEQ ID NO: 574144 - RNA, 18 nt, Homo sapiens
aauacaccacuacauucu

SEQ ID NO: 574145 - RNA, 16 nt, Homo sapiens
aauacacuaauuccuu

SEQ ID NO: 574146 - RNA, 23 nt, Homo sapiens
aauacagauagauauaugcucug

SEQ ID NO: 574147 - RNA, 19 nt, Homo sapiens
aauacagaucaucuuggaa

SEQ ID NO: 574148 - RNA, 24 nt, Homo sapiens
aauacagcagugucaucagaagau

SEQ ID NO: 574149 - RNA, 14 nt, Homo sapiens
aauacaguaagcau

SEQ ID NO: 574150 - RNA, 17 nt, Homo sapiens
aauacaguaagcauagu

SEQ ID NO: 574151 - RNA, 20 nt, Homo sapiens
aauacagucuuccauuugca

SEQ ID NO: 574152 - RNA, 11 nt, Homo sapiens
aauacagugag

SEQ ID NO: 574153 - RNA, 19 nt, Homo sapiens
aauacagugagcucuagca

SEQ ID NO: 574154 - RNA, 23 nt, Homo sapiens
aauacauaguguauuuugcacaa

SEQ ID NO: 574155 - RNA, 14 nt, Homo sapiens
aauacaucaaagag

SEQ ID NO: 574156 - RNA, 19 nt, Homo sapiens
aauacaugcugcuaauuca

SEQ ID NO: 574157 - RNA, 20 nt, Homo sapiens
aauacaugcugcuaauucaa

SEQ ID NO: 574158 - RNA, 20 nt, Homo sapiens
aauacauuucaauuauacua

SEQ ID NO: 574159 - RNA, 22 nt, Homo sapiens
aauacauuucaauuauacuaaa

SEQ ID NO: 574160 - RNA, 18 nt, Homo sapiens
aauaccagugaaccaaag

SEQ ID NO: 574161 - RNA, 22 nt, Homo sapiens
aauaccagugaaccaaagagac

SEQ ID NO: 574162 - RNA, 19 nt, Homo sapiens
aauaccccuuuacuagaag

SEQ ID NO: 574163 - RNA, 17 nt, Homo sapiens
aauaccgcucaguauuu

SEQ ID NO: 574164 - RNA, 21 nt, Homo sapiens
aauaccucuuacuuugcuuga

SEQ ID NO: 574165 - RNA, 14 nt, Homo sapiens
aauaccuucugaac

SEQ ID NO: 574166 - RNA, 22 nt, Homo sapiens
aauaccuucugaacuacacugc

SEQ ID NO: 574167 - RNA, 15 nt, Homo sapiens
aauaccuuggucuca

SEQ ID NO: 574168 - RNA, 19 nt, Homo sapiens
aauaccuuuucucacaaaa

SEQ ID NO: 574169 - RNA, 23 nt, Homo sapiens
aauacgcagaacuaccagguggc

SEQ ID NO: 574170 - RNA, 13 nt, Homo sapiens
aauacgugucaaa

SEQ ID NO: 574171 - RNA, 19 nt, Homo sapiens
aauacuaaaugugcaagua

SEQ ID NO: 574172 - RNA, 20 nt, Homo sapiens
aauacuauauuuauacugua

SEQ ID NO: 574173 - RNA, 16 nt, Homo sapiens
aauacucaaaagagag

SEQ ID NO: 574174 - RNA, 20 nt, Homo sapiens
aauacucugcccucuagagc

SEQ ID NO: 574175 - RNA, 11 nt, Homo sapiens
aauacugagcc

SEQ ID NO: 574176 - RNA, 14 nt, Homo sapiens
aauacugcucugaa

SEQ ID NO: 574177 - RNA, 12 nt, Homo sapiens
aauacuguacaa

SEQ ID NO: 574178 - RNA, 21 nt, Homo sapiens
aauacuuaaauaaacaugacc

SEQ ID NO: 574179 - RNA, 14 nt, Homo sapiens
aauacuugcaacua

SEQ ID NO: 574180 - RNA, 22 nt, Homo sapiens
aauacuugcaacuaaggacaaa

SEQ ID NO: 574181 - RNA, 20 nt, Homo sapiens
aauacuugcaugaaugauuu

SEQ ID NO: 574182 - RNA, 12 nt, Homo sapiens
aauagaaaaagu

SEQ ID NO: 574183 - RNA, 20 nt, Homo sapiens
aauagaaagaaaaauuggaa

SEQ ID NO: 574184 - RNA, 20 nt, Homo sapiens
aauagaaccacuaugaagcu

SEQ ID NO: 574185 - RNA, 20 nt, Homo sapiens
aauagaagaacauccaagga

SEQ ID NO: 574186 - RNA, 19 nt, Homo sapiens
aauagaaggauguacauuu

SEQ ID NO: 574187 - RNA, 16 nt, Homo sapiens
aauagacaguagccaa

SEQ ID NO: 574188 - RNA, 13 nt, Homo sapiens
aauagacauguag

SEQ ID NO: 574189 - RNA, 21 nt, Homo sapiens
aauagacuaacuucaguagga

SEQ ID NO: 574190 - RNA, 17 nt, Homo sapiens
aauagacuucucuuaca

SEQ ID NO: 574191 - RNA, 23 nt, Homo sapiens
aauagaucaaaguccagcaggca

SEQ ID NO: 574192 - RNA, 20 nt, Homo sapiens
aauagaugguguaugcugua

SEQ ID NO: 574193 - RNA, 16 nt, Homo sapiens
aauagauuacugaugu

SEQ ID NO: 574194 - RNA, 15 nt, Homo sapiens
aauagauugcucaaa

SEQ ID NO: 574195 - RNA, 19 nt, Homo sapiens
aauagcaacguagcuucua

SEQ ID NO: 574196 - RNA, 14 nt, Homo sapiens
aauagcaaggugcu

SEQ ID NO: 574197 - RNA, 14 nt, Homo sapiens
aauagcacauaugg

SEQ ID NO: 574198 - RNA, 19 nt, Homo sapiens
aauagcagccuuucucucu

SEQ ID NO: 574199 - RNA, 13 nt, Homo sapiens
aauagcaguggua

SEQ ID NO: 574200 - RNA, 14 nt, Homo sapiens
aauagcauuugcca

SEQ ID NO: 574201 - RNA, 19 nt, Homo sapiens
aauagcauuugccacuuag

SEQ ID NO: 574202 - RNA, 15 nt, Homo sapiens
aauagccacauuugg

SEQ ID NO: 574203 - RNA, 16 nt, Homo sapiens
aauagccacauuugga

SEQ ID NO: 574204 - RNA, 18 nt, Homo sapiens
aauagccuaaaugauggu

SEQ ID NO: 574205 - RNA, 20 nt, Homo sapiens
aauagcgguacaaguucugg

SEQ ID NO: 574206 - RNA, 17 nt, Homo sapiens
aauagcuaaauaccuca

SEQ ID NO: 574207 - RNA, 17 nt, Homo sapiens
aauagcuauacauuaau

SEQ ID NO: 574208 - RNA, 19 nt, Homo sapiens
aauagcugccuucaaggac

SEQ ID NO: 574209 - RNA, 21 nt, Homo sapiens
aauagcuuucaaaagaaauuu

SEQ ID NO: 574210 - RNA, 14 nt, Homo sapiens
aauaggaccagagc

SEQ ID NO: 574211 - RNA, 20 nt, Homo sapiens
aauagggcuaaauguuuaaa

SEQ ID NO: 574212 - RNA, 17 nt, Homo sapiens
aauaggugcuuauucuc

SEQ ID NO: 574213 - RNA, 13 nt, Homo sapiens
aauagguguguga

SEQ ID NO: 574214 - RNA, 15 nt, Homo sapiens
aauaguacauuuuca

SEQ ID NO: 574215 - RNA, 15 nt, Homo sapiens
aauaguauugcugaa

SEQ ID NO: 574216 - RNA, 15 nt, Homo sapiens
aauagugaaaugcca

SEQ ID NO: 574217 - RNA, 15 nt, Homo sapiens
aauagugacaaguga

SEQ ID NO: 574218 - RNA, 14 nt, Homo sapiens
aauagugucauccu

SEQ ID NO: 574219 - RNA, 22 nt, Homo sapiens
aauaguucccuuugccaacaga

SEQ ID NO: 574220 - RNA, 16 nt, Homo sapiens
aauaguuugaacagau

SEQ ID NO: 574221 - RNA, 18 nt, Homo sapiens
aauaguuuugauccuaaa

SEQ ID NO: 574222 - RNA, 17 nt, Homo sapiens
aauauaaaacagucaug

SEQ ID NO: 574223 - RNA, 16 nt, Homo sapiens
aauauaaaguguaaua

SEQ ID NO: 574224 - RNA, 20 nt, Homo sapiens
aauauaaauauccccaggga

SEQ ID NO: 574225 - RNA, 18 nt, Homo sapiens
aauauaaauuuaagcaaa

SEQ ID NO: 574226 - RNA, 12 nt, Homo sapiens
aauauaauacug

SEQ ID NO: 574227 - RNA, 14 nt, Homo sapiens
aauauaauacugua

SEQ ID NO: 574228 - RNA, 19 nt, Homo sapiens
aauauaauaugcacacagu

SEQ ID NO: 574229 - RNA, 17 nt, Homo sapiens
aauauaauauuuacugu

SEQ ID NO: 574230 - RNA, 14 nt, Homo sapiens
aauauaaugaugcu

SEQ ID NO: 574231 - RNA, 16 nt, Homo sapiens
aauauaauuugaucuu

SEQ ID NO: 574232 - RNA, 16 nt, Homo sapiens
aauauacaacuguaaa

SEQ ID NO: 574233 - RNA, 16 nt, Homo sapiens
aauauacaagcuuuua

SEQ ID NO: 574234 - RNA, 15 nt, Homo sapiens
aauauacacauugcu

SEQ ID NO: 574235 - RNA, 21 nt, Homo sapiens
aauauagcuaauaacauguga

SEQ ID NO: 574236 - RNA, 16 nt, Homo sapiens
aauauagcuguacaaa

SEQ ID NO: 574237 - RNA, 22 nt, Homo sapiens
aauauaggauagacacuggaca

SEQ ID NO: 574238 - RNA, 16 nt, Homo sapiens
aauauaggcacauuac

SEQ ID NO: 574239 - RNA, 19 nt, Homo sapiens
aauauagugacuaugaacu

SEQ ID NO: 574240 - RNA, 20 nt, Homo sapiens
aauauauauuaagugugcca

SEQ ID NO: 574241 - RNA, 16 nt, Homo sapiens
aauauaucuaccccag

SEQ ID NO: 574242 - RNA, 18 nt, Homo sapiens
aauauauggaauuccucu

SEQ ID NO: 574243 - RNA, 18 nt, Homo sapiens
aauauaugucuauauaca

SEQ ID NO: 574244 - RNA, 16 nt, Homo sapiens
aauauauucuauucca

SEQ ID NO: 574245 - RNA, 17 nt, Homo sapiens
aauauauucuauuccau

SEQ ID NO: 574246 - RNA, 13 nt, Homo sapiens
aauauauugcuaa

SEQ ID NO: 574247 - RNA, 22 nt, Homo sapiens
aauauauuguaaucacauuccu

SEQ ID NO: 574248 - RNA, 19 nt, Homo sapiens
aauauauuuucaaggaugu

SEQ ID NO: 574249 - RNA, 19 nt, Homo sapiens
aauauauuuuuagacucau

SEQ ID NO: 574250 - RNA, 14 nt, Homo sapiens
aauaucaacucuca

SEQ ID NO: 574251 - RNA, 12 nt, Homo sapiens
aauaucaccuag

SEQ ID NO: 574252 - RNA, 15 nt, Homo sapiens
aauaucacucauuaa

SEQ ID NO: 574253 - RNA, 18 nt, Homo sapiens
aauaucagacaagcacua

SEQ ID NO: 574254 - RNA, 17 nt, Homo sapiens
aauaucccuacauguau

SEQ ID NO: 574255 - RNA, 22 nt, Homo sapiens
aauaucccuacauguauugcac

SEQ ID NO: 574256 - RNA, 17 nt, Homo sapiens
aauauccuccaaugugu

SEQ ID NO: 574257 - RNA, 23 nt, Homo sapiens
aauauccuccaaugugugcaugg

SEQ ID NO: 574258 - RNA, 13 nt, Homo sapiens
aauauccugugua

SEQ ID NO: 574259 - RNA, 12 nt, Homo sapiens
aauaucuaaaaa

SEQ ID NO: 574260 - RNA, 23 nt, Homo sapiens
aauaauggucaguccucaucucu

SEQ ID NO: 574261 - RNA, 14 nt, Homo sapiens
aauaauguacaucu

SEQ ID NO: 574262 - RNA, 14 nt, Homo sapiens
aauaaugugaauga

SEQ ID NO: 574263 - RNA, 15 nt, Homo sapiens
aauaauuaauuucau

SEQ ID NO: 574264 - RNA, 16 nt, Homo sapiens
aauaauuuccuacaca

SEQ ID NO: 574265 - RNA, 16 nt, Homo sapiens
aauaauuugcacugaa

SEQ ID NO: 574266 - RNA, 18 nt, Homo sapiens
aauaauuuuauuaugcaa

SEQ ID NO: 574267 - RNA, 15 nt, Homo sapiens
aauaauuuucauuuc

SEQ ID NO: 574268 - RNA, 19 nt, Homo sapiens
aauaauuuucuaagacagu

SEQ ID NO: 574269 - RNA, 15 nt, Homo sapiens
aagacuuugauccag

SEQ ID NO: 574270 - RNA, 19 nt, Homo sapiens
aagacuuuguccccacuua

SEQ ID NO: 574271 - RNA, 19 nt, Homo sapiens
aagagaaaauuccuagaaa

SEQ ID NO: 574272 - RNA, 21 nt, Homo sapiens
aagagaacucgcgcucaguaa

SEQ ID NO: 574273 - RNA, 16 nt, Homo sapiens
aagagaagaaauagca

SEQ ID NO: 574274 - RNA, 14 nt, Homo sapiens
aagagaagcaauuu

SEQ ID NO: 574275 - RNA, 13 nt, Homo sapiens
aagagaaugaacu

SEQ ID NO: 574276 - RNA, 17 nt, Homo sapiens
aagagacagagaaucuu

SEQ ID NO: 574277 - RNA, 18 nt, Homo sapiens
aagagacauauacuaaga

SEQ ID NO: 574278 - RNA, 16 nt, Homo sapiens
aagagacuccgucuca

SEQ ID NO: 574279 - RNA, 17 nt, Homo sapiens
aagagagagacccucac

SEQ ID NO: 574280 - RNA, 16 nt, Homo sapiens
aagagagagccaugaa

SEQ ID NO: 574281 - RNA, 22 nt, Homo sapiens
aagagagcaacauuuuacccac

SEQ ID NO: 574282 - RNA, 13 nt, Homo sapiens
aagagaguaccau

SEQ ID NO: 574283 - RNA, 23 nt, Homo sapiens
aagagagucgcaucucagugcag

SEQ ID NO: 574284 - RNA, 17 nt, Homo sapiens
aagagaucacaauacuc

SEQ ID NO: 574285 - RNA, 18 nt, Homo sapiens
aagagaucugggcauuaa

SEQ ID NO: 574286 - RNA, 22 nt, Homo sapiens
aagagaugggccuuuucuugaa

SEQ ID NO: 574287 - RNA, 18 nt, Homo sapiens
aagagcaaagggaaauca

SEQ ID NO: 574288 - RNA, 13 nt, Homo sapiens
aagagcacuggag

SEQ ID NO: 574289 - RNA, 23 nt, Homo sapiens
aagagcauccggccaaaugcaaa

SEQ ID NO: 574290 - RNA, 20 nt, Homo sapiens
aagagccauauaaguuugaa

SEQ ID NO: 574291 - RNA, 22 nt, Homo sapiens
aagagcccucaagcggcccuua

SEQ ID NO: 574292 - RNA, 23 nt, Homo sapiens
aagagcuaagauaaagacugugg

SEQ ID NO: 574293 - RNA, 16 nt, Homo sapiens
aagagcugaaacuaua

SEQ ID NO: 574294 - RNA, 16 nt, Homo sapiens
aagagcugcacagcaa

SEQ ID NO: 574295 - RNA, 21 nt, Homo sapiens
aagagcuggaugcacaucagg

SEQ ID NO: 574296 - RNA, 22 nt, Homo sapiens
aagagcuggcaaagguggcucu

SEQ ID NO: 574297 - RNA, 17 nt, Homo sapiens
aagagcuuaacagugug

SEQ ID NO: 574298 - RNA, 16 nt, Homo sapiens
aagagcuuaagaacca

SEQ ID NO: 574299 - RNA, 23 nt, Homo sapiens
aagagcuuugugauauacugguu

SEQ ID NO: 574300 - RNA, 22 nt, Homo sapiens
aagaggacuuaguuugugaugu

SEQ ID NO: 574301 - RNA, 13 nt, Homo sapiens
aagaggagaacaa

SEQ ID NO: 574302 - RNA, 21 nt, Homo sapiens
aagaggagauuggccagugag

SEQ ID NO: 574303 - RNA, 13 nt, Homo sapiens
aagaggccuuccc

SEQ ID NO: 574304 - RNA, 15 nt, Homo sapiens
aagaggcugcugcag

SEQ ID NO: 574305 - RNA, 17 nt, Homo sapiens
aagagggagaagggaug

SEQ ID NO: 574306 - RNA, 16 nt, Homo sapiens
aagaggggccugauga

SEQ ID NO: 574307 - RNA, 18 nt, Homo sapiens
aagagggggcucugccca

SEQ ID NO: 574308 - RNA, 23 nt, Homo sapiens
aagaggguccuuuaguaccugaa

SEQ ID NO: 574309 - RNA, 14 nt, Homo sapiens
aagaggucugagcc

SEQ ID NO: 574310 - RNA, 13 nt, Homo sapiens
aagaggugggagc

SEQ ID NO: 574311 - RNA, 13 nt, Homo sapiens
aagaggugucaug

SEQ ID NO: 574312 - RNA, 15 nt, Homo sapiens
aagagguugaagcua

SEQ ID NO: 574313 - RNA, 21 nt, Homo sapiens
aagagguuuuaaaaaaauccc

SEQ ID NO: 574314 - RNA, 17 nt, Homo sapiens
aagaguaagcaguguua

SEQ ID NO: 574315 - RNA, 13 nt, Homo sapiens
aagaguaguuaua

SEQ ID NO: 574316 - RNA, 15 nt, Homo sapiens
aagaguaguuauaua

SEQ ID NO: 574317 - RNA, 15 nt, Homo sapiens
aagagucugucuuga

SEQ ID NO: 574318 - RNA, 19 nt, Homo sapiens
aagagugaaaaagagaaua

SEQ ID NO: 574319 - RNA, 12 nt, Homo sapiens
aagagugaauuu

SEQ ID NO: 574320 - RNA, 15 nt, Homo sapiens
aagagugagagggca

SEQ ID NO: 574321 - RNA, 13 nt, Homo sapiens
aagaguguggugu

SEQ ID NO: 574322 - RNA, 20 nt, Homo sapiens
aagaguugagauuuugcaau

SEQ ID NO: 574323 - RNA, 13 nt, Homo sapiens
aagaguugccaaa

SEQ ID NO: 574324 - RNA, 24 nt, Homo sapiens
aagaguuucuccuuuugaccaaau

SEQ ID NO: 574325 - RNA, 14 nt, Homo sapiens
aagauaaacacaaa

SEQ ID NO: 574326 - RNA, 17 nt, Homo sapiens
aagauaaaccaguugaa

SEQ ID NO: 574327 - RNA, 14 nt, Homo sapiens
aagauaaaugugcu

SEQ ID NO: 574328 - RNA, 16 nt, Homo sapiens
aagauaaucauugcuu

SEQ ID NO: 574329 - RNA, 20 nt, Homo sapiens
aagauaaucauugcuuaugu

SEQ ID NO: 574330 - RNA, 14 nt, Homo sapiens
aagauaaucucuca

SEQ ID NO: 574331 - RNA, 13 nt, Homo sapiens
aagauacaacagc

SEQ ID NO: 574332 - RNA, 17 nt, Homo sapiens
aagauacacugcagcug

SEQ ID NO: 574333 - RNA, 17 nt, Homo sapiens
aagauacagaacucuuu

SEQ ID NO: 574334 - RNA, 12 nt, Homo sapiens
aagauagacuuc

SEQ ID NO: 574335 - RNA, 18 nt, Homo sapiens
aagauagggaacacucau

SEQ ID NO: 574336 - RNA, 18 nt, Homo sapiens
aagauaguugauucuugc

SEQ ID NO: 574337 - RNA, 13 nt, Homo sapiens
aagauauaugaau

SEQ ID NO: 574338 - RNA, 18 nt, Homo sapiens
aagauauauguguauaca

SEQ ID NO: 574339 - RNA, 14 nt, Homo sapiens
aagaucaagccagu

SEQ ID NO: 574340 - RNA, 17 nt, Homo sapiens
aagaucaauuucuccca

SEQ ID NO: 574341 - RNA, 14 nt, Homo sapiens
aagaucaucuccca

SEQ ID NO: 574342 - RNA, 21 nt, Homo sapiens
aagauccaagaaggccuucau

SEQ ID NO: 574343 - RNA, 18 nt, Homo sapiens
aagauccuccugaccuca

SEQ ID NO: 574344 - RNA, 20 nt, Homo sapiens
aagaucgcaccauugcacuc

SEQ ID NO: 574345 - RNA, 14 nt, Homo sapiens
aagaucucuugcua

SEQ ID NO: 574346 - RNA, 20 nt, Homo sapiens
aagaucuguuuugaaggcaa

SEQ ID NO: 574347 - RNA, 18 nt, Homo sapiens
aagaugaaauugccaaaa

SEQ ID NO: 574348 - RNA, 16 nt, Homo sapiens
aagaugaaggcaucaa

SEQ ID NO: 574349 - RNA, 15 nt, Homo sapiens
aagaugaaguuuuau

SEQ ID NO: 574350 - RNA, 17 nt, Homo sapiens
aagaugaccuuugucuc

SEQ ID NO: 574351 - RNA, 18 nt, Homo sapiens
aagaugaccuuugucuca

SEQ ID NO: 574352 - RNA, 18 nt, Homo sapiens
aagaugagagaacuggag

SEQ ID NO: 574353 - RNA, 15 nt, Homo sapiens
aagaugaugauguua

SEQ ID NO: 574354 - RNA, 19 nt, Homo sapiens
aagaugauggaaacgcacu

SEQ ID NO: 574355 - RNA, 15 nt, Homo sapiens
aagaugauuucucaa

SEQ ID NO: 574356 - RNA, 15 nt, Homo sapiens
aagaugcacugaaaa

SEQ ID NO: 574357 - RNA, 11 nt, Homo sapiens
aagaugcagug

SEQ ID NO: 574358 - RNA, 16 nt, Homo sapiens
aagaugcccacugagg

SEQ ID NO: 574359 - RNA, 14 nt, Homo sapiens
aagaugcguuugcc

SEQ ID NO: 574360 - RNA, 17 nt, Homo sapiens
aagauggaaaucacauu

SEQ ID NO: 574361 - RNA, 20 nt, Homo sapiens
aagauggcacuuauaaccaa

SEQ ID NO: 574362 - RNA, 18 nt, Homo sapiens
aagauggcauccugugaa

SEQ ID NO: 574363 - RNA, 19 nt, Homo sapiens
aagauggccaugcccucca

SEQ ID NO: 574364 - RNA, 19 nt, Homo sapiens
aagauggcucagaggggga

SEQ ID NO: 574365 - RNA, 18 nt, Homo sapiens
aagaugguccgugcccag

SEQ ID NO: 574366 - RNA, 17 nt, Homo sapiens
aagauguauccuuccaa

SEQ ID NO: 574367 - RNA, 22 nt, Homo sapiens
aagauguauuauaccagugaaa

SEQ ID NO: 574368 - RNA, 19 nt, Homo sapiens
aagauguccugacuuugcc

SEQ ID NO: 574369 - RNA, 16 nt, Homo sapiens
aagaugugucuucaau

SEQ ID NO: 574370 - RNA, 22 nt, Homo sapiens
aagauguguugcuauccugaaa

SEQ ID NO: 574371 - RNA, 18 nt, Homo sapiens
aagauguuuuauuuugcc

SEQ ID NO: 574372 - RNA, 16 nt, Homo sapiens
aagauuaaaaagcaca

SEQ ID NO: 574373 - RNA, 14 nt, Homo sapiens
aagauuaaaaccaa

SEQ ID NO: 574374 - RNA, 14 nt, Homo sapiens
aagauuaaaugugu

SEQ ID NO: 574375 - RNA, 16 nt, Homo sapiens
aagauuaacacauuug

SEQ ID NO: 574376 - RNA, 21 nt, Homo sapiens
aagauuaugugacuugcaaua

SEQ ID NO: 574377 - RNA, 23 nt, Homo sapiens
aagauuauugugacuucacugua

SEQ ID NO: 574378 - RNA, 23 nt, Homo sapiens
aagauuauuuuuuaaaaagguaa

SEQ ID NO: 574379 - RNA, 17 nt, Homo sapiens
aagauucuccugugcua

SEQ ID NO: 574380 - RNA, 21 nt, Homo sapiens
aagauuguuggugaauuuuca

SEQ ID NO: 574381 - RNA, 20 nt, Homo sapiens
aagauuuaccauaagggacu

SEQ ID NO: 574382 - RNA, 23 nt, Homo sapiens
aagauuuagaaaaaaguuuacaa

SEQ ID NO: 574383 - RNA, 19 nt, Homo sapiens
aagauuuaugaugcacuua

SEQ ID NO: 574384 - RNA, 16 nt, Homo sapiens
aagauuuuaugcugcu

SEQ ID NO: 574385 - RNA, 16 nt, Homo sapiens
aagauuuuccucuugu

SEQ ID NO: 574386 - RNA, 19 nt, Homo sapiens
aagcaaaauuauguuugcc

SEQ ID NO: 574387 - RNA, 22 nt, Homo sapiens
aagcaaacacuuacagaauuau

SEQ ID NO: 574388 - RNA, 17 nt, Homo sapiens
aagcaaacaucaaauaa

SEQ ID NO: 574389 - RNA, 15 nt, Homo sapiens
aagcaaauaaaugcc

SEQ ID NO: 574390 - RNA, 11 nt, Homo sapiens
aagcaaauaga

SEQ ID NO: 574391 - RNA, 13 nt, Homo sapiens
aagcaacaucuag

SEQ ID NO: 574392 - RNA, 15 nt, Homo sapiens
aagaaccggacaaau

SEQ ID NO: 574393 - RNA, 14 nt, Homo sapiens
aagaaccucuccau

SEQ ID NO: 574394 - RNA, 16 nt, Homo sapiens
aagaacgcgacuucca

SEQ ID NO: 574395 - RNA, 22 nt, Homo sapiens
aagaacggcuuggcagccaguc

SEQ ID NO: 574396 - RNA, 22 nt, Homo sapiens
aagaacuacgggcugcucuacu

SEQ ID NO: 574397 - RNA, 22 nt, Homo sapiens
aagaacuauugugcucagagac

SEQ ID NO: 574398 - RNA, 20 nt, Homo sapiens
aagaacugaaggcauaugca

SEQ ID NO: 574399 - RNA, 20 nt, Homo sapiens
aagaacugacuagugagaug

SEQ ID NO: 574400 - RNA, 17 nt, Homo sapiens
aagaacuguacauugug

SEQ ID NO: 574401 - RNA, 24 nt, Homo sapiens
aagaacugucuauuuucucaguca

SEQ ID NO: 574402 - RNA, 19 nt, Homo sapiens
aagaacuuggcacacucuc

SEQ ID NO: 574403 - RNA, 18 nt, Homo sapiens
aagaagagacucuuugca

SEQ ID NO: 574404 - RNA, 13 nt, Homo sapiens
aagaagauaugca

SEQ ID NO: 574405 - RNA, 23 nt, Homo sapiens
aagaagcaaccucaguaauuuag

SEQ ID NO: 574406 - RNA, 16 nt, Homo sapiens
aagaagccacccuccu

SEQ ID NO: 574407 - RNA, 16 nt, Homo sapiens
aagaagccaggugcaa

SEQ ID NO: 574408 - RNA, 17 nt, Homo sapiens
aagaagcccagugguga

SEQ ID NO: 574409 - RNA, 14 nt, Homo sapiens
aagaagccuuuccu

SEQ ID NO: 574410 - RNA, 14 nt, Homo sapiens
aagaagcgagaugu

SEQ ID NO: 574411 - RNA, 22 nt, Homo sapiens
aagaagcgcggcuaacuuauuc

SEQ ID NO: 574412 - RNA, 12 nt, Homo sapiens
aagaagcucucc

SEQ ID NO: 574413 - RNA, 20 nt, Homo sapiens
aagaagcuggcuaguccuuu

SEQ ID NO: 574414 - RNA, 16 nt, Homo sapiens
aagaagcuucaugcca

SEQ ID NO: 574415 - RNA, 18 nt, Homo sapiens
aagaagcuucaugccagg

SEQ ID NO: 574416 - RNA, 22 nt, Homo sapiens
aagaaggaaaaaauaaaagauc

SEQ ID NO: 574417 - RNA, 21 nt, Homo sapiens
aagaaggaauucuaggcaucc

SEQ ID NO: 574418 - RNA, 19 nt, Homo sapiens
aagaaggacugaacuccau

SEQ ID NO: 574419 - RNA, 20 nt, Homo sapiens
aagaaggacugaacuccauc

SEQ ID NO: 574420 - RNA, 16 nt, Homo sapiens
aagaaggagcugagaa

SEQ ID NO: 574421 - RNA, 13 nt, Homo sapiens
aagaagggcugca

SEQ ID NO: 574422 - RNA, 17 nt, Homo sapiens
aagaaggggcucuggau

SEQ ID NO: 574423 - RNA, 17 nt, Homo sapiens
aagaagguuaccaagaa

SEQ ID NO: 574424 - RNA, 18 nt, Homo sapiens
aagaagugggagcagcuu

SEQ ID NO: 574425 - RNA, 17 nt, Homo sapiens
aagaaguuauuuuccag

SEQ ID NO: 574426 - RNA, 20 nt, Homo sapiens
aagaaguugaacuaugacug

SEQ ID NO: 574427 - RNA, 20 nt, Homo sapiens
aagaaguuguaguguuauca

SEQ ID NO: 574428 - RNA, 12 nt, Homo sapiens
aagaauaauuca

SEQ ID NO: 574429 - RNA, 13 nt, Homo sapiens
aagaauacacaau

SEQ ID NO: 574430 - RNA, 17 nt, Homo sapiens
aagaauagcugcuuccg

SEQ ID NO: 574431 - RNA, 17 nt, Homo sapiens
aagaauaugacuuuuua

SEQ ID NO: 574432 - RNA, 13 nt, Homo sapiens
aagaaucaccuca

SEQ ID NO: 574433 - RNA, 15 nt, Homo sapiens
aagaaucaccucaaa

SEQ ID NO: 574434 - RNA, 18 nt, Homo sapiens
aagaaucuaaaccuuaca

SEQ ID NO: 574435 - RNA, 21 nt, Homo sapiens
aagaaucuaaaccuuacaugu

SEQ ID NO: 574436 - RNA, 13 nt, Homo sapiens
aagaaucuaauag

SEQ ID NO: 574437 - RNA, 18 nt, Homo sapiens
aagaaucuagaagaugug

SEQ ID NO: 574438 - RNA, 17 nt, Homo sapiens
aagaaugaauaauaauu

SEQ ID NO: 574439 - RNA, 15 nt, Homo sapiens
aagaauggcuuucaa

SEQ ID NO: 574440 - RNA, 21 nt, Homo sapiens
aagaauguagucagacugaca

SEQ ID NO: 574441 - RNA, 17 nt, Homo sapiens
aagaauguccauggugg

SEQ ID NO: 574442 - RNA, 22 nt, Homo sapiens
aagaaugucucggucacaucag

SEQ ID NO: 574443 - RNA, 18 nt, Homo sapiens
aagaauuaaaaacuuuca

SEQ ID NO: 574444 - RNA, 14 nt, Homo sapiens
aagaauuacuugug

SEQ ID NO: 574445 - RNA, 23 nt, Homo sapiens
aagaauuagaucgguucugugcc

SEQ ID NO: 574446 - RNA, 12 nt, Homo sapiens
aagaauuccaaa

SEQ ID NO: 574447 - RNA, 15 nt, Homo sapiens
aagaauuccaaagca

SEQ ID NO: 574448 - RNA, 20 nt, Homo sapiens
aagaauuggacaugauguau

SEQ ID NO: 574449 - RNA, 17 nt, Homo sapiens
aagaauugucucugggc

SEQ ID NO: 574450 - RNA, 16 nt, Homo sapiens
aagaauuuaauggacu

SEQ ID NO: 574451 - RNA, 12 nt, Homo sapiens
aagaauuucaca

SEQ ID NO: 574452 - RNA, 20 nt, Homo sapiens
aagaauuuuguuuuacuuuu

SEQ ID NO: 574453 - RNA, 22 nt, Homo sapiens
aagaauuuuuuuuaacauucca

SEQ ID NO: 574454 - RNA, 15 nt, Homo sapiens
aagacaaaaccaaaa

SEQ ID NO: 574455 - RNA, 14 nt, Homo sapiens
aagacaaauucugu

SEQ ID NO: 574456 - RNA, 14 nt, Homo sapiens
aagacaacucugaa

SEQ ID NO: 574457 - RNA, 18 nt, Homo sapiens
aagacacaucuuauugaa

SEQ ID NO: 574458 - RNA, 19 nt, Homo sapiens
aagacagagauaccauuca

SEQ ID NO: 574459 - RNA, 11 nt, Homo sapiens
aagacagagca

SEQ ID NO: 574460 - RNA, 22 nt, Homo sapiens
aagacagugccuauacugccuc

SEQ ID NO: 574461 - RNA, 13 nt, Homo sapiens
aagacaguguaca

SEQ ID NO: 574462 - RNA, 20 nt, Homo sapiens
aagacauacuccuuccauca

SEQ ID NO: 574463 - RNA, 15 nt, Homo sapiens
aagacauacugcuug

SEQ ID NO: 574464 - RNA, 15 nt, Homo sapiens
aagacaucagucucc

SEQ ID NO: 574465 - RNA, 15 nt, Homo sapiens
aagacaucauguauc

SEQ ID NO: 574466 - RNA, 17 nt, Homo sapiens
aagacaucuguggccaa

SEQ ID NO: 574467 - RNA, 13 nt, Homo sapiens
aagacaugaacca

SEQ ID NO: 574468 - RNA, 15 nt, Homo sapiens
aagacauguuggaaa

SEQ ID NO: 574469 - RNA, 21 nt, Homo sapiens
aagacauuaccaugaguaaua

SEQ ID NO: 574470 - RNA, 17 nt, Homo sapiens
aagacauuuccuaccug

SEQ ID NO: 574471 - RNA, 16 nt, Homo sapiens
aagaccaaagaccaag

SEQ ID NO: 574472 - RNA, 12 nt, Homo sapiens
aagaccaaagca

SEQ ID NO: 574473 - RNA, 18 nt, Homo sapiens
aagaccaagacacagauc

SEQ ID NO: 574474 - RNA, 13 nt, Homo sapiens
aagaccaccacuu

SEQ ID NO: 574475 - RNA, 17 nt, Homo sapiens
aagaccagccuggccaa

SEQ ID NO: 574476 - RNA, 16 nt, Homo sapiens
aagaccagcuuugcag

SEQ ID NO: 574477 - RNA, 19 nt, Homo sapiens
aagaccagcuuugcaguga

SEQ ID NO: 574478 - RNA, 21 nt, Homo sapiens
aagaccagcuuugcagugaca

SEQ ID NO: 574479 - RNA, 22 nt, Homo sapiens
aagaccaggccaaugucagggu

SEQ ID NO: 574480 - RNA, 16 nt, Homo sapiens
aagaccaucugguauc

SEQ ID NO: 574481 - RNA, 19 nt, Homo sapiens
aagacccccagcacuuggg

SEQ ID NO: 574482 - RNA, 17 nt, Homo sapiens
aagaccuagugcucuua

SEQ ID NO: 574483 - RNA, 14 nt, Homo sapiens
aagaccucuggcau

SEQ ID NO: 574484 - RNA, 16 nt, Homo sapiens
aagaccugagaaugua

SEQ ID NO: 574485 - RNA, 23 nt, Homo sapiens
aagaccuggagcggcuauuccag

SEQ ID NO: 574486 - RNA, 13 nt, Homo sapiens
aagacgccuucau

SEQ ID NO: 574487 - RNA, 13 nt, Homo sapiens
aagacgcuuccuu

SEQ ID NO: 574488 - RNA, 14 nt, Homo sapiens
aagacuacaaaaau

SEQ ID NO: 574489 - RNA, 18 nt, Homo sapiens
aagacuacuauacaaacu

SEQ ID NO: 574490 - RNA, 18 nt, Homo sapiens
aagacuagaggcuugcau

SEQ ID NO: 574491 - RNA, 13 nt, Homo sapiens
aagacuaucuaca

SEQ ID NO: 574492 - RNA, 15 nt, Homo sapiens
aagacuauuugccau

SEQ ID NO: 574493 - RNA, 15 nt, Homo sapiens
aagacucacuucuca

SEQ ID NO: 574494 - RNA, 21 nt, Homo sapiens
aagacucauucccuagaucuu

SEQ ID NO: 574495 - RNA, 15 nt, Homo sapiens
aagacucauugcuua

SEQ ID NO: 574496 - RNA, 15 nt, Homo sapiens
aagacuccucugggc

SEQ ID NO: 574497 - RNA, 16 nt, Homo sapiens
aagacucugagccaag

SEQ ID NO: 574498 - RNA, 16 nt, Homo sapiens
aagacucugccauuaa

SEQ ID NO: 574499 - RNA, 14 nt, Homo sapiens
aagacucuuuauga

SEQ ID NO: 574500 - RNA, 18 nt, Homo sapiens
aagacugaagacugcaca

SEQ ID NO: 574501 - RNA, 17 nt, Homo sapiens
aagacugaaucuaccug

SEQ ID NO: 574502 - RNA, 11 nt, Homo sapiens
aagacugacca

SEQ ID NO: 574503 - RNA, 19 nt, Homo sapiens
aagacugaugaagaaauuu

SEQ ID NO: 574504 - RNA, 16 nt, Homo sapiens
aagacugccagguggu

SEQ ID NO: 574505 - RNA, 11 nt, Homo sapiens
aagacugucaa

SEQ ID NO: 574506 - RNA, 19 nt, Homo sapiens
aagacugucaaaugaacuu

SEQ ID NO: 574507 - RNA, 22 nt, Homo sapiens
aagacugucaaaugaacuuuua

SEQ ID NO: 574508 - RNA, 23 nt, Homo sapiens
aagacugucaaaugaacuuuuac

SEQ ID NO: 574509 - RNA, 18 nt, Homo sapiens
aagacugucagcuuccaa

SEQ ID NO: 574510 - RNA, 16 nt, Homo sapiens
aagacugugcugagaa

SEQ ID NO: 574511 - RNA, 20 nt, Homo sapiens
aagacuucaguauguuguca

SEQ ID NO: 574512 - RNA, 16 nt, Homo sapiens
aagacuuccacucgau

SEQ ID NO: 574513 - RNA, 13 nt, Homo sapiens
aagacuugacagu

SEQ ID NO: 574514 - RNA, 20 nt, Homo sapiens
aagacuuggguugaucucuu

SEQ ID NO: 574515 - RNA, 20 nt, Homo sapiens
aagacuuuaguuaccgagac

SEQ ID NO: 574516 - RNA, 23 nt, Homo sapiens
aaccaugccuuccucaguaucca

SEQ ID NO: 574517 - RNA, 17 nt, Homo sapiens
aaccauggugaagugcu

SEQ ID NO: 574518 - RNA, 15 nt, Homo sapiens
aaccauuauaaccuu

SEQ ID NO: 574519 - RNA, 22 nt, Homo sapiens
aaccauuguucugaaugcugcu

SEQ ID NO: 574520 - RNA, 23 nt, Homo sapiens
aaccauuuuauuuuuugggccau

SEQ ID NO: 574521 - RNA, 19 nt, Homo sapiens
aaccauuuuuguuacucuc

SEQ ID NO: 574522 - RNA, 23 nt, Homo sapiens
aacccaaauugggacaacagugc

SEQ ID NO: 574523 - RNA, 14 nt, Homo sapiens
aacccaaggagcac

SEQ ID NO: 574524 - RNA, 19 nt, Homo sapiens
aacccaauaaaacugaugu

SEQ ID NO: 574525 - RNA, 15 nt, Homo sapiens
aacccacagccaaac

SEQ ID NO: 574526 - RNA, 14 nt, Homo sapiens
aacccacauauuaa

SEQ ID NO: 574527 - RNA, 14 nt, Homo sapiens
aacccacccggcug

SEQ ID NO: 574528 - RNA, 18 nt, Homo sapiens
aacccaccucucuucccu

SEQ ID NO: 574529 - RNA, 12 nt, Homo sapiens
aacccaccugcu

SEQ ID NO: 574530 - RNA, 17 nt, Homo sapiens
aacccagacaaccaaaa

SEQ ID NO: 574531 - RNA, 18 nt, Homo sapiens
aacccagacaaccaaaac

SEQ ID NO: 574532 - RNA, 20 nt, Homo sapiens
aacccaggaggcggagguug

SEQ ID NO: 574533 - RNA, 20 nt, Homo sapiens
aacccaggagguggagguug

SEQ ID NO: 574534 - RNA, 15 nt, Homo sapiens
aacccauacaaugua

SEQ ID NO: 574535 - RNA, 16 nt, Homo sapiens
aaccccagacacuggu

SEQ ID NO: 574536 - RNA, 16 nt, Homo sapiens
aaccccaucucuacaa

SEQ ID NO: 574537 - RNA, 16 nt, Homo sapiens
aaccccaucucuacua

SEQ ID NO: 574538 - RNA, 20 nt, Homo sapiens
aaccccauguccucagcauu

SEQ ID NO: 574539 - RNA, 21 nt, Homo sapiens
aaccccauguccucagcauuu

SEQ ID NO: 574540 - RNA, 11 nt, Homo sapiens
aacccccagag

SEQ ID NO: 574541 - RNA, 22 nt, Homo sapiens
aacccccagcccacagagccug

SEQ ID NO: 574542 - RNA, 17 nt, Homo sapiens
aacccccaguucaagac

SEQ ID NO: 574543 - RNA, 13 nt, Homo sapiens
aacccccaucucu

SEQ ID NO: 574544 - RNA, 17 nt, Homo sapiens
aacccccaucucuacua

SEQ ID NO: 574545 - RNA, 19 nt, Homo sapiens
aaccccccuccugcuccuc

SEQ ID NO: 574546 - RNA, 22 nt, Homo sapiens
aaccccucuuagcuuacaggaa

SEQ ID NO: 574547 - RNA, 23 nt, Homo sapiens
aaccccugcgcucucuuugcaac

SEQ ID NO: 574548 - RNA, 21 nt, Homo sapiens
aacccgacauguguaccucag

SEQ ID NO: 574549 - RNA, 16 nt, Homo sapiens
aacccgaggcugagaa

SEQ ID NO: 574550 - RNA, 18 nt, Homo sapiens
aacccgauuauuguguau

SEQ ID NO: 574551 - RNA, 14 nt, Homo sapiens
aacccggagagugc

SEQ ID NO: 574552 - RNA, 16 nt, Homo sapiens
aacccggcacugcccu

SEQ ID NO: 574553 - RNA, 20 nt, Homo sapiens
aacccguuucccgguucagg

SEQ ID NO: 574554 - RNA, 22 nt, Homo sapiens
aacccuaaagcaaaucugccac

SEQ ID NO: 574555 - RNA, 17 nt, Homo sapiens
aacccuacuuucuggaa

SEQ ID NO: 574556 - RNA, 15 nt, Homo sapiens
aacccucagcacugu

SEQ ID NO: 574557 - RNA, 19 nt, Homo sapiens
aacccucuaagggaccuca

SEQ ID NO: 574558 - RNA, 13 nt, Homo sapiens
aacccucuugcca

SEQ ID NO: 574559 - RNA, 22 nt, Homo sapiens
aacccucuugccauccugaugg

SEQ ID NO: 574560 - RNA, 21 nt, Homo sapiens
aacccugggaacaauuuccaa

SEQ ID NO: 574561 - RNA, 20 nt, Homo sapiens
aacccuguggggccugaugg

SEQ ID NO: 574562 - RNA, 17 nt, Homo sapiens
aacccuuaaaaaugcac

SEQ ID NO: 574563 - RNA, 14 nt, Homo sapiens
aacccuucaacucc

SEQ ID NO: 574564 - RNA, 21 nt, Homo sapiens
aacccuuccuuucccaaguau

SEQ ID NO: 574565 - RNA, 14 nt, Homo sapiens
aaccgagcaauuuu

SEQ ID NO: 574566 - RNA, 22 nt, Homo sapiens
aaccgaugcuccagccaacccc

SEQ ID NO: 574567 - RNA, 22 nt, Homo sapiens
aaccgaugguccucacaagccu

SEQ ID NO: 574568 - RNA, 23 nt, Homo sapiens
aaccgccggccacacuggucaca

SEQ ID NO: 574569 - RNA, 21 nt, Homo sapiens
aaccgggagaaggcaugagaa

SEQ ID NO: 574570 - RNA, 16 nt, Homo sapiens
aaccguaacccacccc

SEQ ID NO: 574571 - RNA, 14 nt, Homo sapiens
aaccuaaugcucuc

SEQ ID NO: 574572 - RNA, 17 nt, Homo sapiens
aaccuacacacauaccu

SEQ ID NO: 574573 - RNA, 13 nt, Homo sapiens
aaccuacaguuuu

SEQ ID NO: 574574 - RNA, 18 nt, Homo sapiens
aaccuacugcccacauuu

SEQ ID NO: 574575 - RNA, 12 nt, Homo sapiens
aaccuauuuuca

SEQ ID NO: 574576 - RNA, 22 nt, Homo sapiens
aaccucacaaaguagaggaauc

SEQ ID NO: 574577 - RNA, 16 nt, Homo sapiens
aaccucaccauuguga

SEQ ID NO: 574578 - RNA, 14 nt, Homo sapiens
aaccucacugagag

SEQ ID NO: 574579 - RNA, 23 nt, Homo sapiens
aaccucagggcucccaggggucu

SEQ ID NO: 574580 - RNA, 21 nt, Homo sapiens
aaccucauuccccaaccacuu

SEQ ID NO: 574581 - RNA, 14 nt, Homo sapiens
aaccuccacauguu

SEQ ID NO: 574582 - RNA, 20 nt, Homo sapiens
aaccuccgcauccgggguuc

SEQ ID NO: 574583 - RNA, 20 nt, Homo sapiens
aaccuccgccucccggguuc

SEQ ID NO: 574584 - RNA, 20 nt, Homo sapiens
aaccuccgccucucagguuc

SEQ ID NO: 574585 - RNA, 14 nt, Homo sapiens
aaccuccuaagcaa

SEQ ID NO: 574586 - RNA, 21 nt, Homo sapiens
aaccucgcucgaugacuguga

SEQ ID NO: 574587 - RNA, 22 nt, Homo sapiens
aaccucgcucgaugacugugaa

SEQ ID NO: 574588 - RNA, 17 nt, Homo sapiens
aaccucuagagucacug

SEQ ID NO: 574589 - RNA, 18 nt, Homo sapiens
aaccucuaugcaaucuga

SEQ ID NO: 574590 - RNA, 18 nt, Homo sapiens
aaccucucuaagccacag

SEQ ID NO: 574591 - RNA, 18 nt, Homo sapiens
aaccucucuucuaccuua

SEQ ID NO: 574592 - RNA, 13 nt, Homo sapiens
aaccugaguauca

SEQ ID NO: 574593 - RNA, 18 nt, Homo sapiens
aaccugccaugccaggaa

SEQ ID NO: 574594 - RNA, 14 nt, Homo sapiens
aaccugcugugaua

SEQ ID NO: 574595 - RNA, 12 nt, Homo sapiens
aaccugcuuccu

SEQ ID NO: 574596 - RNA, 19 nt, Homo sapiens
aaccuggaauggagacuuu

SEQ ID NO: 574597 - RNA, 16 nt, Homo sapiens
aaccugggcauggugg

SEQ ID NO: 574598 - RNA, 17 nt, Homo sapiens
aaccugggcauuguuga

SEQ ID NO: 574599 - RNA, 15 nt, Homo sapiens
aaccugggugucaga

SEQ ID NO: 574600 - RNA, 17 nt, Homo sapiens
aaccuggugcuggauau

SEQ ID NO: 574601 - RNA, 19 nt, Homo sapiens
aaccugguggcaccagaug

SEQ ID NO: 574602 - RNA, 22 nt, Homo sapiens
aaccugucuccacugugccuuu

SEQ ID NO: 574603 - RNA, 17 nt, Homo sapiens
aaccugugaugagggga

SEQ ID NO: 574604 - RNA, 13 nt, Homo sapiens
aaccuuaauugac

SEQ ID NO: 574605 - RNA, 14 nt, Homo sapiens
aaccuuacaugugu

SEQ ID NO: 574606 - RNA, 13 nt, Homo sapiens
aaccuuaguuuca

SEQ ID NO: 574607 - RNA, 23 nt, Homo sapiens
aaccuuauuuugauaaaauguaa

SEQ ID NO: 574608 - RNA, 21 nt, Homo sapiens
aaccuuccauucacaccagcu

SEQ ID NO: 574609 - RNA, 16 nt, Homo sapiens
aaccuugaaugcugcc

SEQ ID NO: 574610 - RNA, 17 nt, Homo sapiens
aaccuugaaugcugcca

SEQ ID NO: 574611 - RNA, 18 nt, Homo sapiens
aaccuugaaugcugccag

SEQ ID NO: 574612 - RNA, 21 nt, Homo sapiens
aaccuugcuguccugaucugu

SEQ ID NO: 574613 - RNA, 23 nt, Homo sapiens
aaccuugcuguccugaucuguga

SEQ ID NO: 574614 - RNA, 14 nt, Homo sapiens
aaccuuucccucac

SEQ ID NO: 574615 - RNA, 16 nt, Homo sapiens
aaccuuugcuauguaa

SEQ ID NO: 574616 - RNA, 23 nt, Homo sapiens
aacgagauugcuggaaaccaagu

SEQ ID NO: 574617 - RNA, 18 nt, Homo sapiens
aacgagccuccucagggg

SEQ ID NO: 574618 - RNA, 21 nt, Homo sapiens
aacgauccuucaaagucucaa

SEQ ID NO: 574619 - RNA, 22 nt, Homo sapiens
aacgcaaagggcugaaagccau

SEQ ID NO: 574620 - RNA, 12 nt, Homo sapiens
aacgcacaaaac

SEQ ID NO: 574621 - RNA, 17 nt, Homo sapiens
aacgcaccagacacuca

SEQ ID NO: 574622 - RNA, 14 nt, Homo sapiens
aacgcgacuuccac

SEQ ID NO: 574623 - RNA, 14 nt, Homo sapiens
aacgcuuaagucau

SEQ ID NO: 574624 - RNA, 14 nt, Homo sapiens
aacggaugaguuau

SEQ ID NO: 574625 - RNA, 14 nt, Homo sapiens
aacggcuacugaaa

SEQ ID NO: 574626 - RNA, 16 nt, Homo sapiens
aacgucuuuuuauauc

SEQ ID NO: 574627 - RNA, 20 nt, Homo sapiens
aacguguuaaagguuuucuc

SEQ ID NO: 574628 - RNA, 15 nt, Homo sapiens
aacguucugcugcuu

SEQ ID NO: 574629 - RNA, 16 nt, Homo sapiens
aacguucugcugcuug

SEQ ID NO: 574630 - RNA, 14 nt, Homo sapiens
aacuaaaaagccau

SEQ ID NO: 574631 - RNA, 24 nt, Homo sapiens
aacuaaagagcugcacagcaaaag

SEQ ID NO: 574632 - RNA, 21 nt, Homo sapiens
aacuaaauaaaguguugaaca

SEQ ID NO: 574633 - RNA, 15 nt, Homo sapiens
aacuaaccagcauuc

SEQ ID NO: 574634 - RNA, 22 nt, Homo sapiens
aacuaagaaaaaaagcacaaag

SEQ ID NO: 574635 - RNA, 19 nt, Homo sapiens
aacuaagaaauaugcacaa

SEQ ID NO: 574636 - RNA, 13 nt, Homo sapiens
aacuaaggacaaa

SEQ ID NO: 574637 - RNA, 14 nt, Homo sapiens
aacuaauaagcaag

SEQ ID NO: 574638 - RNA, 23 nt, Homo sapiens
aacuaauuuccucugacauguaa

SEQ ID NO: 574639 - RNA, 13 nt, Homo sapiens
aacuaauuugaau

SEQ ID NO: 574640 - RNA, 16 nt, Homo sapiens
aacuacauguaaucca

SEQ ID NO: 574641 - RNA, 21 nt, Homo sapiens
aacuacauuucuacuaugauc

SEQ ID NO: 574642 - RNA, 19 nt, Homo sapiens
aacuacccagguauuacac

SEQ ID NO: 574643 - RNA, 22 nt, Homo sapiens
aacuacccagguauuacacaag

SEQ ID NO: 574644 - RNA, 17 nt, Homo sapiens
aacuaccccacaacacg

SEQ ID NO: 574645 - RNA, 16 nt, Homo sapiens
aacuacggauugcugc

SEQ ID NO: 574646 - RNA, 20 nt, Homo sapiens
aacuacuaaagugccuaccc

SEQ ID NO: 574647 - RNA, 23 nt, Homo sapiens
aacuacuaaagugccuaccccag

SEQ ID NO: 574648 - RNA, 22 nt, Homo sapiens
aacuacugacggaguccugugu

SEQ ID NO: 574649 - RNA, 11 nt, Homo sapiens
aacuacuguac

SEQ ID NO: 574650 - RNA, 13 nt, Homo sapiens
aacuacuguacau

SEQ ID NO: 574651 - RNA, 21 nt, Homo sapiens
aacuacuguguuccuggcaau

SEQ ID NO: 574652 - RNA, 11 nt, Homo sapiens
aacuacuucuu

SEQ ID NO: 574653 - RNA, 17 nt, Homo sapiens
aacuacuucuuacuucu

SEQ ID NO: 574654 - RNA, 20 nt, Homo sapiens
aacuacuuuuuggucaugaa

SEQ ID NO: 574655 - RNA, 23 nt, Homo sapiens
aacuagccagacaaaauuugaga

SEQ ID NO: 574656 - RNA, 20 nt, Homo sapiens
aacuagguuuuugcuucucc

SEQ ID NO: 574657 - RNA, 20 nt, Homo sapiens
aacuaguaaagcaaagugag

SEQ ID NO: 574658 - RNA, 16 nt, Homo sapiens
aacuagugaaauguuc

SEQ ID NO: 574659 - RNA, 15 nt, Homo sapiens
aacuauaacuguugg

SEQ ID NO: 574660 - RNA, 13 nt, Homo sapiens
aacuauaagcaag

SEQ ID NO: 574661 - RNA, 14 nt, Homo sapiens
aacuauaagcaaga

SEQ ID NO: 574662 - RNA, 15 nt, Homo sapiens
aacuauacacuuaau

SEQ ID NO: 574663 - RNA, 17 nt, Homo sapiens
aacuauauucauuucca

SEQ ID NO: 574664 - RNA, 13 nt, Homo sapiens
aacuauauucuca

SEQ ID NO: 574665 - RNA, 14 nt, Homo sapiens
aacuauauucucag

SEQ ID NO: 574666 - RNA, 13 nt, Homo sapiens
aacuauccaaaac

SEQ ID NO: 574667 - RNA, 12 nt, Homo sapiens
aacuauccugau

SEQ ID NO: 574668 - RNA, 16 nt, Homo sapiens
aacuaugacuggagua

SEQ ID NO: 574669 - RNA, 16 nt, Homo sapiens
aacuauguacuuuaaa

SEQ ID NO: 574670 - RNA, 19 nt, Homo sapiens
aacuauguucacaagaaca

SEQ ID NO: 574671 - RNA, 21 nt, Homo sapiens
aacuauuggagggugggagag

SEQ ID NO: 574672 - RNA, 14 nt, Homo sapiens
aacuauugugcuca

SEQ ID NO: 574673 - RNA, 15 nt, Homo sapiens
aacuauuuaaaggaa

SEQ ID NO: 574674 - RNA, 16 nt, Homo sapiens
aacuauuuucaaagac

SEQ ID NO: 574675 - RNA, 15 nt, Homo sapiens
aacucaaaacaccca

SEQ ID NO: 574676 - RNA, 20 nt, Homo sapiens
aacucaaacucuuaaaaccc

SEQ ID NO: 574677 - RNA, 20 nt, Homo sapiens
aacucaaaucgaauagggaa

SEQ ID NO: 574678 - RNA, 15 nt, Homo sapiens
aacucaacuguauaa

SEQ ID NO: 574679 - RNA, 13 nt, Homo sapiens
aacucaagcaaga

SEQ ID NO: 574680 - RNA, 22 nt, Homo sapiens
aacucaauuucuugguauuauu

SEQ ID NO: 574681 - RNA, 16 nt, Homo sapiens
aacucacagcuucucc

SEQ ID NO: 574682 - RNA, 13 nt, Homo sapiens
aacucacaggugu

SEQ ID NO: 574683 - RNA, 16 nt, Homo sapiens
aacucacucugggcug

SEQ ID NO: 574684 - RNA, 17 nt, Homo sapiens
aacucacugauucucua

SEQ ID NO: 574685 - RNA, 13 nt, Homo sapiens
aacucacugccua

SEQ ID NO: 574686 - RNA, 12 nt, Homo sapiens
aacucacuguga

SEQ ID NO: 574687 - RNA, 16 nt, Homo sapiens
aacucagaaacaucag

SEQ ID NO: 574688 - RNA, 15 nt, Homo sapiens
aacucagacauucca

SEQ ID NO: 574689 - RNA, 24 nt, Homo sapiens
aacucaugaucaagauauaugugu

SEQ ID NO: 574690 - RNA, 21 nt, Homo sapiens
aacucauggaccacaguaaca

SEQ ID NO: 574691 - RNA, 14 nt, Homo sapiens
aacuccaagcagac

SEQ ID NO: 574692 - RNA, 15 nt, Homo sapiens
aacuccaauacucac

SEQ ID NO: 574693 - RNA, 18 nt, Homo sapiens
aacuccaucauucaucca

SEQ ID NO: 574694 - RNA, 16 nt, Homo sapiens
aacucccgaccucagg

SEQ ID NO: 574695 - RNA, 21 nt, Homo sapiens
aacucccgaccucaggugauc

SEQ ID NO: 574696 - RNA, 17 nt, Homo sapiens
aacuccuagcugacuca

SEQ ID NO: 574697 - RNA, 13 nt, Homo sapiens
aacuccuauucac

SEQ ID NO: 574698 - RNA, 14 nt, Homo sapiens
aacuccugaccuca

SEQ ID NO: 574699 - RNA, 17 nt, Homo sapiens
aacuccuuguuaaucca

SEQ ID NO: 574700 - RNA, 21 nt, Homo sapiens
aacuccuuguuaauccaguga

SEQ ID NO: 574701 - RNA, 19 nt, Homo sapiens
aacuccuuuuccacuuuaa

SEQ ID NO: 574702 - RNA, 24 nt, Homo sapiens
aacucgcgaguguaacuuucauac

SEQ ID NO: 574703 - RNA, 19 nt, Homo sapiens
aacucuaaagccaagcacu

SEQ ID NO: 574704 - RNA, 22 nt, Homo sapiens
aacucuaagguacacacuuuca

SEQ ID NO: 574705 - RNA, 20 nt, Homo sapiens
aacucuacccuggcacuaua

SEQ ID NO: 574706 - RNA, 17 nt, Homo sapiens
aacucuacucaacccau

SEQ ID NO: 574707 - RNA, 15 nt, Homo sapiens
aacucuaugaacuua

SEQ ID NO: 574708 - RNA, 21 nt, Homo sapiens
aacucucaccaugaugugaag

SEQ ID NO: 574709 - RNA, 20 nt, Homo sapiens
aacucucacuccugaauuca

SEQ ID NO: 574710 - RNA, 20 nt, Homo sapiens
aacucuccuggccuggccau

SEQ ID NO: 574711 - RNA, 15 nt, Homo sapiens
aacucucuagcuuaa

SEQ ID NO: 574712 - RNA, 22 nt, Homo sapiens
aacucugaaagagaaaucaaug

SEQ ID NO: 574713 - RNA, 21 nt, Homo sapiens
aacucugagaucuaaggaugu

SEQ ID NO: 574714 - RNA, 23 nt, Homo sapiens
aacucugcuugauuuuugccucu

SEQ ID NO: 574715 - RNA, 22 nt, Homo sapiens
aacucuggacacucuauaugua

SEQ ID NO: 574716 - RNA, 19 nt, Homo sapiens
aacucuggauuuugaauua

SEQ ID NO: 574717 - RNA, 21 nt, Homo sapiens
aacucuggggcucaagcaguu

SEQ ID NO: 574718 - RNA, 18 nt, Homo sapiens
aacucuguaaucaagaau

SEQ ID NO: 574719 - RNA, 16 nt, Homo sapiens
aacucuuauaacacaa

SEQ ID NO: 574720 - RNA, 11 nt, Homo sapiens
aacucuucagu

SEQ ID NO: 574721 - RNA, 23 nt, Homo sapiens
aacucuucaguuaauucuuagau

SEQ ID NO: 574722 - RNA, 20 nt, Homo sapiens
aacucuucgggagacauguu

SEQ ID NO: 574723 - RNA, 13 nt, Homo sapiens
aacucuugcacag

SEQ ID NO: 574724 - RNA, 20 nt, Homo sapiens
aacucuuucuggccugccuu

SEQ ID NO: 574725 - RNA, 22 nt, Homo sapiens
aacucuuucuggccugccuucg

SEQ ID NO: 574726 - RNA, 17 nt, Homo sapiens
aacugaaggcuaaaaag

SEQ ID NO: 574727 - RNA, 19 nt, Homo sapiens
aacugaaggcuaaaaagca

SEQ ID NO: 574728 - RNA, 21 nt, Homo sapiens
aacugaaggggugcacccacc

SEQ ID NO: 574729 - RNA, 19 nt, Homo sapiens
aacugaauaaauaccucuu

SEQ ID NO: 574730 - RNA, 14 nt, Homo sapiens
aacugaaucacuua

SEQ ID NO: 574731 - RNA, 19 nt, Homo sapiens
aacugacaguaaaucucac

SEQ ID NO: 574732 - RNA, 18 nt, Homo sapiens
aacugacuuaaguggcau

SEQ ID NO: 574733 - RNA, 14 nt, Homo sapiens
aacugacuuuaucc

SEQ ID NO: 574734 - RNA, 17 nt, Homo sapiens
aacugauguuacuagcc

SEQ ID NO: 574735 - RNA, 18 nt, Homo sapiens
aacugauuuuuagcuuua

SEQ ID NO: 574736 - RNA, 21 nt, Homo sapiens
aacugauuuuuagcuuuacaa

SEQ ID NO: 574737 - RNA, 14 nt, Homo sapiens
aacugcaaaccaug

SEQ ID NO: 574738 - RNA, 16 nt, Homo sapiens
aacugcacauugguca

SEQ ID NO: 574739 - RNA, 14 nt, Homo sapiens
aacugcauugagaa

SEQ ID NO: 574740 - RNA, 21 nt, Homo sapiens
aacugccauuauuuucuguca

SEQ ID NO: 574741 - RNA, 16 nt, Homo sapiens
aacugcccccacuguc

SEQ ID NO: 574742 - RNA, 14 nt, Homo sapiens
aacugcccuuccag

SEQ ID NO: 574743 - RNA, 14 nt, Homo sapiens
aacugccucaggac

SEQ ID NO: 574744 - RNA, 14 nt, Homo sapiens
aacugccugggcca

SEQ ID NO: 574745 - RNA, 17 nt, Homo sapiens
aacugcggugaugaugu

SEQ ID NO: 574746 - RNA, 13 nt, Homo sapiens
aacugcuaaugca

SEQ ID NO: 574747 - RNA, 17 nt, Homo sapiens
aacugcucuacuuugag

SEQ ID NO: 574748 - RNA, 15 nt, Homo sapiens
aacugcuuugugcau

SEQ ID NO: 574749 - RNA, 16 nt, Homo sapiens
aacugcuuugugcaua

SEQ ID NO: 574750 - RNA, 21 nt, Homo sapiens
aacuggaaaacagaacacuua

SEQ ID NO: 574751 - RNA, 22 nt, Homo sapiens
aacuggaaaacagaacacuuau

SEQ ID NO: 574752 - RNA, 19 nt, Homo sapiens
aacuggaauaaguguuuau

SEQ ID NO: 574753 - RNA, 14 nt, Homo sapiens
aacugggcauuuca

SEQ ID NO: 574754 - RNA, 20 nt, Homo sapiens
aacugggggcaaagguuuga

SEQ ID NO: 574755 - RNA, 20 nt, Homo sapiens
aacugggggcucuguauaua

SEQ ID NO: 574756 - RNA, 15 nt, Homo sapiens
aacugguucaugaaa

SEQ ID NO: 574757 - RNA, 20 nt, Homo sapiens
aacugguuuaggauuacuua

SEQ ID NO: 574758 - RNA, 21 nt, Homo sapiens
aacuguaaaaugauacuguag

SEQ ID NO: 574759 - RNA, 16 nt, Homo sapiens
aacuguaaaugugaca

SEQ ID NO: 574760 - RNA, 17 nt, Homo sapiens
aacuguacagugucuuu

SEQ ID NO: 574761 - RNA, 22 nt, Homo sapiens
aacuguacauacugcaguguga

SEQ ID NO: 574762 - RNA, 19 nt, Homo sapiens
aacuguagcucaaguuuaa

SEQ ID NO: 574763 - RNA, 12 nt, Homo sapiens
aacuguauuuau

SEQ ID NO: 574764 - RNA, 23 nt, Homo sapiens
aacuguauuucaguauuuuccag

SEQ ID NO: 574765 - RNA, 17 nt, Homo sapiens
aacugucucucuucuca

SEQ ID NO: 574766 - RNA, 15 nt, Homo sapiens
aacugucuuccucaa

SEQ ID NO: 574767 - RNA, 17 nt, Homo sapiens
aacugucuuccucaaaa

SEQ ID NO: 574768 - RNA, 16 nt, Homo sapiens
aacugugacuaggcau

SEQ ID NO: 574769 - RNA, 17 nt, Homo sapiens
aacugugcuccucacuu

SEQ ID NO: 574770 - RNA, 15 nt, Homo sapiens
aacuguggucaaucc

SEQ ID NO: 574771 - RNA, 14 nt, Homo sapiens
aacuguguuuacuc

SEQ ID NO: 574772 - RNA, 22 nt, Homo sapiens
aacuguuaaggagcuucaggga

SEQ ID NO: 574773 - RNA, 21 nt, Homo sapiens
aacuguuggcaaggugacauu

SEQ ID NO: 574774 - RNA, 22 nt, Homo sapiens
aacuuaaaaaaaaaauucugcc

SEQ ID NO: 574775 - RNA, 17 nt, Homo sapiens
aacuuaaaaaaaugaca

SEQ ID NO: 574776 - RNA, 21 nt, Homo sapiens
aacuuaccacccccauacuau

SEQ ID NO: 574777 - RNA, 22 nt, Homo sapiens
aacuuaccaggcaccaaaagaa

SEQ ID NO: 574778 - RNA, 13 nt, Homo sapiens
aacuuacuuccaa

SEQ ID NO: 574779 - RNA, 22 nt, Homo sapiens
aacuuagaggaaaagggcacag

SEQ ID NO: 574780 - RNA, 21 nt, Homo sapiens
aacuuagccauuuuucaaagc

SEQ ID NO: 574781 - RNA, 23 nt, Homo sapiens
aacuuaggcccuagcggcagaaa

SEQ ID NO: 574782 - RNA, 15 nt, Homo sapiens
aacuucaauuuacuu

SEQ ID NO: 574783 - RNA, 22 nt, Homo sapiens
aacuucaccuacauuaucucac

SEQ ID NO: 574784 - RNA, 20 nt, Homo sapiens
aacuucacuaccaagcagcu

SEQ ID NO: 574785 - RNA, 19 nt, Homo sapiens
aacuucagaaagacaguga

SEQ ID NO: 574786 - RNA, 14 nt, Homo sapiens
aacuucauuugaca

SEQ ID NO: 574787 - RNA, 16 nt, Homo sapiens
aacuucauuugacaca

SEQ ID NO: 574788 - RNA, 15 nt, Homo sapiens
aacuuccaauuuaca

SEQ ID NO: 574789 - RNA, 19 nt, Homo sapiens
aacuuccgcugaggggucu

SEQ ID NO: 574790 - RNA, 20 nt, Homo sapiens
aacuuccuuucugugccuca

SEQ ID NO: 574791 - RNA, 19 nt, Homo sapiens
aacuucucuugcuuucuau

SEQ ID NO: 574792 - RNA, 22 nt, Homo sapiens
aacuucugccucccaugcuuac

SEQ ID NO: 574793 - RNA, 18 nt, Homo sapiens
aacuucuuuccucuggag

SEQ ID NO: 574794 - RNA, 20 nt, Homo sapiens
aacuugaaaagaaaaccaca

SEQ ID NO: 574795 - RNA, 15 nt, Homo sapiens
aacuugaaacagauu

SEQ ID NO: 574796 - RNA, 22 nt, Homo sapiens
aacuugaaauauauaauauuca

SEQ ID NO: 574797 - RNA, 22 nt, Homo sapiens
aacuugagcgugaaucuguauc

SEQ ID NO: 574798 - RNA, 16 nt, Homo sapiens
aacuugagggcccaga

SEQ ID NO: 574799 - RNA, 20 nt, Homo sapiens
aacuugauguguuaucucuu

SEQ ID NO: 574800 - RNA, 16 nt, Homo sapiens
aacuugcauugugauu

SEQ ID NO: 574801 - RNA, 12 nt, Homo sapiens
aacuugccaugu

SEQ ID NO: 574802 - RNA, 15 nt, Homo sapiens
aacuugcugcugagu

SEQ ID NO: 574803 - RNA, 18 nt, Homo sapiens
aacuugcugcugugccug

SEQ ID NO: 574804 - RNA, 15 nt, Homo sapiens
aacuuggauggacuu

SEQ ID NO: 574805 - RNA, 19 nt, Homo sapiens
aacuuggucugcagaccau

SEQ ID NO: 574806 - RNA, 21 nt, Homo sapiens
aacuuggucugcagaccaucc

SEQ ID NO: 574807 - RNA, 22 nt, Homo sapiens
aacuuggucugcagaccaucca

SEQ ID NO: 574808 - RNA, 22 nt, Homo sapiens
aacuugguucugcuucaauaaa

SEQ ID NO: 574809 - RNA, 17 nt, Homo sapiens
aacuuguacaccaaugu

SEQ ID NO: 574810 - RNA, 14 nt, Homo sapiens
aacuuguccugacu

SEQ ID NO: 574811 - RNA, 19 nt, Homo sapiens
aacuugucucuucaucuaa

SEQ ID NO: 574812 - RNA, 20 nt, Homo sapiens
aacuuguggccucaagcaau

SEQ ID NO: 574813 - RNA, 17 nt, Homo sapiens
aacuuuaaaaaagcaaa

SEQ ID NO: 574814 - RNA, 15 nt, Homo sapiens
aacuuuaaaaggcaa

SEQ ID NO: 574815 - RNA, 14 nt, Homo sapiens
aacuuuaagucuca

SEQ ID NO: 574816 - RNA, 17 nt, Homo sapiens
aacuuuaccaugcucaa

SEQ ID NO: 574817 - RNA, 19 nt, Homo sapiens
aacuuuagugaaacauaau

SEQ ID NO: 574818 - RNA, 17 nt, Homo sapiens
aacuuuauacacuugga

SEQ ID NO: 574819 - RNA, 15 nt, Homo sapiens
aacuuuaucacuuaa

SEQ ID NO: 574820 - RNA, 13 nt, Homo sapiens
aacuuuauugcau

SEQ ID NO: 574821 - RNA, 18 nt, Homo sapiens
aacuuuauuuaaaugcau

SEQ ID NO: 574822 - RNA, 12 nt, Homo sapiens
aacuuucagugg

SEQ ID NO: 574823 - RNA, 15 nt, Homo sapiens
aacuuuccaaaaccu

SEQ ID NO: 574824 - RNA, 13 nt, Homo sapiens
aacuuuggcuuau

SEQ ID NO: 574825 - RNA, 19 nt, Homo sapiens
aacuuuggugaacaguuuu

SEQ ID NO: 574826 - RNA, 23 nt, Homo sapiens
aacuuugugccuuugaccaucuc

SEQ ID NO: 574827 - RNA, 20 nt, Homo sapiens
aacuuuguuuagcccaaaac

SEQ ID NO: 574828 - RNA, 16 nt, Homo sapiens
aacuuuuaaugaacuu

SEQ ID NO: 574829 - RNA, 22 nt, Homo sapiens
aacuuuuauaaacuuuaccuuu

SEQ ID NO: 574830 - RNA, 17 nt, Homo sapiens
aacuuuucaccaaugag

SEQ ID NO: 574831 - RNA, 15 nt, Homo sapiens
aagaaaaaaagcaca

SEQ ID NO: 574832 - RNA, 21 nt, Homo sapiens
aagaaaaaaugacaccaucuu

SEQ ID NO: 574833 - RNA, 14 nt, Homo sapiens
aagaaaaacaucuu

SEQ ID NO: 574834 - RNA, 23 nt, Homo sapiens
aagaaaaagaccuaugagcacau

SEQ ID NO: 574835 - RNA, 14 nt, Homo sapiens
aagaaaaaguacaa

SEQ ID NO: 574836 - RNA, 14 nt, Homo sapiens
aagaaaaauuaucu

SEQ ID NO: 574837 - RNA, 15 nt, Homo sapiens
aagaaaaauuaucuu

SEQ ID NO: 574838 - RNA, 16 nt, Homo sapiens
aagaaaacaguacaga

SEQ ID NO: 574839 - RNA, 14 nt, Homo sapiens
aagaaaacauuuaa

SEQ ID NO: 574840 - RNA, 20 nt, Homo sapiens
aagaaaaggacaaauaucuu

SEQ ID NO: 574841 - RNA, 15 nt, Homo sapiens
aagaaaauaucacug

SEQ ID NO: 574842 - RNA, 22 nt, Homo sapiens
aagaaaaucacaucacuaccua

SEQ ID NO: 574843 - RNA, 14 nt, Homo sapiens
aagaaaaucauauu

SEQ ID NO: 574844 - RNA, 16 nt, Homo sapiens
aagaaaauggauuuaa

SEQ ID NO: 574845 - RNA, 21 nt, Homo sapiens
aagaaaauguuacuucucuca

SEQ ID NO: 574846 - RNA, 13 nt, Homo sapiens
aagaaacacugcc

SEQ ID NO: 574847 - RNA, 22 nt, Homo sapiens
aagaaaccaccgaaaucccuca

SEQ ID NO: 574848 - RNA, 18 nt, Homo sapiens
aagaaacccucugucauu

SEQ ID NO: 574849 - RNA, 22 nt, Homo sapiens
aagaaacgucuauguguacaga

SEQ ID NO: 574850 - RNA, 15 nt, Homo sapiens
aagaaacuuaccaau

SEQ ID NO: 574851 - RNA, 14 nt, Homo sapiens
aagaaagacuaucu

SEQ ID NO: 574852 - RNA, 16 nt, Homo sapiens
aagaaagaucaaagac

SEQ ID NO: 574853 - RNA, 22 nt, Homo sapiens
aagaaagcaaugccaaucuuca

SEQ ID NO: 574854 - RNA, 19 nt, Homo sapiens
aagaaagccagacaacuuc

SEQ ID NO: 574855 - RNA, 14 nt, Homo sapiens
aagaaagccuaaaa

SEQ ID NO: 574856 - RNA, 15 nt, Homo sapiens
aagaaagggccagga

SEQ ID NO: 574857 - RNA, 12 nt, Homo sapiens
aagaaaguccac

SEQ ID NO: 574858 - RNA, 20 nt, Homo sapiens
aagaaauacucaugugcaau

SEQ ID NO: 574859 - RNA, 18 nt, Homo sapiens
aagaaauauauacuugag

SEQ ID NO: 574860 - RNA, 19 nt, Homo sapiens
aagaaaucaaaagaaucua

SEQ ID NO: 574861 - RNA, 12 nt, Homo sapiens
aagaaaucuggu

SEQ ID NO: 574862 - RNA, 19 nt, Homo sapiens
aagaaaucuuucucccuca

SEQ ID NO: 574863 - RNA, 20 nt, Homo sapiens
aagaaaucuuucucccucaa

SEQ ID NO: 574864 - RNA, 14 nt, Homo sapiens
aagaaaugcccaaa

SEQ ID NO: 574865 - RNA, 11 nt, Homo sapiens
aagaaaugggc

SEQ ID NO: 574866 - RNA, 22 nt, Homo sapiens
aagaaauuccuguagcaucuuc

SEQ ID NO: 574867 - RNA, 12 nt, Homo sapiens
aagaaauuggaa

SEQ ID NO: 574868 - RNA, 16 nt, Homo sapiens
aagaacagagugccug

SEQ ID NO: 574869 - RNA, 20 nt, Homo sapiens
aagaacaguaacugccauca

SEQ ID NO: 574870 - RNA, 18 nt, Homo sapiens
aagaacauggacuuguau

SEQ ID NO: 574871 - RNA, 12 nt, Homo sapiens
aagaacauguga

SEQ ID NO: 574872 - RNA, 22 nt, Homo sapiens
aagaacauuauucaucucuccu

SEQ ID NO: 574873 - RNA, 17 nt, Homo sapiens
aagaaccaaauaccuca

SEQ ID NO: 574874 - RNA, 20 nt, Homo sapiens
aagaacccugcaaauggcua

SEQ ID NO: 574875 - RNA, 16 nt, Homo sapiens
aauccaccugccuugg

SEQ ID NO: 574876 - RNA, 22 nt, Homo sapiens
aauccagcucccuagacugcau

SEQ ID NO: 574877 - RNA, 17 nt, Homo sapiens
aauccagugagcacuag

SEQ ID NO: 574878 - RNA, 13 nt, Homo sapiens
aauccaucugucu

SEQ ID NO: 574879 - RNA, 23 nt, Homo sapiens
aauccauuccaaaauacaauguu

SEQ ID NO: 574880 - RNA, 17 nt, Homo sapiens
aaucccaaucuuucuau

SEQ ID NO: 574881 - RNA, 16 nt, Homo sapiens
aaucccagcacuuugg

SEQ ID NO: 574882 - RNA, 23 nt, Homo sapiens
aaucccauuucccaaaccuaaaa

SEQ ID NO: 574883 - RNA, 22 nt, Homo sapiens
aaucccccauggaaacugcccu

SEQ ID NO: 574884 - RNA, 17 nt, Homo sapiens
aauccccggaaaacugg

SEQ ID NO: 574885 - RNA, 14 nt, Homo sapiens
aaucccgugaaaga

SEQ ID NO: 574886 - RNA, 20 nt, Homo sapiens
aaucccuguacucugaccca

SEQ ID NO: 574887 - RNA, 18 nt, Homo sapiens
aaucccuuugucugucaa

SEQ ID NO: 574888 - RNA, 15 nt, Homo sapiens
aauccguaucugcag

SEQ ID NO: 574889 - RNA, 23 nt, Homo sapiens
aauccuaagacacaaaugcauga

SEQ ID NO: 574890 - RNA, 17 nt, Homo sapiens
aauccuaagcaaaaaga

SEQ ID NO: 574891 - RNA, 16 nt, Homo sapiens
aauccuagacuugaaa

SEQ ID NO: 574892 - RNA, 15 nt, Homo sapiens
aauccuagcacuuug

SEQ ID NO: 574893 - RNA, 20 nt, Homo sapiens
aauccucaaaucagucuucc

SEQ ID NO: 574894 - RNA, 15 nt, Homo sapiens
aauccuccuaccuca

SEQ ID NO: 574895 - RNA, 22 nt, Homo sapiens
aauccucuucuuuauacuguaa

SEQ ID NO: 574896 - RNA, 18 nt, Homo sapiens
aauccugaacuuucuccc

SEQ ID NO: 574897 - RNA, 16 nt, Homo sapiens
aauccugaugguauca

SEQ ID NO: 574898 - RNA, 13 nt, Homo sapiens
aauccugccauuu

SEQ ID NO: 574899 - RNA, 21 nt, Homo sapiens
aauccugcucacaaaaucacu

SEQ ID NO: 574900 - RNA, 20 nt, Homo sapiens
aauccugucauauaauaaaa

SEQ ID NO: 574901 - RNA, 15 nt, Homo sapiens
aauccuuaucccaag

SEQ ID NO: 574902 - RNA, 18 nt, Homo sapiens
aauccuucuaguuuccca

SEQ ID NO: 574903 - RNA, 18 nt, Homo sapiens
aauccuuggggagcacuu

SEQ ID NO: 574904 - RNA, 19 nt, Homo sapiens
aauccuuuacuguuaguca

SEQ ID NO: 574905 - RNA, 13 nt, Homo sapiens
aaucguuccugac

SEQ ID NO: 574906 - RNA, 17 nt, Homo sapiens
aaucuaaaauuucauaa

SEQ ID NO: 574907 - RNA, 20 nt, Homo sapiens
aaucuaaaccuuacaugugu

SEQ ID NO: 574908 - RNA, 13 nt, Homo sapiens
aaucuaaauggaa

SEQ ID NO: 574909 - RNA, 16 nt, Homo sapiens
aaucuaaccacuuaag

SEQ ID NO: 574910 - RNA, 19 nt, Homo sapiens
aaucuaacgggcauucaca

SEQ ID NO: 574911 - RNA, 15 nt, Homo sapiens
aaucuaccacuguau

SEQ ID NO: 574912 - RNA, 17 nt, Homo sapiens
aaucuaccucugaaaaa

SEQ ID NO: 574913 - RNA, 14 nt, Homo sapiens
aaucuacuaauucc

SEQ ID NO: 574914 - RNA, 24 nt, Homo sapiens
aaucuacuggaauagauuccgagg

SEQ ID NO: 574915 - RNA, 12 nt, Homo sapiens
aaucuacuguaa

SEQ ID NO: 574916 - RNA, 21 nt, Homo sapiens
aaucuagagaaggcauuucau

SEQ ID NO: 574917 - RNA, 13 nt, Homo sapiens
aaucuaggugugg

SEQ ID NO: 574918 - RNA, 14 nt, Homo sapiens
aaucuaguuuacag

SEQ ID NO: 574919 - RNA, 18 nt, Homo sapiens
aaucuauaaacaaugaaa

SEQ ID NO: 574920 - RNA, 18 nt, Homo sapiens
aaucuauuccuguaaaua

SEQ ID NO: 574921 - RNA, 13 nt, Homo sapiens
aaucucagcacuu

SEQ ID NO: 574922 - RNA, 16 nt, Homo sapiens
aaucucaugauuccau

SEQ ID NO: 574923 - RNA, 14 nt, Homo sapiens
aaucucauucccag

SEQ ID NO: 574924 - RNA, 13 nt, Homo sapiens
aaucuccagugga

SEQ ID NO: 574925 - RNA, 14 nt, Homo sapiens
aaucuccaguuuuc

SEQ ID NO: 574926 - RNA, 15 nt, Homo sapiens
aaucuccaucucaaa

SEQ ID NO: 574927 - RNA, 22 nt, Homo sapiens
aaucucccagugacaacaucgc

SEQ ID NO: 574928 - RNA, 17 nt, Homo sapiens
aaucuccccuccucaca

SEQ ID NO: 574929 - RNA, 17 nt, Homo sapiens
aaucuccucgacugcuu

SEQ ID NO: 574930 - RNA, 18 nt, Homo sapiens
aaucuccucgacugcuuu

SEQ ID NO: 574931 - RNA, 18 nt, Homo sapiens
aaucucguuucuccucuu

SEQ ID NO: 574932 - RNA, 17 nt, Homo sapiens
aaucucucagcuuuuaa

SEQ ID NO: 574933 - RNA, 16 nt, Homo sapiens
aaucucuccauucccg

SEQ ID NO: 574934 - RNA, 19 nt, Homo sapiens
aaucucucuacucagauga

SEQ ID NO: 574935 - RNA, 17 nt, Homo sapiens
aaucucugugaaauacu

SEQ ID NO: 574936 - RNA, 22 nt, Homo sapiens
aaucucuguucuguuuggcacu

SEQ ID NO: 574937 - RNA, 11 nt, Homo sapiens
aaucucuucau

SEQ ID NO: 574938 - RNA, 22 nt, Homo sapiens
aaucucuucuuugcugcaguca

SEQ ID NO: 574939 - RNA, 20 nt, Homo sapiens
aaucugaacugaccuugaau

SEQ ID NO: 574940 - RNA, 17 nt, Homo sapiens
aaucugaaucagccagu

SEQ ID NO: 574941 - RNA, 12 nt, Homo sapiens
aaucugacaaua

SEQ ID NO: 574942 - RNA, 23 nt, Homo sapiens
aaucugagccagugcuuuaaugg

SEQ ID NO: 574943 - RNA, 17 nt, Homo sapiens
aaucugauuggacauuu

SEQ ID NO: 574944 - RNA, 16 nt, Homo sapiens
aaucugcagugaugca

SEQ ID NO: 574945 - RNA, 13 nt, Homo sapiens
aaucugccuaugu

SEQ ID NO: 574946 - RNA, 16 nt, Homo sapiens
aaucugccuccuucac

SEQ ID NO: 574947 - RNA, 13 nt, Homo sapiens
aaucugcugccau

SEQ ID NO: 574948 - RNA, 16 nt, Homo sapiens
aaucuggacacacugu

SEQ ID NO: 574949 - RNA, 17 nt, Homo sapiens
aaucuggcauucuacac

SEQ ID NO: 574950 - RNA, 16 nt, Homo sapiens
aaucuguauucuugcu

SEQ ID NO: 574951 - RNA, 20 nt, Homo sapiens
aaucuguccguucacaugug

SEQ ID NO: 574952 - RNA, 21 nt, Homo sapiens
aaucuguccguucacaugugu

SEQ ID NO: 574953 - RNA, 21 nt, Homo sapiens
aaucuguguucgauggcucaa

SEQ ID NO: 574954 - RNA, 21 nt, Homo sapiens
aaucuguuaccagaggacaaa

SEQ ID NO: 574955 - RNA, 20 nt, Homo sapiens
aaucuguuuuauaccuugcu

SEQ ID NO: 574956 - RNA, 22 nt, Homo sapiens
aaucuuaccagaugcuacugga

SEQ ID NO: 574957 - RNA, 14 nt, Homo sapiens
aaucuuaguguuca

SEQ ID NO: 574958 - RNA, 16 nt, Homo sapiens
aaucuuauacaacagc

SEQ ID NO: 574959 - RNA, 14 nt, Homo sapiens
aaucuuauuuauac

SEQ ID NO: 574960 - RNA, 11 nt, Homo sapiens
aaucuucaggu

SEQ ID NO: 574961 - RNA, 20 nt, Homo sapiens
aaucuucugccuucucauga

SEQ ID NO: 574962 - RNA, 20 nt, Homo sapiens
aaucuucuugauccacuucu

SEQ ID NO: 574963 - RNA, 13 nt, Homo sapiens
aaucuugaacuuu

SEQ ID NO: 574964 - RNA, 16 nt, Homo sapiens
aaucuugauaccaccu

SEQ ID NO: 574965 - RNA, 13 nt, Homo sapiens
aaucuugggucuu

SEQ ID NO: 574966 - RNA, 23 nt, Homo sapiens
aaucuugggucuuggggacuaac

SEQ ID NO: 574967 - RNA, 20 nt, Homo sapiens
aaucuugucuaacauucccg

SEQ ID NO: 574968 - RNA, 17 nt, Homo sapiens
aaucuuguuaaugucau

SEQ ID NO: 574969 - RNA, 20 nt, Homo sapiens
aaucuuucugcagaaacaga

SEQ ID NO: 574970 - RNA, 14 nt, Homo sapiens
aaucuuugugacag

SEQ ID NO: 574971 - RNA, 18 nt, Homo sapiens
aaucuuuuacaacugccu

SEQ ID NO: 574972 - RNA, 15 nt, Homo sapiens
aaucuuuuacauuuu

SEQ ID NO: 574973 - RNA, 16 nt, Homo sapiens
aaugaaaaacuauguc

SEQ ID NO: 574974 - RNA, 20 nt, Homo sapiens
aaugaaaacauucagaggaa

SEQ ID NO: 574975 - RNA, 14 nt, Homo sapiens
aaugaaaagcaaua

SEQ ID NO: 574976 - RNA, 16 nt, Homo sapiens
aaugaaaagcuuagga

SEQ ID NO: 574977 - RNA, 20 nt, Homo sapiens
aaugaaaaggaaacuugaaa

SEQ ID NO: 574978 - RNA, 14 nt, Homo sapiens
aaugaaaaugcagu

SEQ ID NO: 574979 - RNA, 17 nt, Homo sapiens
aaugaaacuuguggaga

SEQ ID NO: 574980 - RNA, 17 nt, Homo sapiens
aaugaaagaaaaugaga

SEQ ID NO: 574981 - RNA, 22 nt, Homo sapiens
aaugaaagcccucaugugcagu

SEQ ID NO: 574982 - RNA, 12 nt, Homo sapiens
aaugaaaggagu

SEQ ID NO: 574983 - RNA, 22 nt, Homo sapiens
aaugaaaguauuggcauucaaa

SEQ ID NO: 574984 - RNA, 16 nt, Homo sapiens
aaugaaauugucaaaa

SEQ ID NO: 574985 - RNA, 22 nt, Homo sapiens
aaugaacacucuuuugcuuuau

SEQ ID NO: 574986 - RNA, 20 nt, Homo sapiens
aaugaacccccaugauguaa

SEQ ID NO: 574987 - RNA, 13 nt, Homo sapiens
aaugaacccuccu

SEQ ID NO: 574988 - RNA, 17 nt, Homo sapiens
aaugaacuaccaucuga

SEQ ID NO: 574989 - RNA, 14 nt, Homo sapiens
aaugaacucuuuca

SEQ ID NO: 574990 - RNA, 15 nt, Homo sapiens
aaugaacucuuucaa

SEQ ID NO: 574991 - RNA, 15 nt, Homo sapiens
aaugaagaaagggag

SEQ ID NO: 574992 - RNA, 16 nt, Homo sapiens
aaugaagaccaugccu

SEQ ID NO: 574993 - RNA, 16 nt, Homo sapiens
aaugaagcguugccau

SEQ ID NO: 574994 - RNA, 21 nt, Homo sapiens
aaugaaggaaaagcauguuau

SEQ ID NO: 574995 - RNA, 13 nt, Homo sapiens
aaugaauagcuug

SEQ ID NO: 574996 - RNA, 22 nt, Homo sapiens
aaugaauaugaaacacuacaaa

SEQ ID NO: 574997 - RNA, 12 nt, Homo sapiens
aaugaaugccua

SEQ ID NO: 574998 - RNA, 14 nt, Homo sapiens
aaugaauguuuaca

SEQ ID NO: 574999 - RNA, 20 nt, Homo sapiens
aaugaauucgaugcguauuc

SEQ ID NO: 575000 - RNA, 23 nt, Homo sapiens
aaugaauucugggaauccacagc

SEQ ID NO: 575001 - RNA, 16 nt, Homo sapiens
aaugaauuuaucuuua

SEQ ID NO: 575002 - RNA, 16 nt, Homo sapiens
aaugaauuucauguga

SEQ ID NO: 575003 - RNA, 21 nt, Homo sapiens
aaugaauuuuguaugcugaau

SEQ ID NO: 575004 - RNA, 15 nt, Homo sapiens
aaugacacagucuug

SEQ ID NO: 575005 - RNA, 21 nt, Homo sapiens
aaugacacccaugccagagag

SEQ ID NO: 575006 - RNA, 19 nt, Homo sapiens
aaugacagaugcaaguuau

SEQ ID NO: 575007 - RNA, 13 nt, Homo sapiens
aaugacauuugua

SEQ ID NO: 575008 - RNA, 14 nt, Homo sapiens
aaugaccaggccaa

SEQ ID NO: 575009 - RNA, 20 nt, Homo sapiens
aaugaccaggccaagacuca

SEQ ID NO: 575010 - RNA, 16 nt, Homo sapiens
aaugaccuuuuuacaa

SEQ ID NO: 575011 - RNA, 18 nt, Homo sapiens
aaugacuauauaauuuau

SEQ ID NO: 575012 - RNA, 21 nt, Homo sapiens
aaugacucauaggucccugac

SEQ ID NO: 575013 - RNA, 17 nt, Homo sapiens
aaugacuguagaacuua

SEQ ID NO: 575014 - RNA, 17 nt, Homo sapiens
aaugacugugucugccu

SEQ ID NO: 575015 - RNA, 16 nt, Homo sapiens
aaugacuuaaccauau

SEQ ID NO: 575016 - RNA, 14 nt, Homo sapiens
aaugacuuacuuuc

SEQ ID NO: 575017 - RNA, 19 nt, Homo sapiens
aaugagaaggagucagaaa

SEQ ID NO: 575018 - RNA, 15 nt, Homo sapiens
aaugagaccuggaac

SEQ ID NO: 575019 - RNA, 21 nt, Homo sapiens
aaugagacugaacugugugaa

SEQ ID NO: 575020 - RNA, 21 nt, Homo sapiens
aaugagacuuucuaaaucaaa

SEQ ID NO: 575021 - RNA, 18 nt, Homo sapiens
aaugagaggagaacagua

SEQ ID NO: 575022 - RNA, 17 nt, Homo sapiens
aaugagccaucacuaga

SEQ ID NO: 575023 - RNA, 13 nt, Homo sapiens
aaugagccuuagu

SEQ ID NO: 575024 - RNA, 15 nt, Homo sapiens
aaugaggacauguuu

SEQ ID NO: 575025 - RNA, 21 nt, Homo sapiens
aaugaggagacacaccugagg

SEQ ID NO: 575026 - RNA, 22 nt, Homo sapiens
aaugaggauuauugauaguacu

SEQ ID NO: 575027 - RNA, 16 nt, Homo sapiens
aaugagggccaagaaa

SEQ ID NO: 575028 - RNA, 13 nt, Homo sapiens
aaugaguaaaaac

SEQ ID NO: 575029 - RNA, 16 nt, Homo sapiens
aaugaguaacaucuac

SEQ ID NO: 575030 - RNA, 12 nt, Homo sapiens
aaugagugcuua

SEQ ID NO: 575031 - RNA, 14 nt, Homo sapiens
aaugagugcuuaaa

SEQ ID NO: 575032 - RNA, 11 nt, Homo sapiens
aaugagugugc

SEQ ID NO: 575033 - RNA, 20 nt, Homo sapiens
aaugaguuuuaaagauguaa

SEQ ID NO: 575034 - RNA, 15 nt, Homo sapiens
aaugauaagugacaa

SEQ ID NO: 575035 - RNA, 22 nt, Homo sapiens
aaugauacuuaaccaguuagaa

SEQ ID NO: 575036 - RNA, 13 nt, Homo sapiens
aaugauacuuacu

SEQ ID NO: 575037 - RNA, 14 nt, Homo sapiens
aaugauagaacuuu

SEQ ID NO: 575038 - RNA, 18 nt, Homo sapiens
aaugauaugcaagugcaa

SEQ ID NO: 575039 - RNA, 14 nt, Homo sapiens
aaugaucacauucu

SEQ ID NO: 575040 - RNA, 18 nt, Homo sapiens
aaugaucugccucuaaaa

SEQ ID NO: 575041 - RNA, 19 nt, Homo sapiens
aaugaugauccuaggcauu

SEQ ID NO: 575042 - RNA, 15 nt, Homo sapiens
aaugaugaucuucag

SEQ ID NO: 575043 - RNA, 12 nt, Homo sapiens
aaugaugaugac

SEQ ID NO: 575044 - RNA, 17 nt, Homo sapiens
aaugaugcacacugagg

SEQ ID NO: 575045 - RNA, 20 nt, Homo sapiens
aaugaugcucaaaaucuuuc

SEQ ID NO: 575046 - RNA, 15 nt, Homo sapiens
aaugaugggacaaua

SEQ ID NO: 575047 - RNA, 16 nt, Homo sapiens
aaugaugguaaguuaa

SEQ ID NO: 575048 - RNA, 22 nt, Homo sapiens
aaugauucauaagacacuuaga

SEQ ID NO: 575049 - RNA, 19 nt, Homo sapiens
aaugauuggaauauuacaa

SEQ ID NO: 575050 - RNA, 23 nt, Homo sapiens
aaugauugguuaaaaugugauuu

SEQ ID NO: 575051 - RNA, 22 nt, Homo sapiens
aaugauuuagguacgucaaagc

SEQ ID NO: 575052 - RNA, 18 nt, Homo sapiens
aaugauuugcucuuugac

SEQ ID NO: 575053 - RNA, 14 nt, Homo sapiens
aaugauuuuaucug

SEQ ID NO: 575054 - RNA, 14 nt, Homo sapiens
aaugcaaaguacau

SEQ ID NO: 575055 - RNA, 12 nt, Homo sapiens
aaugcaauggaa

SEQ ID NO: 575056 - RNA, 20 nt, Homo sapiens
aaugcacaguacuguuucaa

SEQ ID NO: 575057 - RNA, 14 nt, Homo sapiens
aaugcacaucucau

SEQ ID NO: 575058 - RNA, 23 nt, Homo sapiens
aaugcacauuucagaaauuccaa

SEQ ID NO: 575059 - RNA, 17 nt, Homo sapiens
aaugcaccuagcugugc

SEQ ID NO: 575060 - RNA, 22 nt, Homo sapiens
aaugcaccuagcugugcaagac

SEQ ID NO: 575061 - RNA, 18 nt, Homo sapiens
aaugcagaauucuugagu

SEQ ID NO: 575062 - RNA, 23 nt, Homo sapiens
aaugcagcaggaaggaacaaaga

SEQ ID NO: 575063 - RNA, 16 nt, Homo sapiens
aaugcagcagggaugc

SEQ ID NO: 575064 - RNA, 15 nt, Homo sapiens
aaugcagcaucuuug

SEQ ID NO: 575065 - RNA, 19 nt, Homo sapiens
aaugcaguccucaucucca

SEQ ID NO: 575066 - RNA, 10 nt, Homo sapiens
aaugcagugg

SEQ ID NO: 575067 - RNA, 15 nt, Homo sapiens
aaugcaucucaucaa

SEQ ID NO: 575068 - RNA, 23 nt, Homo sapiens
aaugccaagggggugacuggaag

SEQ ID NO: 575069 - RNA, 15 nt, Homo sapiens
aaugccacuucacca

SEQ ID NO: 575070 - RNA, 13 nt, Homo sapiens
aaugccagcauaa

SEQ ID NO: 575071 - RNA, 23 nt, Homo sapiens
aaugcccuuccagugggacccca

SEQ ID NO: 575072 - RNA, 16 nt, Homo sapiens
aaugccugguaccaga

SEQ ID NO: 575073 - RNA, 22 nt, Homo sapiens
aaugccugguaccagaggaugg

SEQ ID NO: 575074 - RNA, 12 nt, Homo sapiens
aaugccugugaa

SEQ ID NO: 575075 - RNA, 17 nt, Homo sapiens
aaugccuugacaacaga

SEQ ID NO: 575076 - RNA, 19 nt, Homo sapiens
aaugccuuuaaaguaugaa

SEQ ID NO: 575077 - RNA, 16 nt, Homo sapiens
aaugcgacaaguaguu

SEQ ID NO: 575078 - RNA, 18 nt, Homo sapiens
aaugcuaagaaugcauua

SEQ ID NO: 575079 - RNA, 17 nt, Homo sapiens
aaugcuacauacuccaa

SEQ ID NO: 575080 - RNA, 14 nt, Homo sapiens
aaugcuauguucug

SEQ ID NO: 575081 - RNA, 15 nt, Homo sapiens
aaugcucaaucucag

SEQ ID NO: 575082 - RNA, 21 nt, Homo sapiens
aaugcucauuuucugguuugg

SEQ ID NO: 575083 - RNA, 10 nt, Homo sapiens
aaugcuccau

SEQ ID NO: 575084 - RNA, 19 nt, Homo sapiens
aaugcucccagcugugcug

SEQ ID NO: 575085 - RNA, 18 nt, Homo sapiens
aaugcucccugauauuuc

SEQ ID NO: 575086 - RNA, 15 nt, Homo sapiens
aaugcucucagggaa

SEQ ID NO: 575087 - RNA, 12 nt, Homo sapiens
aaugcugcacuu

SEQ ID NO: 575088 - RNA, 21 nt, Homo sapiens
aaugcugcgcuucgcuuggug

SEQ ID NO: 575089 - RNA, 15 nt, Homo sapiens
aaugcugcuuugucc

SEQ ID NO: 575090 - RNA, 17 nt, Homo sapiens
aaugcuggccuguggug

SEQ ID NO: 575091 - RNA, 17 nt, Homo sapiens
aaugcugucccuauaca

SEQ ID NO: 575092 - RNA, 14 nt, Homo sapiens
aaugcuucauucaa

SEQ ID NO: 575093 - RNA, 16 nt, Homo sapiens
aaugcuugaaaccaga

SEQ ID NO: 575094 - RNA, 19 nt, Homo sapiens
aaugcuuuuugaauguuau

SEQ ID NO: 575095 - RNA, 18 nt, Homo sapiens
aaugcuuuuugaguuuca

SEQ ID NO: 575096 - RNA, 14 nt, Homo sapiens
aauggaaaccaagg

SEQ ID NO: 575097 - RNA, 21 nt, Homo sapiens
aauggaaagauccccuaauaa

SEQ ID NO: 575098 - RNA, 15 nt, Homo sapiens
aauggaaaguuguau

SEQ ID NO: 575099 - RNA, 16 nt, Homo sapiens
aauggaacuacuguac

SEQ ID NO: 575100 - RNA, 14 nt, Homo sapiens
aauggaacuaucuc

SEQ ID NO: 575101 - RNA, 21 nt, Homo sapiens
aauggaagaguguuucuucca

SEQ ID NO: 575102 - RNA, 17 nt, Homo sapiens
aauggaauaacuaucuc

SEQ ID NO: 575103 - RNA, 16 nt, Homo sapiens
aauggacaaaauccau

SEQ ID NO: 575104 - RNA, 19 nt, Homo sapiens
aauggacaaaauccaugaa

SEQ ID NO: 575105 - RNA, 18 nt, Homo sapiens
aauggacaagcagugucu

SEQ ID NO: 575106 - RNA, 20 nt, Homo sapiens
aauggacauaagacagacag

SEQ ID NO: 575107 - RNA, 12 nt, Homo sapiens
aauggacuggag

SEQ ID NO: 575108 - RNA, 20 nt, Homo sapiens
aauggagggaauaauaccua

SEQ ID NO: 575109 - RNA, 20 nt, Homo sapiens
aauggaggggacuccaaagc

SEQ ID NO: 575110 - RNA, 17 nt, Homo sapiens
aauggauucucuauuca

SEQ ID NO: 575111 - RNA, 13 nt, Homo sapiens
aauggcagguguc

SEQ ID NO: 575112 - RNA, 22 nt, Homo sapiens
aauggcaugcugaaacucgaag

SEQ ID NO: 575113 - RNA, 13 nt, Homo sapiens
aauggcaugucag

SEQ ID NO: 575114 - RNA, 12 nt, Homo sapiens
aauggcauuugc

SEQ ID NO: 575115 - RNA, 18 nt, Homo sapiens
aauggccagugcugcuuc

SEQ ID NO: 575116 - RNA, 13 nt, Homo sapiens
aauggccaugcag

SEQ ID NO: 575117 - RNA, 22 nt, Homo sapiens
aauggcccaggucucucaacuu

SEQ ID NO: 575118 - RNA, 15 nt, Homo sapiens
aauggcgaaugucau

SEQ ID NO: 575119 - RNA, 16 nt, Homo sapiens
aauggcuaguacugua

SEQ ID NO: 575120 - RNA, 23 nt, Homo sapiens
aaugggaagauuaaaaagcacag

SEQ ID NO: 575121 - RNA, 15 nt, Homo sapiens
aaugggaccgugccc

SEQ ID NO: 575122 - RNA, 18 nt, Homo sapiens
aauaucuaagaaucuuug

SEQ ID NO: 575123 - RNA, 19 nt, Homo sapiens
aauaucugggauucuacuu

SEQ ID NO: 575124 - RNA, 20 nt, Homo sapiens
aauaucugugaaauaucauc

SEQ ID NO: 575125 - RNA, 21 nt, Homo sapiens
aauaugaagcaggaucacaaa

SEQ ID NO: 575126 - RNA, 15 nt, Homo sapiens
aauaugaaugucaca

SEQ ID NO: 575127 - RNA, 22 nt, Homo sapiens
aauaugaugccacuuugcagcu

SEQ ID NO: 575128 - RNA, 15 nt, Homo sapiens
aauaugauuacuuua

SEQ ID NO: 575129 - RNA, 19 nt, Homo sapiens
aauaugcaaaccaggauuu

SEQ ID NO: 575130 - RNA, 20 nt, Homo sapiens
aauauggaacauaugcacag

SEQ ID NO: 575131 - RNA, 23 nt, Homo sapiens
aauaugguugauaguuuaccuga

SEQ ID NO: 575132 - RNA, 16 nt, Homo sapiens
aauauguaaaugguau

SEQ ID NO: 575133 - RNA, 22 nt, Homo sapiens
aauauguagcucauccuuuaca

SEQ ID NO: 575134 - RNA, 14 nt, Homo sapiens
aauaugucaguuug

SEQ ID NO: 575135 - RNA, 17 nt, Homo sapiens
aauaugugaaagacaau

SEQ ID NO: 575136 - RNA, 17 nt, Homo sapiens
aauauguugaguguuca

SEQ ID NO: 575137 - RNA, 18 nt, Homo sapiens
aauauguugguauucucc

SEQ ID NO: 575138 - RNA, 23 nt, Homo sapiens
aauauuaaaaucacugucaauau

SEQ ID NO: 575139 - RNA, 13 nt, Homo sapiens
aauauuaaauaca

SEQ ID NO: 575140 - RNA, 11 nt, Homo sapiens
aauauuaacau

SEQ ID NO: 575141 - RNA, 20 nt, Homo sapiens
aauauuacccagcugaauag

SEQ ID NO: 575142 - RNA, 14 nt, Homo sapiens
aauauuacucucaa

SEQ ID NO: 575143 - RNA, 21 nt, Homo sapiens
aauauuagcaaagaagcuuca

SEQ ID NO: 575144 - RNA, 22 nt, Homo sapiens
aauauuagugauucugauuuca

SEQ ID NO: 575145 - RNA, 23 nt, Homo sapiens
aauauuaucacgcagaucacuaa

SEQ ID NO: 575146 - RNA, 16 nt, Homo sapiens
aauauuauuacuuuau

SEQ ID NO: 575147 - RNA, 15 nt, Homo sapiens
aauauuauuccucaa

SEQ ID NO: 575148 - RNA, 12 nt, Homo sapiens
aauauucacaca

SEQ ID NO: 575149 - RNA, 15 nt, Homo sapiens
aauauuccagaagaa

SEQ ID NO: 575150 - RNA, 12 nt, Homo sapiens
aauauuccugaa

SEQ ID NO: 575151 - RNA, 14 nt, Homo sapiens
aauauuuaagugaa

SEQ ID NO: 575152 - RNA, 13 nt, Homo sapiens
aauauuuauucau

SEQ ID NO: 575153 - RNA, 21 nt, Homo sapiens
aauauuuccaucagcccaucu

SEQ ID NO: 575154 - RNA, 14 nt, Homo sapiens
aauauuuccauuaa

SEQ ID NO: 575155 - RNA, 19 nt, Homo sapiens
aauauuucugauacugcug

SEQ ID NO: 575156 - RNA, 18 nt, Homo sapiens
aauauuucuuucaugucu

SEQ ID NO: 575157 - RNA, 18 nt, Homo sapiens
aauauuugcugacagcug

SEQ ID NO: 575158 - RNA, 15 nt, Homo sapiens
aauauuuguauacac

SEQ ID NO: 575159 - RNA, 19 nt, Homo sapiens
aauauuuguauacacauaa

SEQ ID NO: 575160 - RNA, 20 nt, Homo sapiens
aauauuuguauacacauaau

SEQ ID NO: 575161 - RNA, 18 nt, Homo sapiens
aauauuuuaagaauuuca

SEQ ID NO: 575162 - RNA, 17 nt, Homo sapiens
aauauuuuacaguuuuu

SEQ ID NO: 575163 - RNA, 15 nt, Homo sapiens
aauauuuuauucuca

SEQ ID NO: 575164 - RNA, 14 nt, Homo sapiens
aauauuuuccauaa

SEQ ID NO: 575165 - RNA, 20 nt, Homo sapiens
aauauuuuguaacuauuaca

SEQ ID NO: 575166 - RNA, 16 nt, Homo sapiens
aauauuuuguaauauu

SEQ ID NO: 575167 - RNA, 19 nt, Homo sapiens
aauauuuuguucugcaaau

SEQ ID NO: 575168 - RNA, 18 nt, Homo sapiens
aauauuuuucaugcuauc

SEQ ID NO: 575169 - RNA, 23 nt, Homo sapiens
aauauuuuuguauuucucuauuu

SEQ ID NO: 575170 - RNA, 14 nt, Homo sapiens
aaucaaaagcuauu

SEQ ID NO: 575171 - RNA, 17 nt, Homo sapiens
aaucaaaccugaccaag

SEQ ID NO: 575172 - RNA, 14 nt, Homo sapiens
aaucaaagcacuug

SEQ ID NO: 575173 - RNA, 21 nt, Homo sapiens
aaucaaaucugugcucuuuca

SEQ ID NO: 575174 - RNA, 21 nt, Homo sapiens
aaucaacaaaauggucaucca

SEQ ID NO: 575175 - RNA, 22 nt, Homo sapiens
aaucaacaaaauggucauccaa

SEQ ID NO: 575176 - RNA, 22 nt, Homo sapiens
aaucaacagaaguaucaagcca

SEQ ID NO: 575177 - RNA, 15 nt, Homo sapiens
aaucaacagaugaua

SEQ ID NO: 575178 - RNA, 18 nt, Homo sapiens
aaucaacuagguauuuaa

SEQ ID NO: 575179 - RNA, 16 nt, Homo sapiens
aaucaacucaucauuu

SEQ ID NO: 575180 - RNA, 12 nt, Homo sapiens
aaucaacucuaa

SEQ ID NO: 575181 - RNA, 13 nt, Homo sapiens
aaucaacuugugg

SEQ ID NO: 575182 - RNA, 12 nt, Homo sapiens
aaucaacuuuac

SEQ ID NO: 575183 - RNA, 23 nt, Homo sapiens
aaucaagcuuuugcuugauccag

SEQ ID NO: 575184 - RNA, 18 nt, Homo sapiens
aaucaaggaaagccaggc

SEQ ID NO: 575185 - RNA, 18 nt, Homo sapiens
aaucaaggccagugcuaa

SEQ ID NO: 575186 - RNA, 20 nt, Homo sapiens
aaucaauccugggcaaucag

SEQ ID NO: 575187 - RNA, 15 nt, Homo sapiens
aaucaaucuacucaa

SEQ ID NO: 575188 - RNA, 16 nt, Homo sapiens
aaucaauguguacaag

SEQ ID NO: 575189 - RNA, 20 nt, Homo sapiens
aaucacacagccaagccagu

SEQ ID NO: 575190 - RNA, 16 nt, Homo sapiens
aaucacaccucugggc

SEQ ID NO: 575191 - RNA, 13 nt, Homo sapiens
aaucacagucuca

SEQ ID NO: 575192 - RNA, 14 nt, Homo sapiens
aaucacaucuccag

SEQ ID NO: 575193 - RNA, 13 nt, Homo sapiens
aaucacaugugcu

SEQ ID NO: 575194 - RNA, 12 nt, Homo sapiens
aaucacauuccu

SEQ ID NO: 575195 - RNA, 15 nt, Homo sapiens
aaucacggugguaaa

SEQ ID NO: 575196 - RNA, 15 nt, Homo sapiens
aaucacuccauugga

SEQ ID NO: 575197 - RNA, 11 nt, Homo sapiens
aaucacuggaa

SEQ ID NO: 575198 - RNA, 18 nt, Homo sapiens
aaucacuuagacuccccu

SEQ ID NO: 575199 - RNA, 18 nt, Homo sapiens
aaucacuucaauccucaa

SEQ ID NO: 575200 - RNA, 19 nt, Homo sapiens
aaucacuugccaaaaucca

SEQ ID NO: 575201 - RNA, 17 nt, Homo sapiens
aaucagaacuguuggca

SEQ ID NO: 575202 - RNA, 14 nt, Homo sapiens
aaucagaauuggaa

SEQ ID NO: 575203 - RNA, 14 nt, Homo sapiens
aaucagaugccuca

SEQ ID NO: 575204 - RNA, 14 nt, Homo sapiens
aaucagcaugacaa

SEQ ID NO: 575205 - RNA, 21 nt, Homo sapiens
aaucagcauuagagaaaugaa

SEQ ID NO: 575206 - RNA, 16 nt, Homo sapiens
aaucagcauuuagucu

SEQ ID NO: 575207 - RNA, 15 nt, Homo sapiens
aaucagccacauucu

SEQ ID NO: 575208 - RNA, 22 nt, Homo sapiens
aaucagccucuucucugaugac

SEQ ID NO: 575209 - RNA, 15 nt, Homo sapiens
aaucagccuggccau

SEQ ID NO: 575210 - RNA, 21 nt, Homo sapiens
aaucaggaaugagucaaucag

SEQ ID NO: 575211 - RNA, 14 nt, Homo sapiens
aaucaggccuugcu

SEQ ID NO: 575212 - RNA, 14 nt, Homo sapiens
aaucaggggccaga

SEQ ID NO: 575213 - RNA, 14 nt, Homo sapiens
aaucagguuuccaa

SEQ ID NO: 575214 - RNA, 20 nt, Homo sapiens
aaucaguaaauaccuugaaa

SEQ ID NO: 575215 - RNA, 18 nt, Homo sapiens
aaucagucggcagucaug

SEQ ID NO: 575216 - RNA, 12 nt, Homo sapiens
aaucagugaaga

SEQ ID NO: 575217 - RNA, 13 nt, Homo sapiens
aaucaguuugcuu

SEQ ID NO: 575218 - RNA, 15 nt, Homo sapiens
aaucauacuuaacau

SEQ ID NO: 575219 - RNA, 16 nt, Homo sapiens
aaucauacuuagcaaa

SEQ ID NO: 575220 - RNA, 17 nt, Homo sapiens
aaucauaugauucugcu

SEQ ID NO: 575221 - RNA, 11 nt, Homo sapiens
aaucaucuaag

SEQ ID NO: 575222 - RNA, 21 nt, Homo sapiens
aaucaucugcauuccugauga

SEQ ID NO: 575223 - RNA, 15 nt, Homo sapiens
aaucaugaaaagggg

SEQ ID NO: 575224 - RNA, 20 nt, Homo sapiens
aaucaugaacagcucugaga

SEQ ID NO: 575225 - RNA, 17 nt, Homo sapiens
aaucaugagcaagugaa

SEQ ID NO: 575226 - RNA, 20 nt, Homo sapiens
aaucaugauccuuguguuca

SEQ ID NO: 575227 - RNA, 21 nt, Homo sapiens
aaucaugccauugcacuccag

SEQ ID NO: 575228 - RNA, 17 nt, Homo sapiens
aaucaugcucauguaua

SEQ ID NO: 575229 - RNA, 13 nt, Homo sapiens
aaucauggcucac

SEQ ID NO: 575230 - RNA, 18 nt, Homo sapiens
aaucauguaaaugcucau

SEQ ID NO: 575231 - RNA, 12 nt, Homo sapiens
aaucaugucagu

SEQ ID NO: 575232 - RNA, 17 nt, Homo sapiens
aaucauguguugcagcu

SEQ ID NO: 575233 - RNA, 21 nt, Homo sapiens
aaucauguugaucauguacuu

SEQ ID NO: 575234 - RNA, 17 nt, Homo sapiens
aaucauucuacugaaca

SEQ ID NO: 575235 - RNA, 22 nt, Homo sapiens
aaucauuucaguaucaucucca

SEQ ID NO: 575236 - RNA, 19 nt, Homo sapiens
aaucauuucuagauuauaa

SEQ ID NO: 575237 - RNA, 17 nt, Homo sapiens
aaucauuuuaauuauua

SEQ ID NO: 575238 - RNA, 20 nt, Homo sapiens
aaucauuuucauuccuaaag

SEQ ID NO: 575239 - RNA, 17 nt, Homo sapiens
aaucauuuugugucuca

SEQ ID NO: 575240 - RNA, 16 nt, Homo sapiens
aauccaaaucuguccu

SEQ ID NO: 575241 - RNA, 20 nt, Homo sapiens
aauccaaauggcgucuggaa

SEQ ID NO: 575242 - RNA, 13 nt, Homo sapiens
aauccaagcuccc

SEQ ID NO: 575243 - RNA, 23 nt, Homo sapiens
aauccacagcuauauccugaugc

SEQ ID NO: 575244 - RNA, 18 nt, Homo sapiens
aauccacaucuuuacuca

SEQ ID NO: 575245 - RNA, 22 nt, Homo sapiens
aaugggauggucggaucucaca

SEQ ID NO: 575246 - RNA, 16 nt, Homo sapiens
aaugggcaauuccaga

SEQ ID NO: 575247 - RNA, 13 nt, Homo sapiens
aaugggcagagcc

SEQ ID NO: 575248 - RNA, 22 nt, Homo sapiens
aaugggccacugaaaucuguca

SEQ ID NO: 575249 - RNA, 13 nt, Homo sapiens
aaugggccuccag

SEQ ID NO: 575250 - RNA, 16 nt, Homo sapiens
aaugggcucaaacuuc

SEQ ID NO: 575251 - RNA, 14 nt, Homo sapiens
aaugggcucuucca

SEQ ID NO: 575252 - RNA, 11 nt, Homo sapiens
aauggggacag

SEQ ID NO: 575253 - RNA, 22 nt, Homo sapiens
aauggggggcgggccagggugg

SEQ ID NO: 575254 - RNA, 23 nt, Homo sapiens
aauggggguguaguauuuuugcc

SEQ ID NO: 575255 - RNA, 23 nt, Homo sapiens
aauggguuugcuagaaugugaua

SEQ ID NO: 575256 - RNA, 17 nt, Homo sapiens
aaugguacucuaaucag

SEQ ID NO: 575257 - RNA, 22 nt, Homo sapiens
aaugguauggaacucucuccac

SEQ ID NO: 575258 - RNA, 20 nt, Homo sapiens
aauggucacaauaaaugcca

SEQ ID NO: 575259 - RNA, 14 nt, Homo sapiens
aauggucaguauua

SEQ ID NO: 575260 - RNA, 17 nt, Homo sapiens
aauggucauccaaacuc

SEQ ID NO: 575261 - RNA, 17 nt, Homo sapiens
aauggucuuacauugga

SEQ ID NO: 575262 - RNA, 14 nt, Homo sapiens
aauggugcaaaaaa

SEQ ID NO: 575263 - RNA, 12 nt, Homo sapiens
aauggugcuguu

SEQ ID NO: 575264 - RNA, 17 nt, Homo sapiens
aaugguguuguaugccu

SEQ ID NO: 575265 - RNA, 21 nt, Homo sapiens
aaugguucagaauuaaacuuu

SEQ ID NO: 575266 - RNA, 12 nt, Homo sapiens
aaugguucucuu

SEQ ID NO: 575267 - RNA, 23 nt, Homo sapiens
aaugguuucacuugcucuuugac

SEQ ID NO: 575268 - RNA, 20 nt, Homo sapiens
aaugguuugugucaaaacug

SEQ ID NO: 575269 - RNA, 17 nt, Homo sapiens
aauguaaaauauaucau

SEQ ID NO: 575270 - RNA, 18 nt, Homo sapiens
aauguaaaauguugaaua

SEQ ID NO: 575271 - RNA, 17 nt, Homo sapiens
aauguaaagugcaauca

SEQ ID NO: 575272 - RNA, 21 nt, Homo sapiens
aauguaaauacucaugaauga

SEQ ID NO: 575273 - RNA, 14 nt, Homo sapiens
aauguaagcauacu

SEQ ID NO: 575274 - RNA, 20 nt, Homo sapiens
aauguaaggagccuuuccag

SEQ ID NO: 575275 - RNA, 23 nt, Homo sapiens
aauguaauacuccuaagacuuau

SEQ ID NO: 575276 - RNA, 17 nt, Homo sapiens
aauguacagacauauuu

SEQ ID NO: 575277 - RNA, 17 nt, Homo sapiens
aauguagcuuccaccuc

SEQ ID NO: 575278 - RNA, 14 nt, Homo sapiens
aauguaggacugua

SEQ ID NO: 575279 - RNA, 20 nt, Homo sapiens
aauguaguuagcuccauaaa

SEQ ID NO: 575280 - RNA, 19 nt, Homo sapiens
aauguauaaaaauuaucaa

SEQ ID NO: 575281 - RNA, 22 nt, Homo sapiens
aauguauaaaaauuaucaaaaa

SEQ ID NO: 575282 - RNA, 13 nt, Homo sapiens
aauguauaaagau

SEQ ID NO: 575283 - RNA, 20 nt, Homo sapiens
aauguauauuuugaugagcu

SEQ ID NO: 575284 - RNA, 21 nt, Homo sapiens
aauguaucuauuuguacaauu

SEQ ID NO: 575285 - RNA, 16 nt, Homo sapiens
aauguauguacaauac

SEQ ID NO: 575286 - RNA, 13 nt, Homo sapiens
aauguaugugcuc

SEQ ID NO: 575287 - RNA, 15 nt, Homo sapiens
aauguaugugcucuu

SEQ ID NO: 575288 - RNA, 21 nt, Homo sapiens
aauguaugugcucuuagcaaa

SEQ ID NO: 575289 - RNA, 18 nt, Homo sapiens
aauguauucaaauaccaa

SEQ ID NO: 575290 - RNA, 15 nt, Homo sapiens
aauguauugauucaa

SEQ ID NO: 575291 - RNA, 20 nt, Homo sapiens
aauguauuguaaucuuucau

SEQ ID NO: 575292 - RNA, 21 nt, Homo sapiens
aauguauuuaaccagucuucu

SEQ ID NO: 575293 - RNA, 19 nt, Homo sapiens
aaugucaagaucacaaaga

SEQ ID NO: 575294 - RNA, 15 nt, Homo sapiens
aaugucaaugccagg

SEQ ID NO: 575295 - RNA, 15 nt, Homo sapiens
aaugucaauuggcag

SEQ ID NO: 575296 - RNA, 18 nt, Homo sapiens
aaugucacaguaaugcaa

SEQ ID NO: 575297 - RNA, 19 nt, Homo sapiens
aaugucacagugcuacaau

SEQ ID NO: 575298 - RNA, 17 nt, Homo sapiens
aaugucacuauaucuuc

SEQ ID NO: 575299 - RNA, 14 nt, Homo sapiens
aaugucagaagcuu

SEQ ID NO: 575300 - RNA, 19 nt, Homo sapiens
aaugucagacuuugcugca

SEQ ID NO: 575301 - RNA, 14 nt, Homo sapiens
aaugucagugacau

SEQ ID NO: 575302 - RNA, 19 nt, Homo sapiens
aaugucaguguuugggaaa

SEQ ID NO: 575303 - RNA, 23 nt, Homo sapiens
aauguccauauuuauuuuuaugu

SEQ ID NO: 575304 - RNA, 23 nt, Homo sapiens
aaugucccagugucaguauuuac

SEQ ID NO: 575305 - RNA, 19 nt, Homo sapiens
aaugucuaucaacuuuaau

SEQ ID NO: 575306 - RNA, 23 nt, Homo sapiens
aaugucucacuguucugcaaagg

SEQ ID NO: 575307 - RNA, 15 nt, Homo sapiens
aaugucucaugucaa

SEQ ID NO: 575308 - RNA, 13 nt, Homo sapiens
aaugucucccaca

SEQ ID NO: 575309 - RNA, 14 nt, Homo sapiens
aaugucuucaagac

SEQ ID NO: 575310 - RNA, 19 nt, Homo sapiens
aaugucuugcuguugacau

SEQ ID NO: 575311 - RNA, 22 nt, Homo sapiens
aaugugaaaaugguccaggaga

SEQ ID NO: 575312 - RNA, 15 nt, Homo sapiens
aaugugaaaccauca

SEQ ID NO: 575313 - RNA, 20 nt, Homo sapiens
aaugugaaacggaagcucau

SEQ ID NO: 575314 - RNA, 16 nt, Homo sapiens
aaugugaaauguaacu

SEQ ID NO: 575315 - RNA, 16 nt, Homo sapiens
aaugugaacacuggca

SEQ ID NO: 575316 - RNA, 16 nt, Homo sapiens
aaugugaaggcccaag

SEQ ID NO: 575317 - RNA, 20 nt, Homo sapiens
aaugugaccuuuaauucagg

SEQ ID NO: 575318 - RNA, 18 nt, Homo sapiens
aaugugaggaacucacau

SEQ ID NO: 575319 - RNA, 22 nt, Homo sapiens
aaugugauaauauauugcuaaa

SEQ ID NO: 575320 - RNA, 16 nt, Homo sapiens
aaugugaucauaugag

SEQ ID NO: 575321 - RNA, 12 nt, Homo sapiens
aaugugauugca

SEQ ID NO: 575322 - RNA, 15 nt, Homo sapiens
aaugugauugcagcu

SEQ ID NO: 575323 - RNA, 21 nt, Homo sapiens
aaugugcaaauuuugcauuua

SEQ ID NO: 575324 - RNA, 11 nt, Homo sapiens
aaugugcaaua

SEQ ID NO: 575325 - RNA, 12 nt, Homo sapiens
aaugugccccau

SEQ ID NO: 575326 - RNA, 20 nt, Homo sapiens
aauguggagcagcagccacu

SEQ ID NO: 575327 - RNA, 21 nt, Homo sapiens
aauguggcugcugaaacucau

SEQ ID NO: 575328 - RNA, 15 nt, Homo sapiens
aaugugggaucucag

SEQ ID NO: 575329 - RNA, 20 nt, Homo sapiens
aauguggguauugaguguga

SEQ ID NO: 575330 - RNA, 21 nt, Homo sapiens
aaugugguacauacacaccag

SEQ ID NO: 575331 - RNA, 23 nt, Homo sapiens
aaugugguuacuuccuacuguag

SEQ ID NO: 575332 - RNA, 20 nt, Homo sapiens
aaugugguuggucaaaucaa

SEQ ID NO: 575333 - RNA, 23 nt, Homo sapiens
aaugugucaggugacccugauga

SEQ ID NO: 575334 - RNA, 19 nt, Homo sapiens
aaugugugggguauagaaa

SEQ ID NO: 575335 - RNA, 20 nt, Homo sapiens
aauguguguagauacuuccu

SEQ ID NO: 575336 - RNA, 20 nt, Homo sapiens
aauguguuauuugucacaaa

SEQ ID NO: 575337 - RNA, 15 nt, Homo sapiens
aauguguucuuaacu

SEQ ID NO: 575338 - RNA, 21 nt, Homo sapiens
aauguuaacacucaugaagca

SEQ ID NO: 575339 - RNA, 23 nt, Homo sapiens
aauguuaagacuugacaguggaa

SEQ ID NO: 575340 - RNA, 14 nt, Homo sapiens
aauguuaauguuau

SEQ ID NO: 575341 - RNA, 21 nt, Homo sapiens
aauguuaauugggcaggugaa

SEQ ID NO: 575342 - RNA, 20 nt, Homo sapiens
aauguuacugaucaugcauu

SEQ ID NO: 575343 - RNA, 22 nt, Homo sapiens
aauguuagaaaaauagcuguga

SEQ ID NO: 575344 - RNA, 20 nt, Homo sapiens
aauguucaguucaaaagccu

SEQ ID NO: 575345 - RNA, 12 nt, Homo sapiens
aauguuccuccc

SEQ ID NO: 575346 - RNA, 20 nt, Homo sapiens
aauguugcauuuaugaugca

SEQ ID NO: 575347 - RNA, 16 nt, Homo sapiens
aauguugcccuaauaa

SEQ ID NO: 575348 - RNA, 14 nt, Homo sapiens
aauguugcuuuaac

SEQ ID NO: 575349 - RNA, 15 nt, Homo sapiens
aauguugcuuucuga

SEQ ID NO: 575350 - RNA, 17 nt, Homo sapiens
aauguuggauaaggaau

SEQ ID NO: 575351 - RNA, 15 nt, Homo sapiens
aauguuguccaggaa

SEQ ID NO: 575352 - RNA, 16 nt, Homo sapiens
aauguuuaaagaucau

SEQ ID NO: 575353 - RNA, 20 nt, Homo sapiens
aauguuuaaagaucaugaca

SEQ ID NO: 575354 - RNA, 15 nt, Homo sapiens
aauguuuacagugga

SEQ ID NO: 575355 - RNA, 19 nt, Homo sapiens
aauguuucuggaauucuuc

SEQ ID NO: 575356 - RNA, 17 nt, Homo sapiens
aauguuuguuucagugc

SEQ ID NO: 575357 - RNA, 19 nt, Homo sapiens
aauguuuuccccaaaccau

SEQ ID NO: 575358 - RNA, 15 nt, Homo sapiens
aauguuuugcuuaaa

SEQ ID NO: 575359 - RNA, 20 nt, Homo sapiens
aauguuuuguaaacauuuau

SEQ ID NO: 575360 - RNA, 20 nt, Homo sapiens
aauuaaaaaaaaaacuucau

SEQ ID NO: 575361 - RNA, 15 nt, Homo sapiens
aauuaaaaaccugau

SEQ ID NO: 575362 - RNA, 22 nt, Homo sapiens
aauuaaaaauaccaacuguaca

SEQ ID NO: 575363 - RNA, 17 nt, Homo sapiens
aauuaaaacacuuucaa

SEQ ID NO: 575364 - RNA, 12 nt, Homo sapiens
aauuaaaaccaa

SEQ ID NO: 575365 - RNA, 23 nt, Homo sapiens
aauuaaaaguuugaaaagcaaua

SEQ ID NO: 575366 - RNA, 14 nt, Homo sapiens
aauuaaaauacuau

SEQ ID NO: 575367 - RNA, 19 nt, Homo sapiens
aauuuucuuugcucugucu

SEQ ID NO: 575368 - RNA, 15 nt, Homo sapiens
aauuuugaguauucc

SEQ ID NO: 575369 - RNA, 17 nt, Homo sapiens
aauuuugaguugccaca

SEQ ID NO: 575370 - RNA, 12 nt, Homo sapiens
aauuuugauuca

SEQ ID NO: 575371 - RNA, 14 nt, Homo sapiens
aauuuugccuuuaa

SEQ ID NO: 575372 - RNA, 12 nt, Homo sapiens
aauuuugcugga

SEQ ID NO: 575373 - RNA, 21 nt, Homo sapiens
aauuuugggggaaaaaaucca

SEQ ID NO: 575374 - RNA, 18 nt, Homo sapiens
aauuuugguuacuugaau

SEQ ID NO: 575375 - RNA, 18 nt, Homo sapiens
aauuuuguaaauaugcaa

SEQ ID NO: 575376 - RNA, 21 nt, Homo sapiens
aauuuuguugcaucauguuga

SEQ ID NO: 575377 - RNA, 19 nt, Homo sapiens
aauuuuguuuguugaugug

SEQ ID NO: 575378 - RNA, 19 nt, Homo sapiens
aauuuuguuuucuguggag

SEQ ID NO: 575379 - RNA, 20 nt, Homo sapiens
aauuuuuaaaacccauuuaa

SEQ ID NO: 575380 - RNA, 15 nt, Homo sapiens
aauuuuuacauucau

SEQ ID NO: 575381 - RNA, 14 nt, Homo sapiens
aauuuuuaccuguu

SEQ ID NO: 575382 - RNA, 21 nt, Homo sapiens
aauuuuuacuuagauacuaau

SEQ ID NO: 575383 - RNA, 14 nt, Homo sapiens
aauuuuuacuuuaa

SEQ ID NO: 575384 - RNA, 20 nt, Homo sapiens
aauuuuuauuuuugcugaga

SEQ ID NO: 575385 - RNA, 22 nt, Homo sapiens
aauuuuuauuuuugcugagacu

SEQ ID NO: 575386 - RNA, 14 nt, Homo sapiens
aauuuuuccaugaa

SEQ ID NO: 575387 - RNA, 23 nt, Homo sapiens
aauuuuugaaaaauauugcuaaa

SEQ ID NO: 575388 - RNA, 19 nt, Homo sapiens
aauuuuugcuaugcuguaa

SEQ ID NO: 575389 - RNA, 23 nt, Homo sapiens
aauuuuuuagagagcuguuccca

SEQ ID NO: 575390 - RNA, 23 nt, Homo sapiens
aauuuuuuaguauaaguacauua

SEQ ID NO: 575391 - RNA, 22 nt, Homo sapiens
aauuuuuuuaaccaaaggugaa

SEQ ID NO: 575392 - RNA, 20 nt, Homo sapiens
aauuuuuuugcauuuucaca

SEQ ID NO: 575393 - RNA, 16 nt, Homo sapiens
acaaaaaaagauuuaa

SEQ ID NO: 575394 - RNA, 18 nt, Homo sapiens
acaaaaaauagcuuucaa

SEQ ID NO: 575395 - RNA, 17 nt, Homo sapiens
acaaaaacaaaaaacca

SEQ ID NO: 575396 - RNA, 20 nt, Homo sapiens
acaaaaacagguauauacuu

SEQ ID NO: 575397 - RNA, 19 nt, Homo sapiens
acaaaaagccuuuuccaga

SEQ ID NO: 575398 - RNA, 19 nt, Homo sapiens
acaaaaaggcaaauauuga

SEQ ID NO: 575399 - RNA, 22 nt, Homo sapiens
acaaaaaugaaagcaugucuca

SEQ ID NO: 575400 - RNA, 16 nt, Homo sapiens
acaaaaaugaacugaa

SEQ ID NO: 575401 - RNA, 14 nt, Homo sapiens
acaaaaauguuucc

SEQ ID NO: 575402 - RNA, 13 nt, Homo sapiens
acaaaacaaacuc

SEQ ID NO: 575403 - RNA, 16 nt, Homo sapiens
acaaaacaaucucuca

SEQ ID NO: 575404 - RNA, 21 nt, Homo sapiens
acaaaacccucagcacuguua

SEQ ID NO: 575405 - RNA, 23 nt, Homo sapiens
acaaaaccuacgcacauaccuuc

SEQ ID NO: 575406 - RNA, 22 nt, Homo sapiens
acaaaaccuuuaaucugcaccu

SEQ ID NO: 575407 - RNA, 16 nt, Homo sapiens
acaaaacugccaaaaa

SEQ ID NO: 575408 - RNA, 20 nt, Homo sapiens
acaaaacugcuuugugcaua

SEQ ID NO: 575409 - RNA, 14 nt, Homo sapiens
acaaaagaaacuua

SEQ ID NO: 575410 - RNA, 13 nt, Homo sapiens
acaaaagcaagaa

SEQ ID NO: 575411 - RNA, 13 nt, Homo sapiens
acaaaaggcaucu

SEQ ID NO: 575412 - RNA, 17 nt, Homo sapiens
acaaaagggccaggugc

SEQ ID NO: 575413 - RNA, 19 nt, Homo sapiens
acaaaaguuaaccaggugu

SEQ ID NO: 575414 - RNA, 18 nt, Homo sapiens
acaaaauauuuaagugaa

SEQ ID NO: 575415 - RNA, 12 nt, Homo sapiens
acaaaaucacac

SEQ ID NO: 575416 - RNA, 17 nt, Homo sapiens
acaaaauccaugaacaa

SEQ ID NO: 575417 - RNA, 15 nt, Homo sapiens
acaaaaugauuuuga

SEQ ID NO: 575418 - RNA, 16 nt, Homo sapiens
acaaaaugccaagggg

SEQ ID NO: 575419 - RNA, 12 nt, Homo sapiens
acaaaaugguca

SEQ ID NO: 575420 - RNA, 16 nt, Homo sapiens
acaaaauggucaucca

SEQ ID NO: 575421 - RNA, 20 nt, Homo sapiens
acaaaauggucauccaaacu

SEQ ID NO: 575422 - RNA, 23 nt, Homo sapiens
acaaaauuagcugaagaaguuau

SEQ ID NO: 575423 - RNA, 14 nt, Homo sapiens
acaaaauuaugcaa

SEQ ID NO: 575424 - RNA, 20 nt, Homo sapiens
acaaaauuugagaauacaua

SEQ ID NO: 575425 - RNA, 23 nt, Homo sapiens
acaaaauuuuauuuugugcucau

SEQ ID NO: 575426 - RNA, 14 nt, Homo sapiens
acaaacaaacagaa

SEQ ID NO: 575427 - RNA, 17 nt, Homo sapiens
acaaacaaggcauucau

SEQ ID NO: 575428 - RNA, 23 nt, Homo sapiens
acaaacaaugcauaggauuccaa

SEQ ID NO: 575429 - RNA, 20 nt, Homo sapiens
acaaacacugaaucauguua

SEQ ID NO: 575430 - RNA, 11 nt, Homo sapiens
acaaacagggc

SEQ ID NO: 575431 - RNA, 22 nt, Homo sapiens
acaaacauaaggcacauugugu

SEQ ID NO: 575432 - RNA, 15 nt, Homo sapiens
acaaacaucauuuua

SEQ ID NO: 575433 - RNA, 12 nt, Homo sapiens
acaaacauggau

SEQ ID NO: 575434 - RNA, 16 nt, Homo sapiens
acaaaccaagccaugc

SEQ ID NO: 575435 - RNA, 14 nt, Homo sapiens
acaaaccacaccac

SEQ ID NO: 575436 - RNA, 16 nt, Homo sapiens
acaaaccacugugaac

SEQ ID NO: 575437 - RNA, 16 nt, Homo sapiens
acaaaccgagugcaau

SEQ ID NO: 575438 - RNA, 17 nt, Homo sapiens
acaaaccucaagccagc

SEQ ID NO: 575439 - RNA, 18 nt, Homo sapiens
acaaaccugcacuuauac

SEQ ID NO: 575440 - RNA, 17 nt, Homo sapiens
acaaaccugcauggugu

SEQ ID NO: 575441 - RNA, 18 nt, Homo sapiens
acaaacgggcucgggucu

SEQ ID NO: 575442 - RNA, 12 nt, Homo sapiens
acaaacuaacag

SEQ ID NO: 575443 - RNA, 22 nt, Homo sapiens
acaaacucacacaaccaugacg

SEQ ID NO: 575444 - RNA, 21 nt, Homo sapiens
acaaacucagauccuugguac

SEQ ID NO: 575445 - RNA, 22 nt, Homo sapiens
acaaacucgcacaaccaugacg

SEQ ID NO: 575446 - RNA, 12 nt, Homo sapiens
acaaacugcaau

SEQ ID NO: 575447 - RNA, 14 nt, Homo sapiens
acaaacugccaguu

SEQ ID NO: 575448 - RNA, 15 nt, Homo sapiens
acaaagaacaagcau

SEQ ID NO: 575449 - RNA, 21 nt, Homo sapiens
acaaagaagguuaccaagaag

SEQ ID NO: 575450 - RNA, 18 nt, Homo sapiens
acaaagaauuccaaagca

SEQ ID NO: 575451 - RNA, 15 nt, Homo sapiens
acaaagacaguauuu

SEQ ID NO: 575452 - RNA, 16 nt, Homo sapiens
acaaagagguguacag

SEQ ID NO: 575453 - RNA, 19 nt, Homo sapiens
acaaagagguguacaggua

SEQ ID NO: 575454 - RNA, 15 nt, Homo sapiens
acaaagcacaguguu

SEQ ID NO: 575455 - RNA, 16 nt, Homo sapiens
acaaagcacaguuuga

SEQ ID NO: 575456 - RNA, 19 nt, Homo sapiens
acaaagcacauaacuggau

SEQ ID NO: 575457 - RNA, 15 nt, Homo sapiens
acaaagcccuuccau

SEQ ID NO: 575458 - RNA, 19 nt, Homo sapiens
acaaagcuguuaaacuguu

SEQ ID NO: 575459 - RNA, 16 nt, Homo sapiens
acaaaggaaguucucc

SEQ ID NO: 575460 - RNA, 13 nt, Homo sapiens
acaaaggagccuu

SEQ ID NO: 575461 - RNA, 23 nt, Homo sapiens
acaaaggagccuugauaauacuu

SEQ ID NO: 575462 - RNA, 18 nt, Homo sapiens
acaaaggccacaggcagu

SEQ ID NO: 575463 - RNA, 17 nt, Homo sapiens
acaaagggacuuuggaa

SEQ ID NO: 575464 - RNA, 15 nt, Homo sapiens
acaaagguugcagug

SEQ ID NO: 575465 - RNA, 14 nt, Homo sapiens
acaaaguacauucu

SEQ ID NO: 575466 - RNA, 15 nt, Homo sapiens
acaaagugacauucc

SEQ ID NO: 575467 - RNA, 19 nt, Homo sapiens
acaaagugacauuccugag

SEQ ID NO: 575468 - RNA, 13 nt, Homo sapiens
acaaaguguauac

SEQ ID NO: 575469 - RNA, 17 nt, Homo sapiens
acaaauaaucacauuga

SEQ ID NO: 575470 - RNA, 23 nt, Homo sapiens
acaaaucaacagaagcauuugua

SEQ ID NO: 575471 - RNA, 23 nt, Homo sapiens
acaaauggggacaggaaggauca

SEQ ID NO: 575472 - RNA, 17 nt, Homo sapiens
acaaaugggucccucag

SEQ ID NO: 575473 - RNA, 22 nt, Homo sapiens
acaaauguuuugcucaauagau

SEQ ID NO: 575474 - RNA, 17 nt, Homo sapiens
acaaauuaauuuuacuc

SEQ ID NO: 575475 - RNA, 18 nt, Homo sapiens
acaaauuauaaaaaccau

SEQ ID NO: 575476 - RNA, 16 nt, Homo sapiens
acaaauuauguuacau

SEQ ID NO: 575477 - RNA, 17 nt, Homo sapiens
acaaauuauguuacauc

SEQ ID NO: 575478 - RNA, 11 nt, Homo sapiens
acaaauuccac

SEQ ID NO: 575479 - RNA, 22 nt, Homo sapiens
acaaauugauagucaauaucaa

SEQ ID NO: 575480 - RNA, 21 nt, Homo sapiens
acaaauuuagugcucuuaacu

SEQ ID NO: 575481 - RNA, 23 nt, Homo sapiens
acaaauuugggagggugagacac

SEQ ID NO: 575482 - RNA, 20 nt, Homo sapiens
acaaauuuuucaaaucauuc

SEQ ID NO: 575483 - RNA, 22 nt, Homo sapiens
acaaauuuuucaaaucauuccu

SEQ ID NO: 575484 - RNA, 16 nt, Homo sapiens
acaacaaaaaccaaaa

SEQ ID NO: 575485 - RNA, 18 nt, Homo sapiens
acaacaaaaaccaaaaaa

SEQ ID NO: 575486 - RNA, 15 nt, Homo sapiens
acaacaaaagcuuuu

SEQ ID NO: 575487 - RNA, 15 nt, Homo sapiens
acaacacaauaacac

SEQ ID NO: 575488 - RNA, 24 nt, Homo sapiens
acaacaccuuccuccugcagacac

SEQ ID NO: 575489 - RNA, 16 nt, Homo sapiens
acaugaccacauagca

SEQ ID NO: 575490 - RNA, 10 nt, Homo sapiens
acaugacugg

SEQ ID NO: 575491 - RNA, 23 nt, Homo sapiens
acaugauggggaaggaguacaaa

SEQ ID NO: 575492 - RNA, 13 nt, Homo sapiens
acaugcacacggg

SEQ ID NO: 575493 - RNA, 21 nt, Homo sapiens
acaugcacucagcucuuggcu

SEQ ID NO: 575494 - RNA, 14 nt, Homo sapiens
acaugcauugcucu

SEQ ID NO: 575495 - RNA, 17 nt, Homo sapiens
acaugcccuccuggaca

SEQ ID NO: 575496 - RNA, 17 nt, Homo sapiens
acaugcccuguguggcu

SEQ ID NO: 575497 - RNA, 23 nt, Homo sapiens
acaugcgcacucucauaugccac

SEQ ID NO: 575498 - RNA, 15 nt, Homo sapiens
acaugcggcugccca

SEQ ID NO: 575499 - RNA, 17 nt, Homo sapiens
acaugcgguagccagca

SEQ ID NO: 575500 - RNA, 16 nt, Homo sapiens
acaugcgugugucagg

SEQ ID NO: 575501 - RNA, 15 nt, Homo sapiens
acaugcucaggcuac

SEQ ID NO: 575502 - RNA, 23 nt, Homo sapiens
acaugcugaaaaauauagccuuu

SEQ ID NO: 575503 - RNA, 19 nt, Homo sapiens
acaugcugaaagucuucau

SEQ ID NO: 575504 - RNA, 14 nt, Homo sapiens
acaugcugcucugg

SEQ ID NO: 575505 - RNA, 16 nt, Homo sapiens
acaugcuggugcauau

SEQ ID NO: 575506 - RNA, 17 nt, Homo sapiens
acaugcugugcucuuug

SEQ ID NO: 575507 - RNA, 12 nt, Homo sapiens
acaugcuguuac

SEQ ID NO: 575508 - RNA, 15 nt, Homo sapiens
acaugcuugaauauc

SEQ ID NO: 575509 - RNA, 21 nt, Homo sapiens
acauggaaaacagaguauuuc

SEQ ID NO: 575510 - RNA, 16 nt, Homo sapiens
acauggaacgcuuuca

SEQ ID NO: 575511 - RNA, 17 nt, Homo sapiens
acauggcaauugcacuc

SEQ ID NO: 575512 - RNA, 16 nt, Homo sapiens
acauggcgcccugccu

SEQ ID NO: 575513 - RNA, 18 nt, Homo sapiens
acauggcuguguuugcag

SEQ ID NO: 575514 - RNA, 10 nt, Homo sapiens
acaugggagc

SEQ ID NO: 575515 - RNA, 20 nt, Homo sapiens
acauggugaaaccucaucuc

SEQ ID NO: 575516 - RNA, 18 nt, Homo sapiens
acauggugugaguccaaa

SEQ ID NO: 575517 - RNA, 22 nt, Homo sapiens
acaugguugauuuugugcuguu

SEQ ID NO: 575518 - RNA, 19 nt, Homo sapiens
acauguaagaaaauguuac

SEQ ID NO: 575519 - RNA, 19 nt, Homo sapiens
acauguaauuaaguacuau

SEQ ID NO: 575520 - RNA, 18 nt, Homo sapiens
acauuucuauagccaaaa

SEQ ID NO: 575521 - RNA, 14 nt, Homo sapiens
acauuucuauuuca

SEQ ID NO: 575522 - RNA, 14 nt, Homo sapiens
acauuucucugagc

SEQ ID NO: 575523 - RNA, 22 nt, Homo sapiens
acauuucuggacaguaccugau

SEQ ID NO: 575524 - RNA, 16 nt, Homo sapiens
acauuucuguucucau

SEQ ID NO: 575525 - RNA, 22 nt, Homo sapiens
acauuucuguucucauuugauc

SEQ ID NO: 575526 - RNA, 12 nt, Homo sapiens
acauuugcugaa

SEQ ID NO: 575527 - RNA, 19 nt, Homo sapiens
acauuugguuucugaauaa

SEQ ID NO: 575528 - RNA, 12 nt, Homo sapiens
acauuugugcuc

SEQ ID NO: 575529 - RNA, 23 nt, Homo sapiens
acauuuguuccuggaguuuugau

SEQ ID NO: 575530 - RNA, 15 nt, Homo sapiens
acauuuuacauuaaa

SEQ ID NO: 575531 - RNA, 22 nt, Homo sapiens
acauuuuauuuuuucuugcaaa

SEQ ID NO: 575532 - RNA, 18 nt, Homo sapiens
acauuuucucuaccuucc

SEQ ID NO: 575533 - RNA, 13 nt, Homo sapiens
acauuuugacaca

SEQ ID NO: 575534 - RNA, 16 nt, Homo sapiens
acauuuugacacaaaa

SEQ ID NO: 575535 - RNA, 19 nt, Homo sapiens
acauuuuuauaaaaaugag

SEQ ID NO: 575536 - RNA, 19 nt, Homo sapiens
acauuuuucacuuuugcua

SEQ ID NO: 575537 - RNA, 21 nt, Homo sapiens
acauuuuugucagagugcaca

SEQ ID NO: 575538 - RNA, 19 nt, Homo sapiens
acauuuuuuucuaccuaua

SEQ ID NO: 575539 - RNA, 14 nt, Homo sapiens
acauuuuuuugcug

SEQ ID NO: 575540 - RNA, 9 nt, Homo sapiens
accaaaaaa

SEQ ID NO: 575541 - RNA, 12 nt, Homo sapiens
accaaaaacuga

SEQ ID NO: 575542 - RNA, 23 nt, Homo sapiens
accaaaaagagacugaucaucca

SEQ ID NO: 575543 - RNA, 23 nt, Homo sapiens
accaaaacuaguucaaaugauga

SEQ ID NO: 575544 - RNA, 19 nt, Homo sapiens
accaaaaugacaaugauga

SEQ ID NO: 575545 - RNA, 17 nt, Homo sapiens
accaaaaugauacuuac

SEQ ID NO: 575546 - RNA, 19 nt, Homo sapiens
accaaacaaggaagccaaa

SEQ ID NO: 575547 - RNA, 13 nt, Homo sapiens
accaaacacucag

SEQ ID NO: 575548 - RNA, 16 nt, Homo sapiens
accaaacacucagucc

SEQ ID NO: 575549 - RNA, 12 nt, Homo sapiens
accaaacccagc

SEQ ID NO: 575550 - RNA, 16 nt, Homo sapiens
accaaacccagccacu

SEQ ID NO: 575551 - RNA, 16 nt, Homo sapiens
accaaacucaggugau

SEQ ID NO: 575552 - RNA, 16 nt, Homo sapiens
accaaagaaauuauaa

SEQ ID NO: 575553 - RNA, 16 nt, Homo sapiens
accaaagacaucaguc

SEQ ID NO: 575554 - RNA, 22 nt, Homo sapiens
agcuggggaccugguacccucc

SEQ ID NO: 575555 - RNA, 20 nt, Homo sapiens
agcuggggagaugggggcuu

SEQ ID NO: 575556 - RNA, 20 nt, Homo sapiens
agcugggucaggcagggugc

SEQ ID NO: 575557 - RNA, 18 nt, Homo sapiens
agcugguccuccacuuug

SEQ ID NO: 575558 - RNA, 13 nt, Homo sapiens
agcuggugucagc

SEQ ID NO: 575559 - RNA, 20 nt, Homo sapiens
agcuguaacccucacccaca

SEQ ID NO: 575560 - RNA, 14 nt, Homo sapiens
agcuguaaccgaua

SEQ ID NO: 575561 - RNA, 21 nt, Homo sapiens
agcuguaaccgauaugcacuu

SEQ ID NO: 575562 - RNA, 19 nt, Homo sapiens
agcuguaaucccagcacuu

SEQ ID NO: 575563 - RNA, 16 nt, Homo sapiens
agcuguacaugaugau

SEQ ID NO: 575564 - RNA, 21 nt, Homo sapiens
agcuguaguagcccuuucugu

SEQ ID NO: 575565 - RNA, 15 nt, Homo sapiens
agcugucgucugacu

SEQ ID NO: 575566 - RNA, 18 nt, Homo sapiens
agcugugaagacuugccu

SEQ ID NO: 575567 - RNA, 19 nt, Homo sapiens
agcugugacuucuccaggu

SEQ ID NO: 575568 - RNA, 17 nt, Homo sapiens
agcugugcaugcucagc

SEQ ID NO: 575569 - RNA, 13 nt, Homo sapiens
agcugugcugggu

SEQ ID NO: 575570 - RNA, 20 nt, Homo sapiens
agcugugcugggugagcucu

SEQ ID NO: 575571 - RNA, 21 nt, Homo sapiens
agcuguggagacucuuguacu

SEQ ID NO: 575572 - RNA, 18 nt, Homo sapiens
agcuguggaggauugcua

SEQ ID NO: 575573 - RNA, 18 nt, Homo sapiens
agcugugugaacguguau

SEQ ID NO: 575574 - RNA, 18 nt, Homo sapiens
agcuguuacuuucuuuca

SEQ ID NO: 575575 - RNA, 13 nt, Homo sapiens
agcuguuagggcu

SEQ ID NO: 575576 - RNA, 21 nt, Homo sapiens
agcuguuggaaggacuagguc

SEQ ID NO: 575577 - RNA, 15 nt, Homo sapiens
agcuguuguacguac

SEQ ID NO: 575578 - RNA, 17 nt, Homo sapiens
agcuguugugugagguu

SEQ ID NO: 575579 - RNA, 18 nt, Homo sapiens
agcuguuuauggccucag

SEQ ID NO: 575580 - RNA, 19 nt, Homo sapiens
agcuguuucaaaugugcau

SEQ ID NO: 575581 - RNA, 14 nt, Homo sapiens
agcuguuuccauag

SEQ ID NO: 575582 - RNA, 15 nt, Homo sapiens
agcuguuucucauga

SEQ ID NO: 575583 - RNA, 16 nt, Homo sapiens
agcuuaaaacaagcaa

SEQ ID NO: 575584 - RNA, 15 nt, Homo sapiens
agcuuaagaaccauu

SEQ ID NO: 575585 - RNA, 18 nt, Homo sapiens
agcuuaagaaccauugau

SEQ ID NO: 575586 - RNA, 15 nt, Homo sapiens
agcuuaauagcugua

SEQ ID NO: 575587 - RNA, 17 nt, Homo sapiens
agcuuaaugauucugau

SEQ ID NO: 575588 - RNA, 21 nt, Homo sapiens
agcuuaauggcucaugaccug

SEQ ID NO: 575589 - RNA, 20 nt, Homo sapiens
agcuuacaagccagcuggag

SEQ ID NO: 575590 - RNA, 12 nt, Homo sapiens
agcuuacaggaa

SEQ ID NO: 575591 - RNA, 20 nt, Homo sapiens
agcuuacccaagcuguggca

SEQ ID NO: 575592 - RNA, 14 nt, Homo sapiens
agcuuagaaugcau

SEQ ID NO: 575593 - RNA, 18 nt, Homo sapiens
agcuuagacuaaggccau

SEQ ID NO: 575594 - RNA, 12 nt, Homo sapiens
agcuuagcuguc

SEQ ID NO: 575595 - RNA, 17 nt, Homo sapiens
agcuuagcugucucaga

SEQ ID NO: 575596 - RNA, 14 nt, Homo sapiens
agcuuauagaauaa

SEQ ID NO: 575597 - RNA, 16 nt, Homo sapiens
agcuuauagucuucca

SEQ ID NO: 575598 - RNA, 16 nt, Homo sapiens
agcuuaucuacuucca

SEQ ID NO: 575599 - RNA, 17 nt, Homo sapiens
agcuuaucucuuuuaua

SEQ ID NO: 575600 - RNA, 14 nt, Homo sapiens
agcuucaccagagc

SEQ ID NO: 575601 - RNA, 15 nt, Homo sapiens
agcuucaugccuuug

SEQ ID NO: 575602 - RNA, 20 nt, Homo sapiens
agcuucauuuuacuaaaaag

SEQ ID NO: 575603 - RNA, 21 nt, Homo sapiens
agcuuccaacccgaggcaaua

SEQ ID NO: 575604 - RNA, 17 nt, Homo sapiens
agcuucccaaguagcug

SEQ ID NO: 575605 - RNA, 16 nt, Homo sapiens
agcuucccuguauuac

SEQ ID NO: 575606 - RNA, 19 nt, Homo sapiens
agcuuccuguuucuuccca

SEQ ID NO: 575607 - RNA, 21 nt, Homo sapiens
agcuucuaaucccagcacuuu

SEQ ID NO: 575608 - RNA, 13 nt, Homo sapiens
agcuucucuacag

SEQ ID NO: 575609 - RNA, 18 nt, Homo sapiens
agcuucucuacagacucc

SEQ ID NO: 575610 - RNA, 19 nt, Homo sapiens
agcuucucuacagacucca

SEQ ID NO: 575611 - RNA, 17 nt, Homo sapiens
agcuucucuccacugaa

SEQ ID NO: 575612 - RNA, 18 nt, Homo sapiens
agcuucucuucuuucuga

SEQ ID NO: 575613 - RNA, 21 nt, Homo sapiens
agcuucuuuugauacugaaaa

SEQ ID NO: 575614 - RNA, 18 nt, Homo sapiens
agcuugacaccuggugcu

SEQ ID NO: 575615 - RNA, 17 nt, Homo sapiens
agcuugaucugugauuu

SEQ ID NO: 575616 - RNA, 23 nt, Homo sapiens
agcuugccaauggcggacucaaa

SEQ ID NO: 575617 - RNA, 18 nt, Homo sapiens
agcuuggggccaccaaag

SEQ ID NO: 575618 - RNA, 23 nt, Homo sapiens
agcuugucaccauuggacagucu

SEQ ID NO: 575619 - RNA, 18 nt, Homo sapiens
agcuuguccaucacucua

SEQ ID NO: 575620 - RNA, 20 nt, Homo sapiens
agcuuguggccccuuuuacu

SEQ ID NO: 575621 - RNA, 20 nt, Homo sapiens
agcuuguguccuguccuuuc

SEQ ID NO: 575622 - RNA, 22 nt, Homo sapiens
agcuuguuucugucaagcauau

SEQ ID NO: 575623 - RNA, 16 nt, Homo sapiens
agcuuuaaacucaggg

SEQ ID NO: 575624 - RNA, 14 nt, Homo sapiens
agcuuuacauauuc

SEQ ID NO: 575625 - RNA, 14 nt, Homo sapiens
agcuuuacuacugu

SEQ ID NO: 575626 - RNA, 21 nt, Homo sapiens
agcuuucaacauguacaggaa

SEQ ID NO: 575627 - RNA, 21 nt, Homo sapiens
agcuuucccugccacauccag

SEQ ID NO: 575628 - RNA, 14 nt, Homo sapiens
agcuuucucucaga

SEQ ID NO: 575629 - RNA, 12 nt, Homo sapiens
agcuuucugcca

SEQ ID NO: 575630 - RNA, 19 nt, Homo sapiens
agcuuucugcuaucaaaga

SEQ ID NO: 575631 - RNA, 19 nt, Homo sapiens
agcuuugcagauaacaaaa

SEQ ID NO: 575632 - RNA, 16 nt, Homo sapiens
agcuuugcugccugag

SEQ ID NO: 575633 - RNA, 16 nt, Homo sapiens
agcuuugcugggagag

SEQ ID NO: 575634 - RNA, 22 nt, Homo sapiens
agcuuugugcuugucauuccag

SEQ ID NO: 575635 - RNA, 19 nt, Homo sapiens
agcuuuuauugucacagau

SEQ ID NO: 575636 - RNA, 18 nt, Homo sapiens
agcuuuuccucaccagga

SEQ ID NO: 575637 - RNA, 15 nt, Homo sapiens
agcuuuugccaguau

SEQ ID NO: 575638 - RNA, 18 nt, Homo sapiens
agcuuuuggagggugaua

SEQ ID NO: 575639 - RNA, 18 nt, Homo sapiens
agcuuuuuacucaaagag

SEQ ID NO: 575640 - RNA, 13 nt, Homo sapiens
agcuuuuuuacac

SEQ ID NO: 575641 - RNA, 19 nt, Homo sapiens
aggaaaaaauccucacuca

SEQ ID NO: 575642 - RNA, 17 nt, Homo sapiens
aggaaaaaauuaauacu

SEQ ID NO: 575643 - RNA, 20 nt, Homo sapiens
aggaaaaaccaauagcuuua

SEQ ID NO: 575644 - RNA, 22 nt, Homo sapiens
aggaaaaaugaggaauccaaaa

SEQ ID NO: 575645 - RNA, 13 nt, Homo sapiens
aggaaaacaauaa

SEQ ID NO: 575646 - RNA, 16 nt, Homo sapiens
aggaaaacacagccuc

SEQ ID NO: 575647 - RNA, 16 nt, Homo sapiens
aggaaaacaugcugcu

SEQ ID NO: 575648 - RNA, 18 nt, Homo sapiens
aggaaaagcaaauugaug

SEQ ID NO: 575649 - RNA, 17 nt, Homo sapiens
aggaaaagcauguuaug

SEQ ID NO: 575650 - RNA, 18 nt, Homo sapiens
aggaaaagggagcuauga

SEQ ID NO: 575651 - RNA, 20 nt, Homo sapiens
aggaaaaguaaggugcaguu

SEQ ID NO: 575652 - RNA, 18 nt, Homo sapiens
aggaaaaucacaucucca

SEQ ID NO: 575653 - RNA, 14 nt, Homo sapiens
aggaaacaacagcu

SEQ ID NO: 575654 - RNA, 15 nt, Homo sapiens
aggaaacuaauuucc

SEQ ID NO: 575655 - RNA, 17 nt, Homo sapiens
aggaaacucacacuccc

SEQ ID NO: 575656 - RNA, 16 nt, Homo sapiens
aggaaacucaccugcu

SEQ ID NO: 575657 - RNA, 20 nt, Homo sapiens
aggaaacuccacaucugccu

SEQ ID NO: 575658 - RNA, 21 nt, Homo sapiens
aggaaacuccacaucugccuu

SEQ ID NO: 575659 - RNA, 19 nt, Homo sapiens
aggaaacuguacuacaucu

SEQ ID NO: 575660 - RNA, 21 nt, Homo sapiens
aaucagugccugguguucuga

SEQ ID NO: 575661 - RNA, 13 nt, Homo sapiens
aaucaguguuacc

SEQ ID NO: 575662 - RNA, 16 nt, Homo sapiens
aaucauaaaacuugau

SEQ ID NO: 575663 - RNA, 19 nt, Homo sapiens
aaucauaaaacuugaugug

SEQ ID NO: 575664 - RNA, 21 nt, Homo sapiens
aaucauaguuuaaacugcauu

SEQ ID NO: 575665 - RNA, 14 nt, Homo sapiens
aaucaucaaaaaga

SEQ ID NO: 575666 - RNA, 22 nt, Homo sapiens
aaucauccauccuugccaauag

SEQ ID NO: 575667 - RNA, 24 nt, Homo sapiens
aaucaucuauaaagaagaacuugc

SEQ ID NO: 575668 - RNA, 12 nt, Homo sapiens
aaucaucucacc

SEQ ID NO: 575669 - RNA, 20 nt, Homo sapiens
aaucaugauacaguuuggau

SEQ ID NO: 575670 - RNA, 18 nt, Homo sapiens
aaucauguguugcagcuu

SEQ ID NO: 575671 - RNA, 18 nt, Homo sapiens
aaucauguugaaacaaac

SEQ ID NO: 575672 - RNA, 21 nt, Homo sapiens
aaucauucuuuccccucagag

SEQ ID NO: 575673 - RNA, 21 nt, Homo sapiens
aaucauugcuuaugacaugau

SEQ ID NO: 575674 - RNA, 20 nt, Homo sapiens
aaucauuguagaaacacagu

SEQ ID NO: 575675 - RNA, 20 nt, Homo sapiens
aaucauuguauguggucaug

SEQ ID NO: 575676 - RNA, 16 nt, Homo sapiens
aaucauuucaguauca

SEQ ID NO: 575677 - RNA, 23 nt, Homo sapiens
aaucauuuuucacuguacauuau

SEQ ID NO: 575678 - RNA, 16 nt, Homo sapiens
aauccaaaagacaaaa

SEQ ID NO: 575679 - RNA, 16 nt, Homo sapiens
aauccaaacuaaucca

SEQ ID NO: 575680 - RNA, 20 nt, Homo sapiens
aauccaaacuauuuccuaaa

SEQ ID NO: 575681 - RNA, 14 nt, Homo sapiens
aauccaacauccag

SEQ ID NO: 575682 - RNA, 19 nt, Homo sapiens
aauccaaggaaacaugcag

SEQ ID NO: 575683 - RNA, 21 nt, Homo sapiens
aauccaagugaacacuagcca

SEQ ID NO: 575684 - RNA, 18 nt, Homo sapiens
aauccacaaugagaugca

SEQ ID NO: 575685 - RNA, 14 nt, Homo sapiens
aauccacaucuuua

SEQ ID NO: 575686 - RNA, 15 nt, Homo sapiens
aauccagaacucaaa

SEQ ID NO: 575687 - RNA, 23 nt, Homo sapiens
aauccaggaauuaaaucaucccu

SEQ ID NO: 575688 - RNA, 22 nt, Homo sapiens
aauccaguccagauauuucaca

SEQ ID NO: 575689 - RNA, 16 nt, Homo sapiens
aauccagugagcacua

SEQ ID NO: 575690 - RNA, 23 nt, Homo sapiens
aauccaucacuagccaugauaac

SEQ ID NO: 575691 - RNA, 19 nt, Homo sapiens
aauccauccaaaguucccu

SEQ ID NO: 575692 - RNA, 12 nt, Homo sapiens
aauccaugaacc

SEQ ID NO: 575693 - RNA, 20 nt, Homo sapiens
aauccauguaaauugcaaau

SEQ ID NO: 575694 - RNA, 22 nt, Homo sapiens
aauccauguaaauugcaaauaa

SEQ ID NO: 575695 - RNA, 16 nt, Homo sapiens
aauccauuaucgagca

SEQ ID NO: 575696 - RNA, 20 nt, Homo sapiens
aauccauugaacuggaagaa

SEQ ID NO: 575697 - RNA, 17 nt, Homo sapiens
aaucccaacacuuugag

SEQ ID NO: 575698 - RNA, 17 nt, Homo sapiens
aaucccaagaaauggaa

SEQ ID NO: 575699 - RNA, 15 nt, Homo sapiens
aaucccagcacuuug

SEQ ID NO: 575700 - RNA, 16 nt, Homo sapiens
aaucccagcuaccuca

SEQ ID NO: 575701 - RNA, 17 nt, Homo sapiens
aaucccagcuacucaag

SEQ ID NO: 575702 - RNA, 15 nt, Homo sapiens
aaucccagcuacuug

SEQ ID NO: 575703 - RNA, 21 nt, Homo sapiens
aaucccagggaaggacuugga

SEQ ID NO: 575704 - RNA, 19 nt, Homo sapiens
aaucccaguacgauuugca

SEQ ID NO: 575705 - RNA, 18 nt, Homo sapiens
aauccccaacaugcacug

SEQ ID NO: 575706 - RNA, 15 nt, Homo sapiens
aauccccagcccuuu

SEQ ID NO: 575707 - RNA, 13 nt, Homo sapiens
aauccccuguugu

SEQ ID NO: 575708 - RNA, 22 nt, Homo sapiens
aaucccggucaugcuuuugcca

SEQ ID NO: 575709 - RNA, 17 nt, Homo sapiens
aaucccucagaucccac

SEQ ID NO: 575710 - RNA, 20 nt, Homo sapiens
aaucccuguuuaauauuuaa

SEQ ID NO: 575711 - RNA, 15 nt, Homo sapiens
aauccuaacauucag

SEQ ID NO: 575712 - RNA, 14 nt, Homo sapiens
aauccuaagacaca

SEQ ID NO: 575713 - RNA, 14 nt, Homo sapiens
aauccuaagcaaaa

SEQ ID NO: 575714 - RNA, 14 nt, Homo sapiens
aauccuagcacuuu

SEQ ID NO: 575715 - RNA, 18 nt, Homo sapiens
aauccuaguaugccaaaa

SEQ ID NO: 575716 - RNA, 21 nt, Homo sapiens
aauccucaaaucagucuuccu

SEQ ID NO: 575717 - RNA, 18 nt, Homo sapiens
aauccucauguuacucag

SEQ ID NO: 575718 - RNA, 20 nt, Homo sapiens
aauccugaauaaaccaguau

SEQ ID NO: 575719 - RNA, 21 nt, Homo sapiens
aauccugcauuguuucaagac

SEQ ID NO: 575720 - RNA, 22 nt, Homo sapiens
aauccuggaaggacacagugau

SEQ ID NO: 575721 - RNA, 16 nt, Homo sapiens
aauccugucaccauca

SEQ ID NO: 575722 - RNA, 15 nt, Homo sapiens
aauccugucauauaa

SEQ ID NO: 575723 - RNA, 12 nt, Homo sapiens
aauccuguucca

SEQ ID NO: 575724 - RNA, 21 nt, Homo sapiens
aauccuguuuuuagugcugac

SEQ ID NO: 575725 - RNA, 19 nt, Homo sapiens
aauccuuaguccuacccug

SEQ ID NO: 575726 - RNA, 21 nt, Homo sapiens
aauccuucccugcucuugcag

SEQ ID NO: 575727 - RNA, 19 nt, Homo sapiens
aauccuucuauucuagccu

SEQ ID NO: 575728 - RNA, 15 nt, Homo sapiens
aauccuuuacauuca

SEQ ID NO: 575729 - RNA, 16 nt, Homo sapiens
aauccuuuacauucaa

SEQ ID NO: 575730 - RNA, 12 nt, Homo sapiens
aauccuuuccac

SEQ ID NO: 575731 - RNA, 20 nt, Homo sapiens
aauccuuuuaaaucuugaua

SEQ ID NO: 575732 - RNA, 16 nt, Homo sapiens
aaucgaauacaaauca

SEQ ID NO: 575733 - RNA, 20 nt, Homo sapiens
aaucuaaauggaaccacucu

SEQ ID NO: 575734 - RNA, 14 nt, Homo sapiens
aaucuaaccacuua

SEQ ID NO: 575735 - RNA, 12 nt, Homo sapiens
aaucuaagugau

SEQ ID NO: 575736 - RNA, 23 nt, Homo sapiens
aaucuacaaaagugaaccaucuc

SEQ ID NO: 575737 - RNA, 20 nt, Homo sapiens
aaucuaccugcccuaaggga

SEQ ID NO: 575738 - RNA, 15 nt, Homo sapiens
aaucuacuaauucca

SEQ ID NO: 575739 - RNA, 17 nt, Homo sapiens
aaucuagacaauauaca

SEQ ID NO: 575740 - RNA, 19 nt, Homo sapiens
aaucuagacauucuuuuaa

SEQ ID NO: 575741 - RNA, 22 nt, Homo sapiens
aaucuagguucaggaagaccac

SEQ ID NO: 575742 - RNA, 18 nt, Homo sapiens
aaucuauauuugucuucc

SEQ ID NO: 575743 - RNA, 15 nt, Homo sapiens
aaucuauccauugaa

SEQ ID NO: 575744 - RNA, 22 nt, Homo sapiens
aaucuaugccuaaaaaguauca

SEQ ID NO: 575745 - RNA, 21 nt, Homo sapiens
aaucucaagauucuacuuggu

SEQ ID NO: 575746 - RNA, 16 nt, Homo sapiens
aaucucacaaaugauc

SEQ ID NO: 575747 - RNA, 21 nt, Homo sapiens
aaucucaguuguuugcuucuu

SEQ ID NO: 575748 - RNA, 16 nt, Homo sapiens
aaucucaucucaguga

SEQ ID NO: 575749 - RNA, 16 nt, Homo sapiens
aaucuccaucucaaaa

SEQ ID NO: 575750 - RNA, 15 nt, Homo sapiens
aaucucccacuccag

SEQ ID NO: 575751 - RNA, 16 nt, Homo sapiens
aaucucucaacaugau

SEQ ID NO: 575752 - RNA, 13 nt, Homo sapiens
aaucucuccugaa

SEQ ID NO: 575753 - RNA, 16 nt, Homo sapiens
aaucucucugcagcug

SEQ ID NO: 575754 - RNA, 17 nt, Homo sapiens
aaucucugauaucuuug

SEQ ID NO: 575755 - RNA, 19 nt, Homo sapiens
aaucucuuaauauugagaa

SEQ ID NO: 575756 - RNA, 19 nt, Homo sapiens
aaucucuuauucuaauaaa

SEQ ID NO: 575757 - RNA, 16 nt, Homo sapiens
aaucucuugcacucaa

SEQ ID NO: 575758 - RNA, 13 nt, Homo sapiens
aaucugagccagu

SEQ ID NO: 575759 - RNA, 16 nt, Homo sapiens
aaucugagcugcaggu

SEQ ID NO: 575760 - RNA, 22 nt, Homo sapiens
aaucugaguagagcagccacaa

SEQ ID NO: 575761 - RNA, 23 nt, Homo sapiens
aaucugaucuuuuuauacacaau

SEQ ID NO: 575762 - RNA, 17 nt, Homo sapiens
aaucugauguuaaccaa

SEQ ID NO: 575763 - RNA, 19 nt, Homo sapiens
aaucugauguuaaccaaug

SEQ ID NO: 575764 - RNA, 16 nt, Homo sapiens
aaucugcaaacaugcc

SEQ ID NO: 575765 - RNA, 22 nt, Homo sapiens
aaucuggaccccaucugugaau

SEQ ID NO: 575766 - RNA, 21 nt, Homo sapiens
aaucuggcaggaaucuaucca

SEQ ID NO: 575767 - RNA, 19 nt, Homo sapiens
aaucuggguaucuuuccag

SEQ ID NO: 575768 - RNA, 13 nt, Homo sapiens
aaucuguacaaug

SEQ ID NO: 575769 - RNA, 15 nt, Homo sapiens
augaagcuucaugca

SEQ ID NO: 575770 - RNA, 18 nt, Homo sapiens
augaaggaugugggccca

SEQ ID NO: 575771 - RNA, 20 nt, Homo sapiens
augaaggcaggggcucagug

SEQ ID NO: 575772 - RNA, 18 nt, Homo sapiens
augaagguggaacaagca

SEQ ID NO: 575773 - RNA, 18 nt, Homo sapiens
augaaguaaggagaggga

SEQ ID NO: 575774 - RNA, 15 nt, Homo sapiens
augaagugauucuaa

SEQ ID NO: 575775 - RNA, 15 nt, Homo sapiens
augaagugugugagg

SEQ ID NO: 575776 - RNA, 16 nt, Homo sapiens
augaauaaaguguaag

SEQ ID NO: 575777 - RNA, 21 nt, Homo sapiens
augaauauauuuaagcaacau

SEQ ID NO: 575778 - RNA, 13 nt, Homo sapiens
augaauaugaucc

SEQ ID NO: 575779 - RNA, 20 nt, Homo sapiens
augaauaugaugacaaucag

SEQ ID NO: 575780 - RNA, 19 nt, Homo sapiens
augaaucaaagacauggaa

SEQ ID NO: 575781 - RNA, 15 nt, Homo sapiens
augaaucaucaaagc

SEQ ID NO: 575782 - RNA, 22 nt, Homo sapiens
augaaucucaagauucaguaga

SEQ ID NO: 575783 - RNA, 18 nt, Homo sapiens
augaaucucccacuccag

SEQ ID NO: 575784 - RNA, 12 nt, Homo sapiens
augaaugaaacu

SEQ ID NO: 575785 - RNA, 21 nt, Homo sapiens
augaaugcagauuacacugau

SEQ ID NO: 575786 - RNA, 12 nt, Homo sapiens
augaaugcagug

SEQ ID NO: 575787 - RNA, 13 nt, Homo sapiens
augaauuauuaca

SEQ ID NO: 575788 - RNA, 13 nt, Homo sapiens
augaauuauuaua

SEQ ID NO: 575789 - RNA, 13 nt, Homo sapiens
augaauuauucaa

SEQ ID NO: 575790 - RNA, 13 nt, Homo sapiens
augaauuugucca

SEQ ID NO: 575791 - RNA, 19 nt, Homo sapiens
augacaaccuccauucuau

SEQ ID NO: 575792 - RNA, 16 nt, Homo sapiens
augacaacuuugccag

SEQ ID NO: 575793 - RNA, 22 nt, Homo sapiens
augacaagaacaaagccacuga

SEQ ID NO: 575794 - RNA, 19 nt, Homo sapiens
augacaauguugcauuuau

SEQ ID NO: 575795 - RNA, 12 nt, Homo sapiens
augacacagucu

SEQ ID NO: 575796 - RNA, 10 nt, Homo sapiens
augacacugu

SEQ ID NO: 575797 - RNA, 23 nt, Homo sapiens
augacagggaugccaacaccuuc

SEQ ID NO: 575798 - RNA, 15 nt, Homo sapiens
augacaguagucaca

SEQ ID NO: 575799 - RNA, 11 nt, Homo sapiens
augacagugaa

SEQ ID NO: 575800 - RNA, 12 nt, Homo sapiens
augacagugaau

SEQ ID NO: 575801 - RNA, 18 nt, Homo sapiens
augacagugacacccaga

SEQ ID NO: 575802 - RNA, 13 nt, Homo sapiens
augacagugcuaa

SEQ ID NO: 575803 - RNA, 16 nt, Homo sapiens
augacauuacaauccu

SEQ ID NO: 575804 - RNA, 22 nt, Homo sapiens
augacauuucacugaugcuucu

SEQ ID NO: 575805 - RNA, 23 nt, Homo sapiens
augacauuuuuuuuaacuacuau

SEQ ID NO: 575806 - RNA, 21 nt, Homo sapiens
augaccagcagcagcuuucag

SEQ ID NO: 575807 - RNA, 13 nt, Homo sapiens
augacccaaagac

SEQ ID NO: 575808 - RNA, 19 nt, Homo sapiens
augacccaccccugugcuc

SEQ ID NO: 575809 - RNA, 23 nt, Homo sapiens
augacccccaucccucauaccau

SEQ ID NO: 575810 - RNA, 23 nt, Homo sapiens
augaccuguuauuaccauuagca

SEQ ID NO: 575811 - RNA, 18 nt, Homo sapiens
augaccuuauaguguuaa

SEQ ID NO: 575812 - RNA, 18 nt, Homo sapiens
augacgacauacaugcua

SEQ ID NO: 575813 - RNA, 16 nt, Homo sapiens
augacgcacugcucaa

SEQ ID NO: 575814 - RNA, 22 nt, Homo sapiens
augacgccugucugugugcauc

SEQ ID NO: 575815 - RNA, 22 nt, Homo sapiens
augacgguaaguguucucauga

SEQ ID NO: 575816 - RNA, 17 nt, Homo sapiens
augacgugccuaccucu

SEQ ID NO: 575817 - RNA, 23 nt, Homo sapiens
augacuaaagagagaauguagau

SEQ ID NO: 575818 - RNA, 20 nt, Homo sapiens
augacucauaggucccugac

SEQ ID NO: 575819 - RNA, 14 nt, Homo sapiens
augacuccauucaa

SEQ ID NO: 575820 - RNA, 15 nt, Homo sapiens
augacuccuuucucu

SEQ ID NO: 575821 - RNA, 16 nt, Homo sapiens
augacugaugacauau

SEQ ID NO: 575822 - RNA, 10 nt, Homo sapiens
augacugggc

SEQ ID NO: 575823 - RNA, 21 nt, Homo sapiens
augacuguccaagugccacau

SEQ ID NO: 575824 - RNA, 21 nt, Homo sapiens
augacuuccucacauggucug

SEQ ID NO: 575825 - RNA, 15 nt, Homo sapiens
augacuucugcugaa

SEQ ID NO: 575826 - RNA, 19 nt, Homo sapiens
acugauuucacaacagauc

SEQ ID NO: 575827 - RNA, 20 nt, Homo sapiens
acugauuucacaacagauca

SEQ ID NO: 575828 - RNA, 18 nt, Homo sapiens
acugcaaauauugucaua

SEQ ID NO: 575829 - RNA, 15 nt, Homo sapiens
acugcaacacuggau

SEQ ID NO: 575830 - RNA, 12 nt, Homo sapiens
acugcaaccucc

SEQ ID NO: 575831 - RNA, 23 nt, Homo sapiens
acugcaaccucugccucccaggu

SEQ ID NO: 575832 - RNA, 16 nt, Homo sapiens
acugcaacuucugccu

SEQ ID NO: 575833 - RNA, 14 nt, Homo sapiens
acugcacacuucca

SEQ ID NO: 575834 - RNA, 21 nt, Homo sapiens
acugcacagaagacagcagca

SEQ ID NO: 575835 - RNA, 16 nt, Homo sapiens
acugcaccaagucuca

SEQ ID NO: 575836 - RNA, 17 nt, Homo sapiens
acugcacccagcuccag

SEQ ID NO: 575837 - RNA, 12 nt, Homo sapiens
acugcacugagu

SEQ ID NO: 575838 - RNA, 22 nt, Homo sapiens
acugcagaauguaaagguuuca

SEQ ID NO: 575839 - RNA, 15 nt, Homo sapiens
acugcagaccaacua

SEQ ID NO: 575840 - RNA, 13 nt, Homo sapiens
acugcagaccuca

SEQ ID NO: 575841 - RNA, 19 nt, Homo sapiens
acugcagcaggccacuggg

SEQ ID NO: 575842 - RNA, 17 nt, Homo sapiens
acugcagcaguggcuua

SEQ ID NO: 575843 - RNA, 13 nt, Homo sapiens
acugcagcugcug

SEQ ID NO: 575844 - RNA, 13 nt, Homo sapiens
acugcagcuguga

SEQ ID NO: 575845 - RNA, 15 nt, Homo sapiens
acugcagcuuuacau

SEQ ID NO: 575846 - RNA, 23 nt, Homo sapiens
acugcagggaaaauuauuugcau

SEQ ID NO: 575847 - RNA, 16 nt, Homo sapiens
acugcaggggcugcag

SEQ ID NO: 575848 - RNA, 23 nt, Homo sapiens
acugcagggguccacugugagag

SEQ ID NO: 575849 - RNA, 22 nt, Homo sapiens
acugcagucagcaugaauccag

SEQ ID NO: 575850 - RNA, 16 nt, Homo sapiens
acugcauccucugccu

SEQ ID NO: 575851 - RNA, 20 nt, Homo sapiens
acugcauuguuuucuagccc

SEQ ID NO: 575852 - RNA, 12 nt, Homo sapiens
acugcauuuuac

SEQ ID NO: 575853 - RNA, 19 nt, Homo sapiens
acugcauuuuuaaauacaa

SEQ ID NO: 575854 - RNA, 17 nt, Homo sapiens
acugccaaaaugcucua

SEQ ID NO: 575855 - RNA, 21 nt, Homo sapiens
acugccaggcuugcagucucc

SEQ ID NO: 575856 - RNA, 19 nt, Homo sapiens
acugccaucuuuaucauga

SEQ ID NO: 575857 - RNA, 23 nt, Homo sapiens
acugcccgagcuggugcauuaca

SEQ ID NO: 575858 - RNA, 19 nt, Homo sapiens
acugcccgaggcgccagcu

SEQ ID NO: 575859 - RNA, 16 nt, Homo sapiens
acugccgacaucagca

SEQ ID NO: 575860 - RNA, 18 nt, Homo sapiens
acugccuccugccugggg

SEQ ID NO: 575861 - RNA, 22 nt, Homo sapiens
acugccucuggaauugcucaag

SEQ ID NO: 575862 - RNA, 23 nt, Homo sapiens
acugccuggagggcagggagugg

SEQ ID NO: 575863 - RNA, 19 nt, Homo sapiens
acugccuguagagacaaua

SEQ ID NO: 575864 - RNA, 13 nt, Homo sapiens
acugccuuugcag

SEQ ID NO: 575865 - RNA, 19 nt, Homo sapiens
acugcgaggacaucaaagu

SEQ ID NO: 575866 - RNA, 14 nt, Homo sapiens
acugcggaguccag

SEQ ID NO: 575867 - RNA, 19 nt, Homo sapiens
acugcggucagauguggcu

SEQ ID NO: 575868 - RNA, 17 nt, Homo sapiens
acugcguccugccuaaa

SEQ ID NO: 575869 - RNA, 20 nt, Homo sapiens
acugcuaggcgagugccagg

SEQ ID NO: 575870 - RNA, 19 nt, Homo sapiens
acugcuaugccauuucuuc

SEQ ID NO: 575871 - RNA, 22 nt, Homo sapiens
acugcuccaagggacagguggg

SEQ ID NO: 575872 - RNA, 19 nt, Homo sapiens
acugcucccaucauuccuu

SEQ ID NO: 575873 - RNA, 22 nt, Homo sapiens
acugcucugagaauuguugaga

SEQ ID NO: 575874 - RNA, 19 nt, Homo sapiens
acugcugcaaauacuguau

SEQ ID NO: 575875 - RNA, 15 nt, Homo sapiens
acugcugucuuccaa

SEQ ID NO: 575876 - RNA, 19 nt, Homo sapiens
acugcuguggcccccuguc

SEQ ID NO: 575877 - RNA, 17 nt, Homo sapiens
acugcuucucuuugugc

SEQ ID NO: 575878 - RNA, 18 nt, Homo sapiens
acugcuuuucaguucugu

SEQ ID NO: 575879 - RNA, 22 nt, Homo sapiens
acuggaaaaaaauacaaaaagc

SEQ ID NO: 575880 - RNA, 17 nt, Homo sapiens
acuggaaaacagaacac

SEQ ID NO: 575881 - RNA, 13 nt, Homo sapiens
acuggaaaccuaa

SEQ ID NO: 575882 - RNA, 17 nt, Homo sapiens
acuggaaagacauagcc

SEQ ID NO: 575883 - RNA, 14 nt, Homo sapiens
acuggaaccaggga

SEQ ID NO: 575884 - RNA, 13 nt, Homo sapiens
acuggaagcacag

SEQ ID NO: 575885 - RNA, 16 nt, Homo sapiens
acuggaauagauuccg

SEQ ID NO: 575886 - RNA, 13 nt, Homo sapiens
acuggaaucagcu

SEQ ID NO: 575887 - RNA, 16 nt, Homo sapiens
acuggacaacacugau

SEQ ID NO: 575888 - RNA, 23 nt, Homo sapiens
acuggacaggcaaagacugcagu

SEQ ID NO: 575889 - RNA, 17 nt, Homo sapiens
acuggacccccuggaag

SEQ ID NO: 575890 - RNA, 21 nt, Homo sapiens
acuggagcaucugacucacaa

SEQ ID NO: 575891 - RNA, 19 nt, Homo sapiens
acuggaggaacacagagaa

SEQ ID NO: 575892 - RNA, 16 nt, Homo sapiens
acuggauauguuguua

SEQ ID NO: 575893 - RNA, 15 nt, Homo sapiens
augcuaucucugugu

SEQ ID NO: 575894 - RNA, 13 nt, Homo sapiens
augcuaugcugaa

SEQ ID NO: 575895 - RNA, 20 nt, Homo sapiens
augcuauguucugucuuccc

SEQ ID NO: 575896 - RNA, 21 nt, Homo sapiens
augcucaaggaagggacaaga

SEQ ID NO: 575897 - RNA, 21 nt, Homo sapiens
augcucaaugaaaaggugauu

SEQ ID NO: 575898 - RNA, 14 nt, Homo sapiens
augcucaccaagga

SEQ ID NO: 575899 - RNA, 14 nt, Homo sapiens
augcucagaccagc

SEQ ID NO: 575900 - RNA, 14 nt, Homo sapiens
augcucagggucaa

SEQ ID NO: 575901 - RNA, 18 nt, Homo sapiens
augcucagggucacugaa

SEQ ID NO: 575902 - RNA, 18 nt, Homo sapiens
augcucaguuggugcugc

SEQ ID NO: 575903 - RNA, 21 nt, Homo sapiens
augcucauaaagauguuaaau

SEQ ID NO: 575904 - RNA, 15 nt, Homo sapiens
augcucugugacaag

SEQ ID NO: 575905 - RNA, 15 nt, Homo sapiens
augcucugugccaga

SEQ ID NO: 575906 - RNA, 22 nt, Homo sapiens
augcugaauguacacugauucc

SEQ ID NO: 575907 - RNA, 23 nt, Homo sapiens
augcugacacuuuuucagggcug

SEQ ID NO: 575908 - RNA, 14 nt, Homo sapiens
augcugacagcucu

SEQ ID NO: 575909 - RNA, 15 nt, Homo sapiens
augcugagcugugau

SEQ ID NO: 575910 - RNA, 20 nt, Homo sapiens
augcugcaacaaaauguaga

SEQ ID NO: 575911 - RNA, 13 nt, Homo sapiens
augcugcagugag

SEQ ID NO: 575912 - RNA, 13 nt, Homo sapiens
augcugccagccu

SEQ ID NO: 575913 - RNA, 19 nt, Homo sapiens
augcugcccagccacucca

SEQ ID NO: 575914 - RNA, 15 nt, Homo sapiens
augcugccuggcaca

SEQ ID NO: 575915 - RNA, 15 nt, Homo sapiens
augcugcuauggaag

SEQ ID NO: 575916 - RNA, 15 nt, Homo sapiens
augcugcuguuuaca

SEQ ID NO: 575917 - RNA, 20 nt, Homo sapiens
augcugcuuccauuugacaa

SEQ ID NO: 575918 - RNA, 22 nt, Homo sapiens
augcugggucuccacguggugu

SEQ ID NO: 575919 - RNA, 19 nt, Homo sapiens
augcugguuuucuacccaa

SEQ ID NO: 575920 - RNA, 19 nt, Homo sapiens
augcuguacuugugguucu

SEQ ID NO: 575921 - RNA, 20 nt, Homo sapiens
augcuguauccacaaaucau

SEQ ID NO: 575922 - RNA, 21 nt, Homo sapiens
augcugucccugcacugugcc

SEQ ID NO: 575923 - RNA, 17 nt, Homo sapiens
augcugugauaccuuag

SEQ ID NO: 575924 - RNA, 13 nt, Homo sapiens
augcugugcucaa

SEQ ID NO: 575925 - RNA, 15 nt, Homo sapiens
augcuguuaaccaaa

SEQ ID NO: 575926 - RNA, 17 nt, Homo sapiens
augcuguuaaccaaagg

SEQ ID NO: 575927 - RNA, 19 nt, Homo sapiens
augcuuagucccucaugca

SEQ ID NO: 575928 - RNA, 16 nt, Homo sapiens
augcuugaaaccagaa

SEQ ID NO: 575929 - RNA, 23 nt, Homo sapiens
augcuuguauuuuacuuuuccau

SEQ ID NO: 575930 - RNA, 11 nt, Homo sapiens
augcuuuacaa

SEQ ID NO: 575931 - RNA, 14 nt, Homo sapiens
augcuuucccugag

SEQ ID NO: 575932 - RNA, 18 nt, Homo sapiens
augcuuucucaugucuca

SEQ ID NO: 575933 - RNA, 18 nt, Homo sapiens
augcuuuucauaggcuua

SEQ ID NO: 575934 - RNA, 18 nt, Homo sapiens
augcuuuugcuugcaaug

SEQ ID NO: 575935 - RNA, 13 nt, Homo sapiens
auggaaaaaccau

SEQ ID NO: 575936 - RNA, 18 nt, Homo sapiens
auggaaaaauugacaaaa

SEQ ID NO: 575937 - RNA, 22 nt, Homo sapiens
auggaaaaucagcugcucagca

SEQ ID NO: 575938 - RNA, 21 nt, Homo sapiens
auggaaacagaugaaaagccu

SEQ ID NO: 575939 - RNA, 17 nt, Homo sapiens
auggaaaguuguaucca

SEQ ID NO: 575940 - RNA, 13 nt, Homo sapiens
auggaacagaaua

SEQ ID NO: 575941 - RNA, 15 nt, Homo sapiens
auggaaccacuaaaa

SEQ ID NO: 575942 - RNA, 13 nt, Homo sapiens
auggaagaguuaa

SEQ ID NO: 575943 - RNA, 13 nt, Homo sapiens
auggaagcaaaga

SEQ ID NO: 575944 - RNA, 15 nt, Homo sapiens
auggaagcaaagaca

SEQ ID NO: 575945 - RNA, 16 nt, Homo sapiens
auggaagcaaagacaa

SEQ ID NO: 575946 - RNA, 20 nt, Homo sapiens
auggaagcaaccagcaaauu

SEQ ID NO: 575947 - RNA, 15 nt, Homo sapiens
auggaaggccuuuug

SEQ ID NO: 575948 - RNA, 21 nt, Homo sapiens
auggucacgagguccagaccc

SEQ ID NO: 575949 - RNA, 20 nt, Homo sapiens
augguccaggaucuccacug

SEQ ID NO: 575950 - RNA, 20 nt, Homo sapiens
auggucccaggaagcaggga

SEQ ID NO: 575951 - RNA, 20 nt, Homo sapiens
auggucccaggcuucccaaa

SEQ ID NO: 575952 - RNA, 21 nt, Homo sapiens
augguccuggggcucugugca

SEQ ID NO: 575953 - RNA, 21 nt, Homo sapiens
auggugaaaccucaucucuac

SEQ ID NO: 575954 - RNA, 16 nt, Homo sapiens
auggugaaugaaguca

SEQ ID NO: 575955 - RNA, 16 nt, Homo sapiens
auggugagaugcagcu

SEQ ID NO: 575956 - RNA, 13 nt, Homo sapiens
auggugagcucug

SEQ ID NO: 575957 - RNA, 12 nt, Homo sapiens
auggugcugaau

SEQ ID NO: 575958 - RNA, 13 nt, Homo sapiens
auggugcuuaaaa

SEQ ID NO: 575959 - RNA, 19 nt, Homo sapiens
augguggagggcacuucag

SEQ ID NO: 575960 - RNA, 20 nt, Homo sapiens
augguggcacaggcacugaa

SEQ ID NO: 575961 - RNA, 13 nt, Homo sapiens
augguggccucaa

SEQ ID NO: 575962 - RNA, 18 nt, Homo sapiens
auggugggcaggaucuca

SEQ ID NO: 575963 - RNA, 23 nt, Homo sapiens
augguguagaacacuaauucaua

SEQ ID NO: 575964 - RNA, 22 nt, Homo sapiens
augguguagcccucccacuuug

SEQ ID NO: 575965 - RNA, 20 nt, Homo sapiens
augguguuaaagcuguacac

SEQ ID NO: 575966 - RNA, 21 nt, Homo sapiens
augguuaaaaucacuauugaa

SEQ ID NO: 575967 - RNA, 20 nt, Homo sapiens
augguuacuucuucucuuag

SEQ ID NO: 575968 - RNA, 15 nt, Homo sapiens
augguuagacagcac

SEQ ID NO: 575969 - RNA, 15 nt, Homo sapiens
augguuccauucucu

SEQ ID NO: 575970 - RNA, 19 nt, Homo sapiens
augguuccauucucucucc

SEQ ID NO: 575971 - RNA, 17 nt, Homo sapiens
augguugauggaaaaua

SEQ ID NO: 575972 - RNA, 19 nt, Homo sapiens
augguugauggguucuaau

SEQ ID NO: 575973 - RNA, 21 nt, Homo sapiens
augguuggaaaacacuuucau

SEQ ID NO: 575974 - RNA, 14 nt, Homo sapiens
augguuugugucaa

SEQ ID NO: 575975 - RNA, 21 nt, Homo sapiens
augguuuucuccaagagcuac

SEQ ID NO: 575976 - RNA, 14 nt, Homo sapiens
auguaaaaagaucu

SEQ ID NO: 575977 - RNA, 15 nt, Homo sapiens
auguaaaacaagaaa

SEQ ID NO: 575978 - RNA, 21 nt, Homo sapiens
auguaaaagaacuuacugauu

SEQ ID NO: 575979 - RNA, 16 nt, Homo sapiens
auguaaaauguugaau

SEQ ID NO: 575980 - RNA, 22 nt, Homo sapiens
auguaaaauuuggaguaaauau

SEQ ID NO: 575981 - RNA, 22 nt, Homo sapiens
auguaaagaacgcgacuuccac

SEQ ID NO: 575982 - RNA, 14 nt, Homo sapiens
auguaaagugcaau

SEQ ID NO: 575983 - RNA, 13 nt, Homo sapiens
auguaaaugguau

SEQ ID NO: 575984 - RNA, 15 nt, Homo sapiens
auguaaauuuacuga

SEQ ID NO: 575985 - RNA, 23 nt, Homo sapiens
auguaacauguaggaaguaggaa

SEQ ID NO: 575986 - RNA, 12 nt, Homo sapiens
auguaaccaagc

SEQ ID NO: 575987 - RNA, 21 nt, Homo sapiens
auguaacgaaugguacuacaa

SEQ ID NO: 575988 - RNA, 12 nt, Homo sapiens
auguaacuauaa

SEQ ID NO: 575989 - RNA, 16 nt, Homo sapiens
auguaagaauucagaa

SEQ ID NO: 575990 - RNA, 19 nt, Homo sapiens
auguaagaguucagacuca

SEQ ID NO: 575991 - RNA, 18 nt, Homo sapiens
auguaagaucguucucug

SEQ ID NO: 575992 - RNA, 20 nt, Homo sapiens
auguaaugaucauaagucua

SEQ ID NO: 575993 - RNA, 14 nt, Homo sapiens
auguaauuuaugca

SEQ ID NO: 575994 - RNA, 12 nt, Homo sapiens
auguacaaauag

SEQ ID NO: 575995 - RNA, 17 nt, Homo sapiens
auguacaauaaagcaau

SEQ ID NO: 575996 - RNA, 22 nt, Homo sapiens
auguaccaccaacuacuaccug

SEQ ID NO: 575997 - RNA, 23 nt, Homo sapiens
auguaccggcuuccauccuguca

SEQ ID NO: 575998 - RNA, 17 nt, Homo sapiens
auguaccugaugcuaug

SEQ ID NO: 575999 - RNA, 15 nt, Homo sapiens
auguaccugauguac

SEQ ID NO: 576000 - RNA, 17 nt, Homo sapiens
auguacuguacauaaau

SEQ ID NO: 576001 - RNA, 12 nt, Homo sapiens
auguacuugaag

SEQ ID NO: 576002 - RNA, 18 nt, Homo sapiens
auguagacuuuugcuuua

SEQ ID NO: 576003 - RNA, 22 nt, Homo sapiens
auguagcaauggcacuguugca

SEQ ID NO: 576004 - RNA, 13 nt, Homo sapiens
auguagcacuuac

SEQ ID NO: 576005 - RNA, 17 nt, Homo sapiens
auguagcagauccccag

SEQ ID NO: 576006 - RNA, 18 nt, Homo sapiens
auguagcucaguaauucc

SEQ ID NO: 576007 - RNA, 23 nt, Homo sapiens
auguagcuuccaccucauggauu

SEQ ID NO: 576008 - RNA, 15 nt, Homo sapiens
auguaggacuguaua

SEQ ID NO: 576009 - RNA, 14 nt, Homo sapiens
auguagguguuugu

SEQ ID NO: 576010 - RNA, 21 nt, Homo sapiens
auguaguauuaaaaguugcau

SEQ ID NO: 576011 - RNA, 21 nt, Homo sapiens
auguaguuuuuauauguugua

SEQ ID NO: 576012 - RNA, 22 nt, Homo sapiens
auguauaauuugaggugaaauu

SEQ ID NO: 576013 - RNA, 17 nt, Homo sapiens
auguauacacacauaua

SEQ ID NO: 576014 - RNA, 16 nt, Homo sapiens
auguauagacuuggcu

SEQ ID NO: 576015 - RNA, 18 nt, Homo sapiens
auguauauauacacggua

SEQ ID NO: 576016 - RNA, 22 nt, Homo sapiens
auguauauauauauaguaacua

SEQ ID NO: 576017 - RNA, 14 nt, Homo sapiens
auguauaucauucu

SEQ ID NO: 576018 - RNA, 20 nt, Homo sapiens
auguaucaauauucacuuga

SEQ ID NO: 576019 - RNA, 17 nt, Homo sapiens
auguaucuacaauacau

SEQ ID NO: 576020 - RNA, 17 nt, Homo sapiens
auguaucuauuuguaca

SEQ ID NO: 576021 - RNA, 23 nt, Homo sapiens
auguaucugaguugccaagacaa

SEQ ID NO: 576022 - RNA, 13 nt, Homo sapiens
auguaucugugaa

SEQ ID NO: 576023 - RNA, 13 nt, Homo sapiens
auguaugcagcua

SEQ ID NO: 576024 - RNA, 16 nt, Homo sapiens
auguauguacaauaca

SEQ ID NO: 576025 - RNA, 22 nt, Homo sapiens
auguaugucugcaggugucuga

SEQ ID NO: 576026 - RNA, 14 nt, Homo sapiens
auguaugugcacug

SEQ ID NO: 576027 - RNA, 18 nt, Homo sapiens
auguauguuuacauauca

SEQ ID NO: 576028 - RNA, 17 nt, Homo sapiens
auguauuaucacaucaa

SEQ ID NO: 576029 - RNA, 16 nt, Homo sapiens
auguauuaugagccaa

SEQ ID NO: 576030 - RNA, 18 nt, Homo sapiens
auguauuguaaacaugug

SEQ ID NO: 576031 - RNA, 19 nt, Homo sapiens
auguauuuaaccagucuuc

SEQ ID NO: 576032 - RNA, 22 nt, Homo sapiens
auguauuugaaaauuacauguu

SEQ ID NO: 576033 - RNA, 19 nt, Homo sapiens
auguauuuuccuaauguga

SEQ ID NO: 576034 - RNA, 16 nt, Homo sapiens
augucaauagcaaaug

SEQ ID NO: 576035 - RNA, 22 nt, Homo sapiens
augucaaugccaggauuucuca

SEQ ID NO: 576036 - RNA, 19 nt, Homo sapiens
augucacacaagcuccuua

SEQ ID NO: 576037 - RNA, 14 nt, Homo sapiens
augucacagauucc

SEQ ID NO: 576038 - RNA, 15 nt, Homo sapiens
augucacauucuauu

SEQ ID NO: 576039 - RNA, 20 nt, Homo sapiens
augucaccuacauguuauuc

SEQ ID NO: 576040 - RNA, 12 nt, Homo sapiens
augucaccucag

SEQ ID NO: 576041 - RNA, 13 nt, Homo sapiens
augucaccucagc

SEQ ID NO: 576042 - RNA, 17 nt, Homo sapiens
augucacgaacuugaaa

SEQ ID NO: 576043 - RNA, 14 nt, Homo sapiens
augucacuaaacaa

SEQ ID NO: 576044 - RNA, 17 nt, Homo sapiens
augucacuaaacaagaa

SEQ ID NO: 576045 - RNA, 13 nt, Homo sapiens
augucacugccaa

SEQ ID NO: 576046 - RNA, 14 nt, Homo sapiens
augucagacuggcu

SEQ ID NO: 576047 - RNA, 15 nt, Homo sapiens
augucagacuuugcu

SEQ ID NO: 576048 - RNA, 19 nt, Homo sapiens
augucagagcuauguuccc

SEQ ID NO: 576049 - RNA, 17 nt, Homo sapiens
augucaggaaacauuca

SEQ ID NO: 576050 - RNA, 21 nt, Homo sapiens
augucaggcaaagugcugcug

SEQ ID NO: 576051 - RNA, 14 nt, Homo sapiens
augucagucacuaa

SEQ ID NO: 576052 - RNA, 15 nt, Homo sapiens
augucauagccaaag

SEQ ID NO: 576053 - RNA, 14 nt, Homo sapiens
augucaucaugcuu

SEQ ID NO: 576054 - RNA, 18 nt, Homo sapiens
augucaugccucacuuuc

SEQ ID NO: 576055 - RNA, 21 nt, Homo sapiens
augucauuacauagaacacuu

SEQ ID NO: 576056 - RNA, 11 nt, Homo sapiens
auguccaaaga

SEQ ID NO: 576057 - RNA, 15 nt, Homo sapiens
augucccaacuugua

SEQ ID NO: 576058 - RNA, 19 nt, Homo sapiens
augucccagaucgucucca

SEQ ID NO: 576059 - RNA, 18 nt, Homo sapiens
augucccuccaacacaga

SEQ ID NO: 576060 - RNA, 21 nt, Homo sapiens
augucccuccaacacagaucc

SEQ ID NO: 576061 - RNA, 23 nt, Homo sapiens
auguccggcugaaggcugagugu

SEQ ID NO: 576062 - RNA, 16 nt, Homo sapiens
auguccucagcauuuc

SEQ ID NO: 576063 - RNA, 18 nt, Homo sapiens
auguccucuugaagcaua

SEQ ID NO: 576064 - RNA, 18 nt, Homo sapiens
auguccugacuuugcccc

SEQ ID NO: 576065 - RNA, 15 nt, Homo sapiens
auguccugccuuuua

SEQ ID NO: 576066 - RNA, 17 nt, Homo sapiens
augucgaugacuucauc

SEQ ID NO: 576067 - RNA, 15 nt, Homo sapiens
augucgaugcacagu

SEQ ID NO: 576068 - RNA, 15 nt, Homo sapiens
augucggucuugcaa

SEQ ID NO: 576069 - RNA, 19 nt, Homo sapiens
augucuaccaacugaugaa

SEQ ID NO: 576070 - RNA, 22 nt, Homo sapiens
auugcaucuggguagcuguaag

SEQ ID NO: 576071 - RNA, 12 nt, Homo sapiens
auugccagcaaa

SEQ ID NO: 576072 - RNA, 12 nt, Homo sapiens
auugcccaugau

SEQ ID NO: 576073 - RNA, 15 nt, Homo sapiens
auugccccuuugcag

SEQ ID NO: 576074 - RNA, 14 nt, Homo sapiens
auugccucuacuuu

SEQ ID NO: 576075 - RNA, 15 nt, Homo sapiens
auugccugcagagag

SEQ ID NO: 576076 - RNA, 18 nt, Homo sapiens
auugccuugagguacuuu

SEQ ID NO: 576077 - RNA, 15 nt, Homo sapiens
auugcgcccauuuag

SEQ ID NO: 576078 - RNA, 13 nt, Homo sapiens
auugcgcucucaa

SEQ ID NO: 576079 - RNA, 21 nt, Homo sapiens
auugcuaagacuaacucaaga

SEQ ID NO: 576080 - RNA, 13 nt, Homo sapiens
auugcuacaaauc

SEQ ID NO: 576081 - RNA, 14 nt, Homo sapiens
auugcuacugaugc

SEQ ID NO: 576082 - RNA, 14 nt, Homo sapiens
auugcuaugaauga

SEQ ID NO: 576083 - RNA, 17 nt, Homo sapiens
auugcucagagaaggaa

SEQ ID NO: 576084 - RNA, 14 nt, Homo sapiens
auugcucccuacca

SEQ ID NO: 576085 - RNA, 21 nt, Homo sapiens
auugcucuugagucuuugcag

SEQ ID NO: 576086 - RNA, 21 nt, Homo sapiens
auugcugauuuugucugccca

SEQ ID NO: 576087 - RNA, 21 nt, Homo sapiens
auugcuguccuggaggggcug

SEQ ID NO: 576088 - RNA, 11 nt, Homo sapiens
auugcuucaau

SEQ ID NO: 576089 - RNA, 22 nt, Homo sapiens
auugcuugaguuauauguucac

SEQ ID NO: 576090 - RNA, 16 nt, Homo sapiens
auuggaaaguacuccc

SEQ ID NO: 576091 - RNA, 21 nt, Homo sapiens
auuggaaguguucaagaaaua

SEQ ID NO: 576092 - RNA, 21 nt, Homo sapiens
auuggaauggaacuacuguac

SEQ ID NO: 576093 - RNA, 18 nt, Homo sapiens
auuggaauucuacuggaa

SEQ ID NO: 576094 - RNA, 16 nt, Homo sapiens
auuggacagauuucag

SEQ ID NO: 576095 - RNA, 18 nt, Homo sapiens
auuggacgguuucuagcc

SEQ ID NO: 576096 - RNA, 15 nt, Homo sapiens
auuggacugucuuua

SEQ ID NO: 576097 - RNA, 18 nt, Homo sapiens
auuggagcugaagaccua

SEQ ID NO: 576098 - RNA, 18 nt, Homo sapiens
auuggauguuguguauug

SEQ ID NO: 576099 - RNA, 23 nt, Homo sapiens
auuggauugcgccuuuguauuau

SEQ ID NO: 576100 - RNA, 22 nt, Homo sapiens
auuggauuuccuaauacuguca

SEQ ID NO: 576101 - RNA, 23 nt, Homo sapiens
auuggcaccccuuucuaguucaa

SEQ ID NO: 576102 - RNA, 16 nt, Homo sapiens
auuggcccaacacugu

SEQ ID NO: 576103 - RNA, 18 nt, Homo sapiens
auuggcuauaacaugucu

SEQ ID NO: 576104 - RNA, 18 nt, Homo sapiens
auuggcucuagucacugg

SEQ ID NO: 576105 - RNA, 15 nt, Homo sapiens
auuggcucugugaaa

SEQ ID NO: 576106 - RNA, 13 nt, Homo sapiens
auuggcuuuucau

SEQ ID NO: 576107 - RNA, 21 nt, Homo sapiens
auuggcuuuucauagugcuca

SEQ ID NO: 576108 - RNA, 20 nt, Homo sapiens
auugggacaacagugcuuug

SEQ ID NO: 576109 - RNA, 20 nt, Homo sapiens
auugggacuccaugcuccuu

SEQ ID NO: 576110 - RNA, 16 nt, Homo sapiens
auugggccuuuuggau

SEQ ID NO: 576111 - RNA, 18 nt, Homo sapiens
auuggggaagacuguggc

SEQ ID NO: 576112 - RNA, 23 nt, Homo sapiens
auugggugccagcauacauuuuc

SEQ ID NO: 576113 - RNA, 12 nt, Homo sapiens
auugguaaaaac

SEQ ID NO: 576114 - RNA, 19 nt, Homo sapiens
auuggugaacaguguauag

SEQ ID NO: 576115 - RNA, 18 nt, Homo sapiens
auuguaaaaccccaucuc

SEQ ID NO: 576116 - RNA, 14 nt, Homo sapiens
auuguaaauacugg

SEQ ID NO: 576117 - RNA, 13 nt, Homo sapiens
auuguaacuaaua

SEQ ID NO: 576118 - RNA, 20 nt, Homo sapiens
auuguacaaauguaagcaaa

SEQ ID NO: 576119 - RNA, 20 nt, Homo sapiens
auuguacaagagucccuuug

SEQ ID NO: 576120 - RNA, 18 nt, Homo sapiens
auuguacaaguauuacaa

SEQ ID NO: 576121 - RNA, 14 nt, Homo sapiens
auuguacauaaaag

SEQ ID NO: 576122 - RNA, 16 nt, Homo sapiens
auuguacugguacaaa

SEQ ID NO: 576123 - RNA, 14 nt, Homo sapiens
auuguagccucaau

SEQ ID NO: 576124 - RNA, 15 nt, Homo sapiens
auuguagcucaauac

SEQ ID NO: 576125 - RNA, 18 nt, Homo sapiens
auuguauauucuggaaaa

SEQ ID NO: 576126 - RNA, 19 nt, Homo sapiens
auuguauauuguaauuuaa

SEQ ID NO: 576127 - RNA, 13 nt, Homo sapiens
auuguaucucaua

SEQ ID NO: 576128 - RNA, 20 nt, Homo sapiens
auugucacagaugaagacau

SEQ ID NO: 576129 - RNA, 19 nt, Homo sapiens
auugucagaguucugcucu

SEQ ID NO: 576130 - RNA, 20 nt, Homo sapiens
auugucagaguucugcucua

SEQ ID NO: 576131 - RNA, 23 nt, Homo sapiens
auugucauggggaucaauuuuca

SEQ ID NO: 576132 - RNA, 21 nt, Homo sapiens
auuguccccuaaaccaaaaac

SEQ ID NO: 576133 - RNA, 20 nt, Homo sapiens
auugucccugaaugcuccau

SEQ ID NO: 576134 - RNA, 17 nt, Homo sapiens
auugucgguuaccucug

SEQ ID NO: 576135 - RNA, 20 nt, Homo sapiens
auugucgguuaccucugcau

SEQ ID NO: 576136 - RNA, 21 nt, Homo sapiens
auugucuaaaguuacuacuga

SEQ ID NO: 576137 - RNA, 22 nt, Homo sapiens
auugucucccuuccagcaauaa

SEQ ID NO: 576138 - RNA, 22 nt, Homo sapiens
auugucuccuuccacaaugacu

SEQ ID NO: 576139 - RNA, 18 nt, Homo sapiens
auugucucugugacugaa

SEQ ID NO: 576140 - RNA, 16 nt, Homo sapiens
auugucuguaaugaca

SEQ ID NO: 576141 - RNA, 17 nt, Homo sapiens
auugucuuguuauguac

SEQ ID NO: 576142 - RNA, 17 nt, Homo sapiens
auugugaaccaugguga

SEQ ID NO: 576143 - RNA, 17 nt, Homo sapiens
auugugaauaaguuuuc

SEQ ID NO: 576144 - RNA, 16 nt, Homo sapiens
auugugacuucacugu

SEQ ID NO: 576145 - RNA, 17 nt, Homo sapiens
auugugacuucacugua

SEQ ID NO: 576146 - RNA, 21 nt, Homo sapiens
auugugagcgaauuagcaaua

SEQ ID NO: 576147 - RNA, 18 nt, Homo sapiens
auugugaucagaccauaa

SEQ ID NO: 576148 - RNA, 20 nt, Homo sapiens
auugugauuagacagaacac

SEQ ID NO: 576149 - RNA, 20 nt, Homo sapiens
acuuuuuuugaggacauuga

SEQ ID NO: 576150 - RNA, 18 nt, Homo sapiens
acuuuuuuuuuaaagcca

SEQ ID NO: 576151 - RNA, 19 nt, Homo sapiens
agaaaaaaaccacacaaag

SEQ ID NO: 576152 - RNA, 15 nt, Homo sapiens
agaaaaaaagggauc

SEQ ID NO: 576153 - RNA, 20 nt, Homo sapiens
agaaaaaauaacacacauau

SEQ ID NO: 576154 - RNA, 16 nt, Homo sapiens
agaaaaaauucccuca

SEQ ID NO: 576155 - RNA, 18 nt, Homo sapiens
agaaaaagaaaugaacau

SEQ ID NO: 576156 - RNA, 16 nt, Homo sapiens
agaaaaagaagugccu

SEQ ID NO: 576157 - RNA, 12 nt, Homo sapiens
agaaaaagccac

SEQ ID NO: 576158 - RNA, 18 nt, Homo sapiens
agaaaaaggcaguggccu

SEQ ID NO: 576159 - RNA, 16 nt, Homo sapiens
agaaaaaggcugugcu

SEQ ID NO: 576160 - RNA, 13 nt, Homo sapiens
agaaaaauacuuu

SEQ ID NO: 576161 - RNA, 17 nt, Homo sapiens
agaaaaauaucuuggcc

SEQ ID NO: 576162 - RNA, 20 nt, Homo sapiens
agaaaaaugcuguuuauuca

SEQ ID NO: 576163 - RNA, 12 nt, Homo sapiens
agaaaacaagua

SEQ ID NO: 576164 - RNA, 13 nt, Homo sapiens
agaaaacaaucaa

SEQ ID NO: 576165 - RNA, 22 nt, Homo sapiens
agaaaaccucuccugaccccug

SEQ ID NO: 576166 - RNA, 11 nt, Homo sapiens
agaaaacuggg

SEQ ID NO: 576167 - RNA, 16 nt, Homo sapiens
agaaaagaaauuaguu

SEQ ID NO: 576168 - RNA, 19 nt, Homo sapiens
agaaaagaaauuggacaga

SEQ ID NO: 576169 - RNA, 19 nt, Homo sapiens
agaaaagcaauacuguuuc

SEQ ID NO: 576170 - RNA, 19 nt, Homo sapiens
agaaaagcaugcauaucau

SEQ ID NO: 576171 - RNA, 19 nt, Homo sapiens
agaaaagccuuuuaaucuc

SEQ ID NO: 576172 - RNA, 24 nt, Homo sapiens
agaaaagcugaugaggcuggugac

SEQ ID NO: 576173 - RNA, 16 nt, Homo sapiens
agaaaagcugccauuu

SEQ ID NO: 576174 - RNA, 19 nt, Homo sapiens
agaaaagcugccauuuccc

SEQ ID NO: 576175 - RNA, 17 nt, Homo sapiens
agaaaagggaguuuaaa

SEQ ID NO: 576176 - RNA, 16 nt, Homo sapiens
agaaaaguauucucaa

SEQ ID NO: 576177 - RNA, 15 nt, Homo sapiens
agaaaaguugcagau

SEQ ID NO: 576178 - RNA, 17 nt, Homo sapiens
agaaaauaaauuuaacu

SEQ ID NO: 576179 - RNA, 22 nt, Homo sapiens
agaaaauaauggagaaucacuu

SEQ ID NO: 576180 - RNA, 17 nt, Homo sapiens
agaaaauagagcuuuua

SEQ ID NO: 576181 - RNA, 14 nt, Homo sapiens
agaaaauauucuuu

SEQ ID NO: 576182 - RNA, 20 nt, Homo sapiens
agaaaaucuuuaggcuuuca

SEQ ID NO: 576183 - RNA, 19 nt, Homo sapiens
agaaaaugaaaugcauauu

SEQ ID NO: 576184 - RNA, 16 nt, Homo sapiens
agaaaaugagacaaaa

SEQ ID NO: 576185 - RNA, 22 nt, Homo sapiens
agaaaaugauguguacccaaac

SEQ ID NO: 576186 - RNA, 22 nt, Homo sapiens
agaaaauguucuguuugcugug

SEQ ID NO: 576187 - RNA, 22 nt, Homo sapiens
agaaaauguugagaaucccaaa

SEQ ID NO: 576188 - RNA, 21 nt, Homo sapiens
agaaaauuagugaccauuauu

SEQ ID NO: 576189 - RNA, 21 nt, Homo sapiens
agaaaauuccuagaaauugaa

SEQ ID NO: 576190 - RNA, 17 nt, Homo sapiens
agaaaauugcugugccu

SEQ ID NO: 576191 - RNA, 13 nt, Homo sapiens
auuuaaguauaua

SEQ ID NO: 576192 - RNA, 13 nt, Homo sapiens
auuuaagugcaau

SEQ ID NO: 576193 - RNA, 14 nt, Homo sapiens
auuuaagugcaauu

SEQ ID NO: 576194 - RNA, 15 nt, Homo sapiens
auuuaauaaagauga

SEQ ID NO: 576195 - RNA, 19 nt, Homo sapiens
auuuaauaagaaacaugau

SEQ ID NO: 576196 - RNA, 19 nt, Homo sapiens
auuuaauaucuggcacugu

SEQ ID NO: 576197 - RNA, 20 nt, Homo sapiens
auuuaaucaccacucaaaaa

SEQ ID NO: 576198 - RNA, 17 nt, Homo sapiens
auuuaaugcuuccaggg

SEQ ID NO: 576199 - RNA, 19 nt, Homo sapiens
auuuaauggcaaugcaaaa

SEQ ID NO: 576200 - RNA, 16 nt, Homo sapiens
auuuaauugcuuugaa

SEQ ID NO: 576201 - RNA, 15 nt, Homo sapiens
auuuaauuuccaggg

SEQ ID NO: 576202 - RNA, 15 nt, Homo sapiens
auuuacaaacugaag

SEQ ID NO: 576203 - RNA, 23 nt, Homo sapiens
auuuacaagaagaacucaccagg

SEQ ID NO: 576204 - RNA, 16 nt, Homo sapiens
auuuacacuacauugu

SEQ ID NO: 576205 - RNA, 23 nt, Homo sapiens
auuuacagaaaagacucugacca

SEQ ID NO: 576206 - RNA, 20 nt, Homo sapiens
auuuacagaaacgcauccag

SEQ ID NO: 576207 - RNA, 22 nt, Homo sapiens
auuuacagacugaugccagaca

SEQ ID NO: 576208 - RNA, 21 nt, Homo sapiens
auuuacagcucuguaaccucc

SEQ ID NO: 576209 - RNA, 17 nt, Homo sapiens
auuuacaggaacuucau

SEQ ID NO: 576210 - RNA, 15 nt, Homo sapiens
auuuacagucucuuu

SEQ ID NO: 576211 - RNA, 17 nt, Homo sapiens
auuuacauaaagacugu

SEQ ID NO: 576212 - RNA, 19 nt, Homo sapiens
auuuacauaaagacugugc

SEQ ID NO: 576213 - RNA, 14 nt, Homo sapiens
auuuacaucacuuu

SEQ ID NO: 576214 - RNA, 20 nt, Homo sapiens
auuuacauuuuuaauuuagu

SEQ ID NO: 576215 - RNA, 17 nt, Homo sapiens
auuuacucaaagacaua

SEQ ID NO: 576216 - RNA, 23 nt, Homo sapiens
auuuacuggacaaagaauuccaa

SEQ ID NO: 576217 - RNA, 19 nt, Homo sapiens
auuuagaaaaaaacaugaa

SEQ ID NO: 576218 - RNA, 20 nt, Homo sapiens
auuuagaaaaaaguuuacaa

SEQ ID NO: 576219 - RNA, 21 nt, Homo sapiens
auuuagaaacugauuucuuca

SEQ ID NO: 576220 - RNA, 23 nt, Homo sapiens
auuuagaagccaacuaugauuau

SEQ ID NO: 576221 - RNA, 23 nt, Homo sapiens
auuuagaccccauacaaguuuau

SEQ ID NO: 576222 - RNA, 12 nt, Homo sapiens
auuuagacucau

SEQ ID NO: 576223 - RNA, 14 nt, Homo sapiens
auuuagauaugcaa

SEQ ID NO: 576224 - RNA, 20 nt, Homo sapiens
auuuagauaugcaaaagcug

SEQ ID NO: 576225 - RNA, 12 nt, Homo sapiens
auuuagauuuaa

SEQ ID NO: 576226 - RNA, 15 nt, Homo sapiens
auuuagcaaacuguu

SEQ ID NO: 576227 - RNA, 16 nt, Homo sapiens
auuuagccauuaccca

SEQ ID NO: 576228 - RNA, 20 nt, Homo sapiens
auuuagcccuaaaaugacaa

SEQ ID NO: 576229 - RNA, 19 nt, Homo sapiens
auuuagcccucacauuaga

SEQ ID NO: 576230 - RNA, 21 nt, Homo sapiens
auuuagcuaaacggauuccaa

SEQ ID NO: 576231 - RNA, 13 nt, Homo sapiens
auuuagcuuuaca

SEQ ID NO: 576232 - RNA, 18 nt, Homo sapiens
auuuagguuuuuauuagu

SEQ ID NO: 576233 - RNA, 12 nt, Homo sapiens
auuuaguaauag

SEQ ID NO: 576234 - RNA, 22 nt, Homo sapiens
auuuaguuugauuauucagugu

SEQ ID NO: 576235 - RNA, 17 nt, Homo sapiens
auuuauaaauaacaaaa

SEQ ID NO: 576236 - RNA, 18 nt, Homo sapiens
auuuauagcuaugaaacc

SEQ ID NO: 576237 - RNA, 22 nt, Homo sapiens
auuuauaguguugcuuuccuug

SEQ ID NO: 576238 - RNA, 16 nt, Homo sapiens
auuuauauauauaugu

SEQ ID NO: 576239 - RNA, 16 nt, Homo sapiens
auuuauaucaguuuca

SEQ ID NO: 576240 - RNA, 12 nt, Homo sapiens
auuuauauucau

SEQ ID NO: 576241 - RNA, 23 nt, Homo sapiens
auuuaucagaaauuauacuauau

SEQ ID NO: 576242 - RNA, 21 nt, Homo sapiens
auuuauccuauaagaugacaa

SEQ ID NO: 576243 - RNA, 23 nt, Homo sapiens
auuuaucugugcaaauccuugau

SEQ ID NO: 576244 - RNA, 12 nt, Homo sapiens
auuuaucugugu

SEQ ID NO: 576245 - RNA, 23 nt, Homo sapiens
auuuaugaguuuuugauagcuuu

SEQ ID NO: 576246 - RNA, 16 nt, Homo sapiens
auuuaugaugcacuua

SEQ ID NO: 576247 - RNA, 20 nt, Homo sapiens
auuuaugccucuguauuuaa

SEQ ID NO: 576248 - RNA, 21 nt, Homo sapiens
auuuaugcgaaccuaugucua

SEQ ID NO: 576249 - RNA, 21 nt, Homo sapiens
auuuauguaacuugaaccuau

SEQ ID NO: 576250 - RNA, 15 nt, Homo sapiens
auuuaugucccugac

SEQ ID NO: 576251 - RNA, 13 nt, Homo sapiens
auuuauguuuauu

SEQ ID NO: 576252 - RNA, 13 nt, Homo sapiens
auuuauuaaucua

SEQ ID NO: 576253 - RNA, 12 nt, Homo sapiens
auuuauuacaag

SEQ ID NO: 576254 - RNA, 15 nt, Homo sapiens
auuuauucugaagaa

SEQ ID NO: 576255 - RNA, 13 nt, Homo sapiens
auuuauugccugg

SEQ ID NO: 576256 - RNA, 20 nt, Homo sapiens
auuuauugccuggaguguga

SEQ ID NO: 576257 - RNA, 21 nt, Homo sapiens
auuuauugugcuucgagugac

SEQ ID NO: 576258 - RNA, 13 nt, Homo sapiens
auuuauuuaugua

SEQ ID NO: 576259 - RNA, 18 nt, Homo sapiens
auuuauuuuuauguucuu

SEQ ID NO: 576260 - RNA, 20 nt, Homo sapiens
auuuauuuuuuuacuuccuc

SEQ ID NO: 576261 - RNA, 22 nt, Homo sapiens
auuucaaaagauuguguuccca

SEQ ID NO: 576262 - RNA, 18 nt, Homo sapiens
auuucaaaccauugcucu

SEQ ID NO: 576263 - RNA, 20 nt, Homo sapiens
auuucaaaugugcugucaaa

SEQ ID NO: 576264 - RNA, 14 nt, Homo sapiens
auuucaagcuauaa

SEQ ID NO: 576265 - RNA, 15 nt, Homo sapiens
auuucacacagugaa

SEQ ID NO: 576266 - RNA, 24 nt, Homo sapiens
auuucacauccuguaagugcuuaa

SEQ ID NO: 576267 - RNA, 21 nt, Homo sapiens
auuucaccccacagacacuua

SEQ ID NO: 576268 - RNA, 17 nt, Homo sapiens
auuucaccugugacaaa

SEQ ID NO: 576269 - RNA, 14 nt, Homo sapiens
auuucacgcuuuua

SEQ ID NO: 576270 - RNA, 16 nt, Homo sapiens
auuucacuauguuaca

SEQ ID NO: 576271 - RNA, 18 nt, Homo sapiens
auuucacucucaaacuuc

SEQ ID NO: 576272 - RNA, 14 nt, Homo sapiens
agaacacuaacuca

SEQ ID NO: 576273 - RNA, 16 nt, Homo sapiens
agaacacuacugcuaa

SEQ ID NO: 576274 - RNA, 17 nt, Homo sapiens
agaacacuacugcuaaa

SEQ ID NO: 576275 - RNA, 15 nt, Homo sapiens
agaacagaucaggaa

SEQ ID NO: 576276 - RNA, 15 nt, Homo sapiens
agaacagcagacuca

SEQ ID NO: 576277 - RNA, 17 nt, Homo sapiens
agaacaggacuccacac

SEQ ID NO: 576278 - RNA, 21 nt, Homo sapiens
agaacaguggcucguauccca

SEQ ID NO: 576279 - RNA, 20 nt, Homo sapiens
agaacauacaaggacauuca

SEQ ID NO: 576280 - RNA, 16 nt, Homo sapiens
agaacauacacuguga

SEQ ID NO: 576281 - RNA, 19 nt, Homo sapiens
agaacaugguuaccauguc

SEQ ID NO: 576282 - RNA, 21 nt, Homo sapiens
agaacaugguuaccaugucuu

SEQ ID NO: 576283 - RNA, 12 nt, Homo sapiens
agaacauguuaa

SEQ ID NO: 576284 - RNA, 19 nt, Homo sapiens
agaacauuauucaucucuc

SEQ ID NO: 576285 - RNA, 12 nt, Homo sapiens
agaaccaaaggg

SEQ ID NO: 576286 - RNA, 18 nt, Homo sapiens
agaaccagagcucagaga

SEQ ID NO: 576287 - RNA, 15 nt, Homo sapiens
agaaccauuuacuua

SEQ ID NO: 576288 - RNA, 13 nt, Homo sapiens
agaacccacagug

SEQ ID NO: 576289 - RNA, 18 nt, Homo sapiens
agaacccaccaaccagaa

SEQ ID NO: 576290 - RNA, 13 nt, Homo sapiens
agaaccucuccau

SEQ ID NO: 576291 - RNA, 13 nt, Homo sapiens
agaaccucuuccc

SEQ ID NO: 576292 - RNA, 20 nt, Homo sapiens
agaaccuggaaaaauuccag

SEQ ID NO: 576293 - RNA, 20 nt, Homo sapiens
agaaccuuaaugacaacacu

SEQ ID NO: 576294 - RNA, 22 nt, Homo sapiens
agaaccuugucccagccaguga

SEQ ID NO: 576295 - RNA, 15 nt, Homo sapiens
agaacguggugaccu

SEQ ID NO: 576296 - RNA, 19 nt, Homo sapiens
agaacguuuuuuccucagu

SEQ ID NO: 576297 - RNA, 23 nt, Homo sapiens
agaacguuuuuuccucagugcau

SEQ ID NO: 576298 - RNA, 13 nt, Homo sapiens
agaacuaaagcug

SEQ ID NO: 576299 - RNA, 15 nt, Homo sapiens
agaacuaagcacuuu

SEQ ID NO: 576300 - RNA, 11 nt, Homo sapiens
agaacuacuuc

SEQ ID NO: 576301 - RNA, 20 nt, Homo sapiens
agaacuagccaaaccaggac

SEQ ID NO: 576302 - RNA, 16 nt, Homo sapiens
agaacuauguacuuua

SEQ ID NO: 576303 - RNA, 15 nt, Homo sapiens
agaacucacucuggg

SEQ ID NO: 576304 - RNA, 21 nt, Homo sapiens
agaacucgaugcacugaccug

SEQ ID NO: 576305 - RNA, 18 nt, Homo sapiens
agaacucugggcugcuac

SEQ ID NO: 576306 - RNA, 20 nt, Homo sapiens
agaacugaaggcauaugcac

SEQ ID NO: 576307 - RNA, 18 nt, Homo sapiens
agaacugaauaaacagga

SEQ ID NO: 576308 - RNA, 14 nt, Homo sapiens
agaacugcacuuuu

SEQ ID NO: 576309 - RNA, 16 nt, Homo sapiens
agaacugcagaccuca

SEQ ID NO: 576310 - RNA, 13 nt, Homo sapiens
agaacugccaaag

SEQ ID NO: 576311 - RNA, 23 nt, Homo sapiens
agaacugccauuauuuucuguca

SEQ ID NO: 576312 - RNA, 22 nt, Homo sapiens
agaacuggaggaguuccuugau

SEQ ID NO: 576313 - RNA, 14 nt, Homo sapiens
agaauggcauuugc

SEQ ID NO: 576314 - RNA, 18 nt, Homo sapiens
agaaugggccacuguagg

SEQ ID NO: 576315 - RNA, 13 nt, Homo sapiens
agaaugguuacaa

SEQ ID NO: 576316 - RNA, 23 nt, Homo sapiens
agaauguagacagguauaaugau

SEQ ID NO: 576317 - RNA, 17 nt, Homo sapiens
agaauguaucuccuccu

SEQ ID NO: 576318 - RNA, 15 nt, Homo sapiens
agaauguaucuguga

SEQ ID NO: 576319 - RNA, 20 nt, Homo sapiens
agaaugucucggucacauca

SEQ ID NO: 576320 - RNA, 19 nt, Homo sapiens
agaaugugaaaaaggaaua

SEQ ID NO: 576321 - RNA, 11 nt, Homo sapiens
agaaugugauu

SEQ ID NO: 576322 - RNA, 15 nt, Homo sapiens
agaaugugcacucuc

SEQ ID NO: 576323 - RNA, 16 nt, Homo sapiens
agaauguuaugugcaa

SEQ ID NO: 576324 - RNA, 20 nt, Homo sapiens
agaauguucuccuaaaagac

SEQ ID NO: 576325 - RNA, 23 nt, Homo sapiens
agaauguuggcaaaucacuucaa

SEQ ID NO: 576326 - RNA, 22 nt, Homo sapiens
agaauguuucuggaauucuuca

SEQ ID NO: 576327 - RNA, 18 nt, Homo sapiens
agaauuaaaaaagcauac

SEQ ID NO: 576328 - RNA, 19 nt, Homo sapiens
agaauuaaaacuaugaaau

SEQ ID NO: 576329 - RNA, 15 nt, Homo sapiens
agaauuaacagagau

SEQ ID NO: 576330 - RNA, 23 nt, Homo sapiens
agaauuaccauuuguuaauauca

SEQ ID NO: 576331 - RNA, 22 nt, Homo sapiens
agaauuauaucacuucacuguu

SEQ ID NO: 576332 - RNA, 23 nt, Homo sapiens
agaauuauauuagucuguuugca

SEQ ID NO: 576333 - RNA, 16 nt, Homo sapiens
agaauuaucaucccaa

SEQ ID NO: 576334 - RNA, 17 nt, Homo sapiens
agaauucagacaucuga

SEQ ID NO: 576335 - RNA, 23 nt, Homo sapiens
agaauucucgaacugcauguauu

SEQ ID NO: 576336 - RNA, 15 nt, Homo sapiens
agaauucuuacaugu

SEQ ID NO: 576337 - RNA, 19 nt, Homo sapiens
agaauugcuggaacccagg

SEQ ID NO: 576338 - RNA, 19 nt, Homo sapiens
agaauugcuugaacccagg

SEQ ID NO: 576339 - RNA, 15 nt, Homo sapiens
agaauuggaaucaca

SEQ ID NO: 576340 - RNA, 16 nt, Homo sapiens
agaauugguugccaua

SEQ ID NO: 576341 - RNA, 14 nt, Homo sapiens
agaauuguaucauu

SEQ ID NO: 576342 - RNA, 14 nt, Homo sapiens
agaauuguauguca

SEQ ID NO: 576343 - RNA, 16 nt, Homo sapiens
agaauuguaugucaug

SEQ ID NO: 576344 - RNA, 15 nt, Homo sapiens
agaauugucuugcaa

SEQ ID NO: 576345 - RNA, 16 nt, Homo sapiens
agaauuguuuugcauu

SEQ ID NO: 576346 - RNA, 22 nt, Homo sapiens
agaauuuaaaacgcaugugcag

SEQ ID NO: 576347 - RNA, 14 nt, Homo sapiens
agaauuuagcugua

SEQ ID NO: 576348 - RNA, 10 nt, Homo sapiens
agaauuugca

SEQ ID NO: 576349 - RNA, 16 nt, Homo sapiens
agaauuuucugcauua

SEQ ID NO: 576350 - RNA, 15 nt, Homo sapiens
agacaaaaccaaaac

SEQ ID NO: 576351 - RNA, 16 nt, Homo sapiens
agacaaaagaaacuua

SEQ ID NO: 576352 - RNA, 19 nt, Homo sapiens
agacaaacuuugcaucuca

SEQ ID NO: 576353 - RNA, 20 nt, Homo sapiens
agacaaagacucacucuguc

SEQ ID NO: 576354 - RNA, 18 nt, Homo sapiens
agacaaaucaacagaagc

SEQ ID NO: 576355 - RNA, 12 nt, Homo sapiens
agacaacaaaug

SEQ ID NO: 576356 - RNA, 18 nt, Homo sapiens
agacaacaccuuccuccu

SEQ ID NO: 576357 - RNA, 18 nt, Homo sapiens
agacaacagcauaacuaa

SEQ ID NO: 576358 - RNA, 15 nt, Homo sapiens
agacaacauuucuca

SEQ ID NO: 576359 - RNA, 12 nt, Homo sapiens
agacaaccaaaa

SEQ ID NO: 576360 - RNA, 15 nt, Homo sapiens
agacaaccaaaacau

SEQ ID NO: 576361 - RNA, 16 nt, Homo sapiens
agacaaccuuguccca

SEQ ID NO: 576362 - RNA, 21 nt, Homo sapiens
agacaaccuugucccaaggaa

SEQ ID NO: 576363 - RNA, 23 nt, Homo sapiens
agacaacgaugaauuucuucuaa

SEQ ID NO: 576364 - RNA, 22 nt, Homo sapiens
agacaagaaugugcacucucug

SEQ ID NO: 576365 - RNA, 12 nt, Homo sapiens
agacaagcacua

SEQ ID NO: 576366 - RNA, 13 nt, Homo sapiens
agacaaggugcua

SEQ ID NO: 576367 - RNA, 20 nt, Homo sapiens
agacaauauacaagccaaag

SEQ ID NO: 576368 - RNA, 14 nt, Homo sapiens
agacaauaugugag

SEQ ID NO: 576369 - RNA, 19 nt, Homo sapiens
agacaaugacuuacuguac

SEQ ID NO: 576370 - RNA, 22 nt, Homo sapiens
agacaaugauaugcaagugcaa

SEQ ID NO: 576371 - RNA, 20 nt, Homo sapiens
agacaaugcaccuagcugug

SEQ ID NO: 576372 - RNA, 22 nt, Homo sapiens
agacaauggcccaggucucuca

SEQ ID NO: 576373 - RNA, 22 nt, Homo sapiens
agacaaugugaaaagaaaaaug

SEQ ID NO: 576374 - RNA, 22 nt, Homo sapiens
agacaauuguugaaaccugcua

SEQ ID NO: 576375 - RNA, 20 nt, Homo sapiens
agacacaccccaacaugccu

SEQ ID NO: 576376 - RNA, 20 nt, Homo sapiens
agacacagacuggcaauaaa

SEQ ID NO: 576377 - RNA, 21 nt, Homo sapiens
agacacagauuuuuacacuaa

SEQ ID NO: 576378 - RNA, 13 nt, Homo sapiens
agacacaggugua

SEQ ID NO: 576379 - RNA, 19 nt, Homo sapiens
agacacagugaccauacua

SEQ ID NO: 576380 - RNA, 17 nt, Homo sapiens
agacacaucuccuccau

SEQ ID NO: 576381 - RNA, 16 nt, Homo sapiens
agacacauuggcuuug

SEQ ID NO: 576382 - RNA, 17 nt, Homo sapiens
agacaccagcagcccug

SEQ ID NO: 576383 - RNA, 17 nt, Homo sapiens
agacaccaugugcaaua

SEQ ID NO: 576384 - RNA, 18 nt, Homo sapiens
agacaccuccuucuuccu

SEQ ID NO: 576385 - RNA, 14 nt, Homo sapiens
agacaccugaugac

SEQ ID NO: 576386 - RNA, 23 nt, Homo sapiens
agacaccuucugaguauucucau

SEQ ID NO: 576387 - RNA, 22 nt, Homo sapiens
agacacgauugagaacugacaa

SEQ ID NO: 576388 - RNA, 22 nt, Homo sapiens
agacacggagcccagcccuccc

SEQ ID NO: 576389 - RNA, 22 nt, Homo sapiens
agacacugaaaaaucuaaguga

SEQ ID NO: 576390 - RNA, 13 nt, Homo sapiens
agacacugcacag

SEQ ID NO: 576391 - RNA, 15 nt, Homo sapiens
agacacuuaacucaa

SEQ ID NO: 576392 - RNA, 15 nt, Homo sapiens
agacagaauguaucu

SEQ ID NO: 576393 - RNA, 18 nt, Homo sapiens
agacagaauguaucugug

SEQ ID NO: 576394 - RNA, 14 nt, Homo sapiens
agacagaaugucac

SEQ ID NO: 576395 - RNA, 21 nt, Homo sapiens
agacagacuagaaguuccuag

SEQ ID NO: 576396 - RNA, 16 nt, Homo sapiens
agacagacuugagaac

SEQ ID NO: 576397 - RNA, 17 nt, Homo sapiens
auuugggggcucgggga

SEQ ID NO: 576398 - RNA, 17 nt, Homo sapiens
auuuggucugccagaau

SEQ ID NO: 576399 - RNA, 15 nt, Homo sapiens
auuuguaaaucugcc

SEQ ID NO: 576400 - RNA, 14 nt, Homo sapiens
auuuguaacuuuag

SEQ ID NO: 576401 - RNA, 16 nt, Homo sapiens
auuuguagcaauuuaa

SEQ ID NO: 576402 - RNA, 13 nt, Homo sapiens
auuuguagcacug

SEQ ID NO: 576403 - RNA, 19 nt, Homo sapiens
auuuguagcauaacuguag

SEQ ID NO: 576404 - RNA, 20 nt, Homo sapiens
auuuguagcucuggaccugu

SEQ ID NO: 576405 - RNA, 16 nt, Homo sapiens
auuuguauacacauaa

SEQ ID NO: 576406 - RNA, 21 nt, Homo sapiens
auuuguaugguuccaaagaca

SEQ ID NO: 576407 - RNA, 23 nt, Homo sapiens
auuugucaagcaaauguuuaaaa

SEQ ID NO: 576408 - RNA, 22 nt, Homo sapiens
auuugucacaaauaaacauaau

SEQ ID NO: 576409 - RNA, 13 nt, Homo sapiens
auuugucaugaca

SEQ ID NO: 576410 - RNA, 20 nt, Homo sapiens
auuugucccuaugcauauca

SEQ ID NO: 576411 - RNA, 21 nt, Homo sapiens
auuugucuguaaaaaauggag

SEQ ID NO: 576412 - RNA, 16 nt, Homo sapiens
auuuguuaauaucacu

SEQ ID NO: 576413 - RNA, 13 nt, Homo sapiens
auuuguucagaga

SEQ ID NO: 576414 - RNA, 14 nt, Homo sapiens
auuuguucagagag

SEQ ID NO: 576415 - RNA, 23 nt, Homo sapiens
auuuguuccugccacuguguacu

SEQ ID NO: 576416 - RNA, 17 nt, Homo sapiens
auuuguugagaguguga

SEQ ID NO: 576417 - RNA, 19 nt, Homo sapiens
auuuguugcuaauuugcca

SEQ ID NO: 576418 - RNA, 14 nt, Homo sapiens
auuuguuucaaugg

SEQ ID NO: 576419 - RNA, 18 nt, Homo sapiens
auuuguuucuuucucuga

SEQ ID NO: 576420 - RNA, 16 nt, Homo sapiens
auuuguuugcaauuuu

SEQ ID NO: 576421 - RNA, 15 nt, Homo sapiens
auuuuaaaaaaucaa

SEQ ID NO: 576422 - RNA, 20 nt, Homo sapiens
auuuuaaaaaaucaaucaau

SEQ ID NO: 576423 - RNA, 17 nt, Homo sapiens
auuuuaaaacagaagaa

SEQ ID NO: 576424 - RNA, 16 nt, Homo sapiens
auuuuaaacagaggau

SEQ ID NO: 576425 - RNA, 17 nt, Homo sapiens
auuuuaaacauauccaa

SEQ ID NO: 576426 - RNA, 15 nt, Homo sapiens
auuuuaaauacaaaa

SEQ ID NO: 576427 - RNA, 17 nt, Homo sapiens
auuuuaagaauuucaca

SEQ ID NO: 576428 - RNA, 21 nt, Homo sapiens
auuuuaagaauuucacaagcu

SEQ ID NO: 576429 - RNA, 18 nt, Homo sapiens
auuuuaaguaaaagucua

SEQ ID NO: 576430 - RNA, 22 nt, Homo sapiens
auuuuaaguaaaagucuaccug

SEQ ID NO: 576431 - RNA, 14 nt, Homo sapiens
auuuuaaguacuuu

SEQ ID NO: 576432 - RNA, 16 nt, Homo sapiens
auuuuaauacauugau

SEQ ID NO: 576433 - RNA, 19 nt, Homo sapiens
auuuuaauccccugcacua

SEQ ID NO: 576434 - RNA, 17 nt, Homo sapiens
auuuuacagaagcauuu

SEQ ID NO: 576435 - RNA, 19 nt, Homo sapiens
caaaaaaauuaaaauggau

SEQ ID NO: 576436 - RNA, 21 nt, Homo sapiens
caaaaaaauuaaaauggaugc

SEQ ID NO: 576437 - RNA, 13 nt, Homo sapiens
caaaaaaccacaa

SEQ ID NO: 576438 - RNA, 14 nt, Homo sapiens
caaaaaacccaaga

SEQ ID NO: 576439 - RNA, 14 nt, Homo sapiens
caaaaaaccucacu

SEQ ID NO: 576440 - RNA, 15 nt, Homo sapiens
caaaaaacuacuucu

SEQ ID NO: 576441 - RNA, 21 nt, Homo sapiens
caaaaaagguaacuaacugcu

SEQ ID NO: 576442 - RNA, 23 nt, Homo sapiens
caaaaaauaccuucuaacuuaag

SEQ ID NO: 576443 - RNA, 16 nt, Homo sapiens
caaaaaaucaucucac

SEQ ID NO: 576444 - RNA, 11 nt, Homo sapiens
caaaaaaucug

SEQ ID NO: 576445 - RNA, 23 nt, Homo sapiens
caaaaaauguaauuaacuguaaa

SEQ ID NO: 576446 - RNA, 13 nt, Homo sapiens
caaaaaauuugag

SEQ ID NO: 576447 - RNA, 17 nt, Homo sapiens
caaaaacaaaaaaccac

SEQ ID NO: 576448 - RNA, 17 nt, Homo sapiens
caaaaacaaacaaaagc

SEQ ID NO: 576449 - RNA, 16 nt, Homo sapiens
caaaaacaagcaaugg

SEQ ID NO: 576450 - RNA, 17 nt, Homo sapiens
caaaaacagaauuugag

SEQ ID NO: 576451 - RNA, 21 nt, Homo sapiens
caaaaacagcagaacuucuga

SEQ ID NO: 576452 - RNA, 12 nt, Homo sapiens
caaaaaccaaaa

SEQ ID NO: 576453 - RNA, 15 nt, Homo sapiens
caaaaaccuucccca

SEQ ID NO: 576454 - RNA, 19 nt, Homo sapiens
caaaaacgugccguuuaaa

SEQ ID NO: 576455 - RNA, 15 nt, Homo sapiens
caaaaacuacacaua

SEQ ID NO: 576456 - RNA, 23 nt, Homo sapiens
caaaaagaaaucuugucuuacca

SEQ ID NO: 576457 - RNA, 15 nt, Homo sapiens
caaaaagaugaccuu

SEQ ID NO: 576458 - RNA, 22 nt, Homo sapiens
caaaaagaugaccuuugucuca

SEQ ID NO: 576459 - RNA, 13 nt, Homo sapiens
caaaaagauguau

SEQ ID NO: 576460 - RNA, 12 nt, Homo sapiens
caaaaaggcaaa

SEQ ID NO: 576461 - RNA, 21 nt, Homo sapiens
caaaaaguaacacaguggacu

SEQ ID NO: 576462 - RNA, 12 nt, Homo sapiens
caaaaagucaag

SEQ ID NO: 576463 - RNA, 19 nt, Homo sapiens
caaaaauaaauuguaauaa

SEQ ID NO: 576464 - RNA, 14 nt, Homo sapiens
caaaaauaguauuc

SEQ ID NO: 576465 - RNA, 17 nt, Homo sapiens
caaaaauauuuacacuu

SEQ ID NO: 576466 - RNA, 19 nt, Homo sapiens
caaaaaucguuuugcccga

SEQ ID NO: 576467 - RNA, 23 nt, Homo sapiens
caaaaaugaaagcaugucucaau

SEQ ID NO: 576468 - RNA, 20 nt, Homo sapiens
caaaaaugaaauccagugag

SEQ ID NO: 576469 - RNA, 21 nt, Homo sapiens
caaaaauggauauuauuagaa

SEQ ID NO: 576470 - RNA, 12 nt, Homo sapiens
caaaaauguaau

SEQ ID NO: 576471 - RNA, 20 nt, Homo sapiens
caaaaauguguaagaacaac

SEQ ID NO: 576472 - RNA, 21 nt, Homo sapiens
caaaacaaguuuuucugucaa

SEQ ID NO: 576473 - RNA, 16 nt, Homo sapiens
caaaacagagauguga

SEQ ID NO: 576474 - RNA, 20 nt, Homo sapiens
caaaacagagggcugcauuc

SEQ ID NO: 576475 - RNA, 18 nt, Homo sapiens
caaaacagauuguuugca

SEQ ID NO: 576476 - RNA, 19 nt, Homo sapiens
caaaacagcauaguacugg

SEQ ID NO: 576477 - RNA, 13 nt, Homo sapiens
caaaacaguaaaa

SEQ ID NO: 576478 - RNA, 15 nt, Homo sapiens
caaaacaguuugaaa

SEQ ID NO: 576479 - RNA, 12 nt, Homo sapiens
caaaacaugccg

SEQ ID NO: 576480 - RNA, 19 nt, Homo sapiens
caaaacauucauaggcagu

SEQ ID NO: 576481 - RNA, 14 nt, Homo sapiens
caaaacauugugcc

SEQ ID NO: 576482 - RNA, 21 nt, Homo sapiens
caaaacauugugccaugucaa

SEQ ID NO: 576483 - RNA, 21 nt, Homo sapiens
caaaaccaaugcugaugaccu

SEQ ID NO: 576484 - RNA, 22 nt, Homo sapiens
caaaaccuacgcacauaccuuc

SEQ ID NO: 576485 - RNA, 19 nt, Homo sapiens
caaaaccuuccucuuccag

SEQ ID NO: 576486 - RNA, 14 nt, Homo sapiens
caaaacgacacugc

SEQ ID NO: 576487 - RNA, 12 nt, Homo sapiens
caaaacuacuga

SEQ ID NO: 576488 - RNA, 21 nt, Homo sapiens
caaaacuauccugauuccaaa

SEQ ID NO: 576489 - RNA, 20 nt, Homo sapiens
caaaacucagagaaaugugu

SEQ ID NO: 576490 - RNA, 12 nt, Homo sapiens
caaaacugccuc

SEQ ID NO: 576491 - RNA, 19 nt, Homo sapiens
caaaacugcuuugugcaua

SEQ ID NO: 576492 - RNA, 23 nt, Homo sapiens
caaaacuuaucacgccuacuuaa

SEQ ID NO: 576493 - RNA, 23 nt, Homo sapiens
caaaacuuccuguuuguggaaca

SEQ ID NO: 576494 - RNA, 23 nt, Homo sapiens
caaaagaagacaacauuucucaa

SEQ ID NO: 576495 - RNA, 22 nt, Homo sapiens
caaaagcaagacuguugcucaa

SEQ ID NO: 576496 - RNA, 19 nt, Homo sapiens
caaaagcagauacuugagg

SEQ ID NO: 576497 - RNA, 19 nt, Homo sapiens
caaaagcagcacaaggaau

SEQ ID NO: 576498 - RNA, 14 nt, Homo sapiens
caaaagcaguaaau

SEQ ID NO: 576499 - RNA, 21 nt, Homo sapiens
caaaagcguccagaaaggaga

SEQ ID NO: 576500 - RNA, 14 nt, Homo sapiens
caaaagcugcucag

SEQ ID NO: 576501 - RNA, 22 nt, Homo sapiens
caaaagcugggaaccagcaucu

SEQ ID NO: 576502 - RNA, 20 nt, Homo sapiens
caaaagcuuauucaucuguu

SEQ ID NO: 576503 - RNA, 17 nt, Homo sapiens
caaaaggaaaccaagug

SEQ ID NO: 576504 - RNA, 14 nt, Homo sapiens
caaaaggaccccaa

SEQ ID NO: 576505 - RNA, 18 nt, Homo sapiens
caaaaggccucuuguaaa

SEQ ID NO: 576506 - RNA, 17 nt, Homo sapiens
caaaaggcugauuacug

SEQ ID NO: 576507 - RNA, 15 nt, Homo sapiens
caaaagggccaaaga

SEQ ID NO: 576508 - RNA, 21 nt, Homo sapiens
caaaaguagccaucauuccuu

SEQ ID NO: 576509 - RNA, 23 nt, Homo sapiens
caaaaguagccaucauuccuuua

SEQ ID NO: 576510 - RNA, 14 nt, Homo sapiens
caaaagugcaagau

SEQ ID NO: 576511 - RNA, 20 nt, Homo sapiens
caaaaguggggcuaaaugaa

SEQ ID NO: 576512 - RNA, 20 nt, Homo sapiens
caaaaguuacauguuugcac

SEQ ID NO: 576513 - RNA, 18 nt, Homo sapiens
caaaaguuucuuacucaa

SEQ ID NO: 576514 - RNA, 22 nt, Homo sapiens
caaaaguuucuuacucaaggaa

SEQ ID NO: 576515 - RNA, 17 nt, Homo sapiens
caaaaguuuguuugcuu

SEQ ID NO: 576516 - RNA, 22 nt, Homo sapiens
caaaauaaagaucacacaucaa

SEQ ID NO: 576517 - RNA, 16 nt, Homo sapiens
caaaauaaaggcgcua

SEQ ID NO: 576518 - RNA, 21 nt, Homo sapiens
caaaauaaauaaucuacugua

SEQ ID NO: 576519 - RNA, 20 nt, Homo sapiens
caaaauaaggaugacuuuag

SEQ ID NO: 576520 - RNA, 13 nt, Homo sapiens
caaaauaaguguu

SEQ ID NO: 576521 - RNA, 21 nt, Homo sapiens
agacuuagaaaaauccuacaa

SEQ ID NO: 576522 - RNA, 18 nt, Homo sapiens
agacuuaggaaccuacca

SEQ ID NO: 576523 - RNA, 17 nt, Homo sapiens
agacuuauguauuagcu

SEQ ID NO: 576524 - RNA, 15 nt, Homo sapiens
agacuuauugccaaa

SEQ ID NO: 576525 - RNA, 17 nt, Homo sapiens
agacuucagcuguuccu

SEQ ID NO: 576526 - RNA, 23 nt, Homo sapiens
agacuuccuugcaggagugacuc

SEQ ID NO: 576527 - RNA, 15 nt, Homo sapiens
agacuucguaauuaa

SEQ ID NO: 576528 - RNA, 16 nt, Homo sapiens
agacuuggacuaugau

SEQ ID NO: 576529 - RNA, 16 nt, Homo sapiens
agacuuggggccagcg

SEQ ID NO: 576530 - RNA, 20 nt, Homo sapiens
agacuuggguugaucucuua

SEQ ID NO: 576531 - RNA, 21 nt, Homo sapiens
agacuugguccuaagcaccug

SEQ ID NO: 576532 - RNA, 17 nt, Homo sapiens
agacuuucaaacauaua

SEQ ID NO: 576533 - RNA, 15 nt, Homo sapiens
agacuuuccauuaaa

SEQ ID NO: 576534 - RNA, 18 nt, Homo sapiens
agacuuucuaaaucaaac

SEQ ID NO: 576535 - RNA, 13 nt, Homo sapiens
agacuuucuguua

SEQ ID NO: 576536 - RNA, 19 nt, Homo sapiens
agacuuucuucuagugcuu

SEQ ID NO: 576537 - RNA, 20 nt, Homo sapiens
agacuuuguguucauuucau

SEQ ID NO: 576538 - RNA, 20 nt, Homo sapiens
agacuuuugcuuuaugauau

SEQ ID NO: 576539 - RNA, 15 nt, Homo sapiens
agagaaaagucuacc

SEQ ID NO: 576540 - RNA, 14 nt, Homo sapiens
agagaaaauuugaa

SEQ ID NO: 576541 - RNA, 14 nt, Homo sapiens
agagaaacacugcu

SEQ ID NO: 576542 - RNA, 22 nt, Homo sapiens
agagaaacuagaaacaguuaaa

SEQ ID NO: 576543 - RNA, 23 nt, Homo sapiens
agagaaagaaagggaaacuggcu

SEQ ID NO: 576544 - RNA, 14 nt, Homo sapiens
agagaaaugaauua

SEQ ID NO: 576545 - RNA, 14 nt, Homo sapiens
agagaaccaaaggg

SEQ ID NO: 576546 - RNA, 22 nt, Homo sapiens
agagaaccucagaucaggugca

SEQ ID NO: 576547 - RNA, 20 nt, Homo sapiens
agagaaccuuuagaauaucu

SEQ ID NO: 576548 - RNA, 21 nt, Homo sapiens
agagaaccuuuagaauaucuu

SEQ ID NO: 576549 - RNA, 19 nt, Homo sapiens
agagaacucgcgcucagua

SEQ ID NO: 576550 - RNA, 20 nt, Homo sapiens
agagaagcggauuuccaggg

SEQ ID NO: 576551 - RNA, 12 nt, Homo sapiens
agagaagcugcu

SEQ ID NO: 576552 - RNA, 17 nt, Homo sapiens
agagaaggaggggagca

SEQ ID NO: 576553 - RNA, 19 nt, Homo sapiens
agagaaggcugugagccaa

SEQ ID NO: 576554 - RNA, 21 nt, Homo sapiens
agagaaggggauuaccuugua

SEQ ID NO: 576555 - RNA, 21 nt, Homo sapiens
agagaaguuguaaaguaugua

SEQ ID NO: 576556 - RNA, 17 nt, Homo sapiens
caaagugcugggauuac

SEQ ID NO: 576557 - RNA, 22 nt, Homo sapiens
caaagugcugggauuacaggca

SEQ ID NO: 576558 - RNA, 13 nt, Homo sapiens
caaaguggaggag

SEQ ID NO: 576559 - RNA, 21 nt, Homo sapiens
caaagugguaaauacugugaa

SEQ ID NO: 576560 - RNA, 14 nt, Homo sapiens
caaaguguacaaau

SEQ ID NO: 576561 - RNA, 17 nt, Homo sapiens
caaagugugauauacaa

SEQ ID NO: 576562 - RNA, 22 nt, Homo sapiens
caaaguguugggauuacaggcg

SEQ ID NO: 576563 - RNA, 18 nt, Homo sapiens
caaaguguuguguuccug

SEQ ID NO: 576564 - RNA, 22 nt, Homo sapiens
caaaguuaaaagcaaacacuua

SEQ ID NO: 576565 - RNA, 18 nt, Homo sapiens
caaaguuaaggcuugaua

SEQ ID NO: 576566 - RNA, 22 nt, Homo sapiens
caaauaaaacuagugacagcuu

SEQ ID NO: 576567 - RNA, 14 nt, Homo sapiens
caaauaaaauauca

SEQ ID NO: 576568 - RNA, 13 nt, Homo sapiens
caaauaaaaucua

SEQ ID NO: 576569 - RNA, 13 nt, Homo sapiens
caaauaaaccuuu

SEQ ID NO: 576570 - RNA, 13 nt, Homo sapiens
caaauaaacucca

SEQ ID NO: 576571 - RNA, 22 nt, Homo sapiens
caaauaaaucauccucaugucc

SEQ ID NO: 576572 - RNA, 14 nt, Homo sapiens
caaauaaaugacaa

SEQ ID NO: 576573 - RNA, 15 nt, Homo sapiens
caaauaacagucuga

SEQ ID NO: 576574 - RNA, 13 nt, Homo sapiens
caaauaaguggaa

SEQ ID NO: 576575 - RNA, 22 nt, Homo sapiens
caaauacauggauaacacauuu

SEQ ID NO: 576576 - RNA, 23 nt, Homo sapiens
caaauacccaaaugucccugcaa

SEQ ID NO: 576577 - RNA, 21 nt, Homo sapiens
caaauacuguauauucaggac

SEQ ID NO: 576578 - RNA, 21 nt, Homo sapiens
caaauacuugacucagugaua

SEQ ID NO: 576579 - RNA, 15 nt, Homo sapiens
caaauagaucaugca

SEQ ID NO: 576580 - RNA, 19 nt, Homo sapiens
caaauagaucaugcauuua

SEQ ID NO: 576581 - RNA, 21 nt, Homo sapiens
caaauaggagggagacugugg

SEQ ID NO: 576582 - RNA, 19 nt, Homo sapiens
caaauaggauuaaacacac

SEQ ID NO: 576583 - RNA, 22 nt, Homo sapiens
caaauagguagagucauucaua

SEQ ID NO: 576584 - RNA, 18 nt, Homo sapiens
caaauauaagacauuugu

SEQ ID NO: 576585 - RNA, 15 nt, Homo sapiens
caaauaugcaaacca

SEQ ID NO: 576586 - RNA, 15 nt, Homo sapiens
caaauaugcacuuuc

SEQ ID NO: 576587 - RNA, 12 nt, Homo sapiens
caaauauguaug

SEQ ID NO: 576588 - RNA, 17 nt, Homo sapiens
caaauauuucugauacu

SEQ ID NO: 576589 - RNA, 15 nt, Homo sapiens
caaaucagcugcuac

SEQ ID NO: 576590 - RNA, 20 nt, Homo sapiens
caaaucauccauccuugcca

SEQ ID NO: 576591 - RNA, 21 nt, Homo sapiens
caaaucauccauccuugccaa

SEQ ID NO: 576592 - RNA, 17 nt, Homo sapiens
caaaucauuuguuuaaa

SEQ ID NO: 576593 - RNA, 12 nt, Homo sapiens
caaauccaagga

SEQ ID NO: 576594 - RNA, 19 nt, Homo sapiens
caaauccaaggaaacaugc

SEQ ID NO: 576595 - RNA, 13 nt, Homo sapiens
caaaucguauacc

SEQ ID NO: 576596 - RNA, 22 nt, Homo sapiens
caaaucguccagcgaccuuccu

SEQ ID NO: 576597 - RNA, 22 nt, Homo sapiens
caaaucguggcacguauugcug

SEQ ID NO: 576598 - RNA, 18 nt, Homo sapiens
caaaucuaccacuguaug

SEQ ID NO: 576599 - RNA, 19 nt, Homo sapiens
caaaucuaccacuguauga

SEQ ID NO: 576600 - RNA, 20 nt, Homo sapiens
caaaucuacgguuaugaagg

SEQ ID NO: 576601 - RNA, 19 nt, Homo sapiens
caaaucucaaaguguacaa

SEQ ID NO: 576602 - RNA, 16 nt, Homo sapiens
caaaucuccugcugau

SEQ ID NO: 576603 - RNA, 13 nt, Homo sapiens
caaaucugaggga

SEQ ID NO: 576604 - RNA, 20 nt, Homo sapiens
caaaucugagggagcugagu

SEQ ID NO: 576605 - RNA, 14 nt, Homo sapiens
caaaugaaacuuua

SEQ ID NO: 576606 - RNA, 23 nt, Homo sapiens
caaaugaauggaggaacuuucca

SEQ ID NO: 576607 - RNA, 14 nt, Homo sapiens
caaaugacaaaaag

SEQ ID NO: 576608 - RNA, 16 nt, Homo sapiens
caaaugacccaaagac

SEQ ID NO: 576609 - RNA, 19 nt, Homo sapiens
caaaugaucagccuugcaa

SEQ ID NO: 576610 - RNA, 20 nt, Homo sapiens
caaaugcaaucccauuucug

SEQ ID NO: 576611 - RNA, 18 nt, Homo sapiens
caaaugcacaucucaugg

SEQ ID NO: 576612 - RNA, 22 nt, Homo sapiens
caaaugccaaacacuagcucug

SEQ ID NO: 576613 - RNA, 20 nt, Homo sapiens
caaaugccugguaccagagg

SEQ ID NO: 576614 - RNA, 16 nt, Homo sapiens
caaaugcuauuugaua

SEQ ID NO: 576615 - RNA, 13 nt, Homo sapiens
caaaugcuuuaac

SEQ ID NO: 576616 - RNA, 20 nt, Homo sapiens
caaaugcuuuggacuuuuga

SEQ ID NO: 576617 - RNA, 23 nt, Homo sapiens
caaauggaaagauccccuaauaa

SEQ ID NO: 576618 - RNA, 22 nt, Homo sapiens
caaauggcuacuaagcacauga

SEQ ID NO: 576619 - RNA, 20 nt, Homo sapiens
caaaugguaggcauuuccua

SEQ ID NO: 576620 - RNA, 20 nt, Homo sapiens
caaaugguggguacaaaaag

SEQ ID NO: 576621 - RNA, 14 nt, Homo sapiens
caaauguauagaau

SEQ ID NO: 576622 - RNA, 22 nt, Homo sapiens
caaauguauugauuacaaauaa

SEQ ID NO: 576623 - RNA, 21 nt, Homo sapiens
caaaugucagagcuauguucc

SEQ ID NO: 576624 - RNA, 13 nt, Homo sapiens
caaaugucuaagg

SEQ ID NO: 576625 - RNA, 23 nt, Homo sapiens
caaaugucuucaugaccuacuuc

SEQ ID NO: 576626 - RNA, 13 nt, Homo sapiens
caaaugugcugcu

SEQ ID NO: 576627 - RNA, 20 nt, Homo sapiens
caaaugugcuggucacccuu

SEQ ID NO: 576628 - RNA, 23 nt, Homo sapiens
caaaugugcuggucacccuucaa

SEQ ID NO: 576629 - RNA, 19 nt, Homo sapiens
caaauguguauaaacugcu

SEQ ID NO: 576630 - RNA, 19 nt, Homo sapiens
caaauguguggguuuuuaa

SEQ ID NO: 576631 - RNA, 20 nt, Homo sapiens
caaauuaaaacaaauauaca

SEQ ID NO: 576632 - RNA, 14 nt, Homo sapiens
caaauuaacuguau

SEQ ID NO: 576633 - RNA, 15 nt, Homo sapiens
caaauuacagcccag

SEQ ID NO: 576634 - RNA, 18 nt, Homo sapiens
caaauuauaaaaaccaug

SEQ ID NO: 576635 - RNA, 16 nt, Homo sapiens
caaauuauaugcuaau

SEQ ID NO: 576636 - RNA, 22 nt, Homo sapiens
caaauucaaauaauccauucca

SEQ ID NO: 576637 - RNA, 23 nt, Homo sapiens
caaauucaaauaauccauuccaa

SEQ ID NO: 576638 - RNA, 18 nt, Homo sapiens
caaauucauauucugucu

SEQ ID NO: 576639 - RNA, 12 nt, Homo sapiens
caaauucauccu

SEQ ID NO: 576640 - RNA, 13 nt, Homo sapiens
caaauugaucaag

SEQ ID NO: 576641 - RNA, 16 nt, Homo sapiens
caaauugggaaaucca

SEQ ID NO: 576642 - RNA, 17 nt, Homo sapiens
caaauuguguauauauc

SEQ ID NO: 576643 - RNA, 14 nt, Homo sapiens
caaauuguuuacau

SEQ ID NO: 576644 - RNA, 16 nt, Homo sapiens
caaauuuauugauguu

SEQ ID NO: 576645 - RNA, 21 nt, Homo sapiens
agauagcaucuuauacgagua

SEQ ID NO: 576646 - RNA, 15 nt, Homo sapiens
agauagcuacagugu

SEQ ID NO: 576647 - RNA, 16 nt, Homo sapiens
agauagcuacagugua

SEQ ID NO: 576648 - RNA, 15 nt, Homo sapiens
agauaggaguucucu

SEQ ID NO: 576649 - RNA, 18 nt, Homo sapiens
agauaggaguucucugau

SEQ ID NO: 576650 - RNA, 12 nt, Homo sapiens
agauagggaaaa

SEQ ID NO: 576651 - RNA, 23 nt, Homo sapiens
agauaguggggagacuucuuggc

SEQ ID NO: 576652 - RNA, 17 nt, Homo sapiens
agauaguguaacuugcu

SEQ ID NO: 576653 - RNA, 17 nt, Homo sapiens
agauauauguguauaca

SEQ ID NO: 576654 - RNA, 13 nt, Homo sapiens
agauauuaauaga

SEQ ID NO: 576655 - RNA, 22 nt, Homo sapiens
agauauuaauagauaauaugaa

SEQ ID NO: 576656 - RNA, 17 nt, Homo sapiens
agauauucagaaguaua

SEQ ID NO: 576657 - RNA, 18 nt, Homo sapiens
agauauucagaaguauau

SEQ ID NO: 576658 - RNA, 18 nt, Homo sapiens
agauauucuuauuucacu

SEQ ID NO: 576659 - RNA, 20 nt, Homo sapiens
agauauugaugauaacacuu

SEQ ID NO: 576660 - RNA, 19 nt, Homo sapiens
agauauugugaaguacaua

SEQ ID NO: 576661 - RNA, 22 nt, Homo sapiens
agaucaaaauaaaaagugacac

SEQ ID NO: 576662 - RNA, 14 nt, Homo sapiens
agaucaacaauacc

SEQ ID NO: 576663 - RNA, 13 nt, Homo sapiens
agaucaccaccug

SEQ ID NO: 576664 - RNA, 16 nt, Homo sapiens
agaucacgagaucaag

SEQ ID NO: 576665 - RNA, 17 nt, Homo sapiens
agaucacgucacugcac

SEQ ID NO: 576666 - RNA, 18 nt, Homo sapiens
agaucacgucacugcacu

SEQ ID NO: 576667 - RNA, 19 nt, Homo sapiens
agaucaucuuggaacugca

SEQ ID NO: 576668 - RNA, 11 nt, Homo sapiens
agaucaugcca

SEQ ID NO: 576669 - RNA, 19 nt, Homo sapiens
agaucaugggucaagagau

SEQ ID NO: 576670 - RNA, 23 nt, Homo sapiens
agauccacguguggccuccgucc

SEQ ID NO: 576671 - RNA, 15 nt, Homo sapiens
agaucccacuggaag

SEQ ID NO: 576672 - RNA, 21 nt, Homo sapiens
agaucccagcuucggcauuug

SEQ ID NO: 576673 - RNA, 20 nt, Homo sapiens
agauccccaagccuggcaag

SEQ ID NO: 576674 - RNA, 15 nt, Homo sapiens
agauccccagcuuuc

SEQ ID NO: 576675 - RNA, 14 nt, Homo sapiens
agauccuaaacucu

SEQ ID NO: 576676 - RNA, 16 nt, Homo sapiens
agauccucaagcagac

SEQ ID NO: 576677 - RNA, 13 nt, Homo sapiens
cacagaugucucu

SEQ ID NO: 576678 - RNA, 16 nt, Homo sapiens
cacagauuugagcuca

SEQ ID NO: 576679 - RNA, 13 nt, Homo sapiens
cacagcacccaug

SEQ ID NO: 576680 - RNA, 21 nt, Homo sapiens
cacagcagccccugcacaaag

SEQ ID NO: 576681 - RNA, 15 nt, Homo sapiens
cacagcagcugaaca

SEQ ID NO: 576682 - RNA, 15 nt, Homo sapiens
cacagcaggggagcc

SEQ ID NO: 576683 - RNA, 21 nt, Homo sapiens
cacagcaucauuuugcauuca

SEQ ID NO: 576684 - RNA, 17 nt, Homo sapiens
cacagcaucgggagcac

SEQ ID NO: 576685 - RNA, 11 nt, Homo sapiens
cacagccaaac

SEQ ID NO: 576686 - RNA, 14 nt, Homo sapiens
cacagccaacacgc

SEQ ID NO: 576687 - RNA, 17 nt, Homo sapiens
cacagccaacgagacac

SEQ ID NO: 576688 - RNA, 16 nt, Homo sapiens
cacagcccagaaccac

SEQ ID NO: 576689 - RNA, 17 nt, Homo sapiens
cacagcccugagaguca

SEQ ID NO: 576690 - RNA, 14 nt, Homo sapiens
cacagccucgggga

SEQ ID NO: 576691 - RNA, 22 nt, Homo sapiens
cacagccugacacagugcucga

SEQ ID NO: 576692 - RNA, 15 nt, Homo sapiens
cacagcgagccugug

SEQ ID NO: 576693 - RNA, 14 nt, Homo sapiens
cacagcguccuguc

SEQ ID NO: 576694 - RNA, 18 nt, Homo sapiens
cacagcuauuuagaagca

SEQ ID NO: 576695 - RNA, 20 nt, Homo sapiens
cacagcuccugccaggguga

SEQ ID NO: 576696 - RNA, 20 nt, Homo sapiens
cacagcugaguuaugaugua

SEQ ID NO: 576697 - RNA, 21 nt, Homo sapiens
cacagcugcagcugggcccca

SEQ ID NO: 576698 - RNA, 13 nt, Homo sapiens
cacagcugcauua

SEQ ID NO: 576699 - RNA, 19 nt, Homo sapiens
cacagcugcugcuggaaau

SEQ ID NO: 576700 - RNA, 16 nt, Homo sapiens
cacagcuggcucugac

SEQ ID NO: 576701 - RNA, 20 nt, Homo sapiens
cacagcugggcaaagccaca

SEQ ID NO: 576702 - RNA, 15 nt, Homo sapiens
cacagcuucucuaca

SEQ ID NO: 576703 - RNA, 20 nt, Homo sapiens
cacaggacugaaaagggaau

SEQ ID NO: 576704 - RNA, 21 nt, Homo sapiens
cacaggauuuguaauuccuua

SEQ ID NO: 576705 - RNA, 12 nt, Homo sapiens
cacaggcagcuu

SEQ ID NO: 576706 - RNA, 14 nt, Homo sapiens
cacagggacuugaa

SEQ ID NO: 576707 - RNA, 17 nt, Homo sapiens
cacagggccaacuugag

SEQ ID NO: 576708 - RNA, 18 nt, Homo sapiens
cacaggggcccauggacu

SEQ ID NO: 576709 - RNA, 23 nt, Homo sapiens
cacaggggcccuguacagugaau

SEQ ID NO: 576710 - RNA, 20 nt, Homo sapiens
cacaggugcgggaccaucug

SEQ ID NO: 576711 - RNA, 12 nt, Homo sapiens
cacaggugggag

SEQ ID NO: 576712 - RNA, 16 nt, Homo sapiens
cacagguucaugccac

SEQ ID NO: 576713 - RNA, 15 nt, Homo sapiens
cacaguaagucauuu

SEQ ID NO: 576714 - RNA, 16 nt, Homo sapiens
cacaguaagucauuua

SEQ ID NO: 576715 - RNA, 20 nt, Homo sapiens
cacagucaauggauccacaa

SEQ ID NO: 576716 - RNA, 23 nt, Homo sapiens
cacagucaggggcugggcauccc

SEQ ID NO: 576717 - RNA, 20 nt, Homo sapiens
cacagucccccacccaccuc

SEQ ID NO: 576718 - RNA, 21 nt, Homo sapiens
cacaguccuaccucaguucaa

SEQ ID NO: 576719 - RNA, 11 nt, Homo sapiens
cacagucucau

SEQ ID NO: 576720 - RNA, 15 nt, Homo sapiens
cacagucuuggcuca

SEQ ID NO: 576721 - RNA, 14 nt, Homo sapiens
cacagugaauccag

SEQ ID NO: 576722 - RNA, 15 nt, Homo sapiens
cacagugaauccaga

SEQ ID NO: 576723 - RNA, 12 nt, Homo sapiens
cacagugcaguu

SEQ ID NO: 576724 - RNA, 13 nt, Homo sapiens
cacagugcccaag

SEQ ID NO: 576725 - RNA, 17 nt, Homo sapiens
cacagugcugaccagac

SEQ ID NO: 576726 - RNA, 15 nt, Homo sapiens
cacaguggccaaaga

SEQ ID NO: 576727 - RNA, 15 nt, Homo sapiens
cacaguggggcugca

SEQ ID NO: 576728 - RNA, 16 nt, Homo sapiens
cacaguggugaccccc

SEQ ID NO: 576729 - RNA, 19 nt, Homo sapiens
cacagugguucguuuacca

SEQ ID NO: 576730 - RNA, 11 nt, Homo sapiens
cacagugucug

SEQ ID NO: 576731 - RNA, 19 nt, Homo sapiens
cacagugugugacuuacag

SEQ ID NO: 576732 - RNA, 19 nt, Homo sapiens
cacaguguuuuuauugcuc

SEQ ID NO: 576733 - RNA, 15 nt, Homo sapiens
cacaguuaauucccu

SEQ ID NO: 576734 - RNA, 16 nt, Homo sapiens
cacaguuaucaaaaag

SEQ ID NO: 576735 - RNA, 15 nt, Homo sapiens
cacaguuuaccucag

SEQ ID NO: 576736 - RNA, 15 nt, Homo sapiens
cacaguuuucuggcu

SEQ ID NO: 576737 - RNA, 20 nt, Homo sapiens
cacauaaaagacacagaaca

SEQ ID NO: 576738 - RNA, 22 nt, Homo sapiens
cacauaaccucucugugccauc

SEQ ID NO: 576739 - RNA, 22 nt, Homo sapiens
cacauaagggagauuguauaca

SEQ ID NO: 576740 - RNA, 12 nt, Homo sapiens
cacauacaguau

SEQ ID NO: 576741 - RNA, 21 nt, Homo sapiens
cacauagcgccgugcuguaaa

SEQ ID NO: 576742 - RNA, 21 nt, Homo sapiens
cacauagguaaaaacuggaau

SEQ ID NO: 576743 - RNA, 23 nt, Homo sapiens
cacauaguagguacccaauucaa

SEQ ID NO: 576744 - RNA, 14 nt, Homo sapiens
cacauauacauaua

SEQ ID NO: 576745 - RNA, 18 nt, Homo sapiens
cacauauggaauuuugca

SEQ ID NO: 576746 - RNA, 13 nt, Homo sapiens
cacaucacauucc

SEQ ID NO: 576747 - RNA, 16 nt, Homo sapiens
cacaucagcaauuuca

SEQ ID NO: 576748 - RNA, 17 nt, Homo sapiens
cacauccacaugguuca

SEQ ID NO: 576749 - RNA, 16 nt, Homo sapiens
cacauccaucuacuuu

SEQ ID NO: 576750 - RNA, 17 nt, Homo sapiens
cacauccccagcugccu

SEQ ID NO: 576751 - RNA, 15 nt, Homo sapiens
cacaucccuuugaaa

SEQ ID NO: 576752 - RNA, 20 nt, Homo sapiens
cacauccucugucuauuuga

SEQ ID NO: 576753 - RNA, 20 nt, Homo sapiens
cacauccugaaaaggguguu

SEQ ID NO: 576754 - RNA, 16 nt, Homo sapiens
cacaucuaaagcuuua

SEQ ID NO: 576755 - RNA, 16 nt, Homo sapiens
cacaucuaaccucauc

SEQ ID NO: 576756 - RNA, 14 nt, Homo sapiens
cacaucucccccau

SEQ ID NO: 576757 - RNA, 12 nt, Homo sapiens
cacaucugucac

SEQ ID NO: 576758 - RNA, 15 nt, Homo sapiens
cacaucuguccucac

SEQ ID NO: 576759 - RNA, 17 nt, Homo sapiens
cacaugaaaccuacaca

SEQ ID NO: 576760 - RNA, 14 nt, Homo sapiens
cacaugaacauaug

SEQ ID NO: 576761 - RNA, 18 nt, Homo sapiens
cacaugcuaggaugcgga

SEQ ID NO: 576762 - RNA, 13 nt, Homo sapiens
cacaugcuauguu

SEQ ID NO: 576763 - RNA, 12 nt, Homo sapiens
cacaugcuggug

SEQ ID NO: 576764 - RNA, 20 nt, Homo sapiens
cacaugcuggugcauauacg

SEQ ID NO: 576765 - RNA, 14 nt, Homo sapiens
cacauggcugggau

SEQ ID NO: 576766 - RNA, 17 nt, Homo sapiens
cacauggugugagucca

SEQ ID NO: 576767 - RNA, 19 nt, Homo sapiens
cacauguauugacaacagu

SEQ ID NO: 576768 - RNA, 21 nt, Homo sapiens
cacaugugagcaugucacuuc

SEQ ID NO: 576769 - RNA, 18 nt, Homo sapiens
cacaugugccacacagug

SEQ ID NO: 576770 - RNA, 13 nt, Homo sapiens
cacaugugcugca

SEQ ID NO: 576771 - RNA, 19 nt, Homo sapiens
cacauguucaacuauuaau

SEQ ID NO: 576772 - RNA, 22 nt, Homo sapiens
cacauguucuagguuucagcaa

SEQ ID NO: 576773 - RNA, 16 nt, Homo sapiens
cacauuaaucucaaag

SEQ ID NO: 576774 - RNA, 16 nt, Homo sapiens
cacauuaccauucaua

SEQ ID NO: 576775 - RNA, 23 nt, Homo sapiens
cacauuaucgggagcagugucuu

SEQ ID NO: 576776 - RNA, 18 nt, Homo sapiens
cacauucgggaccaauau

SEQ ID NO: 576777 - RNA, 19 nt, Homo sapiens
cacauucuaaaggcuugau

SEQ ID NO: 576778 - RNA, 20 nt, Homo sapiens
agcccuugagucugucacac

SEQ ID NO: 576779 - RNA, 15 nt, Homo sapiens
agcccuuuacuugac

SEQ ID NO: 576780 - RNA, 14 nt, Homo sapiens
agccgaaguugcac

SEQ ID NO: 576781 - RNA, 15 nt, Homo sapiens
agccgagaucaugcc

SEQ ID NO: 576782 - RNA, 16 nt, Homo sapiens
agccgagaucaugcca

SEQ ID NO: 576783 - RNA, 23 nt, Homo sapiens
agccgagauugcgccauugcacu

SEQ ID NO: 576784 - RNA, 16 nt, Homo sapiens
agccgaggccuacccc

SEQ ID NO: 576785 - RNA, 17 nt, Homo sapiens
agccgccgaccugugac

SEQ ID NO: 576786 - RNA, 16 nt, Homo sapiens
agccgcuucugacugc

SEQ ID NO: 576787 - RNA, 16 nt, Homo sapiens
agccgggcacagcccu

SEQ ID NO: 576788 - RNA, 19 nt, Homo sapiens
agccggggccgucugugug

SEQ ID NO: 576789 - RNA, 17 nt, Homo sapiens
agccggucaucacccag

SEQ ID NO: 576790 - RNA, 15 nt, Homo sapiens
agccguauuuuacau

SEQ ID NO: 576791 - RNA, 13 nt, Homo sapiens
agccuaaaagaca

SEQ ID NO: 576792 - RNA, 20 nt, Homo sapiens
agccuaaaguauacaacugc

SEQ ID NO: 576793 - RNA, 13 nt, Homo sapiens
agccuaaauguua

SEQ ID NO: 576794 - RNA, 17 nt, Homo sapiens
agccuaauaacgugaaa

SEQ ID NO: 576795 - RNA, 19 nt, Homo sapiens
agccuaauacaacauguag

SEQ ID NO: 576796 - RNA, 23 nt, Homo sapiens
agccuaaugagagugcacugcuc

SEQ ID NO: 576797 - RNA, 18 nt, Homo sapiens
agccuacagaagggcagu

SEQ ID NO: 576798 - RNA, 15 nt, Homo sapiens
agccuacagaugaac

SEQ ID NO: 576799 - RNA, 22 nt, Homo sapiens
agccuacccuuccugcauuucu

SEQ ID NO: 576800 - RNA, 15 nt, Homo sapiens
caccugacagcuuua

SEQ ID NO: 576801 - RNA, 18 nt, Homo sapiens
caccugccaaaugaauaa

SEQ ID NO: 576802 - RNA, 19 nt, Homo sapiens
caccugcccugcugagucc

SEQ ID NO: 576803 - RNA, 21 nt, Homo sapiens
caccugccuccucguuccuuu

SEQ ID NO: 576804 - RNA, 19 nt, Homo sapiens
caccugccugcgucuuccg

SEQ ID NO: 576805 - RNA, 21 nt, Homo sapiens
caccuggaugucugggugacc

SEQ ID NO: 576806 - RNA, 23 nt, Homo sapiens
caccuggcagggcucacacuccu

SEQ ID NO: 576807 - RNA, 15 nt, Homo sapiens
caccuggggauuuua

SEQ ID NO: 576808 - RNA, 12 nt, Homo sapiens
caccuguaggca

SEQ ID NO: 576809 - RNA, 18 nt, Homo sapiens
caccugucaucauggagg

SEQ ID NO: 576810 - RNA, 19 nt, Homo sapiens
caccuguccggcccagugc

SEQ ID NO: 576811 - RNA, 14 nt, Homo sapiens
caccugugaguuua

SEQ ID NO: 576812 - RNA, 14 nt, Homo sapiens
caccuguggugacc

SEQ ID NO: 576813 - RNA, 18 nt, Homo sapiens
caccuuaauaugcugcaa

SEQ ID NO: 576814 - RNA, 21 nt, Homo sapiens
caccuuagagcaaccucugua

SEQ ID NO: 576815 - RNA, 13 nt, Homo sapiens
caccuuagugcaa

SEQ ID NO: 576816 - RNA, 15 nt, Homo sapiens
caccuucaagcagcu

SEQ ID NO: 576817 - RNA, 14 nt, Homo sapiens
caccuuccaaagga

SEQ ID NO: 576818 - RNA, 21 nt, Homo sapiens
caccuuccagcuccuguaaca

SEQ ID NO: 576819 - RNA, 13 nt, Homo sapiens
caccuuccauguc

SEQ ID NO: 576820 - RNA, 20 nt, Homo sapiens
caccuucccucgacuugacc

SEQ ID NO: 576821 - RNA, 13 nt, Homo sapiens
caccuuggccucc

SEQ ID NO: 576822 - RNA, 13 nt, Homo sapiens
caccuuugcacgu

SEQ ID NO: 576823 - RNA, 22 nt, Homo sapiens
caccuuugcuacgcaaggaaau

SEQ ID NO: 576824 - RNA, 13 nt, Homo sapiens
caccuuugugcag

SEQ ID NO: 576825 - RNA, 18 nt, Homo sapiens
caccuuuugcacauaaca

SEQ ID NO: 576826 - RNA, 13 nt, Homo sapiens
cacgaaacuuguu

SEQ ID NO: 576827 - RNA, 13 nt, Homo sapiens
cacgaacuugaaa

SEQ ID NO: 576828 - RNA, 16 nt, Homo sapiens
cacgaccauuugauag

SEQ ID NO: 576829 - RNA, 23 nt, Homo sapiens
cacgaugauaucuauauauguau

SEQ ID NO: 576830 - RNA, 11 nt, Homo sapiens
cacgaugcauu

SEQ ID NO: 576831 - RNA, 14 nt, Homo sapiens
cacgaugcauuuaa

SEQ ID NO: 576832 - RNA, 15 nt, Homo sapiens
cacgcaagggcauca

SEQ ID NO: 576833 - RNA, 17 nt, Homo sapiens
cacgcaagugugugagu

SEQ ID NO: 576834 - RNA, 20 nt, Homo sapiens
cacgcacacaucuuaccucu

SEQ ID NO: 576835 - RNA, 22 nt, Homo sapiens
cacgcacacccugccccuggug

SEQ ID NO: 576836 - RNA, 13 nt, Homo sapiens
cacgcaggccacc

SEQ ID NO: 576837 - RNA, 20 nt, Homo sapiens
cacgccagcuccucucugaa

SEQ ID NO: 576838 - RNA, 16 nt, Homo sapiens
cacgcuuugcugcuac

SEQ ID NO: 576839 - RNA, 18 nt, Homo sapiens
cacgcuuuuaauucucau

SEQ ID NO: 576840 - RNA, 20 nt, Homo sapiens
cacggaggaugaugccaguu

SEQ ID NO: 576841 - RNA, 14 nt, Homo sapiens
cacggcauuacccc

SEQ ID NO: 576842 - RNA, 18 nt, Homo sapiens
cacggcguuguaccugua

SEQ ID NO: 576843 - RNA, 23 nt, Homo sapiens
cacggcuccuccuuaugacucca

SEQ ID NO: 576844 - RNA, 18 nt, Homo sapiens
cacggcugcgcacugugu

SEQ ID NO: 576845 - RNA, 24 nt, Homo sapiens
cacgggaaagccgccgaccuguga

SEQ ID NO: 576846 - RNA, 18 nt, Homo sapiens
cacgggcaugggcacucc

SEQ ID NO: 576847 - RNA, 19 nt, Homo sapiens
cacgguuuggaaauauuca

SEQ ID NO: 576848 - RNA, 12 nt, Homo sapiens
cacguaccuuca

SEQ ID NO: 576849 - RNA, 12 nt, Homo sapiens
cacguaucccac

SEQ ID NO: 576850 - RNA, 16 nt, Homo sapiens
cacguaucucuuggua

SEQ ID NO: 576851 - RNA, 20 nt, Homo sapiens
cacgucacugcacuccagcu

SEQ ID NO: 576852 - RNA, 11 nt, Homo sapiens
cacgucauguc

SEQ ID NO: 576853 - RNA, 18 nt, Homo sapiens
cacgugauuuccagugag

SEQ ID NO: 576854 - RNA, 15 nt, Homo sapiens
cacgugccugugguc

SEQ ID NO: 576855 - RNA, 20 nt, Homo sapiens
cacguggagauagugccagg

SEQ ID NO: 576856 - RNA, 19 nt, Homo sapiens
cacgugucuuccacuuugc

SEQ ID NO: 576857 - RNA, 15 nt, Homo sapiens
cacguuagauuugcc

SEQ ID NO: 576858 - RNA, 15 nt, Homo sapiens
cacguucugcucauc

SEQ ID NO: 576859 - RNA, 21 nt, Homo sapiens
cacguugccaggggcuugaga

SEQ ID NO: 576860 - RNA, 23 nt, Homo sapiens
cacguuucuaaaggcuaccuuug

SEQ ID NO: 576861 - RNA, 14 nt, Homo sapiens
cacguuucuucccc

SEQ ID NO: 576862 - RNA, 21 nt, Homo sapiens
cacuaaaaaguggauuacaaa

SEQ ID NO: 576863 - RNA, 18 nt, Homo sapiens
cacuaaaaggaagacagu

SEQ ID NO: 576864 - RNA, 19 nt, Homo sapiens
cacuaaacucuggggcuug

SEQ ID NO: 576865 - RNA, 15 nt, Homo sapiens
cacuaaauccccuca

SEQ ID NO: 576866 - RNA, 16 nt, Homo sapiens
cacuaacaaacucuga

SEQ ID NO: 576867 - RNA, 12 nt, Homo sapiens
cacuaaccaaug

SEQ ID NO: 576868 - RNA, 12 nt, Homo sapiens
cacuaaugcuuu

SEQ ID NO: 576869 - RNA, 23 nt, Homo sapiens
cacuaaugggaagaccaaaauua

SEQ ID NO: 576870 - RNA, 19 nt, Homo sapiens
cacuaauuuauaacuauua

SEQ ID NO: 576871 - RNA, 15 nt, Homo sapiens
cacuacaacagaauu

SEQ ID NO: 576872 - RNA, 16 nt, Homo sapiens
cacuacaacagaauuu

SEQ ID NO: 576873 - RNA, 18 nt, Homo sapiens
cacuacaugaugacucaa

SEQ ID NO: 576874 - RNA, 20 nt, Homo sapiens
cacuaccaaacacucagucc

SEQ ID NO: 576875 - RNA, 23 nt, Homo sapiens
cacuaccaaauucauuugacuuu

SEQ ID NO: 576876 - RNA, 17 nt, Homo sapiens
cacuaccguaaaugucc

SEQ ID NO: 576877 - RNA, 21 nt, Homo sapiens
cacuaccguaaauguccauuu

SEQ ID NO: 576878 - RNA, 16 nt, Homo sapiens
cacuaccuagagucaa

SEQ ID NO: 576879 - RNA, 15 nt, Homo sapiens
cacuagaaaugcagc

SEQ ID NO: 576880 - RNA, 22 nt, Homo sapiens
cacuagaauauuuaaaacauca

SEQ ID NO: 576881 - RNA, 21 nt, Homo sapiens
cacuagacccacuggacucac

SEQ ID NO: 576882 - RNA, 15 nt, Homo sapiens
cacuaggauugugau

SEQ ID NO: 576883 - RNA, 19 nt, Homo sapiens
cacuagucuguguaacuuu

SEQ ID NO: 576884 - RNA, 16 nt, Homo sapiens
cacuagugcaauucca

SEQ ID NO: 576885 - RNA, 20 nt, Homo sapiens
cacuauaauguaagcucuac

SEQ ID NO: 576886 - RNA, 15 nt, Homo sapiens
cacuauauguuuaca

SEQ ID NO: 576887 - RNA, 22 nt, Homo sapiens
cacuaucugggugcaugaucuu

SEQ ID NO: 576888 - RNA, 21 nt, Homo sapiens
cacuauguuuauuuacuaauu

SEQ ID NO: 576889 - RNA, 23 nt, Homo sapiens
cacuauucuuggaccaugccaga

SEQ ID NO: 576890 - RNA, 20 nt, Homo sapiens
cacuauuucccucuacugag

SEQ ID NO: 576891 - RNA, 17 nt, Homo sapiens
cacucaaaauaugucaa

SEQ ID NO: 576892 - RNA, 19 nt, Homo sapiens
cacucaacugguuugacau

SEQ ID NO: 576893 - RNA, 15 nt, Homo sapiens
cacucaauuucucug

SEQ ID NO: 576894 - RNA, 23 nt, Homo sapiens
cacucaauuucucugaggacaca

SEQ ID NO: 576895 - RNA, 19 nt, Homo sapiens
cacucagcguuugcgggaa

SEQ ID NO: 576896 - RNA, 20 nt, Homo sapiens
cacucagcucuuggcuccac

SEQ ID NO: 576897 - RNA, 21 nt, Homo sapiens
cacucaggccaacaagccaac

SEQ ID NO: 576898 - RNA, 13 nt, Homo sapiens
cacucagguucuu

SEQ ID NO: 576899 - RNA, 22 nt, Homo sapiens
cacucagguucuucagggccag

SEQ ID NO: 576900 - RNA, 12 nt, Homo sapiens
cacucagucucu

SEQ ID NO: 576901 - RNA, 16 nt, Homo sapiens
cacucagugccuccac

SEQ ID NO: 576902 - RNA, 12 nt, Homo sapiens
cacucauuccca

SEQ ID NO: 576903 - RNA, 17 nt, Homo sapiens
cacucauuucaucucau

SEQ ID NO: 576904 - RNA, 20 nt, Homo sapiens
cacucauuuggauugccuua

SEQ ID NO: 576905 - RNA, 15 nt, Homo sapiens
agcucuguuuuacaa

SEQ ID NO: 576906 - RNA, 19 nt, Homo sapiens
agcucuguuuuacaauaaa

SEQ ID NO: 576907 - RNA, 20 nt, Homo sapiens
agcucuuacacuacauuaga

SEQ ID NO: 576908 - RNA, 13 nt, Homo sapiens
agcucuucauuuc

SEQ ID NO: 576909 - RNA, 23 nt, Homo sapiens
agcucuucgguuucugagcauaa

SEQ ID NO: 576910 - RNA, 14 nt, Homo sapiens
agcucuucugggca

SEQ ID NO: 576911 - RNA, 18 nt, Homo sapiens
agcucuuggacaacagcu

SEQ ID NO: 576912 - RNA, 22 nt, Homo sapiens
agcucuuuggaucagucuuugu

SEQ ID NO: 576913 - RNA, 14 nt, Homo sapiens
agcugaaaacauaa

SEQ ID NO: 576914 - RNA, 22 nt, Homo sapiens
agcugaaaacuaauguacugua

SEQ ID NO: 576915 - RNA, 23 nt, Homo sapiens
agcugaaaacuaauguacuguac

SEQ ID NO: 576916 - RNA, 19 nt, Homo sapiens
agcugaaauuuuuguguaa

SEQ ID NO: 576917 - RNA, 13 nt, Homo sapiens
agcugaaccuggg

SEQ ID NO: 576918 - RNA, 14 nt, Homo sapiens
agcugaagaacuug

SEQ ID NO: 576919 - RNA, 23 nt, Homo sapiens
agcugaagaacuuggcacacucu

SEQ ID NO: 576920 - RNA, 14 nt, Homo sapiens
agcugaagcuacag

SEQ ID NO: 576921 - RNA, 19 nt, Homo sapiens
agcugaaggugaggggaug

SEQ ID NO: 576922 - RNA, 18 nt, Homo sapiens
agcuuuacaaauauguca

SEQ ID NO: 576923 - RNA, 16 nt, Homo sapiens
agcuuuacuacugugg

SEQ ID NO: 576924 - RNA, 14 nt, Homo sapiens
agcuuuagcuucau

SEQ ID NO: 576925 - RNA, 20 nt, Homo sapiens
agcuuuauuaccaguggcgu

SEQ ID NO: 576926 - RNA, 14 nt, Homo sapiens
agcuuuauucuuca

SEQ ID NO: 576927 - RNA, 20 nt, Homo sapiens
agcuuuccaaagaaauggaa

SEQ ID NO: 576928 - RNA, 23 nt, Homo sapiens
agcuuuccuuguuagaaugcaag

SEQ ID NO: 576929 - RNA, 21 nt, Homo sapiens
agcuuucuccucauccauuuc

SEQ ID NO: 576930 - RNA, 19 nt, Homo sapiens
agcuuucucgcgcccuccc

SEQ ID NO: 576931 - RNA, 13 nt, Homo sapiens
agcuuucucucag

SEQ ID NO: 576932 - RNA, 23 nt, Homo sapiens
agcuuugcaaaaugagacuuucu

SEQ ID NO: 576933 - RNA, 19 nt, Homo sapiens
agcuuugccagcugcugcu

SEQ ID NO: 576934 - RNA, 15 nt, Homo sapiens
agcuuuggaccuaau

SEQ ID NO: 576935 - RNA, 19 nt, Homo sapiens
agcuuuggaccuaauccaa

SEQ ID NO: 576936 - RNA, 18 nt, Homo sapiens
agcuuugguaaucucugu

SEQ ID NO: 576937 - RNA, 19 nt, Homo sapiens
agcuuuguuucaauaucac

SEQ ID NO: 576938 - RNA, 20 nt, Homo sapiens
agcuuuuagaaaaugcaguc

SEQ ID NO: 576939 - RNA, 21 nt, Homo sapiens
agcuuuuagaaaaugcaguca

SEQ ID NO: 576940 - RNA, 20 nt, Homo sapiens
agcuuuuagaaauacugcaa

SEQ ID NO: 576941 - RNA, 14 nt, Homo sapiens
agcuuuuccugcau

SEQ ID NO: 576942 - RNA, 23 nt, Homo sapiens
agcuuuugaggggcugacuucaa

SEQ ID NO: 576943 - RNA, 17 nt, Homo sapiens
aggaaaaaaaaacagcc

SEQ ID NO: 576944 - RNA, 19 nt, Homo sapiens
aggaaaaaauaaaagaucu

SEQ ID NO: 576945 - RNA, 19 nt, Homo sapiens
aggaaaacacuauuuccaa

SEQ ID NO: 576946 - RNA, 22 nt, Homo sapiens
aggaaaacacuauuuccaaaag

SEQ ID NO: 576947 - RNA, 15 nt, Homo sapiens
aggaaaacugggaca

SEQ ID NO: 576948 - RNA, 16 nt, Homo sapiens
aggaaaacugggacau

SEQ ID NO: 576949 - RNA, 15 nt, Homo sapiens
aggaaaagauguaug

SEQ ID NO: 576950 - RNA, 19 nt, Homo sapiens
aggaaaagcggacaucagc

SEQ ID NO: 576951 - RNA, 17 nt, Homo sapiens
aggaaaauaaacugaca

SEQ ID NO: 576952 - RNA, 20 nt, Homo sapiens
aggaaaaugccaugaaaauu

SEQ ID NO: 576953 - RNA, 13 nt, Homo sapiens
aggaaaaugggua

SEQ ID NO: 576954 - RNA, 23 nt, Homo sapiens
aggaaaaugugcacacauauaca

SEQ ID NO: 576955 - RNA, 15 nt, Homo sapiens
aggaaaauuucacau

SEQ ID NO: 576956 - RNA, 13 nt, Homo sapiens
aggaaacaacacc

SEQ ID NO: 576957 - RNA, 13 nt, Homo sapiens
aggaaacaacagc

SEQ ID NO: 576958 - RNA, 13 nt, Homo sapiens
aggaaacaauaua

SEQ ID NO: 576959 - RNA, 14 nt, Homo sapiens
aggaaacaauauaa

SEQ ID NO: 576960 - RNA, 13 nt, Homo sapiens
aggaaacaguucu

SEQ ID NO: 576961 - RNA, 12 nt, Homo sapiens
aggaaaccacaa

SEQ ID NO: 576962 - RNA, 13 nt, Homo sapiens
aggaaacgaugaa

SEQ ID NO: 576963 - RNA, 22 nt, Homo sapiens
aggaaacuaauuuccugauaca

SEQ ID NO: 576964 - RNA, 12 nt, Homo sapiens
aggaaacuugca

SEQ ID NO: 576965 - RNA, 22 nt, Homo sapiens
aggaaacuugcauacagagaca

SEQ ID NO: 576966 - RNA, 16 nt, Homo sapiens
aggaaagaagcauuuc

SEQ ID NO: 576967 - RNA, 13 nt, Homo sapiens
aggaaagcaauaa

SEQ ID NO: 576968 - RNA, 23 nt, Homo sapiens
aggaaaggaugguagauucuguu

SEQ ID NO: 576969 - RNA, 16 nt, Homo sapiens
aggaaaggauuuuacc

SEQ ID NO: 576970 - RNA, 18 nt, Homo sapiens
aggaaagggauaguccaa

SEQ ID NO: 576971 - RNA, 14 nt, Homo sapiens
aggaaagugguugu

SEQ ID NO: 576972 - RNA, 23 nt, Homo sapiens
aggaaauaguaccuucaauacuu

SEQ ID NO: 576973 - RNA, 18 nt, Homo sapiens
aggaaauauauaugugug

SEQ ID NO: 576974 - RNA, 23 nt, Homo sapiens
aggaaauuacugcccacuuguca

SEQ ID NO: 576975 - RNA, 15 nt, Homo sapiens
aggaacaaacagggc

SEQ ID NO: 576976 - RNA, 21 nt, Homo sapiens
aggaacaacagcaucuuucac

SEQ ID NO: 576977 - RNA, 13 nt, Homo sapiens
aggaacacuggcu

SEQ ID NO: 576978 - RNA, 16 nt, Homo sapiens
aggaacagcaauggug

SEQ ID NO: 576979 - RNA, 13 nt, Homo sapiens
aggaacagcacug

SEQ ID NO: 576980 - RNA, 22 nt, Homo sapiens
aggaacagugugguuugggaaa

SEQ ID NO: 576981 - RNA, 21 nt, Homo sapiens
aggaaccacauauaacacuua

SEQ ID NO: 576982 - RNA, 12 nt, Homo sapiens
aggaacccucag

SEQ ID NO: 576983 - RNA, 19 nt, Homo sapiens
aggaacccuccuccuguca

SEQ ID NO: 576984 - RNA, 12 nt, Homo sapiens
aggaaccuacca

SEQ ID NO: 576985 - RNA, 16 nt, Homo sapiens
aggaaccucucgccau

SEQ ID NO: 576986 - RNA, 19 nt, Homo sapiens
aggaaccucucgccaugau

SEQ ID NO: 576987 - RNA, 20 nt, Homo sapiens
aggaacguugccacaccaau

SEQ ID NO: 576988 - RNA, 17 nt, Homo sapiens
aggaacuagaaagaagg

SEQ ID NO: 576989 - RNA, 14 nt, Homo sapiens
aggaacugcaauaa

SEQ ID NO: 576990 - RNA, 14 nt, Homo sapiens
aggaacuugaauac

SEQ ID NO: 576991 - RNA, 18 nt, Homo sapiens
aggaagaaaagcugccau

SEQ ID NO: 576992 - RNA, 23 nt, Homo sapiens
aggaagaagucuaagagugaagu

SEQ ID NO: 576993 - RNA, 15 nt, Homo sapiens
aggaagaaugaaacu

SEQ ID NO: 576994 - RNA, 22 nt, Homo sapiens
aggaagaccaagacacagauca

SEQ ID NO: 576995 - RNA, 15 nt, Homo sapiens
aggaagagucucuaa

SEQ ID NO: 576996 - RNA, 14 nt, Homo sapiens
aggaagcacugaaa

SEQ ID NO: 576997 - RNA, 18 nt, Homo sapiens
aggaagccgccaguacuu

SEQ ID NO: 576998 - RNA, 22 nt, Homo sapiens
aggaagcuuggggaacccauga

SEQ ID NO: 576999 - RNA, 23 nt, Homo sapiens
aggaaggaaauaaucaucuaaga

SEQ ID NO: 577000 - RNA, 21 nt, Homo sapiens
aggaaggaacagcaauggugu

SEQ ID NO: 577001 - RNA, 23 nt, Homo sapiens
aggaaggaagcuguugcuuucuu

SEQ ID NO: 577002 - RNA, 14 nt, Homo sapiens
aggaaggacugucc

SEQ ID NO: 577003 - RNA, 22 nt, Homo sapiens
aggaaggacuuacccaguauua

SEQ ID NO: 577004 - RNA, 15 nt, Homo sapiens
aggaaggaggaccca

SEQ ID NO: 577005 - RNA, 15 nt, Homo sapiens
aggaaggcagcugcu

SEQ ID NO: 577006 - RNA, 15 nt, Homo sapiens
aggaagggagaacuu

SEQ ID NO: 577007 - RNA, 17 nt, Homo sapiens
aggaaggugacugugug

SEQ ID NO: 577008 - RNA, 17 nt, Homo sapiens
aggaaguagaccucuuu

SEQ ID NO: 577009 - RNA, 15 nt, Homo sapiens
aggaaguauggcaaa

SEQ ID NO: 577010 - RNA, 17 nt, Homo sapiens
aggaagucccuugccau

SEQ ID NO: 577011 - RNA, 17 nt, Homo sapiens
aggaaguucaacuucca

SEQ ID NO: 577012 - RNA, 12 nt, Homo sapiens
aggaaguucucc

SEQ ID NO: 577013 - RNA, 16 nt, Homo sapiens
aggaaguucuccagcu

SEQ ID NO: 577014 - RNA, 15 nt, Homo sapiens
aggaauaugggagaa

SEQ ID NO: 577015 - RNA, 18 nt, Homo sapiens
aggaaucaaauuuugcca

SEQ ID NO: 577016 - RNA, 17 nt, Homo sapiens
aggaauccccaacaugc

SEQ ID NO: 577017 - RNA, 21 nt, Homo sapiens
aggaaugcuuccgagacacca

SEQ ID NO: 577018 - RNA, 17 nt, Homo sapiens
aggaauuaaauaaugua

SEQ ID NO: 577019 - RNA, 22 nt, Homo sapiens
aggaauuacgugcucugugggu

SEQ ID NO: 577020 - RNA, 22 nt, Homo sapiens
aggaauuaugucguaagucacu

SEQ ID NO: 577021 - RNA, 19 nt, Homo sapiens
aggaauucaauuuggcaaa

SEQ ID NO: 577022 - RNA, 22 nt, Homo sapiens
aggaauucuaaauaaauuuccc

SEQ ID NO: 577023 - RNA, 16 nt, Homo sapiens
aggaauucuaggcauc

SEQ ID NO: 577024 - RNA, 16 nt, Homo sapiens
aggaauuugcauuuag

SEQ ID NO: 577025 - RNA, 16 nt, Homo sapiens
aggaauuuugucucac

SEQ ID NO: 577026 - RNA, 23 nt, Homo sapiens
aggaauuuuuuuaacuuaaggga

SEQ ID NO: 577027 - RNA, 12 nt, Homo sapiens
aggacaaagccu

SEQ ID NO: 577028 - RNA, 20 nt, Homo sapiens
aggacaaauugcgcccauuu

SEQ ID NO: 577029 - RNA, 18 nt, Homo sapiens
aggacaaccauuccagac

SEQ ID NO: 577030 - RNA, 22 nt, Homo sapiens
cacuuaaacuugcaucacuuaa

SEQ ID NO: 577031 - RNA, 17 nt, Homo sapiens
cacuuaagacuguguau

SEQ ID NO: 577032 - RNA, 14 nt, Homo sapiens
cacuuacagaauua

SEQ ID NO: 577033 - RNA, 19 nt, Homo sapiens
cacuuacauuuacaaacug

SEQ ID NO: 577034 - RNA, 20 nt, Homo sapiens
cacuuagaauccgaagggaa

SEQ ID NO: 577035 - RNA, 14 nt, Homo sapiens
cacuuaguaguuuu

SEQ ID NO: 577036 - RNA, 15 nt, Homo sapiens
cacuuaguaugcagu

SEQ ID NO: 577037 - RNA, 23 nt, Homo sapiens
cacuuauaagaaagaucaaagac

SEQ ID NO: 577038 - RNA, 20 nt, Homo sapiens
cacuuauacccaugaacuua

SEQ ID NO: 577039 - RNA, 17 nt, Homo sapiens
cacuuaucccaagagaa

SEQ ID NO: 577040 - RNA, 17 nt, Homo sapiens
cacuucagaauuccaua

SEQ ID NO: 577041 - RNA, 13 nt, Homo sapiens
cacuucauaucca

SEQ ID NO: 577042 - RNA, 23 nt, Homo sapiens
cacuuccagagccagaaagggug

SEQ ID NO: 577043 - RNA, 15 nt, Homo sapiens
aggaacagcacuggg

SEQ ID NO: 577044 - RNA, 15 nt, Homo sapiens
aggaacaggacugca

SEQ ID NO: 577045 - RNA, 18 nt, Homo sapiens
aggaacaggacugcaaaa

SEQ ID NO: 577046 - RNA, 13 nt, Homo sapiens
aggaacauacaga

SEQ ID NO: 577047 - RNA, 21 nt, Homo sapiens
aggaacaucucugcuuucacu

SEQ ID NO: 577048 - RNA, 18 nt, Homo sapiens
aggaaccagagugcugaa

SEQ ID NO: 577049 - RNA, 16 nt, Homo sapiens
aggaaccccaggagau

SEQ ID NO: 577050 - RNA, 13 nt, Homo sapiens
aggaaccuuccuu

SEQ ID NO: 577051 - RNA, 23 nt, Homo sapiens
aggaacuauguucacaagaacaa

SEQ ID NO: 577052 - RNA, 17 nt, Homo sapiens
aggaacucacauacuga

SEQ ID NO: 577053 - RNA, 23 nt, Homo sapiens
aggaacugcaauaauaucaaaac

SEQ ID NO: 577054 - RNA, 19 nt, Homo sapiens
aggaacuuuuaaaagauua

SEQ ID NO: 577055 - RNA, 22 nt, Homo sapiens
aggaagaaauucagguacagaa

SEQ ID NO: 577056 - RNA, 18 nt, Homo sapiens
aggaagaagauagaucca

SEQ ID NO: 577057 - RNA, 18 nt, Homo sapiens
aggaagacccugccauuc

SEQ ID NO: 577058 - RNA, 20 nt, Homo sapiens
aggaagacuugaagcacaga

SEQ ID NO: 577059 - RNA, 14 nt, Homo sapiens
aggaagagccagga

SEQ ID NO: 577060 - RNA, 20 nt, Homo sapiens
aggaagagccaggacaugaa

SEQ ID NO: 577061 - RNA, 15 nt, Homo sapiens
aggaagauggagguu

SEQ ID NO: 577062 - RNA, 12 nt, Homo sapiens
aggaagcacagc

SEQ ID NO: 577063 - RNA, 14 nt, Homo sapiens
aggaagcauucaga

SEQ ID NO: 577064 - RNA, 12 nt, Homo sapiens
aggaagccaaag

SEQ ID NO: 577065 - RNA, 19 nt, Homo sapiens
aggaagccggugucccugg

SEQ ID NO: 577066 - RNA, 17 nt, Homo sapiens
aggaagcuccacuguca

SEQ ID NO: 577067 - RNA, 19 nt, Homo sapiens
aggaagcuccacugucacc

SEQ ID NO: 577068 - RNA, 14 nt, Homo sapiens
aggaagcuuggcuu

SEQ ID NO: 577069 - RNA, 13 nt, Homo sapiens
aggaaggacuuga

SEQ ID NO: 577070 - RNA, 16 nt, Homo sapiens
aggaaggcuacuugag

SEQ ID NO: 577071 - RNA, 15 nt, Homo sapiens
aggaaggcucuguca

SEQ ID NO: 577072 - RNA, 17 nt, Homo sapiens
aggaaggggccucagga

SEQ ID NO: 577073 - RNA, 14 nt, Homo sapiens
aggaaguacuucca

SEQ ID NO: 577074 - RNA, 14 nt, Homo sapiens
aggaaguauggcaa

SEQ ID NO: 577075 - RNA, 21 nt, Homo sapiens
aggaaguguaguugacugaaa

SEQ ID NO: 577076 - RNA, 22 nt, Homo sapiens
aggaaguugacuuauaguacau

SEQ ID NO: 577077 - RNA, 15 nt, Homo sapiens
aggaauacugaacau

SEQ ID NO: 577078 - RNA, 20 nt, Homo sapiens
aggaauauaugugugccuau

SEQ ID NO: 577079 - RNA, 17 nt, Homo sapiens
aggaauaugggagaaau

SEQ ID NO: 577080 - RNA, 13 nt, Homo sapiens
aggaaucaccaau

SEQ ID NO: 577081 - RNA, 12 nt, Homo sapiens
aggaaucauucc

SEQ ID NO: 577082 - RNA, 21 nt, Homo sapiens
aggaaucauuccagugcuaga

SEQ ID NO: 577083 - RNA, 19 nt, Homo sapiens
aggaauccaaaagacaaaa

SEQ ID NO: 577084 - RNA, 15 nt, Homo sapiens
aggaaucugccuucc

SEQ ID NO: 577085 - RNA, 13 nt, Homo sapiens
aggaaugacaaua

SEQ ID NO: 577086 - RNA, 22 nt, Homo sapiens
aggaaugacuuggguuuaacaa

SEQ ID NO: 577087 - RNA, 13 nt, Homo sapiens
aggaauguagggc

SEQ ID NO: 577088 - RNA, 18 nt, Homo sapiens
aggaauuauagaccucua

SEQ ID NO: 577089 - RNA, 18 nt, Homo sapiens
aggaauucuucuguucuc

SEQ ID NO: 577090 - RNA, 18 nt, Homo sapiens
aggaauugguaaggccuc

SEQ ID NO: 577091 - RNA, 18 nt, Homo sapiens
aggaauuucaagaagugu

SEQ ID NO: 577092 - RNA, 17 nt, Homo sapiens
aggaauuugcauuuagu

SEQ ID NO: 577093 - RNA, 21 nt, Homo sapiens
aggacaaccauuccagacugc

SEQ ID NO: 577094 - RNA, 18 nt, Homo sapiens
aggacaagaggagcauga

SEQ ID NO: 577095 - RNA, 21 nt, Homo sapiens
aggacaagggaaaugucaggg

SEQ ID NO: 577096 - RNA, 15 nt, Homo sapiens
aggacacauggauuu

SEQ ID NO: 577097 - RNA, 18 nt, Homo sapiens
aggacaccuuuuaacuca

SEQ ID NO: 577098 - RNA, 22 nt, Homo sapiens
aggacaccuuuuaacucaccuc

SEQ ID NO: 577099 - RNA, 16 nt, Homo sapiens
aggacacgaacuggaa

SEQ ID NO: 577100 - RNA, 16 nt, Homo sapiens
aggacagaaagaucuu

SEQ ID NO: 577101 - RNA, 15 nt, Homo sapiens
aggacaguggaugcu

SEQ ID NO: 577102 - RNA, 19 nt, Homo sapiens
aggacaguggcacaaucau

SEQ ID NO: 577103 - RNA, 14 nt, Homo sapiens
aggacaucagcaaa

SEQ ID NO: 577104 - RNA, 14 nt, Homo sapiens
aggaccaauugacu

SEQ ID NO: 577105 - RNA, 19 nt, Homo sapiens
aggaccaauugacucucac

SEQ ID NO: 577106 - RNA, 13 nt, Homo sapiens
aggaccacagugg

SEQ ID NO: 577107 - RNA, 16 nt, Homo sapiens
aggacccugggaccac

SEQ ID NO: 577108 - RNA, 15 nt, Homo sapiens
aggacccuguccugc

SEQ ID NO: 577109 - RNA, 18 nt, Homo sapiens
aggaccuuggaagagcaa

SEQ ID NO: 577110 - RNA, 20 nt, Homo sapiens
aggacgaauuugcacaguga

SEQ ID NO: 577111 - RNA, 20 nt, Homo sapiens
aggacgcugaccguggagcu

SEQ ID NO: 577112 - RNA, 23 nt, Homo sapiens
aggacggaguggggggacagaga

SEQ ID NO: 577113 - RNA, 19 nt, Homo sapiens
aggacggcccugccugccu

SEQ ID NO: 577114 - RNA, 18 nt, Homo sapiens
aggacgguuaacuuguau

SEQ ID NO: 577115 - RNA, 21 nt, Homo sapiens
aggacgguuaacuuguauauu

SEQ ID NO: 577116 - RNA, 20 nt, Homo sapiens
aggacguguuacccacugcc

SEQ ID NO: 577117 - RNA, 13 nt, Homo sapiens
aggacuaggcaug

SEQ ID NO: 577118 - RNA, 17 nt, Homo sapiens
aggacuauagcccaggu

SEQ ID NO: 577119 - RNA, 14 nt, Homo sapiens
aggacuauucccuu

SEQ ID NO: 577120 - RNA, 13 nt, Homo sapiens
aggacucacccuc

SEQ ID NO: 577121 - RNA, 22 nt, Homo sapiens
aggacucacccuccacaaagca

SEQ ID NO: 577122 - RNA, 19 nt, Homo sapiens
aggacucccuccucaccuc

SEQ ID NO: 577123 - RNA, 22 nt, Homo sapiens
aggacucccucuaaguggaaua

SEQ ID NO: 577124 - RNA, 15 nt, Homo sapiens
aggacucugcuuaaa

SEQ ID NO: 577125 - RNA, 16 nt, Homo sapiens
aggacugaacuccauc

SEQ ID NO: 577126 - RNA, 14 nt, Homo sapiens
aggacugcauuguu

SEQ ID NO: 577127 - RNA, 21 nt, Homo sapiens
aggacuguuuuauaaacugcu

SEQ ID NO: 577128 - RNA, 20 nt, Homo sapiens
aggacuuaacggcuccagga

SEQ ID NO: 577129 - RNA, 16 nt, Homo sapiens
aggacuuccauuugcu

SEQ ID NO: 577130 - RNA, 13 nt, Homo sapiens
aggacuucuggca

SEQ ID NO: 577131 - RNA, 19 nt, Homo sapiens
aggacuugugucucugugc

SEQ ID NO: 577132 - RNA, 22 nt, Homo sapiens
aggagaaaacaauuccuuagaa

SEQ ID NO: 577133 - RNA, 13 nt, Homo sapiens
aggagaaacacau

SEQ ID NO: 577134 - RNA, 20 nt, Homo sapiens
aggagaaacucccauguaug

SEQ ID NO: 577135 - RNA, 21 nt, Homo sapiens
aggagaacaucauaacccaug

SEQ ID NO: 577136 - RNA, 21 nt, Homo sapiens
aggagaaccacuacaugcagc

SEQ ID NO: 577137 - RNA, 15 nt, Homo sapiens
aggagaagcaauggg

SEQ ID NO: 577138 - RNA, 23 nt, Homo sapiens
aggagaagggggcucugccccag

SEQ ID NO: 577139 - RNA, 15 nt, Homo sapiens
aggagaauaugauaa

SEQ ID NO: 577140 - RNA, 18 nt, Homo sapiens
aggagaaugaaauguaug

SEQ ID NO: 577141 - RNA, 22 nt, Homo sapiens
aggagaaugaaauguaugugcu

SEQ ID NO: 577142 - RNA, 22 nt, Homo sapiens
aggagaauugaauucuggaaac

SEQ ID NO: 577143 - RNA, 19 nt, Homo sapiens
aggagacaagaaauccagu

SEQ ID NO: 577144 - RNA, 16 nt, Homo sapiens
aggagacagaccacuu

SEQ ID NO: 577145 - RNA, 13 nt, Homo sapiens
aggagacagauca

SEQ ID NO: 577146 - RNA, 14 nt, Homo sapiens
aguaugggaucuga

SEQ ID NO: 577147 - RNA, 13 nt, Homo sapiens
aguaugguauaug

SEQ ID NO: 577148 - RNA, 18 nt, Homo sapiens
aguauggugaaacccugu

SEQ ID NO: 577149 - RNA, 14 nt, Homo sapiens
aguauguacuucag

SEQ ID NO: 577150 - RNA, 22 nt, Homo sapiens
aguauguauuauuuacauuuaa

SEQ ID NO: 577151 - RNA, 17 nt, Homo sapiens
aguauguuaagcucuuu

SEQ ID NO: 577152 - RNA, 16 nt, Homo sapiens
aguauuacugcugcug

SEQ ID NO: 577153 - RNA, 19 nt, Homo sapiens
aguauuagaugcacuuaag

SEQ ID NO: 577154 - RNA, 18 nt, Homo sapiens
aguauuauugagcucuau

SEQ ID NO: 577155 - RNA, 18 nt, Homo sapiens
aguauuauuuuacaauca

SEQ ID NO: 577156 - RNA, 23 nt, Homo sapiens
aguauuccaugguguauaugugc

SEQ ID NO: 577157 - RNA, 12 nt, Homo sapiens
aguauuccauuu

SEQ ID NO: 577158 - RNA, 15 nt, Homo sapiens
aguauugcagccaaa

SEQ ID NO: 577159 - RNA, 20 nt, Homo sapiens
aguauugccaccucuggcca

SEQ ID NO: 577160 - RNA, 18 nt, Homo sapiens
aguauuggaagacuuggg

SEQ ID NO: 577161 - RNA, 15 nt, Homo sapiens
aguauuguggcugca

SEQ ID NO: 577162 - RNA, 21 nt, Homo sapiens
aguauuguuuccugagcauaa

SEQ ID NO: 577163 - RNA, 21 nt, Homo sapiens
aguauuuaacuacaucugccu

SEQ ID NO: 577164 - RNA, 22 nt, Homo sapiens
aguauuuauugcaggauggugu

SEQ ID NO: 577165 - RNA, 14 nt, Homo sapiens
aguauuuauuguca

SEQ ID NO: 577166 - RNA, 22 nt, Homo sapiens
aguauuugcugaauggggaccu

SEQ ID NO: 577167 - RNA, 23 nt, Homo sapiens
aguauuugggaagugaagacugg

SEQ ID NO: 577168 - RNA, 14 nt, Homo sapiens
aguauuuuugccaa

SEQ ID NO: 577169 - RNA, 18 nt, Homo sapiens
agucaaagaugccccauu

SEQ ID NO: 577170 - RNA, 17 nt, Homo sapiens
agucaaagcaggauuau

SEQ ID NO: 577171 - RNA, 13 nt, Homo sapiens
agucaacaguauc

SEQ ID NO: 577172 - RNA, 17 nt, Homo sapiens
agucaacaguaucugug

SEQ ID NO: 577173 - RNA, 21 nt, Homo sapiens
agucaaccugccugacauuug

SEQ ID NO: 577174 - RNA, 21 nt, Homo sapiens
agucaaccuuguuucuacugu

SEQ ID NO: 577175 - RNA, 18 nt, Homo sapiens
agucaacucaacauggca

SEQ ID NO: 577176 - RNA, 20 nt, Homo sapiens
agucaauggcuuguucauca

SEQ ID NO: 577177 - RNA, 16 nt, Homo sapiens
aauuuaagaaacuuau

SEQ ID NO: 577178 - RNA, 20 nt, Homo sapiens
aauuuaagaauuugugacau

SEQ ID NO: 577179 - RNA, 18 nt, Homo sapiens
aauuuaauggacugugaa

SEQ ID NO: 577180 - RNA, 14 nt, Homo sapiens
aauuuaauuccucu

SEQ ID NO: 577181 - RNA, 21 nt, Homo sapiens
aauuuaauuucuucaugugau

SEQ ID NO: 577182 - RNA, 15 nt, Homo sapiens
aauuuaauuuugcag

SEQ ID NO: 577183 - RNA, 19 nt, Homo sapiens
aauuuaauuuugcaggauu

SEQ ID NO: 577184 - RNA, 16 nt, Homo sapiens
aauuuacgaaaccaaa

SEQ ID NO: 577185 - RNA, 12 nt, Homo sapiens
aauuuacuugau

SEQ ID NO: 577186 - RNA, 18 nt, Homo sapiens
aauuuagaccccauacaa

SEQ ID NO: 577187 - RNA, 15 nt, Homo sapiens
aauuuagucacacca

SEQ ID NO: 577188 - RNA, 21 nt, Homo sapiens
aauuuauaucagguguauaaa

SEQ ID NO: 577189 - RNA, 20 nt, Homo sapiens
aauuuaucaaacccuagccu

SEQ ID NO: 577190 - RNA, 16 nt, Homo sapiens
aauuuauccauucaau

SEQ ID NO: 577191 - RNA, 20 nt, Homo sapiens
aauuuaucuugucucugggc

SEQ ID NO: 577192 - RNA, 11 nt, Homo sapiens
aauuuaugcaa

SEQ ID NO: 577193 - RNA, 21 nt, Homo sapiens
aauuuaugggagaauugcaca

SEQ ID NO: 577194 - RNA, 16 nt, Homo sapiens
aauuuauuacugaaaa

SEQ ID NO: 577195 - RNA, 16 nt, Homo sapiens
aauuuauucacauaua

SEQ ID NO: 577196 - RNA, 14 nt, Homo sapiens
aauuuauucuuggu

SEQ ID NO: 577197 - RNA, 22 nt, Homo sapiens
aauuuauugauguugugaaauc

SEQ ID NO: 577198 - RNA, 20 nt, Homo sapiens
aauuuauuucaaaaagggaa

SEQ ID NO: 577199 - RNA, 21 nt, Homo sapiens
aauuuauuuccaauguuucaa

SEQ ID NO: 577200 - RNA, 15 nt, Homo sapiens
aauuucaacauguau

SEQ ID NO: 577201 - RNA, 22 nt, Homo sapiens
aauuucacgcuuuuaauucuca

SEQ ID NO: 577202 - RNA, 17 nt, Homo sapiens
aauuucagaaccaaaag

SEQ ID NO: 577203 - RNA, 15 nt, Homo sapiens
aauuucagggugcag

SEQ ID NO: 577204 - RNA, 20 nt, Homo sapiens
aauuucauagcuguacuucu

SEQ ID NO: 577205 - RNA, 23 nt, Homo sapiens
aauuucauuucagccacuucugc

SEQ ID NO: 577206 - RNA, 17 nt, Homo sapiens
aauuucauuuccauuua

SEQ ID NO: 577207 - RNA, 22 nt, Homo sapiens
aauuuccaaagcagccugugaa

SEQ ID NO: 577208 - RNA, 15 nt, Homo sapiens
aauuuccacuuuauu

SEQ ID NO: 577209 - RNA, 15 nt, Homo sapiens
aauuucccccuaaac

SEQ ID NO: 577210 - RNA, 20 nt, Homo sapiens
aauuucuaccagaugugcuu

SEQ ID NO: 577211 - RNA, 15 nt, Homo sapiens
aauuucucauacuua

SEQ ID NO: 577212 - RNA, 17 nt, Homo sapiens
aauuucugccuuucccc

SEQ ID NO: 577213 - RNA, 19 nt, Homo sapiens
aauuucuggaaaacugccu

SEQ ID NO: 577214 - RNA, 21 nt, Homo sapiens
aauuucuuccuuccacaguua

SEQ ID NO: 577215 - RNA, 19 nt, Homo sapiens
aauuucuucuuuuccugca

SEQ ID NO: 577216 - RNA, 20 nt, Homo sapiens
aauuucuuuaaauaaaaccc

SEQ ID NO: 577217 - RNA, 14 nt, Homo sapiens
aauuugaauguggu

SEQ ID NO: 577218 - RNA, 15 nt, Homo sapiens
aauuugacaaaaccc

SEQ ID NO: 577219 - RNA, 13 nt, Homo sapiens
aauuugacauaca

SEQ ID NO: 577220 - RNA, 19 nt, Homo sapiens
aauuugacccuaaaaucua

SEQ ID NO: 577221 - RNA, 17 nt, Homo sapiens
aauuugacugugcauga

SEQ ID NO: 577222 - RNA, 23 nt, Homo sapiens
aauuugagaaccuuggaccacuc

SEQ ID NO: 577223 - RNA, 21 nt, Homo sapiens
aauuugauguuuacaggugga

SEQ ID NO: 577224 - RNA, 23 nt, Homo sapiens
aauuugcaacaguaaucagaguu

SEQ ID NO: 577225 - RNA, 11 nt, Homo sapiens
aauuugcaccu

SEQ ID NO: 577226 - RNA, 13 nt, Homo sapiens
aauuugcacugaa

SEQ ID NO: 577227 - RNA, 15 nt, Homo sapiens
aauuugccaccacua

SEQ ID NO: 577228 - RNA, 13 nt, Homo sapiens
aauuuggaguaaa

SEQ ID NO: 577229 - RNA, 14 nt, Homo sapiens
aauuuggagucuga

SEQ ID NO: 577230 - RNA, 20 nt, Homo sapiens
aauuugggagagccauacau

SEQ ID NO: 577231 - RNA, 14 nt, Homo sapiens
aauuuguaagcaaa

SEQ ID NO: 577232 - RNA, 21 nt, Homo sapiens
aauuuguaagcaacuugcuuc

SEQ ID NO: 577233 - RNA, 19 nt, Homo sapiens
aauuuguaauugcuuacau

SEQ ID NO: 577234 - RNA, 15 nt, Homo sapiens
aauuuguacuucuua

SEQ ID NO: 577235 - RNA, 18 nt, Homo sapiens
aauuugugccacuuuaau

SEQ ID NO: 577236 - RNA, 21 nt, Homo sapiens
aauuugugugcuucugcucau

SEQ ID NO: 577237 - RNA, 22 nt, Homo sapiens
aauuuguguguuuuuagcugug

SEQ ID NO: 577238 - RNA, 20 nt, Homo sapiens
aauuuuaaaaagucaauuca

SEQ ID NO: 577239 - RNA, 16 nt, Homo sapiens
aauuuuaaacauaucc

SEQ ID NO: 577240 - RNA, 17 nt, Homo sapiens
aauuuuaaauguucaca

SEQ ID NO: 577241 - RNA, 16 nt, Homo sapiens
aauuuuaagaauuuca

SEQ ID NO: 577242 - RNA, 18 nt, Homo sapiens
aauuuuaaguacuuugcu

SEQ ID NO: 577243 - RNA, 13 nt, Homo sapiens
aauuuuaauugau

SEQ ID NO: 577244 - RNA, 12 nt, Homo sapiens
aauuuuacccuu

SEQ ID NO: 577245 - RNA, 13 nt, Homo sapiens
aauuuuagucacu

SEQ ID NO: 577246 - RNA, 23 nt, Homo sapiens
aauuuucagcagagaccuuccaa

SEQ ID NO: 577247 - RNA, 20 nt, Homo sapiens
aauuuucauuaaacuugaag

SEQ ID NO: 577248 - RNA, 18 nt, Homo sapiens
aauuuucauucauucacu

SEQ ID NO: 577249 - RNA, 22 nt, Homo sapiens
aauuuucuuccuuugaagcuuu

SEQ ID NO: 577250 - RNA, 13 nt, Homo sapiens
aauuuucuuucac

SEQ ID NO: 577251 - RNA, 20 nt, Homo sapiens
aauuuugaguauuccaugag

SEQ ID NO: 577252 - RNA, 20 nt, Homo sapiens
aauuuugauauaaucuuuca

SEQ ID NO: 577253 - RNA, 15 nt, Homo sapiens
aauuuugccaaauaa

SEQ ID NO: 577254 - RNA, 16 nt, Homo sapiens
aauuuugcuugcugaa

SEQ ID NO: 577255 - RNA, 17 nt, Homo sapiens
aauuuugcuugcugaag

SEQ ID NO: 577256 - RNA, 20 nt, Homo sapiens
aauuuugguuuaugacucuu

SEQ ID NO: 577257 - RNA, 17 nt, Homo sapiens
aauuuuguucucuggga

SEQ ID NO: 577258 - RNA, 20 nt, Homo sapiens
aauuuuguucucugggagaa

SEQ ID NO: 577259 - RNA, 20 nt, Homo sapiens
aauuuuguuuaaaacucaga

SEQ ID NO: 577260 - RNA, 17 nt, Homo sapiens
aauuuuuaagcugcaaa

SEQ ID NO: 577261 - RNA, 15 nt, Homo sapiens
aauuuuuacauggag

SEQ ID NO: 577262 - RNA, 19 nt, Homo sapiens
aauuuuucagcuccuucaa

SEQ ID NO: 577263 - RNA, 12 nt, Homo sapiens
aauuuuucuucc

SEQ ID NO: 577264 - RNA, 20 nt, Homo sapiens
aauuuuugaacaacuguugg

SEQ ID NO: 577265 - RNA, 21 nt, Homo sapiens
aauuuuuuaaaguuacuuugu

SEQ ID NO: 577266 - RNA, 21 nt, Homo sapiens
aauuuuuuaguauaaguacau

SEQ ID NO: 577267 - RNA, 11 nt, Homo sapiens
acaacuuccuc

SEQ ID NO: 577268 - RNA, 19 nt, Homo sapiens
acaacuuggguucuucuca

SEQ ID NO: 577269 - RNA, 22 nt, Homo sapiens
acaacuugucacccaaagccug

SEQ ID NO: 577270 - RNA, 16 nt, Homo sapiens
acaagaagaccagacu

SEQ ID NO: 577271 - RNA, 22 nt, Homo sapiens
acaagaagccacagaccuagga

SEQ ID NO: 577272 - RNA, 23 nt, Homo sapiens
acaagaaucuagaaaaucagauc

SEQ ID NO: 577273 - RNA, 22 nt, Homo sapiens
acaagaauuucuugguaagaag

SEQ ID NO: 577274 - RNA, 15 nt, Homo sapiens
acaagaccaccacuu

SEQ ID NO: 577275 - RNA, 19 nt, Homo sapiens
acaagacccccagcacuug

SEQ ID NO: 577276 - RNA, 18 nt, Homo sapiens
acaagaguugucuugucc

SEQ ID NO: 577277 - RNA, 17 nt, Homo sapiens
acaagauaacugagaau

SEQ ID NO: 577278 - RNA, 20 nt, Homo sapiens
acaagauccuccugcugcag

SEQ ID NO: 577279 - RNA, 12 nt, Homo sapiens
acaagauuagaa

SEQ ID NO: 577280 - RNA, 12 nt, Homo sapiens
acaagauuuaug

SEQ ID NO: 577281 - RNA, 15 nt, Homo sapiens
acaagcaaccaaugg

SEQ ID NO: 577282 - RNA, 13 nt, Homo sapiens
acaagccaaagag

SEQ ID NO: 577283 - RNA, 18 nt, Homo sapiens
acaagcccccccuuccac

SEQ ID NO: 577284 - RNA, 19 nt, Homo sapiens
acaagccucaaagucccuu

SEQ ID NO: 577285 - RNA, 14 nt, Homo sapiens
acaagcuaagaguu

SEQ ID NO: 577286 - RNA, 16 nt, Homo sapiens
acaagcugcacccuca

SEQ ID NO: 577287 - RNA, 13 nt, Homo sapiens
acaaggaagccaa

SEQ ID NO: 577288 - RNA, 15 nt, Homo sapiens
acaaggaagccaaag

SEQ ID NO: 577289 - RNA, 19 nt, Homo sapiens
acaaggaauuucccugugu

SEQ ID NO: 577290 - RNA, 22 nt, Homo sapiens
acaaggagauuucuuaguucau

SEQ ID NO: 577291 - RNA, 14 nt, Homo sapiens
acaaggaucaggcu

SEQ ID NO: 577292 - RNA, 12 nt, Homo sapiens
acaaggccaucu

SEQ ID NO: 577293 - RNA, 17 nt, Homo sapiens
acaaggcccugagcuuu

SEQ ID NO: 577294 - RNA, 20 nt, Homo sapiens
acaagguccucugucaguca

SEQ ID NO: 577295 - RNA, 21 nt, Homo sapiens
acaaguacugguugacuuucu

SEQ ID NO: 577296 - RNA, 15 nt, Homo sapiens
acaaguauccaguca

SEQ ID NO: 577297 - RNA, 14 nt, Homo sapiens
acaaguccagcugg

SEQ ID NO: 577298 - RNA, 12 nt, Homo sapiens
acaagucuucca

SEQ ID NO: 577299 - RNA, 23 nt, Homo sapiens
acaagugccuccuggacuguuca

SEQ ID NO: 577300 - RNA, 15 nt, Homo sapiens
acaagugcugaacag

SEQ ID NO: 577301 - RNA, 12 nt, Homo sapiens
acaagugucagg

SEQ ID NO: 577302 - RNA, 17 nt, Homo sapiens
agucuggguccaggccu

SEQ ID NO: 577303 - RNA, 15 nt, Homo sapiens
agucuggugcuccag

SEQ ID NO: 577304 - RNA, 12 nt, Homo sapiens
agucuguaggga

SEQ ID NO: 577305 - RNA, 16 nt, Homo sapiens
agucugucuacugugg

SEQ ID NO: 577306 - RNA, 22 nt, Homo sapiens
agucugucucuuggcuuuguca

SEQ ID NO: 577307 - RNA, 19 nt, Homo sapiens
agucugucugucugaugau

SEQ ID NO: 577308 - RNA, 11 nt, Homo sapiens
agucugugaaa

SEQ ID NO: 577309 - RNA, 15 nt, Homo sapiens
agucuguguucaaaa

SEQ ID NO: 577310 - RNA, 21 nt, Homo sapiens
agucuguuuucuaaagccagg

SEQ ID NO: 577311 - RNA, 15 nt, Homo sapiens
agucuuaaagcauuu

SEQ ID NO: 577312 - RNA, 20 nt, Homo sapiens
agucuuaauaaaacauugaa

SEQ ID NO: 577313 - RNA, 20 nt, Homo sapiens
agucuuccaguuuaaugaac

SEQ ID NO: 577314 - RNA, 16 nt, Homo sapiens
agucuucucuucugcc

SEQ ID NO: 577315 - RNA, 23 nt, Homo sapiens
agucuucucuuugaagaauuuaa

SEQ ID NO: 577316 - RNA, 20 nt, Homo sapiens
agucuucugguuuucuagcc

SEQ ID NO: 577317 - RNA, 16 nt, Homo sapiens
agucuucuguaauuca

SEQ ID NO: 577318 - RNA, 13 nt, Homo sapiens
agucuucuguaua

SEQ ID NO: 577319 - RNA, 21 nt, Homo sapiens
agucuugcaacagugccaugu

SEQ ID NO: 577320 - RNA, 19 nt, Homo sapiens
agucuugcaguuaucuuag

SEQ ID NO: 577321 - RNA, 19 nt, Homo sapiens
agucuugucauugccagcu

SEQ ID NO: 577322 - RNA, 17 nt, Homo sapiens
agucuuguggauggaaa

SEQ ID NO: 577323 - RNA, 17 nt, Homo sapiens
agucuuuagcuauuacu

SEQ ID NO: 577324 - RNA, 17 nt, Homo sapiens
agucuuuagggguuggg

SEQ ID NO: 577325 - RNA, 20 nt, Homo sapiens
agucuuugagcgagcccauu

SEQ ID NO: 577326 - RNA, 12 nt, Homo sapiens
agucuuugcuca

SEQ ID NO: 577327 - RNA, 15 nt, Homo sapiens
agugaaaaacaucca

SEQ ID NO: 577328 - RNA, 22 nt, Homo sapiens
agugaaaaaucuguggaaugua

SEQ ID NO: 577329 - RNA, 21 nt, Homo sapiens
agugaaaagucucccuuucca

SEQ ID NO: 577330 - RNA, 16 nt, Homo sapiens
agugaaagccagauuc

SEQ ID NO: 577331 - RNA, 13 nt, Homo sapiens
agugaaccuuuag

SEQ ID NO: 577332 - RNA, 14 nt, Homo sapiens
agugaacuaugaag

SEQ ID NO: 577333 - RNA, 14 nt, Homo sapiens
agugaagacuggaa

SEQ ID NO: 577334 - RNA, 15 nt, Homo sapiens
agugaagacuucuug

SEQ ID NO: 577335 - RNA, 20 nt, Homo sapiens
agugaagaugccagugaaac

SEQ ID NO: 577336 - RNA, 17 nt, Homo sapiens
agugaagccaaagggac

SEQ ID NO: 577337 - RNA, 19 nt, Homo sapiens
agugaagucaugaccucca

SEQ ID NO: 577338 - RNA, 18 nt, Homo sapiens
agugaauaaccacuuaaa

SEQ ID NO: 577339 - RNA, 13 nt, Homo sapiens
agugaaucuguau

SEQ ID NO: 577340 - RNA, 14 nt, Homo sapiens
agugaaucuguauu

SEQ ID NO: 577341 - RNA, 13 nt, Homo sapiens
agugaaugcacug

SEQ ID NO: 577342 - RNA, 18 nt, Homo sapiens
agugacaacaucgcaaua

SEQ ID NO: 577343 - RNA, 17 nt, Homo sapiens
agugacaaggcccugag

SEQ ID NO: 577344 - RNA, 13 nt, Homo sapiens
agugacacacaga

SEQ ID NO: 577345 - RNA, 14 nt, Homo sapiens
agugacagcuugag

SEQ ID NO: 577346 - RNA, 20 nt, Homo sapiens
agugacagcuugaguggguu

SEQ ID NO: 577347 - RNA, 19 nt, Homo sapiens
agugacagcuuucugggau

SEQ ID NO: 577348 - RNA, 18 nt, Homo sapiens
agugacaguggucccaga

SEQ ID NO: 577349 - RNA, 12 nt, Homo sapiens
agugacauagcc

SEQ ID NO: 577350 - RNA, 15 nt, Homo sapiens
agugacaugcggcug

SEQ ID NO: 577351 - RNA, 22 nt, Homo sapiens
agugaccccugaccucacugug

SEQ ID NO: 577352 - RNA, 20 nt, Homo sapiens
agugacugcagcuugccaaa

SEQ ID NO: 577353 - RNA, 20 nt, Homo sapiens
agugacuguuguagcauuuu

SEQ ID NO: 577354 - RNA, 17 nt, Homo sapiens
agugacuuuacaggagg

SEQ ID NO: 577355 - RNA, 16 nt, Homo sapiens
agugacuuugagcuga

SEQ ID NO: 577356 - RNA, 20 nt, Homo sapiens
agugacuuugagcugagugc

SEQ ID NO: 577357 - RNA, 19 nt, Homo sapiens
agugagaaaccauauuucc

SEQ ID NO: 577358 - RNA, 21 nt, Homo sapiens
agugagaaagaauaggggcug

SEQ ID NO: 577359 - RNA, 15 nt, Homo sapiens
agugagacacaguaa

SEQ ID NO: 577360 - RNA, 16 nt, Homo sapiens
agugagccgagaucac

SEQ ID NO: 577361 - RNA, 17 nt, Homo sapiens
agugagccgagaucaca

SEQ ID NO: 577362 - RNA, 16 nt, Homo sapiens
agugagccgagaucau

SEQ ID NO: 577363 - RNA, 17 nt, Homo sapiens
agugagccgagaucaug

SEQ ID NO: 577364 - RNA, 20 nt, Homo sapiens
agugagccgagaucaugcca

SEQ ID NO: 577365 - RNA, 19 nt, Homo sapiens
agugagcuguguucuugcc

SEQ ID NO: 577366 - RNA, 17 nt, Homo sapiens
agugagcuuugcugcua

SEQ ID NO: 577367 - RNA, 18 nt, Homo sapiens
agugaggaugacagugac

SEQ ID NO: 577368 - RNA, 20 nt, Homo sapiens
agugagggcucacucagcca

SEQ ID NO: 577369 - RNA, 16 nt, Homo sapiens
agugagugccaugcuu

SEQ ID NO: 577370 - RNA, 22 nt, Homo sapiens
agugauacucccaccucugccu

SEQ ID NO: 577371 - RNA, 15 nt, Homo sapiens
agugauaggcccaag

SEQ ID NO: 577372 - RNA, 16 nt, Homo sapiens
agugauaugcauuucc

SEQ ID NO: 577373 - RNA, 18 nt, Homo sapiens
agugauccauguccugaa

SEQ ID NO: 577374 - RNA, 19 nt, Homo sapiens
agugauccuuccaccucag

SEQ ID NO: 577375 - RNA, 18 nt, Homo sapiens
agugaucuguguucaaaa

SEQ ID NO: 577376 - RNA, 12 nt, Homo sapiens
agugaugcaguu

SEQ ID NO: 577377 - RNA, 14 nt, Homo sapiens
agugauggucagag

SEQ ID NO: 577378 - RNA, 15 nt, Homo sapiens
agugauucucuugcc

SEQ ID NO: 577379 - RNA, 22 nt, Homo sapiens
agugauugaaccagcucaucuc

SEQ ID NO: 577380 - RNA, 19 nt, Homo sapiens
agugcaaaagauuaagauu

SEQ ID NO: 577381 - RNA, 22 nt, Homo sapiens
agugcaacagcacuggcucucu

SEQ ID NO: 577382 - RNA, 19 nt, Homo sapiens
agugcaagcagaugacaaa

SEQ ID NO: 577383 - RNA, 18 nt, Homo sapiens
agugcacuaaacaaauaa

SEQ ID NO: 577384 - RNA, 16 nt, Homo sapiens
agugcacugacuguga

SEQ ID NO: 577385 - RNA, 12 nt, Homo sapiens
agugcacugagc

SEQ ID NO: 577386 - RNA, 16 nt, Homo sapiens
agugcagaagcacaug

SEQ ID NO: 577387 - RNA, 13 nt, Homo sapiens
agugcagccaaag

SEQ ID NO: 577388 - RNA, 19 nt, Homo sapiens
agugcagccuucuccauau

SEQ ID NO: 577389 - RNA, 22 nt, Homo sapiens
acacacuucggcucucuggaca

SEQ ID NO: 577390 - RNA, 22 nt, Homo sapiens
acacacuuucucuucaaugaaa

SEQ ID NO: 577391 - RNA, 16 nt, Homo sapiens
acacagacaaagugcu

SEQ ID NO: 577392 - RNA, 16 nt, Homo sapiens
acacagauagaccuuu

SEQ ID NO: 577393 - RNA, 14 nt, Homo sapiens
acacagaugaaggu

SEQ ID NO: 577394 - RNA, 16 nt, Homo sapiens
acacagauuuuuacac

SEQ ID NO: 577395 - RNA, 14 nt, Homo sapiens
acacagcaguauug

SEQ ID NO: 577396 - RNA, 17 nt, Homo sapiens
acacagcaugugccaag

SEQ ID NO: 577397 - RNA, 17 nt, Homo sapiens
acacagccccauguaca

SEQ ID NO: 577398 - RNA, 20 nt, Homo sapiens
acacagccuuccuucugcuc

SEQ ID NO: 577399 - RNA, 18 nt, Homo sapiens
acacaggcaaaauccuug

SEQ ID NO: 577400 - RNA, 14 nt, Homo sapiens
acacagggcacuga

SEQ ID NO: 577401 - RNA, 17 nt, Homo sapiens
acacagggcccggccac

SEQ ID NO: 577402 - RNA, 22 nt, Homo sapiens
acacaggggcccuguacaguga

SEQ ID NO: 577403 - RNA, 22 nt, Homo sapiens
acacagguagcacagauuuuga

SEQ ID NO: 577404 - RNA, 13 nt, Homo sapiens
acacaguguuuca

SEQ ID NO: 577405 - RNA, 19 nt, Homo sapiens
acacaguuguaggguuaca

SEQ ID NO: 577406 - RNA, 22 nt, Homo sapiens
acacauaagccaaaacugagca

SEQ ID NO: 577407 - RNA, 17 nt, Homo sapiens
acacauacagagcucuc

SEQ ID NO: 577408 - RNA, 13 nt, Homo sapiens
acacauaccuuca

SEQ ID NO: 577409 - RNA, 15 nt, Homo sapiens
acacauauacauaua

SEQ ID NO: 577410 - RNA, 17 nt, Homo sapiens
acacauauacauauaua

SEQ ID NO: 577411 - RNA, 21 nt, Homo sapiens
acacauauauuauuugcagug

SEQ ID NO: 577412 - RNA, 13 nt, Homo sapiens
acacauauugcac

SEQ ID NO: 577413 - RNA, 20 nt, Homo sapiens
acacaugccacaacauggau

SEQ ID NO: 577414 - RNA, 21 nt, Homo sapiens
acacauggcuuaagugacaaa

SEQ ID NO: 577415 - RNA, 24 nt, Homo sapiens
acacauggugugaguccaaagaag

SEQ ID NO: 577416 - RNA, 21 nt, Homo sapiens
acacauucuuaacacaugucc

SEQ ID NO: 577417 - RNA, 19 nt, Homo sapiens
acacauuggaauugauguc

SEQ ID NO: 577418 - RNA, 22 nt, Homo sapiens
acacauuuacacuagaggccag

SEQ ID NO: 577419 - RNA, 18 nt, Homo sapiens
acacauuuaccaaauugc

SEQ ID NO: 577420 - RNA, 20 nt, Homo sapiens
acacauuugcccaauuccag

SEQ ID NO: 577421 - RNA, 13 nt, Homo sapiens
acaccaaaccaaa

SEQ ID NO: 577422 - RNA, 13 nt, Homo sapiens
acaccacacauac

SEQ ID NO: 577423 - RNA, 20 nt, Homo sapiens
acaccaccuauaccaauauu

SEQ ID NO: 577424 - RNA, 20 nt, Homo sapiens
acaccacuaaccauccccaa

SEQ ID NO: 577425 - RNA, 23 nt, Homo sapiens
acaccacuuuacuuguguuauau

SEQ ID NO: 577426 - RNA, 19 nt, Homo sapiens
agugcugaaggaauggaag

SEQ ID NO: 577427 - RNA, 18 nt, Homo sapiens
agugcugaggggcacucu

SEQ ID NO: 577428 - RNA, 20 nt, Homo sapiens
agugcugcuauaucuaucca

SEQ ID NO: 577429 - RNA, 13 nt, Homo sapiens
agugcugcuguaa

SEQ ID NO: 577430 - RNA, 20 nt, Homo sapiens
agugcugggaugacaggugu

SEQ ID NO: 577431 - RNA, 18 nt, Homo sapiens
agugcuggucacuaacca

SEQ ID NO: 577432 - RNA, 14 nt, Homo sapiens
agugcuguuucccg

SEQ ID NO: 577433 - RNA, 15 nt, Homo sapiens
agugcuuaaaaauac

SEQ ID NO: 577434 - RNA, 13 nt, Homo sapiens
agugcuugauaug

SEQ ID NO: 577435 - RNA, 14 nt, Homo sapiens
agugcuuguuagag

SEQ ID NO: 577436 - RNA, 17 nt, Homo sapiens
agugcuuguuccucuca

SEQ ID NO: 577437 - RNA, 16 nt, Homo sapiens
agugcuuugugauagu

SEQ ID NO: 577438 - RNA, 17 nt, Homo sapiens
agugcuuuucagugaua

SEQ ID NO: 577439 - RNA, 14 nt, Homo sapiens
aguggaaaacaaag

SEQ ID NO: 577440 - RNA, 15 nt, Homo sapiens
aguggaauagugaau

SEQ ID NO: 577441 - RNA, 21 nt, Homo sapiens
aguggacaccgcucaguauua

SEQ ID NO: 577442 - RNA, 22 nt, Homo sapiens
aguggacccuggaccauuccag

SEQ ID NO: 577443 - RNA, 12 nt, Homo sapiens
aguggagccagg

SEQ ID NO: 577444 - RNA, 19 nt, Homo sapiens
aguggaguugaaacugcua

SEQ ID NO: 577445 - RNA, 23 nt, Homo sapiens
aguggcaaccuugucucuaugcc

SEQ ID NO: 577446 - RNA, 18 nt, Homo sapiens
aguggcacaggagacucc

SEQ ID NO: 577447 - RNA, 19 nt, Homo sapiens
aguggcacaggagacucca

SEQ ID NO: 577448 - RNA, 22 nt, Homo sapiens
aguggcacggagagaaggccca

SEQ ID NO: 577449 - RNA, 20 nt, Homo sapiens
aguggcaggugggcugccug

SEQ ID NO: 577450 - RNA, 19 nt, Homo sapiens
aguggcauuaaacauuuga

SEQ ID NO: 577451 - RNA, 15 nt, Homo sapiens
aguggcauuugucag

SEQ ID NO: 577452 - RNA, 20 nt, Homo sapiens
aguggccaugccacccuguu

SEQ ID NO: 577453 - RNA, 17 nt, Homo sapiens
aguggcccauggcauuu

SEQ ID NO: 577454 - RNA, 15 nt, Homo sapiens
aguggccgaugauuu

SEQ ID NO: 577455 - RNA, 19 nt, Homo sapiens
aguggccugugcuuuucag

SEQ ID NO: 577456 - RNA, 18 nt, Homo sapiens
aguggcuaccuacauaca

SEQ ID NO: 577457 - RNA, 23 nt, Homo sapiens
aguggcucacgccuaugauccca

SEQ ID NO: 577458 - RNA, 16 nt, Homo sapiens
aguggcucacuggcug

SEQ ID NO: 577459 - RNA, 14 nt, Homo sapiens
aguggcucaugccu

SEQ ID NO: 577460 - RNA, 15 nt, Homo sapiens
aguggcugugccacc

SEQ ID NO: 577461 - RNA, 19 nt, Homo sapiens
aguggcuugagcuucuggg

SEQ ID NO: 577462 - RNA, 11 nt, Homo sapiens
agugggagaag

SEQ ID NO: 577463 - RNA, 20 nt, Homo sapiens
agugggagcugaguggggga

SEQ ID NO: 577464 - RNA, 14 nt, Homo sapiens
agugggcaccucag

SEQ ID NO: 577465 - RNA, 19 nt, Homo sapiens
agugggcagccccucuacc

SEQ ID NO: 577466 - RNA, 20 nt, Homo sapiens
agugggccugguagcacaug

SEQ ID NO: 577467 - RNA, 14 nt, Homo sapiens
agugggcuccagua

SEQ ID NO: 577468 - RNA, 14 nt, Homo sapiens
aguggggacagauu

SEQ ID NO: 577469 - RNA, 16 nt, Homo sapiens
aguggggauccugccc

SEQ ID NO: 577470 - RNA, 15 nt, Homo sapiens
agugggggaucacag

SEQ ID NO: 577471 - RNA, 22 nt, Homo sapiens
agugggggcggggaagggugca

SEQ ID NO: 577472 - RNA, 12 nt, Homo sapiens
aguggggugcug

SEQ ID NO: 577473 - RNA, 23 nt, Homo sapiens
agugggguggugucagacccugg

SEQ ID NO: 577474 - RNA, 13 nt, Homo sapiens
agugggugaauaa

SEQ ID NO: 577475 - RNA, 13 nt, Homo sapiens
aguggguggugga

SEQ ID NO: 577476 - RNA, 16 nt, Homo sapiens
agugggugguggaucu

SEQ ID NO: 577477 - RNA, 24 nt, Homo sapiens
agugggugguggaucuguccaagg

SEQ ID NO: 577478 - RNA, 23 nt, Homo sapiens
agugguacuaagcacagaaacuc

SEQ ID NO: 577479 - RNA, 17 nt, Homo sapiens
agugguauccugugaca

SEQ ID NO: 577480 - RNA, 13 nt, Homo sapiens
agugguaucugac

SEQ ID NO: 577481 - RNA, 17 nt, Homo sapiens
aguggucgagugacaca

SEQ ID NO: 577482 - RNA, 15 nt, Homo sapiens
aguggucgcuuacuu

SEQ ID NO: 577483 - RNA, 16 nt, Homo sapiens
aguggugcccuggaac

SEQ ID NO: 577484 - RNA, 16 nt, Homo sapiens
aguggugguauguaau

SEQ ID NO: 577485 - RNA, 18 nt, Homo sapiens
agugguguaggugggggu

SEQ ID NO: 577486 - RNA, 17 nt, Homo sapiens
aguguaaaauguauauu

SEQ ID NO: 577487 - RNA, 15 nt, Homo sapiens
aguguaauugagaag

SEQ ID NO: 577488 - RNA, 16 nt, Homo sapiens
aguguagauguagcau

SEQ ID NO: 577489 - RNA, 18 nt, Homo sapiens
aguguagggcaacaauac

SEQ ID NO: 577490 - RNA, 20 nt, Homo sapiens
aguguauaccaccuguacau

SEQ ID NO: 577491 - RNA, 13 nt, Homo sapiens
aguguaugauuac

SEQ ID NO: 577492 - RNA, 21 nt, Homo sapiens
aguguaugcacgugugcacac

SEQ ID NO: 577493 - RNA, 23 nt, Homo sapiens
aguguauuuauuuuacagcucau

SEQ ID NO: 577494 - RNA, 21 nt, Homo sapiens
aguguauuuuauguguggccc

SEQ ID NO: 577495 - RNA, 14 nt, Homo sapiens
agugucacaucucu

SEQ ID NO: 577496 - RNA, 22 nt, Homo sapiens
agugucaccaauuccaccaaga

SEQ ID NO: 577497 - RNA, 23 nt, Homo sapiens
aguguccccccuugaagcaauaa

SEQ ID NO: 577498 - RNA, 18 nt, Homo sapiens
aguguccucuugcucaaa

SEQ ID NO: 577499 - RNA, 17 nt, Homo sapiens
aguguccuucuugcucc

SEQ ID NO: 577500 - RNA, 16 nt, Homo sapiens
agugucuccaccuaca

SEQ ID NO: 577501 - RNA, 16 nt, Homo sapiens
agugucugugccaugg

SEQ ID NO: 577502 - RNA, 14 nt, Homo sapiens
agugucuuuugaca

SEQ ID NO: 577503 - RNA, 16 nt, Homo sapiens
agugugaacaaaagau

SEQ ID NO: 577504 - RNA, 13 nt, Homo sapiens
agugugacagggc

SEQ ID NO: 577505 - RNA, 9 nt, Homo sapiens
agugugaga

SEQ ID NO: 577506 - RNA, 23 nt, Homo sapiens
agugugaguggcagccaugccuc

SEQ ID NO: 577507 - RNA, 13 nt, Homo sapiens
agugugaguguga

SEQ ID NO: 577508 - RNA, 16 nt, Homo sapiens
agugugauauacaaag

SEQ ID NO: 577509 - RNA, 19 nt, Homo sapiens
aguguggaagcauagugaa

SEQ ID NO: 577510 - RNA, 16 nt, Homo sapiens
aguguggacaugagca

SEQ ID NO: 577511 - RNA, 16 nt, Homo sapiens
aguuggccaagcagaa

SEQ ID NO: 577512 - RNA, 18 nt, Homo sapiens
aguuggccaugaugucuu

SEQ ID NO: 577513 - RNA, 22 nt, Homo sapiens
aguuggcucugagauacuaaua

SEQ ID NO: 577514 - RNA, 20 nt, Homo sapiens
aguugggcucgcacugccca

SEQ ID NO: 577515 - RNA, 20 nt, Homo sapiens
aguuggggacaugcugcuac

SEQ ID NO: 577516 - RNA, 22 nt, Homo sapiens
aguuggggcacugggcgucuga

SEQ ID NO: 577517 - RNA, 15 nt, Homo sapiens
aguuggugacuggga

SEQ ID NO: 577518 - RNA, 20 nt, Homo sapiens
aguugguuuguaucuugccu

SEQ ID NO: 577519 - RNA, 19 nt, Homo sapiens
aguuguacuucugcuccau

SEQ ID NO: 577520 - RNA, 21 nt, Homo sapiens
aguugugucagcuacugcgga

SEQ ID NO: 577521 - RNA, 18 nt, Homo sapiens
aguuguguuaagcuugcg

SEQ ID NO: 577522 - RNA, 14 nt, Homo sapiens
aguuguuagauuaa

SEQ ID NO: 577523 - RNA, 16 nt, Homo sapiens
aguuguuaugccauga

SEQ ID NO: 577524 - RNA, 17 nt, Homo sapiens
aguuguugacugugauu

SEQ ID NO: 577525 - RNA, 20 nt, Homo sapiens
aguuguuuuccugcuuuaca

SEQ ID NO: 577526 - RNA, 20 nt, Homo sapiens
aguuuaaaacagaagccuga

SEQ ID NO: 577527 - RNA, 15 nt, Homo sapiens
aguuuaauauuccaa

SEQ ID NO: 577528 - RNA, 18 nt, Homo sapiens
aguuuaaugaacuaccau

SEQ ID NO: 577529 - RNA, 13 nt, Homo sapiens
aguuuaaugauua

SEQ ID NO: 577530 - RNA, 14 nt, Homo sapiens
aguuuacccaugaa

SEQ ID NO: 577531 - RNA, 19 nt, Homo sapiens
aguuuaccuauguaacaaa

SEQ ID NO: 577532 - RNA, 22 nt, Homo sapiens
aguuuaccucaggugugccugu

SEQ ID NO: 577533 - RNA, 20 nt, Homo sapiens
aguuuagauugugaggcaau

SEQ ID NO: 577534 - RNA, 20 nt, Homo sapiens
aguuuauaagacuggaauau

SEQ ID NO: 577535 - RNA, 18 nt, Homo sapiens
aguuuauacagaacucac

SEQ ID NO: 577536 - RNA, 14 nt, Homo sapiens
aguuuauaguuaaa

SEQ ID NO: 577537 - RNA, 16 nt, Homo sapiens
aguuuaucaugucagu

SEQ ID NO: 577538 - RNA, 15 nt, Homo sapiens
aguuuauccugacau

SEQ ID NO: 577539 - RNA, 16 nt, Homo sapiens
aguuuauuacaaugua

SEQ ID NO: 577540 - RNA, 16 nt, Homo sapiens
aguuuauugauauuca

SEQ ID NO: 577541 - RNA, 21 nt, Homo sapiens
aguuuauuuuuauacuuucag

SEQ ID NO: 577542 - RNA, 15 nt, Homo sapiens
aguuucaaguuuuaa

SEQ ID NO: 577543 - RNA, 22 nt, Homo sapiens
aguuucaaugugauucuaaugu

SEQ ID NO: 577544 - RNA, 22 nt, Homo sapiens
aguuucacaugagcuauuucca

SEQ ID NO: 577545 - RNA, 15 nt, Homo sapiens
aguuucaucagucaa

SEQ ID NO: 577546 - RNA, 18 nt, Homo sapiens
aguuucauuuaugauaca

SEQ ID NO: 577547 - RNA, 22 nt, Homo sapiens
aguuuccaauuauuugacuuua

SEQ ID NO: 577548 - RNA, 12 nt, Homo sapiens
aguuucccugaa

SEQ ID NO: 577549 - RNA, 21 nt, Homo sapiens
aguuucccuucucccagucca

SEQ ID NO: 577550 - RNA, 16 nt, Homo sapiens
aguuucuaaaaacaca

SEQ ID NO: 577551 - RNA, 23 nt, Homo sapiens
acagaaggaucgugucugcugac

SEQ ID NO: 577552 - RNA, 18 nt, Homo sapiens
acagaaggcaaaguuuac

SEQ ID NO: 577553 - RNA, 18 nt, Homo sapiens
acagaaguaucaagccau

SEQ ID NO: 577554 - RNA, 21 nt, Homo sapiens
acagaaguccccucuacuuua

SEQ ID NO: 577555 - RNA, 16 nt, Homo sapiens
acagaagucuccucaa

SEQ ID NO: 577556 - RNA, 16 nt, Homo sapiens
acagaauaauccagua

SEQ ID NO: 577557 - RNA, 9 nt, Homo sapiens
acagaauuu

SEQ ID NO: 577558 - RNA, 13 nt, Homo sapiens
acagacaacacug

SEQ ID NO: 577559 - RNA, 16 nt, Homo sapiens
acagacacaauaugua

SEQ ID NO: 577560 - RNA, 20 nt, Homo sapiens
acagacacaauauguaugcu

SEQ ID NO: 577561 - RNA, 16 nt, Homo sapiens
acagacacacccagug

SEQ ID NO: 577562 - RNA, 23 nt, Homo sapiens
acagacaccaucuuuugugagau

SEQ ID NO: 577563 - RNA, 17 nt, Homo sapiens
acagacacuguugcaaa

SEQ ID NO: 577564 - RNA, 15 nt, Homo sapiens
acagacacuuuucaa

SEQ ID NO: 577565 - RNA, 13 nt, Homo sapiens
acagacaggaaag

SEQ ID NO: 577566 - RNA, 22 nt, Homo sapiens
acagacauacauagacauuuca

SEQ ID NO: 577567 - RNA, 17 nt, Homo sapiens
acagacaugugcaacca

SEQ ID NO: 577568 - RNA, 17 nt, Homo sapiens
acagaccuacugcacug

SEQ ID NO: 577569 - RNA, 14 nt, Homo sapiens
acagaccucaaggg

SEQ ID NO: 577570 - RNA, 11 nt, Homo sapiens
acagaccucag

SEQ ID NO: 577571 - RNA, 15 nt, Homo sapiens
acagaccugcaguga

SEQ ID NO: 577572 - RNA, 16 nt, Homo sapiens
acagaccugugugugc

SEQ ID NO: 577573 - RNA, 17 nt, Homo sapiens
acagaccuuaguugaaa

SEQ ID NO: 577574 - RNA, 14 nt, Homo sapiens
acagacucacaucc

SEQ ID NO: 577575 - RNA, 21 nt, Homo sapiens
acagacuccaaaaggcccuuu

SEQ ID NO: 577576 - RNA, 14 nt, Homo sapiens
acagacuccugagg

SEQ ID NO: 577577 - RNA, 22 nt, Homo sapiens
acagacuggcaauaaacuccua

SEQ ID NO: 577578 - RNA, 12 nt, Homo sapiens
acagacuguggu

SEQ ID NO: 577579 - RNA, 16 nt, Homo sapiens
acagagaaaagacaua

SEQ ID NO: 577580 - RNA, 20 nt, Homo sapiens
acagagaaauccuaaaagag

SEQ ID NO: 577581 - RNA, 23 nt, Homo sapiens
acagagaagcggauuuccaggga

SEQ ID NO: 577582 - RNA, 17 nt, Homo sapiens
acagagacaggcccaag

SEQ ID NO: 577583 - RNA, 13 nt, Homo sapiens
acagagacucaga

SEQ ID NO: 577584 - RNA, 16 nt, Homo sapiens
acagagacuuuaauca

SEQ ID NO: 577585 - RNA, 18 nt, Homo sapiens
acagagaggaggggacca

SEQ ID NO: 577586 - RNA, 17 nt, Homo sapiens
acagagauaccauucaa

SEQ ID NO: 577587 - RNA, 22 nt, Homo sapiens
acagagaugcaugcgcaggcuc

SEQ ID NO: 577588 - RNA, 20 nt, Homo sapiens
acagagcaagacuccaucuc

SEQ ID NO: 577589 - RNA, 18 nt, Homo sapiens
acagagcaggacugcaca

SEQ ID NO: 577590 - RNA, 20 nt, Homo sapiens
acagagcgagacuccgucuc

SEQ ID NO: 577591 - RNA, 12 nt, Homo sapiens
acagagcgagau

SEQ ID NO: 577592 - RNA, 20 nt, Homo sapiens
acagagcgagauuccaucuc

SEQ ID NO: 577593 - RNA, 20 nt, Homo sapiens
acagagcgagauuccgucuu

SEQ ID NO: 577594 - RNA, 16 nt, Homo sapiens
acagagcucucugagg

SEQ ID NO: 577595 - RNA, 18 nt, Homo sapiens
acagaggagaagcaaugg

SEQ ID NO: 577596 - RNA, 16 nt, Homo sapiens
acagaggagaugccac

SEQ ID NO: 577597 - RNA, 15 nt, Homo sapiens
acagaggagugcagc

SEQ ID NO: 577598 - RNA, 18 nt, Homo sapiens
acagaggcugacuucaga

SEQ ID NO: 577599 - RNA, 14 nt, Homo sapiens
acagagggaagcca

SEQ ID NO: 577600 - RNA, 15 nt, Homo sapiens
acagagggaagccau

SEQ ID NO: 577601 - RNA, 23 nt, Homo sapiens
acagagggcaggaacuugcacaa

SEQ ID NO: 577602 - RNA, 18 nt, Homo sapiens
acagagggcucaccucuu

SEQ ID NO: 577603 - RNA, 23 nt, Homo sapiens
acagaguacgugaaaugcucaag

SEQ ID NO: 577604 - RNA, 12 nt, Homo sapiens
acagaguaucuu

SEQ ID NO: 577605 - RNA, 15 nt, Homo sapiens
acagagucucacucu

SEQ ID NO: 577606 - RNA, 13 nt, Homo sapiens
acagagugcauug

SEQ ID NO: 577607 - RNA, 20 nt, Homo sapiens
acagaguugccaggcacuuu

SEQ ID NO: 577608 - RNA, 20 nt, Homo sapiens
acagauaccccccuacuuaa

SEQ ID NO: 577609 - RNA, 19 nt, Homo sapiens
acagaucaagcugugagac

SEQ ID NO: 577610 - RNA, 21 nt, Homo sapiens
acagauccgacuuuggccucu

SEQ ID NO: 577611 - RNA, 16 nt, Homo sapiens
acagaugaauaccuuu

SEQ ID NO: 577612 - RNA, 16 nt, Homo sapiens
acagaugauacuucca

SEQ ID NO: 577613 - RNA, 19 nt, Homo sapiens
acagaugcuuuucugucuc

SEQ ID NO: 577614 - RNA, 16 nt, Homo sapiens
acagauggauuugccu

SEQ ID NO: 577615 - RNA, 17 nt, Homo sapiens
acagauggcagugccau

SEQ ID NO: 577616 - RNA, 19 nt, Homo sapiens
acagauggcagugccauaa

SEQ ID NO: 577617 - RNA, 14 nt, Homo sapiens
acagauuccuggca

SEQ ID NO: 577618 - RNA, 15 nt, Homo sapiens
acagauuguuugcaa

SEQ ID NO: 577619 - RNA, 14 nt, Homo sapiens
acagauuucaguaa

SEQ ID NO: 577620 - RNA, 22 nt, Homo sapiens
acagauuugagcucagcccugg

SEQ ID NO: 577621 - RNA, 22 nt, Homo sapiens
acagauuuuaccuauccacaau

SEQ ID NO: 577622 - RNA, 20 nt, Homo sapiens
acagauuuuagacuuaccuu

SEQ ID NO: 577623 - RNA, 21 nt, Homo sapiens
acagcaaaaccauugcuucac

SEQ ID NO: 577624 - RNA, 14 nt, Homo sapiens
acagcaaaacucca

SEQ ID NO: 577625 - RNA, 14 nt, Homo sapiens
acagcaaaagaaga

SEQ ID NO: 577626 - RNA, 18 nt, Homo sapiens
acagcaaauaacagucug

SEQ ID NO: 577627 - RNA, 18 nt, Homo sapiens
acagcaaccccaggcuga

SEQ ID NO: 577628 - RNA, 17 nt, Homo sapiens
acagcaaccucuucaug

SEQ ID NO: 577629 - RNA, 22 nt, Homo sapiens
acagcacaaccggucccuucca

SEQ ID NO: 577630 - RNA, 13 nt, Homo sapiens
acagcacccugug

SEQ ID NO: 577631 - RNA, 21 nt, Homo sapiens
acagcacccuguggucuuccu

SEQ ID NO: 577632 - RNA, 20 nt, Homo sapiens
acagcacuggcucucuccag

SEQ ID NO: 577633 - RNA, 16 nt, Homo sapiens
auaaaauucauuaguu

SEQ ID NO: 577634 - RNA, 11 nt, Homo sapiens
auaaaauuccu

SEQ ID NO: 577635 - RNA, 14 nt, Homo sapiens
auaaaauugcacuu

SEQ ID NO: 577636 - RNA, 17 nt, Homo sapiens
auaaacacuuucuggaa

SEQ ID NO: 577637 - RNA, 22 nt, Homo sapiens
auaaacagacuguuaauuauag

SEQ ID NO: 577638 - RNA, 22 nt, Homo sapiens
auaaacaggaaaaugccagagc

SEQ ID NO: 577639 - RNA, 15 nt, Homo sapiens
auaaaccacuuucua

SEQ ID NO: 577640 - RNA, 13 nt, Homo sapiens
auaaaccauucca

SEQ ID NO: 577641 - RNA, 18 nt, Homo sapiens
auaaacggcaguguuaaa

SEQ ID NO: 577642 - RNA, 13 nt, Homo sapiens
auaaacuacacaa

SEQ ID NO: 577643 - RNA, 14 nt, Homo sapiens
auaaacuauacacu

SEQ ID NO: 577644 - RNA, 23 nt, Homo sapiens
auaaacuauacacuuaaugauac

SEQ ID NO: 577645 - RNA, 16 nt, Homo sapiens
auaaacuccuacuaaa

SEQ ID NO: 577646 - RNA, 17 nt, Homo sapiens
auaaacugaagagcuua

SEQ ID NO: 577647 - RNA, 12 nt, Homo sapiens
auaaacugagag

SEQ ID NO: 577648 - RNA, 17 nt, Homo sapiens
auaaacugucacucuag

SEQ ID NO: 577649 - RNA, 15 nt, Homo sapiens
auaaacuucagggau

SEQ ID NO: 577650 - RNA, 23 nt, Homo sapiens
auaaagaagguuggugaauuuca

SEQ ID NO: 577651 - RNA, 20 nt, Homo sapiens
auaaagaauuaacagagauu

SEQ ID NO: 577652 - RNA, 15 nt, Homo sapiens
auaaagacaggguuu

SEQ ID NO: 577653 - RNA, 17 nt, Homo sapiens
auaaagagacagugaua

SEQ ID NO: 577654 - RNA, 15 nt, Homo sapiens
auaaagauuucuagu

SEQ ID NO: 577655 - RNA, 21 nt, Homo sapiens
auaaagcaguauuuuucuuga

SEQ ID NO: 577656 - RNA, 18 nt, Homo sapiens
auaaagcuauguauauaa

SEQ ID NO: 577657 - RNA, 18 nt, Homo sapiens
auaaaggcaguuuucuaa

SEQ ID NO: 577658 - RNA, 18 nt, Homo sapiens
auaaaggcugagcucuua

SEQ ID NO: 577659 - RNA, 14 nt, Homo sapiens
auaaagggugccag

SEQ ID NO: 577660 - RNA, 15 nt, Homo sapiens
auaaagggugccagg

SEQ ID NO: 577661 - RNA, 21 nt, Homo sapiens
auaaaguaccacacauauugc

SEQ ID NO: 577662 - RNA, 11 nt, Homo sapiens
auaaagucaac

SEQ ID NO: 577663 - RNA, 23 nt, Homo sapiens
auaaagucaaggacgaauuugca

SEQ ID NO: 577664 - RNA, 14 nt, Homo sapiens
auaaaguccugaca

SEQ ID NO: 577665 - RNA, 11 nt, Homo sapiens
auaaagugaug

SEQ ID NO: 577666 - RNA, 16 nt, Homo sapiens
auaaauaaaagcuaga

SEQ ID NO: 577667 - RNA, 23 nt, Homo sapiens
auaaauaacccugggcuguccag

SEQ ID NO: 577668 - RNA, 13 nt, Homo sapiens
auaaauaagcaaa

SEQ ID NO: 577669 - RNA, 16 nt, Homo sapiens
auaaauaaucaucccu

SEQ ID NO: 577670 - RNA, 21 nt, Homo sapiens
auaaauacaagauucucugau

SEQ ID NO: 577671 - RNA, 15 nt, Homo sapiens
auaaauacgugucaa

SEQ ID NO: 577672 - RNA, 16 nt, Homo sapiens
auaaauauuacaguga

SEQ ID NO: 577673 - RNA, 21 nt, Homo sapiens
auaaauauuauuagauuuauu

SEQ ID NO: 577674 - RNA, 16 nt, Homo sapiens
auaaauauugcuccag

SEQ ID NO: 577675 - RNA, 22 nt, Homo sapiens
acagcugguccuccacuuugcu

SEQ ID NO: 577676 - RNA, 15 nt, Homo sapiens
acagcugucccuguc

SEQ ID NO: 577677 - RNA, 11 nt, Homo sapiens
acagcugugag

SEQ ID NO: 577678 - RNA, 20 nt, Homo sapiens
acagcuucacuagaguucuu

SEQ ID NO: 577679 - RNA, 19 nt, Homo sapiens
acagcuucuccaagcauca

SEQ ID NO: 577680 - RNA, 19 nt, Homo sapiens
acagcuucucuacagacuc

SEQ ID NO: 577681 - RNA, 21 nt, Homo sapiens
acagcuucucuacagacucca

SEQ ID NO: 577682 - RNA, 19 nt, Homo sapiens
acagcuucuucaucuuuaa

SEQ ID NO: 577683 - RNA, 21 nt, Homo sapiens
acagcuugggucagguucuug

SEQ ID NO: 577684 - RNA, 23 nt, Homo sapiens
acagcuuuaucuccccaggagca

SEQ ID NO: 577685 - RNA, 13 nt, Homo sapiens
acagcuuucacag

SEQ ID NO: 577686 - RNA, 23 nt, Homo sapiens
acaggaaaaaaaaaaaucuaucc

SEQ ID NO: 577687 - RNA, 18 nt, Homo sapiens
acaggaaaaaaacuuuua

SEQ ID NO: 577688 - RNA, 14 nt, Homo sapiens
acaggaaaaugcca

SEQ ID NO: 577689 - RNA, 17 nt, Homo sapiens
acaggaaaauguaucca

SEQ ID NO: 577690 - RNA, 23 nt, Homo sapiens
acaggaaaggccccaaucuugcc

SEQ ID NO: 577691 - RNA, 16 nt, Homo sapiens
acaggaaagggcaaag

SEQ ID NO: 577692 - RNA, 20 nt, Homo sapiens
acaggaagcaccccaugcca

SEQ ID NO: 577693 - RNA, 17 nt, Homo sapiens
acaggaaggaaccagaa

SEQ ID NO: 577694 - RNA, 16 nt, Homo sapiens
acaggaaguaguucua

SEQ ID NO: 577695 - RNA, 18 nt, Homo sapiens
acaggaauacuuaacuca

SEQ ID NO: 577696 - RNA, 20 nt, Homo sapiens
acaggaauggaacacacuug

SEQ ID NO: 577697 - RNA, 15 nt, Homo sapiens
acaggacagcgggaa

SEQ ID NO: 577698 - RNA, 21 nt, Homo sapiens
acaggacccugggaccacaga

SEQ ID NO: 577699 - RNA, 15 nt, Homo sapiens
acaggagaccuggca

SEQ ID NO: 577700 - RNA, 23 nt, Homo sapiens
acaggaggcccccaucuaugagc

SEQ ID NO: 577701 - RNA, 22 nt, Homo sapiens
acaggcaaauguacuucucacc

SEQ ID NO: 577702 - RNA, 23 nt, Homo sapiens
acaggcaaauguacuucucaccc

SEQ ID NO: 577703 - RNA, 18 nt, Homo sapiens
acaggcacacaggucuca

SEQ ID NO: 577704 - RNA, 13 nt, Homo sapiens
acaggcacccacc

SEQ ID NO: 577705 - RNA, 13 nt, Homo sapiens
acaggcacuccaa

SEQ ID NO: 577706 - RNA, 18 nt, Homo sapiens
acaggccauacuuuacaa

SEQ ID NO: 577707 - RNA, 23 nt, Homo sapiens
acaggcccggcccagccuaggcc

SEQ ID NO: 577708 - RNA, 20 nt, Homo sapiens
acaggcgcccgccaccaugc

SEQ ID NO: 577709 - RNA, 21 nt, Homo sapiens
acaggcgcccgccaccaugcc

SEQ ID NO: 577710 - RNA, 22 nt, Homo sapiens
acaggcgugauccaccacaccu

SEQ ID NO: 577711 - RNA, 21 nt, Homo sapiens
acaggcucuuagcagcuucca

SEQ ID NO: 577712 - RNA, 20 nt, Homo sapiens
acaggcugagaacucguuca

SEQ ID NO: 577713 - RNA, 17 nt, Homo sapiens
acaggcuggagugcagu

SEQ ID NO: 577714 - RNA, 23 nt, Homo sapiens
acaggcuucugagcacagcugca

SEQ ID NO: 577715 - RNA, 20 nt, Homo sapiens
acaggcuuguuaccaccaug

SEQ ID NO: 577716 - RNA, 17 nt, Homo sapiens
acagggaauacauugua

SEQ ID NO: 577717 - RNA, 18 nt, Homo sapiens
acagggacugaaaaccuc

SEQ ID NO: 577718 - RNA, 14 nt, Homo sapiens
acagggagaaaauc

SEQ ID NO: 577719 - RNA, 23 nt, Homo sapiens
acagggagaaguagcuaguagca

SEQ ID NO: 577720 - RNA, 14 nt, Homo sapiens
acagggcagcagug

SEQ ID NO: 577721 - RNA, 14 nt, Homo sapiens
acagggcauucaaa

SEQ ID NO: 577722 - RNA, 22 nt, Homo sapiens
acagggcgguaccuugugccca

SEQ ID NO: 577723 - RNA, 21 nt, Homo sapiens
acagggggugggaaggggaug

SEQ ID NO: 577724 - RNA, 17 nt, Homo sapiens
acagggucauguuugca

SEQ ID NO: 577725 - RNA, 20 nt, Homo sapiens
acagggucucacucugucgc

SEQ ID NO: 577726 - RNA, 17 nt, Homo sapiens
acagggucuugcucugu

SEQ ID NO: 577727 - RNA, 21 nt, Homo sapiens
acagggugacucacagccgca

SEQ ID NO: 577728 - RNA, 22 nt, Homo sapiens
acagggugcuccuugucaauac

SEQ ID NO: 577729 - RNA, 20 nt, Homo sapiens
acagggugucguucugucgc

SEQ ID NO: 577730 - RNA, 19 nt, Homo sapiens
acaggucccaccuccagcc

SEQ ID NO: 577731 - RNA, 20 nt, Homo sapiens
acaggucggggaccaaaggc

SEQ ID NO: 577732 - RNA, 12 nt, Homo sapiens
acaggucuuccg

SEQ ID NO: 577733 - RNA, 12 nt, Homo sapiens
acaggugacaug

SEQ ID NO: 577734 - RNA, 16 nt, Homo sapiens
acaggugaugcucugg

SEQ ID NO: 577735 - RNA, 17 nt, Homo sapiens
acaggugccuucccaga

SEQ ID NO: 577736 - RNA, 18 nt, Homo sapiens
acaggugcgguuccucau

SEQ ID NO: 577737 - RNA, 19 nt, Homo sapiens
acagguggcaggaccagga

SEQ ID NO: 577738 - RNA, 15 nt, Homo sapiens
acaggugggcuguau

SEQ ID NO: 577739 - RNA, 23 nt, Homo sapiens
acagguguuuuuccacaagugcc

SEQ ID NO: 577740 - RNA, 19 nt, Homo sapiens
acagguuacagugagcaaa

SEQ ID NO: 577741 - RNA, 14 nt, Homo sapiens
acaguaaaaauccu

SEQ ID NO: 577742 - RNA, 16 nt, Homo sapiens
acaguaaaauuaacuc

SEQ ID NO: 577743 - RNA, 21 nt, Homo sapiens
acaguaaccauuucaguguau

SEQ ID NO: 577744 - RNA, 19 nt, Homo sapiens
acaguaacuuuauguguaa

SEQ ID NO: 577745 - RNA, 17 nt, Homo sapiens
acaguaaguccaguaaa

SEQ ID NO: 577746 - RNA, 15 nt, Homo sapiens
acaguacagaaggca

SEQ ID NO: 577747 - RNA, 17 nt, Homo sapiens
acaguacagaaggcaaa

SEQ ID NO: 577748 - RNA, 18 nt, Homo sapiens
acaguacagcaugugccu

SEQ ID NO: 577749 - RNA, 18 nt, Homo sapiens
acaguacccaaacugcuu

SEQ ID NO: 577750 - RNA, 14 nt, Homo sapiens
acaguacucacuuu

SEQ ID NO: 577751 - RNA, 20 nt, Homo sapiens
acaguacucacuuuuuccaa

SEQ ID NO: 577752 - RNA, 13 nt, Homo sapiens
acaguacugauac

SEQ ID NO: 577753 - RNA, 22 nt, Homo sapiens
acaguacugauacauaauuuaa

SEQ ID NO: 577754 - RNA, 23 nt, Homo sapiens
acauauuccugguguagcacuua

SEQ ID NO: 577755 - RNA, 23 nt, Homo sapiens
acauauugcaggauucuguaaua

SEQ ID NO: 577756 - RNA, 18 nt, Homo sapiens
acauauuuagaccaauau

SEQ ID NO: 577757 - RNA, 12 nt, Homo sapiens
acauauuuuaga

SEQ ID NO: 577758 - RNA, 15 nt, Homo sapiens
acauauuuuuauacu

SEQ ID NO: 577759 - RNA, 20 nt, Homo sapiens
acaucaaaacuaaccaucug

SEQ ID NO: 577760 - RNA, 16 nt, Homo sapiens
acaucacaccugcccu

SEQ ID NO: 577761 - RNA, 13 nt, Homo sapiens
acaucacauucca

SEQ ID NO: 577762 - RNA, 19 nt, Homo sapiens
acaucaccuuuuugacuuu

SEQ ID NO: 577763 - RNA, 20 nt, Homo sapiens
acaucacuuguacaaaauaa

SEQ ID NO: 577764 - RNA, 10 nt, Homo sapiens
acaucacuuu

SEQ ID NO: 577765 - RNA, 18 nt, Homo sapiens
acaucagaccugucuucc

SEQ ID NO: 577766 - RNA, 24 nt, Homo sapiens
acaucagcaagacuuuauaauucc

SEQ ID NO: 577767 - RNA, 23 nt, Homo sapiens
acaucaugcuggaaccugcaaaa

SEQ ID NO: 577768 - RNA, 12 nt, Homo sapiens
acaucauggacu

SEQ ID NO: 577769 - RNA, 14 nt, Homo sapiens
acaucauggacuga

SEQ ID NO: 577770 - RNA, 21 nt, Homo sapiens
acaucauucugugucucugca

SEQ ID NO: 577771 - RNA, 19 nt, Homo sapiens
acauccaaagcagacagcu

SEQ ID NO: 577772 - RNA, 21 nt, Homo sapiens
acauccaaccccccaccugcc

SEQ ID NO: 577773 - RNA, 15 nt, Homo sapiens
acauccaacuccagc

SEQ ID NO: 577774 - RNA, 16 nt, Homo sapiens
acauccaacuccagca

SEQ ID NO: 577775 - RNA, 14 nt, Homo sapiens
acauccagaucuau

SEQ ID NO: 577776 - RNA, 21 nt, Homo sapiens
acauccaggaaggaccuugcu

SEQ ID NO: 577777 - RNA, 15 nt, Homo sapiens
acauccauguuccga

SEQ ID NO: 577778 - RNA, 15 nt, Homo sapiens
acauccccagcugcc

SEQ ID NO: 577779 - RNA, 21 nt, Homo sapiens
acaucccugauucucucucca

SEQ ID NO: 577780 - RNA, 22 nt, Homo sapiens
acaucccuuccuggaaacagca

SEQ ID NO: 577781 - RNA, 20 nt, Homo sapiens
acauccuccacugacuuccu

SEQ ID NO: 577782 - RNA, 20 nt, Homo sapiens
acauccugaccuugcacaaa

SEQ ID NO: 577783 - RNA, 21 nt, Homo sapiens
acauccuguauaagcacugaa

SEQ ID NO: 577784 - RNA, 17 nt, Homo sapiens
acaucuaguuaaucaua

SEQ ID NO: 577785 - RNA, 16 nt, Homo sapiens
acaucucccucccaca

SEQ ID NO: 577786 - RNA, 18 nt, Homo sapiens
acaucucgggaguccucu

SEQ ID NO: 577787 - RNA, 19 nt, Homo sapiens
acaucucucuggcuucuga

SEQ ID NO: 577788 - RNA, 20 nt, Homo sapiens
acaucugcaauaugaauuca

SEQ ID NO: 577789 - RNA, 15 nt, Homo sapiens
acaucuggcccugac

SEQ ID NO: 577790 - RNA, 19 nt, Homo sapiens
acaucuguccuacacuuga

SEQ ID NO: 577791 - RNA, 12 nt, Homo sapiens
acaucuucucaa

SEQ ID NO: 577792 - RNA, 21 nt, Homo sapiens
acaucuucucaaccuuaucaa

SEQ ID NO: 577793 - RNA, 21 nt, Homo sapiens
acaucuugaauacucugcccu

SEQ ID NO: 577794 - RNA, 19 nt, Homo sapiens
acaucuugcucugcauuua

SEQ ID NO: 577795 - RNA, 16 nt, Homo sapiens
acaucuuguaacuuaa

SEQ ID NO: 577796 - RNA, 20 nt, Homo sapiens
acaucuugucuaauuuucac

SEQ ID NO: 577797 - RNA, 22 nt, Homo sapiens
acaugaaaggacccugugagcc

SEQ ID NO: 577798 - RNA, 18 nt, Homo sapiens
auaauauuuacuguuaga

SEQ ID NO: 577799 - RNA, 19 nt, Homo sapiens
auaaucacauuaucaucug

SEQ ID NO: 577800 - RNA, 19 nt, Homo sapiens
auaaucaucccuccuugcc

SEQ ID NO: 577801 - RNA, 19 nt, Homo sapiens
auaaucaugcucauguaua

SEQ ID NO: 577802 - RNA, 19 nt, Homo sapiens
auaaucauuucuacuucaa

SEQ ID NO: 577803 - RNA, 15 nt, Homo sapiens
auaauccacccccag

SEQ ID NO: 577804 - RNA, 20 nt, Homo sapiens
auaaucuuuggguaacuuca

SEQ ID NO: 577805 - RNA, 16 nt, Homo sapiens
auaaugaaauaaucag

SEQ ID NO: 577806 - RNA, 18 nt, Homo sapiens
auaaugacaggcauccaa

SEQ ID NO: 577807 - RNA, 16 nt, Homo sapiens
auaaugaggaguuuau

SEQ ID NO: 577808 - RNA, 14 nt, Homo sapiens
auaaugaggaugau

SEQ ID NO: 577809 - RNA, 19 nt, Homo sapiens
auaaugcaauccuuagucc

SEQ ID NO: 577810 - RNA, 15 nt, Homo sapiens
auaaugcuacugucu

SEQ ID NO: 577811 - RNA, 12 nt, Homo sapiens
auaaugcugaag

SEQ ID NO: 577812 - RNA, 12 nt, Homo sapiens
auaaugcuguuc

SEQ ID NO: 577813 - RNA, 17 nt, Homo sapiens
auaauggaaacauuuac

SEQ ID NO: 577814 - RNA, 18 nt, Homo sapiens
auaauguauuuucagcuc

SEQ ID NO: 577815 - RNA, 13 nt, Homo sapiens
auaaugugcaaau

SEQ ID NO: 577816 - RNA, 17 nt, Homo sapiens
auaauguuacauuauua

SEQ ID NO: 577817 - RNA, 13 nt, Homo sapiens
auaauuaauuacu

SEQ ID NO: 577818 - RNA, 15 nt, Homo sapiens
auaauuaguuccuca

SEQ ID NO: 577819 - RNA, 18 nt, Homo sapiens
auaauucaaagcaccaaa

SEQ ID NO: 577820 - RNA, 19 nt, Homo sapiens
auaauucagcacuuaacua

SEQ ID NO: 577821 - RNA, 15 nt, Homo sapiens
auaauucccuaucuu

SEQ ID NO: 577822 - RNA, 20 nt, Homo sapiens
auaauugcucauaagcaaua

SEQ ID NO: 577823 - RNA, 17 nt, Homo sapiens
auaauuggacucuguca

SEQ ID NO: 577824 - RNA, 18 nt, Homo sapiens
auaauuggcuugaugucc

SEQ ID NO: 577825 - RNA, 13 nt, Homo sapiens
auaauuguuucau

SEQ ID NO: 577826 - RNA, 17 nt, Homo sapiens
auaauuguuucauucau

SEQ ID NO: 577827 - RNA, 15 nt, Homo sapiens
auaauuuaacuucag

SEQ ID NO: 577828 - RNA, 17 nt, Homo sapiens
auaauuucaaaccacac

SEQ ID NO: 577829 - RNA, 14 nt, Homo sapiens
auaauuucuacucu

SEQ ID NO: 577830 - RNA, 20 nt, Homo sapiens
auaauuugaaaaaguuccau

SEQ ID NO: 577831 - RNA, 13 nt, Homo sapiens
auaauuugcacug

SEQ ID NO: 577832 - RNA, 18 nt, Homo sapiens
auaauuugggugacuaga

SEQ ID NO: 577833 - RNA, 20 nt, Homo sapiens
auaauuuucauucauucacu

SEQ ID NO: 577834 - RNA, 11 nt, Homo sapiens
auaauuuugca

SEQ ID NO: 577835 - RNA, 19 nt, Homo sapiens
auacaaaaguuaaccaggu

SEQ ID NO: 577836 - RNA, 21 nt, Homo sapiens
auacaaaauaaagaucacaca

SEQ ID NO: 577837 - RNA, 14 nt, Homo sapiens
auacaaaauauuua

SEQ ID NO: 577838 - RNA, 14 nt, Homo sapiens
auacaaacaaugca

SEQ ID NO: 577839 - RNA, 12 nt, Homo sapiens
auacaaaccuac

SEQ ID NO: 577840 - RNA, 18 nt, Homo sapiens
auacaacagugcauuuac

SEQ ID NO: 577841 - RNA, 12 nt, Homo sapiens
auacaaccagcc

SEQ ID NO: 577842 - RNA, 12 nt, Homo sapiens
auacaacuuuac

SEQ ID NO: 577843 - RNA, 16 nt, Homo sapiens
auacaagaaagcaaug

SEQ ID NO: 577844 - RNA, 19 nt, Homo sapiens
auacaagaaagcaaugcca

SEQ ID NO: 577845 - RNA, 22 nt, Homo sapiens
auacaagcuuuuaguauccaca

SEQ ID NO: 577846 - RNA, 13 nt, Homo sapiens
auacaaguaauau

SEQ ID NO: 577847 - RNA, 14 nt, Homo sapiens
auacaauacagauc

SEQ ID NO: 577848 - RNA, 16 nt, Homo sapiens
auacaaugaccacaua

SEQ ID NO: 577849 - RNA, 15 nt, Homo sapiens
auacacaacuuugca

SEQ ID NO: 577850 - RNA, 12 nt, Homo sapiens
auacacacauau

SEQ ID NO: 577851 - RNA, 19 nt, Homo sapiens
auacacagauauauacaca

SEQ ID NO: 577852 - RNA, 18 nt, Homo sapiens
auacaccacugcaaaaug

SEQ ID NO: 577853 - RNA, 16 nt, Homo sapiens
auacacgaauagacau

SEQ ID NO: 577854 - RNA, 15 nt, Homo sapiens
auacacuaugaagau

SEQ ID NO: 577855 - RNA, 13 nt, Homo sapiens
auacacugucacg

SEQ ID NO: 577856 - RNA, 20 nt, Homo sapiens
auacacuuaaugauacaugu

SEQ ID NO: 577857 - RNA, 21 nt, Homo sapiens
auacagaaagaagcaguucuc

SEQ ID NO: 577858 - RNA, 15 nt, Homo sapiens
auacagagcucucug

SEQ ID NO: 577859 - RNA, 15 nt, Homo sapiens
auacagaucaucuug

SEQ ID NO: 577860 - RNA, 22 nt, Homo sapiens
auacagccaaagauaaucucuc

SEQ ID NO: 577861 - RNA, 19 nt, Homo sapiens
auacagcuguauugucuga

SEQ ID NO: 577862 - RNA, 14 nt, Homo sapiens
auacaggacacuaa

SEQ ID NO: 577863 - RNA, 18 nt, Homo sapiens
auacaggaggcagacaau

SEQ ID NO: 577864 - RNA, 23 nt, Homo sapiens
auacagggauuacuggugugagc

SEQ ID NO: 577865 - RNA, 15 nt, Homo sapiens
auacaguagaagcuc

SEQ ID NO: 577866 - RNA, 12 nt, Homo sapiens
auacagugucuu

SEQ ID NO: 577867 - RNA, 13 nt, Homo sapiens
auacauaagacca

SEQ ID NO: 577868 - RNA, 15 nt, Homo sapiens
auacauaauacauga

SEQ ID NO: 577869 - RNA, 17 nt, Homo sapiens
auacauaauacaugauu

SEQ ID NO: 577870 - RNA, 12 nt, Homo sapiens
auacauacaugu

SEQ ID NO: 577871 - RNA, 13 nt, Homo sapiens
auacauacaugua

SEQ ID NO: 577872 - RNA, 18 nt, Homo sapiens
auacauauauguauauau

SEQ ID NO: 577873 - RNA, 12 nt, Homo sapiens
auacaucaaaga

SEQ ID NO: 577874 - RNA, 16 nt, Homo sapiens
auacaugaagcuucau

SEQ ID NO: 577875 - RNA, 18 nt, Homo sapiens
auacaugcugcuaauuca

SEQ ID NO: 577876 - RNA, 20 nt, Homo sapiens
auacauggaaacgcaaauga

SEQ ID NO: 577877 - RNA, 11 nt, Homo sapiens
accgucuuucu

SEQ ID NO: 577878 - RNA, 19 nt, Homo sapiens
accgugaccguuugcuaua

SEQ ID NO: 577879 - RNA, 21 nt, Homo sapiens
accgugagugacauagccuca

SEQ ID NO: 577880 - RNA, 17 nt, Homo sapiens
accgugggcucccugac

SEQ ID NO: 577881 - RNA, 23 nt, Homo sapiens
accguucauucaggcaacgcaca

SEQ ID NO: 577882 - RNA, 21 nt, Homo sapiens
accguuuugaagcuacugugu

SEQ ID NO: 577883 - RNA, 14 nt, Homo sapiens
accuaaaaacaaaa

SEQ ID NO: 577884 - RNA, 16 nt, Homo sapiens
accuaaaccaccagug

SEQ ID NO: 577885 - RNA, 20 nt, Homo sapiens
accuaaacgguucaguuucu

SEQ ID NO: 577886 - RNA, 14 nt, Homo sapiens
accuaagcacuucu

SEQ ID NO: 577887 - RNA, 17 nt, Homo sapiens
accuaagucucugugaa

SEQ ID NO: 577888 - RNA, 14 nt, Homo sapiens
accuaaucucugua

SEQ ID NO: 577889 - RNA, 19 nt, Homo sapiens
accuaauucgaugaaggcu

SEQ ID NO: 577890 - RNA, 15 nt, Homo sapiens
accuacagagcaccu

SEQ ID NO: 577891 - RNA, 14 nt, Homo sapiens
accuacagugcugu

SEQ ID NO: 577892 - RNA, 15 nt, Homo sapiens
accuacagugcugug

SEQ ID NO: 577893 - RNA, 13 nt, Homo sapiens
accuaccaucagg

SEQ ID NO: 577894 - RNA, 13 nt, Homo sapiens
accuacgugccac

SEQ ID NO: 577895 - RNA, 20 nt, Homo sapiens
accuacuuugguaguggaau

SEQ ID NO: 577896 - RNA, 16 nt, Homo sapiens
accuagaacacuaacu

SEQ ID NO: 577897 - RNA, 14 nt, Homo sapiens
accuagggcacuuu

SEQ ID NO: 577898 - RNA, 15 nt, Homo sapiens
accuagggcacuuua

SEQ ID NO: 577899 - RNA, 18 nt, Homo sapiens
accuaguauaucagugac

SEQ ID NO: 577900 - RNA, 16 nt, Homo sapiens
accuagugccccagac

SEQ ID NO: 577901 - RNA, 23 nt, Homo sapiens
accuaguucuccccgauggggca

SEQ ID NO: 577902 - RNA, 13 nt, Homo sapiens
accuaguuugcac

SEQ ID NO: 577903 - RNA, 16 nt, Homo sapiens
accuauauugauuuaa

SEQ ID NO: 577904 - RNA, 15 nt, Homo sapiens
accuauccucacugc

SEQ ID NO: 577905 - RNA, 11 nt, Homo sapiens
accuaugccug

SEQ ID NO: 577906 - RNA, 15 nt, Homo sapiens
accuaugccuguggu

SEQ ID NO: 577907 - RNA, 12 nt, Homo sapiens
accuauguaaca

SEQ ID NO: 577908 - RNA, 16 nt, Homo sapiens
accuauuucugaugau

SEQ ID NO: 577909 - RNA, 13 nt, Homo sapiens
accuauuugacuu

SEQ ID NO: 577910 - RNA, 15 nt, Homo sapiens
accuauuugacuuac

SEQ ID NO: 577911 - RNA, 21 nt, Homo sapiens
accuauuuuuuucucuauucu

SEQ ID NO: 577912 - RNA, 18 nt, Homo sapiens
accucaaacuuccaguca

SEQ ID NO: 577913 - RNA, 17 nt, Homo sapiens
accucaagguguucucu

SEQ ID NO: 577914 - RNA, 20 nt, Homo sapiens
accucaagguguucucugua

SEQ ID NO: 577915 - RNA, 14 nt, Homo sapiens
accucaaguucuug

SEQ ID NO: 577916 - RNA, 15 nt, Homo sapiens
accucacauccaucu

SEQ ID NO: 577917 - RNA, 12 nt, Homo sapiens
accucaccaaac

SEQ ID NO: 577918 - RNA, 14 nt, Homo sapiens
accucaccaaggac

SEQ ID NO: 577919 - RNA, 16 nt, Homo sapiens
accucagacuuaccag

SEQ ID NO: 577920 - RNA, 17 nt, Homo sapiens
accucagugucauuuau

SEQ ID NO: 577921 - RNA, 22 nt, Homo sapiens
accucagugucauuuaugaaaa

SEQ ID NO: 577922 - RNA, 22 nt, Homo sapiens
accucauagcuaauuuuugcaa

SEQ ID NO: 577923 - RNA, 23 nt, Homo sapiens
accucauagcuaauuuuugcaaa

SEQ ID NO: 577924 - RNA, 16 nt, Homo sapiens
accucauccaugcacu

SEQ ID NO: 577925 - RNA, 18 nt, Homo sapiens
accucauccaugcacuuu

SEQ ID NO: 577926 - RNA, 19 nt, Homo sapiens
accucauccaugcacuuua

SEQ ID NO: 577927 - RNA, 21 nt, Homo sapiens
accucaucuguggagcugcca

SEQ ID NO: 577928 - RNA, 13 nt, Homo sapiens
accucauggauug

SEQ ID NO: 577929 - RNA, 18 nt, Homo sapiens
accucauggauugccaca

SEQ ID NO: 577930 - RNA, 22 nt, Homo sapiens
accuccaaacuuauagcgcuga

SEQ ID NO: 577931 - RNA, 23 nt, Homo sapiens
accuccagcuguacuagugccau

SEQ ID NO: 577932 - RNA, 17 nt, Homo sapiens
accuccagugucagggu

SEQ ID NO: 577933 - RNA, 16 nt, Homo sapiens
accuccauaugcugua

SEQ ID NO: 577934 - RNA, 14 nt, Homo sapiens
aucaguuggaguuu

SEQ ID NO: 577935 - RNA, 12 nt, Homo sapiens
aucaguuugacu

SEQ ID NO: 577936 - RNA, 20 nt, Homo sapiens
aucaguuuuuucaccuggaa

SEQ ID NO: 577937 - RNA, 20 nt, Homo sapiens
aucauaaaacuuuuguguca

SEQ ID NO: 577938 - RNA, 16 nt, Homo sapiens
aucauaagaauagcug

SEQ ID NO: 577939 - RNA, 12 nt, Homo sapiens
aucauaaggaag

SEQ ID NO: 577940 - RNA, 16 nt, Homo sapiens
aucauaauuacauucc

SEQ ID NO: 577941 - RNA, 18 nt, Homo sapiens
aucauaauucagcacuua

SEQ ID NO: 577942 - RNA, 22 nt, Homo sapiens
aucauaauucagcacuuaacua

SEQ ID NO: 577943 - RNA, 17 nt, Homo sapiens
aucauacaaacucucac

SEQ ID NO: 577944 - RNA, 15 nt, Homo sapiens
aucauacugccuacu

SEQ ID NO: 577945 - RNA, 13 nt, Homo sapiens
aucauagggauaa

SEQ ID NO: 577946 - RNA, 14 nt, Homo sapiens
aucauauauauagu

SEQ ID NO: 577947 - RNA, 20 nt, Homo sapiens
aucauauauauaguuaugca

SEQ ID NO: 577948 - RNA, 21 nt, Homo sapiens
aucauauccuaugacccagca

SEQ ID NO: 577949 - RNA, 22 nt, Homo sapiens
aucaucagagccuuuccucaaa

SEQ ID NO: 577950 - RNA, 17 nt, Homo sapiens
aucaucccaacagccaa

SEQ ID NO: 577951 - RNA, 22 nt, Homo sapiens
aucaucccagcugcucccaaau

SEQ ID NO: 577952 - RNA, 23 nt, Homo sapiens
aucaucuccaucauaugccugac

SEQ ID NO: 577953 - RNA, 19 nt, Homo sapiens
aucaucuucucauuuugca

SEQ ID NO: 577954 - RNA, 20 nt, Homo sapiens
aucaugaaaaugucuauuca

SEQ ID NO: 577955 - RNA, 17 nt, Homo sapiens
aucaugaaacaccuuaa

SEQ ID NO: 577956 - RNA, 17 nt, Homo sapiens
aucaugaaaccaaaaag

SEQ ID NO: 577957 - RNA, 15 nt, Homo sapiens
aucaugaacagcucu

SEQ ID NO: 577958 - RNA, 23 nt, Homo sapiens
aucaugagcaagugaacacuguu

SEQ ID NO: 577959 - RNA, 20 nt, Homo sapiens
aucaugauccuuguguucag

SEQ ID NO: 577960 - RNA, 23 nt, Homo sapiens
aucaugaugcuagccagcaaaga

SEQ ID NO: 577961 - RNA, 19 nt, Homo sapiens
aucaugcaaaugcuguauu

SEQ ID NO: 577962 - RNA, 12 nt, Homo sapiens
aucaugcuuaug

SEQ ID NO: 577963 - RNA, 14 nt, Homo sapiens
aucauggaaaugua

SEQ ID NO: 577964 - RNA, 20 nt, Homo sapiens
aucauggaaauguauuuuag

SEQ ID NO: 577965 - RNA, 17 nt, Homo sapiens
aucauggagaacagcau

SEQ ID NO: 577966 - RNA, 21 nt, Homo sapiens
aucauggagaagugaaggcau

SEQ ID NO: 577967 - RNA, 15 nt, Homo sapiens
aucauggcucacugc

SEQ ID NO: 577968 - RNA, 22 nt, Homo sapiens
aucaugguacauuuaucacuga

SEQ ID NO: 577969 - RNA, 14 nt, Homo sapiens
aucaugguagucac

SEQ ID NO: 577970 - RNA, 14 nt, Homo sapiens
aucaugucauaaac

SEQ ID NO: 577971 - RNA, 20 nt, Homo sapiens
aucauguggcccaacucucc

SEQ ID NO: 577972 - RNA, 12 nt, Homo sapiens
aucauguuugcu

SEQ ID NO: 577973 - RNA, 14 nt, Homo sapiens
aucauuaacugcca

SEQ ID NO: 577974 - RNA, 14 nt, Homo sapiens
aucauuacugguaa

SEQ ID NO: 577975 - RNA, 17 nt, Homo sapiens
aucauucaaguguaaaa

SEQ ID NO: 577976 - RNA, 15 nt, Homo sapiens
aucauucagcaucua

SEQ ID NO: 577977 - RNA, 15 nt, Homo sapiens
aucauucccauuuug

SEQ ID NO: 577978 - RNA, 16 nt, Homo sapiens
aucauucccucucauc

SEQ ID NO: 577979 - RNA, 16 nt, Homo sapiens
aucauucucauucuca

SEQ ID NO: 577980 - RNA, 17 nt, Homo sapiens
aucauucucugucucau

SEQ ID NO: 577981 - RNA, 20 nt, Homo sapiens
aucauuggaacaacugauac

SEQ ID NO: 577982 - RNA, 15 nt, Homo sapiens
aucauuucaguauca

SEQ ID NO: 577983 - RNA, 20 nt, Homo sapiens
aucauuuccccaacagggca

SEQ ID NO: 577984 - RNA, 17 nt, Homo sapiens
aucauuuccugggagaa

SEQ ID NO: 577985 - RNA, 22 nt, Homo sapiens
aucauuucuauuucuccuccau

SEQ ID NO: 577986 - RNA, 14 nt, Homo sapiens
aucauuucugccau

SEQ ID NO: 577987 - RNA, 22 nt, Homo sapiens
aucauuuuaagaagacaugaca

SEQ ID NO: 577988 - RNA, 18 nt, Homo sapiens
aucauuuuuauacaggac

SEQ ID NO: 577989 - RNA, 19 nt, Homo sapiens
aucauuuuuauacaggaca

SEQ ID NO: 577990 - RNA, 16 nt, Homo sapiens
aucauuuuugaugacu

SEQ ID NO: 577991 - RNA, 20 nt, Homo sapiens
auccaaaaauagcccugcaa

SEQ ID NO: 577992 - RNA, 13 nt, Homo sapiens
auccaaaagacaa

SEQ ID NO: 577993 - RNA, 14 nt, Homo sapiens
auccaaaaucuuga

SEQ ID NO: 577994 - RNA, 18 nt, Homo sapiens
auccaaagaacaucugca

SEQ ID NO: 577995 - RNA, 14 nt, Homo sapiens
auccaaagacugua

SEQ ID NO: 577996 - RNA, 15 nt, Homo sapiens
auccaaagacuguac

SEQ ID NO: 577997 - RNA, 17 nt, Homo sapiens
auccaaagcugaauaca

SEQ ID NO: 577998 - RNA, 17 nt, Homo sapiens
auccaaauuuauugugc

SEQ ID NO: 577999 - RNA, 17 nt, Homo sapiens
accugcgcacagguggg

SEQ ID NO: 578000 - RNA, 16 nt, Homo sapiens
accugcucacagggau

SEQ ID NO: 578001 - RNA, 13 nt, Homo sapiens
accugcuggugag

SEQ ID NO: 578002 - RNA, 17 nt, Homo sapiens
accugcugugaugacuu

SEQ ID NO: 578003 - RNA, 16 nt, Homo sapiens
accugcuuagcugccu

SEQ ID NO: 578004 - RNA, 13 nt, Homo sapiens
accugcuuggucu

SEQ ID NO: 578005 - RNA, 17 nt, Homo sapiens
accugcuuggucuuuca

SEQ ID NO: 578006 - RNA, 17 nt, Homo sapiens
accuggaaucagugaag

SEQ ID NO: 578007 - RNA, 12 nt, Homo sapiens
accuggauccag

SEQ ID NO: 578008 - RNA, 20 nt, Homo sapiens
accuggauccagcacuggug

SEQ ID NO: 578009 - RNA, 17 nt, Homo sapiens
accuggauguacuuaag

SEQ ID NO: 578010 - RNA, 22 nt, Homo sapiens
accuggauuuuuuauguacaac

SEQ ID NO: 578011 - RNA, 21 nt, Homo sapiens
accuggcaacaaaaaguaaug

SEQ ID NO: 578012 - RNA, 20 nt, Homo sapiens
accuggcagacuugcccagg

SEQ ID NO: 578013 - RNA, 19 nt, Homo sapiens
accuggcauggugcaggga

SEQ ID NO: 578014 - RNA, 23 nt, Homo sapiens
accuggcauuccuucugaccaca

SEQ ID NO: 578015 - RNA, 16 nt, Homo sapiens
accuggccccaggcug

SEQ ID NO: 578016 - RNA, 21 nt, Homo sapiens
accuggccccaggcugucacc

SEQ ID NO: 578017 - RNA, 19 nt, Homo sapiens
accuggcccuugcaaucuu

SEQ ID NO: 578018 - RNA, 17 nt, Homo sapiens
accuggccuuucacuuu

SEQ ID NO: 578019 - RNA, 14 nt, Homo sapiens
accuggcuuuuacu

SEQ ID NO: 578020 - RNA, 21 nt, Homo sapiens
accugggagaccagggaccac

SEQ ID NO: 578021 - RNA, 17 nt, Homo sapiens
accuggggcacagucca

SEQ ID NO: 578022 - RNA, 20 nt, Homo sapiens
accuggggcacaguccagga

SEQ ID NO: 578023 - RNA, 22 nt, Homo sapiens
accugggggccuggccuugcaa

SEQ ID NO: 578024 - RNA, 19 nt, Homo sapiens
accuggucugguugggcag

SEQ ID NO: 578025 - RNA, 13 nt, Homo sapiens
accuggugcacuu

SEQ ID NO: 578026 - RNA, 14 nt, Homo sapiens
accuguaaaacuuu

SEQ ID NO: 578027 - RNA, 13 nt, Homo sapiens
accuguaauccca

SEQ ID NO: 578028 - RNA, 18 nt, Homo sapiens
accuguaauccuagcacu

SEQ ID NO: 578029 - RNA, 14 nt, Homo sapiens
accuguacauucuu

SEQ ID NO: 578030 - RNA, 24 nt, Homo sapiens
accuguacauucuuccaucaucac

SEQ ID NO: 578031 - RNA, 14 nt, Homo sapiens
accuguacucuucc

SEQ ID NO: 578032 - RNA, 21 nt, Homo sapiens
accuguagauucagguaauac

SEQ ID NO: 578033 - RNA, 11 nt, Homo sapiens
accuguagucc

SEQ ID NO: 578034 - RNA, 18 nt, Homo sapiens
accuguauacagugcaga

SEQ ID NO: 578035 - RNA, 14 nt, Homo sapiens
accugucauuguau

SEQ ID NO: 578036 - RNA, 21 nt, Homo sapiens
accuguccggcccagugccag

SEQ ID NO: 578037 - RNA, 17 nt, Homo sapiens
accugucucuaccuaag

SEQ ID NO: 578038 - RNA, 21 nt, Homo sapiens
accugugcacguuggaacuuu

SEQ ID NO: 578039 - RNA, 17 nt, Homo sapiens
accugugccuccucaga

SEQ ID NO: 578040 - RNA, 14 nt, Homo sapiens
accugugugcuugg

SEQ ID NO: 578041 - RNA, 14 nt, Homo sapiens
accuguucaagaag

SEQ ID NO: 578042 - RNA, 18 nt, Homo sapiens
accuguucuguguugcaa

SEQ ID NO: 578043 - RNA, 20 nt, Homo sapiens
accuguugagacugauucag

SEQ ID NO: 578044 - RNA, 12 nt, Homo sapiens
accuguuuucac

SEQ ID NO: 578045 - RNA, 19 nt, Homo sapiens
accuguuuucgcaccuacc

SEQ ID NO: 578046 - RNA, 22 nt, Homo sapiens
accuguuuucgcaccuaccauc

SEQ ID NO: 578047 - RNA, 14 nt, Homo sapiens
accuuaaaauguaa

SEQ ID NO: 578048 - RNA, 18 nt, Homo sapiens
accuuaagagacacucca

SEQ ID NO: 578049 - RNA, 18 nt, Homo sapiens
accuuaaugacaacacuu

SEQ ID NO: 578050 - RNA, 17 nt, Homo sapiens
accuuacaacucgggga

SEQ ID NO: 578051 - RNA, 15 nt, Homo sapiens
accuuaguuccuuac

SEQ ID NO: 578052 - RNA, 18 nt, Homo sapiens
accuuaucaagaggaucu

SEQ ID NO: 578053 - RNA, 22 nt, Homo sapiens
accuuauuaaagguaugcauuu

SEQ ID NO: 578054 - RNA, 22 nt, Homo sapiens
accuucaaaauguucuauuuaa

SEQ ID NO: 578055 - RNA, 15 nt, Homo sapiens
accuucaagaucuca

SEQ ID NO: 578056 - RNA, 15 nt, Homo sapiens
accuucaauuccugg

SEQ ID NO: 578057 - RNA, 14 nt, Homo sapiens
auccccagcugccu

SEQ ID NO: 578058 - RNA, 16 nt, Homo sapiens
auccccaggcaccuca

SEQ ID NO: 578059 - RNA, 14 nt, Homo sapiens
auccccauccucca

SEQ ID NO: 578060 - RNA, 16 nt, Homo sapiens
auccccugcacuaggc

SEQ ID NO: 578061 - RNA, 20 nt, Homo sapiens
auccccuguguggucuccau

SEQ ID NO: 578062 - RNA, 23 nt, Homo sapiens
aucccguaccucuucccaugacu

SEQ ID NO: 578063 - RNA, 17 nt, Homo sapiens
aucccguaucacagugu

SEQ ID NO: 578064 - RNA, 14 nt, Homo sapiens
aucccguguugcca

SEQ ID NO: 578065 - RNA, 16 nt, Homo sapiens
aucccguguugccaug

SEQ ID NO: 578066 - RNA, 20 nt, Homo sapiens
aucccuacauguauugcaca

SEQ ID NO: 578067 - RNA, 15 nt, Homo sapiens
aucccuaucuugcag

SEQ ID NO: 578068 - RNA, 12 nt, Homo sapiens
aucccucauacc

SEQ ID NO: 578069 - RNA, 15 nt, Homo sapiens
aucccuccuugccua

SEQ ID NO: 578070 - RNA, 16 nt, Homo sapiens
aucccugaaacaucuc

SEQ ID NO: 578071 - RNA, 20 nt, Homo sapiens
aucccugcccagccuguggu

SEQ ID NO: 578072 - RNA, 21 nt, Homo sapiens
aucccuggguucaacucugcu

SEQ ID NO: 578073 - RNA, 17 nt, Homo sapiens
aucccugguuccuagca

SEQ ID NO: 578074 - RNA, 23 nt, Homo sapiens
aucccuguucauuguaagcacuu

SEQ ID NO: 578075 - RNA, 17 nt, Homo sapiens
aucccuuaagaaguuag

SEQ ID NO: 578076 - RNA, 16 nt, Homo sapiens
aucccuuaccucggug

SEQ ID NO: 578077 - RNA, 16 nt, Homo sapiens
aucccuuugucuguca

SEQ ID NO: 578078 - RNA, 16 nt, Homo sapiens
aucccuuuuuuuacau

SEQ ID NO: 578079 - RNA, 13 nt, Homo sapiens
auccgaaacggca

SEQ ID NO: 578080 - RNA, 19 nt, Homo sapiens
auccgaaguaugagggaaa

SEQ ID NO: 578081 - RNA, 12 nt, Homo sapiens
auccgacuugaa

SEQ ID NO: 578082 - RNA, 15 nt, Homo sapiens
auccgagugugauuu

SEQ ID NO: 578083 - RNA, 15 nt, Homo sapiens
auccgccuaccucag

SEQ ID NO: 578084 - RNA, 22 nt, Homo sapiens
auccgcuguccagcagcugcca

SEQ ID NO: 578085 - RNA, 13 nt, Homo sapiens
auccguacauuca

SEQ ID NO: 578086 - RNA, 20 nt, Homo sapiens
auccuaaaagagaucugggc

SEQ ID NO: 578087 - RNA, 16 nt, Homo sapiens
auccuaaauaauguua

SEQ ID NO: 578088 - RNA, 13 nt, Homo sapiens
auccuaacaugac

SEQ ID NO: 578089 - RNA, 13 nt, Homo sapiens
auccuaacauuca

SEQ ID NO: 578090 - RNA, 17 nt, Homo sapiens
auccuacaagacacagu

SEQ ID NO: 578091 - RNA, 20 nt, Homo sapiens
auccuacaaggcuggcagug

SEQ ID NO: 578092 - RNA, 14 nt, Homo sapiens
auccuagcacuuug

SEQ ID NO: 578093 - RNA, 15 nt, Homo sapiens
auccuagcacuuugg

SEQ ID NO: 578094 - RNA, 15 nt, Homo sapiens
auccuagccaacauc

SEQ ID NO: 578095 - RNA, 14 nt, Homo sapiens
auccuaggcauuug

SEQ ID NO: 578096 - RNA, 15 nt, Homo sapiens
auccuaggcauuugc

SEQ ID NO: 578097 - RNA, 18 nt, Homo sapiens
auccuaguaauugccuag

SEQ ID NO: 578098 - RNA, 14 nt, Homo sapiens
auccuauaucuguu

SEQ ID NO: 578099 - RNA, 11 nt, Homo sapiens
auccuauuuau

SEQ ID NO: 578100 - RNA, 15 nt, Homo sapiens
auccuauuuaucaga

SEQ ID NO: 578101 - RNA, 20 nt, Homo sapiens
auccucacagugaacacuca

SEQ ID NO: 578102 - RNA, 17 nt, Homo sapiens
auccucaccauccacag

SEQ ID NO: 578103 - RNA, 18 nt, Homo sapiens
auccucacgccuuggccu

SEQ ID NO: 578104 - RNA, 20 nt, Homo sapiens
auccucacugggugggguga

SEQ ID NO: 578105 - RNA, 16 nt, Homo sapiens
auccucagccgagaaa

SEQ ID NO: 578106 - RNA, 18 nt, Homo sapiens
auccuccaagaauuugac

SEQ ID NO: 578107 - RNA, 15 nt, Homo sapiens
auccuccacagagag

SEQ ID NO: 578108 - RNA, 15 nt, Homo sapiens
auccuccaguaccuu

SEQ ID NO: 578109 - RNA, 21 nt, Homo sapiens
auccuccccagcgccaucugu

SEQ ID NO: 578110 - RNA, 18 nt, Homo sapiens
auccucccuccaccucaa

SEQ ID NO: 578111 - RNA, 21 nt, Homo sapiens
auccucccuggcagacacaac

SEQ ID NO: 578112 - RNA, 14 nt, Homo sapiens
auccuccuaccuca

SEQ ID NO: 578113 - RNA, 17 nt, Homo sapiens
auccuccuaccucagcc

SEQ ID NO: 578114 - RNA, 13 nt, Homo sapiens
auccuccucagcc

SEQ ID NO: 578115 - RNA, 15 nt, Homo sapiens
auccucguucuaaua

SEQ ID NO: 578116 - RNA, 21 nt, Homo sapiens
auccucucccauggagacaag

SEQ ID NO: 578117 - RNA, 12 nt, Homo sapiens
auccucucucuc

SEQ ID NO: 578118 - RNA, 23 nt, Homo sapiens
auccucuggaaaaggcuuucaug

SEQ ID NO: 578119 - RNA, 14 nt, Homo sapiens
auccugaacuuucu

SEQ ID NO: 578120 - RNA, 13 nt, Homo sapiens
auccugaauucca

SEQ ID NO: 578121 - RNA, 15 nt, Homo sapiens
auccugacauauuca

SEQ ID NO: 578122 - RNA, 12 nt, Homo sapiens
acuaacacuggc

SEQ ID NO: 578123 - RNA, 20 nt, Homo sapiens
acuaaccaguaccucuguau

SEQ ID NO: 578124 - RNA, 14 nt, Homo sapiens
acuaacccaaugcc

SEQ ID NO: 578125 - RNA, 12 nt, Homo sapiens
acuaaccuggua

SEQ ID NO: 578126 - RNA, 16 nt, Homo sapiens
acuaacuagacuaaga

SEQ ID NO: 578127 - RNA, 17 nt, Homo sapiens
acuaacugcuucaucuc

SEQ ID NO: 578128 - RNA, 16 nt, Homo sapiens
acuaagaaauauucca

SEQ ID NO: 578129 - RNA, 14 nt, Homo sapiens
acuaagacaccuga

SEQ ID NO: 578130 - RNA, 18 nt, Homo sapiens
acuaagagaaugugcuca

SEQ ID NO: 578131 - RNA, 19 nt, Homo sapiens
acuaagaugaaauugccaa

SEQ ID NO: 578132 - RNA, 19 nt, Homo sapiens
acuaagcaaauaggcaaaa

SEQ ID NO: 578133 - RNA, 12 nt, Homo sapiens
acuaagcucuuu

SEQ ID NO: 578134 - RNA, 16 nt, Homo sapiens
acuaaggaaucuuucu

SEQ ID NO: 578135 - RNA, 22 nt, Homo sapiens
acuaaggaguaaucuguguaca

SEQ ID NO: 578136 - RNA, 14 nt, Homo sapiens
acuaauaaauugac

SEQ ID NO: 578137 - RNA, 13 nt, Homo sapiens
acuaaucaagaaa

SEQ ID NO: 578138 - RNA, 14 nt, Homo sapiens
acuaaucuuauuca

SEQ ID NO: 578139 - RNA, 15 nt, Homo sapiens
acuaaugaggauugc

SEQ ID NO: 578140 - RNA, 16 nt, Homo sapiens
acuaaugaugcuuuua

SEQ ID NO: 578141 - RNA, 15 nt, Homo sapiens
acuaaugcuaagaaa

SEQ ID NO: 578142 - RNA, 20 nt, Homo sapiens
acuaaugggaagaccaaaau

SEQ ID NO: 578143 - RNA, 19 nt, Homo sapiens
acuaauuauacuacuuugu

SEQ ID NO: 578144 - RNA, 20 nt, Homo sapiens
acuaauuauacuacuuuguu

SEQ ID NO: 578145 - RNA, 19 nt, Homo sapiens
acuaauuuauaacuauuau

SEQ ID NO: 578146 - RNA, 15 nt, Homo sapiens
acuaauuuuacaugu

SEQ ID NO: 578147 - RNA, 17 nt, Homo sapiens
acuaauuuuguacguau

SEQ ID NO: 578148 - RNA, 20 nt, Homo sapiens
acuaauuuuuauuuuugcug

SEQ ID NO: 578149 - RNA, 22 nt, Homo sapiens
acuacaacuuuuguuuucugau

SEQ ID NO: 578150 - RNA, 21 nt, Homo sapiens
acuacaagacaauuguugaaa

SEQ ID NO: 578151 - RNA, 15 nt, Homo sapiens
acuacaaugauggua

SEQ ID NO: 578152 - RNA, 17 nt, Homo sapiens
acuacaguaacugugac

SEQ ID NO: 578153 - RNA, 18 nt, Homo sapiens
acuacaguaacugugacu

SEQ ID NO: 578154 - RNA, 14 nt, Homo sapiens
acuaccaacuuuca

SEQ ID NO: 578155 - RNA, 16 nt, Homo sapiens
acuacccgagcccagc

SEQ ID NO: 578156 - RNA, 20 nt, Homo sapiens
acuaccuaacauuauuuauu

SEQ ID NO: 578157 - RNA, 17 nt, Homo sapiens
acuaccucccacugagg

SEQ ID NO: 578158 - RNA, 23 nt, Homo sapiens
acuaccuugguucccccacugau

SEQ ID NO: 578159 - RNA, 21 nt, Homo sapiens
acuacguagcuaguaagcauu

SEQ ID NO: 578160 - RNA, 16 nt, Homo sapiens
acuacuaaagugccua

SEQ ID NO: 578161 - RNA, 22 nt, Homo sapiens
acuacuccucugcagugccuug

SEQ ID NO: 578162 - RNA, 12 nt, Homo sapiens
acuacuccugua

SEQ ID NO: 578163 - RNA, 20 nt, Homo sapiens
acuagaaaauuagacuguga

SEQ ID NO: 578164 - RNA, 16 nt, Homo sapiens
acuagaagagauuucu

SEQ ID NO: 578165 - RNA, 18 nt, Homo sapiens
acuagaccuguaacuuuu

SEQ ID NO: 578166 - RNA, 18 nt, Homo sapiens
acuagagggauacacuga

SEQ ID NO: 578167 - RNA, 23 nt, Homo sapiens
acuagagucugaacagcuguaau

SEQ ID NO: 578168 - RNA, 13 nt, Homo sapiens
acuagauacugaa

SEQ ID NO: 578169 - RNA, 17 nt, Homo sapiens
acuagauguaugugaau

SEQ ID NO: 578170 - RNA, 15 nt, Homo sapiens
acuagauugcaugcu

SEQ ID NO: 578171 - RNA, 13 nt, Homo sapiens
acuagcacaguaa

SEQ ID NO: 578172 - RNA, 10 nt, Homo sapiens
acuagcauua

SEQ ID NO: 578173 - RNA, 22 nt, Homo sapiens
acuagccaggaaguacuuccac

SEQ ID NO: 578174 - RNA, 21 nt, Homo sapiens
acuagcccaaugaaaugaauu

SEQ ID NO: 578175 - RNA, 20 nt, Homo sapiens
acuagcccuccuuuuuccaa

SEQ ID NO: 578176 - RNA, 14 nt, Homo sapiens
acuagcuuacugag

SEQ ID NO: 578177 - RNA, 17 nt, Homo sapiens
acuaggaauucuuugca

SEQ ID NO: 578178 - RNA, 23 nt, Homo sapiens
acuaggcucuuaugugugccuuu

SEQ ID NO: 578179 - RNA, 16 nt, Homo sapiens
acuagggagccauuug

SEQ ID NO: 578180 - RNA, 18 nt, Homo sapiens
acuagggagccauuugag

SEQ ID NO: 578181 - RNA, 11 nt, Homo sapiens
acuagggccaa

SEQ ID NO: 578182 - RNA, 11 nt, Homo sapiens
aucuaccagca

SEQ ID NO: 578183 - RNA, 21 nt, Homo sapiens
aucuaccaggugaucuauuca

SEQ ID NO: 578184 - RNA, 14 nt, Homo sapiens
aucuacuaauucca

SEQ ID NO: 578185 - RNA, 13 nt, Homo sapiens
aucuagcauuuau

SEQ ID NO: 578186 - RNA, 20 nt, Homo sapiens
aucuagccagagcccuucac

SEQ ID NO: 578187 - RNA, 20 nt, Homo sapiens
aucuaguucucaaucacugc

SEQ ID NO: 578188 - RNA, 16 nt, Homo sapiens
aucuauaguucacuga

SEQ ID NO: 578189 - RNA, 16 nt, Homo sapiens
aucuaugccuaaaaag

SEQ ID NO: 578190 - RNA, 18 nt, Homo sapiens
aucuauggaaaugugaga

SEQ ID NO: 578191 - RNA, 13 nt, Homo sapiens
aucuaugucauau

SEQ ID NO: 578192 - RNA, 15 nt, Homo sapiens
aucuauguguaugca

SEQ ID NO: 578193 - RNA, 23 nt, Homo sapiens
aucuauugcagagacucauuuca

SEQ ID NO: 578194 - RNA, 16 nt, Homo sapiens
aucuauuuguacaauu

SEQ ID NO: 578195 - RNA, 17 nt, Homo sapiens
aucucaaaguguacaaa

SEQ ID NO: 578196 - RNA, 14 nt, Homo sapiens
aucucaaauucuca

SEQ ID NO: 578197 - RNA, 16 nt, Homo sapiens
aucucaacaaccugaa

SEQ ID NO: 578198 - RNA, 18 nt, Homo sapiens
aucucaagauucaguaga

SEQ ID NO: 578199 - RNA, 12 nt, Homo sapiens
aucucacuuuau

SEQ ID NO: 578200 - RNA, 20 nt, Homo sapiens
aucucagaaccuugucccag

SEQ ID NO: 578201 - RNA, 18 nt, Homo sapiens
aucucagauacuuaugaa

SEQ ID NO: 578202 - RNA, 12 nt, Homo sapiens
aucucagcacuu

SEQ ID NO: 578203 - RNA, 15 nt, Homo sapiens
aucucauuccacugu

SEQ ID NO: 578204 - RNA, 20 nt, Homo sapiens
aucucauuggacccuuccau

SEQ ID NO: 578205 - RNA, 18 nt, Homo sapiens
aucucauuucauucucac

SEQ ID NO: 578206 - RNA, 18 nt, Homo sapiens
aucucauuuuacacaaag

SEQ ID NO: 578207 - RNA, 20 nt, Homo sapiens
aucuccaaaauaaaacuuuu

SEQ ID NO: 578208 - RNA, 20 nt, Homo sapiens
aucuccagauggaauggggu

SEQ ID NO: 578209 - RNA, 17 nt, Homo sapiens
aucuccagggcuccaaa

SEQ ID NO: 578210 - RNA, 20 nt, Homo sapiens
aucuccaucauaugccugac

SEQ ID NO: 578211 - RNA, 17 nt, Homo sapiens
aucuccccaggccucca

SEQ ID NO: 578212 - RNA, 16 nt, Homo sapiens
aucuccccucagauuc

SEQ ID NO: 578213 - RNA, 17 nt, Homo sapiens
aucuccccucagauucc

SEQ ID NO: 578214 - RNA, 18 nt, Homo sapiens
aucuccccucucaccuca

SEQ ID NO: 578215 - RNA, 23 nt, Homo sapiens
aucuccccucucaccucauuccc

SEQ ID NO: 578216 - RNA, 22 nt, Homo sapiens
aucucccugccgccucaaugug

SEQ ID NO: 578217 - RNA, 13 nt, Homo sapiens
aucucccugcuuu

SEQ ID NO: 578218 - RNA, 22 nt, Homo sapiens
aucucccugcuuuggucuugcc

SEQ ID NO: 578219 - RNA, 18 nt, Homo sapiens
aucucccuuuuccaugac

SEQ ID NO: 578220 - RNA, 17 nt, Homo sapiens
aucuccucagacaguaa

SEQ ID NO: 578221 - RNA, 13 nt, Homo sapiens
aucuccugacaga

SEQ ID NO: 578222 - RNA, 17 nt, Homo sapiens
aucuccugcgcccuuca

SEQ ID NO: 578223 - RNA, 17 nt, Homo sapiens
aucuccuguccaucagc

SEQ ID NO: 578224 - RNA, 19 nt, Homo sapiens
aucuccugugcauggguga

SEQ ID NO: 578225 - RNA, 23 nt, Homo sapiens
aucuccuguuuguugagugcacu

SEQ ID NO: 578226 - RNA, 18 nt, Homo sapiens
aucuccuuaccucuggaa

SEQ ID NO: 578227 - RNA, 19 nt, Homo sapiens
aucucggcuguuccugaga

SEQ ID NO: 578228 - RNA, 22 nt, Homo sapiens
aucucuaacauaugauacugau

SEQ ID NO: 578229 - RNA, 20 nt, Homo sapiens
aucucuaauuagucuaucaa

SEQ ID NO: 578230 - RNA, 23 nt, Homo sapiens
aucucuacccauccccugaugcc

SEQ ID NO: 578231 - RNA, 18 nt, Homo sapiens
aucucuacuaaaaacaca

SEQ ID NO: 578232 - RNA, 20 nt, Homo sapiens
aucucuacuaaaaacacaaa

SEQ ID NO: 578233 - RNA, 22 nt, Homo sapiens
aucucucagccccaaacaccca

SEQ ID NO: 578234 - RNA, 21 nt, Homo sapiens
aucucuccagccccugacccc

SEQ ID NO: 578235 - RNA, 16 nt, Homo sapiens
aucucucccacuuccu

SEQ ID NO: 578236 - RNA, 12 nt, Homo sapiens
aucucucuggcu

SEQ ID NO: 578237 - RNA, 22 nt, Homo sapiens
aucucugauucccugauuuaau

SEQ ID NO: 578238 - RNA, 20 nt, Homo sapiens
aucucugccauaucagugaa

SEQ ID NO: 578239 - RNA, 21 nt, Homo sapiens
aucucugccucucccaggcug

SEQ ID NO: 578240 - RNA, 16 nt, Homo sapiens
aucucugcuuucacuc

SEQ ID NO: 578241 - RNA, 19 nt, Homo sapiens
aucucugguugucuaguca

SEQ ID NO: 578242 - RNA, 19 nt, Homo sapiens
aucucugguuuucuugcca

SEQ ID NO: 578243 - RNA, 16 nt, Homo sapiens
aucucuuagaagccau

SEQ ID NO: 578244 - RNA, 21 nt, Homo sapiens
acccucgggccccauccucau

SEQ ID NO: 578245 - RNA, 15 nt, Homo sapiens
acccucucacuuugg

SEQ ID NO: 578246 - RNA, 19 nt, Homo sapiens
acccucuccccacugcuca

SEQ ID NO: 578247 - RNA, 17 nt, Homo sapiens
acccucuccuccagugu

SEQ ID NO: 578248 - RNA, 14 nt, Homo sapiens
acccucucuucccu

SEQ ID NO: 578249 - RNA, 19 nt, Homo sapiens
acccucuuagaaaaaccac

SEQ ID NO: 578250 - RNA, 21 nt, Homo sapiens
acccucuuuuaccaacuuccu

SEQ ID NO: 578251 - RNA, 20 nt, Homo sapiens
acccugagcagaauacuggu

SEQ ID NO: 578252 - RNA, 16 nt, Homo sapiens
acccugaguucaucca

SEQ ID NO: 578253 - RNA, 17 nt, Homo sapiens
acccugcaaaggacugu

SEQ ID NO: 578254 - RNA, 17 nt, Homo sapiens
acccugccggguagcug

SEQ ID NO: 578255 - RNA, 19 nt, Homo sapiens
acccugccuuaucuugcac

SEQ ID NO: 578256 - RNA, 15 nt, Homo sapiens
acccugcgauuuugc

SEQ ID NO: 578257 - RNA, 16 nt, Homo sapiens
acccugcgauuuugcc

SEQ ID NO: 578258 - RNA, 16 nt, Homo sapiens
acccugcuucaaauau

SEQ ID NO: 578259 - RNA, 18 nt, Homo sapiens
acccuggaccauuccagg

SEQ ID NO: 578260 - RNA, 18 nt, Homo sapiens
acccuggccuagaccagc

SEQ ID NO: 578261 - RNA, 16 nt, Homo sapiens
acccugggaccacaga

SEQ ID NO: 578262 - RNA, 23 nt, Homo sapiens
acccuggggcaggggugcuuccu

SEQ ID NO: 578263 - RNA, 20 nt, Homo sapiens
acccuggugaccuccuguca

SEQ ID NO: 578264 - RNA, 22 nt, Homo sapiens
acccugucaaguuaacaaggaa

SEQ ID NO: 578265 - RNA, 22 nt, Homo sapiens
acccuguccggcccagugccac

SEQ ID NO: 578266 - RNA, 14 nt, Homo sapiens
acccuuacuuccug

SEQ ID NO: 578267 - RNA, 18 nt, Homo sapiens
acccuuagcgggacaaag

SEQ ID NO: 578268 - RNA, 15 nt, Homo sapiens
acccuuaucaccagc

SEQ ID NO: 578269 - RNA, 20 nt, Homo sapiens
acccuuaucaccagcugccu

SEQ ID NO: 578270 - RNA, 13 nt, Homo sapiens
acccuuauuacac

SEQ ID NO: 578271 - RNA, 13 nt, Homo sapiens
acccuucaacgcu

SEQ ID NO: 578272 - RNA, 15 nt, Homo sapiens
acccuucccagcccu

SEQ ID NO: 578273 - RNA, 22 nt, Homo sapiens
acccuucucgcuuuugccauua

SEQ ID NO: 578274 - RNA, 17 nt, Homo sapiens
acccuucuuuugaagga

SEQ ID NO: 578275 - RNA, 15 nt, Homo sapiens
acccuugaaccaaua

SEQ ID NO: 578276 - RNA, 20 nt, Homo sapiens
acccuugaucuuaacaaagc

SEQ ID NO: 578277 - RNA, 15 nt, Homo sapiens
acccuugauuauacu

SEQ ID NO: 578278 - RNA, 18 nt, Homo sapiens
acccuugguggcuuaugg

SEQ ID NO: 578279 - RNA, 22 nt, Homo sapiens
acccuugugagagcccauuccc

SEQ ID NO: 578280 - RNA, 23 nt, Homo sapiens
acccuuuaagauauccaucuuuu

SEQ ID NO: 578281 - RNA, 14 nt, Homo sapiens
acccuuucauucag

SEQ ID NO: 578282 - RNA, 13 nt, Homo sapiens
aacaugcuuuaga

SEQ ID NO: 578283 - RNA, 17 nt, Homo sapiens
aacauggaaaacagagu

SEQ ID NO: 578284 - RNA, 15 nt, Homo sapiens
aacauggacuuguau

SEQ ID NO: 578285 - RNA, 16 nt, Homo sapiens
aacaugguaaaacccc

SEQ ID NO: 578286 - RNA, 22 nt, Homo sapiens
aacaugguaaaaccccaucucu

SEQ ID NO: 578287 - RNA, 22 nt, Homo sapiens
aacauggugaaaccccgucucu

SEQ ID NO: 578288 - RNA, 23 nt, Homo sapiens
aacauggugaaaccucaucucua

SEQ ID NO: 578289 - RNA, 15 nt, Homo sapiens
aacauguacacuggu

SEQ ID NO: 578290 - RNA, 14 nt, Homo sapiens
aacauguaugugca

SEQ ID NO: 578291 - RNA, 15 nt, Homo sapiens
aacauguccuaauuc

SEQ ID NO: 578292 - RNA, 22 nt, Homo sapiens
aacaugugacuaauuggaagaa

SEQ ID NO: 578293 - RNA, 14 nt, Homo sapiens
aacauguucacuua

SEQ ID NO: 578294 - RNA, 16 nt, Homo sapiens
aacauguuuauugagc

SEQ ID NO: 578295 - RNA, 13 nt, Homo sapiens
aacauuaccaaaa

SEQ ID NO: 578296 - RNA, 15 nt, Homo sapiens
aacauuagaugucau

SEQ ID NO: 578297 - RNA, 22 nt, Homo sapiens
aacauuaggaauuguuuauaca

SEQ ID NO: 578298 - RNA, 20 nt, Homo sapiens
aacauuaggaguaacuuuca

SEQ ID NO: 578299 - RNA, 17 nt, Homo sapiens
aacauuaucuaguucau

SEQ ID NO: 578300 - RNA, 22 nt, Homo sapiens
aacauuaucuaguucauugaau

SEQ ID NO: 578301 - RNA, 18 nt, Homo sapiens
aacauuauuuauucagcu

SEQ ID NO: 578302 - RNA, 14 nt, Homo sapiens
aacauucacagccc

SEQ ID NO: 578303 - RNA, 14 nt, Homo sapiens
aacauucaguuccc

SEQ ID NO: 578304 - RNA, 17 nt, Homo sapiens
aacauuccaaugcauug

SEQ ID NO: 578305 - RNA, 23 nt, Homo sapiens
aacauuccauuugaagcagugau

SEQ ID NO: 578306 - RNA, 14 nt, Homo sapiens
aacauuccuguuga

SEQ ID NO: 578307 - RNA, 20 nt, Homo sapiens
aacauuccuguugaugggaa

SEQ ID NO: 578308 - RNA, 21 nt, Homo sapiens
aacauucugaaucaagcacac

SEQ ID NO: 578309 - RNA, 11 nt, Homo sapiens
aacauucugua

SEQ ID NO: 578310 - RNA, 21 nt, Homo sapiens
aacauucuuuuaacuucuuuc

SEQ ID NO: 578311 - RNA, 19 nt, Homo sapiens
aacauugcaauaaauggcu

SEQ ID NO: 578312 - RNA, 20 nt, Homo sapiens
aacauugcaauaaauggcuu

SEQ ID NO: 578313 - RNA, 13 nt, Homo sapiens
aacauugcacuuu

SEQ ID NO: 578314 - RNA, 14 nt, Homo sapiens
aacauugcacuuua

SEQ ID NO: 578315 - RNA, 23 nt, Homo sapiens
aacauugccauguaacuauguau

SEQ ID NO: 578316 - RNA, 17 nt, Homo sapiens
aacauugguucuuucau

SEQ ID NO: 578317 - RNA, 13 nt, Homo sapiens
aacauuguacaag

SEQ ID NO: 578318 - RNA, 22 nt, Homo sapiens
aacauuguacaagucacccagc

SEQ ID NO: 578319 - RNA, 15 nt, Homo sapiens
aacauugugauguau

SEQ ID NO: 578320 - RNA, 22 nt, Homo sapiens
aacauugugccaugucaaacaa

SEQ ID NO: 578321 - RNA, 21 nt, Homo sapiens
aacauuuaaagagauuucccu

SEQ ID NO: 578322 - RNA, 20 nt, Homo sapiens
aacauuucucaaaugcacau

SEQ ID NO: 578323 - RNA, 20 nt, Homo sapiens
aacauuucuggacaguaccu

SEQ ID NO: 578324 - RNA, 10 nt, Homo sapiens
aacauuugcc

SEQ ID NO: 578325 - RNA, 23 nt, Homo sapiens
aacauuugccaagugaguugaau

SEQ ID NO: 578326 - RNA, 13 nt, Homo sapiens
aacauuugcugaa

SEQ ID NO: 578327 - RNA, 14 nt, Homo sapiens
aacauuuguuccug

SEQ ID NO: 578328 - RNA, 22 nt, Homo sapiens
aacauuuucagaccaugaauga

SEQ ID NO: 578329 - RNA, 19 nt, Homo sapiens
aacauuuuuuagucuguaa

SEQ ID NO: 578330 - RNA, 19 nt, Homo sapiens
aacauuuuuucccagugag

SEQ ID NO: 578331 - RNA, 19 nt, Homo sapiens
aaccaaaaugauacuuacu

SEQ ID NO: 578332 - RNA, 22 nt, Homo sapiens
aaccaaacccagacaaccaaaa

SEQ ID NO: 578333 - RNA, 18 nt, Homo sapiens
aaccaaaggugaaggaau

SEQ ID NO: 578334 - RNA, 20 nt, Homo sapiens
aaccaaaucuggaagccaaa

SEQ ID NO: 578335 - RNA, 14 nt, Homo sapiens
aaccaacaaaaaga

SEQ ID NO: 578336 - RNA, 20 nt, Homo sapiens
aaccaagacaaaaagccaca

SEQ ID NO: 578337 - RNA, 21 nt, Homo sapiens
aaccaagagauaacuguaaau

SEQ ID NO: 578338 - RNA, 22 nt, Homo sapiens
aaccaagaggcugguuuuggca

SEQ ID NO: 578339 - RNA, 16 nt, Homo sapiens
aaccaaggaaagugaa

SEQ ID NO: 578340 - RNA, 16 nt, Homo sapiens
aaccaaggacugagca

SEQ ID NO: 578341 - RNA, 20 nt, Homo sapiens
aaccaagucaggccaggugg

SEQ ID NO: 578342 - RNA, 15 nt, Homo sapiens
aaccaauagcuuuaa

SEQ ID NO: 578343 - RNA, 11 nt, Homo sapiens
aaccaaugcaa

SEQ ID NO: 578344 - RNA, 12 nt, Homo sapiens
aaccaaugcaag

SEQ ID NO: 578345 - RNA, 23 nt, Homo sapiens
aaccaaugcuuucucaugucuca

SEQ ID NO: 578346 - RNA, 14 nt, Homo sapiens
aaccaauuucuucc

SEQ ID NO: 578347 - RNA, 22 nt, Homo sapiens
aaccacaaagcacaguuugaac

SEQ ID NO: 578348 - RNA, 17 nt, Homo sapiens
aaccacacaaagacauu

SEQ ID NO: 578349 - RNA, 12 nt, Homo sapiens
aaccacagagaa

SEQ ID NO: 578350 - RNA, 18 nt, Homo sapiens
aaccacagucuauaccau

SEQ ID NO: 578351 - RNA, 16 nt, Homo sapiens
aaccacauugaagaau

SEQ ID NO: 578352 - RNA, 12 nt, Homo sapiens
aaccaccaaucc

SEQ ID NO: 578353 - RNA, 19 nt, Homo sapiens
aaccaccgcauaugcaugc

SEQ ID NO: 578354 - RNA, 17 nt, Homo sapiens
aaccacuggucaugccc

SEQ ID NO: 578355 - RNA, 14 nt, Homo sapiens
aaccacuucccuca

SEQ ID NO: 578356 - RNA, 19 nt, Homo sapiens
aaccagaaacaccccucug

SEQ ID NO: 578357 - RNA, 16 nt, Homo sapiens
aaccagaaaggugauu

SEQ ID NO: 578358 - RNA, 14 nt, Homo sapiens
aaccagagugcuga

SEQ ID NO: 578359 - RNA, 19 nt, Homo sapiens
aaccagauggaacacugga

SEQ ID NO: 578360 - RNA, 21 nt, Homo sapiens
aaccagauggaacacuggaac

SEQ ID NO: 578361 - RNA, 14 nt, Homo sapiens
aaccagccaggcag

SEQ ID NO: 578362 - RNA, 23 nt, Homo sapiens
aaccagcccuugagucugucaca

SEQ ID NO: 578363 - RNA, 14 nt, Homo sapiens
aaccagcucugaac

SEQ ID NO: 578364 - RNA, 16 nt, Homo sapiens
aaccagcuucaugugg

SEQ ID NO: 578365 - RNA, 19 nt, Homo sapiens
aaccaggauuuccuugacu

SEQ ID NO: 578366 - RNA, 18 nt, Homo sapiens
aaccaguaacgugcugcu

SEQ ID NO: 578367 - RNA, 18 nt, Homo sapiens
aaccaguacuaaccugga

SEQ ID NO: 578368 - RNA, 13 nt, Homo sapiens
aaccagucugaag

SEQ ID NO: 578369 - RNA, 17 nt, Homo sapiens
aaccaguuaaagccaca

SEQ ID NO: 578370 - RNA, 14 nt, Homo sapiens
aaccaguuacccaa

SEQ ID NO: 578371 - RNA, 18 nt, Homo sapiens
aaccaguuaugugaauga

SEQ ID NO: 578372 - RNA, 14 nt, Homo sapiens
aaccaguugaauca

SEQ ID NO: 578373 - RNA, 14 nt, Homo sapiens
aaccaguuuaucca

SEQ ID NO: 578374 - RNA, 18 nt, Homo sapiens
aaccauaaagggugccag

SEQ ID NO: 578375 - RNA, 14 nt, Homo sapiens
aaccauaacacuug

SEQ ID NO: 578376 - RNA, 13 nt, Homo sapiens
aaccaucacauga

SEQ ID NO: 578377 - RNA, 17 nt, Homo sapiens
aaccauccagugacaaa

SEQ ID NO: 578378 - RNA, 15 nt, Homo sapiens
aaccaucccugaugu

SEQ ID NO: 578379 - RNA, 18 nt, Homo sapiens
aaccaucgguccacaccu

SEQ ID NO: 578380 - RNA, 19 nt, Homo sapiens
aaccaucugaagaaacuuc

SEQ ID NO: 578381 - RNA, 16 nt, Homo sapiens
aaccaugacugugacc

SEQ ID NO: 578382 - RNA, 22 nt, Homo sapiens
aaccauucaaaugacgccugau

SEQ ID NO: 578383 - RNA, 18 nt, Homo sapiens
aaccauugcugacuuuag

SEQ ID NO: 578384 - RNA, 13 nt, Homo sapiens
aaccauuuacuua

SEQ ID NO: 578385 - RNA, 15 nt, Homo sapiens
aacccaaagagacag

SEQ ID NO: 578386 - RNA, 13 nt, Homo sapiens
aacccaagcuccu

SEQ ID NO: 578387 - RNA, 13 nt, Homo sapiens
aacccaaugccug

SEQ ID NO: 578388 - RNA, 15 nt, Homo sapiens
aacccacagaccuca

SEQ ID NO: 578389 - RNA, 18 nt, Homo sapiens
aacccacagaugucucug

SEQ ID NO: 578390 - RNA, 13 nt, Homo sapiens
aacccaccuugac

SEQ ID NO: 578391 - RNA, 20 nt, Homo sapiens
aacccacgauuuucuccagc

SEQ ID NO: 578392 - RNA, 22 nt, Homo sapiens
aacccacuagaagcaacuagga

SEQ ID NO: 578393 - RNA, 19 nt, Homo sapiens
aacccagagguggauguua

SEQ ID NO: 578394 - RNA, 20 nt, Homo sapiens
aacccaggagauggaaguug

SEQ ID NO: 578395 - RNA, 23 nt, Homo sapiens
aacccauacaauguauguacaau

SEQ ID NO: 578396 - RNA, 23 nt, Homo sapiens
aacccauauuucauccaggaggc

SEQ ID NO: 578397 - RNA, 22 nt, Homo sapiens
aacccauuccaguacaguauuc

SEQ ID NO: 578398 - RNA, 23 nt, Homo sapiens
aacccauuccaguacaguauucu

SEQ ID NO: 578399 - RNA, 21 nt, Homo sapiens
aaccccaagcugccucugggc

SEQ ID NO: 578400 - RNA, 15 nt, Homo sapiens
aaccccauguccuca

SEQ ID NO: 578401 - RNA, 15 nt, Homo sapiens
aacccccaacccaaa

SEQ ID NO: 578402 - RNA, 16 nt, Homo sapiens
aaccccgucucuacua

SEQ ID NO: 578403 - RNA, 20 nt, Homo sapiens
aaccccucugcuuuuaacuc

SEQ ID NO: 578404 - RNA, 19 nt, Homo sapiens
aaguaccacacauauugca

SEQ ID NO: 578405 - RNA, 15 nt, Homo sapiens
aaguacccugagaua

SEQ ID NO: 578406 - RNA, 13 nt, Homo sapiens
aaguacccuuuug

SEQ ID NO: 578407 - RNA, 18 nt, Homo sapiens
aaguaccuguagugagaa

SEQ ID NO: 578408 - RNA, 18 nt, Homo sapiens
aaguaccuugaacucuua

SEQ ID NO: 578409 - RNA, 20 nt, Homo sapiens
aaguacuggcucuuuauuca

SEQ ID NO: 578410 - RNA, 15 nt, Homo sapiens
aaguacuuuaccuga

SEQ ID NO: 578411 - RNA, 16 nt, Homo sapiens
aaguagaggaauccau

SEQ ID NO: 578412 - RNA, 22 nt, Homo sapiens
aaguagauuagaaaacuagauu

SEQ ID NO: 578413 - RNA, 15 nt, Homo sapiens
aaguagauugccagc

SEQ ID NO: 578414 - RNA, 22 nt, Homo sapiens
aaguagcuaggacuacagacau

SEQ ID NO: 578415 - RNA, 21 nt, Homo sapiens
aaguagcuaguagcaaugugc

SEQ ID NO: 578416 - RNA, 18 nt, Homo sapiens
aaguagcucuggugaccu

SEQ ID NO: 578417 - RNA, 20 nt, Homo sapiens
aaguagcuuucuccagauca

SEQ ID NO: 578418 - RNA, 16 nt, Homo sapiens
aaguaggacuaucaca

SEQ ID NO: 578419 - RNA, 17 nt, Homo sapiens
aaguagguuuacauuca

SEQ ID NO: 578420 - RNA, 20 nt, Homo sapiens
aaguauauaaugcuugcacc

SEQ ID NO: 578421 - RNA, 21 nt, Homo sapiens
aaguauauguucagcagugug

SEQ ID NO: 578422 - RNA, 18 nt, Homo sapiens
aaguaucaagccaugugc

SEQ ID NO: 578423 - RNA, 13 nt, Homo sapiens
aaguaugagggaa

SEQ ID NO: 578424 - RNA, 12 nt, Homo sapiens
aaguauuagcca

SEQ ID NO: 578425 - RNA, 18 nt, Homo sapiens
aaguauuauuuauuugaa

SEQ ID NO: 578426 - RNA, 19 nt, Homo sapiens
aaguauuauuuauuugaau

SEQ ID NO: 578427 - RNA, 18 nt, Homo sapiens
aaguauugcaccuuugaa

SEQ ID NO: 578428 - RNA, 18 nt, Homo sapiens
aaguauugcugaguccaa

SEQ ID NO: 578429 - RNA, 15 nt, Homo sapiens
aaguauuggcauuca

SEQ ID NO: 578430 - RNA, 22 nt, Homo sapiens
aaguauuuuuuaauccuaccuc

SEQ ID NO: 578431 - RNA, 13 nt, Homo sapiens
aagucaagcacau

SEQ ID NO: 578432 - RNA, 21 nt, Homo sapiens
aagucaauaaaagagcugucu

SEQ ID NO: 578433 - RNA, 23 nt, Homo sapiens
aagucacaccagggcaacucuug

SEQ ID NO: 578434 - RNA, 17 nt, Homo sapiens
aagucacauuuuaccaa

SEQ ID NO: 578435 - RNA, 18 nt, Homo sapiens
aagucaccggagcuuuca

SEQ ID NO: 578436 - RNA, 13 nt, Homo sapiens
aagucacugcaca

SEQ ID NO: 578437 - RNA, 21 nt, Homo sapiens
aagucagagacagauaccucc

SEQ ID NO: 578438 - RNA, 19 nt, Homo sapiens
aagucagaggagauguggu

SEQ ID NO: 578439 - RNA, 16 nt, Homo sapiens
aagucagaucuggucu

SEQ ID NO: 578440 - RNA, 18 nt, Homo sapiens
aagucagucuuauagcaa

SEQ ID NO: 578441 - RNA, 22 nt, Homo sapiens
aagucagugcccaacuguuaua

SEQ ID NO: 578442 - RNA, 19 nt, Homo sapiens
aagucaucauuacuuggga

SEQ ID NO: 578443 - RNA, 21 nt, Homo sapiens
aagucaucuguuuaauuuaca

SEQ ID NO: 578444 - RNA, 17 nt, Homo sapiens
aagucaugugcauuucc

SEQ ID NO: 578445 - RNA, 23 nt, Homo sapiens
aaguccaaccugccugugcauga

SEQ ID NO: 578446 - RNA, 15 nt, Homo sapiens
aaguccaauuccaaa

SEQ ID NO: 578447 - RNA, 21 nt, Homo sapiens
aaguccaauuccaaagccaga

SEQ ID NO: 578448 - RNA, 23 nt, Homo sapiens
aaguccagaaacuguucccaccu

SEQ ID NO: 578449 - RNA, 17 nt, Homo sapiens
aaguccagaagggucau

SEQ ID NO: 578450 - RNA, 18 nt, Homo sapiens
aaguccagcucagucuca

SEQ ID NO: 578451 - RNA, 20 nt, Homo sapiens
aagucccugacucucuguga

SEQ ID NO: 578452 - RNA, 19 nt, Homo sapiens
aagucccuuccuauucucc

SEQ ID NO: 578453 - RNA, 18 nt, Homo sapiens
aagucccuuuaugcagag

SEQ ID NO: 578454 - RNA, 19 nt, Homo sapiens
aaguccuacaagcuaaaau

SEQ ID NO: 578455 - RNA, 14 nt, Homo sapiens
aaguccucugcucc

SEQ ID NO: 578456 - RNA, 23 nt, Homo sapiens
aaguccugacacuauucauuuga

SEQ ID NO: 578457 - RNA, 19 nt, Homo sapiens
aagucgagggacuuuaugu

SEQ ID NO: 578458 - RNA, 18 nt, Homo sapiens
aagucgucacuaauacac

SEQ ID NO: 578459 - RNA, 23 nt, Homo sapiens
aagucuaaauaaaugaaguauuu

SEQ ID NO: 578460 - RNA, 14 nt, Homo sapiens
aagucuagaaucau

SEQ ID NO: 578461 - RNA, 18 nt, Homo sapiens
aagucucucguaguguua

SEQ ID NO: 578462 - RNA, 18 nt, Homo sapiens
aagucucugugaauugaa

SEQ ID NO: 578463 - RNA, 16 nt, Homo sapiens
aagucugaacguggaa

SEQ ID NO: 578464 - RNA, 20 nt, Homo sapiens
aagucugucugucugaugau

SEQ ID NO: 578465 - RNA, 16 nt, Homo sapiens
aagucuuagacuugaa

SEQ ID NO: 578466 - RNA, 22 nt, Homo sapiens
aagucuuccauagagacuuugu

SEQ ID NO: 578467 - RNA, 23 nt, Homo sapiens
aagucuuccauagagacuuugug

SEQ ID NO: 578468 - RNA, 13 nt, Homo sapiens
aagugaaagcaag

SEQ ID NO: 578469 - RNA, 15 nt, Homo sapiens
aagugaaccaucuca

SEQ ID NO: 578470 - RNA, 21 nt, Homo sapiens
aagugaagaacacuacugcua

SEQ ID NO: 578471 - RNA, 16 nt, Homo sapiens
aagugaagcuggugga

SEQ ID NO: 578472 - RNA, 13 nt, Homo sapiens
aagugacacagca

SEQ ID NO: 578473 - RNA, 15 nt, Homo sapiens
aagugacuauagaau

SEQ ID NO: 578474 - RNA, 14 nt, Homo sapiens
aagugacucucaca

SEQ ID NO: 578475 - RNA, 19 nt, Homo sapiens
aagugacugaccaugcacu

SEQ ID NO: 578476 - RNA, 24 nt, Homo sapiens
aagugacuucuggagaaagcucau

SEQ ID NO: 578477 - RNA, 19 nt, Homo sapiens
aagugagacccugucucaa

SEQ ID NO: 578478 - RNA, 20 nt, Homo sapiens
aagugagacccugucucaaa

SEQ ID NO: 578479 - RNA, 15 nt, Homo sapiens
aagugagagagacaa

SEQ ID NO: 578480 - RNA, 12 nt, Homo sapiens
aagugagcagag

SEQ ID NO: 578481 - RNA, 17 nt, Homo sapiens
aagugagggcucacuca

SEQ ID NO: 578482 - RNA, 17 nt, Homo sapiens
aagugaguuuguaaaua

SEQ ID NO: 578483 - RNA, 22 nt, Homo sapiens
aagugauaucccccagccucaa

SEQ ID NO: 578484 - RNA, 17 nt, Homo sapiens
aagugauaugcauuucc

SEQ ID NO: 578485 - RNA, 19 nt, Homo sapiens
aagugaucaaacuacauau

SEQ ID NO: 578486 - RNA, 20 nt, Homo sapiens
aagugauccuuccaccucag

SEQ ID NO: 578487 - RNA, 20 nt, Homo sapiens
aagugaucuguccaccucgg

SEQ ID NO: 578488 - RNA, 16 nt, Homo sapiens
aagugaugucauuuga

SEQ ID NO: 578489 - RNA, 13 nt, Homo sapiens
aagugauuaucuc

SEQ ID NO: 578490 - RNA, 16 nt, Homo sapiens
aagugauuugccugua

SEQ ID NO: 578491 - RNA, 13 nt, Homo sapiens
aagugcacuuuaa

SEQ ID NO: 578492 - RNA, 23 nt, Homo sapiens
aagugcauaugaaauccuugacu

SEQ ID NO: 578493 - RNA, 15 nt, Homo sapiens
aagugccauuaacaa

SEQ ID NO: 578494 - RNA, 15 nt, Homo sapiens
aagugcgaguccucc

SEQ ID NO: 578495 - RNA, 12 nt, Homo sapiens
aagugcugcuau

SEQ ID NO: 578496 - RNA, 22 nt, Homo sapiens
aagugcugggaugacaggugug

SEQ ID NO: 578497 - RNA, 21 nt, Homo sapiens
aagugcugggauuacaggugu

SEQ ID NO: 578498 - RNA, 16 nt, Homo sapiens
aaguggacuuguuacc

SEQ ID NO: 578499 - RNA, 19 nt, Homo sapiens
aaguggccaagaagcagug

SEQ ID NO: 578500 - RNA, 15 nt, Homo sapiens
aaguggccuuuccag

SEQ ID NO: 578501 - RNA, 22 nt, Homo sapiens
aaguggcuugacaaucauuuga

SEQ ID NO: 578502 - RNA, 19 nt, Homo sapiens
aaguguaaaaaaugucuca

SEQ ID NO: 578503 - RNA, 22 nt, Homo sapiens
aaguguaaauagaagaguuuaa

SEQ ID NO: 578504 - RNA, 15 nt, Homo sapiens
aaguguaaauccuuu

SEQ ID NO: 578505 - RNA, 14 nt, Homo sapiens
aaguguaauagauu

SEQ ID NO: 578506 - RNA, 15 nt, Homo sapiens
aaguguaccugugua

SEQ ID NO: 578507 - RNA, 16 nt, Homo sapiens
aaguguaccuguguac

SEQ ID NO: 578508 - RNA, 24 nt, Homo sapiens
aaguguauuuauuuuacagcucau

SEQ ID NO: 578509 - RNA, 13 nt, Homo sapiens
aagugucaaggug

SEQ ID NO: 578510 - RNA, 22 nt, Homo sapiens
aaguguccuggaaauucugcug

SEQ ID NO: 578511 - RNA, 16 nt, Homo sapiens
aaguguccuucuugcu

SEQ ID NO: 578512 - RNA, 18 nt, Homo sapiens
aagugucuagacauauuu

SEQ ID NO: 578513 - RNA, 17 nt, Homo sapiens
aagugucuagagucaug

SEQ ID NO: 578514 - RNA, 12 nt, Homo sapiens
aagugucuucca

SEQ ID NO: 578515 - RNA, 16 nt, Homo sapiens
aagugugaagugcaga

SEQ ID NO: 578516 - RNA, 19 nt, Homo sapiens
aagugugaagugcagauga

SEQ ID NO: 578517 - RNA, 11 nt, Homo sapiens
aagugugagua

SEQ ID NO: 578518 - RNA, 20 nt, Homo sapiens
aagugugauauacaaagugu

SEQ ID NO: 578519 - RNA, 23 nt, Homo sapiens
aaguguggguuugguuagaggaa

SEQ ID NO: 578520 - RNA, 12 nt, Homo sapiens
aaguguguaugu

SEQ ID NO: 578521 - RNA, 16 nt, Homo sapiens
aaguguguaugugcau

SEQ ID NO: 578522 - RNA, 11 nt, Homo sapiens
aaguguuccag

SEQ ID NO: 578523 - RNA, 20 nt, Homo sapiens
aaguguucugauuccuucaa

SEQ ID NO: 578524 - RNA, 18 nt, Homo sapiens
aaguguugauuacauaau

SEQ ID NO: 578525 - RNA, 17 nt, Homo sapiens
aauaagaaagugcgagu

SEQ ID NO: 578526 - RNA, 15 nt, Homo sapiens
aauaagaauuugcau

SEQ ID NO: 578527 - RNA, 21 nt, Homo sapiens
aauaagauauuuaguaauauu

SEQ ID NO: 578528 - RNA, 13 nt, Homo sapiens
aauaagcaaucaa

SEQ ID NO: 578529 - RNA, 22 nt, Homo sapiens
aauaagcaguauguuuguuuca

SEQ ID NO: 578530 - RNA, 15 nt, Homo sapiens
aauaagcccaacaga

SEQ ID NO: 578531 - RNA, 17 nt, Homo sapiens
gguccccaucaucccag

SEQ ID NO: 578532 - RNA, 15 nt, Homo sapiens
gguccccauccccac

SEQ ID NO: 578533 - RNA, 17 nt, Homo sapiens
ggucccccgacugccug

SEQ ID NO: 578534 - RNA, 20 nt, Homo sapiens
ggucccggggccagcacuuc

SEQ ID NO: 578535 - RNA, 13 nt, Homo sapiens
ggucccugagcuc

SEQ ID NO: 578536 - RNA, 16 nt, Homo sapiens
ggucccuuccaugccc

SEQ ID NO: 578537 - RNA, 13 nt, Homo sapiens
gguccuacccauc

SEQ ID NO: 578538 - RNA, 21 nt, Homo sapiens
gguccuagaaguucaguuuuu

SEQ ID NO: 578539 - RNA, 21 nt, Homo sapiens
gguccuagacuucccagggca

SEQ ID NO: 578540 - RNA, 17 nt, Homo sapiens
gguccugaaaguaacuc

SEQ ID NO: 578541 - RNA, 15 nt, Homo sapiens
gguccuggcuccuga

SEQ ID NO: 578542 - RNA, 17 nt, Homo sapiens
gguccuugcugcaccug

SEQ ID NO: 578543 - RNA, 16 nt, Homo sapiens
ggucguuuuccaaaga

SEQ ID NO: 578544 - RNA, 16 nt, Homo sapiens
ggucuaacacuggcau

SEQ ID NO: 578545 - RNA, 16 nt, Homo sapiens
ggucucaaacuccuga

SEQ ID NO: 578546 - RNA, 17 nt, Homo sapiens
ggucucaagguucucau

SEQ ID NO: 578547 - RNA, 20 nt, Homo sapiens
ggucucaggagaagggauag

SEQ ID NO: 578548 - RNA, 21 nt, Homo sapiens
ggucucauuuagaacuugcag

SEQ ID NO: 578549 - RNA, 19 nt, Homo sapiens
ggucuccccuccugcacac

SEQ ID NO: 578550 - RNA, 21 nt, Homo sapiens
ggucuccuuggcugucugugg

SEQ ID NO: 578551 - RNA, 20 nt, Homo sapiens
ggucucgaacuccugaccuc

SEQ ID NO: 578552 - RNA, 16 nt, Homo sapiens
ggucucuaccacugcu

SEQ ID NO: 578553 - RNA, 21 nt, Homo sapiens
ggucucuauacuacauuauua

SEQ ID NO: 578554 - RNA, 15 nt, Homo sapiens
ggucucuggggaccc

SEQ ID NO: 578555 - RNA, 17 nt, Homo sapiens
ggucucuuuguucaauu

SEQ ID NO: 578556 - RNA, 23 nt, Homo sapiens
ggucugagucuauguucaaagac

SEQ ID NO: 578557 - RNA, 16 nt, Homo sapiens
ggucugcucuuucucu

SEQ ID NO: 578558 - RNA, 23 nt, Homo sapiens
ggucugcucuuucucugccagug

SEQ ID NO: 578559 - RNA, 22 nt, Homo sapiens
ggucugcuuaaagcuucccucu

SEQ ID NO: 578560 - RNA, 17 nt, Homo sapiens
ggucugggacuuccuug

SEQ ID NO: 578561 - RNA, 21 nt, Homo sapiens
ggucugggacuuccuugcucu

SEQ ID NO: 578562 - RNA, 19 nt, Homo sapiens
ggucugggcaccaccucug

SEQ ID NO: 578563 - RNA, 16 nt, Homo sapiens
ggucugggcagcaccu

SEQ ID NO: 578564 - RNA, 17 nt, Homo sapiens
ggucugggcagcaccuc

SEQ ID NO: 578565 - RNA, 22 nt, Homo sapiens
ggucuuauuauauuguccaggc

SEQ ID NO: 578566 - RNA, 15 nt, Homo sapiens
ggucuucccuaccuc

SEQ ID NO: 578567 - RNA, 11 nt, Homo sapiens
ggucuugacuc

SEQ ID NO: 578568 - RNA, 14 nt, Homo sapiens
ggucuugacucuaa

SEQ ID NO: 578569 - RNA, 16 nt, Homo sapiens
ggucuuggggucauga

SEQ ID NO: 578570 - RNA, 15 nt, Homo sapiens
ggucuuucagcucau

SEQ ID NO: 578571 - RNA, 21 nt, Homo sapiens
ggucuuuccuaaggcugcaag

SEQ ID NO: 578572 - RNA, 13 nt, Homo sapiens
ggucuuucugugc

SEQ ID NO: 578573 - RNA, 15 nt, Homo sapiens
ggucuuuucuagucu

SEQ ID NO: 578574 - RNA, 16 nt, Homo sapiens
ggucuuuugguuauga

SEQ ID NO: 578575 - RNA, 18 nt, Homo sapiens
ggugaaaccccgucucua

SEQ ID NO: 578576 - RNA, 23 nt, Homo sapiens
ggugaaacgacucaaaaugacag

SEQ ID NO: 578577 - RNA, 16 nt, Homo sapiens
ggugaacacuuaguga

SEQ ID NO: 578578 - RNA, 19 nt, Homo sapiens
ggugaagggagagccagcu

SEQ ID NO: 578579 - RNA, 19 nt, Homo sapiens
ggugaaguuaaaacaccuu

SEQ ID NO: 578580 - RNA, 12 nt, Homo sapiens
ggugaaugagaa

SEQ ID NO: 578581 - RNA, 17 nt, Homo sapiens
ggugacaccuccgagag

SEQ ID NO: 578582 - RNA, 12 nt, Homo sapiens
ggugacacucua

SEQ ID NO: 578583 - RNA, 13 nt, Homo sapiens
ggugacacucuau

SEQ ID NO: 578584 - RNA, 21 nt, Homo sapiens
ggugacacucuauaagauucc

SEQ ID NO: 578585 - RNA, 12 nt, Homo sapiens
ggugacacuguu

SEQ ID NO: 578586 - RNA, 20 nt, Homo sapiens
ggugacaguccaaaccacuc

SEQ ID NO: 578587 - RNA, 14 nt, Homo sapiens
ggugaccacaccuu

SEQ ID NO: 578588 - RNA, 18 nt, Homo sapiens
ggugagagucugggucca

SEQ ID NO: 578589 - RNA, 13 nt, Homo sapiens
ggugaggaccacu

SEQ ID NO: 578590 - RNA, 14 nt, Homo sapiens
ggugaggcaauaaa

SEQ ID NO: 578591 - RNA, 17 nt, Homo sapiens
ggugaguccccuacucc

SEQ ID NO: 578592 - RNA, 19 nt, Homo sapiens
ggugagugcuugucaugga

SEQ ID NO: 578593 - RNA, 19 nt, Homo sapiens
ggugaucaauuaaauguag

SEQ ID NO: 578594 - RNA, 17 nt, Homo sapiens
ggugauccgccuaccuc

SEQ ID NO: 578595 - RNA, 22 nt, Homo sapiens
ggugauuacauaaucuguacaa

SEQ ID NO: 578596 - RNA, 19 nt, Homo sapiens
ggugauuuccucuaaagaa

SEQ ID NO: 578597 - RNA, 14 nt, Homo sapiens
ggugcaaaucaaug

SEQ ID NO: 578598 - RNA, 13 nt, Homo sapiens
ggugcagcuguca

SEQ ID NO: 578599 - RNA, 17 nt, Homo sapiens
ggugcaguaucaugccc

SEQ ID NO: 578600 - RNA, 11 nt, Homo sapiens
ggugcaucugc

SEQ ID NO: 578601 - RNA, 16 nt, Homo sapiens
ggugcaugaugcugcc

SEQ ID NO: 578602 - RNA, 17 nt, Homo sapiens
ggugcaugaugcugccc

SEQ ID NO: 578603 - RNA, 19 nt, Homo sapiens
ggugcaugggcucgccgug

SEQ ID NO: 578604 - RNA, 15 nt, Homo sapiens
ggugccaaguuccac

SEQ ID NO: 578605 - RNA, 19 nt, Homo sapiens
ggugccacucccugagcuu

SEQ ID NO: 578606 - RNA, 16 nt, Homo sapiens
ggugccagcaacugaa

SEQ ID NO: 578607 - RNA, 19 nt, Homo sapiens
ggugccaucacgcuuguga

SEQ ID NO: 578608 - RNA, 18 nt, Homo sapiens
ggugcccauuugugauca

SEQ ID NO: 578609 - RNA, 18 nt, Homo sapiens
ggugccuggccaugucac

SEQ ID NO: 578610 - RNA, 22 nt, Homo sapiens
ggugccuucucacaucugucca

SEQ ID NO: 578611 - RNA, 19 nt, Homo sapiens
ggugcuacagggaauuugu

SEQ ID NO: 578612 - RNA, 16 nt, Homo sapiens
ggugcucacgacucuu

SEQ ID NO: 578613 - RNA, 20 nt, Homo sapiens
ggugcuggaagucuccauga

SEQ ID NO: 578614 - RNA, 19 nt, Homo sapiens
gguggaaacuccugugucu

SEQ ID NO: 578615 - RNA, 20 nt, Homo sapiens
gguggaaaucaacccucucc

SEQ ID NO: 578616 - RNA, 15 nt, Homo sapiens
gguggaacaagcaca

SEQ ID NO: 578617 - RNA, 19 nt, Homo sapiens
gguggaaggcagacagcag

SEQ ID NO: 578618 - RNA, 14 nt, Homo sapiens
gguggagugucaca

SEQ ID NO: 578619 - RNA, 20 nt, Homo sapiens
gguggaucacaaggucaaga

SEQ ID NO: 578620 - RNA, 21 nt, Homo sapiens
gguggaucacgaggucaggag

SEQ ID NO: 578621 - RNA, 19 nt, Homo sapiens
gguggauuccgagugguga

SEQ ID NO: 578622 - RNA, 15 nt, Homo sapiens
gguggcccccucucc

SEQ ID NO: 578623 - RNA, 16 nt, Homo sapiens
gguggcucuccaguua

SEQ ID NO: 578624 - RNA, 16 nt, Homo sapiens
ggugggacuccagcuc

SEQ ID NO: 578625 - RNA, 14 nt, Homo sapiens
cucgcagccugaag

SEQ ID NO: 578626 - RNA, 21 nt, Homo sapiens
cucgcccagacaccaugugca

SEQ ID NO: 578627 - RNA, 17 nt, Homo sapiens
cucgcuuuguugcccag

SEQ ID NO: 578628 - RNA, 22 nt, Homo sapiens
cucggagaaacgggugagcuga

SEQ ID NO: 578629 - RNA, 18 nt, Homo sapiens
cucggcaccuccccggcc

SEQ ID NO: 578630 - RNA, 23 nt, Homo sapiens
cucggccuccucccacaagcacc

SEQ ID NO: 578631 - RNA, 14 nt, Homo sapiens
cucggcuugaucac

SEQ ID NO: 578632 - RNA, 14 nt, Homo sapiens
cucgggcugacccu

SEQ ID NO: 578633 - RNA, 17 nt, Homo sapiens
cucggucucccaaagug

SEQ ID NO: 578634 - RNA, 20 nt, Homo sapiens
cucggugagccggggccguc

SEQ ID NO: 578635 - RNA, 18 nt, Homo sapiens
cucguauaauauucacac

SEQ ID NO: 578636 - RNA, 21 nt, Homo sapiens
cucguaucccaaaucugucag

SEQ ID NO: 578637 - RNA, 11 nt, Homo sapiens
cucgugccaug

SEQ ID NO: 578638 - RNA, 16 nt, Homo sapiens
cucgugccaugaucug

SEQ ID NO: 578639 - RNA, 22 nt, Homo sapiens
cucgugcccaucaagugcaguc

SEQ ID NO: 578640 - RNA, 20 nt, Homo sapiens
cucgugguuagcaagauaca

SEQ ID NO: 578641 - RNA, 15 nt, Homo sapiens
cucguguuugcuuaa

SEQ ID NO: 578642 - RNA, 18 nt, Homo sapiens
cucguugcccagcacugu

SEQ ID NO: 578643 - RNA, 15 nt, Homo sapiens
cucuaaaagaaaaag

SEQ ID NO: 578644 - RNA, 18 nt, Homo sapiens
cucuaaacugguacaauu

SEQ ID NO: 578645 - RNA, 19 nt, Homo sapiens
cucuaaacugguacaauuu

SEQ ID NO: 578646 - RNA, 14 nt, Homo sapiens
cucuaacauccuug

SEQ ID NO: 578647 - RNA, 12 nt, Homo sapiens
cucuaacuucaa

SEQ ID NO: 578648 - RNA, 17 nt, Homo sapiens
cucuaagccaacuuuaa

SEQ ID NO: 578649 - RNA, 19 nt, Homo sapiens
cucuaagccacucuuccaa

SEQ ID NO: 578650 - RNA, 16 nt, Homo sapiens
cucuaagguacacacu

SEQ ID NO: 578651 - RNA, 17 nt, Homo sapiens
cucuaagucauguaugu

SEQ ID NO: 578652 - RNA, 16 nt, Homo sapiens
cucuaauguacaauaa

SEQ ID NO: 578653 - RNA, 18 nt, Homo sapiens
cucuaauucacagugcuc

SEQ ID NO: 578654 - RNA, 19 nt, Homo sapiens
cucuaauucggauuugcca

SEQ ID NO: 578655 - RNA, 17 nt, Homo sapiens
gguuagugaugcaguua

SEQ ID NO: 578656 - RNA, 17 nt, Homo sapiens
gguuauaacaguguuua

SEQ ID NO: 578657 - RNA, 23 nt, Homo sapiens
gguuauucacaaccucaccaaac

SEQ ID NO: 578658 - RNA, 18 nt, Homo sapiens
gguuauuuauuuccuuag

SEQ ID NO: 578659 - RNA, 23 nt, Homo sapiens
gguucaagcaauccuccuaccuc

SEQ ID NO: 578660 - RNA, 19 nt, Homo sapiens
gguucaagcacacuggaau

SEQ ID NO: 578661 - RNA, 13 nt, Homo sapiens
gguucaagugauu

SEQ ID NO: 578662 - RNA, 14 nt, Homo sapiens
gguucacuugccau

SEQ ID NO: 578663 - RNA, 16 nt, Homo sapiens
gguucagacacagcuc

SEQ ID NO: 578664 - RNA, 20 nt, Homo sapiens
gguucagacaccuguucaca

SEQ ID NO: 578665 - RNA, 20 nt, Homo sapiens
gguucagccuucguguggcu

SEQ ID NO: 578666 - RNA, 19 nt, Homo sapiens
gguucagggaacugcuugc

SEQ ID NO: 578667 - RNA, 15 nt, Homo sapiens
gguucagucacugcu

SEQ ID NO: 578668 - RNA, 21 nt, Homo sapiens
gguuccaguaaucugagcagu

SEQ ID NO: 578669 - RNA, 22 nt, Homo sapiens
gguucccaauaaaagugacucu

SEQ ID NO: 578670 - RNA, 16 nt, Homo sapiens
gguuccccacacaggg

SEQ ID NO: 578671 - RNA, 16 nt, Homo sapiens
gguucuaaggggaccu

SEQ ID NO: 578672 - RNA, 16 nt, Homo sapiens
gguucuuacagcacau

SEQ ID NO: 578673 - RNA, 20 nt, Homo sapiens
gguucuugguagagauucau

SEQ ID NO: 578674 - RNA, 22 nt, Homo sapiens
gguucuuuccaugcagacuccu

SEQ ID NO: 578675 - RNA, 15 nt, Homo sapiens
gguugaaacauaucu

SEQ ID NO: 578676 - RNA, 18 nt, Homo sapiens
gguugaagcagacuggau

SEQ ID NO: 578677 - RNA, 22 nt, Homo sapiens
gguugaaugagcgucagcaucc

SEQ ID NO: 578678 - RNA, 17 nt, Homo sapiens
gguugagcucuucuuaa

SEQ ID NO: 578679 - RNA, 18 nt, Homo sapiens
gguugagggaugcuggaa

SEQ ID NO: 578680 - RNA, 16 nt, Homo sapiens
gguugcagugcugagc

SEQ ID NO: 578681 - RNA, 19 nt, Homo sapiens
gguuggacuguaagggauu

SEQ ID NO: 578682 - RNA, 17 nt, Homo sapiens
gguuggagcgagcaucc

SEQ ID NO: 578683 - RNA, 15 nt, Homo sapiens
gguugggcuauagca

SEQ ID NO: 578684 - RNA, 22 nt, Homo sapiens
gguugggcuggugcucacagcu

SEQ ID NO: 578685 - RNA, 18 nt, Homo sapiens
gguuguauaaagcaaaag

SEQ ID NO: 578686 - RNA, 15 nt, Homo sapiens
gguugucaguuacau

SEQ ID NO: 578687 - RNA, 19 nt, Homo sapiens
gguuuaacaagcugucuac

SEQ ID NO: 578688 - RNA, 21 nt, Homo sapiens
gguuuauuccagagaagccag

SEQ ID NO: 578689 - RNA, 22 nt, Homo sapiens
gguuuauuccagagaagccagg

SEQ ID NO: 578690 - RNA, 14 nt, Homo sapiens
gguuucaccauauu

SEQ ID NO: 578691 - RNA, 19 nt, Homo sapiens
gguuuccaaaggcauuuua

SEQ ID NO: 578692 - RNA, 21 nt, Homo sapiens
gguuuccaagucccgggucuc

SEQ ID NO: 578693 - RNA, 19 nt, Homo sapiens
gguuucucugugcucugaa

SEQ ID NO: 578694 - RNA, 20 nt, Homo sapiens
gguuucugagagagugccau

SEQ ID NO: 578695 - RNA, 14 nt, Homo sapiens
gguuugaagcugac

SEQ ID NO: 578696 - RNA, 17 nt, Homo sapiens
gguuuguugcagccaaa

SEQ ID NO: 578697 - RNA, 18 nt, Homo sapiens
gguuuguugcagccaaag

SEQ ID NO: 578698 - RNA, 16 nt, Homo sapiens
gguuuuaacaauuucc

SEQ ID NO: 578699 - RNA, 18 nt, Homo sapiens
gguuuuauaaaagccuug

SEQ ID NO: 578700 - RNA, 20 nt, Homo sapiens
gguuuuguuuuuuuucagcc

SEQ ID NO: 578701 - RNA, 15 nt, Homo sapiens
gguuuuuucaauuua

SEQ ID NO: 578702 - RNA, 23 nt, Homo sapiens
gguuuuuuuuuucuuuuuugcca

SEQ ID NO: 578703 - RNA, 14 nt, Homo sapiens
guaaaaacuuguac

SEQ ID NO: 578704 - RNA, 14 nt, Homo sapiens
guaaaaauccaaaa

SEQ ID NO: 578705 - RNA, 23 nt, Homo sapiens
guaaaaauuuuuuugcauuuuca

SEQ ID NO: 578706 - RNA, 21 nt, Homo sapiens
guaaaacaaucuguuuuggcu

SEQ ID NO: 578707 - RNA, 14 nt, Homo sapiens
guaaaacaguuaca

SEQ ID NO: 578708 - RNA, 14 nt, Homo sapiens
guaaaacauuacuu

SEQ ID NO: 578709 - RNA, 12 nt, Homo sapiens
guaaaacuguau

SEQ ID NO: 578710 - RNA, 14 nt, Homo sapiens
guaaaagcaaaaaa

SEQ ID NO: 578711 - RNA, 22 nt, Homo sapiens
guaaaagcuuacacagguuuca

SEQ ID NO: 578712 - RNA, 13 nt, Homo sapiens
guaaaagugcuuu

SEQ ID NO: 578713 - RNA, 17 nt, Homo sapiens
guaaaagugcuuuccau

SEQ ID NO: 578714 - RNA, 16 nt, Homo sapiens
guaaaauaagguauua

SEQ ID NO: 578715 - RNA, 20 nt, Homo sapiens
guaaaauauagcuguacaaa

SEQ ID NO: 578716 - RNA, 11 nt, Homo sapiens
guaaaauaugu

SEQ ID NO: 578717 - RNA, 13 nt, Homo sapiens
guaaaaugaaauu

SEQ ID NO: 578718 - RNA, 22 nt, Homo sapiens
guaaaaugaguuuguauuauua

SEQ ID NO: 578719 - RNA, 18 nt, Homo sapiens
guaaaaugucaauagcaa

SEQ ID NO: 578720 - RNA, 19 nt, Homo sapiens
guaaaauuaugagugauua

SEQ ID NO: 578721 - RNA, 14 nt, Homo sapiens
guaaaauuauuuca

SEQ ID NO: 578722 - RNA, 23 nt, Homo sapiens
guaaaauugaaaggcauucucug

SEQ ID NO: 578723 - RNA, 18 nt, Homo sapiens
guaaaauuuaaaucauau

SEQ ID NO: 578724 - RNA, 15 nt, Homo sapiens
guaaaauuuguguaa

SEQ ID NO: 578725 - RNA, 22 nt, Homo sapiens
guaaaauuuguguaaauuugua

SEQ ID NO: 578726 - RNA, 15 nt, Homo sapiens
guaaacaaaggaauu

SEQ ID NO: 578727 - RNA, 20 nt, Homo sapiens
guaaacagauggcacuuuga

SEQ ID NO: 578728 - RNA, 21 nt, Homo sapiens
guaaacagauggcacuuugaa

SEQ ID NO: 578729 - RNA, 13 nt, Homo sapiens
guaaacauaauuc

SEQ ID NO: 578730 - RNA, 17 nt, Homo sapiens
guaaacgggaacaugcc

SEQ ID NO: 578731 - RNA, 23 nt, Homo sapiens
guaaacuaagguagacuacuuug

SEQ ID NO: 578732 - RNA, 22 nt, Homo sapiens
guaaacuuaacuguucuuugcc

SEQ ID NO: 578733 - RNA, 16 nt, Homo sapiens
guaaagaaaaaaacuu

SEQ ID NO: 578734 - RNA, 16 nt, Homo sapiens
guaaagaaacugaugu

SEQ ID NO: 578735 - RNA, 20 nt, Homo sapiens
guaaagaacguggucagagu

SEQ ID NO: 578736 - RNA, 18 nt, Homo sapiens
guaaagacugguuuucug

SEQ ID NO: 578737 - RNA, 20 nt, Homo sapiens
guaaagccuuaaguggcaga

SEQ ID NO: 578738 - RNA, 14 nt, Homo sapiens
guaaagcuguucaa

SEQ ID NO: 578739 - RNA, 12 nt, Homo sapiens
guaaaggcagua

SEQ ID NO: 578740 - RNA, 22 nt, Homo sapiens
guaaaguauuauuuauuugaau

SEQ ID NO: 578741 - RNA, 18 nt, Homo sapiens
guaaauaauuugcacuga

SEQ ID NO: 578742 - RNA, 19 nt, Homo sapiens
guaaauaccaagagcaauu

SEQ ID NO: 578743 - RNA, 13 nt, Homo sapiens
guaaauacuguga

SEQ ID NO: 578744 - RNA, 13 nt, Homo sapiens
guaaauaugcaaa

SEQ ID NO: 578745 - RNA, 21 nt, Homo sapiens
guaaaucauguugaucaugua

SEQ ID NO: 578746 - RNA, 17 nt, Homo sapiens
guccccuccacugucac

SEQ ID NO: 578747 - RNA, 18 nt, Homo sapiens
guccccuuuccucuaacu

SEQ ID NO: 578748 - RNA, 13 nt, Homo sapiens
gucccgcacagug

SEQ ID NO: 578749 - RNA, 16 nt, Homo sapiens
gucccggguguguaca

SEQ ID NO: 578750 - RNA, 14 nt, Homo sapiens
gucccucagugaua

SEQ ID NO: 578751 - RNA, 16 nt, Homo sapiens
gucccucccaucucua

SEQ ID NO: 578752 - RNA, 15 nt, Homo sapiens
gucccucccugccug

SEQ ID NO: 578753 - RNA, 17 nt, Homo sapiens
gucccucgcgcccaaaa

SEQ ID NO: 578754 - RNA, 12 nt, Homo sapiens
gucccucggagc

SEQ ID NO: 578755 - RNA, 22 nt, Homo sapiens
gucccucuucucuccucaguuu

SEQ ID NO: 578756 - RNA, 16 nt, Homo sapiens
gucccucuuugaggga

SEQ ID NO: 578757 - RNA, 14 nt, Homo sapiens
gucccugcaagccc

SEQ ID NO: 578758 - RNA, 22 nt, Homo sapiens
gucccuguuuucccacgaggaa

SEQ ID NO: 578759 - RNA, 18 nt, Homo sapiens
gucccuugagacucccca

SEQ ID NO: 578760 - RNA, 18 nt, Homo sapiens
gucccuuggaaccuuugu

SEQ ID NO: 578761 - RNA, 17 nt, Homo sapiens
gucccuuucccuaccuu

SEQ ID NO: 578762 - RNA, 15 nt, Homo sapiens
guccgaucuuugacu

SEQ ID NO: 578763 - RNA, 13 nt, Homo sapiens
guccgccaguguu

SEQ ID NO: 578764 - RNA, 14 nt, Homo sapiens
guccgugcacugga

SEQ ID NO: 578765 - RNA, 13 nt, Homo sapiens
guccuaaggccca

SEQ ID NO: 578766 - RNA, 14 nt, Homo sapiens
guccuaggacuuaa

SEQ ID NO: 578767 - RNA, 15 nt, Homo sapiens
guccuaggacuuaaa

SEQ ID NO: 578768 - RNA, 12 nt, Homo sapiens
guccucacccau

SEQ ID NO: 578769 - RNA, 20 nt, Homo sapiens
guccucaccugguugaccca

SEQ ID NO: 578770 - RNA, 23 nt, Homo sapiens
guccucagaugggaauugcacag

SEQ ID NO: 578771 - RNA, 20 nt, Homo sapiens
guccuccaacaccaagcaca

SEQ ID NO: 578772 - RNA, 15 nt, Homo sapiens
guccuccaagccagc

SEQ ID NO: 578773 - RNA, 12 nt, Homo sapiens
guccuccagaca

SEQ ID NO: 578774 - RNA, 14 nt, Homo sapiens
guccuccagacaac

SEQ ID NO: 578775 - RNA, 18 nt, Homo sapiens
guccuccagaccaccagc

SEQ ID NO: 578776 - RNA, 18 nt, Homo sapiens
guccuccucuaccucucu

SEQ ID NO: 578777 - RNA, 21 nt, Homo sapiens
guccucuucugcaucuugggg

SEQ ID NO: 578778 - RNA, 15 nt, Homo sapiens
guccucuugcucaaa

SEQ ID NO: 578779 - RNA, 16 nt, Homo sapiens
guccugacacuauuca

SEQ ID NO: 578780 - RNA, 14 nt, Homo sapiens
guccugagacuuuu

SEQ ID NO: 578781 - RNA, 22 nt, Homo sapiens
guccugaguguucaugcuuugu

SEQ ID NO: 578782 - RNA, 16 nt, Homo sapiens
guccugaucugugaua

SEQ ID NO: 578783 - RNA, 21 nt, Homo sapiens
guccugcagucccacacugug

SEQ ID NO: 578784 - RNA, 18 nt, Homo sapiens
cugauacuuauuuaccua

SEQ ID NO: 578785 - RNA, 18 nt, Homo sapiens
cugauacuuugacagugu

SEQ ID NO: 578786 - RNA, 22 nt, Homo sapiens
cugauauaacaaacuacaugua

SEQ ID NO: 578787 - RNA, 19 nt, Homo sapiens
cugauauuuucucuaggaa

SEQ ID NO: 578788 - RNA, 14 nt, Homo sapiens
cugaucauuacaug

SEQ ID NO: 578789 - RNA, 17 nt, Homo sapiens
cugauccagagcacaga

SEQ ID NO: 578790 - RNA, 18 nt, Homo sapiens
cugauccagagcacagau

SEQ ID NO: 578791 - RNA, 17 nt, Homo sapiens
cugauccagaugcccag

SEQ ID NO: 578792 - RNA, 23 nt, Homo sapiens
cugauccagauguuaugcuccug

SEQ ID NO: 578793 - RNA, 19 nt, Homo sapiens
cugaucccuggccacugaa

SEQ ID NO: 578794 - RNA, 18 nt, Homo sapiens
cugauccuccaacagcug

SEQ ID NO: 578795 - RNA, 21 nt, Homo sapiens
cugauccuccaacagcuguca

SEQ ID NO: 578796 - RNA, 23 nt, Homo sapiens
cugaucguagaaaauuugcuuua

SEQ ID NO: 578797 - RNA, 20 nt, Homo sapiens
cugaucgugcuaaauuuuca

SEQ ID NO: 578798 - RNA, 13 nt, Homo sapiens
cugaucuauacaa

SEQ ID NO: 578799 - RNA, 20 nt, Homo sapiens
cugaucugcaguuuuugccu

SEQ ID NO: 578800 - RNA, 21 nt, Homo sapiens
cugaucuuugaaaacacuaca

SEQ ID NO: 578801 - RNA, 22 nt, Homo sapiens
cugaugaaaacauagcaucuca

SEQ ID NO: 578802 - RNA, 16 nt, Homo sapiens
cugaugaacuguggug

SEQ ID NO: 578803 - RNA, 23 nt, Homo sapiens
cugaugaagaaauuuaugaagca

SEQ ID NO: 578804 - RNA, 18 nt, Homo sapiens
cugaugaaggcaugccua

SEQ ID NO: 578805 - RNA, 13 nt, Homo sapiens
cugaugacuuuau

SEQ ID NO: 578806 - RNA, 21 nt, Homo sapiens
cugaugacuuuauccugaguc

SEQ ID NO: 578807 - RNA, 22 nt, Homo sapiens
cugaugacuuuauccugagucc

SEQ ID NO: 578808 - RNA, 17 nt, Homo sapiens
cugaugagcacaucucu

SEQ ID NO: 578809 - RNA, 14 nt, Homo sapiens
cugaugccauguaa

SEQ ID NO: 578810 - RNA, 17 nt, Homo sapiens
cugaugccuuuuggacc

SEQ ID NO: 578811 - RNA, 15 nt, Homo sapiens
cugaugcugggaccc

SEQ ID NO: 578812 - RNA, 20 nt, Homo sapiens
cugaugcuguuaaccaaagg

SEQ ID NO: 578813 - RNA, 16 nt, Homo sapiens
cugaugcuuuggugug

SEQ ID NO: 578814 - RNA, 14 nt, Homo sapiens
cugauggaccagga

SEQ ID NO: 578815 - RNA, 15 nt, Homo sapiens
cugauggcugaagaa

SEQ ID NO: 578816 - RNA, 19 nt, Homo sapiens
cugaugucuccacuuucac

SEQ ID NO: 578817 - RNA, 16 nt, Homo sapiens
cugaugugacauucca

SEQ ID NO: 578818 - RNA, 18 nt, Homo sapiens
cugauguguccucaggga

SEQ ID NO: 578819 - RNA, 17 nt, Homo sapiens
cugauguuaaaauucca

SEQ ID NO: 578820 - RNA, 16 nt, Homo sapiens
cugauguuaaccaaug

SEQ ID NO: 578821 - RNA, 22 nt, Homo sapiens
cugauuaaaaaaucucccaaag

SEQ ID NO: 578822 - RNA, 22 nt, Homo sapiens
cugauuaaugauuguuugucaa

SEQ ID NO: 578823 - RNA, 19 nt, Homo sapiens
cugauuagaaaugaccaau

SEQ ID NO: 578824 - RNA, 17 nt, Homo sapiens
cugauuauuuagagcca

SEQ ID NO: 578825 - RNA, 20 nt, Homo sapiens
cugauuauuuagagccauua

SEQ ID NO: 578826 - RNA, 18 nt, Homo sapiens
cugauuauuuaucacaua

SEQ ID NO: 578827 - RNA, 20 nt, Homo sapiens
cugauucauaauaaauaucu

SEQ ID NO: 578828 - RNA, 21 nt, Homo sapiens
cugauucauacuccuuuuggc

SEQ ID NO: 578829 - RNA, 19 nt, Homo sapiens
cugauuccuucaacuggcu

SEQ ID NO: 578830 - RNA, 19 nt, Homo sapiens
cugauucucuacaugcucu

SEQ ID NO: 578831 - RNA, 19 nt, Homo sapiens
cugauugaucacacagugu

SEQ ID NO: 578832 - RNA, 15 nt, Homo sapiens
cugauuggugauuca

SEQ ID NO: 578833 - RNA, 14 nt, Homo sapiens
cugauuguuuucau

SEQ ID NO: 578834 - RNA, 14 nt, Homo sapiens
cugauuuaacacuu

SEQ ID NO: 578835 - RNA, 22 nt, Homo sapiens
cugauuuauuucuacuauauac

SEQ ID NO: 578836 - RNA, 17 nt, Homo sapiens
cugauuuccuaauguca

SEQ ID NO: 578837 - RNA, 17 nt, Homo sapiens
cugauuuccuucugcua

SEQ ID NO: 578838 - RNA, 18 nt, Homo sapiens
cugauuucuucagaauua

SEQ ID NO: 578839 - RNA, 20 nt, Homo sapiens
cugauuucuucagaauuaga

SEQ ID NO: 578840 - RNA, 17 nt, Homo sapiens
cugauuuuguauguaaa

SEQ ID NO: 578841 - RNA, 19 nt, Homo sapiens
cugauuuuguauguaaaua

SEQ ID NO: 578842 - RNA, 19 nt, Homo sapiens
cugauuuuuagcuuuacaa

SEQ ID NO: 578843 - RNA, 15 nt, Homo sapiens
cugcaaaaaaagccu

SEQ ID NO: 578844 - RNA, 11 nt, Homo sapiens
cugcaaaaaga

SEQ ID NO: 578845 - RNA, 20 nt, Homo sapiens
cugcaaaaguucucaauguu

SEQ ID NO: 578846 - RNA, 12 nt, Homo sapiens
cugcaaaccuuc

SEQ ID NO: 578847 - RNA, 19 nt, Homo sapiens
cugcaaagucgccagucac

SEQ ID NO: 578848 - RNA, 15 nt, Homo sapiens
cugcaaauuaaugua

SEQ ID NO: 578849 - RNA, 13 nt, Homo sapiens
cugcaacggaauu

SEQ ID NO: 578850 - RNA, 14 nt, Homo sapiens
cugcaacucaagga

SEQ ID NO: 578851 - RNA, 16 nt, Homo sapiens
cugcaacugaaugacu

SEQ ID NO: 578852 - RNA, 20 nt, Homo sapiens
cugcaacuugugaacuccau

SEQ ID NO: 578853 - RNA, 19 nt, Homo sapiens
cugcaagaauuaaaacuga

SEQ ID NO: 578854 - RNA, 12 nt, Homo sapiens
cugcaagcauuu

SEQ ID NO: 578855 - RNA, 17 nt, Homo sapiens
cugcaagccugucugag

SEQ ID NO: 578856 - RNA, 17 nt, Homo sapiens
cugcaauaauaucaaaa

SEQ ID NO: 578857 - RNA, 18 nt, Homo sapiens
cugcaauaugaauucaag

SEQ ID NO: 578858 - RNA, 20 nt, Homo sapiens
cugcaauccagccugggcaa

SEQ ID NO: 578859 - RNA, 21 nt, Homo sapiens
cugcaaucugagccagugcuu

SEQ ID NO: 578860 - RNA, 18 nt, Homo sapiens
cugcaaugggcacuggga

SEQ ID NO: 578861 - RNA, 23 nt, Homo sapiens
cugcacaaaagcagauacuugag

SEQ ID NO: 578862 - RNA, 20 nt, Homo sapiens
cugcacagaaauuuucaauu

SEQ ID NO: 578863 - RNA, 21 nt, Homo sapiens
cugcacagauggauuugccug

SEQ ID NO: 578864 - RNA, 13 nt, Homo sapiens
cugcacagugaag

SEQ ID NO: 578865 - RNA, 18 nt, Homo sapiens
cugcacagugcaucucag

SEQ ID NO: 578866 - RNA, 14 nt, Homo sapiens
cugcacaguuuucu

SEQ ID NO: 578867 - RNA, 20 nt, Homo sapiens
cugcaccagagcaaccucuc

SEQ ID NO: 578868 - RNA, 14 nt, Homo sapiens
gucugauguggcaa

SEQ ID NO: 578869 - RNA, 21 nt, Homo sapiens
gucugcacuguucaaaccucu

SEQ ID NO: 578870 - RNA, 20 nt, Homo sapiens
gucugccacuugucaaagaa

SEQ ID NO: 578871 - RNA, 18 nt, Homo sapiens
gucugccaggcacucuca

SEQ ID NO: 578872 - RNA, 22 nt, Homo sapiens
gucugcccugaacccacugcug

SEQ ID NO: 578873 - RNA, 23 nt, Homo sapiens
gucugcugacuguuucauucacu

SEQ ID NO: 578874 - RNA, 19 nt, Homo sapiens
gucugcuucuguccaggac

SEQ ID NO: 578875 - RNA, 18 nt, Homo sapiens
gucuggaaagugauguca

SEQ ID NO: 578876 - RNA, 14 nt, Homo sapiens
gucuggaauugugg

SEQ ID NO: 578877 - RNA, 17 nt, Homo sapiens
gucuggccacugucaag

SEQ ID NO: 578878 - RNA, 16 nt, Homo sapiens
gucugggauauggcug

SEQ ID NO: 578879 - RNA, 15 nt, Homo sapiens
gucugggcaccaccu

SEQ ID NO: 578880 - RNA, 20 nt, Homo sapiens
gucuggggagaaaucccuca

SEQ ID NO: 578881 - RNA, 15 nt, Homo sapiens
gucugggucuaccag

SEQ ID NO: 578882 - RNA, 17 nt, Homo sapiens
gucugggucuaccagga

SEQ ID NO: 578883 - RNA, 21 nt, Homo sapiens
gucugguucacaguuuagcau

SEQ ID NO: 578884 - RNA, 17 nt, Homo sapiens
gucuguaaaaaauggag

SEQ ID NO: 578885 - RNA, 13 nt, Homo sapiens
gucuguacauacu

SEQ ID NO: 578886 - RNA, 23 nt, Homo sapiens
gucuguaguauacagacaggaag

SEQ ID NO: 578887 - RNA, 19 nt, Homo sapiens
gucuguauauacauuucau

SEQ ID NO: 578888 - RNA, 17 nt, Homo sapiens
gucuguccuugaaggac

SEQ ID NO: 578889 - RNA, 15 nt, Homo sapiens
gucugucugcagugc

SEQ ID NO: 578890 - RNA, 12 nt, Homo sapiens
gucugucuucaa

SEQ ID NO: 578891 - RNA, 15 nt, Homo sapiens
gucuguggagccauc

SEQ ID NO: 578892 - RNA, 19 nt, Homo sapiens
gucugugugaaugugggca

SEQ ID NO: 578893 - RNA, 20 nt, Homo sapiens
gucugugugaugaacuuucu

SEQ ID NO: 578894 - RNA, 20 nt, Homo sapiens
gucugugugcaagugugugc

SEQ ID NO: 578895 - RNA, 13 nt, Homo sapiens
gucuguuaacuua

SEQ ID NO: 578896 - RNA, 15 nt, Homo sapiens
gucuguucacugcau

SEQ ID NO: 578897 - RNA, 16 nt, Homo sapiens
gucuguucuuuaccaa

SEQ ID NO: 578898 - RNA, 11 nt, Homo sapiens
gucuguuggca

SEQ ID NO: 578899 - RNA, 21 nt, Homo sapiens
gucuguuucaagauuucugca

SEQ ID NO: 578900 - RNA, 13 nt, Homo sapiens
gucuguuugcauu

SEQ ID NO: 578901 - RNA, 13 nt, Homo sapiens
gucuguuugccac

SEQ ID NO: 578902 - RNA, 16 nt, Homo sapiens
gucuguuuugccuuca

SEQ ID NO: 578903 - RNA, 15 nt, Homo sapiens
gucuuaaacuccugg

SEQ ID NO: 578904 - RNA, 14 nt, Homo sapiens
gucuuaaagcauuu

SEQ ID NO: 578905 - RNA, 14 nt, Homo sapiens
gucuuaacugucac

SEQ ID NO: 578906 - RNA, 13 nt, Homo sapiens
gucuuacauugga

SEQ ID NO: 578907 - RNA, 12 nt, Homo sapiens
gucuuagucaaa

SEQ ID NO: 578908 - RNA, 16 nt, Homo sapiens
cugcagucccccgaga

SEQ ID NO: 578909 - RNA, 14 nt, Homo sapiens
cugcaguccuacuc

SEQ ID NO: 578910 - RNA, 15 nt, Homo sapiens
cugcaguccuacuca

SEQ ID NO: 578911 - RNA, 16 nt, Homo sapiens
cugcaguccuacucaa

SEQ ID NO: 578912 - RNA, 15 nt, Homo sapiens
cugcaguuccaucag

SEQ ID NO: 578913 - RNA, 18 nt, Homo sapiens
cugcaguuuuauugcuaa

SEQ ID NO: 578914 - RNA, 21 nt, Homo sapiens
cugcauacuggccgagcugcu

SEQ ID NO: 578915 - RNA, 20 nt, Homo sapiens
cugcauaucauaaugggggu

SEQ ID NO: 578916 - RNA, 15 nt, Homo sapiens
cugcaucugugaaaa

SEQ ID NO: 578917 - RNA, 22 nt, Homo sapiens
cugcaugacaaacacacaucca

SEQ ID NO: 578918 - RNA, 15 nt, Homo sapiens
cugcaugaccuacca

SEQ ID NO: 578919 - RNA, 15 nt, Homo sapiens
cugcaugcucuggaa

SEQ ID NO: 578920 - RNA, 16 nt, Homo sapiens
cugcauggagaagggu

SEQ ID NO: 578921 - RNA, 20 nt, Homo sapiens
cugcauguaccauuugcaug

SEQ ID NO: 578922 - RNA, 16 nt, Homo sapiens
cugcauguacuguaua

SEQ ID NO: 578923 - RNA, 17 nt, Homo sapiens
cugcauguucauugcaa

SEQ ID NO: 578924 - RNA, 17 nt, Homo sapiens
cugcauucuucugagca

SEQ ID NO: 578925 - RNA, 18 nt, Homo sapiens
cugcauuuggucaggggg

SEQ ID NO: 578926 - RNA, 13 nt, Homo sapiens
cugccaaacacau

SEQ ID NO: 578927 - RNA, 14 nt, Homo sapiens
cugccacauccagc

SEQ ID NO: 578928 - RNA, 13 nt, Homo sapiens
cugccacauucua

SEQ ID NO: 578929 - RNA, 23 nt, Homo sapiens
cugccacugggcucuggaccuca

SEQ ID NO: 578930 - RNA, 18 nt, Homo sapiens
cugccacuguguacugug

SEQ ID NO: 578931 - RNA, 11 nt, Homo sapiens
cugccagagaa

SEQ ID NO: 578932 - RNA, 16 nt, Homo sapiens
cugccagccacaucca

SEQ ID NO: 578933 - RNA, 16 nt, Homo sapiens
cugccagcucucugau

SEQ ID NO: 578934 - RNA, 19 nt, Homo sapiens
cugccaggauaaagcuucc

SEQ ID NO: 578935 - RNA, 20 nt, Homo sapiens
cugccaggcuguuucagcca

SEQ ID NO: 578936 - RNA, 20 nt, Homo sapiens
cugccaggggauuuggggcu

SEQ ID NO: 578937 - RNA, 13 nt, Homo sapiens
cugccagugccag

SEQ ID NO: 578938 - RNA, 16 nt, Homo sapiens
cugccaugauagcugg

SEQ ID NO: 578939 - RNA, 17 nt, Homo sapiens
cugccaugccacugcca

SEQ ID NO: 578940 - RNA, 22 nt, Homo sapiens
cugccaugccuccccaaauugg

SEQ ID NO: 578941 - RNA, 23 nt, Homo sapiens
cugccaugggugcagacccugaa

SEQ ID NO: 578942 - RNA, 16 nt, Homo sapiens
cugccauguuuaguga

SEQ ID NO: 578943 - RNA, 23 nt, Homo sapiens
cugccauuggacuauggagugca

SEQ ID NO: 578944 - RNA, 14 nt, Homo sapiens
cugcccaaugccuu

SEQ ID NO: 578945 - RNA, 17 nt, Homo sapiens
cugcccacgcagaggac

SEQ ID NO: 578946 - RNA, 20 nt, Homo sapiens
cugcccacuguuucucuuga

SEQ ID NO: 578947 - RNA, 22 nt, Homo sapiens
cugcccagacacagacuggcaa

SEQ ID NO: 578948 - RNA, 21 nt, Homo sapiens
cugcccagaccccucuggcca

SEQ ID NO: 578949 - RNA, 16 nt, Homo sapiens
cugcccagacugauga

SEQ ID NO: 578950 - RNA, 13 nt, Homo sapiens
cugcccagugcaa

SEQ ID NO: 578951 - RNA, 16 nt, Homo sapiens
cugcccauacugagcc

SEQ ID NO: 578952 - RNA, 22 nt, Homo sapiens
cugcccauggacaggcuggcuc

SEQ ID NO: 578953 - RNA, 19 nt, Homo sapiens
cugcccauucaccaaaauu

SEQ ID NO: 578954 - RNA, 20 nt, Homo sapiens
cugccccaaacaaauaugca

SEQ ID NO: 578955 - RNA, 21 nt, Homo sapiens
cugccccaaacaaauaugcaa

SEQ ID NO: 578956 - RNA, 13 nt, Homo sapiens
cugccccaccacg

SEQ ID NO: 578957 - RNA, 19 nt, Homo sapiens
cugccccaggccugaaaga

SEQ ID NO: 578958 - RNA, 15 nt, Homo sapiens
cugccccccaugagg

SEQ ID NO: 578959 - RNA, 21 nt, Homo sapiens
cugccccggcaguggggagcg

SEQ ID NO: 578960 - RNA, 13 nt, Homo sapiens
cugccccuguuga

SEQ ID NO: 578961 - RNA, 18 nt, Homo sapiens
cugcccgggagggcuucc

SEQ ID NO: 578962 - RNA, 16 nt, Homo sapiens
cugcccuagagcacac

SEQ ID NO: 578963 - RNA, 17 nt, Homo sapiens
cugcccucucccugugu

SEQ ID NO: 578964 - RNA, 17 nt, Homo sapiens
cugcccugcccaaguga

SEQ ID NO: 578965 - RNA, 17 nt, Homo sapiens
cugcccugcucccacag

SEQ ID NO: 578966 - RNA, 20 nt, Homo sapiens
cugcccuucccccugcaaaa

SEQ ID NO: 578967 - RNA, 17 nt, Homo sapiens
cugcccuuccugccuga

SEQ ID NO: 578968 - RNA, 18 nt, Homo sapiens
cugcccuuccugccugau

SEQ ID NO: 578969 - RNA, 13 nt, Homo sapiens
cugcccuucucac

SEQ ID NO: 578970 - RNA, 14 nt, Homo sapiens
cugcccuuguucca

SEQ ID NO: 578971 - RNA, 17 nt, Homo sapiens
cugcccuuuccuaggcc

SEQ ID NO: 578972 - RNA, 21 nt, Homo sapiens
cugccgcccuccacaccucua

SEQ ID NO: 578973 - RNA, 16 nt, Homo sapiens
cugccgcugcaccugc

SEQ ID NO: 578974 - RNA, 22 nt, Homo sapiens
cugccggaaucacuucuccaau

SEQ ID NO: 578975 - RNA, 19 nt, Homo sapiens
cugccuaaauccacucugc

SEQ ID NO: 578976 - RNA, 18 nt, Homo sapiens
cugccuaaguggcugcug

SEQ ID NO: 578977 - RNA, 23 nt, Homo sapiens
cugccuaguaagggaacuaugga

SEQ ID NO: 578978 - RNA, 14 nt, Homo sapiens
cugccuaugucaua

SEQ ID NO: 578979 - RNA, 17 nt, Homo sapiens
cugccucagacguugcc

SEQ ID NO: 578980 - RNA, 13 nt, Homo sapiens
cugccucagcaau

SEQ ID NO: 578981 - RNA, 14 nt, Homo sapiens
cugccucagcaauu

SEQ ID NO: 578982 - RNA, 20 nt, Homo sapiens
cugccucagccaguggcaca

SEQ ID NO: 578983 - RNA, 15 nt, Homo sapiens
cugccucagccuucu

SEQ ID NO: 578984 - RNA, 19 nt, Homo sapiens
cugccuccccaacccugcc

SEQ ID NO: 578985 - RNA, 12 nt, Homo sapiens
cugccuccucau

SEQ ID NO: 578986 - RNA, 15 nt, Homo sapiens
cugccuccucuucaa

SEQ ID NO: 578987 - RNA, 15 nt, Homo sapiens
cugccuccugugacg

SEQ ID NO: 578988 - RNA, 20 nt, Homo sapiens
cugccucuggaauugcucaa

SEQ ID NO: 578989 - RNA, 23 nt, Homo sapiens
cugccugaaacagccauguccaa

SEQ ID NO: 578990 - RNA, 16 nt, Homo sapiens
gugaccccugaccuca

SEQ ID NO: 578991 - RNA, 19 nt, Homo sapiens
gugacccugagaaggcaaa

SEQ ID NO: 578992 - RNA, 20 nt, Homo sapiens
gugacccuucagggccagaa

SEQ ID NO: 578993 - RNA, 20 nt, Homo sapiens
gugaccuugggaccaaaggg

SEQ ID NO: 578994 - RNA, 16 nt, Homo sapiens
gugacgugcacuguga

SEQ ID NO: 578995 - RNA, 20 nt, Homo sapiens
gugacucgagucacacucaa

SEQ ID NO: 578996 - RNA, 21 nt, Homo sapiens
gugacucuauauagcugauca

SEQ ID NO: 578997 - RNA, 16 nt, Homo sapiens
gugacuucacuguaua

SEQ ID NO: 578998 - RNA, 16 nt, Homo sapiens
gugacuucccugguca

SEQ ID NO: 578999 - RNA, 13 nt, Homo sapiens
gugacuugcaaua

SEQ ID NO: 579000 - RNA, 20 nt, Homo sapiens
gugacuuucaagcuacucac

SEQ ID NO: 579001 - RNA, 12 nt, Homo sapiens
gugacuuucuaa

SEQ ID NO: 579002 - RNA, 17 nt, Homo sapiens
gugagaaaaugccucaa

SEQ ID NO: 579003 - RNA, 23 nt, Homo sapiens
gugagaaauuugccuuguucaau

SEQ ID NO: 579004 - RNA, 13 nt, Homo sapiens
gugagaaguucau

SEQ ID NO: 579005 - RNA, 23 nt, Homo sapiens
gugagaauaaacuagacucugaa

SEQ ID NO: 579006 - RNA, 12 nt, Homo sapiens
gugagacccagc

SEQ ID NO: 579007 - RNA, 17 nt, Homo sapiens
gugagcaagggggccca

SEQ ID NO: 579008 - RNA, 11 nt, Homo sapiens
gugagcacuag

SEQ ID NO: 579009 - RNA, 15 nt, Homo sapiens
gugagcacuagaaua

SEQ ID NO: 579010 - RNA, 20 nt, Homo sapiens
gugagccacugugucuggcc

SEQ ID NO: 579011 - RNA, 23 nt, Homo sapiens
gugagcguagcagcucagcucuu

SEQ ID NO: 579012 - RNA, 19 nt, Homo sapiens
gugaggaagccuauuugaa

SEQ ID NO: 579013 - RNA, 21 nt, Homo sapiens
gugaggacaaaucuguuguuu

SEQ ID NO: 579014 - RNA, 14 nt, Homo sapiens
gugaggcugugucu

SEQ ID NO: 579015 - RNA, 14 nt, Homo sapiens
gugaggcuucccac

SEQ ID NO: 579016 - RNA, 18 nt, Homo sapiens
gugagggcucacucagcc

SEQ ID NO: 579017 - RNA, 15 nt, Homo sapiens
gugagguucuugggu

SEQ ID NO: 579018 - RNA, 15 nt, Homo sapiens
gugagucgagauugc

SEQ ID NO: 579019 - RNA, 16 nt, Homo sapiens
gugagucuugguucua

SEQ ID NO: 579020 - RNA, 14 nt, Homo sapiens
gugagugugugcaa

SEQ ID NO: 579021 - RNA, 21 nt, Homo sapiens
gugaguuacagcgagaggcag

SEQ ID NO: 579022 - RNA, 15 nt, Homo sapiens
gugaguuaucacuuc

SEQ ID NO: 579023 - RNA, 22 nt, Homo sapiens
gugaguuuuacucuuaaaucau

SEQ ID NO: 579024 - RNA, 15 nt, Homo sapiens
gugauaaugcagacu

SEQ ID NO: 579025 - RNA, 13 nt, Homo sapiens
gugauacauuucu

SEQ ID NO: 579026 - RNA, 20 nt, Homo sapiens
gugauaggacauucuaugcu

SEQ ID NO: 579027 - RNA, 23 nt, Homo sapiens
gugauauacugguucacauccua

SEQ ID NO: 579028 - RNA, 16 nt, Homo sapiens
gugauauagugcuguu

SEQ ID NO: 579029 - RNA, 19 nt, Homo sapiens
gugaucaacuguucagggu

SEQ ID NO: 579030 - RNA, 22 nt, Homo sapiens
gugaucacugagacagccacuu

SEQ ID NO: 579031 - RNA, 17 nt, Homo sapiens
gugauccacccaccucg

SEQ ID NO: 579032 - RNA, 19 nt, Homo sapiens
cugcuaugcuaaaccuccu

SEQ ID NO: 579033 - RNA, 16 nt, Homo sapiens
cugcucaagaagacau

SEQ ID NO: 579034 - RNA, 19 nt, Homo sapiens
cugcucaauaaaguacaag

SEQ ID NO: 579035 - RNA, 18 nt, Homo sapiens
cugcucacaaaaucacuu

SEQ ID NO: 579036 - RNA, 21 nt, Homo sapiens
cugcucagagcuuuaaaagua

SEQ ID NO: 579037 - RNA, 21 nt, Homo sapiens
cugcucaggaaaccacaaccu

SEQ ID NO: 579038 - RNA, 12 nt, Homo sapiens
cugcuccaaagu

SEQ ID NO: 579039 - RNA, 16 nt, Homo sapiens
cugcuccaguccugga

SEQ ID NO: 579040 - RNA, 22 nt, Homo sapiens
cugcucccacacuugugccagc

SEQ ID NO: 579041 - RNA, 17 nt, Homo sapiens
cugcucccaccaggaga

SEQ ID NO: 579042 - RNA, 15 nt, Homo sapiens
cugcucccaucauuc

SEQ ID NO: 579043 - RNA, 16 nt, Homo sapiens
cugcucccauccucac

SEQ ID NO: 579044 - RNA, 13 nt, Homo sapiens
cugcucccauucc

SEQ ID NO: 579045 - RNA, 17 nt, Homo sapiens
cugcuccgcugcuccuu

SEQ ID NO: 579046 - RNA, 22 nt, Homo sapiens
cugcuccuguucacaccagaga

SEQ ID NO: 579047 - RNA, 17 nt, Homo sapiens
cugcucggcuugaucac

SEQ ID NO: 579048 - RNA, 18 nt, Homo sapiens
cugcucguggccaaaagu

SEQ ID NO: 579049 - RNA, 16 nt, Homo sapiens
cugcucuacccaugag

SEQ ID NO: 579050 - RNA, 15 nt, Homo sapiens
cugcucucuguggug

SEQ ID NO: 579051 - RNA, 13 nt, Homo sapiens
cugcucugagcca

SEQ ID NO: 579052 - RNA, 21 nt, Homo sapiens
cugcucugaggcuuccagaga

SEQ ID NO: 579053 - RNA, 13 nt, Homo sapiens
cugcucugcuaua

SEQ ID NO: 579054 - RNA, 22 nt, Homo sapiens
cugcucuguaggucauuggcca

SEQ ID NO: 579055 - RNA, 17 nt, Homo sapiens
cugcucuucugugccca

SEQ ID NO: 579056 - RNA, 17 nt, Homo sapiens
cugcucuugaucugugu

SEQ ID NO: 579057 - RNA, 14 nt, Homo sapiens
cugcucuuguucua

SEQ ID NO: 579058 - RNA, 23 nt, Homo sapiens
cugcucuuucucugccagugaca

SEQ ID NO: 579059 - RNA, 17 nt, Homo sapiens
cugcucuuuugugauga

SEQ ID NO: 579060 - RNA, 17 nt, Homo sapiens
cugcugaaggaggguca

SEQ ID NO: 579061 - RNA, 14 nt, Homo sapiens
cugcugacugccaa

SEQ ID NO: 579062 - RNA, 22 nt, Homo sapiens
cugcugagucagacugucagaa

SEQ ID NO: 579063 - RNA, 18 nt, Homo sapiens
cugcugagugcaccacuu

SEQ ID NO: 579064 - RNA, 14 nt, Homo sapiens
cugcugcaaggugg

SEQ ID NO: 579065 - RNA, 21 nt, Homo sapiens
cugcugcagggacagcccuga

SEQ ID NO: 579066 - RNA, 17 nt, Homo sapiens
cugcugcauagcucuau

SEQ ID NO: 579067 - RNA, 21 nt, Homo sapiens
cugcugccauauuguagcuca

SEQ ID NO: 579068 - RNA, 17 nt, Homo sapiens
cugcugccucuguggaa

SEQ ID NO: 579069 - RNA, 21 nt, Homo sapiens
cugcugccucuuucccuagga

SEQ ID NO: 579070 - RNA, 18 nt, Homo sapiens
cugcugcuccagugcagg

SEQ ID NO: 579071 - RNA, 12 nt, Homo sapiens
cugcugcugcua

SEQ ID NO: 579072 - RNA, 15 nt, Homo sapiens
cugcugcuguuaucu

SEQ ID NO: 579073 - RNA, 15 nt, Homo sapiens
cugcuggccaugaau

SEQ ID NO: 579074 - RNA, 16 nt, Homo sapiens
cugcuggcugcucccc

SEQ ID NO: 579075 - RNA, 16 nt, Homo sapiens
cugcugggacugagaa

SEQ ID NO: 579076 - RNA, 20 nt, Homo sapiens
cugcugggcucugccuuaaa

SEQ ID NO: 579077 - RNA, 14 nt, Homo sapiens
cugcuggucuucaa

SEQ ID NO: 579078 - RNA, 11 nt, Homo sapiens
cugcuguaaau

SEQ ID NO: 579079 - RNA, 16 nt, Homo sapiens
cugcuguaugugagcu

SEQ ID NO: 579080 - RNA, 16 nt, Homo sapiens
cugcugucacuuccca

SEQ ID NO: 579081 - RNA, 21 nt, Homo sapiens
cugcuguccacaugaccucca

SEQ ID NO: 579082 - RNA, 21 nt, Homo sapiens
cugcuguggcgugagggugag

SEQ ID NO: 579083 - RNA, 13 nt, Homo sapiens
cugcuguguguga

SEQ ID NO: 579084 - RNA, 19 nt, Homo sapiens
cugcuguucauguuacuca

SEQ ID NO: 579085 - RNA, 20 nt, Homo sapiens
cugcuguuccugcuccauga

SEQ ID NO: 579086 - RNA, 15 nt, Homo sapiens
cugcuuacuugguga

SEQ ID NO: 579087 - RNA, 16 nt, Homo sapiens
cugcuucaaauauuuc

SEQ ID NO: 579088 - RNA, 13 nt, Homo sapiens
cugcuucagucca

SEQ ID NO: 579089 - RNA, 20 nt, Homo sapiens
cugcuucaugggaaaacaga

SEQ ID NO: 579090 - RNA, 16 nt, Homo sapiens
cugcuucaugugaaca

SEQ ID NO: 579091 - RNA, 17 nt, Homo sapiens
cugcuucccauugagua

SEQ ID NO: 579092 - RNA, 19 nt, Homo sapiens
cugcuuccccuuccuaagu

SEQ ID NO: 579093 - RNA, 13 nt, Homo sapiens
cugcuuccugucu

SEQ ID NO: 579094 - RNA, 19 nt, Homo sapiens
cugcuucuacggccaugag

SEQ ID NO: 579095 - RNA, 15 nt, Homo sapiens
cugcuucugcacuuc

SEQ ID NO: 579096 - RNA, 16 nt, Homo sapiens
cugcuucugcacuuca

SEQ ID NO: 579097 - RNA, 17 nt, Homo sapiens
cugcuucuuuucacuuc

SEQ ID NO: 579098 - RNA, 22 nt, Homo sapiens
cugcuucuuuucacuucagagc

SEQ ID NO: 579099 - RNA, 15 nt, Homo sapiens
cugcuugaccaaaga

SEQ ID NO: 579100 - RNA, 20 nt, Homo sapiens
cugcuugaccguacucucac

SEQ ID NO: 579101 - RNA, 20 nt, Homo sapiens
cugcuugaugaagcaaggaa

SEQ ID NO: 579102 - RNA, 11 nt, Homo sapiens
cugcuugcaca

SEQ ID NO: 579103 - RNA, 16 nt, Homo sapiens
cugcuuguacuaagcc

SEQ ID NO: 579104 - RNA, 13 nt, Homo sapiens
cugcuugugaucu

SEQ ID NO: 579105 - RNA, 16 nt, Homo sapiens
cugcuugugaucucac

SEQ ID NO: 579106 - RNA, 14 nt, Homo sapiens
cugcuuuaucuuuu

SEQ ID NO: 579107 - RNA, 19 nt, Homo sapiens
cugcuuugaaacuugccug

SEQ ID NO: 579108 - RNA, 19 nt, Homo sapiens
cugcuuuugaaaucuguau

SEQ ID NO: 579109 - RNA, 18 nt, Homo sapiens
cugcuuuuugcuucuuga

SEQ ID NO: 579110 - RNA, 21 nt, Homo sapiens
cugcuuuuuuuuuuccagcaa

SEQ ID NO: 579111 - RNA, 15 nt, Homo sapiens
cuggaaaaauuccag

SEQ ID NO: 579112 - RNA, 22 nt, Homo sapiens
gugcccauguguacauucugcc

SEQ ID NO: 579113 - RNA, 13 nt, Homo sapiens
gugccccacaaaa

SEQ ID NO: 579114 - RNA, 13 nt, Homo sapiens
gugccccaugccu

SEQ ID NO: 579115 - RNA, 15 nt, Homo sapiens
gugcccgaguagcau

SEQ ID NO: 579116 - RNA, 10 nt, Homo sapiens
gugcccucca

SEQ ID NO: 579117 - RNA, 17 nt, Homo sapiens
gugcccugcaggcacag

SEQ ID NO: 579118 - RNA, 14 nt, Homo sapiens
gugccuaacaccag

SEQ ID NO: 579119 - RNA, 21 nt, Homo sapiens
gugccuccaccaccacuggcc

SEQ ID NO: 579120 - RNA, 22 nt, Homo sapiens
gugccuccaggugugcacgugg

SEQ ID NO: 579121 - RNA, 18 nt, Homo sapiens
gugccuccuagagugcag

SEQ ID NO: 579122 - RNA, 15 nt, Homo sapiens
gugccugaucugcac

SEQ ID NO: 579123 - RNA, 22 nt, Homo sapiens
gugccugaucugcacauuucau

SEQ ID NO: 579124 - RNA, 14 nt, Homo sapiens
gugccuggccaugu

SEQ ID NO: 579125 - RNA, 17 nt, Homo sapiens
gugccuggccaugucac

SEQ ID NO: 579126 - RNA, 15 nt, Homo sapiens
gugccuguacaggaa

SEQ ID NO: 579127 - RNA, 16 nt, Homo sapiens
gugccuguagugccag

SEQ ID NO: 579128 - RNA, 11 nt, Homo sapiens
gugccuuccac

SEQ ID NO: 579129 - RNA, 15 nt, Homo sapiens
gugcgagugugugca

SEQ ID NO: 579130 - RNA, 16 nt, Homo sapiens
gugcgcaauugcucau

SEQ ID NO: 579131 - RNA, 21 nt, Homo sapiens
gugcgugaagaccaacaaagu

SEQ ID NO: 579132 - RNA, 23 nt, Homo sapiens
gugcuaaaaaauuaaaccaagca

SEQ ID NO: 579133 - RNA, 17 nt, Homo sapiens
gugcuacaacaugugag

SEQ ID NO: 579134 - RNA, 17 nt, Homo sapiens
gugcuaucgcaccacug

SEQ ID NO: 579135 - RNA, 16 nt, Homo sapiens
gugcucagcuacuucu

SEQ ID NO: 579136 - RNA, 17 nt, Homo sapiens
gugcucauccucacugc

SEQ ID NO: 579137 - RNA, 14 nt, Homo sapiens
gugcucugaagugu

SEQ ID NO: 579138 - RNA, 18 nt, Homo sapiens
gugcucugggcucacugc

SEQ ID NO: 579139 - RNA, 16 nt, Homo sapiens
gugcucuggggguccc

SEQ ID NO: 579140 - RNA, 16 nt, Homo sapiens
gugcucuuaagccuaa

SEQ ID NO: 579141 - RNA, 18 nt, Homo sapiens
gugcucuuggcugacccc

SEQ ID NO: 579142 - RNA, 20 nt, Homo sapiens
gugcugacaacuuagcucag

SEQ ID NO: 579143 - RNA, 15 nt, Homo sapiens
gugcugauguuuaca

SEQ ID NO: 579144 - RNA, 15 nt, Homo sapiens
gugcugcacaaaagc

SEQ ID NO: 579145 - RNA, 18 nt, Homo sapiens
gugcugcagguggcagag

SEQ ID NO: 579146 - RNA, 14 nt, Homo sapiens
gugcugcugcugcu

SEQ ID NO: 579147 - RNA, 15 nt, Homo sapiens
gugcugggauuacag

SEQ ID NO: 579148 - RNA, 18 nt, Homo sapiens
gugcugggauuacaggug

SEQ ID NO: 579149 - RNA, 20 nt, Homo sapiens
gugcugggauuacaggugua

SEQ ID NO: 579150 - RNA, 16 nt, Homo sapiens
gugcugggggaaugag

SEQ ID NO: 579151 - RNA, 22 nt, Homo sapiens
gugcugucuugaugacugcuga

SEQ ID NO: 579152 - RNA, 21 nt, Homo sapiens
gugcugugcacaccugcucuc

SEQ ID NO: 579153 - RNA, 17 nt, Homo sapiens
gugcuguggccugggca

SEQ ID NO: 579154 - RNA, 14 nt, Homo sapiens
gugcuucugcucau

SEQ ID NO: 579155 - RNA, 19 nt, Homo sapiens
gugcuucuggaaacuacca

SEQ ID NO: 579156 - RNA, 15 nt, Homo sapiens
gugcuugagccagga

SEQ ID NO: 579157 - RNA, 12 nt, Homo sapiens
cuggacugcaau

SEQ ID NO: 579158 - RNA, 18 nt, Homo sapiens
cuggacugcacacuucca

SEQ ID NO: 579159 - RNA, 12 nt, Homo sapiens
cuggacuuuccu

SEQ ID NO: 579160 - RNA, 20 nt, Homo sapiens
cuggagaacuagagaaggac

SEQ ID NO: 579161 - RNA, 22 nt, Homo sapiens
cuggagaagucuuagacuugaa

SEQ ID NO: 579162 - RNA, 18 nt, Homo sapiens
cuggagacaaggugcuaa

SEQ ID NO: 579163 - RNA, 20 nt, Homo sapiens
cuggagaccgcuucaccccu

SEQ ID NO: 579164 - RNA, 21 nt, Homo sapiens
cuggagagguuaaggugcaau

SEQ ID NO: 579165 - RNA, 19 nt, Homo sapiens
cuggagaguaagaauauag

SEQ ID NO: 579166 - RNA, 13 nt, Homo sapiens
cuggagauaugaa

SEQ ID NO: 579167 - RNA, 20 nt, Homo sapiens
cuggagauaugaaggauuac

SEQ ID NO: 579168 - RNA, 22 nt, Homo sapiens
cuggagaugcagcuacuggaau

SEQ ID NO: 579169 - RNA, 22 nt, Homo sapiens
cuggagauggacaacucaauga

SEQ ID NO: 579170 - RNA, 17 nt, Homo sapiens
cuggagcagguggcuug

SEQ ID NO: 579171 - RNA, 19 nt, Homo sapiens
cuggagccagagagacaga

SEQ ID NO: 579172 - RNA, 18 nt, Homo sapiens
cuggagcccacaaccuuc

SEQ ID NO: 579173 - RNA, 20 nt, Homo sapiens
cuggagcccauccagucucc

SEQ ID NO: 579174 - RNA, 20 nt, Homo sapiens
cuggagccuccacugccucu

SEQ ID NO: 579175 - RNA, 17 nt, Homo sapiens
cuggagcucaucugcaa

SEQ ID NO: 579176 - RNA, 18 nt, Homo sapiens
cuggagcucaucugcaaa

SEQ ID NO: 579177 - RNA, 19 nt, Homo sapiens
cuggagcugaggaaucuaa

SEQ ID NO: 579178 - RNA, 19 nt, Homo sapiens
cuggaggaaccacauauaa

SEQ ID NO: 579179 - RNA, 17 nt, Homo sapiens
cuggaggacggucaguc

SEQ ID NO: 579180 - RNA, 17 nt, Homo sapiens
cuggaggaguuccuuga

SEQ ID NO: 579181 - RNA, 17 nt, Homo sapiens
cuggaggcugagcugca

SEQ ID NO: 579182 - RNA, 19 nt, Homo sapiens
cuggaggcugagcugcauc

SEQ ID NO: 579183 - RNA, 19 nt, Homo sapiens
cuggagggaggggugagau

SEQ ID NO: 579184 - RNA, 17 nt, Homo sapiens
cuggagguugaagccaa

SEQ ID NO: 579185 - RNA, 15 nt, Homo sapiens
cuggaguaaaccaug

SEQ ID NO: 579186 - RNA, 23 nt, Homo sapiens
cuggagucugucucuuucagugc

SEQ ID NO: 579187 - RNA, 12 nt, Homo sapiens
cuggagugaaau

SEQ ID NO: 579188 - RNA, 14 nt, Homo sapiens
cuggagugcaaugg

SEQ ID NO: 579189 - RNA, 13 nt, Homo sapiens
cuggagugcagug

SEQ ID NO: 579190 - RNA, 20 nt, Homo sapiens
cuggaguggaguggcgugau

SEQ ID NO: 579191 - RNA, 18 nt, Homo sapiens
cuggagugugucagagcc

SEQ ID NO: 579192 - RNA, 15 nt, Homo sapiens
cuggauaaaccaccc

SEQ ID NO: 579193 - RNA, 15 nt, Homo sapiens
cuggauacuggacac

SEQ ID NO: 579194 - RNA, 15 nt, Homo sapiens
cuggaucacagacac

SEQ ID NO: 579195 - RNA, 13 nt, Homo sapiens
cuggaucaguaaa

SEQ ID NO: 579196 - RNA, 21 nt, Homo sapiens
cuggaucuaccagcauaaaua

SEQ ID NO: 579197 - RNA, 15 nt, Homo sapiens
cuggaucuaugugua

SEQ ID NO: 579198 - RNA, 21 nt, Homo sapiens
cuggaucuauguguaugcaga

SEQ ID NO: 579199 - RNA, 17 nt, Homo sapiens
cuggauggcaccagagg

SEQ ID NO: 579200 - RNA, 16 nt, Homo sapiens
cuggauggcaccucag

SEQ ID NO: 579201 - RNA, 18 nt, Homo sapiens
cuggaugggggucccugu

SEQ ID NO: 579202 - RNA, 14 nt, Homo sapiens
cuggauguauguaa

SEQ ID NO: 579203 - RNA, 19 nt, Homo sapiens
cuggaugucugggugaccu

SEQ ID NO: 579204 - RNA, 23 nt, Homo sapiens
cuggcaacaugaagaaugcauuc

SEQ ID NO: 579205 - RNA, 22 nt, Homo sapiens
cuggcaagaaagcuugagucuc

SEQ ID NO: 579206 - RNA, 20 nt, Homo sapiens
cuggcaauaaacuccuacua

SEQ ID NO: 579207 - RNA, 12 nt, Homo sapiens
cuggcacacucc

SEQ ID NO: 579208 - RNA, 22 nt, Homo sapiens
cuggcacugaauuaaucaucua

SEQ ID NO: 579209 - RNA, 12 nt, Homo sapiens
cuggcacugacu

SEQ ID NO: 579210 - RNA, 19 nt, Homo sapiens
cuggcagacucgggaccaa

SEQ ID NO: 579211 - RNA, 12 nt, Homo sapiens
cuggcagagccu

SEQ ID NO: 579212 - RNA, 20 nt, Homo sapiens
cuggcagcaucuucacuucu

SEQ ID NO: 579213 - RNA, 15 nt, Homo sapiens
cuggcagcucuccag

SEQ ID NO: 579214 - RNA, 21 nt, Homo sapiens
cuggcaggagccggcugccua

SEQ ID NO: 579215 - RNA, 23 nt, Homo sapiens
cuggcaggagccggcugccuacc

SEQ ID NO: 579216 - RNA, 17 nt, Homo sapiens
cuggcagggcccaguga

SEQ ID NO: 579217 - RNA, 22 nt, Homo sapiens
cuggcagguaggucggcacuug

SEQ ID NO: 579218 - RNA, 20 nt, Homo sapiens
cuggcaucaggucugggcaa

SEQ ID NO: 579219 - RNA, 15 nt, Homo sapiens
cuggcaugacacucu

SEQ ID NO: 579220 - RNA, 21 nt, Homo sapiens
cuggcauuacaauugcaguuu

SEQ ID NO: 579221 - RNA, 22 nt, Homo sapiens
cuggcauuccuucugaccacag

SEQ ID NO: 579222 - RNA, 23 nt, Homo sapiens
cuggccaguccugguccuggcug

SEQ ID NO: 579223 - RNA, 22 nt, Homo sapiens
cuggccaugccuggagacauau

SEQ ID NO: 579224 - RNA, 24 nt, Homo sapiens
cuggccaugccuggagacauauca

SEQ ID NO: 579225 - RNA, 13 nt, Homo sapiens
cuggcccaaagca

SEQ ID NO: 579226 - RNA, 15 nt, Homo sapiens
cuggcccacugagcc

SEQ ID NO: 579227 - RNA, 16 nt, Homo sapiens
cuggccccuagaauca

SEQ ID NO: 579228 - RNA, 19 nt, Homo sapiens
cuggccccuguggggaaca

SEQ ID NO: 579229 - RNA, 19 nt, Homo sapiens
cuggcccgcaauacuguag

SEQ ID NO: 579230 - RNA, 17 nt, Homo sapiens
cuggcccucgacacuca

SEQ ID NO: 579231 - RNA, 14 nt, Homo sapiens
cuggcccugaggug

SEQ ID NO: 579232 - RNA, 13 nt, Homo sapiens
cuggccucaagca

SEQ ID NO: 579233 - RNA, 22 nt, Homo sapiens
cuggccucccacccgaugcugc

SEQ ID NO: 579234 - RNA, 20 nt, Homo sapiens
guggguacucaauguguacu

SEQ ID NO: 579235 - RNA, 18 nt, Homo sapiens
guggguguggccagcaca

SEQ ID NO: 579236 - RNA, 22 nt, Homo sapiens
guggguuuuuuugaauguuggu

SEQ ID NO: 579237 - RNA, 19 nt, Homo sapiens
gugguacuuuauucuugcu

SEQ ID NO: 579238 - RNA, 23 nt, Homo sapiens
gugguagaagccaguacagagaa

SEQ ID NO: 579239 - RNA, 18 nt, Homo sapiens
gugguaugaaaugucuga

SEQ ID NO: 579240 - RNA, 18 nt, Homo sapiens
gugguaugguuguauaca

SEQ ID NO: 579241 - RNA, 24 nt, Homo sapiens
guggucaagcccucgucuagagca

SEQ ID NO: 579242 - RNA, 21 nt, Homo sapiens
guggucauuuccuaugcaaau

SEQ ID NO: 579243 - RNA, 17 nt, Homo sapiens
gugguccuuugggguga

SEQ ID NO: 579244 - RNA, 15 nt, Homo sapiens
guggucuugaucucc

SEQ ID NO: 579245 - RNA, 17 nt, Homo sapiens
guggugacaccuccccc

SEQ ID NO: 579246 - RNA, 20 nt, Homo sapiens
guggugacaggcccagugga

SEQ ID NO: 579247 - RNA, 21 nt, Homo sapiens
guggugagccgagauugcacc

SEQ ID NO: 579248 - RNA, 23 nt, Homo sapiens
guggugagccgagauugcaccau

SEQ ID NO: 579249 - RNA, 18 nt, Homo sapiens
gugguggagaaccacagc

SEQ ID NO: 579250 - RNA, 21 nt, Homo sapiens
gugguuauuuagggaacugcu

SEQ ID NO: 579251 - RNA, 21 nt, Homo sapiens
gugguugauuuuaaugaaugc

SEQ ID NO: 579252 - RNA, 15 nt, Homo sapiens
gugguuguuuuguca

SEQ ID NO: 579253 - RNA, 17 nt, Homo sapiens
gugguuucuacuucccc

SEQ ID NO: 579254 - RNA, 22 nt, Homo sapiens
gugguuuuauacugaaggaaaa

SEQ ID NO: 579255 - RNA, 17 nt, Homo sapiens
guguaacacuugucaag

SEQ ID NO: 579256 - RNA, 20 nt, Homo sapiens
guguaagaacaacuaccuga

SEQ ID NO: 579257 - RNA, 17 nt, Homo sapiens
guguaagcucacaucca

SEQ ID NO: 579258 - RNA, 16 nt, Homo sapiens
guguaauggaaaccaa

SEQ ID NO: 579259 - RNA, 20 nt, Homo sapiens
guguaauggaaaccaaggaa

SEQ ID NO: 579260 - RNA, 14 nt, Homo sapiens
guguacaaugccuu

SEQ ID NO: 579261 - RNA, 19 nt, Homo sapiens
guguacagucuuguauuaa

SEQ ID NO: 579262 - RNA, 20 nt, Homo sapiens
guguaccuccucucaguguu

SEQ ID NO: 579263 - RNA, 13 nt, Homo sapiens
guguacucuuuau

SEQ ID NO: 579264 - RNA, 21 nt, Homo sapiens
guguauauauaguagcauuuc

SEQ ID NO: 579265 - RNA, 20 nt, Homo sapiens
guguauauuuuuguauguca

SEQ ID NO: 579266 - RNA, 23 nt, Homo sapiens
guguaucggaugcuuuuguucag

SEQ ID NO: 579267 - RNA, 17 nt, Homo sapiens
guguaucuuuaagaaaa

SEQ ID NO: 579268 - RNA, 13 nt, Homo sapiens
guguaugcacgug

SEQ ID NO: 579269 - RNA, 13 nt, Homo sapiens
guguaugucagug

SEQ ID NO: 579270 - RNA, 15 nt, Homo sapiens
guguaugucaguggu

SEQ ID NO: 579271 - RNA, 23 nt, Homo sapiens
guguaugugagagauucugugau

SEQ ID NO: 579272 - RNA, 16 nt, Homo sapiens
guguaugugcauuaaa

SEQ ID NO: 579273 - RNA, 20 nt, Homo sapiens
guguaugugcauuaaacaaa

SEQ ID NO: 579274 - RNA, 15 nt, Homo sapiens
gugucaccaauucca

SEQ ID NO: 579275 - RNA, 22 nt, Homo sapiens
gugucaccaauuccaccaagac

SEQ ID NO: 579276 - RNA, 21 nt, Homo sapiens
gugucaccaugagcaccucca

SEQ ID NO: 579277 - RNA, 21 nt, Homo sapiens
gugucacuacucacagucucu

SEQ ID NO: 579278 - RNA, 18 nt, Homo sapiens
gugucagagcccagggga

SEQ ID NO: 579279 - RNA, 21 nt, Homo sapiens
cugggaggagauaaacaccaa

SEQ ID NO: 579280 - RNA, 18 nt, Homo sapiens
cugggagucacacagugu

SEQ ID NO: 579281 - RNA, 18 nt, Homo sapiens
cugggauccaguguauaa

SEQ ID NO: 579282 - RNA, 20 nt, Homo sapiens
cugggauccaguguauaaau

SEQ ID NO: 579283 - RNA, 14 nt, Homo sapiens
cugggaucugagua

SEQ ID NO: 579284 - RNA, 19 nt, Homo sapiens
cugggaucuggcacacucc

SEQ ID NO: 579285 - RNA, 13 nt, Homo sapiens
cugggaugacagg

SEQ ID NO: 579286 - RNA, 14 nt, Homo sapiens
cugggauguagaac

SEQ ID NO: 579287 - RNA, 21 nt, Homo sapiens
cugggauuacaggcgugaucc

SEQ ID NO: 579288 - RNA, 22 nt, Homo sapiens
cugggauuacagggaugagcca

SEQ ID NO: 579289 - RNA, 16 nt, Homo sapiens
cugggcaacacugcag

SEQ ID NO: 579290 - RNA, 22 nt, Homo sapiens
cugggcaagggggaacaaauca

SEQ ID NO: 579291 - RNA, 15 nt, Homo sapiens
cugggcagagccugu

SEQ ID NO: 579292 - RNA, 20 nt, Homo sapiens
cugggcagccguuuuccuca

SEQ ID NO: 579293 - RNA, 20 nt, Homo sapiens
cugggcaggguucuccaagg

SEQ ID NO: 579294 - RNA, 14 nt, Homo sapiens
cugggcagugccac

SEQ ID NO: 579295 - RNA, 15 nt, Homo sapiens
cugggcauacuuucu

SEQ ID NO: 579296 - RNA, 13 nt, Homo sapiens
cugggcauugcuu

SEQ ID NO: 579297 - RNA, 11 nt, Homo sapiens
cugggccaaaa

SEQ ID NO: 579298 - RNA, 20 nt, Homo sapiens
cugggccaaguuccucuagu

SEQ ID NO: 579299 - RNA, 22 nt, Homo sapiens
cugggccaaguuccucuagugc

SEQ ID NO: 579300 - RNA, 14 nt, Homo sapiens
cugggccaggagcc

SEQ ID NO: 579301 - RNA, 16 nt, Homo sapiens
cugggccauguccaaa

SEQ ID NO: 579302 - RNA, 17 nt, Homo sapiens
cugggccauguccaaag

SEQ ID NO: 579303 - RNA, 20 nt, Homo sapiens
cugggccauucuccacagca

SEQ ID NO: 579304 - RNA, 18 nt, Homo sapiens
cugggcccucuuaucuca

SEQ ID NO: 579305 - RNA, 15 nt, Homo sapiens
cugggccguggcaca

SEQ ID NO: 579306 - RNA, 18 nt, Homo sapiens
cugggccugcuuuuccag

SEQ ID NO: 579307 - RNA, 16 nt, Homo sapiens
cugggcggcugugcuu

SEQ ID NO: 579308 - RNA, 22 nt, Homo sapiens
cugggcuaaguaaauaggaauu

SEQ ID NO: 579309 - RNA, 15 nt, Homo sapiens
cugggcucacugugc

SEQ ID NO: 579310 - RNA, 20 nt, Homo sapiens
cugggcuccguuguaccaag

SEQ ID NO: 579311 - RNA, 12 nt, Homo sapiens
cugggcucucca

SEQ ID NO: 579312 - RNA, 18 nt, Homo sapiens
cugggcucuggaccucag

SEQ ID NO: 579313 - RNA, 23 nt, Homo sapiens
cugggcugcuguagaugacuacu

SEQ ID NO: 579314 - RNA, 13 nt, Homo sapiens
cugggcugggaaa

SEQ ID NO: 579315 - RNA, 20 nt, Homo sapiens
cugggcuggggccaccuuug

SEQ ID NO: 579316 - RNA, 13 nt, Homo sapiens
cugggcuguaacg

SEQ ID NO: 579317 - RNA, 16 nt, Homo sapiens
cugggcugucugucac

SEQ ID NO: 579318 - RNA, 19 nt, Homo sapiens
cugggcuuguuguuuuuaa

SEQ ID NO: 579319 - RNA, 16 nt, Homo sapiens
cugggcuuucacgggc

SEQ ID NO: 579320 - RNA, 22 nt, Homo sapiens
cuggggaagagaaaagcccaag

SEQ ID NO: 579321 - RNA, 17 nt, Homo sapiens
cuggggaagagguuuua

SEQ ID NO: 579322 - RNA, 17 nt, Homo sapiens
cuggggaauacuggcca

SEQ ID NO: 579323 - RNA, 16 nt, Homo sapiens
cuggggacccccgugg

SEQ ID NO: 579324 - RNA, 15 nt, Homo sapiens
cuggggacuccucaa

SEQ ID NO: 579325 - RNA, 19 nt, Homo sapiens
cuggggaggcccuagggga

SEQ ID NO: 579326 - RNA, 23 nt, Homo sapiens
cuggggaucccacucuucuugca

SEQ ID NO: 579327 - RNA, 14 nt, Homo sapiens
cuggggcaauggga

SEQ ID NO: 579328 - RNA, 19 nt, Homo sapiens
cuggggcaggucacuuuac

SEQ ID NO: 579329 - RNA, 20 nt, Homo sapiens
cuggggcccaaguugcagug

SEQ ID NO: 579330 - RNA, 14 nt, Homo sapiens
cuggggccccaucu

SEQ ID NO: 579331 - RNA, 22 nt, Homo sapiens
cuggggcuccgaaauuccaagg

SEQ ID NO: 579332 - RNA, 18 nt, Homo sapiens
cugggggcacagcugucu

SEQ ID NO: 579333 - RNA, 12 nt, Homo sapiens
cugggggccaug

SEQ ID NO: 579334 - RNA, 23 nt, Homo sapiens
cuggggggcguggagagcccggc

SEQ ID NO: 579335 - RNA, 19 nt, Homo sapiens
cuggggucacccaaccuga

SEQ ID NO: 579336 - RNA, 16 nt, Homo sapiens
cugggguccauucucu

SEQ ID NO: 579337 - RNA, 21 nt, Homo sapiens
cugggguuggacuguaaggga

SEQ ID NO: 579338 - RNA, 14 nt, Homo sapiens
cuggguagcuguaa

SEQ ID NO: 579339 - RNA, 15 nt, Homo sapiens
cuggguaugcucugu

SEQ ID NO: 579340 - RNA, 19 nt, Homo sapiens
cuggguaugcucugugaca

SEQ ID NO: 579341 - RNA, 16 nt, Homo sapiens
cugggucaugcacuga

SEQ ID NO: 579342 - RNA, 16 nt, Homo sapiens
cugggucucacuccug

SEQ ID NO: 579343 - RNA, 11 nt, Homo sapiens
cugggugaccc

SEQ ID NO: 579344 - RNA, 19 nt, Homo sapiens
cugggugaccucacuuuag

SEQ ID NO: 579345 - RNA, 12 nt, Homo sapiens
cugggugccugc

SEQ ID NO: 579346 - RNA, 19 nt, Homo sapiens
cuggguggccucgggacac

SEQ ID NO: 579347 - RNA, 22 nt, Homo sapiens
cuggguuccuccucuccuacuc

SEQ ID NO: 579348 - RNA, 17 nt, Homo sapiens
cuggguuucuaagcagu

SEQ ID NO: 579349 - RNA, 18 nt, Homo sapiens
cuggguuucuagagguca

SEQ ID NO: 579350 - RNA, 20 nt, Homo sapiens
cuggguuuggaccccagcug

SEQ ID NO: 579351 - RNA, 23 nt, Homo sapiens
cugguaacguggcuccaccuuga

SEQ ID NO: 579352 - RNA, 14 nt, Homo sapiens
cugguaauauugac

SEQ ID NO: 579353 - RNA, 15 nt, Homo sapiens
cugguaaucagcaaa

SEQ ID NO: 579354 - RNA, 20 nt, Homo sapiens
cugguaauuuaagauuccag

SEQ ID NO: 579355 - RNA, 23 nt, Homo sapiens
guuaaaagcaaaaagauguauau

SEQ ID NO: 579356 - RNA, 19 nt, Homo sapiens
guuaaaagggaacacaaaa

SEQ ID NO: 579357 - RNA, 20 nt, Homo sapiens
guuaaaauacucagugcuaa

SEQ ID NO: 579358 - RNA, 13 nt, Homo sapiens
guuaaacagagaa

SEQ ID NO: 579359 - RNA, 19 nt, Homo sapiens
guuaaacccacagccaaac

SEQ ID NO: 579360 - RNA, 17 nt, Homo sapiens
guuaaagcauaugcuau

SEQ ID NO: 579361 - RNA, 18 nt, Homo sapiens
guuaaagguucacagggg

SEQ ID NO: 579362 - RNA, 14 nt, Homo sapiens
guuaaagugaauaa

SEQ ID NO: 579363 - RNA, 18 nt, Homo sapiens
guuaaauaauauggcuau

SEQ ID NO: 579364 - RNA, 15 nt, Homo sapiens
guuaaauacaagucu

SEQ ID NO: 579365 - RNA, 19 nt, Homo sapiens
guuaaauauacacuagcuu

SEQ ID NO: 579366 - RNA, 18 nt, Homo sapiens
guuaaaugaaauuguaaa

SEQ ID NO: 579367 - RNA, 13 nt, Homo sapiens
guuaaauuuagca

SEQ ID NO: 579368 - RNA, 13 nt, Homo sapiens
guuaacaguuuuu

SEQ ID NO: 579369 - RNA, 22 nt, Homo sapiens
guuaacuuuuguaccaaauagc

SEQ ID NO: 579370 - RNA, 19 nt, Homo sapiens
guuaagcagccugccauau

SEQ ID NO: 579371 - RNA, 18 nt, Homo sapiens
guuaaggguuaguuuaca

SEQ ID NO: 579372 - RNA, 14 nt, Homo sapiens
guuaauaacagcuc

SEQ ID NO: 579373 - RNA, 20 nt, Homo sapiens
guuaauaagugguaucugac

SEQ ID NO: 579374 - RNA, 17 nt, Homo sapiens
guuaaucauguauuaaa

SEQ ID NO: 579375 - RNA, 13 nt, Homo sapiens
guuaauccaguga

SEQ ID NO: 579376 - RNA, 16 nt, Homo sapiens
guuaaugcugaaacau

SEQ ID NO: 579377 - RNA, 13 nt, Homo sapiens
guuaauggucaca

SEQ ID NO: 579378 - RNA, 12 nt, Homo sapiens
guuaaugucauu

SEQ ID NO: 579379 - RNA, 18 nt, Homo sapiens
guuaaugucauugcuaaa

SEQ ID NO: 579380 - RNA, 17 nt, Homo sapiens
guuaauguuauaucaua

SEQ ID NO: 579381 - RNA, 16 nt, Homo sapiens
guuaauugcagucuaa

SEQ ID NO: 579382 - RNA, 18 nt, Homo sapiens
guuacaaaauacaaaagu

SEQ ID NO: 579383 - RNA, 16 nt, Homo sapiens
guuacacagcccaaga

SEQ ID NO: 579384 - RNA, 12 nt, Homo sapiens
guuacagauuaa

SEQ ID NO: 579385 - RNA, 21 nt, Homo sapiens
guuacagcgagaggcagagaa

SEQ ID NO: 579386 - RNA, 11 nt, Homo sapiens
guuacauauua

SEQ ID NO: 579387 - RNA, 18 nt, Homo sapiens
guuacauguuugcaccuu

SEQ ID NO: 579388 - RNA, 22 nt, Homo sapiens
guuacauuaaagcccuguguua

SEQ ID NO: 579389 - RNA, 10 nt, Homo sapiens
guuacauuuc

SEQ ID NO: 579390 - RNA, 15 nt, Homo sapiens
guuaccaacuaccua

SEQ ID NO: 579391 - RNA, 17 nt, Homo sapiens
guuaccaugucuuucuc

SEQ ID NO: 579392 - RNA, 17 nt, Homo sapiens
guuaccauuguaauauu

SEQ ID NO: 579393 - RNA, 21 nt, Homo sapiens
guuacugagauguuuuaccau

SEQ ID NO: 579394 - RNA, 19 nt, Homo sapiens
guuacugcuugaccaaaga

SEQ ID NO: 579395 - RNA, 21 nt, Homo sapiens
guuacugcuugaccaaagagc

SEQ ID NO: 579396 - RNA, 18 nt, Homo sapiens
guuacuggggucacccaa

SEQ ID NO: 579397 - RNA, 14 nt, Homo sapiens
guuacugucuucag

SEQ ID NO: 579398 - RNA, 21 nt, Homo sapiens
guuacuguguuuaucuugaua

SEQ ID NO: 579399 - RNA, 19 nt, Homo sapiens
guuacuuaauugccagcaa

SEQ ID NO: 579400 - RNA, 17 nt, Homo sapiens
guuacuugaaauaccag

SEQ ID NO: 579401 - RNA, 20 nt, Homo sapiens
guuacuugaaauaccaguga

SEQ ID NO: 579402 - RNA, 21 nt, Homo sapiens
guuacuugaaauaccagugaa

SEQ ID NO: 579403 - RNA, 18 nt, Homo sapiens
cuguaaauugcagaauuc

SEQ ID NO: 579404 - RNA, 19 nt, Homo sapiens
cuguaacaauuauguuuuc

SEQ ID NO: 579405 - RNA, 15 nt, Homo sapiens
cuguaacacaagcca

SEQ ID NO: 579406 - RNA, 16 nt, Homo sapiens
cuguaacagacuaauu

SEQ ID NO: 579407 - RNA, 16 nt, Homo sapiens
cuguaacuacaaugau

SEQ ID NO: 579408 - RNA, 17 nt, Homo sapiens
cuguaacuacaaugaug

SEQ ID NO: 579409 - RNA, 22 nt, Homo sapiens
cuguaacuacaaugaugguaaa

SEQ ID NO: 579410 - RNA, 17 nt, Homo sapiens
cuguaacugucucagaa

SEQ ID NO: 579411 - RNA, 18 nt, Homo sapiens
cuguaagauaauguugcu

SEQ ID NO: 579412 - RNA, 12 nt, Homo sapiens
cuguaagcauuc

SEQ ID NO: 579413 - RNA, 13 nt, Homo sapiens
cuguaagcauucu

SEQ ID NO: 579414 - RNA, 13 nt, Homo sapiens
cuguaaucaauau

SEQ ID NO: 579415 - RNA, 15 nt, Homo sapiens
cuguaaucagcaaua

SEQ ID NO: 579416 - RNA, 20 nt, Homo sapiens
cuguaaucagcucuccuggc

SEQ ID NO: 579417 - RNA, 19 nt, Homo sapiens
cuguaaucccagcacuuug

SEQ ID NO: 579418 - RNA, 21 nt, Homo sapiens
cuguaaucccagcuacuuggg

SEQ ID NO: 579419 - RNA, 21 nt, Homo sapiens
cuguaauccuagcacuuuggg

SEQ ID NO: 579420 - RNA, 12 nt, Homo sapiens
cuguaaugacaa

SEQ ID NO: 579421 - RNA, 15 nt, Homo sapiens
cuguaauguguacug

SEQ ID NO: 579422 - RNA, 16 nt, Homo sapiens
cuguacagagacucua

SEQ ID NO: 579423 - RNA, 13 nt, Homo sapiens
cuguacagugaau

SEQ ID NO: 579424 - RNA, 12 nt, Homo sapiens
cuguacauacau

SEQ ID NO: 579425 - RNA, 20 nt, Homo sapiens
cuguacauacucaguaaaau

SEQ ID NO: 579426 - RNA, 15 nt, Homo sapiens
cuguacauacugcag

SEQ ID NO: 579427 - RNA, 16 nt, Homo sapiens
cuguaccacaucugcu

SEQ ID NO: 579428 - RNA, 15 nt, Homo sapiens
cuguaccaguuaauu

SEQ ID NO: 579429 - RNA, 18 nt, Homo sapiens
cuguaccugugcacguug

SEQ ID NO: 579430 - RNA, 16 nt, Homo sapiens
cuguaccuguuccuua

SEQ ID NO: 579431 - RNA, 15 nt, Homo sapiens
cuguacggacacugu

SEQ ID NO: 579432 - RNA, 14 nt, Homo sapiens
cuguacuacaucua

SEQ ID NO: 579433 - RNA, 16 nt, Homo sapiens
cuguacuagugccauu

SEQ ID NO: 579434 - RNA, 22 nt, Homo sapiens
cuguacuauccuguaaauauau

SEQ ID NO: 579435 - RNA, 17 nt, Homo sapiens
cuguacucccagcacuu

SEQ ID NO: 579436 - RNA, 18 nt, Homo sapiens
cuguacucuugaauacaa

SEQ ID NO: 579437 - RNA, 20 nt, Homo sapiens
cuguacuguucugugucuuu

SEQ ID NO: 579438 - RNA, 21 nt, Homo sapiens
cuguagaagaagcccauauca

SEQ ID NO: 579439 - RNA, 18 nt, Homo sapiens
cuguagacuagugccgua

SEQ ID NO: 579440 - RNA, 19 nt, Homo sapiens
cuguagauguugucuuggc

SEQ ID NO: 579441 - RNA, 21 nt, Homo sapiens
cuguagauucagguaauacaa

SEQ ID NO: 579442 - RNA, 18 nt, Homo sapiens
cuguagauucuguggaac

SEQ ID NO: 579443 - RNA, 17 nt, Homo sapiens
cuguagcaagaugcaaa

SEQ ID NO: 579444 - RNA, 15 nt, Homo sapiens
cuguagcacgcugcc

SEQ ID NO: 579445 - RNA, 12 nt, Homo sapiens
cuguagccucag

SEQ ID NO: 579446 - RNA, 17 nt, Homo sapiens
cuguagcucaaucugca

SEQ ID NO: 579447 - RNA, 14 nt, Homo sapiens
cuguaggaaccaau

SEQ ID NO: 579448 - RNA, 21 nt, Homo sapiens
cuguaggacuguuugugacug

SEQ ID NO: 579449 - RNA, 16 nt, Homo sapiens
cuguaggggcaaaaau

SEQ ID NO: 579450 - RNA, 15 nt, Homo sapiens
cuguagguucuugau

SEQ ID NO: 579451 - RNA, 15 nt, Homo sapiens
cuguaguagcccuuu

SEQ ID NO: 579452 - RNA, 14 nt, Homo sapiens
cuguagucccagcu

SEQ ID NO: 579453 - RNA, 19 nt, Homo sapiens
cuguagucccagcuacucg

SEQ ID NO: 579454 - RNA, 21 nt, Homo sapiens
cuguagucccagcuacucggg

SEQ ID NO: 579455 - RNA, 14 nt, Homo sapiens
cuguagucccaguu

SEQ ID NO: 579456 - RNA, 18 nt, Homo sapiens
cuguagugagauagcauu

SEQ ID NO: 579457 - RNA, 13 nt, Homo sapiens
cuguaguugacaa

SEQ ID NO: 579458 - RNA, 22 nt, Homo sapiens
cuguauaauacuuuguauacaa

SEQ ID NO: 579459 - RNA, 13 nt, Homo sapiens
cuguauauuccau

SEQ ID NO: 579460 - RNA, 19 nt, Homo sapiens
cuguaucacagacuggcaa

SEQ ID NO: 579461 - RNA, 14 nt, Homo sapiens
cuguaucaugacaa

SEQ ID NO: 579462 - RNA, 18 nt, Homo sapiens
cuguaucggagacaguga

SEQ ID NO: 579463 - RNA, 14 nt, Homo sapiens
cuguaucuugaugu

SEQ ID NO: 579464 - RNA, 20 nt, Homo sapiens
cuguaucuugauguuuagaa

SEQ ID NO: 579465 - RNA, 18 nt, Homo sapiens
cuguaugaaugucugugg

SEQ ID NO: 579466 - RNA, 20 nt, Homo sapiens
cuguaugccuucagcauugc

SEQ ID NO: 579467 - RNA, 19 nt, Homo sapiens
cuguauuacagcuuucaca

SEQ ID NO: 579468 - RNA, 16 nt, Homo sapiens
cuguauuacauaaaua

SEQ ID NO: 579469 - RNA, 13 nt, Homo sapiens
cuguauuaccucc

SEQ ID NO: 579470 - RNA, 23 nt, Homo sapiens
cuguauucuguuugcguacuugu

SEQ ID NO: 579471 - RNA, 14 nt, Homo sapiens
cuguauugcuccuc

SEQ ID NO: 579472 - RNA, 21 nt, Homo sapiens
cuguauuugaaauaagaauuc

SEQ ID NO: 579473 - RNA, 19 nt, Homo sapiens
cuguauuuuacaagucaaa

SEQ ID NO: 579474 - RNA, 20 nt, Homo sapiens
cuguauuuuacaagucaaaa

SEQ ID NO: 579475 - RNA, 15 nt, Homo sapiens
cugucaaaacacugu

SEQ ID NO: 579476 - RNA, 21 nt, Homo sapiens
cugucaaaugaugugcaaaac

SEQ ID NO: 579477 - RNA, 17 nt, Homo sapiens
guucccagacagcuuuu

SEQ ID NO: 579478 - RNA, 22 nt, Homo sapiens
guucccagcaggaauuucuuuu

SEQ ID NO: 579479 - RNA, 21 nt, Homo sapiens
guuccccaguagagcucuacu

SEQ ID NO: 579480 - RNA, 16 nt, Homo sapiens
guucccccaguaccuc

SEQ ID NO: 579481 - RNA, 14 nt, Homo sapiens
guucccccugugca

SEQ ID NO: 579482 - RNA, 14 nt, Homo sapiens
guuccccucuuguc

SEQ ID NO: 579483 - RNA, 15 nt, Homo sapiens
guucccuccuggucc

SEQ ID NO: 579484 - RNA, 22 nt, Homo sapiens
guucccugacuccuccaaggaa

SEQ ID NO: 579485 - RNA, 16 nt, Homo sapiens
guucccuguucuuccu

SEQ ID NO: 579486 - RNA, 19 nt, Homo sapiens
guucccuugcagggguccc

SEQ ID NO: 579487 - RNA, 12 nt, Homo sapiens
guucccuuuaaa

SEQ ID NO: 579488 - RNA, 17 nt, Homo sapiens
guucccuuugccuuaaa

SEQ ID NO: 579489 - RNA, 18 nt, Homo sapiens
guuccgcacuuuccacuu

SEQ ID NO: 579490 - RNA, 19 nt, Homo sapiens
guuccgcacuuuccacuuc

SEQ ID NO: 579491 - RNA, 15 nt, Homo sapiens
guuccgccacuccag

SEQ ID NO: 579492 - RNA, 14 nt, Homo sapiens
guuccuaacuggaa

SEQ ID NO: 579493 - RNA, 21 nt, Homo sapiens
guuccuaagccuguugcugaa

SEQ ID NO: 579494 - RNA, 15 nt, Homo sapiens
guuccuauugucauu

SEQ ID NO: 579495 - RNA, 21 nt, Homo sapiens
guuccuauuuggggcuugcau

SEQ ID NO: 579496 - RNA, 23 nt, Homo sapiens
guuccugaauacaagccuaugcg

SEQ ID NO: 579497 - RNA, 21 nt, Homo sapiens
guuccuguccaaacucagugc

SEQ ID NO: 579498 - RNA, 18 nt, Homo sapiens
guuccuucacauccugug

SEQ ID NO: 579499 - RNA, 20 nt, Homo sapiens
guuccuuccucugagccuug

SEQ ID NO: 579500 - RNA, 20 nt, Homo sapiens
guuccuuuauuuuauguaaa

SEQ ID NO: 579501 - RNA, 15 nt, Homo sapiens
guuccuuucuuuucc

SEQ ID NO: 579502 - RNA, 14 nt, Homo sapiens
guucgagacuccau

SEQ ID NO: 579503 - RNA, 13 nt, Homo sapiens
guucgauggcuca

SEQ ID NO: 579504 - RNA, 19 nt, Homo sapiens
guucuaacaaaacaaguug

SEQ ID NO: 579505 - RNA, 22 nt, Homo sapiens
guucuauaauaaguuuugauau

SEQ ID NO: 579506 - RNA, 23 nt, Homo sapiens
guucucacaccaacagugugaag

SEQ ID NO: 579507 - RNA, 21 nt, Homo sapiens
guucucacuagaugacuguaa

SEQ ID NO: 579508 - RNA, 19 nt, Homo sapiens
guucucagguguugccaaa

SEQ ID NO: 579509 - RNA, 18 nt, Homo sapiens
guucucagguucacucau

SEQ ID NO: 579510 - RNA, 18 nt, Homo sapiens
guucucaugaacuacccc

SEQ ID NO: 579511 - RNA, 14 nt, Homo sapiens
guucucccaaagau

SEQ ID NO: 579512 - RNA, 19 nt, Homo sapiens
guucucccaccaccucacc

SEQ ID NO: 579513 - RNA, 22 nt, Homo sapiens
guucucuauugcugcucucuca

SEQ ID NO: 579514 - RNA, 18 nt, Homo sapiens
guucucucguaacugguu

SEQ ID NO: 579515 - RNA, 15 nt, Homo sapiens
guucucucugugcuc

SEQ ID NO: 579516 - RNA, 21 nt, Homo sapiens
guucucucuuaguaacauaga

SEQ ID NO: 579517 - RNA, 13 nt, Homo sapiens
guucucugccuca

SEQ ID NO: 579518 - RNA, 18 nt, Homo sapiens
guucucuuugguguuaca

SEQ ID NO: 579519 - RNA, 15 nt, Homo sapiens
guucugaaagugacu

SEQ ID NO: 579520 - RNA, 14 nt, Homo sapiens
guucugaacuggaa

SEQ ID NO: 579521 - RNA, 24 nt, Homo sapiens
guucugcuucaauaaaucuuugga

SEQ ID NO: 579522 - RNA, 17 nt, Homo sapiens
guucuggccaccccaga

SEQ ID NO: 579523 - RNA, 18 nt, Homo sapiens
guucugggagcucaaggc

SEQ ID NO: 579524 - RNA, 12 nt, Homo sapiens
guucugucauau

SEQ ID NO: 579525 - RNA, 15 nt, Homo sapiens
guucugucuucccaa

SEQ ID NO: 579526 - RNA, 12 nt, Homo sapiens
guucugugcaca

SEQ ID NO: 579527 - RNA, 18 nt, Homo sapiens
guucuguugaccugugca

SEQ ID NO: 579528 - RNA, 18 nt, Homo sapiens
cugucugugaauauccag

SEQ ID NO: 579529 - RNA, 14 nt, Homo sapiens
cugucugugccaug

SEQ ID NO: 579530 - RNA, 13 nt, Homo sapiens
cugucuguuacca

SEQ ID NO: 579531 - RNA, 23 nt, Homo sapiens
cugucuuaaaugagaaguacuug

SEQ ID NO: 579532 - RNA, 21 nt, Homo sapiens
cugucuuagugcaaaaaacau

SEQ ID NO: 579533 - RNA, 11 nt, Homo sapiens
cugucuuccaa

SEQ ID NO: 579534 - RNA, 20 nt, Homo sapiens
cugucuuccaaggagaccaa

SEQ ID NO: 579535 - RNA, 23 nt, Homo sapiens
cugucuuggcauuaaaccacauc

SEQ ID NO: 579536 - RNA, 15 nt, Homo sapiens
cugucuuggggccac

SEQ ID NO: 579537 - RNA, 16 nt, Homo sapiens
cugucuugugagcuga

SEQ ID NO: 579538 - RNA, 18 nt, Homo sapiens
cugucuuuauaacccaua

SEQ ID NO: 579539 - RNA, 19 nt, Homo sapiens
cugucuuugaguuguggug

SEQ ID NO: 579540 - RNA, 19 nt, Homo sapiens
cugugaaagaaccaaaaga

SEQ ID NO: 579541 - RNA, 15 nt, Homo sapiens
cugugaaauaucauc

SEQ ID NO: 579542 - RNA, 19 nt, Homo sapiens
cugugaauauccagaaaua

SEQ ID NO: 579543 - RNA, 14 nt, Homo sapiens
cugugaaucugaaa

SEQ ID NO: 579544 - RNA, 18 nt, Homo sapiens
cugugaccaggaaggaag

SEQ ID NO: 579545 - RNA, 21 nt, Homo sapiens
cugugaccccuccuuucuucc

SEQ ID NO: 579546 - RNA, 18 nt, Homo sapiens
cugugacuucuccagguc

SEQ ID NO: 579547 - RNA, 16 nt, Homo sapiens
cugugagccauugucc

SEQ ID NO: 579548 - RNA, 18 nt, Homo sapiens
cugugagccggagcucau

SEQ ID NO: 579549 - RNA, 19 nt, Homo sapiens
cugugaggaaguguggaaa

SEQ ID NO: 579550 - RNA, 18 nt, Homo sapiens
cugugaggccccuggaca

SEQ ID NO: 579551 - RNA, 22 nt, Homo sapiens
cugugaggccccuggacaagca

SEQ ID NO: 579552 - RNA, 14 nt, Homo sapiens
cugugauaccuuag

SEQ ID NO: 579553 - RNA, 18 nt, Homo sapiens
cugugauacgaugcuuca

SEQ ID NO: 579554 - RNA, 18 nt, Homo sapiens
cugugauuaacuugcuua

SEQ ID NO: 579555 - RNA, 21 nt, Homo sapiens
cugugauuucuuucuuugcac

SEQ ID NO: 579556 - RNA, 19 nt, Homo sapiens
cugugcacaaaacccagac

SEQ ID NO: 579557 - RNA, 18 nt, Homo sapiens
cugugcacugcccaugga

SEQ ID NO: 579558 - RNA, 18 nt, Homo sapiens
cugugcagagaugacugu

SEQ ID NO: 579559 - RNA, 21 nt, Homo sapiens
cugugcaggcauggucccuua

SEQ ID NO: 579560 - RNA, 14 nt, Homo sapiens
cugugcaucaacca

SEQ ID NO: 579561 - RNA, 13 nt, Homo sapiens
cugugcaugccau

SEQ ID NO: 579562 - RNA, 18 nt, Homo sapiens
cugugccagacauugcuc

SEQ ID NO: 579563 - RNA, 13 nt, Homo sapiens
cugugccagagau

SEQ ID NO: 579564 - RNA, 14 nt, Homo sapiens
cugugccccaccac

SEQ ID NO: 579565 - RNA, 15 nt, Homo sapiens
cugugccccaccacg

SEQ ID NO: 579566 - RNA, 18 nt, Homo sapiens
cugugccuccccccagac

SEQ ID NO: 579567 - RNA, 21 nt, Homo sapiens
cugugccucgcauccuaugcu

SEQ ID NO: 579568 - RNA, 17 nt, Homo sapiens
cugugccucugccuguc

SEQ ID NO: 579569 - RNA, 13 nt, Homo sapiens
cugugccugcuca

SEQ ID NO: 579570 - RNA, 16 nt, Homo sapiens
cugugccuuuuaucua

SEQ ID NO: 579571 - RNA, 23 nt, Homo sapiens
cugugcggugucaccaugagcac

SEQ ID NO: 579572 - RNA, 14 nt, Homo sapiens
cugugcguuacuaa

SEQ ID NO: 579573 - RNA, 16 nt, Homo sapiens
cugugcucacuaccug

SEQ ID NO: 579574 - RNA, 18 nt, Homo sapiens
cugugcucauuuugcaau

SEQ ID NO: 579575 - RNA, 22 nt, Homo sapiens
cugugcugcccugaagaauggc

SEQ ID NO: 579576 - RNA, 23 nt, Homo sapiens
cugugcugugacucgagucacac

SEQ ID NO: 579577 - RNA, 17 nt, Homo sapiens
cugugcuucgacuacug

SEQ ID NO: 579578 - RNA, 23 nt, Homo sapiens
cugugcuucgacuacugcuccug

SEQ ID NO: 579579 - RNA, 18 nt, Homo sapiens
cugugcuucgguaggcga

SEQ ID NO: 579580 - RNA, 17 nt, Homo sapiens
cuguggaccacccuagc

SEQ ID NO: 579581 - RNA, 17 nt, Homo sapiens
cuguggaccacugcaug

SEQ ID NO: 579582 - RNA, 21 nt, Homo sapiens
cuguggagaucagaaagugac

SEQ ID NO: 579583 - RNA, 12 nt, Homo sapiens
cuguggaugcuu

SEQ ID NO: 579584 - RNA, 16 nt, Homo sapiens
cuguggauuauuucau

SEQ ID NO: 579585 - RNA, 15 nt, Homo sapiens
cuguggccaaguucu

SEQ ID NO: 579586 - RNA, 24 nt, Homo sapiens
cuguggccacucgagugcccaagg

SEQ ID NO: 579587 - RNA, 14 nt, Homo sapiens
cuguggccccaaga

SEQ ID NO: 579588 - RNA, 14 nt, Homo sapiens
cuguggccugggca

SEQ ID NO: 579589 - RNA, 18 nt, Homo sapiens
cuguggccuguuaacugg

SEQ ID NO: 579590 - RNA, 16 nt, Homo sapiens
cuguggcggugccugg

SEQ ID NO: 579591 - RNA, 17 nt, Homo sapiens
cuguggcuagugacaaa

SEQ ID NO: 579592 - RNA, 19 nt, Homo sapiens
cuguggcuuuuuguucaga

SEQ ID NO: 579593 - RNA, 16 nt, Homo sapiens
cugugggcaagccuaa

SEQ ID NO: 579594 - RNA, 22 nt, Homo sapiens
cugugggcauggucaaaggcuc

SEQ ID NO: 579595 - RNA, 21 nt, Homo sapiens
cuguggggcaggagugccagg

SEQ ID NO: 579596 - RNA, 24 nt, Homo sapiens
cugugggguauacagcauugacuc

SEQ ID NO: 579597 - RNA, 21 nt, Homo sapiens
cugugggucugggagucacac

SEQ ID NO: 579598 - RNA, 18 nt, Homo sapiens
cuguuuuuuuugcugcua

SEQ ID NO: 579599 - RNA, 18 nt, Homo sapiens
cuuaaaaaauacuugcau

SEQ ID NO: 579600 - RNA, 12 nt, Homo sapiens
cuuaaaaacugu

SEQ ID NO: 579601 - RNA, 21 nt, Homo sapiens
cuuaaaaauauuuuuucugua

SEQ ID NO: 579602 - RNA, 13 nt, Homo sapiens
cuuaaaaauuuau

SEQ ID NO: 579603 - RNA, 17 nt, Homo sapiens
cuuaaaacaaagccaug

SEQ ID NO: 579604 - RNA, 15 nt, Homo sapiens
cuuaaaacaaauuca

SEQ ID NO: 579605 - RNA, 17 nt, Homo sapiens
cuuaaaagaugccuuaa

SEQ ID NO: 579606 - RNA, 22 nt, Homo sapiens
cuuaaaauaagcagguggaucu

SEQ ID NO: 579607 - RNA, 19 nt, Homo sapiens
cuuaaaauaauauacaugc

SEQ ID NO: 579608 - RNA, 20 nt, Homo sapiens
cuuaaaauaaugaauacauu

SEQ ID NO: 579609 - RNA, 23 nt, Homo sapiens
cuuaaaauaaugaauacauuucc

SEQ ID NO: 579610 - RNA, 23 nt, Homo sapiens
cuuaaaauagaaauaagugguua

SEQ ID NO: 579611 - RNA, 17 nt, Homo sapiens
cuuaaaauauauuucag

SEQ ID NO: 579612 - RNA, 19 nt, Homo sapiens
cuuaaaauuaauaaaucau

SEQ ID NO: 579613 - RNA, 19 nt, Homo sapiens
cuuaaacccuuuagugcuu

SEQ ID NO: 579614 - RNA, 16 nt, Homo sapiens
cuuaaaccuaccuccc

SEQ ID NO: 579615 - RNA, 18 nt, Homo sapiens
cuuaaacuaugaaccuuc

SEQ ID NO: 579616 - RNA, 21 nt, Homo sapiens
cuuaaacucuggacacucuau

SEQ ID NO: 579617 - RNA, 15 nt, Homo sapiens
cuuaaacuugaccca

SEQ ID NO: 579618 - RNA, 18 nt, Homo sapiens
cuuaaagaccaucuggua

SEQ ID NO: 579619 - RNA, 20 nt, Homo sapiens
cuuaaagcauuccccaaaga

SEQ ID NO: 579620 - RNA, 20 nt, Homo sapiens
cuuaaagcauuugcaacagc

SEQ ID NO: 579621 - RNA, 22 nt, Homo sapiens
cuuaaagcccgccugacagaaa

SEQ ID NO: 579622 - RNA, 21 nt, Homo sapiens
cuuaaaggcaccaucuaauag

SEQ ID NO: 579623 - RNA, 23 nt, Homo sapiens
cuuaaaggccuggaaccagggag

SEQ ID NO: 579624 - RNA, 20 nt, Homo sapiens
cuuaaagggcccaaugaauu

SEQ ID NO: 579625 - RNA, 22 nt, Homo sapiens
cuuaaagggucuuaugaaacaa

SEQ ID NO: 579626 - RNA, 15 nt, Homo sapiens
cuuaaagugaaggaa

SEQ ID NO: 579627 - RNA, 14 nt, Homo sapiens
cuuaaauaugugaa

SEQ ID NO: 579628 - RNA, 14 nt, Homo sapiens
cuuaaauccauccu

SEQ ID NO: 579629 - RNA, 18 nt, Homo sapiens
cuuaaaugacagugaauu

SEQ ID NO: 579630 - RNA, 13 nt, Homo sapiens
cuuaaaugccaau

SEQ ID NO: 579631 - RNA, 18 nt, Homo sapiens
cuuaaauguuuauacugu

SEQ ID NO: 579632 - RNA, 20 nt, Homo sapiens
cuuaaauguuuauacuguau

SEQ ID NO: 579633 - RNA, 20 nt, Homo sapiens
cuuaacaaaacaagugcaag

SEQ ID NO: 579634 - RNA, 14 nt, Homo sapiens
cuuaacaaagccuu

SEQ ID NO: 579635 - RNA, 15 nt, Homo sapiens
cuuaacaaagccuuu

SEQ ID NO: 579636 - RNA, 14 nt, Homo sapiens
cuuaacacuugacc

SEQ ID NO: 579637 - RNA, 22 nt, Homo sapiens
cuuaacccccuagaaagacaga

SEQ ID NO: 579638 - RNA, 19 nt, Homo sapiens
cuuaaccuuugcuauguaa

SEQ ID NO: 579639 - RNA, 19 nt, Homo sapiens
cuuaacggaccaaagcaag

SEQ ID NO: 579640 - RNA, 18 nt, Homo sapiens
cuuaacuaauuugaaugu

SEQ ID NO: 579641 - RNA, 23 nt, Homo sapiens
cuuaacucacuggcgagaauaca

SEQ ID NO: 579642 - RNA, 18 nt, Homo sapiens
cuuaagaauacacaggau

SEQ ID NO: 579643 - RNA, 12 nt, Homo sapiens
cuuaagagccag

SEQ ID NO: 579644 - RNA, 15 nt, Homo sapiens
cuuaagagugcugug

SEQ ID NO: 579645 - RNA, 12 nt, Homo sapiens
cuuaagcacuuu

SEQ ID NO: 579646 - RNA, 21 nt, Homo sapiens
cuuaaggucuaacuguggaau

SEQ ID NO: 579647 - RNA, 16 nt, Homo sapiens
cuuaaguacuguagaa

SEQ ID NO: 579648 - RNA, 20 nt, Homo sapiens
cuuaagugcccacauuugau

SEQ ID NO: 579649 - RNA, 20 nt, Homo sapiens
cuuaauaaaagaacaugcuu

SEQ ID NO: 579650 - RNA, 19 nt, Homo sapiens
cuuaauaaaauaaacuaga

SEQ ID NO: 579651 - RNA, 23 nt, Homo sapiens
cuuaauaaaggcccccacuucuc

SEQ ID NO: 579652 - RNA, 16 nt, Homo sapiens
guuucaaguaccaaaa

SEQ ID NO: 579653 - RNA, 22 nt, Homo sapiens
guuucauauugaugugugucua

SEQ ID NO: 579654 - RNA, 14 nt, Homo sapiens
guuucaugaaauga

SEQ ID NO: 579655 - RNA, 20 nt, Homo sapiens
guuucauguuuugugacuau

SEQ ID NO: 579656 - RNA, 20 nt, Homo sapiens
guuuccacaggaacaacagc

SEQ ID NO: 579657 - RNA, 14 nt, Homo sapiens
guuuccacuggcuu

SEQ ID NO: 579658 - RNA, 16 nt, Homo sapiens
guuuccagccugcuag

SEQ ID NO: 579659 - RNA, 21 nt, Homo sapiens
guuucccaucagacugucaag

SEQ ID NO: 579660 - RNA, 20 nt, Homo sapiens
guuucccccuucuacauuuc

SEQ ID NO: 579661 - RNA, 14 nt, Homo sapiens
guuucccuuccuua

SEQ ID NO: 579662 - RNA, 23 nt, Homo sapiens
guuuccgaaggguuuugcuacau

SEQ ID NO: 579663 - RNA, 19 nt, Homo sapiens
guuuccuagcugugugaau

SEQ ID NO: 579664 - RNA, 16 nt, Homo sapiens
guuuccucauuccuga

SEQ ID NO: 579665 - RNA, 17 nt, Homo sapiens
guuuccuucugacuuaa

SEQ ID NO: 579666 - RNA, 21 nt, Homo sapiens
guuucuaaaaacacacacaaa

SEQ ID NO: 579667 - RNA, 19 nt, Homo sapiens
guuucuaaaguguuggcaa

SEQ ID NO: 579668 - RNA, 21 nt, Homo sapiens
guuucuacuuccccauuucag

SEQ ID NO: 579669 - RNA, 20 nt, Homo sapiens
guuucuagcuagaaauauga

SEQ ID NO: 579670 - RNA, 11 nt, Homo sapiens
guuucuagucu

SEQ ID NO: 579671 - RNA, 15 nt, Homo sapiens
guuucuccacaacag

SEQ ID NO: 579672 - RNA, 16 nt, Homo sapiens
guuucuccacaacagc

SEQ ID NO: 579673 - RNA, 19 nt, Homo sapiens
guuucuccucuuuccuccu

SEQ ID NO: 579674 - RNA, 15 nt, Homo sapiens
guuucucugcuguca

SEQ ID NO: 579675 - RNA, 21 nt, Homo sapiens
guuucucuugaagaacugacu

SEQ ID NO: 579676 - RNA, 12 nt, Homo sapiens
guuucugauuaa

SEQ ID NO: 579677 - RNA, 16 nt, Homo sapiens
guuucuggaagacugc

SEQ ID NO: 579678 - RNA, 18 nt, Homo sapiens
guuucuggaagacugcuc

SEQ ID NO: 579679 - RNA, 14 nt, Homo sapiens
guuucuggaauuga

SEQ ID NO: 579680 - RNA, 16 nt, Homo sapiens
guuucuggaauugaua

SEQ ID NO: 579681 - RNA, 17 nt, Homo sapiens
guuucugguggucuguu

SEQ ID NO: 579682 - RNA, 21 nt, Homo sapiens
guuucugucaagcauauugga

SEQ ID NO: 579683 - RNA, 19 nt, Homo sapiens
guuucuguucucccuggga

SEQ ID NO: 579684 - RNA, 19 nt, Homo sapiens
guuucuuaaaaaacauaua

SEQ ID NO: 579685 - RNA, 15 nt, Homo sapiens
guuucuuccacaaca

SEQ ID NO: 579686 - RNA, 21 nt, Homo sapiens
guuucuucuucaagacucuga

SEQ ID NO: 579687 - RNA, 21 nt, Homo sapiens
guuucuucuuuuccuuuaucc

SEQ ID NO: 579688 - RNA, 20 nt, Homo sapiens
guuucuugcuuggaagccag

SEQ ID NO: 579689 - RNA, 22 nt, Homo sapiens
guuugacccaggggucagccuu

SEQ ID NO: 579690 - RNA, 23 nt, Homo sapiens
guuugacgacagugcauuugccu

SEQ ID NO: 579691 - RNA, 13 nt, Homo sapiens
guuugacucagua

SEQ ID NO: 579692 - RNA, 13 nt, Homo sapiens
guuugagaccagc

SEQ ID NO: 579693 - RNA, 21 nt, Homo sapiens
guuugagacuauggaauccaa

SEQ ID NO: 579694 - RNA, 16 nt, Homo sapiens
guuugauauaccaaau

SEQ ID NO: 579695 - RNA, 12 nt, Homo sapiens
guuugauguaug

SEQ ID NO: 579696 - RNA, 23 nt, Homo sapiens
guuugauugaggagcugcacuga

SEQ ID NO: 579697 - RNA, 16 nt, Homo sapiens
guuugcaauagucuua

SEQ ID NO: 579698 - RNA, 16 nt, Homo sapiens
guuugcaaugucacaa

SEQ ID NO: 579699 - RNA, 16 nt, Homo sapiens
guuugcaauuuuucca

SEQ ID NO: 579700 - RNA, 23 nt, Homo sapiens
guuugcaccuuucuaguugaaaa

SEQ ID NO: 579701 - RNA, 19 nt, Homo sapiens
guuugcacuuggcaaaaag

SEQ ID NO: 579702 - RNA, 18 nt, Homo sapiens
guuugcagaaaagcaccu

SEQ ID NO: 579703 - RNA, 19 nt, Homo sapiens
guuugccaagcugaagcua

SEQ ID NO: 579704 - RNA, 22 nt, Homo sapiens
guuugcgggaaaauaaaccacu

SEQ ID NO: 579705 - RNA, 17 nt, Homo sapiens
guuuggaaaaguggcgu

SEQ ID NO: 579706 - RNA, 15 nt, Homo sapiens
guuuggaagcacuga

SEQ ID NO: 579707 - RNA, 14 nt, Homo sapiens
guuuggagucacug

SEQ ID NO: 579708 - RNA, 23 nt, Homo sapiens
guuuggccgggugcgguggcuca

SEQ ID NO: 579709 - RNA, 20 nt, Homo sapiens
guuuggcuauaagugcucaa

SEQ ID NO: 579710 - RNA, 22 nt, Homo sapiens
guuugggaauauccauguacuu

SEQ ID NO: 579711 - RNA, 23 nt, Homo sapiens
guuugguagacuuggacaucucu

SEQ ID NO: 579712 - RNA, 13 nt, Homo sapiens
guuuggucauuuu

SEQ ID NO: 579713 - RNA, 19 nt, Homo sapiens
guuugguuguaaaugcucg

SEQ ID NO: 579714 - RNA, 17 nt, Homo sapiens
guuuguaagacuuacaa

SEQ ID NO: 579715 - RNA, 21 nt, Homo sapiens
guuuguacucaaagcccagaa

SEQ ID NO: 579716 - RNA, 14 nt, Homo sapiens
guuuguaugagaug

SEQ ID NO: 579717 - RNA, 11 nt, Homo sapiens
guuugucauau

SEQ ID NO: 579718 - RNA, 17 nt, Homo sapiens
guuugugaacgcuguga

SEQ ID NO: 579719 - RNA, 20 nt, Homo sapiens
uaacagaugcaaugugcuac

SEQ ID NO: 579720 - RNA, 14 nt, Homo sapiens
uaacagcaaauaac

SEQ ID NO: 579721 - RNA, 17 nt, Homo sapiens
uaacagcauuaacuguc

SEQ ID NO: 579722 - RNA, 13 nt, Homo sapiens
uaacagccaagaa

SEQ ID NO: 579723 - RNA, 16 nt, Homo sapiens
uaacagccucuugccc

SEQ ID NO: 579724 - RNA, 17 nt, Homo sapiens
uaacagccucuugcccg

SEQ ID NO: 579725 - RNA, 22 nt, Homo sapiens
uaacaggcucaauauuccugaa

SEQ ID NO: 579726 - RNA, 16 nt, Homo sapiens
uaacaggugccuuccc

SEQ ID NO: 579727 - RNA, 19 nt, Homo sapiens
uaacaguaguccuuugaua

SEQ ID NO: 579728 - RNA, 17 nt, Homo sapiens
uaacagucuagugcaaa

SEQ ID NO: 579729 - RNA, 15 nt, Homo sapiens
uaacauaaugcacuu

SEQ ID NO: 579730 - RNA, 22 nt, Homo sapiens
uaacauaauuuguacauaugua

SEQ ID NO: 579731 - RNA, 21 nt, Homo sapiens
uaacauagauuuaagugaaua

SEQ ID NO: 579732 - RNA, 10 nt, Homo sapiens
uaacaucaac

SEQ ID NO: 579733 - RNA, 14 nt, Homo sapiens
uaacaucaacaaca

SEQ ID NO: 579734 - RNA, 16 nt, Homo sapiens
uaacaucaacaacaca

SEQ ID NO: 579735 - RNA, 21 nt, Homo sapiens
uaacaucacugucuugccaga

SEQ ID NO: 579736 - RNA, 10 nt, Homo sapiens
uaacaucccu

SEQ ID NO: 579737 - RNA, 14 nt, Homo sapiens
uaacaugauuucaa

SEQ ID NO: 579738 - RNA, 23 nt, Homo sapiens
uaacauggugaaaccccgucucu

SEQ ID NO: 579739 - RNA, 20 nt, Homo sapiens
uaacaugucuuucagcauua

SEQ ID NO: 579740 - RNA, 12 nt, Homo sapiens
uaacauguguau

SEQ ID NO: 579741 - RNA, 23 nt, Homo sapiens
uaacauuaaugccugcuuuuugg

SEQ ID NO: 579742 - RNA, 19 nt, Homo sapiens
uaacauuagcuaaaacugc

SEQ ID NO: 579743 - RNA, 14 nt, Homo sapiens
uaacauuccauguu

SEQ ID NO: 579744 - RNA, 15 nt, Homo sapiens
uaacauugcacuuua

SEQ ID NO: 579745 - RNA, 19 nt, Homo sapiens
uaacauuguaaaguaugug

SEQ ID NO: 579746 - RNA, 16 nt, Homo sapiens
uaacauuguacuguaa

SEQ ID NO: 579747 - RNA, 16 nt, Homo sapiens
uaacauuuaaauucca

SEQ ID NO: 579748 - RNA, 17 nt, Homo sapiens
uaacauuuaaauuccac

SEQ ID NO: 579749 - RNA, 22 nt, Homo sapiens
uaacauuuaaauuccacagauu

SEQ ID NO: 579750 - RNA, 17 nt, Homo sapiens
uaacauuuccuuacaga

SEQ ID NO: 579751 - RNA, 16 nt, Homo sapiens
uaacauuucuguucuc

SEQ ID NO: 579752 - RNA, 17 nt, Homo sapiens
uaacauuucuguucuca

SEQ ID NO: 579753 - RNA, 18 nt, Homo sapiens
uaacauuucuguucucau

SEQ ID NO: 579754 - RNA, 12 nt, Homo sapiens
uaacauuugccu

SEQ ID NO: 579755 - RNA, 14 nt, Homo sapiens
uaacauuugccuua

SEQ ID NO: 579756 - RNA, 23 nt, Homo sapiens
uaacauuuguguaauaugaaaua

SEQ ID NO: 579757 - RNA, 22 nt, Homo sapiens
uaaccaaagcccaaagugguau

SEQ ID NO: 579758 - RNA, 23 nt, Homo sapiens
uaaccaaugccuuuuuagaugua

SEQ ID NO: 579759 - RNA, 19 nt, Homo sapiens
uaaccacaaagcacaguuu

SEQ ID NO: 579760 - RNA, 21 nt, Homo sapiens
uaaccacaaagcacaguuuga

SEQ ID NO: 579761 - RNA, 23 nt, Homo sapiens
uaaccaguccacaccacuguugc

SEQ ID NO: 579762 - RNA, 14 nt, Homo sapiens
uaaccauuugcacu

SEQ ID NO: 579763 - RNA, 19 nt, Homo sapiens
uaacccaagacaugacauu

SEQ ID NO: 579764 - RNA, 23 nt, Homo sapiens
uaaccccugcgcucucuuugcaa

SEQ ID NO: 579765 - RNA, 17 nt, Homo sapiens
uaacccuuaucaccagc

SEQ ID NO: 579766 - RNA, 18 nt, Homo sapiens
uaaccgauaugcacuuga

SEQ ID NO: 579767 - RNA, 17 nt, Homo sapiens
uaaccgcacaugcacac

SEQ ID NO: 579768 - RNA, 15 nt, Homo sapiens
uaaccuagugaauuu

SEQ ID NO: 579769 - RNA, 19 nt, Homo sapiens
uaaccucagugucauuuau

SEQ ID NO: 579770 - RNA, 22 nt, Homo sapiens
uaaccucgcucgaugacuguga

SEQ ID NO: 579771 - RNA, 19 nt, Homo sapiens
uaaccucucugaacugcaa

SEQ ID NO: 579772 - RNA, 16 nt, Homo sapiens
uaaccucucugugcca

SEQ ID NO: 579773 - RNA, 18 nt, Homo sapiens
uaaccucugcacuacuga

SEQ ID NO: 579774 - RNA, 12 nt, Homo sapiens
uaaccucuggcc

SEQ ID NO: 579775 - RNA, 20 nt, Homo sapiens
uaaccugccaacauacuuua

SEQ ID NO: 579776 - RNA, 18 nt, Homo sapiens
uaaccugggcauuguuga

SEQ ID NO: 579777 - RNA, 22 nt, Homo sapiens
uaaccuugaaaaaaaacagugg

SEQ ID NO: 579778 - RNA, 16 nt, Homo sapiens
uaacuaaaugcucaua

SEQ ID NO: 579779 - RNA, 10 nt, Homo sapiens
uaacuacccu

SEQ ID NO: 579780 - RNA, 19 nt, Homo sapiens
uaacuagacuaagaagauu

SEQ ID NO: 579781 - RNA, 20 nt, Homo sapiens
uaacuaguggcucucaguua

SEQ ID NO: 579782 - RNA, 19 nt, Homo sapiens
cuuggaguaaaacuguaua

SEQ ID NO: 579783 - RNA, 15 nt, Homo sapiens
cuuggauuaaauaca

SEQ ID NO: 579784 - RNA, 17 nt, Homo sapiens
cuuggauucuuuccauu

SEQ ID NO: 579785 - RNA, 16 nt, Homo sapiens
cuuggcacacucucca

SEQ ID NO: 579786 - RNA, 17 nt, Homo sapiens
cuuggcaguguggacau

SEQ ID NO: 579787 - RNA, 20 nt, Homo sapiens
cuuggcaguguggcagugac

SEQ ID NO: 579788 - RNA, 21 nt, Homo sapiens
cuuggcccacacugaggcuua

SEQ ID NO: 579789 - RNA, 22 nt, Homo sapiens
cuuggccucccaaagugcuagu

SEQ ID NO: 579790 - RNA, 17 nt, Homo sapiens
cuuggccucccaaucuu

SEQ ID NO: 579791 - RNA, 16 nt, Homo sapiens
cuuggcucacugcaac

SEQ ID NO: 579792 - RNA, 23 nt, Homo sapiens
cuuggcucccauucacucuucca

SEQ ID NO: 579793 - RNA, 16 nt, Homo sapiens
cuuggcugcagccauc

SEQ ID NO: 579794 - RNA, 13 nt, Homo sapiens
cuuggcugugaaa

SEQ ID NO: 579795 - RNA, 22 nt, Homo sapiens
cuuggcuuacugcagccuuugc

SEQ ID NO: 579796 - RNA, 16 nt, Homo sapiens
cuuggcuucagacucg

SEQ ID NO: 579797 - RNA, 17 nt, Homo sapiens
cuuggcuucugugauga

SEQ ID NO: 579798 - RNA, 21 nt, Homo sapiens
cuuggcuugccugguggggga
